United States Patent 7,888,497 (BIOINFORMATICALLY DETECTABLE GROUP OF NOVEL REGULATORY OLIGONUCLEOTIDES AND USES THEREOF) - sequence listing, part 109

SEQ ID NO: 4613065 - DNA, 18 bp, Homo sapiens
tgagctcctgatcagagg

SEQ ID NO: 4613066 - DNA, 21 bp, Homo sapiens
tgagctctgagaggccctgga

SEQ ID NO: 4613067 - DNA, 17 bp, Homo sapiens
tgagctggggactcagg

SEQ ID NO: 4613068 - DNA, 15 bp, Homo sapiens
tgaggaagagtttat

SEQ ID NO: 4613069 - DNA, 23 bp, Homo sapiens
tgaggaagccaggtccacggtct

SEQ ID NO: 4613070 - DNA, 22 bp, Homo sapiens
tgaggacacccaggaatgaccc

SEQ ID NO: 4613071 - DNA, 21 bp, Homo sapiens
tgaggagatgaccagggatgc

SEQ ID NO: 4613072 - DNA, 20 bp, Homo sapiens
tgaggagctcaacggtctgg

SEQ ID NO: 4613073 - DNA, 23 bp, Homo sapiens
tgaggaggatgtccctgggccag

SEQ ID NO: 4613074 - DNA, 22 bp, Homo sapiens
tgaggagtctgaggtcctgagc

SEQ ID NO: 4613075 - DNA, 18 bp, Homo sapiens
tgaggatgagacccagcc

SEQ ID NO: 4613076 - DNA, 20 bp, Homo sapiens
tgaggatgagacccagcccc

SEQ ID NO: 4613077 - DNA, 21 bp, Homo sapiens
tgaggatgagacccagcccct

SEQ ID NO: 4613078 - DNA, 18 bp, Homo sapiens
tgaggcatccgtgaggca

SEQ ID NO: 4613079 - DNA, 21 bp, Homo sapiens
tgaggcatccgtgaggcaggg

SEQ ID NO: 4613080 - DNA, 13 bp, Homo sapiens
tgaggccacactc

SEQ ID NO: 4613081 - DNA, 20 bp, Homo sapiens
tgaggccacactcagcacaa

SEQ ID NO: 4613082 - DNA, 22 bp, Homo sapiens
tgaggccactgctgcttctcca

SEQ ID NO: 4613083 - DNA, 21 bp, Homo sapiens
tgaggccagcctggcctcctg

SEQ ID NO: 4613084 - DNA, 22 bp, Homo sapiens
tgaggccagcctggcctcctgc

SEQ ID NO: 4613085 - DNA, 15 bp, Homo sapiens
tgaggccatctcagg

SEQ ID NO: 4613086 - DNA, 17 bp, Homo sapiens
tgaggccatctcaggag

SEQ ID NO: 4613087 - DNA, 21 bp, Homo sapiens
tgaggcccccgtcagggagag

SEQ ID NO: 4613088 - DNA, 14 bp, Homo sapiens
tgaggccctgcacc

SEQ ID NO: 4613089 - DNA, 11 bp, Homo sapiens
tgaggctggca

SEQ ID NO: 4613090 - DNA, 14 bp, Homo sapiens
tgaggctggcacag

SEQ ID NO: 4613091 - DNA, 17 bp, Homo sapiens
tgaggctggcacaggac

SEQ ID NO: 4613092 - DNA, 22 bp, Homo sapiens
tgaggctgtaactgagagaaag

SEQ ID NO: 4613093 - DNA, 17 bp, Homo sapiens
tgagggaaggagacagg

SEQ ID NO: 4613094 - DNA, 13 bp, Homo sapiens
tgagggcagcagc

SEQ ID NO: 4613095 - DNA, 15 bp, Homo sapiens
tgagggcagcagcca

SEQ ID NO: 4613096 - DNA, 15 bp, Homo sapiens
tgagggcagtgccct

SEQ ID NO: 4613097 - DNA, 17 bp, Homo sapiens
tgagggcagtgcccttt

SEQ ID NO: 4613098 - DNA, 21 bp, Homo sapiens
tgagggcagttcgcagccacc

SEQ ID NO: 4613099 - DNA, 23 bp, Homo sapiens
tgagggcagttcgcagccaccct

SEQ ID NO: 4613100 - DNA, 22 bp, Homo sapiens
tgagggtcattctttattcttt

SEQ ID NO: 4613101 - DNA, 16 bp, Homo sapiens
tgaggtattttttcct

SEQ ID NO: 4613102 - DNA, 16 bp, Homo sapiens
tgaggtcaccagggga

SEQ ID NO: 4613103 - DNA, 17 bp, Homo sapiens
tgaggtcaccaggggag

SEQ ID NO: 4613104 - DNA, 21 bp, Homo sapiens
tgaggtcaccaggggaggagc

SEQ ID NO: 4613105 - DNA, 18 bp, Homo sapiens
tgaggtcagggagtgctg

SEQ ID NO: 4613106 - DNA, 16 bp, Homo sapiens
tgaggtcctgagcact

SEQ ID NO: 4613107 - DNA, 20 bp, Homo sapiens
tgaggtcctgagcactgcca

SEQ ID NO: 4613108 - DNA, 21 bp, Homo sapiens
tgaggtcctgagcactgccag

SEQ ID NO: 4613109 - DNA, 23 bp, Homo sapiens
tgaggtcctgagcactgccagga

SEQ ID NO: 4613110 - DNA, 16 bp, Homo sapiens
tgaggtctcgaccctg

SEQ ID NO: 4613111 - DNA, 12 bp, Homo sapiens
tgaggtgcccag

SEQ ID NO: 4613112 - DNA, 14 bp, Homo sapiens
tgaggtgcccagga

SEQ ID NO: 4613113 - DNA, 17 bp, Homo sapiens
tgagtacaaatgcctta

SEQ ID NO: 4613114 - DNA, 16 bp, Homo sapiens
tgagtagctgggatta

SEQ ID NO: 4613115 - DNA, 18 bp, Homo sapiens
tgagtatttctgttcctt

SEQ ID NO: 4613116 - DNA, 20 bp, Homo sapiens
tgagtatttctgttcctttt

SEQ ID NO: 4613117 - DNA, 22 bp, Homo sapiens
tgagtatttttaaaaaatatgt

SEQ ID NO: 4613118 - DNA, 20 bp, Homo sapiens
tgagtctgtttcccaagcta

SEQ ID NO: 4613119 - DNA, 16 bp, Homo sapiens
tgagtctgttttgtaa

SEQ ID NO: 4613120 - DNA, 19 bp, Homo sapiens
tgagtgacctccttctgca

SEQ ID NO: 4613121 - DNA, 22 bp, Homo sapiens
tgagtgggagagtacctgtgtg

SEQ ID NO: 4613122 - DNA, 17 bp, Homo sapiens
tgagtgtgacagggcca

SEQ ID NO: 4613123 - DNA, 14 bp, Homo sapiens
tgagtttcagctgg

SEQ ID NO: 4613124 - DNA, 20 bp, Homo sapiens
tgataaaagttttgatattt

SEQ ID NO: 4613125 - DNA, 14 bp, Homo sapiens
tgatacagttttga

SEQ ID NO: 4613126 - DNA, 14 bp, Homo sapiens
tgatactgctgctt

SEQ ID NO: 4613127 - DNA, 21 bp, Homo sapiens
tgatagctgtttcaaatgtgc

SEQ ID NO: 4613128 - DNA, 21 bp, Homo sapiens
tgataggcctagtacaatctt

SEQ ID NO: 4613129 - DNA, 20 bp, Homo sapiens
tgatatgtatccatcaggat

SEQ ID NO: 4613130 - DNA, 23 bp, Homo sapiens
tgatcaagatatatgtgtataca

SEQ ID NO: 4613131 - DNA, 12 bp, Homo sapiens
tgatcagaggca

SEQ ID NO: 4613132 - DNA, 23 bp, Homo sapiens
tgatcagaggcatttgagcagct

SEQ ID NO: 4613133 - DNA, 20 bp, Homo sapiens
tgatcaggccccacccctgt

SEQ ID NO: 4613134 - DNA, 20 bp, Homo sapiens
tgatcataaactgactatca

SEQ ID NO: 4613135 - DNA, 15 bp, Homo sapiens
tgatcatgtactttt

SEQ ID NO: 4613136 - DNA, 19 bp, Homo sapiens
tgatccgcccacctcagcc

SEQ ID NO: 4613137 - DNA, 21 bp, Homo sapiens
tgatccgcccacctcagcctc

SEQ ID NO: 4613138 - DNA, 11 bp, Homo sapiens
tgatcctcagt

SEQ ID NO: 4613139 - DNA, 22 bp, Homo sapiens
tgatcctcagtgcaaaatgtct

SEQ ID NO: 4613140 - DNA, 12 bp, Homo sapiens
tgatcctcccac

SEQ ID NO: 4613141 - DNA, 22 bp, Homo sapiens
tgatccttttttgtcattttat

SEQ ID NO: 4613142 - DNA, 23 bp, Homo sapiens
tgatccttttttgtcattttatg

SEQ ID NO: 4613143 - DNA, 16 bp, Homo sapiens
tgatcggaaagctctt

SEQ ID NO: 4613144 - DNA, 18 bp, Homo sapiens
tgatctcgaactcctaac

SEQ ID NO: 4613145 - DNA, 17 bp, Homo sapiens
tgatctcggctcactgc

SEQ ID NO: 4613146 - DNA, 15 bp, Homo sapiens
tgatctctctagctt

SEQ ID NO: 4613147 - DNA, 14 bp, Homo sapiens
tgatcttgaactcc

SEQ ID NO: 4613148 - DNA, 19 bp, Homo sapiens
tgatcttttaaaatcatga

SEQ ID NO: 4613149 - DNA, 19 bp, Homo sapiens
tgatgagggcagcagccag

SEQ ID NO: 4613150 - DNA, 23 bp, Homo sapiens
tgatgagggcagcagccagccct

SEQ ID NO: 4613151 - DNA, 24 bp, Homo sapiens
tgatgagggcagcagccagccctg

SEQ ID NO: 4613152 - DNA, 16 bp, Homo sapiens
tgatgaggtatttttt

SEQ ID NO: 4613153 - DNA, 15 bp, Homo sapiens
tgatgagtaaactga

SEQ ID NO: 4613154 - DNA, 16 bp, Homo sapiens
tgatgcagataaaata

SEQ ID NO: 4613155 - DNA, 21 bp, Homo sapiens
tgatgcatcagaaagggaggg

SEQ ID NO: 4613156 - DNA, 13 bp, Homo sapiens
tgatgcatgtctt

SEQ ID NO: 4613157 - DNA, 18 bp, Homo sapiens
tgatggatggcagactct

SEQ ID NO: 4613158 - DNA, 13 bp, Homo sapiens
tgatggcagagga

SEQ ID NO: 4613159 - DNA, 22 bp, Homo sapiens
tgatggtgttttggggatgaga

SEQ ID NO: 4613160 - DNA, 16 bp, Homo sapiens
tgatgtagtatgctta

SEQ ID NO: 4613161 - DNA, 21 bp, Homo sapiens
tgcccttgctgggcctggggg

SEQ ID NO: 4613162 - DNA, 11 bp, Homo sapiens
tgccctttgag

SEQ ID NO: 4613163 - DNA, 19 bp, Homo sapiens
tgccgagcaaccgtggccc

SEQ ID NO: 4613164 - DNA, 16 bp, Homo sapiens
tgccgtgtgagtgtga

SEQ ID NO: 4613165 - DNA, 20 bp, Homo sapiens
tgccgtgtgagtgtgacagg

SEQ ID NO: 4613166 - DNA, 22 bp, Homo sapiens
tgccgtgtgagtgtgacagggc

SEQ ID NO: 4613167 - DNA, 23 bp, Homo sapiens
tgccgtgtgagtgtgacagggcc

SEQ ID NO: 4613168 - DNA, 21 bp, Homo sapiens
tgcctagagatatttcaagct

SEQ ID NO: 4613169 - DNA, 15 bp, Homo sapiens
tgcctagtggcttcc

SEQ ID NO: 4613170 - DNA, 20 bp, Homo sapiens
tgcctagtgggagttaggac

SEQ ID NO: 4613171 - DNA, 20 bp, Homo sapiens
tgcctataatcttatacaac

SEQ ID NO: 4613172 - DNA, 16 bp, Homo sapiens
tgcctcacatctccct

SEQ ID NO: 4613173 - DNA, 18 bp, Homo sapiens
tgcctcactaatttttgt

SEQ ID NO: 4613174 - DNA, 17 bp, Homo sapiens
tgcctcagcctcccgag

SEQ ID NO: 4613175 - DNA, 17 bp, Homo sapiens
tgcctccatctttttct

SEQ ID NO: 4613176 - DNA, 22 bp, Homo sapiens
tgcctccatctttttcttgggt

SEQ ID NO: 4613177 - DNA, 23 bp, Homo sapiens
tgcctccatctttttcttgggtg

SEQ ID NO: 4613178 - DNA, 14 bp, Homo sapiens
tgcctccctggtga

SEQ ID NO: 4613179 - DNA, 21 bp, Homo sapiens
tgcctccgaaggggctctgag

SEQ ID NO: 4613180 - DNA, 14 bp, Homo sapiens
tgcctcctctctcc

SEQ ID NO: 4613181 - DNA, 14 bp, Homo sapiens
tgcctcgctccctt

SEQ ID NO: 4613182 - DNA, 23 bp, Homo sapiens
tgcctctactgggaaggctactt

SEQ ID NO: 4613183 - DNA, 14 bp, Homo sapiens
tgcctctcacagct

SEQ ID NO: 4613184 - DNA, 18 bp, Homo sapiens
tgcctctcacagctgagt

SEQ ID NO: 4613185 - DNA, 11 bp, Homo sapiens
tgcctctgagg

SEQ ID NO: 4613186 - DNA, 22 bp, Homo sapiens
tgcctgcaactttttgccttct

SEQ ID NO: 4613187 - DNA, 13 bp, Homo sapiens
tgcctgcctgctc

SEQ ID NO: 4613188 - DNA, 11 bp, Homo sapiens
tgcctggagga

SEQ ID NO: 4613189 - DNA, 15 bp, Homo sapiens
tgcctggaggacctg

SEQ ID NO: 4613190 - DNA, 19 bp, Homo sapiens
tgcctggaggacctgagcc

SEQ ID NO: 4613191 - DNA, 22 bp, Homo sapiens
tgcctggatgagaaacagctca

SEQ ID NO: 4613192 - DNA, 16 bp, Homo sapiens
tgcctggcctggcaca

SEQ ID NO: 4613193 - DNA, 20 bp, Homo sapiens
tgcctggcctggcacacatc

SEQ ID NO: 4613194 - DNA, 16 bp, Homo sapiens
tgcctgggatgccctt

SEQ ID NO: 4613195 - DNA, 23 bp, Homo sapiens
tgcctgggcaatggccaggggcc

SEQ ID NO: 4613196 - DNA, 23 bp, Homo sapiens
tgcctgggggcttttgccactcc

SEQ ID NO: 4613197 - DNA, 16 bp, Homo sapiens
tgcctgggtaggcccc

SEQ ID NO: 4613198 - DNA, 19 bp, Homo sapiens
tgcctgggtaggccccaca

SEQ ID NO: 4613199 - DNA, 21 bp, Homo sapiens
tgcctggttctaggctgctgc

SEQ ID NO: 4613200 - DNA, 12 bp, Homo sapiens
tgcctgtcaagt

SEQ ID NO: 4613201 - DNA, 20 bp, Homo sapiens
tgccttaaaatggaattgaa

SEQ ID NO: 4613202 - DNA, 15 bp, Homo sapiens
tgccttaacctggga

SEQ ID NO: 4613203 - DNA, 22 bp, Homo sapiens
tgccttaccaagttgtgctttt

SEQ ID NO: 4613204 - DNA, 15 bp, Homo sapiens
tgccttcttccttga

SEQ ID NO: 4613205 - DNA, 19 bp, Homo sapiens
tgcctttaattttcttgtt

SEQ ID NO: 4613206 - DNA, 16 bp, Homo sapiens
tgcctttgctcttata

SEQ ID NO: 4613207 - DNA, 18 bp, Homo sapiens
tgcctttgctcttataaa

SEQ ID NO: 4613208 - DNA, 13 bp, Homo sapiens
tgcctttgggcac

SEQ ID NO: 4613209 - DNA, 14 bp, Homo sapiens
tgcgcaagtgcctg

SEQ ID NO: 4613210 - DNA, 21 bp, Homo sapiens
tgcgcaagtgcctgggattct

SEQ ID NO: 4613211 - DNA, 20 bp, Homo sapiens
tgcgcttcagtaacaagtgt

SEQ ID NO: 4613212 - DNA, 20 bp, Homo sapiens
tgcggatactcttggagagt

SEQ ID NO: 4613213 - DNA, 22 bp, Homo sapiens
tgcgggtgaacaaagcagccac

SEQ ID NO: 4613214 - DNA, 16 bp, Homo sapiens
tgcgtacacagagaag

SEQ ID NO: 4613215 - DNA, 17 bp, Homo sapiens
tgcgtgccgtgtgagtg

SEQ ID NO: 4613216 - DNA, 19 bp, Homo sapiens
tgcgtgccgtgtgagtgtg

SEQ ID NO: 4613217 - DNA, 20 bp, Homo sapiens
tgcgtggggcaggaaagcat

SEQ ID NO: 4613218 - DNA, 23 bp, Homo sapiens
tgctaacaaagacaaaagtctgt

SEQ ID NO: 4613219 - DNA, 17 bp, Homo sapiens
tgctaatcaaagccagg

SEQ ID NO: 4613220 - DNA, 15 bp, Homo sapiens
tgctaatgcaaatta

SEQ ID NO: 4613221 - DNA, 15 bp, Homo sapiens
tgctacaggggccag

SEQ ID NO: 4613222 - DNA, 14 bp, Homo sapiens
tgctacgtgtgaaa

SEQ ID NO: 4613223 - DNA, 22 bp, Homo sapiens
tgctacgtgtgaaatctgtctt

SEQ ID NO: 4613224 - DNA, 23 bp, Homo sapiens
tgctacgtgtgaaatctgtcttt

SEQ ID NO: 4613225 - DNA, 20 bp, Homo sapiens
tgctactgattgtttcattg

SEQ ID NO: 4613226 - DNA, 21 bp, Homo sapiens
tgctacttgaaggtacacccc

SEQ ID NO: 4613227 - DNA, 14 bp, Homo sapiens
tgctagaaattttc

SEQ ID NO: 4613228 - DNA, 14 bp, Homo sapiens
tgctagcacaatat

SEQ ID NO: 4613229 - DNA, 12 bp, Homo sapiens
tgctagcacatg

SEQ ID NO: 4613230 - DNA, 21 bp, Homo sapiens
tgctagggttaggaggtcctt

SEQ ID NO: 4613231 - DNA, 18 bp, Homo sapiens
tgctagtcgcccctcaga

SEQ ID NO: 4613232 - DNA, 20 bp, Homo sapiens
tgctagtcgcccctcagagc

SEQ ID NO: 4613233 - DNA, 21 bp, Homo sapiens
tgctagtcgcccctcagagca

SEQ ID NO: 4613234 - DNA, 22 bp, Homo sapiens
tgctagtcgcccctcagagcat

SEQ ID NO: 4613235 - DNA, 18 bp, Homo sapiens
tgctatagagcctacctg

SEQ ID NO: 4613236 - DNA, 22 bp, Homo sapiens
tgctatccatttctcatgtttt

SEQ ID NO: 4613237 - DNA, 19 bp, Homo sapiens
tgctatgttctgtcttccc

SEQ ID NO: 4613238 - DNA, 16 bp, Homo sapiens
tgctattctagagctt

SEQ ID NO: 4613239 - DNA, 18 bp, Homo sapiens
tgctattgcagaatgaag

SEQ ID NO: 4613240 - DNA, 14 bp, Homo sapiens
tgctatttgaagaa

SEQ ID NO: 4613241 - DNA, 18 bp, Homo sapiens
tgctcaccgactcacctg

SEQ ID NO: 4613242 - DNA, 17 bp, Homo sapiens
tgctcagctctgggcca

SEQ ID NO: 4613243 - DNA, 15 bp, Homo sapiens
tgctcatgagctcct

SEQ ID NO: 4613244 - DNA, 15 bp, Homo sapiens
tgctcattcttcagt

SEQ ID NO: 4613245 - DNA, 18 bp, Homo sapiens
tgctcattcttcagttct

SEQ ID NO: 4613246 - DNA, 22 bp, Homo sapiens
tgctcattcttcagttctctac

SEQ ID NO: 4613247 - DNA, 16 bp, Homo sapiens
tgctccaggcctgcag

SEQ ID NO: 4613248 - DNA, 14 bp, Homo sapiens
tgctccattcactc

SEQ ID NO: 4613249 - DNA, 12 bp, Homo sapiens
tgctcccaagcc

SEQ ID NO: 4613250 - DNA, 19 bp, Homo sapiens
tgctcccaagcccctgacc

SEQ ID NO: 4613251 - DNA, 20 bp, Homo sapiens
tgctcccaagcccctgaccc

SEQ ID NO: 4613252 - DNA, 23 bp, Homo sapiens
tgctccctgtgtccacctgtggg

SEQ ID NO: 4613253 - DNA, 13 bp, Homo sapiens
tgctcgccctgcg

SEQ ID NO: 4613254 - DNA, 16 bp, Homo sapiens
tgctcggggtgcacag

SEQ ID NO: 4613255 - DNA, 18 bp, Homo sapiens
tgctcggggtgcacagga

SEQ ID NO: 4613256 - DNA, 19 bp, Homo sapiens
tgctcggggtgcacaggag

SEQ ID NO: 4613257 - DNA, 22 bp, Homo sapiens
tgctcggggtgcacaggagggg

SEQ ID NO: 4613258 - DNA, 17 bp, Homo sapiens
tgctctaagcccaggat

SEQ ID NO: 4613259 - DNA, 14 bp, Homo sapiens
tgctctagtgggac

SEQ ID NO: 4613260 - DNA, 20 bp, Homo sapiens
tgctctcgaccggccctgca

SEQ ID NO: 4613261 - DNA, 19 bp, Homo sapiens
tgctctgcagcattgaagt

SEQ ID NO: 4613262 - DNA, 19 bp, Homo sapiens
tgctctgcccaggcaagga

SEQ ID NO: 4613263 - DNA, 23 bp, Homo sapiens
tgctctgcccaggcaaggaacag

SEQ ID NO: 4613264 - DNA, 16 bp, Homo sapiens
tgctcttgaaatattc

SEQ ID NO: 4613265 - DNA, 20 bp, Homo sapiens
tgctcttgaaatattcagaa

SEQ ID NO: 4613266 - DNA, 14 bp, Homo sapiens
tgctctttccactt

SEQ ID NO: 4613267 - DNA, 19 bp, Homo sapiens
tgctctttccacttgccct

SEQ ID NO: 4613268 - DNA, 17 bp, Homo sapiens
tgctgagaacctggcct

SEQ ID NO: 4613269 - DNA, 23 bp, Homo sapiens
tgctgagacgccacggagggctg

SEQ ID NO: 4613270 - DNA, 14 bp, Homo sapiens
tgctgagctctgag

SEQ ID NO: 4613271 - DNA, 23 bp, Homo sapiens
tgctgagctctgagaggccctgg

SEQ ID NO: 4613272 - DNA, 15 bp, Homo sapiens
tgctgatcttttaaa

SEQ ID NO: 4613273 - DNA, 15 bp, Homo sapiens
tgctgatggagcctt

SEQ ID NO: 4613274 - DNA, 16 bp, Homo sapiens
tgctgatggagccttc

SEQ ID NO: 4613275 - DNA, 16 bp, Homo sapiens
tgctgcaaacttaatg

SEQ ID NO: 4613276 - DNA, 20 bp, Homo sapiens
tgctgcacaccaaggccctg

SEQ ID NO: 4613277 - DNA, 11 bp, Homo sapiens
tgctgcctggg

SEQ ID NO: 4613278 - DNA, 21 bp, Homo sapiens
tgctgcctgggtaggccccac

SEQ ID NO: 4613279 - DNA, 15 bp, Homo sapiens
tgctgcggagcaaga

SEQ ID NO: 4613280 - DNA, 15 bp, Homo sapiens
tgctgctgagaacct

SEQ ID NO: 4613281 - DNA, 18 bp, Homo sapiens
tgctgctgagaacctggc

SEQ ID NO: 4613282 - DNA, 19 bp, Homo sapiens
tgctgctgagaacctggcc

SEQ ID NO: 4613283 - DNA, 12 bp, Homo sapiens
tgctgcttgtca

SEQ ID NO: 4613284 - DNA, 21 bp, Homo sapiens
tgctgctttttctgcgcttca

SEQ ID NO: 4613285 - DNA, 22 bp, Homo sapiens
tgctggccccgcccctgccccc

SEQ ID NO: 4613286 - DNA, 19 bp, Homo sapiens
tgctggctcacagtacagc

SEQ ID NO: 4613287 - DNA, 15 bp, Homo sapiens
tgctggctcccaggg

SEQ ID NO: 4613288 - DNA, 17 bp, Homo sapiens
tgctgggccactgggga

SEQ ID NO: 4613289 - DNA, 21 bp, Homo sapiens
tgctgggctgacggtgcagtc

SEQ ID NO: 4613290 - DNA, 24 bp, Homo sapiens
tgctgggctgacggtgcagtctgg

SEQ ID NO: 4613291 - DNA, 14 bp, Homo sapiens
tgctgggctgggcc

SEQ ID NO: 4613292 - DNA, 16 bp, Homo sapiens
tgctgggctgggccct

SEQ ID NO: 4613293 - DNA, 16 bp, Homo sapiens
tgctggggccaggccc

SEQ ID NO: 4613294 - DNA, 15 bp, Homo sapiens
tgctgggggaatgag

SEQ ID NO: 4613295 - DNA, 20 bp, Homo sapiens
tgctgggggaatgagcccag

SEQ ID NO: 4613296 - DNA, 12 bp, Homo sapiens
tgctggtttttc

SEQ ID NO: 4613297 - DNA, 18 bp, Homo sapiens
tgctgtaaatttggcttc

SEQ ID NO: 4613298 - DNA, 20 bp, Homo sapiens
tgctgtaaatttggcttctg

SEQ ID NO: 4613299 - DNA, 19 bp, Homo sapiens
tgctgtatgacccctggcc

SEQ ID NO: 4613300 - DNA, 17 bp, Homo sapiens
tgctgtccccactgccc

SEQ ID NO: 4613301 - DNA, 18 bp, Homo sapiens
tgctgtccccactgcccc

SEQ ID NO: 4613302 - DNA, 21 bp, Homo sapiens
tgctgtcctgtttctgtcaag

SEQ ID NO: 4613303 - DNA, 16 bp, Homo sapiens
tgctgtgaactttcat

SEQ ID NO: 4613304 - DNA, 20 bp, Homo sapiens
tgctgtgccatgctgggcca

SEQ ID NO: 4613305 - DNA, 15 bp, Homo sapiens
tgctgtgccccacca

SEQ ID NO: 4613306 - DNA, 19 bp, Homo sapiens
tgctgtgtagttccctctg

SEQ ID NO: 4613307 - DNA, 21 bp, Homo sapiens
tgctgtgtagttccctctgcc

SEQ ID NO: 4613308 - DNA, 14 bp, Homo sapiens
tgctgtttacaaca

SEQ ID NO: 4613309 - DNA, 16 bp, Homo sapiens
tgcttaaaaatacttc

SEQ ID NO: 4613310 - DNA, 16 bp, Homo sapiens
tgcttaaaagaaagtt

SEQ ID NO: 4613311 - DNA, 20 bp, Homo sapiens
tgcttattcttaacttatta

SEQ ID NO: 4613312 - DNA, 21 bp, Homo sapiens
tgcttcagtcatcagccagca

SEQ ID NO: 4613313 - DNA, 12 bp, Homo sapiens
tgcttcattatt

SEQ ID NO: 4613314 - DNA, 11 bp, Homo sapiens
tgcttccacct

SEQ ID NO: 4613315 - DNA, 17 bp, Homo sapiens
tgcttccacctcacccc

SEQ ID NO: 4613316 - DNA, 14 bp, Homo sapiens
tgcttcccaggttc

SEQ ID NO: 4613317 - DNA, 13 bp, Homo sapiens
tgcttccgttcct

SEQ ID NO: 4613318 - DNA, 16 bp, Homo sapiens
tgcttctcctgatcct

SEQ ID NO: 4613319 - DNA, 21 bp, Homo sapiens
tgcttctctagctctctaggc

SEQ ID NO: 4613320 - DNA, 23 bp, Homo sapiens
tgcttctctagctctctaggcct

SEQ ID NO: 4613321 - DNA, 13 bp, Homo sapiens
tgcttgagcccag

SEQ ID NO: 4613322 - DNA, 21 bp, Homo sapiens
tgcttgctcccaagcccctga

SEQ ID NO: 4613323 - DNA, 21 bp, Homo sapiens
tgcttggggggtgatgagggc

SEQ ID NO: 4613324 - DNA, 16 bp, Homo sapiens
tgcttgtactgggaca

SEQ ID NO: 4613325 - DNA, 13 bp, Homo sapiens
tgctttaaagata

SEQ ID NO: 4613326 - DNA, 14 bp, Homo sapiens
tgctttcctgggcc

SEQ ID NO: 4613327 - DNA, 17 bp, Homo sapiens
tgctttcggagctcctg

SEQ ID NO: 4613328 - DNA, 13 bp, Homo sapiens
tgctttctgaaat

SEQ ID NO: 4613329 - DNA, 14 bp, Homo sapiens
tgctttgcaaagac

SEQ ID NO: 4613330 - DNA, 17 bp, Homo sapiens
tgctttgtgcctttggg

SEQ ID NO: 4613331 - DNA, 13 bp, Homo sapiens
tgcttttctgttt

SEQ ID NO: 4613332 - DNA, 19 bp, Homo sapiens
tgctttttgcgtacacaga

SEQ ID NO: 4613333 - DNA, 21 bp, Homo sapiens
tgctttttgcgtacacagaga

SEQ ID NO: 4613334 - DNA, 14 bp, Homo sapiens
tgcttttttaaata

SEQ ID NO: 4613335 - DNA, 17 bp, Homo sapiens
tgcttttttaaatatta

SEQ ID NO: 4613336 - DNA, 15 bp, Homo sapiens
tggaaaaaatatttt

SEQ ID NO: 4613337 - DNA, 13 bp, Homo sapiens
tggaaaaaccttg

SEQ ID NO: 4613338 - DNA, 21 bp, Homo sapiens
tggaaaacaaagccaaacaaa

SEQ ID NO: 4613339 - DNA, 14 bp, Homo sapiens
tggaaaagacagaa

SEQ ID NO: 4613340 - DNA, 22 bp, Homo sapiens
tggaaaagggtcttgggaaata

SEQ ID NO: 4613341 - DNA, 14 bp, Homo sapiens
tggaaacaaaacag

SEQ ID NO: 4613342 - DNA, 22 bp, Homo sapiens
tggaaaggagcctaggccaggt

SEQ ID NO: 4613343 - DNA, 14 bp, Homo sapiens
tggaaatacacagt

SEQ ID NO: 4613344 - DNA, 15 bp, Homo sapiens
tggaaatgctgggct

SEQ ID NO: 4613345 - DNA, 20 bp, Homo sapiens
tggaaatgctgggctgacgg

SEQ ID NO: 4613346 - DNA, 17 bp, Homo sapiens
tggaaattggaagagca

SEQ ID NO: 4613347 - DNA, 17 bp, Homo sapiens
tggaacacggccacatc

SEQ ID NO: 4613348 - DNA, 17 bp, Homo sapiens
tggaacgctaatgaaac

SEQ ID NO: 4613349 - DNA, 18 bp, Homo sapiens
tggaacgctaatgaaaca

SEQ ID NO: 4613350 - DNA, 21 bp, Homo sapiens
tggaactgaagggggcggcct

SEQ ID NO: 4613351 - DNA, 22 bp, Homo sapiens
tggaactgaagggggcggccta

SEQ ID NO: 4613352 - DNA, 20 bp, Homo sapiens
tggaactttctgttccctat

SEQ ID NO: 4613353 - DNA, 19 bp, Homo sapiens
tggaagagccgagcacctg

SEQ ID NO: 4613354 - DNA, 12 bp, Homo sapiens
tggaagccaggt

SEQ ID NO: 4613355 - DNA, 18 bp, Homo sapiens
tggaagctgctgaggccc

SEQ ID NO: 4613356 - DNA, 19 bp, Homo sapiens
tggaagcttactctctgct

SEQ ID NO: 4613357 - DNA, 23 bp, Homo sapiens
tggaaggcagacagcaggcagcg

SEQ ID NO: 4613358 - DNA, 16 bp, Homo sapiens
tggaaggcctccctct

SEQ ID NO: 4613359 - DNA, 15 bp, Homo sapiens
tggaagtgtgacttc

SEQ ID NO: 4613360 - DNA, 17 bp, Homo sapiens
tggaagtgtgacttctt

SEQ ID NO: 4613361 - DNA, 13 bp, Homo sapiens
tggaatatttgaa

SEQ ID NO: 4613362 - DNA, 20 bp, Homo sapiens
tggaatgcagaggtctccaa

SEQ ID NO: 4613363 - DNA, 18 bp, Homo sapiens
tggaattattgtagacat

SEQ ID NO: 4613364 - DNA, 17 bp, Homo sapiens
tggacacgagccacaag

SEQ ID NO: 4613365 - DNA, 20 bp, Homo sapiens
tggacacgagccacaagctg

SEQ ID NO: 4613366 - DNA, 22 bp, Homo sapiens
tggacacgagccacaagctgca

SEQ ID NO: 4613367 - DNA, 12 bp, Homo sapiens
tggacagcatca

SEQ ID NO: 4613368 - DNA, 20 bp, Homo sapiens
tggacagcatcagaaatcct

SEQ ID NO: 4613369 - DNA, 15 bp, Homo sapiens
tggacagctgtgcct

SEQ ID NO: 4613370 - DNA, 16 bp, Homo sapiens
tggacagctgtgcctc

SEQ ID NO: 4613371 - DNA, 18 bp, Homo sapiens
tggacagctgtgcctcgc

SEQ ID NO: 4613372 - DNA, 19 bp, Homo sapiens
tggacagctgtgcctcgct

SEQ ID NO: 4613373 - DNA, 23 bp, Homo sapiens
tggacaggactaacactcagaag

SEQ ID NO: 4613374 - DNA, 19 bp, Homo sapiens
tggacatagagagggagaa

SEQ ID NO: 4613375 - DNA, 23 bp, Homo sapiens
tggacatagagagggagaagaag

SEQ ID NO: 4613376 - DNA, 13 bp, Homo sapiens
tggacctgggaca

SEQ ID NO: 4613377 - DNA, 15 bp, Homo sapiens
tggactcagggcagc

SEQ ID NO: 4613378 - DNA, 20 bp, Homo sapiens
tggactcagggcagcgccag

SEQ ID NO: 4613379 - DNA, 19 bp, Homo sapiens
tggactccgaggtggttca

SEQ ID NO: 4613380 - DNA, 21 bp, Homo sapiens
tggactccgaggtggttcaga

SEQ ID NO: 4613381 - DNA, 19 bp, Homo sapiens
tggactctgcacatgtctt

SEQ ID NO: 4613382 - DNA, 21 bp, Homo sapiens
tggactggaggcccctggagc

SEQ ID NO: 4613383 - DNA, 16 bp, Homo sapiens
tggactggttatcttg

SEQ ID NO: 4613384 - DNA, 20 bp, Homo sapiens
tggactggttatcttgttat

SEQ ID NO: 4613385 - DNA, 16 bp, Homo sapiens
tggacttaaagaaaaa

SEQ ID NO: 4613386 - DNA, 18 bp, Homo sapiens
tggagaaaaaggtgccat

SEQ ID NO: 4613387 - DNA, 16 bp, Homo sapiens
tggagaaagagctgcc

SEQ ID NO: 4613388 - DNA, 20 bp, Homo sapiens
tggagaaagagctgcctgga

SEQ ID NO: 4613389 - DNA, 21 bp, Homo sapiens
tggagaaagagctgcctggat

SEQ ID NO: 4613390 - DNA, 21 bp, Homo sapiens
tggagaacagtggttgcctgg

SEQ ID NO: 4613391 - DNA, 14 bp, Homo sapiens
tggagacaaggtgc

SEQ ID NO: 4613392 - DNA, 18 bp, Homo sapiens
tggagacctttctagaca

SEQ ID NO: 4613393 - DNA, 14 bp, Homo sapiens
tggagagccctggg

SEQ ID NO: 4613394 - DNA, 16 bp, Homo sapiens
tggagagccctgggac

SEQ ID NO: 4613395 - DNA, 20 bp, Homo sapiens
tggagagccctgggaccgct

SEQ ID NO: 4613396 - DNA, 23 bp, Homo sapiens
tggagagctaggagcaaagcctg

SEQ ID NO: 4613397 - DNA, 22 bp, Homo sapiens
tggagaggcttccctacacagg

SEQ ID NO: 4613398 - DNA, 13 bp, Homo sapiens
tggagatcacagc

SEQ ID NO: 4613399 - DNA, 17 bp, Homo sapiens
tggagatcacagcccca

SEQ ID NO: 4613400 - DNA, 23 bp, Homo sapiens
tggagatcacagccccacccttg

SEQ ID NO: 4613401 - DNA, 20 bp, Homo sapiens
tggagatcagaaagtgacat

SEQ ID NO: 4613402 - DNA, 13 bp, Homo sapiens
tggagcaagctct

SEQ ID NO: 4613403 - DNA, 13 bp, Homo sapiens
tggagcaggagcc

SEQ ID NO: 4613404 - DNA, 18 bp, Homo sapiens
tggagcaggagccccgcc

SEQ ID NO: 4613405 - DNA, 19 bp, Homo sapiens
tggagcagtaatgcagcat

SEQ ID NO: 4613406 - DNA, 16 bp, Homo sapiens
tggagccactctgttc

SEQ ID NO: 4613407 - DNA, 22 bp, Homo sapiens
tggagctactccccacctccca

SEQ ID NO: 4613408 - DNA, 19 bp, Homo sapiens
tggagctgccacagagaag

SEQ ID NO: 4613409 - DNA, 13 bp, Homo sapiens
tggaggaagagcc

SEQ ID NO: 4613410 - DNA, 18 bp, Homo sapiens
tggaggaagagccacctg

SEQ ID NO: 4613411 - DNA, 23 bp, Homo sapiens
tggaggaagagccacctgcaaga

SEQ ID NO: 4613412 - DNA, 20 bp, Homo sapiens
tggaggacctgagcctgccg

SEQ ID NO: 4613413 - DNA, 15 bp, Homo sapiens
tggaggagagaagaa

SEQ ID NO: 4613414 - DNA, 13 bp, Homo sapiens
tggaggagagaga

SEQ ID NO: 4613415 - DNA, 16 bp, Homo sapiens
tggaggagagagaccc

SEQ ID NO: 4613416 - DNA, 14 bp, Homo sapiens
tggaggagccaggc

SEQ ID NO: 4613417 - DNA, 14 bp, Homo sapiens
tggaggcagatgcc

SEQ ID NO: 4613418 - DNA, 16 bp, Homo sapiens
tggaggcccctggagc

SEQ ID NO: 4613419 - DNA, 16 bp, Homo sapiens
tggaggccctcctgtg

SEQ ID NO: 4613420 - DNA, 16 bp, Homo sapiens
tggagggcaagccctg

SEQ ID NO: 4613421 - DNA, 13 bp, Homo sapiens
tggagggcttggc

SEQ ID NO: 4613422 - DNA, 16 bp, Homo sapiens
tggaggggctggggac

SEQ ID NO: 4613423 - DNA, 14 bp, Homo sapiens
tggaggtgtgggag

SEQ ID NO: 4613424 - DNA, 14 bp, Homo sapiens
tggagtagcctgga

SEQ ID NO: 4613425 - DNA, 23 bp, Homo sapiens
tggagtagcctggactgtttcat

SEQ ID NO: 4613426 - DNA, 15 bp, Homo sapiens
tggagtatgatttac

SEQ ID NO: 4613427 - DNA, 16 bp, Homo sapiens
tggagtcccttttcat

SEQ ID NO: 4613428 - DNA, 18 bp, Homo sapiens
tggagtctcactcttgtc

SEQ ID NO: 4613429 - DNA, 22 bp, Homo sapiens
tggagtgagaggcccccaccct

SEQ ID NO: 4613430 - DNA, 15 bp, Homo sapiens
tggagtgtgagccac

SEQ ID NO: 4613431 - DNA, 23 bp, Homo sapiens
tggagtttaggaattggaggctg

SEQ ID NO: 4613432 - DNA, 19 bp, Homo sapiens
tggatcttgaatgtggtct

SEQ ID NO: 4613433 - DNA, 15 bp, Homo sapiens
tggatgctgtgctac

SEQ ID NO: 4613434 - DNA, 12 bp, Homo sapiens
tggatggtttgt

SEQ ID NO: 4613435 - DNA, 20 bp, Homo sapiens
tggattaaacctttttataa

SEQ ID NO: 4613436 - DNA, 23 bp, Homo sapiens
tggattcattctcataattccta

SEQ ID NO: 4613437 - DNA, 22 bp, Homo sapiens
tggattgctggggccaggcccc

SEQ ID NO: 4613438 - DNA, 22 bp, Homo sapiens
tggattttttattattattcaa

SEQ ID NO: 4613439 - DNA, 16 bp, Homo sapiens
tggcaaaacagccctc

SEQ ID NO: 4613440 - DNA, 22 bp, Homo sapiens
tggcaaacgagactttctcctg

SEQ ID NO: 4613441 - DNA, 18 bp, Homo sapiens
tggcacagaagaggagtc

SEQ ID NO: 4613442 - DNA, 19 bp, Homo sapiens
tggcacagaagaggagtca

SEQ ID NO: 4613443 - DNA, 14 bp, Homo sapiens
tggcacaggacatg

SEQ ID NO: 4613444 - DNA, 15 bp, Homo sapiens
tggcacttatcatta

SEQ ID NO: 4613445 - DNA, 19 bp, Homo sapiens
tggcacttccacctccagc

SEQ ID NO: 4613446 - DNA, 17 bp, Homo sapiens
tggcagatgtaggaggg

SEQ ID NO: 4613447 - DNA, 20 bp, Homo sapiens
tggcagatgtaggagggact

SEQ ID NO: 4613448 - DNA, 18 bp, Homo sapiens
tggcagccacacttctca

SEQ ID NO: 4613449 - DNA, 14 bp, Homo sapiens
tggcaggagctact

SEQ ID NO: 4613450 - DNA, 17 bp, Homo sapiens
tggcaggagctactgag

SEQ ID NO: 4613451 - DNA, 23 bp, Homo sapiens
tggcaggagctactgagaacata

SEQ ID NO: 4613452 - DNA, 12 bp, Homo sapiens
tggcagggaccg

SEQ ID NO: 4613453 - DNA, 13 bp, Homo sapiens
tggcagggaccgg

SEQ ID NO: 4613454 - DNA, 20 bp, Homo sapiens
tggcagggaccggcagagct

SEQ ID NO: 4613455 - DNA, 23 bp, Homo sapiens
tggcagggaccggcagagctcta

SEQ ID NO: 4613456 - DNA, 14 bp, Homo sapiens
tggcagggcagcag

SEQ ID NO: 4613457 - DNA, 19 bp, Homo sapiens
tggcagggcagcaggaggc

SEQ ID NO: 4613458 - DNA, 13 bp, Homo sapiens
tggcaggggagca

SEQ ID NO: 4613459 - DNA, 15 bp, Homo sapiens
tggcagtggcagaga

SEQ ID NO: 4613460 - DNA, 23 bp, Homo sapiens
tggcagttaattggatgttcact

SEQ ID NO: 4613461 - DNA, 15 bp, Homo sapiens
tggcatatggtccta

SEQ ID NO: 4613462 - DNA, 14 bp, Homo sapiens
tggcatattttaat

SEQ ID NO: 4613463 - DNA, 17 bp, Homo sapiens
tggcatcctgtgaagtc

SEQ ID NO: 4613464 - DNA, 13 bp, Homo sapiens
tggcatgcatctt

SEQ ID NO: 4613465 - DNA, 14 bp, Homo sapiens
tggcatgcatcttt

SEQ ID NO: 4613466 - DNA, 15 bp, Homo sapiens
tggcatgttgatttc

SEQ ID NO: 4613467 - DNA, 14 bp, Homo sapiens
tggccaagcctatc

SEQ ID NO: 4613468 - DNA, 17 bp, Homo sapiens
tggccaagctgaggtgc

SEQ ID NO: 4613469 - DNA, 23 bp, Homo sapiens
tggccaagctgaggtgcccagga

SEQ ID NO: 4613470 - DNA, 17 bp, Homo sapiens
tggccaatttttgtact

SEQ ID NO: 4613471 - DNA, 17 bp, Homo sapiens
tggccacagccttccct

SEQ ID NO: 4613472 - DNA, 22 bp, Homo sapiens
tggccacagccttccctctgca

SEQ ID NO: 4613473 - DNA, 17 bp, Homo sapiens
tggccaccttttcagcg

SEQ ID NO: 4613474 - DNA, 20 bp, Homo sapiens
tggccaggctgatctcgaac

SEQ ID NO: 4613475 - DNA, 14 bp, Homo sapiens
tggccaggggccag

SEQ ID NO: 4613476 - DNA, 15 bp, Homo sapiens
tggccatcatcctcc

SEQ ID NO: 4613477 - DNA, 14 bp, Homo sapiens
tggcccagttctga

SEQ ID NO: 4613478 - DNA, 15 bp, Homo sapiens
tggcccccagcttca

SEQ ID NO: 4613479 - DNA, 21 bp, Homo sapiens
tggcccccatcagccctgcta

SEQ ID NO: 4613480 - DNA, 20 bp, Homo sapiens
tggccccgcaaggcctccag

SEQ ID NO: 4613481 - DNA, 19 bp, Homo sapiens
tggccccgcccctgccccc

SEQ ID NO: 4613482 - DNA, 19 bp, Homo sapiens
tggcccctccaatcctccc

SEQ ID NO: 4613483 - DNA, 13 bp, Homo sapiens
tggcccctgcctg

SEQ ID NO: 4613484 - DNA, 13 bp, Homo sapiens
tggccctgctttc

SEQ ID NO: 4613485 - DNA, 23 bp, Homo sapiens
tggcccttacttgcttctctagc

SEQ ID NO: 4613486 - DNA, 15 bp, Homo sapiens
tggcccttcctggac

SEQ ID NO: 4613487 - DNA, 16 bp, Homo sapiens
tggcccttcctggaca

SEQ ID NO: 4613488 - DNA, 17 bp, Homo sapiens
tggcccttcctggacag

SEQ ID NO: 4613489 - DNA, 18 bp, Homo sapiens
tggcccttcctggacagc

SEQ ID NO: 4613490 - DNA, 15 bp, Homo sapiens
tggccgagtccaagc

SEQ ID NO: 4613491 - DNA, 17 bp, Homo sapiens
tggccgagtccaagctg

SEQ ID NO: 4613492 - DNA, 17 bp, Homo sapiens
tggccgggctctcatgg

SEQ ID NO: 4613493 - DNA, 21 bp, Homo sapiens
tggcctaaacctcagttatta

SEQ ID NO: 4613494 - DNA, 15 bp, Homo sapiens
tggcctaaatttctt

SEQ ID NO: 4613495 - DNA, 17 bp, Homo sapiens
tggcctaaatttcttct

SEQ ID NO: 4613496 - DNA, 15 bp, Homo sapiens
tggcctaatttacaa

SEQ ID NO: 4613497 - DNA, 14 bp, Homo sapiens
tggcctatgcacat

SEQ ID NO: 4613498 - DNA, 15 bp, Homo sapiens
tggcctatgcacata

SEQ ID NO: 4613499 - DNA, 17 bp, Homo sapiens
tggcctatgcacatatg

SEQ ID NO: 4613500 - DNA, 16 bp, Homo sapiens
tggcctatgtggtcta

SEQ ID NO: 4613501 - DNA, 12 bp, Homo sapiens
tggcctcagagc

SEQ ID NO: 4613502 - DNA, 13 bp, Homo sapiens
tggcctccctgct

SEQ ID NO: 4613503 - DNA, 13 bp, Homo sapiens
tggcctcctgcct

SEQ ID NO: 4613504 - DNA, 19 bp, Homo sapiens
tggcctcgtgaggggcaag

SEQ ID NO: 4613505 - DNA, 18 bp, Homo sapiens
tggcctgaactgaggaga

SEQ ID NO: 4613506 - DNA, 17 bp, Homo sapiens
tggcctggcccccagct

SEQ ID NO: 4613507 - DNA, 19 bp, Homo sapiens
tggcctgtagaatagcctg

SEQ ID NO: 4613508 - DNA, 17 bp, Homo sapiens
tggccttaaagagggac

SEQ ID NO: 4613509 - DNA, 14 bp, Homo sapiens
tggccttctaggaa

SEQ ID NO: 4613510 - DNA, 18 bp, Homo sapiens
tggccttgtaagaccctt

SEQ ID NO: 4613511 - DNA, 14 bp, Homo sapiens
tggcggggaaccct

SEQ ID NO: 4613512 - DNA, 14 bp, Homo sapiens
tggcgtctccctcg

SEQ ID NO: 4613513 - DNA, 20 bp, Homo sapiens
tggctactccctggaccacg

SEQ ID NO: 4613514 - DNA, 22 bp, Homo sapiens
tggctactctgtgccagagcct

SEQ ID NO: 4613515 - DNA, 15 bp, Homo sapiens
tggctagagggccca

SEQ ID NO: 4613516 - DNA, 14 bp, Homo sapiens
tggctcacagtaca

SEQ ID NO: 4613517 - DNA, 13 bp, Homo sapiens
tggctcagccagc

SEQ ID NO: 4613518 - DNA, 22 bp, Homo sapiens
tggctccctctctcctggactg

SEQ ID NO: 4613519 - DNA, 12 bp, Homo sapiens
tggctctgctgg

SEQ ID NO: 4613520 - DNA, 22 bp, Homo sapiens
tggctgagggcagttcgcagcc

SEQ ID NO: 4613521 - DNA, 23 bp, Homo sapiens
tggctgagggcagttcgcagcca

SEQ ID NO: 4613522 - DNA, 18 bp, Homo sapiens
tggctgattcagcatttt

SEQ ID NO: 4613523 - DNA, 17 bp, Homo sapiens
tggctgcttcctgtgac

SEQ ID NO: 4613524 - DNA, 17 bp, Homo sapiens
tggctggctgagggcag

SEQ ID NO: 4613525 - DNA, 15 bp, Homo sapiens
tggctgggacgtggc

SEQ ID NO: 4613526 - DNA, 23 bp, Homo sapiens
tggctgggacgtggctcagccag

SEQ ID NO: 4613527 - DNA, 13 bp, Homo sapiens
tggctgtaatcat

SEQ ID NO: 4613528 - DNA, 21 bp, Homo sapiens
tggcttaggaatgacttactt

SEQ ID NO: 4613529 - DNA, 16 bp, Homo sapiens
tggcttcagcccccac

SEQ ID NO: 4613530 - DNA, 18 bp, Homo sapiens
tggcttcagcccccacca

SEQ ID NO: 4613531 - DNA, 23 bp, Homo sapiens
tggcttcagcccccaccagggga

SEQ ID NO: 4613532 - DNA, 19 bp, Homo sapiens
tggcttcccatccccagcg

SEQ ID NO: 4613533 - DNA, 20 bp, Homo sapiens
tggcttcccatccccagcga

SEQ ID NO: 4613534 - DNA, 21 bp, Homo sapiens
tggcttcccatccccagcgat

SEQ ID NO: 4613535 - DNA, 15 bp, Homo sapiens
tggctttcagggcag

SEQ ID NO: 4613536 - DNA, 15 bp, Homo sapiens
tggctttcctgctgg

SEQ ID NO: 4613537 - DNA, 23 bp, Homo sapiens
tgggaaagacatccataaagaag

SEQ ID NO: 4613538 - DNA, 18 bp, Homo sapiens
tgggaactctcctggcct

SEQ ID NO: 4613539 - DNA, 21 bp, Homo sapiens
tgggaagactgaggcatccgt

SEQ ID NO: 4613540 - DNA, 12 bp, Homo sapiens
tgggaaggggct

SEQ ID NO: 4613541 - DNA, 14 bp, Homo sapiens
tgggacaccaggga

SEQ ID NO: 4613542 - DNA, 13 bp, Homo sapiens
tgggaccaacctg

SEQ ID NO: 4613543 - DNA, 13 bp, Homo sapiens
tgggaccccagct

SEQ ID NO: 4613544 - DNA, 14 bp, Homo sapiens
tgggaccccagctg

SEQ ID NO: 4613545 - DNA, 20 bp, Homo sapiens
tgggaccgctacaccactct

SEQ ID NO: 4613546 - DNA, 18 bp, Homo sapiens
tgggacctccccagccca

SEQ ID NO: 4613547 - DNA, 22 bp, Homo sapiens
tgggactagaggctcagtggtg

SEQ ID NO: 4613548 - DNA, 18 bp, Homo sapiens
tgggactcatccttgccc

SEQ ID NO: 4613549 - DNA, 21 bp, Homo sapiens
tgggactcatccttgcccagg

SEQ ID NO: 4613550 - DNA, 22 bp, Homo sapiens
tgggactcatccttgcccaggt

SEQ ID NO: 4613551 - DNA, 17 bp, Homo sapiens
tgggactttcccaccca

SEQ ID NO: 4613552 - DNA, 19 bp, Homo sapiens
tgggactttcccacccagg

SEQ ID NO: 4613553 - DNA, 17 bp, Homo sapiens
tgggacttttctttctt

SEQ ID NO: 4613554 - DNA, 19 bp, Homo sapiens
tgggagagtacctgtgtgt

SEQ ID NO: 4613555 - DNA, 23 bp, Homo sapiens
tgggagagtacctgtgtgtttcg

SEQ ID NO: 4613556 - DNA, 15 bp, Homo sapiens
tgggagctgagctgg

SEQ ID NO: 4613557 - DNA, 14 bp, Homo sapiens
tgggagggaaaagg

SEQ ID NO: 4613558 - DNA, 12 bp, Homo sapiens
tgggatatcatt

SEQ ID NO: 4613559 - DNA, 14 bp, Homo sapiens
tgggatatcatttt

SEQ ID NO: 4613560 - DNA, 15 bp, Homo sapiens
tgggatatcatttta

SEQ ID NO: 4613561 - DNA, 16 bp, Homo sapiens
tgggatatcattttaa

SEQ ID NO: 4613562 - DNA, 22 bp, Homo sapiens
tgggattcaggaaaaggcctgg

SEQ ID NO: 4613563 - DNA, 23 bp, Homo sapiens
tgggattcaggaaaaggcctggg

SEQ ID NO: 4613564 - DNA, 14 bp, Homo sapiens
tgggcaatggccag

SEQ ID NO: 4613565 - DNA, 20 bp, Homo sapiens
tgggcacaattcctgtgctc

SEQ ID NO: 4613566 - DNA, 17 bp, Homo sapiens
tgggcacccccagcctg

SEQ ID NO: 4613567 - DNA, 22 bp, Homo sapiens
tgggcacccccagcctgggcct

SEQ ID NO: 4613568 - DNA, 15 bp, Homo sapiens
tgggcactggcccag

SEQ ID NO: 4613569 - DNA, 20 bp, Homo sapiens
tgggcagaggaatgtgggct

SEQ ID NO: 4613570 - DNA, 21 bp, Homo sapiens
tgggcagccagaccagcaggc

SEQ ID NO: 4613571 - DNA, 13 bp, Homo sapiens
tgggcagggagcg

SEQ ID NO: 4613572 - DNA, 18 bp, Homo sapiens
tgggccaccgtgcctggc

SEQ ID NO: 4613573 - DNA, 23 bp, Homo sapiens
tgggccactggggactttattta

SEQ ID NO: 4613574 - DNA, 13 bp, Homo sapiens
tgggccagggctg

SEQ ID NO: 4613575 - DNA, 20 bp, Homo sapiens
tgggccagggctgccctgag

SEQ ID NO: 4613576 - DNA, 21 bp, Homo sapiens
tgggccatgaaccaaatggtt

SEQ ID NO: 4613577 - DNA, 22 bp, Homo sapiens
tgggcccatctctccctgcgca

SEQ ID NO: 4613578 - DNA, 13 bp, Homo sapiens
tgggccccacatg

SEQ ID NO: 4613579 - DNA, 17 bp, Homo sapiens
tgggccccacatggctt

SEQ ID NO: 4613580 - DNA, 18 bp, Homo sapiens
tgggccccgggctggaga

SEQ ID NO: 4613581 - DNA, 19 bp, Homo sapiens
tgggccctctttccctgcg

SEQ ID NO: 4613582 - DNA, 13 bp, Homo sapiens
tgggccctggggc

SEQ ID NO: 4613583 - DNA, 16 bp, Homo sapiens
tgggccctggggcctg

SEQ ID NO: 4613584 - DNA, 22 bp, Homo sapiens
tgggccctggggcctgtactgc

SEQ ID NO: 4613585 - DNA, 17 bp, Homo sapiens
tgggcctatggagagcc

SEQ ID NO: 4613586 - DNA, 20 bp, Homo sapiens
tgggcctatggagagccctg

SEQ ID NO: 4613587 - DNA, 22 bp, Homo sapiens
tgggcctatggagagccctggg

SEQ ID NO: 4613588 - DNA, 11 bp, Homo sapiens
tgggcctcagg

SEQ ID NO: 4613589 - DNA, 16 bp, Homo sapiens
tgggcctcaggctctg

SEQ ID NO: 4613590 - DNA, 18 bp, Homo sapiens
tgggcctcaggctctgca

SEQ ID NO: 4613591 - DNA, 19 bp, Homo sapiens
tgggcctcaggctctgcac

SEQ ID NO: 4613592 - DNA, 18 bp, Homo sapiens
tgggcctgctgctgagaa

SEQ ID NO: 4613593 - DNA, 23 bp, Homo sapiens
tgggcctgctgctgagaacctgg

SEQ ID NO: 4613594 - DNA, 16 bp, Homo sapiens
tgggcctggccctgct

SEQ ID NO: 4613595 - DNA, 17 bp, Homo sapiens
tgggcctggccctgctt

SEQ ID NO: 4613596 - DNA, 22 bp, Homo sapiens
tgggcctgggggttttccaagc

SEQ ID NO: 4613597 - DNA, 19 bp, Homo sapiens
tgggccttagtgggccagg

SEQ ID NO: 4613598 - DNA, 20 bp, Homo sapiens
tgggctcaagctttcccgcc

SEQ ID NO: 4613599 - DNA, 13 bp, Homo sapiens
tgggctcctccag

SEQ ID NO: 4613600 - DNA, 23 bp, Homo sapiens
tgggctcctccagggtgtgtgct

SEQ ID NO: 4613601 - DNA, 14 bp, Homo sapiens
tgggctctggactc

SEQ ID NO: 4613602 - DNA, 14 bp, Homo sapiens
tgggctgacccagc

SEQ ID NO: 4613603 - DNA, 18 bp, Homo sapiens
tgggctgacccagcatct

SEQ ID NO: 4613604 - DNA, 21 bp, Homo sapiens
tgggctggggaggaggagaga

SEQ ID NO: 4613605 - DNA, 20 bp, Homo sapiens
tgggctgtaacgtggcactg

SEQ ID NO: 4613606 - DNA, 22 bp, Homo sapiens
tggggaaggagaaggagtgcca

SEQ ID NO: 4613607 - DNA, 16 bp, Homo sapiens
tggggaagtgaggaag

SEQ ID NO: 4613608 - DNA, 14 bp, Homo sapiens
tggggaggcaggca

SEQ ID NO: 4613609 - DNA, 13 bp, Homo sapiens
tggggatagtctg

SEQ ID NO: 4613610 - DNA, 19 bp, Homo sapiens
tggggatagtctgggtcag

SEQ ID NO: 4613611 - DNA, 13 bp, Homo sapiens
tggggatcacagc

SEQ ID NO: 4613612 - DNA, 23 bp, Homo sapiens
tggggatcacagcctcacccctg

SEQ ID NO: 4613613 - DNA, 15 bp, Homo sapiens
tggggatgaggtcac

SEQ ID NO: 4613614 - DNA, 10 bp, Homo sapiens
tggggcagca

SEQ ID NO: 4613615 - DNA, 12 bp, Homo sapiens
tggggcaggagt

SEQ ID NO: 4613616 - DNA, 13 bp, Homo sapiens
tggggcaggagta

SEQ ID NO: 4613617 - DNA, 19 bp, Homo sapiens
tggggcaggagtagctgag

SEQ ID NO: 4613618 - DNA, 11 bp, Homo sapiens
tggggccactt

SEQ ID NO: 4613619 - DNA, 13 bp, Homo sapiens
tggggccaggccc

SEQ ID NO: 4613620 - DNA, 14 bp, Homo sapiens
tggggccaggcccc

SEQ ID NO: 4613621 - DNA, 19 bp, Homo sapiens
tggggccaggccccatgga

SEQ ID NO: 4613622 - DNA, 19 bp, Homo sapiens
tggggccgccacggcctgg

SEQ ID NO: 4613623 - DNA, 20 bp, Homo sapiens
tggggccgccacggcctggc

SEQ ID NO: 4613624 - DNA, 18 bp, Homo sapiens
tggggcctgtactgcctg

SEQ ID NO: 4613625 - DNA, 19 bp, Homo sapiens
tggggcctgtactgcctgc

SEQ ID NO: 4613626 - DNA, 20 bp, Homo sapiens
tggggctgcagttggtctcc

SEQ ID NO: 4613627 - DNA, 14 bp, Homo sapiens
tgggggaagaggag

SEQ ID NO: 4613628 - DNA, 15 bp, Homo sapiens
tgggggaagaggaga

SEQ ID NO: 4613629 - DNA, 23 bp, Homo sapiens
tgggggaatgagcccagagaaca

SEQ ID NO: 4613630 - DNA, 11 bp, Homo sapiens
tgggggcctgg

SEQ ID NO: 4613631 - DNA, 12 bp, Homo sapiens
tgggggcctggc

SEQ ID NO: 4613632 - DNA, 18 bp, Homo sapiens
tggggggtgatgagggca

SEQ ID NO: 4613633 - DNA, 19 bp, Homo sapiens
tggggggtgatgagggcag

SEQ ID NO: 4613634 - DNA, 18 bp, Homo sapiens
tgggggttttccaagccc

SEQ ID NO: 4613635 - DNA, 20 bp, Homo sapiens
tggggtcaagaaacagccag

SEQ ID NO: 4613636 - DNA, 21 bp, Homo sapiens
tggggtcaagaaacagccagc

SEQ ID NO: 4613637 - DNA, 16 bp, Homo sapiens
tggggtcaagctgagc

SEQ ID NO: 4613638 - DNA, 12 bp, Homo sapiens
tggggtgacagt

SEQ ID NO: 4613639 - DNA, 16 bp, Homo sapiens
tggggtgacagtcatc

SEQ ID NO: 4613640 - DNA, 18 bp, Homo sapiens
tgggtaaaagcagggcag

SEQ ID NO: 4613641 - DNA, 21 bp, Homo sapiens
tgggtagaaagagatacagag

SEQ ID NO: 4613642 - DNA, 16 bp, Homo sapiens
tgggtaggccccacaa

SEQ ID NO: 4613643 - DNA, 22 bp, Homo sapiens
tgggtaggccccacaaggcctg

SEQ ID NO: 4613644 - DNA, 23 bp, Homo sapiens
tgggtaggccccacaaggcctgg

SEQ ID NO: 4613645 - DNA, 17 bp, Homo sapiens
tgggtcaaaaaaaagaa

SEQ ID NO: 4613646 - DNA, 15 bp, Homo sapiens
tgggtcactcattaa

SEQ ID NO: 4613647 - DNA, 21 bp, Homo sapiens
tgggtcagacccatctctccc

SEQ ID NO: 4613648 - DNA, 13 bp, Homo sapiens
tgggtcaggcagg

SEQ ID NO: 4613649 - DNA, 21 bp, Homo sapiens
tgggtctaggacacagttcct

SEQ ID NO: 4613650 - DNA, 22 bp, Homo sapiens
tgggtctaggacacagttcctg

SEQ ID NO: 4613651 - DNA, 21 bp, Homo sapiens
tgggtctggctagagggccca

SEQ ID NO: 4613652 - DNA, 14 bp, Homo sapiens
tgggtgtagccagg

SEQ ID NO: 4613653 - DNA, 14 bp, Homo sapiens
tgggtgtcatttca

SEQ ID NO: 4613654 - DNA, 19 bp, Homo sapiens
tgggtgtcatttcattcca

SEQ ID NO: 4613655 - DNA, 22 bp, Homo sapiens
tgggtgtctgggctcaagcttt

SEQ ID NO: 4613656 - DNA, 18 bp, Homo sapiens
tggtaaaacagtttcatc

SEQ ID NO: 4613657 - DNA, 18 bp, Homo sapiens
tggtaatcctcttctaaa

SEQ ID NO: 4613658 - DNA, 20 bp, Homo sapiens
tggtaggaatgcttccgaga

SEQ ID NO: 4613659 - DNA, 14 bp, Homo sapiens
tggtaggttgggac

SEQ ID NO: 4613660 - DNA, 16 bp, Homo sapiens
tggtatagaaatgctg

SEQ ID NO: 4613661 - DNA, 20 bp, Homo sapiens
tggtatcctactgagcattt

SEQ ID NO: 4613662 - DNA, 22 bp, Homo sapiens
tggtcagctgccccaatgtgac

SEQ ID NO: 4613663 - DNA, 20 bp, Homo sapiens
tggtcagtagtttcatgttt

SEQ ID NO: 4613664 - DNA, 22 bp, Homo sapiens
tggtcagtagtttcatgtttta

SEQ ID NO: 4613665 - DNA, 20 bp, Homo sapiens
tggtcatgaattcatactct

SEQ ID NO: 4613666 - DNA, 21 bp, Homo sapiens
tggtccagaccagccctgcag

SEQ ID NO: 4613667 - DNA, 15 bp, Homo sapiens
tggtcccacatccct

SEQ ID NO: 4613668 - DNA, 17 bp, Homo sapiens
tggtcccacatccctgg

SEQ ID NO: 4613669 - DNA, 20 bp, Homo sapiens
tggtcccacatccctgggcc

SEQ ID NO: 4613670 - DNA, 13 bp, Homo sapiens
tggtccctgggag

SEQ ID NO: 4613671 - DNA, 16 bp, Homo sapiens
tggtcccttaaggcac

SEQ ID NO: 4613672 - DNA, 13 bp, Homo sapiens
tggtcctgaccag

SEQ ID NO: 4613673 - DNA, 20 bp, Homo sapiens
tggtcggatctcacaggctg

SEQ ID NO: 4613674 - DNA, 18 bp, Homo sapiens
tggtctagaccagggctg

SEQ ID NO: 4613675 - DNA, 12 bp, Homo sapiens
tggtctcaggat

SEQ ID NO: 4613676 - DNA, 15 bp, Homo sapiens
tggtctcccttctct

SEQ ID NO: 4613677 - DNA, 16 bp, Homo sapiens
tggtcttagctttaca

SEQ ID NO: 4613678 - DNA, 18 bp, Homo sapiens
tggtcttagctttacatt

SEQ ID NO: 4613679 - DNA, 14 bp, Homo sapiens
tggtctttccatct

SEQ ID NO: 4613680 - DNA, 13 bp, Homo sapiens
tggtgacttctgc

SEQ ID NO: 4613681 - DNA, 14 bp, Homo sapiens
tggtgacttctgct

SEQ ID NO: 4613682 - DNA, 15 bp, Homo sapiens
tggtgacttgtctgc

SEQ ID NO: 4613683 - DNA, 21 bp, Homo sapiens
tggtgacttgtctgcctcctg

SEQ ID NO: 4613684 - DNA, 16 bp, Homo sapiens
tggtgagatgcagctg

SEQ ID NO: 4613685 - DNA, 17 bp, Homo sapiens
tggtgagatgcagctgg

SEQ ID NO: 4613686 - DNA, 23 bp, Homo sapiens
tggtgcaggtagacctgtctcct

SEQ ID NO: 4613687 - DNA, 15 bp, Homo sapiens
tggtgcattcctgaa

SEQ ID NO: 4613688 - DNA, 20 bp, Homo sapiens
tggtgctatttgaagaaaaa

SEQ ID NO: 4613689 - DNA, 18 bp, Homo sapiens
tggtgcttattcttaact

SEQ ID NO: 4613690 - DNA, 19 bp, Homo sapiens
tggtgcttggagggggaag

SEQ ID NO: 4613691 - DNA, 13 bp, Homo sapiens
tggtggcattttt

SEQ ID NO: 4613692 - DNA, 15 bp, Homo sapiens
tggtggcatttttgc

SEQ ID NO: 4613693 - DNA, 12 bp, Homo sapiens
tggtggcctcag

SEQ ID NO: 4613694 - DNA, 14 bp, Homo sapiens
tggtggggcagctc

SEQ ID NO: 4613695 - DNA, 18 bp, Homo sapiens
tggttcagacaagacaga

SEQ ID NO: 4613696 - DNA, 15 bp, Homo sapiens
tggttctttcagctg

SEQ ID NO: 4613697 - DNA, 16 bp, Homo sapiens
tggttgtctagtcatt

SEQ ID NO: 4613698 - DNA, 18 bp, Homo sapiens
tggttgtgtgtgttctgt

SEQ ID NO: 4613699 - DNA, 20 bp, Homo sapiens
tggtttagttataaaaggct

SEQ ID NO: 4613700 - DNA, 16 bp, Homo sapiens
tggtttcaaactcctg

SEQ ID NO: 4613701 - DNA, 15 bp, Homo sapiens
tggttttaaaagcac

SEQ ID NO: 4613702 - DNA, 22 bp, Homo sapiens
tgtaaaaacagcattgctttct

SEQ ID NO: 4613703 - DNA, 14 bp, Homo sapiens
tgtaaaacaaaatt

SEQ ID NO: 4613704 - DNA, 22 bp, Homo sapiens
tgtaaaacaaagattgattgat

SEQ ID NO: 4613705 - DNA, 21 bp, Homo sapiens
tgtaaaaggccaaacctctgt

SEQ ID NO: 4613706 - DNA, 23 bp, Homo sapiens
tgtaaaaggccaaacctctgttc

SEQ ID NO: 4613707 - DNA, 22 bp, Homo sapiens
tgtaaacaaaccacagcaggat

SEQ ID NO: 4613708 - DNA, 19 bp, Homo sapiens
tgtaaactgaatataaagc

SEQ ID NO: 4613709 - DNA, 12 bp, Homo sapiens
tgtaaacttctg

SEQ ID NO: 4613710 - DNA, 14 bp, Homo sapiens
tgtaaacttctgaa

SEQ ID NO: 4613711 - DNA, 17 bp, Homo sapiens
tgtaaacttctgaagac

SEQ ID NO: 4613712 - DNA, 17 bp, Homo sapiens
tgtaaataggattttta

SEQ ID NO: 4613713 - DNA, 18 bp, Homo sapiens
tgtaaataggatttttag

SEQ ID NO: 4613714 - DNA, 18 bp, Homo sapiens
tgtaaatatttactcttt

SEQ ID NO: 4613715 - DNA, 21 bp, Homo sapiens
tgtaaatttggcttctgttgt

SEQ ID NO: 4613716 - DNA, 16 bp, Homo sapiens
tgtaactattaacctt

SEQ ID NO: 4613717 - DNA, 21 bp, Homo sapiens
tgtaagaacaactacctgagc

SEQ ID NO: 4613718 - DNA, 18 bp, Homo sapiens
tgtaagacccttattgct

SEQ ID NO: 4613719 - DNA, 19 bp, Homo sapiens
tgtaagcaggagagaaatt

SEQ ID NO: 4613720 - DNA, 12 bp, Homo sapiens
tgtaagggcagt

SEQ ID NO: 4613721 - DNA, 16 bp, Homo sapiens
tgtaagggcagtgccc

SEQ ID NO: 4613722 - DNA, 15 bp, Homo sapiens
tgtaatatgacagat

SEQ ID NO: 4613723 - DNA, 19 bp, Homo sapiens
tgtaatattcattcaaaag

SEQ ID NO: 4613724 - DNA, 16 bp, Homo sapiens
tgtaatatttagctgt

SEQ ID NO: 4613725 - DNA, 21 bp, Homo sapiens
tgtaatatttagctgtaaact

SEQ ID NO: 4613726 - DNA, 22 bp, Homo sapiens
tgtaatatttttatatacagag

SEQ ID NO: 4613727 - DNA, 20 bp, Homo sapiens
tgtaatcaaaaggaggaatt

SEQ ID NO: 4613728 - DNA, 12 bp, Homo sapiens
tgtaatcaggca

SEQ ID NO: 4613729 - DNA, 21 bp, Homo sapiens
tgtaatcaggcaaggaggagg

SEQ ID NO: 4613730 - DNA, 22 bp, Homo sapiens
tgtaatcaggcaaggaggagga

SEQ ID NO: 4613731 - DNA, 22 bp, Homo sapiens
tgtaatgtgtggtggcctcagc

SEQ ID NO: 4613732 - DNA, 20 bp, Homo sapiens
tgtaatttaatgcctgccca

SEQ ID NO: 4613733 - DNA, 19 bp, Homo sapiens
tgtaatttgatgaggtatt

SEQ ID NO: 4613734 - DNA, 17 bp, Homo sapiens
tgtacaaatacatgtgt

SEQ ID NO: 4613735 - DNA, 20 bp, Homo sapiens
tgtacaaatacatgtgtata

SEQ ID NO: 4613736 - DNA, 17 bp, Homo sapiens
tgtacacgtgtcctgta

SEQ ID NO: 4613737 - DNA, 24 bp, Homo sapiens
tgtacactacattttttctaataa

SEQ ID NO: 4613738 - DNA, 19 bp, Homo sapiens
tgtacactttttacagcag

SEQ ID NO: 4613739 - DNA, 22 bp, Homo sapiens
tgtacactttttacagcagcaa

SEQ ID NO: 4613740 - DNA, 12 bp, Homo sapiens
tgtacagttttt

SEQ ID NO: 4613741 - DNA, 21 bp, Homo sapiens
tgtacatgtgtagcctgtgca

SEQ ID NO: 4613742 - DNA, 18 bp, Homo sapiens
tgtacatgtgtgcagagc

SEQ ID NO: 4613743 - DNA, 21 bp, Homo sapiens
tgtacatgtgtgcagagcaga

SEQ ID NO: 4613744 - DNA, 16 bp, Homo sapiens
tgtacattctgcctag

SEQ ID NO: 4613745 - DNA, 20 bp, Homo sapiens
tgtacatttcacaggctaat

SEQ ID NO: 4613746 - DNA, 17 bp, Homo sapiens
tgtaccagcccagatgt

SEQ ID NO: 4613747 - DNA, 20 bp, Homo sapiens
tgtaccagcccagatgtttt

SEQ ID NO: 4613748 - DNA, 18 bp, Homo sapiens
tgtaccgcgtctaccctg

SEQ ID NO: 4613749 - DNA, 20 bp, Homo sapiens
tgtaccgcgtctaccctggg

SEQ ID NO: 4613750 - DNA, 20 bp, Homo sapiens
tgtaccgtcgacaagaatgt

SEQ ID NO: 4613751 - DNA, 13 bp, Homo sapiens
tgtactgcctgct

SEQ ID NO: 4613752 - DNA, 21 bp, Homo sapiens
tgtacttctctgtgtgcacac

SEQ ID NO: 4613753 - DNA, 18 bp, Homo sapiens
tgtacttttcattctctt

SEQ ID NO: 4613754 - DNA, 18 bp, Homo sapiens
tgtagaaaagggaactga

SEQ ID NO: 4613755 - DNA, 20 bp, Homo sapiens
tgtagaaaagggaactgaac

SEQ ID NO: 4613756 - DNA, 23 bp, Homo sapiens
tgtagaaaagggaactgaacatt

SEQ ID NO: 4613757 - DNA, 20 bp, Homo sapiens
tgtagaactcactctgggct

SEQ ID NO: 4613758 - DNA, 21 bp, Homo sapiens
tgtagaactcactctgggctg

SEQ ID NO: 4613759 - DNA, 12 bp, Homo sapiens
tgtagacactct

SEQ ID NO: 4613760 - DNA, 20 bp, Homo sapiens
tgtagacactctgacaagct

SEQ ID NO: 4613761 - DNA, 19 bp, Homo sapiens
tgtagactcttgctcctgc

SEQ ID NO: 4613762 - DNA, 16 bp, Homo sapiens
tgtagactgtttcaca

SEQ ID NO: 4613763 - DNA, 14 bp, Homo sapiens
tgtagccagccggg

SEQ ID NO: 4613764 - DNA, 15 bp, Homo sapiens
tgtagccagccgggg

SEQ ID NO: 4613765 - DNA, 20 bp, Homo sapiens
tgtagccaggtatggctctg

SEQ ID NO: 4613766 - DNA, 21 bp, Homo sapiens
tgtagcctaaagggcagggcc

SEQ ID NO: 4613767 - DNA, 20 bp, Homo sapiens
tgtagcctgtgcatgtatgt

SEQ ID NO: 4613768 - DNA, 13 bp, Homo sapiens
tgtagctgtgacc

SEQ ID NO: 4613769 - DNA, 16 bp, Homo sapiens
tgtagctgtgacctgc

SEQ ID NO: 4613770 - DNA, 16 bp, Homo sapiens
tgtagcttcttctgaa

SEQ ID NO: 4613771 - DNA, 14 bp, Homo sapiens
tgtagctttcctgg

SEQ ID NO: 4613772 - DNA, 17 bp, Homo sapiens
tgtagctttcctggaag

SEQ ID NO: 4613773 - DNA, 20 bp, Homo sapiens
tgtaggaattcttttgggga

SEQ ID NO: 4613774 - DNA, 23 bp, Homo sapiens
tgtaggaattcttttggggaagt

SEQ ID NO: 4613775 - DNA, 16 bp, Homo sapiens
tgtagggcaagaggat

SEQ ID NO: 4613776 - DNA, 23 bp, Homo sapiens
tgtagggcaagaggatgaaggaa

SEQ ID NO: 4613777 - DNA, 17 bp, Homo sapiens
tgtagtgagatagcatt

SEQ ID NO: 4613778 - DNA, 19 bp, Homo sapiens
tgtagtttttatatgttgt

SEQ ID NO: 4613779 - DNA, 14 bp, Homo sapiens
tgtataaatgtgat

SEQ ID NO: 4613780 - DNA, 14 bp, Homo sapiens
tgtatacatacatg

SEQ ID NO: 4613781 - DNA, 17 bp, Homo sapiens
tgtatagtatctgtata

SEQ ID NO: 4613782 - DNA, 13 bp, Homo sapiens
tgtatattccttt

SEQ ID NO: 4613783 - DNA, 15 bp, Homo sapiens
tgtatattcctttta

SEQ ID NO: 4613784 - DNA, 21 bp, Homo sapiens
tgtatattccttttaaagaag

SEQ ID NO: 4613785 - DNA, 23 bp, Homo sapiens
tgtatcactctgtgtctgagtgg

SEQ ID NO: 4613786 - DNA, 16 bp, Homo sapiens
tgtatctacattaaaa

SEQ ID NO: 4613787 - DNA, 21 bp, Homo sapiens
tgtatctacattaaaatgaca

SEQ ID NO: 4613788 - DNA, 22 bp, Homo sapiens
tgtatctacattaaaatgacaa

SEQ ID NO: 4613789 - DNA, 22 bp, Homo sapiens
tgtatcttaatatatacatttt

SEQ ID NO: 4613790 - DNA, 23 bp, Homo sapiens
tgtatgaataatgaaaataaaac

SEQ ID NO: 4613791 - DNA, 19 bp, Homo sapiens
tgtatgacccctggccaca

SEQ ID NO: 4613792 - DNA, 23 bp, Homo sapiens
tgtatgacccctggccacagcct

SEQ ID NO: 4613793 - DNA, 18 bp, Homo sapiens
tgtatgcagctatctggt

SEQ ID NO: 4613794 - DNA, 14 bp, Homo sapiens
tgtatgccttctgt

SEQ ID NO: 4613795 - DNA, 15 bp, Homo sapiens
tgtatgccttctgta

SEQ ID NO: 4613796 - DNA, 22 bp, Homo sapiens
tgtatgtttatcaaagagcact

SEQ ID NO: 4613797 - DNA, 18 bp, Homo sapiens
tgtattactgaataatat

SEQ ID NO: 4613798 - DNA, 14 bp, Homo sapiens
tgtattctttataa

SEQ ID NO: 4613799 - DNA, 22 bp, Homo sapiens
tgtatttctctattttcataat

SEQ ID NO: 4613800 - DNA, 15 bp, Homo sapiens
tgtattttcctaatg

SEQ ID NO: 4613801 - DNA, 12 bp, Homo sapiens
tgtcaaagaagg

SEQ ID NO: 4613802 - DNA, 14 bp, Homo sapiens
tgtcaaagatgccc

SEQ ID NO: 4613803 - DNA, 18 bp, Homo sapiens
tgtcaagctggtgctact

SEQ ID NO: 4613804 - DNA, 16 bp, Homo sapiens
tgtcacccaggctgga

SEQ ID NO: 4613805 - DNA, 17 bp, Homo sapiens
tgtcaccctgcaggact

SEQ ID NO: 4613806 - DNA, 13 bp, Homo sapiens
tgtcaccttcacc

SEQ ID NO: 4613807 - DNA, 14 bp, Homo sapiens
tgtcaccttcacct

SEQ ID NO: 4613808 - DNA, 17 bp, Homo sapiens
tgtcacttgctgctttt

SEQ ID NO: 4613809 - DNA, 14 bp, Homo sapiens
tgtcagacataaag

SEQ ID NO: 4613810 - DNA, 14 bp, Homo sapiens
tgtcagaggaacaa

SEQ ID NO: 4613811 - DNA, 17 bp, Homo sapiens
tgtcagtcacagccacc

SEQ ID NO: 4613812 - DNA, 18 bp, Homo sapiens
tgtcagtcacagccaccc

SEQ ID NO: 4613813 - DNA, 22 bp, Homo sapiens
tgtcagtcacagccacccctga

SEQ ID NO: 4613814 - DNA, 15 bp, Homo sapiens
tgtcagtgtagacac

SEQ ID NO: 4613815 - DNA, 18 bp, Homo sapiens
tgtcagtgtagacacagg

SEQ ID NO: 4613816 - DNA, 20 bp, Homo sapiens
tgtcagtgttaaagattttg

SEQ ID NO: 4613817 - DNA, 21 bp, Homo sapiens
tgtcagttccaaacagacaaa

SEQ ID NO: 4613818 - DNA, 20 bp, Homo sapiens
tgtcatagttatgtgatttt

SEQ ID NO: 4613819 - DNA, 23 bp, Homo sapiens
tgtcatatcagcacatattttct

SEQ ID NO: 4613820 - DNA, 20 bp, Homo sapiens
tgtcatggccttgaaacagt

SEQ ID NO: 4613821 - DNA, 18 bp, Homo sapiens
tgtcatgtctgcttgtca

SEQ ID NO: 4613822 - DNA, 15 bp, Homo sapiens
tgtcattcagaaaaa

SEQ ID NO: 4613823 - DNA, 13 bp, Homo sapiens
tgtcattgtattc

SEQ ID NO: 4613824 - DNA, 16 bp, Homo sapiens
tgtcatttcattccat

SEQ ID NO: 4613825 - DNA, 19 bp, Homo sapiens
tgttctctgaattttcaga

SEQ ID NO: 4613826 - DNA, 22 bp, Homo sapiens
tgttctctgcttgacagactca

SEQ ID NO: 4613827 - DNA, 14 bp, Homo sapiens
tgttctgtcttccc

SEQ ID NO: 4613828 - DNA, 22 bp, Homo sapiens
tgttctgttctcatagaggaaa

SEQ ID NO: 4613829 - DNA, 15 bp, Homo sapiens
tgttctttcctcaca

SEQ ID NO: 4613830 - DNA, 20 bp, Homo sapiens
tgttctttggaaatacacag

SEQ ID NO: 4613831 - DNA, 19 bp, Homo sapiens
tgttgaaccctccccacca

SEQ ID NO: 4613832 - DNA, 22 bp, Homo sapiens
tgttgagaagcgtttttaacct

SEQ ID NO: 4613833 - DNA, 14 bp, Homo sapiens
tgttgataatatat

SEQ ID NO: 4613834 - DNA, 17 bp, Homo sapiens
tgttgatcatgtacttt

SEQ ID NO: 4613835 - DNA, 19 bp, Homo sapiens
tgttgatcatgtacttttt

SEQ ID NO: 4613836 - DNA, 23 bp, Homo sapiens
tgttgatcatgtactttttagta

SEQ ID NO: 4613837 - DNA, 15 bp, Homo sapiens
tgttgcctcctctct

SEQ ID NO: 4613838 - DNA, 23 bp, Homo sapiens
tgttgcctcctctctccctgcct

SEQ ID NO: 4613839 - DNA, 16 bp, Homo sapiens
tgttgcctttgctctt

SEQ ID NO: 4613840 - DNA, 22 bp, Homo sapiens
tgttgcctttttcattttccaa

SEQ ID NO: 4613841 - DNA, 20 bp, Homo sapiens
tgttggatttttgtcttgtg

SEQ ID NO: 4613842 - DNA, 21 bp, Homo sapiens
tgttggcaaacgagactttct

SEQ ID NO: 4613843 - DNA, 23 bp, Homo sapiens
tgttggcaaacgagactttctcc

SEQ ID NO: 4613844 - DNA, 16 bp, Homo sapiens
tgttggggggtgggag

SEQ ID NO: 4613845 - DNA, 17 bp, Homo sapiens
tgttgtaaaacaaaatt

SEQ ID NO: 4613846 - DNA, 12 bp, Homo sapiens
tgttgtcaagga

SEQ ID NO: 4613847 - DNA, 13 bp, Homo sapiens
tgttgtcaccttc

SEQ ID NO: 4613848 - DNA, 14 bp, Homo sapiens
tgttgtcttagcat

SEQ ID NO: 4613849 - DNA, 12 bp, Homo sapiens
tgttgttgttgt

SEQ ID NO: 4613850 - DNA, 11 bp, Homo sapiens
tgttgtttgat

SEQ ID NO: 4613851 - DNA, 14 bp, Homo sapiens
tgtttaaaataaaa

SEQ ID NO: 4613852 - DNA, 15 bp, Homo sapiens
tgtttaaaataaaat

SEQ ID NO: 4613853 - DNA, 21 bp, Homo sapiens
tgtttaaaataaaatgaaaat

SEQ ID NO: 4613854 - DNA, 22 bp, Homo sapiens
tgtttaaaataaaatgaaaatt

SEQ ID NO: 4613855 - DNA, 22 bp, Homo sapiens
tgtttaaagtgtacttataaac

SEQ ID NO: 4613856 - DNA, 15 bp, Homo sapiens
tgtttaataaagctt

SEQ ID NO: 4613857 - DNA, 19 bp, Homo sapiens
tgtttaataaagctttata

SEQ ID NO: 4613858 - DNA, 15 bp, Homo sapiens
tgtttaatgtgaact

SEQ ID NO: 4613859 - DNA, 12 bp, Homo sapiens
tgtttacatgag

SEQ ID NO: 4613860 - DNA, 17 bp, Homo sapiens
tgtttacatttgatgca

SEQ ID NO: 4613861 - DNA, 17 bp, Homo sapiens
tgtttactttaaacttg

SEQ ID NO: 4613862 - DNA, 18 bp, Homo sapiens
tgtttactttaaacttgt

SEQ ID NO: 4613863 - DNA, 14 bp, Homo sapiens
tgtttagttttaca

SEQ ID NO: 4613864 - DNA, 19 bp, Homo sapiens
tgtttataaatcttatgct

SEQ ID NO: 4613865 - DNA, 13 bp, Homo sapiens
tgtttcaaatgga

SEQ ID NO: 4613866 - DNA, 16 bp, Homo sapiens
tgtttcaaatggactg

SEQ ID NO: 4613867 - DNA, 16 bp, Homo sapiens
tgtttcaaatgtgcat

SEQ ID NO: 4613868 - DNA, 16 bp, Homo sapiens
tgtttcatagttttct

SEQ ID NO: 4613869 - DNA, 15 bp, Homo sapiens
tgtttcatctcagct

SEQ ID NO: 4613870 - DNA, 16 bp, Homo sapiens
tgtttcatctcagctt

SEQ ID NO: 4613871 - DNA, 11 bp, Homo sapiens
tgtttcatttg

SEQ ID NO: 4613872 - DNA, 14 bp, Homo sapiens
tgtttccagggtct

SEQ ID NO: 4613873 - DNA, 14 bp, Homo sapiens
tgtttcccaagcta

SEQ ID NO: 4613874 - DNA, 13 bp, Homo sapiens
tgtttcccccact

SEQ ID NO: 4613875 - DNA, 15 bp, Homo sapiens
tgtttccctctcctt

SEQ ID NO: 4613876 - DNA, 12 bp, Homo sapiens
tgtttccctgct

SEQ ID NO: 4613877 - DNA, 13 bp, Homo sapiens
tgtttcctggcct

SEQ ID NO: 4613878 - DNA, 20 bp, Homo sapiens
tgtttcctggcctcagagct

SEQ ID NO: 4613879 - DNA, 13 bp, Homo sapiens
tgtttctgaatgt

SEQ ID NO: 4613880 - DNA, 13 bp, Homo sapiens
tgtttctgtcaag

SEQ ID NO: 4613881 - DNA, 16 bp, Homo sapiens
tgtttgaaatgtttaa

SEQ ID NO: 4613882 - DNA, 17 bp, Homo sapiens
tgtttgcagcctgctct

SEQ ID NO: 4613883 - DNA, 16 bp, Homo sapiens
tgtttgcttgaatgct

SEQ ID NO: 4613884 - DNA, 20 bp, Homo sapiens
tgtttggaatgttagaatga

SEQ ID NO: 4613885 - DNA, 15 bp, Homo sapiens
tgtttggggcaggag

SEQ ID NO: 4613886 - DNA, 16 bp, Homo sapiens
tgtttgtagctttcct

SEQ ID NO: 4613887 - DNA, 22 bp, Homo sapiens
tgtttgtagctttcctggaagt

SEQ ID NO: 4613888 - DNA, 17 bp, Homo sapiens
tgtttgtgggtatttct

SEQ ID NO: 4613889 - DNA, 23 bp, Homo sapiens
tgttttaaaatgtgaggcaataa

SEQ ID NO: 4613890 - DNA, 12 bp, Homo sapiens
tgttttaaagaa

SEQ ID NO: 4613891 - DNA, 11 bp, Homo sapiens
tgttttaacaa

SEQ ID NO: 4613892 - DNA, 14 bp, Homo sapiens
tgttttaacaaaaa

SEQ ID NO: 4613893 - DNA, 22 bp, Homo sapiens
tgttttaatttatactggcatg

SEQ ID NO: 4613894 - DNA, 19 bp, Homo sapiens
tgttttacgtctgggagaa

SEQ ID NO: 4613895 - DNA, 20 bp, Homo sapiens
tgttttagtcattaatgtgt

SEQ ID NO: 4613896 - DNA, 21 bp, Homo sapiens
tgttttagtgtttatgtttaa

SEQ ID NO: 4613897 - DNA, 12 bp, Homo sapiens
tgttttatcctt

SEQ ID NO: 4613898 - DNA, 21 bp, Homo sapiens
tgttttatccttacaatgtga

SEQ ID NO: 4613899 - DNA, 15 bp, Homo sapiens
tgttttattactgtt

SEQ ID NO: 4613900 - DNA, 16 bp, Homo sapiens
tgttttattactgttt

SEQ ID NO: 4613901 - DNA, 18 bp, Homo sapiens
tgttttccattgtttgaa

SEQ ID NO: 4613902 - DNA, 14 bp, Homo sapiens
tgttttctttgagg

SEQ ID NO: 4613903 - DNA, 20 bp, Homo sapiens
tgttttgaaaagtttcctag

SEQ ID NO: 4613904 - DNA, 12 bp, Homo sapiens
tgttttgcactt

SEQ ID NO: 4613905 - DNA, 20 bp, Homo sapiens
tgttttggggatgagagggt

SEQ ID NO: 4613906 - DNA, 17 bp, Homo sapiens
tgttttgtttttttgag

SEQ ID NO: 4613907 - DNA, 13 bp, Homo sapiens
tgtttttaatgct

SEQ ID NO: 4613908 - DNA, 23 bp, Homo sapiens
tgtttttctatagaaaaagtaaa

SEQ ID NO: 4613909 - DNA, 13 bp, Homo sapiens
tgtttttttgaga

SEQ ID NO: 4613910 - DNA, 20 bp, Homo sapiens
tgtttttttttttgagatgg

SEQ ID NO: 4613911 - DNA, 16 bp, Homo sapiens
ttaaaaaaaaatcttg

SEQ ID NO: 4613912 - DNA, 12 bp, Homo sapiens
ttaaaaacttaa

SEQ ID NO: 4613913 - DNA, 12 bp, Homo sapiens
ttaaaaagaaat

SEQ ID NO: 4613914 - DNA, 12 bp, Homo sapiens
ttaaaaaggaac

SEQ ID NO: 4613915 - DNA, 17 bp, Homo sapiens
ttaaaaatacttctatg

SEQ ID NO: 4613916 - DNA, 13 bp, Homo sapiens
ttaaaaatgttct

SEQ ID NO: 4613917 - DNA, 17 bp, Homo sapiens
ttaaaaattacctttaa

SEQ ID NO: 4613918 - DNA, 16 bp, Homo sapiens
ttaaaacacagaaact

SEQ ID NO: 4613919 - DNA, 17 bp, Homo sapiens
ttaaaacatatttcatt

SEQ ID NO: 4613920 - DNA, 22 bp, Homo sapiens
ttaaaacatatttcattttaac

SEQ ID NO: 4613921 - DNA, 19 bp, Homo sapiens
ttaaaagaaggaccctttt

SEQ ID NO: 4613922 - DNA, 21 bp, Homo sapiens
ttaaaagaggagaaaatttat

SEQ ID NO: 4613923 - DNA, 14 bp, Homo sapiens
ttaaaataaatatt

SEQ ID NO: 4613924 - DNA, 13 bp, Homo sapiens
ttaaaatacattt

SEQ ID NO: 4613925 - DNA, 16 bp, Homo sapiens
ttaaaatcatgatcct

SEQ ID NO: 4613926 - DNA, 12 bp, Homo sapiens
ttaaaatgacaa

SEQ ID NO: 4613927 - DNA, 13 bp, Homo sapiens
ttaaaatgacaaa

SEQ ID NO: 4613928 - DNA, 15 bp, Homo sapiens
ttaaaatgacaaaca

SEQ ID NO: 4613929 - DNA, 20 bp, Homo sapiens
ttaaaatgtgaggcaataag

SEQ ID NO: 4613930 - DNA, 17 bp, Homo sapiens
ttaaaatgtttggatgg

SEQ ID NO: 4613931 - DNA, 19 bp, Homo sapiens
ttaaacataagctaaatca

SEQ ID NO: 4613932 - DNA, 20 bp, Homo sapiens
ttaaactaaggccctcttga

SEQ ID NO: 4613933 - DNA, 20 bp, Homo sapiens
ttaaagaatatgacttttta

SEQ ID NO: 4613934 - DNA, 16 bp, Homo sapiens
ttaaaggcttctctct

SEQ ID NO: 4613935 - DNA, 14 bp, Homo sapiens
ttaaagtggactta

SEQ ID NO: 4613936 - DNA, 15 bp, Homo sapiens
ttaaagtttaaatac

SEQ ID NO: 4613937 - DNA, 20 bp, Homo sapiens
tgtccacagagtttttcagg

SEQ ID NO: 4613938 - DNA, 17 bp, Homo sapiens
tgtccagctgagcgcca

SEQ ID NO: 4613939 - DNA, 16 bp, Homo sapiens
tgtcccactatctggg

SEQ ID NO: 4613940 - DNA, 21 bp, Homo sapiens
tgtcccagggccctcccagcc

SEQ ID NO: 4613941 - DNA, 22 bp, Homo sapiens
tgtccccaaatccgaacctcct

SEQ ID NO: 4613942 - DNA, 17 bp, Homo sapiens
tgtccccaccctccact

SEQ ID NO: 4613943 - DNA, 18 bp, Homo sapiens
tgtccccaccctccactc

SEQ ID NO: 4613944 - DNA, 22 bp, Homo sapiens
tgtccccaccctccactcagct

SEQ ID NO: 4613945 - DNA, 20 bp, Homo sapiens
tgtccccctaatattaggga

SEQ ID NO: 4613946 - DNA, 12 bp, Homo sapiens
tgtccctgcagg

SEQ ID NO: 4613947 - DNA, 15 bp, Homo sapiens
tgtccctgggccagg

SEQ ID NO: 4613948 - DNA, 14 bp, Homo sapiens
tgtcccttccagga

SEQ ID NO: 4613949 - DNA, 14 bp, Homo sapiens
tgtcctagccaggt

SEQ ID NO: 4613950 - DNA, 15 bp, Homo sapiens
tgtcctagccaggtc

SEQ ID NO: 4613951 - DNA, 23 bp, Homo sapiens
tgtcctagccaggtctcctggga

SEQ ID NO: 4613952 - DNA, 23 bp, Homo sapiens
tgtcctccaacaccaagcacagc

SEQ ID NO: 4613953 - DNA, 15 bp, Homo sapiens
tgtcctgatttctac

SEQ ID NO: 4613954 - DNA, 20 bp, Homo sapiens
tgtcctgatttctacaactg

SEQ ID NO: 4613955 - DNA, 18 bp, Homo sapiens
tgtcctgcagcaaacact

SEQ ID NO: 4613956 - DNA, 14 bp, Homo sapiens
tgtcctgtcctgct

SEQ ID NO: 4613957 - DNA, 15 bp, Homo sapiens
tgtcctttgaggccc

SEQ ID NO: 4613958 - DNA, 20 bp, Homo sapiens
tgtcctttgaggccccaact

SEQ ID NO: 4613959 - DNA, 19 bp, Homo sapiens
tgtcgaattcctactgaca

SEQ ID NO: 4613960 - DNA, 12 bp, Homo sapiens
tgtcgctgcttc

SEQ ID NO: 4613961 - DNA, 15 bp, Homo sapiens
tgtcgctgcttcgtg

SEQ ID NO: 4613962 - DNA, 15 bp, Homo sapiens
tgtcgtttttattcc

SEQ ID NO: 4613963 - DNA, 17 bp, Homo sapiens
tgtctagtcattgtcat

SEQ ID NO: 4613964 - DNA, 17 bp, Homo sapiens
tgtctatagttgtcagt

SEQ ID NO: 4613965 - DNA, 15 bp, Homo sapiens
tgtctatcatatgaa

SEQ ID NO: 4613966 - DNA, 18 bp, Homo sapiens
tgtctatgatgttgctgt

SEQ ID NO: 4613967 - DNA, 23 bp, Homo sapiens
tgtctatgatgttgctgttcaca

SEQ ID NO: 4613968 - DNA, 23 bp, Homo sapiens
tgtctcagtgattcgcttttggt

SEQ ID NO: 4613969 - DNA, 21 bp, Homo sapiens
tgtctcccgtgcatgctctgc

SEQ ID NO: 4613970 - DNA, 18 bp, Homo sapiens
tgtctcctatatatttct

SEQ ID NO: 4613971 - DNA, 22 bp, Homo sapiens
tgtctcctatatatttctatta

SEQ ID NO: 4613972 - DNA, 15 bp, Homo sapiens
tgtctcgagcgccct

SEQ ID NO: 4613973 - DNA, 20 bp, Homo sapiens
tgtctcgtggtaggactgta

SEQ ID NO: 4613974 - DNA, 14 bp, Homo sapiens
tgtctctggctact

SEQ ID NO: 4613975 - DNA, 22 bp, Homo sapiens
tgtctctggctactccctggac

SEQ ID NO: 4613976 - DNA, 14 bp, Homo sapiens
tgtctcttccatgc

SEQ ID NO: 4613977 - DNA, 17 bp, Homo sapiens
tgtctgaagcccaaagc

SEQ ID NO: 4613978 - DNA, 16 bp, Homo sapiens
tgtctgaatcatgtct

SEQ ID NO: 4613979 - DNA, 17 bp, Homo sapiens
tgtctgaatcatgtctg

SEQ ID NO: 4613980 - DNA, 18 bp, Homo sapiens
tgtctgaatcatgtctgt

SEQ ID NO: 4613981 - DNA, 15 bp, Homo sapiens
tgtctgcacagggtc

SEQ ID NO: 4613982 - DNA, 21 bp, Homo sapiens
tgtctgcctcctgctttggga

SEQ ID NO: 4613983 - DNA, 23 bp, Homo sapiens
tgtctggaaacctgtcattgtat

SEQ ID NO: 4613984 - DNA, 15 bp, Homo sapiens
tgtctgtacacgtgt

SEQ ID NO: 4613985 - DNA, 16 bp, Homo sapiens
tgtctgtatccccagt

SEQ ID NO: 4613986 - DNA, 14 bp, Homo sapiens
tgtctgtgaacaga

SEQ ID NO: 4613987 - DNA, 22 bp, Homo sapiens
tgtctgtggttgcagtctttcc

SEQ ID NO: 4613988 - DNA, 11 bp, Homo sapiens
tgtctgttaca

SEQ ID NO: 4613989 - DNA, 22 bp, Homo sapiens
tgtcttaaagggaatcattttt

SEQ ID NO: 4613990 - DNA, 19 bp, Homo sapiens
tgtcttaatttttgaaaaa

SEQ ID NO: 4613991 - DNA, 17 bp, Homo sapiens
tgtcttactactttaaa

SEQ ID NO: 4613992 - DNA, 16 bp, Homo sapiens
tgtcttatgtgaaaaa

SEQ ID NO: 4613993 - DNA, 21 bp, Homo sapiens
tgtcttatgtgaaaaattaac

SEQ ID NO: 4613994 - DNA, 15 bp, Homo sapiens
tgtcttattgaaaaa

SEQ ID NO: 4613995 - DNA, 13 bp, Homo sapiens
tgtcttcacctga

SEQ ID NO: 4613996 - DNA, 22 bp, Homo sapiens
tgtcttgtacatgtgtagcctg

SEQ ID NO: 4613997 - DNA, 21 bp, Homo sapiens
tgtcttgtgtttttgtcttat

SEQ ID NO: 4613998 - DNA, 18 bp, Homo sapiens
tgtcttgttcattttgag

SEQ ID NO: 4613999 - DNA, 18 bp, Homo sapiens
tgtctttgcggggcctgt

SEQ ID NO: 4614000 - DNA, 19 bp, Homo sapiens
tgtcttttatttaacaaaa

SEQ ID NO: 4614001 - DNA, 14 bp, Homo sapiens
tgtgaaaaattaac

SEQ ID NO: 4614002 - DNA, 15 bp, Homo sapiens
tgtgaaaaattaact

SEQ ID NO: 4614003 - DNA, 19 bp, Homo sapiens
tgtgaaacagttgctgtga

SEQ ID NO: 4614004 - DNA, 17 bp, Homo sapiens
tgtgaaatctgtctttg

SEQ ID NO: 4614005 - DNA, 17 bp, Homo sapiens
tgtgaacagctttgtat

SEQ ID NO: 4614006 - DNA, 14 bp, Homo sapiens
tgtgaacccaggac

SEQ ID NO: 4614007 - DNA, 21 bp, Homo sapiens
tgtgaacccaggacaagcatg

SEQ ID NO: 4614008 - DNA, 19 bp, Homo sapiens
tgtgaacctgggcactccg

SEQ ID NO: 4614009 - DNA, 12 bp, Homo sapiens
tgtgaactgtgt

SEQ ID NO: 4614010 - DNA, 13 bp, Homo sapiens
tgtgaactttcat

SEQ ID NO: 4614011 - DNA, 17 bp, Homo sapiens
tgtgaataatggcactg

SEQ ID NO: 4614012 - DNA, 19 bp, Homo sapiens
tgtgaatccatgggtctgg

SEQ ID NO: 4614013 - DNA, 21 bp, Homo sapiens
tgtgaatccatgggtctggct

SEQ ID NO: 4614014 - DNA, 22 bp, Homo sapiens
tgtgaatctgcttttcctctgc

SEQ ID NO: 4614015 - DNA, 21 bp, Homo sapiens
tgtgacacttatctcactgtt

SEQ ID NO: 4614016 - DNA, 19 bp, Homo sapiens
tgtgaccagtctgaccctt

SEQ ID NO: 4614017 - DNA, 21 bp, Homo sapiens
tgtgaccatcatttcccaggc

SEQ ID NO: 4614018 - DNA, 15 bp, Homo sapiens
tgtgacccccagctc

SEQ ID NO: 4614019 - DNA, 14 bp, Homo sapiens
tgtgacccctcctt

SEQ ID NO: 4614020 - DNA, 15 bp, Homo sapiens
tgtgacctgctgagc

SEQ ID NO: 4614021 - DNA, 16 bp, Homo sapiens
tgtgacctgctgagct

SEQ ID NO: 4614022 - DNA, 15 bp, Homo sapiens
tgtgacctggggcag

SEQ ID NO: 4614023 - DNA, 16 bp, Homo sapiens
tgtgacgactgcaaag

SEQ ID NO: 4614024 - DNA, 19 bp, Homo sapiens
tgtgacttcttacacataa

SEQ ID NO: 4614025 - DNA, 18 bp, Homo sapiens
tgtgagacagtgggaaat

SEQ ID NO: 4614026 - DNA, 19 bp, Homo sapiens
tgtgagacagtgggaaata

SEQ ID NO: 4614027 - DNA, 11 bp, Homo sapiens
tgtgagtgtga

SEQ ID NO: 4614028 - DNA, 13 bp, Homo sapiens
tgtgagtgtgaca

SEQ ID NO: 4614029 - DNA, 14 bp, Homo sapiens
tgtgagtgtgacag

SEQ ID NO: 4614030 - DNA, 15 bp, Homo sapiens
tgtgagtgtgacagg

SEQ ID NO: 4614031 - DNA, 16 bp, Homo sapiens
tgtgagtgtgacaggg

SEQ ID NO: 4614032 - DNA, 18 bp, Homo sapiens
tgtgataaaatgttgaac

SEQ ID NO: 4614033 - DNA, 13 bp, Homo sapiens
tgtgatcaggccc

SEQ ID NO: 4614034 - DNA, 14 bp, Homo sapiens
tgtgatggagggga

SEQ ID NO: 4614035 - DNA, 17 bp, Homo sapiens
tgtgatgggccacaagg

SEQ ID NO: 4614036 - DNA, 20 bp, Homo sapiens
tgtgatgttgtcttagcatg

SEQ ID NO: 4614037 - DNA, 19 bp, Homo sapiens
tgtgatttctttaaaagaa

SEQ ID NO: 4614038 - DNA, 22 bp, Homo sapiens
tgtgatttctttaaaagaatga

SEQ ID NO: 4614039 - DNA, 21 bp, Homo sapiens
tgtgcacatacgggctttaat

SEQ ID NO: 4614040 - DNA, 13 bp, Homo sapiens
tgtgcagagcaga

SEQ ID NO: 4614041 - DNA, 14 bp, Homo sapiens
tgtgcagagcagac

SEQ ID NO: 4614042 - DNA, 17 bp, Homo sapiens
tgtgcagagcagacagg

SEQ ID NO: 4614043 - DNA, 16 bp, Homo sapiens
tgtgcatggaggccct

SEQ ID NO: 4614044 - DNA, 20 bp, Homo sapiens
tgtgcatgtatgtcttggac

SEQ ID NO: 4614045 - DNA, 22 bp, Homo sapiens
tgtgccagaaagtcccccctcg

SEQ ID NO: 4614046 - DNA, 13 bp, Homo sapiens
tgtgccagagcct

SEQ ID NO: 4614047 - DNA, 21 bp, Homo sapiens
tgtgccagagcctggggctct

SEQ ID NO: 4614048 - DNA, 15 bp, Homo sapiens
tgtgccccaccacgt

SEQ ID NO: 4614049 - DNA, 14 bp, Homo sapiens
tgtgccctgtgtgt

SEQ ID NO: 4614050 - DNA, 16 bp, Homo sapiens
tgtgcgtcccagctga

SEQ ID NO: 4614051 - DNA, 23 bp, Homo sapiens
tgtgcgtcccagctgaaggcagt

SEQ ID NO: 4614052 - DNA, 20 bp, Homo sapiens
tgtgctacaggggccagaag

SEQ ID NO: 4614053 - DNA, 15 bp, Homo sapiens
tgtgctacgtgtgaa

SEQ ID NO: 4614054 - DNA, 20 bp, Homo sapiens
tgtgctagaaattttcaaga

SEQ ID NO: 4614055 - DNA, 14 bp, Homo sapiens
tgtgctagaagctc

SEQ ID NO: 4614056 - DNA, 22 bp, Homo sapiens
tgtgcttccttggttcatgctt

SEQ ID NO: 4614057 - DNA, 21 bp, Homo sapiens
tgtggaattttgagaaaaata

SEQ ID NO: 4614058 - DNA, 18 bp, Homo sapiens
tgtggacacctccctgtg

SEQ ID NO: 4614059 - DNA, 14 bp, Homo sapiens
tgtggacaggacta

SEQ ID NO: 4614060 - DNA, 18 bp, Homo sapiens
tgtggagatcacagcccc

SEQ ID NO: 4614061 - DNA, 15 bp, Homo sapiens
tgtggaggaagagcc

SEQ ID NO: 4614062 - DNA, 19 bp, Homo sapiens
tgtggaggaagagccacct

SEQ ID NO: 4614063 - DNA, 20 bp, Homo sapiens
tgtggaggaagagccacctg

SEQ ID NO: 4614064 - DNA, 15 bp, Homo sapiens
tgtggataagtggct

SEQ ID NO: 4614065 - DNA, 16 bp, Homo sapiens
tgtggcagctgtctca

SEQ ID NO: 4614066 - DNA, 13 bp, Homo sapiens
tgtggcagggcgt

SEQ ID NO: 4614067 - DNA, 13 bp, Homo sapiens
tgtggccccaccc

SEQ ID NO: 4614068 - DNA, 16 bp, Homo sapiens
tgtggcgtctccctcg

SEQ ID NO: 4614069 - DNA, 17 bp, Homo sapiens
tgtggctccaagctcag

SEQ ID NO: 4614070 - DNA, 23 bp, Homo sapiens
tgtggctccaagctcaggtgcct

SEQ ID NO: 4614071 - DNA, 17 bp, Homo sapiens
tgtggctccctctctcc

SEQ ID NO: 4614072 - DNA, 22 bp, Homo sapiens
tgtggctccctctctcctggac

SEQ ID NO: 4614073 - DNA, 14 bp, Homo sapiens
tgtgggagcctcgc

SEQ ID NO: 4614074 - DNA, 19 bp, Homo sapiens
tgtgggccaccgtgcctgg

SEQ ID NO: 4614075 - DNA, 22 bp, Homo sapiens
tgtgggccaccgtgcctggctg

SEQ ID NO: 4614076 - DNA, 13 bp, Homo sapiens
tgtggggaaaggg

SEQ ID NO: 4614077 - DNA, 16 bp, Homo sapiens
tgtggggtggacctgg

SEQ ID NO: 4614078 - DNA, 21 bp, Homo sapiens
tgtgggtatttcttggcatgc

SEQ ID NO: 4614079 - DNA, 19 bp, Homo sapiens
tgtggtacatggtgtttgt

SEQ ID NO: 4614080 - DNA, 11 bp, Homo sapiens
tgtggtctcag

SEQ ID NO: 4614081 - DNA, 13 bp, Homo sapiens
tgtggtctcagga

SEQ ID NO: 4614082 - DNA, 14 bp, Homo sapiens
tgtggtctcaggat

SEQ ID NO: 4614083 - DNA, 22 bp, Homo sapiens
tgtggtgacttctgctgctggc

SEQ ID NO: 4614084 - DNA, 17 bp, Homo sapiens
tgtggtgcattcctgaa

SEQ ID NO: 4614085 - DNA, 14 bp, Homo sapiens
tgtggtggcctcag

SEQ ID NO: 4614086 - DNA, 14 bp, Homo sapiens
tgtgtacaaagaaa

SEQ ID NO: 4614087 - DNA, 21 bp, Homo sapiens
tgtgtacaaatacatgtgtat

SEQ ID NO: 4614088 - DNA, 14 bp, Homo sapiens
tgtgtagcctgtgc

SEQ ID NO: 4614089 - DNA, 23 bp, Homo sapiens
tgtgtagcctgtgcatgtatgtc

SEQ ID NO: 4614090 - DNA, 19 bp, Homo sapiens
tgtgtagctgtgacctgct

SEQ ID NO: 4614091 - DNA, 13 bp, Homo sapiens
tgtgtagttccct

SEQ ID NO: 4614092 - DNA, 20 bp, Homo sapiens
tgtgtagttccctctgcctg

SEQ ID NO: 4614093 - DNA, 17 bp, Homo sapiens
tgtgtatttctctgtga

SEQ ID NO: 4614094 - DNA, 18 bp, Homo sapiens
tgtgtatttctctgtgaa

SEQ ID NO: 4614095 - DNA, 19 bp, Homo sapiens
tgtgtatttctctgtgaat

SEQ ID NO: 4614096 - DNA, 16 bp, Homo sapiens
tgtgtctgaatcatgt

SEQ ID NO: 4614097 - DNA, 12 bp, Homo sapiens
tgtgtctgagtg

SEQ ID NO: 4614098 - DNA, 14 bp, Homo sapiens
tgtgtctgtacacg

SEQ ID NO: 4614099 - DNA, 21 bp, Homo sapiens
tgtgtctgtacacgtgtcctg

SEQ ID NO: 4614100 - DNA, 13 bp, Homo sapiens
tgtgtctgtggtt

SEQ ID NO: 4614101 - DNA, 13 bp, Homo sapiens
tgtgtgaatgtgg

SEQ ID NO: 4614102 - DNA, 15 bp, Homo sapiens
tgtgtgcagagcaga

SEQ ID NO: 4614103 - DNA, 14 bp, Homo sapiens
tgtgtggacaggac

SEQ ID NO: 4614104 - DNA, 23 bp, Homo sapiens
tgtgtgggccaccgtgcctggct

SEQ ID NO: 4614105 - DNA, 16 bp, Homo sapiens
tgtgtggtgcattcct

SEQ ID NO: 4614106 - DNA, 14 bp, Homo sapiens
tgtgtgtatgtgta

SEQ ID NO: 4614107 - DNA, 14 bp, Homo sapiens
tgtgtgtgttctgt

SEQ ID NO: 4614108 - DNA, 12 bp, Homo sapiens
tgtgtgtttcaa

SEQ ID NO: 4614109 - DNA, 22 bp, Homo sapiens
tgtgttaacttgcctccatctt

SEQ ID NO: 4614110 - DNA, 21 bp, Homo sapiens
tgtgttatcggacattctaat

SEQ ID NO: 4614111 - DNA, 23 bp, Homo sapiens
tgtgttatcggacattctaatgc

SEQ ID NO: 4614112 - DNA, 20 bp, Homo sapiens
tgtgttcgttgcacagctgt

SEQ ID NO: 4614113 - DNA, 10 bp, Homo sapiens
tgtgttctaa

SEQ ID NO: 4614114 - DNA, 16 bp, Homo sapiens
tgtgttctaacttatt

SEQ ID NO: 4614115 - DNA, 16 bp, Homo sapiens
tgtgttgccctggcat

SEQ ID NO: 4614116 - DNA, 19 bp, Homo sapiens
tgtgttgtcttttttatgt

SEQ ID NO: 4614117 - DNA, 23 bp, Homo sapiens
tgtgtttatatgtcttgcaaagc

SEQ ID NO: 4614118 - DNA, 22 bp, Homo sapiens
tgtgtttcaaaaccatgcctgg

SEQ ID NO: 4614119 - DNA, 15 bp, Homo sapiens
tgtgtttcaaatgga

SEQ ID NO: 4614120 - DNA, 17 bp, Homo sapiens
tgtgtttcaaggtcaga

SEQ ID NO: 4614121 - DNA, 18 bp, Homo sapiens
tgtgtttgatttgtctca

SEQ ID NO: 4614122 - DNA, 18 bp, Homo sapiens
tgttaaaaagaaatccag

SEQ ID NO: 4614123 - DNA, 16 bp, Homo sapiens
tgttaaccaaggaaat

SEQ ID NO: 4614124 - DNA, 17 bp, Homo sapiens
tgttaacttgcctccat

SEQ ID NO: 4614125 - DNA, 21 bp, Homo sapiens
tgttaacttgcctccatcttt

SEQ ID NO: 4614126 - DNA, 20 bp, Homo sapiens
tgttaaggacccttttaagc

SEQ ID NO: 4614127 - DNA, 19 bp, Homo sapiens
tgttaataaaagtacatgt

SEQ ID NO: 4614128 - DNA, 18 bp, Homo sapiens
tgttaccatgtatgtata

SEQ ID NO: 4614129 - DNA, 15 bp, Homo sapiens
tgttaccttcacatg

SEQ ID NO: 4614130 - DNA, 17 bp, Homo sapiens
tgttactgctttgcaaa

SEQ ID NO: 4614131 - DNA, 14 bp, Homo sapiens
tgttacttctctga

SEQ ID NO: 4614132 - DNA, 20 bp, Homo sapiens
tgttagaaaatgacttattt

SEQ ID NO: 4614133 - DNA, 18 bp, Homo sapiens
tgttagaaagtgcttaga

SEQ ID NO: 4614134 - DNA, 18 bp, Homo sapiens
tgttagagacttttttct

SEQ ID NO: 4614135 - DNA, 20 bp, Homo sapiens
tgttagctttccaaggaagc

SEQ ID NO: 4614136 - DNA, 22 bp, Homo sapiens
tgttagctttccaaggaagcag

SEQ ID NO: 4614137 - DNA, 21 bp, Homo sapiens
tgttaggattttcacattctt

SEQ ID NO: 4614138 - DNA, 17 bp, Homo sapiens
tgttataccccatatat

SEQ ID NO: 4614139 - DNA, 18 bp, Homo sapiens
tgttatcccaatcattgt

SEQ ID NO: 4614140 - DNA, 20 bp, Homo sapiens
tgttatcggacattctaatg

SEQ ID NO: 4614141 - DNA, 14 bp, Homo sapiens
tgttatgacagtga

SEQ ID NO: 4614142 - DNA, 22 bp, Homo sapiens
tgttatgtaaaaggccaaacct

SEQ ID NO: 4614143 - DNA, 16 bp, Homo sapiens
tgttcacagcttttct

SEQ ID NO: 4614144 - DNA, 12 bp, Homo sapiens
tgttcatacagt

SEQ ID NO: 4614145 - DNA, 19 bp, Homo sapiens
tgttcatttagataatttg

SEQ ID NO: 4614146 - DNA, 21 bp, Homo sapiens
tgttcatttagataatttgaa

SEQ ID NO: 4614147 - DNA, 17 bp, Homo sapiens
tgttcatttcacacagt

SEQ ID NO: 4614148 - DNA, 19 bp, Homo sapiens
tgttcatttcacacagtga

SEQ ID NO: 4614149 - DNA, 17 bp, Homo sapiens
tgttccagattcctatg

SEQ ID NO: 4614150 - DNA, 18 bp, Homo sapiens
tgttccagctgaggcagg

SEQ ID NO: 4614151 - DNA, 23 bp, Homo sapiens
tgttccagctgaggcagggggat

SEQ ID NO: 4614152 - DNA, 20 bp, Homo sapiens
tgttccctatggagaggctt

SEQ ID NO: 4614153 - DNA, 14 bp, Homo sapiens
tgttcccttcctct

SEQ ID NO: 4614154 - DNA, 21 bp, Homo sapiens
tgttcccttcctcttcctgcc

SEQ ID NO: 4614155 - DNA, 17 bp, Homo sapiens
tgttcgttgcacagctg

SEQ ID NO: 4614156 - DNA, 17 bp, Homo sapiens
tgttctacccgttccaa

SEQ ID NO: 4614157 - DNA, 18 bp, Homo sapiens
tgttctacccgttccaaa

SEQ ID NO: 4614158 - DNA, 21 bp, Homo sapiens
tgttctccataggagggaagg

SEQ ID NO: 4614159 - DNA, 23 bp, Homo sapiens
ttactgcctataatcttatacaa

SEQ ID NO: 4614160 - DNA, 15 bp, Homo sapiens
ttactgctttgcaaa

SEQ ID NO: 4614161 - DNA, 13 bp, Homo sapiens
ttactgtatactg

SEQ ID NO: 4614162 - DNA, 18 bp, Homo sapiens
ttactgtgaggagtctgg

SEQ ID NO: 4614163 - DNA, 19 bp, Homo sapiens
ttacttgaggatcatatga

SEQ ID NO: 4614164 - DNA, 13 bp, Homo sapiens
ttacttgcttctc

SEQ ID NO: 4614165 - DNA, 15 bp, Homo sapiens
ttacttgctttcaat

SEQ ID NO: 4614166 - DNA, 18 bp, Homo sapiens
ttactttaatttccttga

SEQ ID NO: 4614167 - DNA, 14 bp, Homo sapiens
ttacttttattatt

SEQ ID NO: 4614168 - DNA, 19 bp, Homo sapiens
ttactttttcttgtattca

SEQ ID NO: 4614169 - DNA, 17 bp, Homo sapiens
ttacttttttacactga

SEQ ID NO: 4614170 - DNA, 10 bp, Homo sapiens
ttagaaactg

SEQ ID NO: 4614171 - DNA, 21 bp, Homo sapiens
ttagaaagggaaggaaatccc

SEQ ID NO: 4614172 - DNA, 12 bp, Homo sapiens
ttagaagcagag

SEQ ID NO: 4614173 - DNA, 18 bp, Homo sapiens
ttagagggtgaaggagaa

SEQ ID NO: 4614174 - DNA, 23 bp, Homo sapiens
ttagataatcaagggcactgtga

SEQ ID NO: 4614175 - DNA, 15 bp, Homo sapiens
ttagataatttgaaa

SEQ ID NO: 4614176 - DNA, 18 bp, Homo sapiens
ttagatacacttcttaaa

SEQ ID NO: 4614177 - DNA, 15 bp, Homo sapiens
ttagatgattatata

SEQ ID NO: 4614178 - DNA, 12 bp, Homo sapiens
ttagcagacagg

SEQ ID NO: 4614179 - DNA, 11 bp, Homo sapiens
ttagcatggta

SEQ ID NO: 4614180 - DNA, 21 bp, Homo sapiens
ttagccaactgtttccctgct

SEQ ID NO: 4614181 - DNA, 22 bp, Homo sapiens
ttagccaactgtttccctgctg

SEQ ID NO: 4614182 - DNA, 15 bp, Homo sapiens
ttagctctattgata

SEQ ID NO: 4614183 - DNA, 16 bp, Homo sapiens
ttagctgcacggcatt

SEQ ID NO: 4614184 - DNA, 13 bp, Homo sapiens
ttagcttccttaa

SEQ ID NO: 4614185 - DNA, 21 bp, Homo sapiens
ttagctttccaaggaagcaga

SEQ ID NO: 4614186 - DNA, 14 bp, Homo sapiens
ttagctttgaaact

SEQ ID NO: 4614187 - DNA, 20 bp, Homo sapiens
ttaggaatatacatagtctt

SEQ ID NO: 4614188 - DNA, 16 bp, Homo sapiens
ttaggattttcacatt

SEQ ID NO: 4614189 - DNA, 16 bp, Homo sapiens
ttaggtcttcctgtgg

SEQ ID NO: 4614190 - DNA, 19 bp, Homo sapiens
ttaggtttggtttggtttt

SEQ ID NO: 4614191 - DNA, 19 bp, Homo sapiens
ttagtaatggcagagcagt

SEQ ID NO: 4614192 - DNA, 19 bp, Homo sapiens
ttagtcgggcatgagtctg

SEQ ID NO: 4614193 - DNA, 13 bp, Homo sapiens
ttagtgaatggga

SEQ ID NO: 4614194 - DNA, 14 bp, Homo sapiens
ttagtgcatccagt

SEQ ID NO: 4614195 - DNA, 15 bp, Homo sapiens
ttagtgggccagggc

SEQ ID NO: 4614196 - DNA, 22 bp, Homo sapiens
ttagtgtgacagtttccaaatt

SEQ ID NO: 4614197 - DNA, 15 bp, Homo sapiens
ttagttcaatacagt

SEQ ID NO: 4614198 - DNA, 23 bp, Homo sapiens
ttagttttacattttaaaatgtt

SEQ ID NO: 4614199 - DNA, 18 bp, Homo sapiens
ttagtttttgtgaagttt

SEQ ID NO: 4614200 - DNA, 21 bp, Homo sapiens
ttataaaaataaagggaagaa

SEQ ID NO: 4614201 - DNA, 17 bp, Homo sapiens
ttataaaaatataaatt

SEQ ID NO: 4614202 - DNA, 18 bp, Homo sapiens
ttataaaaatataaattg

SEQ ID NO: 4614203 - DNA, 13 bp, Homo sapiens
ttataaaatggct

SEQ ID NO: 4614204 - DNA, 19 bp, Homo sapiens
ttataaacagataatgctt

SEQ ID NO: 4614205 - DNA, 20 bp, Homo sapiens
ttataaactatttttttctt

SEQ ID NO: 4614206 - DNA, 13 bp, Homo sapiens
ttataaggaaact

SEQ ID NO: 4614207 - DNA, 13 bp, Homo sapiens
ttataatactgtt

SEQ ID NO: 4614208 - DNA, 14 bp, Homo sapiens
ttataatactgttt

SEQ ID NO: 4614209 - DNA, 19 bp, Homo sapiens
ttataatttataaatacag

SEQ ID NO: 4614210 - DNA, 21 bp, Homo sapiens
ttatacaacagcaaaccctga

SEQ ID NO: 4614211 - DNA, 23 bp, Homo sapiens
ttatacaataacccagttacttt

SEQ ID NO: 4614212 - DNA, 13 bp, Homo sapiens
ttatacagaccta

SEQ ID NO: 4614213 - DNA, 15 bp, Homo sapiens
ttatacagacctaat

SEQ ID NO: 4614214 - DNA, 21 bp, Homo sapiens
ttatacagacctaatatcatt

SEQ ID NO: 4614215 - DNA, 16 bp, Homo sapiens
ttatacctgctatcag

SEQ ID NO: 4614216 - DNA, 14 bp, Homo sapiens
ttatagaaaaggaa

SEQ ID NO: 4614217 - DNA, 15 bp, Homo sapiens
ttatagaaaaggaac

SEQ ID NO: 4614218 - DNA, 18 bp, Homo sapiens
ttatagcaacaacaattg

SEQ ID NO: 4614219 - DNA, 18 bp, Homo sapiens
ttatagcaagatattgat

SEQ ID NO: 4614220 - DNA, 20 bp, Homo sapiens
ttataggctagacttagatt

SEQ ID NO: 4614221 - DNA, 12 bp, Homo sapiens
ttatatggcagg

SEQ ID NO: 4614222 - DNA, 18 bp, Homo sapiens
ttatatgttgtaatattt

SEQ ID NO: 4614223 - DNA, 20 bp, Homo sapiens
ttatattaaagtaaatggca

SEQ ID NO: 4614224 - DNA, 24 bp, Homo sapiens
ttatattaaagtaaatggcatgga

SEQ ID NO: 4614225 - DNA, 21 bp, Homo sapiens
ttatattatccataggtttct

SEQ ID NO: 4614226 - DNA, 13 bp, Homo sapiens
ttatatttattgt

SEQ ID NO: 4614227 - DNA, 17 bp, Homo sapiens
ttatatttattgttaga

SEQ ID NO: 4614228 - DNA, 19 bp, Homo sapiens
ttatcagggaacttagtaa

SEQ ID NO: 4614229 - DNA, 12 bp, Homo sapiens
ttatcctagcct

SEQ ID NO: 4614230 - DNA, 23 bp, Homo sapiens
ttatcgaacgtggtctgattttg

SEQ ID NO: 4614231 - DNA, 14 bp, Homo sapiens
ttatctcactgttt

SEQ ID NO: 4614232 - DNA, 19 bp, Homo sapiens
ttatcttgaaaaagtattg

SEQ ID NO: 4614233 - DNA, 20 bp, Homo sapiens
ttatcttgttattattgtta

SEQ ID NO: 4614234 - DNA, 12 bp, Homo sapiens
ttatgaaaactc

SEQ ID NO: 4614235 - DNA, 20 bp, Homo sapiens
ttatgaagaaagatactaat

SEQ ID NO: 4614236 - DNA, 19 bp, Homo sapiens
ttatgaattataaatgtgt

SEQ ID NO: 4614237 - DNA, 21 bp, Homo sapiens
ttatgacagaggttttgaaat

SEQ ID NO: 4614238 - DNA, 15 bp, Homo sapiens
ttatgagatctaatg

SEQ ID NO: 4614239 - DNA, 18 bp, Homo sapiens
ttatgagatctaatgtga

SEQ ID NO: 4614240 - DNA, 19 bp, Homo sapiens
ttatgagggtcctctactt

SEQ ID NO: 4614241 - DNA, 20 bp, Homo sapiens
ttatgcacttttagaaatgc

SEQ ID NO: 4614242 - DNA, 14 bp, Homo sapiens
ttatgccagctcca

SEQ ID NO: 4614243 - DNA, 13 bp, Homo sapiens
ttatggaaaactg

SEQ ID NO: 4614244 - DNA, 22 bp, Homo sapiens
ttatggttatgttcatctaaac

SEQ ID NO: 4614245 - DNA, 14 bp, Homo sapiens
ttatgtacagaaaa

SEQ ID NO: 4614246 - DNA, 12 bp, Homo sapiens
ttatgtgaaaaa

SEQ ID NO: 4614247 - DNA, 16 bp, Homo sapiens
ttatgtgaaaaattaa

SEQ ID NO: 4614248 - DNA, 16 bp, Homo sapiens
ttattaaaaatgttct

SEQ ID NO: 4614249 - DNA, 14 bp, Homo sapiens
ttattaaacccctt

SEQ ID NO: 4614250 - DNA, 18 bp, Homo sapiens
ttattaaacgtatgcatg

SEQ ID NO: 4614251 - DNA, 22 bp, Homo sapiens
ttattaaacgtatgcatgtgaa

SEQ ID NO: 4614252 - DNA, 22 bp, Homo sapiens
ttattaatcatacaaactctca

SEQ ID NO: 4614253 - DNA, 17 bp, Homo sapiens
ttattacaaatgcaaat

SEQ ID NO: 4614254 - DNA, 15 bp, Homo sapiens
ttattacatgtaatt

SEQ ID NO: 4614255 - DNA, 21 bp, Homo sapiens
ttattacctcaggtgccaacc

SEQ ID NO: 4614256 - DNA, 14 bp, Homo sapiens
ttattactgtttct

SEQ ID NO: 4614257 - DNA, 12 bp, Homo sapiens
ttattattcaga

SEQ ID NO: 4614258 - DNA, 18 bp, Homo sapiens
ttattcacatatgtctta

SEQ ID NO: 4614259 - DNA, 15 bp, Homo sapiens
ttattccaggagaag

SEQ ID NO: 4614260 - DNA, 21 bp, Homo sapiens
ttattgaaaaaaaaaatgttg

SEQ ID NO: 4614261 - DNA, 22 bp, Homo sapiens
ttattgaaaaaaaaaatgttga

SEQ ID NO: 4614262 - DNA, 14 bp, Homo sapiens
ttattgcagaatgt

SEQ ID NO: 4614263 - DNA, 15 bp, Homo sapiens
ttattggaaatgtac

SEQ ID NO: 4614264 - DNA, 12 bp, Homo sapiens
ttattgggactt

SEQ ID NO: 4614265 - DNA, 19 bp, Homo sapiens
ttattgggatatcatttta

SEQ ID NO: 4614266 - DNA, 14 bp, Homo sapiens
ttattgtagacatg

SEQ ID NO: 4614267 - DNA, 12 bp, Homo sapiens
ttatttaaatta

SEQ ID NO: 4614268 - DNA, 18 bp, Homo sapiens
ttatttagcatggggatt

SEQ ID NO: 4614269 - DNA, 21 bp, Homo sapiens
ttatttattaaaaatgttctc

SEQ ID NO: 4614270 - DNA, 15 bp, Homo sapiens
ttatttccactaaaa

SEQ ID NO: 4614271 - DNA, 12 bp, Homo sapiens
ttaaatataaag

SEQ ID NO: 4614272 - DNA, 12 bp, Homo sapiens
ttaaatatcatt

SEQ ID NO: 4614273 - DNA, 23 bp, Homo sapiens
ttaaatatcattctttgtatctt

SEQ ID NO: 4614274 - DNA, 15 bp, Homo sapiens
ttaaatattgtaata

SEQ ID NO: 4614275 - DNA, 19 bp, Homo sapiens
ttaaatattgtaatatgac

SEQ ID NO: 4614276 - DNA, 22 bp, Homo sapiens
ttaaatattttctattttaaga

SEQ ID NO: 4614277 - DNA, 16 bp, Homo sapiens
ttaaatcctaccaaag

SEQ ID NO: 4614278 - DNA, 15 bp, Homo sapiens
ttaaatctagacatt

SEQ ID NO: 4614279 - DNA, 19 bp, Homo sapiens
ttaaatctagacattcttt

SEQ ID NO: 4614280 - DNA, 17 bp, Homo sapiens
ttaaattacaattttat

SEQ ID NO: 4614281 - DNA, 18 bp, Homo sapiens
ttaaattacaattttatc

SEQ ID NO: 4614282 - DNA, 12 bp, Homo sapiens
ttaaattttatt

SEQ ID NO: 4614283 - DNA, 14 bp, Homo sapiens
ttaacaaaaaatgt

SEQ ID NO: 4614284 - DNA, 20 bp, Homo sapiens
ttaacatacaagaaaatgta

SEQ ID NO: 4614285 - DNA, 21 bp, Homo sapiens
ttaacatacaagaaaatgtat

SEQ ID NO: 4614286 - DNA, 15 bp, Homo sapiens
ttaacatgatttcaa

SEQ ID NO: 4614287 - DNA, 16 bp, Homo sapiens
ttaacatgatttcaaa

SEQ ID NO: 4614288 - DNA, 17 bp, Homo sapiens
ttaacatttcattgtac

SEQ ID NO: 4614289 - DNA, 18 bp, Homo sapiens
ttaacatttcattgtaca

SEQ ID NO: 4614290 - DNA, 14 bp, Homo sapiens
ttaacattttgagc

SEQ ID NO: 4614291 - DNA, 17 bp, Homo sapiens
ttaacctgttttgttaa

SEQ ID NO: 4614292 - DNA, 14 bp, Homo sapiens
ttaacggtgctaaa

SEQ ID NO: 4614293 - DNA, 14 bp, Homo sapiens
ttaactccctccac

SEQ ID NO: 4614294 - DNA, 16 bp, Homo sapiens
ttaactccctccacca

SEQ ID NO: 4614295 - DNA, 20 bp, Homo sapiens
ttaactccctccaccagcct

SEQ ID NO: 4614296 - DNA, 13 bp, Homo sapiens
ttaactctgtctt

SEQ ID NO: 4614297 - DNA, 22 bp, Homo sapiens
ttaactggtaagcgatttgaaa

SEQ ID NO: 4614298 - DNA, 16 bp, Homo sapiens
ttaactgtaaacttgg

SEQ ID NO: 4614299 - DNA, 13 bp, Homo sapiens
ttaagaaaacaag

SEQ ID NO: 4614300 - DNA, 12 bp, Homo sapiens
ttaagaactgct

SEQ ID NO: 4614301 - DNA, 11 bp, Homo sapiens
ttaagcagctt

SEQ ID NO: 4614302 - DNA, 22 bp, Homo sapiens
ttaagcattttgaaacaaagta

SEQ ID NO: 4614303 - DNA, 16 bp, Homo sapiens
ttaagccaaagaaaca

SEQ ID NO: 4614304 - DNA, 15 bp, Homo sapiens
ttaagctcccctgcc

SEQ ID NO: 4614305 - DNA, 13 bp, Homo sapiens
ttaagctctgccc

SEQ ID NO: 4614306 - DNA, 17 bp, Homo sapiens
ttaaggacccttttaag

SEQ ID NO: 4614307 - DNA, 22 bp, Homo sapiens
ttaaggagcaaaaatctgagaa

SEQ ID NO: 4614308 - DNA, 17 bp, Homo sapiens
ttaaggcacagtgggag

SEQ ID NO: 4614309 - DNA, 20 bp, Homo sapiens
ttaaggcacagtgggagctg

SEQ ID NO: 4614310 - DNA, 14 bp, Homo sapiens
ttaagtatcttttt

SEQ ID NO: 4614311 - DNA, 19 bp, Homo sapiens
ttaagtgaatacattaacg

SEQ ID NO: 4614312 - DNA, 16 bp, Homo sapiens
ttaataaaagtacatg

SEQ ID NO: 4614313 - DNA, 11 bp, Homo sapiens
ttaataaagct

SEQ ID NO: 4614314 - DNA, 13 bp, Homo sapiens
ttaataaattgct

SEQ ID NO: 4614315 - DNA, 15 bp, Homo sapiens
ttaataaattgctta

SEQ ID NO: 4614316 - DNA, 24 bp, Homo sapiens
ttaataatcagcaagaatttgatc

SEQ ID NO: 4614317 - DNA, 16 bp, Homo sapiens
ttaatacctttaaata

SEQ ID NO: 4614318 - DNA, 17 bp, Homo sapiens
ttaatacctttaaatat

SEQ ID NO: 4614319 - DNA, 17 bp, Homo sapiens
ttaatagggaatatatc

SEQ ID NO: 4614320 - DNA, 23 bp, Homo sapiens
ttaatatactcagggattccttc

SEQ ID NO: 4614321 - DNA, 16 bp, Homo sapiens
ttaatcaagagaaact

SEQ ID NO: 4614322 - DNA, 16 bp, Homo sapiens
ttaatcagttctgtgt

SEQ ID NO: 4614323 - DNA, 16 bp, Homo sapiens
ttaatcattatttgag

SEQ ID NO: 4614324 - DNA, 13 bp, Homo sapiens
ttaatcattttca

SEQ ID NO: 4614325 - DNA, 18 bp, Homo sapiens
ttaatccagtctatcatt

SEQ ID NO: 4614326 - DNA, 19 bp, Homo sapiens
ttaatcttctctcttgatt

SEQ ID NO: 4614327 - DNA, 12 bp, Homo sapiens
ttaatcttgatc

SEQ ID NO: 4614328 - DNA, 14 bp, Homo sapiens
ttaatcttgctttc

SEQ ID NO: 4614329 - DNA, 12 bp, Homo sapiens
ttaatctttaaa

SEQ ID NO: 4614330 - DNA, 23 bp, Homo sapiens
ttaatgaatcacatttttttatg

SEQ ID NO: 4614331 - DNA, 18 bp, Homo sapiens
ttaatgataaaatagcca

SEQ ID NO: 4614332 - DNA, 12 bp, Homo sapiens
ttaatgcctgcc

SEQ ID NO: 4614333 - DNA, 23 bp, Homo sapiens
ttaatgcctgcccattagagaag

SEQ ID NO: 4614334 - DNA, 16 bp, Homo sapiens
ttaatgctatttgaac

SEQ ID NO: 4614335 - DNA, 21 bp, Homo sapiens
ttaatgctatttgaacaagtg

SEQ ID NO: 4614336 - DNA, 16 bp, Homo sapiens
ttaatgctgtttctaa

SEQ ID NO: 4614337 - DNA, 21 bp, Homo sapiens
ttaatggcatttctctttaaa

SEQ ID NO: 4614338 - DNA, 20 bp, Homo sapiens
ttaatggtatcctactgagc

SEQ ID NO: 4614339 - DNA, 23 bp, Homo sapiens
ttaatggtatcctactgagcatt

SEQ ID NO: 4614340 - DNA, 20 bp, Homo sapiens
ttaatgtatcttaaaggaca

SEQ ID NO: 4614341 - DNA, 17 bp, Homo sapiens
ttaatgtgaactctccc

SEQ ID NO: 4614342 - DNA, 19 bp, Homo sapiens
ttaatgtgaactctcccct

SEQ ID NO: 4614343 - DNA, 23 bp, Homo sapiens
ttaatgtgaactctcccctcccc

SEQ ID NO: 4614344 - DNA, 13 bp, Homo sapiens
ttaatgttttcat

SEQ ID NO: 4614345 - DNA, 22 bp, Homo sapiens
ttaatgttttcattatgttcat

SEQ ID NO: 4614346 - DNA, 16 bp, Homo sapiens
ttaattaaacattgtg

SEQ ID NO: 4614347 - DNA, 13 bp, Homo sapiens
ttaatttcaggaa

SEQ ID NO: 4614348 - DNA, 18 bp, Homo sapiens
ttaatttcaggaaaatgt

SEQ ID NO: 4614349 - DNA, 15 bp, Homo sapiens
ttaatttgaaatctg

SEQ ID NO: 4614350 - DNA, 21 bp, Homo sapiens
ttaatttgggaatttgttgtg

SEQ ID NO: 4614351 - DNA, 20 bp, Homo sapiens
ttaattttaatgctgtttct

SEQ ID NO: 4614352 - DNA, 16 bp, Homo sapiens
ttacaaaatttattct

SEQ ID NO: 4614353 - DNA, 14 bp, Homo sapiens
ttacaaagttatat

SEQ ID NO: 4614354 - DNA, 21 bp, Homo sapiens
ttacaaatgcaaatttctata

SEQ ID NO: 4614355 - DNA, 14 bp, Homo sapiens
ttacaactttctaa

SEQ ID NO: 4614356 - DNA, 15 bp, Homo sapiens
ttacacatttttcag

SEQ ID NO: 4614357 - DNA, 14 bp, Homo sapiens
ttacagactgaaag

SEQ ID NO: 4614358 - DNA, 16 bp, Homo sapiens
ttacagactgaaaggt

SEQ ID NO: 4614359 - DNA, 13 bp, Homo sapiens
ttacagcagcaat

SEQ ID NO: 4614360 - DNA, 22 bp, Homo sapiens
ttacagccaagtgccaaatgct

SEQ ID NO: 4614361 - DNA, 23 bp, Homo sapiens
ttacagccaagtgccaaatgctc

SEQ ID NO: 4614362 - DNA, 14 bp, Homo sapiens
ttacagcctctgac

SEQ ID NO: 4614363 - DNA, 15 bp, Homo sapiens
ttacagcctctgact

SEQ ID NO: 4614364 - DNA, 15 bp, Homo sapiens
ttacaggcgcctgcc

SEQ ID NO: 4614365 - DNA, 21 bp, Homo sapiens
ttacataatctgtacaatgaa

SEQ ID NO: 4614366 - DNA, 13 bp, Homo sapiens
ttacatccagagt

SEQ ID NO: 4614367 - DNA, 13 bp, Homo sapiens
ttacatctaagaa

SEQ ID NO: 4614368 - DNA, 16 bp, Homo sapiens
ttacatctaagaattt

SEQ ID NO: 4614369 - DNA, 15 bp, Homo sapiens
ttacatgtaatttga

SEQ ID NO: 4614370 - DNA, 20 bp, Homo sapiens
ttaccaaagagatattgata

SEQ ID NO: 4614371 - DNA, 20 bp, Homo sapiens
ttacccagggtggagtgcag

SEQ ID NO: 4614372 - DNA, 21 bp, Homo sapiens
ttacccatcttgcttccaaga

SEQ ID NO: 4614373 - DNA, 23 bp, Homo sapiens
ttaccctgtacatatgtaaacat

SEQ ID NO: 4614374 - DNA, 17 bp, Homo sapiens
ttacctgtctctctctt

SEQ ID NO: 4614375 - DNA, 23 bp, Homo sapiens
ttaccttcacatgtcctattact

SEQ ID NO: 4614376 - DNA, 21 bp, Homo sapiens
ttactaactctggtttaattt

SEQ ID NO: 4614377 - DNA, 22 bp, Homo sapiens
ttactaagcactgtgtttatat

SEQ ID NO: 4614378 - DNA, 21 bp, Homo sapiens
ttactaaggcaggtgggcaga

SEQ ID NO: 4614379 - DNA, 13 bp, Homo sapiens
ttactaccttatc

SEQ ID NO: 4614380 - DNA, 13 bp, Homo sapiens
ttactctttgcaa

SEQ ID NO: 4614381 - DNA, 16 bp, Homo sapiens
ttactgaataatatca

SEQ ID NO: 4614382 - DNA, 16 bp, Homo sapiens
ttactgactcctcagt

SEQ ID NO: 4614383 - DNA, 15 bp, Homo sapiens
ttccactattttcaa

SEQ ID NO: 4614384 - DNA, 15 bp, Homo sapiens
ttccacttgccctgt

SEQ ID NO: 4614385 - DNA, 16 bp, Homo sapiens
ttccagattcctatga

SEQ ID NO: 4614386 - DNA, 23 bp, Homo sapiens
ttccaggagaagggggctctgcc

SEQ ID NO: 4614387 - DNA, 18 bp, Homo sapiens
ttccatccttgactgaag

SEQ ID NO: 4614388 - DNA, 17 bp, Homo sapiens
ttccatctatcactgca

SEQ ID NO: 4614389 - DNA, 18 bp, Homo sapiens
ttccatctatcactgcat

SEQ ID NO: 4614390 - DNA, 15 bp, Homo sapiens
ttccatggccctcat

SEQ ID NO: 4614391 - DNA, 14 bp, Homo sapiens
ttccattttccccc

SEQ ID NO: 4614392 - DNA, 18 bp, Homo sapiens
ttccattttcccccacta

SEQ ID NO: 4614393 - DNA, 22 bp, Homo sapiens
ttcccaagagcatcatgcctct

SEQ ID NO: 4614394 - DNA, 20 bp, Homo sapiens
ttcccaagctagactgtgtc

SEQ ID NO: 4614395 - DNA, 16 bp, Homo sapiens
ttcccaagctcccttc

SEQ ID NO: 4614396 - DNA, 14 bp, Homo sapiens
ttcccacaagcctg

SEQ ID NO: 4614397 - DNA, 13 bp, Homo sapiens
ttcccatccccag

SEQ ID NO: 4614398 - DNA, 19 bp, Homo sapiens
ttccccaagatctgccaga

SEQ ID NO: 4614399 - DNA, 23 bp, Homo sapiens
ttccccaagatctgccagacctg

SEQ ID NO: 4614400 - DNA, 22 bp, Homo sapiens
ttccccagctcccccaggcaga

SEQ ID NO: 4614401 - DNA, 20 bp, Homo sapiens
ttccccatgaaccctgccct

SEQ ID NO: 4614402 - DNA, 18 bp, Homo sapiens
ttcccccaccagctaagg

SEQ ID NO: 4614403 - DNA, 12 bp, Homo sapiens
ttcccccaccct

SEQ ID NO: 4614404 - DNA, 21 bp, Homo sapiens
ttccccctcttcttctgaaga

SEQ ID NO: 4614405 - DNA, 21 bp, Homo sapiens
ttcccccttccaaataataaa

SEQ ID NO: 4614406 - DNA, 17 bp, Homo sapiens
ttccccctttctctgcc

SEQ ID NO: 4614407 - DNA, 23 bp, Homo sapiens
ttccccctttctctgcctggcaa

SEQ ID NO: 4614408 - DNA, 15 bp, Homo sapiens
ttcccctatcattta

SEQ ID NO: 4614409 - DNA, 13 bp, Homo sapiens
ttccctagcagga

SEQ ID NO: 4614410 - DNA, 16 bp, Homo sapiens
ttccctagcaggaact

SEQ ID NO: 4614411 - DNA, 22 bp, Homo sapiens
ttccctataggaacagcccagc

SEQ ID NO: 4614412 - DNA, 13 bp, Homo sapiens
ttccctctccttc

SEQ ID NO: 4614413 - DNA, 11 bp, Homo sapiens
ttccctctgcc

SEQ ID NO: 4614414 - DNA, 15 bp, Homo sapiens
ttccctctgcctggg

SEQ ID NO: 4614415 - DNA, 14 bp, Homo sapiens
ttcccttcctcagc

SEQ ID NO: 4614416 - DNA, 22 bp, Homo sapiens
ttcccttcttggtttccaaagg

SEQ ID NO: 4614417 - DNA, 16 bp, Homo sapiens
ttcccttgctcatgag

SEQ ID NO: 4614418 - DNA, 16 bp, Homo sapiens
ttccctttatttctct

SEQ ID NO: 4614419 - DNA, 17 bp, Homo sapiens
ttccctttatttctctt

SEQ ID NO: 4614420 - DNA, 23 bp, Homo sapiens
ttccgctttgaaagaagcaagac

SEQ ID NO: 4614421 - DNA, 18 bp, Homo sapiens
ttccgtagccagctgctc

SEQ ID NO: 4614422 - DNA, 20 bp, Homo sapiens
ttccgttcctccccctgctc

SEQ ID NO: 4614423 - DNA, 14 bp, Homo sapiens
ttcctaacaaaatg

SEQ ID NO: 4614424 - DNA, 15 bp, Homo sapiens
ttcctacagcactac

SEQ ID NO: 4614425 - DNA, 20 bp, Homo sapiens
ttcctacagcactactgggt

SEQ ID NO: 4614426 - DNA, 22 bp, Homo sapiens
ttcctacagcactactgggtgt

SEQ ID NO: 4614427 - DNA, 23 bp, Homo sapiens
ttcctacagcactactgggtgtc

SEQ ID NO: 4614428 - DNA, 17 bp, Homo sapiens
ttcctagtaagtcagga

SEQ ID NO: 4614429 - DNA, 20 bp, Homo sapiens
ttcctagtaagtcaggacag

SEQ ID NO: 4614430 - DNA, 18 bp, Homo sapiens
ttcctatgacacagttat

SEQ ID NO: 4614431 - DNA, 13 bp, Homo sapiens
ttcctcacatttg

SEQ ID NO: 4614432 - DNA, 17 bp, Homo sapiens
ttcctccccctgcaact

SEQ ID NO: 4614433 - DNA, 14 bp, Homo sapiens
ttcctccccctgct

SEQ ID NO: 4614434 - DNA, 16 bp, Homo sapiens
ttcctcctgcctttct

SEQ ID NO: 4614435 - DNA, 17 bp, Homo sapiens
ttcctcctgcctttctc

SEQ ID NO: 4614436 - DNA, 18 bp, Homo sapiens
ttcctcctgcctttctca

SEQ ID NO: 4614437 - DNA, 17 bp, Homo sapiens
ttcctctccaccctccc

SEQ ID NO: 4614438 - DNA, 11 bp, Homo sapiens
ttcctctgccc

SEQ ID NO: 4614439 - DNA, 17 bp, Homo sapiens
ttcctcttcctgccctt

SEQ ID NO: 4614440 - DNA, 14 bp, Homo sapiens
ttcctgaaccatgt

SEQ ID NO: 4614441 - DNA, 15 bp, Homo sapiens
ttcctgaagcattta

SEQ ID NO: 4614442 - DNA, 14 bp, Homo sapiens
ttcctgaagctgag

SEQ ID NO: 4614443 - DNA, 21 bp, Homo sapiens
ttcctgcccttgaaccccctc

SEQ ID NO: 4614444 - DNA, 17 bp, Homo sapiens
ttcctgcctttaagcca

SEQ ID NO: 4614445 - DNA, 14 bp, Homo sapiens
ttcctgctgcctgg

SEQ ID NO: 4614446 - DNA, 22 bp, Homo sapiens
ttcctggaagtcaaataaatgt

SEQ ID NO: 4614447 - DNA, 20 bp, Homo sapiens
ttcctggacagctgtgcctc

SEQ ID NO: 4614448 - DNA, 17 bp, Homo sapiens
ttcctggacttaaagaa

SEQ ID NO: 4614449 - DNA, 17 bp, Homo sapiens
ttcctggcctcagagct

SEQ ID NO: 4614450 - DNA, 16 bp, Homo sapiens
ttcctgggaacatcac

SEQ ID NO: 4614451 - DNA, 17 bp, Homo sapiens
ttcctgggcctttgcaa

SEQ ID NO: 4614452 - DNA, 17 bp, Homo sapiens
ttcctggggaccaagat

SEQ ID NO: 4614453 - DNA, 17 bp, Homo sapiens
ttcctgggtggctactc

SEQ ID NO: 4614454 - DNA, 22 bp, Homo sapiens
ttcctgggtggctactctgtgc

SEQ ID NO: 4614455 - DNA, 22 bp, Homo sapiens
ttcctgtagccttctgtaggaa

SEQ ID NO: 4614456 - DNA, 20 bp, Homo sapiens
ttcctgtatttgttcccaag

SEQ ID NO: 4614457 - DNA, 13 bp, Homo sapiens
ttcctgtggctcc

SEQ ID NO: 4614458 - DNA, 21 bp, Homo sapiens
ttcctgtggttttattacaaa

SEQ ID NO: 4614459 - DNA, 19 bp, Homo sapiens
ttcctgttcagtaataaaa

SEQ ID NO: 4614460 - DNA, 15 bp, Homo sapiens
ttcctgtttccaggg

SEQ ID NO: 4614461 - DNA, 16 bp, Homo sapiens
ttcctgtttccagggt

SEQ ID NO: 4614462 - DNA, 12 bp, Homo sapiens
ttccttaagtat

SEQ ID NO: 4614463 - DNA, 18 bp, Homo sapiens
ttccttatcctagccttt

SEQ ID NO: 4614464 - DNA, 14 bp, Homo sapiens
ttccttccagcctt

SEQ ID NO: 4614465 - DNA, 19 bp, Homo sapiens
ttccttccatgctcccaac

SEQ ID NO: 4614466 - DNA, 22 bp, Homo sapiens
ttccttcccagaatgttactga

SEQ ID NO: 4614467 - DNA, 18 bp, Homo sapiens
ttccttcgaaaggccttc

SEQ ID NO: 4614468 - DNA, 18 bp, Homo sapiens
ttccttctaagtgtactt

SEQ ID NO: 4614469 - DNA, 13 bp, Homo sapiens
ttccttgttcagc

SEQ ID NO: 4614470 - DNA, 20 bp, Homo sapiens
ttcctttcaataaagttgtt

SEQ ID NO: 4614471 - DNA, 20 bp, Homo sapiens
ttcctttgcccttcctcctg

SEQ ID NO: 4614472 - DNA, 19 bp, Homo sapiens
ttccttttaaagaagcttt

SEQ ID NO: 4614473 - DNA, 15 bp, Homo sapiens
ttcgaaaggccttca

SEQ ID NO: 4614474 - DNA, 17 bp, Homo sapiens
ttcgaaaggccttcaga

SEQ ID NO: 4614475 - DNA, 18 bp, Homo sapiens
ttcgaatggggtagaaac

SEQ ID NO: 4614476 - DNA, 19 bp, Homo sapiens
ttcgcagccaccctgagga

SEQ ID NO: 4614477 - DNA, 21 bp, Homo sapiens
ttcgcatgtttaatgtgaact

SEQ ID NO: 4614478 - DNA, 17 bp, Homo sapiens
ttcggacagacatatgg

SEQ ID NO: 4614479 - DNA, 13 bp, Homo sapiens
ttcggggctggga

SEQ ID NO: 4614480 - DNA, 20 bp, Homo sapiens
ttcgtaacggccttgatccc

SEQ ID NO: 4614481 - DNA, 20 bp, Homo sapiens
ttcgtcatgttggccaggct

SEQ ID NO: 4614482 - DNA, 18 bp, Homo sapiens
ttcgtgaacatagagttt

SEQ ID NO: 4614483 - DNA, 20 bp, Homo sapiens
ttcgtgaacatagagtttgg

SEQ ID NO: 4614484 - DNA, 13 bp, Homo sapiens
ttcgtgagctggg

SEQ ID NO: 4614485 - DNA, 12 bp, Homo sapiens
ttcgttcctgcg

SEQ ID NO: 4614486 - DNA, 17 bp, Homo sapiens
ttcgttgcacagctgtt

SEQ ID NO: 4614487 - DNA, 22 bp, Homo sapiens
ttcgtttggtcttaggtcttcc

SEQ ID NO: 4614488 - DNA, 23 bp, Homo sapiens
ttctaaaatagcaataactgaaa

SEQ ID NO: 4614489 - DNA, 23 bp, Homo sapiens
ttctaacttatttataaaaagat

SEQ ID NO: 4614490 - DNA, 14 bp, Homo sapiens
ttctaataaagcca

SEQ ID NO: 4614491 - DNA, 21 bp, Homo sapiens
ttctaatgcatatttataaga

SEQ ID NO: 4614492 - DNA, 22 bp, Homo sapiens
ttctaatgcatatttataagag

SEQ ID NO: 4614493 - DNA, 22 bp, Homo sapiens
ttctaattaaccttactaatta

SEQ ID NO: 4614494 - DNA, 12 bp, Homo sapiens
ttatttctatga

SEQ ID NO: 4614495 - DNA, 22 bp, Homo sapiens
ttatttgaaaacatataaagca

SEQ ID NO: 4614496 - DNA, 16 bp, Homo sapiens
ttattttattattcag

SEQ ID NO: 4614497 - DNA, 22 bp, Homo sapiens
ttattttcagtgcatcattact

SEQ ID NO: 4614498 - DNA, 18 bp, Homo sapiens
ttattttcccctatcatt

SEQ ID NO: 4614499 - DNA, 20 bp, Homo sapiens
ttattttcttttgaattgtt

SEQ ID NO: 4614500 - DNA, 20 bp, Homo sapiens
ttattttggcttcatttcaa

SEQ ID NO: 4614501 - DNA, 16 bp, Homo sapiens
ttcaaaatcagttttt

SEQ ID NO: 4614502 - DNA, 14 bp, Homo sapiens
ttcaaactcctgac

SEQ ID NO: 4614503 - DNA, 22 bp, Homo sapiens
ttcaaagctaaaaaattgttaa

SEQ ID NO: 4614504 - DNA, 15 bp, Homo sapiens
ttcaaatacttttgg

SEQ ID NO: 4614505 - DNA, 16 bp, Homo sapiens
ttcaacaaatttcatt

SEQ ID NO: 4614506 - DNA, 20 bp, Homo sapiens
ttcaacaaatttcattgcac

SEQ ID NO: 4614507 - DNA, 21 bp, Homo sapiens
ttcaacaaatttcattgcact

SEQ ID NO: 4614508 - DNA, 23 bp, Homo sapiens
ttcaacaaatttcattgcacttt

SEQ ID NO: 4614509 - DNA, 16 bp, Homo sapiens
ttcaacctaaatactg

SEQ ID NO: 4614510 - DNA, 16 bp, Homo sapiens
ttcaagaatgaaaaat

SEQ ID NO: 4614511 - DNA, 17 bp, Homo sapiens
ttcaagaatgaaaaata

SEQ ID NO: 4614512 - DNA, 21 bp, Homo sapiens
ttcaagaatgaaaaatataat

SEQ ID NO: 4614513 - DNA, 17 bp, Homo sapiens
ttcaagacgaggggcag

SEQ ID NO: 4614514 - DNA, 18 bp, Homo sapiens
ttcaagagctagaaaaat

SEQ ID NO: 4614515 - DNA, 14 bp, Homo sapiens
ttcaagatgagcct

SEQ ID NO: 4614516 - DNA, 23 bp, Homo sapiens
ttcaagatgagcctgggctcata

SEQ ID NO: 4614517 - DNA, 19 bp, Homo sapiens
ttcaagctcatgtcattat

SEQ ID NO: 4614518 - DNA, 16 bp, Homo sapiens
ttcaaggaggcccact

SEQ ID NO: 4614519 - DNA, 13 bp, Homo sapiens
ttcaaggccttca

SEQ ID NO: 4614520 - DNA, 14 bp, Homo sapiens
ttcaaggccttcag

SEQ ID NO: 4614521 - DNA, 12 bp, Homo sapiens
ttcaataaagtt

SEQ ID NO: 4614522 - DNA, 21 bp, Homo sapiens
ttcaataaagttgttgcattc

SEQ ID NO: 4614523 - DNA, 22 bp, Homo sapiens
ttcaataaagttgttgcattcc

SEQ ID NO: 4614524 - DNA, 19 bp, Homo sapiens
ttcaatagctaagcatctc

SEQ ID NO: 4614525 - DNA, 22 bp, Homo sapiens
ttcaatatgaatctataagtag

SEQ ID NO: 4614526 - DNA, 18 bp, Homo sapiens
ttcaattagtggtcataa

SEQ ID NO: 4614527 - DNA, 19 bp, Homo sapiens
ttcaattccaccagggcca

SEQ ID NO: 4614528 - DNA, 15 bp, Homo sapiens
ttcacaaacattagt

SEQ ID NO: 4614529 - DNA, 18 bp, Homo sapiens
ttcacacgctgttctaat

SEQ ID NO: 4614530 - DNA, 21 bp, Homo sapiens
ttcacagcaccaaaggctcag

SEQ ID NO: 4614531 - DNA, 17 bp, Homo sapiens
ttcacagcttttcttga

SEQ ID NO: 4614532 - DNA, 20 bp, Homo sapiens
ttcacatctctggaaattta

SEQ ID NO: 4614533 - DNA, 18 bp, Homo sapiens
ttcacattaggctgttgg

SEQ ID NO: 4614534 - DNA, 15 bp, Homo sapiens
ttcaccaaaaccaaa

SEQ ID NO: 4614535 - DNA, 14 bp, Homo sapiens
ttcacccaccatgc

SEQ ID NO: 4614536 - DNA, 12 bp, Homo sapiens
ttcacccactcc

SEQ ID NO: 4614537 - DNA, 17 bp, Homo sapiens
ttcacgaagtgttgcat

SEQ ID NO: 4614538 - DNA, 18 bp, Homo sapiens
ttcactactcatgcgtga

SEQ ID NO: 4614539 - DNA, 17 bp, Homo sapiens
ttcactgccagttgtct

SEQ ID NO: 4614540 - DNA, 21 bp, Homo sapiens
ttcacttcaaagctaaaaaat

SEQ ID NO: 4614541 - DNA, 15 bp, Homo sapiens
ttcagacaagacaga

SEQ ID NO: 4614542 - DNA, 12 bp, Homo sapiens
ttcagatataaa

SEQ ID NO: 4614543 - DNA, 14 bp, Homo sapiens
ttcagatataaaag

SEQ ID NO: 4614544 - DNA, 15 bp, Homo sapiens
ttcagatataaaaga

SEQ ID NO: 4614545 - DNA, 17 bp, Homo sapiens
ttcagcagcaaattttc

SEQ ID NO: 4614546 - DNA, 20 bp, Homo sapiens
ttcagcagcaaattttcagc

SEQ ID NO: 4614547 - DNA, 22 bp, Homo sapiens
ttcagcattaagctgttcctgt

SEQ ID NO: 4614548 - DNA, 20 bp, Homo sapiens
ttcagcctgccttcttttct

SEQ ID NO: 4614549 - DNA, 16 bp, Homo sapiens
ttcagctctttccaaa

SEQ ID NO: 4614550 - DNA, 18 bp, Homo sapiens
ttcaggaaaaggcctggg

SEQ ID NO: 4614551 - DNA, 13 bp, Homo sapiens
ttcagggcctcca

SEQ ID NO: 4614552 - DNA, 15 bp, Homo sapiens
ttcagtaacaagtgt

SEQ ID NO: 4614553 - DNA, 13 bp, Homo sapiens
ttcagtaccaaag

SEQ ID NO: 4614554 - DNA, 20 bp, Homo sapiens
ttcagtcagggtttgtcaga

SEQ ID NO: 4614555 - DNA, 21 bp, Homo sapiens
ttcagtcatataaaagctatg

SEQ ID NO: 4614556 - DNA, 12 bp, Homo sapiens
ttcagttttcag

SEQ ID NO: 4614557 - DNA, 15 bp, Homo sapiens
ttcataagatattct

SEQ ID NO: 4614558 - DNA, 13 bp, Homo sapiens
ttcataatcagta

SEQ ID NO: 4614559 - DNA, 18 bp, Homo sapiens
ttcatacactaaccaaat

SEQ ID NO: 4614560 - DNA, 14 bp, Homo sapiens
ttcatacagtttta

SEQ ID NO: 4614561 - DNA, 20 bp, Homo sapiens
ttcatactctgttgcctcct

SEQ ID NO: 4614562 - DNA, 17 bp, Homo sapiens
ttcatccttctttcctt

SEQ ID NO: 4614563 - DNA, 19 bp, Homo sapiens
ttcatctaaatgaaagtgg

SEQ ID NO: 4614564 - DNA, 18 bp, Homo sapiens
ttcatctgggaaagacat

SEQ ID NO: 4614565 - DNA, 16 bp, Homo sapiens
ttcatgacattatgtg

SEQ ID NO: 4614566 - DNA, 22 bp, Homo sapiens
ttcatgattatagcaactaatg

SEQ ID NO: 4614567 - DNA, 20 bp, Homo sapiens
ttcatgggcctggatgcaga

SEQ ID NO: 4614568 - DNA, 15 bp, Homo sapiens
ttcatgtacagaggt

SEQ ID NO: 4614569 - DNA, 17 bp, Homo sapiens
ttcatgttttaacaaaa

SEQ ID NO: 4614570 - DNA, 18 bp, Homo sapiens
ttcatgttttaacaaaaa

SEQ ID NO: 4614571 - DNA, 15 bp, Homo sapiens
ttcattacttgaatg

SEQ ID NO: 4614572 - DNA, 22 bp, Homo sapiens
ttcattatgcacttttagaaat

SEQ ID NO: 4614573 - DNA, 23 bp, Homo sapiens
ttcattatgcacttttagaaatg

SEQ ID NO: 4614574 - DNA, 13 bp, Homo sapiens
ttcattatgttca

SEQ ID NO: 4614575 - DNA, 23 bp, Homo sapiens
ttcattattcaagaatgaaaaat

SEQ ID NO: 4614576 - DNA, 16 bp, Homo sapiens
ttcattctcctcctcc

SEQ ID NO: 4614577 - DNA, 23 bp, Homo sapiens
ttcattctcctcctcctccctcc

SEQ ID NO: 4614578 - DNA, 14 bp, Homo sapiens
ttcattctctttta

SEQ ID NO: 4614579 - DNA, 12 bp, Homo sapiens
ttcattgcactt

SEQ ID NO: 4614580 - DNA, 22 bp, Homo sapiens
ttcattgcactttcctttcaat

SEQ ID NO: 4614581 - DNA, 20 bp, Homo sapiens
ttcattgggaagattctcta

SEQ ID NO: 4614582 - DNA, 15 bp, Homo sapiens
ttcatttaactttat

SEQ ID NO: 4614583 - DNA, 18 bp, Homo sapiens
ttcatttagataatttga

SEQ ID NO: 4614584 - DNA, 21 bp, Homo sapiens
ttcatttagataatttgaaaa

SEQ ID NO: 4614585 - DNA, 22 bp, Homo sapiens
ttcatttagataatttgaaaaa

SEQ ID NO: 4614586 - DNA, 14 bp, Homo sapiens
ttcatttcaatcat

SEQ ID NO: 4614587 - DNA, 11 bp, Homo sapiens
ttcatttcatt

SEQ ID NO: 4614588 - DNA, 13 bp, Homo sapiens
ttcattttccaat

SEQ ID NO: 4614589 - DNA, 16 bp, Homo sapiens
ttccaaaagccaatgg

SEQ ID NO: 4614590 - DNA, 15 bp, Homo sapiens
ttccaaacagacaaa

SEQ ID NO: 4614591 - DNA, 19 bp, Homo sapiens
ttccaaagaatattttgat

SEQ ID NO: 4614592 - DNA, 17 bp, Homo sapiens
ttccaagaaaatatcac

SEQ ID NO: 4614593 - DNA, 16 bp, Homo sapiens
ttccaagccctcagct

SEQ ID NO: 4614594 - DNA, 15 bp, Homo sapiens
ttccaagcttcatat

SEQ ID NO: 4614595 - DNA, 16 bp, Homo sapiens
ttccaagcttcatatt

SEQ ID NO: 4614596 - DNA, 18 bp, Homo sapiens
ttccaatagaaagaaact

SEQ ID NO: 4614597 - DNA, 20 bp, Homo sapiens
ttccaatagaaagaaactaa

SEQ ID NO: 4614598 - DNA, 16 bp, Homo sapiens
ttccacacgcattaat

SEQ ID NO: 4614599 - DNA, 18 bp, Homo sapiens
ttccaccacaggaatgta

SEQ ID NO: 4614600 - DNA, 15 bp, Homo sapiens
ttccaccagggccag

SEQ ID NO: 4614601 - DNA, 21 bp, Homo sapiens
ttccaccagggccagagcagc

SEQ ID NO: 4614602 - DNA, 18 bp, Homo sapiens
ttccacctcacaactcct

SEQ ID NO: 4614603 - DNA, 15 bp, Homo sapiens
ttccacctccagcct

SEQ ID NO: 4614604 - DNA, 14 bp, Homo sapiens
ttccactaaaaata

SEQ ID NO: 4614605 - DNA, 19 bp, Homo sapiens
ttgactggctgtgtgacct

SEQ ID NO: 4614606 - DNA, 15 bp, Homo sapiens
ttgagaagcgttttt

SEQ ID NO: 4614607 - DNA, 19 bp, Homo sapiens
ttgagaccccagtgcctgc

SEQ ID NO: 4614608 - DNA, 19 bp, Homo sapiens
ttgagatctggggaggcag

SEQ ID NO: 4614609 - DNA, 19 bp, Homo sapiens
ttgagcatattttcttact

SEQ ID NO: 4614610 - DNA, 18 bp, Homo sapiens
ttgagcccagaacttcaa

SEQ ID NO: 4614611 - DNA, 22 bp, Homo sapiens
ttgagctatttccttccagcct

SEQ ID NO: 4614612 - DNA, 16 bp, Homo sapiens
ttgaggatcatatgaa

SEQ ID NO: 4614613 - DNA, 22 bp, Homo sapiens
ttgagtcattatccttgctatg

SEQ ID NO: 4614614 - DNA, 18 bp, Homo sapiens
ttgagtctgttttgtaaa

SEQ ID NO: 4614615 - DNA, 20 bp, Homo sapiens
ttgagtttcagctggaaact

SEQ ID NO: 4614616 - DNA, 21 bp, Homo sapiens
ttgataatatatattaagtgt

SEQ ID NO: 4614617 - DNA, 21 bp, Homo sapiens
ttgataggcctagtacaatct

SEQ ID NO: 4614618 - DNA, 23 bp, Homo sapiens
ttgataggcctagtacaatcttg

SEQ ID NO: 4614619 - DNA, 14 bp, Homo sapiens
ttgatattgaagga

SEQ ID NO: 4614620 - DNA, 12 bp, Homo sapiens
ttgatcagaatc

SEQ ID NO: 4614621 - DNA, 13 bp, Homo sapiens
ttgatcagaatcc

SEQ ID NO: 4614622 - DNA, 17 bp, Homo sapiens
ttgatcatgtacttttt

SEQ ID NO: 4614623 - DNA, 23 bp, Homo sapiens
ttgatccctaaccctacaaagag

SEQ ID NO: 4614624 - DNA, 21 bp, Homo sapiens
ttgatgcagataaaatatttt

SEQ ID NO: 4614625 - DNA, 21 bp, Homo sapiens
ttgatggagtgtgagccacct

SEQ ID NO: 4614626 - DNA, 13 bp, Homo sapiens
ttgatgtgtcttt

SEQ ID NO: 4614627 - DNA, 14 bp, Homo sapiens
ttgattaaaaatgt

SEQ ID NO: 4614628 - DNA, 13 bp, Homo sapiens
ttgattcacttca

SEQ ID NO: 4614629 - DNA, 15 bp, Homo sapiens
ttgatttttaaagtt

SEQ ID NO: 4614630 - DNA, 16 bp, Homo sapiens
ttgcaaagcctttaaa

SEQ ID NO: 4614631 - DNA, 20 bp, Homo sapiens
ttgcaactaggtatttctaa

SEQ ID NO: 4614632 - DNA, 16 bp, Homo sapiens
ttgcacctgtccccac

SEQ ID NO: 4614633 - DNA, 20 bp, Homo sapiens
ttgcagcatatcgtttaatt

SEQ ID NO: 4614634 - DNA, 23 bp, Homo sapiens
ttgcagcctgctctagtgggaca

SEQ ID NO: 4614635 - DNA, 23 bp, Homo sapiens
ttgcaggtaagtctggttttgtc

SEQ ID NO: 4614636 - DNA, 14 bp, Homo sapiens
ttgcatactgaaaa

SEQ ID NO: 4614637 - DNA, 15 bp, Homo sapiens
ttgcattcttttggc

SEQ ID NO: 4614638 - DNA, 18 bp, Homo sapiens
ttgcatttagcttctttc

SEQ ID NO: 4614639 - DNA, 13 bp, Homo sapiens
ttgccaaaattca

SEQ ID NO: 4614640 - DNA, 24 bp, Homo sapiens
ttgccacatccctatagaccactg

SEQ ID NO: 4614641 - DNA, 16 bp, Homo sapiens
ttgccggtggtgcagg

SEQ ID NO: 4614642 - DNA, 18 bp, Homo sapiens
ttgcctccatctttttct

SEQ ID NO: 4614643 - DNA, 21 bp, Homo sapiens
ttgcctccatctttttcttgg

SEQ ID NO: 4614644 - DNA, 22 bp, Homo sapiens
ttgcctccatctttttcttggg

SEQ ID NO: 4614645 - DNA, 23 bp, Homo sapiens
ttgcctccatctttttcttgggt

SEQ ID NO: 4614646 - DNA, 22 bp, Homo sapiens
ttgcctcctctctccctgcctc

SEQ ID NO: 4614647 - DNA, 23 bp, Homo sapiens
ttgcctgggggcttttgccactc

SEQ ID NO: 4614648 - DNA, 15 bp, Homo sapiens
ttgccttttaatttt

SEQ ID NO: 4614649 - DNA, 17 bp, Homo sapiens
ttgcctttttcattttc

SEQ ID NO: 4614650 - DNA, 22 bp, Homo sapiens
ttgcctttttcattttccaata

SEQ ID NO: 4614651 - DNA, 13 bp, Homo sapiens
ttgcggggcctgt

SEQ ID NO: 4614652 - DNA, 17 bp, Homo sapiens
ttgcggggcctgtctca

SEQ ID NO: 4614653 - DNA, 15 bp, Homo sapiens
ttgcgtggactctgc

SEQ ID NO: 4614654 - DNA, 18 bp, Homo sapiens
ttgctatcaacaataaaa

SEQ ID NO: 4614655 - DNA, 22 bp, Homo sapiens
ttgctatggcaggataagaaag

SEQ ID NO: 4614656 - DNA, 13 bp, Homo sapiens
ttgctccattcac

SEQ ID NO: 4614657 - DNA, 15 bp, Homo sapiens
ttgctcccaggatct

SEQ ID NO: 4614658 - DNA, 14 bp, Homo sapiens
ttgctcctgcttct

SEQ ID NO: 4614659 - DNA, 13 bp, Homo sapiens
ttgctcttgggga

SEQ ID NO: 4614660 - DNA, 15 bp, Homo sapiens
ttgctctttcacctg

SEQ ID NO: 4614661 - DNA, 19 bp, Homo sapiens
ttgctggaagaaactaaaa

SEQ ID NO: 4614662 - DNA, 15 bp, Homo sapiens
ttgctggggccaggc

SEQ ID NO: 4614663 - DNA, 21 bp, Homo sapiens
ttgctgtaccagcccagatgt

SEQ ID NO: 4614664 - DNA, 18 bp, Homo sapiens
ttgcttactgatattatc

SEQ ID NO: 4614665 - DNA, 21 bp, Homo sapiens
ttgcttcagtcatcagccagc

SEQ ID NO: 4614666 - DNA, 13 bp, Homo sapiens
ttgcttgaatgct

SEQ ID NO: 4614667 - DNA, 20 bp, Homo sapiens
ttgctttatgccttcttatt

SEQ ID NO: 4614668 - DNA, 16 bp, Homo sapiens
ttgctttcctgggcct

SEQ ID NO: 4614669 - DNA, 15 bp, Homo sapiens
ttgcttttttaaata

SEQ ID NO: 4614670 - DNA, 17 bp, Homo sapiens
ttggaaaagacagaaaa

SEQ ID NO: 4614671 - DNA, 23 bp, Homo sapiens
ttggaaatgtacttttggataag

SEQ ID NO: 4614672 - DNA, 12 bp, Homo sapiens
ttggaagaaaaa

SEQ ID NO: 4614673 - DNA, 12 bp, Homo sapiens
ttggaagctgct

SEQ ID NO: 4614674 - DNA, 13 bp, Homo sapiens
ttggaatatttga

SEQ ID NO: 4614675 - DNA, 18 bp, Homo sapiens
ttggaatatttgaataat

SEQ ID NO: 4614676 - DNA, 16 bp, Homo sapiens
ttggacagaaaatgca

SEQ ID NO: 4614677 - DNA, 17 bp, Homo sapiens
ttggacagaaaatgcaa

SEQ ID NO: 4614678 - DNA, 18 bp, Homo sapiens
ttggactagccagaattc

SEQ ID NO: 4614679 - DNA, 19 bp, Homo sapiens
ttggactgttttgaaaagt

SEQ ID NO: 4614680 - DNA, 22 bp, Homo sapiens
ttggagaaccagggctcttctc

SEQ ID NO: 4614681 - DNA, 23 bp, Homo sapiens
ttggagaccctgcaaacagaaca

SEQ ID NO: 4614682 - DNA, 12 bp, Homo sapiens
ttggataagtag

SEQ ID NO: 4614683 - DNA, 22 bp, Homo sapiens
ttggattcccttaaacaaaagt

SEQ ID NO: 4614684 - DNA, 19 bp, Homo sapiens
ttggatttgtgtgtatgtg

SEQ ID NO: 4614685 - DNA, 14 bp, Homo sapiens
ttggcacagaacag

SEQ ID NO: 4614686 - DNA, 15 bp, Homo sapiens
ttggcacagaacagg

SEQ ID NO: 4614687 - DNA, 11 bp, Homo sapiens
ttggcagctga

SEQ ID NO: 4614688 - DNA, 15 bp, Homo sapiens
ttggcatctgctttt

SEQ ID NO: 4614689 - DNA, 19 bp, Homo sapiens
ttggcatgcatctttaatt

SEQ ID NO: 4614690 - DNA, 15 bp, Homo sapiens
ttggccaggctggtt

SEQ ID NO: 4614691 - DNA, 17 bp, Homo sapiens
ttggcctgatcagacca

SEQ ID NO: 4614692 - DNA, 20 bp, Homo sapiens
ttggcctgtgatgttttatc

SEQ ID NO: 4614693 - DNA, 16 bp, Homo sapiens
ttggcttcatttcaat

SEQ ID NO: 4614694 - DNA, 21 bp, Homo sapiens
ttggcttcatttcaatcattg

SEQ ID NO: 4614695 - DNA, 16 bp, Homo sapiens
ttggctttcctgtttc

SEQ ID NO: 4614696 - DNA, 18 bp, Homo sapiens
ttgggaacagggttactg

SEQ ID NO: 4614697 - DNA, 20 bp, Homo sapiens
ttgggaatgaaattaacaca

SEQ ID NO: 4614698 - DNA, 23 bp, Homo sapiens
ttgggcagccagaccagcaggct

SEQ ID NO: 4614699 - DNA, 18 bp, Homo sapiens
ttgggcagcgcccttcct

SEQ ID NO: 4614700 - DNA, 23 bp, Homo sapiens
ttgggcagcgcccttcctctcca

SEQ ID NO: 4614701 - DNA, 14 bp, Homo sapiens
ttgggccataatta

SEQ ID NO: 4614702 - DNA, 16 bp, Homo sapiens
ttgggctgacccagca

SEQ ID NO: 4614703 - DNA, 19 bp, Homo sapiens
ttggggacatctctttgaa

SEQ ID NO: 4614704 - DNA, 20 bp, Homo sapiens
ttggggaggacaaaacttct

SEQ ID NO: 4614705 - DNA, 15 bp, Homo sapiens
ttgggtgaatttcag

SEQ ID NO: 4614706 - DNA, 21 bp, Homo sapiens
ttggtaaaacagtttcatcta

SEQ ID NO: 4614707 - DNA, 20 bp, Homo sapiens
ttggtcatttggcagcccct

SEQ ID NO: 4614708 - DNA, 22 bp, Homo sapiens
ttggtgaatcggttgttctttc

SEQ ID NO: 4614709 - DNA, 15 bp, Homo sapiens
ttggtgaattttcaa

SEQ ID NO: 4614710 - DNA, 22 bp, Homo sapiens
ttggtgacttgtctgcctcctg

SEQ ID NO: 4614711 - DNA, 18 bp, Homo sapiens
ttggtggcctaatttaca

SEQ ID NO: 4614712 - DNA, 14 bp, Homo sapiens
ttggtgtgccctgt

SEQ ID NO: 4614713 - DNA, 23 bp, Homo sapiens
ttggttctgaagccatgtagcca

SEQ ID NO: 4614714 - DNA, 16 bp, Homo sapiens
ttggttggtttttaca

SEQ ID NO: 4614715 - DNA, 20 bp, Homo sapiens
ttctaatttatattatccat

SEQ ID NO: 4614716 - DNA, 17 bp, Homo sapiens
ttctacccgttccaaaa

SEQ ID NO: 4614717 - DNA, 14 bp, Homo sapiens
ttctacccttttcc

SEQ ID NO: 4614718 - DNA, 21 bp, Homo sapiens
ttctagataaccttgtttatt

SEQ ID NO: 4614719 - DNA, 19 bp, Homo sapiens
ttctagtacacttttatga

SEQ ID NO: 4614720 - DNA, 21 bp, Homo sapiens
ttctataaatttaagaaaaca

SEQ ID NO: 4614721 - DNA, 14 bp, Homo sapiens
ttctatagccaact

SEQ ID NO: 4614722 - DNA, 16 bp, Homo sapiens
ttctatgatccttttt

SEQ ID NO: 4614723 - DNA, 22 bp, Homo sapiens
ttctatgatccttttttgtcat

SEQ ID NO: 4614724 - DNA, 19 bp, Homo sapiens
ttctattatggaaaactgt

SEQ ID NO: 4614725 - DNA, 22 bp, Homo sapiens
ttctattttaagactgatttta

SEQ ID NO: 4614726 - DNA, 12 bp, Homo sapiens
ttctcaaatctt

SEQ ID NO: 4614727 - DNA, 21 bp, Homo sapiens
ttctcacacacaactgtccat

SEQ ID NO: 4614728 - DNA, 18 bp, Homo sapiens
ttctcagtttctgcctgg

SEQ ID NO: 4614729 - DNA, 19 bp, Homo sapiens
ttctcagtttctgcctggg

SEQ ID NO: 4614730 - DNA, 20 bp, Homo sapiens
ttctcagtttctgcctgggc

SEQ ID NO: 4614731 - DNA, 15 bp, Homo sapiens
ttctccacagcaacc

SEQ ID NO: 4614732 - DNA, 20 bp, Homo sapiens
ttctccacttcatttttaag

SEQ ID NO: 4614733 - DNA, 17 bp, Homo sapiens
ttctccatttaagacac

SEQ ID NO: 4614734 - DNA, 18 bp, Homo sapiens
ttctccatttaagacaca

SEQ ID NO: 4614735 - DNA, 20 bp, Homo sapiens
ttctcccaggcctctgcccc

SEQ ID NO: 4614736 - DNA, 18 bp, Homo sapiens
ttctcctggcccctgcct

SEQ ID NO: 4614737 - DNA, 12 bp, Homo sapiens
ttctctcatcta

SEQ ID NO: 4614738 - DNA, 17 bp, Homo sapiens
ttctctctacagtgcca

SEQ ID NO: 4614739 - DNA, 12 bp, Homo sapiens
ttctctctcacc

SEQ ID NO: 4614740 - DNA, 13 bp, Homo sapiens
ttctctgcctggc

SEQ ID NO: 4614741 - DNA, 14 bp, Homo sapiens
ttctctgcctggca

SEQ ID NO: 4614742 - DNA, 16 bp, Homo sapiens
ttctctgcttgacaga

SEQ ID NO: 4614743 - DNA, 19 bp, Homo sapiens
ttctcttaagattaatttt

SEQ ID NO: 4614744 - DNA, 11 bp, Homo sapiens
ttctcttagag

SEQ ID NO: 4614745 - DNA, 18 bp, Homo sapiens
ttctcttctacccttttc

SEQ ID NO: 4614746 - DNA, 13 bp, Homo sapiens
ttctctttcaaag

SEQ ID NO: 4614747 - DNA, 16 bp, Homo sapiens
ttctctttctgtttcc

SEQ ID NO: 4614748 - DNA, 17 bp, Homo sapiens
ttctctttctgtttcct

SEQ ID NO: 4614749 - DNA, 18 bp, Homo sapiens
ttctgaagaaaaattact

SEQ ID NO: 4614750 - DNA, 14 bp, Homo sapiens
ttctgaagactgag

SEQ ID NO: 4614751 - DNA, 16 bp, Homo sapiens
ttctgaagactgagaa

SEQ ID NO: 4614752 - DNA, 23 bp, Homo sapiens
ttctgaagatcagaacattcagc

SEQ ID NO: 4614753 - DNA, 14 bp, Homo sapiens
ttctgcaaaataca

SEQ ID NO: 4614754 - DNA, 22 bp, Homo sapiens
ttctgcctagagtgtagcctaa

SEQ ID NO: 4614755 - DNA, 19 bp, Homo sapiens
ttctgcctgggcaatggcc

SEQ ID NO: 4614756 - DNA, 21 bp, Homo sapiens
ttctgcctttaattttcttgt

SEQ ID NO: 4614757 - DNA, 14 bp, Homo sapiens
ttctgctcagctct

SEQ ID NO: 4614758 - DNA, 14 bp, Homo sapiens
ttctgcttgtccca

SEQ ID NO: 4614759 - DNA, 17 bp, Homo sapiens
ttctggccttgtaagac

SEQ ID NO: 4614760 - DNA, 19 bp, Homo sapiens
ttctgggaagtcctagccc

SEQ ID NO: 4614761 - DNA, 22 bp, Homo sapiens
ttctgggagacacccaaagggt

SEQ ID NO: 4614762 - DNA, 16 bp, Homo sapiens
ttctgggctctggact

SEQ ID NO: 4614763 - DNA, 16 bp, Homo sapiens
ttctggggctgtgtta

SEQ ID NO: 4614764 - DNA, 17 bp, Homo sapiens
ttctgtgtggtgcattc

SEQ ID NO: 4614765 - DNA, 19 bp, Homo sapiens
ttctgttatttttaagctt

SEQ ID NO: 4614766 - DNA, 17 bp, Homo sapiens
ttctgttcctttttgta

SEQ ID NO: 4614767 - DNA, 21 bp, Homo sapiens
ttctgtttcctggcctcagag

SEQ ID NO: 4614768 - DNA, 13 bp, Homo sapiens
ttctgtttttaat

SEQ ID NO: 4614769 - DNA, 21 bp, Homo sapiens
ttcttaaattttgtaggattt

SEQ ID NO: 4614770 - DNA, 21 bp, Homo sapiens
ttcttaagacgtgattttgct

SEQ ID NO: 4614771 - DNA, 23 bp, Homo sapiens
ttcttacttttcctggacttaaa

SEQ ID NO: 4614772 - DNA, 23 bp, Homo sapiens
ttcttagggcacatgaaaaattt

SEQ ID NO: 4614773 - DNA, 23 bp, Homo sapiens
ttcttataggctagacttagatt

SEQ ID NO: 4614774 - DNA, 19 bp, Homo sapiens
ttcttatccttacactccc

SEQ ID NO: 4614775 - DNA, 18 bp, Homo sapiens
ttcttatgcaaaatggaa

SEQ ID NO: 4614776 - DNA, 16 bp, Homo sapiens
ttcttcacctcttcca

SEQ ID NO: 4614777 - DNA, 19 bp, Homo sapiens
ttcttcagcgtaaaatggt

SEQ ID NO: 4614778 - DNA, 13 bp, Homo sapiens
ttcttctgaagat

SEQ ID NO: 4614779 - DNA, 22 bp, Homo sapiens
ttcttggcttaatcattttcat

SEQ ID NO: 4614780 - DNA, 15 bp, Homo sapiens
ttcttgtcagacata

SEQ ID NO: 4614781 - DNA, 16 bp, Homo sapiens
ttctttaaaagaatga

SEQ ID NO: 4614782 - DNA, 20 bp, Homo sapiens
ttctttagaatttttaccca

SEQ ID NO: 4614783 - DNA, 13 bp, Homo sapiens
ttctttattcttt

SEQ ID NO: 4614784 - DNA, 11 bp, Homo sapiens
ttctttcctcc

SEQ ID NO: 4614785 - DNA, 15 bp, Homo sapiens
ttctttccttgttca

SEQ ID NO: 4614786 - DNA, 19 bp, Homo sapiens
ttctttctagttcagctgc

SEQ ID NO: 4614787 - DNA, 13 bp, Homo sapiens
ttctttgtatctt

SEQ ID NO: 4614788 - DNA, 21 bp, Homo sapiens
ttcttttcacattaggctgtt

SEQ ID NO: 4614789 - DNA, 18 bp, Homo sapiens
ttcttttgccacatccct

SEQ ID NO: 4614790 - DNA, 19 bp, Homo sapiens
ttctttttttcctttttaa

SEQ ID NO: 4614791 - DNA, 23 bp, Homo sapiens
ttgaaaaaaaaaatgttgagaag

SEQ ID NO: 4614792 - DNA, 21 bp, Homo sapiens
ttgaaaaactctttattttcc

SEQ ID NO: 4614793 - DNA, 17 bp, Homo sapiens
ttgaaaaagtattgttt

SEQ ID NO: 4614794 - DNA, 23 bp, Homo sapiens
ttgaaaagatgtacctggtggat

SEQ ID NO: 4614795 - DNA, 12 bp, Homo sapiens
ttgaaacaaagt

SEQ ID NO: 4614796 - DNA, 22 bp, Homo sapiens
ttgaaataattatgcagacaca

SEQ ID NO: 4614797 - DNA, 13 bp, Homo sapiens
ttgaaatctttta

SEQ ID NO: 4614798 - DNA, 15 bp, Homo sapiens
ttgaaatggcattta

SEQ ID NO: 4614799 - DNA, 20 bp, Homo sapiens
ttgaaatgtttaataaagct

SEQ ID NO: 4614800 - DNA, 22 bp, Homo sapiens
ttgaaatgtttaataaagcttt

SEQ ID NO: 4614801 - DNA, 23 bp, Homo sapiens
ttgaaatgtttaataaagcttta

SEQ ID NO: 4614802 - DNA, 15 bp, Homo sapiens
ttgaaccatccactt

SEQ ID NO: 4614803 - DNA, 21 bp, Homo sapiens
ttgaaccatccacttacatat

SEQ ID NO: 4614804 - DNA, 20 bp, Homo sapiens
ttgaactgtaccatgtgcta

SEQ ID NO: 4614805 - DNA, 14 bp, Homo sapiens
ttgaaggagtttaa

SEQ ID NO: 4614806 - DNA, 11 bp, Homo sapiens
ttgaaggccag

SEQ ID NO: 4614807 - DNA, 15 bp, Homo sapiens
ttgaaggtacacccc

SEQ ID NO: 4614808 - DNA, 17 bp, Homo sapiens
ttgaagtacttaacata

SEQ ID NO: 4614809 - DNA, 17 bp, Homo sapiens
ttgaataaagtattcta

SEQ ID NO: 4614810 - DNA, 12 bp, Homo sapiens
ttgaataagcag

SEQ ID NO: 4614811 - DNA, 15 bp, Homo sapiens
ttgaataatgacaga

SEQ ID NO: 4614812 - DNA, 21 bp, Homo sapiens
ttgaatatattttatcttggt

SEQ ID NO: 4614813 - DNA, 14 bp, Homo sapiens
ttgaatctatttca

SEQ ID NO: 4614814 - DNA, 14 bp, Homo sapiens
ttgaattttctgtg

SEQ ID NO: 4614815 - DNA, 21 bp, Homo sapiens
ttgacaatgttgtcctcctgt

SEQ ID NO: 4614816 - DNA, 18 bp, Homo sapiens
ttgacacatatgaacaca

SEQ ID NO: 4614817 - DNA, 13 bp, Homo sapiens
ttgacactggtat

SEQ ID NO: 4614818 - DNA, 18 bp, Homo sapiens
ttgacagatcaagctgtg

SEQ ID NO: 4614819 - DNA, 19 bp, Homo sapiens
ttgacagatcaagctgtga

SEQ ID NO: 4614820 - DNA, 20 bp, Homo sapiens
ttgacataggtcataaagca

SEQ ID NO: 4614821 - DNA, 23 bp, Homo sapiens
ttgacgccctgcatcctcctccc

SEQ ID NO: 4614822 - DNA, 15 bp, Homo sapiens
ttgactaattttaca

SEQ ID NO: 4614823 - DNA, 18 bp, Homo sapiens
ttgactcttatttataga

SEQ ID NO: 4614824 - DNA, 19 bp, Homo sapiens
ttgactcttatttatagaa

SEQ ID NO: 4614825 - DNA, 23 bp, Homo sapiens
ttgactgaagcgaacatcttcat

SEQ ID NO: 4614826 - DNA, 18 bp, Homo sapiens
tttcacaggtagcctatt

SEQ ID NO: 4614827 - DNA, 17 bp, Homo sapiens
tttcacattaggctgtt

SEQ ID NO: 4614828 - DNA, 15 bp, Homo sapiens
tttcacatttctact

SEQ ID NO: 4614829 - DNA, 21 bp, Homo sapiens
tttcaccatgatggccaggct

SEQ ID NO: 4614830 - DNA, 12 bp, Homo sapiens
tttcagaaatct

SEQ ID NO: 4614831 - DNA, 20 bp, Homo sapiens
tttcagagactttttttata

SEQ ID NO: 4614832 - DNA, 22 bp, Homo sapiens
tttcagagcccccagccctggg

SEQ ID NO: 4614833 - DNA, 20 bp, Homo sapiens
tttcagatgcttctgggaga

SEQ ID NO: 4614834 - DNA, 18 bp, Homo sapiens
tttcagcattaagctgtt

SEQ ID NO: 4614835 - DNA, 21 bp, Homo sapiens
tttcagcgatgtatgcagcta

SEQ ID NO: 4614836 - DNA, 15 bp, Homo sapiens
tttcagctatcagta

SEQ ID NO: 4614837 - DNA, 15 bp, Homo sapiens
tttcagttttcagga

SEQ ID NO: 4614838 - DNA, 20 bp, Homo sapiens
tttcatcagtaagcagcctt

SEQ ID NO: 4614839 - DNA, 17 bp, Homo sapiens
tttcatccttctttcct

SEQ ID NO: 4614840 - DNA, 19 bp, Homo sapiens
tttcatccttctttccttg

SEQ ID NO: 4614841 - DNA, 14 bp, Homo sapiens
tttcatctaaatga

SEQ ID NO: 4614842 - DNA, 16 bp, Homo sapiens
tttcatctcagctttt

SEQ ID NO: 4614843 - DNA, 15 bp, Homo sapiens
tttcatctgggaaag

SEQ ID NO: 4614844 - DNA, 21 bp, Homo sapiens
tttcatgtggtgaatatgcaa

SEQ ID NO: 4614845 - DNA, 17 bp, Homo sapiens
tttcatgttttaacaaa

SEQ ID NO: 4614846 - DNA, 12 bp, Homo sapiens
tttcattccatt

SEQ ID NO: 4614847 - DNA, 17 bp, Homo sapiens
tttcattccattgccta

SEQ ID NO: 4614848 - DNA, 22 bp, Homo sapiens
tttcattctcctcctcctccct

SEQ ID NO: 4614849 - DNA, 22 bp, Homo sapiens
tttttaaaaataaatctaaatg

SEQ ID NO: 4614850 - DNA, 22 bp, Homo sapiens
tttttaaaaatgtgtcaaaata

SEQ ID NO: 4614851 - DNA, 22 bp, Homo sapiens
tttttaaaagccttccagtttt

SEQ ID NO: 4614852 - DNA, 16 bp, Homo sapiens
tttttaaatattttct

SEQ ID NO: 4614853 - DNA, 11 bp, Homo sapiens
tttttaagaaa

SEQ ID NO: 4614854 - DNA, 18 bp, Homo sapiens
tttttaagtgtatcttaa

SEQ ID NO: 4614855 - DNA, 20 bp, Homo sapiens
tttttaatgaccaattgagt

SEQ ID NO: 4614856 - DNA, 13 bp, Homo sapiens
tttttagttcaat

SEQ ID NO: 4614857 - DNA, 18 bp, Homo sapiens
tttttagttcaatacagt

SEQ ID NO: 4614858 - DNA, 18 bp, Homo sapiens
tttttatagcaacaacaa

SEQ ID NO: 4614859 - DNA, 12 bp, Homo sapiens
tttttatataca

SEQ ID NO: 4614860 - DNA, 14 bp, Homo sapiens
tttttattatgcat

SEQ ID NO: 4614861 - DNA, 15 bp, Homo sapiens
tttttcagttttcag

SEQ ID NO: 4614862 - DNA, 15 bp, Homo sapiens
tttttcatttaactt

SEQ ID NO: 4614863 - DNA, 16 bp, Homo sapiens
tttttcattttccaat

SEQ ID NO: 4614864 - DNA, 17 bp, Homo sapiens
tttttcattttccaata

SEQ ID NO: 4614865 - DNA, 22 bp, Homo sapiens
tttttggactagccagaattct

SEQ ID NO: 4614866 - DNA, 17 bp, Homo sapiens
tttttggtgtgccctgt

SEQ ID NO: 4614867 - DNA, 15 bp, Homo sapiens
tttttggttttaaaa

SEQ ID NO: 4614868 - DNA, 12 bp, Homo sapiens
tttttgtaacta

SEQ ID NO: 4614869 - DNA, 14 bp, Homo sapiens
tttttgtcatttta

SEQ ID NO: 4614870 - DNA, 17 bp, Homo sapiens
tttttgtccatcttgtt

SEQ ID NO: 4614871 - DNA, 16 bp, Homo sapiens
tttttgtcttattgaa

SEQ ID NO: 4614872 - DNA, 17 bp, Homo sapiens
tttttgttgtgttctgt

SEQ ID NO: 4614873 - DNA, 18 bp, Homo sapiens
ttttttaaaaggccattt

SEQ ID NO: 4614874 - DNA, 13 bp, Homo sapiens
ttttttaaaccag

SEQ ID NO: 4614875 - DNA, 13 bp, Homo sapiens
ttttttacagatt

SEQ ID NO: 4614876 - DNA, 11 bp, Homo sapiens
gtacttgtcaa

SEQ ID NO: 4614877 - DNA, 17 bp, Homo sapiens
gtacttgtcaaagaagg

SEQ ID NO: 4614878 - DNA, 17 bp, Homo sapiens
gtacttttagtagagac

SEQ ID NO: 4614879 - DNA, 22 bp, Homo sapiens
gtacttttcattctcttttaat

SEQ ID NO: 4614880 - DNA, 23 bp, Homo sapiens
gtactttttagtaatttcttttt

SEQ ID NO: 4614881 - DNA, 20 bp, Homo sapiens
gtagaaaagggaactgaaca

SEQ ID NO: 4614882 - DNA, 12 bp, Homo sapiens
gtagaaacattg

SEQ ID NO: 4614883 - DNA, 13 bp, Homo sapiens
gtagaattccttc

SEQ ID NO: 4614884 - DNA, 23 bp, Homo sapiens
gtagaattccttcgaaaggcctt

SEQ ID NO: 4614885 - DNA, 21 bp, Homo sapiens
gtagacctgtctcctggcggt

SEQ ID NO: 4614886 - DNA, 14 bp, Homo sapiens
gtagagacagtgtt

SEQ ID NO: 4614887 - DNA, 17 bp, Homo sapiens
gtagatgggagggaggc

SEQ ID NO: 4614888 - DNA, 19 bp, Homo sapiens
gtagccagcacacagggca

SEQ ID NO: 4614889 - DNA, 11 bp, Homo sapiens
gtagccagccg

SEQ ID NO: 4614890 - DNA, 15 bp, Homo sapiens
gtagccagccggggc

SEQ ID NO: 4614891 - DNA, 22 bp, Homo sapiens
gtagccaggtactgcattctct

SEQ ID NO: 4614892 - DNA, 15 bp, Homo sapiens
gtagcctaaagggca

SEQ ID NO: 4614893 - DNA, 17 bp, Homo sapiens
gtagcctaaagggcagg

SEQ ID NO: 4614894 - DNA, 13 bp, Homo sapiens
gtagcctggactg

SEQ ID NO: 4614895 - DNA, 12 bp, Homo sapiens
gtagcctgtgca

SEQ ID NO: 4614896 - DNA, 19 bp, Homo sapiens
gtagctatagttgcagccc

SEQ ID NO: 4614897 - DNA, 22 bp, Homo sapiens
gtagctgagctcacaaggcagc

SEQ ID NO: 4614898 - DNA, 18 bp, Homo sapiens
gtagctgtgacctgctga

SEQ ID NO: 4614899 - DNA, 20 bp, Homo sapiens
gtagctgtgacctgctgagc

SEQ ID NO: 4614900 - DNA, 21 bp, Homo sapiens
gtagctgtgacctgctgagct

SEQ ID NO: 4614901 - DNA, 19 bp, Homo sapiens
gtagcttgctccctgtgtc

SEQ ID NO: 4614902 - DNA, 17 bp, Homo sapiens
gtagctttcctggaagt

SEQ ID NO: 4614903 - DNA, 13 bp, Homo sapiens
gtaggaagcattt

SEQ ID NO: 4614904 - DNA, 15 bp, Homo sapiens
gtaggaccaggccac

SEQ ID NO: 4614905 - DNA, 15 bp, Homo sapiens
gtaggactgtagaaa

SEQ ID NO: 4614906 - DNA, 21 bp, Homo sapiens
gtaggatagctactaaatata

SEQ ID NO: 4614907 - DNA, 21 bp, Homo sapiens
gtaggccccacaaggcctggt

SEQ ID NO: 4614908 - DNA, 15 bp, Homo sapiens
gtagggcaagaggat

SEQ ID NO: 4614909 - DNA, 16 bp, Homo sapiens
gtagtgagcgagtgga

SEQ ID NO: 4614910 - DNA, 16 bp, Homo sapiens
gtagtgccgcagtggg

SEQ ID NO: 4614911 - DNA, 14 bp, Homo sapiens
gtagttaaataact

SEQ ID NO: 4614912 - DNA, 18 bp, Homo sapiens
gtagttccctctgcctgg

SEQ ID NO: 4614913 - DNA, 21 bp, Homo sapiens
gtataacggtttaattctgtc

SEQ ID NO: 4614914 - DNA, 23 bp, Homo sapiens
gtatagaaatgctggtttttcag

SEQ ID NO: 4614915 - DNA, 18 bp, Homo sapiens
gtatataagttgctgtgt

SEQ ID NO: 4614916 - DNA, 23 bp, Homo sapiens
gtatataatttactttgtagact

SEQ ID NO: 4614917 - DNA, 23 bp, Homo sapiens
gtatattcttattggaaatgtac

SEQ ID NO: 4614918 - DNA, 19 bp, Homo sapiens
gtatcacgggtcacttgaa

SEQ ID NO: 4614919 - DNA, 21 bp, Homo sapiens
gtatcactctgtgtctgagtg

SEQ ID NO: 4614920 - DNA, 18 bp, Homo sapiens
gtatcatgccctgtgcaa

SEQ ID NO: 4614921 - DNA, 15 bp, Homo sapiens
gtatccaccttgcac

SEQ ID NO: 4614922 - DNA, 22 bp, Homo sapiens
gtatccccagtgcccggtgcag

SEQ ID NO: 4614923 - DNA, 15 bp, Homo sapiens
gtatcgatgttatgt

SEQ ID NO: 4614924 - DNA, 18 bp, Homo sapiens
gtatctacagtaatgaaa

SEQ ID NO: 4614925 - DNA, 21 bp, Homo sapiens
gtatctacattaaaatgacaa

SEQ ID NO: 4614926 - DNA, 22 bp, Homo sapiens
gtatctacattaaaatgacaaa

SEQ ID NO: 4614927 - DNA, 22 bp, Homo sapiens
gtatcttaatatatacattttt

SEQ ID NO: 4614928 - DNA, 19 bp, Homo sapiens
gtatgaataatgaaaataa

SEQ ID NO: 4614929 - DNA, 18 bp, Homo sapiens
gtatgacccctggccaca

SEQ ID NO: 4614930 - DNA, 20 bp, Homo sapiens
gtatgacccctggccacagc

SEQ ID NO: 4614931 - DNA, 20 bp, Homo sapiens
gtatgatctctctagctttg

SEQ ID NO: 4614932 - DNA, 23 bp, Homo sapiens
gtatgatctctctagctttgtca

SEQ ID NO: 4614933 - DNA, 20 bp, Homo sapiens
gtatgccacacctggcctta

SEQ ID NO: 4614934 - DNA, 23 bp, Homo sapiens
gtatgccactgcactccagcctg

SEQ ID NO: 4614935 - DNA, 21 bp, Homo sapiens
gtatgtttatcaaagagcact

SEQ ID NO: 4614936 - DNA, 22 bp, Homo sapiens
gtattaaacaagtcaattctgt

SEQ ID NO: 4614937 - DNA, 16 bp, Homo sapiens
gtattacacaagccaa

SEQ ID NO: 4614938 - DNA, 19 bp, Homo sapiens
gtattacagctttcacagt

SEQ ID NO: 4614939 - DNA, 22 bp, Homo sapiens
gtattactgaataatatcaaat

SEQ ID NO: 4614940 - DNA, 14 bp, Homo sapiens
gtattattttccaa

SEQ ID NO: 4614941 - DNA, 22 bp, Homo sapiens
gtattcaaatgttagagtttaa

SEQ ID NO: 4614942 - DNA, 21 bp, Homo sapiens
gtattcatgaaaactgttttt

SEQ ID NO: 4614943 - DNA, 21 bp, Homo sapiens
gtatttagaagcagagggaca

SEQ ID NO: 4614944 - DNA, 18 bp, Homo sapiens
gtatttataaaaatataa

SEQ ID NO: 4614945 - DNA, 21 bp, Homo sapiens
gtatttataaaaatataaatt

SEQ ID NO: 4614946 - DNA, 13 bp, Homo sapiens
gtatttctctgtg

SEQ ID NO: 4614947 - DNA, 15 bp, Homo sapiens
gtatttctctgtgaa

SEQ ID NO: 4614948 - DNA, 16 bp, Homo sapiens
gtatttctctgtgaat

SEQ ID NO: 4614949 - DNA, 18 bp, Homo sapiens
gtatttggaatatttgaa

SEQ ID NO: 4614950 - DNA, 16 bp, Homo sapiens
gtatttgtttgtagct

SEQ ID NO: 4614951 - DNA, 19 bp, Homo sapiens
gtatttttctgacttttac

SEQ ID NO: 4614952 - DNA, 13 bp, Homo sapiens
gtcaaaaaaggaa

SEQ ID NO: 4614953 - DNA, 20 bp, Homo sapiens
gtcaaaaaattatttgctat

SEQ ID NO: 4614954 - DNA, 17 bp, Homo sapiens
gtcaaaattgtttaaaa

SEQ ID NO: 4614955 - DNA, 17 bp, Homo sapiens
gtcaaataaatgtttcc

SEQ ID NO: 4614956 - DNA, 14 bp, Homo sapiens
gtcaacctcctgga

SEQ ID NO: 4614957 - DNA, 15 bp, Homo sapiens
gtcaagctgagctgg

SEQ ID NO: 4614958 - DNA, 14 bp, Homo sapiens
gtcaagctggtgct

SEQ ID NO: 4614959 - DNA, 18 bp, Homo sapiens
gtcaataaacaacagctg

SEQ ID NO: 4614960 - DNA, 17 bp, Homo sapiens
gtcacaaagaatttaaa

SEQ ID NO: 4614961 - DNA, 20 bp, Homo sapiens
gtcacacccaccccctgcct

SEQ ID NO: 4614962 - DNA, 21 bp, Homo sapiens
gtcacacccaccccctgcctg

SEQ ID NO: 4614963 - DNA, 18 bp, Homo sapiens
gtcacactcttcagtgac

SEQ ID NO: 4614964 - DNA, 12 bp, Homo sapiens
gtcacagccacc

SEQ ID NO: 4614965 - DNA, 21 bp, Homo sapiens
gtcacatggcctatgcacata

SEQ ID NO: 4614966 - DNA, 15 bp, Homo sapiens
gtcacattatttatt

SEQ ID NO: 4614967 - DNA, 20 bp, Homo sapiens
gtcacccaggctggagtgca

SEQ ID NO: 4614968 - DNA, 19 bp, Homo sapiens
gtcacccagggacactcca

SEQ ID NO: 4614969 - DNA, 16 bp, Homo sapiens
gtcacctacatatgct

SEQ ID NO: 4614970 - DNA, 15 bp, Homo sapiens
gtcacctcccatccc

SEQ ID NO: 4614971 - DNA, 13 bp, Homo sapiens
gtcacctccttcc

SEQ ID NO: 4614972 - DNA, 14 bp, Homo sapiens
gtcacctccttccc

SEQ ID NO: 4614973 - DNA, 15 bp, Homo sapiens
gtcacctccttcccc

SEQ ID NO: 4614974 - DNA, 16 bp, Homo sapiens
gtcacctccttcccca

SEQ ID NO: 4614975 - DNA, 23 bp, Homo sapiens
gtcacctccttccccagctcccc

SEQ ID NO: 4614976 - DNA, 22 bp, Homo sapiens
gtcacctctgtgacccctcctt

SEQ ID NO: 4614977 - DNA, 21 bp, Homo sapiens
gtcacctgccccgtagagaat

SEQ ID NO: 4614978 - DNA, 21 bp, Homo sapiens
gtcacttcttcacctcttcca

SEQ ID NO: 4614979 - DNA, 17 bp, Homo sapiens
gtcacttgactcttgaa

SEQ ID NO: 4614980 - DNA, 15 bp, Homo sapiens
gtcacttgctgcttt

SEQ ID NO: 4614981 - DNA, 16 bp, Homo sapiens
gtcagacataaagcca

SEQ ID NO: 4614982 - DNA, 15 bp, Homo sapiens
gtcagatgaggccct

SEQ ID NO: 4614983 - DNA, 20 bp, Homo sapiens
gtcagatgaggccctgcacc

SEQ ID NO: 4614984 - DNA, 16 bp, Homo sapiens
gtcagcaatttaacta

SEQ ID NO: 4614985 - DNA, 10 bp, Homo sapiens
gtcagccagg

SEQ ID NO: 4614986 - DNA, 13 bp, Homo sapiens
ggtgcccaggaga

SEQ ID NO: 4614987 - DNA, 18 bp, Homo sapiens
ggtgctaaaaatgaaaat

SEQ ID NO: 4614988 - DNA, 19 bp, Homo sapiens
ggtgctgactggcttcagc

SEQ ID NO: 4614989 - DNA, 14 bp, Homo sapiens
ggtggagggaagga

SEQ ID NO: 4614990 - DNA, 16 bp, Homo sapiens
ggtggcatttttgctt

SEQ ID NO: 4614991 - DNA, 19 bp, Homo sapiens
ggtggctactctgtgccag

SEQ ID NO: 4614992 - DNA, 21 bp, Homo sapiens
ggtggtgcaggtagacctgtc

SEQ ID NO: 4614993 - DNA, 14 bp, Homo sapiens
ggtggttcagacaa

SEQ ID NO: 4614994 - DNA, 21 bp, Homo sapiens
ggtgtatgccacacctggcct

SEQ ID NO: 4614995 - DNA, 23 bp, Homo sapiens
ggtgtcaaacattcgtgagctgg

SEQ ID NO: 4614996 - DNA, 18 bp, Homo sapiens
ggtgtcatttcattccat

SEQ ID NO: 4614997 - DNA, 19 bp, Homo sapiens
ggtgtgataaaatgttgaa

SEQ ID NO: 4614998 - DNA, 19 bp, Homo sapiens
ggtgtgccagaaagtcccc

SEQ ID NO: 4614999 - DNA, 21 bp, Homo sapiens
ggtgtgttcgttgcacagctg

SEQ ID NO: 4615000 - DNA, 22 bp, Homo sapiens
ggtgttttttatgaagtgcgtg

SEQ ID NO: 4615001 - DNA, 12 bp, Homo sapiens
ggttaagtgttt

SEQ ID NO: 4615002 - DNA, 16 bp, Homo sapiens
ggttaccaagaagcct

SEQ ID NO: 4615003 - DNA, 19 bp, Homo sapiens
ggttcacgtaatcctcctg

SEQ ID NO: 4615004 - DNA, 13 bp, Homo sapiens
ggttcccaagctc

SEQ ID NO: 4615005 - DNA, 16 bp, Homo sapiens
ggttcccaagctcaga

SEQ ID NO: 4615006 - DNA, 15 bp, Homo sapiens
ggttcccacaagcct

SEQ ID NO: 4615007 - DNA, 19 bp, Homo sapiens
ggttcccacaagcctgcct

SEQ ID NO: 4615008 - DNA, 17 bp, Homo sapiens
ggttccttccttagttt

SEQ ID NO: 4615009 - DNA, 18 bp, Homo sapiens
ggttctccccctttctct

SEQ ID NO: 4615010 - DNA, 17 bp, Homo sapiens
ggttcttaaaaaggaac

SEQ ID NO: 4615011 - DNA, 13 bp, Homo sapiens
ggttgatcttgaa

SEQ ID NO: 4615012 - DNA, 18 bp, Homo sapiens
ggttgcagtctttccccc

SEQ ID NO: 4615013 - DNA, 15 bp, Homo sapiens
ggttggggtgacagt

SEQ ID NO: 4615014 - DNA, 15 bp, Homo sapiens
ggttgtgtgtgttct

SEQ ID NO: 4615015 - DNA, 17 bp, Homo sapiens
ggttgtgtgtgttctgt

SEQ ID NO: 4615016 - DNA, 15 bp, Homo sapiens
ggttgtgttgaggtt

SEQ ID NO: 4615017 - DNA, 18 bp, Homo sapiens
ggtttaagctctgcccct

SEQ ID NO: 4615018 - DNA, 13 bp, Homo sapiens
ggtttctctccct

SEQ ID NO: 4615019 - DNA, 18 bp, Homo sapiens
ggtttctctctacagtgc

SEQ ID NO: 4615020 - DNA, 15 bp, Homo sapiens
ggtttctttcagatt

SEQ ID NO: 4615021 - DNA, 23 bp, Homo sapiens
ggtttgcatttaaacatgtttaa

SEQ ID NO: 4615022 - DNA, 23 bp, Homo sapiens
ggtttgcgggggtctgagtctat

SEQ ID NO: 4615023 - DNA, 15 bp, Homo sapiens
ggttttccaagccct

SEQ ID NO: 4615024 - DNA, 20 bp, Homo sapiens
ggtttttaaatatatatttt

SEQ ID NO: 4615025 - DNA, 22 bp, Homo sapiens
gtaaaaaatgtctcatgtcaat

SEQ ID NO: 4615026 - DNA, 18 bp, Homo sapiens
gtaaaaacagcattgctt

SEQ ID NO: 4615027 - DNA, 23 bp, Homo sapiens
gtaaaaacagcattgctttctga

SEQ ID NO: 4615028 - DNA, 17 bp, Homo sapiens
gtaaaacagggccacat

SEQ ID NO: 4615029 - DNA, 21 bp, Homo sapiens
gtaaaaccttgttctattttt

SEQ ID NO: 4615030 - DNA, 21 bp, Homo sapiens
gtaaaagatcaggttatactt

SEQ ID NO: 4615031 - DNA, 21 bp, Homo sapiens
gtaaaataggcaccattgctt

SEQ ID NO: 4615032 - DNA, 23 bp, Homo sapiens
gtaaaatccccttcgctgaaatt

SEQ ID NO: 4615033 - DNA, 20 bp, Homo sapiens
gtaaacagaagcctgtttca

SEQ ID NO: 4615034 - DNA, 14 bp, Homo sapiens
gtaaacagggtacc

SEQ ID NO: 4615035 - DNA, 20 bp, Homo sapiens
gtaaacctagtaaaaccttg

SEQ ID NO: 4615036 - DNA, 14 bp, Homo sapiens
gtaaactgaggccc

SEQ ID NO: 4615037 - DNA, 13 bp, Homo sapiens
gtaaacttctgaa

SEQ ID NO: 4615038 - DNA, 14 bp, Homo sapiens
gtaaagactggttt

SEQ ID NO: 4615039 - DNA, 18 bp, Homo sapiens
gtaaagactggttttctg

SEQ ID NO: 4615040 - DNA, 16 bp, Homo sapiens
gtaaagctagaaatga

SEQ ID NO: 4615041 - DNA, 14 bp, Homo sapiens
gtaaagtccccaga

SEQ ID NO: 4615042 - DNA, 23 bp, Homo sapiens
gtaaagtccccagagaaagcgca

SEQ ID NO: 4615043 - DNA, 15 bp, Homo sapiens
gtaaatcagaaagta

SEQ ID NO: 4615044 - DNA, 15 bp, Homo sapiens
gtaaatttggcttct

SEQ ID NO: 4615045 - DNA, 19 bp, Homo sapiens
gtaaccaaggccctgtctc

SEQ ID NO: 4615046 - DNA, 19 bp, Homo sapiens
gtaacctgggcttaagttt

SEQ ID NO: 4615047 - DNA, 21 bp, Homo sapiens
gtaacgagggcaacagggagc

SEQ ID NO: 4615048 - DNA, 20 bp, Homo sapiens
gtaactggctttcctgctgg

SEQ ID NO: 4615049 - DNA, 23 bp, Homo sapiens
gtaactggttaaaaaacaaatgt

SEQ ID NO: 4615050 - DNA, 18 bp, Homo sapiens
gtaagaacaactacctga

SEQ ID NO: 4615051 - DNA, 15 bp, Homo sapiens
gtaagaccaccttcc

SEQ ID NO: 4615052 - DNA, 20 bp, Homo sapiens
gtaagaccaccttcccttcc

SEQ ID NO: 4615053 - DNA, 22 bp, Homo sapiens
gtaagggaatttaatacttttc

SEQ ID NO: 4615054 - DNA, 17 bp, Homo sapiens
gtaagtcaggacagctt

SEQ ID NO: 4615055 - DNA, 19 bp, Homo sapiens
gtaatatcaaagcatttta

SEQ ID NO: 4615056 - DNA, 13 bp, Homo sapiens
gtaatatgacaga

SEQ ID NO: 4615057 - DNA, 13 bp, Homo sapiens
gtaatatttttat

SEQ ID NO: 4615058 - DNA, 18 bp, Homo sapiens
gtaatatttttatataca

SEQ ID NO: 4615059 - DNA, 21 bp, Homo sapiens
gtaatcaggcaaggaggagga

SEQ ID NO: 4615060 - DNA, 22 bp, Homo sapiens
gtaatcctcaagaaataaaagg

SEQ ID NO: 4615061 - DNA, 13 bp, Homo sapiens
gtaatcctcctga

SEQ ID NO: 4615062 - DNA, 14 bp, Homo sapiens
gtaatcctcctgag

SEQ ID NO: 4615063 - DNA, 17 bp, Homo sapiens
gtaatcctcttctaaaa

SEQ ID NO: 4615064 - DNA, 12 bp, Homo sapiens
gtaatctgtgta

SEQ ID NO: 4615065 - DNA, 15 bp, Homo sapiens
gtaatgaagaatcac

SEQ ID NO: 4615066 - DNA, 18 bp, Homo sapiens
gtaatggaggtcccagcc

SEQ ID NO: 4615067 - DNA, 13 bp, Homo sapiens
gtaatggcagagc

SEQ ID NO: 4615068 - DNA, 20 bp, Homo sapiens
gtaatgtgtggtggcctcag

SEQ ID NO: 4615069 - DNA, 17 bp, Homo sapiens
gtaattgctttgtgcct

SEQ ID NO: 4615070 - DNA, 21 bp, Homo sapiens
gtaatttctttttttcctttt

SEQ ID NO: 4615071 - DNA, 20 bp, Homo sapiens
gtacaaaatccagctatgaa

SEQ ID NO: 4615072 - DNA, 22 bp, Homo sapiens
gtacaaatgccttaaaatggaa

SEQ ID NO: 4615073 - DNA, 18 bp, Homo sapiens
gtacaatcttagtgaatg

SEQ ID NO: 4615074 - DNA, 12 bp, Homo sapiens
gtacaatcttgg

SEQ ID NO: 4615075 - DNA, 15 bp, Homo sapiens
gtacacagagaaggc

SEQ ID NO: 4615076 - DNA, 14 bp, Homo sapiens
gtacacctgtgtgg

SEQ ID NO: 4615077 - DNA, 14 bp, Homo sapiens
gtacacgtgtcctg

SEQ ID NO: 4615078 - DNA, 21 bp, Homo sapiens
gtacactacgcactggacagc

SEQ ID NO: 4615079 - DNA, 14 bp, Homo sapiens
gtacactttttaca

SEQ ID NO: 4615080 - DNA, 14 bp, Homo sapiens
gtacaggagaggca

SEQ ID NO: 4615081 - DNA, 15 bp, Homo sapiens
gtacaggagaggcag

SEQ ID NO: 4615082 - DNA, 14 bp, Homo sapiens
gtacagtcttgtat

SEQ ID NO: 4615083 - DNA, 12 bp, Homo sapiens
gtacagtgaaca

SEQ ID NO: 4615084 - DNA, 12 bp, Homo sapiens
gtacagttttta

SEQ ID NO: 4615085 - DNA, 17 bp, Homo sapiens
gtacatgtgtgcagagc

SEQ ID NO: 4615086 - DNA, 18 bp, Homo sapiens
gtacatgtgtgcagagca

SEQ ID NO: 4615087 - DNA, 12 bp, Homo sapiens
gtacattctgcc

SEQ ID NO: 4615088 - DNA, 21 bp, Homo sapiens
gtaccaggtattattatcttt

SEQ ID NO: 4615089 - DNA, 11 bp, Homo sapiens
gtacctgtcca

SEQ ID NO: 4615090 - DNA, 15 bp, Homo sapiens
gtacctgtgtgtttc

SEQ ID NO: 4615091 - DNA, 11 bp, Homo sapiens
gtactctttaa

SEQ ID NO: 4615092 - DNA, 13 bp, Homo sapiens
gtactgcctgctt

SEQ ID NO: 4615093 - DNA, 14 bp, Homo sapiens
gtactgttcataca

SEQ ID NO: 4615094 - DNA, 20 bp, Homo sapiens
gtacttaagctcccctgcct

SEQ ID NO: 4615095 - DNA, 21 bp, Homo sapiens
gtacttaagctcccctgcctt

SEQ ID NO: 4615096 - DNA, 18 bp, Homo sapiens
gtacttcctctgtgaact

SEQ ID NO: 4615097 - DNA, 13 bp, Homo sapiens
gggggccctgcta

SEQ ID NO: 4615098 - DNA, 11 bp, Homo sapiens
gggggcctggc

SEQ ID NO: 4615099 - DNA, 15 bp, Homo sapiens
gggggcggcctatga

SEQ ID NO: 4615100 - DNA, 18 bp, Homo sapiens
ggggtcaagctgagctgg

SEQ ID NO: 4615101 - DNA, 12 bp, Homo sapiens
ggggtcacaccc

SEQ ID NO: 4615102 - DNA, 16 bp, Homo sapiens
ggggtcccatcagtga

SEQ ID NO: 4615103 - DNA, 18 bp, Homo sapiens
ggggtgaatacttatttt

SEQ ID NO: 4615104 - DNA, 21 bp, Homo sapiens
ggggtgacagtcatcatcagg

SEQ ID NO: 4615105 - DNA, 18 bp, Homo sapiens
ggggtgacggccctcatc

SEQ ID NO: 4615106 - DNA, 13 bp, Homo sapiens
ggggtgcacagga

SEQ ID NO: 4615107 - DNA, 14 bp, Homo sapiens
gggtaggccccaca

SEQ ID NO: 4615108 - DNA, 10 bp, Homo sapiens
gggtattttt

SEQ ID NO: 4615109 - DNA, 19 bp, Homo sapiens
gggtcaagaaacagccagc

SEQ ID NO: 4615110 - DNA, 12 bp, Homo sapiens
gggtcaagcctc

SEQ ID NO: 4615111 - DNA, 20 bp, Homo sapiens
gggtcagacccatctctccc

SEQ ID NO: 4615112 - DNA, 18 bp, Homo sapiens
gggtcagccagggcctgc

SEQ ID NO: 4615113 - DNA, 12 bp, Homo sapiens
gggtcggaggtg

SEQ ID NO: 4615114 - DNA, 17 bp, Homo sapiens
gggtctctccctcaggt

SEQ ID NO: 4615115 - DNA, 20 bp, Homo sapiens
gggtctctgtgtgtgtatga

SEQ ID NO: 4615116 - DNA, 13 bp, Homo sapiens
gggtgacagtcat

SEQ ID NO: 4615117 - DNA, 18 bp, Homo sapiens
gggtgacggccctcatct

SEQ ID NO: 4615118 - DNA, 21 bp, Homo sapiens
gggtgatgagggcagcagcca

SEQ ID NO: 4615119 - DNA, 16 bp, Homo sapiens
gggtgcacaggagggg

SEQ ID NO: 4615120 - DNA, 12 bp, Homo sapiens
gggtgctcagaa

SEQ ID NO: 4615121 - DNA, 13 bp, Homo sapiens
gggtgctcagaat

SEQ ID NO: 4615122 - DNA, 18 bp, Homo sapiens
gggtggctactctgtgcc

SEQ ID NO: 4615123 - DNA, 20 bp, Homo sapiens
gggtggctactctgtgccag

SEQ ID NO: 4615124 - DNA, 14 bp, Homo sapiens
gggtgggtgctcag

SEQ ID NO: 4615125 - DNA, 15 bp, Homo sapiens
gggtgggtgctcaga

SEQ ID NO: 4615126 - DNA, 14 bp, Homo sapiens
gggttcaagcttgt

SEQ ID NO: 4615127 - DNA, 16 bp, Homo sapiens
gggtttaagctctgcc

SEQ ID NO: 4615128 - DNA, 22 bp, Homo sapiens
gggtttaagctctgccccttcc

SEQ ID NO: 4615129 - DNA, 23 bp, Homo sapiens
gggtttaagctctgccccttccc

SEQ ID NO: 4615130 - DNA, 20 bp, Homo sapiens
gggttttccaagccctcagc

SEQ ID NO: 4615131 - DNA, 18 bp, Homo sapiens
gggtttttagagaatgtg

SEQ ID NO: 4615132 - DNA, 18 bp, Homo sapiens
ggtaaaacagggccacat

SEQ ID NO: 4615133 - DNA, 17 bp, Homo sapiens
ggtaaaagcagggcagc

SEQ ID NO: 4615134 - DNA, 22 bp, Homo sapiens
ggtaacgagggcaacagggagc

SEQ ID NO: 4615135 - DNA, 12 bp, Homo sapiens
ggtaactgtcct

SEQ ID NO: 4615136 - DNA, 13 bp, Homo sapiens
ggtaactgtcctg

SEQ ID NO: 4615137 - DNA, 14 bp, Homo sapiens
ggtaactgtcctgt

SEQ ID NO: 4615138 - DNA, 17 bp, Homo sapiens
ggtaactgtcctgtcct

SEQ ID NO: 4615139 - DNA, 16 bp, Homo sapiens
ggtacctcaagcccca

SEQ ID NO: 4615140 - DNA, 20 bp, Homo sapiens
ggtactgcattctctcccat

SEQ ID NO: 4615141 - DNA, 14 bp, Homo sapiens
ggtacttcctctgt

SEQ ID NO: 4615142 - DNA, 16 bp, Homo sapiens
ggtacttcctctgtga

SEQ ID NO: 4615143 - DNA, 16 bp, Homo sapiens
ggtagccagcacacag

SEQ ID NO: 4615144 - DNA, 21 bp, Homo sapiens
ggtagccagcacacagggcag

SEQ ID NO: 4615145 - DNA, 18 bp, Homo sapiens
ggtaggttgggacaccag

SEQ ID NO: 4615146 - DNA, 21 bp, Homo sapiens
ggtagtgccgcagtggggtca

SEQ ID NO: 4615147 - DNA, 21 bp, Homo sapiens
ggtattaaacaagtcaattct

SEQ ID NO: 4615148 - DNA, 21 bp, Homo sapiens
ggtattgcagagaagatttta

SEQ ID NO: 4615149 - DNA, 16 bp, Homo sapiens
ggtatttagaagcaga

SEQ ID NO: 4615150 - DNA, 13 bp, Homo sapiens
ggtatttgtttgt

SEQ ID NO: 4615151 - DNA, 18 bp, Homo sapiens
ggtattttgtttctttta

SEQ ID NO: 4615152 - DNA, 14 bp, Homo sapiens
ggtcaagaaacagc

SEQ ID NO: 4615153 - DNA, 11 bp, Homo sapiens
ggtcaagcctc

SEQ ID NO: 4615154 - DNA, 17 bp, Homo sapiens
ggtcaagctgagctggc

SEQ ID NO: 4615155 - DNA, 18 bp, Homo sapiens
ggtcacacccaccccctg

SEQ ID NO: 4615156 - DNA, 14 bp, Homo sapiens
ggtcagacccatct

SEQ ID NO: 4615157 - DNA, 18 bp, Homo sapiens
ggtcagacccatctctcc

SEQ ID NO: 4615158 - DNA, 13 bp, Homo sapiens
ggtcagccagggc

SEQ ID NO: 4615159 - DNA, 19 bp, Homo sapiens
ggtcagccagggcctgcga

SEQ ID NO: 4615160 - DNA, 17 bp, Homo sapiens
ggtcagcccatggaggc

SEQ ID NO: 4615161 - DNA, 16 bp, Homo sapiens
ggtcagggagtgctgg

SEQ ID NO: 4615162 - DNA, 20 bp, Homo sapiens
ggtcagggagtgctggctca

SEQ ID NO: 4615163 - DNA, 11 bp, Homo sapiens
ggtcataaaat

SEQ ID NO: 4615164 - DNA, 12 bp, Homo sapiens
ggtcataaaata

SEQ ID NO: 4615165 - DNA, 15 bp, Homo sapiens
ggtcataaagcattg

SEQ ID NO: 4615166 - DNA, 22 bp, Homo sapiens
ggtcatgaattcatactctgtt

SEQ ID NO: 4615167 - DNA, 13 bp, Homo sapiens
ggtccactcttgt

SEQ ID NO: 4615168 - DNA, 23 bp, Homo sapiens
ggtcccacatccctgggcctgct

SEQ ID NO: 4615169 - DNA, 15 bp, Homo sapiens
ggtcccagccctggg

SEQ ID NO: 4615170 - DNA, 18 bp, Homo sapiens
ggtcccatcagtgaaaga

SEQ ID NO: 4615171 - DNA, 21 bp, Homo sapiens
ggtccgtgcgggaaattcagt

SEQ ID NO: 4615172 - DNA, 23 bp, Homo sapiens
ggtcctctgtcagtcacagccac

SEQ ID NO: 4615173 - DNA, 15 bp, Homo sapiens
ggtcctgagcactgc

SEQ ID NO: 4615174 - DNA, 18 bp, Homo sapiens
ggtcctgagcactgccag

SEQ ID NO: 4615175 - DNA, 19 bp, Homo sapiens
ggtcctgagcactgccagg

SEQ ID NO: 4615176 - DNA, 21 bp, Homo sapiens
ggtcctgagcactgccaggag

SEQ ID NO: 4615177 - DNA, 22 bp, Homo sapiens
ggtcctgagcactgccaggagg

SEQ ID NO: 4615178 - DNA, 19 bp, Homo sapiens
ggtcctggtggggcagctc

SEQ ID NO: 4615179 - DNA, 10 bp, Homo sapiens
ggtccttcaa

SEQ ID NO: 4615180 - DNA, 15 bp, Homo sapiens
ggtcgtggagagcta

SEQ ID NO: 4615181 - DNA, 20 bp, Homo sapiens
ggtcgtggagagctaggagc

SEQ ID NO: 4615182 - DNA, 15 bp, Homo sapiens
ggtctagaccagggc

SEQ ID NO: 4615183 - DNA, 22 bp, Homo sapiens
ggtctcaggatatccttatcag

SEQ ID NO: 4615184 - DNA, 13 bp, Homo sapiens
ggtctcctgggaa

SEQ ID NO: 4615185 - DNA, 23 bp, Homo sapiens
ggtctccttccttcccagaatgt

SEQ ID NO: 4615186 - DNA, 20 bp, Homo sapiens
ggtctctgaagggacccccc

SEQ ID NO: 4615187 - DNA, 19 bp, Homo sapiens
ggtctctgttgactggctg

SEQ ID NO: 4615188 - DNA, 17 bp, Homo sapiens
ggtctgagtctatgttc

SEQ ID NO: 4615189 - DNA, 18 bp, Homo sapiens
ggtctggcccgggcatcc

SEQ ID NO: 4615190 - DNA, 15 bp, Homo sapiens
ggtctgtgtgaatgt

SEQ ID NO: 4615191 - DNA, 16 bp, Homo sapiens
ggtctgtgtgaatgtg

SEQ ID NO: 4615192 - DNA, 21 bp, Homo sapiens
ggtcttgaactcctggactca

SEQ ID NO: 4615193 - DNA, 13 bp, Homo sapiens
ggtcttgggaaat

SEQ ID NO: 4615194 - DNA, 20 bp, Homo sapiens
ggtcttgggaaatatgaatg

SEQ ID NO: 4615195 - DNA, 20 bp, Homo sapiens
ggtctttcagtactttttta

SEQ ID NO: 4615196 - DNA, 21 bp, Homo sapiens
ggtctttgttatgacagtgaa

SEQ ID NO: 4615197 - DNA, 16 bp, Homo sapiens
ggtcttttcatctggg

SEQ ID NO: 4615198 - DNA, 17 bp, Homo sapiens
ggtgaagctatttatct

SEQ ID NO: 4615199 - DNA, 18 bp, Homo sapiens
ggtgaatacttattttca

SEQ ID NO: 4615200 - DNA, 17 bp, Homo sapiens
ggtgacaagatagagag

SEQ ID NO: 4615201 - DNA, 20 bp, Homo sapiens
ggtgacagtcatcatcaggg

SEQ ID NO: 4615202 - DNA, 23 bp, Homo sapiens
ggtgacagtcatcatcagggcct

SEQ ID NO: 4615203 - DNA, 22 bp, Homo sapiens
ggtgaccccagggcacaggagc

SEQ ID NO: 4615204 - DNA, 12 bp, Homo sapiens
ggtgacggccct

SEQ ID NO: 4615205 - DNA, 13 bp, Homo sapiens
ggtgatgagggca

SEQ ID NO: 4615206 - DNA, 19 bp, Homo sapiens
ggtgatgagggcagcagcc

SEQ ID NO: 4615207 - DNA, 18 bp, Homo sapiens
ggtgcatgccgggaccat

SEQ ID NO: 4615208 - DNA, 12 bp, Homo sapiens
ggtgcccaggag

SEQ ID NO: 4615209 - DNA, 20 bp, Homo sapiens
gggcaatggccaggggccag

SEQ ID NO: 4615210 - DNA, 17 bp, Homo sapiens
gggcacaggagctacct

SEQ ID NO: 4615211 - DNA, 14 bp, Homo sapiens
gggcacaggccatg

SEQ ID NO: 4615212 - DNA, 19 bp, Homo sapiens
gggcacccccagcctgggc

SEQ ID NO: 4615213 - DNA, 22 bp, Homo sapiens
gggcactccgcgccgatgccac

SEQ ID NO: 4615214 - DNA, 23 bp, Homo sapiens
gggcactccgcgccgatgccacc

SEQ ID NO: 4615215 - DNA, 13 bp, Homo sapiens
gggcactggccca

SEQ ID NO: 4615216 - DNA, 15 bp, Homo sapiens
gggcactggcccagg

SEQ ID NO: 4615217 - DNA, 14 bp, Homo sapiens
gggcactgggctgt

SEQ ID NO: 4615218 - DNA, 18 bp, Homo sapiens
gggcagactgtgaacttg

SEQ ID NO: 4615219 - DNA, 23 bp, Homo sapiens
gggcagaggaatgtgggctatgt

SEQ ID NO: 4615220 - DNA, 14 bp, Homo sapiens
gggcagagtcctgc

SEQ ID NO: 4615221 - DNA, 16 bp, Homo sapiens
gggcagagtcctgcct

SEQ ID NO: 4615222 - DNA, 15 bp, Homo sapiens
gggcagcacctctgc

SEQ ID NO: 4615223 - DNA, 14 bp, Homo sapiens
gggcagcagccagc

SEQ ID NO: 4615224 - DNA, 17 bp, Homo sapiens
gggcagcagccagccct

SEQ ID NO: 4615225 - DNA, 18 bp, Homo sapiens
gggcagcagccagccctg

SEQ ID NO: 4615226 - DNA, 15 bp, Homo sapiens
gggcagcgccaggct

SEQ ID NO: 4615227 - DNA, 21 bp, Homo sapiens
gggcagcgcccttcctctcca

SEQ ID NO: 4615228 - DNA, 21 bp, Homo sapiens
gggcagcgggagcctccctgc

SEQ ID NO: 4615229 - DNA, 14 bp, Homo sapiens
gggcagctcctctg

SEQ ID NO: 4615230 - DNA, 17 bp, Homo sapiens
gggcagctcctctgtct

SEQ ID NO: 4615231 - DNA, 14 bp, Homo sapiens
gggcaggagtagct

SEQ ID NO: 4615232 - DNA, 15 bp, Homo sapiens
gggcagggaaggaca

SEQ ID NO: 4615233 - DNA, 22 bp, Homo sapiens
gggcagggaaggacaggaccct

SEQ ID NO: 4615234 - DNA, 14 bp, Homo sapiens
gggcaggggcaggg

SEQ ID NO: 4615235 - DNA, 16 bp, Homo sapiens
gggcaggggcaggggc

SEQ ID NO: 4615236 - DNA, 12 bp, Homo sapiens
gggcaggggcgg

SEQ ID NO: 4615237 - DNA, 23 bp, Homo sapiens
gggcaggggcgggcggagggagg

SEQ ID NO: 4615238 - DNA, 21 bp, Homo sapiens
gggcagttcgcagccaccctg

SEQ ID NO: 4615239 - DNA, 23 bp, Homo sapiens
gggcagttcgcagccaccctgag

SEQ ID NO: 4615240 - DNA, 22 bp, Homo sapiens
gggcatccacgtagggggcagg

SEQ ID NO: 4615241 - DNA, 23 bp, Homo sapiens
gggcatgagtctgtttcccaagc

SEQ ID NO: 4615242 - DNA, 14 bp, Homo sapiens
gggcattgctttcc

SEQ ID NO: 4615243 - DNA, 19 bp, Homo sapiens
gggccaccgtgcctggctg

SEQ ID NO: 4615244 - DNA, 11 bp, Homo sapiens
gggccactggg

SEQ ID NO: 4615245 - DNA, 22 bp, Homo sapiens
gggccactggggactttattta

SEQ ID NO: 4615246 - DNA, 14 bp, Homo sapiens
gggccagagcagct

SEQ ID NO: 4615247 - DNA, 13 bp, Homo sapiens
gggccaggcctgg

SEQ ID NO: 4615248 - DNA, 20 bp, Homo sapiens
gggccagggctgccctgaga

SEQ ID NO: 4615249 - DNA, 18 bp, Homo sapiens
gggccagtgctccagcca

SEQ ID NO: 4615250 - DNA, 19 bp, Homo sapiens
gggccagtggggcctgtgg

SEQ ID NO: 4615251 - DNA, 19 bp, Homo sapiens
gggccatctgactgccaag

SEQ ID NO: 4615252 - DNA, 21 bp, Homo sapiens
gggccatctgactgccaagcc

SEQ ID NO: 4615253 - DNA, 24 bp, Homo sapiens
gggccatctgactgccaagccaga

SEQ ID NO: 4615254 - DNA, 16 bp, Homo sapiens
gggccattctccacag

SEQ ID NO: 4615255 - DNA, 18 bp, Homo sapiens
gggccattctccacagca

SEQ ID NO: 4615256 - DNA, 21 bp, Homo sapiens
gggccccatcctcatccctga

SEQ ID NO: 4615257 - DNA, 18 bp, Homo sapiens
gggccccgggctggagaa

SEQ ID NO: 4615258 - DNA, 21 bp, Homo sapiens
gggccctcccagcccattgct

SEQ ID NO: 4615259 - DNA, 13 bp, Homo sapiens
gggccctctttcc

SEQ ID NO: 4615260 - DNA, 9 bp, Homo sapiens
gggccctgc

SEQ ID NO: 4615261 - DNA, 21 bp, Homo sapiens
gggccgccacggcctggctgg

SEQ ID NO: 4615262 - DNA, 17 bp, Homo sapiens
gggccggggaactggcc

SEQ ID NO: 4615263 - DNA, 19 bp, Homo sapiens
gggccggggaactggccaa

SEQ ID NO: 4615264 - DNA, 14 bp, Homo sapiens
gggcctatggagag

SEQ ID NO: 4615265 - DNA, 18 bp, Homo sapiens
gggcctatggagagccct

SEQ ID NO: 4615266 - DNA, 16 bp, Homo sapiens
gggcctcaggctctgc

SEQ ID NO: 4615267 - DNA, 13 bp, Homo sapiens
gggcctcattgtg

SEQ ID NO: 4615268 - DNA, 14 bp, Homo sapiens
gggcctgagagaat

SEQ ID NO: 4615269 - DNA, 16 bp, Homo sapiens
gggcctgcagaaggaa

SEQ ID NO: 4615270 - DNA, 13 bp, Homo sapiens
gggcctgctgctg

SEQ ID NO: 4615271 - DNA, 16 bp, Homo sapiens
gggcctgctgctgaga

SEQ ID NO: 4615272 - DNA, 23 bp, Homo sapiens
gggcctgctgtcacctcgctggg

SEQ ID NO: 4615273 - DNA, 14 bp, Homo sapiens
gggcctggagcccc

SEQ ID NO: 4615274 - DNA, 12 bp, Homo sapiens
gggcctggcata

SEQ ID NO: 4615275 - DNA, 14 bp, Homo sapiens
gggcctggctggct

SEQ ID NO: 4615276 - DNA, 16 bp, Homo sapiens
gggcctggggcctgag

SEQ ID NO: 4615277 - DNA, 13 bp, Homo sapiens
gggcctgggggtt

SEQ ID NO: 4615278 - DNA, 16 bp, Homo sapiens
gggcctgtactgcctg

SEQ ID NO: 4615279 - DNA, 20 bp, Homo sapiens
gggcctgtactgcctgcttg

SEQ ID NO: 4615280 - DNA, 21 bp, Homo sapiens
gggccttagggcactgggctg

SEQ ID NO: 4615281 - DNA, 22 bp, Homo sapiens
gggcggcctatgacttgggcac

SEQ ID NO: 4615282 - DNA, 23 bp, Homo sapiens
gggctctaacgcctgagcccagg

SEQ ID NO: 4615283 - DNA, 20 bp, Homo sapiens
gggctctaaggtactgtggg

SEQ ID NO: 4615284 - DNA, 17 bp, Homo sapiens
gggctctcaaagtataa

SEQ ID NO: 4615285 - DNA, 22 bp, Homo sapiens
gggctctcatggtacttcctct

SEQ ID NO: 4615286 - DNA, 18 bp, Homo sapiens
gggctctgccccaggccc

SEQ ID NO: 4615287 - DNA, 16 bp, Homo sapiens
gggctgacccagcatc

SEQ ID NO: 4615288 - DNA, 20 bp, Homo sapiens
gggctgctctttccacttgc

SEQ ID NO: 4615289 - DNA, 19 bp, Homo sapiens
gggctggagaaagagctgc

SEQ ID NO: 4615290 - DNA, 20 bp, Homo sapiens
gggctggagaaagagctgcc

SEQ ID NO: 4615291 - DNA, 12 bp, Homo sapiens
gggctggggagg

SEQ ID NO: 4615292 - DNA, 16 bp, Homo sapiens
gggctggggaggagga

SEQ ID NO: 4615293 - DNA, 13 bp, Homo sapiens
gggctggtcacct

SEQ ID NO: 4615294 - DNA, 23 bp, Homo sapiens
gggctggttctgtaattgtgtgt

SEQ ID NO: 4615295 - DNA, 16 bp, Homo sapiens
gggcttacggccctgg

SEQ ID NO: 4615296 - DNA, 19 bp, Homo sapiens
ggggaaggaaggagggcac

SEQ ID NO: 4615297 - DNA, 19 bp, Homo sapiens
ggggaatgagcccagagaa

SEQ ID NO: 4615298 - DNA, 23 bp, Homo sapiens
ggggacagagcaagaccctgcct

SEQ ID NO: 4615299 - DNA, 14 bp, Homo sapiens
ggggagaggggtca

SEQ ID NO: 4615300 - DNA, 17 bp, Homo sapiens
ggggagaggtcagcctt

SEQ ID NO: 4615301 - DNA, 22 bp, Homo sapiens
ggggagcagtggccatcatcct

SEQ ID NO: 4615302 - DNA, 12 bp, Homo sapiens
ggggaggagcct

SEQ ID NO: 4615303 - DNA, 14 bp, Homo sapiens
ggggatagtctggg

SEQ ID NO: 4615304 - DNA, 14 bp, Homo sapiens
ggggatccagccac

SEQ ID NO: 4615305 - DNA, 18 bp, Homo sapiens
ggggattgcagagtgacc

SEQ ID NO: 4615306 - DNA, 13 bp, Homo sapiens
ggggcaagctagg

SEQ ID NO: 4615307 - DNA, 17 bp, Homo sapiens
ggggcaggagtagctga

SEQ ID NO: 4615308 - DNA, 13 bp, Homo sapiens
ggggcaggggcag

SEQ ID NO: 4615309 - DNA, 19 bp, Homo sapiens
ggggccaggagtggggaga

SEQ ID NO: 4615310 - DNA, 14 bp, Homo sapiens
ggggccccgccagg

SEQ ID NO: 4615311 - DNA, 22 bp, Homo sapiens
ggggccccgccagggctgggga

SEQ ID NO: 4615312 - DNA, 21 bp, Homo sapiens
ggggcctgcagaaggaaagaa

SEQ ID NO: 4615313 - DNA, 15 bp, Homo sapiens
ggggcctgtactgcc

SEQ ID NO: 4615314 - DNA, 17 bp, Homo sapiens
ggggcctgtactgcctg

SEQ ID NO: 4615315 - DNA, 12 bp, Homo sapiens
ggggcctgtgga

SEQ ID NO: 4615316 - DNA, 17 bp, Homo sapiens
ggggctatcctgggacc

SEQ ID NO: 4615317 - DNA, 22 bp, Homo sapiens
ggggctctaacgcctgagccca

SEQ ID NO: 4615318 - DNA, 19 bp, Homo sapiens
ggggctctgccccaggccc

SEQ ID NO: 4615319 - DNA, 22 bp, Homo sapiens
gggggagccggtaactgtcctg

SEQ ID NO: 4615320 - DNA, 15 bp, Homo sapiens
ggctctaacgcctga

SEQ ID NO: 4615321 - DNA, 16 bp, Homo sapiens
ggctctaacgcctgag

SEQ ID NO: 4615322 - DNA, 20 bp, Homo sapiens
ggctctaaggtactgtgggg

SEQ ID NO: 4615323 - DNA, 16 bp, Homo sapiens
ggctctagccccagcg

SEQ ID NO: 4615324 - DNA, 17 bp, Homo sapiens
ggctctcctggcttccc

SEQ ID NO: 4615325 - DNA, 20 bp, Homo sapiens
ggctctctgagtcctggccc

SEQ ID NO: 4615326 - DNA, 14 bp, Homo sapiens
ggctctgaggcgcc

SEQ ID NO: 4615327 - DNA, 19 bp, Homo sapiens
ggctctgcacagacaagca

SEQ ID NO: 4615328 - DNA, 20 bp, Homo sapiens
ggctctgcacagacaagcag

SEQ ID NO: 4615329 - DNA, 19 bp, Homo sapiens
ggctctgctggccggagca

SEQ ID NO: 4615330 - DNA, 12 bp, Homo sapiens
ggctctggactc

SEQ ID NO: 4615331 - DNA, 13 bp, Homo sapiens
ggctctggactcc

SEQ ID NO: 4615332 - DNA, 14 bp, Homo sapiens
ggctctggactcca

SEQ ID NO: 4615333 - DNA, 17 bp, Homo sapiens
ggctctgggtgctgccc

SEQ ID NO: 4615334 - DNA, 18 bp, Homo sapiens
ggctctgggtgctgccct

SEQ ID NO: 4615335 - DNA, 13 bp, Homo sapiens
ggctgaaagacag

SEQ ID NO: 4615336 - DNA, 16 bp, Homo sapiens
ggctgaccacagcaca

SEQ ID NO: 4615337 - DNA, 17 bp, Homo sapiens
ggctgaccacagcacag

SEQ ID NO: 4615338 - DNA, 18 bp, Homo sapiens
ggctgattcctctcattt

SEQ ID NO: 4615339 - DNA, 13 bp, Homo sapiens
ggctgccctgaga

SEQ ID NO: 4615340 - DNA, 21 bp, Homo sapiens
ggctgccctgagaagctgctc

SEQ ID NO: 4615341 - DNA, 24 bp, Homo sapiens
ggctgccctgagaagctgctccag

SEQ ID NO: 4615342 - DNA, 19 bp, Homo sapiens
ggctgcctgtgggcttccc

SEQ ID NO: 4615343 - DNA, 17 bp, Homo sapiens
ggctgctgcacaccaag

SEQ ID NO: 4615344 - DNA, 13 bp, Homo sapiens
ggctggagaaaga

SEQ ID NO: 4615345 - DNA, 21 bp, Homo sapiens
ggctggagaaagagctgcctg

SEQ ID NO: 4615346 - DNA, 23 bp, Homo sapiens
ggctggagaaagagctgcctgga

SEQ ID NO: 4615347 - DNA, 13 bp, Homo sapiens
ggctggagaagga

SEQ ID NO: 4615348 - DNA, 20 bp, Homo sapiens
ggctggcctcccaaatgagc

SEQ ID NO: 4615349 - DNA, 12 bp, Homo sapiens
ggctggctgagg

SEQ ID NO: 4615350 - DNA, 18 bp, Homo sapiens
ggctgggacgtggctcag

SEQ ID NO: 4615351 - DNA, 21 bp, Homo sapiens
ggctgggccctctttccctgc

SEQ ID NO: 4615352 - DNA, 17 bp, Homo sapiens
ggctggggaggaggaga

SEQ ID NO: 4615353 - DNA, 14 bp, Homo sapiens
ggctgtatttgctg

SEQ ID NO: 4615354 - DNA, 14 bp, Homo sapiens
ggctgtcatctgtg

SEQ ID NO: 4615355 - DNA, 12 bp, Homo sapiens
ggctgtggaagg

SEQ ID NO: 4615356 - DNA, 13 bp, Homo sapiens
ggctgttgcatgg

SEQ ID NO: 4615357 - DNA, 14 bp, Homo sapiens
ggctgtttcatcag

SEQ ID NO: 4615358 - DNA, 15 bp, Homo sapiens
ggcttaagaactgct

SEQ ID NO: 4615359 - DNA, 14 bp, Homo sapiens
ggcttaatcatttt

SEQ ID NO: 4615360 - DNA, 16 bp, Homo sapiens
ggcttacggccctggc

SEQ ID NO: 4615361 - DNA, 11 bp, Homo sapiens
ggcttcatttc

SEQ ID NO: 4615362 - DNA, 15 bp, Homo sapiens
ggcttcatttcaatc

SEQ ID NO: 4615363 - DNA, 17 bp, Homo sapiens
ggcttcccatccccagc

SEQ ID NO: 4615364 - DNA, 18 bp, Homo sapiens
ggcttcccatccccagcg

SEQ ID NO: 4615365 - DNA, 14 bp, Homo sapiens
ggcttctcctcctc

SEQ ID NO: 4615366 - DNA, 13 bp, Homo sapiens
ggcttctctctca

SEQ ID NO: 4615367 - DNA, 17 bp, Homo sapiens
ggctttatgcaaataca

SEQ ID NO: 4615368 - DNA, 11 bp, Homo sapiens
ggctttcatgt

SEQ ID NO: 4615369 - DNA, 17 bp, Homo sapiens
ggctttttgccatctgt

SEQ ID NO: 4615370 - DNA, 22 bp, Homo sapiens
gggaaaactgccaatatagaaa

SEQ ID NO: 4615371 - DNA, 16 bp, Homo sapiens
gggaaatgtacacttt

SEQ ID NO: 4615372 - DNA, 18 bp, Homo sapiens
gggaaatgtacacttttt

SEQ ID NO: 4615373 - DNA, 21 bp, Homo sapiens
gggaaccactcccaccacagg

SEQ ID NO: 4615374 - DNA, 13 bp, Homo sapiens
gggaactggccaa

SEQ ID NO: 4615375 - DNA, 19 bp, Homo sapiens
gggaactggccaagctgag

SEQ ID NO: 4615376 - DNA, 21 bp, Homo sapiens
gggaactggccaagctgaggt

SEQ ID NO: 4615377 - DNA, 14 bp, Homo sapiens
gggaagagtagctg

SEQ ID NO: 4615378 - DNA, 23 bp, Homo sapiens
gggaaggacaggaccctcaggaa

SEQ ID NO: 4615379 - DNA, 20 bp, Homo sapiens
gggaaggagacaggatgagg

SEQ ID NO: 4615380 - DNA, 22 bp, Homo sapiens
gggaaggccggcagcgggcgga

SEQ ID NO: 4615381 - DNA, 16 bp, Homo sapiens
gggaagtagtccttgg

SEQ ID NO: 4615382 - DNA, 18 bp, Homo sapiens
gggaatgagcccagagaa

SEQ ID NO: 4615383 - DNA, 13 bp, Homo sapiens
gggaatgggactg

SEQ ID NO: 4615384 - DNA, 14 bp, Homo sapiens
gggaattctcttgg

SEQ ID NO: 4615385 - DNA, 13 bp, Homo sapiens
gggacaagcaggc

SEQ ID NO: 4615386 - DNA, 19 bp, Homo sapiens
gggacaagtggactcaggg

SEQ ID NO: 4615387 - DNA, 22 bp, Homo sapiens
gggacacaacacagataatttt

SEQ ID NO: 4615388 - DNA, 14 bp, Homo sapiens
gggaccccagctgc

SEQ ID NO: 4615389 - DNA, 21 bp, Homo sapiens
gggaccgctacaccactctgg

SEQ ID NO: 4615390 - DNA, 18 bp, Homo sapiens
gggaccggtgctgcagga

SEQ ID NO: 4615391 - DNA, 17 bp, Homo sapiens
gggacctataactgccc

SEQ ID NO: 4615392 - DNA, 16 bp, Homo sapiens
gggacctccccagccc

SEQ ID NO: 4615393 - DNA, 18 bp, Homo sapiens
gggacctccccagcccag

SEQ ID NO: 4615394 - DNA, 19 bp, Homo sapiens
gggacctccccagcccagg

SEQ ID NO: 4615395 - DNA, 14 bp, Homo sapiens
gggacgtggctcag

SEQ ID NO: 4615396 - DNA, 17 bp, Homo sapiens
gggactgccaggctgtt

SEQ ID NO: 4615397 - DNA, 23 bp, Homo sapiens
gggactgtcctagccaggtctcc

SEQ ID NO: 4615398 - DNA, 15 bp, Homo sapiens
gggactgtcgctgct

SEQ ID NO: 4615399 - DNA, 22 bp, Homo sapiens
gggactgtggtgacttctgctg

SEQ ID NO: 4615400 - DNA, 17 bp, Homo sapiens
gggactttcccacccag

SEQ ID NO: 4615401 - DNA, 14 bp, Homo sapiens
gggagaagaaagaa

SEQ ID NO: 4615402 - DNA, 19 bp, Homo sapiens
gggagacctcagaagtaaa

SEQ ID NO: 4615403 - DNA, 19 bp, Homo sapiens
gggagaggtcaccagctgc

SEQ ID NO: 4615404 - DNA, 23 bp, Homo sapiens
gggagagttgtgatggaggggag

SEQ ID NO: 4615405 - DNA, 17 bp, Homo sapiens
gggagatgtcaggatgt

SEQ ID NO: 4615406 - DNA, 17 bp, Homo sapiens
gggagattcaagggacc

SEQ ID NO: 4615407 - DNA, 20 bp, Homo sapiens
gggagcacggactgtcagtt

SEQ ID NO: 4615408 - DNA, 20 bp, Homo sapiens
gggagccggtaactgtcctg

SEQ ID NO: 4615409 - DNA, 12 bp, Homo sapiens
gggagcctccct

SEQ ID NO: 4615410 - DNA, 16 bp, Homo sapiens
gggagctgcaggggca

SEQ ID NO: 4615411 - DNA, 24 bp, Homo sapiens
gggaggaaatttgaatgggtccat

SEQ ID NO: 4615412 - DNA, 16 bp, Homo sapiens
gggaggacaaaacttc

SEQ ID NO: 4615413 - DNA, 22 bp, Homo sapiens
gggaggagcctgtgcgtcccag

SEQ ID NO: 4615414 - DNA, 12 bp, Homo sapiens
gggagggctctg

SEQ ID NO: 4615415 - DNA, 14 bp, Homo sapiens
gggagggctctgag

SEQ ID NO: 4615416 - DNA, 20 bp, Homo sapiens
gggagggctctgaggcgccc

SEQ ID NO: 4615417 - DNA, 17 bp, Homo sapiens
gggagtgtactcccagg

SEQ ID NO: 4615418 - DNA, 18 bp, Homo sapiens
gggagtgtactcccaggg

SEQ ID NO: 4615419 - DNA, 16 bp, Homo sapiens
gggagttttgctctct

SEQ ID NO: 4615420 - DNA, 17 bp, Homo sapiens
gggatagtctgggtcag

SEQ ID NO: 4615421 - DNA, 20 bp, Homo sapiens
gggatcacagcctcacccct

SEQ ID NO: 4615422 - DNA, 14 bp, Homo sapiens
gggatccagccact

SEQ ID NO: 4615423 - DNA, 16 bp, Homo sapiens
gggatgctgggctggg

SEQ ID NO: 4615424 - DNA, 21 bp, Homo sapiens
gggatggggtggggggacagg

SEQ ID NO: 4615425 - DNA, 20 bp, Homo sapiens
gggatggtcggatctcacag

SEQ ID NO: 4615426 - DNA, 16 bp, Homo sapiens
gggatgtctgttgaaa

SEQ ID NO: 4615427 - DNA, 22 bp, Homo sapiens
gggatttcaccactcaaaggcc

SEQ ID NO: 4615428 - DNA, 13 bp, Homo sapiens
gggcaagaggatg

SEQ ID NO: 4615429 - DNA, 14 bp, Homo sapiens
gggcaagccctgcc

SEQ ID NO: 4615430 - DNA, 23 bp, Homo sapiens
gggcaagctaggccccagaggcc

SEQ ID NO: 4615431 - DNA, 17 bp, Homo sapiens
gggcaatggccaggggc

SEQ ID NO: 4615432 - DNA, 13 bp, Homo sapiens
gtgggtctctgaa

SEQ ID NO: 4615433 - DNA, 20 bp, Homo sapiens
gtggtacttaagctcccctg

SEQ ID NO: 4615434 - DNA, 18 bp, Homo sapiens
gtggtctagaccagggct

SEQ ID NO: 4615435 - DNA, 15 bp, Homo sapiens
gtggtgcattcctga

SEQ ID NO: 4615436 - DNA, 13 bp, Homo sapiens
gtggtggcctcag

SEQ ID NO: 4615437 - DNA, 14 bp, Homo sapiens
gtggtggcctcagc

SEQ ID NO: 4615438 - DNA, 22 bp, Homo sapiens
gtggttttattacaaatgcaaa

SEQ ID NO: 4615439 - DNA, 19 bp, Homo sapiens
gtgtaaatagttactccag

SEQ ID NO: 4615440 - DNA, 13 bp, Homo sapiens
gtgtacaaagaaa

SEQ ID NO: 4615441 - DNA, 18 bp, Homo sapiens
gtgtacaaatacatgtgt

SEQ ID NO: 4615442 - DNA, 22 bp, Homo sapiens
gtgtacaaattgtcgtttttat

SEQ ID NO: 4615443 - DNA, 22 bp, Homo sapiens
gtgtacagtcttgtattaagtt

SEQ ID NO: 4615444 - DNA, 18 bp, Homo sapiens
gtgtacatgtgtgcagag

SEQ ID NO: 4615445 - DNA, 16 bp, Homo sapiens
gtgtagcctaaagggc

SEQ ID NO: 4615446 - DNA, 14 bp, Homo sapiens
gtgtagcctgtgca

SEQ ID NO: 4615447 - DNA, 19 bp, Homo sapiens
gtgtagctgtaagggcagt

SEQ ID NO: 4615448 - DNA, 15 bp, Homo sapiens
gtgtagctgtgacct

SEQ ID NO: 4615449 - DNA, 16 bp, Homo sapiens
gtgtagctgtgacctg

SEQ ID NO: 4615450 - DNA, 20 bp, Homo sapiens
gtgtagctgtgacctgctga

SEQ ID NO: 4615451 - DNA, 22 bp, Homo sapiens
gtgtagctgtgacctgctgagc

SEQ ID NO: 4615452 - DNA, 18 bp, Homo sapiens
gtgtagttccctctgcct

SEQ ID NO: 4615453 - DNA, 15 bp, Homo sapiens
gtgtatattcctttt

SEQ ID NO: 4615454 - DNA, 17 bp, Homo sapiens
gtgtatttctctgtgaa

SEQ ID NO: 4615455 - DNA, 18 bp, Homo sapiens
gtgtatttctctgtgaat

SEQ ID NO: 4615456 - DNA, 17 bp, Homo sapiens
gtgtcacctccttcccc

SEQ ID NO: 4615457 - DNA, 21 bp, Homo sapiens
gtgtcagttcaactttcagaa

SEQ ID NO: 4615458 - DNA, 17 bp, Homo sapiens
gtgtcatttcattccat

SEQ ID NO: 4615459 - DNA, 16 bp, Homo sapiens
gtgtccacctgtgggt

SEQ ID NO: 4615460 - DNA, 16 bp, Homo sapiens
gtgtccctctctctgg

SEQ ID NO: 4615461 - DNA, 21 bp, Homo sapiens
gtgtcctgtagttgcgtggac

SEQ ID NO: 4615462 - DNA, 23 bp, Homo sapiens
gtgtctatgatgttgctgttcac

SEQ ID NO: 4615463 - DNA, 13 bp, Homo sapiens
gtgtctgcacagg

SEQ ID NO: 4615464 - DNA, 19 bp, Homo sapiens
gtgtctgggctcaagcttt

SEQ ID NO: 4615465 - DNA, 23 bp, Homo sapiens
gtgtctgggctcaagctttcccg

SEQ ID NO: 4615466 - DNA, 20 bp, Homo sapiens
gtgtgaagtacaataattca

SEQ ID NO: 4615467 - DNA, 15 bp, Homo sapiens
gtgtgaatgtgggca

SEQ ID NO: 4615468 - DNA, 21 bp, Homo sapiens
gtgtgaatgtgggcactggcc

SEQ ID NO: 4615469 - DNA, 22 bp, Homo sapiens
gtgtgacaattctgtttttaat

SEQ ID NO: 4615470 - DNA, 14 bp, Homo sapiens
gtgtgacagggcca

SEQ ID NO: 4615471 - DNA, 17 bp, Homo sapiens
gtgtgacagtgtatggg

SEQ ID NO: 4615472 - DNA, 18 bp, Homo sapiens
gtgtgacagtttccaaat

SEQ ID NO: 4615473 - DNA, 19 bp, Homo sapiens
gtgtgataaaatgttgaac

SEQ ID NO: 4615474 - DNA, 14 bp, Homo sapiens
gtgtgccctgtgtg

SEQ ID NO: 4615475 - DNA, 22 bp, Homo sapiens
gtgtgcctgtctgttacactgg

SEQ ID NO: 4615476 - DNA, 13 bp, Homo sapiens
gtgtggacaggac

SEQ ID NO: 4615477 - DNA, 20 bp, Homo sapiens
gtgtgggccaccgtgcctgg

SEQ ID NO: 4615478 - DNA, 13 bp, Homo sapiens
gtgtggtggcctc

SEQ ID NO: 4615479 - DNA, 20 bp, Homo sapiens
gtgtgtacaaatacatgtgt

SEQ ID NO: 4615480 - DNA, 19 bp, Homo sapiens
gtgtgtgggccaccgtgcc

SEQ ID NO: 4615481 - DNA, 15 bp, Homo sapiens
gtgtgtgtggcaggg

SEQ ID NO: 4615482 - DNA, 14 bp, Homo sapiens
gtgttacagaggac

SEQ ID NO: 4615483 - DNA, 18 bp, Homo sapiens
gtgttactgctttgcaaa

SEQ ID NO: 4615484 - DNA, 20 bp, Homo sapiens
gtgttactgctttgcaaaga

SEQ ID NO: 4615485 - DNA, 20 bp, Homo sapiens
gtgttcagctctttccaaat

SEQ ID NO: 4615486 - DNA, 17 bp, Homo sapiens
gtgttcctcagtagctt

SEQ ID NO: 4615487 - DNA, 18 bp, Homo sapiens
gtgttctgtttgaaacta

SEQ ID NO: 4615488 - DNA, 16 bp, Homo sapiens
gtgttggcaaacgaga

SEQ ID NO: 4615489 - DNA, 23 bp, Homo sapiens
gtgttgtatctacagtaatgaaa

SEQ ID NO: 4615490 - DNA, 20 bp, Homo sapiens
gtgttgtgaaactgtaaatt

SEQ ID NO: 4615491 - DNA, 23 bp, Homo sapiens
gtgtttaacggcactgtggcctt

SEQ ID NO: 4615492 - DNA, 20 bp, Homo sapiens
gtgtttgcagcctgctctag

SEQ ID NO: 4615493 - DNA, 19 bp, Homo sapiens
gttaaacttacttagtgtt

SEQ ID NO: 4615494 - DNA, 15 bp, Homo sapiens
gttaaataactgtgt

SEQ ID NO: 4615495 - DNA, 14 bp, Homo sapiens
gttaactacatatt

SEQ ID NO: 4615496 - DNA, 15 bp, Homo sapiens
gttaacttgcctcca

SEQ ID NO: 4615497 - DNA, 17 bp, Homo sapiens
gttaagaatgaagttct

SEQ ID NO: 4615498 - DNA, 21 bp, Homo sapiens
gttaagaatgaagttctgcta

SEQ ID NO: 4615499 - DNA, 22 bp, Homo sapiens
gttaaggacccttttaagcatg

SEQ ID NO: 4615500 - DNA, 23 bp, Homo sapiens
gttaaggacccttttaagcatgt

SEQ ID NO: 4615501 - DNA, 17 bp, Homo sapiens
gttaatgatggcagagg

SEQ ID NO: 4615502 - DNA, 18 bp, Homo sapiens
gttaatgatggcagagga

SEQ ID NO: 4615503 - DNA, 15 bp, Homo sapiens
gttaatgtggactgg

SEQ ID NO: 4615504 - DNA, 22 bp, Homo sapiens
gttacactggaggagagaagaa

SEQ ID NO: 4615505 - DNA, 23 bp, Homo sapiens
gttacactggaggagagaagaat

SEQ ID NO: 4615506 - DNA, 16 bp, Homo sapiens
gttacagccaagtgcc

SEQ ID NO: 4615507 - DNA, 23 bp, Homo sapiens
gttacagccaagtgccaaatgct

SEQ ID NO: 4615508 - DNA, 20 bp, Homo sapiens
gttacccagggtggagtgca

SEQ ID NO: 4615509 - DNA, 22 bp, Homo sapiens
gttactccagtgccaacaatcc

SEQ ID NO: 4615510 - DNA, 15 bp, Homo sapiens
gttagaaaatgactt

SEQ ID NO: 4615511 - DNA, 21 bp, Homo sapiens
gttagaaaatgacttatttct

SEQ ID NO: 4615512 - DNA, 12 bp, Homo sapiens
gttagaaagtgc

SEQ ID NO: 4615513 - DNA, 19 bp, Homo sapiens
gttagaatgagatctgaat

SEQ ID NO: 4615514 - DNA, 14 bp, Homo sapiens
gttaggttacagat

SEQ ID NO: 4615515 - DNA, 14 bp, Homo sapiens
gttatattcacagt

SEQ ID NO: 4615516 - DNA, 18 bp, Homo sapiens
gttatcccaatcattgtt

SEQ ID NO: 4615517 - DNA, 21 bp, Homo sapiens
gttatcggacattctaatgca

SEQ ID NO: 4615518 - DNA, 22 bp, Homo sapiens
gttatcggacattctaatgcat

SEQ ID NO: 4615519 - DNA, 14 bp, Homo sapiens
gttatcttgttatt

SEQ ID NO: 4615520 - DNA, 18 bp, Homo sapiens
gttatcttgttattattg

SEQ ID NO: 4615521 - DNA, 13 bp, Homo sapiens
gttatttaagcat

SEQ ID NO: 4615522 - DNA, 24 bp, Homo sapiens
gttattttaatacctttaaatatc

SEQ ID NO: 4615523 - DNA, 12 bp, Homo sapiens
gttcaaaatcat

SEQ ID NO: 4615524 - DNA, 19 bp, Homo sapiens
gttcaaagactgtgaacag

SEQ ID NO: 4615525 - DNA, 15 bp, Homo sapiens
gttcaagcagttctc

SEQ ID NO: 4615526 - DNA, 15 bp, Homo sapiens
gttcacagcttttct

SEQ ID NO: 4615527 - DNA, 16 bp, Homo sapiens
gttcacagcttttctt

SEQ ID NO: 4615528 - DNA, 18 bp, Homo sapiens
gttcacagcttttcttga

SEQ ID NO: 4615529 - DNA, 21 bp, Homo sapiens
gttcacgtaatcctcctgagt

SEQ ID NO: 4615530 - DNA, 15 bp, Homo sapiens
gttcagacaagacag

SEQ ID NO: 4615531 - DNA, 13 bp, Homo sapiens
gttcagctactcc

SEQ ID NO: 4615532 - DNA, 16 bp, Homo sapiens
gttcatacagttttat

SEQ ID NO: 4615533 - DNA, 17 bp, Homo sapiens
gttcatatttattgatt

SEQ ID NO: 4615534 - DNA, 20 bp, Homo sapiens
gttcatcaccatttcctcct

SEQ ID NO: 4615535 - DNA, 19 bp, Homo sapiens
gttcattgtaaaaattttt

SEQ ID NO: 4615536 - DNA, 15 bp, Homo sapiens
gttcatttagataat

SEQ ID NO: 4615537 - DNA, 20 bp, Homo sapiens
gttcattttgagtattttta

SEQ ID NO: 4615538 - DNA, 19 bp, Homo sapiens
gttccaaaagccaatggct

SEQ ID NO: 4615539 - DNA, 19 bp, Homo sapiens
gttccagattcctatgatg

SEQ ID NO: 4615540 - DNA, 22 bp, Homo sapiens
gttccattgaagccgactctgg

SEQ ID NO: 4615541 - DNA, 21 bp, Homo sapiens
gttcccaagagcatcatgcct

SEQ ID NO: 4615542 - DNA, 23 bp, Homo sapiens
gttcccaagagcatcatgcctct

SEQ ID NO: 4615543 - DNA, 19 bp, Homo sapiens
gttcccacaagcctgcctc

SEQ ID NO: 4615544 - DNA, 20 bp, Homo sapiens
gttcccacaagcctgcctcg

SEQ ID NO: 4615545 - DNA, 15 bp, Homo sapiens
gttcccttcctcttc

SEQ ID NO: 4615546 - DNA, 22 bp, Homo sapiens
gttcccttcctcttcctgccct

SEQ ID NO: 4615547 - DNA, 18 bp, Homo sapiens
gttcctgcagcagagcct

SEQ ID NO: 4615548 - DNA, 15 bp, Homo sapiens
gttcctgctgcctgg

SEQ ID NO: 4615549 - DNA, 15 bp, Homo sapiens
gttcctggctcagcc

SEQ ID NO: 4615550 - DNA, 20 bp, Homo sapiens
gttcctgttcagtaataaaa

SEQ ID NO: 4615551 - DNA, 19 bp, Homo sapiens
gttcgcagccaccctgagg

SEQ ID NO: 4615552 - DNA, 18 bp, Homo sapiens
gttctaacttatttataa

SEQ ID NO: 4615553 - DNA, 15 bp, Homo sapiens
gttctactccttccc

SEQ ID NO: 4615554 - DNA, 18 bp, Homo sapiens
gttctagacctctggtta

SEQ ID NO: 4615555 - DNA, 17 bp, Homo sapiens
gttctatttttcaatca

SEQ ID NO: 4615556 - DNA, 21 bp, Homo sapiens
gttctcaacatactgtaatca

SEQ ID NO: 4615557 - DNA, 15 bp, Homo sapiens
gttctgagaaggtga

SEQ ID NO: 4615558 - DNA, 14 bp, Homo sapiens
gttctgcttgctcc

SEQ ID NO: 4615559 - DNA, 23 bp, Homo sapiens
gttctgcttgctcccaagcccct

SEQ ID NO: 4615560 - DNA, 14 bp, Homo sapiens
gttctgtcttccca

SEQ ID NO: 4615561 - DNA, 13 bp, Homo sapiens
gttctgttctcat

SEQ ID NO: 4615562 - DNA, 17 bp, Homo sapiens
gttcttatgcaaaatgg

SEQ ID NO: 4615563 - DNA, 20 bp, Homo sapiens
gttctttcctccccctgcaa

SEQ ID NO: 4615564 - DNA, 11 bp, Homo sapiens
gttctttgttt

SEQ ID NO: 4615565 - DNA, 15 bp, Homo sapiens
gttcttttctctctt

SEQ ID NO: 4615566 - DNA, 12 bp, Homo sapiens
gttcttttgcat

SEQ ID NO: 4615567 - DNA, 22 bp, Homo sapiens
gttgaaacttacactgtttcat

SEQ ID NO: 4615568 - DNA, 14 bp, Homo sapiens
gttgcagcccaagg

SEQ ID NO: 4615569 - DNA, 14 bp, Homo sapiens
gttgcagtctttcc

SEQ ID NO: 4615570 - DNA, 19 bp, Homo sapiens
gttgcagtctttcccccag

SEQ ID NO: 4615571 - DNA, 12 bp, Homo sapiens
gttgcctcctct

SEQ ID NO: 4615572 - DNA, 16 bp, Homo sapiens
gttgcctcctctctcc

SEQ ID NO: 4615573 - DNA, 20 bp, Homo sapiens
gttgcctcctctctccctgc

SEQ ID NO: 4615574 - DNA, 21 bp, Homo sapiens
gttgctcaccgactcacctgc

SEQ ID NO: 4615575 - DNA, 14 bp, Homo sapiens
gttgctctttcacc

SEQ ID NO: 4615576 - DNA, 20 bp, Homo sapiens
gttggacatttttttcgaat

SEQ ID NO: 4615577 - DNA, 19 bp, Homo sapiens
gttggagccactctgttcc

SEQ ID NO: 4615578 - DNA, 21 bp, Homo sapiens
gttggcaaacgagactttctc

SEQ ID NO: 4615579 - DNA, 13 bp, Homo sapiens
gttggccaggctg

SEQ ID NO: 4615580 - DNA, 17 bp, Homo sapiens
gttggggggtgggagag

SEQ ID NO: 4615581 - DNA, 14 bp, Homo sapiens
gttggggtgacagt

SEQ ID NO: 4615582 - DNA, 23 bp, Homo sapiens
gttggggtggtttttgagccatg

SEQ ID NO: 4615583 - DNA, 16 bp, Homo sapiens
gttggtgacttgtctg

SEQ ID NO: 4615584 - DNA, 23 bp, Homo sapiens
gttggtgacttgtctgcctcctg

SEQ ID NO: 4615585 - DNA, 17 bp, Homo sapiens
gttgtccttaaatttgt

SEQ ID NO: 4615586 - DNA, 22 bp, Homo sapiens
gttgtcttatgtgaaaaattaa

SEQ ID NO: 4615587 - DNA, 16 bp, Homo sapiens
gttgtgcctccctggt

SEQ ID NO: 4615588 - DNA, 14 bp, Homo sapiens
gttgtggccaatgt

SEQ ID NO: 4615589 - DNA, 13 bp, Homo sapiens
gttgtgtgtgttc

SEQ ID NO: 4615590 - DNA, 16 bp, Homo sapiens
gttgtgtgtgttctgt

SEQ ID NO: 4615591 - DNA, 15 bp, Homo sapiens
gttgttaataaaagt

SEQ ID NO: 4615592 - DNA, 19 bp, Homo sapiens
gtttaaataccagtacttg

SEQ ID NO: 4615593 - DNA, 15 bp, Homo sapiens
gtttaagctctgccc

SEQ ID NO: 4615594 - DNA, 17 bp, Homo sapiens
gtttaagctctgcccct

SEQ ID NO: 4615595 - DNA, 13 bp, Homo sapiens
gtttaataaagct

SEQ ID NO: 4615596 - DNA, 15 bp, Homo sapiens
gtttaataaagcttt

SEQ ID NO: 4615597 - DNA, 16 bp, Homo sapiens
gtttaatacaggaaat

SEQ ID NO: 4615598 - DNA, 16 bp, Homo sapiens
gtttaatgtgaactct

SEQ ID NO: 4615599 - DNA, 17 bp, Homo sapiens
gtttaatgtgaactctc

SEQ ID NO: 4615600 - DNA, 23 bp, Homo sapiens
gtttaatgtgaactctcccctcc

SEQ ID NO: 4615601 - DNA, 15 bp, Homo sapiens
gtttaattctgtctt

SEQ ID NO: 4615602 - DNA, 22 bp, Homo sapiens
gtttaattttgtgaatctattg

SEQ ID NO: 4615603 - DNA, 17 bp, Homo sapiens
gtttaggaattggaggc

SEQ ID NO: 4615604 - DNA, 15 bp, Homo sapiens
gtttaggtgaattaa

SEQ ID NO: 4615605 - DNA, 15 bp, Homo sapiens
gtttagttttacact

SEQ ID NO: 4615606 - DNA, 23 bp, Homo sapiens
gtttatagagaatgatgataaca

SEQ ID NO: 4615607 - DNA, 17 bp, Homo sapiens
gtttatatgtcttgcaa

SEQ ID NO: 4615608 - DNA, 13 bp, Homo sapiens
gtttatttcacac

SEQ ID NO: 4615609 - DNA, 20 bp, Homo sapiens
gtttatttccactattttca

SEQ ID NO: 4615610 - DNA, 21 bp, Homo sapiens
gtttatttccactattttcaa

SEQ ID NO: 4615611 - DNA, 23 bp, Homo sapiens
gtttcaaagtgtctcattctcag

SEQ ID NO: 4615612 - DNA, 20 bp, Homo sapiens
gtttcaacaaatttcattgc

SEQ ID NO: 4615613 - DNA, 14 bp, Homo sapiens
gtttcaactttctt

SEQ ID NO: 4615614 - DNA, 16 bp, Homo sapiens
gtttcagctggaaact

SEQ ID NO: 4615615 - DNA, 10 bp, Homo sapiens
gtttcagttg

SEQ ID NO: 4615616 - DNA, 16 bp, Homo sapiens
gtttcatagttttcta

SEQ ID NO: 4615617 - DNA, 19 bp, Homo sapiens
gtttcatagttttctaaat

SEQ ID NO: 4615618 - DNA, 15 bp, Homo sapiens
gtttcatctcagctt

SEQ ID NO: 4615619 - DNA, 16 bp, Homo sapiens
gtttcatctcagcttt

SEQ ID NO: 4615620 - DNA, 20 bp, Homo sapiens
gtttcatctcagcttttgat

SEQ ID NO: 4615621 - DNA, 15 bp, Homo sapiens
gtttcattacttgaa

SEQ ID NO: 4615622 - DNA, 18 bp, Homo sapiens
gtttcattacttgaatgt

SEQ ID NO: 4615623 - DNA, 11 bp, Homo sapiens
gtttcccaagc

SEQ ID NO: 4615624 - DNA, 14 bp, Homo sapiens
gtttcccccactcc

SEQ ID NO: 4615625 - DNA, 15 bp, Homo sapiens
gtttccctctccttc

SEQ ID NO: 4615626 - DNA, 17 bp, Homo sapiens
gtttcctgacattgtct

SEQ ID NO: 4615627 - DNA, 17 bp, Homo sapiens
gtttcctggcctcagag

SEQ ID NO: 4615628 - DNA, 18 bp, Homo sapiens
gtttcctggcctcagagc

SEQ ID NO: 4615629 - DNA, 20 bp, Homo sapiens
gtttcctggcctcagagctt

SEQ ID NO: 4615630 - DNA, 23 bp, Homo sapiens
gtttcctggcctcagagcttcct

SEQ ID NO: 4615631 - DNA, 17 bp, Homo sapiens
gtttcctggttccgttt

SEQ ID NO: 4615632 - DNA, 23 bp, Homo sapiens
gtttcgtcatgttggccaggctg

SEQ ID NO: 4615633 - DNA, 13 bp, Homo sapiens
gtttctctccctc

SEQ ID NO: 4615634 - DNA, 14 bp, Homo sapiens
gtttctctccctcc

SEQ ID NO: 4615635 - DNA, 12 bp, Homo sapiens
gtttctgcctgg

SEQ ID NO: 4615636 - DNA, 19 bp, Homo sapiens
gtttcttgcttggaagcca

SEQ ID NO: 4615637 - DNA, 23 bp, Homo sapiens
gtttcttgcttggaagccaggta

SEQ ID NO: 4615638 - DNA, 15 bp, Homo sapiens
gtttgaaacaaagaa

SEQ ID NO: 4615639 - DNA, 17 bp, Homo sapiens
gtttgaaacaaagaagg

SEQ ID NO: 4615640 - DNA, 16 bp, Homo sapiens
gtttgatttgtctcat

SEQ ID NO: 4615641 - DNA, 16 bp, Homo sapiens
gtttgcaggggtgacg

SEQ ID NO: 4615642 - DNA, 19 bp, Homo sapiens
gtttggcaaaactcaggca

SEQ ID NO: 4615643 - DNA, 12 bp, Homo sapiens
gtttgggaaggt

SEQ ID NO: 4615644 - DNA, 21 bp, Homo sapiens
gtttggggcaggagtagctga

SEQ ID NO: 4615645 - DNA, 23 bp, Homo sapiens
gtttggggcaggagtagctgagc

SEQ ID NO: 4615646 - DNA, 17 bp, Homo sapiens
gtttggtcttaggtctt

SEQ ID NO: 4615647 - DNA, 15 bp, Homo sapiens
gtttgtgtgtttcaa

SEQ ID NO: 4615648 - DNA, 15 bp, Homo sapiens
gtttgtttctttgtg

SEQ ID NO: 4615649 - DNA, 16 bp, Homo sapiens
gttttaagtactacac

SEQ ID NO: 4615650 - DNA, 16 bp, Homo sapiens
gttttatacccttttt

SEQ ID NO: 4615651 - DNA, 18 bp, Homo sapiens
gttttattactgtttcta

SEQ ID NO: 4615652 - DNA, 16 bp, Homo sapiens
gttttcaaaatacttc

SEQ ID NO: 4615653 - DNA, 13 bp, Homo sapiens
gttttgagtaaaa

SEQ ID NO: 4615654 - DNA, 19 bp, Homo sapiens
gtctgggtcagacccatct

SEQ ID NO: 4615655 - DNA, 13 bp, Homo sapiens
gtctggtgttcca

SEQ ID NO: 4615656 - DNA, 18 bp, Homo sapiens
gtctggttgggcagccag

SEQ ID NO: 4615657 - DNA, 19 bp, Homo sapiens
gtctgtacacgtgtcctgt

SEQ ID NO: 4615658 - DNA, 20 bp, Homo sapiens
gtctgtaggtgaaagaacaa

SEQ ID NO: 4615659 - DNA, 16 bp, Homo sapiens
gtctgtctttcctgaa

SEQ ID NO: 4615660 - DNA, 18 bp, Homo sapiens
gtctgtgaacagagagac

SEQ ID NO: 4615661 - DNA, 21 bp, Homo sapiens
gtctgtgaacagagagaccct

SEQ ID NO: 4615662 - DNA, 17 bp, Homo sapiens
gtctgtggttgcagtct

SEQ ID NO: 4615663 - DNA, 22 bp, Homo sapiens
gtctgtggttgcagtctttccc

SEQ ID NO: 4615664 - DNA, 14 bp, Homo sapiens
gtctgtgtgaatgt

SEQ ID NO: 4615665 - DNA, 15 bp, Homo sapiens
gtctgttcttgaagc

SEQ ID NO: 4615666 - DNA, 14 bp, Homo sapiens
gtctgttgaaataa

SEQ ID NO: 4615667 - DNA, 14 bp, Homo sapiens
gtctgttttgtaaa

SEQ ID NO: 4615668 - DNA, 15 bp, Homo sapiens
gtctgttttgtaaag

SEQ ID NO: 4615669 - DNA, 21 bp, Homo sapiens
gtcttaatggtatcctactga

SEQ ID NO: 4615670 - DNA, 21 bp, Homo sapiens
gtcttaccagtgacgctgctg

SEQ ID NO: 4615671 - DNA, 22 bp, Homo sapiens
gtcttaccagtgacgctgctga

SEQ ID NO: 4615672 - DNA, 16 bp, Homo sapiens
gtcttaggtcttcctg

SEQ ID NO: 4615673 - DNA, 19 bp, Homo sapiens
gtcttaggtcttcctgtgg

SEQ ID NO: 4615674 - DNA, 23 bp, Homo sapiens
gtcttaggtcttcctgtggctcc

SEQ ID NO: 4615675 - DNA, 20 bp, Homo sapiens
gtcttattgaaaaaaaaaat

SEQ ID NO: 4615676 - DNA, 20 bp, Homo sapiens
gtcttcacctgattcaacta

SEQ ID NO: 4615677 - DNA, 17 bp, Homo sapiens
gtcttcctgtggctccc

SEQ ID NO: 4615678 - DNA, 23 bp, Homo sapiens
gtcttcctgtggctccctctctc

SEQ ID NO: 4615679 - DNA, 20 bp, Homo sapiens
gtcttgcaaagcctttaaat

SEQ ID NO: 4615680 - DNA, 16 bp, Homo sapiens
gtcttggctttcatgt

SEQ ID NO: 4615681 - DNA, 20 bp, Homo sapiens
gtcttggctttcatgttatt

SEQ ID NO: 4615682 - DNA, 21 bp, Homo sapiens
gtcttgggaaatatgaatgcc

SEQ ID NO: 4615683 - DNA, 15 bp, Homo sapiens
gtcttggggccactt

SEQ ID NO: 4615684 - DNA, 21 bp, Homo sapiens
gtcttgtggttgtgtgtgttc

SEQ ID NO: 4615685 - DNA, 22 bp, Homo sapiens
gtcttgtggttgtgtgtgttct

SEQ ID NO: 4615686 - DNA, 17 bp, Homo sapiens
gtcttgtgtatttctct

SEQ ID NO: 4615687 - DNA, 23 bp, Homo sapiens
gtcttgtgtatttctctgtgaat

SEQ ID NO: 4615688 - DNA, 17 bp, Homo sapiens
gtcttgttcattttgag

SEQ ID NO: 4615689 - DNA, 15 bp, Homo sapiens
gtctttaaatgctgc

SEQ ID NO: 4615690 - DNA, 16 bp, Homo sapiens
gtctttcagtactttt

SEQ ID NO: 4615691 - DNA, 19 bp, Homo sapiens
gtctttctcctctttgaga

SEQ ID NO: 4615692 - DNA, 11 bp, Homo sapiens
gtcttttcatc

SEQ ID NO: 4615693 - DNA, 16 bp, Homo sapiens
gtctttttatgcattt

SEQ ID NO: 4615694 - DNA, 17 bp, Homo sapiens
gtgaaacgtctggactg

SEQ ID NO: 4615695 - DNA, 21 bp, Homo sapiens
gtgaaagaaagggacccacct

SEQ ID NO: 4615696 - DNA, 17 bp, Homo sapiens
gtgaaataacaaaatgg

SEQ ID NO: 4615697 - DNA, 22 bp, Homo sapiens
gtgaaataccaacctgaagaca

SEQ ID NO: 4615698 - DNA, 20 bp, Homo sapiens
gtgaaatccatactgtagac

SEQ ID NO: 4615699 - DNA, 13 bp, Homo sapiens
gtgaaatctgtct

SEQ ID NO: 4615700 - DNA, 15 bp, Homo sapiens
gtgaaattaagcatt

SEQ ID NO: 4615701 - DNA, 18 bp, Homo sapiens
gtgaacagcttgctgtca

SEQ ID NO: 4615702 - DNA, 20 bp, Homo sapiens
gtgaactctcccctccccat

SEQ ID NO: 4615703 - DNA, 13 bp, Homo sapiens
gtgaactgacagg

SEQ ID NO: 4615704 - DNA, 22 bp, Homo sapiens
gtgaagccaattcagacaggca

SEQ ID NO: 4615705 - DNA, 18 bp, Homo sapiens
gtgaaggcttctctgttc

SEQ ID NO: 4615706 - DNA, 19 bp, Homo sapiens
gtgaagtacaataattcat

SEQ ID NO: 4615707 - DNA, 16 bp, Homo sapiens
gtgaagtacacctgtg

SEQ ID NO: 4615708 - DNA, 16 bp, Homo sapiens
gtgaataatggcactg

SEQ ID NO: 4615709 - DNA, 23 bp, Homo sapiens
gtgaatacttattttcagtgcat

SEQ ID NO: 4615710 - DNA, 13 bp, Homo sapiens
gtgaatattgctt

SEQ ID NO: 4615711 - DNA, 21 bp, Homo sapiens
gtgaatctgcttttcctctgc

SEQ ID NO: 4615712 - DNA, 18 bp, Homo sapiens
gtgaattttcaaggcctt

SEQ ID NO: 4615713 - DNA, 16 bp, Homo sapiens
gtgacaattctgtttt

SEQ ID NO: 4615714 - DNA, 16 bp, Homo sapiens
gtgacagactcctgag

SEQ ID NO: 4615715 - DNA, 12 bp, Homo sapiens
gtgacagggcca

SEQ ID NO: 4615716 - DNA, 21 bp, Homo sapiens
gtgacagggccagtggggcct

SEQ ID NO: 4615717 - DNA, 11 bp, Homo sapiens
gtgacagtcat

SEQ ID NO: 4615718 - DNA, 19 bp, Homo sapiens
gtgacagtcatcatcaggg

SEQ ID NO: 4615719 - DNA, 13 bp, Homo sapiens
gtgacagtttcca

SEQ ID NO: 4615720 - DNA, 16 bp, Homo sapiens
gtgacccagagccacc

SEQ ID NO: 4615721 - DNA, 19 bp, Homo sapiens
gtgaccccagggcacagga

SEQ ID NO: 4615722 - DNA, 17 bp, Homo sapiens
gtgacccccagctccgg

SEQ ID NO: 4615723 - DNA, 18 bp, Homo sapiens
gtgacccggcaccccctg

SEQ ID NO: 4615724 - DNA, 12 bp, Homo sapiens
gtgacctgctga

SEQ ID NO: 4615725 - DNA, 13 bp, Homo sapiens
gtgacgctgctga

SEQ ID NO: 4615726 - DNA, 14 bp, Homo sapiens
gtgacggccctcat

SEQ ID NO: 4615727 - DNA, 17 bp, Homo sapiens
gtgacttctgctgctgg

SEQ ID NO: 4615728 - DNA, 22 bp, Homo sapiens
gtgacttcttacacataaagca

SEQ ID NO: 4615729 - DNA, 23 bp, Homo sapiens
gtgacttgtctgcctcctgcttt

SEQ ID NO: 4615730 - DNA, 14 bp, Homo sapiens
gtgagagaaagaga

SEQ ID NO: 4615731 - DNA, 16 bp, Homo sapiens
gtgagagaaagagaga

SEQ ID NO: 4615732 - DNA, 19 bp, Homo sapiens
gtgagagaaagagagaagc

SEQ ID NO: 4615733 - DNA, 20 bp, Homo sapiens
gtgagagaaagagagaagcc

SEQ ID NO: 4615734 - DNA, 18 bp, Homo sapiens
gtgagatgcagctggaaa

SEQ ID NO: 4615735 - DNA, 21 bp, Homo sapiens
gtgagcagggtcaagcctctt

SEQ ID NO: 4615736 - DNA, 15 bp, Homo sapiens
gtgagcccagctggg

SEQ ID NO: 4615737 - DNA, 23 bp, Homo sapiens
gtgagcgagtggatgctgtgcta

SEQ ID NO: 4615738 - DNA, 14 bp, Homo sapiens
gtgagctggggact

SEQ ID NO: 4615739 - DNA, 21 bp, Homo sapiens
gtgaggagtctgggtccatcc

SEQ ID NO: 4615740 - DNA, 16 bp, Homo sapiens
gtgaggatgagaccca

SEQ ID NO: 4615741 - DNA, 23 bp, Homo sapiens
gtgaggcaataagaattactttg

SEQ ID NO: 4615742 - DNA, 23 bp, Homo sapiens
gtgaggcaatgggagctgaggcc

SEQ ID NO: 4615743 - DNA, 20 bp, Homo sapiens
gtgaggggaagacaaagcac

SEQ ID NO: 4615744 - DNA, 17 bp, Homo sapiens
gtgaggggcaagctagg

SEQ ID NO: 4615745 - DNA, 19 bp, Homo sapiens
gtgaggggcaagctaggcc

SEQ ID NO: 4615746 - DNA, 16 bp, Homo sapiens
gtgagtatttctgttc

SEQ ID NO: 4615747 - DNA, 13 bp, Homo sapiens
gtgagtgtgacag

SEQ ID NO: 4615748 - DNA, 16 bp, Homo sapiens
gtgagtgtgacagggc

SEQ ID NO: 4615749 - DNA, 13 bp, Homo sapiens
gtgataaaatttt

SEQ ID NO: 4615750 - DNA, 20 bp, Homo sapiens
gtgatcaatatttttatatc

SEQ ID NO: 4615751 - DNA, 14 bp, Homo sapiens
gtgatcaggcccca

SEQ ID NO: 4615752 - DNA, 14 bp, Homo sapiens
gtgatcatatgagg

SEQ ID NO: 4615753 - DNA, 21 bp, Homo sapiens
gtgatcctctcacctcagcct

SEQ ID NO: 4615754 - DNA, 12 bp, Homo sapiens
gtgatctaccca

SEQ ID NO: 4615755 - DNA, 23 bp, Homo sapiens
gtgatctcccctcacactttgcc

SEQ ID NO: 4615756 - DNA, 19 bp, Homo sapiens
gtgatgagggcagcagcca

SEQ ID NO: 4615757 - DNA, 12 bp, Homo sapiens
gtgatggagggg

SEQ ID NO: 4615758 - DNA, 13 bp, Homo sapiens
gtgatggagggga

SEQ ID NO: 4615759 - DNA, 22 bp, Homo sapiens
gtgatggaggggagaggggtca

SEQ ID NO: 4615760 - DNA, 15 bp, Homo sapiens
gtgatgtgaagccaa

SEQ ID NO: 4615761 - DNA, 10 bp, Homo sapiens
gtgatgtgga

SEQ ID NO: 4615762 - DNA, 14 bp, Homo sapiens
gtgatgtggaggaa

SEQ ID NO: 4615763 - DNA, 13 bp, Homo sapiens
gtgattaatgttt

SEQ ID NO: 4615764 - DNA, 21 bp, Homo sapiens
gtgatttctttaaaagaatga

SEQ ID NO: 4615765 - DNA, 21 bp, Homo sapiens
gtcagctttggattgctgggg

SEQ ID NO: 4615766 - DNA, 13 bp, Homo sapiens
gtcaggacagctt

SEQ ID NO: 4615767 - DNA, 13 bp, Homo sapiens
gtcaggatgaggc

SEQ ID NO: 4615768 - DNA, 14 bp, Homo sapiens
gtcagggagtgctg

SEQ ID NO: 4615769 - DNA, 13 bp, Homo sapiens
gtcagtgtagaca

SEQ ID NO: 4615770 - DNA, 21 bp, Homo sapiens
gtcagtgtagacacaggtcac

SEQ ID NO: 4615771 - DNA, 20 bp, Homo sapiens
gtcagttcaactttcagaag

SEQ ID NO: 4615772 - DNA, 18 bp, Homo sapiens
gtcataaaatagaataat

SEQ ID NO: 4615773 - DNA, 21 bp, Homo sapiens
gtcataaatttgaataagcag

SEQ ID NO: 4615774 - DNA, 12 bp, Homo sapiens
gtcataataaat

SEQ ID NO: 4615775 - DNA, 15 bp, Homo sapiens
gtcatagtttcctga

SEQ ID NO: 4615776 - DNA, 17 bp, Homo sapiens
gtcatcatcagggcctg

SEQ ID NO: 4615777 - DNA, 23 bp, Homo sapiens
gtcatcatcagggcctggggcct

SEQ ID NO: 4615778 - DNA, 15 bp, Homo sapiens
gtcatggccttgaaa

SEQ ID NO: 4615779 - DNA, 12 bp, Homo sapiens
gtcatgtctgct

SEQ ID NO: 4615780 - DNA, 15 bp, Homo sapiens
gtcatgtctgcttgt

SEQ ID NO: 4615781 - DNA, 23 bp, Homo sapiens
gtcatgtttgcaggggtgacggc

SEQ ID NO: 4615782 - DNA, 19 bp, Homo sapiens
gtcattatccttgctatga

SEQ ID NO: 4615783 - DNA, 17 bp, Homo sapiens
gtcattctttattcttt

SEQ ID NO: 4615784 - DNA, 17 bp, Homo sapiens
gtcattcttttgccaca

SEQ ID NO: 4615785 - DNA, 14 bp, Homo sapiens
gtcatttcattcca

SEQ ID NO: 4615786 - DNA, 16 bp, Homo sapiens
gtcatttcattccatt

SEQ ID NO: 4615787 - DNA, 18 bp, Homo sapiens
gtcattttattttgtaat

SEQ ID NO: 4615788 - DNA, 19 bp, Homo sapiens
gtcattttattttgtaata

SEQ ID NO: 4615789 - DNA, 19 bp, Homo sapiens
gtccaagacagggctcatt

SEQ ID NO: 4615790 - DNA, 19 bp, Homo sapiens
gtccaatttgtaaaaacag

SEQ ID NO: 4615791 - DNA, 13 bp, Homo sapiens
gtccacctgtggg

SEQ ID NO: 4615792 - DNA, 18 bp, Homo sapiens
gtccagaagacgtggtct

SEQ ID NO: 4615793 - DNA, 16 bp, Homo sapiens
gtccaggtcctggtgg

SEQ ID NO: 4615794 - DNA, 23 bp, Homo sapiens
gtccaggtcctggtggggcagct

SEQ ID NO: 4615795 - DNA, 23 bp, Homo sapiens
gtccaggttgatcttgaactcct

SEQ ID NO: 4615796 - DNA, 15 bp, Homo sapiens
gtccatagagatgag

SEQ ID NO: 4615797 - DNA, 16 bp, Homo sapiens
gtccatagagatgagc

SEQ ID NO: 4615798 - DNA, 21 bp, Homo sapiens
gtccatagagatgagcccacc

SEQ ID NO: 4615799 - DNA, 9 bp, Homo sapiens
gtccatctt

SEQ ID NO: 4615800 - DNA, 12 bp, Homo sapiens
gtccatcttgtt

SEQ ID NO: 4615801 - DNA, 19 bp, Homo sapiens
gtccatcttgtttcatttg

SEQ ID NO: 4615802 - DNA, 21 bp, Homo sapiens
gtccatcttgtttcatttgct

SEQ ID NO: 4615803 - DNA, 13 bp, Homo sapiens
gtcccaaatccgc

SEQ ID NO: 4615804 - DNA, 19 bp, Homo sapiens
gtcccaaatccgccagtgt

SEQ ID NO: 4615805 - DNA, 16 bp, Homo sapiens
gtcccaaggagggggc

SEQ ID NO: 4615806 - DNA, 13 bp, Homo sapiens
gtcccacatccct

SEQ ID NO: 4615807 - DNA, 21 bp, Homo sapiens
gtcccacatccctgggcctgc

SEQ ID NO: 4615808 - DNA, 19 bp, Homo sapiens
gtcccacccccttccccca

SEQ ID NO: 4615809 - DNA, 17 bp, Homo sapiens
gtcccactatctgggtg

SEQ ID NO: 4615810 - DNA, 16 bp, Homo sapiens
gtcccagcatccctgg

SEQ ID NO: 4615811 - DNA, 19 bp, Homo sapiens
gtcccagcatccctggagc

SEQ ID NO: 4615812 - DNA, 20 bp, Homo sapiens
gtcccagctgaaggcagtgg

SEQ ID NO: 4615813 - DNA, 21 bp, Homo sapiens
gtcccagctgaaggcagtggc

SEQ ID NO: 4615814 - DNA, 12 bp, Homo sapiens
gtcccagggccc

SEQ ID NO: 4615815 - DNA, 15 bp, Homo sapiens
gtcccagggccctcc

SEQ ID NO: 4615816 - DNA, 19 bp, Homo sapiens
gtcccagggccctcccagc

SEQ ID NO: 4615817 - DNA, 16 bp, Homo sapiens
gtcccatttttctctt

SEQ ID NO: 4615818 - DNA, 17 bp, Homo sapiens
gtccccaccctccactc

SEQ ID NO: 4615819 - DNA, 18 bp, Homo sapiens
gtccctgcagggccatct

SEQ ID NO: 4615820 - DNA, 16 bp, Homo sapiens
gtccctggagggcaag

SEQ ID NO: 4615821 - DNA, 19 bp, Homo sapiens
gtccctgggccagggtctg

SEQ ID NO: 4615822 - DNA, 15 bp, Homo sapiens
gtccctggggctagg

SEQ ID NO: 4615823 - DNA, 16 bp, Homo sapiens
gtccctgtccctctag

SEQ ID NO: 4615824 - DNA, 16 bp, Homo sapiens
gtccgtcctggcacag

SEQ ID NO: 4615825 - DNA, 21 bp, Homo sapiens
gtccgtcctggcacagaagag

SEQ ID NO: 4615826 - DNA, 19 bp, Homo sapiens
gtcctctgtcagtcacagc

SEQ ID NO: 4615827 - DNA, 19 bp, Homo sapiens
gtcctgaccaggatggagc

SEQ ID NO: 4615828 - DNA, 18 bp, Homo sapiens
gtcctgagcactgccagg

SEQ ID NO: 4615829 - DNA, 19 bp, Homo sapiens
gtcctgagcactgccagga

SEQ ID NO: 4615830 - DNA, 20 bp, Homo sapiens
gtcctgagcactgccaggag

SEQ ID NO: 4615831 - DNA, 13 bp, Homo sapiens
gtcctgcagtcct

SEQ ID NO: 4615832 - DNA, 18 bp, Homo sapiens
gtcctgcccatgccccag

SEQ ID NO: 4615833 - DNA, 14 bp, Homo sapiens
gtcctggaggggct

SEQ ID NO: 4615834 - DNA, 16 bp, Homo sapiens
gtcctggcacagaaga

SEQ ID NO: 4615835 - DNA, 13 bp, Homo sapiens
gtccttactcctg

SEQ ID NO: 4615836 - DNA, 22 bp, Homo sapiens
gtccttactcctgtgggagcct

SEQ ID NO: 4615837 - DNA, 15 bp, Homo sapiens
gtcctttatctgcac

SEQ ID NO: 4615838 - DNA, 23 bp, Homo sapiens
gtcctttcaattccaccagggcc

SEQ ID NO: 4615839 - DNA, 18 bp, Homo sapiens
gtcctttcccaccattcc

SEQ ID NO: 4615840 - DNA, 16 bp, Homo sapiens
gtcctttgaggcccca

SEQ ID NO: 4615841 - DNA, 12 bp, Homo sapiens
gtcctttggaca

SEQ ID NO: 4615842 - DNA, 11 bp, Homo sapiens
gtcgggcatga

SEQ ID NO: 4615843 - DNA, 21 bp, Homo sapiens
gtcgggcatgagtctgtttcc

SEQ ID NO: 4615844 - DNA, 14 bp, Homo sapiens
gtctaaaacaataa

SEQ ID NO: 4615845 - DNA, 14 bp, Homo sapiens
gtctaccctgggat

SEQ ID NO: 4615846 - DNA, 15 bp, Homo sapiens
gtctagaccagggct

SEQ ID NO: 4615847 - DNA, 18 bp, Homo sapiens
gtctattttgtctatagg

SEQ ID NO: 4615848 - DNA, 22 bp, Homo sapiens
gtctcagtgattcgcttttggt

SEQ ID NO: 4615849 - DNA, 12 bp, Homo sapiens
gtctcatatatt

SEQ ID NO: 4615850 - DNA, 17 bp, Homo sapiens
gtctcattgtcacctct

SEQ ID NO: 4615851 - DNA, 15 bp, Homo sapiens
gtctcatttgggcta

SEQ ID NO: 4615852 - DNA, 18 bp, Homo sapiens
gtctccaggggcctgcag

SEQ ID NO: 4615853 - DNA, 21 bp, Homo sapiens
gtctcccgtgcatgctctgca

SEQ ID NO: 4615854 - DNA, 23 bp, Homo sapiens
gtctcccgtgcatgctctgcagc

SEQ ID NO: 4615855 - DNA, 13 bp, Homo sapiens
gtctcctggcggt

SEQ ID NO: 4615856 - DNA, 13 bp, Homo sapiens
gtctcctgggaaa

SEQ ID NO: 4615857 - DNA, 13 bp, Homo sapiens
gtctcgaccctgt

SEQ ID NO: 4615858 - DNA, 20 bp, Homo sapiens
gtctcgaccctgtcccctag

SEQ ID NO: 4615859 - DNA, 13 bp, Homo sapiens
gtctcgagcgccc

SEQ ID NO: 4615860 - DNA, 15 bp, Homo sapiens
gtctcgagcgccctg

SEQ ID NO: 4615861 - DNA, 18 bp, Homo sapiens
gtctcgagcgccctgcag

SEQ ID NO: 4615862 - DNA, 14 bp, Homo sapiens
gtctctccctcagg

SEQ ID NO: 4615863 - DNA, 10 bp, Homo sapiens
gtctctgaag

SEQ ID NO: 4615864 - DNA, 19 bp, Homo sapiens
gtctctgaagtactaacac

SEQ ID NO: 4615865 - DNA, 13 bp, Homo sapiens
gtctctgtgtgtg

SEQ ID NO: 4615866 - DNA, 18 bp, Homo sapiens
gtctcttcggcagggagg

SEQ ID NO: 4615867 - DNA, 18 bp, Homo sapiens
gtctgaagaaggaaggcc

SEQ ID NO: 4615868 - DNA, 19 bp, Homo sapiens
gtctgaagaaggaaggcct

SEQ ID NO: 4615869 - DNA, 17 bp, Homo sapiens
gtctgaatcatgtctgt

SEQ ID NO: 4615870 - DNA, 24 bp, Homo sapiens
gtctgaatcatgtctgtatcccca

SEQ ID NO: 4615871 - DNA, 21 bp, Homo sapiens
gtctgacagtagctcttagac

SEQ ID NO: 4615872 - DNA, 19 bp, Homo sapiens
gtctgatccatccatctct

SEQ ID NO: 4615873 - DNA, 14 bp, Homo sapiens
gtctgcttgtcaaa

SEQ ID NO: 4615874 - DNA, 14 bp, Homo sapiens
gtctggctccctgc

SEQ ID NO: 4615875 - DNA, 22 bp, Homo sapiens
gtctgggatgtattcaagtgaa

SEQ ID NO: 4615876 - DNA, 18 bp, Homo sapiens
gtctgggctcaagctttc

SEQ ID NO: 4615877 - DNA, 24 bp, Homo sapiens
taaagtatttataaaaatataaat

SEQ ID NO: 4615878 - DNA, 16 bp, Homo sapiens
taaagtctatggacag

SEQ ID NO: 4615879 - DNA, 20 bp, Homo sapiens
taaagttggttcacttcaaa

SEQ ID NO: 4615880 - DNA, 14 bp, Homo sapiens
taaagttgttgcat

SEQ ID NO: 4615881 - DNA, 16 bp, Homo sapiens
taaagtttaaatacca

SEQ ID NO: 4615882 - DNA, 17 bp, Homo sapiens
taaataaaaatatgtaa

SEQ ID NO: 4615883 - DNA, 13 bp, Homo sapiens
taaataactgtgt

SEQ ID NO: 4615884 - DNA, 14 bp, Homo sapiens
taaataactgtgtg

SEQ ID NO: 4615885 - DNA, 17 bp, Homo sapiens
taaatacagcatacttc

SEQ ID NO: 4615886 - DNA, 17 bp, Homo sapiens
taaataccagtacttga

SEQ ID NO: 4615887 - DNA, 12 bp, Homo sapiens
taaataggattt

SEQ ID NO: 4615888 - DNA, 21 bp, Homo sapiens
taaatatatattttgtacttt

SEQ ID NO: 4615889 - DNA, 23 bp, Homo sapiens
taaatatcattctttgtatctta

SEQ ID NO: 4615890 - DNA, 16 bp, Homo sapiens
taaatatctttttcct

SEQ ID NO: 4615891 - DNA, 21 bp, Homo sapiens
taaatatgtgacattcctgat

SEQ ID NO: 4615892 - DNA, 19 bp, Homo sapiens
taaatattagttaatggat

SEQ ID NO: 4615893 - DNA, 15 bp, Homo sapiens
taaatattgtaatat

SEQ ID NO: 4615894 - DNA, 21 bp, Homo sapiens
taaatattgtaatatgacaga

SEQ ID NO: 4615895 - DNA, 16 bp, Homo sapiens
taaatattttctattt

SEQ ID NO: 4615896 - DNA, 17 bp, Homo sapiens
taaatattttctatttt

SEQ ID NO: 4615897 - DNA, 14 bp, Homo sapiens
taaatcagaaagta

SEQ ID NO: 4615898 - DNA, 13 bp, Homo sapiens
taaatcctgtgtt

SEQ ID NO: 4615899 - DNA, 16 bp, Homo sapiens
taaatctaaacaaaaa

SEQ ID NO: 4615900 - DNA, 14 bp, Homo sapiens
taaatgattatctt

SEQ ID NO: 4615901 - DNA, 17 bp, Homo sapiens
taaatgctgctttttct

SEQ ID NO: 4615902 - DNA, 13 bp, Homo sapiens
taaatgtacaaat

SEQ ID NO: 4615903 - DNA, 20 bp, Homo sapiens
taaatgtgagtatttctgtt

SEQ ID NO: 4615904 - DNA, 17 bp, Homo sapiens
taaatgtttcccccact

SEQ ID NO: 4615905 - DNA, 13 bp, Homo sapiens
taaattacaattt

SEQ ID NO: 4615906 - DNA, 17 bp, Homo sapiens
taaattacaattttatc

SEQ ID NO: 4615907 - DNA, 15 bp, Homo sapiens
taaattgtacatttt

SEQ ID NO: 4615908 - DNA, 22 bp, Homo sapiens
taaattgtacattttgtaaaat

SEQ ID NO: 4615909 - DNA, 18 bp, Homo sapiens
taaattgttcctctttgt

SEQ ID NO: 4615910 - DNA, 13 bp, Homo sapiens
taaatttaagaaa

SEQ ID NO: 4615911 - DNA, 17 bp, Homo sapiens
taaatttactttacaca

SEQ ID NO: 4615912 - DNA, 13 bp, Homo sapiens
taaatttgattta

SEQ ID NO: 4615913 - DNA, 22 bp, Homo sapiens
taaatttgatttacatatatta

SEQ ID NO: 4615914 - DNA, 14 bp, Homo sapiens
taacaaaaaatgta

SEQ ID NO: 4615915 - DNA, 18 bp, Homo sapiens
taacaaaaactacacata

SEQ ID NO: 4615916 - DNA, 12 bp, Homo sapiens
taacaaaatgga

SEQ ID NO: 4615917 - DNA, 13 bp, Homo sapiens
taacaaagacaaa

SEQ ID NO: 4615918 - DNA, 20 bp, Homo sapiens
taacaagtcgatgaactatt

SEQ ID NO: 4615919 - DNA, 14 bp, Homo sapiens
taacaatagttctt

SEQ ID NO: 4615920 - DNA, 14 bp, Homo sapiens
taacactcagaagc

SEQ ID NO: 4615921 - DNA, 18 bp, Homo sapiens
taacactcagaagcctgg

SEQ ID NO: 4615922 - DNA, 19 bp, Homo sapiens
taacactcagaagcctggg

SEQ ID NO: 4615923 - DNA, 22 bp, Homo sapiens
taacactgtgatttatctttca

SEQ ID NO: 4615924 - DNA, 15 bp, Homo sapiens
taacagatgcaatgt

SEQ ID NO: 4615925 - DNA, 21 bp, Homo sapiens
taacagatgcaatgtgctact

SEQ ID NO: 4615926 - DNA, 17 bp, Homo sapiens
taacagggaaggcaggc

SEQ ID NO: 4615927 - DNA, 19 bp, Homo sapiens
taacagggaaggcaggcag

SEQ ID NO: 4615928 - DNA, 20 bp, Homo sapiens
taacagggaaggcaggcagg

SEQ ID NO: 4615929 - DNA, 14 bp, Homo sapiens
taacaggtattttg

SEQ ID NO: 4615930 - DNA, 20 bp, Homo sapiens
taacaggtattttgtttctt

SEQ ID NO: 4615931 - DNA, 23 bp, Homo sapiens
taacaggtattttgtttctttta

SEQ ID NO: 4615932 - DNA, 18 bp, Homo sapiens
taacatacaagaaaatgt

SEQ ID NO: 4615933 - DNA, 15 bp, Homo sapiens
taacatttaaattcc

SEQ ID NO: 4615934 - DNA, 16 bp, Homo sapiens
taacatttaaattcca

SEQ ID NO: 4615935 - DNA, 17 bp, Homo sapiens
taacatttcattgtaca

SEQ ID NO: 4615936 - DNA, 15 bp, Homo sapiens
taacattttttaccc

SEQ ID NO: 4615937 - DNA, 15 bp, Homo sapiens
taaccaaggccctgt

SEQ ID NO: 4615938 - DNA, 16 bp, Homo sapiens
taaccaatttgtaatg

SEQ ID NO: 4615939 - DNA, 18 bp, Homo sapiens
taaccacggttatttaag

SEQ ID NO: 4615940 - DNA, 22 bp, Homo sapiens
taaccacttcgcacacacccat

SEQ ID NO: 4615941 - DNA, 22 bp, Homo sapiens
taacccagttacttttttacac

SEQ ID NO: 4615942 - DNA, 15 bp, Homo sapiens
taacctaataattgt

SEQ ID NO: 4615943 - DNA, 18 bp, Homo sapiens
taacctaataattgtatc

SEQ ID NO: 4615944 - DNA, 20 bp, Homo sapiens
taacctaataattgtatcta

SEQ ID NO: 4615945 - DNA, 19 bp, Homo sapiens
taacctgcacaggcttgct

SEQ ID NO: 4615946 - DNA, 11 bp, Homo sapiens
taacctgggac

SEQ ID NO: 4615947 - DNA, 18 bp, Homo sapiens
taacctgggaccaacctg

SEQ ID NO: 4615948 - DNA, 21 bp, Homo sapiens
taacctgggaccaacctgacc

SEQ ID NO: 4615949 - DNA, 18 bp, Homo sapiens
taaccttgtttattagca

SEQ ID NO: 4615950 - DNA, 20 bp, Homo sapiens
taaccttttttgtcttattg

SEQ ID NO: 4615951 - DNA, 14 bp, Homo sapiens
taacgcctgagccc

SEQ ID NO: 4615952 - DNA, 16 bp, Homo sapiens
taacgtgaaacttata

SEQ ID NO: 4615953 - DNA, 14 bp, Homo sapiens
taactaaaggggac

SEQ ID NO: 4615954 - DNA, 17 bp, Homo sapiens
taactatatttgctttt

SEQ ID NO: 4615955 - DNA, 22 bp, Homo sapiens
taactcaaattcaatgcttcta

SEQ ID NO: 4615956 - DNA, 12 bp, Homo sapiens
taactccctcca

SEQ ID NO: 4615957 - DNA, 14 bp, Homo sapiens
taactccctccacc

SEQ ID NO: 4615958 - DNA, 18 bp, Homo sapiens
taactccctccaccagcc

SEQ ID NO: 4615959 - DNA, 21 bp, Homo sapiens
taactccctccaccagcctgc

SEQ ID NO: 4615960 - DNA, 11 bp, Homo sapiens
taactctgtct

SEQ ID NO: 4615961 - DNA, 14 bp, Homo sapiens
taactctgtcttca

SEQ ID NO: 4615962 - DNA, 18 bp, Homo sapiens
taactgaatacagtctca

SEQ ID NO: 4615963 - DNA, 19 bp, Homo sapiens
taactgatgagtaaactga

SEQ ID NO: 4615964 - DNA, 19 bp, Homo sapiens
taactggctttcctgctgg

SEQ ID NO: 4615965 - DNA, 12 bp, Homo sapiens
taactgtaaact

SEQ ID NO: 4615966 - DNA, 13 bp, Homo sapiens
taactgtaaactt

SEQ ID NO: 4615967 - DNA, 15 bp, Homo sapiens
taactgtcctgtcct

SEQ ID NO: 4615968 - DNA, 23 bp, Homo sapiens
taacttgccatccgcacagaaaa

SEQ ID NO: 4615969 - DNA, 13 bp, Homo sapiens
taacttgcctcca

SEQ ID NO: 4615970 - DNA, 16 bp, Homo sapiens
taactttcttaccatt

SEQ ID NO: 4615971 - DNA, 13 bp, Homo sapiens
taacttttgtttt

SEQ ID NO: 4615972 - DNA, 21 bp, Homo sapiens
taacttttgtttttttttgtt

SEQ ID NO: 4615973 - DNA, 22 bp, Homo sapiens
taacttttttgtggcaattagt

SEQ ID NO: 4615974 - DNA, 12 bp, Homo sapiens
taagaaaagtaa

SEQ ID NO: 4615975 - DNA, 15 bp, Homo sapiens
taagaaaggaagcaa

SEQ ID NO: 4615976 - DNA, 20 bp, Homo sapiens
taagaaaggaagcaacagat

SEQ ID NO: 4615977 - DNA, 12 bp, Homo sapiens
taagaactgctt

SEQ ID NO: 4615978 - DNA, 12 bp, Homo sapiens
taagaactgtgg

SEQ ID NO: 4615979 - DNA, 16 bp, Homo sapiens
taagaagttagaaggc

SEQ ID NO: 4615980 - DNA, 16 bp, Homo sapiens
taagaatgaagttctg

SEQ ID NO: 4615981 - DNA, 14 bp, Homo sapiens
taagaatgcattat

SEQ ID NO: 4615982 - DNA, 22 bp, Homo sapiens
taagacccttattgctgtcctg

SEQ ID NO: 4615983 - DNA, 15 bp, Homo sapiens
taagactttgggata

SEQ ID NO: 4615984 - DNA, 23 bp, Homo sapiens
taagagggcagactgtgaacttg

SEQ ID NO: 4615985 - DNA, 14 bp, Homo sapiens
taagatagaacaca

SEQ ID NO: 4615986 - DNA, 16 bp, Homo sapiens
taagatattctttaca

SEQ ID NO: 4615987 - DNA, 14 bp, Homo sapiens
taagatttctttat

SEQ ID NO: 4615988 - DNA, 16 bp, Homo sapiens
taagcaatcattttat

SEQ ID NO: 4615989 - DNA, 19 bp, Homo sapiens
gtgattttaactctgtctt

SEQ ID NO: 4615990 - DNA, 13 bp, Homo sapiens
gtgcaaaatgtct

SEQ ID NO: 4615991 - DNA, 17 bp, Homo sapiens
gtgcaaaatgtcttgtg

SEQ ID NO: 4615992 - DNA, 23 bp, Homo sapiens
gtgcaaacacagcatgggtccag

SEQ ID NO: 4615993 - DNA, 22 bp, Homo sapiens
gtgcaacaaggtcctctgtcag

SEQ ID NO: 4615994 - DNA, 13 bp, Homo sapiens
gtgcaaccaggga

SEQ ID NO: 4615995 - DNA, 14 bp, Homo sapiens
gtgcacaaatacaa

SEQ ID NO: 4615996 - DNA, 15 bp, Homo sapiens
gtgcactgcccatgg

SEQ ID NO: 4615997 - DNA, 12 bp, Homo sapiens
gtgcactttctc

SEQ ID NO: 4615998 - DNA, 16 bp, Homo sapiens
gtgcagaaatttgaat

SEQ ID NO: 4615999 - DNA, 16 bp, Homo sapiens
gtgcagacagaagtct

SEQ ID NO: 4616000 - DNA, 19 bp, Homo sapiens
gtgcagagcagacaggcta

SEQ ID NO: 4616001 - DNA, 16 bp, Homo sapiens
gtgcagggcctggcat

SEQ ID NO: 4616002 - DNA, 17 bp, Homo sapiens
gtgcaggggatggggtg

SEQ ID NO: 4616003 - DNA, 22 bp, Homo sapiens
gtgcaggtagacctgtctcctg

SEQ ID NO: 4616004 - DNA, 15 bp, Homo sapiens
gtgcagtactttgtg

SEQ ID NO: 4616005 - DNA, 18 bp, Homo sapiens
gtgcagtggagggggcaa

SEQ ID NO: 4616006 - DNA, 14 bp, Homo sapiens
gtgcagtttctttt

SEQ ID NO: 4616007 - DNA, 16 bp, Homo sapiens
gtgcatcacatctgca

SEQ ID NO: 4616008 - DNA, 21 bp, Homo sapiens
gtgcatggaggccctcctgtg

SEQ ID NO: 4616009 - DNA, 17 bp, Homo sapiens
gtgcatgtctgttcttc

SEQ ID NO: 4616010 - DNA, 17 bp, Homo sapiens
gtgcattcctgaagtct

SEQ ID NO: 4616011 - DNA, 15 bp, Homo sapiens
gtgccaaatgctctc

SEQ ID NO: 4616012 - DNA, 21 bp, Homo sapiens
gtgccaagtccaggtcctggt

SEQ ID NO: 4616013 - DNA, 16 bp, Homo sapiens
gtgccaccaccctgcc

SEQ ID NO: 4616014 - DNA, 19 bp, Homo sapiens
gtgccacccccagccctgg

SEQ ID NO: 4616015 - DNA, 20 bp, Homo sapiens
gtgccacccccagccctggc

SEQ ID NO: 4616016 - DNA, 16 bp, Homo sapiens
gtgccagagcctgggg

SEQ ID NO: 4616017 - DNA, 20 bp, Homo sapiens
gtgccagcaggggggctgtg

SEQ ID NO: 4616018 - DNA, 20 bp, Homo sapiens
gtgccataccttctcccagg

SEQ ID NO: 4616019 - DNA, 21 bp, Homo sapiens
gtgccataccttctcccaggc

SEQ ID NO: 4616020 - DNA, 22 bp, Homo sapiens
gtgccataccttctcccaggcc

SEQ ID NO: 4616021 - DNA, 15 bp, Homo sapiens
gtgccatgctgggcc

SEQ ID NO: 4616022 - DNA, 15 bp, Homo sapiens
gtgcccactccgcca

SEQ ID NO: 4616023 - DNA, 20 bp, Homo sapiens
gtgcccactccgccagccac

SEQ ID NO: 4616024 - DNA, 19 bp, Homo sapiens
gtgcccggtgcagggcctg

SEQ ID NO: 4616025 - DNA, 12 bp, Homo sapiens
gtgccctgtgtg

SEQ ID NO: 4616026 - DNA, 14 bp, Homo sapiens
gtgccctgtgtgtg

SEQ ID NO: 4616027 - DNA, 23 bp, Homo sapiens
gtgccgcagtggggtcaagctga

SEQ ID NO: 4616028 - DNA, 15 bp, Homo sapiens
gtgcctgcacatcat

SEQ ID NO: 4616029 - DNA, 15 bp, Homo sapiens
gtgcctggaggtgtg

SEQ ID NO: 4616030 - DNA, 12 bp, Homo sapiens
gtgcctggcctg

SEQ ID NO: 4616031 - DNA, 12 bp, Homo sapiens
gtgcctggctga

SEQ ID NO: 4616032 - DNA, 15 bp, Homo sapiens
gtgcctgggattcta

SEQ ID NO: 4616033 - DNA, 19 bp, Homo sapiens
gtgcctttgggcacggccc

SEQ ID NO: 4616034 - DNA, 20 bp, Homo sapiens
gtgcctttgggcacggccct

SEQ ID NO: 4616035 - DNA, 18 bp, Homo sapiens
gtgcgatctcggctcagt

SEQ ID NO: 4616036 - DNA, 13 bp, Homo sapiens
gtgcgtgaatgta

SEQ ID NO: 4616037 - DNA, 18 bp, Homo sapiens
gtgctacgtgtgaaatct

SEQ ID NO: 4616038 - DNA, 22 bp, Homo sapiens
gtgctacgtgtgaaatctgtct

SEQ ID NO: 4616039 - DNA, 22 bp, Homo sapiens
gtgctcagaataaggcaggcat

SEQ ID NO: 4616040 - DNA, 18 bp, Homo sapiens
gtgctccatggctgccat

SEQ ID NO: 4616041 - DNA, 16 bp, Homo sapiens
gtgctcctgaaagaaa

SEQ ID NO: 4616042 - DNA, 12 bp, Homo sapiens
gtgctgcaggag

SEQ ID NO: 4616043 - DNA, 14 bp, Homo sapiens
gtgctggctcacag

SEQ ID NO: 4616044 - DNA, 19 bp, Homo sapiens
gtgctggctcacagtacag

SEQ ID NO: 4616045 - DNA, 21 bp, Homo sapiens
gtgctggctcacagtacagca

SEQ ID NO: 4616046 - DNA, 21 bp, Homo sapiens
gtgctgggggaatgagcccag

SEQ ID NO: 4616047 - DNA, 21 bp, Homo sapiens
gtgctgtcttttgttctctga

SEQ ID NO: 4616048 - DNA, 22 bp, Homo sapiens
gtgctgttttattactgtttct

SEQ ID NO: 4616049 - DNA, 19 bp, Homo sapiens
gtgcttattcttaacttat

SEQ ID NO: 4616050 - DNA, 13 bp, Homo sapiens
gtgcttggagggg

SEQ ID NO: 4616051 - DNA, 18 bp, Homo sapiens
gtgcttggagggggaaga

SEQ ID NO: 4616052 - DNA, 19 bp, Homo sapiens
gtgctttccttttttaaaa

SEQ ID NO: 4616053 - DNA, 13 bp, Homo sapiens
gtgcttttctgtt

SEQ ID NO: 4616054 - DNA, 15 bp, Homo sapiens
gtggaaggcagacag

SEQ ID NO: 4616055 - DNA, 14 bp, Homo sapiens
gtggaatgagtgtg

SEQ ID NO: 4616056 - DNA, 19 bp, Homo sapiens
gtggaattttgagaaaaat

SEQ ID NO: 4616057 - DNA, 20 bp, Homo sapiens
gtggacctgggacaagcagg

SEQ ID NO: 4616058 - DNA, 23 bp, Homo sapiens
gtggacctgggacaagcaggccg

SEQ ID NO: 4616059 - DNA, 21 bp, Homo sapiens
gtggactggtgtcataaactt

SEQ ID NO: 4616060 - DNA, 13 bp, Homo sapiens
gtggagaccacac

SEQ ID NO: 4616061 - DNA, 16 bp, Homo sapiens
gtggagatcacagccc

SEQ ID NO: 4616062 - DNA, 19 bp, Homo sapiens
gtggagctactccccacct

SEQ ID NO: 4616063 - DNA, 18 bp, Homo sapiens
gtggagctgccacagaga

SEQ ID NO: 4616064 - DNA, 16 bp, Homo sapiens
gtggaggaagagccac

SEQ ID NO: 4616065 - DNA, 21 bp, Homo sapiens
gtggaggaagagccacctgca

SEQ ID NO: 4616066 - DNA, 12 bp, Homo sapiens
gtggaggctgct

SEQ ID NO: 4616067 - DNA, 14 bp, Homo sapiens
gtggagggaaggat

SEQ ID NO: 4616068 - DNA, 15 bp, Homo sapiens
gtggagggggcaagc

SEQ ID NO: 4616069 - DNA, 16 bp, Homo sapiens
gtggagggggcaagct

SEQ ID NO: 4616070 - DNA, 15 bp, Homo sapiens
gtggataagtggctg

SEQ ID NO: 4616071 - DNA, 14 bp, Homo sapiens
gtggatgtttttaa

SEQ ID NO: 4616072 - DNA, 19 bp, Homo sapiens
gtggattttttattattat

SEQ ID NO: 4616073 - DNA, 12 bp, Homo sapiens
gtggcaattagt

SEQ ID NO: 4616074 - DNA, 22 bp, Homo sapiens
gtggcagggaccggcagagctc

SEQ ID NO: 4616075 - DNA, 19 bp, Homo sapiens
gtggcatgttgatttctat

SEQ ID NO: 4616076 - DNA, 16 bp, Homo sapiens
gtggcccttcccggca

SEQ ID NO: 4616077 - DNA, 15 bp, Homo sapiens
gtggcccttcctgga

SEQ ID NO: 4616078 - DNA, 18 bp, Homo sapiens
gtggcccttcctggacag

SEQ ID NO: 4616079 - DNA, 21 bp, Homo sapiens
gtggcccttcctggacagctg

SEQ ID NO: 4616080 - DNA, 23 bp, Homo sapiens
gtggcctcagctgaatgcctcct

SEQ ID NO: 4616081 - DNA, 15 bp, Homo sapiens
gtggcctccctgctg

SEQ ID NO: 4616082 - DNA, 19 bp, Homo sapiens
gtggcctctttgtctaaaa

SEQ ID NO: 4616083 - DNA, 22 bp, Homo sapiens
gtggcctgtagaatagcctgtg

SEQ ID NO: 4616084 - DNA, 20 bp, Homo sapiens
gtggccttgttctgtcacca

SEQ ID NO: 4616085 - DNA, 23 bp, Homo sapiens
gtggcctttttctgagatgctca

SEQ ID NO: 4616086 - DNA, 15 bp, Homo sapiens
gtggcgtctccctcg

SEQ ID NO: 4616087 - DNA, 18 bp, Homo sapiens
gtggctactctgtgccag

SEQ ID NO: 4616088 - DNA, 21 bp, Homo sapiens
gtggctactctgtgccagagc

SEQ ID NO: 4616089 - DNA, 18 bp, Homo sapiens
gtggctccctctctcctg

SEQ ID NO: 4616090 - DNA, 16 bp, Homo sapiens
gtggcttcactcctgc

SEQ ID NO: 4616091 - DNA, 12 bp, Homo sapiens
gtgggagcctcg

SEQ ID NO: 4616092 - DNA, 13 bp, Homo sapiens
gtgggagcctcgc

SEQ ID NO: 4616093 - DNA, 17 bp, Homo sapiens
gtgggagctgagctgga

SEQ ID NO: 4616094 - DNA, 18 bp, Homo sapiens
gtgggagttttgctctct

SEQ ID NO: 4616095 - DNA, 12 bp, Homo sapiens
gtgggcagagga

SEQ ID NO: 4616096 - DNA, 20 bp, Homo sapiens
gtgggccaccgtgcctggct

SEQ ID NO: 4616097 - DNA, 15 bp, Homo sapiens
gtgggccccgggctg

SEQ ID NO: 4616098 - DNA, 19 bp, Homo sapiens
gtgggctcagcagggctgg

SEQ ID NO: 4616099 - DNA, 11 bp, Homo sapiens
gtgggtctctg

SEQ ID NO: 4616100 - DNA, 22 bp, Homo sapiens
gttttgagtaaaaagacatttt

SEQ ID NO: 4616101 - DNA, 10 bp, Homo sapiens
gttttggaca

SEQ ID NO: 4616102 - DNA, 21 bp, Homo sapiens
gttttggaggttctgaaatac

SEQ ID NO: 4616103 - DNA, 19 bp, Homo sapiens
gttttgtggattaaacctt

SEQ ID NO: 4616104 - DNA, 15 bp, Homo sapiens
gttttgttctttaaa

SEQ ID NO: 4616105 - DNA, 17 bp, Homo sapiens
gttttgtttttttgaga

SEQ ID NO: 4616106 - DNA, 13 bp, Homo sapiens
gtttttagagaat

SEQ ID NO: 4616107 - DNA, 20 bp, Homo sapiens
gtttttagcatgttcctcct

SEQ ID NO: 4616108 - DNA, 19 bp, Homo sapiens
gtttttcctgttcttaaga

SEQ ID NO: 4616109 - DNA, 18 bp, Homo sapiens
gtttttgctaaatgtgag

SEQ ID NO: 4616110 - DNA, 17 bp, Homo sapiens
gtttttggaaaaacctt

SEQ ID NO: 4616111 - DNA, 11 bp, Homo sapiens
gtttttgtaat

SEQ ID NO: 4616112 - DNA, 16 bp, Homo sapiens
gttttttatgaagtgc

SEQ ID NO: 4616113 - DNA, 12 bp, Homo sapiens
gtttttttgaga

SEQ ID NO: 4616114 - DNA, 20 bp, Homo sapiens
taaaaaaactggccttttga

SEQ ID NO: 4616115 - DNA, 21 bp, Homo sapiens
taaaaaaactggccttttgat

SEQ ID NO: 4616116 - DNA, 12 bp, Homo sapiens
taaaaaaagtag

SEQ ID NO: 4616117 - DNA, 23 bp, Homo sapiens
taaaaaacatgtggttacacagt

SEQ ID NO: 4616118 - DNA, 16 bp, Homo sapiens
taaaaaatattttctc

SEQ ID NO: 4616119 - DNA, 12 bp, Homo sapiens
taaaaaatgtct

SEQ ID NO: 4616120 - DNA, 16 bp, Homo sapiens
taaaaacagcattgct

SEQ ID NO: 4616121 - DNA, 18 bp, Homo sapiens
taaaaacttaaatattgt

SEQ ID NO: 4616122 - DNA, 22 bp, Homo sapiens
taaaaacttaaatattgtaata

SEQ ID NO: 4616123 - DNA, 14 bp, Homo sapiens
taaaaactttattg

SEQ ID NO: 4616124 - DNA, 23 bp, Homo sapiens
taaaaagaaaatattaaattaca

SEQ ID NO: 4616125 - DNA, 16 bp, Homo sapiens
taaaaagaaatccagt

SEQ ID NO: 4616126 - DNA, 21 bp, Homo sapiens
taaaaagtaatgacttagaaa

SEQ ID NO: 4616127 - DNA, 14 bp, Homo sapiens
taaaaataaatcta

SEQ ID NO: 4616128 - DNA, 12 bp, Homo sapiens
taaaaatataaa

SEQ ID NO: 4616129 - DNA, 17 bp, Homo sapiens
taaaaatataaattgta

SEQ ID NO: 4616130 - DNA, 15 bp, Homo sapiens
taaaaatatagcaaa

SEQ ID NO: 4616131 - DNA, 11 bp, Homo sapiens
taaaaatgcaa

SEQ ID NO: 4616132 - DNA, 16 bp, Homo sapiens
taaaaatgttctcaaa

SEQ ID NO: 4616133 - DNA, 22 bp, Homo sapiens
taaaaattacctttaattttaa

SEQ ID NO: 4616134 - DNA, 17 bp, Homo sapiens
taaaacaaaatttgact

SEQ ID NO: 4616135 - DNA, 21 bp, Homo sapiens
taaaacaaaatttgactaatt

SEQ ID NO: 4616136 - DNA, 23 bp, Homo sapiens
taaaacaaagattgattgatttt

SEQ ID NO: 4616137 - DNA, 21 bp, Homo sapiens
taaaacaaatatacattttct

SEQ ID NO: 4616138 - DNA, 22 bp, Homo sapiens
taaaacaaatatacattttcta

SEQ ID NO: 4616139 - DNA, 23 bp, Homo sapiens
taaaacaataaaattttttttca

SEQ ID NO: 4616140 - DNA, 14 bp, Homo sapiens
taaaacagaagcct

SEQ ID NO: 4616141 - DNA, 18 bp, Homo sapiens
taaaacatatttcatttt

SEQ ID NO: 4616142 - DNA, 20 bp, Homo sapiens
taaaacatatttcattttaa

SEQ ID NO: 4616143 - DNA, 14 bp, Homo sapiens
taaaacattatttc

SEQ ID NO: 4616144 - DNA, 19 bp, Homo sapiens
taaaacccacaagtgtcta

SEQ ID NO: 4616145 - DNA, 19 bp, Homo sapiens
taaaactaaggcttttatt

SEQ ID NO: 4616146 - DNA, 21 bp, Homo sapiens
taaaactaaggcttttatttc

SEQ ID NO: 4616147 - DNA, 14 bp, Homo sapiens
taaaagcacaatca

SEQ ID NO: 4616148 - DNA, 12 bp, Homo sapiens
taaaagccttcc

SEQ ID NO: 4616149 - DNA, 18 bp, Homo sapiens
taaaaggccaaacctctg

SEQ ID NO: 4616150 - DNA, 20 bp, Homo sapiens
taaaaggccaaacctctgtt

SEQ ID NO: 4616151 - DNA, 21 bp, Homo sapiens
taaaagttttgaaggaaacct

SEQ ID NO: 4616152 - DNA, 21 bp, Homo sapiens
taaaagttttttattatgcat

SEQ ID NO: 4616153 - DNA, 19 bp, Homo sapiens
taaaataaaatgaaaattg

SEQ ID NO: 4616154 - DNA, 14 bp, Homo sapiens
taaaatagaaaaag

SEQ ID NO: 4616155 - DNA, 19 bp, Homo sapiens
taaaatagaataattcttt

SEQ ID NO: 4616156 - DNA, 13 bp, Homo sapiens
taaaatagcaata

SEQ ID NO: 4616157 - DNA, 14 bp, Homo sapiens
taaaatagcaataa

SEQ ID NO: 4616158 - DNA, 19 bp, Homo sapiens
taaaatagcaataactgaa

SEQ ID NO: 4616159 - DNA, 15 bp, Homo sapiens
taaaatatcataaag

SEQ ID NO: 4616160 - DNA, 18 bp, Homo sapiens
taaaatatcataaagcat

SEQ ID NO: 4616161 - DNA, 20 bp, Homo sapiens
taaaatatcataaagcattt

SEQ ID NO: 4616162 - DNA, 12 bp, Homo sapiens
taaaatgaacat

SEQ ID NO: 4616163 - DNA, 16 bp, Homo sapiens
taaaatgaacatctct

SEQ ID NO: 4616164 - DNA, 15 bp, Homo sapiens
taaaatgacaaacat

SEQ ID NO: 4616165 - DNA, 23 bp, Homo sapiens
taaaatgatttgtagtggaaaca

SEQ ID NO: 4616166 - DNA, 15 bp, Homo sapiens
taaaatgccagtctc

SEQ ID NO: 4616167 - DNA, 12 bp, Homo sapiens
taaaatggaatt

SEQ ID NO: 4616168 - DNA, 13 bp, Homo sapiens
taaaatggtcatg

SEQ ID NO: 4616169 - DNA, 21 bp, Homo sapiens
taaaatgtgtacagtgaacaa

SEQ ID NO: 4616170 - DNA, 13 bp, Homo sapiens
taaaatgttgaac

SEQ ID NO: 4616171 - DNA, 12 bp, Homo sapiens
taaaatgtttaa

SEQ ID NO: 4616172 - DNA, 22 bp, Homo sapiens
taaaatgtttcattatgcactt

SEQ ID NO: 4616173 - DNA, 19 bp, Homo sapiens
taaaattttttaaaagttt

SEQ ID NO: 4616174 - DNA, 16 bp, Homo sapiens
taaaattttttttcat

SEQ ID NO: 4616175 - DNA, 17 bp, Homo sapiens
taaaattttttttcatg

SEQ ID NO: 4616176 - DNA, 14 bp, Homo sapiens
taaacaaacaagcc

SEQ ID NO: 4616177 - DNA, 18 bp, Homo sapiens
taaacaaaccacagcagg

SEQ ID NO: 4616178 - DNA, 15 bp, Homo sapiens
taaacaacagctgaa

SEQ ID NO: 4616179 - DNA, 22 bp, Homo sapiens
taaacagataatgcttttacta

SEQ ID NO: 4616180 - DNA, 14 bp, Homo sapiens
taaacataagctaa

SEQ ID NO: 4616181 - DNA, 23 bp, Homo sapiens
taaacataagtgtacgattctta

SEQ ID NO: 4616182 - DNA, 18 bp, Homo sapiens
taaacatatggctttagt

SEQ ID NO: 4616183 - DNA, 13 bp, Homo sapiens
taaacatgtttaa

SEQ ID NO: 4616184 - DNA, 16 bp, Homo sapiens
taaaccagggatgtct

SEQ ID NO: 4616185 - DNA, 17 bp, Homo sapiens
taaacctagtaaaacct

SEQ ID NO: 4616186 - DNA, 20 bp, Homo sapiens
taaacgcagaagagggggag

SEQ ID NO: 4616187 - DNA, 21 bp, Homo sapiens
taaactaggattgacattcta

SEQ ID NO: 4616188 - DNA, 20 bp, Homo sapiens
taaactatgttcctaacaaa

SEQ ID NO: 4616189 - DNA, 16 bp, Homo sapiens
taaactgaatataaag

SEQ ID NO: 4616190 - DNA, 20 bp, Homo sapiens
taaactgaatataaagctta

SEQ ID NO: 4616191 - DNA, 18 bp, Homo sapiens
taaactgactatcataaa

SEQ ID NO: 4616192 - DNA, 15 bp, Homo sapiens
taaacttggaatcaa

SEQ ID NO: 4616193 - DNA, 16 bp, Homo sapiens
taaactttatttgtaa

SEQ ID NO: 4616194 - DNA, 20 bp, Homo sapiens
taaagaaaaatatcttggcc

SEQ ID NO: 4616195 - DNA, 16 bp, Homo sapiens
taaagaaactgaggcc

SEQ ID NO: 4616196 - DNA, 18 bp, Homo sapiens
taaagaaactgaggccca

SEQ ID NO: 4616197 - DNA, 22 bp, Homo sapiens
taaagaagacattttctcttag

SEQ ID NO: 4616198 - DNA, 19 bp, Homo sapiens
taaagactggttttctgcc

SEQ ID NO: 4616199 - DNA, 15 bp, Homo sapiens
taaagagaaaattga

SEQ ID NO: 4616200 - DNA, 23 bp, Homo sapiens
taaagatcatttataatactgtt

SEQ ID NO: 4616201 - DNA, 21 bp, Homo sapiens
taaagattttgttttgttgga

SEQ ID NO: 4616202 - DNA, 23 bp, Homo sapiens
taaagccagttagatagaagaat

SEQ ID NO: 4616203 - DNA, 18 bp, Homo sapiens
taaagccatgctaaaatt

SEQ ID NO: 4616204 - DNA, 14 bp, Homo sapiens
taaagctagaaatg

SEQ ID NO: 4616205 - DNA, 14 bp, Homo sapiens
taaaggacataaaa

SEQ ID NO: 4616206 - DNA, 21 bp, Homo sapiens
taaaggcaaaaccgtgctctt

SEQ ID NO: 4616207 - DNA, 19 bp, Homo sapiens
taaaggcttctctctcacc

SEQ ID NO: 4616208 - DNA, 21 bp, Homo sapiens
taaaggtacgattatacttga

SEQ ID NO: 4616209 - DNA, 18 bp, Homo sapiens
taaagtacaaatgaagaa

SEQ ID NO: 4616210 - DNA, 20 bp, Homo sapiens
taaagtacacaattgtttta

SEQ ID NO: 4616211 - DNA, 15 bp, Homo sapiens
tcaaataaatgtttc

SEQ ID NO: 4616212 - DNA, 22 bp, Homo sapiens
tcaaatatagaaagttgatatt

SEQ ID NO: 4616213 - DNA, 20 bp, Homo sapiens
tcaaatctaccactgtatga

SEQ ID NO: 4616214 - DNA, 23 bp, Homo sapiens
tcaaatcttggcaatattcctta

SEQ ID NO: 4616215 - DNA, 17 bp, Homo sapiens
tcaaatgtgcattttgt

SEQ ID NO: 4616216 - DNA, 17 bp, Homo sapiens
tcaaattcaatgcttct

SEQ ID NO: 4616217 - DNA, 20 bp, Homo sapiens
tcaaattgtcagcaatttaa

SEQ ID NO: 4616218 - DNA, 22 bp, Homo sapiens
tcaaattgtgcagtactttgtg

SEQ ID NO: 4616219 - DNA, 16 bp, Homo sapiens
tcaacaaatttcattg

SEQ ID NO: 4616220 - DNA, 19 bp, Homo sapiens
tcaacaaatttcattgcac

SEQ ID NO: 4616221 - DNA, 20 bp, Homo sapiens
tcaacaaatttcattgcact

SEQ ID NO: 4616222 - DNA, 21 bp, Homo sapiens
tcaacaacgtgagagaaagag

SEQ ID NO: 4616223 - DNA, 18 bp, Homo sapiens
tcaacaataaaatttttt

SEQ ID NO: 4616224 - DNA, 13 bp, Homo sapiens
tcaacatgtaggg

SEQ ID NO: 4616225 - DNA, 13 bp, Homo sapiens
tcaaccagataac

SEQ ID NO: 4616226 - DNA, 16 bp, Homo sapiens
tcaaccccactgtaga

SEQ ID NO: 4616227 - DNA, 17 bp, Homo sapiens
tcaactactattcaaaa

SEQ ID NO: 4616228 - DNA, 19 bp, Homo sapiens
tcaactcccttctcggggt

SEQ ID NO: 4616229 - DNA, 18 bp, Homo sapiens
tcaagaaacagccagcaa

SEQ ID NO: 4616230 - DNA, 20 bp, Homo sapiens
tcaagaaacagccagcaaga

SEQ ID NO: 4616231 - DNA, 21 bp, Homo sapiens
tcaagaatgaaaaatataatg

SEQ ID NO: 4616232 - DNA, 18 bp, Homo sapiens
tcaagacgaggggcaggg

SEQ ID NO: 4616233 - DNA, 12 bp, Homo sapiens
tcaagagaaact

SEQ ID NO: 4616234 - DNA, 13 bp, Homo sapiens
tcaagagaaactt

SEQ ID NO: 4616235 - DNA, 16 bp, Homo sapiens
tcaagagaaacttcaa

SEQ ID NO: 4616236 - DNA, 16 bp, Homo sapiens
tcaagagacactcccc

SEQ ID NO: 4616237 - DNA, 18 bp, Homo sapiens
tcaagatatatgtgtata

SEQ ID NO: 4616238 - DNA, 19 bp, Homo sapiens
tcaagatatatgtgtatac

SEQ ID NO: 4616239 - DNA, 20 bp, Homo sapiens
tcaagatatatgtgtataca

SEQ ID NO: 4616240 - DNA, 21 bp, Homo sapiens
tcaagatatatgtgtatacat

SEQ ID NO: 4616241 - DNA, 16 bp, Homo sapiens
tcaagatgagcctggg

SEQ ID NO: 4616242 - DNA, 15 bp, Homo sapiens
tcaagcaccacgccc

SEQ ID NO: 4616243 - DNA, 16 bp, Homo sapiens
tcaagccatgtataaa

SEQ ID NO: 4616244 - DNA, 20 bp, Homo sapiens
tcaagccatgtataaatgtg

SEQ ID NO: 4616245 - DNA, 16 bp, Homo sapiens
tcaagcgattctcctg

SEQ ID NO: 4616246 - DNA, 12 bp, Homo sapiens
tcaagctgagct

SEQ ID NO: 4616247 - DNA, 16 bp, Homo sapiens
tcaagctgagctggct

SEQ ID NO: 4616248 - DNA, 13 bp, Homo sapiens
tcaagctttcccg

SEQ ID NO: 4616249 - DNA, 22 bp, Homo sapiens
tcaagctttcccgcccagcctc

SEQ ID NO: 4616250 - DNA, 22 bp, Homo sapiens
tcaaggatggttttgggactag

SEQ ID NO: 4616251 - DNA, 19 bp, Homo sapiens
tcaaggcagttgcttgtgt

SEQ ID NO: 4616252 - DNA, 10 bp, Homo sapiens
tcaaggcctt

SEQ ID NO: 4616253 - DNA, 13 bp, Homo sapiens
tcaaggccttcag

SEQ ID NO: 4616254 - DNA, 15 bp, Homo sapiens
tcaaggtcagaacag

SEQ ID NO: 4616255 - DNA, 15 bp, Homo sapiens
tcaagtatccttgtt

SEQ ID NO: 4616256 - DNA, 12 bp, Homo sapiens
tcaagtattttg

SEQ ID NO: 4616257 - DNA, 20 bp, Homo sapiens
tcaagtattttgtgtttgga

SEQ ID NO: 4616258 - DNA, 15 bp, Homo sapiens
tcaagtgtcacctcc

SEQ ID NO: 4616259 - DNA, 16 bp, Homo sapiens
tcaagtgtcacctcct

SEQ ID NO: 4616260 - DNA, 21 bp, Homo sapiens
tcaagtgtcacctccttcccc

SEQ ID NO: 4616261 - DNA, 11 bp, Homo sapiens
tcaataaagtt

SEQ ID NO: 4616262 - DNA, 20 bp, Homo sapiens
tcaataaagttgttgcattc

SEQ ID NO: 4616263 - DNA, 21 bp, Homo sapiens
tcaataaagttgttgcattcc

SEQ ID NO: 4616264 - DNA, 20 bp, Homo sapiens
tcaatactgtatgccttctg

SEQ ID NO: 4616265 - DNA, 17 bp, Homo sapiens
tcaatagctttgtagtt

SEQ ID NO: 4616266 - DNA, 14 bp, Homo sapiens
tcaatatgaatcta

SEQ ID NO: 4616267 - DNA, 16 bp, Homo sapiens
tcaatcatttattcat

SEQ ID NO: 4616268 - DNA, 20 bp, Homo sapiens
tcaattagtggtcataaaat

SEQ ID NO: 4616269 - DNA, 18 bp, Homo sapiens
tcaattccaccagggcca

SEQ ID NO: 4616270 - DNA, 21 bp, Homo sapiens
tcaattccaccagggccagag

SEQ ID NO: 4616271 - DNA, 19 bp, Homo sapiens
tcaattccgtagccagctg

SEQ ID NO: 4616272 - DNA, 12 bp, Homo sapiens
tcaattctgtgt

SEQ ID NO: 4616273 - DNA, 14 bp, Homo sapiens
tcaattgacaaatg

SEQ ID NO: 4616274 - DNA, 16 bp, Homo sapiens
tcaattttatgtattc

SEQ ID NO: 4616275 - DNA, 17 bp, Homo sapiens
tcaatttttgtctcaga

SEQ ID NO: 4616276 - DNA, 20 bp, Homo sapiens
tcacaaataagtaatatctt

SEQ ID NO: 4616277 - DNA, 17 bp, Homo sapiens
tcacaacagtcacctca

SEQ ID NO: 4616278 - DNA, 19 bp, Homo sapiens
tcacaactccttccatcct

SEQ ID NO: 4616279 - DNA, 23 bp, Homo sapiens
tcacaaggcagcaaggcccgagc

SEQ ID NO: 4616280 - DNA, 19 bp, Homo sapiens
tcacacacagactgttgtc

SEQ ID NO: 4616281 - DNA, 20 bp, Homo sapiens
tcacacaggcatttcctggg

SEQ ID NO: 4616282 - DNA, 23 bp, Homo sapiens
tcacacaggcatttcctgggtgg

SEQ ID NO: 4616283 - DNA, 18 bp, Homo sapiens
tcacactaagagggcaga

SEQ ID NO: 4616284 - DNA, 21 bp, Homo sapiens
tcacactaagagggcagactg

SEQ ID NO: 4616285 - DNA, 15 bp, Homo sapiens
tcacagccccaccct

SEQ ID NO: 4616286 - DNA, 17 bp, Homo sapiens
tcacagccccacccttg

SEQ ID NO: 4616287 - DNA, 19 bp, Homo sapiens
tcacagccccacccttgtc

SEQ ID NO: 4616288 - DNA, 16 bp, Homo sapiens
tcacagccgtttgaat

SEQ ID NO: 4616289 - DNA, 18 bp, Homo sapiens
tcacagcctcacccctgc

SEQ ID NO: 4616290 - DNA, 20 bp, Homo sapiens
tcacagcctcacccctgccc

SEQ ID NO: 4616291 - DNA, 21 bp, Homo sapiens
tcacagcctcacccctgcccc

SEQ ID NO: 4616292 - DNA, 18 bp, Homo sapiens
tcacagcttttcttgata

SEQ ID NO: 4616293 - DNA, 19 bp, Homo sapiens
tcacagcttttcttgatag

SEQ ID NO: 4616294 - DNA, 16 bp, Homo sapiens
tcacaggctgagaact

SEQ ID NO: 4616295 - DNA, 17 bp, Homo sapiens
tcacagtacagcatgtg

SEQ ID NO: 4616296 - DNA, 18 bp, Homo sapiens
tcacagtacagcatgtgc

SEQ ID NO: 4616297 - DNA, 14 bp, Homo sapiens
tcacatatgtctta

SEQ ID NO: 4616298 - DNA, 16 bp, Homo sapiens
tcacatatgtcttact

SEQ ID NO: 4616299 - DNA, 17 bp, Homo sapiens
tcacatctctggaaatt

SEQ ID NO: 4616300 - DNA, 13 bp, Homo sapiens
tcacatgaccaca

SEQ ID NO: 4616301 - DNA, 14 bp, Homo sapiens
tcacatgaccacat

SEQ ID NO: 4616302 - DNA, 12 bp, Homo sapiens
tcacattaacat

SEQ ID NO: 4616303 - DNA, 14 bp, Homo sapiens
tcacattaacattt

SEQ ID NO: 4616304 - DNA, 19 bp, Homo sapiens
tcacattaacattttgagc

SEQ ID NO: 4616305 - DNA, 20 bp, Homo sapiens
tcacattaatttaattacta

SEQ ID NO: 4616306 - DNA, 15 bp, Homo sapiens
tcacattaggctgtt

SEQ ID NO: 4616307 - DNA, 20 bp, Homo sapiens
tcacatttttttatgctctt

SEQ ID NO: 4616308 - DNA, 14 bp, Homo sapiens
tcaccaagcagtgg

SEQ ID NO: 4616309 - DNA, 11 bp, Homo sapiens
tcaccagctgc

SEQ ID NO: 4616310 - DNA, 20 bp, Homo sapiens
tcaccagctgctgtgcccca

SEQ ID NO: 4616311 - DNA, 17 bp, Homo sapiens
tcaccaggggaggagcc

SEQ ID NO: 4616312 - DNA, 19 bp, Homo sapiens
tcaccaggggaggagcctg

SEQ ID NO: 4616313 - DNA, 23 bp, Homo sapiens
tcaccagtgcatcacatctgcac

SEQ ID NO: 4616314 - DNA, 12 bp, Homo sapiens
tcaccagtgcca

SEQ ID NO: 4616315 - DNA, 15 bp, Homo sapiens
tcaccagtgccacgt

SEQ ID NO: 4616316 - DNA, 18 bp, Homo sapiens
tcaccagtgccacgtcat

SEQ ID NO: 4616317 - DNA, 21 bp, Homo sapiens
tcaccagtgccacgtcatgag

SEQ ID NO: 4616318 - DNA, 15 bp, Homo sapiens
tcacccactcccttg

SEQ ID NO: 4616319 - DNA, 14 bp, Homo sapiens
tcacccaggctgga

SEQ ID NO: 4616320 - DNA, 15 bp, Homo sapiens
tcacccctcccctgg

SEQ ID NO: 4616321 - DNA, 17 bp, Homo sapiens
tcacccctcccctggga

SEQ ID NO: 4616322 - DNA, 19 bp, Homo sapiens
tatattaccccttcatgtc

SEQ ID NO: 4616323 - DNA, 16 bp, Homo sapiens
tatattagctgaaaca

SEQ ID NO: 4616324 - DNA, 15 bp, Homo sapiens
tatattatatacata

SEQ ID NO: 4616325 - DNA, 14 bp, Homo sapiens
tatattcacagttt

SEQ ID NO: 4616326 - DNA, 15 bp, Homo sapiens
tatattcacagtttt

SEQ ID NO: 4616327 - DNA, 13 bp, Homo sapiens
tatattcctttta

SEQ ID NO: 4616328 - DNA, 19 bp, Homo sapiens
tatattccttttaaagaag

SEQ ID NO: 4616329 - DNA, 16 bp, Homo sapiens
tatattgctgcatttt

SEQ ID NO: 4616330 - DNA, 23 bp, Homo sapiens
tatattgttgttactttttcttg

SEQ ID NO: 4616331 - DNA, 23 bp, Homo sapiens
tatatttagctccaaaccttcac

SEQ ID NO: 4616332 - DNA, 12 bp, Homo sapiens
tatatttatttc

SEQ ID NO: 4616333 - DNA, 14 bp, Homo sapiens
tatatttgcttttt

SEQ ID NO: 4616334 - DNA, 21 bp, Homo sapiens
tatatttttataataaacata

SEQ ID NO: 4616335 - DNA, 23 bp, Homo sapiens
tatcaaaaagtattatcattgct

SEQ ID NO: 4616336 - DNA, 22 bp, Homo sapiens
tatcaaagcattttataaatga

SEQ ID NO: 4616337 - DNA, 14 bp, Homo sapiens
tatcaaataaaata

SEQ ID NO: 4616338 - DNA, 16 bp, Homo sapiens
tatcaaataaaatatc

SEQ ID NO: 4616339 - DNA, 14 bp, Homo sapiens
tatcaaataaaatt

SEQ ID NO: 4616340 - DNA, 14 bp, Homo sapiens
tatcaccagtgcat

SEQ ID NO: 4616341 - DNA, 13 bp, Homo sapiens
tatcactaaataa

SEQ ID NO: 4616342 - DNA, 16 bp, Homo sapiens
tatcactaaataaaca

SEQ ID NO: 4616343 - DNA, 10 bp, Homo sapiens
tatcactcta

SEQ ID NO: 4616344 - DNA, 13 bp, Homo sapiens
tatcactgcatta

SEQ ID NO: 4616345 - DNA, 15 bp, Homo sapiens
tatcagaataggaag

SEQ ID NO: 4616346 - DNA, 16 bp, Homo sapiens
tatcagactcagtttt

SEQ ID NO: 4616347 - DNA, 24 bp, Homo sapiens
tatcagactcagttttttgtaact

SEQ ID NO: 4616348 - DNA, 14 bp, Homo sapiens
tatcaggcaagata

SEQ ID NO: 4616349 - DNA, 20 bp, Homo sapiens
tatcaggcaggaccaggtgg

SEQ ID NO: 4616350 - DNA, 13 bp, Homo sapiens
tatcagggcctga

SEQ ID NO: 4616351 - DNA, 13 bp, Homo sapiens
tatcatgcaaaat

SEQ ID NO: 4616352 - DNA, 13 bp, Homo sapiens
tatcattaaaaat

SEQ ID NO: 4616353 - DNA, 12 bp, Homo sapiens
tatcattctttg

SEQ ID NO: 4616354 - DNA, 18 bp, Homo sapiens
tatcattctttgtatctt

SEQ ID NO: 4616355 - DNA, 21 bp, Homo sapiens
tatcattctttgtatcttaaa

SEQ ID NO: 4616356 - DNA, 15 bp, Homo sapiens
tatcattttattcac

SEQ ID NO: 4616357 - DNA, 17 bp, Homo sapiens
tatccaaggaaacattt

SEQ ID NO: 4616358 - DNA, 23 bp, Homo sapiens
tatccaaggaaacattttatcat

SEQ ID NO: 4616359 - DNA, 16 bp, Homo sapiens
tatcccaatcattgtt

SEQ ID NO: 4616360 - DNA, 14 bp, Homo sapiens
tatcctaaataaaa

SEQ ID NO: 4616361 - DNA, 20 bp, Homo sapiens
tatcctactgagcatttgca

SEQ ID NO: 4616362 - DNA, 11 bp, Homo sapiens
tatcctgggac

SEQ ID NO: 4616363 - DNA, 13 bp, Homo sapiens
tatcctgggacct

SEQ ID NO: 4616364 - DNA, 15 bp, Homo sapiens
tatcctgggggaaga

SEQ ID NO: 4616365 - DNA, 20 bp, Homo sapiens
tatcctgggggaagaggaga

SEQ ID NO: 4616366 - DNA, 21 bp, Homo sapiens
tatcctgggggaagaggagat

SEQ ID NO: 4616367 - DNA, 17 bp, Homo sapiens
tatccttacaatgtgaa

SEQ ID NO: 4616368 - DNA, 17 bp, Homo sapiens
tatcggctcacaaagag

SEQ ID NO: 4616369 - DNA, 17 bp, Homo sapiens
tatctacagtaatgaaa

SEQ ID NO: 4616370 - DNA, 18 bp, Homo sapiens
tatctacattaaaatgac

SEQ ID NO: 4616371 - DNA, 21 bp, Homo sapiens
tatctacattaaaatgacaaa

SEQ ID NO: 4616372 - DNA, 13 bp, Homo sapiens
tatctattagata

SEQ ID NO: 4616373 - DNA, 12 bp, Homo sapiens
tatctattagca

SEQ ID NO: 4616374 - DNA, 15 bp, Homo sapiens
tatctattgaaaata

SEQ ID NO: 4616375 - DNA, 17 bp, Homo sapiens
tatctcgaatttgaaga

SEQ ID NO: 4616376 - DNA, 17 bp, Homo sapiens
tatctctatttgagaat

SEQ ID NO: 4616377 - DNA, 16 bp, Homo sapiens
tatctgcacctagaac

SEQ ID NO: 4616378 - DNA, 19 bp, Homo sapiens
tatctggccatatttacta

SEQ ID NO: 4616379 - DNA, 20 bp, Homo sapiens
tatctgtgtttttgaaatat

SEQ ID NO: 4616380 - DNA, 18 bp, Homo sapiens
tatctgtttaaagcatat

SEQ ID NO: 4616381 - DNA, 20 bp, Homo sapiens
tatctgtttcctgacattgt

SEQ ID NO: 4616382 - DNA, 14 bp, Homo sapiens
tatcttaaaggaca

SEQ ID NO: 4616383 - DNA, 16 bp, Homo sapiens
tatcttaaaggacata

SEQ ID NO: 4616384 - DNA, 22 bp, Homo sapiens
tatcttaaaggacataaaattt

SEQ ID NO: 4616385 - DNA, 21 bp, Homo sapiens
tatcttaggtagtcatgctgt

SEQ ID NO: 4616386 - DNA, 18 bp, Homo sapiens
tatcttgaaaaagtattg

SEQ ID NO: 4616387 - DNA, 20 bp, Homo sapiens
tatcttgctcattcttcagt

SEQ ID NO: 4616388 - DNA, 21 bp, Homo sapiens
tatctttaaaaaaaaatcttg

SEQ ID NO: 4616389 - DNA, 16 bp, Homo sapiens
tatctttcagttatta

SEQ ID NO: 4616390 - DNA, 17 bp, Homo sapiens
tatgaaaatatagacat

SEQ ID NO: 4616391 - DNA, 19 bp, Homo sapiens
tatgaatgcccccagctgg

SEQ ID NO: 4616392 - DNA, 16 bp, Homo sapiens
tatgacaaattcaaga

SEQ ID NO: 4616393 - DNA, 11 bp, Homo sapiens
tatgacacagt

SEQ ID NO: 4616394 - DNA, 22 bp, Homo sapiens
tatgacataagcaatcatttta

SEQ ID NO: 4616395 - DNA, 23 bp, Homo sapiens
tatgacataagcaatcattttat

SEQ ID NO: 4616396 - DNA, 16 bp, Homo sapiens
tatgacatttcttaaa

SEQ ID NO: 4616397 - DNA, 14 bp, Homo sapiens
tatgacccctggcc

SEQ ID NO: 4616398 - DNA, 22 bp, Homo sapiens
tatgactttttataaaatggct

SEQ ID NO: 4616399 - DNA, 15 bp, Homo sapiens
tatgagcttccaagg

SEQ ID NO: 4616400 - DNA, 13 bp, Homo sapiens
tatgaggaaaggt

SEQ ID NO: 4616401 - DNA, 20 bp, Homo sapiens
tatgaggataatgggaagag

SEQ ID NO: 4616402 - DNA, 17 bp, Homo sapiens
tatgagtacaaatgcct

SEQ ID NO: 4616403 - DNA, 20 bp, Homo sapiens
tatgagtacaaatgccttaa

SEQ ID NO: 4616404 - DNA, 20 bp, Homo sapiens
tatgatctctctagctttgt

SEQ ID NO: 4616405 - DNA, 22 bp, Homo sapiens
tatgatcttgagtataagaaat

SEQ ID NO: 4616406 - DNA, 21 bp, Homo sapiens
tatgatgaaaacctacatatt

SEQ ID NO: 4616407 - DNA, 14 bp, Homo sapiens
tatgcaaaatggaa

SEQ ID NO: 4616408 - DNA, 12 bp, Homo sapiens
tatgcaaataca

SEQ ID NO: 4616409 - DNA, 19 bp, Homo sapiens
tatgcacatatggactctg

SEQ ID NO: 4616410 - DNA, 18 bp, Homo sapiens
tatgcaccttgtgtctgt

SEQ ID NO: 4616411 - DNA, 20 bp, Homo sapiens
tatgcaccttgtgtctgtac

SEQ ID NO: 4616412 - DNA, 16 bp, Homo sapiens
tatgcatgtgaagaaa

SEQ ID NO: 4616413 - DNA, 22 bp, Homo sapiens
tatgccactgcactccagcctg

SEQ ID NO: 4616414 - DNA, 20 bp, Homo sapiens
tatgccacttccttttaact

SEQ ID NO: 4616415 - DNA, 23 bp, Homo sapiens
tatgccttggggaggacaaaact

SEQ ID NO: 4616416 - DNA, 15 bp, Homo sapiens
tatgctgcaatacat

SEQ ID NO: 4616417 - DNA, 15 bp, Homo sapiens
tatgctggaggcaga

SEQ ID NO: 4616418 - DNA, 21 bp, Homo sapiens
tatggaaatcttttacatttt

SEQ ID NO: 4616419 - DNA, 18 bp, Homo sapiens
tatggacagggctgtctc

SEQ ID NO: 4616420 - DNA, 16 bp, Homo sapiens
tatggactctgcacat

SEQ ID NO: 4616421 - DNA, 14 bp, Homo sapiens
tatggagagccctg

SEQ ID NO: 4616422 - DNA, 16 bp, Homo sapiens
tatggagagccctggg

SEQ ID NO: 4616423 - DNA, 15 bp, Homo sapiens
tatggatttgttaca

SEQ ID NO: 4616424 - DNA, 12 bp, Homo sapiens
tatggcaggagc

SEQ ID NO: 4616425 - DNA, 20 bp, Homo sapiens
tatggcaggagctactgaga

SEQ ID NO: 4616426 - DNA, 23 bp, Homo sapiens
tatgtaatgtgtggtggcctcag

SEQ ID NO: 4616427 - DNA, 14 bp, Homo sapiens
tatgtaatttcaaa

SEQ ID NO: 4616428 - DNA, 16 bp, Homo sapiens
tatgtagtcataataa

SEQ ID NO: 4616429 - DNA, 15 bp, Homo sapiens
tatgtattttcctaa

SEQ ID NO: 4616430 - DNA, 16 bp, Homo sapiens
tatgtattttcctaat

SEQ ID NO: 4616431 - DNA, 22 bp, Homo sapiens
tatgtcgtagaattccttcgaa

SEQ ID NO: 4616432 - DNA, 23 bp, Homo sapiens
tatgtcgtagaattccttcgaaa

SEQ ID NO: 4616433 - DNA, 15 bp, Homo sapiens
tagggcactgggctg

SEQ ID NO: 4616434 - DNA, 21 bp, Homo sapiens
tagggcctggtccctgggagg

SEQ ID NO: 4616435 - DNA, 15 bp, Homo sapiens
taggggattttaaaa

SEQ ID NO: 4616436 - DNA, 12 bp, Homo sapiens
taggggcttggt

SEQ ID NO: 4616437 - DNA, 12 bp, Homo sapiens
tagggggcaggg

SEQ ID NO: 4616438 - DNA, 16 bp, Homo sapiens
tagggggcaggggcag

SEQ ID NO: 4616439 - DNA, 21 bp, Homo sapiens
taggtatttctaacgccagca

SEQ ID NO: 4616440 - DNA, 14 bp, Homo sapiens
taggtcataaagca

SEQ ID NO: 4616441 - DNA, 20 bp, Homo sapiens
taggtcattcttttgccaca

SEQ ID NO: 4616442 - DNA, 23 bp, Homo sapiens
taggtcattcttttgccacatcc

SEQ ID NO: 4616443 - DNA, 17 bp, Homo sapiens
taggtcttcctgtggct

SEQ ID NO: 4616444 - DNA, 17 bp, Homo sapiens
taggtgaaagaacaagt

SEQ ID NO: 4616445 - DNA, 16 bp, Homo sapiens
taggtgataaaatttt

SEQ ID NO: 4616446 - DNA, 13 bp, Homo sapiens
taggttatacaat

SEQ ID NO: 4616447 - DNA, 14 bp, Homo sapiens
taggttatacaata

SEQ ID NO: 4616448 - DNA, 21 bp, Homo sapiens
taggttatacaataacccagt

SEQ ID NO: 4616449 - DNA, 11 bp, Homo sapiens
taggttctttt

SEQ ID NO: 4616450 - DNA, 13 bp, Homo sapiens
taggttgggacac

SEQ ID NO: 4616451 - DNA, 17 bp, Homo sapiens
tagtaaccaaggccctg

SEQ ID NO: 4616452 - DNA, 21 bp, Homo sapiens
tagtaatttctttttttcctt

SEQ ID NO: 4616453 - DNA, 17 bp, Homo sapiens
tagtattaatggacaaa

SEQ ID NO: 4616454 - DNA, 12 bp, Homo sapiens
tagtcataataa

SEQ ID NO: 4616455 - DNA, 19 bp, Homo sapiens
tagtcatgctgtgcatttt

SEQ ID NO: 4616456 - DNA, 13 bp, Homo sapiens
tagtcattgtcat

SEQ ID NO: 4616457 - DNA, 20 bp, Homo sapiens
tagtcccatttttctcttgc

SEQ ID NO: 4616458 - DNA, 15 bp, Homo sapiens
tagtccgtcctggca

SEQ ID NO: 4616459 - DNA, 10 bp, Homo sapiens
tagtccttgg

SEQ ID NO: 4616460 - DNA, 17 bp, Homo sapiens
tagtcgggcatgagtct

SEQ ID NO: 4616461 - DNA, 12 bp, Homo sapiens
tagtctgggtca

SEQ ID NO: 4616462 - DNA, 17 bp, Homo sapiens
tagtctgggtcagaccc

SEQ ID NO: 4616463 - DNA, 18 bp, Homo sapiens
tagtctgggtcagaccca

SEQ ID NO: 4616464 - DNA, 17 bp, Homo sapiens
tagtctttgtttacatg

SEQ ID NO: 4616465 - DNA, 24 bp, Homo sapiens
tagtctttgtttacatgagttcaa

SEQ ID NO: 4616466 - DNA, 21 bp, Homo sapiens
tagtgaatcacgtaaagctag

SEQ ID NO: 4616467 - DNA, 15 bp, Homo sapiens
tagtgacccacatgc

SEQ ID NO: 4616468 - DNA, 23 bp, Homo sapiens
tagtgctttccttttttaaaaat

SEQ ID NO: 4616469 - DNA, 14 bp, Homo sapiens
tagtgtaataagac

SEQ ID NO: 4616470 - DNA, 14 bp, Homo sapiens
tagtgtatctttaa

SEQ ID NO: 4616471 - DNA, 21 bp, Homo sapiens
tagtgtgacagtttccaaatt

SEQ ID NO: 4616472 - DNA, 16 bp, Homo sapiens
tagttataaaaggctt

SEQ ID NO: 4616473 - DNA, 18 bp, Homo sapiens
tagttataaaaggcttta

SEQ ID NO: 4616474 - DNA, 12 bp, Homo sapiens
tagttcaataca

SEQ ID NO: 4616475 - DNA, 13 bp, Homo sapiens
tagttcaatacag

SEQ ID NO: 4616476 - DNA, 15 bp, Homo sapiens
tagttcaatacagtg

SEQ ID NO: 4616477 - DNA, 21 bp, Homo sapiens
tagttcaatacagtgaaggtc

SEQ ID NO: 4616478 - DNA, 14 bp, Homo sapiens
tagttccctctgcc

SEQ ID NO: 4616479 - DNA, 17 bp, Homo sapiens
tagttccctctgcctgg

SEQ ID NO: 4616480 - DNA, 20 bp, Homo sapiens
tagttgagattgtactgttc

SEQ ID NO: 4616481 - DNA, 21 bp, Homo sapiens
tagttgagattgtactgttca

SEQ ID NO: 4616482 - DNA, 19 bp, Homo sapiens
tagttgcagcccaaggaca

SEQ ID NO: 4616483 - DNA, 15 bp, Homo sapiens
tagttggtctttcca

SEQ ID NO: 4616484 - DNA, 14 bp, Homo sapiens
tagttgtctgtgct

SEQ ID NO: 4616485 - DNA, 12 bp, Homo sapiens
tagtttatctta

SEQ ID NO: 4616486 - DNA, 19 bp, Homo sapiens
tagtttcaaagtgtctcat

SEQ ID NO: 4616487 - DNA, 10 bp, Homo sapiens
tagtttttgt

SEQ ID NO: 4616488 - DNA, 14 bp, Homo sapiens
tataaaagactgac

SEQ ID NO: 4616489 - DNA, 18 bp, Homo sapiens
tataaaagctatggtgag

SEQ ID NO: 4616490 - DNA, 14 bp, Homo sapiens
tataaagcttaata

SEQ ID NO: 4616491 - DNA, 21 bp, Homo sapiens
tataaagggggagggaaatag

SEQ ID NO: 4616492 - DNA, 15 bp, Homo sapiens
tataaatgatatcaa

SEQ ID NO: 4616493 - DNA, 15 bp, Homo sapiens
tataaatgtgtttat

SEQ ID NO: 4616494 - DNA, 17 bp, Homo sapiens
tataaattgtacatttt

SEQ ID NO: 4616495 - DNA, 21 bp, Homo sapiens
tataaattgtacattttgtaa

SEQ ID NO: 4616496 - DNA, 21 bp, Homo sapiens
tataaatttaagaaaacaagt

SEQ ID NO: 4616497 - DNA, 17 bp, Homo sapiens
tataaattttttttgtt

SEQ ID NO: 4616498 - DNA, 14 bp, Homo sapiens
tataactgcccagc

SEQ ID NO: 4616499 - DNA, 22 bp, Homo sapiens
tataagaaaagtaatgaagaat

SEQ ID NO: 4616500 - DNA, 17 bp, Homo sapiens
tataagaaatgcatatg

SEQ ID NO: 4616501 - DNA, 16 bp, Homo sapiens
tataagagcatgaaat

SEQ ID NO: 4616502 - DNA, 22 bp, Homo sapiens
tataagcagattgctttaattt

SEQ ID NO: 4616503 - DNA, 16 bp, Homo sapiens
tataagcccactgtta

SEQ ID NO: 4616504 - DNA, 23 bp, Homo sapiens
tataaggactttttgatggaatt

SEQ ID NO: 4616505 - DNA, 22 bp, Homo sapiens
tataagtaattcagtgggaatt

SEQ ID NO: 4616506 - DNA, 15 bp, Homo sapiens
tataagtagtaaatc

SEQ ID NO: 4616507 - DNA, 16 bp, Homo sapiens
tataagtagtaaatca

SEQ ID NO: 4616508 - DNA, 23 bp, Homo sapiens
tataatactgttttaaaatgtga

SEQ ID NO: 4616509 - DNA, 18 bp, Homo sapiens
tataatcccagcactttg

SEQ ID NO: 4616510 - DNA, 14 bp, Homo sapiens
tataatcttataca

SEQ ID NO: 4616511 - DNA, 17 bp, Homo sapiens
tataatcttatacaaca

SEQ ID NO: 4616512 - DNA, 24 bp, Homo sapiens
tataattagtcgggcatgagtctg

SEQ ID NO: 4616513 - DNA, 20 bp, Homo sapiens
tataattggtgctatttgaa

SEQ ID NO: 4616514 - DNA, 20 bp, Homo sapiens
tataatttactttgtagact

SEQ ID NO: 4616515 - DNA, 21 bp, Homo sapiens
tatacaacagcaaaccctgat

SEQ ID NO: 4616516 - DNA, 16 bp, Homo sapiens
tatacaataacccagt

SEQ ID NO: 4616517 - DNA, 18 bp, Homo sapiens
tatacaataacccagtta

SEQ ID NO: 4616518 - DNA, 13 bp, Homo sapiens
tatacaatgttct

SEQ ID NO: 4616519 - DNA, 19 bp, Homo sapiens
tatacattttctaaataaa

SEQ ID NO: 4616520 - DNA, 22 bp, Homo sapiens
tatacattttttaggacatctt

SEQ ID NO: 4616521 - DNA, 15 bp, Homo sapiens
tataccctttttcat

SEQ ID NO: 4616522 - DNA, 16 bp, Homo sapiens
tataccctttttcatt

SEQ ID NO: 4616523 - DNA, 21 bp, Homo sapiens
tatactactttgttaggattt

SEQ ID NO: 4616524 - DNA, 14 bp, Homo sapiens
tatagcaaatgcag

SEQ ID NO: 4616525 - DNA, 16 bp, Homo sapiens
tatagcaacaacaatt

SEQ ID NO: 4616526 - DNA, 16 bp, Homo sapiens
tatagcaagatattga

SEQ ID NO: 4616527 - DNA, 18 bp, Homo sapiens
tatagccaactgctaatg

SEQ ID NO: 4616528 - DNA, 19 bp, Homo sapiens
tatagccaactgctaatgc

SEQ ID NO: 4616529 - DNA, 17 bp, Homo sapiens
tataggagccccaggca

SEQ ID NO: 4616530 - DNA, 20 bp, Homo sapiens
tatagttaatattttgttct

SEQ ID NO: 4616531 - DNA, 19 bp, Homo sapiens
tatataaaactaaggcttt

SEQ ID NO: 4616532 - DNA, 18 bp, Homo sapiens
tatataagttgctgtgtg

SEQ ID NO: 4616533 - DNA, 23 bp, Homo sapiens
tatatacagaggaaatctgtaac

SEQ ID NO: 4616534 - DNA, 11 bp, Homo sapiens
tatatatatat

SEQ ID NO: 4616535 - DNA, 15 bp, Homo sapiens
tatatatatatactt

SEQ ID NO: 4616536 - DNA, 13 bp, Homo sapiens
tatatatttctat

SEQ ID NO: 4616537 - DNA, 17 bp, Homo sapiens
tatatatttctattatt

SEQ ID NO: 4616538 - DNA, 16 bp, Homo sapiens
tatatcgatgatggaa

SEQ ID NO: 4616539 - DNA, 17 bp, Homo sapiens
tatatctatatgtactt

SEQ ID NO: 4616540 - DNA, 14 bp, Homo sapiens
tatatctctatttg

SEQ ID NO: 4616541 - DNA, 19 bp, Homo sapiens
tatatgtacttgtcaaaga

SEQ ID NO: 4616542 - DNA, 16 bp, Homo sapiens
tatatgtgtatacata

SEQ ID NO: 4616543 - DNA, 20 bp, Homo sapiens
tatattaagtgtgccaaatc

SEQ ID NO: 4616544 - DNA, 14 bp, Homo sapiens
tatattaatattta

SEQ ID NO: 4616545 - DNA, 19 bp, Homo sapiens
tagaactcactctgggctg

SEQ ID NO: 4616546 - DNA, 20 bp, Homo sapiens
tagaactcactctgggctgt

SEQ ID NO: 4616547 - DNA, 15 bp, Homo sapiens
tagaactgtctgtga

SEQ ID NO: 4616548 - DNA, 16 bp, Homo sapiens
tagaactgtctgtgaa

SEQ ID NO: 4616549 - DNA, 13 bp, Homo sapiens
tagaagaatttta

SEQ ID NO: 4616550 - DNA, 15 bp, Homo sapiens
tagaagcaaggagaa

SEQ ID NO: 4616551 - DNA, 20 bp, Homo sapiens
tagaagcagagggacaacca

SEQ ID NO: 4616552 - DNA, 20 bp, Homo sapiens
tagaataattcttttctgag

SEQ ID NO: 4616553 - DNA, 22 bp, Homo sapiens
tagaatggataaaataatgctg

SEQ ID NO: 4616554 - DNA, 14 bp, Homo sapiens
tagaattaaaaaag

SEQ ID NO: 4616555 - DNA, 15 bp, Homo sapiens
tagaatttttaccca

SEQ ID NO: 4616556 - DNA, 20 bp, Homo sapiens
tagacaaaccatctcctcct

SEQ ID NO: 4616557 - DNA, 20 bp, Homo sapiens
tagacaatgatttggccagg

SEQ ID NO: 4616558 - DNA, 18 bp, Homo sapiens
tagacagaaacatgtctt

SEQ ID NO: 4616559 - DNA, 21 bp, Homo sapiens
tagacatcattgtcagccttg

SEQ ID NO: 4616560 - DNA, 19 bp, Homo sapiens
tagacatgcccaaaactta

SEQ ID NO: 4616561 - DNA, 16 bp, Homo sapiens
tagactcgcctatctt

SEQ ID NO: 4616562 - DNA, 22 bp, Homo sapiens
tagactctgtctacctggtctg

SEQ ID NO: 4616563 - DNA, 24 bp, Homo sapiens
tagactgtgtctgaatcatgtctg

SEQ ID NO: 4616564 - DNA, 13 bp, Homo sapiens
tagagaaacattt

SEQ ID NO: 4616565 - DNA, 14 bp, Homo sapiens
tagagaaacatttg

SEQ ID NO: 4616566 - DNA, 16 bp, Homo sapiens
tagagaaacatttgga

SEQ ID NO: 4616567 - DNA, 16 bp, Homo sapiens
tagagaatgtgtttca

SEQ ID NO: 4616568 - DNA, 18 bp, Homo sapiens
tagagaatgtgtttcaaa

SEQ ID NO: 4616569 - DNA, 12 bp, Homo sapiens
tagagacagtgt

SEQ ID NO: 4616570 - DNA, 20 bp, Homo sapiens
tagagacagtgtttcgtcat

SEQ ID NO: 4616571 - DNA, 14 bp, Homo sapiens
tagagcccattaat

SEQ ID NO: 4616572 - DNA, 21 bp, Homo sapiens
tagagcgggatggggatggga

SEQ ID NO: 4616573 - DNA, 23 bp, Homo sapiens
tagaggcattacttgctttcaat

SEQ ID NO: 4616574 - DNA, 15 bp, Homo sapiens
tagaggtactagaat

SEQ ID NO: 4616575 - DNA, 18 bp, Homo sapiens
tagaggtactagaatgct

SEQ ID NO: 4616576 - DNA, 23 bp, Homo sapiens
tagaggtgttacagaggaccctt

SEQ ID NO: 4616577 - DNA, 13 bp, Homo sapiens
tagagtgtagcct

SEQ ID NO: 4616578 - DNA, 21 bp, Homo sapiens
tagagtgtagcctaaagggca

SEQ ID NO: 4616579 - DNA, 23 bp, Homo sapiens
tagagtgtagcctaaagggcagg

SEQ ID NO: 4616580 - DNA, 18 bp, Homo sapiens
tagatgtgcccttttata

SEQ ID NO: 4616581 - DNA, 14 bp, Homo sapiens
tagatgttgctctt

SEQ ID NO: 4616582 - DNA, 22 bp, Homo sapiens
tagatttctatgatcctttttt

SEQ ID NO: 4616583 - DNA, 17 bp, Homo sapiens
tagatttttttttccac

SEQ ID NO: 4616584 - DNA, 23 bp, Homo sapiens
tagatttttttttccacttttgt

SEQ ID NO: 4616585 - DNA, 23 bp, Homo sapiens
tagcaaataatttcctggtgtga

SEQ ID NO: 4616586 - DNA, 12 bp, Homo sapiens
tagcaaatgcag

SEQ ID NO: 4616587 - DNA, 19 bp, Homo sapiens
tagcaaatgcagaaccaca

SEQ ID NO: 4616588 - DNA, 18 bp, Homo sapiens
tagcaacaacaattggta

SEQ ID NO: 4616589 - DNA, 13 bp, Homo sapiens
tagcaataactga

SEQ ID NO: 4616590 - DNA, 15 bp, Homo sapiens
tagcaataactgaaa

SEQ ID NO: 4616591 - DNA, 16 bp, Homo sapiens
tagcaataactgaaaa

SEQ ID NO: 4616592 - DNA, 17 bp, Homo sapiens
tagcaataactgaaaat

SEQ ID NO: 4616593 - DNA, 20 bp, Homo sapiens
tagcaggaacttctagctca

SEQ ID NO: 4616594 - DNA, 21 bp, Homo sapiens
tagcagtgtgaagtacaataa

SEQ ID NO: 4616595 - DNA, 15 bp, Homo sapiens
tagcatcatcctgca

SEQ ID NO: 4616596 - DNA, 13 bp, Homo sapiens
tagcatggcggca

SEQ ID NO: 4616597 - DNA, 18 bp, Homo sapiens
tagcatggcggcacacat

SEQ ID NO: 4616598 - DNA, 17 bp, Homo sapiens
tagcatggggattgcag

SEQ ID NO: 4616599 - DNA, 23 bp, Homo sapiens
tagcatgttcctccttttcttca

SEQ ID NO: 4616600 - DNA, 17 bp, Homo sapiens
tagcatttttgtaactt

SEQ ID NO: 4616601 - DNA, 19 bp, Homo sapiens
tagccaactgtttccctgc

SEQ ID NO: 4616602 - DNA, 18 bp, Homo sapiens
tagccagcacacagggca

SEQ ID NO: 4616603 - DNA, 23 bp, Homo sapiens
tagccaggtctcctgggaaaggg

SEQ ID NO: 4616604 - DNA, 19 bp, Homo sapiens
tagccatgatggcaacaga

SEQ ID NO: 4616605 - DNA, 17 bp, Homo sapiens
tagccattgatcataaa

SEQ ID NO: 4616606 - DNA, 15 bp, Homo sapiens
tagcccagtgttttc

SEQ ID NO: 4616607 - DNA, 21 bp, Homo sapiens
tagccccattgctccattcac

SEQ ID NO: 4616608 - DNA, 20 bp, Homo sapiens
tagccctcagacatttatat

SEQ ID NO: 4616609 - DNA, 15 bp, Homo sapiens
tagcctaaagggcag

SEQ ID NO: 4616610 - DNA, 16 bp, Homo sapiens
tagcctaaagggcagg

SEQ ID NO: 4616611 - DNA, 20 bp, Homo sapiens
tagcctaacacactccaaga

SEQ ID NO: 4616612 - DNA, 17 bp, Homo sapiens
tagcctggactgtttca

SEQ ID NO: 4616613 - DNA, 21 bp, Homo sapiens
tagcctggactgtttcatagt

SEQ ID NO: 4616614 - DNA, 13 bp, Homo sapiens
tagcctgtggcct

SEQ ID NO: 4616615 - DNA, 19 bp, Homo sapiens
tagctagtttgctttttgc

SEQ ID NO: 4616616 - DNA, 21 bp, Homo sapiens
tagctatagttgcagcccaag

SEQ ID NO: 4616617 - DNA, 14 bp, Homo sapiens
tagctctctaggcc

SEQ ID NO: 4616618 - DNA, 23 bp, Homo sapiens
tagctcttttttgtttgtttctt

SEQ ID NO: 4616619 - DNA, 19 bp, Homo sapiens
tagctgtaagggcagtgcc

SEQ ID NO: 4616620 - DNA, 23 bp, Homo sapiens
tagctgtaagggcagtgcccatg

SEQ ID NO: 4616621 - DNA, 14 bp, Homo sapiens
tagctgtgacctgc

SEQ ID NO: 4616622 - DNA, 17 bp, Homo sapiens
tagctgtgacctgctga

SEQ ID NO: 4616623 - DNA, 15 bp, Homo sapiens
tagctgtttcaaatg

SEQ ID NO: 4616624 - DNA, 18 bp, Homo sapiens
tagctgtttcaaatgtgc

SEQ ID NO: 4616625 - DNA, 14 bp, Homo sapiens
tagctttacatttt

SEQ ID NO: 4616626 - DNA, 15 bp, Homo sapiens
tagctttcaattccg

SEQ ID NO: 4616627 - DNA, 23 bp, Homo sapiens
tagctttcaattccgtagccagc

SEQ ID NO: 4616628 - DNA, 19 bp, Homo sapiens
tagctttccaaggaagcag

SEQ ID NO: 4616629 - DNA, 13 bp, Homo sapiens
tagctttgaaact

SEQ ID NO: 4616630 - DNA, 12 bp, Homo sapiens
taggaaaatgct

SEQ ID NO: 4616631 - DNA, 18 bp, Homo sapiens
taggaaaatgcttattga

SEQ ID NO: 4616632 - DNA, 10 bp, Homo sapiens
taggaacagc

SEQ ID NO: 4616633 - DNA, 23 bp, Homo sapiens
taggaagaacgttttttcctcag

SEQ ID NO: 4616634 - DNA, 17 bp, Homo sapiens
taggaagatatgccact

SEQ ID NO: 4616635 - DNA, 13 bp, Homo sapiens
taggaaggaaact

SEQ ID NO: 4616636 - DNA, 19 bp, Homo sapiens
taggaatattttcttctgc

SEQ ID NO: 4616637 - DNA, 14 bp, Homo sapiens
taggaatggaggag

SEQ ID NO: 4616638 - DNA, 14 bp, Homo sapiens
taggacatcttaaa

SEQ ID NO: 4616639 - DNA, 13 bp, Homo sapiens
taggaccaggcca

SEQ ID NO: 4616640 - DNA, 15 bp, Homo sapiens
taggaccaggccacc

SEQ ID NO: 4616641 - DNA, 16 bp, Homo sapiens
taggagcaaagcctgt

SEQ ID NO: 4616642 - DNA, 12 bp, Homo sapiens
taggagggactg

SEQ ID NO: 4616643 - DNA, 21 bp, Homo sapiens
taggatagctaactgtaaatc

SEQ ID NO: 4616644 - DNA, 20 bp, Homo sapiens
taggattggagtatgattta

SEQ ID NO: 4616645 - DNA, 14 bp, Homo sapiens
taggatttttagaa

SEQ ID NO: 4616646 - DNA, 15 bp, Homo sapiens
taggcatttcctgct

SEQ ID NO: 4616647 - DNA, 22 bp, Homo sapiens
taggccaccattataatttata

SEQ ID NO: 4616648 - DNA, 17 bp, Homo sapiens
taggccccacaaggcct

SEQ ID NO: 4616649 - DNA, 14 bp, Homo sapiens
taggccccagaggc

SEQ ID NO: 4616650 - DNA, 21 bp, Homo sapiens
taggccccagaggccctggag

SEQ ID NO: 4616651 - DNA, 22 bp, Homo sapiens
taggccccagaggccctggagg

SEQ ID NO: 4616652 - DNA, 23 bp, Homo sapiens
tagggagtatgctggaggcagag

SEQ ID NO: 4616653 - DNA, 22 bp, Homo sapiens
tagggatgcggatcctgctggg

SEQ ID NO: 4616654 - DNA, 18 bp, Homo sapiens
tagggatttattttcaat

SEQ ID NO: 4616655 - DNA, 14 bp, Homo sapiens
tagggcactgggct

SEQ ID NO: 4616656 - DNA, 17 bp, Homo sapiens
tacctgtctctctcttc

SEQ ID NO: 4616657 - DNA, 14 bp, Homo sapiens
taccttctcccagg

SEQ ID NO: 4616658 - DNA, 16 bp, Homo sapiens
taccttctcccaggcc

SEQ ID NO: 4616659 - DNA, 17 bp, Homo sapiens
taccttctcccaggcct

SEQ ID NO: 4616660 - DNA, 23 bp, Homo sapiens
taccttctcccaggcctctgccc

SEQ ID NO: 4616661 - DNA, 21 bp, Homo sapiens
tacgagaaaatctgcatgttt

SEQ ID NO: 4616662 - DNA, 19 bp, Homo sapiens
tacgatatttcgtttggtc

SEQ ID NO: 4616663 - DNA, 19 bp, Homo sapiens
tacgcaggtatttagaagc

SEQ ID NO: 4616664 - DNA, 20 bp, Homo sapiens
tacgcaggtatttagaagca

SEQ ID NO: 4616665 - DNA, 23 bp, Homo sapiens
tacgccaatgttatgccagctcc

SEQ ID NO: 4616666 - DNA, 14 bp, Homo sapiens
tacgtatttttctg

SEQ ID NO: 4616667 - DNA, 16 bp, Homo sapiens
tacgtgtgaaatctgt

SEQ ID NO: 4616668 - DNA, 16 bp, Homo sapiens
tactaactaaatacca

SEQ ID NO: 4616669 - DNA, 18 bp, Homo sapiens
tactaaggagtaatctgt

SEQ ID NO: 4616670 - DNA, 23 bp, Homo sapiens
tactaatagagtacttaatatac

SEQ ID NO: 4616671 - DNA, 16 bp, Homo sapiens
tactaatgtaaaatga

SEQ ID NO: 4616672 - DNA, 20 bp, Homo sapiens
tactaatgtaaaatgatttg

SEQ ID NO: 4616673 - DNA, 20 bp, Homo sapiens
tactacactccatgtcaggt

SEQ ID NO: 4616674 - DNA, 17 bp, Homo sapiens
tactacccatagaaaac

SEQ ID NO: 4616675 - DNA, 15 bp, Homo sapiens
tactaccctttgctg

SEQ ID NO: 4616676 - DNA, 12 bp, Homo sapiens
tactactttgtt

SEQ ID NO: 4616677 - DNA, 22 bp, Homo sapiens
tactactttgttaggattttca

SEQ ID NO: 4616678 - DNA, 23 bp, Homo sapiens
tactactttgttaggattttcac

SEQ ID NO: 4616679 - DNA, 23 bp, Homo sapiens
tactaggaagaacgttttttcct

SEQ ID NO: 4616680 - DNA, 23 bp, Homo sapiens
tactaggcttaatacctgggtga

SEQ ID NO: 4616681 - DNA, 19 bp, Homo sapiens
tactagttacacatcttca

SEQ ID NO: 4616682 - DNA, 15 bp, Homo sapiens
tactcagggattcct

SEQ ID NO: 4616683 - DNA, 21 bp, Homo sapiens
tactcagggattccttctaag

SEQ ID NO: 4616684 - DNA, 21 bp, Homo sapiens
tactccagtgccaacaatcct

SEQ ID NO: 4616685 - DNA, 22 bp, Homo sapiens
tactcccactcccggcctgtca

SEQ ID NO: 4616686 - DNA, 21 bp, Homo sapiens
tactcctgtgggagcctcgca

SEQ ID NO: 4616687 - DNA, 13 bp, Homo sapiens
tactctctgcttc

SEQ ID NO: 4616688 - DNA, 17 bp, Homo sapiens
tactctgtcgcccaggc

SEQ ID NO: 4616689 - DNA, 16 bp, Homo sapiens
tactctgtgccagagc

SEQ ID NO: 4616690 - DNA, 17 bp, Homo sapiens
tactctgtgccagagcc

SEQ ID NO: 4616691 - DNA, 20 bp, Homo sapiens
tactctgtgccagagcctgg

SEQ ID NO: 4616692 - DNA, 21 bp, Homo sapiens
tactctgtgccagagcctggg

SEQ ID NO: 4616693 - DNA, 19 bp, Homo sapiens
tactctgttgcctcctctc

SEQ ID NO: 4616694 - DNA, 23 bp, Homo sapiens
tactctgttgcctcctctctccc

SEQ ID NO: 4616695 - DNA, 14 bp, Homo sapiens
tactcttgatttca

SEQ ID NO: 4616696 - DNA, 15 bp, Homo sapiens
tactgattgtttcat

SEQ ID NO: 4616697 - DNA, 22 bp, Homo sapiens
tactgcacactgcacatttgct

SEQ ID NO: 4616698 - DNA, 15 bp, Homo sapiens
tactgcagcacctcc

SEQ ID NO: 4616699 - DNA, 22 bp, Homo sapiens
tactgcattctctcccatcctg

SEQ ID NO: 4616700 - DNA, 21 bp, Homo sapiens
tactgcctataatcttataca

SEQ ID NO: 4616701 - DNA, 22 bp, Homo sapiens
tactgcctataatcttatacaa

SEQ ID NO: 4616702 - DNA, 11 bp, Homo sapiens
tactgcctgct

SEQ ID NO: 4616703 - DNA, 13 bp, Homo sapiens
tactgggaaggct

SEQ ID NO: 4616704 - DNA, 23 bp, Homo sapiens
tactgggccttagtgggccaggg

SEQ ID NO: 4616705 - DNA, 14 bp, Homo sapiens
tactgggtgtcatt

SEQ ID NO: 4616706 - DNA, 17 bp, Homo sapiens
tactgggtgtcatttca

SEQ ID NO: 4616707 - DNA, 20 bp, Homo sapiens
tactgggtgtcatttcattc

SEQ ID NO: 4616708 - DNA, 22 bp, Homo sapiens
tactgggtgtcatttcattcca

SEQ ID NO: 4616709 - DNA, 13 bp, Homo sapiens
tactgtaatttct

SEQ ID NO: 4616710 - DNA, 15 bp, Homo sapiens
tactgtagacactct

SEQ ID NO: 4616711 - DNA, 20 bp, Homo sapiens
tactgtagacactctgacaa

SEQ ID NO: 4616712 - DNA, 18 bp, Homo sapiens
tactgtatgccttctgta

SEQ ID NO: 4616713 - DNA, 14 bp, Homo sapiens
tactgtggggtgga

SEQ ID NO: 4616714 - DNA, 15 bp, Homo sapiens
tactgttcatacagt

SEQ ID NO: 4616715 - DNA, 12 bp, Homo sapiens
tactgttctcaa

SEQ ID NO: 4616716 - DNA, 13 bp, Homo sapiens
tactgtttctaaa

SEQ ID NO: 4616717 - DNA, 15 bp, Homo sapiens
tacttaacatttcat

SEQ ID NO: 4616718 - DNA, 22 bp, Homo sapiens
tacttaacatttcattgtacaa

SEQ ID NO: 4616719 - DNA, 19 bp, Homo sapiens
tacttaagctcccctgcct

SEQ ID NO: 4616720 - DNA, 19 bp, Homo sapiens
tacttattttcagtgcatc

SEQ ID NO: 4616721 - DNA, 20 bp, Homo sapiens
tacttattttcagtgcatca

SEQ ID NO: 4616722 - DNA, 23 bp, Homo sapiens
tacttcataagatattctttaca

SEQ ID NO: 4616723 - DNA, 19 bp, Homo sapiens
tacttcctctgtgaactgt

SEQ ID NO: 4616724 - DNA, 20 bp, Homo sapiens
tacttcctctgtgaactgtg

SEQ ID NO: 4616725 - DNA, 18 bp, Homo sapiens
tacttctcagtccccttc

SEQ ID NO: 4616726 - DNA, 24 bp, Homo sapiens
tacttgaagaaacagagtggcctc

SEQ ID NO: 4616727 - DNA, 13 bp, Homo sapiens
tacttgaatgtag

SEQ ID NO: 4616728 - DNA, 20 bp, Homo sapiens
tacttgaggatcatatgaat

SEQ ID NO: 4616729 - DNA, 18 bp, Homo sapiens
tacttgagggaccaatat

SEQ ID NO: 4616730 - DNA, 20 bp, Homo sapiens
tacttgagggaccaatatta

SEQ ID NO: 4616731 - DNA, 15 bp, Homo sapiens
tacttgctttcaatt

SEQ ID NO: 4616732 - DNA, 23 bp, Homo sapiens
tacttggctgcttcctgtgacag

SEQ ID NO: 4616733 - DNA, 15 bp, Homo sapiens
tacttgtcaaagaag

SEQ ID NO: 4616734 - DNA, 16 bp, Homo sapiens
tacttgtcaaagaagg

SEQ ID NO: 4616735 - DNA, 11 bp, Homo sapiens
tacttgtgaaa

SEQ ID NO: 4616736 - DNA, 17 bp, Homo sapiens
tactttaaacttgtctt

SEQ ID NO: 4616737 - DNA, 15 bp, Homo sapiens
tactttaaatcctac

SEQ ID NO: 4616738 - DNA, 20 bp, Homo sapiens
tactttaaatcctaccaaag

SEQ ID NO: 4616739 - DNA, 19 bp, Homo sapiens
tacttttagtagagacagt

SEQ ID NO: 4616740 - DNA, 21 bp, Homo sapiens
tacttttagtagagacagtgt

SEQ ID NO: 4616741 - DNA, 13 bp, Homo sapiens
tacttttattatt

SEQ ID NO: 4616742 - DNA, 17 bp, Homo sapiens
tacttttcttcagtcct

SEQ ID NO: 4616743 - DNA, 17 bp, Homo sapiens
tactttttcttgtattc

SEQ ID NO: 4616744 - DNA, 21 bp, Homo sapiens
tacttttttaaatattttcta

SEQ ID NO: 4616745 - DNA, 20 bp, Homo sapiens
tacttttttacactgataaa

SEQ ID NO: 4616746 - DNA, 19 bp, Homo sapiens
tacttttttttagttcaat

SEQ ID NO: 4616747 - DNA, 21 bp, Homo sapiens
tacttttttttagttcaatac

SEQ ID NO: 4616748 - DNA, 19 bp, Homo sapiens
tagaaaaagtaaaagatca

SEQ ID NO: 4616749 - DNA, 12 bp, Homo sapiens
tagaaaaataaa

SEQ ID NO: 4616750 - DNA, 15 bp, Homo sapiens
tagaaaaataaaaat

SEQ ID NO: 4616751 - DNA, 21 bp, Homo sapiens
tagaaaacttgacatgtagct

SEQ ID NO: 4616752 - DNA, 22 bp, Homo sapiens
tagaaaacttgacatgtagctt

SEQ ID NO: 4616753 - DNA, 17 bp, Homo sapiens
tagaaaatgacttattt

SEQ ID NO: 4616754 - DNA, 20 bp, Homo sapiens
tagaaaatgacttatttctg

SEQ ID NO: 4616755 - DNA, 22 bp, Homo sapiens
tagaaaatgacttatttctgct

SEQ ID NO: 4616756 - DNA, 13 bp, Homo sapiens
tagaaaattattt

SEQ ID NO: 4616757 - DNA, 17 bp, Homo sapiens
tagaaaattcagctcct

SEQ ID NO: 4616758 - DNA, 15 bp, Homo sapiens
tagaaacattgtaaa

SEQ ID NO: 4616759 - DNA, 16 bp, Homo sapiens
tagaaagaaactaaac

SEQ ID NO: 4616760 - DNA, 18 bp, Homo sapiens
tagaaagagatacagagg

SEQ ID NO: 4616761 - DNA, 13 bp, Homo sapiens
tagaaattttcaa

SEQ ID NO: 4616762 - DNA, 22 bp, Homo sapiens
tagaaatttttcagatgcttct

SEQ ID NO: 4616763 - DNA, 14 bp, Homo sapiens
tagaactagccaaa

SEQ ID NO: 4616764 - DNA, 15 bp, Homo sapiens
tagaactcactctgg

SEQ ID NO: 4616765 - DNA, 18 bp, Homo sapiens
tagaactcactctgggct

SEQ ID NO: 4616766 - DNA, 13 bp, Homo sapiens
taatttgaaaaag

SEQ ID NO: 4616767 - DNA, 16 bp, Homo sapiens
taattttaatgctgtt

SEQ ID NO: 4616768 - DNA, 19 bp, Homo sapiens
taattttgcatactgaaaa

SEQ ID NO: 4616769 - DNA, 23 bp, Homo sapiens
taatttttattatgaaactttcc

SEQ ID NO: 4616770 - DNA, 15 bp, Homo sapiens
taattttttcttaag

SEQ ID NO: 4616771 - DNA, 15 bp, Homo sapiens
tacaaaatttattct

SEQ ID NO: 4616772 - DNA, 17 bp, Homo sapiens
tacaaagaaataacaag

SEQ ID NO: 4616773 - DNA, 13 bp, Homo sapiens
tacaaagatgact

SEQ ID NO: 4616774 - DNA, 14 bp, Homo sapiens
tacaaatgaagaaa

SEQ ID NO: 4616775 - DNA, 17 bp, Homo sapiens
tacaaatgaagaaagtc

SEQ ID NO: 4616776 - DNA, 14 bp, Homo sapiens
tacaaattgtcgtt

SEQ ID NO: 4616777 - DNA, 14 bp, Homo sapiens
tacaaccatatatt

SEQ ID NO: 4616778 - DNA, 14 bp, Homo sapiens
tacaagaaaatgta

SEQ ID NO: 4616779 - DNA, 22 bp, Homo sapiens
tacaaggtaggctgcaaaatta

SEQ ID NO: 4616780 - DNA, 14 bp, Homo sapiens
tacaataacccagt

SEQ ID NO: 4616781 - DNA, 22 bp, Homo sapiens
tacaataagcgttaagggcaga

SEQ ID NO: 4616782 - DNA, 18 bp, Homo sapiens
tacaataattcatattct

SEQ ID NO: 4616783 - DNA, 20 bp, Homo sapiens
tacaatcacattaacatttt

SEQ ID NO: 4616784 - DNA, 20 bp, Homo sapiens
tacaatcagcccagtgcaaa

SEQ ID NO: 4616785 - DNA, 12 bp, Homo sapiens
tacaatgtgaat

SEQ ID NO: 4616786 - DNA, 13 bp, Homo sapiens
tacacaattctta

SEQ ID NO: 4616787 - DNA, 13 bp, Homo sapiens
tacacacatatat

SEQ ID NO: 4616788 - DNA, 13 bp, Homo sapiens
tacacagagaagg

SEQ ID NO: 4616789 - DNA, 17 bp, Homo sapiens
tacacagagaaggctat

SEQ ID NO: 4616790 - DNA, 22 bp, Homo sapiens
tacacagtgtgaataaagtgct

SEQ ID NO: 4616791 - DNA, 16 bp, Homo sapiens
tacacatttttaaatt

SEQ ID NO: 4616792 - DNA, 17 bp, Homo sapiens
tacacatttttaaattg

SEQ ID NO: 4616793 - DNA, 20 bp, Homo sapiens
tacacatttttaaattgtta

SEQ ID NO: 4616794 - DNA, 23 bp, Homo sapiens
tacacatttttaaattgttagct

SEQ ID NO: 4616795 - DNA, 12 bp, Homo sapiens
tacaccactctg

SEQ ID NO: 4616796 - DNA, 17 bp, Homo sapiens
tacaccactctggcagc

SEQ ID NO: 4616797 - DNA, 20 bp, Homo sapiens
tacaccactctggcagccac

SEQ ID NO: 4616798 - DNA, 21 bp, Homo sapiens
tacaccactctggcagccaca

SEQ ID NO: 4616799 - DNA, 17 bp, Homo sapiens
tacacgtgtcctgtagt

SEQ ID NO: 4616800 - DNA, 15 bp, Homo sapiens
tacacgtttatctta

SEQ ID NO: 4616801 - DNA, 18 bp, Homo sapiens
tacactaggaaacgtgtt

SEQ ID NO: 4616802 - DNA, 19 bp, Homo sapiens
tacactttttacagcagca

SEQ ID NO: 4616803 - DNA, 17 bp, Homo sapiens
tacagacctaatatcat

SEQ ID NO: 4616804 - DNA, 13 bp, Homo sapiens
tacagactgaaag

SEQ ID NO: 4616805 - DNA, 10 bp, Homo sapiens
tacagaggac

SEQ ID NO: 4616806 - DNA, 17 bp, Homo sapiens
tacagcactactgggtg

SEQ ID NO: 4616807 - DNA, 19 bp, Homo sapiens
tacagcactactgggtgtc

SEQ ID NO: 4616808 - DNA, 22 bp, Homo sapiens
tacagcactactgggtgtcatt

SEQ ID NO: 4616809 - DNA, 19 bp, Homo sapiens
tacaggactggttccttcc

SEQ ID NO: 4616810 - DNA, 20 bp, Homo sapiens
tacaggactggttccttcct

SEQ ID NO: 4616811 - DNA, 14 bp, Homo sapiens
tacaggagaggcag

SEQ ID NO: 4616812 - DNA, 19 bp, Homo sapiens
tacaggagaggcagcatgc

SEQ ID NO: 4616813 - DNA, 17 bp, Homo sapiens
tacaggcctgcagcccc

SEQ ID NO: 4616814 - DNA, 16 bp, Homo sapiens
tacaggcgcctgccac

SEQ ID NO: 4616815 - DNA, 16 bp, Homo sapiens
tacagggagctgggac

SEQ ID NO: 4616816 - DNA, 11 bp, Homo sapiens
tacaggggtga

SEQ ID NO: 4616817 - DNA, 13 bp, Homo sapiens
tacagtaatgaaa

SEQ ID NO: 4616818 - DNA, 17 bp, Homo sapiens
tacagtaatgaaatgtt

SEQ ID NO: 4616819 - DNA, 13 bp, Homo sapiens
tacagtgtacagt

SEQ ID NO: 4616820 - DNA, 20 bp, Homo sapiens
tacagttttatacccttttt

SEQ ID NO: 4616821 - DNA, 19 bp, Homo sapiens
tacagtttttatttagcat

SEQ ID NO: 4616822 - DNA, 12 bp, Homo sapiens
tacataagtcct

SEQ ID NO: 4616823 - DNA, 15 bp, Homo sapiens
tacataatctgtaca

SEQ ID NO: 4616824 - DNA, 19 bp, Homo sapiens
tacatacggttctgttata

SEQ ID NO: 4616825 - DNA, 18 bp, Homo sapiens
tacataggtctgtatggc

SEQ ID NO: 4616826 - DNA, 13 bp, Homo sapiens
tacatagtctttg

SEQ ID NO: 4616827 - DNA, 16 bp, Homo sapiens
tacatagttgagattg

SEQ ID NO: 4616828 - DNA, 12 bp, Homo sapiens
tacatatgtaaa

SEQ ID NO: 4616829 - DNA, 13 bp, Homo sapiens
tacatatgtaaac

SEQ ID NO: 4616830 - DNA, 17 bp, Homo sapiens
tacatatgtaaacataa

SEQ ID NO: 4616831 - DNA, 22 bp, Homo sapiens
tacatcagtatagtgttttatt

SEQ ID NO: 4616832 - DNA, 23 bp, Homo sapiens
tacatccaaagcagacagctcca

SEQ ID NO: 4616833 - DNA, 20 bp, Homo sapiens
tacatgatacatttttattt

SEQ ID NO: 4616834 - DNA, 20 bp, Homo sapiens
tacatgtatctggtttgtca

SEQ ID NO: 4616835 - DNA, 16 bp, Homo sapiens
tacatgtgtagcctgt

SEQ ID NO: 4616836 - DNA, 13 bp, Homo sapiens
tacatgtttataa

SEQ ID NO: 4616837 - DNA, 17 bp, Homo sapiens
tacattaacggtgctaa

SEQ ID NO: 4616838 - DNA, 22 bp, Homo sapiens
tacattccagtagccagtatct

SEQ ID NO: 4616839 - DNA, 11 bp, Homo sapiens
tacatttaaag

SEQ ID NO: 4616840 - DNA, 19 bp, Homo sapiens
tacatttgatgcatgtctt

SEQ ID NO: 4616841 - DNA, 18 bp, Homo sapiens
tacatttggataaacaac

SEQ ID NO: 4616842 - DNA, 23 bp, Homo sapiens
tacatttgtaagtgtaaaaaatg

SEQ ID NO: 4616843 - DNA, 17 bp, Homo sapiens
tacattttaagcctttt

SEQ ID NO: 4616844 - DNA, 11 bp, Homo sapiens
tacattttatt

SEQ ID NO: 4616845 - DNA, 13 bp, Homo sapiens
tacattttattct

SEQ ID NO: 4616846 - DNA, 16 bp, Homo sapiens
tacattttcagtacca

SEQ ID NO: 4616847 - DNA, 16 bp, Homo sapiens
tacattttctaaataa

SEQ ID NO: 4616848 - DNA, 20 bp, Homo sapiens
tacattttctaaataaaaat

SEQ ID NO: 4616849 - DNA, 14 bp, Homo sapiens
tacattttgtaaaa

SEQ ID NO: 4616850 - DNA, 22 bp, Homo sapiens
tacattttttctaataaagcca

SEQ ID NO: 4616851 - DNA, 23 bp, Homo sapiens
tacattttttctaataaagccat

SEQ ID NO: 4616852 - DNA, 19 bp, Homo sapiens
taccaaagaaacaccactt

SEQ ID NO: 4616853 - DNA, 13 bp, Homo sapiens
taccatacattta

SEQ ID NO: 4616854 - DNA, 13 bp, Homo sapiens
taccatcttaatc

SEQ ID NO: 4616855 - DNA, 15 bp, Homo sapiens
taccatcttaatctt

SEQ ID NO: 4616856 - DNA, 18 bp, Homo sapiens
taccatcttaatctttat

SEQ ID NO: 4616857 - DNA, 15 bp, Homo sapiens
tacccaccagggaga

SEQ ID NO: 4616858 - DNA, 20 bp, Homo sapiens
tacccaccgggccactcctt

SEQ ID NO: 4616859 - DNA, 20 bp, Homo sapiens
tacccagggtggagtgcagt

SEQ ID NO: 4616860 - DNA, 18 bp, Homo sapiens
tacccatcttgcttccaa

SEQ ID NO: 4616861 - DNA, 19 bp, Homo sapiens
tacccatgttacttctctg

SEQ ID NO: 4616862 - DNA, 20 bp, Homo sapiens
tacccatgttacttctctga

SEQ ID NO: 4616863 - DNA, 18 bp, Homo sapiens
tacccattgttcccttcc

SEQ ID NO: 4616864 - DNA, 21 bp, Homo sapiens
tacccccaggtggaaggcaga

SEQ ID NO: 4616865 - DNA, 18 bp, Homo sapiens
tacccctttctggctctc

SEQ ID NO: 4616866 - DNA, 22 bp, Homo sapiens
tacccgagaagcacttgagcat

SEQ ID NO: 4616867 - DNA, 15 bp, Homo sapiens
tacctacacccaagg

SEQ ID NO: 4616868 - DNA, 15 bp, Homo sapiens
tacctagctggctct

SEQ ID NO: 4616869 - DNA, 15 bp, Homo sapiens
tacctatctgtggaa

SEQ ID NO: 4616870 - DNA, 20 bp, Homo sapiens
tacctatctgtggaaagcta

SEQ ID NO: 4616871 - DNA, 13 bp, Homo sapiens
tacctatgtaaca

SEQ ID NO: 4616872 - DNA, 14 bp, Homo sapiens
tacctcaaactatc

SEQ ID NO: 4616873 - DNA, 21 bp, Homo sapiens
tacctcaagccccatttcctc

SEQ ID NO: 4616874 - DNA, 22 bp, Homo sapiens
tacctcaagccccatttcctca

SEQ ID NO: 4616875 - DNA, 13 bp, Homo sapiens
tacctcaggtgcc

SEQ ID NO: 4616876 - DNA, 19 bp, Homo sapiens
tacctcaggtgccaaccca

SEQ ID NO: 4616877 - DNA, 24 bp, Homo sapiens
tacctgccctctatttattagcca

SEQ ID NO: 4616878 - DNA, 15 bp, Homo sapiens
taagcaccagtggga

SEQ ID NO: 4616879 - DNA, 24 bp, Homo sapiens
taagcaccagtgggactgtggtga

SEQ ID NO: 4616880 - DNA, 14 bp, Homo sapiens
taagcactgtgttt

SEQ ID NO: 4616881 - DNA, 18 bp, Homo sapiens
taagcactgtgtttatat

SEQ ID NO: 4616882 - DNA, 23 bp, Homo sapiens
taagcactgtgtttatatgtctt

SEQ ID NO: 4616883 - DNA, 18 bp, Homo sapiens
taagcagaacatactgtt

SEQ ID NO: 4616884 - DNA, 17 bp, Homo sapiens
taagcagattgctttaa

SEQ ID NO: 4616885 - DNA, 14 bp, Homo sapiens
taagcataatctga

SEQ ID NO: 4616886 - DNA, 21 bp, Homo sapiens
taagcattttgaaacaaagta

SEQ ID NO: 4616887 - DNA, 16 bp, Homo sapiens
taagccaaagaaacaa

SEQ ID NO: 4616888 - DNA, 16 bp, Homo sapiens
taagccagttggatct

SEQ ID NO: 4616889 - DNA, 13 bp, Homo sapiens
taagccctggccc

SEQ ID NO: 4616890 - DNA, 17 bp, Homo sapiens
taagcgatttgaaacac

SEQ ID NO: 4616891 - DNA, 17 bp, Homo sapiens
taagctcccctgcctta

SEQ ID NO: 4616892 - DNA, 18 bp, Homo sapiens
taagctctgccccttccc

SEQ ID NO: 4616893 - DNA, 22 bp, Homo sapiens
taagctgttcctgttcagtaat

SEQ ID NO: 4616894 - DNA, 21 bp, Homo sapiens
taaggactttttgatggaatt

SEQ ID NO: 4616895 - DNA, 13 bp, Homo sapiens
taaggcttttatt

SEQ ID NO: 4616896 - DNA, 16 bp, Homo sapiens
taaggcttttatttct

SEQ ID NO: 4616897 - DNA, 19 bp, Homo sapiens
taagggaatttaatacttt

SEQ ID NO: 4616898 - DNA, 20 bp, Homo sapiens
taagggcagtgcccatgtgt

SEQ ID NO: 4616899 - DNA, 23 bp, Homo sapiens
taagggcagtgcccatgtgtaca

SEQ ID NO: 4616900 - DNA, 20 bp, Homo sapiens
taagggtgggtgctcagaat

SEQ ID NO: 4616901 - DNA, 23 bp, Homo sapiens
taaggtttcaacaaatttcattg

SEQ ID NO: 4616902 - DNA, 16 bp, Homo sapiens
taagtagtaaatcaga

SEQ ID NO: 4616903 - DNA, 14 bp, Homo sapiens
taagtcacatatca

SEQ ID NO: 4616904 - DNA, 19 bp, Homo sapiens
taagtcacatatcagaata

SEQ ID NO: 4616905 - DNA, 14 bp, Homo sapiens
taagtgaagggaaa

SEQ ID NO: 4616906 - DNA, 19 bp, Homo sapiens
taagtgcaaacacagcatg

SEQ ID NO: 4616907 - DNA, 19 bp, Homo sapiens
taagtgtaaaaaatgtctc

SEQ ID NO: 4616908 - DNA, 14 bp, Homo sapiens
taagtgtgccaaat

SEQ ID NO: 4616909 - DNA, 18 bp, Homo sapiens
taagtgtgccaaatcagt

SEQ ID NO: 4616910 - DNA, 17 bp, Homo sapiens
taagttcctgctgcctg

SEQ ID NO: 4616911 - DNA, 19 bp, Homo sapiens
taagttcctgctgcctggg

SEQ ID NO: 4616912 - DNA, 23 bp, Homo sapiens
taagttgctgtgtgtctgtcctg

SEQ ID NO: 4616913 - DNA, 13 bp, Homo sapiens
taagtttttgcta

SEQ ID NO: 4616914 - DNA, 20 bp, Homo sapiens
taataaagccatttcttata

SEQ ID NO: 4616915 - DNA, 12 bp, Homo sapiens
taataaagcttt

SEQ ID NO: 4616916 - DNA, 15 bp, Homo sapiens
taataaagctttata

SEQ ID NO: 4616917 - DNA, 21 bp, Homo sapiens
taataaattgcttactgatat

SEQ ID NO: 4616918 - DNA, 14 bp, Homo sapiens
taataattgtatct

SEQ ID NO: 4616919 - DNA, 21 bp, Homo sapiens
taataattgtatctacattaa

SEQ ID NO: 4616920 - DNA, 15 bp, Homo sapiens
taatacctgggtgat

SEQ ID NO: 4616921 - DNA, 20 bp, Homo sapiens
taatacctgggtgattacat

SEQ ID NO: 4616922 - DNA, 14 bp, Homo sapiens
taatacctttaaat

SEQ ID NO: 4616923 - DNA, 22 bp, Homo sapiens
taatacctttaaatatcattct

SEQ ID NO: 4616924 - DNA, 20 bp, Homo sapiens
taatagagtacttaatatac

SEQ ID NO: 4616925 - DNA, 19 bp, Homo sapiens
taatagatttttttttcca

SEQ ID NO: 4616926 - DNA, 15 bp, Homo sapiens
taatagcatttttgt

SEQ ID NO: 4616927 - DNA, 18 bp, Homo sapiens
taatagggaaaattctaa

SEQ ID NO: 4616928 - DNA, 14 bp, Homo sapiens
taatagtttatctt

SEQ ID NO: 4616929 - DNA, 21 bp, Homo sapiens
taatataccagcttgtatgca

SEQ ID NO: 4616930 - DNA, 15 bp, Homo sapiens
taatatatacatttt

SEQ ID NO: 4616931 - DNA, 21 bp, Homo sapiens
taatatattctgaagcaacat

SEQ ID NO: 4616932 - DNA, 14 bp, Homo sapiens
taatatcaaataaa

SEQ ID NO: 4616933 - DNA, 24 bp, Homo sapiens
taatatcattttattcacatatgt

SEQ ID NO: 4616934 - DNA, 22 bp, Homo sapiens
taatatgtttttttaaacctca

SEQ ID NO: 4616935 - DNA, 13 bp, Homo sapiens
taatcaagagaaa

SEQ ID NO: 4616936 - DNA, 15 bp, Homo sapiens
taatcaagagaaact

SEQ ID NO: 4616937 - DNA, 18 bp, Homo sapiens
taatcaagagaaacttca

SEQ ID NO: 4616938 - DNA, 13 bp, Homo sapiens
taatcacttttca

SEQ ID NO: 4616939 - DNA, 15 bp, Homo sapiens
taatcaggcaaggag

SEQ ID NO: 4616940 - DNA, 17 bp, Homo sapiens
taatcaggcaaggagga

SEQ ID NO: 4616941 - DNA, 17 bp, Homo sapiens
taatcagttctgtgtgg

SEQ ID NO: 4616942 - DNA, 14 bp, Homo sapiens
taatcatttgttta

SEQ ID NO: 4616943 - DNA, 12 bp, Homo sapiens
taatcattttca

SEQ ID NO: 4616944 - DNA, 19 bp, Homo sapiens
taatccctgggcattgctt

SEQ ID NO: 4616945 - DNA, 20 bp, Homo sapiens
taatccctgggcattgcttt

SEQ ID NO: 4616946 - DNA, 14 bp, Homo sapiens
taatccctgtaata

SEQ ID NO: 4616947 - DNA, 19 bp, Homo sapiens
taatctgtgtacaaagaaa

SEQ ID NO: 4616948 - DNA, 15 bp, Homo sapiens
taatcttatacaaca

SEQ ID NO: 4616949 - DNA, 18 bp, Homo sapiens
taatcttgctttctttag

SEQ ID NO: 4616950 - DNA, 20 bp, Homo sapiens
taatcttgctttctttagaa

SEQ ID NO: 4616951 - DNA, 22 bp, Homo sapiens
taatcttgctttctttagaatt

SEQ ID NO: 4616952 - DNA, 21 bp, Homo sapiens
taatgaaaataaaacacacct

SEQ ID NO: 4616953 - DNA, 23 bp, Homo sapiens
taatgaaaataaaacacacctcg

SEQ ID NO: 4616954 - DNA, 14 bp, Homo sapiens
taatgaagaatcac

SEQ ID NO: 4616955 - DNA, 10 bp, Homo sapiens
taatgcactg

SEQ ID NO: 4616956 - DNA, 18 bp, Homo sapiens
taatgcactgtttttaat

SEQ ID NO: 4616957 - DNA, 19 bp, Homo sapiens
taatgcatatttataagag

SEQ ID NO: 4616958 - DNA, 15 bp, Homo sapiens
taatgctctatgttt

SEQ ID NO: 4616959 - DNA, 24 bp, Homo sapiens
taatgctgcaaacttaatgttctt

SEQ ID NO: 4616960 - DNA, 16 bp, Homo sapiens
taatgctgtttctaag

SEQ ID NO: 4616961 - DNA, 14 bp, Homo sapiens
taatggaggtccca

SEQ ID NO: 4616962 - DNA, 14 bp, Homo sapiens
taatggcatttctc

SEQ ID NO: 4616963 - DNA, 22 bp, Homo sapiens
taatggtatcctactgagcatt

SEQ ID NO: 4616964 - DNA, 14 bp, Homo sapiens
taatgtgaaaatca

SEQ ID NO: 4616965 - DNA, 15 bp, Homo sapiens
taatgtgaaaatcat

SEQ ID NO: 4616966 - DNA, 20 bp, Homo sapiens
taatgtgaactctcccctcc

SEQ ID NO: 4616967 - DNA, 21 bp, Homo sapiens
taatgtgaactctcccctccc

SEQ ID NO: 4616968 - DNA, 22 bp, Homo sapiens
taatgtgatcatatgaggacct

SEQ ID NO: 4616969 - DNA, 17 bp, Homo sapiens
taatgttaaccaaggaa

SEQ ID NO: 4616970 - DNA, 19 bp, Homo sapiens
taatgttgataatatatat

SEQ ID NO: 4616971 - DNA, 21 bp, Homo sapiens
taatgttttcattatgttcat

SEQ ID NO: 4616972 - DNA, 19 bp, Homo sapiens
taattaaatgaacttatgt

SEQ ID NO: 4616973 - DNA, 15 bp, Homo sapiens
taattaagcagaaac

SEQ ID NO: 4616974 - DNA, 22 bp, Homo sapiens
taattaatgtttgtgggtattt

SEQ ID NO: 4616975 - DNA, 22 bp, Homo sapiens
taattagtcgggcatgagtctg

SEQ ID NO: 4616976 - DNA, 18 bp, Homo sapiens
taattatgaaaagaaata

SEQ ID NO: 4616977 - DNA, 14 bp, Homo sapiens
taattattattatt

SEQ ID NO: 4616978 - DNA, 13 bp, Homo sapiens
taattcctacagc

SEQ ID NO: 4616979 - DNA, 18 bp, Homo sapiens
taattccttatcctagcc

SEQ ID NO: 4616980 - DNA, 17 bp, Homo sapiens
taattctggagatactg

SEQ ID NO: 4616981 - DNA, 19 bp, Homo sapiens
taattcttcagcgtaaaat

SEQ ID NO: 4616982 - DNA, 22 bp, Homo sapiens
taattcttcagcgtaaaatggt

SEQ ID NO: 4616983 - DNA, 15 bp, Homo sapiens
taattcttttctgag

SEQ ID NO: 4616984 - DNA, 18 bp, Homo sapiens
taattggtgctatttgaa

SEQ ID NO: 4616985 - DNA, 16 bp, Homo sapiens
taattgtaagtgaaat

SEQ ID NO: 4616986 - DNA, 14 bp, Homo sapiens
taatttatactggc

SEQ ID NO: 4616987 - DNA, 19 bp, Homo sapiens
taatttatttccactaaaa

SEQ ID NO: 4616988 - DNA, 15 bp, Homo sapiens
taatttcatgtgtat

SEQ ID NO: 4616989 - DNA, 19 bp, Homo sapiens
tcggacattctaatgcata

SEQ ID NO: 4616990 - DNA, 13 bp, Homo sapiens
tcggactgccaaa

SEQ ID NO: 4616991 - DNA, 13 bp, Homo sapiens
tcggagctcctgt

SEQ ID NO: 4616992 - DNA, 17 bp, Homo sapiens
tcggaggtgctgtcccc

SEQ ID NO: 4616993 - DNA, 13 bp, Homo sapiens
tcggatctcacag

SEQ ID NO: 4616994 - DNA, 19 bp, Homo sapiens
tcggatgacaccctggcct

SEQ ID NO: 4616995 - DNA, 16 bp, Homo sapiens
tcggggctgggaagtc

SEQ ID NO: 4616996 - DNA, 14 bp, Homo sapiens
tcggggtgcacagg

SEQ ID NO: 4616997 - DNA, 17 bp, Homo sapiens
tcggggtgcacaggagg

SEQ ID NO: 4616998 - DNA, 22 bp, Homo sapiens
tcggtttgccaaaattcatttc

SEQ ID NO: 4616999 - DNA, 16 bp, Homo sapiens
tcgtaacctggtgcct

SEQ ID NO: 4617000 - DNA, 16 bp, Homo sapiens
tcgtccttactcctgt

SEQ ID NO: 4617001 - DNA, 19 bp, Homo sapiens
tcgtccttactcctgtggg

SEQ ID NO: 4617002 - DNA, 17 bp, Homo sapiens
tcgtgaacatagagttt

SEQ ID NO: 4617003 - DNA, 18 bp, Homo sapiens
tcgtgagctggggactca

SEQ ID NO: 4617004 - DNA, 22 bp, Homo sapiens
tcgtgatctacccacctcggcc

SEQ ID NO: 4617005 - DNA, 15 bp, Homo sapiens
tcgtgatgtggagga

SEQ ID NO: 4617006 - DNA, 20 bp, Homo sapiens
tcgtgatgtggaggaagagc

SEQ ID NO: 4617007 - DNA, 13 bp, Homo sapiens
tcgtgcactttct

SEQ ID NO: 4617008 - DNA, 16 bp, Homo sapiens
tcgtggagagctagga

SEQ ID NO: 4617009 - DNA, 14 bp, Homo sapiens
tcgtggtaggactg

SEQ ID NO: 4617010 - DNA, 15 bp, Homo sapiens
tcgtggtaggactgt

SEQ ID NO: 4617011 - DNA, 20 bp, Homo sapiens
tcgtggtaggactgtagaaa

SEQ ID NO: 4617012 - DNA, 14 bp, Homo sapiens
tcgtgtatttatta

SEQ ID NO: 4617013 - DNA, 15 bp, Homo sapiens
tcgtgtatttattac

SEQ ID NO: 4617014 - DNA, 11 bp, Homo sapiens
tcgttctgtgg

SEQ ID NO: 4617015 - DNA, 22 bp, Homo sapiens
tcgttgcacagctgtttgaaat

SEQ ID NO: 4617016 - DNA, 13 bp, Homo sapiens
tcgtttggtctta

SEQ ID NO: 4617017 - DNA, 14 bp, Homo sapiens
tctaaataaaaata

SEQ ID NO: 4617018 - DNA, 22 bp, Homo sapiens
tctaaatgtacaaattcttata

SEQ ID NO: 4617019 - DNA, 14 bp, Homo sapiens
tctaacctgtgacc

SEQ ID NO: 4617020 - DNA, 15 bp, Homo sapiens
tctaacgcctgagcc

SEQ ID NO: 4617021 - DNA, 16 bp, Homo sapiens
tctaacgcctgagccc

SEQ ID NO: 4617022 - DNA, 23 bp, Homo sapiens
tctaacgcctgagcccagggagg

SEQ ID NO: 4617023 - DNA, 16 bp, Homo sapiens
tctaagaaaatgtagt

SEQ ID NO: 4617024 - DNA, 14 bp, Homo sapiens
tctaagcattccac

SEQ ID NO: 4617025 - DNA, 17 bp, Homo sapiens
tctaagcccaggatctc

SEQ ID NO: 4617026 - DNA, 22 bp, Homo sapiens
tctaagtatattatatggcagg

SEQ ID NO: 4617027 - DNA, 19 bp, Homo sapiens
tctaagtcgtgcactttct

SEQ ID NO: 4617028 - DNA, 13 bp, Homo sapiens
tctaagtgtactt

SEQ ID NO: 4617029 - DNA, 14 bp, Homo sapiens
tctaatacctctgt

SEQ ID NO: 4617030 - DNA, 17 bp, Homo sapiens
tctaatacctctgtgtg

SEQ ID NO: 4617031 - DNA, 12 bp, Homo sapiens
tctaatgcatat

SEQ ID NO: 4617032 - DNA, 16 bp, Homo sapiens
tctaatgcatatttat

SEQ ID NO: 4617033 - DNA, 17 bp, Homo sapiens
tctaatgtgaaaatcat

SEQ ID NO: 4617034 - DNA, 23 bp, Homo sapiens
tctaattaaccttactaattata

SEQ ID NO: 4617035 - DNA, 22 bp, Homo sapiens
tctaattgtaagtgaaattaag

SEQ ID NO: 4617036 - DNA, 13 bp, Homo sapiens
tctacaaataatt

SEQ ID NO: 4617037 - DNA, 21 bp, Homo sapiens
tctacacctcctttaagattt

SEQ ID NO: 4617038 - DNA, 17 bp, Homo sapiens
tctacaggcctgcagcc

SEQ ID NO: 4617039 - DNA, 13 bp, Homo sapiens
tctacccttttcc

SEQ ID NO: 4617040 - DNA, 17 bp, Homo sapiens
tctacccttttcctttt

SEQ ID NO: 4617041 - DNA, 19 bp, Homo sapiens
tctaccgtaattgctttgt

SEQ ID NO: 4617042 - DNA, 23 bp, Homo sapiens
tctaccgtaattgctttgtgcct

SEQ ID NO: 4617043 - DNA, 13 bp, Homo sapiens
tctactccttccc

SEQ ID NO: 4617044 - DNA, 19 bp, Homo sapiens
tctactgggaaggctactt

SEQ ID NO: 4617045 - DNA, 20 bp, Homo sapiens
tctactgggaaggctacttc

SEQ ID NO: 4617046 - DNA, 18 bp, Homo sapiens
tctacttgtcatatcact

SEQ ID NO: 4617047 - DNA, 13 bp, Homo sapiens
tctagaccagggc

SEQ ID NO: 4617048 - DNA, 14 bp, Homo sapiens
tctagagagggaat

SEQ ID NO: 4617049 - DNA, 23 bp, Homo sapiens
tctagataaccttgtttattagc

SEQ ID NO: 4617050 - DNA, 16 bp, Homo sapiens
tctagatacaggactg

SEQ ID NO: 4617051 - DNA, 16 bp, Homo sapiens
tctagatggcaacatt

SEQ ID NO: 4617052 - DNA, 23 bp, Homo sapiens
tctagatggcaacattggacaga

SEQ ID NO: 4617053 - DNA, 22 bp, Homo sapiens
tctagcccaaaggtaagttgct

SEQ ID NO: 4617054 - DNA, 15 bp, Homo sapiens
tctagctctctaggc

SEQ ID NO: 4617055 - DNA, 16 bp, Homo sapiens
tctaggaatggaggag

SEQ ID NO: 4617056 - DNA, 20 bp, Homo sapiens
tctaggaatggaggagccag

SEQ ID NO: 4617057 - DNA, 22 bp, Homo sapiens
tctaggaatggaggagccaggc

SEQ ID NO: 4617058 - DNA, 23 bp, Homo sapiens
tctaggaatggaggagccaggcc

SEQ ID NO: 4617059 - DNA, 14 bp, Homo sapiens
tctaggcctctcca

SEQ ID NO: 4617060 - DNA, 19 bp, Homo sapiens
tctaggctgctgcacacca

SEQ ID NO: 4617061 - DNA, 23 bp, Homo sapiens
tctagggactgccaggctgtttc

SEQ ID NO: 4617062 - DNA, 14 bp, Homo sapiens
tctaggtcctggct

SEQ ID NO: 4617063 - DNA, 17 bp, Homo sapiens
tctaggttatacaataa

SEQ ID NO: 4617064 - DNA, 16 bp, Homo sapiens
tctagtacacttttat

SEQ ID NO: 4617065 - DNA, 13 bp, Homo sapiens
tctagtttattct

SEQ ID NO: 4617066 - DNA, 21 bp, Homo sapiens
tctagtttctcaaaaccctta

SEQ ID NO: 4617067 - DNA, 21 bp, Homo sapiens
tctagtttttggaaaaacctt

SEQ ID NO: 4617068 - DNA, 17 bp, Homo sapiens
tctataaatttaagaaa

SEQ ID NO: 4617069 - DNA, 18 bp, Homo sapiens
tctataaatttaagaaaa

SEQ ID NO: 4617070 - DNA, 20 bp, Homo sapiens
tctataaatttaagaaaaca

SEQ ID NO: 4617071 - DNA, 17 bp, Homo sapiens
tctataagtagtaaatc

SEQ ID NO: 4617072 - DNA, 21 bp, Homo sapiens
tctataagtagtaaatcagaa

SEQ ID NO: 4617073 - DNA, 20 bp, Homo sapiens
tctatagccaactgctaatg

SEQ ID NO: 4617074 - DNA, 21 bp, Homo sapiens
tctatatgtacttgtcaaaga

SEQ ID NO: 4617075 - DNA, 23 bp, Homo sapiens
tctatatgtacttgtcaaagaag

SEQ ID NO: 4617076 - DNA, 17 bp, Homo sapiens
tctatcagactcagttt

SEQ ID NO: 4617077 - DNA, 13 bp, Homo sapiens
tctatcatatgaa

SEQ ID NO: 4617078 - DNA, 14 bp, Homo sapiens
tctatctctttctt

SEQ ID NO: 4617079 - DNA, 21 bp, Homo sapiens
tctatgatgttgctgttcaca

SEQ ID NO: 4617080 - DNA, 20 bp, Homo sapiens
tctatggcttatttctatga

SEQ ID NO: 4617081 - DNA, 19 bp, Homo sapiens
tctatgttagtataagctt

SEQ ID NO: 4617082 - DNA, 18 bp, Homo sapiens
tctatgttcaaagactgt

SEQ ID NO: 4617083 - DNA, 21 bp, Homo sapiens
tctatgttcaaagactgtgaa

SEQ ID NO: 4617084 - DNA, 21 bp, Homo sapiens
tctattaatcaagagaaactt

SEQ ID NO: 4617085 - DNA, 14 bp, Homo sapiens
tctattacactgga

SEQ ID NO: 4617086 - DNA, 15 bp, Homo sapiens
tctattatggaaaac

SEQ ID NO: 4617087 - DNA, 18 bp, Homo sapiens
tctattctgtcagtgtta

SEQ ID NO: 4617088 - DNA, 12 bp, Homo sapiens
tctattggtctc

SEQ ID NO: 4617089 - DNA, 16 bp, Homo sapiens
tctattgttaagtatt

SEQ ID NO: 4617090 - DNA, 16 bp, Homo sapiens
tctattttcataatca

SEQ ID NO: 4617091 - DNA, 18 bp, Homo sapiens
tctcaaagtataatcttt

SEQ ID NO: 4617092 - DNA, 20 bp, Homo sapiens
tctcaaagtataatctttct

SEQ ID NO: 4617093 - DNA, 14 bp, Homo sapiens
tctcaagtaatata

SEQ ID NO: 4617094 - DNA, 16 bp, Homo sapiens
tctcacctcctgctgg

SEQ ID NO: 4617095 - DNA, 17 bp, Homo sapiens
tctcacctcctgctggg

SEQ ID NO: 4617096 - DNA, 22 bp, Homo sapiens
tctcactcttgtcacccaggct

SEQ ID NO: 4617097 - DNA, 16 bp, Homo sapiens
tctcactgcttgaact

SEQ ID NO: 4617098 - DNA, 14 bp, Homo sapiens
tctcactgtgtccc

SEQ ID NO: 4617099 - DNA, 17 bp, Homo sapiens
tctcagctcactgcaac

SEQ ID NO: 4617100 - DNA, 22 bp, Homo sapiens
tccatcccaaccagtgccaagg

SEQ ID NO: 4617101 - DNA, 12 bp, Homo sapiens
tccatcctggtc

SEQ ID NO: 4617102 - DNA, 16 bp, Homo sapiens
tccatccttgactgaa

SEQ ID NO: 4617103 - DNA, 17 bp, Homo sapiens
tccatctatcactgcat

SEQ ID NO: 4617104 - DNA, 23 bp, Homo sapiens
tccatcttgtttcatttgcttgc

SEQ ID NO: 4617105 - DNA, 13 bp, Homo sapiens
tccatctttttct

SEQ ID NO: 4617106 - DNA, 18 bp, Homo sapiens
tccatctttttcttgggt

SEQ ID NO: 4617107 - DNA, 16 bp, Homo sapiens
tccatgctcccaactc

SEQ ID NO: 4617108 - DNA, 20 bp, Homo sapiens
tccatgctgcaaaggagaag

SEQ ID NO: 4617109 - DNA, 20 bp, Homo sapiens
tccattaatacccatgcttt

SEQ ID NO: 4617110 - DNA, 14 bp, Homo sapiens
tccattcccacccc

SEQ ID NO: 4617111 - DNA, 12 bp, Homo sapiens
tccattctacat

SEQ ID NO: 4617112 - DNA, 14 bp, Homo sapiens
tccatttctcatgt

SEQ ID NO: 4617113 - DNA, 21 bp, Homo sapiens
tccattttcccccactactgc

SEQ ID NO: 4617114 - DNA, 21 bp, Homo sapiens
tcccaaacccagtctcctctc

SEQ ID NO: 4617115 - DNA, 18 bp, Homo sapiens
tcccaaatccgccagtgt

SEQ ID NO: 4617116 - DNA, 19 bp, Homo sapiens
tcccaaatccgccagtgtt

SEQ ID NO: 4617117 - DNA, 18 bp, Homo sapiens
tcccaaccagtgccaagg

SEQ ID NO: 4617118 - DNA, 23 bp, Homo sapiens
tcccaaccagtgccaaggacctc

SEQ ID NO: 4617119 - DNA, 15 bp, Homo sapiens
tcccaaccctggctt

SEQ ID NO: 4617120 - DNA, 18 bp, Homo sapiens
tcccaagcccctgacccg

SEQ ID NO: 4617121 - DNA, 15 bp, Homo sapiens
tcccaagctagactg

SEQ ID NO: 4617122 - DNA, 20 bp, Homo sapiens
tcccaagctagactgtgtct

SEQ ID NO: 4617123 - DNA, 22 bp, Homo sapiens
tcccaaggagggggcctcattg

SEQ ID NO: 4617124 - DNA, 18 bp, Homo sapiens
tcccaatggtgcttggag

SEQ ID NO: 4617125 - DNA, 21 bp, Homo sapiens
tcccaatggtgcttggagggg

SEQ ID NO: 4617126 - DNA, 23 bp, Homo sapiens
tcccaatggtgcttggaggggga

SEQ ID NO: 4617127 - DNA, 14 bp, Homo sapiens
tcccacaagcctgc

SEQ ID NO: 4617128 - DNA, 17 bp, Homo sapiens
tcccacaagcctgcctc

SEQ ID NO: 4617129 - DNA, 21 bp, Homo sapiens
tcccacatccctgggcctgct

SEQ ID NO: 4617130 - DNA, 22 bp, Homo sapiens
tcccacatccctgggcctgctg

SEQ ID NO: 4617131 - DNA, 23 bp, Homo sapiens
tcccacatccctgggcctgctgc

SEQ ID NO: 4617132 - DNA, 19 bp, Homo sapiens
tcccacatgaggccatctc

SEQ ID NO: 4617133 - DNA, 14 bp, Homo sapiens
tcccaccacaggca

SEQ ID NO: 4617134 - DNA, 15 bp, Homo sapiens
tcccaccagcttcac

SEQ ID NO: 4617135 - DNA, 15 bp, Homo sapiens
tcccacccacatgtg

SEQ ID NO: 4617136 - DNA, 20 bp, Homo sapiens
tcccaccccattttctgtgg

SEQ ID NO: 4617137 - DNA, 24 bp, Homo sapiens
tcccaccgcccagcggcttgcctg

SEQ ID NO: 4617138 - DNA, 16 bp, Homo sapiens
tcccacctagcagcac

SEQ ID NO: 4617139 - DNA, 14 bp, Homo sapiens
tcccactatctggg

SEQ ID NO: 4617140 - DNA, 22 bp, Homo sapiens
tcccagacctgcctcttccccc

SEQ ID NO: 4617141 - DNA, 16 bp, Homo sapiens
tcccagactactattt

SEQ ID NO: 4617142 - DNA, 20 bp, Homo sapiens
tcccagactactattttctt

SEQ ID NO: 4617143 - DNA, 23 bp, Homo sapiens
tcccagactactattttcttttt

SEQ ID NO: 4617144 - DNA, 9 bp, Homo sapiens
tcccagagc

SEQ ID NO: 4617145 - DNA, 22 bp, Homo sapiens
tcccagagctcatcccccctgc

SEQ ID NO: 4617146 - DNA, 16 bp, Homo sapiens
tcccagaggctgcccc

SEQ ID NO: 4617147 - DNA, 17 bp, Homo sapiens
tcccagaggctgcccca

SEQ ID NO: 4617148 - DNA, 23 bp, Homo sapiens
tcccagcatccctggagcaggag

SEQ ID NO: 4617149 - DNA, 14 bp, Homo sapiens
tcccagccctgggg

SEQ ID NO: 4617150 - DNA, 18 bp, Homo sapiens
tcccaggaggtgcagtgg

SEQ ID NO: 4617151 - DNA, 18 bp, Homo sapiens
tcccaggccccatgacct

SEQ ID NO: 4617152 - DNA, 16 bp, Homo sapiens
tcccaggcctctgccc

SEQ ID NO: 4617153 - DNA, 19 bp, Homo sapiens
tcccagggccctcccagcc

SEQ ID NO: 4617154 - DNA, 14 bp, Homo sapiens
tcccagggcttacg

SEQ ID NO: 4617155 - DNA, 15 bp, Homo sapiens
tcccagtactttgga

SEQ ID NO: 4617156 - DNA, 17 bp, Homo sapiens
tcccagtttctcagaag

SEQ ID NO: 4617157 - DNA, 14 bp, Homo sapiens
tcccatccagggcc

SEQ ID NO: 4617158 - DNA, 14 bp, Homo sapiens
tcccatccccagcg

SEQ ID NO: 4617159 - DNA, 15 bp, Homo sapiens
tcccatccccagcga

SEQ ID NO: 4617160 - DNA, 23 bp, Homo sapiens
tcccatcccgtaagaccaccttc

SEQ ID NO: 4617161 - DNA, 13 bp, Homo sapiens
tcccatcctgggg

SEQ ID NO: 4617162 - DNA, 17 bp, Homo sapiens
tcccatgagactgccct

SEQ ID NO: 4617163 - DNA, 21 bp, Homo sapiens
tcccatgtggcttgtttgcct

SEQ ID NO: 4617164 - DNA, 22 bp, Homo sapiens
tccccaaaggaaccgcccagtg

SEQ ID NO: 4617165 - DNA, 14 bp, Homo sapiens
tccccaaatccgaa

SEQ ID NO: 4617166 - DNA, 15 bp, Homo sapiens
tccccaagatctgcc

SEQ ID NO: 4617167 - DNA, 22 bp, Homo sapiens
tccccaagatctgccagacctg

SEQ ID NO: 4617168 - DNA, 13 bp, Homo sapiens
tccccaccctcca

SEQ ID NO: 4617169 - DNA, 15 bp, Homo sapiens
tccccaccctccact

SEQ ID NO: 4617170 - DNA, 21 bp, Homo sapiens
tccccagagctgtgccagcag

SEQ ID NO: 4617171 - DNA, 23 bp, Homo sapiens
tccccagcagggtcttttcatct

SEQ ID NO: 4617172 - DNA, 17 bp, Homo sapiens
tccccagcccaggaaaa

SEQ ID NO: 4617173 - DNA, 23 bp, Homo sapiens
tccccagcgattccctctcccag

SEQ ID NO: 4617174 - DNA, 16 bp, Homo sapiens
tccccagctcccccag

SEQ ID NO: 4617175 - DNA, 19 bp, Homo sapiens
tccccagctcccccaggca

SEQ ID NO: 4617176 - DNA, 14 bp, Homo sapiens
tccccagctgttta

SEQ ID NO: 4617177 - DNA, 15 bp, Homo sapiens
tccccagctgtttat

SEQ ID NO: 4617178 - DNA, 20 bp, Homo sapiens
tccccagtagagaaacattt

SEQ ID NO: 4617179 - DNA, 14 bp, Homo sapiens
tccccagtctctgg

SEQ ID NO: 4617180 - DNA, 13 bp, Homo sapiens
tccccagtgcccg

SEQ ID NO: 4617181 - DNA, 13 bp, Homo sapiens
tccccatctgtgt

SEQ ID NO: 4617182 - DNA, 18 bp, Homo sapiens
tccccatctgtgttctaa

SEQ ID NO: 4617183 - DNA, 23 bp, Homo sapiens
tccccatgaaccctgccctgctc

SEQ ID NO: 4617184 - DNA, 14 bp, Homo sapiens
tcccccaatgacct

SEQ ID NO: 4617185 - DNA, 12 bp, Homo sapiens
tcccccaccctc

SEQ ID NO: 4617186 - DNA, 11 bp, Homo sapiens
tcccccactcc

SEQ ID NO: 4617187 - DNA, 20 bp, Homo sapiens
tccccctcttcttctgaaga

SEQ ID NO: 4617188 - DNA, 21 bp, Homo sapiens
tccccctgcaacttccgctga

SEQ ID NO: 4617189 - DNA, 17 bp, Homo sapiens
tccccctgcttccacct

SEQ ID NO: 4617190 - DNA, 20 bp, Homo sapiens
tccccctttctctgcctggc

SEQ ID NO: 4617191 - DNA, 20 bp, Homo sapiens
tccccgaagagtcagccccg

SEQ ID NO: 4617192 - DNA, 15 bp, Homo sapiens
tccccgctctgccgc

SEQ ID NO: 4617193 - DNA, 23 bp, Homo sapiens
tcccctagggactgtcctagcca

SEQ ID NO: 4617194 - DNA, 19 bp, Homo sapiens
tcccctccccatctgtgtt

SEQ ID NO: 4617195 - DNA, 18 bp, Homo sapiens
tcccctccttggctttat

SEQ ID NO: 4617196 - DNA, 15 bp, Homo sapiens
tcccctgccttaacc

SEQ ID NO: 4617197 - DNA, 23 bp, Homo sapiens
tcccctgccttaacctgggacca

SEQ ID NO: 4617198 - DNA, 23 bp, Homo sapiens
tccccttttaaggtttcaacaaa

SEQ ID NO: 4617199 - DNA, 14 bp, Homo sapiens
tcccgcagcctcgc

SEQ ID NO: 4617200 - DNA, 23 bp, Homo sapiens
tcccgtggaacgtttttcctgtt

SEQ ID NO: 4617201 - DNA, 12 bp, Homo sapiens
tccctacacagg

SEQ ID NO: 4617202 - DNA, 15 bp, Homo sapiens
tccctagctcttccc

SEQ ID NO: 4617203 - DNA, 13 bp, Homo sapiens
tccctaggcccaa

SEQ ID NO: 4617204 - DNA, 16 bp, Homo sapiens
tccctataggaacagc

SEQ ID NO: 4617205 - DNA, 21 bp, Homo sapiens
tccctataggaacagcccagc

SEQ ID NO: 4617206 - DNA, 16 bp, Homo sapiens
tccctatatcagggcc

SEQ ID NO: 4617207 - DNA, 18 bp, Homo sapiens
tccctatggagaggcttc

SEQ ID NO: 4617208 - DNA, 23 bp, Homo sapiens
tccctattagatacacttcttaa

SEQ ID NO: 4617209 - DNA, 15 bp, Homo sapiens
tccctccaccagcct

SEQ ID NO: 4617210 - DNA, 16 bp, Homo sapiens
tccctccaccagcctg

SEQ ID NO: 4617211 - DNA, 19 bp, Homo sapiens
tccctccaccagcctgctg

SEQ ID NO: 4617212 - DNA, 21 bp, Homo sapiens
tccctccaccagcctgctgac

SEQ ID NO: 4617213 - DNA, 22 bp, Homo sapiens
tccctccaccagcctgctgaca

SEQ ID NO: 4617214 - DNA, 15 bp, Homo sapiens
tccctccgccttctc

SEQ ID NO: 4617215 - DNA, 22 bp, Homo sapiens
tccctccgccttctcccacatg

SEQ ID NO: 4617216 - DNA, 14 bp, Homo sapiens
tccctcctcactcc

SEQ ID NO: 4617217 - DNA, 16 bp, Homo sapiens
tccctcctttcctttg

SEQ ID NO: 4617218 - DNA, 13 bp, Homo sapiens
tccctctcccagg

SEQ ID NO: 4617219 - DNA, 15 bp, Homo sapiens
tccctctcccaggcc

SEQ ID NO: 4617220 - DNA, 12 bp, Homo sapiens
tccctctctcct

SEQ ID NO: 4617221 - DNA, 14 bp, Homo sapiens
tccctctctcctgg

SEQ ID NO: 4617222 - DNA, 15 bp, Homo sapiens
tccctctctcctgga

SEQ ID NO: 4617223 - DNA, 17 bp, Homo sapiens
tccctctctcctggact

SEQ ID NO: 4617224 - DNA, 14 bp, Homo sapiens
tccctctctctgga

SEQ ID NO: 4617225 - DNA, 19 bp, Homo sapiens
tccctctgcattgacctgg

SEQ ID NO: 4617226 - DNA, 11 bp, Homo sapiens
tccctctgcct

SEQ ID NO: 4617227 - DNA, 16 bp, Homo sapiens
tccctgcctcacatct

SEQ ID NO: 4617228 - DNA, 18 bp, Homo sapiens
tccctgcctcacatctcc

SEQ ID NO: 4617229 - DNA, 19 bp, Homo sapiens
tccctgcctcacatctccc

SEQ ID NO: 4617230 - DNA, 18 bp, Homo sapiens
tccctgcctcaggcctct

SEQ ID NO: 4617231 - DNA, 20 bp, Homo sapiens
tccctgcctcaggcctctgt

SEQ ID NO: 4617232 - DNA, 14 bp, Homo sapiens
tccctgctgtgcca

SEQ ID NO: 4617233 - DNA, 16 bp, Homo sapiens
tccctggaccacgagg

SEQ ID NO: 4617234 - DNA, 18 bp, Homo sapiens
tccctggagcaggagccc

SEQ ID NO: 4617235 - DNA, 19 bp, Homo sapiens
tccctggagcaggagcccc

SEQ ID NO: 4617236 - DNA, 19 bp, Homo sapiens
tccctgggaggaaatttga

SEQ ID NO: 4617237 - DNA, 18 bp, Homo sapiens
tccctgggccagggtctg

SEQ ID NO: 4617238 - DNA, 24 bp, Homo sapiens
tccctgggccagggtctgtgtgaa

SEQ ID NO: 4617239 - DNA, 13 bp, Homo sapiens
tccctgggcctgc

SEQ ID NO: 4617240 - DNA, 20 bp, Homo sapiens
tccctgggcctgctgctgag

SEQ ID NO: 4617241 - DNA, 22 bp, Homo sapiens
tccctgtgtccacctgtgggtg

SEQ ID NO: 4617242 - DNA, 16 bp, Homo sapiens
tcccttacccatcttg

SEQ ID NO: 4617243 - DNA, 18 bp, Homo sapiens
tcccttacccatcttgct

SEQ ID NO: 4617244 - DNA, 16 bp, Homo sapiens
tcccttattagttaca

SEQ ID NO: 4617245 - DNA, 20 bp, Homo sapiens
tcccttcaagacgaggggca

SEQ ID NO: 4617246 - DNA, 21 bp, Homo sapiens
tcccttcaagacgaggggcag

SEQ ID NO: 4617247 - DNA, 13 bp, Homo sapiens
tcccttcctcttc

SEQ ID NO: 4617248 - DNA, 21 bp, Homo sapiens
tcccttgctcatgagctcctg

SEQ ID NO: 4617249 - DNA, 17 bp, Homo sapiens
tccctttatttctcttc

SEQ ID NO: 4617250 - DNA, 20 bp, Homo sapiens
tcccttttataattaatgtt

SEQ ID NO: 4617251 - DNA, 21 bp, Homo sapiens
tcccttttataattaatgttt

SEQ ID NO: 4617252 - DNA, 18 bp, Homo sapiens
tccgaacctcctctgtga

SEQ ID NO: 4617253 - DNA, 17 bp, Homo sapiens
tccgaaggggctctgag

SEQ ID NO: 4617254 - DNA, 16 bp, Homo sapiens
tccgcaccctccctag

SEQ ID NO: 4617255 - DNA, 13 bp, Homo sapiens
tccgccagccaca

SEQ ID NO: 4617256 - DNA, 16 bp, Homo sapiens
tccgccagccacagga

SEQ ID NO: 4617257 - DNA, 19 bp, Homo sapiens
tccgccagccacaggacca

SEQ ID NO: 4617258 - DNA, 21 bp, Homo sapiens
tccgccagccacaggaccacc

SEQ ID NO: 4617259 - DNA, 16 bp, Homo sapiens
tccgccagtgtttctg

SEQ ID NO: 4617260 - DNA, 19 bp, Homo sapiens
tccgccagtgtttctgaat

SEQ ID NO: 4617261 - DNA, 18 bp, Homo sapiens
tccgcccacctcagcctc

SEQ ID NO: 4617262 - DNA, 17 bp, Homo sapiens
tccgcgccgatgccacc

SEQ ID NO: 4617263 - DNA, 18 bp, Homo sapiens
tccgcgccgatgccaccg

SEQ ID NO: 4617264 - DNA, 21 bp, Homo sapiens
tccgtagccagctgctcccca

SEQ ID NO: 4617265 - DNA, 16 bp, Homo sapiens
tccgttcacatgtgtg

SEQ ID NO: 4617266 - DNA, 16 bp, Homo sapiens
tccgtttcgcgctggc

SEQ ID NO: 4617267 - DNA, 20 bp, Homo sapiens
tcctaaagaagacattttct

SEQ ID NO: 4617268 - DNA, 22 bp, Homo sapiens
tcctaaagaagacattttctct

SEQ ID NO: 4617269 - DNA, 15 bp, Homo sapiens
tcctaatgtgatcat

SEQ ID NO: 4617270 - DNA, 19 bp, Homo sapiens
tcctaatgtgatcatatga

SEQ ID NO: 4617271 - DNA, 20 bp, Homo sapiens
tcctacagcactactgggtg

SEQ ID NO: 4617272 - DNA, 21 bp, Homo sapiens
tcctacagcactactgggtgt

SEQ ID NO: 4617273 - DNA, 20 bp, Homo sapiens
tcctagccaggtctcctggg

SEQ ID NO: 4617274 - DNA, 14 bp, Homo sapiens
tcctagcctttggg

SEQ ID NO: 4617275 - DNA, 20 bp, Homo sapiens
tcctagctacttggcaggct

SEQ ID NO: 4617276 - DNA, 21 bp, Homo sapiens
tcctagctacttggcaggctg

SEQ ID NO: 4617277 - DNA, 16 bp, Homo sapiens
tcctaggatgtcatgt

SEQ ID NO: 4617278 - DNA, 21 bp, Homo sapiens
tcctaggtcatgcctcctccc

SEQ ID NO: 4617279 - DNA, 21 bp, Homo sapiens
tcctagtaagtcaggacagct

SEQ ID NO: 4617280 - DNA, 16 bp, Homo sapiens
tcctatagtcgtgggt

SEQ ID NO: 4617281 - DNA, 15 bp, Homo sapiens
tcctatatatttcta

SEQ ID NO: 4617282 - DNA, 16 bp, Homo sapiens
tcctatatatttctat

SEQ ID NO: 4617283 - DNA, 16 bp, Homo sapiens
tcctatcctaaataaa

SEQ ID NO: 4617284 - DNA, 17 bp, Homo sapiens
tcctatgatggatggca

SEQ ID NO: 4617285 - DNA, 22 bp, Homo sapiens
tcctatgatggatggcagactc

SEQ ID NO: 4617286 - DNA, 17 bp, Homo sapiens
tcctcaagaaataaaag

SEQ ID NO: 4617287 - DNA, 19 bp, Homo sapiens
tcctcagatcatccagaag

SEQ ID NO: 4617288 - DNA, 14 bp, Homo sapiens
tcctcagcaggcca

SEQ ID NO: 4617289 - DNA, 16 bp, Homo sapiens
tcctcagtccctcttc

SEQ ID NO: 4617290 - DNA, 10 bp, Homo sapiens
tcctcagtgc

SEQ ID NO: 4617291 - DNA, 19 bp, Homo sapiens
tcctcagtgcatttgtgct

SEQ ID NO: 4617292 - DNA, 15 bp, Homo sapiens
tcctccagcccctgt

SEQ ID NO: 4617293 - DNA, 16 bp, Homo sapiens
tcctccccctgctccc

SEQ ID NO: 4617294 - DNA, 18 bp, Homo sapiens
tcctccccctgctcccct

SEQ ID NO: 4617295 - DNA, 11 bp, Homo sapiens
tcctccctcct

SEQ ID NO: 4617296 - DNA, 13 bp, Homo sapiens
tcctcctccctcc

SEQ ID NO: 4617297 - DNA, 19 bp, Homo sapiens
tcctcctgagtagctggga

SEQ ID NO: 4617298 - DNA, 12 bp, Homo sapiens
tcctcctgcctt

SEQ ID NO: 4617299 - DNA, 12 bp, Homo sapiens
tcctcctgttca

SEQ ID NO: 4617300 - DNA, 16 bp, Homo sapiens
tcctccttggtgcctg

SEQ ID NO: 4617301 - DNA, 22 bp, Homo sapiens
tcctccttttcttcaccctccc

SEQ ID NO: 4617302 - DNA, 16 bp, Homo sapiens
tcctcgttctccctgg

SEQ ID NO: 4617303 - DNA, 18 bp, Homo sapiens
tcctctcatttccagctt

SEQ ID NO: 4617304 - DNA, 14 bp, Homo sapiens
tcctctccaccctc

SEQ ID NO: 4617305 - DNA, 15 bp, Homo sapiens
tcctctccattttag

SEQ ID NO: 4617306 - DNA, 17 bp, Homo sapiens
tcctctctccctgcctc

SEQ ID NO: 4617307 - DNA, 22 bp, Homo sapiens
tcctctgatagctgtttcaaat

SEQ ID NO: 4617308 - DNA, 14 bp, Homo sapiens
tcctctgccagcag

SEQ ID NO: 4617309 - DNA, 16 bp, Homo sapiens
tcctctgccagcagga

SEQ ID NO: 4617310 - DNA, 23 bp, Homo sapiens
tcctctgccagcaggaataaaga

SEQ ID NO: 4617311 - DNA, 23 bp, Homo sapiens
tcctctgtctcgagcgccctgca

SEQ ID NO: 4617312 - DNA, 15 bp, Homo sapiens
tcctctgttaatgtg

SEQ ID NO: 4617313 - DNA, 20 bp, Homo sapiens
tcctcttgtgatttctttaa

SEQ ID NO: 4617314 - DNA, 22 bp, Homo sapiens
tcctgaaccatgtggataactt

SEQ ID NO: 4617315 - DNA, 13 bp, Homo sapiens
tcctgaagctgag

SEQ ID NO: 4617316 - DNA, 15 bp, Homo sapiens
tcctgaagggaacta

SEQ ID NO: 4617317 - DNA, 14 bp, Homo sapiens
tcctgacattgtct

SEQ ID NO: 4617318 - DNA, 16 bp, Homo sapiens
tcctgagcactgccag

SEQ ID NO: 4617319 - DNA, 19 bp, Homo sapiens
tcctgagcactgccaggag

SEQ ID NO: 4617320 - DNA, 23 bp, Homo sapiens
tcctgagcactgccaggagggac

SEQ ID NO: 4617321 - DNA, 16 bp, Homo sapiens
tcctgaggacagctgt

SEQ ID NO: 4617322 - DNA, 18 bp, Homo sapiens
tcctgaggacagctgtcc

SEQ ID NO: 4617323 - DNA, 19 bp, Homo sapiens
tcctgaggacagctgtcct

SEQ ID NO: 4617324 - DNA, 18 bp, Homo sapiens
tcctgagtagctgggatt

SEQ ID NO: 4617325 - DNA, 13 bp, Homo sapiens
tcctgcagcaaac

SEQ ID NO: 4617326 - DNA, 19 bp, Homo sapiens
tcctgcagcaaacactcca

SEQ ID NO: 4617327 - DNA, 22 bp, Homo sapiens
tcctgcagcaaacactccaccc

SEQ ID NO: 4617328 - DNA, 15 bp, Homo sapiens
tcctgcagggcttct

SEQ ID NO: 4617329 - DNA, 19 bp, Homo sapiens
tcctgcagggcttctcctc

SEQ ID NO: 4617330 - DNA, 15 bp, Homo sapiens
tcctgccagggtgag

SEQ ID NO: 4617331 - DNA, 21 bp, Homo sapiens
tcctgccccaactccttccag

SEQ ID NO: 4617332 - DNA, 15 bp, Homo sapiens
tcctgcctctactgg

SEQ ID NO: 4617333 - DNA, 22 bp, Homo sapiens
tcctgcctctactgggaaggct

SEQ ID NO: 4617334 - DNA, 19 bp, Homo sapiens
tcctgcctttaagccaaag

SEQ ID NO: 4617335 - DNA, 18 bp, Homo sapiens
tcctgctaagttaatgtt

SEQ ID NO: 4617336 - DNA, 22 bp, Homo sapiens
tcctgctcattatgccacttcc

SEQ ID NO: 4617337 - DNA, 11 bp, Homo sapiens
tcctgctgcct

SEQ ID NO: 4617338 - DNA, 12 bp, Homo sapiens
tcctgctgcctg

SEQ ID NO: 4617339 - DNA, 15 bp, Homo sapiens
tcctgctgcctgggt

SEQ ID NO: 4617340 - DNA, 13 bp, Homo sapiens
tcctgctggggcc

SEQ ID NO: 4617341 - DNA, 18 bp, Homo sapiens
tcctgctttgggaagccg

SEQ ID NO: 4617342 - DNA, 21 bp, Homo sapiens
tcctggaagtcaaataaatgt

SEQ ID NO: 4617343 - DNA, 22 bp, Homo sapiens
tcctggacagctgtgcctcgct

SEQ ID NO: 4617344 - DNA, 19 bp, Homo sapiens
tcctggacattttttcagt

SEQ ID NO: 4617345 - DNA, 11 bp, Homo sapiens
tcctggagggg

SEQ ID NO: 4617346 - DNA, 19 bp, Homo sapiens
tcctggaggggctggggac

SEQ ID NO: 4617347 - DNA, 13 bp, Homo sapiens
tcctggcctgcct

SEQ ID NO: 4617348 - DNA, 22 bp, Homo sapiens
tcctggccttctaggaatggag

SEQ ID NO: 4617349 - DNA, 23 bp, Homo sapiens
tcctggccttctaggaatggagg

SEQ ID NO: 4617350 - DNA, 15 bp, Homo sapiens
tcctggctggccgca

SEQ ID NO: 4617351 - DNA, 14 bp, Homo sapiens
tcctggcttcccat

SEQ ID NO: 4617352 - DNA, 15 bp, Homo sapiens
tcctgggaaagggag

SEQ ID NO: 4617353 - DNA, 17 bp, Homo sapiens
tcctgggaaagggagat

SEQ ID NO: 4617354 - DNA, 21 bp, Homo sapiens
tcctgggaaagggagatgtca

SEQ ID NO: 4617355 - DNA, 17 bp, Homo sapiens
tcctgggacctccccag

SEQ ID NO: 4617356 - DNA, 19 bp, Homo sapiens
tcctgggacctccccagcc

SEQ ID NO: 4617357 - DNA, 21 bp, Homo sapiens
tcctgggacctccccagccca

SEQ ID NO: 4617358 - DNA, 13 bp, Homo sapiens
tcctgggtggcta

SEQ ID NO: 4617359 - DNA, 23 bp, Homo sapiens
tcctgggtggctactctgtgcca

SEQ ID NO: 4617360 - DNA, 18 bp, Homo sapiens
tcctggtcagctgcccca

SEQ ID NO: 4617361 - DNA, 21 bp, Homo sapiens
tcctggtggggcagctcctct

SEQ ID NO: 4617362 - DNA, 21 bp, Homo sapiens
tcctgtagccttctgtaggaa

SEQ ID NO: 4617363 - DNA, 21 bp, Homo sapiens
tcctgtagttgcgtggactct

SEQ ID NO: 4617364 - DNA, 23 bp, Homo sapiens
tcctgtagttgcgtggactctgc

SEQ ID NO: 4617365 - DNA, 17 bp, Homo sapiens
tcctgtatttgttccca

SEQ ID NO: 4617366 - DNA, 22 bp, Homo sapiens
tcctgtatttgttcccaagagc

SEQ ID NO: 4617367 - DNA, 18 bp, Homo sapiens
tcctgtggttttattaca

SEQ ID NO: 4617368 - DNA, 19 bp, Homo sapiens
tcctgtgtaacgactacaa

SEQ ID NO: 4617369 - DNA, 19 bp, Homo sapiens
tcctgttcttaagacgtga

SEQ ID NO: 4617370 - DNA, 16 bp, Homo sapiens
tcctgtttctgtcaag

SEQ ID NO: 4617371 - DNA, 18 bp, Homo sapiens
tccttaaagagtgtggca

SEQ ID NO: 4617372 - DNA, 23 bp, Homo sapiens
tccttaaagagtgtggcaaaata

SEQ ID NO: 4617373 - DNA, 20 bp, Homo sapiens
tccttactcctgtgggagcc

SEQ ID NO: 4617374 - DNA, 14 bp, Homo sapiens
tccttatcagagct

SEQ ID NO: 4617375 - DNA, 14 bp, Homo sapiens
tccttatcctagcc

SEQ ID NO: 4617376 - DNA, 20 bp, Homo sapiens
tccttatcctagcctttggg

SEQ ID NO: 4617377 - DNA, 17 bp, Homo sapiens
tccttcacctcactgaa

SEQ ID NO: 4617378 - DNA, 17 bp, Homo sapiens
tccttcagttctgcttg

SEQ ID NO: 4617379 - DNA, 18 bp, Homo sapiens
tccttcagttctgcttgc

SEQ ID NO: 4617380 - DNA, 16 bp, Homo sapiens
tccttccagccttttt

SEQ ID NO: 4617381 - DNA, 15 bp, Homo sapiens
tccttccatccttga

SEQ ID NO: 4617382 - DNA, 13 bp, Homo sapiens
tccttccattcca

SEQ ID NO: 4617383 - DNA, 21 bp, Homo sapiens
tccttcccagaatgttactga

SEQ ID NO: 4617384 - DNA, 18 bp, Homo sapiens
tccttccccagctccccc

SEQ ID NO: 4617385 - DNA, 12 bp, Homo sapiens
tccttcctgccc

SEQ ID NO: 4617386 - DNA, 14 bp, Homo sapiens
tccttccttagttt

SEQ ID NO: 4617387 - DNA, 15 bp, Homo sapiens
tccttcgaaaggcct

SEQ ID NO: 4617388 - DNA, 20 bp, Homo sapiens
tccttcgaaaggccttcaga

SEQ ID NO: 4617389 - DNA, 15 bp, Homo sapiens
tccttctattctagc

SEQ ID NO: 4617390 - DNA, 19 bp, Homo sapiens
tccttctccttctcacaca

SEQ ID NO: 4617391 - DNA, 13 bp, Homo sapiens
tccttctctcact

SEQ ID NO: 4617392 - DNA, 21 bp, Homo sapiens
tccttctggcagattcaaatc

SEQ ID NO: 4617393 - DNA, 23 bp, Homo sapiens
tccttgcccaggtgagggaagga

SEQ ID NO: 4617394 - DNA, 20 bp, Homo sapiens
tccttggctttatgcaaata

SEQ ID NO: 4617395 - DNA, 15 bp, Homo sapiens
tccttggttcatgct

SEQ ID NO: 4617396 - DNA, 16 bp, Homo sapiens
tcctttatctgcacct

SEQ ID NO: 4617397 - DNA, 15 bp, Homo sapiens
tcctttcaataaagt

SEQ ID NO: 4617398 - DNA, 23 bp, Homo sapiens
tcctttccaatagaaagaaacta

SEQ ID NO: 4617399 - DNA, 22 bp, Homo sapiens
tcctttgatcagtataattttt

SEQ ID NO: 4617400 - DNA, 16 bp, Homo sapiens
tcctttgcccttcctc

SEQ ID NO: 4617401 - DNA, 19 bp, Homo sapiens
tcctttgcccttcctcctg

SEQ ID NO: 4617402 - DNA, 16 bp, Homo sapiens
tcctttgtagctactt

SEQ ID NO: 4617403 - DNA, 14 bp, Homo sapiens
tcctttgtcttgga

SEQ ID NO: 4617404 - DNA, 17 bp, Homo sapiens
tccttttaaagaagctt

SEQ ID NO: 4617405 - DNA, 19 bp, Homo sapiens
tccttttcttcaccctccc

SEQ ID NO: 4617406 - DNA, 17 bp, Homo sapiens
tcctttttcaaatgagt

SEQ ID NO: 4617407 - DNA, 12 bp, Homo sapiens
tcctttttgtaa

SEQ ID NO: 4617408 - DNA, 22 bp, Homo sapiens
tcgaaacctacaagatttcctt

SEQ ID NO: 4617409 - DNA, 15 bp, Homo sapiens
tcgaacgtggtctga

SEQ ID NO: 4617410 - DNA, 18 bp, Homo sapiens
tcgaatggggtagaaaca

SEQ ID NO: 4617411 - DNA, 14 bp, Homo sapiens
tcgacagacagcca

SEQ ID NO: 4617412 - DNA, 16 bp, Homo sapiens
tcgacagatgattttc

SEQ ID NO: 4617413 - DNA, 15 bp, Homo sapiens
tcgacagggcctgga

SEQ ID NO: 4617414 - DNA, 18 bp, Homo sapiens
tcgacagggcctggagcc

SEQ ID NO: 4617415 - DNA, 14 bp, Homo sapiens
tcgaccctgtcccc

SEQ ID NO: 4617416 - DNA, 16 bp, Homo sapiens
tcgatgttatgtaaaa

SEQ ID NO: 4617417 - DNA, 15 bp, Homo sapiens
tcgatttctccagga

SEQ ID NO: 4617418 - DNA, 21 bp, Homo sapiens
tcgcacacacccatgtaacca

SEQ ID NO: 4617419 - DNA, 12 bp, Homo sapiens
tcgcagccaccc

SEQ ID NO: 4617420 - DNA, 21 bp, Homo sapiens
tcgcagccaccctgaggagtc

SEQ ID NO: 4617421 - DNA, 14 bp, Homo sapiens
tcgcatgtttaatg

SEQ ID NO: 4617422 - DNA, 13 bp, Homo sapiens
tcgccccaaagtt

SEQ ID NO: 4617423 - DNA, 20 bp, Homo sapiens
tcgccccagcaggtgctgac

SEQ ID NO: 4617424 - DNA, 12 bp, Homo sapiens
tcgcccctcaga

SEQ ID NO: 4617425 - DNA, 15 bp, Homo sapiens
tcgcctatcttaggt

SEQ ID NO: 4617426 - DNA, 20 bp, Homo sapiens
tcgctccccactctgctctg

SEQ ID NO: 4617427 - DNA, 11 bp, Homo sapiens
tcgctgaaagc

SEQ ID NO: 4617428 - DNA, 20 bp, Homo sapiens
tcgctgggctctaaggtact

SEQ ID NO: 4617429 - DNA, 22 bp, Homo sapiens
tcgctgtattttgagtttcagc

SEQ ID NO: 4617430 - DNA, 18 bp, Homo sapiens
tcgctgttggagcaaacc

SEQ ID NO: 4617431 - DNA, 21 bp, Homo sapiens
tcgctgttggagcaaaccatt

SEQ ID NO: 4617432 - DNA, 22 bp, Homo sapiens
tcggacatgcttttctgccact

SEQ ID NO: 4617433 - DNA, 18 bp, Homo sapiens
tcacccctcccctgggac

SEQ ID NO: 4617434 - DNA, 13 bp, Homo sapiens
tcacccctgcccc

SEQ ID NO: 4617435 - DNA, 20 bp, Homo sapiens
tcacccctgcccctgtggga

SEQ ID NO: 4617436 - DNA, 16 bp, Homo sapiens
tcaccgactcacctgc

SEQ ID NO: 4617437 - DNA, 19 bp, Homo sapiens
tcaccgactcacctgcgca

SEQ ID NO: 4617438 - DNA, 16 bp, Homo sapiens
tcacctagcagcctca

SEQ ID NO: 4617439 - DNA, 12 bp, Homo sapiens
tcacctcagcac

SEQ ID NO: 4617440 - DNA, 12 bp, Homo sapiens
tcacctcccatc

SEQ ID NO: 4617441 - DNA, 12 bp, Homo sapiens
tcacctcctgct

SEQ ID NO: 4617442 - DNA, 17 bp, Homo sapiens
tcacctccttccccagc

SEQ ID NO: 4617443 - DNA, 18 bp, Homo sapiens
tcacctccttccccagct

SEQ ID NO: 4617444 - DNA, 19 bp, Homo sapiens
tcacctccttccccagctc

SEQ ID NO: 4617445 - DNA, 18 bp, Homo sapiens
tcacctctgggaccccag

SEQ ID NO: 4617446 - DNA, 22 bp, Homo sapiens
tcacctctgggaccccagctgc

SEQ ID NO: 4617447 - DNA, 19 bp, Homo sapiens
tcacctgattcaactaaaa

SEQ ID NO: 4617448 - DNA, 23 bp, Homo sapiens
tcacctgccccgtagagaatgtg

SEQ ID NO: 4617449 - DNA, 21 bp, Homo sapiens
tcacctgcgcaagtgcctggg

SEQ ID NO: 4617450 - DNA, 15 bp, Homo sapiens
tcacctgtactattg

SEQ ID NO: 4617451 - DNA, 22 bp, Homo sapiens
tcacgaagtgttgcatggatgt

SEQ ID NO: 4617452 - DNA, 18 bp, Homo sapiens
tcacgtaaagctagaaat

SEQ ID NO: 4617453 - DNA, 19 bp, Homo sapiens
tcacgtaaagctagaaatg

SEQ ID NO: 4617454 - DNA, 19 bp, Homo sapiens
tcacgtaatcctcctgagt

SEQ ID NO: 4617455 - DNA, 12 bp, Homo sapiens
tcacgtcatttg

SEQ ID NO: 4617456 - DNA, 15 bp, Homo sapiens
tcactaaactttatt

SEQ ID NO: 4617457 - DNA, 14 bp, Homo sapiens
tcactagaatggat

SEQ ID NO: 4617458 - DNA, 17 bp, Homo sapiens
tcactcaagaagcacac

SEQ ID NO: 4617459 - DNA, 18 bp, Homo sapiens
tcactcattaatgaatca

SEQ ID NO: 4617460 - DNA, 16 bp, Homo sapiens
tcactcctgctgtaaa

SEQ ID NO: 4617461 - DNA, 13 bp, Homo sapiens
tcactctgggctg

SEQ ID NO: 4617462 - DNA, 22 bp, Homo sapiens
tcactcttgtcacccaggctgg

SEQ ID NO: 4617463 - DNA, 20 bp, Homo sapiens
tcactgaaaacatctggaag

SEQ ID NO: 4617464 - DNA, 14 bp, Homo sapiens
tcactgaaacatgg

SEQ ID NO: 4617465 - DNA, 18 bp, Homo sapiens
tcactgcaacctccgcct

SEQ ID NO: 4617466 - DNA, 16 bp, Homo sapiens
tcactgcaatctctgc

SEQ ID NO: 4617467 - DNA, 20 bp, Homo sapiens
tcactgcaatctctgcctcc

SEQ ID NO: 4617468 - DNA, 15 bp, Homo sapiens
tcactgggagaggtt

SEQ ID NO: 4617469 - DNA, 11 bp, Homo sapiens
tcactgtgtta

SEQ ID NO: 4617470 - DNA, 14 bp, Homo sapiens
tcactgtgttactg

SEQ ID NO: 4617471 - DNA, 13 bp, Homo sapiens
tcacttactattg

SEQ ID NO: 4617472 - DNA, 13 bp, Homo sapiens
tcacttatacctg

SEQ ID NO: 4617473 - DNA, 15 bp, Homo sapiens
tcacttcaaagctaa

SEQ ID NO: 4617474 - DNA, 20 bp, Homo sapiens
tcacttcaaagctaaaaaat

SEQ ID NO: 4617475 - DNA, 17 bp, Homo sapiens
tcacttcacgctttcag

SEQ ID NO: 4617476 - DNA, 19 bp, Homo sapiens
tcacttccagcttgcctgt

SEQ ID NO: 4617477 - DNA, 16 bp, Homo sapiens
tcacttccccaagatc

SEQ ID NO: 4617478 - DNA, 21 bp, Homo sapiens
tcacttccccaagatctgcca

SEQ ID NO: 4617479 - DNA, 16 bp, Homo sapiens
tcacttcctttgccct

SEQ ID NO: 4617480 - DNA, 21 bp, Homo sapiens
tcacttcctttgcccttcctc

SEQ ID NO: 4617481 - DNA, 12 bp, Homo sapiens
tcacttcttcac

SEQ ID NO: 4617482 - DNA, 18 bp, Homo sapiens
tcacttgctgctttttct

SEQ ID NO: 4617483 - DNA, 15 bp, Homo sapiens
tcactttaagatctt

SEQ ID NO: 4617484 - DNA, 20 bp, Homo sapiens
tcagaaagggagggctctga

SEQ ID NO: 4617485 - DNA, 21 bp, Homo sapiens
tcagaaagggagggctctgag

SEQ ID NO: 4617486 - DNA, 19 bp, Homo sapiens
tcagaaagtaacaatctat

SEQ ID NO: 4617487 - DNA, 17 bp, Homo sapiens
tcagaaagtgacatttg

SEQ ID NO: 4617488 - DNA, 20 bp, Homo sapiens
tcagaaatcctctgttaatg

SEQ ID NO: 4617489 - DNA, 23 bp, Homo sapiens
tcagaacattcagctctggagaa

SEQ ID NO: 4617490 - DNA, 15 bp, Homo sapiens
tcagaagcctggggg

SEQ ID NO: 4617491 - DNA, 14 bp, Homo sapiens
tcagaaggagaagg

SEQ ID NO: 4617492 - DNA, 19 bp, Homo sapiens
tcagaaggagaaggctgga

SEQ ID NO: 4617493 - DNA, 17 bp, Homo sapiens
tcagaattgcacatcta

SEQ ID NO: 4617494 - DNA, 18 bp, Homo sapiens
tcagaattgcacatctaa

SEQ ID NO: 4617495 - DNA, 16 bp, Homo sapiens
tcagacataaagccat

SEQ ID NO: 4617496 - DNA, 18 bp, Homo sapiens
tcagacccatctctccct

SEQ ID NO: 4617497 - DNA, 16 bp, Homo sapiens
tcagactttggaaaat

SEQ ID NO: 4617498 - DNA, 21 bp, Homo sapiens
tcagactttggaaaatgcatt

SEQ ID NO: 4617499 - DNA, 19 bp, Homo sapiens
tcagagatcaggatcagct

SEQ ID NO: 4617500 - DNA, 14 bp, Homo sapiens
tcagagcgcacagg

SEQ ID NO: 4617501 - DNA, 21 bp, Homo sapiens
tcagagctaagggtgggtgct

SEQ ID NO: 4617502 - DNA, 23 bp, Homo sapiens
tcagagctaagggtgggtgctca

SEQ ID NO: 4617503 - DNA, 17 bp, Homo sapiens
tcagagcttcctgggga

SEQ ID NO: 4617504 - DNA, 20 bp, Homo sapiens
tcagagcttcctggggacca

SEQ ID NO: 4617505 - DNA, 23 bp, Homo sapiens
tcagagcttcctggggaccaaga

SEQ ID NO: 4617506 - DNA, 12 bp, Homo sapiens
tcagaggaacaa

SEQ ID NO: 4617507 - DNA, 18 bp, Homo sapiens
tcagaggcacaaaagggt

SEQ ID NO: 4617508 - DNA, 14 bp, Homo sapiens
tcagataactgggt

SEQ ID NO: 4617509 - DNA, 15 bp, Homo sapiens
tcagataatatgttt

SEQ ID NO: 4617510 - DNA, 17 bp, Homo sapiens
tcagataatatgtttag

SEQ ID NO: 4617511 - DNA, 18 bp, Homo sapiens
tcagatataaaagactga

SEQ ID NO: 4617512 - DNA, 18 bp, Homo sapiens
tcagatgaggccctgcac

SEQ ID NO: 4617513 - DNA, 14 bp, Homo sapiens
tcagattgcatgtg

SEQ ID NO: 4617514 - DNA, 15 bp, Homo sapiens
tcagattgcatgtga

SEQ ID NO: 4617515 - DNA, 16 bp, Homo sapiens
tcagattgcatgtgac

SEQ ID NO: 4617516 - DNA, 17 bp, Homo sapiens
tcagattgcatgtgact

SEQ ID NO: 4617517 - DNA, 14 bp, Homo sapiens
tcagattttttcct

SEQ ID NO: 4617518 - DNA, 19 bp, Homo sapiens
tcagcaagttagaactagc

SEQ ID NO: 4617519 - DNA, 21 bp, Homo sapiens
tcagcaagttagaactagcca

SEQ ID NO: 4617520 - DNA, 18 bp, Homo sapiens
tcagcacatattttctgt

SEQ ID NO: 4617521 - DNA, 18 bp, Homo sapiens
tcagcactgtggacacct

SEQ ID NO: 4617522 - DNA, 18 bp, Homo sapiens
tcagcagcaaattttcag

SEQ ID NO: 4617523 - DNA, 21 bp, Homo sapiens
tcagcaggctagacagaaaca

SEQ ID NO: 4617524 - DNA, 12 bp, Homo sapiens
tcagcagggctg

SEQ ID NO: 4617525 - DNA, 20 bp, Homo sapiens
tcagcagggctggtcacctc

SEQ ID NO: 4617526 - DNA, 21 bp, Homo sapiens
tcagcagggctggtcacctcc

SEQ ID NO: 4617527 - DNA, 20 bp, Homo sapiens
tcagcatgcctgtcctttca

SEQ ID NO: 4617528 - DNA, 21 bp, Homo sapiens
tcagcattttttatcaggcag

SEQ ID NO: 4617529 - DNA, 23 bp, Homo sapiens
tcagcattttttatcaggcagga

SEQ ID NO: 4617530 - DNA, 14 bp, Homo sapiens
tcagccagggcctg

SEQ ID NO: 4617531 - DNA, 18 bp, Homo sapiens
tcagccagtggggatgag

SEQ ID NO: 4617532 - DNA, 14 bp, Homo sapiens
tcagcccatggagg

SEQ ID NO: 4617533 - DNA, 16 bp, Homo sapiens
tcagcccatggaggca

SEQ ID NO: 4617534 - DNA, 22 bp, Homo sapiens
tcagccccgacttcctgactct

SEQ ID NO: 4617535 - DNA, 20 bp, Homo sapiens
tcagcctaccgctggccctg

SEQ ID NO: 4617536 - DNA, 22 bp, Homo sapiens
tcagcctaccgctggccctgcc

SEQ ID NO: 4617537 - DNA, 23 bp, Homo sapiens
tcagcctaccgctggccctgccg

SEQ ID NO: 4617538 - DNA, 20 bp, Homo sapiens
tcagcctcccaagtagctgg

SEQ ID NO: 4617539 - DNA, 20 bp, Homo sapiens
tcagccttgctacttgaagg

SEQ ID NO: 4617540 - DNA, 14 bp, Homo sapiens
tcagcgtggccttg

SEQ ID NO: 4617541 - DNA, 23 bp, Homo sapiens
tcagctgccccaatgtgacctgg

SEQ ID NO: 4617542 - DNA, 18 bp, Homo sapiens
tcagctggtcctgaccag

SEQ ID NO: 4617543 - DNA, 19 bp, Homo sapiens
tcagctttggattgctggg

SEQ ID NO: 4617544 - DNA, 21 bp, Homo sapiens
tatgtgaaaaattaacttttt

SEQ ID NO: 4617545 - DNA, 15 bp, Homo sapiens
tatgtgacattcctg

SEQ ID NO: 4617546 - DNA, 16 bp, Homo sapiens
tatgtgattttaactc

SEQ ID NO: 4617547 - DNA, 21 bp, Homo sapiens
tatgtgattttaactctgtct

SEQ ID NO: 4617548 - DNA, 12 bp, Homo sapiens
tatgttcatgta

SEQ ID NO: 4617549 - DNA, 13 bp, Homo sapiens
tatgttctgtctt

SEQ ID NO: 4617550 - DNA, 20 bp, Homo sapiens
tatgttggttgatataacac

SEQ ID NO: 4617551 - DNA, 13 bp, Homo sapiens
tatgtttaaaata

SEQ ID NO: 4617552 - DNA, 14 bp, Homo sapiens
tatgtttatttcat

SEQ ID NO: 4617553 - DNA, 18 bp, Homo sapiens
tattaaaaaaactggcct

SEQ ID NO: 4617554 - DNA, 17 bp, Homo sapiens
tattaaaatacatttta

SEQ ID NO: 4617555 - DNA, 22 bp, Homo sapiens
tattaaacaagtcaattctgtg

SEQ ID NO: 4617556 - DNA, 21 bp, Homo sapiens
tattaaacgtatgcatgtgaa

SEQ ID NO: 4617557 - DNA, 14 bp, Homo sapiens
tattaaagtattct

SEQ ID NO: 4617558 - DNA, 13 bp, Homo sapiens
tattaaccttttt

SEQ ID NO: 4617559 - DNA, 22 bp, Homo sapiens
tattaagtgtgccaaatcagtt

SEQ ID NO: 4617560 - DNA, 17 bp, Homo sapiens
tattaatactacccata

SEQ ID NO: 4617561 - DNA, 14 bp, Homo sapiens
tattaatcaagaga

SEQ ID NO: 4617562 - DNA, 18 bp, Homo sapiens
tattaatcaagagaaact

SEQ ID NO: 4617563 - DNA, 19 bp, Homo sapiens
tattaattttctacaaata

SEQ ID NO: 4617564 - DNA, 18 bp, Homo sapiens
tattacatgtaatttgat

SEQ ID NO: 4617565 - DNA, 19 bp, Homo sapiens
tattaccatcttaatcttt

SEQ ID NO: 4617566 - DNA, 16 bp, Homo sapiens
tattacttttctgttt

SEQ ID NO: 4617567 - DNA, 16 bp, Homo sapiens
tattagttacaaagtt

SEQ ID NO: 4617568 - DNA, 14 bp, Homo sapiens
tattatagaaaatt

SEQ ID NO: 4617569 - DNA, 15 bp, Homo sapiens
tattatatggcagga

SEQ ID NO: 4617570 - DNA, 21 bp, Homo sapiens
tattattcagaattatacaga

SEQ ID NO: 4617571 - DNA, 15 bp, Homo sapiens
tattatttatttctg

SEQ ID NO: 4617572 - DNA, 16 bp, Homo sapiens
tattcacatatgtctt

SEQ ID NO: 4617573 - DNA, 20 bp, Homo sapiens
tattcacatatgtcttacta

SEQ ID NO: 4617574 - DNA, 12 bp, Homo sapiens
tattcatggcta

SEQ ID NO: 4617575 - DNA, 13 bp, Homo sapiens
tattctagagctt

SEQ ID NO: 4617576 - DNA, 16 bp, Homo sapiens
tattctagagctttta

SEQ ID NO: 4617577 - DNA, 13 bp, Homo sapiens
tattctattaact

SEQ ID NO: 4617578 - DNA, 19 bp, Homo sapiens
tattctattaactttaatt

SEQ ID NO: 4617579 - DNA, 22 bp, Homo sapiens
tattctgtcagtgttaaagatt

SEQ ID NO: 4617580 - DNA, 12 bp, Homo sapiens
tattctttacaa

SEQ ID NO: 4617581 - DNA, 14 bp, Homo sapiens
tattctttactatt

SEQ ID NO: 4617582 - DNA, 23 bp, Homo sapiens
tattgagggtcattctttattct

SEQ ID NO: 4617583 - DNA, 16 bp, Homo sapiens
tattgattaaaaatgt

SEQ ID NO: 4617584 - DNA, 17 bp, Homo sapiens
tattgattaaaaatgtg

SEQ ID NO: 4617585 - DNA, 17 bp, Homo sapiens
tattgctctatgttagt

SEQ ID NO: 4617586 - DNA, 14 bp, Homo sapiens
tattggaagctgct

SEQ ID NO: 4617587 - DNA, 12 bp, Homo sapiens
tattgtacagtt

SEQ ID NO: 4617588 - DNA, 13 bp, Homo sapiens
tattgtacagttt

SEQ ID NO: 4617589 - DNA, 15 bp, Homo sapiens
tattgttagaaaatg

SEQ ID NO: 4617590 - DNA, 16 bp, Homo sapiens
tattgttagaaaatga

SEQ ID NO: 4617591 - DNA, 22 bp, Homo sapiens
tattgttagaaaatgacttatt

SEQ ID NO: 4617592 - DNA, 13 bp, Homo sapiens
tattgtttctgca

SEQ ID NO: 4617593 - DNA, 17 bp, Homo sapiens
tatttaacaaaaaatgt

SEQ ID NO: 4617594 - DNA, 17 bp, Homo sapiens
tatttactctttgcaaa

SEQ ID NO: 4617595 - DNA, 14 bp, Homo sapiens
tatttagaagcaga

SEQ ID NO: 4617596 - DNA, 16 bp, Homo sapiens
tatttaggaaaatgct

SEQ ID NO: 4617597 - DNA, 13 bp, Homo sapiens
tatttataaaaat

SEQ ID NO: 4617598 - DNA, 22 bp, Homo sapiens
tatttatctgtgtttttgaaat

SEQ ID NO: 4617599 - DNA, 22 bp, Homo sapiens
tatttatgccttgatgatttaa

SEQ ID NO: 4617600 - DNA, 11 bp, Homo sapiens
tatttattgtt

SEQ ID NO: 4617601 - DNA, 15 bp, Homo sapiens
tatttattgttagaa

SEQ ID NO: 4617602 - DNA, 12 bp, Homo sapiens
tatttcatttta

SEQ ID NO: 4617603 - DNA, 16 bp, Homo sapiens
tatttccactattttc

SEQ ID NO: 4617604 - DNA, 20 bp, Homo sapiens
tatttccactattttcaaag

SEQ ID NO: 4617605 - DNA, 12 bp, Homo sapiens
tatttccttcca

SEQ ID NO: 4617606 - DNA, 15 bp, Homo sapiens
tatttccttccagcc

SEQ ID NO: 4617607 - DNA, 13 bp, Homo sapiens
tatttctagccat

SEQ ID NO: 4617608 - DNA, 14 bp, Homo sapiens
tatttctatgacaa

SEQ ID NO: 4617609 - DNA, 16 bp, Homo sapiens
tatttctatgacaaat

SEQ ID NO: 4617610 - DNA, 20 bp, Homo sapiens
tatttctatgacaaattcaa

SEQ ID NO: 4617611 - DNA, 17 bp, Homo sapiens
tatttctctgtgaatcc

SEQ ID NO: 4617612 - DNA, 14 bp, Homo sapiens
tatttctgcctccc

SEQ ID NO: 4617613 - DNA, 19 bp, Homo sapiens
tatttctgttcctttttgt

SEQ ID NO: 4617614 - DNA, 21 bp, Homo sapiens
tatttcttggcatgcatcttt

SEQ ID NO: 4617615 - DNA, 13 bp, Homo sapiens
tatttgaagaaaa

SEQ ID NO: 4617616 - DNA, 17 bp, Homo sapiens
tatttgaagaaaaaaat

SEQ ID NO: 4617617 - DNA, 20 bp, Homo sapiens
tatttgaagaaaaaaatgta

SEQ ID NO: 4617618 - DNA, 11 bp, Homo sapiens
tatttgaagag

SEQ ID NO: 4617619 - DNA, 14 bp, Homo sapiens
tatttgatttctaa

SEQ ID NO: 4617620 - DNA, 15 bp, Homo sapiens
tatttgatttctaat

SEQ ID NO: 4617621 - DNA, 15 bp, Homo sapiens
tatttgctttttgct

SEQ ID NO: 4617622 - DNA, 16 bp, Homo sapiens
tatttggaatatttga

SEQ ID NO: 4617623 - DNA, 17 bp, Homo sapiens
tatttggaatatttgaa

SEQ ID NO: 4617624 - DNA, 22 bp, Homo sapiens
tatttgggagggaaaagggaag

SEQ ID NO: 4617625 - DNA, 19 bp, Homo sapiens
tatttgtaaaccattgtaa

SEQ ID NO: 4617626 - DNA, 18 bp, Homo sapiens
tatttgtttgtagctttc

SEQ ID NO: 4617627 - DNA, 13 bp, Homo sapiens
tattttaatacct

SEQ ID NO: 4617628 - DNA, 20 bp, Homo sapiens
tattttcaaccataaaagaa

SEQ ID NO: 4617629 - DNA, 22 bp, Homo sapiens
tattttcaaccataaaagaagt

SEQ ID NO: 4617630 - DNA, 19 bp, Homo sapiens
tattttcagtgcatcatta

SEQ ID NO: 4617631 - DNA, 22 bp, Homo sapiens
tattttccaaaagtggcctctt

SEQ ID NO: 4617632 - DNA, 14 bp, Homo sapiens
tattttccttccat

SEQ ID NO: 4617633 - DNA, 22 bp, Homo sapiens
tattttccttccatgctcccaa

SEQ ID NO: 4617634 - DNA, 14 bp, Homo sapiens
tattttctatttta

SEQ ID NO: 4617635 - DNA, 17 bp, Homo sapiens
tattttgacactggtat

SEQ ID NO: 4617636 - DNA, 15 bp, Homo sapiens
tattttgtactttgt

SEQ ID NO: 4617637 - DNA, 16 bp, Homo sapiens
tattttgttgtgcact

SEQ ID NO: 4617638 - DNA, 21 bp, Homo sapiens
tattttgttttgtgcagagat

SEQ ID NO: 4617639 - DNA, 23 bp, Homo sapiens
tatttttaaaaaatgaaatcctt

SEQ ID NO: 4617640 - DNA, 23 bp, Homo sapiens
tatttttatattaaagtaaatgg

SEQ ID NO: 4617641 - DNA, 18 bp, Homo sapiens
tatttttgtatttctcta

SEQ ID NO: 4617642 - DNA, 14 bp, Homo sapiens
tattttttcctttt

SEQ ID NO: 4617643 - DNA, 16 bp, Homo sapiens
tcaaaaaaaagaaaaa

SEQ ID NO: 4617644 - DNA, 16 bp, Homo sapiens
tcaaaactgtttgtta

SEQ ID NO: 4617645 - DNA, 18 bp, Homo sapiens
tcaaaatacatttgtaag

SEQ ID NO: 4617646 - DNA, 14 bp, Homo sapiens
tcaaaatacttctt

SEQ ID NO: 4617647 - DNA, 15 bp, Homo sapiens
tcaaaatacttcttt

SEQ ID NO: 4617648 - DNA, 16 bp, Homo sapiens
tcaaaatcagtttttc

SEQ ID NO: 4617649 - DNA, 17 bp, Homo sapiens
tcaaaatcagtttttca

SEQ ID NO: 4617650 - DNA, 16 bp, Homo sapiens
tcaaactcctgacctc

SEQ ID NO: 4617651 - DNA, 23 bp, Homo sapiens
tcaaagaaggtttgtgtttttct

SEQ ID NO: 4617652 - DNA, 18 bp, Homo sapiens
tcaaagctttcctgtttc

SEQ ID NO: 4617653 - DNA, 21 bp, Homo sapiens
tcaaagtgtctcattctcaga

SEQ ID NO: 4617654 - DNA, 17 bp, Homo sapiens
tcaaataaaatatcata

SEQ ID NO: 4617655 - DNA, 20 bp, Homo sapiens
tcaaataaaatatcataaag

SEQ ID NO: 4617656 - DNA, 21 bp, Homo sapiens
tcaggaaaatgtattgattca

SEQ ID NO: 4617657 - DNA, 18 bp, Homo sapiens
tcaggaaatgaaaggtga

SEQ ID NO: 4617658 - DNA, 15 bp, Homo sapiens
tcaggaattcagtgc

SEQ ID NO: 4617659 - DNA, 16 bp, Homo sapiens
tcaggacacaggcctg

SEQ ID NO: 4617660 - DNA, 17 bp, Homo sapiens
tcaggacacaggcctgt

SEQ ID NO: 4617661 - DNA, 18 bp, Homo sapiens
tcaggacacaggcctgtg

SEQ ID NO: 4617662 - DNA, 19 bp, Homo sapiens
tcaggagaaggtggtggca

SEQ ID NO: 4617663 - DNA, 18 bp, Homo sapiens
tcaggagatggagggctt

SEQ ID NO: 4617664 - DNA, 15 bp, Homo sapiens
tcaggatccagtctg

SEQ ID NO: 4617665 - DNA, 15 bp, Homo sapiens
tcaggcaaggaggag

SEQ ID NO: 4617666 - DNA, 20 bp, Homo sapiens
tcaggcaaggaggaggagtc

SEQ ID NO: 4617667 - DNA, 17 bp, Homo sapiens
tcaggcaggaccaggtg

SEQ ID NO: 4617668 - DNA, 11 bp, Homo sapiens
tcaggcctctg

SEQ ID NO: 4617669 - DNA, 15 bp, Homo sapiens
tcaggctactagaat

SEQ ID NO: 4617670 - DNA, 18 bp, Homo sapiens
tcaggctagccctgccct

SEQ ID NO: 4617671 - DNA, 13 bp, Homo sapiens
tcaggctctgcac

SEQ ID NO: 4617672 - DNA, 18 bp, Homo sapiens
tcaggctctgcacagaca

SEQ ID NO: 4617673 - DNA, 22 bp, Homo sapiens
tcaggctctgcacagacaagca

SEQ ID NO: 4617674 - DNA, 19 bp, Homo sapiens
tcagggagtgctggctcac

SEQ ID NO: 4617675 - DNA, 14 bp, Homo sapiens
tcagggcctgcccc

SEQ ID NO: 4617676 - DNA, 16 bp, Homo sapiens
tcagggcctgccccct

SEQ ID NO: 4617677 - DNA, 19 bp, Homo sapiens
tcagggcctgccccctggg

SEQ ID NO: 4617678 - DNA, 18 bp, Homo sapiens
tcagggcctggggcctga

SEQ ID NO: 4617679 - DNA, 22 bp, Homo sapiens
tcagggcctggggcctgagaga

SEQ ID NO: 4617680 - DNA, 22 bp, Homo sapiens
tcagggtttgtcagaggaacaa

SEQ ID NO: 4617681 - DNA, 16 bp, Homo sapiens
tcaggtaatcatttta

SEQ ID NO: 4617682 - DNA, 16 bp, Homo sapiens
tcaggtgatccgccca

SEQ ID NO: 4617683 - DNA, 23 bp, Homo sapiens
tcaggtgtgataaaatgttgaac

SEQ ID NO: 4617684 - DNA, 14 bp, Homo sapiens
tcagtaaatagtgt

SEQ ID NO: 4617685 - DNA, 17 bp, Homo sapiens
tcagtaatcacttttca

SEQ ID NO: 4617686 - DNA, 14 bp, Homo sapiens
tcagtaccaaagaa

SEQ ID NO: 4617687 - DNA, 16 bp, Homo sapiens
tcagtataatttttta

SEQ ID NO: 4617688 - DNA, 13 bp, Homo sapiens
tcagtatttaact

SEQ ID NO: 4617689 - DNA, 15 bp, Homo sapiens
tcagtatttaactaa

SEQ ID NO: 4617690 - DNA, 14 bp, Homo sapiens
tcagtcacagccac

SEQ ID NO: 4617691 - DNA, 18 bp, Homo sapiens
tcagtcctcctctccttt

SEQ ID NO: 4617692 - DNA, 20 bp, Homo sapiens
tcagtgaagtctagaatcat

SEQ ID NO: 4617693 - DNA, 14 bp, Homo sapiens
tcagtgactcctgc

SEQ ID NO: 4617694 - DNA, 16 bp, Homo sapiens
tcagtgactcctgctg

SEQ ID NO: 4617695 - DNA, 14 bp, Homo sapiens
tcagtgcaaaatgt

SEQ ID NO: 4617696 - DNA, 15 bp, Homo sapiens
tcagtgcaaaatgtc

SEQ ID NO: 4617697 - DNA, 17 bp, Homo sapiens
tcagtgcaaaatgtctt

SEQ ID NO: 4617698 - DNA, 18 bp, Homo sapiens
tcagtgcaaaatgtcttg

SEQ ID NO: 4617699 - DNA, 20 bp, Homo sapiens
tcagtgcaaaatgtcttgtg

SEQ ID NO: 4617700 - DNA, 17 bp, Homo sapiens
tcagtgcaacctctgct

SEQ ID NO: 4617701 - DNA, 14 bp, Homo sapiens
tcagtgcatttgtg

SEQ ID NO: 4617702 - DNA, 23 bp, Homo sapiens
tcagtgtaaatagttactccagt

SEQ ID NO: 4617703 - DNA, 17 bp, Homo sapiens
tcagtgtagacacaggt

SEQ ID NO: 4617704 - DNA, 23 bp, Homo sapiens
tcagtgttactgcctataatctt

SEQ ID NO: 4617705 - DNA, 22 bp, Homo sapiens
tcagttctctactccctcttgt

SEQ ID NO: 4617706 - DNA, 18 bp, Homo sapiens
tcagtttctgcctgggca

SEQ ID NO: 4617707 - DNA, 20 bp, Homo sapiens
tcataaaaatctagcacact

SEQ ID NO: 4617708 - DNA, 21 bp, Homo sapiens
tcataaagcattggagtttca

SEQ ID NO: 4617709 - DNA, 16 bp, Homo sapiens
tcataaatttacttta

SEQ ID NO: 4617710 - DNA, 21 bp, Homo sapiens
tcataaatttgaataagcaga

SEQ ID NO: 4617711 - DNA, 16 bp, Homo sapiens
tcataagatattcttt

SEQ ID NO: 4617712 - DNA, 21 bp, Homo sapiens
tcataagatattctttacaaa

SEQ ID NO: 4617713 - DNA, 16 bp, Homo sapiens
tcataagtaaacctag

SEQ ID NO: 4617714 - DNA, 13 bp, Homo sapiens
tcatacctacacc

SEQ ID NO: 4617715 - DNA, 13 bp, Homo sapiens
tcatactctgttg

SEQ ID NO: 4617716 - DNA, 15 bp, Homo sapiens
tcatactctgttgcc

SEQ ID NO: 4617717 - DNA, 20 bp, Homo sapiens
tcatactctgttgcctcctc

SEQ ID NO: 4617718 - DNA, 20 bp, Homo sapiens
tcatagaaacttcatggttt

SEQ ID NO: 4617719 - DNA, 18 bp, Homo sapiens
tcatagaggaaattcaaa

SEQ ID NO: 4617720 - DNA, 22 bp, Homo sapiens
tcatagttatgtgattttcctt

SEQ ID NO: 4617721 - DNA, 16 bp, Homo sapiens
tcatagttttctaaat

SEQ ID NO: 4617722 - DNA, 16 bp, Homo sapiens
tcatataaaagctatg

SEQ ID NO: 4617723 - DNA, 17 bp, Homo sapiens
tcatatcactaaataaa

SEQ ID NO: 4617724 - DNA, 21 bp, Homo sapiens
tcatatgaggacctttatatc

SEQ ID NO: 4617725 - DNA, 12 bp, Homo sapiens
tcatcagggcct

SEQ ID NO: 4617726 - DNA, 13 bp, Homo sapiens
tcatcagggcctg

SEQ ID NO: 4617727 - DNA, 21 bp, Homo sapiens
tcatcagggcctggggcctga

SEQ ID NO: 4617728 - DNA, 20 bp, Homo sapiens
tcatcagtaagcagcctttg

SEQ ID NO: 4617729 - DNA, 19 bp, Homo sapiens
tcatcatagtaaaagaaat

SEQ ID NO: 4617730 - DNA, 11 bp, Homo sapiens
tcatcatcagg

SEQ ID NO: 4617731 - DNA, 15 bp, Homo sapiens
tcatcatcagggcct

SEQ ID NO: 4617732 - DNA, 16 bp, Homo sapiens
tcatcatcagggcctg

SEQ ID NO: 4617733 - DNA, 17 bp, Homo sapiens
tcatcccccctgctgcc

SEQ ID NO: 4617734 - DNA, 19 bp, Homo sapiens
tcatcccccctgctgccca

SEQ ID NO: 4617735 - DNA, 14 bp, Homo sapiens
tcatccttctttcc

SEQ ID NO: 4617736 - DNA, 18 bp, Homo sapiens
tcatccttgcccaggtga

SEQ ID NO: 4617737 - DNA, 17 bp, Homo sapiens
tcatccttttggataag

SEQ ID NO: 4617738 - DNA, 17 bp, Homo sapiens
tcatctatgaggaaagg

SEQ ID NO: 4617739 - DNA, 12 bp, Homo sapiens
tcatctgcaaaa

SEQ ID NO: 4617740 - DNA, 13 bp, Homo sapiens
tcatctgcaaaag

SEQ ID NO: 4617741 - DNA, 13 bp, Homo sapiens
tcatctgggaaag

SEQ ID NO: 4617742 - DNA, 19 bp, Homo sapiens
tcatgaattcatactctgt

SEQ ID NO: 4617743 - DNA, 22 bp, Homo sapiens
tcatgaattcatactctgttgc

SEQ ID NO: 4617744 - DNA, 18 bp, Homo sapiens
tcatgcaaaagttctcat

SEQ ID NO: 4617745 - DNA, 16 bp, Homo sapiens
tcatgcctctgaggcc

SEQ ID NO: 4617746 - DNA, 21 bp, Homo sapiens
tcatgcctctgaggccagcct

SEQ ID NO: 4617747 - DNA, 16 bp, Homo sapiens
tcatgctgtgcatttt

SEQ ID NO: 4617748 - DNA, 15 bp, Homo sapiens
tcatggagtagcctg

SEQ ID NO: 4617749 - DNA, 17 bp, Homo sapiens
tcatggagtagcctgga

SEQ ID NO: 4617750 - DNA, 22 bp, Homo sapiens
tcatggcagatgtaggagggac

SEQ ID NO: 4617751 - DNA, 19 bp, Homo sapiens
tcatggccttgaaacagtt

SEQ ID NO: 4617752 - DNA, 23 bp, Homo sapiens
tcatggccttgaaacagttccat

SEQ ID NO: 4617753 - DNA, 18 bp, Homo sapiens
tcatggctgtgtccactg

SEQ ID NO: 4617754 - DNA, 18 bp, Homo sapiens
tcatggtttgcatttaaa

SEQ ID NO: 4617755 - DNA, 19 bp, Homo sapiens
tcatgtaaagaaatgtctt

SEQ ID NO: 4617756 - DNA, 15 bp, Homo sapiens
tcatgtaatcctcaa

SEQ ID NO: 4617757 - DNA, 13 bp, Homo sapiens
tcatgtacttttt

SEQ ID NO: 4617758 - DNA, 13 bp, Homo sapiens
tcatgtctgtatc

SEQ ID NO: 4617759 - DNA, 14 bp, Homo sapiens
tcatgtctgtatcc

SEQ ID NO: 4617760 - DNA, 18 bp, Homo sapiens
tcatgtctgtatccccag

SEQ ID NO: 4617761 - DNA, 20 bp, Homo sapiens
tcatgtctgtatccccagtg

SEQ ID NO: 4617762 - DNA, 17 bp, Homo sapiens
tcatgttggccaggctg

SEQ ID NO: 4617763 - DNA, 22 bp, Homo sapiens
tcattaatgacacttgtcccca

SEQ ID NO: 4617764 - DNA, 14 bp, Homo sapiens
tcattactgggcct

SEQ ID NO: 4617765 - DNA, 17 bp, Homo sapiens
tcattactgtgaggagt

SEQ ID NO: 4617766 - DNA, 17 bp, Homo sapiens
tcattactgttccagat

SEQ ID NO: 4617767 - DNA, 19 bp, Homo sapiens
tcattactgttccagattc

SEQ ID NO: 4617768 - DNA, 15 bp, Homo sapiens
tcattacttgaatgt

SEQ ID NO: 4617769 - DNA, 18 bp, Homo sapiens
tcattatgcacttttaga

SEQ ID NO: 4617770 - DNA, 13 bp, Homo sapiens
tcattatgttcat

SEQ ID NO: 4617771 - DNA, 13 bp, Homo sapiens
tcattcagaaaaa

SEQ ID NO: 4617772 - DNA, 14 bp, Homo sapiens
tcattcagaaaaaa

SEQ ID NO: 4617773 - DNA, 19 bp, Homo sapiens
tcattcagcagcaaatttt

SEQ ID NO: 4617774 - DNA, 18 bp, Homo sapiens
tcattctatgaacagtga

SEQ ID NO: 4617775 - DNA, 18 bp, Homo sapiens
tcattctcagagtaaaat

SEQ ID NO: 4617776 - DNA, 21 bp, Homo sapiens
tcattctcataattcctacag

SEQ ID NO: 4617777 - DNA, 23 bp, Homo sapiens
tcattctcctcctcctccctcct

SEQ ID NO: 4617778 - DNA, 19 bp, Homo sapiens
tcattcttttgccacatcc

SEQ ID NO: 4617779 - DNA, 12 bp, Homo sapiens
tcattgatttta

SEQ ID NO: 4617780 - DNA, 20 bp, Homo sapiens
tcattgattttataattggt

SEQ ID NO: 4617781 - DNA, 21 bp, Homo sapiens
tcattgccatcaccatttggt

SEQ ID NO: 4617782 - DNA, 16 bp, Homo sapiens
tcattgtacaagtatt

SEQ ID NO: 4617783 - DNA, 21 bp, Homo sapiens
tcattgtacaagtattacaac

SEQ ID NO: 4617784 - DNA, 14 bp, Homo sapiens
tcattgtattcaga

SEQ ID NO: 4617785 - DNA, 16 bp, Homo sapiens
tcatttaactttataa

SEQ ID NO: 4617786 - DNA, 21 bp, Homo sapiens
tcatttaactttataacttaa

SEQ ID NO: 4617787 - DNA, 17 bp, Homo sapiens
tcatttataatactgtt

SEQ ID NO: 4617788 - DNA, 18 bp, Homo sapiens
tcatttataatactgttt

SEQ ID NO: 4617789 - DNA, 15 bp, Homo sapiens
tcatttcacacagtg

SEQ ID NO: 4617790 - DNA, 14 bp, Homo sapiens
tcatttcattccat

SEQ ID NO: 4617791 - DNA, 15 bp, Homo sapiens
tcatttcattccatt

SEQ ID NO: 4617792 - DNA, 16 bp, Homo sapiens
tcatttcattccattg

SEQ ID NO: 4617793 - DNA, 13 bp, Homo sapiens
tcatttccagctt

SEQ ID NO: 4617794 - DNA, 17 bp, Homo sapiens
tcattttaaaaacttta

SEQ ID NO: 4617795 - DNA, 23 bp, Homo sapiens
tcattttaacatgatttcaaaat

SEQ ID NO: 4617796 - DNA, 20 bp, Homo sapiens
tcattttagtgtatctttaa

SEQ ID NO: 4617797 - DNA, 22 bp, Homo sapiens
tcattttatgaatatcattgat

SEQ ID NO: 4617798 - DNA, 14 bp, Homo sapiens
tcattttccaatac

SEQ ID NO: 4617799 - DNA, 18 bp, Homo sapiens
tcattttgagtattttta

SEQ ID NO: 4617800 - DNA, 13 bp, Homo sapiens
tcatttttatagc

SEQ ID NO: 4617801 - DNA, 14 bp, Homo sapiens
tcatttttatagca

SEQ ID NO: 4617802 - DNA, 16 bp, Homo sapiens
tcatttttatagcaac

SEQ ID NO: 4617803 - DNA, 21 bp, Homo sapiens
tcatttttatagcaacaacaa

SEQ ID NO: 4617804 - DNA, 12 bp, Homo sapiens
tcatttttgtag

SEQ ID NO: 4617805 - DNA, 13 bp, Homo sapiens
tccaaaccttcac

SEQ ID NO: 4617806 - DNA, 23 bp, Homo sapiens
tccaaaccttcacacacagactg

SEQ ID NO: 4617807 - DNA, 18 bp, Homo sapiens
tccaaatccaaggaaaca

SEQ ID NO: 4617808 - DNA, 11 bp, Homo sapiens
tccaagaaaat

SEQ ID NO: 4617809 - DNA, 14 bp, Homo sapiens
tccaagcatttcat

SEQ ID NO: 4617810 - DNA, 21 bp, Homo sapiens
tccaagcatttcatgaaaaag

SEQ ID NO: 4617811 - DNA, 16 bp, Homo sapiens
tccaagccctcagctg

SEQ ID NO: 4617812 - DNA, 12 bp, Homo sapiens
tccaagctggga

SEQ ID NO: 4617813 - DNA, 14 bp, Homo sapiens
tccaaggaaacatg

SEQ ID NO: 4617814 - DNA, 14 bp, Homo sapiens
tccaagtcctttat

SEQ ID NO: 4617815 - DNA, 17 bp, Homo sapiens
tccaatagaaagaaact

SEQ ID NO: 4617816 - DNA, 16 bp, Homo sapiens
tccaatgccacagaca

SEQ ID NO: 4617817 - DNA, 22 bp, Homo sapiens
tccaatttgtaaaaacagcatt

SEQ ID NO: 4617818 - DNA, 16 bp, Homo sapiens
tccacaaatcttcagt

SEQ ID NO: 4617819 - DNA, 16 bp, Homo sapiens
tccacactgcagggag

SEQ ID NO: 4617820 - DNA, 13 bp, Homo sapiens
tccacagattttt

SEQ ID NO: 4617821 - DNA, 20 bp, Homo sapiens
tccacagatttttttgtaag

SEQ ID NO: 4617822 - DNA, 14 bp, Homo sapiens
tccacatcagatgc

SEQ ID NO: 4617823 - DNA, 13 bp, Homo sapiens
tccaccactgtgc

SEQ ID NO: 4617824 - DNA, 13 bp, Homo sapiens
tccaccagggcca

SEQ ID NO: 4617825 - DNA, 19 bp, Homo sapiens
tccaccagggccagagcag

SEQ ID NO: 4617826 - DNA, 20 bp, Homo sapiens
tccaccagggccagagcagc

SEQ ID NO: 4617827 - DNA, 14 bp, Homo sapiens
tccaccctccacct

SEQ ID NO: 4617828 - DNA, 22 bp, Homo sapiens
tccaccctcccagacctgcctc

SEQ ID NO: 4617829 - DNA, 22 bp, Homo sapiens
tccaccctggccgagtccaagc

SEQ ID NO: 4617830 - DNA, 12 bp, Homo sapiens
tccacctcaccc

SEQ ID NO: 4617831 - DNA, 16 bp, Homo sapiens
tccacctcaccccact

SEQ ID NO: 4617832 - DNA, 17 bp, Homo sapiens
tccacctccagcctctg

SEQ ID NO: 4617833 - DNA, 23 bp, Homo sapiens
tccacctccagcctctggtccta

SEQ ID NO: 4617834 - DNA, 13 bp, Homo sapiens
tccacctgtgggt

SEQ ID NO: 4617835 - DNA, 22 bp, Homo sapiens
tccacggatgcgtgggcagagg

SEQ ID NO: 4617836 - DNA, 23 bp, Homo sapiens
tccacggatgcgtgggcagagga

SEQ ID NO: 4617837 - DNA, 17 bp, Homo sapiens
tccactaaaaatattgt

SEQ ID NO: 4617838 - DNA, 13 bp, Homo sapiens
tccactattttca

SEQ ID NO: 4617839 - DNA, 22 bp, Homo sapiens
tccactcagctgtcctgcagca

SEQ ID NO: 4617840 - DNA, 16 bp, Homo sapiens
tccacttcatttttaa

SEQ ID NO: 4617841 - DNA, 24 bp, Homo sapiens
tccagaagacgtggtctagaccag

SEQ ID NO: 4617842 - DNA, 16 bp, Homo sapiens
tccagagacaacaggt

SEQ ID NO: 4617843 - DNA, 22 bp, Homo sapiens
tccagagttctgtgacacatgc

SEQ ID NO: 4617844 - DNA, 18 bp, Homo sapiens
tccagatgcagggcagtc

SEQ ID NO: 4617845 - DNA, 19 bp, Homo sapiens
tccagattcctatgatgga

SEQ ID NO: 4617846 - DNA, 17 bp, Homo sapiens
tccagccacagaaaaga

SEQ ID NO: 4617847 - DNA, 12 bp, Homo sapiens
tccagcccctgt

SEQ ID NO: 4617848 - DNA, 13 bp, Homo sapiens
tccagcccctgtc

SEQ ID NO: 4617849 - DNA, 14 bp, Homo sapiens
tccagcccctgtcc

SEQ ID NO: 4617850 - DNA, 16 bp, Homo sapiens
tccagcccctgtccca

SEQ ID NO: 4617851 - DNA, 21 bp, Homo sapiens
tccagcctgggggacagagca

SEQ ID NO: 4617852 - DNA, 17 bp, Homo sapiens
tccagcgtggtgtgaga

SEQ ID NO: 4617853 - DNA, 15 bp, Homo sapiens
tccagctagtgaccc

SEQ ID NO: 4617854 - DNA, 20 bp, Homo sapiens
tccagctagtgacccacatg

SEQ ID NO: 4617855 - DNA, 12 bp, Homo sapiens
tccaggagaagg

SEQ ID NO: 4617856 - DNA, 23 bp, Homo sapiens
tccaggattttaatttcaggaaa

SEQ ID NO: 4617857 - DNA, 22 bp, Homo sapiens
tccaggcaatggcctaaacttc

SEQ ID NO: 4617858 - DNA, 21 bp, Homo sapiens
tccaggcaccaggactagggc

SEQ ID NO: 4617859 - DNA, 20 bp, Homo sapiens
tccaggcctgcagcaggagt

SEQ ID NO: 4617860 - DNA, 13 bp, Homo sapiens
tccaggggcctgc

SEQ ID NO: 4617861 - DNA, 18 bp, Homo sapiens
tccaggggcctgcagaag

SEQ ID NO: 4617862 - DNA, 21 bp, Homo sapiens
tccaggtcctggtggggcagc

SEQ ID NO: 4617863 - DNA, 22 bp, Homo sapiens
tccaggtcctggtggggcagct

SEQ ID NO: 4617864 - DNA, 23 bp, Homo sapiens
tccagtgaatagatgtgcccttt

SEQ ID NO: 4617865 - DNA, 20 bp, Homo sapiens
tccagttcatcgattttcta

SEQ ID NO: 4617866 - DNA, 13 bp, Homo sapiens
tccagttcccact

SEQ ID NO: 4617867 - DNA, 15 bp, Homo sapiens
tccagttcctttaga

SEQ ID NO: 4617868 - DNA, 16 bp, Homo sapiens
tccataaagtacaaat

SEQ ID NO: 4617869 - DNA, 18 bp, Homo sapiens
tccataaagtacaaatga

SEQ ID NO: 4617870 - DNA, 20 bp, Homo sapiens
tccataaagtacaaatgaag

SEQ ID NO: 4617871 - DNA, 14 bp, Homo sapiens
tccataaccccacc

SEQ ID NO: 4617872 - DNA, 18 bp, Homo sapiens
tccatactgtagacactc

SEQ ID NO: 4617873 - DNA, 22 bp, Homo sapiens
tccatagcctaatccctgggca

SEQ ID NO: 4617874 - DNA, 21 bp, Homo sapiens
tccataggtttctctccctcc

SEQ ID NO: 4617875 - DNA, 19 bp, Homo sapiens
tccatatttgatttctaat

SEQ ID NO: 4617876 - DNA, 17 bp, Homo sapiens
tccatcaactaaaacat

SEQ ID NO: 4617877 - DNA, 14 bp, Homo sapiens
tccatccatctctc

SEQ ID NO: 4617878 - DNA, 21 bp, Homo sapiens
ggattgctggggccaggcccc

SEQ ID NO: 4617879 - DNA, 12 bp, Homo sapiens
ggcaaataaaag

SEQ ID NO: 4617880 - DNA, 13 bp, Homo sapiens
ggcaacagggagc

SEQ ID NO: 4617881 - DNA, 16 bp, Homo sapiens
ggcaacattggacaga

SEQ ID NO: 4617882 - DNA, 23 bp, Homo sapiens
ggcaacattggacagaaaatgca

SEQ ID NO: 4617883 - DNA, 16 bp, Homo sapiens
ggcaacgcacaaaaca

SEQ ID NO: 4617884 - DNA, 12 bp, Homo sapiens
ggcaagccctgc

SEQ ID NO: 4617885 - DNA, 18 bp, Homo sapiens
ggcaagccctgcccacag

SEQ ID NO: 4617886 - DNA, 20 bp, Homo sapiens
ggcaatgggagctgaggcca

SEQ ID NO: 4617887 - DNA, 19 bp, Homo sapiens
ggcacaattcctgtgctca

SEQ ID NO: 4617888 - DNA, 16 bp, Homo sapiens
ggcacaggagctacct

SEQ ID NO: 4617889 - DNA, 19 bp, Homo sapiens
ggcacaggagctacctgtg

SEQ ID NO: 4617890 - DNA, 16 bp, Homo sapiens
ggcacagtgggagctg

SEQ ID NO: 4617891 - DNA, 23 bp, Homo sapiens
ggcacccccacaagctgtccctg

SEQ ID NO: 4617892 - DNA, 24 bp, Homo sapiens
ggcacccccacaagctgtccctgc

SEQ ID NO: 4617893 - DNA, 13 bp, Homo sapiens
ggcaccccctgca

SEQ ID NO: 4617894 - DNA, 16 bp, Homo sapiens
ggcaccccctgcagct

SEQ ID NO: 4617895 - DNA, 16 bp, Homo sapiens
ggcacccgtccccaca

SEQ ID NO: 4617896 - DNA, 20 bp, Homo sapiens
ggcaccgccacgtcccagca

SEQ ID NO: 4617897 - DNA, 17 bp, Homo sapiens
ggcacctgggccctggg

SEQ ID NO: 4617898 - DNA, 23 bp, Homo sapiens
ggcacctgggccctggggcctgt

SEQ ID NO: 4617899 - DNA, 23 bp, Homo sapiens
ggcactccgcgccgatgccaccg

SEQ ID NO: 4617900 - DNA, 13 bp, Homo sapiens
ggcactggcccag

SEQ ID NO: 4617901 - DNA, 12 bp, Homo sapiens
ggcactgggctg

SEQ ID NO: 4617902 - DNA, 13 bp, Homo sapiens
ggcactgggctgt

SEQ ID NO: 4617903 - DNA, 22 bp, Homo sapiens
ggcactgggctgttgttccatt

SEQ ID NO: 4617904 - DNA, 16 bp, Homo sapiens
ggcacttaatttgtaa

SEQ ID NO: 4617905 - DNA, 19 bp, Homo sapiens
ggcacttccacctccagcc

SEQ ID NO: 4617906 - DNA, 22 bp, Homo sapiens
ggcacttccacctccagcctct

SEQ ID NO: 4617907 - DNA, 17 bp, Homo sapiens
ggcagaaatagttgtct

SEQ ID NO: 4617908 - DNA, 18 bp, Homo sapiens
ggcagaagcttggaggag

SEQ ID NO: 4617909 - DNA, 19 bp, Homo sapiens
ggcagaagcttggaggagg

SEQ ID NO: 4617910 - DNA, 17 bp, Homo sapiens
ggcagacagcaggcagc

SEQ ID NO: 4617911 - DNA, 23 bp, Homo sapiens
ggcagacagcaggcagcgccaag

SEQ ID NO: 4617912 - DNA, 14 bp, Homo sapiens
ggcagactgtgaac

SEQ ID NO: 4617913 - DNA, 13 bp, Homo sapiens
ggcagagctctac

SEQ ID NO: 4617914 - DNA, 22 bp, Homo sapiens
ggcagagctctacaggcctgca

SEQ ID NO: 4617915 - DNA, 22 bp, Homo sapiens
ggcagattttggttggttttta

SEQ ID NO: 4617916 - DNA, 12 bp, Homo sapiens
ggcagcaaggcc

SEQ ID NO: 4617917 - DNA, 13 bp, Homo sapiens
ggcagcaaggccc

SEQ ID NO: 4617918 - DNA, 16 bp, Homo sapiens
ggcagcaaggcccgag

SEQ ID NO: 4617919 - DNA, 18 bp, Homo sapiens
ggcagcaaggcccgagca

SEQ ID NO: 4617920 - DNA, 21 bp, Homo sapiens
ggcagcaaggcccgagcagct

SEQ ID NO: 4617921 - DNA, 22 bp, Homo sapiens
ggcagcaaggcccgagcagctg

SEQ ID NO: 4617922 - DNA, 17 bp, Homo sapiens
ggcagcagccagccctg

SEQ ID NO: 4617923 - DNA, 18 bp, Homo sapiens
ggcagcagccagccctgc

SEQ ID NO: 4617924 - DNA, 20 bp, Homo sapiens
ggcagcagccagccctgcct

SEQ ID NO: 4617925 - DNA, 22 bp, Homo sapiens
ggcagcagccagccctgcctgg

SEQ ID NO: 4617926 - DNA, 23 bp, Homo sapiens
ggcagcagccagccctgcctgga

SEQ ID NO: 4617927 - DNA, 23 bp, Homo sapiens
ggcagcatgcttgggctgaccca

SEQ ID NO: 4617928 - DNA, 15 bp, Homo sapiens
ggcagcatggagaga

SEQ ID NO: 4617929 - DNA, 21 bp, Homo sapiens
ggcagccacacttctcaggac

SEQ ID NO: 4617930 - DNA, 20 bp, Homo sapiens
ggcagcctggacatagagag

SEQ ID NO: 4617931 - DNA, 20 bp, Homo sapiens
ggcagcgccaagtgcgtgcc

SEQ ID NO: 4617932 - DNA, 22 bp, Homo sapiens
ggcagcgccaggctgaccacag

SEQ ID NO: 4617933 - DNA, 16 bp, Homo sapiens
ggcaggaaagcatgca

SEQ ID NO: 4617934 - DNA, 23 bp, Homo sapiens
ggcaggaccaggtggcacttcca

SEQ ID NO: 4617935 - DNA, 17 bp, Homo sapiens
ggcaggagtagctgagc

SEQ ID NO: 4617936 - DNA, 18 bp, Homo sapiens
ggcaggagtagctgagct

SEQ ID NO: 4617937 - DNA, 13 bp, Homo sapiens
ggcaggcagggct

SEQ ID NO: 4617938 - DNA, 15 bp, Homo sapiens
ggcaggcagggctct

SEQ ID NO: 4617939 - DNA, 19 bp, Homo sapiens
ggcaggcagggctctcctg

SEQ ID NO: 4617940 - DNA, 15 bp, Homo sapiens
ggcaggccgggcctg

SEQ ID NO: 4617941 - DNA, 16 bp, Homo sapiens
ggcagggaaggacagg

SEQ ID NO: 4617942 - DNA, 22 bp, Homo sapiens
ggcagggagcggccggccagcc

SEQ ID NO: 4617943 - DNA, 12 bp, Homo sapiens
ggcagggcagca

SEQ ID NO: 4617944 - DNA, 20 bp, Homo sapiens
ggcagggcccacgtgtatag

SEQ ID NO: 4617945 - DNA, 16 bp, Homo sapiens
ggcagggctctcctgg

SEQ ID NO: 4617946 - DNA, 17 bp, Homo sapiens
ggcagggctctcctggc

SEQ ID NO: 4617947 - DNA, 18 bp, Homo sapiens
ggcagggctctcctggct

SEQ ID NO: 4617948 - DNA, 13 bp, Homo sapiens
ggcaggggagcag

SEQ ID NO: 4617949 - DNA, 23 bp, Homo sapiens
ggcaggggcgggcggagggaggg

SEQ ID NO: 4617950 - DNA, 15 bp, Homo sapiens
ggcaggtgggcagac

SEQ ID NO: 4617951 - DNA, 14 bp, Homo sapiens
ggcagtgcccatgt

SEQ ID NO: 4617952 - DNA, 19 bp, Homo sapiens
ggcagttcgcagccaccct

SEQ ID NO: 4617953 - DNA, 23 bp, Homo sapiens
ggcagttcgcagccaccctgagg

SEQ ID NO: 4617954 - DNA, 16 bp, Homo sapiens
ggcagtttgggaaggt

SEQ ID NO: 4617955 - DNA, 13 bp, Homo sapiens
ggcatagagtagg

SEQ ID NO: 4617956 - DNA, 20 bp, Homo sapiens
ggcatccacgtagggggcag

SEQ ID NO: 4617957 - DNA, 23 bp, Homo sapiens
ggcatgagtctgtttcccaagct

SEQ ID NO: 4617958 - DNA, 19 bp, Homo sapiens
ggcatggtcccttaaggca

SEQ ID NO: 4617959 - DNA, 19 bp, Homo sapiens
ggcattgaggaagagtctt

SEQ ID NO: 4617960 - DNA, 16 bp, Homo sapiens
ggcatttcctgggtgg

SEQ ID NO: 4617961 - DNA, 18 bp, Homo sapiens
ggcatttcctgggtggct

SEQ ID NO: 4617962 - DNA, 14 bp, Homo sapiens
ggccaaaatcaaga

SEQ ID NO: 4617963 - DNA, 22 bp, Homo sapiens
ggccaaacatggccagactccc

SEQ ID NO: 4617964 - DNA, 19 bp, Homo sapiens
ggccaaacccttgctttcc

SEQ ID NO: 4617965 - DNA, 12 bp, Homo sapiens
ggccaaacctct

SEQ ID NO: 4617966 - DNA, 16 bp, Homo sapiens
ggccaacagcaagtgt

SEQ ID NO: 4617967 - DNA, 13 bp, Homo sapiens
ggccaagcctatc

SEQ ID NO: 4617968 - DNA, 12 bp, Homo sapiens
ggccaaggtgcc

SEQ ID NO: 4617969 - DNA, 12 bp, Homo sapiens
ggccaagttctt

SEQ ID NO: 4617970 - DNA, 16 bp, Homo sapiens
ggccacactcagcaca

SEQ ID NO: 4617971 - DNA, 14 bp, Homo sapiens
ggccacagccttcc

SEQ ID NO: 4617972 - DNA, 20 bp, Homo sapiens
ggccacagccttccctctgc

SEQ ID NO: 4617973 - DNA, 16 bp, Homo sapiens
ggccacatcaaagagg

SEQ ID NO: 4617974 - DNA, 15 bp, Homo sapiens
ggccactccttcctg

SEQ ID NO: 4617975 - DNA, 20 bp, Homo sapiens
ggccactccttcctgcccca

SEQ ID NO: 4617976 - DNA, 13 bp, Homo sapiens
ggccactggggac

SEQ ID NO: 4617977 - DNA, 22 bp, Homo sapiens
ggccagacctgcagacgcccag

SEQ ID NO: 4617978 - DNA, 15 bp, Homo sapiens
ggccagagcagctcc

SEQ ID NO: 4617979 - DNA, 11 bp, Homo sapiens
ggccagcctgg

SEQ ID NO: 4617980 - DNA, 17 bp, Homo sapiens
ggccagcctggcctcct

SEQ ID NO: 4617981 - DNA, 18 bp, Homo sapiens
ggccagcctggcctcctg

SEQ ID NO: 4617982 - DNA, 21 bp, Homo sapiens
ggccagcctggcctcctgcct

SEQ ID NO: 4617983 - DNA, 15 bp, Homo sapiens
ggccaggagagtccg

SEQ ID NO: 4617984 - DNA, 14 bp, Homo sapiens
ggccaggccccatg

SEQ ID NO: 4617985 - DNA, 14 bp, Homo sapiens
ggccagggctgccc

SEQ ID NO: 4617986 - DNA, 19 bp, Homo sapiens
ggccagggctgccctgaga

SEQ ID NO: 4617987 - DNA, 13 bp, Homo sapiens
ggccagtgctcca

SEQ ID NO: 4617988 - DNA, 18 bp, Homo sapiens
ggccagtggggcctgtgg

SEQ ID NO: 4617989 - DNA, 19 bp, Homo sapiens
ggccagtggggcctgtgga

SEQ ID NO: 4617990 - DNA, 15 bp, Homo sapiens
ggccataattatgaa

SEQ ID NO: 4617991 - DNA, 17 bp, Homo sapiens
ggccataattatgaaaa

SEQ ID NO: 4617992 - DNA, 15 bp, Homo sapiens
ggccatctcaggaga

SEQ ID NO: 4617993 - DNA, 21 bp, Homo sapiens
ggccatctgactgccaagcca

SEQ ID NO: 4617994 - DNA, 13 bp, Homo sapiens
ggcccaagagccc

SEQ ID NO: 4617995 - DNA, 14 bp, Homo sapiens
ggcccaagagcccg

SEQ ID NO: 4617996 - DNA, 23 bp, Homo sapiens
ggcccacggtttcagctagacaa

SEQ ID NO: 4617997 - DNA, 18 bp, Homo sapiens
ggcccacgtgtatagtat

SEQ ID NO: 4617998 - DNA, 21 bp, Homo sapiens
ggcccatctctccctgcgcac

SEQ ID NO: 4617999 - DNA, 23 bp, Homo sapiens
ggccccacaaggcctggtctggg

SEQ ID NO: 4618000 - DNA, 15 bp, Homo sapiens
ggccccacccctgta

SEQ ID NO: 4618001 - DNA, 16 bp, Homo sapiens
ggccccacccctgtaa

SEQ ID NO: 4618002 - DNA, 12 bp, Homo sapiens
ggccccagaggc

SEQ ID NO: 4618003 - DNA, 13 bp, Homo sapiens
ggccccagaggcc

SEQ ID NO: 4618004 - DNA, 14 bp, Homo sapiens
ggccccagaggccc

SEQ ID NO: 4618005 - DNA, 16 bp, Homo sapiens
ggccccaggacctggc

SEQ ID NO: 4618006 - DNA, 20 bp, Homo sapiens
ggccccatcctcatccctga

SEQ ID NO: 4618007 - DNA, 14 bp, Homo sapiens
ggccccatgacctc

SEQ ID NO: 4618008 - DNA, 15 bp, Homo sapiens
ggcccccatctcatg

SEQ ID NO: 4618009 - DNA, 14 bp, Homo sapiens
ggccccgccagggc

SEQ ID NO: 4618010 - DNA, 21 bp, Homo sapiens
ggccccgccagggctggggac

SEQ ID NO: 4618011 - DNA, 23 bp, Homo sapiens
ggccccgccttttcccccaccct

SEQ ID NO: 4618012 - DNA, 13 bp, Homo sapiens
ggcccgcgcagct

SEQ ID NO: 4618013 - DNA, 23 bp, Homo sapiens
ggcccggagctgcccctctctgg

SEQ ID NO: 4618014 - DNA, 20 bp, Homo sapiens
ggccctcattaatgacactt

SEQ ID NO: 4618015 - DNA, 12 bp, Homo sapiens
ggccctcccagc

SEQ ID NO: 4618016 - DNA, 21 bp, Homo sapiens
ggccctcccagcccattgctg

SEQ ID NO: 4618017 - DNA, 20 bp, Homo sapiens
ggccctcctgtgctggggga

SEQ ID NO: 4618018 - DNA, 19 bp, Homo sapiens
ggccctctttccctgcgag

SEQ ID NO: 4618019 - DNA, 11 bp, Homo sapiens
ggccctgcacc

SEQ ID NO: 4618020 - DNA, 13 bp, Homo sapiens
ggccctgcatctg

SEQ ID NO: 4618021 - DNA, 22 bp, Homo sapiens
ggccctgcatctgtctgctctg

SEQ ID NO: 4618022 - DNA, 18 bp, Homo sapiens
ggccctggatcagcgtgg

SEQ ID NO: 4618023 - DNA, 22 bp, Homo sapiens
ggccctggcacccccacaagct

SEQ ID NO: 4618024 - DNA, 13 bp, Homo sapiens
ggccctggccttg

SEQ ID NO: 4618025 - DNA, 15 bp, Homo sapiens
ggccctggggcctgt

SEQ ID NO: 4618026 - DNA, 12 bp, Homo sapiens
ggccctgtctct

SEQ ID NO: 4618027 - DNA, 14 bp, Homo sapiens
ggccctgtctctgg

SEQ ID NO: 4618028 - DNA, 19 bp, Homo sapiens
ggccgatggggaaggagaa

SEQ ID NO: 4618029 - DNA, 17 bp, Homo sapiens
ggccgccacggcctggc

SEQ ID NO: 4618030 - DNA, 23 bp, Homo sapiens
ggccgcccccagccccctcctgg

SEQ ID NO: 4618031 - DNA, 18 bp, Homo sapiens
ggccggggaactggccaa

SEQ ID NO: 4618032 - DNA, 19 bp, Homo sapiens
ggccggggaactggccaag

SEQ ID NO: 4618033 - DNA, 21 bp, Homo sapiens
ggccggggaactggccaagct

SEQ ID NO: 4618034 - DNA, 15 bp, Homo sapiens
ggcctaatttacaag

SEQ ID NO: 4618035 - DNA, 13 bp, Homo sapiens
ggcctagactctg

SEQ ID NO: 4618036 - DNA, 17 bp, Homo sapiens
ggcctagtaaccaaggc

SEQ ID NO: 4618037 - DNA, 18 bp, Homo sapiens
ggcctagtaaccaaggcc

SEQ ID NO: 4618038 - DNA, 20 bp, Homo sapiens
ggcctagtaaccaaggccct

SEQ ID NO: 4618039 - DNA, 18 bp, Homo sapiens
ggcctatgacttgggcac

SEQ ID NO: 4618040 - DNA, 20 bp, Homo sapiens
ggcctatgcacatatggact

SEQ ID NO: 4618041 - DNA, 17 bp, Homo sapiens
ggcctatggagagccct

SEQ ID NO: 4618042 - DNA, 20 bp, Homo sapiens
ggcctcacccctcccctggg

SEQ ID NO: 4618043 - DNA, 11 bp, Homo sapiens
ggcctcagagc

SEQ ID NO: 4618044 - DNA, 17 bp, Homo sapiens
ggcctcagagcttcctg

SEQ ID NO: 4618045 - DNA, 13 bp, Homo sapiens
ggcctcaggctct

SEQ ID NO: 4618046 - DNA, 17 bp, Homo sapiens
ggcctcaggctctgcac

SEQ ID NO: 4618047 - DNA, 13 bp, Homo sapiens
ggcctccctgctg

SEQ ID NO: 4618048 - DNA, 16 bp, Homo sapiens
ggcctccctgctgtgc

SEQ ID NO: 4618049 - DNA, 19 bp, Homo sapiens
ggcctcgcaggaagaccca

SEQ ID NO: 4618050 - DNA, 16 bp, Homo sapiens
ggcctcgtgaggggca

SEQ ID NO: 4618051 - DNA, 16 bp, Homo sapiens
ggcctctgccccaaga

SEQ ID NO: 4618052 - DNA, 20 bp, Homo sapiens
ggcctctgccccaagagcag

SEQ ID NO: 4618053 - DNA, 23 bp, Homo sapiens
ggcctctttgtctaaaacaataa

SEQ ID NO: 4618054 - DNA, 15 bp, Homo sapiens
ggcctgaactgagga

SEQ ID NO: 4618055 - DNA, 17 bp, Homo sapiens
ggcctgaactgaggaga

SEQ ID NO: 4618056 - DNA, 22 bp, Homo sapiens
ggcctgagcccctttgcctgtc

SEQ ID NO: 4618057 - DNA, 13 bp, Homo sapiens
ggcctgctgctga

SEQ ID NO: 4618058 - DNA, 18 bp, Homo sapiens
ggcctgctgctgagaacc

SEQ ID NO: 4618059 - DNA, 12 bp, Homo sapiens
ggcctggccctg

SEQ ID NO: 4618060 - DNA, 12 bp, Homo sapiens
ggcctggctggc

SEQ ID NO: 4618061 - DNA, 14 bp, Homo sapiens
ggcctggctggctg

SEQ ID NO: 4618062 - DNA, 17 bp, Homo sapiens
ggcctggctggctgagg

SEQ ID NO: 4618063 - DNA, 19 bp, Homo sapiens
ggcctggctggctgagggc

SEQ ID NO: 4618064 - DNA, 14 bp, Homo sapiens
ggcctggggcctga

SEQ ID NO: 4618065 - DNA, 18 bp, Homo sapiens
ggcctggggcctgagaga

SEQ ID NO: 4618066 - DNA, 22 bp, Homo sapiens
ggcctgggggttttccaagccc

SEQ ID NO: 4618067 - DNA, 11 bp, Homo sapiens
ggcctggggtg

SEQ ID NO: 4618068 - DNA, 18 bp, Homo sapiens
ggcctgtactgcctgctt

SEQ ID NO: 4618069 - DNA, 19 bp, Homo sapiens
ggcctgtggaatgagtgtg

SEQ ID NO: 4618070 - DNA, 18 bp, Homo sapiens
ggcctgtgggtctctgaa

SEQ ID NO: 4618071 - DNA, 15 bp, Homo sapiens
ggcctgttgctatag

SEQ ID NO: 4618072 - DNA, 22 bp, Homo sapiens
ggccttagtgggccagggctgc

SEQ ID NO: 4618073 - DNA, 22 bp, Homo sapiens
ggccttctttctagagagggaa

SEQ ID NO: 4618074 - DNA, 19 bp, Homo sapiens
ggccttgggccctctggtt

SEQ ID NO: 4618075 - DNA, 18 bp, Homo sapiens
ggccttgttctgtcacca

SEQ ID NO: 4618076 - DNA, 23 bp, Homo sapiens
ggcctttgcaagatgcttggttg

SEQ ID NO: 4618077 - DNA, 12 bp, Homo sapiens
ggcgcactgtga

SEQ ID NO: 4618078 - DNA, 16 bp, Homo sapiens
ggcgccatctcggctc

SEQ ID NO: 4618079 - DNA, 17 bp, Homo sapiens
ggcgccatctcggctca

SEQ ID NO: 4618080 - DNA, 19 bp, Homo sapiens
ggcgccccaacccgtggag

SEQ ID NO: 4618081 - DNA, 16 bp, Homo sapiens
ggcggaggggatccag

SEQ ID NO: 4618082 - DNA, 12 bp, Homo sapiens
ggcgtctccctc

SEQ ID NO: 4618083 - DNA, 12 bp, Homo sapiens
ggcgtgatctcg

SEQ ID NO: 4618084 - DNA, 19 bp, Homo sapiens
ggctactctgtgccagagc

SEQ ID NO: 4618085 - DNA, 21 bp, Homo sapiens
ggctactctgtgccagagcct

SEQ ID NO: 4618086 - DNA, 15 bp, Homo sapiens
ggctagggaggacca

SEQ ID NO: 4618087 - DNA, 15 bp, Homo sapiens
ggctatcctgggacc

SEQ ID NO: 4618088 - DNA, 12 bp, Homo sapiens
ggctcaagtctg

SEQ ID NO: 4618089 - DNA, 23 bp, Homo sapiens
ggctcacagtacagcatgtgcct

SEQ ID NO: 4618090 - DNA, 16 bp, Homo sapiens
ggctcagcagggctgg

SEQ ID NO: 4618091 - DNA, 19 bp, Homo sapiens
ggctcagcagggctggtca

SEQ ID NO: 4618092 - DNA, 15 bp, Homo sapiens
ggctcagccagcact

SEQ ID NO: 4618093 - DNA, 18 bp, Homo sapiens
ggctcagggcctcaggca

SEQ ID NO: 4618094 - DNA, 18 bp, Homo sapiens
ggctcagtgcaacctctg

SEQ ID NO: 4618095 - DNA, 19 bp, Homo sapiens
ggctcagtgcaacctctgc

SEQ ID NO: 4618096 - DNA, 16 bp, Homo sapiens
ggctccagatgcaggg

SEQ ID NO: 4618097 - DNA, 18 bp, Homo sapiens
ggctccagatgcagggca

SEQ ID NO: 4618098 - DNA, 16 bp, Homo sapiens
ggctcccgtggcctgt

SEQ ID NO: 4618099 - DNA, 16 bp, Homo sapiens
ggctccctctctcctg

SEQ ID NO: 4618100 - DNA, 14 bp, Homo sapiens
ggctctaacgcctg

SEQ ID NO: 4618101 - DNA, 14 bp, Homo sapiens
ggagagagccagga

SEQ ID NO: 4618102 - DNA, 22 bp, Homo sapiens
ggagagagccaggatgcccaga

SEQ ID NO: 4618103 - DNA, 13 bp, Homo sapiens
ggagagccctggg

SEQ ID NO: 4618104 - DNA, 13 bp, Homo sapiens
ggagagctaggag

SEQ ID NO: 4618105 - DNA, 22 bp, Homo sapiens
ggagaggcagcatgcttgggct

SEQ ID NO: 4618106 - DNA, 14 bp, Homo sapiens
ggagaggcgagagg

SEQ ID NO: 4618107 - DNA, 16 bp, Homo sapiens
ggagagtacctgtgtg

SEQ ID NO: 4618108 - DNA, 21 bp, Homo sapiens
ggagagttgtgatggagggga

SEQ ID NO: 4618109 - DNA, 13 bp, Homo sapiens
ggagatgaccagg

SEQ ID NO: 4618110 - DNA, 18 bp, Homo sapiens
ggagatgaccagggatgc

SEQ ID NO: 4618111 - DNA, 14 bp, Homo sapiens
ggagcaaagcctgt

SEQ ID NO: 4618112 - DNA, 15 bp, Homo sapiens
ggagcaaagcctgtt

SEQ ID NO: 4618113 - DNA, 19 bp, Homo sapiens
ggagcaagctcttcccttg

SEQ ID NO: 4618114 - DNA, 12 bp, Homo sapiens
ggagcacctgtc

SEQ ID NO: 4618115 - DNA, 20 bp, Homo sapiens
ggagcaggttccccaagggc

SEQ ID NO: 4618116 - DNA, 17 bp, Homo sapiens
ggagccaggccccaccc

SEQ ID NO: 4618117 - DNA, 23 bp, Homo sapiens
ggagccaggccccaccccttccc

SEQ ID NO: 4618118 - DNA, 16 bp, Homo sapiens
ggagccccgccacagc

SEQ ID NO: 4618119 - DNA, 19 bp, Homo sapiens
ggagccccttctgctcagc

SEQ ID NO: 4618120 - DNA, 18 bp, Homo sapiens
ggagccggtaactgtcct

SEQ ID NO: 4618121 - DNA, 20 bp, Homo sapiens
ggagccggtaactgtcctgt

SEQ ID NO: 4618122 - DNA, 16 bp, Homo sapiens
ggagcctccctgcctc

SEQ ID NO: 4618123 - DNA, 14 bp, Homo sapiens
ggagcctgtgaacc

SEQ ID NO: 4618124 - DNA, 19 bp, Homo sapiens
ggagcctgtgaacccagga

SEQ ID NO: 4618125 - DNA, 22 bp, Homo sapiens
ggagcctgtgcgtcccagctga

SEQ ID NO: 4618126 - DNA, 21 bp, Homo sapiens
ggagcgtgggctcagcagggc

SEQ ID NO: 4618127 - DNA, 14 bp, Homo sapiens
ggagctacctgtgt

SEQ ID NO: 4618128 - DNA, 19 bp, Homo sapiens
ggagctacctgtgtggaca

SEQ ID NO: 4618129 - DNA, 22 bp, Homo sapiens
ggagctacctgtgtggacagga

SEQ ID NO: 4618130 - DNA, 22 bp, Homo sapiens
ggagctcaacggtctggcaggg

SEQ ID NO: 4618131 - DNA, 19 bp, Homo sapiens
ggagctgccacagagaagt

SEQ ID NO: 4618132 - DNA, 21 bp, Homo sapiens
ggagctgggacacttaacaga

SEQ ID NO: 4618133 - DNA, 14 bp, Homo sapiens
ggaggaagagccac

SEQ ID NO: 4618134 - DNA, 19 bp, Homo sapiens
ggaggaagagccacctgca

SEQ ID NO: 4618135 - DNA, 16 bp, Homo sapiens
ggaggaatgctggact

SEQ ID NO: 4618136 - DNA, 20 bp, Homo sapiens
ggaggaccagtcaggatgag

SEQ ID NO: 4618137 - DNA, 22 bp, Homo sapiens
ggaggaccagtcaggatgaggc

SEQ ID NO: 4618138 - DNA, 22 bp, Homo sapiens
ggaggacctgagcctgccgagc

SEQ ID NO: 4618139 - DNA, 13 bp, Homo sapiens
ggaggagagaaga

SEQ ID NO: 4618140 - DNA, 19 bp, Homo sapiens
ggaggagagagaccccgca

SEQ ID NO: 4618141 - DNA, 14 bp, Homo sapiens
ggaggagccaggcc

SEQ ID NO: 4618142 - DNA, 16 bp, Homo sapiens
ggaggagccaggcccc

SEQ ID NO: 4618143 - DNA, 17 bp, Homo sapiens
ggaggagccaggcccca

SEQ ID NO: 4618144 - DNA, 18 bp, Homo sapiens
ggaggagtcagatgaggc

SEQ ID NO: 4618145 - DNA, 22 bp, Homo sapiens
ggaggagtcagatgaggccctg

SEQ ID NO: 4618146 - DNA, 20 bp, Homo sapiens
ggaggatgtccctgggccag

SEQ ID NO: 4618147 - DNA, 11 bp, Homo sapiens
ggaggcagcat

SEQ ID NO: 4618148 - DNA, 14 bp, Homo sapiens
ggaggctgctcggg

SEQ ID NO: 4618149 - DNA, 13 bp, Homo sapiens
ggaggctttctgg

SEQ ID NO: 4618150 - DNA, 18 bp, Homo sapiens
ggaggctttctgggctct

SEQ ID NO: 4618151 - DNA, 21 bp, Homo sapiens
ggaggctttctgggctctgga

SEQ ID NO: 4618152 - DNA, 18 bp, Homo sapiens
ggagggaaggagcagtca

SEQ ID NO: 4618153 - DNA, 22 bp, Homo sapiens
ggagggacaaaggagcctgtga

SEQ ID NO: 4618154 - DNA, 15 bp, Homo sapiens
ggagggaggggaggg

SEQ ID NO: 4618155 - DNA, 15 bp, Homo sapiens
ggagggctctgaggc

SEQ ID NO: 4618156 - DNA, 14 bp, Homo sapiens
ggaggggaggggtg

SEQ ID NO: 4618157 - DNA, 18 bp, Homo sapiens
ggagggtttgggcagagc

SEQ ID NO: 4618158 - DNA, 14 bp, Homo sapiens
ggaggtcccagccc

SEQ ID NO: 4618159 - DNA, 20 bp, Homo sapiens
ggaggtccttaggcctctga

SEQ ID NO: 4618160 - DNA, 21 bp, Homo sapiens
ggaggtctccaggggcctgca

SEQ ID NO: 4618161 - DNA, 18 bp, Homo sapiens
ggaggtgcagtggagggg

SEQ ID NO: 4618162 - DNA, 21 bp, Homo sapiens
ggaggtgcctgaaagctggga

SEQ ID NO: 4618163 - DNA, 21 bp, Homo sapiens
ggaggtgggcaaagggaagta

SEQ ID NO: 4618164 - DNA, 15 bp, Homo sapiens
ggagtagcctggact

SEQ ID NO: 4618165 - DNA, 15 bp, Homo sapiens
ggagtagctgagctc

SEQ ID NO: 4618166 - DNA, 16 bp, Homo sapiens
ggagtagctgagctca

SEQ ID NO: 4618167 - DNA, 15 bp, Homo sapiens
ggagtatgctggagg

SEQ ID NO: 4618168 - DNA, 15 bp, Homo sapiens
ggagtcagatgaggc

SEQ ID NO: 4618169 - DNA, 12 bp, Homo sapiens
ggagtctctctt

SEQ ID NO: 4618170 - DNA, 21 bp, Homo sapiens
ggagtctgaggtcctgagcac

SEQ ID NO: 4618171 - DNA, 15 bp, Homo sapiens
ggagtgagaggcccc

SEQ ID NO: 4618172 - DNA, 22 bp, Homo sapiens
ggagtgctggctcacagtacag

SEQ ID NO: 4618173 - DNA, 14 bp, Homo sapiens
ggagtggggagagt

SEQ ID NO: 4618174 - DNA, 13 bp, Homo sapiens
ggagtggtgcaga

SEQ ID NO: 4618175 - DNA, 16 bp, Homo sapiens
ggagtggtgcagacag

SEQ ID NO: 4618176 - DNA, 19 bp, Homo sapiens
ggagtgtactcccagggct

SEQ ID NO: 4618177 - DNA, 18 bp, Homo sapiens
ggagttttgctctctgtc

SEQ ID NO: 4618178 - DNA, 16 bp, Homo sapiens
ggagtttttttataca

SEQ ID NO: 4618179 - DNA, 17 bp, Homo sapiens
ggataaaataatgctgc

SEQ ID NO: 4618180 - DNA, 14 bp, Homo sapiens
ggataaagccactt

SEQ ID NO: 4618181 - DNA, 20 bp, Homo sapiens
ggataactttacagaaatgg

SEQ ID NO: 4618182 - DNA, 19 bp, Homo sapiens
ggatagctaactgtaaatc

SEQ ID NO: 4618183 - DNA, 18 bp, Homo sapiens
ggataggaaaaatgagta

SEQ ID NO: 4618184 - DNA, 15 bp, Homo sapiens
ggatagtctgggtca

SEQ ID NO: 4618185 - DNA, 17 bp, Homo sapiens
ggatatttactgctctt

SEQ ID NO: 4618186 - DNA, 21 bp, Homo sapiens
ggatattttttggtgtgccct

SEQ ID NO: 4618187 - DNA, 16 bp, Homo sapiens
ggatcagattgcatgt

SEQ ID NO: 4618188 - DNA, 16 bp, Homo sapiens
ggatcagcgtggcctt

SEQ ID NO: 4618189 - DNA, 12 bp, Homo sapiens
ggatccagccac

SEQ ID NO: 4618190 - DNA, 23 bp, Homo sapiens
ggatccagccacttccccctctt

SEQ ID NO: 4618191 - DNA, 17 bp, Homo sapiens
ggatctcctgccagccc

SEQ ID NO: 4618192 - DNA, 18 bp, Homo sapiens
ggatctcctgccagccca

SEQ ID NO: 4618193 - DNA, 20 bp, Homo sapiens
ggatctcctgccagcccagc

SEQ ID NO: 4618194 - DNA, 20 bp, Homo sapiens
ggatcttgaatgtggtctca

SEQ ID NO: 4618195 - DNA, 21 bp, Homo sapiens
ggatcttgaatgtggtctcag

SEQ ID NO: 4618196 - DNA, 22 bp, Homo sapiens
ggatcttgaatgtggtctcagg

SEQ ID NO: 4618197 - DNA, 17 bp, Homo sapiens
ggatgagaaacagctca

SEQ ID NO: 4618198 - DNA, 21 bp, Homo sapiens
ggatgagaaacagctcagcca

SEQ ID NO: 4618199 - DNA, 14 bp, Homo sapiens
ggatgcccttcccc

SEQ ID NO: 4618200 - DNA, 21 bp, Homo sapiens
ggatgcggatcctgctggggc

SEQ ID NO: 4618201 - DNA, 16 bp, Homo sapiens
ggatgcggatggccgg

SEQ ID NO: 4618202 - DNA, 17 bp, Homo sapiens
ggatgcgtgggcagagg

SEQ ID NO: 4618203 - DNA, 12 bp, Homo sapiens
ggatgctgtgct

SEQ ID NO: 4618204 - DNA, 16 bp, Homo sapiens
ggatggagaaagaagt

SEQ ID NO: 4618205 - DNA, 12 bp, Homo sapiens
ggatggcagact

SEQ ID NO: 4618206 - DNA, 16 bp, Homo sapiens
ggatgttgctccatcc

SEQ ID NO: 4618207 - DNA, 19 bp, Homo sapiens
ggattacaggcgcctgcca

SEQ ID NO: 4618208 - DNA, 21 bp, Homo sapiens
ggattcaggaaaaggcctggg

SEQ ID NO: 4618209 - DNA, 21 bp, Homo sapiens
ggattcagtcataaagaggta

SEQ ID NO: 4618210 - DNA, 20 bp, Homo sapiens
ggattgaacttctttgaatt

SEQ ID NO: 4618211 - DNA, 13 bp, Homo sapiens
ggattgcagagtg

SEQ ID NO: 4618212 - DNA, 12 bp, Homo sapiens
ggaagagccacc

SEQ ID NO: 4618213 - DNA, 14 bp, Homo sapiens
ggaagaggagatgt

SEQ ID NO: 4618214 - DNA, 22 bp, Homo sapiens
ggaagcagaagacgggagggga

SEQ ID NO: 4618215 - DNA, 14 bp, Homo sapiens
ggaagccaaagagt

SEQ ID NO: 4618216 - DNA, 11 bp, Homo sapiens
ggaagccaggt

SEQ ID NO: 4618217 - DNA, 18 bp, Homo sapiens
ggaagccaggtacaggag

SEQ ID NO: 4618218 - DNA, 13 bp, Homo sapiens
ggaagcccccacc

SEQ ID NO: 4618219 - DNA, 22 bp, Homo sapiens
ggaagcccccaccgtgggcagg

SEQ ID NO: 4618220 - DNA, 15 bp, Homo sapiens
ggaagcccctgggcc

SEQ ID NO: 4618221 - DNA, 20 bp, Homo sapiens
ggaagccgtgctcgccccag

SEQ ID NO: 4618222 - DNA, 23 bp, Homo sapiens
ggaagctttatttatagaaatga

SEQ ID NO: 4618223 - DNA, 21 bp, Homo sapiens
ggaaggaggccaaccagcccg

SEQ ID NO: 4618224 - DNA, 12 bp, Homo sapiens
ggaaggagggca

SEQ ID NO: 4618225 - DNA, 14 bp, Homo sapiens
ggaaggagggcaca

SEQ ID NO: 4618226 - DNA, 14 bp, Homo sapiens
ggaaggcagacagc

SEQ ID NO: 4618227 - DNA, 17 bp, Homo sapiens
ggaaggcagacagcagg

SEQ ID NO: 4618228 - DNA, 15 bp, Homo sapiens
ggaaggcaggcaggg

SEQ ID NO: 4618229 - DNA, 19 bp, Homo sapiens
ggaaggcaggcagggctct

SEQ ID NO: 4618230 - DNA, 22 bp, Homo sapiens
ggaaggcaggcagggctctcct

SEQ ID NO: 4618231 - DNA, 13 bp, Homo sapiens
ggaaggcctccct

SEQ ID NO: 4618232 - DNA, 17 bp, Homo sapiens
ggaagggagtctctctt

SEQ ID NO: 4618233 - DNA, 13 bp, Homo sapiens
ggaaggggccacg

SEQ ID NO: 4618234 - DNA, 21 bp, Homo sapiens
ggaagtcgtccttactcctgt

SEQ ID NO: 4618235 - DNA, 22 bp, Homo sapiens
ggaagtcgtccttactcctgtg

SEQ ID NO: 4618236 - DNA, 13 bp, Homo sapiens
ggaatacatttta

SEQ ID NO: 4618237 - DNA, 16 bp, Homo sapiens
ggaatagaagcaaatt

SEQ ID NO: 4618238 - DNA, 22 bp, Homo sapiens
ggaatataagaaaagtaatgaa

SEQ ID NO: 4618239 - DNA, 15 bp, Homo sapiens
ggaatatttgaataa

SEQ ID NO: 4618240 - DNA, 23 bp, Homo sapiens
ggaatcctatatagaatgctgca

SEQ ID NO: 4618241 - DNA, 20 bp, Homo sapiens
ggaatcctgaaagggcactt

SEQ ID NO: 4618242 - DNA, 13 bp, Homo sapiens
ggaatggaggagc

SEQ ID NO: 4618243 - DNA, 22 bp, Homo sapiens
ggaatggaggagccaggcccca

SEQ ID NO: 4618244 - DNA, 13 bp, Homo sapiens
ggaatgtgggcta

SEQ ID NO: 4618245 - DNA, 16 bp, Homo sapiens
ggaattattgtagaca

SEQ ID NO: 4618246 - DNA, 13 bp, Homo sapiens
ggaattcatgcaa

SEQ ID NO: 4618247 - DNA, 15 bp, Homo sapiens
ggacaaaggagcctg

SEQ ID NO: 4618248 - DNA, 16 bp, Homo sapiens
ggacaaaggagcctgt

SEQ ID NO: 4618249 - DNA, 18 bp, Homo sapiens
ggacaaaggagcctgtga

SEQ ID NO: 4618250 - DNA, 18 bp, Homo sapiens
ggacaaccagaaggccct

SEQ ID NO: 4618251 - DNA, 11 bp, Homo sapiens
ggacacaggcc

SEQ ID NO: 4618252 - DNA, 12 bp, Homo sapiens
ggacacaggcct

SEQ ID NO: 4618253 - DNA, 14 bp, Homo sapiens
ggacacaggcctgt

SEQ ID NO: 4618254 - DNA, 17 bp, Homo sapiens
ggacacagttcctggga

SEQ ID NO: 4618255 - DNA, 19 bp, Homo sapiens
ggacacagttcctgggaac

SEQ ID NO: 4618256 - DNA, 19 bp, Homo sapiens
ggacactcgtcaccccagc

SEQ ID NO: 4618257 - DNA, 12 bp, Homo sapiens
ggacacttttat

SEQ ID NO: 4618258 - DNA, 23 bp, Homo sapiens
ggacagaaagaccctgatgcagg

SEQ ID NO: 4618259 - DNA, 12 bp, Homo sapiens
ggacagctgtgc

SEQ ID NO: 4618260 - DNA, 14 bp, Homo sapiens
ggacagctgtgcct

SEQ ID NO: 4618261 - DNA, 17 bp, Homo sapiens
ggacagctgtgcctcgc

SEQ ID NO: 4618262 - DNA, 19 bp, Homo sapiens
ggacaggctgaagagaggg

SEQ ID NO: 4618263 - DNA, 23 bp, Homo sapiens
ggacaggctggctccagatgcag

SEQ ID NO: 4618264 - DNA, 12 bp, Homo sapiens
ggacagtggcag

SEQ ID NO: 4618265 - DNA, 23 bp, Homo sapiens
ggacataaatcacagaaaattta

SEQ ID NO: 4618266 - DNA, 21 bp, Homo sapiens
ggacatgagatcagggcctgc

SEQ ID NO: 4618267 - DNA, 16 bp, Homo sapiens
ggacatgcggtagcca

SEQ ID NO: 4618268 - DNA, 17 bp, Homo sapiens
ggacattctaatgcata

SEQ ID NO: 4618269 - DNA, 18 bp, Homo sapiens
ggacattctaatgcatat

SEQ ID NO: 4618270 - DNA, 22 bp, Homo sapiens
ggacattctaatgcatatttat

SEQ ID NO: 4618271 - DNA, 22 bp, Homo sapiens
ggacattgttctttccggccaa

SEQ ID NO: 4618272 - DNA, 15 bp, Homo sapiens
ggacattttttcagt

SEQ ID NO: 4618273 - DNA, 17 bp, Homo sapiens
ggaccaccaatggattg

SEQ ID NO: 4618274 - DNA, 17 bp, Homo sapiens
ggaccagtcaggatgag

SEQ ID NO: 4618275 - DNA, 21 bp, Homo sapiens
ggaccagtcaggatgaggccc

SEQ ID NO: 4618276 - DNA, 22 bp, Homo sapiens
ggaccagtcaggatgaggcccc

SEQ ID NO: 4618277 - DNA, 23 bp, Homo sapiens
ggaccagtcaggatgaggccccg

SEQ ID NO: 4618278 - DNA, 14 bp, Homo sapiens
ggacccacctgcta

SEQ ID NO: 4618279 - DNA, 12 bp, Homo sapiens
ggacccagccct

SEQ ID NO: 4618280 - DNA, 12 bp, Homo sapiens
ggaccccagctg

SEQ ID NO: 4618281 - DNA, 19 bp, Homo sapiens
ggaccgctacaccactctg

SEQ ID NO: 4618282 - DNA, 15 bp, Homo sapiens
ggaccggcagagctc

SEQ ID NO: 4618283 - DNA, 16 bp, Homo sapiens
ggaccggtgctgcagg

SEQ ID NO: 4618284 - DNA, 17 bp, Homo sapiens
ggaccggtgctgcagga

SEQ ID NO: 4618285 - DNA, 17 bp, Homo sapiens
ggacctccccagcccag

SEQ ID NO: 4618286 - DNA, 18 bp, Homo sapiens
ggacctccccagcccagg

SEQ ID NO: 4618287 - DNA, 16 bp, Homo sapiens
ggacctcctcttcccc

SEQ ID NO: 4618288 - DNA, 23 bp, Homo sapiens
ggacctcctcttcccccttccaa

SEQ ID NO: 4618289 - DNA, 19 bp, Homo sapiens
ggacctgagcctgccgagc

SEQ ID NO: 4618290 - DNA, 23 bp, Homo sapiens
ggacctgagcctgccgagcaacc

SEQ ID NO: 4618291 - DNA, 20 bp, Homo sapiens
ggacctgggacaagcaggcc

SEQ ID NO: 4618292 - DNA, 18 bp, Homo sapiens
ggacgtggctcagccagc

SEQ ID NO: 4618293 - DNA, 19 bp, Homo sapiens
ggactaacactcagaagcc

SEQ ID NO: 4618294 - DNA, 17 bp, Homo sapiens
ggactcatccttgccca

SEQ ID NO: 4618295 - DNA, 23 bp, Homo sapiens
ggactcatccttgcccaggtgag

SEQ ID NO: 4618296 - DNA, 23 bp, Homo sapiens
ggactccacggatgcgtgggcag

SEQ ID NO: 4618297 - DNA, 15 bp, Homo sapiens
ggactctgcacatga

SEQ ID NO: 4618298 - DNA, 12 bp, Homo sapiens
ggactgccaaat

SEQ ID NO: 4618299 - DNA, 21 bp, Homo sapiens
ggactggaggcccctggagcc

SEQ ID NO: 4618300 - DNA, 14 bp, Homo sapiens
ggactggttatctt

SEQ ID NO: 4618301 - DNA, 18 bp, Homo sapiens
ggactggttatcttgtta

SEQ ID NO: 4618302 - DNA, 16 bp, Homo sapiens
ggactggttccttcct

SEQ ID NO: 4618303 - DNA, 14 bp, Homo sapiens
ggactgtcgctgct

SEQ ID NO: 4618304 - DNA, 17 bp, Homo sapiens
ggactgtggtgacttct

SEQ ID NO: 4618305 - DNA, 21 bp, Homo sapiens
ggactgtttcatagttttcta

SEQ ID NO: 4618306 - DNA, 16 bp, Homo sapiens
ggactttatttatttc

SEQ ID NO: 4618307 - DNA, 18 bp, Homo sapiens
ggactttcccacccagga

SEQ ID NO: 4618308 - DNA, 16 bp, Homo sapiens
ggagaaagagctgcct

SEQ ID NO: 4618309 - DNA, 15 bp, Homo sapiens
ggagaaatacccatg

SEQ ID NO: 4618310 - DNA, 15 bp, Homo sapiens
ggagaaattgacaga

SEQ ID NO: 4618311 - DNA, 22 bp, Homo sapiens
ggagaacagtggttgcctgggg

SEQ ID NO: 4618312 - DNA, 21 bp, Homo sapiens
ggagaaccagggctcttctca

SEQ ID NO: 4618313 - DNA, 14 bp, Homo sapiens
ggagaagcacagct

SEQ ID NO: 4618314 - DNA, 20 bp, Homo sapiens
ggagaaggacatgagatcag

SEQ ID NO: 4618315 - DNA, 12 bp, Homo sapiens
ggagaaggagtg

SEQ ID NO: 4618316 - DNA, 18 bp, Homo sapiens
ggagaaggctggagaagg

SEQ ID NO: 4618317 - DNA, 19 bp, Homo sapiens
ggagaagggggctctgccc

SEQ ID NO: 4618318 - DNA, 16 bp, Homo sapiens
ggagacaaggtgctaa

SEQ ID NO: 4618319 - DNA, 20 bp, Homo sapiens
ggagacaggatgaggtctcg

SEQ ID NO: 4618320 - DNA, 13 bp, Homo sapiens
ggagagaagctct

SEQ ID NO: 4618321 - DNA, 14 bp, Homo sapiens
ggagagaagctctt

SEQ ID NO: 4618322 - DNA, 13 bp, Homo sapiens
ggagagagccagg

SEQ ID NO: 4618323 - DNA, 17 bp, Homo sapiens
gcttactctctgcttcc

SEQ ID NO: 4618324 - DNA, 19 bp, Homo sapiens
gcttagagaggcttgaagg

SEQ ID NO: 4618325 - DNA, 14 bp, Homo sapiens
gcttagaggttctg

SEQ ID NO: 4618326 - DNA, 19 bp, Homo sapiens
gcttattgatgaggtttat

SEQ ID NO: 4618327 - DNA, 23 bp, Homo sapiens
gcttatttctatgacaaattcaa

SEQ ID NO: 4618328 - DNA, 15 bp, Homo sapiens
gcttcactcctgctg

SEQ ID NO: 4618329 - DNA, 20 bp, Homo sapiens
gcttcactcctgctgtaaat

SEQ ID NO: 4618330 - DNA, 18 bp, Homo sapiens
gcttcactctctccgtct

SEQ ID NO: 4618331 - DNA, 17 bp, Homo sapiens
gcttcagcccccaccag

SEQ ID NO: 4618332 - DNA, 22 bp, Homo sapiens
gcttcagcccccaccaggggaa

SEQ ID NO: 4618333 - DNA, 19 bp, Homo sapiens
gcttcagtcatcagccagc

SEQ ID NO: 4618334 - DNA, 14 bp, Homo sapiens
gcttcatgtgaaca

SEQ ID NO: 4618335 - DNA, 15 bp, Homo sapiens
gcttcatttcaatca

SEQ ID NO: 4618336 - DNA, 19 bp, Homo sapiens
gcttccacctcaccccact

SEQ ID NO: 4618337 - DNA, 23 bp, Homo sapiens
gcttccatcccaaccagtgccaa

SEQ ID NO: 4618338 - DNA, 13 bp, Homo sapiens
gcttcccatcccc

SEQ ID NO: 4618339 - DNA, 16 bp, Homo sapiens
gcttcccatccccagc

SEQ ID NO: 4618340 - DNA, 17 bp, Homo sapiens
gcttcccatccccagcg

SEQ ID NO: 4618341 - DNA, 18 bp, Homo sapiens
gcttctcagtttctgcct

SEQ ID NO: 4618342 - DNA, 21 bp, Homo sapiens
gcttctcagtttctgcctggg

SEQ ID NO: 4618343 - DNA, 23 bp, Homo sapiens
gcttctcagtttctgcctgggca

SEQ ID NO: 4618344 - DNA, 18 bp, Homo sapiens
gcttctctagctctctag

SEQ ID NO: 4618345 - DNA, 19 bp, Homo sapiens
gcttctctagctctctagg

SEQ ID NO: 4618346 - DNA, 19 bp, Homo sapiens
gcttctctcttttaaagta

SEQ ID NO: 4618347 - DNA, 17 bp, Homo sapiens
gcttctgttgtcacctt

SEQ ID NO: 4618348 - DNA, 19 bp, Homo sapiens
gcttctgttgtcaccttca

SEQ ID NO: 4618349 - DNA, 14 bp, Homo sapiens
gcttcttcgttcct

SEQ ID NO: 4618350 - DNA, 19 bp, Homo sapiens
gcttgaactaggctgagca

SEQ ID NO: 4618351 - DNA, 17 bp, Homo sapiens
gcttgaaggccagcagc

SEQ ID NO: 4618352 - DNA, 13 bp, Homo sapiens
gcttgagcccaga

SEQ ID NO: 4618353 - DNA, 14 bp, Homo sapiens
gcttgcctgtttct

SEQ ID NO: 4618354 - DNA, 15 bp, Homo sapiens
gcttgctcccaagcc

SEQ ID NO: 4618355 - DNA, 16 bp, Homo sapiens
gcttgctcccaagccc

SEQ ID NO: 4618356 - DNA, 19 bp, Homo sapiens
gcttgctcccaagcccctg

SEQ ID NO: 4618357 - DNA, 13 bp, Homo sapiens
gcttgctccctgt

SEQ ID NO: 4618358 - DNA, 12 bp, Homo sapiens
gcttggaagcca

SEQ ID NO: 4618359 - DNA, 22 bp, Homo sapiens
gcttggcttcctcttcttgttg

SEQ ID NO: 4618360 - DNA, 18 bp, Homo sapiens
gcttgggctgacccagca

SEQ ID NO: 4618361 - DNA, 22 bp, Homo sapiens
gcttggggggtgatgagggcag

SEQ ID NO: 4618362 - DNA, 22 bp, Homo sapiens
gcttgggtgaatttcaggggaa

SEQ ID NO: 4618363 - DNA, 20 bp, Homo sapiens
gcttggtcctagggtgggaa

SEQ ID NO: 4618364 - DNA, 18 bp, Homo sapiens
gcttgtaaatatggggat

SEQ ID NO: 4618365 - DNA, 14 bp, Homo sapiens
gcttgtactgggac

SEQ ID NO: 4618366 - DNA, 16 bp, Homo sapiens
gcttgtactgggacat

SEQ ID NO: 4618367 - DNA, 14 bp, Homo sapiens
gcttgtagccagcc

SEQ ID NO: 4618368 - DNA, 15 bp, Homo sapiens
gcttgtagccagccg

SEQ ID NO: 4618369 - DNA, 16 bp, Homo sapiens
gcttgtagccagccgg

SEQ ID NO: 4618370 - DNA, 15 bp, Homo sapiens
gcttgtttgcctgtc

SEQ ID NO: 4618371 - DNA, 23 bp, Homo sapiens
gctttacattttcagtaccaaag

SEQ ID NO: 4618372 - DNA, 14 bp, Homo sapiens
gctttcagggcctc

SEQ ID NO: 4618373 - DNA, 18 bp, Homo sapiens
gctttcagggcctccagc

SEQ ID NO: 4618374 - DNA, 23 bp, Homo sapiens
gctttcccgcccagcctcacttc

SEQ ID NO: 4618375 - DNA, 17 bp, Homo sapiens
gctttcctgctggtccg

SEQ ID NO: 4618376 - DNA, 14 bp, Homo sapiens
gctttcctggaagt

SEQ ID NO: 4618377 - DNA, 19 bp, Homo sapiens
gctttcctgggcctttgca

SEQ ID NO: 4618378 - DNA, 15 bp, Homo sapiens
gctttcctgtttcca

SEQ ID NO: 4618379 - DNA, 14 bp, Homo sapiens
gctttctgggctct

SEQ ID NO: 4618380 - DNA, 18 bp, Homo sapiens
gctttctgggctctggac

SEQ ID NO: 4618381 - DNA, 21 bp, Homo sapiens
gctttctgggctctggactcc

SEQ ID NO: 4618382 - DNA, 22 bp, Homo sapiens
gctttctgggctctggactcca

SEQ ID NO: 4618383 - DNA, 16 bp, Homo sapiens
gctttgaaagaagcaa

SEQ ID NO: 4618384 - DNA, 17 bp, Homo sapiens
gctttgaaagaagcaag

SEQ ID NO: 4618385 - DNA, 19 bp, Homo sapiens
gctttgaaagaagcaagac

SEQ ID NO: 4618386 - DNA, 13 bp, Homo sapiens
gctttgctccttc

SEQ ID NO: 4618387 - DNA, 20 bp, Homo sapiens
gctttggttatatttagctc

SEQ ID NO: 4618388 - DNA, 18 bp, Homo sapiens
gctttgtatgtttatgaa

SEQ ID NO: 4618389 - DNA, 12 bp, Homo sapiens
gctttgtgcctt

SEQ ID NO: 4618390 - DNA, 19 bp, Homo sapiens
gctttgtgcctttgggcac

SEQ ID NO: 4618391 - DNA, 14 bp, Homo sapiens
gcttttaatggatg

SEQ ID NO: 4618392 - DNA, 13 bp, Homo sapiens
gcttttctgccac

SEQ ID NO: 4618393 - DNA, 17 bp, Homo sapiens
gcttttctgccactcca

SEQ ID NO: 4618394 - DNA, 18 bp, Homo sapiens
gcttttgccactccttgt

SEQ ID NO: 4618395 - DNA, 15 bp, Homo sapiens
ggaaaaaatatttta

SEQ ID NO: 4618396 - DNA, 15 bp, Homo sapiens
ggaaaaatgtatcca

SEQ ID NO: 4618397 - DNA, 21 bp, Homo sapiens
ggaaaagagggagaagaaaga

SEQ ID NO: 4618398 - DNA, 16 bp, Homo sapiens
ggaaaatgcattgtat

SEQ ID NO: 4618399 - DNA, 20 bp, Homo sapiens
ggaaacttctgtaaggggca

SEQ ID NO: 4618400 - DNA, 21 bp, Homo sapiens
ggaaacttctgtaaggggcag

SEQ ID NO: 4618401 - DNA, 17 bp, Homo sapiens
ggaaagagagaccccag

SEQ ID NO: 4618402 - DNA, 14 bp, Homo sapiens
ggaaagcatgcatt

SEQ ID NO: 4618403 - DNA, 16 bp, Homo sapiens
ggaaagccctgtgctc

SEQ ID NO: 4618404 - DNA, 19 bp, Homo sapiens
ggaaaggagcctaggccag

SEQ ID NO: 4618405 - DNA, 14 bp, Homo sapiens
ggaaagggagatgt

SEQ ID NO: 4618406 - DNA, 18 bp, Homo sapiens
ggaaagggagatgtcagg

SEQ ID NO: 4618407 - DNA, 21 bp, Homo sapiens
ggaaaggggcaggccagagct

SEQ ID NO: 4618408 - DNA, 18 bp, Homo sapiens
ggaaataacagagagaat

SEQ ID NO: 4618409 - DNA, 19 bp, Homo sapiens
ggaaataacagagagaatg

SEQ ID NO: 4618410 - DNA, 16 bp, Homo sapiens
ggaaataatatcattt

SEQ ID NO: 4618411 - DNA, 14 bp, Homo sapiens
ggaaatagctaata

SEQ ID NO: 4618412 - DNA, 14 bp, Homo sapiens
ggaaatatgaatgc

SEQ ID NO: 4618413 - DNA, 11 bp, Homo sapiens
ggaaatcagaa

SEQ ID NO: 4618414 - DNA, 19 bp, Homo sapiens
ggaaatcttttacattttt

SEQ ID NO: 4618415 - DNA, 22 bp, Homo sapiens
ggaaatcttttacatttttcct

SEQ ID NO: 4618416 - DNA, 12 bp, Homo sapiens
ggaaatgtactt

SEQ ID NO: 4618417 - DNA, 20 bp, Homo sapiens
ggaaatgtattttgacactg

SEQ ID NO: 4618418 - DNA, 11 bp, Homo sapiens
ggaaattcagt

SEQ ID NO: 4618419 - DNA, 15 bp, Homo sapiens
ggaacaaacagggct

SEQ ID NO: 4618420 - DNA, 14 bp, Homo sapiens
ggaacacacttgga

SEQ ID NO: 4618421 - DNA, 14 bp, Homo sapiens
ggaacacggccaca

SEQ ID NO: 4618422 - DNA, 20 bp, Homo sapiens
ggaacagcccagcacaggta

SEQ ID NO: 4618423 - DNA, 22 bp, Homo sapiens
ggaactcctaaacctttgcccc

SEQ ID NO: 4618424 - DNA, 13 bp, Homo sapiens
ggaactctcctgg

SEQ ID NO: 4618425 - DNA, 12 bp, Homo sapiens
ggaactgaaggg

SEQ ID NO: 4618426 - DNA, 20 bp, Homo sapiens
ggaactgaagggggcggcct

SEQ ID NO: 4618427 - DNA, 20 bp, Homo sapiens
ggaactgattgctcccagga

SEQ ID NO: 4618428 - DNA, 14 bp, Homo sapiens
ggaactggccaagc

SEQ ID NO: 4618429 - DNA, 17 bp, Homo sapiens
ggaactggccaagctga

SEQ ID NO: 4618430 - DNA, 21 bp, Homo sapiens
ggaacttctagctcatttaac

SEQ ID NO: 4618431 - DNA, 20 bp, Homo sapiens
ggaagacccaacacatggga

SEQ ID NO: 4618432 - DNA, 16 bp, Homo sapiens
ggaagagacagcccag

SEQ ID NO: 4618433 - DNA, 17 bp, Homo sapiens
ggaagagacagcccagg

SEQ ID NO: 4618434 - DNA, 21 bp, Homo sapiens
gagcatcatgcctctgaggcc

SEQ ID NO: 4618435 - DNA, 22 bp, Homo sapiens
gagcatcatgcctctgaggcca

SEQ ID NO: 4618436 - DNA, 23 bp, Homo sapiens
gagcatcatgcctctgaggccag

SEQ ID NO: 4618437 - DNA, 12 bp, Homo sapiens
gagcatttgcac

SEQ ID NO: 4618438 - DNA, 22 bp, Homo sapiens
gagccaaagcttatgtgacatg

SEQ ID NO: 4618439 - DNA, 14 bp, Homo sapiens
gagccaaattttat

SEQ ID NO: 4618440 - DNA, 16 bp, Homo sapiens
gagccaaccttgctct

SEQ ID NO: 4618441 - DNA, 13 bp, Homo sapiens
gagccacaaaaga

SEQ ID NO: 4618442 - DNA, 18 bp, Homo sapiens
gagccacaagctgcactg

SEQ ID NO: 4618443 - DNA, 12 bp, Homo sapiens
gagccacctcac

SEQ ID NO: 4618444 - DNA, 12 bp, Homo sapiens
gagccacctgca

SEQ ID NO: 4618445 - DNA, 13 bp, Homo sapiens
gagccacctgcaa

SEQ ID NO: 4618446 - DNA, 14 bp, Homo sapiens
gagccacctgcaag

SEQ ID NO: 4618447 - DNA, 16 bp, Homo sapiens
gagccaggccccaccc

SEQ ID NO: 4618448 - DNA, 12 bp, Homo sapiens
gagcccaccctg

SEQ ID NO: 4618449 - DNA, 17 bp, Homo sapiens
gagcccagggaggccga

SEQ ID NO: 4618450 - DNA, 15 bp, Homo sapiens
gagcccattaatctt

SEQ ID NO: 4618451 - DNA, 18 bp, Homo sapiens
gagcccattaatcttgat

SEQ ID NO: 4618452 - DNA, 17 bp, Homo sapiens
gagcccccagccctggg

SEQ ID NO: 4618453 - DNA, 20 bp, Homo sapiens
gagcccccagccctgggaac

SEQ ID NO: 4618454 - DNA, 21 bp, Homo sapiens
gagcccctcctccagcccctg

SEQ ID NO: 4618455 - DNA, 17 bp, Homo sapiens
gagccccttctgctcag

SEQ ID NO: 4618456 - DNA, 20 bp, Homo sapiens
gagcccctttgcctgtcaag

SEQ ID NO: 4618457 - DNA, 18 bp, Homo sapiens
gagcccgtgccaccccca

SEQ ID NO: 4618458 - DNA, 14 bp, Homo sapiens
gagccgctggcaga

SEQ ID NO: 4618459 - DNA, 18 bp, Homo sapiens
gagccggtaactgtcctg

SEQ ID NO: 4618460 - DNA, 19 bp, Homo sapiens
gagccggtaactgtcctgt

SEQ ID NO: 4618461 - DNA, 22 bp, Homo sapiens
gagccggtaactgtcctgtcct

SEQ ID NO: 4618462 - DNA, 15 bp, Homo sapiens
gagcctaggccaggt

SEQ ID NO: 4618463 - DNA, 17 bp, Homo sapiens
gagcctaggccaggtgc

SEQ ID NO: 4618464 - DNA, 16 bp, Homo sapiens
gagcctcgctttttca

SEQ ID NO: 4618465 - DNA, 20 bp, Homo sapiens
gagcctcgctttttcatcct

SEQ ID NO: 4618466 - DNA, 21 bp, Homo sapiens
gagcctcgctttttcatcctt

SEQ ID NO: 4618467 - DNA, 14 bp, Homo sapiens
gagcctgccgagca

SEQ ID NO: 4618468 - DNA, 15 bp, Homo sapiens
gagcctgccgagcaa

SEQ ID NO: 4618469 - DNA, 21 bp, Homo sapiens
gagcctgtgaacccaggacaa

SEQ ID NO: 4618470 - DNA, 12 bp, Homo sapiens
gagcgccctgca

SEQ ID NO: 4618471 - DNA, 15 bp, Homo sapiens
gagcgggtgcaagca

SEQ ID NO: 4618472 - DNA, 21 bp, Homo sapiens
gagcgtgggctcagcagggct

SEQ ID NO: 4618473 - DNA, 15 bp, Homo sapiens
gagctaagggtgggt

SEQ ID NO: 4618474 - DNA, 14 bp, Homo sapiens
gagctacctgtgtg

SEQ ID NO: 4618475 - DNA, 17 bp, Homo sapiens
gagctcaacggtctggc

SEQ ID NO: 4618476 - DNA, 22 bp, Homo sapiens
gagctcaacggtctggcagggc

SEQ ID NO: 4618477 - DNA, 20 bp, Homo sapiens
gagctcacaaggcagcaagg

SEQ ID NO: 4618478 - DNA, 23 bp, Homo sapiens
gagctcacaaggcagcaaggccc

SEQ ID NO: 4618479 - DNA, 18 bp, Homo sapiens
gagctcatcccccctgct

SEQ ID NO: 4618480 - DNA, 23 bp, Homo sapiens
gagctcatcccccctgctgccca

SEQ ID NO: 4618481 - DNA, 17 bp, Homo sapiens
gagctcctgatcagagg

SEQ ID NO: 4618482 - DNA, 13 bp, Homo sapiens
gagctctacaggc

SEQ ID NO: 4618483 - DNA, 20 bp, Homo sapiens
gagctctacaggcctgcagc

SEQ ID NO: 4618484 - DNA, 11 bp, Homo sapiens
gagctctgaga

SEQ ID NO: 4618485 - DNA, 15 bp, Homo sapiens
gagctctgagaggcc

SEQ ID NO: 4618486 - DNA, 16 bp, Homo sapiens
gagctctgagaggccc

SEQ ID NO: 4618487 - DNA, 19 bp, Homo sapiens
gagctctgagaggccctgg

SEQ ID NO: 4618488 - DNA, 23 bp, Homo sapiens
gagctctgagaggccctggatca

SEQ ID NO: 4618489 - DNA, 21 bp, Homo sapiens
gagctgccagcctgaggtgcc

SEQ ID NO: 4618490 - DNA, 22 bp, Homo sapiens
gagctgccagcctgaggtgccc

SEQ ID NO: 4618491 - DNA, 18 bp, Homo sapiens
gagctgcccctctctggg

SEQ ID NO: 4618492 - DNA, 23 bp, Homo sapiens
gagctgcctggatgagaaacagc

SEQ ID NO: 4618493 - DNA, 21 bp, Homo sapiens
gagctgggacacttaacagat

SEQ ID NO: 4618494 - DNA, 19 bp, Homo sapiens
gagctggggactcagggac

SEQ ID NO: 4618495 - DNA, 23 bp, Homo sapiens
gagctgtctgaagcccaaagcct

SEQ ID NO: 4618496 - DNA, 13 bp, Homo sapiens
gagctgtgccagc

SEQ ID NO: 4618497 - DNA, 15 bp, Homo sapiens
gagctgtgccagcag

SEQ ID NO: 4618498 - DNA, 15 bp, Homo sapiens
gagcttcctggggac

SEQ ID NO: 4618499 - DNA, 20 bp, Homo sapiens
gagcttgctcattaattttg

SEQ ID NO: 4618500 - DNA, 15 bp, Homo sapiens
gaggaaagcaagtgt

SEQ ID NO: 4618501 - DNA, 15 bp, Homo sapiens
gaggaagagccacct

SEQ ID NO: 4618502 - DNA, 23 bp, Homo sapiens
gaggaagagccacctgcaagatg

SEQ ID NO: 4618503 - DNA, 15 bp, Homo sapiens
gaggaatgtgggcta

SEQ ID NO: 4618504 - DNA, 14 bp, Homo sapiens
gaggacagctgtcc

SEQ ID NO: 4618505 - DNA, 12 bp, Homo sapiens
gaggacctgagc

SEQ ID NO: 4618506 - DNA, 15 bp, Homo sapiens
gaggacctgagcctg

SEQ ID NO: 4618507 - DNA, 17 bp, Homo sapiens
gaggacctgagcctgcc

SEQ ID NO: 4618508 - DNA, 20 bp, Homo sapiens
gaggactcccaaccctggct

SEQ ID NO: 4618509 - DNA, 13 bp, Homo sapiens
gaggagagaagaa

SEQ ID NO: 4618510 - DNA, 20 bp, Homo sapiens
gaggagatgtgatcaggccc

SEQ ID NO: 4618511 - DNA, 18 bp, Homo sapiens
gaggagcaacggccccag

SEQ ID NO: 4618512 - DNA, 16 bp, Homo sapiens
gaggagccaggcccca

SEQ ID NO: 4618513 - DNA, 20 bp, Homo sapiens
gaggagccaggccccacccc

SEQ ID NO: 4618514 - DNA, 18 bp, Homo sapiens
gaggagcccagcggccca

SEQ ID NO: 4618515 - DNA, 21 bp, Homo sapiens
gaggagcctgtgcgtcccagc

SEQ ID NO: 4618516 - DNA, 14 bp, Homo sapiens
gaggaggagagagt

SEQ ID NO: 4618517 - DNA, 23 bp, Homo sapiens
gaggaggagtcagatgaggccct

SEQ ID NO: 4618518 - DNA, 19 bp, Homo sapiens
gaggaggatgtccctgggc

SEQ ID NO: 4618519 - DNA, 22 bp, Homo sapiens
gaggaggatgtccctgggccag

SEQ ID NO: 4618520 - DNA, 23 bp, Homo sapiens
gaggaggatgtccctgggccagg

SEQ ID NO: 4618521 - DNA, 20 bp, Homo sapiens
gaggagtcagatgaggccct

SEQ ID NO: 4618522 - DNA, 14 bp, Homo sapiens
gaggagtctgaggt

SEQ ID NO: 4618523 - DNA, 21 bp, Homo sapiens
gaggagtctgaggtcctgagc

SEQ ID NO: 4618524 - DNA, 20 bp, Homo sapiens
gaggatagtagttaaataac

SEQ ID NO: 4618525 - DNA, 24 bp, Homo sapiens
gaggatcatatgaattagccaaaa

SEQ ID NO: 4618526 - DNA, 13 bp, Homo sapiens
gaggatgtccctg

SEQ ID NO: 4618527 - DNA, 19 bp, Homo sapiens
gaggatgtccctgggccag

SEQ ID NO: 4618528 - DNA, 20 bp, Homo sapiens
gaggatgtccctgggccagg

SEQ ID NO: 4618529 - DNA, 22 bp, Homo sapiens
gaggcaatgggagctgaggcca

SEQ ID NO: 4618530 - DNA, 19 bp, Homo sapiens
gaggcagatgcccttgctg

SEQ ID NO: 4618531 - DNA, 20 bp, Homo sapiens
gaggcatccgtgaggcaggg

SEQ ID NO: 4618532 - DNA, 21 bp, Homo sapiens
gaggcatccgtgaggcaggga

SEQ ID NO: 4618533 - DNA, 14 bp, Homo sapiens
gaggcattgacata

SEQ ID NO: 4618534 - DNA, 16 bp, Homo sapiens
gaggcatttgagcagc

SEQ ID NO: 4618535 - DNA, 17 bp, Homo sapiens
gaggcatttgagcagct

SEQ ID NO: 4618536 - DNA, 20 bp, Homo sapiens
gaggcatttgagcagctgaa

SEQ ID NO: 4618537 - DNA, 14 bp, Homo sapiens
gaggccaaccagcc

SEQ ID NO: 4618538 - DNA, 20 bp, Homo sapiens
gaggccaaccagcccgacag

SEQ ID NO: 4618539 - DNA, 18 bp, Homo sapiens
gaggccacactcagcaca

SEQ ID NO: 4618540 - DNA, 15 bp, Homo sapiens
gaggccagcctggcc

SEQ ID NO: 4618541 - DNA, 16 bp, Homo sapiens
gaggccagcctggcct

SEQ ID NO: 4618542 - DNA, 16 bp, Homo sapiens
gaggccatacttgtga

SEQ ID NO: 4618543 - DNA, 15 bp, Homo sapiens
gaggccatctcagga

SEQ ID NO: 4618544 - DNA, 14 bp, Homo sapiens
gaggccccaactca

SEQ ID NO: 4618545 - DNA, 18 bp, Homo sapiens
gaggcccccgtcagggag

SEQ ID NO: 4618546 - DNA, 21 bp, Homo sapiens
gaggccccgccttttccccca

SEQ ID NO: 4618547 - DNA, 13 bp, Homo sapiens
gaggccctgcacc

SEQ ID NO: 4618548 - DNA, 18 bp, Homo sapiens
gaggccgaagctaacagg

SEQ ID NO: 4618549 - DNA, 15 bp, Homo sapiens
gaggccttgagaggc

SEQ ID NO: 4618550 - DNA, 18 bp, Homo sapiens
gaggctgctcggggtgca

SEQ ID NO: 4618551 - DNA, 13 bp, Homo sapiens
gaggctggcacag

SEQ ID NO: 4618552 - DNA, 22 bp, Homo sapiens
gaggcttccctacacagggcct

SEQ ID NO: 4618553 - DNA, 23 bp, Homo sapiens
gaggcttccctacacagggcctg

SEQ ID NO: 4618554 - DNA, 15 bp, Homo sapiens
gaggcttgaaggcca

SEQ ID NO: 4618555 - DNA, 21 bp, Homo sapiens
gaggctttctgggctctggac

SEQ ID NO: 4618556 - DNA, 18 bp, Homo sapiens
gagggaaatgtacacttt

SEQ ID NO: 4618557 - DNA, 19 bp, Homo sapiens
gagggaaattgtaaatcct

SEQ ID NO: 4618558 - DNA, 13 bp, Homo sapiens
gagggaacaaaac

SEQ ID NO: 4618559 - DNA, 16 bp, Homo sapiens
gagggacaggctgaag

SEQ ID NO: 4618560 - DNA, 17 bp, Homo sapiens
gagggacaggctgaaga

SEQ ID NO: 4618561 - DNA, 18 bp, Homo sapiens
gagggacaggctgaagag

SEQ ID NO: 4618562 - DNA, 21 bp, Homo sapiens
gagggacaggctgaagagagg

SEQ ID NO: 4618563 - DNA, 15 bp, Homo sapiens
gagggactgtcgctg

SEQ ID NO: 4618564 - DNA, 22 bp, Homo sapiens
gagggagcaagtccttcccttt

SEQ ID NO: 4618565 - DNA, 13 bp, Homo sapiens
gagggaggggagg

SEQ ID NO: 4618566 - DNA, 18 bp, Homo sapiens
gagggataattggttatt

SEQ ID NO: 4618567 - DNA, 15 bp, Homo sapiens
gagggatggagaaag

SEQ ID NO: 4618568 - DNA, 16 bp, Homo sapiens
gagggcaagccctgcc

SEQ ID NO: 4618569 - DNA, 13 bp, Homo sapiens
gagggcagcagcc

SEQ ID NO: 4618570 - DNA, 16 bp, Homo sapiens
gagggcagcagccagc

SEQ ID NO: 4618571 - DNA, 23 bp, Homo sapiens
gagggcagcagccagccctgcct

SEQ ID NO: 4618572 - DNA, 19 bp, Homo sapiens
gagggcagccccctcccta

SEQ ID NO: 4618573 - DNA, 13 bp, Homo sapiens
gagggcagtgccc

SEQ ID NO: 4618574 - DNA, 18 bp, Homo sapiens
gagggcagttcgcagcca

SEQ ID NO: 4618575 - DNA, 13 bp, Homo sapiens
gagggctctgagg

SEQ ID NO: 4618576 - DNA, 14 bp, Homo sapiens
gagggctctgaggc

SEQ ID NO: 4618577 - DNA, 15 bp, Homo sapiens
gagggctctgaggcg

SEQ ID NO: 4618578 - DNA, 16 bp, Homo sapiens
gagggcttggcccagc

SEQ ID NO: 4618579 - DNA, 12 bp, Homo sapiens
gaggggagaagc

SEQ ID NO: 4618580 - DNA, 20 bp, Homo sapiens
gaggggagaggtcagccttg

SEQ ID NO: 4618581 - DNA, 17 bp, Homo sapiens
gaggggcaagctaggcc

SEQ ID NO: 4618582 - DNA, 23 bp, Homo sapiens
gaggggcaagctaggccccagag

SEQ ID NO: 4618583 - DNA, 23 bp, Homo sapiens
gaggggcagatggaaaggagcct

SEQ ID NO: 4618584 - DNA, 17 bp, Homo sapiens
gagggggcaagctttgc

SEQ ID NO: 4618585 - DNA, 16 bp, Homo sapiens
gagggggcctcattgt

SEQ ID NO: 4618586 - DNA, 14 bp, Homo sapiens
gaggggtctcggat

SEQ ID NO: 4618587 - DNA, 23 bp, Homo sapiens
gaggggtctcggatgacaccctg

SEQ ID NO: 4618588 - DNA, 14 bp, Homo sapiens
gagggtcagccagg

SEQ ID NO: 4618589 - DNA, 18 bp, Homo sapiens
gagggtgacagcttcctt

SEQ ID NO: 4618590 - DNA, 16 bp, Homo sapiens
gagggtttgggcagag

SEQ ID NO: 4618591 - DNA, 13 bp, Homo sapiens
gaggtcaccagct

SEQ ID NO: 4618592 - DNA, 18 bp, Homo sapiens
gaggtcaccagctgctgt

SEQ ID NO: 4618593 - DNA, 22 bp, Homo sapiens
gaggtcaccagctgctgtgccc

SEQ ID NO: 4618594 - DNA, 22 bp, Homo sapiens
gaggtcagccttgacctaatga

SEQ ID NO: 4618595 - DNA, 11 bp, Homo sapiens
gaggtcaggga

SEQ ID NO: 4618596 - DNA, 18 bp, Homo sapiens
gaggtcccagccctgggg

SEQ ID NO: 4618597 - DNA, 16 bp, Homo sapiens
gaggtcctgagcactg

SEQ ID NO: 4618598 - DNA, 23 bp, Homo sapiens
gaggtcctgagcactgccaggag

SEQ ID NO: 4618599 - DNA, 21 bp, Homo sapiens
gaggtccttaggcctctgaga

SEQ ID NO: 4618600 - DNA, 16 bp, Homo sapiens
gaggtcctttggacag

SEQ ID NO: 4618601 - DNA, 18 bp, Homo sapiens
gaggtcctttggacagct

SEQ ID NO: 4618602 - DNA, 16 bp, Homo sapiens
gaggtctccaaactga

SEQ ID NO: 4618603 - DNA, 21 bp, Homo sapiens
gaggtgaaagaaagggaccca

SEQ ID NO: 4618604 - DNA, 17 bp, Homo sapiens
gaggtgaccccagggca

SEQ ID NO: 4618605 - DNA, 23 bp, Homo sapiens
gaggtgaccccagggcacaggag

SEQ ID NO: 4618606 - DNA, 15 bp, Homo sapiens
gaggtgcagtggagg

SEQ ID NO: 4618607 - DNA, 13 bp, Homo sapiens
gaggtgcccagga

SEQ ID NO: 4618608 - DNA, 14 bp, Homo sapiens
gaggtgcccaggag

SEQ ID NO: 4618609 - DNA, 16 bp, Homo sapiens
gaggtgttacagagga

SEQ ID NO: 4618610 - DNA, 18 bp, Homo sapiens
gaggtgttgcagcccaaa

SEQ ID NO: 4618611 - DNA, 13 bp, Homo sapiens
gaggttctgcctc

SEQ ID NO: 4618612 - DNA, 15 bp, Homo sapiens
gaggttctgcctcta

SEQ ID NO: 4618613 - DNA, 17 bp, Homo sapiens
gaggttggggtgtacta

SEQ ID NO: 4618614 - DNA, 19 bp, Homo sapiens
gaggtttagcaatagctag

SEQ ID NO: 4618615 - DNA, 13 bp, Homo sapiens
gagtacaaatgcc

SEQ ID NO: 4618616 - DNA, 20 bp, Homo sapiens
gagtagcctggactgtttca

SEQ ID NO: 4618617 - DNA, 14 bp, Homo sapiens
gagtagctgagctc

SEQ ID NO: 4618618 - DNA, 15 bp, Homo sapiens
gagtagctgagctca

SEQ ID NO: 4618619 - DNA, 16 bp, Homo sapiens
gagtatagtgcaaatt

SEQ ID NO: 4618620 - DNA, 17 bp, Homo sapiens
gagtatgccactgcact

SEQ ID NO: 4618621 - DNA, 24 bp, Homo sapiens
gagtatgccactgcactccagcct

SEQ ID NO: 4618622 - DNA, 21 bp, Homo sapiens
gagtatttttaaaaaatatgt

SEQ ID NO: 4618623 - DNA, 20 bp, Homo sapiens
gagtcagatgaggccctgca

SEQ ID NO: 4618624 - DNA, 13 bp, Homo sapiens
gagtcagcacagg

SEQ ID NO: 4618625 - DNA, 22 bp, Homo sapiens
gagtcaggtgaggcatctttac

SEQ ID NO: 4618626 - DNA, 20 bp, Homo sapiens
gagtcagtgaagtctagaat

SEQ ID NO: 4618627 - DNA, 18 bp, Homo sapiens
gagtcattcgttctgtgg

SEQ ID NO: 4618628 - DNA, 14 bp, Homo sapiens
gagtccaagctggg

SEQ ID NO: 4618629 - DNA, 19 bp, Homo sapiens
gagtcctgccttcttcctt

SEQ ID NO: 4618630 - DNA, 16 bp, Homo sapiens
gagtctcactcttgtc

SEQ ID NO: 4618631 - DNA, 17 bp, Homo sapiens
gagtctgaggtcctgag

SEQ ID NO: 4618632 - DNA, 19 bp, Homo sapiens
gagtctgaggtcctgagca

SEQ ID NO: 4618633 - DNA, 22 bp, Homo sapiens
gagtctgaggtcctgagcactg

SEQ ID NO: 4618634 - DNA, 23 bp, Homo sapiens
gagtctgaggtcctgagcactgc

SEQ ID NO: 4618635 - DNA, 16 bp, Homo sapiens
gagtctgtttcccaag

SEQ ID NO: 4618636 - DNA, 20 bp, Homo sapiens
gagtcttactctgtcgccca

SEQ ID NO: 4618637 - DNA, 17 bp, Homo sapiens
gagtgaagtattgctga

SEQ ID NO: 4618638 - DNA, 22 bp, Homo sapiens
gagtgaagtattgctgaaaagt

SEQ ID NO: 4618639 - DNA, 23 bp, Homo sapiens
gagtgacctccttctgcaaagtg

SEQ ID NO: 4618640 - DNA, 18 bp, Homo sapiens
gagtgacggctggcatgg

SEQ ID NO: 4618641 - DNA, 19 bp, Homo sapiens
gagtgagaggcccccaccc

SEQ ID NO: 4618642 - DNA, 23 bp, Homo sapiens
gagtgagaggcccccacccttgg

SEQ ID NO: 4618643 - DNA, 14 bp, Homo sapiens
gagtgctggctcac

SEQ ID NO: 4618644 - DNA, 22 bp, Homo sapiens
gagtgctggctcacagtacagc

SEQ ID NO: 4618645 - DNA, 11 bp, Homo sapiens
gagtggcctcc

SEQ ID NO: 4618646 - DNA, 15 bp, Homo sapiens
gagtggcctccctgc

SEQ ID NO: 4618647 - DNA, 16 bp, Homo sapiens
gagtggcctccctgct

SEQ ID NO: 4618648 - DNA, 15 bp, Homo sapiens
gagtggcttcactcc

SEQ ID NO: 4618649 - DNA, 16 bp, Homo sapiens
gagtgggccccgggct

SEQ ID NO: 4618650 - DNA, 20 bp, Homo sapiens
gagtgggccccgggctggag

SEQ ID NO: 4618651 - DNA, 16 bp, Homo sapiens
gagtggtgcagacaga

SEQ ID NO: 4618652 - DNA, 15 bp, Homo sapiens
gagtggttcctgtgg

SEQ ID NO: 4618653 - DNA, 15 bp, Homo sapiens
gagtgtactcccagg

SEQ ID NO: 4618654 - DNA, 20 bp, Homo sapiens
gagtgtagcctaaagggcag

SEQ ID NO: 4618655 - DNA, 18 bp, Homo sapiens
gagtgtagctgtaagggc

SEQ ID NO: 4618656 - DNA, 20 bp, Homo sapiens
gagtgtagctgtaagggcag

SEQ ID NO: 4618657 - DNA, 23 bp, Homo sapiens
gagtgtagctgtaagggcagtgc

SEQ ID NO: 4618658 - DNA, 16 bp, Homo sapiens
gagtgtgacagggcca

SEQ ID NO: 4618659 - DNA, 23 bp, Homo sapiens
gagtgtgagccacctaagatctc

SEQ ID NO: 4618660 - DNA, 19 bp, Homo sapiens
gagttaatgatggcagagg

SEQ ID NO: 4618661 - DNA, 14 bp, Homo sapiens
gagttatatgttca

SEQ ID NO: 4618662 - DNA, 13 bp, Homo sapiens
gagtttcagctgg

SEQ ID NO: 4618663 - DNA, 20 bp, Homo sapiens
gataaaaatatcatcatagt

SEQ ID NO: 4618664 - DNA, 21 bp, Homo sapiens
gataaagccacttctggcttc

SEQ ID NO: 4618665 - DNA, 21 bp, Homo sapiens
gataaataacttttttttaag

SEQ ID NO: 4618666 - DNA, 20 bp, Homo sapiens
gataaccttgtttattagca

SEQ ID NO: 4618667 - DNA, 19 bp, Homo sapiens
gataactttacagaaatgg

SEQ ID NO: 4618668 - DNA, 19 bp, Homo sapiens
gataagtggctgtttcatc

SEQ ID NO: 4618669 - DNA, 17 bp, Homo sapiens
gataatagcatttttgt

SEQ ID NO: 4618670 - DNA, 19 bp, Homo sapiens
gataatagcatttttgtaa

SEQ ID NO: 4618671 - DNA, 20 bp, Homo sapiens
gataataggggattttaaaa

SEQ ID NO: 4618672 - DNA, 19 bp, Homo sapiens
gataattagatgattatat

SEQ ID NO: 4618673 - DNA, 21 bp, Homo sapiens
gataattagatgattatatat

SEQ ID NO: 4618674 - DNA, 16 bp, Homo sapiens
gataatttaaaatcca

SEQ ID NO: 4618675 - DNA, 13 bp, Homo sapiens
gataatttgaaaa

SEQ ID NO: 4618676 - DNA, 22 bp, Homo sapiens
gatacaggactggttccttcct

SEQ ID NO: 4618677 - DNA, 20 bp, Homo sapiens
gatactctttctaatgctga

SEQ ID NO: 4618678 - DNA, 12 bp, Homo sapiens
gatactgctgct

SEQ ID NO: 4618679 - DNA, 19 bp, Homo sapiens
gatactgctgcttgtcaaa

SEQ ID NO: 4618680 - DNA, 13 bp, Homo sapiens
gatagatgtttgg

SEQ ID NO: 4618681 - DNA, 22 bp, Homo sapiens
gatagtcctgacctcatgatct

SEQ ID NO: 4618682 - DNA, 14 bp, Homo sapiens
gatagtctgggtca

SEQ ID NO: 4618683 - DNA, 22 bp, Homo sapiens
gatatcattttaaaaactttat

SEQ ID NO: 4618684 - DNA, 20 bp, Homo sapiens
gatatctagctagtaatata

SEQ ID NO: 4618685 - DNA, 21 bp, Homo sapiens
gatatggcattgcactgctta

SEQ ID NO: 4618686 - DNA, 18 bp, Homo sapiens
gatatggcttaggaatga

SEQ ID NO: 4618687 - DNA, 15 bp, Homo sapiens
gatattatagaaaat

SEQ ID NO: 4618688 - DNA, 15 bp, Homo sapiens
gatattctttacaaa

SEQ ID NO: 4618689 - DNA, 15 bp, Homo sapiens
gatattgaaggaatt

SEQ ID NO: 4618690 - DNA, 17 bp, Homo sapiens
gatcaaatatagaaagt

SEQ ID NO: 4618691 - DNA, 17 bp, Homo sapiens
gatcacagccccaccct

SEQ ID NO: 4618692 - DNA, 21 bp, Homo sapiens
gatcagaacattcagctctgg

SEQ ID NO: 4618693 - DNA, 22 bp, Homo sapiens
gatcagaacattcagctctgga

SEQ ID NO: 4618694 - DNA, 22 bp, Homo sapiens
gatcagaggcatttgagcagct

SEQ ID NO: 4618695 - DNA, 16 bp, Homo sapiens
gatcagcgtggccttg

SEQ ID NO: 4618696 - DNA, 17 bp, Homo sapiens
gatcagcgtggccttgt

SEQ ID NO: 4618697 - DNA, 18 bp, Homo sapiens
gatcaggatcagctttga

SEQ ID NO: 4618698 - DNA, 12 bp, Homo sapiens
gatcaggcccca

SEQ ID NO: 4618699 - DNA, 13 bp, Homo sapiens
gatcaggccccac

SEQ ID NO: 4618700 - DNA, 14 bp, Homo sapiens
gatcagggcctgcc

SEQ ID NO: 4618701 - DNA, 22 bp, Homo sapiens
gatcagggcctgccccctgggg

SEQ ID NO: 4618702 - DNA, 16 bp, Homo sapiens
gatcatgctgcagtgg

SEQ ID NO: 4618703 - DNA, 18 bp, Homo sapiens
gatcattggagtttagga

SEQ ID NO: 4618704 - DNA, 21 bp, Homo sapiens
gatcatttataatactgtttt

SEQ ID NO: 4618705 - DNA, 11 bp, Homo sapiens
gatccagccac

SEQ ID NO: 4618706 - DNA, 12 bp, Homo sapiens
gatcccaggagg

SEQ ID NO: 4618707 - DNA, 14 bp, Homo sapiens
gatccccagctgtt

SEQ ID NO: 4618708 - DNA, 16 bp, Homo sapiens
gatccccttgatagat

SEQ ID NO: 4618709 - DNA, 19 bp, Homo sapiens
gatcctgctggggccgcca

SEQ ID NO: 4618710 - DNA, 22 bp, Homo sapiens
gatcctgggtcaaaaaaaagaa

SEQ ID NO: 4618711 - DNA, 21 bp, Homo sapiens
gatccttgtgttcagctcttt

SEQ ID NO: 4618712 - DNA, 15 bp, Homo sapiens
gatccttttttgtca

SEQ ID NO: 4618713 - DNA, 16 bp, Homo sapiens
gatccttttttgtcat

SEQ ID NO: 4618714 - DNA, 17 bp, Homo sapiens
gatccttttttgtcatt

SEQ ID NO: 4618715 - DNA, 20 bp, Homo sapiens
gatccttttttgtcatttta

SEQ ID NO: 4618716 - DNA, 19 bp, Homo sapiens
gatctcctgccagcccagc

SEQ ID NO: 4618717 - DNA, 20 bp, Homo sapiens
gatctcggtttgccaaaatt

SEQ ID NO: 4618718 - DNA, 19 bp, Homo sapiens
gatctctgagaccacagag

SEQ ID NO: 4618719 - DNA, 17 bp, Homo sapiens
gatctgcatctgataga

SEQ ID NO: 4618720 - DNA, 17 bp, Homo sapiens
gatctgccagacctgca

SEQ ID NO: 4618721 - DNA, 14 bp, Homo sapiens
gatctggggaggca

SEQ ID NO: 4618722 - DNA, 17 bp, Homo sapiens
gatctggggaggcaggc

SEQ ID NO: 4618723 - DNA, 22 bp, Homo sapiens
gatcttgaatgtggtctcagga

SEQ ID NO: 4618724 - DNA, 23 bp, Homo sapiens
gatcttgagtataagaaatgcat

SEQ ID NO: 4618725 - DNA, 17 bp, Homo sapiens
gatgacaccctggcctg

SEQ ID NO: 4618726 - DNA, 22 bp, Homo sapiens
gatgaccagggatgctgggctg

SEQ ID NO: 4618727 - DNA, 19 bp, Homo sapiens
gatgagaaacagctcagcc

SEQ ID NO: 4618728 - DNA, 15 bp, Homo sapiens
gatgagacccagccc

SEQ ID NO: 4618729 - DNA, 21 bp, Homo sapiens
gatgagacccagccccttccc

SEQ ID NO: 4618730 - DNA, 16 bp, Homo sapiens
gatgagatttttaaaa

SEQ ID NO: 4618731 - DNA, 12 bp, Homo sapiens
gatgagcccacc

SEQ ID NO: 4618732 - DNA, 12 bp, Homo sapiens
gatgagggcagc

SEQ ID NO: 4618733 - DNA, 13 bp, Homo sapiens
gatgagggcagca

SEQ ID NO: 4618734 - DNA, 16 bp, Homo sapiens
gatgagggcagcagcc

SEQ ID NO: 4618735 - DNA, 18 bp, Homo sapiens
gatgaggtcaccagggga

SEQ ID NO: 4618736 - DNA, 19 bp, Homo sapiens
gatgagtaaactgaggccc

SEQ ID NO: 4618737 - DNA, 16 bp, Homo sapiens
gatgagtcttgatcta

SEQ ID NO: 4618738 - DNA, 18 bp, Homo sapiens
gatgatacatccaaagca

SEQ ID NO: 4618739 - DNA, 16 bp, Homo sapiens
gatgatcgctgtattt

SEQ ID NO: 4618740 - DNA, 18 bp, Homo sapiens
gatgcaatgtgctactga

SEQ ID NO: 4618741 - DNA, 13 bp, Homo sapiens
gatgcaggtcagc

SEQ ID NO: 4618742 - DNA, 22 bp, Homo sapiens
gatgcaggtcagcccatggagg

SEQ ID NO: 4618743 - DNA, 20 bp, Homo sapiens
gatgcatcagaaagggaggg

SEQ ID NO: 4618744 - DNA, 17 bp, Homo sapiens
gatgcatgtcttttaaa

SEQ ID NO: 4618745 - DNA, 18 bp, Homo sapiens
gatgcccagaggactccc

SEQ ID NO: 4618746 - DNA, 17 bp, Homo sapiens
gatgcccttgctgggcc

SEQ ID NO: 4618747 - DNA, 16 bp, Homo sapiens
gatgcggatcctgctg

SEQ ID NO: 4618748 - DNA, 20 bp, Homo sapiens
gatgcggatcctgctggggc

SEQ ID NO: 4618749 - DNA, 14 bp, Homo sapiens
gatgcgtgggcaga

SEQ ID NO: 4618750 - DNA, 15 bp, Homo sapiens
gatgcgtgggcagag

SEQ ID NO: 4618751 - DNA, 17 bp, Homo sapiens
gatgcgtgggcagagga

SEQ ID NO: 4618752 - DNA, 21 bp, Homo sapiens
gatgctgacattcacctgccc

SEQ ID NO: 4618753 - DNA, 13 bp, Homo sapiens
gatgctgggctgg

SEQ ID NO: 4618754 - DNA, 13 bp, Homo sapiens
gatggaaaggtga

SEQ ID NO: 4618755 - DNA, 17 bp, Homo sapiens
gatggaattaaatgtgg

SEQ ID NO: 4618756 - DNA, 15 bp, Homo sapiens
gatggacacgagcca

SEQ ID NO: 4618757 - DNA, 19 bp, Homo sapiens
gatggacacgagccacaag

SEQ ID NO: 4618758 - DNA, 18 bp, Homo sapiens
gatggacttacctggcag

SEQ ID NO: 4618759 - DNA, 22 bp, Homo sapiens
gatggagcaaacctagccccca

SEQ ID NO: 4618760 - DNA, 17 bp, Homo sapiens
gatggagcaagctcttc

SEQ ID NO: 4618761 - DNA, 15 bp, Homo sapiens
gatggagggcttggc

SEQ ID NO: 4618762 - DNA, 18 bp, Homo sapiens
gatggagttcttgtgcca

SEQ ID NO: 4618763 - DNA, 19 bp, Homo sapiens
gatggagttcttgtgccat

SEQ ID NO: 4618764 - DNA, 16 bp, Homo sapiens
gatggatggcagactc

SEQ ID NO: 4618765 - DNA, 15 bp, Homo sapiens
gatggcagaggagct

SEQ ID NO: 4618766 - DNA, 13 bp, Homo sapiens
gatggccaggctg

SEQ ID NO: 4618767 - DNA, 20 bp, Homo sapiens
gcacaatcactaaactttat

SEQ ID NO: 4618768 - DNA, 18 bp, Homo sapiens
gcacacagaggggagtca

SEQ ID NO: 4618769 - DNA, 15 bp, Homo sapiens
gcacacagctgagca

SEQ ID NO: 4618770 - DNA, 13 bp, Homo sapiens
gcacacaggcagc

SEQ ID NO: 4618771 - DNA, 17 bp, Homo sapiens
gcacacaggcagccagc

SEQ ID NO: 4618772 - DNA, 13 bp, Homo sapiens
gcacaccaaggcc

SEQ ID NO: 4618773 - DNA, 16 bp, Homo sapiens
gcacaccaaggccctg

SEQ ID NO: 4618774 - DNA, 19 bp, Homo sapiens
gcacactcatgcacacaga

SEQ ID NO: 4618775 - DNA, 19 bp, Homo sapiens
gcacagaacaggaggtgtg

SEQ ID NO: 4618776 - DNA, 23 bp, Homo sapiens
gcacagaacaggaggtgtgaatg

SEQ ID NO: 4618777 - DNA, 14 bp, Homo sapiens
gcacagaagaggag

SEQ ID NO: 4618778 - DNA, 19 bp, Homo sapiens
gcacagacaagcagccctt

SEQ ID NO: 4618779 - DNA, 15 bp, Homo sapiens
gcacagcagcctggg

SEQ ID NO: 4618780 - DNA, 17 bp, Homo sapiens
gcacagctgtttgaaat

SEQ ID NO: 4618781 - DNA, 12 bp, Homo sapiens
gcacaggagcta

SEQ ID NO: 4618782 - DNA, 16 bp, Homo sapiens
gcacaggagctacctg

SEQ ID NO: 4618783 - DNA, 21 bp, Homo sapiens
gcacaggagctacctgtgtgg

SEQ ID NO: 4618784 - DNA, 18 bp, Homo sapiens
gcacaggccccgaggagc

SEQ ID NO: 4618785 - DNA, 14 bp, Homo sapiens
gcacaggcttgctg

SEQ ID NO: 4618786 - DNA, 19 bp, Homo sapiens
gcacaggcttgctgtatga

SEQ ID NO: 4618787 - DNA, 17 bp, Homo sapiens
gcacagggagtgcacat

SEQ ID NO: 4618788 - DNA, 14 bp, Homo sapiens
gcacagtgggagct

SEQ ID NO: 4618789 - DNA, 16 bp, Homo sapiens
gcacagtgggagctga

SEQ ID NO: 4618790 - DNA, 19 bp, Homo sapiens
gcacagtgggagctgagct

SEQ ID NO: 4618791 - DNA, 13 bp, Homo sapiens
gcacatatggact

SEQ ID NO: 4618792 - DNA, 18 bp, Homo sapiens
gcacatatggactctgca

SEQ ID NO: 4618793 - DNA, 22 bp, Homo sapiens
gcacatcatgagccttcagtca

SEQ ID NO: 4618794 - DNA, 13 bp, Homo sapiens
gcacatgtcttgt

SEQ ID NO: 4618795 - DNA, 20 bp, Homo sapiens
gcacatgtcttgtacatgtg

SEQ ID NO: 4618796 - DNA, 21 bp, Homo sapiens
gcacatgtcttgtacatgtgt

SEQ ID NO: 4618797 - DNA, 18 bp, Homo sapiens
gcacattaactccctcca

SEQ ID NO: 4618798 - DNA, 14 bp, Homo sapiens
gcacccccagcctg

SEQ ID NO: 4618799 - DNA, 15 bp, Homo sapiens
gcacccccagcctgg

SEQ ID NO: 4618800 - DNA, 21 bp, Homo sapiens
gcacccccagcctgggcctat

SEQ ID NO: 4618801 - DNA, 14 bp, Homo sapiens
gcaccccctgcagc

SEQ ID NO: 4618802 - DNA, 13 bp, Homo sapiens
gcacccgtcccca

SEQ ID NO: 4618803 - DNA, 17 bp, Homo sapiens
gcaccctcatacacaga

SEQ ID NO: 4618804 - DNA, 19 bp, Homo sapiens
gcaccgcctgaaggcacag

SEQ ID NO: 4618805 - DNA, 21 bp, Homo sapiens
gcacctacagtgtacagtctt

SEQ ID NO: 4618806 - DNA, 13 bp, Homo sapiens
gcacctccaggcc

SEQ ID NO: 4618807 - DNA, 13 bp, Homo sapiens
gcacctgcctcag

SEQ ID NO: 4618808 - DNA, 14 bp, Homo sapiens
gcacctgcctcagg

SEQ ID NO: 4618809 - DNA, 15 bp, Homo sapiens
gcacctgcctcagga

SEQ ID NO: 4618810 - DNA, 15 bp, Homo sapiens
gcacctgggccctgg

SEQ ID NO: 4618811 - DNA, 17 bp, Homo sapiens
gcacctgggccctgggg

SEQ ID NO: 4618812 - DNA, 18 bp, Homo sapiens
gcacctgtccccaccctc

SEQ ID NO: 4618813 - DNA, 21 bp, Homo sapiens
gcacctgtccccaccctccac

SEQ ID NO: 4618814 - DNA, 23 bp, Homo sapiens
gcacctgtccccaccctccactc

SEQ ID NO: 4618815 - DNA, 14 bp, Homo sapiens
gcaccttgtgtctg

SEQ ID NO: 4618816 - DNA, 22 bp, Homo sapiens
gcaccttgtgtctgtacacgtg

SEQ ID NO: 4618817 - DNA, 13 bp, Homo sapiens
gcacgcctgcccc

SEQ ID NO: 4618818 - DNA, 21 bp, Homo sapiens
gcactactgggtgtcatttca

SEQ ID NO: 4618819 - DNA, 16 bp, Homo sapiens
gcactccagcctgggg

SEQ ID NO: 4618820 - DNA, 21 bp, Homo sapiens
gcactccagcctgggggacag

SEQ ID NO: 4618821 - DNA, 21 bp, Homo sapiens
gcactccccagagctgtgcca

SEQ ID NO: 4618822 - DNA, 17 bp, Homo sapiens
gcactcggggtccctgg

SEQ ID NO: 4618823 - DNA, 18 bp, Homo sapiens
gcactcggggtccctgga

SEQ ID NO: 4618824 - DNA, 19 bp, Homo sapiens
gcactcggggtccctggag

SEQ ID NO: 4618825 - DNA, 22 bp, Homo sapiens
gcactgaaggctttcagggcct

SEQ ID NO: 4618826 - DNA, 13 bp, Homo sapiens
gcactgcctctca

SEQ ID NO: 4618827 - DNA, 12 bp, Homo sapiens
gcactggcccag

SEQ ID NO: 4618828 - DNA, 22 bp, Homo sapiens
gcactgtgaacctgggcactcc

SEQ ID NO: 4618829 - DNA, 19 bp, Homo sapiens
gcactgtgatacagttttg

SEQ ID NO: 4618830 - DNA, 17 bp, Homo sapiens
gcactgtgtttatatgt

SEQ ID NO: 4618831 - DNA, 18 bp, Homo sapiens
gcacttaatttgtaaact

SEQ ID NO: 4618832 - DNA, 22 bp, Homo sapiens
gcacttaatttgtaaacttctg

SEQ ID NO: 4618833 - DNA, 20 bp, Homo sapiens
gcacttagacctgccagcca

SEQ ID NO: 4618834 - DNA, 21 bp, Homo sapiens
gcacttatctcgaatttgaag

SEQ ID NO: 4618835 - DNA, 21 bp, Homo sapiens
gcacttggcaaaaagaatccc

SEQ ID NO: 4618836 - DNA, 20 bp, Homo sapiens
gcactttccaatgccacaga

SEQ ID NO: 4618837 - DNA, 21 bp, Homo sapiens
gcactttccaatgccacagac

SEQ ID NO: 4618838 - DNA, 22 bp, Homo sapiens
gcactttccaatgccacagaca

SEQ ID NO: 4618839 - DNA, 14 bp, Homo sapiens
gcactttcctttca

SEQ ID NO: 4618840 - DNA, 16 bp, Homo sapiens
gcactttcctttcaat

SEQ ID NO: 4618841 - DNA, 22 bp, Homo sapiens
gcactttcctttcaataaagtt

SEQ ID NO: 4618842 - DNA, 12 bp, Homo sapiens
gcagaaatagtt

SEQ ID NO: 4618843 - DNA, 16 bp, Homo sapiens
gcagaaatagttgtct

SEQ ID NO: 4618844 - DNA, 21 bp, Homo sapiens
gcagaaatagttgtctgtgct

SEQ ID NO: 4618845 - DNA, 16 bp, Homo sapiens
gcagaacatactgttc

SEQ ID NO: 4618846 - DNA, 17 bp, Homo sapiens
gcagaacggtttttgga

SEQ ID NO: 4618847 - DNA, 17 bp, Homo sapiens
gcagaagagggggaggg

SEQ ID NO: 4618848 - DNA, 17 bp, Homo sapiens
gcagaagcttggaggag

SEQ ID NO: 4618849 - DNA, 15 bp, Homo sapiens
gcagaatgaagccat

SEQ ID NO: 4618850 - DNA, 17 bp, Homo sapiens
gcagacagaagtctcct

SEQ ID NO: 4618851 - DNA, 12 bp, Homo sapiens
gcagacctctgg

SEQ ID NO: 4618852 - DNA, 22 bp, Homo sapiens
gcagacctgtcaccctgcagga

SEQ ID NO: 4618853 - DNA, 22 bp, Homo sapiens
gcagagaacagaactggaggca

SEQ ID NO: 4618854 - DNA, 23 bp, Homo sapiens
gcagagaacagaactggaggcag

SEQ ID NO: 4618855 - DNA, 15 bp, Homo sapiens
gcagagaagccccgg

SEQ ID NO: 4618856 - DNA, 18 bp, Homo sapiens
gcagagatcgacagacag

SEQ ID NO: 4618857 - DNA, 23 bp, Homo sapiens
gcagagatcgacagacagccagg

SEQ ID NO: 4618858 - DNA, 15 bp, Homo sapiens
gcagagcagacaggc

SEQ ID NO: 4618859 - DNA, 17 bp, Homo sapiens
gcagagctctacaggcc

SEQ ID NO: 4618860 - DNA, 12 bp, Homo sapiens
gcagagggacaa

SEQ ID NO: 4618861 - DNA, 19 bp, Homo sapiens
gcagagggacaaccagaag

SEQ ID NO: 4618862 - DNA, 20 bp, Homo sapiens
gcagatgctagcacatgccc

SEQ ID NO: 4618863 - DNA, 17 bp, Homo sapiens
gcagatgtaggagggac

SEQ ID NO: 4618864 - DNA, 22 bp, Homo sapiens
gcagcaaggcccgagcagctga

SEQ ID NO: 4618865 - DNA, 18 bp, Homo sapiens
gcagcaccgttctgtgca

SEQ ID NO: 4618866 - DNA, 16 bp, Homo sapiens
gcagcacctccaggcc

SEQ ID NO: 4618867 - DNA, 17 bp, Homo sapiens
gcagcacctccaggcct

SEQ ID NO: 4618868 - DNA, 23 bp, Homo sapiens
gcagcactccccagagctgtgcc

SEQ ID NO: 4618869 - DNA, 22 bp, Homo sapiens
gcagcacttagacctgccagcc

SEQ ID NO: 4618870 - DNA, 23 bp, Homo sapiens
gcagcacttagacctgccagcca

SEQ ID NO: 4618871 - DNA, 13 bp, Homo sapiens
gcagcagagcctg

SEQ ID NO: 4618872 - DNA, 16 bp, Homo sapiens
gcagcagccagccctg

SEQ ID NO: 4618873 - DNA, 17 bp, Homo sapiens
gcagcagccagccctgc

SEQ ID NO: 4618874 - DNA, 22 bp, Homo sapiens
gcagcagccagccctgcctgga

SEQ ID NO: 4618875 - DNA, 23 bp, Homo sapiens
gcagcagccagccctgcctggag

SEQ ID NO: 4618876 - DNA, 15 bp, Homo sapiens
gcagcaggaggcttt

SEQ ID NO: 4618877 - DNA, 14 bp, Homo sapiens
gcagcatgcttggg

SEQ ID NO: 4618878 - DNA, 18 bp, Homo sapiens
gatgggccaggcagagaa

SEQ ID NO: 4618879 - DNA, 19 bp, Homo sapiens
gatgtccctgggccagggt

SEQ ID NO: 4618880 - DNA, 22 bp, Homo sapiens
gatgtccctgggccagggtctg

SEQ ID NO: 4618881 - DNA, 12 bp, Homo sapiens
gatgtgaagcca

SEQ ID NO: 4618882 - DNA, 15 bp, Homo sapiens
gatgtgacattccat

SEQ ID NO: 4618883 - DNA, 14 bp, Homo sapiens
gatgtgatcaggcc

SEQ ID NO: 4618884 - DNA, 15 bp, Homo sapiens
gatgtgatcaggccc

SEQ ID NO: 4618885 - DNA, 21 bp, Homo sapiens
gatgtggaggaagagccacct

SEQ ID NO: 4618886 - DNA, 23 bp, Homo sapiens
gatgttgtcttagcatggtacct

SEQ ID NO: 4618887 - DNA, 17 bp, Homo sapiens
gatgtttccctctcctt

SEQ ID NO: 4618888 - DNA, 21 bp, Homo sapiens
gatgttttacgtctgggagaa

SEQ ID NO: 4618889 - DNA, 23 bp, Homo sapiens
gatgttttagccattgttggctt

SEQ ID NO: 4618890 - DNA, 19 bp, Homo sapiens
gattaaacctttttataaa

SEQ ID NO: 4618891 - DNA, 18 bp, Homo sapiens
gattaaatatttgaagag

SEQ ID NO: 4618892 - DNA, 16 bp, Homo sapiens
gattaatgttttcatt

SEQ ID NO: 4618893 - DNA, 15 bp, Homo sapiens
gattacataatctgt

SEQ ID NO: 4618894 - DNA, 16 bp, Homo sapiens
gattacttgtaattat

SEQ ID NO: 4618895 - DNA, 20 bp, Homo sapiens
gattataaaattaatcacaa

SEQ ID NO: 4618896 - DNA, 12 bp, Homo sapiens
gattatcttgaa

SEQ ID NO: 4618897 - DNA, 16 bp, Homo sapiens
gattattttagctaaa

SEQ ID NO: 4618898 - DNA, 21 bp, Homo sapiens
gattattttctacacatacat

SEQ ID NO: 4618899 - DNA, 16 bp, Homo sapiens
gattcacttcacgctt

SEQ ID NO: 4618900 - DNA, 18 bp, Homo sapiens
gattcagattgttatcta

SEQ ID NO: 4618901 - DNA, 17 bp, Homo sapiens
gattcaggaaaaggcct

SEQ ID NO: 4618902 - DNA, 20 bp, Homo sapiens
gattcaggaaaaggcctggg

SEQ ID NO: 4618903 - DNA, 20 bp, Homo sapiens
gattcatggagtagcctgga

SEQ ID NO: 4618904 - DNA, 24 bp, Homo sapiens
gattcatggagtagcctggactgt

SEQ ID NO: 4618905 - DNA, 15 bp, Homo sapiens
gattcattctcataa

SEQ ID NO: 4618906 - DNA, 14 bp, Homo sapiens
gattccctctccca

SEQ ID NO: 4618907 - DNA, 19 bp, Homo sapiens
gattccctctcccaggccc

SEQ ID NO: 4618908 - DNA, 20 bp, Homo sapiens
gattccctctcccaggcccc

SEQ ID NO: 4618909 - DNA, 14 bp, Homo sapiens
gattcctctcattt

SEQ ID NO: 4618910 - DNA, 22 bp, Homo sapiens
gattcctctcatttccagcttc

SEQ ID NO: 4618911 - DNA, 16 bp, Homo sapiens
gattctctctttaacc

SEQ ID NO: 4618912 - DNA, 19 bp, Homo sapiens
gattgatttgggttttttt

SEQ ID NO: 4618913 - DNA, 18 bp, Homo sapiens
gattgctcccaggatctc

SEQ ID NO: 4618914 - DNA, 16 bp, Homo sapiens
gattgctggggccagg

SEQ ID NO: 4618915 - DNA, 18 bp, Homo sapiens
gattggaagaaacacgtg

SEQ ID NO: 4618916 - DNA, 23 bp, Homo sapiens
gattgtgtgactattcatggcta

SEQ ID NO: 4618917 - DNA, 21 bp, Homo sapiens
gatttaccaattcacccactc

SEQ ID NO: 4618918 - DNA, 20 bp, Homo sapiens
gatttagaggtaaaagtaca

SEQ ID NO: 4618919 - DNA, 21 bp, Homo sapiens
gatttagtgtttttacctctg

SEQ ID NO: 4618920 - DNA, 17 bp, Homo sapiens
gatttgggtttttttgt

SEQ ID NO: 4618921 - DNA, 23 bp, Homo sapiens
gatttgtgaaacagttgctgtga

SEQ ID NO: 4618922 - DNA, 14 bp, Homo sapiens
gattttaactctgt

SEQ ID NO: 4618923 - DNA, 22 bp, Homo sapiens
gattttaatagggaatatatct

SEQ ID NO: 4618924 - DNA, 19 bp, Homo sapiens
gattttcacattcttggct

SEQ ID NO: 4618925 - DNA, 20 bp, Homo sapiens
gattttggaactgtgtttca

SEQ ID NO: 4618926 - DNA, 23 bp, Homo sapiens
gatttttaaagtttaaataccag

SEQ ID NO: 4618927 - DNA, 15 bp, Homo sapiens
gatttttagaattaa

SEQ ID NO: 4618928 - DNA, 15 bp, Homo sapiens
gatttttgtcttgtg

SEQ ID NO: 4618929 - DNA, 18 bp, Homo sapiens
gattttttattattattc

SEQ ID NO: 4618930 - DNA, 16 bp, Homo sapiens
gatttttttcctcccc

SEQ ID NO: 4618931 - DNA, 13 bp, Homo sapiens
gatttttttgtaa

SEQ ID NO: 4618932 - DNA, 21 bp, Homo sapiens
gcaaaacagccctcagactgt

SEQ ID NO: 4618933 - DNA, 10 bp, Homo sapiens
gcaaaatatg

SEQ ID NO: 4618934 - DNA, 13 bp, Homo sapiens
gcaaaatatgttt

SEQ ID NO: 4618935 - DNA, 21 bp, Homo sapiens
gcaaaatcaacatgactggtg

SEQ ID NO: 4618936 - DNA, 16 bp, Homo sapiens
gcaaaatgtcttgtgt

SEQ ID NO: 4618937 - DNA, 14 bp, Homo sapiens
gcaaaattaaatct

SEQ ID NO: 4618938 - DNA, 22 bp, Homo sapiens
gcaaacacagcatgggtccaga

SEQ ID NO: 4618939 - DNA, 13 bp, Homo sapiens
gcaaacagaacag

SEQ ID NO: 4618940 - DNA, 14 bp, Homo sapiens
gcaaacagaacagg

SEQ ID NO: 4618941 - DNA, 14 bp, Homo sapiens
gcaaaccacttctc

SEQ ID NO: 4618942 - DNA, 16 bp, Homo sapiens
gcaaacgtccacaaag

SEQ ID NO: 4618943 - DNA, 18 bp, Homo sapiens
gcaaacttaatgttctta

SEQ ID NO: 4618944 - DNA, 15 bp, Homo sapiens
gcaaagcctttaaat

SEQ ID NO: 4618945 - DNA, 12 bp, Homo sapiens
gcaaaggagaag

SEQ ID NO: 4618946 - DNA, 13 bp, Homo sapiens
gcaaagtggcagg

SEQ ID NO: 4618947 - DNA, 14 bp, Homo sapiens
gcaaagtggcaggg

SEQ ID NO: 4618948 - DNA, 20 bp, Homo sapiens
gcaaagtggcagggaccggc

SEQ ID NO: 4618949 - DNA, 19 bp, Homo sapiens
gcaaataatttcctggtgt

SEQ ID NO: 4618950 - DNA, 15 bp, Homo sapiens
gcaaatcctatgtga

SEQ ID NO: 4618951 - DNA, 23 bp, Homo sapiens
gcaaatcctatgtgattttaact

SEQ ID NO: 4618952 - DNA, 20 bp, Homo sapiens
gcaacagaaaccaagagaca

SEQ ID NO: 4618953 - DNA, 22 bp, Homo sapiens
gcaacagatagatgttgctctt

SEQ ID NO: 4618954 - DNA, 12 bp, Homo sapiens
gcaacagggagc

SEQ ID NO: 4618955 - DNA, 21 bp, Homo sapiens
gcaacagggagcacctgtctg

SEQ ID NO: 4618956 - DNA, 14 bp, Homo sapiens
gcaacatcccatct

SEQ ID NO: 4618957 - DNA, 18 bp, Homo sapiens
gcaacattggacagaaaa

SEQ ID NO: 4618958 - DNA, 15 bp, Homo sapiens
gcaacccgtgccaag

SEQ ID NO: 4618959 - DNA, 19 bp, Homo sapiens
gcaacccgtgccaagtcca

SEQ ID NO: 4618960 - DNA, 18 bp, Homo sapiens
gcaaccgcctcaaaatgt

SEQ ID NO: 4618961 - DNA, 19 bp, Homo sapiens
gcaaccgtggcccttcctg

SEQ ID NO: 4618962 - DNA, 21 bp, Homo sapiens
gcaaccgtggcccttcctgga

SEQ ID NO: 4618963 - DNA, 22 bp, Homo sapiens
gcaaccgtggcccttcctggac

SEQ ID NO: 4618964 - DNA, 13 bp, Homo sapiens
gcaacctctgcct

SEQ ID NO: 4618965 - DNA, 23 bp, Homo sapiens
gcaacctcttggcctgatcagac

SEQ ID NO: 4618966 - DNA, 15 bp, Homo sapiens
gcaacggccccagcg

SEQ ID NO: 4618967 - DNA, 17 bp, Homo sapiens
gcaacttccgctgaggg

SEQ ID NO: 4618968 - DNA, 18 bp, Homo sapiens
gcaacttccgctgagggg

SEQ ID NO: 4618969 - DNA, 14 bp, Homo sapiens
gcaagacctcatct

SEQ ID NO: 4618970 - DNA, 18 bp, Homo sapiens
gcaagacctcatctgtgg

SEQ ID NO: 4618971 - DNA, 21 bp, Homo sapiens
gcaagacctcatctgtggagc

SEQ ID NO: 4618972 - DNA, 17 bp, Homo sapiens
gcaagccctgcccacag

SEQ ID NO: 4618973 - DNA, 18 bp, Homo sapiens
gcaagccctgcccacaga

SEQ ID NO: 4618974 - DNA, 12 bp, Homo sapiens
gcaagctttgct

SEQ ID NO: 4618975 - DNA, 16 bp, Homo sapiens
gcaaggcccgagcagc

SEQ ID NO: 4618976 - DNA, 17 bp, Homo sapiens
gcaaggcccgagcagct

SEQ ID NO: 4618977 - DNA, 18 bp, Homo sapiens
gcaaggcccgagcagctg

SEQ ID NO: 4618978 - DNA, 24 bp, Homo sapiens
gcaaggcccgagcagctgagcagg

SEQ ID NO: 4618979 - DNA, 13 bp, Homo sapiens
gcaagtgcctggg

SEQ ID NO: 4618980 - DNA, 15 bp, Homo sapiens
gcaagttcatgtgtg

SEQ ID NO: 4618981 - DNA, 13 bp, Homo sapiens
gcaataaagaaga

SEQ ID NO: 4618982 - DNA, 17 bp, Homo sapiens
gcaataactgaaaatga

SEQ ID NO: 4618983 - DNA, 13 bp, Homo sapiens
gcaatcattttat

SEQ ID NO: 4618984 - DNA, 16 bp, Homo sapiens
gcaatcattttatgct

SEQ ID NO: 4618985 - DNA, 20 bp, Homo sapiens
gcaatcattttatgctgttt

SEQ ID NO: 4618986 - DNA, 16 bp, Homo sapiens
gcaatgtggcaaactg

SEQ ID NO: 4618987 - DNA, 19 bp, Homo sapiens
gcaatttaactagacacag

SEQ ID NO: 4618988 - DNA, 17 bp, Homo sapiens
gcacaatcactaaactt

SEQ ID NO: 4618989 - DNA, 16 bp, Homo sapiens
gccagatttgtctttt

SEQ ID NO: 4618990 - DNA, 14 bp, Homo sapiens
gccagcaacgcttg

SEQ ID NO: 4618991 - DNA, 12 bp, Homo sapiens
gccagcacacag

SEQ ID NO: 4618992 - DNA, 17 bp, Homo sapiens
gccagcaggaataaaga

SEQ ID NO: 4618993 - DNA, 19 bp, Homo sapiens
gccagcaggaataaagact

SEQ ID NO: 4618994 - DNA, 19 bp, Homo sapiens
gccagcaggggggctgtgc

SEQ ID NO: 4618995 - DNA, 21 bp, Homo sapiens
gccagcaggggggctgtgcca

SEQ ID NO: 4618996 - DNA, 9 bp, Homo sapiens
gccagccac

SEQ ID NO: 4618997 - DNA, 11 bp, Homo sapiens
gccagccacag

SEQ ID NO: 4618998 - DNA, 14 bp, Homo sapiens
gccagccacagacc

SEQ ID NO: 4618999 - DNA, 15 bp, Homo sapiens
gccagccacagaccc

SEQ ID NO: 4619000 - DNA, 15 bp, Homo sapiens
gccagccacaggacc

SEQ ID NO: 4619001 - DNA, 19 bp, Homo sapiens
gccagccacaggaccacct

SEQ ID NO: 4619002 - DNA, 14 bp, Homo sapiens
gccagcccctggcc

SEQ ID NO: 4619003 - DNA, 14 bp, Homo sapiens
gccagccctgcctg

SEQ ID NO: 4619004 - DNA, 20 bp, Homo sapiens
gccagccctgcctggaggac

SEQ ID NO: 4619005 - DNA, 23 bp, Homo sapiens
gccagccctgcctggaggacctg

SEQ ID NO: 4619006 - DNA, 15 bp, Homo sapiens
gccagcctgaggtgc

SEQ ID NO: 4619007 - DNA, 16 bp, Homo sapiens
gccagcctgaggtgcc

SEQ ID NO: 4619008 - DNA, 19 bp, Homo sapiens
gccagcctgaggtgcccac

SEQ ID NO: 4619009 - DNA, 21 bp, Homo sapiens
gccagcctgaggtgcccactc

SEQ ID NO: 4619010 - DNA, 23 bp, Homo sapiens
gccagcctggcctcctgcctcta

SEQ ID NO: 4619011 - DNA, 18 bp, Homo sapiens
gccaggagcagccctggc

SEQ ID NO: 4619012 - DNA, 15 bp, Homo sapiens
gccaggagtggggag

SEQ ID NO: 4619013 - DNA, 12 bp, Homo sapiens
gccaggatgccc

SEQ ID NO: 4619014 - DNA, 22 bp, Homo sapiens
gccaggatggaacacggccaca

SEQ ID NO: 4619015 - DNA, 15 bp, Homo sapiens
gccaggccccacccc

SEQ ID NO: 4619016 - DNA, 15 bp, Homo sapiens
gccaggccccatgga

SEQ ID NO: 4619017 - DNA, 20 bp, Homo sapiens
gccaggcctgggtgatctgc

SEQ ID NO: 4619018 - DNA, 16 bp, Homo sapiens
gccaggctgaccacag

SEQ ID NO: 4619019 - DNA, 20 bp, Homo sapiens
gccaggctgaccacagcaca

SEQ ID NO: 4619020 - DNA, 11 bp, Homo sapiens
gccaggctggt

SEQ ID NO: 4619021 - DNA, 13 bp, Homo sapiens
gccagggcctgcg

SEQ ID NO: 4619022 - DNA, 16 bp, Homo sapiens
gccagggcctgcgagg

SEQ ID NO: 4619023 - DNA, 19 bp, Homo sapiens
gccagggctggggacagag

SEQ ID NO: 4619024 - DNA, 19 bp, Homo sapiens
gccagggtctctccctcag

SEQ ID NO: 4619025 - DNA, 20 bp, Homo sapiens
gccagggtctctccctcagg

SEQ ID NO: 4619026 - DNA, 19 bp, Homo sapiens
gccagggtctgtgtgaatg

SEQ ID NO: 4619027 - DNA, 22 bp, Homo sapiens
gccagggtctgtgtgaatgtgg

SEQ ID NO: 4619028 - DNA, 14 bp, Homo sapiens
gccaggtactgcat

SEQ ID NO: 4619029 - DNA, 22 bp, Homo sapiens
gccaggtagttggaactttctg

SEQ ID NO: 4619030 - DNA, 18 bp, Homo sapiens
gccaggtgcaaccaggga

SEQ ID NO: 4619031 - DNA, 17 bp, Homo sapiens
gccagtctcattgtcac

SEQ ID NO: 4619032 - DNA, 15 bp, Homo sapiens
gccagtggggcctgt

SEQ ID NO: 4619033 - DNA, 19 bp, Homo sapiens
gccagtggggcctgtggaa

SEQ ID NO: 4619034 - DNA, 21 bp, Homo sapiens
gccagtggggcctgtggaatg

SEQ ID NO: 4619035 - DNA, 11 bp, Homo sapiens
gccagtgtttc

SEQ ID NO: 4619036 - DNA, 12 bp, Homo sapiens
gccagtgtttct

SEQ ID NO: 4619037 - DNA, 17 bp, Homo sapiens
gccagtgtttctgaatg

SEQ ID NO: 4619038 - DNA, 15 bp, Homo sapiens
gccataattatgaaa

SEQ ID NO: 4619039 - DNA, 16 bp, Homo sapiens
gccataattatgaaaa

SEQ ID NO: 4619040 - DNA, 22 bp, Homo sapiens
gccataccttctcccaggcctc

SEQ ID NO: 4619041 - DNA, 22 bp, Homo sapiens
gccatattgtcacctcagcact

SEQ ID NO: 4619042 - DNA, 17 bp, Homo sapiens
gccatatttactacctt

SEQ ID NO: 4619043 - DNA, 15 bp, Homo sapiens
gccatcatcctcccg

SEQ ID NO: 4619044 - DNA, 19 bp, Homo sapiens
gccatctcacctcctgctg

SEQ ID NO: 4619045 - DNA, 20 bp, Homo sapiens
gccatctcacctcctgctgg

SEQ ID NO: 4619046 - DNA, 21 bp, Homo sapiens
gccatctcacctcctgctggg

SEQ ID NO: 4619047 - DNA, 17 bp, Homo sapiens
gccatctcagcttgctg

SEQ ID NO: 4619048 - DNA, 17 bp, Homo sapiens
gccatctgactgccaag

SEQ ID NO: 4619049 - DNA, 19 bp, Homo sapiens
gccatctgactgccaagcc

SEQ ID NO: 4619050 - DNA, 16 bp, Homo sapiens
gccatgaaccaaatgg

SEQ ID NO: 4619051 - DNA, 22 bp, Homo sapiens
gccatgatggcaacagaaacca

SEQ ID NO: 4619052 - DNA, 13 bp, Homo sapiens
gccatgctgggcc

SEQ ID NO: 4619053 - DNA, 17 bp, Homo sapiens
gccattctccacagcaa

SEQ ID NO: 4619054 - DNA, 19 bp, Homo sapiens
gccattctgcatgagctga

SEQ ID NO: 4619055 - DNA, 21 bp, Homo sapiens
gccattttggggggttattta

SEQ ID NO: 4619056 - DNA, 16 bp, Homo sapiens
gccattttggtgctta

SEQ ID NO: 4619057 - DNA, 17 bp, Homo sapiens
gcccaaagcctgaggac

SEQ ID NO: 4619058 - DNA, 20 bp, Homo sapiens
gcccaaagcctgaggacaga

SEQ ID NO: 4619059 - DNA, 20 bp, Homo sapiens
gcccaaagcttgtaaatatg

SEQ ID NO: 4619060 - DNA, 21 bp, Homo sapiens
gcccacagaaagccaggagca

SEQ ID NO: 4619061 - DNA, 13 bp, Homo sapiens
gcccacctcagcc

SEQ ID NO: 4619062 - DNA, 21 bp, Homo sapiens
gcccactccgccagccacagg

SEQ ID NO: 4619063 - DNA, 14 bp, Homo sapiens
gcccagagaacagc

SEQ ID NO: 4619064 - DNA, 13 bp, Homo sapiens
gcccagagcctgg

SEQ ID NO: 4619065 - DNA, 22 bp, Homo sapiens
gcccagaggagcccagcggccc

SEQ ID NO: 4619066 - DNA, 17 bp, Homo sapiens
gcccagatgaactgact

SEQ ID NO: 4619067 - DNA, 21 bp, Homo sapiens
gcccagatgttttacgtctgg

SEQ ID NO: 4619068 - DNA, 20 bp, Homo sapiens
gcccagcctcacttcctttg

SEQ ID NO: 4619069 - DNA, 14 bp, Homo sapiens
gcccagcggcccaa

SEQ ID NO: 4619070 - DNA, 21 bp, Homo sapiens
gcccagcggcttgcctgcctg

SEQ ID NO: 4619071 - DNA, 23 bp, Homo sapiens
gcccagctggcctggcccccagc

SEQ ID NO: 4619072 - DNA, 18 bp, Homo sapiens
gcccagctgggtcaggca

SEQ ID NO: 4619073 - DNA, 17 bp, Homo sapiens
gcccaggatactggcac

SEQ ID NO: 4619074 - DNA, 12 bp, Homo sapiens
gcccaggcaagg

SEQ ID NO: 4619075 - DNA, 18 bp, Homo sapiens
gcccaggcaaggaacaga

SEQ ID NO: 4619076 - DNA, 20 bp, Homo sapiens
gcccaggctggagtgcagtg

SEQ ID NO: 4619077 - DNA, 12 bp, Homo sapiens
gcccagggaggc

SEQ ID NO: 4619078 - DNA, 23 bp, Homo sapiens
gcccaggtatcctgggggaagag

SEQ ID NO: 4619079 - DNA, 23 bp, Homo sapiens
gcccaggtgagggaaggagacag

SEQ ID NO: 4619080 - DNA, 16 bp, Homo sapiens
gcccagtgttttcttt

SEQ ID NO: 4619081 - DNA, 21 bp, Homo sapiens
gcccagtgttttctttgagga

SEQ ID NO: 4619082 - DNA, 18 bp, Homo sapiens
gcccagttcatcaccatt

SEQ ID NO: 4619083 - DNA, 22 bp, Homo sapiens
gcccatccattaggccagcaac

SEQ ID NO: 4619084 - DNA, 20 bp, Homo sapiens
gcccatggacaggctggctc

SEQ ID NO: 4619085 - DNA, 23 bp, Homo sapiens
gcccatggacaggctggctccag

SEQ ID NO: 4619086 - DNA, 19 bp, Homo sapiens
gcccatggaggcagatgcc

SEQ ID NO: 4619087 - DNA, 23 bp, Homo sapiens
gcccatggaggcagatgcccttg

SEQ ID NO: 4619088 - DNA, 15 bp, Homo sapiens
gcccatggcttctgg

SEQ ID NO: 4619089 - DNA, 21 bp, Homo sapiens
gcccatgtgtacattctgcct

SEQ ID NO: 4619090 - DNA, 15 bp, Homo sapiens
gcccattaatcttga

SEQ ID NO: 4619091 - DNA, 15 bp, Homo sapiens
gcccattgctgccaa

SEQ ID NO: 4619092 - DNA, 17 bp, Homo sapiens
gccccaacccgtggagg

SEQ ID NO: 4619093 - DNA, 14 bp, Homo sapiens
gccccaactccttc

SEQ ID NO: 4619094 - DNA, 18 bp, Homo sapiens
gccccaactccttccagc

SEQ ID NO: 4619095 - DNA, 19 bp, Homo sapiens
gccccaactccttccagct

SEQ ID NO: 4619096 - DNA, 23 bp, Homo sapiens
gccccaagagcaggaggtgcctg

SEQ ID NO: 4619097 - DNA, 15 bp, Homo sapiens
gccccacaaggcctg

SEQ ID NO: 4619098 - DNA, 15 bp, Homo sapiens
gccccaccccttccc

SEQ ID NO: 4619099 - DNA, 18 bp, Homo sapiens
gccccacgttgtccctga

SEQ ID NO: 4619100 - DNA, 23 bp, Homo sapiens
gcagcatgcttgggctgacccag

SEQ ID NO: 4619101 - DNA, 13 bp, Homo sapiens
gcagcattgaagt

SEQ ID NO: 4619102 - DNA, 21 bp, Homo sapiens
gcagccaccctgaggagtctg

SEQ ID NO: 4619103 - DNA, 11 bp, Homo sapiens
gcagccagccc

SEQ ID NO: 4619104 - DNA, 13 bp, Homo sapiens
gcagccagccctg

SEQ ID NO: 4619105 - DNA, 16 bp, Homo sapiens
gcagccagccctgcct

SEQ ID NO: 4619106 - DNA, 17 bp, Homo sapiens
gcagccagccctgcctg

SEQ ID NO: 4619107 - DNA, 18 bp, Homo sapiens
gcagccagccctgcctgg

SEQ ID NO: 4619108 - DNA, 21 bp, Homo sapiens
gcagccagccctgcctggagg

SEQ ID NO: 4619109 - DNA, 13 bp, Homo sapiens
gcagcccaaggac

SEQ ID NO: 4619110 - DNA, 15 bp, Homo sapiens
gcagcccaaggacag

SEQ ID NO: 4619111 - DNA, 20 bp, Homo sapiens
gcagcccaaggacagttcag

SEQ ID NO: 4619112 - DNA, 23 bp, Homo sapiens
gcagcccaaggacagttcagaga

SEQ ID NO: 4619113 - DNA, 23 bp, Homo sapiens
gcagcccctgttttctgctgttt

SEQ ID NO: 4619114 - DNA, 21 bp, Homo sapiens
gcagcctcaaaacgggtcagt

SEQ ID NO: 4619115 - DNA, 21 bp, Homo sapiens
gcagcctcccatccagggccc

SEQ ID NO: 4619116 - DNA, 18 bp, Homo sapiens
gcagcctggacatagaga

SEQ ID NO: 4619117 - DNA, 14 bp, Homo sapiens
gcagcctggggctg

SEQ ID NO: 4619118 - DNA, 18 bp, Homo sapiens
gcagcgcccttcctctcc

SEQ ID NO: 4619119 - DNA, 14 bp, Homo sapiens
gcagcgggcggagg

SEQ ID NO: 4619120 - DNA, 15 bp, Homo sapiens
gcagctccaccactg

SEQ ID NO: 4619121 - DNA, 19 bp, Homo sapiens
gcagctccaccactgtgca

SEQ ID NO: 4619122 - DNA, 12 bp, Homo sapiens
gcagctgagcag

SEQ ID NO: 4619123 - DNA, 18 bp, Homo sapiens
gcagctgagcagggccgg

SEQ ID NO: 4619124 - DNA, 21 bp, Homo sapiens
gcagctgagcagggccgggga

SEQ ID NO: 4619125 - DNA, 23 bp, Homo sapiens
gcagctggaaaagggtcttggga

SEQ ID NO: 4619126 - DNA, 21 bp, Homo sapiens
gcagcttcaacttttctcttt

SEQ ID NO: 4619127 - DNA, 17 bp, Homo sapiens
gcagcttgtagccagcc

SEQ ID NO: 4619128 - DNA, 19 bp, Homo sapiens
gcagcttgtagccagccgg

SEQ ID NO: 4619129 - DNA, 16 bp, Homo sapiens
gcaggaacaaacaggg

SEQ ID NO: 4619130 - DNA, 18 bp, Homo sapiens
gcaggaacaaacagggct

SEQ ID NO: 4619131 - DNA, 20 bp, Homo sapiens
gcaggaacttctagctcatt

SEQ ID NO: 4619132 - DNA, 13 bp, Homo sapiens
gcaggaataaaga

SEQ ID NO: 4619133 - DNA, 16 bp, Homo sapiens
gcaggaccaggtggca

SEQ ID NO: 4619134 - DNA, 17 bp, Homo sapiens
gcaggaccaggtggcac

SEQ ID NO: 4619135 - DNA, 14 bp, Homo sapiens
gcaggactgtgcct

SEQ ID NO: 4619136 - DNA, 16 bp, Homo sapiens
gcaggagccccgccac

SEQ ID NO: 4619137 - DNA, 19 bp, Homo sapiens
gcaggagctactgagaaca

SEQ ID NO: 4619138 - DNA, 22 bp, Homo sapiens
gcaggaggctttctgggctctg

SEQ ID NO: 4619139 - DNA, 15 bp, Homo sapiens
gcaggagtagctgag

SEQ ID NO: 4619140 - DNA, 18 bp, Homo sapiens
gcaggagtagctgagctc

SEQ ID NO: 4619141 - DNA, 21 bp, Homo sapiens
gcaggagtgtcctgcccatgc

SEQ ID NO: 4619142 - DNA, 19 bp, Homo sapiens
gcaggcaatgctgtacttt

SEQ ID NO: 4619143 - DNA, 16 bp, Homo sapiens
gcaggcaccgccacgt

SEQ ID NO: 4619144 - DNA, 13 bp, Homo sapiens
gcaggcagcgcca

SEQ ID NO: 4619145 - DNA, 13 bp, Homo sapiens
gcaggcagggctc

SEQ ID NO: 4619146 - DNA, 14 bp, Homo sapiens
gcaggcagggctct

SEQ ID NO: 4619147 - DNA, 13 bp, Homo sapiens
gcaggcatttctg

SEQ ID NO: 4619148 - DNA, 15 bp, Homo sapiens
gcaggccgggcctgc

SEQ ID NO: 4619149 - DNA, 14 bp, Homo sapiens
gcaggctagacaga

SEQ ID NO: 4619150 - DNA, 13 bp, Homo sapiens
gcagggaaggaca

SEQ ID NO: 4619151 - DNA, 12 bp, Homo sapiens
gcagggcagcag

SEQ ID NO: 4619152 - DNA, 20 bp, Homo sapiens
gcagggcccacgtgtatagt

SEQ ID NO: 4619153 - DNA, 20 bp, Homo sapiens
gcagggccggggaactggcc

SEQ ID NO: 4619154 - DNA, 12 bp, Homo sapiens
gcagggctctcc

SEQ ID NO: 4619155 - DNA, 20 bp, Homo sapiens
gcagggctggtcacctccca

SEQ ID NO: 4619156 - DNA, 22 bp, Homo sapiens
gcagggctggtcacctcccatc

SEQ ID NO: 4619157 - DNA, 19 bp, Homo sapiens
gcaggggagggtcagccag

SEQ ID NO: 4619158 - DNA, 15 bp, Homo sapiens
gcagggggccccgcc

SEQ ID NO: 4619159 - DNA, 20 bp, Homo sapiens
gcagggggccccgccagggc

SEQ ID NO: 4619160 - DNA, 23 bp, Homo sapiens
gcagggggccccgccagggctgg

SEQ ID NO: 4619161 - DNA, 20 bp, Homo sapiens
gcaggggtgacggccctcat

SEQ ID NO: 4619162 - DNA, 15 bp, Homo sapiens
gcagggtcaagcctc

SEQ ID NO: 4619163 - DNA, 15 bp, Homo sapiens
gcagggtcttttcat

SEQ ID NO: 4619164 - DNA, 16 bp, Homo sapiens
gcagggtcttttcatc

SEQ ID NO: 4619165 - DNA, 22 bp, Homo sapiens
gcaggtatttagaagcagaggg

SEQ ID NO: 4619166 - DNA, 19 bp, Homo sapiens
gcaggtatttcagaaggag

SEQ ID NO: 4619167 - DNA, 23 bp, Homo sapiens
gcaggtatttcagaaggagaagg

SEQ ID NO: 4619168 - DNA, 20 bp, Homo sapiens
gcagtcactgggagaggtta

SEQ ID NO: 4619169 - DNA, 19 bp, Homo sapiens
gcagtctttcccccaggaa

SEQ ID NO: 4619170 - DNA, 13 bp, Homo sapiens
gcagtggcagaga

SEQ ID NO: 4619171 - DNA, 20 bp, Homo sapiens
gcagtggccatcatcctccc

SEQ ID NO: 4619172 - DNA, 19 bp, Homo sapiens
gcagtggcgcattctaggc

SEQ ID NO: 4619173 - DNA, 19 bp, Homo sapiens
gcagtggggtcaagctgag

SEQ ID NO: 4619174 - DNA, 14 bp, Homo sapiens
gcagtggtgcgatc

SEQ ID NO: 4619175 - DNA, 19 bp, Homo sapiens
gcagtgtgaagtacaataa

SEQ ID NO: 4619176 - DNA, 17 bp, Homo sapiens
gcagttcgcagccaccc

SEQ ID NO: 4619177 - DNA, 18 bp, Homo sapiens
gcagttcgcagccaccct

SEQ ID NO: 4619178 - DNA, 13 bp, Homo sapiens
gcagttgaggtgg

SEQ ID NO: 4619179 - DNA, 21 bp, Homo sapiens
gcagttgaggtggggtagtgc

SEQ ID NO: 4619180 - DNA, 16 bp, Homo sapiens
gcagttgatgtgtctt

SEQ ID NO: 4619181 - DNA, 13 bp, Homo sapiens
gcagttgcttgtg

SEQ ID NO: 4619182 - DNA, 14 bp, Homo sapiens
gcataatctgaaaa

SEQ ID NO: 4619183 - DNA, 15 bp, Homo sapiens
gcatacgcctcttgt

SEQ ID NO: 4619184 - DNA, 21 bp, Homo sapiens
gcatacttcaaaactgtttgt

SEQ ID NO: 4619185 - DNA, 16 bp, Homo sapiens
gcatactttgtaaata

SEQ ID NO: 4619186 - DNA, 19 bp, Homo sapiens
gcatagagtaggtactcca

SEQ ID NO: 4619187 - DNA, 19 bp, Homo sapiens
gcatattgttggcacagaa

SEQ ID NO: 4619188 - DNA, 13 bp, Homo sapiens
gcatatttataag

SEQ ID NO: 4619189 - DNA, 15 bp, Homo sapiens
gcatatttataagag

SEQ ID NO: 4619190 - DNA, 16 bp, Homo sapiens
gcatatttataagaga

SEQ ID NO: 4619191 - DNA, 20 bp, Homo sapiens
gcatattttcttacttttat

SEQ ID NO: 4619192 - DNA, 17 bp, Homo sapiens
gcatcacatctgcacac

SEQ ID NO: 4619193 - DNA, 22 bp, Homo sapiens
gcatcagaaagggagggctctg

SEQ ID NO: 4619194 - DNA, 20 bp, Homo sapiens
gcatcagaaatcctctgtta

SEQ ID NO: 4619195 - DNA, 22 bp, Homo sapiens
gcatcagaaatcctctgttaat

SEQ ID NO: 4619196 - DNA, 13 bp, Homo sapiens
gcatcatgcctct

SEQ ID NO: 4619197 - DNA, 15 bp, Homo sapiens
gcatcatgcctctga

SEQ ID NO: 4619198 - DNA, 16 bp, Homo sapiens
gcatcatgcctctgag

SEQ ID NO: 4619199 - DNA, 19 bp, Homo sapiens
gcatccacgtagggggcag

SEQ ID NO: 4619200 - DNA, 14 bp, Homo sapiens
gcatccagcagcag

SEQ ID NO: 4619201 - DNA, 16 bp, Homo sapiens
gcatccctggagcagg

SEQ ID NO: 4619202 - DNA, 20 bp, Homo sapiens
gcatccctggagcaggagcc

SEQ ID NO: 4619203 - DNA, 20 bp, Homo sapiens
gcatcctcagttcctgcagc

SEQ ID NO: 4619204 - DNA, 20 bp, Homo sapiens
gcatcctgcccgagggcagc

SEQ ID NO: 4619205 - DNA, 21 bp, Homo sapiens
gcatcctgcccgagggcagcc

SEQ ID NO: 4619206 - DNA, 13 bp, Homo sapiens
gcatctgtctgct

SEQ ID NO: 4619207 - DNA, 12 bp, Homo sapiens
gcatgaaatttt

SEQ ID NO: 4619208 - DNA, 21 bp, Homo sapiens
gcatgaccacccctctcgcct

SEQ ID NO: 4619209 - DNA, 14 bp, Homo sapiens
gcatgactgtcgcc

SEQ ID NO: 4619210 - DNA, 11 bp, Homo sapiens
gcatgagctga

SEQ ID NO: 4619211 - DNA, 16 bp, Homo sapiens
gcatgagtctgtttcc

SEQ ID NO: 4619212 - DNA, 22 bp, Homo sapiens
gcatgcttgggctgacccagca

SEQ ID NO: 4619213 - DNA, 23 bp, Homo sapiens
gcatgggtccagaagacgtggtc

SEQ ID NO: 4619214 - DNA, 19 bp, Homo sapiens
gcatggtcccacatccctg

SEQ ID NO: 4619215 - DNA, 14 bp, Homo sapiens
gcatgtatgtcttg

SEQ ID NO: 4619216 - DNA, 17 bp, Homo sapiens
gcatgtcttttaaaatg

SEQ ID NO: 4619217 - DNA, 20 bp, Homo sapiens
gcatgtgactctgaagctga

SEQ ID NO: 4619218 - DNA, 13 bp, Homo sapiens
gcatgttcctcct

SEQ ID NO: 4619219 - DNA, 14 bp, Homo sapiens
gcatgttcctcctt

SEQ ID NO: 4619220 - DNA, 23 bp, Homo sapiens
gcatgttcctccttttcttcacc

SEQ ID NO: 4619221 - DNA, 14 bp, Homo sapiens
gcatgtttaatgtg

SEQ ID NO: 4619222 - DNA, 18 bp, Homo sapiens
gcattacttgctttcaat

SEQ ID NO: 4619223 - DNA, 18 bp, Homo sapiens
gcattatccttttatctc

SEQ ID NO: 4619224 - DNA, 14 bp, Homo sapiens
gcattatcttgctc

SEQ ID NO: 4619225 - DNA, 21 bp, Homo sapiens
gcattattctcttttatctgt

SEQ ID NO: 4619226 - DNA, 14 bp, Homo sapiens
gcattcatttttat

SEQ ID NO: 4619227 - DNA, 18 bp, Homo sapiens
gcattcatttttatagca

SEQ ID NO: 4619228 - DNA, 17 bp, Homo sapiens
gcattctctcccatcct

SEQ ID NO: 4619229 - DNA, 17 bp, Homo sapiens
gcattctggcataattt

SEQ ID NO: 4619230 - DNA, 22 bp, Homo sapiens
gcattgacataggtcataaagc

SEQ ID NO: 4619231 - DNA, 16 bp, Homo sapiens
gcattgacctggaggg

SEQ ID NO: 4619232 - DNA, 22 bp, Homo sapiens
gcattgactttcagtaaacata

SEQ ID NO: 4619233 - DNA, 13 bp, Homo sapiens
gcattgctttctg

SEQ ID NO: 4619234 - DNA, 18 bp, Homo sapiens
gcattgtgaactgacagg

SEQ ID NO: 4619235 - DNA, 16 bp, Homo sapiens
gcatttcataaactaa

SEQ ID NO: 4619236 - DNA, 12 bp, Homo sapiens
gcatttcctgct

SEQ ID NO: 4619237 - DNA, 14 bp, Homo sapiens
gcatttcctgctga

SEQ ID NO: 4619238 - DNA, 14 bp, Homo sapiens
gcatttcctgggtg

SEQ ID NO: 4619239 - DNA, 14 bp, Homo sapiens
gcatttgagcagct

SEQ ID NO: 4619240 - DNA, 17 bp, Homo sapiens
gcatttgtgctagaaat

SEQ ID NO: 4619241 - DNA, 17 bp, Homo sapiens
gccaaaattcatttcta

SEQ ID NO: 4619242 - DNA, 15 bp, Homo sapiens
gccaaacaaaactga

SEQ ID NO: 4619243 - DNA, 18 bp, Homo sapiens
gccaaacatggccagact

SEQ ID NO: 4619244 - DNA, 20 bp, Homo sapiens
gccaaacatggccagactcc

SEQ ID NO: 4619245 - DNA, 17 bp, Homo sapiens
gccaaacccttgctttc

SEQ ID NO: 4619246 - DNA, 20 bp, Homo sapiens
gccaaacccttgctttcctg

SEQ ID NO: 4619247 - DNA, 23 bp, Homo sapiens
gccaaacccttgctttcctgggc

SEQ ID NO: 4619248 - DNA, 16 bp, Homo sapiens
gccaaacctctgttca

SEQ ID NO: 4619249 - DNA, 17 bp, Homo sapiens
gccaaccagcccgacag

SEQ ID NO: 4619250 - DNA, 22 bp, Homo sapiens
gccaacctgttcttagagtgta

SEQ ID NO: 4619251 - DNA, 23 bp, Homo sapiens
gccaaccttgctcttggggaagg

SEQ ID NO: 4619252 - DNA, 14 bp, Homo sapiens
gccaactcctcaca

SEQ ID NO: 4619253 - DNA, 17 bp, Homo sapiens
gccaactgctaatgcaa

SEQ ID NO: 4619254 - DNA, 19 bp, Homo sapiens
gccaactgtttccctgctg

SEQ ID NO: 4619255 - DNA, 22 bp, Homo sapiens
gccaactgtttccctgctgaat

SEQ ID NO: 4619256 - DNA, 23 bp, Homo sapiens
gccaagattttcctcttgtgatt

SEQ ID NO: 4619257 - DNA, 11 bp, Homo sapiens
gccaagccaga

SEQ ID NO: 4619258 - DNA, 15 bp, Homo sapiens
gccaagccagattct

SEQ ID NO: 4619259 - DNA, 20 bp, Homo sapiens
gccaagccagattctcttga

SEQ ID NO: 4619260 - DNA, 22 bp, Homo sapiens
gccaagccagattctcttgaat

SEQ ID NO: 4619261 - DNA, 23 bp, Homo sapiens
gccaagctgaggtgcccaggaga

SEQ ID NO: 4619262 - DNA, 14 bp, Homo sapiens
gccaaggtgccacc

SEQ ID NO: 4619263 - DNA, 19 bp, Homo sapiens
gccaaggtggagggaagga

SEQ ID NO: 4619264 - DNA, 16 bp, Homo sapiens
gccaagtaaacagggt

SEQ ID NO: 4619265 - DNA, 20 bp, Homo sapiens
gccaagtaaacagggtacct

SEQ ID NO: 4619266 - DNA, 15 bp, Homo sapiens
gccaagtccaggtcc

SEQ ID NO: 4619267 - DNA, 17 bp, Homo sapiens
gccaagtccaggtcctg

SEQ ID NO: 4619268 - DNA, 22 bp, Homo sapiens
gccaagtccaggtcctggtggg

SEQ ID NO: 4619269 - DNA, 18 bp, Homo sapiens
gccaagtgcgtgccgtgt

SEQ ID NO: 4619270 - DNA, 12 bp, Homo sapiens
gccaagttctta

SEQ ID NO: 4619271 - DNA, 17 bp, Homo sapiens
gccaattcagacaggca

SEQ ID NO: 4619272 - DNA, 22 bp, Homo sapiens
gccacaagctgcactgtgaacc

SEQ ID NO: 4619273 - DNA, 15 bp, Homo sapiens
gccacacgcctctgt

SEQ ID NO: 4619274 - DNA, 16 bp, Homo sapiens
gccacacgcctctgtg

SEQ ID NO: 4619275 - DNA, 17 bp, Homo sapiens
gccacacgcctctgtgt

SEQ ID NO: 4619276 - DNA, 16 bp, Homo sapiens
gccacactcagcacaa

SEQ ID NO: 4619277 - DNA, 18 bp, Homo sapiens
gccacacttcgctcttga

SEQ ID NO: 4619278 - DNA, 22 bp, Homo sapiens
gccacacttctcaggacacagg

SEQ ID NO: 4619279 - DNA, 15 bp, Homo sapiens
gccacagacaactca

SEQ ID NO: 4619280 - DNA, 20 bp, Homo sapiens
gccacagacccctgggagct

SEQ ID NO: 4619281 - DNA, 12 bp, Homo sapiens
gccacagccttc

SEQ ID NO: 4619282 - DNA, 14 bp, Homo sapiens
gccacagccttccc

SEQ ID NO: 4619283 - DNA, 15 bp, Homo sapiens
gccacagccttccct

SEQ ID NO: 4619284 - DNA, 19 bp, Homo sapiens
gccacagccttccctctgc

SEQ ID NO: 4619285 - DNA, 23 bp, Homo sapiens
gccacagccttcggacagacata

SEQ ID NO: 4619286 - DNA, 11 bp, Homo sapiens
gccacaggacc

SEQ ID NO: 4619287 - DNA, 15 bp, Homo sapiens
gccacaggaccacct

SEQ ID NO: 4619288 - DNA, 17 bp, Homo sapiens
gccacaggaccacctcc

SEQ ID NO: 4619289 - DNA, 15 bp, Homo sapiens
gccacagtagaactg

SEQ ID NO: 4619290 - DNA, 16 bp, Homo sapiens
gccacattgggcagcg

SEQ ID NO: 4619291 - DNA, 14 bp, Homo sapiens
gccaccccaacctc

SEQ ID NO: 4619292 - DNA, 16 bp, Homo sapiens
gccaccctgaggagtc

SEQ ID NO: 4619293 - DNA, 19 bp, Homo sapiens
gccaccctgaggagtctga

SEQ ID NO: 4619294 - DNA, 22 bp, Homo sapiens
gccaccctgaggagtctgaggt

SEQ ID NO: 4619295 - DNA, 19 bp, Homo sapiens
gccaccggcctgtgggtct

SEQ ID NO: 4619296 - DNA, 16 bp, Homo sapiens
gccaccgtgcctggct

SEQ ID NO: 4619297 - DNA, 23 bp, Homo sapiens
gccacctcagaccccggggtgag

SEQ ID NO: 4619298 - DNA, 13 bp, Homo sapiens
gccacctgcaaga

SEQ ID NO: 4619299 - DNA, 18 bp, Homo sapiens
gccacctgcaagatggac

SEQ ID NO: 4619300 - DNA, 22 bp, Homo sapiens
gccacgaacctcggggtggggg

SEQ ID NO: 4619301 - DNA, 20 bp, Homo sapiens
gccacggcctggctggtggg

SEQ ID NO: 4619302 - DNA, 23 bp, Homo sapiens
gccacgtcccagcatccctggag

SEQ ID NO: 4619303 - DNA, 14 bp, Homo sapiens
gccactaacttcta

SEQ ID NO: 4619304 - DNA, 12 bp, Homo sapiens
gccactccttgt

SEQ ID NO: 4619305 - DNA, 13 bp, Homo sapiens
gccactgctgctt

SEQ ID NO: 4619306 - DNA, 21 bp, Homo sapiens
gccacttccccctcttcttct

SEQ ID NO: 4619307 - DNA, 19 bp, Homo sapiens
gccactttcagagccccca

SEQ ID NO: 4619308 - DNA, 20 bp, Homo sapiens
gccagaagatgaacagactg

SEQ ID NO: 4619309 - DNA, 16 bp, Homo sapiens
gccagaccagcaggct

SEQ ID NO: 4619310 - DNA, 13 bp, Homo sapiens
gccagacctgcag

SEQ ID NO: 4619311 - DNA, 14 bp, Homo sapiens
gccagacctgcaga

SEQ ID NO: 4619312 - DNA, 13 bp, Homo sapiens
gccagacctgcat

SEQ ID NO: 4619313 - DNA, 19 bp, Homo sapiens
gccagacctgcatggtcaa

SEQ ID NO: 4619314 - DNA, 22 bp, Homo sapiens
gccagacctgcatggtcaagcc

SEQ ID NO: 4619315 - DNA, 21 bp, Homo sapiens
gccagactctaggttatacaa

SEQ ID NO: 4619316 - DNA, 13 bp, Homo sapiens
gccagagcagctc

SEQ ID NO: 4619317 - DNA, 15 bp, Homo sapiens
gccagagcagctcca

SEQ ID NO: 4619318 - DNA, 21 bp, Homo sapiens
gccagagcagctccaccactg

SEQ ID NO: 4619319 - DNA, 16 bp, Homo sapiens
gccagagcctggggct

SEQ ID NO: 4619320 - DNA, 13 bp, Homo sapiens
gccagattctctt

SEQ ID NO: 4619321 - DNA, 15 bp, Homo sapiens
gccagatttgtcttt

SEQ ID NO: 4619322 - DNA, 13 bp, Homo sapiens
gcctggggcctga

SEQ ID NO: 4619323 - DNA, 17 bp, Homo sapiens
gcctggggcctgagaga

SEQ ID NO: 4619324 - DNA, 21 bp, Homo sapiens
gcctggggctctaacgcctga

SEQ ID NO: 4619325 - DNA, 22 bp, Homo sapiens
gcctggggctctaacgcctgag

SEQ ID NO: 4619326 - DNA, 19 bp, Homo sapiens
gcctgggggcctggctggc

SEQ ID NO: 4619327 - DNA, 23 bp, Homo sapiens
gcctgggggttttccaagccctc

SEQ ID NO: 4619328 - DNA, 22 bp, Homo sapiens
gcctggggtgacccggcacccc

SEQ ID NO: 4619329 - DNA, 22 bp, Homo sapiens
gcctgggtaggccccacaaggc

SEQ ID NO: 4619330 - DNA, 21 bp, Homo sapiens
gcctgggtgatctgctgctga

SEQ ID NO: 4619331 - DNA, 16 bp, Homo sapiens
gcctggtccctgggag

SEQ ID NO: 4619332 - DNA, 14 bp, Homo sapiens
gcctggttagaggc

SEQ ID NO: 4619333 - DNA, 17 bp, Homo sapiens
gcctggttctaggctgc

SEQ ID NO: 4619334 - DNA, 18 bp, Homo sapiens
gcctgtactgcctgcttg

SEQ ID NO: 4619335 - DNA, 20 bp, Homo sapiens
gcctgtactgcctgcttggg

SEQ ID NO: 4619336 - DNA, 15 bp, Homo sapiens
gcctgtctcagtgat

SEQ ID NO: 4619337 - DNA, 17 bp, Homo sapiens
gcctgtctcagtgattc

SEQ ID NO: 4619338 - DNA, 18 bp, Homo sapiens
gcctgtgaacccaggaca

SEQ ID NO: 4619339 - DNA, 20 bp, Homo sapiens
gcctgtgatgttttatcctt

SEQ ID NO: 4619340 - DNA, 16 bp, Homo sapiens
gcctgtggcctttgca

SEQ ID NO: 4619341 - DNA, 13 bp, Homo sapiens
gcctgtgggcttc

SEQ ID NO: 4619342 - DNA, 15 bp, Homo sapiens
gcctgtgtagctgtg

SEQ ID NO: 4619343 - DNA, 13 bp, Homo sapiens
gcctgtgtcttta

SEQ ID NO: 4619344 - DNA, 15 bp, Homo sapiens
gcctgttcatggcag

SEQ ID NO: 4619345 - DNA, 20 bp, Homo sapiens
gcctgttgctatagagccta

SEQ ID NO: 4619346 - DNA, 14 bp, Homo sapiens
gccttaaagaggga

SEQ ID NO: 4619347 - DNA, 14 bp, Homo sapiens
gccttagtgggcca

SEQ ID NO: 4619348 - DNA, 18 bp, Homo sapiens
gccttcagacacatgcta

SEQ ID NO: 4619349 - DNA, 16 bp, Homo sapiens
gccttcagtcagggtt

SEQ ID NO: 4619350 - DNA, 15 bp, Homo sapiens
gccttcagtttattt

SEQ ID NO: 4619351 - DNA, 21 bp, Homo sapiens
gccttcccaagttgtgcttga

SEQ ID NO: 4619352 - DNA, 24 bp, Homo sapiens
gccttccctctgcattgacctgga

SEQ ID NO: 4619353 - DNA, 19 bp, Homo sapiens
gccttctaggaatggagga

SEQ ID NO: 4619354 - DNA, 14 bp, Homo sapiens
gccttctcccacat

SEQ ID NO: 4619355 - DNA, 15 bp, Homo sapiens
gccttctcccacatg

SEQ ID NO: 4619356 - DNA, 20 bp, Homo sapiens
gccttctcccacatgaggcc

SEQ ID NO: 4619357 - DNA, 14 bp, Homo sapiens
gccttctggccttg

SEQ ID NO: 4619358 - DNA, 11 bp, Homo sapiens
gccttctgtat

SEQ ID NO: 4619359 - DNA, 21 bp, Homo sapiens
gccttcttccttgaggggcag

SEQ ID NO: 4619360 - DNA, 21 bp, Homo sapiens
gccttcttttctcccttttaa

SEQ ID NO: 4619361 - DNA, 18 bp, Homo sapiens
gccttgacctaatgaggt

SEQ ID NO: 4619362 - DNA, 15 bp, Homo sapiens
gccttgatccccttg

SEQ ID NO: 4619363 - DNA, 21 bp, Homo sapiens
gccttggggaggacaaaactt

SEQ ID NO: 4619364 - DNA, 17 bp, Homo sapiens
gcctttcctgtagcctt

SEQ ID NO: 4619365 - DNA, 19 bp, Homo sapiens
gcctttctcaactgtccca

SEQ ID NO: 4619366 - DNA, 21 bp, Homo sapiens
gccttttccacacgcattaat

SEQ ID NO: 4619367 - DNA, 17 bp, Homo sapiens
gccttttcccccaccct

SEQ ID NO: 4619368 - DNA, 14 bp, Homo sapiens
gcgaacatcttcat

SEQ ID NO: 4619369 - DNA, 19 bp, Homo sapiens
gcgaacatcttcatataaa

SEQ ID NO: 4619370 - DNA, 17 bp, Homo sapiens
gcgaagacccggccagg

SEQ ID NO: 4619371 - DNA, 19 bp, Homo sapiens
gcgagaggtgagctacttt

SEQ ID NO: 4619372 - DNA, 18 bp, Homo sapiens
gcgagtggatgctgtgct

SEQ ID NO: 4619373 - DNA, 18 bp, Homo sapiens
gcgattccctctcccagg

SEQ ID NO: 4619374 - DNA, 19 bp, Homo sapiens
gcgattccctctcccaggc

SEQ ID NO: 4619375 - DNA, 13 bp, Homo sapiens
gcgattctcctgc

SEQ ID NO: 4619376 - DNA, 16 bp, Homo sapiens
gcgcatatagactgta

SEQ ID NO: 4619377 - DNA, 20 bp, Homo sapiens
gcgccacccaccatcaaagg

SEQ ID NO: 4619378 - DNA, 21 bp, Homo sapiens
gcgccaggatggaacacggcc

SEQ ID NO: 4619379 - DNA, 22 bp, Homo sapiens
gcgccaggctgaccacagcaca

SEQ ID NO: 4619380 - DNA, 16 bp, Homo sapiens
gcgccatctcggctca

SEQ ID NO: 4619381 - DNA, 13 bp, Homo sapiens
gcgccctgcagac

SEQ ID NO: 4619382 - DNA, 16 bp, Homo sapiens
gcgccctgcagaccct

SEQ ID NO: 4619383 - DNA, 14 bp, Homo sapiens
gcgcccttcctctc

SEQ ID NO: 4619384 - DNA, 16 bp, Homo sapiens
gcgcccttcctctcca

SEQ ID NO: 4619385 - DNA, 18 bp, Homo sapiens
gcgcccttcctctccacc

SEQ ID NO: 4619386 - DNA, 15 bp, Homo sapiens
gcgccgatgccaccg

SEQ ID NO: 4619387 - DNA, 17 bp, Homo sapiens
gcggaggggatccagcc

SEQ ID NO: 4619388 - DNA, 18 bp, Homo sapiens
gcggaggggatccagcca

SEQ ID NO: 4619389 - DNA, 20 bp, Homo sapiens
gcggaggggatccagccact

SEQ ID NO: 4619390 - DNA, 20 bp, Homo sapiens
gcggatactcttggagagtt

SEQ ID NO: 4619391 - DNA, 18 bp, Homo sapiens
gcggcccgcgcagctgcc

SEQ ID NO: 4619392 - DNA, 19 bp, Homo sapiens
gcggcccgcgcagctgcct

SEQ ID NO: 4619393 - DNA, 13 bp, Homo sapiens
gcggccggccagc

SEQ ID NO: 4619394 - DNA, 19 bp, Homo sapiens
gcggcctatgacttgggca

SEQ ID NO: 4619395 - DNA, 15 bp, Homo sapiens
gcggctctagcccca

SEQ ID NO: 4619396 - DNA, 14 bp, Homo sapiens
gcgggcggagggag

SEQ ID NO: 4619397 - DNA, 19 bp, Homo sapiens
gcggttcctcgttctccct

SEQ ID NO: 4619398 - DNA, 23 bp, Homo sapiens
gcggttggtgacttgtctgcctc

SEQ ID NO: 4619399 - DNA, 16 bp, Homo sapiens
gcgtacacagagaagg

SEQ ID NO: 4619400 - DNA, 14 bp, Homo sapiens
gcgtcaaagaaaat

SEQ ID NO: 4619401 - DNA, 13 bp, Homo sapiens
gcgtccttggctg

SEQ ID NO: 4619402 - DNA, 12 bp, Homo sapiens
gcgtctccctcg

SEQ ID NO: 4619403 - DNA, 21 bp, Homo sapiens
gcgtgccgtgtgagtgtgaca

SEQ ID NO: 4619404 - DNA, 21 bp, Homo sapiens
gcgtggccttgttctgtcacc

SEQ ID NO: 4619405 - DNA, 12 bp, Homo sapiens
gcgtgggcagag

SEQ ID NO: 4619406 - DNA, 12 bp, Homo sapiens
gctaaaaatatt

SEQ ID NO: 4619407 - DNA, 23 bp, Homo sapiens
gctaaaattaaaaagaaaatatt

SEQ ID NO: 4619408 - DNA, 15 bp, Homo sapiens
gctaaagcccagaga

SEQ ID NO: 4619409 - DNA, 16 bp, Homo sapiens
gctaaagcccagagac

SEQ ID NO: 4619410 - DNA, 14 bp, Homo sapiens
gctaaagccttcct

SEQ ID NO: 4619411 - DNA, 18 bp, Homo sapiens
gctaacagggaaggcagg

SEQ ID NO: 4619412 - DNA, 20 bp, Homo sapiens
gctaaccacttcgcacacac

SEQ ID NO: 4619413 - DNA, 19 bp, Homo sapiens
gctaatcaaagccagggtc

SEQ ID NO: 4619414 - DNA, 15 bp, Homo sapiens
gctacaggggccaga

SEQ ID NO: 4619415 - DNA, 16 bp, Homo sapiens
gctacccgcagagttc

SEQ ID NO: 4619416 - DNA, 19 bp, Homo sapiens
gctacctgtgtggacagga

SEQ ID NO: 4619417 - DNA, 20 bp, Homo sapiens
gctacctgtgtggacaggac

SEQ ID NO: 4619418 - DNA, 22 bp, Homo sapiens
gctacctgtgtggacaggacta

SEQ ID NO: 4619419 - DNA, 21 bp, Homo sapiens
gctacgtgtgaaatctgtctt

SEQ ID NO: 4619420 - DNA, 13 bp, Homo sapiens
gctactccctgga

SEQ ID NO: 4619421 - DNA, 17 bp, Homo sapiens
gctactctgtgccagag

SEQ ID NO: 4619422 - DNA, 18 bp, Homo sapiens
gctactctgtgccagagc

SEQ ID NO: 4619423 - DNA, 15 bp, Homo sapiens
gctactgagaacata

SEQ ID NO: 4619424 - DNA, 14 bp, Homo sapiens
gctacttggcaggc

SEQ ID NO: 4619425 - DNA, 23 bp, Homo sapiens
gctacttttttttagttcaatac

SEQ ID NO: 4619426 - DNA, 22 bp, Homo sapiens
gctagacaatgatttggccagg

SEQ ID NO: 4619427 - DNA, 11 bp, Homo sapiens
gctagacagaa

SEQ ID NO: 4619428 - DNA, 17 bp, Homo sapiens
gctagactgtgtctgaa

SEQ ID NO: 4619429 - DNA, 20 bp, Homo sapiens
gctagacttagattcattaa

SEQ ID NO: 4619430 - DNA, 15 bp, Homo sapiens
gctagagggcccaaa

SEQ ID NO: 4619431 - DNA, 13 bp, Homo sapiens
gctagcaaagact

SEQ ID NO: 4619432 - DNA, 16 bp, Homo sapiens
gctaggccccagaggc

SEQ ID NO: 4619433 - DNA, 18 bp, Homo sapiens
gctagtcgcccctcagag

SEQ ID NO: 4619434 - DNA, 17 bp, Homo sapiens
gctatagttgcagccca

SEQ ID NO: 4619435 - DNA, 22 bp, Homo sapiens
gctatagttgcagcccaaggac

SEQ ID NO: 4619436 - DNA, 14 bp, Homo sapiens
gctatattagctga

SEQ ID NO: 4619437 - DNA, 19 bp, Homo sapiens
gctatcacctagcagcctc

SEQ ID NO: 4619438 - DNA, 13 bp, Homo sapiens
gctatcctgggac

SEQ ID NO: 4619439 - DNA, 14 bp, Homo sapiens
gctatcctgggacc

SEQ ID NO: 4619440 - DNA, 19 bp, Homo sapiens
gctatggcaggataagaaa

SEQ ID NO: 4619441 - DNA, 20 bp, Homo sapiens
gctatggcaggataagaaag

SEQ ID NO: 4619442 - DNA, 15 bp, Homo sapiens
gctatggtgagatgc

SEQ ID NO: 4619443 - DNA, 16 bp, Homo sapiens
gctatggtgagatgca

SEQ ID NO: 4619444 - DNA, 19 bp, Homo sapiens
gctatgttctgtcttccca

SEQ ID NO: 4619445 - DNA, 16 bp, Homo sapiens
gctattctagagcttt

SEQ ID NO: 4619446 - DNA, 19 bp, Homo sapiens
gctattctagagcttttat

SEQ ID NO: 4619447 - DNA, 20 bp, Homo sapiens
gctattgcagaatgaagcca

SEQ ID NO: 4619448 - DNA, 18 bp, Homo sapiens
gctattttcatcacagtt

SEQ ID NO: 4619449 - DNA, 19 bp, Homo sapiens
gctcaagtctgcacagagc

SEQ ID NO: 4619450 - DNA, 22 bp, Homo sapiens
gctcacaaggcagcaaggcccg

SEQ ID NO: 4619451 - DNA, 15 bp, Homo sapiens
gctcacagtacagca

SEQ ID NO: 4619452 - DNA, 22 bp, Homo sapiens
gctcacagtacagcatgtgcct

SEQ ID NO: 4619453 - DNA, 17 bp, Homo sapiens
gctcaccgactcacctg

SEQ ID NO: 4619454 - DNA, 20 bp, Homo sapiens
gctcactgcaacctctgcct

SEQ ID NO: 4619455 - DNA, 20 bp, Homo sapiens
gctcagaataaggcaggcat

SEQ ID NO: 4619456 - DNA, 18 bp, Homo sapiens
gctcagaggcgcactgtg

SEQ ID NO: 4619457 - DNA, 20 bp, Homo sapiens
gctcagaggcgcactgtgac

SEQ ID NO: 4619458 - DNA, 18 bp, Homo sapiens
gctcagcagggctggtca

SEQ ID NO: 4619459 - DNA, 14 bp, Homo sapiens
gctcagccagtggg

SEQ ID NO: 4619460 - DNA, 18 bp, Homo sapiens
gctcagtgcaacctctgc

SEQ ID NO: 4619461 - DNA, 17 bp, Homo sapiens
gctcatcccccctgctg

SEQ ID NO: 4619462 - DNA, 18 bp, Homo sapiens
gctcatcccccctgctgc

SEQ ID NO: 4619463 - DNA, 19 bp, Homo sapiens
gctcatcccccctgctgcc

SEQ ID NO: 4619464 - DNA, 21 bp, Homo sapiens
gctcatcccccctgctgccca

SEQ ID NO: 4619465 - DNA, 13 bp, Homo sapiens
gctcatctgttgt

SEQ ID NO: 4619466 - DNA, 19 bp, Homo sapiens
gctcatgagctcctgatca

SEQ ID NO: 4619467 - DNA, 20 bp, Homo sapiens
gctcatggctgtgtccactg

SEQ ID NO: 4619468 - DNA, 16 bp, Homo sapiens
gctcatgtcattatga

SEQ ID NO: 4619469 - DNA, 16 bp, Homo sapiens
gctcattatgccactt

SEQ ID NO: 4619470 - DNA, 14 bp, Homo sapiens
gctccaaaccttca

SEQ ID NO: 4619471 - DNA, 22 bp, Homo sapiens
gctccaaaccttcacacacaga

SEQ ID NO: 4619472 - DNA, 21 bp, Homo sapiens
gctccaccactgtgcacttag

SEQ ID NO: 4619473 - DNA, 19 bp, Homo sapiens
gctccaccctggccgagtc

SEQ ID NO: 4619474 - DNA, 17 bp, Homo sapiens
gctccagatgcagggca

SEQ ID NO: 4619475 - DNA, 19 bp, Homo sapiens
gctccagatgcagggcagt

SEQ ID NO: 4619476 - DNA, 19 bp, Homo sapiens
gctccatatttgatttcta

SEQ ID NO: 4619477 - DNA, 22 bp, Homo sapiens
gctccatcctttgtcttggaac

SEQ ID NO: 4619478 - DNA, 18 bp, Homo sapiens
gctcccaactcccttctg

SEQ ID NO: 4619479 - DNA, 21 bp, Homo sapiens
gctcccaatggtgcttggagg

SEQ ID NO: 4619480 - DNA, 22 bp, Homo sapiens
gctcccaatggtgcttggaggg

SEQ ID NO: 4619481 - DNA, 14 bp, Homo sapiens
gctcccagggccat

SEQ ID NO: 4619482 - DNA, 17 bp, Homo sapiens
gctccccactctgctct

SEQ ID NO: 4619483 - DNA, 19 bp, Homo sapiens
gctccccactctgctctga

SEQ ID NO: 4619484 - DNA, 13 bp, Homo sapiens
gctcccccaggca

SEQ ID NO: 4619485 - DNA, 11 bp, Homo sapiens
gctccctctct

SEQ ID NO: 4619486 - DNA, 12 bp, Homo sapiens
gctccctctctc

SEQ ID NO: 4619487 - DNA, 20 bp, Homo sapiens
gctccctctctcctggactg

SEQ ID NO: 4619488 - DNA, 22 bp, Homo sapiens
gctcccttcaagacgaggggca

SEQ ID NO: 4619489 - DNA, 18 bp, Homo sapiens
gctcctagtatgccctgt

SEQ ID NO: 4619490 - DNA, 19 bp, Homo sapiens
gctcctagtatgccctgta

SEQ ID NO: 4619491 - DNA, 21 bp, Homo sapiens
gctcctctgtctcgagcgccc

SEQ ID NO: 4619492 - DNA, 18 bp, Homo sapiens
gctccttcagttctgctt

SEQ ID NO: 4619493 - DNA, 18 bp, Homo sapiens
gctcggggtgcacaggag

SEQ ID NO: 4619494 - DNA, 19 bp, Homo sapiens
gctcggggtgcacaggagg

SEQ ID NO: 4619495 - DNA, 21 bp, Homo sapiens
gctcggggtgcacaggagggg

SEQ ID NO: 4619496 - DNA, 20 bp, Homo sapiens
gctctaacgcctgagcccag

SEQ ID NO: 4619497 - DNA, 15 bp, Homo sapiens
gctctacaggcctgc

SEQ ID NO: 4619498 - DNA, 14 bp, Homo sapiens
gctctagccccagc

SEQ ID NO: 4619499 - DNA, 17 bp, Homo sapiens
gctctcccatttcctga

SEQ ID NO: 4619500 - DNA, 15 bp, Homo sapiens
gctctcctggcttcc

SEQ ID NO: 4619501 - DNA, 17 bp, Homo sapiens
gctctcctggcttccca

SEQ ID NO: 4619502 - DNA, 18 bp, Homo sapiens
gctctcgaccggccctgc

SEQ ID NO: 4619503 - DNA, 15 bp, Homo sapiens
gctctctaggcctct

SEQ ID NO: 4619504 - DNA, 19 bp, Homo sapiens
gctctctaggcctctccag

SEQ ID NO: 4619505 - DNA, 18 bp, Homo sapiens
gctctctctagaatgagc

SEQ ID NO: 4619506 - DNA, 21 bp, Homo sapiens
gctctctgagtcctggcccaa

SEQ ID NO: 4619507 - DNA, 17 bp, Homo sapiens
gctctgagccaaccttg

SEQ ID NO: 4619508 - DNA, 20 bp, Homo sapiens
gctctgatgcatcagaaagg

SEQ ID NO: 4619509 - DNA, 23 bp, Homo sapiens
gctctgcacagacaagcagccct

SEQ ID NO: 4619510 - DNA, 17 bp, Homo sapiens
gctctgcacccctctgc

SEQ ID NO: 4619511 - DNA, 19 bp, Homo sapiens
gctctgcagcattgaagta

SEQ ID NO: 4619512 - DNA, 21 bp, Homo sapiens
gctctgcagcattgaagtatg

SEQ ID NO: 4619513 - DNA, 23 bp, Homo sapiens
gctctgcccaggcaaggaacaga

SEQ ID NO: 4619514 - DNA, 12 bp, Homo sapiens
gctctgccccag

SEQ ID NO: 4619515 - DNA, 13 bp, Homo sapiens
gctctgccccagg

SEQ ID NO: 4619516 - DNA, 17 bp, Homo sapiens
gctctgccccaggccct

SEQ ID NO: 4619517 - DNA, 15 bp, Homo sapiens
gctctgccccttccc

SEQ ID NO: 4619518 - DNA, 19 bp, Homo sapiens
gctctgccccttccccatg

SEQ ID NO: 4619519 - DNA, 14 bp, Homo sapiens
gctctgcctgtctg

SEQ ID NO: 4619520 - DNA, 15 bp, Homo sapiens
gctctgcctgtctgg

SEQ ID NO: 4619521 - DNA, 16 bp, Homo sapiens
gctctgcgcgttcctc

SEQ ID NO: 4619522 - DNA, 20 bp, Homo sapiens
gctctggaataaagttgcag

SEQ ID NO: 4619523 - DNA, 22 bp, Homo sapiens
gctctggaataaagttgcagat

SEQ ID NO: 4619524 - DNA, 24 bp, Homo sapiens
gctctggaataaagttgcagatga

SEQ ID NO: 4619525 - DNA, 14 bp, Homo sapiens
gctctgggccattc

SEQ ID NO: 4619526 - DNA, 23 bp, Homo sapiens
gctctgggccattctccacagca

SEQ ID NO: 4619527 - DNA, 16 bp, Homo sapiens
gctctgggtgctgccc

SEQ ID NO: 4619528 - DNA, 23 bp, Homo sapiens
gctctgttacccagggtggagtg

SEQ ID NO: 4619529 - DNA, 13 bp, Homo sapiens
gctcttccccatc

SEQ ID NO: 4619530 - DNA, 13 bp, Homo sapiens
gctcttcccttgc

SEQ ID NO: 4619531 - DNA, 13 bp, Homo sapiens
gctcttctcaggg

SEQ ID NO: 4619532 - DNA, 18 bp, Homo sapiens
gctcttgaggagctcaac

SEQ ID NO: 4619533 - DNA, 14 bp, Homo sapiens
gctcttggggaagg

SEQ ID NO: 4619534 - DNA, 21 bp, Homo sapiens
gctctttcacctgggtgtctg

SEQ ID NO: 4619535 - DNA, 12 bp, Homo sapiens
gctctttccaaa

SEQ ID NO: 4619536 - DNA, 20 bp, Homo sapiens
gctcttttttgtttgtttct

SEQ ID NO: 4619537 - DNA, 21 bp, Homo sapiens
gctgaaacaactccttttact

SEQ ID NO: 4619538 - DNA, 18 bp, Homo sapiens
gctgaagagagggacagg

SEQ ID NO: 4619539 - DNA, 13 bp, Homo sapiens
gctgaagatggca

SEQ ID NO: 4619540 - DNA, 21 bp, Homo sapiens
gctgaataacctgcacaggct

SEQ ID NO: 4619541 - DNA, 16 bp, Homo sapiens
gctgacattcacctgc

SEQ ID NO: 4619542 - DNA, 13 bp, Homo sapiens
gctgaccacagca

SEQ ID NO: 4619543 - DNA, 16 bp, Homo sapiens
gctgaccacagcacag

SEQ ID NO: 4619544 - DNA, 20 bp, Homo sapiens
gctgacccagcatctcccag

SEQ ID NO: 4619545 - DNA, 22 bp, Homo sapiens
gctgacccagcatctcccagca

SEQ ID NO: 4619546 - DNA, 13 bp, Homo sapiens
gctgacttcactt

SEQ ID NO: 4619547 - DNA, 19 bp, Homo sapiens
gctgacttcatctcccacc

SEQ ID NO: 4619548 - DNA, 20 bp, Homo sapiens
gctgacttggttctgaagcc

SEQ ID NO: 4619549 - DNA, 13 bp, Homo sapiens
gctgagaacctgg

SEQ ID NO: 4619550 - DNA, 15 bp, Homo sapiens
gctgagaacctggcc

SEQ ID NO: 4619551 - DNA, 18 bp, Homo sapiens
gctgagaacctggccttc

SEQ ID NO: 4619552 - DNA, 22 bp, Homo sapiens
gctgagcacttagcaggcaccg

SEQ ID NO: 4619553 - DNA, 13 bp, Homo sapiens
gctgagcagggcc

SEQ ID NO: 4619554 - DNA, 14 bp, Homo sapiens
gctgagcgccagga

SEQ ID NO: 4619555 - DNA, 16 bp, Homo sapiens
gctgagctcacaaggc

SEQ ID NO: 4619556 - DNA, 18 bp, Homo sapiens
gctgagctctgagaggcc

SEQ ID NO: 4619557 - DNA, 22 bp, Homo sapiens
gctgagctggaaggggccacgt

SEQ ID NO: 4619558 - DNA, 21 bp, Homo sapiens
gctgaggggtctcggatgaca

SEQ ID NO: 4619559 - DNA, 15 bp, Homo sapiens
gctgaggtgcccagg

SEQ ID NO: 4619560 - DNA, 17 bp, Homo sapiens
gctgaggtgcccaggag

SEQ ID NO: 4619561 - DNA, 14 bp, Homo sapiens
gctgcaaaggagaa

SEQ ID NO: 4619562 - DNA, 22 bp, Homo sapiens
gctgcaaaggagaagcacagct

SEQ ID NO: 4619563 - DNA, 15 bp, Homo sapiens
gctgcacaccaaggc

SEQ ID NO: 4619564 - DNA, 13 bp, Homo sapiens
gctgcactgtgaa

SEQ ID NO: 4619565 - DNA, 21 bp, Homo sapiens
gctgcactgtgaacctgggca

SEQ ID NO: 4619566 - DNA, 21 bp, Homo sapiens
gctgcagttttgctatctggg

SEQ ID NO: 4619567 - DNA, 19 bp, Homo sapiens
gctgccaaggtggagggaa

SEQ ID NO: 4619568 - DNA, 15 bp, Homo sapiens
gctgccacagagaag

SEQ ID NO: 4619569 - DNA, 22 bp, Homo sapiens
gctgccagcctgaggtgcccac

SEQ ID NO: 4619570 - DNA, 23 bp, Homo sapiens
gctgccatctcacctcctgctgg

SEQ ID NO: 4619571 - DNA, 13 bp, Homo sapiens
gctgcccagtgca

SEQ ID NO: 4619572 - DNA, 17 bp, Homo sapiens
gctgcccatcatgtggc

SEQ ID NO: 4619573 - DNA, 18 bp, Homo sapiens
gctgccccaatgtgacct

SEQ ID NO: 4619574 - DNA, 17 bp, Homo sapiens
gctgcccctctctgggc

SEQ ID NO: 4619575 - DNA, 18 bp, Homo sapiens
gctgccctgagaagctgc

SEQ ID NO: 4619576 - DNA, 22 bp, Homo sapiens
gctgccctgagaagctgctcca

SEQ ID NO: 4619577 - DNA, 19 bp, Homo sapiens
gctgcctgggtaggcccca

SEQ ID NO: 4619578 - DNA, 20 bp, Homo sapiens
gctgcctgggtaggccccac

SEQ ID NO: 4619579 - DNA, 15 bp, Homo sapiens
gctgcgggggcaggc

SEQ ID NO: 4619580 - DNA, 15 bp, Homo sapiens
gctgctccaggcctg

SEQ ID NO: 4619581 - DNA, 16 bp, Homo sapiens
gctgctccaggcctgc

SEQ ID NO: 4619582 - DNA, 19 bp, Homo sapiens
gctgctccccagcagcgga

SEQ ID NO: 4619583 - DNA, 22 bp, Homo sapiens
gctgctcggggtgcacaggagg

SEQ ID NO: 4619584 - DNA, 18 bp, Homo sapiens
gctgctgagaacctggcc

SEQ ID NO: 4619585 - DNA, 13 bp, Homo sapiens
gctgctgaggccc

SEQ ID NO: 4619586 - DNA, 21 bp, Homo sapiens
gctgctgcacaccaaggccct

SEQ ID NO: 4619587 - DNA, 14 bp, Homo sapiens
gctgctgtgcccca

SEQ ID NO: 4619588 - DNA, 23 bp, Homo sapiens
gctgcttcctgtgacagtgaaat

SEQ ID NO: 4619589 - DNA, 13 bp, Homo sapiens
gctgcttgtcaaa

SEQ ID NO: 4619590 - DNA, 22 bp, Homo sapiens
gctggaaaagggtcttgggaaa

SEQ ID NO: 4619591 - DNA, 23 bp, Homo sapiens
gctggactggaggcccctggagc

SEQ ID NO: 4619592 - DNA, 21 bp, Homo sapiens
gctggagaaagagctgcctgg

SEQ ID NO: 4619593 - DNA, 18 bp, Homo sapiens
gctggcatggtggctccc

SEQ ID NO: 4619594 - DNA, 19 bp, Homo sapiens
gctggccaaagtcacttcc

SEQ ID NO: 4619595 - DNA, 20 bp, Homo sapiens
gctggccaatttttgtactt

SEQ ID NO: 4619596 - DNA, 19 bp, Homo sapiens
gctggccccgcccctgccc

SEQ ID NO: 4619597 - DNA, 18 bp, Homo sapiens
gctggccgcccccagccc

SEQ ID NO: 4619598 - DNA, 22 bp, Homo sapiens
gctggccggggctctgggtgct

SEQ ID NO: 4619599 - DNA, 22 bp, Homo sapiens
gctggcctcccaaatgagccat

SEQ ID NO: 4619600 - DNA, 19 bp, Homo sapiens
gctggcctggcccccagct

SEQ ID NO: 4619601 - DNA, 23 bp, Homo sapiens
gctggctcacagtacagcatgtg

SEQ ID NO: 4619602 - DNA, 19 bp, Homo sapiens
gctggctcccagggccatg

SEQ ID NO: 4619603 - DNA, 17 bp, Homo sapiens
gctgggacgtggctcag

SEQ ID NO: 4619604 - DNA, 21 bp, Homo sapiens
gctgggacgtggctcagccag

SEQ ID NO: 4619605 - DNA, 18 bp, Homo sapiens
gctgggccactggggact

SEQ ID NO: 4619606 - DNA, 24 bp, Homo sapiens
gctgggccctctttccctgcgaga

SEQ ID NO: 4619607 - DNA, 15 bp, Homo sapiens
gctgggctctgcctt

SEQ ID NO: 4619608 - DNA, 18 bp, Homo sapiens
gctggggaccggttccca

SEQ ID NO: 4619609 - DNA, 14 bp, Homo sapiens
gctggggaggagga

SEQ ID NO: 4619610 - DNA, 14 bp, Homo sapiens
gctggggccaggcc

SEQ ID NO: 4619611 - DNA, 14 bp, Homo sapiens
gctggggccgccac

SEQ ID NO: 4619612 - DNA, 22 bp, Homo sapiens
gctggggccgccacggcctggc

SEQ ID NO: 4619613 - DNA, 16 bp, Homo sapiens
gctgggtcaggcaggg

SEQ ID NO: 4619614 - DNA, 20 bp, Homo sapiens
gctggtcacctcccatcccg

SEQ ID NO: 4619615 - DNA, 16 bp, Homo sapiens
gctggtccgtgcggga

SEQ ID NO: 4619616 - DNA, 15 bp, Homo sapiens
gctggtgctactgtt

SEQ ID NO: 4619617 - DNA, 16 bp, Homo sapiens
gctggtgggaaggccg

SEQ ID NO: 4619618 - DNA, 20 bp, Homo sapiens
gctggtggtcatgaattcat

SEQ ID NO: 4619619 - DNA, 19 bp, Homo sapiens
gctggtttcaaactcctga

SEQ ID NO: 4619620 - DNA, 17 bp, Homo sapiens
gctgtaaatttggcttc

SEQ ID NO: 4619621 - DNA, 18 bp, Homo sapiens
gctgtaaatttggcttct

SEQ ID NO: 4619622 - DNA, 12 bp, Homo sapiens
gctgtaagggca

SEQ ID NO: 4619623 - DNA, 14 bp, Homo sapiens
gctgtaagggcagt

SEQ ID NO: 4619624 - DNA, 22 bp, Homo sapiens
gctgtactcttctgactgcccc

SEQ ID NO: 4619625 - DNA, 19 bp, Homo sapiens
gctgtatgacccctggcca

SEQ ID NO: 4619626 - DNA, 23 bp, Homo sapiens
gctgtattttgagtttcagctgg

SEQ ID NO: 4619627 - DNA, 16 bp, Homo sapiens
gctgtcacttcttcac

SEQ ID NO: 4619628 - DNA, 15 bp, Homo sapiens
gctgtcatctgtgca

SEQ ID NO: 4619629 - DNA, 16 bp, Homo sapiens
gctgtcatctgtgcac

SEQ ID NO: 4619630 - DNA, 22 bp, Homo sapiens
gctgtcatctgtgcactgccca

SEQ ID NO: 4619631 - DNA, 17 bp, Homo sapiens
gctgtccccactgcccc

SEQ ID NO: 4619632 - DNA, 13 bp, Homo sapiens
gctgtccctgcag

SEQ ID NO: 4619633 - DNA, 19 bp, Homo sapiens
gctgtctgaagcccaaagc

SEQ ID NO: 4619634 - DNA, 23 bp, Homo sapiens
gctgtgacaagccaatgtgaatt

SEQ ID NO: 4619635 - DNA, 12 bp, Homo sapiens
gctgtgacctgc

SEQ ID NO: 4619636 - DNA, 17 bp, Homo sapiens
gctgtgacctgctgagc

SEQ ID NO: 4619637 - DNA, 23 bp, Homo sapiens
gctgtgacctgctgagctctgag

SEQ ID NO: 4619638 - DNA, 21 bp, Homo sapiens
gctgtgcattttttttttcat

SEQ ID NO: 4619639 - DNA, 19 bp, Homo sapiens
gctgtgccaacctgttctt

SEQ ID NO: 4619640 - DNA, 23 bp, Homo sapiens
gctgtggtttccatctgaaagta

SEQ ID NO: 4619641 - DNA, 15 bp, Homo sapiens
gctgtgtagttccct

SEQ ID NO: 4619642 - DNA, 21 bp, Homo sapiens
gctgtgtagttccctctgcct

SEQ ID NO: 4619643 - DNA, 13 bp, Homo sapiens
gctgtgtgacctt

SEQ ID NO: 4619644 - DNA, 13 bp, Homo sapiens
gctgtgtgtctgt

SEQ ID NO: 4619645 - DNA, 18 bp, Homo sapiens
gctgttgttccattgaag

SEQ ID NO: 4619646 - DNA, 12 bp, Homo sapiens
gctgtttacaac

SEQ ID NO: 4619647 - DNA, 23 bp, Homo sapiens
gctgtttacaacatcaccagtgc

SEQ ID NO: 4619648 - DNA, 14 bp, Homo sapiens
gctgtttgaaatgt

SEQ ID NO: 4619649 - DNA, 15 bp, Homo sapiens
gctgtttgaaatgtt

SEQ ID NO: 4619650 - DNA, 17 bp, Homo sapiens
gcttaaaaatacttcta

SEQ ID NO: 4619651 - DNA, 17 bp, Homo sapiens
gcttaagaactgcttca

SEQ ID NO: 4619652 - DNA, 12 bp, Homo sapiens
gcttacggccct

SEQ ID NO: 4619653 - DNA, 13 bp, Homo sapiens
caggagtggggag

SEQ ID NO: 4619654 - DNA, 15 bp, Homo sapiens
caggagtggggagag

SEQ ID NO: 4619655 - DNA, 16 bp, Homo sapiens
caggagtggggagagt

SEQ ID NO: 4619656 - DNA, 24 bp, Homo sapiens
caggagtggtgcagacagaagtct

SEQ ID NO: 4619657 - DNA, 22 bp, Homo sapiens
caggagtgtcctgcccatgccc

SEQ ID NO: 4619658 - DNA, 15 bp, Homo sapiens
caggatactggcaca

SEQ ID NO: 4619659 - DNA, 17 bp, Homo sapiens
caggatactggcacaga

SEQ ID NO: 4619660 - DNA, 20 bp, Homo sapiens
caggatactggcacagaggt

SEQ ID NO: 4619661 - DNA, 22 bp, Homo sapiens
caggatctcctgccagcccagc

SEQ ID NO: 4619662 - DNA, 22 bp, Homo sapiens
caggatctctttccccaaggac

SEQ ID NO: 4619663 - DNA, 16 bp, Homo sapiens
caggatgaggccccgc

SEQ ID NO: 4619664 - DNA, 14 bp, Homo sapiens
caggatgaggtctc

SEQ ID NO: 4619665 - DNA, 23 bp, Homo sapiens
caggatgaggtctcgaccctgtc

SEQ ID NO: 4619666 - DNA, 21 bp, Homo sapiens
caggatgcccagatgaactga

SEQ ID NO: 4619667 - DNA, 22 bp, Homo sapiens
caggatgcccagatgaactgac

SEQ ID NO: 4619668 - DNA, 15 bp, Homo sapiens
caggatgctttggtt

SEQ ID NO: 4619669 - DNA, 15 bp, Homo sapiens
caggatggagcaagc

SEQ ID NO: 4619670 - DNA, 20 bp, Homo sapiens
caggatggagcaagctcttc

SEQ ID NO: 4619671 - DNA, 20 bp, Homo sapiens
caggcaccgccacgtcccag

SEQ ID NO: 4619672 - DNA, 24 bp, Homo sapiens
caggcaccgccacgtcccagcatc

SEQ ID NO: 4619673 - DNA, 20 bp, Homo sapiens
caggcagaaatagttgtctg

SEQ ID NO: 4619674 - DNA, 19 bp, Homo sapiens
caggcagagaacagaactg

SEQ ID NO: 4619675 - DNA, 20 bp, Homo sapiens
caggcagcgccaagtgcgtg

SEQ ID NO: 4619676 - DNA, 13 bp, Homo sapiens
caggcaggaacaa

SEQ ID NO: 4619677 - DNA, 22 bp, Homo sapiens
caggcaggctttctgggtgtga

SEQ ID NO: 4619678 - DNA, 16 bp, Homo sapiens
caggcagggctctcct

SEQ ID NO: 4619679 - DNA, 19 bp, Homo sapiens
caggcagggctctcctggc

SEQ ID NO: 4619680 - DNA, 21 bp, Homo sapiens
caggcagggctctcctggctt

SEQ ID NO: 4619681 - DNA, 24 bp, Homo sapiens
caggcatgctggctcccagggcca

SEQ ID NO: 4619682 - DNA, 15 bp, Homo sapiens
caggcattcctgaag

SEQ ID NO: 4619683 - DNA, 15 bp, Homo sapiens
caggcattgaggaag

SEQ ID NO: 4619684 - DNA, 13 bp, Homo sapiens
caggccccacccc

SEQ ID NO: 4619685 - DNA, 14 bp, Homo sapiens
caggccccacccct

SEQ ID NO: 4619686 - DNA, 15 bp, Homo sapiens
caggccccacccctt

SEQ ID NO: 4619687 - DNA, 19 bp, Homo sapiens
caggccccatgacctccag

SEQ ID NO: 4619688 - DNA, 20 bp, Homo sapiens
caggccccatgacctccagc

SEQ ID NO: 4619689 - DNA, 13 bp, Homo sapiens
caggccccatgga

SEQ ID NO: 4619690 - DNA, 14 bp, Homo sapiens
caggccccatggag

SEQ ID NO: 4619691 - DNA, 18 bp, Homo sapiens
caggccccatggagggta

SEQ ID NO: 4619692 - DNA, 13 bp, Homo sapiens
caggccgggcctg

SEQ ID NO: 4619693 - DNA, 21 bp, Homo sapiens
caggcctcacccctcccctgg

SEQ ID NO: 4619694 - DNA, 13 bp, Homo sapiens
caggcctctgccc

SEQ ID NO: 4619695 - DNA, 16 bp, Homo sapiens
caggcctgtgtagctg

SEQ ID NO: 4619696 - DNA, 22 bp, Homo sapiens
caggcctgtgtagctgtgacct

SEQ ID NO: 4619697 - DNA, 17 bp, Homo sapiens
caggctacaaagcagag

SEQ ID NO: 4619698 - DNA, 12 bp, Homo sapiens
caggctctgcac

SEQ ID NO: 4619699 - DNA, 18 bp, Homo sapiens
caggctgaagcaggttcc

SEQ ID NO: 4619700 - DNA, 14 bp, Homo sapiens
caggctgaccacag

SEQ ID NO: 4619701 - DNA, 17 bp, Homo sapiens
caggctgaccacagcac

SEQ ID NO: 4619702 - DNA, 20 bp, Homo sapiens
caggctgaccacagcacagc

SEQ ID NO: 4619703 - DNA, 20 bp, Homo sapiens
caggctggctccagatgcag

SEQ ID NO: 4619704 - DNA, 13 bp, Homo sapiens
caggctgtttcag

SEQ ID NO: 4619705 - DNA, 16 bp, Homo sapiens
cagggaacttagtaag

SEQ ID NO: 4619706 - DNA, 12 bp, Homo sapiens
cagggaaggcag

SEQ ID NO: 4619707 - DNA, 13 bp, Homo sapiens
cagggaaggcagg

SEQ ID NO: 4619708 - DNA, 17 bp, Homo sapiens
cagggaaggcaggcagg

SEQ ID NO: 4619709 - DNA, 15 bp, Homo sapiens
cagggacaagtcttt

SEQ ID NO: 4619710 - DNA, 18 bp, Homo sapiens
cagggaccggcagagctc

SEQ ID NO: 4619711 - DNA, 20 bp, Homo sapiens
cagggaccggcagagctcta

SEQ ID NO: 4619712 - DNA, 22 bp, Homo sapiens
cagggaccggcagagctctaca

SEQ ID NO: 4619713 - DNA, 22 bp, Homo sapiens
cagggaccggtgctgcaggagt

SEQ ID NO: 4619714 - DNA, 19 bp, Homo sapiens
cagggagaggtcaccagct

SEQ ID NO: 4619715 - DNA, 21 bp, Homo sapiens
cagggagaggtcaccagctgc

SEQ ID NO: 4619716 - DNA, 23 bp, Homo sapiens
cagggagcggccggccagcccct

SEQ ID NO: 4619717 - DNA, 14 bp, Homo sapiens
cagggagctgatgt

SEQ ID NO: 4619718 - DNA, 15 bp, Homo sapiens
cagggagctgcaggg

SEQ ID NO: 4619719 - DNA, 16 bp, Homo sapiens
cagggagtgctggctc

SEQ ID NO: 4619720 - DNA, 18 bp, Homo sapiens
cagggatgctgggctggg

SEQ ID NO: 4619721 - DNA, 22 bp, Homo sapiens
cagggatgctgggctgggccct

SEQ ID NO: 4619722 - DNA, 18 bp, Homo sapiens
cagggatgtctgttgaaa

SEQ ID NO: 4619723 - DNA, 12 bp, Homo sapiens
cagggcacagga

SEQ ID NO: 4619724 - DNA, 16 bp, Homo sapiens
cagggcacaggagcta

SEQ ID NO: 4619725 - DNA, 13 bp, Homo sapiens
cagggcagcgcca

SEQ ID NO: 4619726 - DNA, 15 bp, Homo sapiens
cagggcagcgccagg

SEQ ID NO: 4619727 - DNA, 16 bp, Homo sapiens
cagggcagcgccaggc

SEQ ID NO: 4619728 - DNA, 19 bp, Homo sapiens
cagggcagcgccaggctga

SEQ ID NO: 4619729 - DNA, 12 bp, Homo sapiens
cagggccagagc

SEQ ID NO: 4619730 - DNA, 15 bp, Homo sapiens
cagggccagagcagc

SEQ ID NO: 4619731 - DNA, 16 bp, Homo sapiens
cagggccagagcagct

SEQ ID NO: 4619732 - DNA, 17 bp, Homo sapiens
cagggccagtggggcct

SEQ ID NO: 4619733 - DNA, 20 bp, Homo sapiens
cagggccagtggggcctgtg

SEQ ID NO: 4619734 - DNA, 21 bp, Homo sapiens
cagggccagtggggcctgtgg

SEQ ID NO: 4619735 - DNA, 18 bp, Homo sapiens
cagggccatctgactgcc

SEQ ID NO: 4619736 - DNA, 16 bp, Homo sapiens
cagggcccccatctca

SEQ ID NO: 4619737 - DNA, 21 bp, Homo sapiens
cagggcccccatctcatgccc

SEQ ID NO: 4619738 - DNA, 16 bp, Homo sapiens
cagggccctcccagcc

SEQ ID NO: 4619739 - DNA, 17 bp, Homo sapiens
cagggccctcccagccc

SEQ ID NO: 4619740 - DNA, 12 bp, Homo sapiens
cagggccgggga

SEQ ID NO: 4619741 - DNA, 24 bp, Homo sapiens
cagggccggggaactggccaagct

SEQ ID NO: 4619742 - DNA, 15 bp, Homo sapiens
cagggcctgagtgac

SEQ ID NO: 4619743 - DNA, 12 bp, Homo sapiens
cagggcctgcta

SEQ ID NO: 4619744 - DNA, 14 bp, Homo sapiens
cagggcctggagcc

SEQ ID NO: 4619745 - DNA, 16 bp, Homo sapiens
cagggcctggagcccc

SEQ ID NO: 4619746 - DNA, 15 bp, Homo sapiens
cagggcctggcatag

SEQ ID NO: 4619747 - DNA, 13 bp, Homo sapiens
cagggcctggggc

SEQ ID NO: 4619748 - DNA, 17 bp, Homo sapiens
cagggcctggggcctga

SEQ ID NO: 4619749 - DNA, 21 bp, Homo sapiens
cagggcctggggcctgagaga

SEQ ID NO: 4619750 - DNA, 23 bp, Homo sapiens
cagggcctggggcctgagagaat

SEQ ID NO: 4619751 - DNA, 14 bp, Homo sapiens
cagggctctcctgg

SEQ ID NO: 4619752 - DNA, 15 bp, Homo sapiens
cagggctctcctggc

SEQ ID NO: 4619753 - DNA, 16 bp, Homo sapiens
cagggctgccctgaga

SEQ ID NO: 4619754 - DNA, 17 bp, Homo sapiens
cagggctgccctgagaa

SEQ ID NO: 4619755 - DNA, 13 bp, Homo sapiens
cagggctgctctt

SEQ ID NO: 4619756 - DNA, 10 bp, Homo sapiens
cagggctggg

SEQ ID NO: 4619757 - DNA, 18 bp, Homo sapiens
cagggcttacggccctgg

SEQ ID NO: 4619758 - DNA, 17 bp, Homo sapiens
cagggcttctcctcctc

SEQ ID NO: 4619759 - DNA, 16 bp, Homo sapiens
caggggaaggaaggag

SEQ ID NO: 4619760 - DNA, 15 bp, Homo sapiens
caggggaggagcctg

SEQ ID NO: 4619761 - DNA, 22 bp, Homo sapiens
caggggagggtcagccagggcc

SEQ ID NO: 4619762 - DNA, 20 bp, Homo sapiens
caggggatttcaccactcaa

SEQ ID NO: 4619763 - DNA, 15 bp, Homo sapiens
caggggcatgactgt

SEQ ID NO: 4619764 - DNA, 20 bp, Homo sapiens
cagataaagaaactgaggcc

SEQ ID NO: 4619765 - DNA, 16 bp, Homo sapiens
cagataacataccttt

SEQ ID NO: 4619766 - DNA, 13 bp, Homo sapiens
cagataacctaat

SEQ ID NO: 4619767 - DNA, 18 bp, Homo sapiens
cagataacctaataattg

SEQ ID NO: 4619768 - DNA, 16 bp, Homo sapiens
cagatacataggtctg

SEQ ID NO: 4619769 - DNA, 17 bp, Homo sapiens
cagatcaagctgtgaga

SEQ ID NO: 4619770 - DNA, 12 bp, Homo sapiens
cagatgaggccc

SEQ ID NO: 4619771 - DNA, 15 bp, Homo sapiens
cagatgaggccctgc

SEQ ID NO: 4619772 - DNA, 17 bp, Homo sapiens
cagatgaggccctgcac

SEQ ID NO: 4619773 - DNA, 20 bp, Homo sapiens
cagatgaggccctgcacctt

SEQ ID NO: 4619774 - DNA, 17 bp, Homo sapiens
cagatgcccttgctggg

SEQ ID NO: 4619775 - DNA, 16 bp, Homo sapiens
cagatgctaggaagct

SEQ ID NO: 4619776 - DNA, 16 bp, Homo sapiens
cagatggaaaggagcc

SEQ ID NO: 4619777 - DNA, 23 bp, Homo sapiens
cagatgggcatatgtgtcagtgg

SEQ ID NO: 4619778 - DNA, 17 bp, Homo sapiens
cagatgtaggagggact

SEQ ID NO: 4619779 - DNA, 24 bp, Homo sapiens
cagatgtaggagggactgtcgctg

SEQ ID NO: 4619780 - DNA, 18 bp, Homo sapiens
cagatgttttacgtctgg

SEQ ID NO: 4619781 - DNA, 13 bp, Homo sapiens
cagattctcttga

SEQ ID NO: 4619782 - DNA, 14 bp, Homo sapiens
cagattctcttgaa

SEQ ID NO: 4619783 - DNA, 12 bp, Homo sapiens
cagattgcatgt

SEQ ID NO: 4619784 - DNA, 15 bp, Homo sapiens
cagattgcatgtgac

SEQ ID NO: 4619785 - DNA, 17 bp, Homo sapiens
cagatttactaaatcaa

SEQ ID NO: 4619786 - DNA, 24 bp, Homo sapiens
cagatttgtctttttgttgtaaaa

SEQ ID NO: 4619787 - DNA, 14 bp, Homo sapiens
cagatttttttgta

SEQ ID NO: 4619788 - DNA, 21 bp, Homo sapiens
cagcaaacactccaccctcca

SEQ ID NO: 4619789 - DNA, 13 bp, Homo sapiens
cagcaaattttca

SEQ ID NO: 4619790 - DNA, 12 bp, Homo sapiens
cagcaaccccag

SEQ ID NO: 4619791 - DNA, 15 bp, Homo sapiens
cagcaaggcccgagc

SEQ ID NO: 4619792 - DNA, 16 bp, Homo sapiens
cagcaaggcccgagca

SEQ ID NO: 4619793 - DNA, 20 bp, Homo sapiens
cagcaaggcccgagcagctg

SEQ ID NO: 4619794 - DNA, 13 bp, Homo sapiens
cagcaagtgtttg

SEQ ID NO: 4619795 - DNA, 23 bp, Homo sapiens
cagcaagttagaactagccaaac

SEQ ID NO: 4619796 - DNA, 15 bp, Homo sapiens
cagcaatattttgta

SEQ ID NO: 4619797 - DNA, 16 bp, Homo sapiens
cagcacacaggcagcc

SEQ ID NO: 4619798 - DNA, 20 bp, Homo sapiens
cagcacacaggcagccagcc

SEQ ID NO: 4619799 - DNA, 15 bp, Homo sapiens
cagcacacagggcag

SEQ ID NO: 4619800 - DNA, 19 bp, Homo sapiens
cagcacacagggcagtgag

SEQ ID NO: 4619801 - DNA, 18 bp, Homo sapiens
cagcacctccaggcctgt

SEQ ID NO: 4619802 - DNA, 15 bp, Homo sapiens
cagcactactgggtg

SEQ ID NO: 4619803 - DNA, 16 bp, Homo sapiens
cagcactactgggtgt

SEQ ID NO: 4619804 - DNA, 19 bp, Homo sapiens
cagcactactgggtgtcat

SEQ ID NO: 4619805 - DNA, 20 bp, Homo sapiens
cagcactactgggtgtcatt

SEQ ID NO: 4619806 - DNA, 21 bp, Homo sapiens
cagcactccccagagctgtgc

SEQ ID NO: 4619807 - DNA, 14 bp, Homo sapiens
cagcactgtggaca

SEQ ID NO: 4619808 - DNA, 19 bp, Homo sapiens
cagcacttagacctgccag

SEQ ID NO: 4619809 - DNA, 18 bp, Homo sapiens
cagcacttgtccagctga

SEQ ID NO: 4619810 - DNA, 18 bp, Homo sapiens
cagcagaaaacctgttca

SEQ ID NO: 4619811 - DNA, 16 bp, Homo sapiens
cagcagacatccacac

SEQ ID NO: 4619812 - DNA, 15 bp, Homo sapiens
cagcagcaaattttc

SEQ ID NO: 4619813 - DNA, 22 bp, Homo sapiens
cagcagcacttagacctgccag

SEQ ID NO: 4619814 - DNA, 14 bp, Homo sapiens
cagcagccagccct

SEQ ID NO: 4619815 - DNA, 19 bp, Homo sapiens
cagcagccagccctgcctg

SEQ ID NO: 4619816 - DNA, 20 bp, Homo sapiens
cagcagccagccctgcctgg

SEQ ID NO: 4619817 - DNA, 21 bp, Homo sapiens
cagcagccagccctgcctgga

SEQ ID NO: 4619818 - DNA, 21 bp, Homo sapiens
cagcagcctggggctggcctc

SEQ ID NO: 4619819 - DNA, 13 bp, Homo sapiens
cagcaggaataaa

SEQ ID NO: 4619820 - DNA, 14 bp, Homo sapiens
cagcaggaataaag

SEQ ID NO: 4619821 - DNA, 15 bp, Homo sapiens
cagcaggaataaaga

SEQ ID NO: 4619822 - DNA, 16 bp, Homo sapiens
cagcaggctagacaga

SEQ ID NO: 4619823 - DNA, 20 bp, Homo sapiens
cagcagggctggtcacctcc

SEQ ID NO: 4619824 - DNA, 15 bp, Homo sapiens
cagcaggggggctgt

SEQ ID NO: 4619825 - DNA, 20 bp, Homo sapiens
cagcagggtcttttcatctg

SEQ ID NO: 4619826 - DNA, 22 bp, Homo sapiens
cagcagttgaggtggggtagtg

SEQ ID NO: 4619827 - DNA, 21 bp, Homo sapiens
cagcatacttcaaaactgttt

SEQ ID NO: 4619828 - DNA, 16 bp, Homo sapiens
cagcatcagaaatcct

SEQ ID NO: 4619829 - DNA, 12 bp, Homo sapiens
cagcatccctgg

SEQ ID NO: 4619830 - DNA, 23 bp, Homo sapiens
cagcatctcccagcaagacctca

SEQ ID NO: 4619831 - DNA, 19 bp, Homo sapiens
cagcatgcctgtcctttca

SEQ ID NO: 4619832 - DNA, 15 bp, Homo sapiens
cagcatgcttgggct

SEQ ID NO: 4619833 - DNA, 18 bp, Homo sapiens
cagcatgggtccagaaga

SEQ ID NO: 4619834 - DNA, 13 bp, Homo sapiens
cagcatgtgcctt

SEQ ID NO: 4619835 - DNA, 16 bp, Homo sapiens
cagcattgctttctga

SEQ ID NO: 4619836 - DNA, 20 bp, Homo sapiens
cagccaacacgcacctgcct

SEQ ID NO: 4619837 - DNA, 23 bp, Homo sapiens
cagccaacacgcacctgcctcag

SEQ ID NO: 4619838 - DNA, 20 bp, Homo sapiens
cagccacacttctcaggaca

SEQ ID NO: 4619839 - DNA, 12 bp, Homo sapiens
cagccacaggac

SEQ ID NO: 4619840 - DNA, 15 bp, Homo sapiens
cagccacaggaccac

SEQ ID NO: 4619841 - DNA, 18 bp, Homo sapiens
cagccaccctgaggagtc

SEQ ID NO: 4619842 - DNA, 17 bp, Homo sapiens
cagccagaacgtggctc

SEQ ID NO: 4619843 - DNA, 13 bp, Homo sapiens
cagccagccctgc

SEQ ID NO: 4619844 - DNA, 14 bp, Homo sapiens
cagccagccctgcc

SEQ ID NO: 4619845 - DNA, 16 bp, Homo sapiens
cagccagccctgcctg

SEQ ID NO: 4619846 - DNA, 17 bp, Homo sapiens
cagccagccctgcctgg

SEQ ID NO: 4619847 - DNA, 21 bp, Homo sapiens
cagccagccctgcctggagga

SEQ ID NO: 4619848 - DNA, 16 bp, Homo sapiens
cagccagggcctgcga

SEQ ID NO: 4619849 - DNA, 13 bp, Homo sapiens
cagccaggtgcat

SEQ ID NO: 4619850 - DNA, 22 bp, Homo sapiens
cagcccaaggacagttcagaga

SEQ ID NO: 4619851 - DNA, 14 bp, Homo sapiens
cagcccagagcctg

SEQ ID NO: 4619852 - DNA, 18 bp, Homo sapiens
cagcccagagcctggctg

SEQ ID NO: 4619853 - DNA, 14 bp, Homo sapiens
cagcccagcacagg

SEQ ID NO: 4619854 - DNA, 16 bp, Homo sapiens
cagcccagctggcctg

SEQ ID NO: 4619855 - DNA, 22 bp, Homo sapiens
cagcccaggatactggcacaga

SEQ ID NO: 4619856 - DNA, 22 bp, Homo sapiens
cagcccatccattaggccagca

SEQ ID NO: 4619857 - DNA, 21 bp, Homo sapiens
cagcccatggaggcagatgcc

SEQ ID NO: 4619858 - DNA, 12 bp, Homo sapiens
cagccccaccct

SEQ ID NO: 4619859 - DNA, 22 bp, Homo sapiens
cagccccctcctggtgccacct

SEQ ID NO: 4619860 - DNA, 19 bp, Homo sapiens
cagccccgacttcctgact

SEQ ID NO: 4619861 - DNA, 19 bp, Homo sapiens
cagcccctaagtgcaaaca

SEQ ID NO: 4619862 - DNA, 20 bp, Homo sapiens
cagcccgacagtgccatccc

SEQ ID NO: 4619863 - DNA, 14 bp, Homo sapiens
cagccctgcctgga

SEQ ID NO: 4619864 - DNA, 20 bp, Homo sapiens
cagccctgcctggaggacct

SEQ ID NO: 4619865 - DNA, 21 bp, Homo sapiens
cagccctgctagacgcaccgc

SEQ ID NO: 4619866 - DNA, 22 bp, Homo sapiens
cagccctgctagacgcaccgcc

SEQ ID NO: 4619867 - DNA, 15 bp, Homo sapiens
cagccctggccccca

SEQ ID NO: 4619868 - DNA, 12 bp, Homo sapiens
cagccctgggaa

SEQ ID NO: 4619869 - DNA, 17 bp, Homo sapiens
cagcccttggcttgtgt

SEQ ID NO: 4619870 - DNA, 19 bp, Homo sapiens
cagcccttggcttgtgtta

SEQ ID NO: 4619871 - DNA, 21 bp, Homo sapiens
cagcctaccgctggccctgcc

SEQ ID NO: 4619872 - DNA, 22 bp, Homo sapiens
cagcctaccgctggccctgccg

SEQ ID NO: 4619873 - DNA, 17 bp, Homo sapiens
cagcctcacccctgccc

SEQ ID NO: 4619874 - DNA, 14 bp, Homo sapiens
cagcctcacttcct

SEQ ID NO: 4619875 - DNA, 23 bp, Homo sapiens
cagcctcccatccagggccccca

SEQ ID NO: 4619876 - DNA, 23 bp, Homo sapiens
cagcctccccctgtcccctctat

SEQ ID NO: 4619877 - DNA, 18 bp, Homo sapiens
cagcctcccgagtagctg

SEQ ID NO: 4619878 - DNA, 22 bp, Homo sapiens
cagcctgaggtgcccactccgc

SEQ ID NO: 4619879 - DNA, 11 bp, Homo sapiens
cagcctgctga

SEQ ID NO: 4619880 - DNA, 13 bp, Homo sapiens
cagcctgggccta

SEQ ID NO: 4619881 - DNA, 18 bp, Homo sapiens
cagcctgggcctatggag

SEQ ID NO: 4619882 - DNA, 21 bp, Homo sapiens
cagcctgggcctatggagagc

SEQ ID NO: 4619883 - DNA, 23 bp, Homo sapiens
cagcctgggcctatggagagccc

SEQ ID NO: 4619884 - DNA, 18 bp, Homo sapiens
cagcctggggctggcctc

SEQ ID NO: 4619885 - DNA, 16 bp, Homo sapiens
cagcctgggggacaga

SEQ ID NO: 4619886 - DNA, 19 bp, Homo sapiens
cagccttccctctgcattg

SEQ ID NO: 4619887 - DNA, 19 bp, Homo sapiens
cagccttcggacagacata

SEQ ID NO: 4619888 - DNA, 19 bp, Homo sapiens
cagccttgctacttgaagg

SEQ ID NO: 4619889 - DNA, 18 bp, Homo sapiens
cagcgatgtatgcagcta

SEQ ID NO: 4619890 - DNA, 24 bp, Homo sapiens
cagcgccaagtaaacagggtacct

SEQ ID NO: 4619891 - DNA, 18 bp, Homo sapiens
cagcgccaggctgaccac

SEQ ID NO: 4619892 - DNA, 15 bp, Homo sapiens
cagcgcccttcctct

SEQ ID NO: 4619893 - DNA, 20 bp, Homo sapiens
cagcgcccttcctctccacc

SEQ ID NO: 4619894 - DNA, 17 bp, Homo sapiens
cagcgcgcaacgctctg

SEQ ID NO: 4619895 - DNA, 21 bp, Homo sapiens
cagcggaaagccctgtgctcc

SEQ ID NO: 4619896 - DNA, 15 bp, Homo sapiens
cagcggcccaagagc

SEQ ID NO: 4619897 - DNA, 14 bp, Homo sapiens
cagcgggcggaggg

SEQ ID NO: 4619898 - DNA, 14 bp, Homo sapiens
cagcgtaaaatggt

SEQ ID NO: 4619899 - DNA, 16 bp, Homo sapiens
cagcgtaaaatggtga

SEQ ID NO: 4619900 - DNA, 21 bp, Homo sapiens
cagcgtgcccgcttccgctgt

SEQ ID NO: 4619901 - DNA, 12 bp, Homo sapiens
cagcgtggcctt

SEQ ID NO: 4619902 - DNA, 13 bp, Homo sapiens
cagcgtggccttg

SEQ ID NO: 4619903 - DNA, 14 bp, Homo sapiens
cagcgtggccttgt

SEQ ID NO: 4619904 - DNA, 15 bp, Homo sapiens
cagcgtggccttgtt

SEQ ID NO: 4619905 - DNA, 17 bp, Homo sapiens
cagcgtggcttttccta

SEQ ID NO: 4619906 - DNA, 23 bp, Homo sapiens
cagctaaccacttcgcacacacc

SEQ ID NO: 4619907 - DNA, 23 bp, Homo sapiens
cagctagacaatgatttggccag

SEQ ID NO: 4619908 - DNA, 20 bp, Homo sapiens
cagctagtgacccacatgcc

SEQ ID NO: 4619909 - DNA, 14 bp, Homo sapiens
cagctcagccagtg

SEQ ID NO: 4619910 - DNA, 17 bp, Homo sapiens
cagctccagcccccggg

SEQ ID NO: 4619911 - DNA, 15 bp, Homo sapiens
cagctcccccaggca

SEQ ID NO: 4619912 - DNA, 12 bp, Homo sapiens
cagctcctctgt

SEQ ID NO: 4619913 - DNA, 14 bp, Homo sapiens
cagctcctctgtct

SEQ ID NO: 4619914 - DNA, 15 bp, Homo sapiens
cagctcctctgtctc

SEQ ID NO: 4619915 - DNA, 18 bp, Homo sapiens
cagctcctctgtctcgag

SEQ ID NO: 4619916 - DNA, 11 bp, Homo sapiens
cagctcctgcc

SEQ ID NO: 4619917 - DNA, 12 bp, Homo sapiens
cagctctggaga

SEQ ID NO: 4619918 - DNA, 13 bp, Homo sapiens
cagctctggagaa

SEQ ID NO: 4619919 - DNA, 23 bp, Homo sapiens
cagctctttccaaattaaaacaa

SEQ ID NO: 4619920 - DNA, 17 bp, Homo sapiens
cagctgaataacctgca

SEQ ID NO: 4619921 - DNA, 17 bp, Homo sapiens
cagctgaatgcctcctg

SEQ ID NO: 4619922 - DNA, 23 bp, Homo sapiens
cagctgaatgcctcctgtgggga

SEQ ID NO: 4619923 - DNA, 24 bp, Homo sapiens
cagctgactgaatgcagaacggtt

SEQ ID NO: 4619924 - DNA, 22 bp, Homo sapiens
cagctgacttggttctgaagcc

SEQ ID NO: 4619925 - DNA, 15 bp, Homo sapiens
cagctgagcagggcc

SEQ ID NO: 4619926 - DNA, 16 bp, Homo sapiens
cagctgagcagggccg

SEQ ID NO: 4619927 - DNA, 16 bp, Homo sapiens
cagctgagcgccagga

SEQ ID NO: 4619928 - DNA, 18 bp, Homo sapiens
cagctgagcgccaggatg

SEQ ID NO: 4619929 - DNA, 17 bp, Homo sapiens
cagctgaggcaggggga

SEQ ID NO: 4619930 - DNA, 12 bp, Homo sapiens
cagctgagttgt

SEQ ID NO: 4619931 - DNA, 16 bp, Homo sapiens
cagctgctctaagccc

SEQ ID NO: 4619932 - DNA, 18 bp, Homo sapiens
cagctgctctaagcccag

SEQ ID NO: 4619933 - DNA, 20 bp, Homo sapiens
cagctgctctaagcccagga

SEQ ID NO: 4619934 - DNA, 21 bp, Homo sapiens
cagctgctctaagcccaggat

SEQ ID NO: 4619935 - DNA, 23 bp, Homo sapiens
cagctgctctaagcccaggatct

SEQ ID NO: 4619936 - DNA, 21 bp, Homo sapiens
cagctggaggaatacatttta

SEQ ID NO: 4619937 - DNA, 22 bp, Homo sapiens
cagctggaggaatacattttat

SEQ ID NO: 4619938 - DNA, 19 bp, Homo sapiens
cagctggcccgtgacagac

SEQ ID NO: 4619939 - DNA, 14 bp, Homo sapiens
cagctgggtcaggc

SEQ ID NO: 4619940 - DNA, 15 bp, Homo sapiens
cagctgggtcaggca

SEQ ID NO: 4619941 - DNA, 16 bp, Homo sapiens
cagctgggtcaggcag

SEQ ID NO: 4619942 - DNA, 18 bp, Homo sapiens
cagctggtcctgaccagg

SEQ ID NO: 4619943 - DNA, 13 bp, Homo sapiens
cagctgtgcctcg

SEQ ID NO: 4619944 - DNA, 14 bp, Homo sapiens
cagctgtgcctcgc

SEQ ID NO: 4619945 - DNA, 23 bp, Homo sapiens
cagctgtttgaaatgtttaataa

SEQ ID NO: 4619946 - DNA, 23 bp, Homo sapiens
cagcttcacctctgggaccccag

SEQ ID NO: 4619947 - DNA, 22 bp, Homo sapiens
cagcttctcagtttctgcctgg

SEQ ID NO: 4619948 - DNA, 19 bp, Homo sapiens
cagcttgtatgcaatggat

SEQ ID NO: 4619949 - DNA, 11 bp, Homo sapiens
cagctttgtcc

SEQ ID NO: 4619950 - DNA, 21 bp, Homo sapiens
caggaaaaaaaaaaaaagaaa

SEQ ID NO: 4619951 - DNA, 17 bp, Homo sapiens
caggaaaaacccgtcaa

SEQ ID NO: 4619952 - DNA, 19 bp, Homo sapiens
caggaaaaggcctggggtg

SEQ ID NO: 4619953 - DNA, 19 bp, Homo sapiens
caggaaagcatgcattgaa

SEQ ID NO: 4619954 - DNA, 17 bp, Homo sapiens
caggaacttctagctca

SEQ ID NO: 4619955 - DNA, 14 bp, Homo sapiens
caggaataaagact

SEQ ID NO: 4619956 - DNA, 21 bp, Homo sapiens
caggaatgacccttttgtgtc

SEQ ID NO: 4619957 - DNA, 14 bp, Homo sapiens
caggacaagcatgg

SEQ ID NO: 4619958 - DNA, 20 bp, Homo sapiens
caggacacaggcctgtgtag

SEQ ID NO: 4619959 - DNA, 21 bp, Homo sapiens
caggacatgcggtagccagca

SEQ ID NO: 4619960 - DNA, 22 bp, Homo sapiens
caggacatgcggtagccagcac

SEQ ID NO: 4619961 - DNA, 23 bp, Homo sapiens
caggacatgcggtagccagcaca

SEQ ID NO: 4619962 - DNA, 17 bp, Homo sapiens
caggacctggctgccat

SEQ ID NO: 4619963 - DNA, 17 bp, Homo sapiens
caggactggttccttcc

SEQ ID NO: 4619964 - DNA, 21 bp, Homo sapiens
caggagaagaaagaggtgacc

SEQ ID NO: 4619965 - DNA, 16 bp, Homo sapiens
caggagaagagaggaa

SEQ ID NO: 4619966 - DNA, 11 bp, Homo sapiens
caggagagagc

SEQ ID NO: 4619967 - DNA, 14 bp, Homo sapiens
caggagaggcagca

SEQ ID NO: 4619968 - DNA, 21 bp, Homo sapiens
caggagaggcagcatgcttgg

SEQ ID NO: 4619969 - DNA, 20 bp, Homo sapiens
caggagatggagggcttggc

SEQ ID NO: 4619970 - DNA, 15 bp, Homo sapiens
caggagcagccctgg

SEQ ID NO: 4619971 - DNA, 14 bp, Homo sapiens
caggagccccgcca

SEQ ID NO: 4619972 - DNA, 18 bp, Homo sapiens
caggagctacctgtgtgg

SEQ ID NO: 4619973 - DNA, 22 bp, Homo sapiens
caggaggctttctgggctctgg

SEQ ID NO: 4619974 - DNA, 16 bp, Homo sapiens
caggagggacaaagga

SEQ ID NO: 4619975 - DNA, 23 bp, Homo sapiens
caggagggacaaaggagcctgtg

SEQ ID NO: 4619976 - DNA, 19 bp, Homo sapiens
caggagggggtcgtggaga

SEQ ID NO: 4619977 - DNA, 20 bp, Homo sapiens
caggagggggtcgtggagag

SEQ ID NO: 4619978 - DNA, 17 bp, Homo sapiens
caggaggtgcagtggag

SEQ ID NO: 4619979 - DNA, 18 bp, Homo sapiens
caggaggtgcagtggagg

SEQ ID NO: 4619980 - DNA, 22 bp, Homo sapiens
caggaggtgcagtggagggggc

SEQ ID NO: 4619981 - DNA, 14 bp, Homo sapiens
caggaggtgtgaat

SEQ ID NO: 4619982 - DNA, 17 bp, Homo sapiens
caggaggtgtgaatgca

SEQ ID NO: 4619983 - DNA, 14 bp, Homo sapiens
caggagtagctgag

SEQ ID NO: 4619984 - DNA, 17 bp, Homo sapiens
caggagtagctgagctc

SEQ ID NO: 4619985 - DNA, 13 bp, Homo sapiens
caccactctggca

SEQ ID NO: 4619986 - DNA, 19 bp, Homo sapiens
caccactctggcagccaca

SEQ ID NO: 4619987 - DNA, 10 bp, Homo sapiens
caccagcctg

SEQ ID NO: 4619988 - DNA, 13 bp, Homo sapiens
caccagcctgctg

SEQ ID NO: 4619989 - DNA, 16 bp, Homo sapiens
caccagcctgctgaca

SEQ ID NO: 4619990 - DNA, 20 bp, Homo sapiens
caccagctgctgtgccccac

SEQ ID NO: 4619991 - DNA, 20 bp, Homo sapiens
caccagcttcactctctccg

SEQ ID NO: 4619992 - DNA, 13 bp, Homo sapiens
caccagggaagaa

SEQ ID NO: 4619993 - DNA, 11 bp, Homo sapiens
caccagggcca

SEQ ID NO: 4619994 - DNA, 13 bp, Homo sapiens
caccagggccaga

SEQ ID NO: 4619995 - DNA, 15 bp, Homo sapiens
caccagggccagagc

SEQ ID NO: 4619996 - DNA, 16 bp, Homo sapiens
caccagggccagagca

SEQ ID NO: 4619997 - DNA, 19 bp, Homo sapiens
caccaggggaaggaaggag

SEQ ID NO: 4619998 - DNA, 20 bp, Homo sapiens
caccaggggaggagcctgtg

SEQ ID NO: 4619999 - DNA, 21 bp, Homo sapiens
caccagtctagtccgtcctgg

SEQ ID NO: 4620000 - DNA, 19 bp, Homo sapiens
caccagtgcatcacatctg

SEQ ID NO: 4620001 - DNA, 20 bp, Homo sapiens
caccagtgcatcacatctgc

SEQ ID NO: 4620002 - DNA, 17 bp, Homo sapiens
caccagtgccacgtcat

SEQ ID NO: 4620003 - DNA, 20 bp, Homo sapiens
caccagtgggactgtggtga

SEQ ID NO: 4620004 - DNA, 21 bp, Homo sapiens
caccattatgctggtgtatgt

SEQ ID NO: 4620005 - DNA, 11 bp, Homo sapiens
caccattcctg

SEQ ID NO: 4620006 - DNA, 22 bp, Homo sapiens
caccattcctgcctttaagcca

SEQ ID NO: 4620007 - DNA, 15 bp, Homo sapiens
caccattgaactgta

SEQ ID NO: 4620008 - DNA, 21 bp, Homo sapiens
cacccaatcaagggaagaagg

SEQ ID NO: 4620009 - DNA, 13 bp, Homo sapiens
cacccacatgtga

SEQ ID NO: 4620010 - DNA, 19 bp, Homo sapiens
cacccacatgtgacacata

SEQ ID NO: 4620011 - DNA, 13 bp, Homo sapiens
cacccaggctgga

SEQ ID NO: 4620012 - DNA, 15 bp, Homo sapiens
cacccaggctggagt

SEQ ID NO: 4620013 - DNA, 17 bp, Homo sapiens
cacccagtagcccagag

SEQ ID NO: 4620014 - DNA, 16 bp, Homo sapiens
cacccagttcttcatt

SEQ ID NO: 4620015 - DNA, 18 bp, Homo sapiens
caccccaccctccctacc

SEQ ID NO: 4620016 - DNA, 16 bp, Homo sapiens
cacccccagccctggc

SEQ ID NO: 4620017 - DNA, 15 bp, Homo sapiens
cacccccagcctggg

SEQ ID NO: 4620018 - DNA, 19 bp, Homo sapiens
cacccccagcctgggccta

SEQ ID NO: 4620019 - DNA, 14 bp, Homo sapiens
cacccccagttcct

SEQ ID NO: 4620020 - DNA, 14 bp, Homo sapiens
caccccctgcctgg

SEQ ID NO: 4620021 - DNA, 12 bp, Homo sapiens
cacccccttccc

SEQ ID NO: 4620022 - DNA, 14 bp, Homo sapiens
cacccccttccccc

SEQ ID NO: 4620023 - DNA, 13 bp, Homo sapiens
cacccctccccat

SEQ ID NO: 4620024 - DNA, 18 bp, Homo sapiens
cacccctcccctgggact

SEQ ID NO: 4620025 - DNA, 17 bp, Homo sapiens
cacccctgcccctgtgg

SEQ ID NO: 4620026 - DNA, 21 bp, Homo sapiens
cacccctgtaatcaggcaagg

SEQ ID NO: 4620027 - DNA, 22 bp, Homo sapiens
cacccctgtaatcaggcaagga

SEQ ID NO: 4620028 - DNA, 20 bp, Homo sapiens
cacccggctcgtgtatttat

SEQ ID NO: 4620029 - DNA, 23 bp, Homo sapiens
cacccgtccccacacgagggccc

SEQ ID NO: 4620030 - DNA, 13 bp, Homo sapiens
caccctccacctt

SEQ ID NO: 4620031 - DNA, 19 bp, Homo sapiens
caccctcccagacctgcct

SEQ ID NO: 4620032 - DNA, 11 bp, Homo sapiens
caccctcccta

SEQ ID NO: 4620033 - DNA, 23 bp, Homo sapiens
caccctccctagctctgaaatca

SEQ ID NO: 4620034 - DNA, 16 bp, Homo sapiens
caccctcctgtaccgt

SEQ ID NO: 4620035 - DNA, 17 bp, Homo sapiens
caccctgaggtcaggga

SEQ ID NO: 4620036 - DNA, 12 bp, Homo sapiens
caccctgccccc

SEQ ID NO: 4620037 - DNA, 13 bp, Homo sapiens
caccctggcctga

SEQ ID NO: 4620038 - DNA, 15 bp, Homo sapiens
cacccttgggcagag

SEQ ID NO: 4620039 - DNA, 14 bp, Homo sapiens
caccgactcacctg

SEQ ID NO: 4620040 - DNA, 16 bp, Homo sapiens
caccgactcacctgcg

SEQ ID NO: 4620041 - DNA, 16 bp, Homo sapiens
caccgccacgtcccag

SEQ ID NO: 4620042 - DNA, 17 bp, Homo sapiens
caccgcctgaaggcaca

SEQ ID NO: 4620043 - DNA, 19 bp, Homo sapiens
caccgcctgaaggcacagc

SEQ ID NO: 4620044 - DNA, 18 bp, Homo sapiens
caccggcctgtgggtctc

SEQ ID NO: 4620045 - DNA, 19 bp, Homo sapiens
caccggcctgtgggtctct

SEQ ID NO: 4620046 - DNA, 20 bp, Homo sapiens
caccggcctgtgggtctctg

SEQ ID NO: 4620047 - DNA, 19 bp, Homo sapiens
caccgggccactccttcct

SEQ ID NO: 4620048 - DNA, 21 bp, Homo sapiens
caccgggccactccttcctgc

SEQ ID NO: 4620049 - DNA, 14 bp, Homo sapiens
caccgttcattcag

SEQ ID NO: 4620050 - DNA, 13 bp, Homo sapiens
caccgttctgtgc

SEQ ID NO: 4620051 - DNA, 16 bp, Homo sapiens
cacctacagtgtacag

SEQ ID NO: 4620052 - DNA, 22 bp, Homo sapiens
cacctacttttctttcctcaga

SEQ ID NO: 4620053 - DNA, 14 bp, Homo sapiens
cacctagcagcacc

SEQ ID NO: 4620054 - DNA, 12 bp, Homo sapiens
cacctagcagcc

SEQ ID NO: 4620055 - DNA, 14 bp, Homo sapiens
cacctcacaactcc

SEQ ID NO: 4620056 - DNA, 15 bp, Homo sapiens
cacctcacaactcct

SEQ ID NO: 4620057 - DNA, 16 bp, Homo sapiens
cacctcaccccactta

SEQ ID NO: 4620058 - DNA, 12 bp, Homo sapiens
cacctcagcctc

SEQ ID NO: 4620059 - DNA, 13 bp, Homo sapiens
cacctcagcctcc

SEQ ID NO: 4620060 - DNA, 17 bp, Homo sapiens
cacctccaagcatttca

SEQ ID NO: 4620061 - DNA, 19 bp, Homo sapiens
cacctccaagcatttcatg

SEQ ID NO: 4620062 - DNA, 15 bp, Homo sapiens
cacctccaggcctgt

SEQ ID NO: 4620063 - DNA, 14 bp, Homo sapiens
cacctcctctgcca

SEQ ID NO: 4620064 - DNA, 14 bp, Homo sapiens
cacctcctgctggg

SEQ ID NO: 4620065 - DNA, 19 bp, Homo sapiens
cacctccttccccagctcc

SEQ ID NO: 4620066 - DNA, 14 bp, Homo sapiens
cacctcgctgggct

SEQ ID NO: 4620067 - DNA, 20 bp, Homo sapiens
cacctcggagggatggagaa

SEQ ID NO: 4620068 - DNA, 19 bp, Homo sapiens
cacctctgggaccccagct

SEQ ID NO: 4620069 - DNA, 21 bp, Homo sapiens
cacctctgggaccccagctgc

SEQ ID NO: 4620070 - DNA, 23 bp, Homo sapiens
cacctctgtgacccctccttgtc

SEQ ID NO: 4620071 - DNA, 12 bp, Homo sapiens
cacctcttccac

SEQ ID NO: 4620072 - DNA, 23 bp, Homo sapiens
cacctgacactaaccagagtcag

SEQ ID NO: 4620073 - DNA, 18 bp, Homo sapiens
cacctgcgcaagtgcctg

SEQ ID NO: 4620074 - DNA, 20 bp, Homo sapiens
cacctgggccctggggcctg

SEQ ID NO: 4620075 - DNA, 21 bp, Homo sapiens
cacctgggccctggggcctgt

SEQ ID NO: 4620076 - DNA, 22 bp, Homo sapiens
cacctgggccctggggcctgta

SEQ ID NO: 4620077 - DNA, 23 bp, Homo sapiens
cacctgggccctggggcctgtac

SEQ ID NO: 4620078 - DNA, 22 bp, Homo sapiens
cacctgtccccaccctccactc

SEQ ID NO: 4620079 - DNA, 13 bp, Homo sapiens
caccttcccttcc

SEQ ID NO: 4620080 - DNA, 15 bp, Homo sapiens
caccttcccttcctc

SEQ ID NO: 4620081 - DNA, 15 bp, Homo sapiens
caccttgtgtctgta

SEQ ID NO: 4620082 - DNA, 17 bp, Homo sapiens
cacgagccacaagctgc

SEQ ID NO: 4620083 - DNA, 21 bp, Homo sapiens
cacgagccacaagctgcactg

SEQ ID NO: 4620084 - DNA, 12 bp, Homo sapiens
cacgagccacct

SEQ ID NO: 4620085 - DNA, 15 bp, Homo sapiens
cacgcacctgcctca

SEQ ID NO: 4620086 - DNA, 15 bp, Homo sapiens
cacgcctctgtgtac

SEQ ID NO: 4620087 - DNA, 19 bp, Homo sapiens
cacggaggcctcgagcaga

SEQ ID NO: 4620088 - DNA, 22 bp, Homo sapiens
cacggaggcctcgagcagagag

SEQ ID NO: 4620089 - DNA, 18 bp, Homo sapiens
cacggatgcgtgggcaga

SEQ ID NO: 4620090 - DNA, 20 bp, Homo sapiens
cacggatgcgtgggcagagg

SEQ ID NO: 4620091 - DNA, 19 bp, Homo sapiens
cacggcacctgggccctgg

SEQ ID NO: 4620092 - DNA, 16 bp, Homo sapiens
cacggcctggctggtg

SEQ ID NO: 4620093 - DNA, 14 bp, Homo sapiens
cacggttatttaag

SEQ ID NO: 4620094 - DNA, 16 bp, Homo sapiens
cacggttatttaagca

SEQ ID NO: 4620095 - DNA, 16 bp, Homo sapiens
cacgtaatcctcctga

SEQ ID NO: 4620096 - DNA, 18 bp, Homo sapiens
cacgtaatcctcctgagt

SEQ ID NO: 4620097 - DNA, 18 bp, Homo sapiens
caatgtgacctggggcag

SEQ ID NO: 4620098 - DNA, 23 bp, Homo sapiens
caatgtgactgaaacaaaatgtt

SEQ ID NO: 4620099 - DNA, 23 bp, Homo sapiens
caatgtggaaaaaatattttaaa

SEQ ID NO: 4620100 - DNA, 18 bp, Homo sapiens
caatgttatgccagctcc

SEQ ID NO: 4620101 - DNA, 23 bp, Homo sapiens
caattagtgtgacagtttccaaa

SEQ ID NO: 4620102 - DNA, 15 bp, Homo sapiens
caattcagacaggca

SEQ ID NO: 4620103 - DNA, 21 bp, Homo sapiens
caattccgtagccagctgctc

SEQ ID NO: 4620104 - DNA, 19 bp, Homo sapiens
caattctgtgtggtatatt

SEQ ID NO: 4620105 - DNA, 23 bp, Homo sapiens
caattctgtttttaatgctattt

SEQ ID NO: 4620106 - DNA, 14 bp, Homo sapiens
caattgacaaatga

SEQ ID NO: 4620107 - DNA, 15 bp, Homo sapiens
caattgacaaatgat

SEQ ID NO: 4620108 - DNA, 17 bp, Homo sapiens
caattgggagctgccaa

SEQ ID NO: 4620109 - DNA, 21 bp, Homo sapiens
caattgggagctgccaagagt

SEQ ID NO: 4620110 - DNA, 20 bp, Homo sapiens
caattttatgtattctttct

SEQ ID NO: 4620111 - DNA, 18 bp, Homo sapiens
caatttttgtacttttag

SEQ ID NO: 4620112 - DNA, 21 bp, Homo sapiens
cacaaaacctgtattactgaa

SEQ ID NO: 4620113 - DNA, 12 bp, Homo sapiens
cacaagctgcac

SEQ ID NO: 4620114 - DNA, 17 bp, Homo sapiens
cacaagctgtccctgca

SEQ ID NO: 4620115 - DNA, 14 bp, Homo sapiens
cacaaggcagcaag

SEQ ID NO: 4620116 - DNA, 15 bp, Homo sapiens
cacaaggcagcaagg

SEQ ID NO: 4620117 - DNA, 14 bp, Homo sapiens
cacaaggcctggtc

SEQ ID NO: 4620118 - DNA, 20 bp, Homo sapiens
cacaatcactaaactttatt

SEQ ID NO: 4620119 - DNA, 14 bp, Homo sapiens
cacaattcctgtgc

SEQ ID NO: 4620120 - DNA, 16 bp, Homo sapiens
cacaattgttttacct

SEQ ID NO: 4620121 - DNA, 17 bp, Homo sapiens
cacaattgttttacctg

SEQ ID NO: 4620122 - DNA, 15 bp, Homo sapiens
cacacaccctgaggt

SEQ ID NO: 4620123 - DNA, 15 bp, Homo sapiens
cacacagactgttgt

SEQ ID NO: 4620124 - DNA, 22 bp, Homo sapiens
cacacagactgttgtccctgca

SEQ ID NO: 4620125 - DNA, 15 bp, Homo sapiens
cacacagctgagcac

SEQ ID NO: 4620126 - DNA, 17 bp, Homo sapiens
cacacagctgagcactt

SEQ ID NO: 4620127 - DNA, 10 bp, Homo sapiens
cacacaggca

SEQ ID NO: 4620128 - DNA, 14 bp, Homo sapiens
cacacaggcagcca

SEQ ID NO: 4620129 - DNA, 16 bp, Homo sapiens
cacacaggcagccagc

SEQ ID NO: 4620130 - DNA, 17 bp, Homo sapiens
cacacaggcatttcctg

SEQ ID NO: 4620131 - DNA, 21 bp, Homo sapiens
cacacaggcatttcctgggtg

SEQ ID NO: 4620132 - DNA, 12 bp, Homo sapiens
cacacagggcag

SEQ ID NO: 4620133 - DNA, 15 bp, Homo sapiens
cacacattttatgag

SEQ ID NO: 4620134 - DNA, 12 bp, Homo sapiens
cacaccaaggcc

SEQ ID NO: 4620135 - DNA, 21 bp, Homo sapiens
cacaccaaggccctgcatctg

SEQ ID NO: 4620136 - DNA, 19 bp, Homo sapiens
cacacccaccccctgcctg

SEQ ID NO: 4620137 - DNA, 12 bp, Homo sapiens
cacaccctgagg

SEQ ID NO: 4620138 - DNA, 13 bp, Homo sapiens
cacaccctgaggt

SEQ ID NO: 4620139 - DNA, 13 bp, Homo sapiens
cacacgcctctgt

SEQ ID NO: 4620140 - DNA, 15 bp, Homo sapiens
cacacgcctctgtgt

SEQ ID NO: 4620141 - DNA, 15 bp, Homo sapiens
cacacttcgctcttg

SEQ ID NO: 4620142 - DNA, 18 bp, Homo sapiens
cacacttcgctcttgagg

SEQ ID NO: 4620143 - DNA, 14 bp, Homo sapiens
cacacttctcagga

SEQ ID NO: 4620144 - DNA, 17 bp, Homo sapiens
cacacttctcaggacac

SEQ ID NO: 4620145 - DNA, 23 bp, Homo sapiens
cacagaaaagaaagttcatgctt

SEQ ID NO: 4620146 - DNA, 12 bp, Homo sapiens
cacagaaaattt

SEQ ID NO: 4620147 - DNA, 23 bp, Homo sapiens
cacagaaagccaggagcagccct

SEQ ID NO: 4620148 - DNA, 14 bp, Homo sapiens
cacagacaagcagc

SEQ ID NO: 4620149 - DNA, 22 bp, Homo sapiens
cacagacaagcagcccttgctt

SEQ ID NO: 4620150 - DNA, 17 bp, Homo sapiens
cacagacccctgggagc

SEQ ID NO: 4620151 - DNA, 22 bp, Homo sapiens
cacagactgttgtccctgcact

SEQ ID NO: 4620152 - DNA, 23 bp, Homo sapiens
cacagactgttgtccctgcactc

SEQ ID NO: 4620153 - DNA, 11 bp, Homo sapiens
cacagagaagg

SEQ ID NO: 4620154 - DNA, 20 bp, Homo sapiens
cacagagaagtttgtagcca

SEQ ID NO: 4620155 - DNA, 21 bp, Homo sapiens
cacagatggctttcagggcag

SEQ ID NO: 4620156 - DNA, 16 bp, Homo sapiens
cacagatttttttgta

SEQ ID NO: 4620157 - DNA, 18 bp, Homo sapiens
cacagatttttttgtaag

SEQ ID NO: 4620158 - DNA, 14 bp, Homo sapiens
cacagcaaccccag

SEQ ID NO: 4620159 - DNA, 16 bp, Homo sapiens
cacagcaattcctcag

SEQ ID NO: 4620160 - DNA, 15 bp, Homo sapiens
cacagcacagccaac

SEQ ID NO: 4620161 - DNA, 14 bp, Homo sapiens
cacagcagcctggg

SEQ ID NO: 4620162 - DNA, 22 bp, Homo sapiens
cacagccaacacgcacctgcct

SEQ ID NO: 4620163 - DNA, 13 bp, Homo sapiens
cacagccccaccc

SEQ ID NO: 4620164 - DNA, 19 bp, Homo sapiens
cacagccccacccttgtcc

SEQ ID NO: 4620165 - DNA, 15 bp, Homo sapiens
cacagcctcacccct

SEQ ID NO: 4620166 - DNA, 17 bp, Homo sapiens
cacagcctcacccctgc

SEQ ID NO: 4620167 - DNA, 18 bp, Homo sapiens
cacagccttccctctgca

SEQ ID NO: 4620168 - DNA, 23 bp, Homo sapiens
cacagccttcggacagacatatg

SEQ ID NO: 4620169 - DNA, 10 bp, Homo sapiens
cacagctcct

SEQ ID NO: 4620170 - DNA, 17 bp, Homo sapiens
cacagctgtttgaaatg

SEQ ID NO: 4620171 - DNA, 20 bp, Homo sapiens
cacaggacatgcggtagcca

SEQ ID NO: 4620172 - DNA, 23 bp, Homo sapiens
cacaggaccacctcctctgccag

SEQ ID NO: 4620173 - DNA, 18 bp, Homo sapiens
cacaggagctacctgtgt

SEQ ID NO: 4620174 - DNA, 18 bp, Homo sapiens
cacaggcagccagccgtg

SEQ ID NO: 4620175 - DNA, 19 bp, Homo sapiens
cacaggcagccagccgtgg

SEQ ID NO: 4620176 - DNA, 15 bp, Homo sapiens
cacaggcatttcctg

SEQ ID NO: 4620177 - DNA, 14 bp, Homo sapiens
cacaggcctgtgta

SEQ ID NO: 4620178 - DNA, 21 bp, Homo sapiens
cacaggcctgtgtagctgtga

SEQ ID NO: 4620179 - DNA, 23 bp, Homo sapiens
cacaggcctgtgtagctgtgacc

SEQ ID NO: 4620180 - DNA, 20 bp, Homo sapiens
cacagtagaactgtctgtga

SEQ ID NO: 4620181 - DNA, 21 bp, Homo sapiens
cacagtgaaacgcaattttac

SEQ ID NO: 4620182 - DNA, 13 bp, Homo sapiens
cacagtgggagct

SEQ ID NO: 4620183 - DNA, 21 bp, Homo sapiens
cacatatgcaccttgtgtctg

SEQ ID NO: 4620184 - DNA, 16 bp, Homo sapiens
cacatcatgagccttc

SEQ ID NO: 4620185 - DNA, 13 bp, Homo sapiens
cacatccctgggc

SEQ ID NO: 4620186 - DNA, 18 bp, Homo sapiens
cacatccctgggcctgct

SEQ ID NO: 4620187 - DNA, 17 bp, Homo sapiens
cacatctgcacactctc

SEQ ID NO: 4620188 - DNA, 15 bp, Homo sapiens
cacatgaaaaatttt

SEQ ID NO: 4620189 - DNA, 16 bp, Homo sapiens
cacatgaggccatctc

SEQ ID NO: 4620190 - DNA, 13 bp, Homo sapiens
cacatgctatgtt

SEQ ID NO: 4620191 - DNA, 23 bp, Homo sapiens
cacattaacattttgagctattt

SEQ ID NO: 4620192 - DNA, 17 bp, Homo sapiens
cacattaactccctcca

SEQ ID NO: 4620193 - DNA, 22 bp, Homo sapiens
cacattaactccctccaccagc

SEQ ID NO: 4620194 - DNA, 15 bp, Homo sapiens
cacattaggctgttg

SEQ ID NO: 4620195 - DNA, 23 bp, Homo sapiens
cacattcagggctattttttccc

SEQ ID NO: 4620196 - DNA, 22 bp, Homo sapiens
cacattcttggcttaatcattt

SEQ ID NO: 4620197 - DNA, 23 bp, Homo sapiens
cacattgggcagcgcccttcctc

SEQ ID NO: 4620198 - DNA, 18 bp, Homo sapiens
cacattgttcaactccct

SEQ ID NO: 4620199 - DNA, 13 bp, Homo sapiens
cacattttatgag

SEQ ID NO: 4620200 - DNA, 15 bp, Homo sapiens
cacattttatgagag

SEQ ID NO: 4620201 - DNA, 16 bp, Homo sapiens
caccaaggccctgcat

SEQ ID NO: 4620202 - DNA, 18 bp, Homo sapiens
caccaagggcgcaagagt

SEQ ID NO: 4620203 - DNA, 22 bp, Homo sapiens
caccaagttggaacatccttgg

SEQ ID NO: 4620204 - DNA, 23 bp, Homo sapiens
caccaatgtacccaccgggccac

SEQ ID NO: 4620205 - DNA, 13 bp, Homo sapiens
caccaccacaccc

SEQ ID NO: 4620206 - DNA, 20 bp, Homo sapiens
caccacgtctggctccctgc

SEQ ID NO: 4620207 - DNA, 12 bp, Homo sapiens
caccactctggc

SEQ ID NO: 4620208 - DNA, 16 bp, Homo sapiens
cacgtagggggcaggg

SEQ ID NO: 4620209 - DNA, 17 bp, Homo sapiens
cacgtagggggcagggg

SEQ ID NO: 4620210 - DNA, 22 bp, Homo sapiens
cacgtcccagcatccctggagc

SEQ ID NO: 4620211 - DNA, 20 bp, Homo sapiens
cacgtctggctccctgcccc

SEQ ID NO: 4620212 - DNA, 13 bp, Homo sapiens
cactaaaatacat

SEQ ID NO: 4620213 - DNA, 13 bp, Homo sapiens
cactaaactttat

SEQ ID NO: 4620214 - DNA, 19 bp, Homo sapiens
cactaagagggcagactgt

SEQ ID NO: 4620215 - DNA, 15 bp, Homo sapiens
cactaatttttgtat

SEQ ID NO: 4620216 - DNA, 23 bp, Homo sapiens
cactaatttttgtattatttttg

SEQ ID NO: 4620217 - DNA, 17 bp, Homo sapiens
cactactgcagcacctc

SEQ ID NO: 4620218 - DNA, 15 bp, Homo sapiens
cactactgggtgtca

SEQ ID NO: 4620219 - DNA, 21 bp, Homo sapiens
cactactgggtgtcatttcat

SEQ ID NO: 4620220 - DNA, 13 bp, Homo sapiens
cactagaatggat

SEQ ID NO: 4620221 - DNA, 21 bp, Homo sapiens
cactagtgcaattccaagaaa

SEQ ID NO: 4620222 - DNA, 14 bp, Homo sapiens
cactatacagattc

SEQ ID NO: 4620223 - DNA, 18 bp, Homo sapiens
cactatctgggtgcatga

SEQ ID NO: 4620224 - DNA, 16 bp, Homo sapiens
cactattttcaaagaa

SEQ ID NO: 4620225 - DNA, 12 bp, Homo sapiens
cactcaaaggcc

SEQ ID NO: 4620226 - DNA, 20 bp, Homo sapiens
cactcaaaggccagacctgc

SEQ ID NO: 4620227 - DNA, 13 bp, Homo sapiens
cactcaagcttgg

SEQ ID NO: 4620228 - DNA, 13 bp, Homo sapiens
cactcagaagcct

SEQ ID NO: 4620229 - DNA, 15 bp, Homo sapiens
cactcagaagcctgg

SEQ ID NO: 4620230 - DNA, 19 bp, Homo sapiens
cactcagaagcctgggggc

SEQ ID NO: 4620231 - DNA, 20 bp, Homo sapiens
cactcagctgtcctgcagca

SEQ ID NO: 4620232 - DNA, 16 bp, Homo sapiens
cactcagttgcagggt

SEQ ID NO: 4620233 - DNA, 11 bp, Homo sapiens
cactccaactc

SEQ ID NO: 4620234 - DNA, 17 bp, Homo sapiens
cactccaccctccacct

SEQ ID NO: 4620235 - DNA, 12 bp, Homo sapiens
cactccagcctg

SEQ ID NO: 4620236 - DNA, 13 bp, Homo sapiens
cactccagcctgg

SEQ ID NO: 4620237 - DNA, 14 bp, Homo sapiens
cactccagcctggg

SEQ ID NO: 4620238 - DNA, 13 bp, Homo sapiens
cactccagctcct

SEQ ID NO: 4620239 - DNA, 17 bp, Homo sapiens
cactccccagagctgtg

SEQ ID NO: 4620240 - DNA, 9 bp, Homo sapiens
cactcccta

SEQ ID NO: 4620241 - DNA, 14 bp, Homo sapiens
cactccctaggccc

SEQ ID NO: 4620242 - DNA, 15 bp, Homo sapiens
cactccctaggccca

SEQ ID NO: 4620243 - DNA, 20 bp, Homo sapiens
cactccctaggcccaagtct

SEQ ID NO: 4620244 - DNA, 14 bp, Homo sapiens
cactccgccagcca

SEQ ID NO: 4620245 - DNA, 16 bp, Homo sapiens
cactccgccagccaca

SEQ ID NO: 4620246 - DNA, 19 bp, Homo sapiens
cactccgccagccacagga

SEQ ID NO: 4620247 - DNA, 21 bp, Homo sapiens
cactccgccagccacaggacc

SEQ ID NO: 4620248 - DNA, 17 bp, Homo sapiens
cactccgcgccgatgcc

SEQ ID NO: 4620249 - DNA, 12 bp, Homo sapiens
cactcctgctgt

SEQ ID NO: 4620250 - DNA, 12 bp, Homo sapiens
cactccttcctg

SEQ ID NO: 4620251 - DNA, 14 bp, Homo sapiens
cactccttcctgcc

SEQ ID NO: 4620252 - DNA, 15 bp, Homo sapiens
cactccttcctgccc

SEQ ID NO: 4620253 - DNA, 17 bp, Homo sapiens
cactccttctctcactg

SEQ ID NO: 4620254 - DNA, 19 bp, Homo sapiens
cactcggggtccctggagg

SEQ ID NO: 4620255 - DNA, 22 bp, Homo sapiens
cactctcttctccattccctag

SEQ ID NO: 4620256 - DNA, 17 bp, Homo sapiens
cactctgacaagctggc

SEQ ID NO: 4620257 - DNA, 19 bp, Homo sapiens
cactctgacaagctggcca

SEQ ID NO: 4620258 - DNA, 20 bp, Homo sapiens
cactctgacaagctggccaa

SEQ ID NO: 4620259 - DNA, 15 bp, Homo sapiens
cactctggcagccac

SEQ ID NO: 4620260 - DNA, 18 bp, Homo sapiens
cactctggcagccacact

SEQ ID NO: 4620261 - DNA, 17 bp, Homo sapiens
cactctgtgtctgagtg

SEQ ID NO: 4620262 - DNA, 17 bp, Homo sapiens
cactcttctcagccact

SEQ ID NO: 4620263 - DNA, 15 bp, Homo sapiens
cactcttctcttgag

SEQ ID NO: 4620264 - DNA, 20 bp, Homo sapiens
cactcttgtcacccaggctg

SEQ ID NO: 4620265 - DNA, 22 bp, Homo sapiens
cactcttgttgaagtgctgttt

SEQ ID NO: 4620266 - DNA, 15 bp, Homo sapiens
cactgaaaacatctg

SEQ ID NO: 4620267 - DNA, 20 bp, Homo sapiens
cactgaaggctttcagggcc

SEQ ID NO: 4620268 - DNA, 21 bp, Homo sapiens
cactgaaggctttcagggcct

SEQ ID NO: 4620269 - DNA, 16 bp, Homo sapiens
cactgactgtatggca

SEQ ID NO: 4620270 - DNA, 18 bp, Homo sapiens
cactgataaaagttttga

SEQ ID NO: 4620271 - DNA, 18 bp, Homo sapiens
cactgataatcacactgc

SEQ ID NO: 4620272 - DNA, 19 bp, Homo sapiens
cactgatgttgtgttttta

SEQ ID NO: 4620273 - DNA, 17 bp, Homo sapiens
cactgcaacctctgcct

SEQ ID NO: 4620274 - DNA, 18 bp, Homo sapiens
cactgcaacctctgcctc

SEQ ID NO: 4620275 - DNA, 17 bp, Homo sapiens
cactgcactccagcctg

SEQ ID NO: 4620276 - DNA, 19 bp, Homo sapiens
cactgcactccagcctggg

SEQ ID NO: 4620277 - DNA, 17 bp, Homo sapiens
cactgcagacttgtcca

SEQ ID NO: 4620278 - DNA, 14 bp, Homo sapiens
cactgcagggagga

SEQ ID NO: 4620279 - DNA, 19 bp, Homo sapiens
cactgcattatcttgctca

SEQ ID NO: 4620280 - DNA, 20 bp, Homo sapiens
cactgcattatcttgctcat

SEQ ID NO: 4620281 - DNA, 12 bp, Homo sapiens
cactgccaggag

SEQ ID NO: 4620282 - DNA, 13 bp, Homo sapiens
cactgccaggagg

SEQ ID NO: 4620283 - DNA, 15 bp, Homo sapiens
cactgcctctcacag

SEQ ID NO: 4620284 - DNA, 18 bp, Homo sapiens
cactggaggagagaagaa

SEQ ID NO: 4620285 - DNA, 19 bp, Homo sapiens
cactggtaggttgggacac

SEQ ID NO: 4620286 - DNA, 22 bp, Homo sapiens
cactggtaggttgggacaccag

SEQ ID NO: 4620287 - DNA, 18 bp, Homo sapiens
cactgtagacaggaaagc

SEQ ID NO: 4620288 - DNA, 23 bp, Homo sapiens
cactgtatagatccacagggagc

SEQ ID NO: 4620289 - DNA, 15 bp, Homo sapiens
cactgtgacccccag

SEQ ID NO: 4620290 - DNA, 19 bp, Homo sapiens
cactgtgatcaatattttt

SEQ ID NO: 4620291 - DNA, 21 bp, Homo sapiens
cactgtgatcaatatttttat

SEQ ID NO: 4620292 - DNA, 16 bp, Homo sapiens
cactgttctgttctca

SEQ ID NO: 4620293 - DNA, 15 bp, Homo sapiens
cactgtttgttttta

SEQ ID NO: 4620294 - DNA, 11 bp, Homo sapiens
cacttaatctt

SEQ ID NO: 4620295 - DNA, 14 bp, Homo sapiens
cacttaatttgtaa

SEQ ID NO: 4620296 - DNA, 19 bp, Homo sapiens
cacttacatatatttttaa

SEQ ID NO: 4620297 - DNA, 19 bp, Homo sapiens
cacttagacctgccagcca

SEQ ID NO: 4620298 - DNA, 22 bp, Homo sapiens
cacttagacctgccagccactg

SEQ ID NO: 4620299 - DNA, 21 bp, Homo sapiens
cacttatctcgaatttgaaga

SEQ ID NO: 4620300 - DNA, 24 bp, Homo sapiens
cacttatctcgaatttgaagagat

SEQ ID NO: 4620301 - DNA, 15 bp, Homo sapiens
cacttcaatgcacat

SEQ ID NO: 4620302 - DNA, 17 bp, Homo sapiens
cacttcacgctttcagc

SEQ ID NO: 4620303 - DNA, 14 bp, Homo sapiens
cacttcatttttaa

SEQ ID NO: 4620304 - DNA, 20 bp, Homo sapiens
cacttccacctccagcctct

SEQ ID NO: 4620305 - DNA, 20 bp, Homo sapiens
cacttcctttgcccttcctc

SEQ ID NO: 4620306 - DNA, 22 bp, Homo sapiens
cacttcctttgcccttcctcct

SEQ ID NO: 4620307 - DNA, 15 bp, Homo sapiens
cacttccttttaact

SEQ ID NO: 4620308 - DNA, 13 bp, Homo sapiens
cacttcgcacaca

SEQ ID NO: 4620309 - DNA, 14 bp, Homo sapiens
cacttcgcacacac

SEQ ID NO: 4620310 - DNA, 17 bp, Homo sapiens
cacttcgcacacaccca

SEQ ID NO: 4620311 - DNA, 21 bp, Homo sapiens
cacttctcaggacacaggcct

SEQ ID NO: 4620312 - DNA, 22 bp, Homo sapiens
cacttctcaggacacaggcctg

SEQ ID NO: 4620313 - DNA, 23 bp, Homo sapiens
cacttctggcttcagcccccacc

SEQ ID NO: 4620314 - DNA, 12 bp, Homo sapiens
cacttcttcacc

SEQ ID NO: 4620315 - DNA, 23 bp, Homo sapiens
cacttgacagactgtagcttctc

SEQ ID NO: 4620316 - DNA, 12 bp, Homo sapiens
cacttgccctgt

SEQ ID NO: 4620317 - DNA, 13 bp, Homo sapiens
cacttgccctgtg

SEQ ID NO: 4620318 - DNA, 16 bp, Homo sapiens
cacttgccctgtgttc

SEQ ID NO: 4620319 - DNA, 17 bp, Homo sapiens
cacttgctgctttttct

SEQ ID NO: 4620320 - DNA, 14 bp, Homo sapiens
cacttgcttcttat

SEQ ID NO: 4620321 - DNA, 15 bp, Homo sapiens
cacttgtccagctga

SEQ ID NO: 4620322 - DNA, 20 bp, Homo sapiens
cacttgtcccactatctggg

SEQ ID NO: 4620323 - DNA, 18 bp, Homo sapiens
cactttcctttcaataaa

SEQ ID NO: 4620324 - DNA, 23 bp, Homo sapiens
cactttctcggtccactcttgtt

SEQ ID NO: 4620325 - DNA, 17 bp, Homo sapiens
cactttgcaactccctg

SEQ ID NO: 4620326 - DNA, 13 bp, Homo sapiens
cacttttatgttt

SEQ ID NO: 4620327 - DNA, 17 bp, Homo sapiens
cactttttacagcagca

SEQ ID NO: 4620328 - DNA, 15 bp, Homo sapiens
cagaaaacctgttca

SEQ ID NO: 4620329 - DNA, 16 bp, Homo sapiens
cagaaaagtaattttg

SEQ ID NO: 4620330 - DNA, 15 bp, Homo sapiens
cagaaacatgtcttg

SEQ ID NO: 4620331 - DNA, 16 bp, Homo sapiens
cagaaaccaagagaca

SEQ ID NO: 4620332 - DNA, 15 bp, Homo sapiens
cagaaagccaggagc

SEQ ID NO: 4620333 - DNA, 16 bp, Homo sapiens
cagaaagggagggctc

SEQ ID NO: 4620334 - DNA, 18 bp, Homo sapiens
cagaaagggagggctctg

SEQ ID NO: 4620335 - DNA, 20 bp, Homo sapiens
cagaaagggagggctctgag

SEQ ID NO: 4620336 - DNA, 22 bp, Homo sapiens
cagaaagggagggctctgaggc

SEQ ID NO: 4620337 - DNA, 16 bp, Homo sapiens
cagaaatagttgtctg

SEQ ID NO: 4620338 - DNA, 17 bp, Homo sapiens
cagaaatagttgtctgt

SEQ ID NO: 4620339 - DNA, 18 bp, Homo sapiens
cagaaatagttgtctgtg

SEQ ID NO: 4620340 - DNA, 22 bp, Homo sapiens
cagaaatcctctgttaatgtgg

SEQ ID NO: 4620341 - DNA, 12 bp, Homo sapiens
cagaacactctt

SEQ ID NO: 4620342 - DNA, 21 bp, Homo sapiens
cagaacaggaggtgtgaatgc

SEQ ID NO: 4620343 - DNA, 13 bp, Homo sapiens
cagaacagggtca

SEQ ID NO: 4620344 - DNA, 14 bp, Homo sapiens
cagaacagggtcat

SEQ ID NO: 4620345 - DNA, 19 bp, Homo sapiens
cagaacattcagctctgga

SEQ ID NO: 4620346 - DNA, 19 bp, Homo sapiens
cagaaccagtacctcagta

SEQ ID NO: 4620347 - DNA, 13 bp, Homo sapiens
cagaacgtggctc

SEQ ID NO: 4620348 - DNA, 17 bp, Homo sapiens
cagaagaggggcagctt

SEQ ID NO: 4620349 - DNA, 14 bp, Homo sapiens
cagaagagggggag

SEQ ID NO: 4620350 - DNA, 15 bp, Homo sapiens
cagaagatgaacaga

SEQ ID NO: 4620351 - DNA, 18 bp, Homo sapiens
cagaagatgaacagactg

SEQ ID NO: 4620352 - DNA, 12 bp, Homo sapiens
cagaagcctggg

SEQ ID NO: 4620353 - DNA, 19 bp, Homo sapiens
cagaagcctgggggcctgg

SEQ ID NO: 4620354 - DNA, 20 bp, Homo sapiens
cagaagcctgggggcctggc

SEQ ID NO: 4620355 - DNA, 17 bp, Homo sapiens
cagaaggaaagaagggg

SEQ ID NO: 4620356 - DNA, 12 bp, Homo sapiens
cagaaggccctt

SEQ ID NO: 4620357 - DNA, 21 bp, Homo sapiens
cagaaggcccttaactatcac

SEQ ID NO: 4620358 - DNA, 13 bp, Homo sapiens
cagaagtgaaaat

SEQ ID NO: 4620359 - DNA, 23 bp, Homo sapiens
cagaagtgaggatgagacccagc

SEQ ID NO: 4620360 - DNA, 20 bp, Homo sapiens
cagaataaggcaggcattga

SEQ ID NO: 4620361 - DNA, 13 bp, Homo sapiens
cagaataggaaga

SEQ ID NO: 4620362 - DNA, 20 bp, Homo sapiens
cagaataggaagatatgcca

SEQ ID NO: 4620363 - DNA, 15 bp, Homo sapiens
cagacaagcagccct

SEQ ID NO: 4620364 - DNA, 21 bp, Homo sapiens
cagacagctccaccctggccg

SEQ ID NO: 4620365 - DNA, 20 bp, Homo sapiens
cagacaggccccgtgaggca

SEQ ID NO: 4620366 - DNA, 12 bp, Homo sapiens
cagacataaagc

SEQ ID NO: 4620367 - DNA, 15 bp, Homo sapiens
cagacataaagccat

SEQ ID NO: 4620368 - DNA, 13 bp, Homo sapiens
cagacccctggga

SEQ ID NO: 4620369 - DNA, 13 bp, Homo sapiens
cagaccctgccct

SEQ ID NO: 4620370 - DNA, 15 bp, Homo sapiens
cagaccctgcccttg

SEQ ID NO: 4620371 - DNA, 18 bp, Homo sapiens
cagacctaaagcaagcct

SEQ ID NO: 4620372 - DNA, 21 bp, Homo sapiens
cagacctaaagcaagcctgaa

SEQ ID NO: 4620373 - DNA, 17 bp, Homo sapiens
cagacctaatatcattt

SEQ ID NO: 4620374 - DNA, 19 bp, Homo sapiens
cagacctaatatcatttta

SEQ ID NO: 4620375 - DNA, 18 bp, Homo sapiens
cagacctgcatggtcaag

SEQ ID NO: 4620376 - DNA, 22 bp, Homo sapiens
cagacctgcatggtcaagcctc

SEQ ID NO: 4620377 - DNA, 20 bp, Homo sapiens
cagacctgtcaccctgcagg

SEQ ID NO: 4620378 - DNA, 21 bp, Homo sapiens
cagacctgtcaccctgcagga

SEQ ID NO: 4620379 - DNA, 19 bp, Homo sapiens
cagacctgttagcagacag

SEQ ID NO: 4620380 - DNA, 20 bp, Homo sapiens
cagacctgttagcagacagg

SEQ ID NO: 4620381 - DNA, 14 bp, Homo sapiens
cagactcagttttt

SEQ ID NO: 4620382 - DNA, 16 bp, Homo sapiens
cagactcagttttttg

SEQ ID NO: 4620383 - DNA, 17 bp, Homo sapiens
cagactcagttttttgt

SEQ ID NO: 4620384 - DNA, 13 bp, Homo sapiens
cagactcctgagg

SEQ ID NO: 4620385 - DNA, 14 bp, Homo sapiens
cagactcctgagga

SEQ ID NO: 4620386 - DNA, 18 bp, Homo sapiens
cagactctaggttataca

SEQ ID NO: 4620387 - DNA, 20 bp, Homo sapiens
cagactgaaaggtgtgaaca

SEQ ID NO: 4620388 - DNA, 23 bp, Homo sapiens
cagactttggaaaatgcattgta

SEQ ID NO: 4620389 - DNA, 13 bp, Homo sapiens
cagagaaagcgca

SEQ ID NO: 4620390 - DNA, 16 bp, Homo sapiens
cagagaaagcgcagat

SEQ ID NO: 4620391 - DNA, 18 bp, Homo sapiens
cagagaacagaactggag

SEQ ID NO: 4620392 - DNA, 21 bp, Homo sapiens
cagagaagtttgtagccaggt

SEQ ID NO: 4620393 - DNA, 16 bp, Homo sapiens
cagagagacccttgtg

SEQ ID NO: 4620394 - DNA, 15 bp, Homo sapiens
cagagatcaggatca

SEQ ID NO: 4620395 - DNA, 18 bp, Homo sapiens
cagagatcaggatcagct

SEQ ID NO: 4620396 - DNA, 19 bp, Homo sapiens
cagagatcgacagacagcc

SEQ ID NO: 4620397 - DNA, 21 bp, Homo sapiens
cagagcaagtcctcactcttc

SEQ ID NO: 4620398 - DNA, 22 bp, Homo sapiens
cagagcactttgcaactccctg

SEQ ID NO: 4620399 - DNA, 13 bp, Homo sapiens
cagagcagacagg

SEQ ID NO: 4620400 - DNA, 12 bp, Homo sapiens
cagagcagctcc

SEQ ID NO: 4620401 - DNA, 14 bp, Homo sapiens
cagagcagctccac

SEQ ID NO: 4620402 - DNA, 20 bp, Homo sapiens
cagagcagctccaccactgt

SEQ ID NO: 4620403 - DNA, 21 bp, Homo sapiens
cagagcagtctaaacagagtc

SEQ ID NO: 4620404 - DNA, 15 bp, Homo sapiens
cagagcccccagccc

SEQ ID NO: 4620405 - DNA, 17 bp, Homo sapiens
cagagcccccagccctg

SEQ ID NO: 4620406 - DNA, 18 bp, Homo sapiens
cagagcccccagccctgg

SEQ ID NO: 4620407 - DNA, 22 bp, Homo sapiens
cagagcccctcctccagcccct

SEQ ID NO: 4620408 - DNA, 13 bp, Homo sapiens
cagagcctggggc

SEQ ID NO: 4620409 - DNA, 16 bp, Homo sapiens
cagagcctggggctct

SEQ ID NO: 4620410 - DNA, 14 bp, Homo sapiens
cagagcgtccttgg

SEQ ID NO: 4620411 - DNA, 22 bp, Homo sapiens
cagagctcatcccccctgctgc

SEQ ID NO: 4620412 - DNA, 23 bp, Homo sapiens
cagagctcatcccccctgctgcc

SEQ ID NO: 4620413 - DNA, 13 bp, Homo sapiens
cagagctgtgcca

SEQ ID NO: 4620414 - DNA, 15 bp, Homo sapiens
cagagcttcctgggg

SEQ ID NO: 4620415 - DNA, 17 bp, Homo sapiens
cagagcttcctggggac

SEQ ID NO: 4620416 - DNA, 19 bp, Homo sapiens
cagaggaatgtgggctatg

SEQ ID NO: 4620417 - DNA, 17 bp, Homo sapiens
cagaggaatttatacct

SEQ ID NO: 4620418 - DNA, 18 bp, Homo sapiens
cagaggaatttatacctc

SEQ ID NO: 4620419 - DNA, 17 bp, Homo sapiens
cagaggcatttgagcag

SEQ ID NO: 4620420 - DNA, 14 bp, Homo sapiens
cagaggccctggag

SEQ ID NO: 4620421 - DNA, 16 bp, Homo sapiens
cagaggccctggaggt

SEQ ID NO: 4620422 - DNA, 14 bp, Homo sapiens
cagaggctgcccca

SEQ ID NO: 4620423 - DNA, 12 bp, Homo sapiens
cagagtccggga

SEQ ID NO: 4620424 - DNA, 14 bp, Homo sapiens
cagagtcctgcctt

SEQ ID NO: 4620425 - DNA, 15 bp, Homo sapiens
cagagtcctgccttc

SEQ ID NO: 4620426 - DNA, 18 bp, Homo sapiens
cagagtcctgccttcttc

SEQ ID NO: 4620427 - DNA, 15 bp, Homo sapiens
cagagtgaccagcac

SEQ ID NO: 4620428 - DNA, 18 bp, Homo sapiens
cagagtggcctccctgct

SEQ ID NO: 4620429 - DNA, 15 bp, Homo sapiens
cagagtgggccccgg

SEQ ID NO: 4620430 - DNA, 15 bp, Homo sapiens
cagagtgtacaaatt

SEQ ID NO: 4620431 - DNA, 16 bp, Homo sapiens
cagataaacaaacaag

SEQ ID NO: 4620432 - DNA, 17 bp, Homo sapiens
catccctgactggccaa

SEQ ID NO: 4620433 - DNA, 13 bp, Homo sapiens
catccctgggcct

SEQ ID NO: 4620434 - DNA, 18 bp, Homo sapiens
catccctgggcctgctgc

SEQ ID NO: 4620435 - DNA, 16 bp, Homo sapiens
catcctcatccctgac

SEQ ID NO: 4620436 - DNA, 21 bp, Homo sapiens
catcctctgatagctgtttca

SEQ ID NO: 4620437 - DNA, 21 bp, Homo sapiens
catcctgcagggcttctcctc

SEQ ID NO: 4620438 - DNA, 15 bp, Homo sapiens
catcctggggcagca

SEQ ID NO: 4620439 - DNA, 18 bp, Homo sapiens
catcctggggcagcactc

SEQ ID NO: 4620440 - DNA, 19 bp, Homo sapiens
catcctggggcagcactcc

SEQ ID NO: 4620441 - DNA, 20 bp, Homo sapiens
catccttcaaggtggcagct

SEQ ID NO: 4620442 - DNA, 15 bp, Homo sapiens
catccttctttcctt

SEQ ID NO: 4620443 - DNA, 17 bp, Homo sapiens
catccttctttccttgt

SEQ ID NO: 4620444 - DNA, 22 bp, Homo sapiens
catctaaacacaacaataactt

SEQ ID NO: 4620445 - DNA, 22 bp, Homo sapiens
catctaacaggaaaagagggag

SEQ ID NO: 4620446 - DNA, 22 bp, Homo sapiens
catctaactgatgagtaaactg

SEQ ID NO: 4620447 - DNA, 16 bp, Homo sapiens
catctaggtcctggct

SEQ ID NO: 4620448 - DNA, 14 bp, Homo sapiens
catctatcactgca

SEQ ID NO: 4620449 - DNA, 17 bp, Homo sapiens
catctatcactgcatta

SEQ ID NO: 4620450 - DNA, 20 bp, Homo sapiens
catctatcactgcattatct

SEQ ID NO: 4620451 - DNA, 13 bp, Homo sapiens
catctcaggagat

SEQ ID NO: 4620452 - DNA, 22 bp, Homo sapiens
catctcatgcccctggctggga

SEQ ID NO: 4620453 - DNA, 23 bp, Homo sapiens
catctccttacagtcactaatat

SEQ ID NO: 4620454 - DNA, 16 bp, Homo sapiens
catctcggctcactgc

SEQ ID NO: 4620455 - DNA, 16 bp, Homo sapiens
catctctctcttgcct

SEQ ID NO: 4620456 - DNA, 18 bp, Homo sapiens
catctctctcttgcctga

SEQ ID NO: 4620457 - DNA, 13 bp, Homo sapiens
catctctgcttgg

SEQ ID NO: 4620458 - DNA, 14 bp, Homo sapiens
catctcttgaaacc

SEQ ID NO: 4620459 - DNA, 12 bp, Homo sapiens
catctgactgcc

SEQ ID NO: 4620460 - DNA, 20 bp, Homo sapiens
catctgcaaaaggcctcttg

SEQ ID NO: 4620461 - DNA, 13 bp, Homo sapiens
catctgcacactc

SEQ ID NO: 4620462 - DNA, 14 bp, Homo sapiens
catctgggaaagac

SEQ ID NO: 4620463 - DNA, 16 bp, Homo sapiens
catctgggctcctcca

SEQ ID NO: 4620464 - DNA, 20 bp, Homo sapiens
catctgggctcctccagggt

SEQ ID NO: 4620465 - DNA, 17 bp, Homo sapiens
catctgtctgctctgca

SEQ ID NO: 4620466 - DNA, 21 bp, Homo sapiens
catctgtgcactgcccatgga

SEQ ID NO: 4620467 - DNA, 13 bp, Homo sapiens
catctgtgttcta

SEQ ID NO: 4620468 - DNA, 22 bp, Homo sapiens
catcttaaatctaaacaaaaaa

SEQ ID NO: 4620469 - DNA, 13 bp, Homo sapiens
catcttcaatatg

SEQ ID NO: 4620470 - DNA, 15 bp, Homo sapiens
catcttcaatatgaa

SEQ ID NO: 4620471 - DNA, 19 bp, Homo sapiens
catcttcaatatgaatcta

SEQ ID NO: 4620472 - DNA, 13 bp, Homo sapiens
catctttgtgaag

SEQ ID NO: 4620473 - DNA, 14 bp, Homo sapiens
catgaaaaagctgc

SEQ ID NO: 4620474 - DNA, 13 bp, Homo sapiens
catgaaaaatttt

SEQ ID NO: 4620475 - DNA, 22 bp, Homo sapiens
catgaaagtagcagtgtgaagt

SEQ ID NO: 4620476 - DNA, 12 bp, Homo sapiens
catgaaccaaat

SEQ ID NO: 4620477 - DNA, 13 bp, Homo sapiens
catgaaccctgcc

SEQ ID NO: 4620478 - DNA, 15 bp, Homo sapiens
catgaaccctgccct

SEQ ID NO: 4620479 - DNA, 17 bp, Homo sapiens
catgaataacatttaaa

SEQ ID NO: 4620480 - DNA, 20 bp, Homo sapiens
catgaataacatttaaattc

SEQ ID NO: 4620481 - DNA, 21 bp, Homo sapiens
catgaatcccacccacatgtg

SEQ ID NO: 4620482 - DNA, 17 bp, Homo sapiens
catgaattcatactctg

SEQ ID NO: 4620483 - DNA, 17 bp, Homo sapiens
catgacctccagctttc

SEQ ID NO: 4620484 - DNA, 20 bp, Homo sapiens
catgacctccagctttcctg

SEQ ID NO: 4620485 - DNA, 21 bp, Homo sapiens
catgacctccagctttcctgt

SEQ ID NO: 4620486 - DNA, 15 bp, Homo sapiens
catgactgtcgccac

SEQ ID NO: 4620487 - DNA, 14 bp, Homo sapiens
catgagactgccct

SEQ ID NO: 4620488 - DNA, 22 bp, Homo sapiens
catgagactttccgactgcttt

SEQ ID NO: 4620489 - DNA, 18 bp, Homo sapiens
catgagctcctgatcaga

SEQ ID NO: 4620490 - DNA, 22 bp, Homo sapiens
catgaggccactgctgcttctc

SEQ ID NO: 4620491 - DNA, 15 bp, Homo sapiens
catgaggccatctca

SEQ ID NO: 4620492 - DNA, 18 bp, Homo sapiens
catgaggccatctcagga

SEQ ID NO: 4620493 - DNA, 18 bp, Homo sapiens
catgagtctgtttcccaa

SEQ ID NO: 4620494 - DNA, 21 bp, Homo sapiens
catgagttggggtctggcagc

SEQ ID NO: 4620495 - DNA, 23 bp, Homo sapiens
catgagttggggtctggcagcct

SEQ ID NO: 4620496 - DNA, 14 bp, Homo sapiens
catgatacattttt

SEQ ID NO: 4620497 - DNA, 19 bp, Homo sapiens
catgatcaagatatatgtg

SEQ ID NO: 4620498 - DNA, 15 bp, Homo sapiens
catgatcttgagcaa

SEQ ID NO: 4620499 - DNA, 14 bp, Homo sapiens
catgatgcgggcca

SEQ ID NO: 4620500 - DNA, 12 bp, Homo sapiens
catgatggcaac

SEQ ID NO: 4620501 - DNA, 22 bp, Homo sapiens
catgatggcaacagaaaccaag

SEQ ID NO: 4620502 - DNA, 21 bp, Homo sapiens
catgatggccaggctgatctc

SEQ ID NO: 4620503 - DNA, 21 bp, Homo sapiens
catgatgtgaagagtttcaca

SEQ ID NO: 4620504 - DNA, 17 bp, Homo sapiens
catgatgtttccctctc

SEQ ID NO: 4620505 - DNA, 21 bp, Homo sapiens
catgattatagcaactaatgt

SEQ ID NO: 4620506 - DNA, 16 bp, Homo sapiens
catgcaaaatatgttt

SEQ ID NO: 4620507 - DNA, 13 bp, Homo sapiens
catgcaccttgct

SEQ ID NO: 4620508 - DNA, 15 bp, Homo sapiens
catgcactgatgttg

SEQ ID NO: 4620509 - DNA, 20 bp, Homo sapiens
catgcactgatgttgtgttt

SEQ ID NO: 4620510 - DNA, 20 bp, Homo sapiens
catgcagctcttcaacatga

SEQ ID NO: 4620511 - DNA, 12 bp, Homo sapiens
catgccccagtc

SEQ ID NO: 4620512 - DNA, 13 bp, Homo sapiens
catgcctctgagg

SEQ ID NO: 4620513 - DNA, 18 bp, Homo sapiens
catgcctctgaggccagc

SEQ ID NO: 4620514 - DNA, 20 bp, Homo sapiens
catgcctctgaggccagcct

SEQ ID NO: 4620515 - DNA, 22 bp, Homo sapiens
catgcctctgaggccagcctgg

SEQ ID NO: 4620516 - DNA, 23 bp, Homo sapiens
catgcctctgaggccagcctggc

SEQ ID NO: 4620517 - DNA, 16 bp, Homo sapiens
catgctatgttctgtc

SEQ ID NO: 4620518 - DNA, 18 bp, Homo sapiens
catgctatgttctgtctt

SEQ ID NO: 4620519 - DNA, 22 bp, Homo sapiens
catgctatgttctgtcttccca

SEQ ID NO: 4620520 - DNA, 11 bp, Homo sapiens
catgctcccaa

SEQ ID NO: 4620521 - DNA, 14 bp, Homo sapiens
catgctcccaactc

SEQ ID NO: 4620522 - DNA, 16 bp, Homo sapiens
catgctcccaactccc

SEQ ID NO: 4620523 - DNA, 17 bp, Homo sapiens
catgctcccaactccct

SEQ ID NO: 4620524 - DNA, 20 bp, Homo sapiens
catgctcccaactcccttct

SEQ ID NO: 4620525 - DNA, 18 bp, Homo sapiens
catgctgcaaaggagaag

SEQ ID NO: 4620526 - DNA, 15 bp, Homo sapiens
catgctgcagtgggt

SEQ ID NO: 4620527 - DNA, 22 bp, Homo sapiens
catgctggctcccagggccatg

SEQ ID NO: 4620528 - DNA, 20 bp, Homo sapiens
catgctgggccactggggac

SEQ ID NO: 4620529 - DNA, 16 bp, Homo sapiens
catgctgtgcattttt

SEQ ID NO: 4620530 - DNA, 19 bp, Homo sapiens
catgcttctactgtgacac

SEQ ID NO: 4620531 - DNA, 14 bp, Homo sapiens
catgcttgggctga

SEQ ID NO: 4620532 - DNA, 15 bp, Homo sapiens
catgcttgggctgac

SEQ ID NO: 4620533 - DNA, 22 bp, Homo sapiens
catgcttgggctgacccagcat

SEQ ID NO: 4620534 - DNA, 17 bp, Homo sapiens
catgcttttctgccact

SEQ ID NO: 4620535 - DNA, 20 bp, Homo sapiens
catgcttttctgccactcca

SEQ ID NO: 4620536 - DNA, 14 bp, Homo sapiens
catggacaggctgg

SEQ ID NO: 4620537 - DNA, 16 bp, Homo sapiens
catggacaggctggct

SEQ ID NO: 4620538 - DNA, 18 bp, Homo sapiens
catggacaggctggctcc

SEQ ID NO: 4620539 - DNA, 15 bp, Homo sapiens
catggaggcagatgc

SEQ ID NO: 4620540 - DNA, 16 bp, Homo sapiens
catggaggcagatgcc

SEQ ID NO: 4620541 - DNA, 19 bp, Homo sapiens
catggaggcagatgccctt

SEQ ID NO: 4620542 - DNA, 23 bp, Homo sapiens
catggaggcagatgcccttgctg

SEQ ID NO: 4620543 - DNA, 13 bp, Homo sapiens
catggaggccctc

SEQ ID NO: 4620544 - DNA, 21 bp, Homo sapiens
catggagggtatactgagggg

SEQ ID NO: 4620545 - DNA, 23 bp, Homo sapiens
catggagggtatactgaggggtc

SEQ ID NO: 4620546 - DNA, 22 bp, Homo sapiens
catggagtagaggtactagaat

SEQ ID NO: 4620547 - DNA, 13 bp, Homo sapiens
catggcatatttt

SEQ ID NO: 4620548 - DNA, 15 bp, Homo sapiens
catggcatattttaa

SEQ ID NO: 4620549 - DNA, 14 bp, Homo sapiens
catggccagactcc

SEQ ID NO: 4620550 - DNA, 22 bp, Homo sapiens
catggccctcattaatgacact

SEQ ID NO: 4620551 - DNA, 16 bp, Homo sapiens
catggcctatgcacat

SEQ ID NO: 4620552 - DNA, 18 bp, Homo sapiens
catggccttgaaacagtt

SEQ ID NO: 4620553 - DNA, 19 bp, Homo sapiens
catggctacctcagaaaga

SEQ ID NO: 4620554 - DNA, 23 bp, Homo sapiens
catggctgtgtttgcagcctgct

SEQ ID NO: 4620555 - DNA, 17 bp, Homo sapiens
catggggattgcagagt

SEQ ID NO: 4620556 - DNA, 22 bp, Homo sapiens
catgggtctggctagagggccc

SEQ ID NO: 4620557 - DNA, 16 bp, Homo sapiens
catggtacttcctctg

SEQ ID NO: 4620558 - DNA, 18 bp, Homo sapiens
catggtacttcctctgtg

SEQ ID NO: 4620559 - DNA, 13 bp, Homo sapiens
catggtcaagcct

SEQ ID NO: 4620560 - DNA, 16 bp, Homo sapiens
catggtcaagcctctt

SEQ ID NO: 4620561 - DNA, 16 bp, Homo sapiens
catggtcccacatccc

SEQ ID NO: 4620562 - DNA, 17 bp, Homo sapiens
catggtcccacatccct

SEQ ID NO: 4620563 - DNA, 20 bp, Homo sapiens
catggtcccacatccctggg

SEQ ID NO: 4620564 - DNA, 23 bp, Homo sapiens
catggtcccacatccctgggcct

SEQ ID NO: 4620565 - DNA, 17 bp, Homo sapiens
catggtcccttaaggca

SEQ ID NO: 4620566 - DNA, 17 bp, Homo sapiens
catggtggctcccgcct

SEQ ID NO: 4620567 - DNA, 17 bp, Homo sapiens
catggtttgcatttaaa

SEQ ID NO: 4620568 - DNA, 17 bp, Homo sapiens
catgtaaagaaatgtct

SEQ ID NO: 4620569 - DNA, 15 bp, Homo sapiens
catgtaaccactgca

SEQ ID NO: 4620570 - DNA, 16 bp, Homo sapiens
catgtaaccactgcac

SEQ ID NO: 4620571 - DNA, 14 bp, Homo sapiens
catgtaagaagccc

SEQ ID NO: 4620572 - DNA, 22 bp, Homo sapiens
catgtactttttagtaatttct

SEQ ID NO: 4620573 - DNA, 16 bp, Homo sapiens
catgtagccacccaac

SEQ ID NO: 4620574 - DNA, 17 bp, Homo sapiens
catgtagccacccaact

SEQ ID NO: 4620575 - DNA, 15 bp, Homo sapiens
catgtagcttcttct

SEQ ID NO: 4620576 - DNA, 16 bp, Homo sapiens
catgtagcttcttctg

SEQ ID NO: 4620577 - DNA, 19 bp, Homo sapiens
catgtagcttcttctgaaa

SEQ ID NO: 4620578 - DNA, 14 bp, Homo sapiens
catgtagggcaaga

SEQ ID NO: 4620579 - DNA, 18 bp, Homo sapiens
catgtagggcaagaggat

SEQ ID NO: 4620580 - DNA, 21 bp, Homo sapiens
catgtataaatataagtctat

SEQ ID NO: 4620581 - DNA, 21 bp, Homo sapiens
catgtatgtcttggacactgt

SEQ ID NO: 4620582 - DNA, 16 bp, Homo sapiens
catgtcattatgacat

SEQ ID NO: 4620583 - DNA, 21 bp, Homo sapiens
catgtcctaaagaagacattt

SEQ ID NO: 4620584 - DNA, 13 bp, Homo sapiens
catgtctgcttgt

SEQ ID NO: 4620585 - DNA, 22 bp, Homo sapiens
catgtctgcttgtcaaaagaaa

SEQ ID NO: 4620586 - DNA, 17 bp, Homo sapiens
catgtctgtatccccag

SEQ ID NO: 4620587 - DNA, 23 bp, Homo sapiens
catgtctgtatccccagtgcccg

SEQ ID NO: 4620588 - DNA, 14 bp, Homo sapiens
catgtcttgtacat

SEQ ID NO: 4620589 - DNA, 16 bp, Homo sapiens
catgtgacacatatgc

SEQ ID NO: 4620590 - DNA, 16 bp, Homo sapiens
catgtgactctgaagc

SEQ ID NO: 4620591 - DNA, 21 bp, Homo sapiens
catgtgatgttgtcttagcat

SEQ ID NO: 4620592 - DNA, 15 bp, Homo sapiens
catgtgattaatgtt

SEQ ID NO: 4620593 - DNA, 16 bp, Homo sapiens
catgtgattaatgttt

SEQ ID NO: 4620594 - DNA, 22 bp, Homo sapiens
catgtgattaatgttttcatta

SEQ ID NO: 4620595 - DNA, 15 bp, Homo sapiens
catgtgtacattctg

SEQ ID NO: 4620596 - DNA, 16 bp, Homo sapiens
catgtgtagcctgtgc

SEQ ID NO: 4620597 - DNA, 23 bp, Homo sapiens
catgtgtatattccttttaaaga

SEQ ID NO: 4620598 - DNA, 12 bp, Homo sapiens
catgtgtgcaga

SEQ ID NO: 4620599 - DNA, 13 bp, Homo sapiens
catgtgtgcagag

SEQ ID NO: 4620600 - DNA, 17 bp, Homo sapiens
catgtgtgcagagcaga

SEQ ID NO: 4620601 - DNA, 19 bp, Homo sapiens
catgtgtgcagagcagaca

SEQ ID NO: 4620602 - DNA, 20 bp, Homo sapiens
catgtgtgcagagcagacag

SEQ ID NO: 4620603 - DNA, 21 bp, Homo sapiens
catgtgtggtacatggtgttt

SEQ ID NO: 4620604 - DNA, 14 bp, Homo sapiens
catgttacttctct

SEQ ID NO: 4620605 - DNA, 20 bp, Homo sapiens
catgttcacaccgctgcact

SEQ ID NO: 4620606 - DNA, 21 bp, Homo sapiens
catgttgatcatgtacttttt

SEQ ID NO: 4620607 - DNA, 18 bp, Homo sapiens
catgttggccaggctggt

SEQ ID NO: 4620608 - DNA, 21 bp, Homo sapiens
catgttgtgcctccctggtga

SEQ ID NO: 4620609 - DNA, 13 bp, Homo sapiens
catgtttaatgtg

SEQ ID NO: 4620610 - DNA, 14 bp, Homo sapiens
catgtttaatgtga

SEQ ID NO: 4620611 - DNA, 18 bp, Homo sapiens
catgtttaatgtgaactc

SEQ ID NO: 4620612 - DNA, 22 bp, Homo sapiens
catgtttaatgtgaactctccc

SEQ ID NO: 4620613 - DNA, 23 bp, Homo sapiens
catgtttataaatcttatgctct

SEQ ID NO: 4620614 - DNA, 12 bp, Homo sapiens
catgttttaaca

SEQ ID NO: 4620615 - DNA, 14 bp, Homo sapiens
catgttttaacaaa

SEQ ID NO: 4620616 - DNA, 15 bp, Homo sapiens
catgttttaacaaaa

SEQ ID NO: 4620617 - DNA, 15 bp, Homo sapiens
catgttttccattgt

SEQ ID NO: 4620618 - DNA, 18 bp, Homo sapiens
cattaaaggcttctctct

SEQ ID NO: 4620619 - DNA, 24 bp, Homo sapiens
cattaaaggcttctctctcaccag

SEQ ID NO: 4620620 - DNA, 15 bp, Homo sapiens
cattaacggtgctaa

SEQ ID NO: 4620621 - DNA, 14 bp, Homo sapiens
cattaactccctcc

SEQ ID NO: 4620622 - DNA, 20 bp, Homo sapiens
cattaactccctccaccagc

SEQ ID NO: 4620623 - DNA, 12 bp, Homo sapiens
cattaatcttga

SEQ ID NO: 4620624 - DNA, 13 bp, Homo sapiens
cattaatcttgat

SEQ ID NO: 4620625 - DNA, 13 bp, Homo sapiens
cattactgggcct

SEQ ID NO: 4620626 - DNA, 12 bp, Homo sapiens
cattacttgaat

SEQ ID NO: 4620627 - DNA, 14 bp, Homo sapiens
cattacttgaatgt

SEQ ID NO: 4620628 - DNA, 15 bp, Homo sapiens
cattacttgctttca

SEQ ID NO: 4620629 - DNA, 20 bp, Homo sapiens
cattaggccagcaacgcttg

SEQ ID NO: 4620630 - DNA, 14 bp, Homo sapiens
cattataatttata

SEQ ID NO: 4620631 - DNA, 15 bp, Homo sapiens
cattatccttttatc

SEQ ID NO: 4620632 - DNA, 22 bp, Homo sapiens
cattatgacatttcttaaaact

SEQ ID NO: 4620633 - DNA, 22 bp, Homo sapiens
cattatgcacttttagaaatgc

SEQ ID NO: 4620634 - DNA, 23 bp, Homo sapiens
cattatttattaaaaatgttctc

SEQ ID NO: 4620635 - DNA, 19 bp, Homo sapiens
cattcagcagcaaattttc

SEQ ID NO: 4620636 - DNA, 20 bp, Homo sapiens
cattcagcagcaaattttca

SEQ ID NO: 4620637 - DNA, 20 bp, Homo sapiens
cattcagctctggagaacag

SEQ ID NO: 4620638 - DNA, 21 bp, Homo sapiens
cattcagctctggagaacagt

SEQ ID NO: 4620639 - DNA, 15 bp, Homo sapiens
cattcattttgaaat

SEQ ID NO: 4620640 - DNA, 11 bp, Homo sapiens
cattcattttt

SEQ ID NO: 4620641 - DNA, 12 bp, Homo sapiens
cattccctagca

SEQ ID NO: 4620642 - DNA, 22 bp, Homo sapiens
cattcctaaagaaaaatatctt

SEQ ID NO: 4620643 - DNA, 18 bp, Homo sapiens
cattcctgaagtctctaa

SEQ ID NO: 4620644 - DNA, 16 bp, Homo sapiens
cattctaatgcatatt

SEQ ID NO: 4620645 - DNA, 21 bp, Homo sapiens
cattctaatgcatatttataa

SEQ ID NO: 4620646 - DNA, 17 bp, Homo sapiens
cattctacagttgtgat

SEQ ID NO: 4620647 - DNA, 16 bp, Homo sapiens
cattctcataattcct

SEQ ID NO: 4620648 - DNA, 15 bp, Homo sapiens
cattctccacagcaa

SEQ ID NO: 4620649 - DNA, 13 bp, Homo sapiens
cattctcctcctc

SEQ ID NO: 4620650 - DNA, 16 bp, Homo sapiens
cattctcctcctcctc

SEQ ID NO: 4620651 - DNA, 18 bp, Homo sapiens
cattctctatgtactatg

SEQ ID NO: 4620652 - DNA, 16 bp, Homo sapiens
cattctgcatgagctg

SEQ ID NO: 4620653 - DNA, 15 bp, Homo sapiens
cattcttcagttctc

SEQ ID NO: 4620654 - DNA, 17 bp, Homo sapiens
cattcttccgcaccctc

SEQ ID NO: 4620655 - DNA, 19 bp, Homo sapiens
cattcttggcttaatcatt

SEQ ID NO: 4620656 - DNA, 20 bp, Homo sapiens
cattctttgtatcttaaatc

SEQ ID NO: 4620657 - DNA, 20 bp, Homo sapiens
cattcttttgccacatccct

SEQ ID NO: 4620658 - DNA, 18 bp, Homo sapiens
cattgaaaaatttctaac

SEQ ID NO: 4620659 - DNA, 21 bp, Homo sapiens
cattgaagccgactctggccc

SEQ ID NO: 4620660 - DNA, 23 bp, Homo sapiens
cattgaagccgactctggccctg

SEQ ID NO: 4620661 - DNA, 19 bp, Homo sapiens
cattgaagtatggtgtgtt

SEQ ID NO: 4620662 - DNA, 13 bp, Homo sapiens
cattgacctggag

SEQ ID NO: 4620663 - DNA, 19 bp, Homo sapiens
cattgacctggaggggaga

SEQ ID NO: 4620664 - DNA, 19 bp, Homo sapiens
cattgattttataattggt

SEQ ID NO: 4620665 - DNA, 19 bp, Homo sapiens
cattgcactttcctttcaa

SEQ ID NO: 4620666 - DNA, 20 bp, Homo sapiens
cattgcactttcctttcaat

SEQ ID NO: 4620667 - DNA, 21 bp, Homo sapiens
cattgcactttcctttcaata

SEQ ID NO: 4620668 - DNA, 23 bp, Homo sapiens
cattgcactttcctttcaataaa

SEQ ID NO: 4620669 - DNA, 21 bp, Homo sapiens
cattgccatcaccatttggtg

SEQ ID NO: 4620670 - DNA, 21 bp, Homo sapiens
cattgctgccaaggtggaggg

SEQ ID NO: 4620671 - DNA, 19 bp, Homo sapiens
cattgcttaaaagaaagtt

SEQ ID NO: 4620672 - DNA, 12 bp, Homo sapiens
cattgctttctg

SEQ ID NO: 4620673 - DNA, 17 bp, Homo sapiens
cattggacagaaaatgc

SEQ ID NO: 4620674 - DNA, 20 bp, Homo sapiens
cattggacagaaaatgcaat

SEQ ID NO: 4620675 - DNA, 16 bp, Homo sapiens
cattggcatctgcttt

SEQ ID NO: 4620676 - DNA, 22 bp, Homo sapiens
cattgggcagcgcccttcctct

SEQ ID NO: 4620677 - DNA, 13 bp, Homo sapiens
cattgtaaaccac

SEQ ID NO: 4620678 - DNA, 21 bp, Homo sapiens
cattgtaaatatttactcttt

SEQ ID NO: 4620679 - DNA, 13 bp, Homo sapiens
cattgtaactatt

SEQ ID NO: 4620680 - DNA, 17 bp, Homo sapiens
cattgtaactattaacc

SEQ ID NO: 4620681 - DNA, 16 bp, Homo sapiens
cattgtatcgatgtta

SEQ ID NO: 4620682 - DNA, 13 bp, Homo sapiens
cattgtcagcctt

SEQ ID NO: 4620683 - DNA, 19 bp, Homo sapiens
cattgtctcctatatattt

SEQ ID NO: 4620684 - DNA, 15 bp, Homo sapiens
cattgttcaactccc

SEQ ID NO: 4620685 - DNA, 14 bp, Homo sapiens
cattgttcccttcc

SEQ ID NO: 4620686 - DNA, 15 bp, Homo sapiens
cattgttcccttcct

SEQ ID NO: 4620687 - DNA, 16 bp, Homo sapiens
cattgttcccttcctc

SEQ ID NO: 4620688 - DNA, 20 bp, Homo sapiens
cattgttcccttcctcttcc

SEQ ID NO: 4620689 - DNA, 23 bp, Homo sapiens
cattgttcccttcctcttcctgc

SEQ ID NO: 4620690 - DNA, 19 bp, Homo sapiens
cattgtttgaaacaaagaa

SEQ ID NO: 4620691 - DNA, 14 bp, Homo sapiens
cattgttttctttt

SEQ ID NO: 4620692 - DNA, 17 bp, Homo sapiens
catttaaattccacaga

SEQ ID NO: 4620693 - DNA, 23 bp, Homo sapiens
catttaatttcaacctaaatact

SEQ ID NO: 4620694 - DNA, 23 bp, Homo sapiens
catttacaacccggttcactctt

SEQ ID NO: 4620695 - DNA, 17 bp, Homo sapiens
catttagagggtgaagg

SEQ ID NO: 4620696 - DNA, 15 bp, Homo sapiens
catttagataatttg

SEQ ID NO: 4620697 - DNA, 16 bp, Homo sapiens
catttagataatttga

SEQ ID NO: 4620698 - DNA, 18 bp, Homo sapiens
catttagataatttgaaa

SEQ ID NO: 4620699 - DNA, 20 bp, Homo sapiens
catttagataatttgaaaaa

SEQ ID NO: 4620700 - DNA, 21 bp, Homo sapiens
catttagataatttgaaaaag

SEQ ID NO: 4620701 - DNA, 23 bp, Homo sapiens
catttagttacaacctgaaggaa

SEQ ID NO: 4620702 - DNA, 13 bp, Homo sapiens
catttcacacagt

SEQ ID NO: 4620703 - DNA, 19 bp, Homo sapiens
catttcagggtcttggctg

SEQ ID NO: 4620704 - DNA, 15 bp, Homo sapiens
catttcatgaaaaag

SEQ ID NO: 4620705 - DNA, 21 bp, Homo sapiens
catttcatgaaaaagctgctt

SEQ ID NO: 4620706 - DNA, 19 bp, Homo sapiens
catttcattccattgccta

SEQ ID NO: 4620707 - DNA, 17 bp, Homo sapiens
catttcattgtacaagt

SEQ ID NO: 4620708 - DNA, 20 bp, Homo sapiens
catttcattgtacaagtatt

SEQ ID NO: 4620709 - DNA, 22 bp, Homo sapiens
catttcctcacactaagagggc

SEQ ID NO: 4620710 - DNA, 12 bp, Homo sapiens
catttcctgctg

SEQ ID NO: 4620711 - DNA, 22 bp, Homo sapiens
catttcctgggtggctactctg

SEQ ID NO: 4620712 - DNA, 23 bp, Homo sapiens
catttctaattaaccttactaat

SEQ ID NO: 4620713 - DNA, 16 bp, Homo sapiens
catttgatgcatgtct

SEQ ID NO: 4620714 - DNA, 14 bp, Homo sapiens
catttgcacctctg

SEQ ID NO: 4620715 - DNA, 18 bp, Homo sapiens
catttgcttgtactggga

SEQ ID NO: 4620716 - DNA, 22 bp, Homo sapiens
catttggtgtgttcctgtggga

SEQ ID NO: 4620717 - DNA, 19 bp, Homo sapiens
catttgtaagtgtaaaaaa

SEQ ID NO: 4620718 - DNA, 20 bp, Homo sapiens
catttgtaagtgtaaaaaat

SEQ ID NO: 4620719 - DNA, 22 bp, Homo sapiens
catttgtaagtgtaaaaaatgt

SEQ ID NO: 4620720 - DNA, 14 bp, Homo sapiens
catttgtagtgagc

SEQ ID NO: 4620721 - DNA, 18 bp, Homo sapiens
cattttaaaaactttatt

SEQ ID NO: 4620722 - DNA, 16 bp, Homo sapiens
cattttaaaatgttta

SEQ ID NO: 4620723 - DNA, 18 bp, Homo sapiens
cattttaacatgatttca

SEQ ID NO: 4620724 - DNA, 16 bp, Homo sapiens
cattttagtgtatctt

SEQ ID NO: 4620725 - DNA, 15 bp, Homo sapiens
cattttattttgtaa

SEQ ID NO: 4620726 - DNA, 16 bp, Homo sapiens
cattttattttgtaat

SEQ ID NO: 4620727 - DNA, 16 bp, Homo sapiens
cattttcagtaccaaa

SEQ ID NO: 4620728 - DNA, 17 bp, Homo sapiens
cattttcagtaccaaag

SEQ ID NO: 4620729 - DNA, 18 bp, Homo sapiens
cattttctaaataaaaat

SEQ ID NO: 4620730 - DNA, 20 bp, Homo sapiens
cattttctcttagagatttt

SEQ ID NO: 4620731 - DNA, 12 bp, Homo sapiens
cattttctgtgg

SEQ ID NO: 4620732 - DNA, 13 bp, Homo sapiens
cattttgaaacaa

SEQ ID NO: 4620733 - DNA, 12 bp, Homo sapiens
cattttgagcta

SEQ ID NO: 4620734 - DNA, 15 bp, Homo sapiens
cattttgtaaaatat

SEQ ID NO: 4620735 - DNA, 16 bp, Homo sapiens
cattttgtaaaatatt

SEQ ID NO: 4620736 - DNA, 16 bp, Homo sapiens
catttttaaattgtta

SEQ ID NO: 4620737 - DNA, 23 bp, Homo sapiens
catttttaagatagaacacaaaa

SEQ ID NO: 4620738 - DNA, 14 bp, Homo sapiens
catttttatttctt

SEQ ID NO: 4620739 - DNA, 20 bp, Homo sapiens
catttttcagatataaaaga

SEQ ID NO: 4620740 - DNA, 22 bp, Homo sapiens
catttttgagcagatcttggaa

SEQ ID NO: 4620741 - DNA, 11 bp, Homo sapiens
catttttgctt

SEQ ID NO: 4620742 - DNA, 13 bp, Homo sapiens
catttttgtaact

SEQ ID NO: 4620743 - DNA, 14 bp, Homo sapiens
cattttttctaata

SEQ ID NO: 4620744 - DNA, 20 bp, Homo sapiens
ccaaaagccaatggctgcag

SEQ ID NO: 4620745 - DNA, 15 bp, Homo sapiens
ccaaaagtggcctct

SEQ ID NO: 4620746 - DNA, 18 bp, Homo sapiens
ccaaaagtggcctctttg

SEQ ID NO: 4620747 - DNA, 21 bp, Homo sapiens
ccaaaagtggcctctttgtct

SEQ ID NO: 4620748 - DNA, 20 bp, Homo sapiens
ccaaaatggtgggattacag

SEQ ID NO: 4620749 - DNA, 17 bp, Homo sapiens
ccaaacccagtctcctc

SEQ ID NO: 4620750 - DNA, 17 bp, Homo sapiens
ccaaacccttgctttcc

SEQ ID NO: 4620751 - DNA, 23 bp, Homo sapiens
ccaaacccttgctttcctgggcc

SEQ ID NO: 4620752 - DNA, 20 bp, Homo sapiens
ccaaacctctgttcagtgta

SEQ ID NO: 4620753 - DNA, 13 bp, Homo sapiens
ccaaacctgtctt

SEQ ID NO: 4620754 - DNA, 21 bp, Homo sapiens
ccaaaccttcacacacagact

SEQ ID NO: 4620755 - DNA, 12 bp, Homo sapiens
ccaaagaaacaa

SEQ ID NO: 4620756 - DNA, 9 bp, Homo sapiens
ccaaagagt

SEQ ID NO: 4620757 - DNA, 21 bp, Homo sapiens
ccaaaggaatttgcatccagc

SEQ ID NO: 4620758 - DNA, 21 bp, Homo sapiens
ccaaagggtgaagctatttat

SEQ ID NO: 4620759 - DNA, 22 bp, Homo sapiens
ccaaagtggtatagaaatgctg

SEQ ID NO: 4620760 - DNA, 21 bp, Homo sapiens
ccaaatccgaacctcctctgt

SEQ ID NO: 4620761 - DNA, 20 bp, Homo sapiens
ccaaatccgccagtgtttct

SEQ ID NO: 4620762 - DNA, 23 bp, Homo sapiens
ccaaatggttcttacttttcctg

SEQ ID NO: 4620763 - DNA, 18 bp, Homo sapiens
ccaaatttaagactctcg

SEQ ID NO: 4620764 - DNA, 14 bp, Homo sapiens
caggggcctgcaga

SEQ ID NO: 4620765 - DNA, 18 bp, Homo sapiens
caggggcgggcggaggga

SEQ ID NO: 4620766 - DNA, 22 bp, Homo sapiens
caggggctgactctccagggag

SEQ ID NO: 4620767 - DNA, 16 bp, Homo sapiens
cagggggatttggtag

SEQ ID NO: 4620768 - DNA, 13 bp, Homo sapiens
cagggtcaagcct

SEQ ID NO: 4620769 - DNA, 16 bp, Homo sapiens
cagggtcctcagctca

SEQ ID NO: 4620770 - DNA, 17 bp, Homo sapiens
cagggtctccttccttc

SEQ ID NO: 4620771 - DNA, 15 bp, Homo sapiens
cagggtctgtgtgaa

SEQ ID NO: 4620772 - DNA, 23 bp, Homo sapiens
cagggtctgtgtgaatgtgggca

SEQ ID NO: 4620773 - DNA, 23 bp, Homo sapiens
cagggtcttttcatctgggaaag

SEQ ID NO: 4620774 - DNA, 22 bp, Homo sapiens
cagggtgagcagggtcaagcct

SEQ ID NO: 4620775 - DNA, 13 bp, Homo sapiens
caggtacaggaga

SEQ ID NO: 4620776 - DNA, 18 bp, Homo sapiens
caggtacaggagaggcag

SEQ ID NO: 4620777 - DNA, 20 bp, Homo sapiens
caggtacaggagaggcagca

SEQ ID NO: 4620778 - DNA, 13 bp, Homo sapiens
caggtagcctatt

SEQ ID NO: 4620779 - DNA, 20 bp, Homo sapiens
caggtagttggaactttctg

SEQ ID NO: 4620780 - DNA, 15 bp, Homo sapiens
caggtatccaaaaat

SEQ ID NO: 4620781 - DNA, 16 bp, Homo sapiens
caggtatttagaagca

SEQ ID NO: 4620782 - DNA, 17 bp, Homo sapiens
caggtatttagaagcag

SEQ ID NO: 4620783 - DNA, 20 bp, Homo sapiens
caggtatttagaagcagagg

SEQ ID NO: 4620784 - DNA, 18 bp, Homo sapiens
caggtatttcagaaggag

SEQ ID NO: 4620785 - DNA, 20 bp, Homo sapiens
caggtatttcagaaggagaa

SEQ ID NO: 4620786 - DNA, 11 bp, Homo sapiens
caggtattttg

SEQ ID NO: 4620787 - DNA, 14 bp, Homo sapiens
caggtctcctggga

SEQ ID NO: 4620788 - DNA, 15 bp, Homo sapiens
caggtctcctgggaa

SEQ ID NO: 4620789 - DNA, 16 bp, Homo sapiens
caggtgagggaaggag

SEQ ID NO: 4620790 - DNA, 24 bp, Homo sapiens
caggtgcaaccagggagctgcagg

SEQ ID NO: 4620791 - DNA, 23 bp, Homo sapiens
caggtgctgacttcatctcccac

SEQ ID NO: 4620792 - DNA, 18 bp, Homo sapiens
caggtggaaggcagacag

SEQ ID NO: 4620793 - DNA, 19 bp, Homo sapiens
caggtggcccttcccggca

SEQ ID NO: 4620794 - DNA, 15 bp, Homo sapiens
caggttcccaagctc

SEQ ID NO: 4620795 - DNA, 23 bp, Homo sapiens
cagtaaatagtgtcatataaact

SEQ ID NO: 4620796 - DNA, 12 bp, Homo sapiens
cagtaccaaaga

SEQ ID NO: 4620797 - DNA, 21 bp, Homo sapiens
cagtacttgagggaccaatat

SEQ ID NO: 4620798 - DNA, 16 bp, Homo sapiens
cagtactttgtgcatt

SEQ ID NO: 4620799 - DNA, 20 bp, Homo sapiens
cagtagagaaacatttggaa

SEQ ID NO: 4620800 - DNA, 18 bp, Homo sapiens
cagtaggaccaggccacc

SEQ ID NO: 4620801 - DNA, 13 bp, Homo sapiens
cagtatcatgccc

SEQ ID NO: 4620802 - DNA, 19 bp, Homo sapiens
cagtatcatgccctgtgca

SEQ ID NO: 4620803 - DNA, 14 bp, Homo sapiens
cagtattaaggttt

SEQ ID NO: 4620804 - DNA, 13 bp, Homo sapiens
cagtatttaacta

SEQ ID NO: 4620805 - DNA, 17 bp, Homo sapiens
cagtattttctccactt

SEQ ID NO: 4620806 - DNA, 14 bp, Homo sapiens
cagtcaagctccta

SEQ ID NO: 4620807 - DNA, 16 bp, Homo sapiens
cagtcaagctcctagt

SEQ ID NO: 4620808 - DNA, 19 bp, Homo sapiens
cagtcaggatgaggccccg

SEQ ID NO: 4620809 - DNA, 15 bp, Homo sapiens
cagtcataaagaggt

SEQ ID NO: 4620810 - DNA, 16 bp, Homo sapiens
cagtcatcatcagggc

SEQ ID NO: 4620811 - DNA, 20 bp, Homo sapiens
cagtcatcatcagggcctgg

SEQ ID NO: 4620812 - DNA, 13 bp, Homo sapiens
cagtcattggctg

SEQ ID NO: 4620813 - DNA, 15 bp, Homo sapiens
cagtcctccctagct

SEQ ID NO: 4620814 - DNA, 13 bp, Homo sapiens
cagtcctttccca

SEQ ID NO: 4620815 - DNA, 16 bp, Homo sapiens
cagtcctttcccacca

SEQ ID NO: 4620816 - DNA, 22 bp, Homo sapiens
cagtcctttcccaccattcctg

SEQ ID NO: 4620817 - DNA, 14 bp, Homo sapiens
cagtcggccccatc

SEQ ID NO: 4620818 - DNA, 15 bp, Homo sapiens
cagtcgtgatgtgga

SEQ ID NO: 4620819 - DNA, 21 bp, Homo sapiens
cagtctagtccgtcctggcac

SEQ ID NO: 4620820 - DNA, 12 bp, Homo sapiens
cagtctcattgt

SEQ ID NO: 4620821 - DNA, 18 bp, Homo sapiens
cagtctttcccccaggaa

SEQ ID NO: 4620822 - DNA, 19 bp, Homo sapiens
cagtgaaacgcaattttac

SEQ ID NO: 4620823 - DNA, 15 bp, Homo sapiens
cagtgaaagaaactg

SEQ ID NO: 4620824 - DNA, 12 bp, Homo sapiens
cagtgaacaaat

SEQ ID NO: 4620825 - DNA, 20 bp, Homo sapiens
cagtgaagtctagaatcata

SEQ ID NO: 4620826 - DNA, 14 bp, Homo sapiens
cagtgacgctgctg

SEQ ID NO: 4620827 - DNA, 15 bp, Homo sapiens
cagtgacgctgctga

SEQ ID NO: 4620828 - DNA, 16 bp, Homo sapiens
cagtgactcctgctgg

SEQ ID NO: 4620829 - DNA, 17 bp, Homo sapiens
cagtgactcctgctggt

SEQ ID NO: 4620830 - DNA, 13 bp, Homo sapiens
cagtgcaaaatgt

SEQ ID NO: 4620831 - DNA, 21 bp, Homo sapiens
cagtgcagtttcttttcacat

SEQ ID NO: 4620832 - DNA, 10 bp, Homo sapiens
cagtgcatca

SEQ ID NO: 4620833 - DNA, 18 bp, Homo sapiens
cagtgcatcacatctgca

SEQ ID NO: 4620834 - DNA, 20 bp, Homo sapiens
cagtgcatcacatctgcaca

SEQ ID NO: 4620835 - DNA, 14 bp, Homo sapiens
cagtgcatcattac

SEQ ID NO: 4620836 - DNA, 21 bp, Homo sapiens
cagtgcatcattactgttcca

SEQ ID NO: 4620837 - DNA, 13 bp, Homo sapiens
cagtgccaaggac

SEQ ID NO: 4620838 - DNA, 16 bp, Homo sapiens
cagtgccacgtcatga

SEQ ID NO: 4620839 - DNA, 13 bp, Homo sapiens
cagtgccatcccc

SEQ ID NO: 4620840 - DNA, 23 bp, Homo sapiens
cagtgcccatgtgtacattctgc

SEQ ID NO: 4620841 - DNA, 20 bp, Homo sapiens
cagtgcccggtgcagggcct

SEQ ID NO: 4620842 - DNA, 11 bp, Homo sapiens
cagtgcccttt

SEQ ID NO: 4620843 - DNA, 13 bp, Homo sapiens
cagtgccctttga

SEQ ID NO: 4620844 - DNA, 22 bp, Homo sapiens
cagtgccttcaacaacgtgaga

SEQ ID NO: 4620845 - DNA, 18 bp, Homo sapiens
cagtggagggggcaagct

SEQ ID NO: 4620846 - DNA, 13 bp, Homo sapiens
cagtggcagagaa

SEQ ID NO: 4620847 - DNA, 14 bp, Homo sapiens
cagtggcagagaat

SEQ ID NO: 4620848 - DNA, 14 bp, Homo sapiens
cagtggccatcatc

SEQ ID NO: 4620849 - DNA, 20 bp, Homo sapiens
cagtggcctttttctgagat

SEQ ID NO: 4620850 - DNA, 15 bp, Homo sapiens
cagtggggcctgtgg

SEQ ID NO: 4620851 - DNA, 16 bp, Homo sapiens
cagtggggcctgtgga

SEQ ID NO: 4620852 - DNA, 23 bp, Homo sapiens
cagtggggtcaagctgagctggc

SEQ ID NO: 4620853 - DNA, 16 bp, Homo sapiens
cagtggttgcctgggg

SEQ ID NO: 4620854 - DNA, 19 bp, Homo sapiens
cagtgtaaatagttactcc

SEQ ID NO: 4620855 - DNA, 18 bp, Homo sapiens
cagtgtacagtcttgtat

SEQ ID NO: 4620856 - DNA, 21 bp, Homo sapiens
cagtgtagacacaggtcacca

SEQ ID NO: 4620857 - DNA, 22 bp, Homo sapiens
cagtgtttcgtcatgttggcca

SEQ ID NO: 4620858 - DNA, 18 bp, Homo sapiens
cagtgtttctgaatgttt

SEQ ID NO: 4620859 - DNA, 15 bp, Homo sapiens
cagtgtttggacagg

SEQ ID NO: 4620860 - DNA, 15 bp, Homo sapiens
cagtgttttctttga

SEQ ID NO: 4620861 - DNA, 12 bp, Homo sapiens
cagttaaagcca

SEQ ID NO: 4620862 - DNA, 13 bp, Homo sapiens
cagttaaagccac

SEQ ID NO: 4620863 - DNA, 16 bp, Homo sapiens
cagttacttttttaca

SEQ ID NO: 4620864 - DNA, 14 bp, Homo sapiens
cagttattaaatga

SEQ ID NO: 4620865 - DNA, 18 bp, Homo sapiens
cagttattacatgtaatt

SEQ ID NO: 4620866 - DNA, 17 bp, Homo sapiens
cagttcctatgacacag

SEQ ID NO: 4620867 - DNA, 18 bp, Homo sapiens
cagttcctatgacacagt

SEQ ID NO: 4620868 - DNA, 16 bp, Homo sapiens
cagttcctgcagcaga

SEQ ID NO: 4620869 - DNA, 19 bp, Homo sapiens
cagttcctgcagcagagcc

SEQ ID NO: 4620870 - DNA, 15 bp, Homo sapiens
cagttcgcagccacc

SEQ ID NO: 4620871 - DNA, 16 bp, Homo sapiens
cagttctctactccct

SEQ ID NO: 4620872 - DNA, 23 bp, Homo sapiens
cagttctctactccctcttgtca

SEQ ID NO: 4620873 - DNA, 13 bp, Homo sapiens
cagttctgcttgc

SEQ ID NO: 4620874 - DNA, 16 bp, Homo sapiens
cagttctgcttgctcc

SEQ ID NO: 4620875 - DNA, 18 bp, Homo sapiens
cagttctgcttgctccca

SEQ ID NO: 4620876 - DNA, 19 bp, Homo sapiens
cagttctgcttgctcccaa

SEQ ID NO: 4620877 - DNA, 20 bp, Homo sapiens
cagttctgcttgctcccaag

SEQ ID NO: 4620878 - DNA, 21 bp, Homo sapiens
cagttctgtgtggtgcattcc

SEQ ID NO: 4620879 - DNA, 23 bp, Homo sapiens
cagttctgtgtggtgcattcctg

SEQ ID NO: 4620880 - DNA, 13 bp, Homo sapiens
cagttcttcattt

SEQ ID NO: 4620881 - DNA, 19 bp, Homo sapiens
cagttcttcatttggagga

SEQ ID NO: 4620882 - DNA, 17 bp, Homo sapiens
cagttgatgtgtctttt

SEQ ID NO: 4620883 - DNA, 12 bp, Homo sapiens
cagttgctgtga

SEQ ID NO: 4620884 - DNA, 14 bp, Homo sapiens
cagttgtccttaaa

SEQ ID NO: 4620885 - DNA, 19 bp, Homo sapiens
cagttgtccttaaatttgt

SEQ ID NO: 4620886 - DNA, 23 bp, Homo sapiens
cagttgtcttatgtgaaaaatta

SEQ ID NO: 4620887 - DNA, 21 bp, Homo sapiens
cagtttatttccactattttc

SEQ ID NO: 4620888 - DNA, 18 bp, Homo sapiens
cagtttcatctaaatgaa

SEQ ID NO: 4620889 - DNA, 13 bp, Homo sapiens
cagtttccaaatt

SEQ ID NO: 4620890 - DNA, 14 bp, Homo sapiens
cagtttctgcctgg

SEQ ID NO: 4620891 - DNA, 16 bp, Homo sapiens
cagtttctgcctgggc

SEQ ID NO: 4620892 - DNA, 17 bp, Homo sapiens
cagtttctgcctgggca

SEQ ID NO: 4620893 - DNA, 21 bp, Homo sapiens
cagtttcttgcttggaagcca

SEQ ID NO: 4620894 - DNA, 23 bp, Homo sapiens
cagtttcttttcacattaggctg

SEQ ID NO: 4620895 - DNA, 22 bp, Homo sapiens
cataaaaatctagcacactctt

SEQ ID NO: 4620896 - DNA, 16 bp, Homo sapiens
cataaaagaagtttca

SEQ ID NO: 4620897 - DNA, 14 bp, Homo sapiens
cataaaatcaaaac

SEQ ID NO: 4620898 - DNA, 15 bp, Homo sapiens
cataaactttctcca

SEQ ID NO: 4620899 - DNA, 12 bp, Homo sapiens
cataaagaagca

SEQ ID NO: 4620900 - DNA, 21 bp, Homo sapiens
cataaagaagcaataaagaag

SEQ ID NO: 4620901 - DNA, 18 bp, Homo sapiens
cataaagtacaaatgaag

SEQ ID NO: 4620902 - DNA, 20 bp, Homo sapiens
cataaatttactttacacaa

SEQ ID NO: 4620903 - DNA, 16 bp, Homo sapiens
cataaccaatttgtaa

SEQ ID NO: 4620904 - DNA, 21 bp, Homo sapiens
cataactcacacccctgcccc

SEQ ID NO: 4620905 - DNA, 23 bp, Homo sapiens
cataactcacacccctgccccca

SEQ ID NO: 4620906 - DNA, 19 bp, Homo sapiens
cataagtcctttcaattcc

SEQ ID NO: 4620907 - DNA, 13 bp, Homo sapiens
cataattatgaaa

SEQ ID NO: 4620908 - DNA, 14 bp, Homo sapiens
cataattatgaaaa

SEQ ID NO: 4620909 - DNA, 19 bp, Homo sapiens
cataattcctacagcacta

SEQ ID NO: 4620910 - DNA, 16 bp, Homo sapiens
catacaagaaaatgta

SEQ ID NO: 4620911 - DNA, 14 bp, Homo sapiens
catacatgctactt

SEQ ID NO: 4620912 - DNA, 16 bp, Homo sapiens
cataccttctcccagg

SEQ ID NO: 4620913 - DNA, 17 bp, Homo sapiens
cataccttctcccaggc

SEQ ID NO: 4620914 - DNA, 17 bp, Homo sapiens
catactaccctttgctg

SEQ ID NO: 4620915 - DNA, 13 bp, Homo sapiens
catactctgttgc

SEQ ID NO: 4620916 - DNA, 14 bp, Homo sapiens
catactctgttgcc

SEQ ID NO: 4620917 - DNA, 20 bp, Homo sapiens
catactctgttgcctcctct

SEQ ID NO: 4620918 - DNA, 21 bp, Homo sapiens
catactctgttgcctcctctc

SEQ ID NO: 4620919 - DNA, 22 bp, Homo sapiens
catactgagaatctaggccacc

SEQ ID NO: 4620920 - DNA, 19 bp, Homo sapiens
catactgtagacactctga

SEQ ID NO: 4620921 - DNA, 19 bp, Homo sapiens
catacttaacatttcattg

SEQ ID NO: 4620922 - DNA, 14 bp, Homo sapiens
catacttggctgct

SEQ ID NO: 4620923 - DNA, 21 bp, Homo sapiens
catacttggctgcttcctgtg

SEQ ID NO: 4620924 - DNA, 13 bp, Homo sapiens
catacttgtgaaa

SEQ ID NO: 4620925 - DNA, 19 bp, Homo sapiens
catagaaaacttgacatgt

SEQ ID NO: 4620926 - DNA, 13 bp, Homo sapiens
catagagatgagc

SEQ ID NO: 4620927 - DNA, 14 bp, Homo sapiens
catagagatgagcc

SEQ ID NO: 4620928 - DNA, 19 bp, Homo sapiens
catagagtaggtactccat

SEQ ID NO: 4620929 - DNA, 23 bp, Homo sapiens
catagggtcggaggtgctgtccc

SEQ ID NO: 4620930 - DNA, 16 bp, Homo sapiens
cataggtcataaagca

SEQ ID NO: 4620931 - DNA, 16 bp, Homo sapiens
cataggtctgtatggc

SEQ ID NO: 4620932 - DNA, 14 bp, Homo sapiens
cataggtttctctc

SEQ ID NO: 4620933 - DNA, 23 bp, Homo sapiens
catagttttctaaatgtacaaat

SEQ ID NO: 4620934 - DNA, 18 bp, Homo sapiens
catatactgttcttcatt

SEQ ID NO: 4620935 - DNA, 21 bp, Homo sapiens
catatactgttcttcatttta

SEQ ID NO: 4620936 - DNA, 19 bp, Homo sapiens
catatattgaggttcattg

SEQ ID NO: 4620937 - DNA, 22 bp, Homo sapiens
catatatttggagtttttctga

SEQ ID NO: 4620938 - DNA, 20 bp, Homo sapiens
catatcagaataggaagata

SEQ ID NO: 4620939 - DNA, 18 bp, Homo sapiens
catatcggctcacaaaga

SEQ ID NO: 4620940 - DNA, 23 bp, Homo sapiens
catatgaacacagacaaagtgct

SEQ ID NO: 4620941 - DNA, 22 bp, Homo sapiens
catatgaccattgagtccctgc

SEQ ID NO: 4620942 - DNA, 17 bp, Homo sapiens
catatgcaccttgtgtc

SEQ ID NO: 4620943 - DNA, 18 bp, Homo sapiens
catatgcaccttgtgtct

SEQ ID NO: 4620944 - DNA, 20 bp, Homo sapiens
catatgcaccttgtgtctgt

SEQ ID NO: 4620945 - DNA, 15 bp, Homo sapiens
catatggactctgca

SEQ ID NO: 4620946 - DNA, 20 bp, Homo sapiens
catatgggatattcccaagc

SEQ ID NO: 4620947 - DNA, 21 bp, Homo sapiens
catatgtcttactactttaaa

SEQ ID NO: 4620948 - DNA, 18 bp, Homo sapiens
catattagtattaatact

SEQ ID NO: 4620949 - DNA, 16 bp, Homo sapiens
catattgttggcacag

SEQ ID NO: 4620950 - DNA, 13 bp, Homo sapiens
catatttactacc

SEQ ID NO: 4620951 - DNA, 15 bp, Homo sapiens
catatttgatttcta

SEQ ID NO: 4620952 - DNA, 17 bp, Homo sapiens
catatttgatttctaat

SEQ ID NO: 4620953 - DNA, 21 bp, Homo sapiens
catatttgatttctaattgta

SEQ ID NO: 4620954 - DNA, 23 bp, Homo sapiens
catatttgatttctaattgtaag

SEQ ID NO: 4620955 - DNA, 17 bp, Homo sapiens
catattttcttactttt

SEQ ID NO: 4620956 - DNA, 23 bp, Homo sapiens
catcaaagaggctgaggctggca

SEQ ID NO: 4620957 - DNA, 17 bp, Homo sapiens
catcaaaggaatataag

SEQ ID NO: 4620958 - DNA, 21 bp, Homo sapiens
catcaaaggaatataagaaaa

SEQ ID NO: 4620959 - DNA, 13 bp, Homo sapiens
catcacaaaatgt

SEQ ID NO: 4620960 - DNA, 20 bp, Homo sapiens
catcacatctgcacactctc

SEQ ID NO: 4620961 - DNA, 21 bp, Homo sapiens
catcaccagtgccacgtcatg

SEQ ID NO: 4620962 - DNA, 14 bp, Homo sapiens
catcaccatttcct

SEQ ID NO: 4620963 - DNA, 14 bp, Homo sapiens
catcaccatttggt

SEQ ID NO: 4620964 - DNA, 15 bp, Homo sapiens
catcagaaagaattg

SEQ ID NO: 4620965 - DNA, 23 bp, Homo sapiens
catcagaaagaattgatcagaat

SEQ ID NO: 4620966 - DNA, 17 bp, Homo sapiens
catcagaaagggagggc

SEQ ID NO: 4620967 - DNA, 23 bp, Homo sapiens
catcagaaagggagggctctgag

SEQ ID NO: 4620968 - DNA, 15 bp, Homo sapiens
catcagccctgctag

SEQ ID NO: 4620969 - DNA, 11 bp, Homo sapiens
catcagggcct

SEQ ID NO: 4620970 - DNA, 17 bp, Homo sapiens
catcagtaagcagcctt

SEQ ID NO: 4620971 - DNA, 16 bp, Homo sapiens
catcatcagggcctgg

SEQ ID NO: 4620972 - DNA, 19 bp, Homo sapiens
catcatcctcccgccagga

SEQ ID NO: 4620973 - DNA, 21 bp, Homo sapiens
catcatcctcccgccaggagc

SEQ ID NO: 4620974 - DNA, 22 bp, Homo sapiens
catcatcctcccgccaggagct

SEQ ID NO: 4620975 - DNA, 23 bp, Homo sapiens
catcatcctcccgccaggagctt

SEQ ID NO: 4620976 - DNA, 16 bp, Homo sapiens
catcattactgttcca

SEQ ID NO: 4620977 - DNA, 20 bp, Homo sapiens
catcattgtcagccttgcta

SEQ ID NO: 4620978 - DNA, 15 bp, Homo sapiens
catccagaggagctg

SEQ ID NO: 4620979 - DNA, 12 bp, Homo sapiens
catccagcagca

SEQ ID NO: 4620980 - DNA, 16 bp, Homo sapiens
catccataaagaagca

SEQ ID NO: 4620981 - DNA, 16 bp, Homo sapiens
catccatctctctctt

SEQ ID NO: 4620982 - DNA, 19 bp, Homo sapiens
catccatgttccgagaaga

SEQ ID NO: 4620983 - DNA, 17 bp, Homo sapiens
catcccccctgctgccc

SEQ ID NO: 4620984 - DNA, 20 bp, Homo sapiens
catcccccctgctgcccagt

SEQ ID NO: 4620985 - DNA, 18 bp, Homo sapiens
catcccgtaagaccacct

SEQ ID NO: 4620986 - DNA, 23 bp, Homo sapiens
ccaccggcctgtgggtctctgaa

SEQ ID NO: 4620987 - DNA, 13 bp, Homo sapiens
ccaccgggccact

SEQ ID NO: 4620988 - DNA, 15 bp, Homo sapiens
ccaccgggccactcc

SEQ ID NO: 4620989 - DNA, 21 bp, Homo sapiens
ccaccgggccactccttcctg

SEQ ID NO: 4620990 - DNA, 14 bp, Homo sapiens
ccaccgtgcctggc

SEQ ID NO: 4620991 - DNA, 23 bp, Homo sapiens
ccacctagcagcaccgttctgtg

SEQ ID NO: 4620992 - DNA, 12 bp, Homo sapiens
ccacctcagcct

SEQ ID NO: 4620993 - DNA, 14 bp, Homo sapiens
ccacctcagcctcc

SEQ ID NO: 4620994 - DNA, 13 bp, Homo sapiens
ccacctccagcct

SEQ ID NO: 4620995 - DNA, 19 bp, Homo sapiens
ccacctcctctgccagcag

SEQ ID NO: 4620996 - DNA, 17 bp, Homo sapiens
ccacctgcaagatggac

SEQ ID NO: 4620997 - DNA, 22 bp, Homo sapiens
ccacctgctagtcgcccctcag

SEQ ID NO: 4620998 - DNA, 12 bp, Homo sapiens
ccacctgtgggt

SEQ ID NO: 4620999 - DNA, 20 bp, Homo sapiens
ccaccttcccttcctcagca

SEQ ID NO: 4621000 - DNA, 23 bp, Homo sapiens
ccaccttcccttcctcagcaggc

SEQ ID NO: 4621001 - DNA, 24 bp, Homo sapiens
ccaccttcccttcctcagcaggcc

SEQ ID NO: 4621002 - DNA, 13 bp, Homo sapiens
ccaccttccgttc

SEQ ID NO: 4621003 - DNA, 15 bp, Homo sapiens
ccaccttccgttccc

SEQ ID NO: 4621004 - DNA, 22 bp, Homo sapiens
ccacgaggctgattcctctcat

SEQ ID NO: 4621005 - DNA, 23 bp, Homo sapiens
ccacggatgcgtgggcagaggaa

SEQ ID NO: 4621006 - DNA, 15 bp, Homo sapiens
ccacggcacctgggc

SEQ ID NO: 4621007 - DNA, 12 bp, Homo sapiens
ccacggcctggc

SEQ ID NO: 4621008 - DNA, 19 bp, Homo sapiens
ccacggcctggctggtggg

SEQ ID NO: 4621009 - DNA, 21 bp, Homo sapiens
ccacggtctgttcttgaagca

SEQ ID NO: 4621010 - DNA, 15 bp, Homo sapiens
ccacgtagggggcag

SEQ ID NO: 4621011 - DNA, 21 bp, Homo sapiens
ccacgtagggggcaggggcag

SEQ ID NO: 4621012 - DNA, 12 bp, Homo sapiens
ccacgtcccagc

SEQ ID NO: 4621013 - DNA, 13 bp, Homo sapiens
ccacgtcccagca

SEQ ID NO: 4621014 - DNA, 15 bp, Homo sapiens
ccacgtcccagcatc

SEQ ID NO: 4621015 - DNA, 17 bp, Homo sapiens
ccacgtctggctccctg

SEQ ID NO: 4621016 - DNA, 18 bp, Homo sapiens
ccacgtctggctccctgc

SEQ ID NO: 4621017 - DNA, 18 bp, Homo sapiens
ccacgtgtatagtatctg

SEQ ID NO: 4621018 - DNA, 20 bp, Homo sapiens
ccacgtgtatagtatctgta

SEQ ID NO: 4621019 - DNA, 22 bp, Homo sapiens
ccacgtgtatagtatctgtata

SEQ ID NO: 4621020 - DNA, 23 bp, Homo sapiens
ccacgtgtatagtatctgtatat

SEQ ID NO: 4621021 - DNA, 14 bp, Homo sapiens
ccactaaaaatatt

SEQ ID NO: 4621022 - DNA, 23 bp, Homo sapiens
ccactaaaaatattgtttctgca

SEQ ID NO: 4621023 - DNA, 17 bp, Homo sapiens
ccactaacttctaaaga

SEQ ID NO: 4621024 - DNA, 16 bp, Homo sapiens
ccactcaaaggccaga

SEQ ID NO: 4621025 - DNA, 20 bp, Homo sapiens
ccactccagctccttcgctt

SEQ ID NO: 4621026 - DNA, 22 bp, Homo sapiens
ccactccgccagccacaggacc

SEQ ID NO: 4621027 - DNA, 13 bp, Homo sapiens
ccactccttgtcc

SEQ ID NO: 4621028 - DNA, 21 bp, Homo sapiens
ccactctgccccttgccctcc

SEQ ID NO: 4621029 - DNA, 17 bp, Homo sapiens
ccactctggcagccaca

SEQ ID NO: 4621030 - DNA, 22 bp, Homo sapiens
ccactctggcagccacacttct

SEQ ID NO: 4621031 - DNA, 17 bp, Homo sapiens
ccactcttttgctgtgc

SEQ ID NO: 4621032 - DNA, 14 bp, Homo sapiens
ccactgccccacgt

SEQ ID NO: 4621033 - DNA, 16 bp, Homo sapiens
ccactgctgcttctcc

SEQ ID NO: 4621034 - DNA, 23 bp, Homo sapiens
ccactgctgggggtgagctgtac

SEQ ID NO: 4621035 - DNA, 18 bp, Homo sapiens
ccactggggactttattt

SEQ ID NO: 4621036 - DNA, 20 bp, Homo sapiens
ccacttcaatgcacatggtg

SEQ ID NO: 4621037 - DNA, 18 bp, Homo sapiens
ccacttctccatgctgca

SEQ ID NO: 4621038 - DNA, 19 bp, Homo sapiens
ccacttctccatgctgcaa

SEQ ID NO: 4621039 - DNA, 20 bp, Homo sapiens
ccacttctggcttcagcccc

SEQ ID NO: 4621040 - DNA, 22 bp, Homo sapiens
ccacttctggcttcagccccca

SEQ ID NO: 4621041 - DNA, 11 bp, Homo sapiens
ccacttttgtt

SEQ ID NO: 4621042 - DNA, 13 bp, Homo sapiens
ccacttttgttct

SEQ ID NO: 4621043 - DNA, 13 bp, Homo sapiens
ccagaaagtcccc

SEQ ID NO: 4621044 - DNA, 18 bp, Homo sapiens
ccagaacgtggctctgct

SEQ ID NO: 4621045 - DNA, 21 bp, Homo sapiens
ccagaacgtggctctgctggc

SEQ ID NO: 4621046 - DNA, 21 bp, Homo sapiens
ccagaacgtggtttgcctgag

SEQ ID NO: 4621047 - DNA, 19 bp, Homo sapiens
ccagaacttcaagatgagc

SEQ ID NO: 4621048 - DNA, 21 bp, Homo sapiens
ccagaagacgtggtctagacc

SEQ ID NO: 4621049 - DNA, 22 bp, Homo sapiens
ccagaagacgtggtctagacca

SEQ ID NO: 4621050 - DNA, 18 bp, Homo sapiens
ccagaagatgaacagact

SEQ ID NO: 4621051 - DNA, 20 bp, Homo sapiens
ccagaagatgaacagactga

SEQ ID NO: 4621052 - DNA, 23 bp, Homo sapiens
ccagaagatgaacagactgacct

SEQ ID NO: 4621053 - DNA, 12 bp, Homo sapiens
ccagaaggccct

SEQ ID NO: 4621054 - DNA, 17 bp, Homo sapiens
ccagaccagccctgcag

SEQ ID NO: 4621055 - DNA, 13 bp, Homo sapiens
ccagacctgcatg

SEQ ID NO: 4621056 - DNA, 23 bp, Homo sapiens
ccagacctgttagcagacaggcc

SEQ ID NO: 4621057 - DNA, 16 bp, Homo sapiens
ccagactacttgggag

SEQ ID NO: 4621058 - DNA, 13 bp, Homo sapiens
ccagactcccttg

SEQ ID NO: 4621059 - DNA, 17 bp, Homo sapiens
ccagactctaggttata

SEQ ID NO: 4621060 - DNA, 12 bp, Homo sapiens
ccagagaacagc

SEQ ID NO: 4621061 - DNA, 13 bp, Homo sapiens
ccagagcagctcc

SEQ ID NO: 4621062 - DNA, 15 bp, Homo sapiens
ccagagccaaatttt

SEQ ID NO: 4621063 - DNA, 12 bp, Homo sapiens
ccagagcctggg

SEQ ID NO: 4621064 - DNA, 14 bp, Homo sapiens
ccagagcctggggc

SEQ ID NO: 4621065 - DNA, 16 bp, Homo sapiens
ccagagcctggggctc

SEQ ID NO: 4621066 - DNA, 15 bp, Homo sapiens
ccagagcgtccttgg

SEQ ID NO: 4621067 - DNA, 22 bp, Homo sapiens
ccagagcgtccttggctgccgt

SEQ ID NO: 4621068 - DNA, 14 bp, Homo sapiens
ccagagctcatccc

SEQ ID NO: 4621069 - DNA, 17 bp, Homo sapiens
ccagagctcatcccccc

SEQ ID NO: 4621070 - DNA, 12 bp, Homo sapiens
ccagagctgtgc

SEQ ID NO: 4621071 - DNA, 17 bp, Homo sapiens
ccagagctgtgccagca

SEQ ID NO: 4621072 - DNA, 19 bp, Homo sapiens
ccagagctgtgccagcagg

SEQ ID NO: 4621073 - DNA, 13 bp, Homo sapiens
ccagaggccctgg

SEQ ID NO: 4621074 - DNA, 14 bp, Homo sapiens
ccagatgcagggca

SEQ ID NO: 4621075 - DNA, 18 bp, Homo sapiens
ccagatgcagggcagtca

SEQ ID NO: 4621076 - DNA, 21 bp, Homo sapiens
ccagatgttttacgtctggga

SEQ ID NO: 4621077 - DNA, 23 bp, Homo sapiens
ccagatttgtctttttgttgtaa

SEQ ID NO: 4621078 - DNA, 15 bp, Homo sapiens
ccagcacactattta

SEQ ID NO: 4621079 - DNA, 20 bp, Homo sapiens
ccagcacactatttacaaga

SEQ ID NO: 4621080 - DNA, 20 bp, Homo sapiens
ccagcacttgtccagctgag

SEQ ID NO: 4621081 - DNA, 14 bp, Homo sapiens
ccagcaggaataaa

SEQ ID NO: 4621082 - DNA, 15 bp, Homo sapiens
ccagcaggaataaag

SEQ ID NO: 4621083 - DNA, 19 bp, Homo sapiens
ccagcaggggggctgtgcc

SEQ ID NO: 4621084 - DNA, 23 bp, Homo sapiens
ccagcaggggggctgtgccaacc

SEQ ID NO: 4621085 - DNA, 21 bp, Homo sapiens
ccagcagggtcttttcatctg

SEQ ID NO: 4621086 - DNA, 16 bp, Homo sapiens
ccagcatctcccagca

SEQ ID NO: 4621087 - DNA, 15 bp, Homo sapiens
ccagccacagacccc

SEQ ID NO: 4621088 - DNA, 16 bp, Homo sapiens
ccagccacagacccct

SEQ ID NO: 4621089 - DNA, 22 bp, Homo sapiens
ccagccacagacccctgggagc

SEQ ID NO: 4621090 - DNA, 13 bp, Homo sapiens
ccagccacaggac

SEQ ID NO: 4621091 - DNA, 20 bp, Homo sapiens
ccagccacaggaccacctcc

SEQ ID NO: 4621092 - DNA, 13 bp, Homo sapiens
ccagccaggtgca

SEQ ID NO: 4621093 - DNA, 15 bp, Homo sapiens
ccagcccagatgttt

SEQ ID NO: 4621094 - DNA, 23 bp, Homo sapiens
ccagcccaggaaaaactggaagc

SEQ ID NO: 4621095 - DNA, 21 bp, Homo sapiens
ccagcccatccattaggccag

SEQ ID NO: 4621096 - DNA, 18 bp, Homo sapiens
ccagccccctcctggtgc

SEQ ID NO: 4621097 - DNA, 13 bp, Homo sapiens
ccagccccttccc

SEQ ID NO: 4621098 - DNA, 19 bp, Homo sapiens
ccagccccttcccctggga

SEQ ID NO: 4621099 - DNA, 20 bp, Homo sapiens
ccagccccttcccctgggaa

SEQ ID NO: 4621100 - DNA, 15 bp, Homo sapiens
ccagccctgcctgga

SEQ ID NO: 4621101 - DNA, 18 bp, Homo sapiens
ccagccctgcctggagga

SEQ ID NO: 4621102 - DNA, 21 bp, Homo sapiens
ccagccctgcctggaggacct

SEQ ID NO: 4621103 - DNA, 12 bp, Homo sapiens
ccagccctggga

SEQ ID NO: 4621104 - DNA, 15 bp, Homo sapiens
ccagccctgggaacc

SEQ ID NO: 4621105 - DNA, 22 bp, Homo sapiens
ccagccctgggaaccactccca

SEQ ID NO: 4621106 - DNA, 20 bp, Homo sapiens
ccagccggggcgagtggcac

SEQ ID NO: 4621107 - DNA, 21 bp, Homo sapiens
ccagccggggcgagtggcacg

SEQ ID NO: 4621108 - DNA, 14 bp, Homo sapiens
ccagccgtggccag

SEQ ID NO: 4621109 - DNA, 17 bp, Homo sapiens
ccagcctcacttccttt

SEQ ID NO: 4621110 - DNA, 22 bp, Homo sapiens
ccagcctcacttcctttgccct

SEQ ID NO: 4621111 - DNA, 21 bp, Homo sapiens
ccagcctgaggtgcccactcc

SEQ ID NO: 4621112 - DNA, 12 bp, Homo sapiens
ccagcctggcct

SEQ ID NO: 4621113 - DNA, 13 bp, Homo sapiens
ccagcctggcctc

SEQ ID NO: 4621114 - DNA, 14 bp, Homo sapiens
ccagcctggcctcc

SEQ ID NO: 4621115 - DNA, 17 bp, Homo sapiens
ccagcctggcctcctgc

SEQ ID NO: 4621116 - DNA, 19 bp, Homo sapiens
ccagcctggcctcctgcct

SEQ ID NO: 4621117 - DNA, 17 bp, Homo sapiens
ccagcctgggcctatgg

SEQ ID NO: 4621118 - DNA, 19 bp, Homo sapiens
ccagcctgggcctatggag

SEQ ID NO: 4621119 - DNA, 15 bp, Homo sapiens
ccagcgctgctggtc

SEQ ID NO: 4621120 - DNA, 16 bp, Homo sapiens
ccagcggacagtggca

SEQ ID NO: 4621121 - DNA, 18 bp, Homo sapiens
ccagcggacagtggcagg

SEQ ID NO: 4621122 - DNA, 19 bp, Homo sapiens
ccagcggacagtggcagga

SEQ ID NO: 4621123 - DNA, 21 bp, Homo sapiens
ccagctaaggacatttcccag

SEQ ID NO: 4621124 - DNA, 23 bp, Homo sapiens
ccagctaaggacatttcccaggg

SEQ ID NO: 4621125 - DNA, 20 bp, Homo sapiens
ccagctagtgacccacatgc

SEQ ID NO: 4621126 - DNA, 19 bp, Homo sapiens
ccagctcccccaggcagaa

SEQ ID NO: 4621127 - DNA, 18 bp, Homo sapiens
ccagctccggcctgtcct

SEQ ID NO: 4621128 - DNA, 13 bp, Homo sapiens
ccagctgaaggca

SEQ ID NO: 4621129 - DNA, 15 bp, Homo sapiens
ccagctgaaggcagt

SEQ ID NO: 4621130 - DNA, 16 bp, Homo sapiens
ccagctgaaggcagtg

SEQ ID NO: 4621131 - DNA, 18 bp, Homo sapiens
ccagctgaaggcagtggc

SEQ ID NO: 4621132 - DNA, 18 bp, Homo sapiens
ccagctgaggcaggggga

SEQ ID NO: 4621133 - DNA, 21 bp, Homo sapiens
ccagctgctctaagcccagga

SEQ ID NO: 4621134 - DNA, 23 bp, Homo sapiens
ccagctgctctaagcccaggatc

SEQ ID NO: 4621135 - DNA, 17 bp, Homo sapiens
ccagctgctgtgcccca

SEQ ID NO: 4621136 - DNA, 17 bp, Homo sapiens
ccagcttcacctctggg

SEQ ID NO: 4621137 - DNA, 22 bp, Homo sapiens
ccagcttctcagtttctgcctg

SEQ ID NO: 4621138 - DNA, 23 bp, Homo sapiens
ccagcttgcctgtttcttctcta

SEQ ID NO: 4621139 - DNA, 12 bp, Homo sapiens
ccagctttcctg

SEQ ID NO: 4621140 - DNA, 11 bp, Homo sapiens
ccaggaaagga

SEQ ID NO: 4621141 - DNA, 18 bp, Homo sapiens
ccaggacctggctgccat

SEQ ID NO: 4621142 - DNA, 23 bp, Homo sapiens
ccaggagaagggggctctgcccc

SEQ ID NO: 4621143 - DNA, 15 bp, Homo sapiens
ccaggagagagccag

SEQ ID NO: 4621144 - DNA, 16 bp, Homo sapiens
ccaggagagagccagg

SEQ ID NO: 4621145 - DNA, 23 bp, Homo sapiens
ccaggagggacaaaggagcctgt

SEQ ID NO: 4621146 - DNA, 22 bp, Homo sapiens
ccaggaggtgcagtggaggggg

SEQ ID NO: 4621147 - DNA, 14 bp, Homo sapiens
ccaggagtggggag

SEQ ID NO: 4621148 - DNA, 20 bp, Homo sapiens
ccaggatactggcacagagg

SEQ ID NO: 4621149 - DNA, 14 bp, Homo sapiens
ccaggatcagattg

SEQ ID NO: 4621150 - DNA, 20 bp, Homo sapiens
ccaggatctcctgccagccc

SEQ ID NO: 4621151 - DNA, 22 bp, Homo sapiens
ccaggatctcctgccagcccag

SEQ ID NO: 4621152 - DNA, 23 bp, Homo sapiens
ccaggatctctttccccaaggac

SEQ ID NO: 4621153 - DNA, 14 bp, Homo sapiens
ccaggatggagcaa

SEQ ID NO: 4621154 - DNA, 18 bp, Homo sapiens
ccaggatggagcaagctc

SEQ ID NO: 4621155 - DNA, 20 bp, Homo sapiens
ccaggatggagcaagctctt

SEQ ID NO: 4621156 - DNA, 21 bp, Homo sapiens
ccaggatggagcaagctcttc

SEQ ID NO: 4621157 - DNA, 24 bp, Homo sapiens
ccaggatggagcaagctcttccct

SEQ ID NO: 4621158 - DNA, 11 bp, Homo sapiens
ccaggcaagga

SEQ ID NO: 4621159 - DNA, 16 bp, Homo sapiens
ccaggcagaaatagtt

SEQ ID NO: 4621160 - DNA, 17 bp, Homo sapiens
ccaggcagaaatagttg

SEQ ID NO: 4621161 - DNA, 20 bp, Homo sapiens
ccaggcagaaatagttgtct

SEQ ID NO: 4621162 - DNA, 22 bp, Homo sapiens
ccaggcagaaatagttgtctgt

SEQ ID NO: 4621163 - DNA, 20 bp, Homo sapiens
ccaggccccaccccttccct

SEQ ID NO: 4621164 - DNA, 13 bp, Homo sapiens
ccaggccccatga

SEQ ID NO: 4621165 - DNA, 21 bp, Homo sapiens
ccaggccccatgacctccagc

SEQ ID NO: 4621166 - DNA, 14 bp, Homo sapiens
ccaggccctactac

SEQ ID NO: 4621167 - DNA, 14 bp, Homo sapiens
ccaggcctctgccc

SEQ ID NO: 4621168 - DNA, 16 bp, Homo sapiens
ccaggctgaccacagc

SEQ ID NO: 4621169 - DNA, 23 bp, Homo sapiens
ccaggctgaccacagcacagcca

SEQ ID NO: 4621170 - DNA, 12 bp, Homo sapiens
ccaggctgagcc

SEQ ID NO: 4621171 - DNA, 13 bp, Homo sapiens
ccaggctgtttca

SEQ ID NO: 4621172 - DNA, 12 bp, Homo sapiens
ccagggagatgt

SEQ ID NO: 4621173 - DNA, 10 bp, Homo sapiens
ccagggcaca

SEQ ID NO: 4621174 - DNA, 13 bp, Homo sapiens
ccagggcacagga

SEQ ID NO: 4621175 - DNA, 13 bp, Homo sapiens
ccagggccagagc

SEQ ID NO: 4621176 - DNA, 15 bp, Homo sapiens
ccagggccctcccag

SEQ ID NO: 4621177 - DNA, 13 bp, Homo sapiens
ccagggcctgcga

SEQ ID NO: 4621178 - DNA, 16 bp, Homo sapiens
ccagggctgccctgag

SEQ ID NO: 4621179 - DNA, 19 bp, Homo sapiens
ccagggctgccctgagaag

SEQ ID NO: 4621180 - DNA, 21 bp, Homo sapiens
ccagggctgccctgagaagct

SEQ ID NO: 4621181 - DNA, 23 bp, Homo sapiens
ccagggctgccctgagaagctgc

SEQ ID NO: 4621182 - DNA, 12 bp, Homo sapiens
ccagggctgggg

SEQ ID NO: 4621183 - DNA, 16 bp, Homo sapiens
ccaggggaaggaagga

SEQ ID NO: 4621184 - DNA, 19 bp, Homo sapiens
ccaggggaaggaaggaggg

SEQ ID NO: 4621185 - DNA, 22 bp, Homo sapiens
ccaggggaaggaaggagggcac

SEQ ID NO: 4621186 - DNA, 17 bp, Homo sapiens
ccaggggacactttgtt

SEQ ID NO: 4621187 - DNA, 17 bp, Homo sapiens
ccaggggaggagcctgt

SEQ ID NO: 4621188 - DNA, 21 bp, Homo sapiens
ccaggggccaggagtggggag

SEQ ID NO: 4621189 - DNA, 23 bp, Homo sapiens
ccaggggccaggagtggggagag

SEQ ID NO: 4621190 - DNA, 16 bp, Homo sapiens
ccagggtctctccctc

SEQ ID NO: 4621191 - DNA, 20 bp, Homo sapiens
ccagggtctgtgtgaatgtg

SEQ ID NO: 4621192 - DNA, 13 bp, Homo sapiens
ccaggtacaggag

SEQ ID NO: 4621193 - DNA, 15 bp, Homo sapiens
ccaggtacaggagag

SEQ ID NO: 4621194 - DNA, 23 bp, Homo sapiens
ccaggtacaggagaggcagcatg

SEQ ID NO: 4621195 - DNA, 22 bp, Homo sapiens
ccaggtactgcattctctccca

SEQ ID NO: 4621196 - DNA, 21 bp, Homo sapiens
ccaggtagttggaactttctg

SEQ ID NO: 4621197 - DNA, 21 bp, Homo sapiens
ccaggtatcctgggggaagag

SEQ ID NO: 4621198 - DNA, 17 bp, Homo sapiens
ccaggtatggctctgca

SEQ ID NO: 4621199 - DNA, 19 bp, Homo sapiens
ccaggtcctggtggggcag

SEQ ID NO: 4621200 - DNA, 15 bp, Homo sapiens
ccaggtctcctggga

SEQ ID NO: 4621201 - DNA, 15 bp, Homo sapiens
ccaggtgagaattca

SEQ ID NO: 4621202 - DNA, 18 bp, Homo sapiens
ccaggtgagggaaggaga

SEQ ID NO: 4621203 - DNA, 21 bp, Homo sapiens
ccaggtgagggaaggagacag

SEQ ID NO: 4621204 - DNA, 19 bp, Homo sapiens
ccaggtggcacttccacct

SEQ ID NO: 4621205 - DNA, 22 bp, Homo sapiens
ccaggttcaagcgattctcctg

SEQ ID NO: 4621206 - DNA, 17 bp, Homo sapiens
ccagtactttggaaagc

SEQ ID NO: 4621207 - DNA, 11 bp, Homo sapiens
ccagtagagaa

SEQ ID NO: 4621208 - DNA, 13 bp, Homo sapiens
ccaacaccaagca

SEQ ID NO: 4621209 - DNA, 16 bp, Homo sapiens
ccaacaccaagcacag

SEQ ID NO: 4621210 - DNA, 19 bp, Homo sapiens
ccaacaccaagcacagcag

SEQ ID NO: 4621211 - DNA, 22 bp, Homo sapiens
ccaacaccaagcacagcagcct

SEQ ID NO: 4621212 - DNA, 23 bp, Homo sapiens
ccaacaccaagcacagcagcctg

SEQ ID NO: 4621213 - DNA, 17 bp, Homo sapiens
ccaacacgcacctgcct

SEQ ID NO: 4621214 - DNA, 15 bp, Homo sapiens
ccaacagcaagtgtt

SEQ ID NO: 4621215 - DNA, 13 bp, Homo sapiens
ccaacatgcactg

SEQ ID NO: 4621216 - DNA, 17 bp, Homo sapiens
ccaacatgcactgatgt

SEQ ID NO: 4621217 - DNA, 23 bp, Homo sapiens
ccaacatgcactgatgttgtgtt

SEQ ID NO: 4621218 - DNA, 12 bp, Homo sapiens
ccaaccagcccg

SEQ ID NO: 4621219 - DNA, 13 bp, Homo sapiens
ccaaccagcccga

SEQ ID NO: 4621220 - DNA, 19 bp, Homo sapiens
ccaaccccttaagccctgg

SEQ ID NO: 4621221 - DNA, 17 bp, Homo sapiens
ccaacccgtggaggctg

SEQ ID NO: 4621222 - DNA, 17 bp, Homo sapiens
ccaaccctggcttgggg

SEQ ID NO: 4621223 - DNA, 14 bp, Homo sapiens
ccaacgaaaagcac

SEQ ID NO: 4621224 - DNA, 19 bp, Homo sapiens
ccaacgaaaagcacatcca

SEQ ID NO: 4621225 - DNA, 22 bp, Homo sapiens
ccaactcaagtgtcacctcctt

SEQ ID NO: 4621226 - DNA, 17 bp, Homo sapiens
ccaactcccttctgctt

SEQ ID NO: 4621227 - DNA, 18 bp, Homo sapiens
ccaactcccttctgcttg

SEQ ID NO: 4621228 - DNA, 18 bp, Homo sapiens
ccaactgctaatgcaaat

SEQ ID NO: 4621229 - DNA, 17 bp, Homo sapiens
ccaactgtttccctgct

SEQ ID NO: 4621230 - DNA, 13 bp, Homo sapiens
ccaagaaaatatc

SEQ ID NO: 4621231 - DNA, 16 bp, Homo sapiens
ccaagacagggctcat

SEQ ID NO: 4621232 - DNA, 19 bp, Homo sapiens
ccaagagacacaattacgc

SEQ ID NO: 4621233 - DNA, 16 bp, Homo sapiens
ccaagagcaggaggtg

SEQ ID NO: 4621234 - DNA, 16 bp, Homo sapiens
ccaagagcatcatgcc

SEQ ID NO: 4621235 - DNA, 17 bp, Homo sapiens
ccaagagcatcatgcct

SEQ ID NO: 4621236 - DNA, 22 bp, Homo sapiens
ccaagagcatcatgcctctgag

SEQ ID NO: 4621237 - DNA, 17 bp, Homo sapiens
ccaagatctgccagacc

SEQ ID NO: 4621238 - DNA, 18 bp, Homo sapiens
ccaagatctgccagacct

SEQ ID NO: 4621239 - DNA, 20 bp, Homo sapiens
ccaagatctgccagacctgc

SEQ ID NO: 4621240 - DNA, 13 bp, Homo sapiens
ccaagatttacca

SEQ ID NO: 4621241 - DNA, 19 bp, Homo sapiens
ccaagattttcctcttgtg

SEQ ID NO: 4621242 - DNA, 20 bp, Homo sapiens
ccaagattttcctcttgtga

SEQ ID NO: 4621243 - DNA, 18 bp, Homo sapiens
ccaagcacagcagcctgg

SEQ ID NO: 4621244 - DNA, 22 bp, Homo sapiens
ccaagcatttcatgaaaaagct

SEQ ID NO: 4621245 - DNA, 15 bp, Homo sapiens
ccaagccctcagctg

SEQ ID NO: 4621246 - DNA, 15 bp, Homo sapiens
ccaagctaatttata

SEQ ID NO: 4621247 - DNA, 12 bp, Homo sapiens
ccaagctgaggt

SEQ ID NO: 4621248 - DNA, 22 bp, Homo sapiens
ccaagctgaggtgcccaggaga

SEQ ID NO: 4621249 - DNA, 22 bp, Homo sapiens
ccaagcttggtttgtggcgtct

SEQ ID NO: 4621250 - DNA, 13 bp, Homo sapiens
ccaaggacagttc

SEQ ID NO: 4621251 - DNA, 20 bp, Homo sapiens
ccaaggagggggcctcattg

SEQ ID NO: 4621252 - DNA, 17 bp, Homo sapiens
ccaaggccctgcatctg

SEQ ID NO: 4621253 - DNA, 13 bp, Homo sapiens
ccaagggccctgg

SEQ ID NO: 4621254 - DNA, 21 bp, Homo sapiens
ccaagggccctggcaccccca

SEQ ID NO: 4621255 - DNA, 21 bp, Homo sapiens
ccaaggggcaaatttttattt

SEQ ID NO: 4621256 - DNA, 15 bp, Homo sapiens
ccaaggtgccaccac

SEQ ID NO: 4621257 - DNA, 16 bp, Homo sapiens
ccaaggtggagggaag

SEQ ID NO: 4621258 - DNA, 18 bp, Homo sapiens
ccaaggtggagggaagga

SEQ ID NO: 4621259 - DNA, 17 bp, Homo sapiens
ccaaggttgtcagcttt

SEQ ID NO: 4621260 - DNA, 15 bp, Homo sapiens
ccaagtccaggtcct

SEQ ID NO: 4621261 - DNA, 16 bp, Homo sapiens
ccaagtccaggtcctg

SEQ ID NO: 4621262 - DNA, 22 bp, Homo sapiens
ccaagttgatttagtgttttta

SEQ ID NO: 4621263 - DNA, 20 bp, Homo sapiens
ccaataatcagaaaagtaat

SEQ ID NO: 4621264 - DNA, 16 bp, Homo sapiens
ccaatattgtacagtt

SEQ ID NO: 4621265 - DNA, 18 bp, Homo sapiens
ccaatattgtacagtttt

SEQ ID NO: 4621266 - DNA, 17 bp, Homo sapiens
ccaatcggactgccaaa

SEQ ID NO: 4621267 - DNA, 19 bp, Homo sapiens
ccaatcggactgccaaatt

SEQ ID NO: 4621268 - DNA, 13 bp, Homo sapiens
ccaatgccacaga

SEQ ID NO: 4621269 - DNA, 19 bp, Homo sapiens
ccaatgttagagacttttt

SEQ ID NO: 4621270 - DNA, 15 bp, Homo sapiens
ccaattaagcagctt

SEQ ID NO: 4621271 - DNA, 14 bp, Homo sapiens
ccaattcacccact

SEQ ID NO: 4621272 - DNA, 14 bp, Homo sapiens
ccaattcagacagg

SEQ ID NO: 4621273 - DNA, 14 bp, Homo sapiens
ccaatttttgtact

SEQ ID NO: 4621274 - DNA, 12 bp, Homo sapiens
ccacaagcctgc

SEQ ID NO: 4621275 - DNA, 13 bp, Homo sapiens
ccacaagctgcac

SEQ ID NO: 4621276 - DNA, 14 bp, Homo sapiens
ccacaagctgcact

SEQ ID NO: 4621277 - DNA, 15 bp, Homo sapiens
ccacaagctgtccct

SEQ ID NO: 4621278 - DNA, 18 bp, Homo sapiens
ccacaagctgtccctgca

SEQ ID NO: 4621279 - DNA, 17 bp, Homo sapiens
ccacaaggctgttgcat

SEQ ID NO: 4621280 - DNA, 12 bp, Homo sapiens
ccacacatttta

SEQ ID NO: 4621281 - DNA, 23 bp, Homo sapiens
ccacacgcctctgtgtacatgtg

SEQ ID NO: 4621282 - DNA, 17 bp, Homo sapiens
ccacacttcgctcttga

SEQ ID NO: 4621283 - DNA, 23 bp, Homo sapiens
ccacacttctcaggacacaggcc

SEQ ID NO: 4621284 - DNA, 24 bp, Homo sapiens
ccacacttctcaggacacaggcct

SEQ ID NO: 4621285 - DNA, 18 bp, Homo sapiens
ccacagaaagccaggagc

SEQ ID NO: 4621286 - DNA, 22 bp, Homo sapiens
ccacagaaagccaggagcagcc

SEQ ID NO: 4621287 - DNA, 16 bp, Homo sapiens
ccacagacccctggga

SEQ ID NO: 4621288 - DNA, 21 bp, Homo sapiens
ccacagagaagtttgtagcca

SEQ ID NO: 4621289 - DNA, 18 bp, Homo sapiens
ccacagagtttttcagga

SEQ ID NO: 4621290 - DNA, 15 bp, Homo sapiens
ccacagatttttttg

SEQ ID NO: 4621291 - DNA, 19 bp, Homo sapiens
ccacagatttttttgtaag

SEQ ID NO: 4621292 - DNA, 14 bp, Homo sapiens
ccacagcaggatcg

SEQ ID NO: 4621293 - DNA, 21 bp, Homo sapiens
ccacagcaggatcgaagggtt

SEQ ID NO: 4621294 - DNA, 11 bp, Homo sapiens
ccacagccttc

SEQ ID NO: 4621295 - DNA, 16 bp, Homo sapiens
ccacaggaccacctcc

SEQ ID NO: 4621296 - DNA, 13 bp, Homo sapiens
ccacatccctggg

SEQ ID NO: 4621297 - DNA, 15 bp, Homo sapiens
ccacatccctgggcc

SEQ ID NO: 4621298 - DNA, 16 bp, Homo sapiens
ccacatccctgggcct

SEQ ID NO: 4621299 - DNA, 22 bp, Homo sapiens
ccacatccctgggcctgctgct

SEQ ID NO: 4621300 - DNA, 23 bp, Homo sapiens
ccacatccctgggcctgctgctg

SEQ ID NO: 4621301 - DNA, 20 bp, Homo sapiens
ccacatgaggccatctcagg

SEQ ID NO: 4621302 - DNA, 15 bp, Homo sapiens
ccacatgtgacacat

SEQ ID NO: 4621303 - DNA, 19 bp, Homo sapiens
ccacatgtgacacatatgc

SEQ ID NO: 4621304 - DNA, 22 bp, Homo sapiens
ccacattgggcagcgcccttcc

SEQ ID NO: 4621305 - DNA, 11 bp, Homo sapiens
ccaccaagggc

SEQ ID NO: 4621306 - DNA, 13 bp, Homo sapiens
ccaccacaggcat

SEQ ID NO: 4621307 - DNA, 15 bp, Homo sapiens
ccaccagggccagag

SEQ ID NO: 4621308 - DNA, 16 bp, Homo sapiens
ccaccatgcctcacta

SEQ ID NO: 4621309 - DNA, 11 bp, Homo sapiens
ccacccaggaa

SEQ ID NO: 4621310 - DNA, 13 bp, Homo sapiens
ccacccaggaaag

SEQ ID NO: 4621311 - DNA, 18 bp, Homo sapiens
ccacccaggaaaggagga

SEQ ID NO: 4621312 - DNA, 12 bp, Homo sapiens
ccacccccacca

SEQ ID NO: 4621313 - DNA, 12 bp, Homo sapiens
ccacccccagcc

SEQ ID NO: 4621314 - DNA, 15 bp, Homo sapiens
ccacccccagttcct

SEQ ID NO: 4621315 - DNA, 14 bp, Homo sapiens
ccaccccctgcctg

SEQ ID NO: 4621316 - DNA, 18 bp, Homo sapiens
ccacccctctcgcctcat

SEQ ID NO: 4621317 - DNA, 20 bp, Homo sapiens
ccaccccttggaggagagag

SEQ ID NO: 4621318 - DNA, 23 bp, Homo sapiens
ccaccccttggaggagagagacc

SEQ ID NO: 4621319 - DNA, 23 bp, Homo sapiens
ccaccctgaggagtctgaggtcc

SEQ ID NO: 4621320 - DNA, 18 bp, Homo sapiens
ccagtcaggatgaggccc

SEQ ID NO: 4621321 - DNA, 22 bp, Homo sapiens
ccagtcctccctagctcttccc

SEQ ID NO: 4621322 - DNA, 17 bp, Homo sapiens
ccagtcggccccatctc

SEQ ID NO: 4621323 - DNA, 21 bp, Homo sapiens
ccagtctagtccgtcctggca

SEQ ID NO: 4621324 - DNA, 24 bp, Homo sapiens
ccagtctagtccgtcctggcacag

SEQ ID NO: 4621325 - DNA, 13 bp, Homo sapiens
ccagtctcattgt

SEQ ID NO: 4621326 - DNA, 22 bp, Homo sapiens
ccagtctctggggtcaggaaga

SEQ ID NO: 4621327 - DNA, 24 bp, Homo sapiens
ccagtgcaggtatttcagaaggag

SEQ ID NO: 4621328 - DNA, 20 bp, Homo sapiens
ccagtgcatcacatctgcac

SEQ ID NO: 4621329 - DNA, 21 bp, Homo sapiens
ccagtgcatcacatctgcaca

SEQ ID NO: 4621330 - DNA, 14 bp, Homo sapiens
ccagtgccaaggac

SEQ ID NO: 4621331 - DNA, 11 bp, Homo sapiens
ccagtgccacg

SEQ ID NO: 4621332 - DNA, 15 bp, Homo sapiens
ccagtgcctgcacat

SEQ ID NO: 4621333 - DNA, 19 bp, Homo sapiens
ccagtgctgtctgggatgt

SEQ ID NO: 4621334 - DNA, 15 bp, Homo sapiens
ccagtggggcctgtg

SEQ ID NO: 4621335 - DNA, 11 bp, Homo sapiens
ccagtgttttc

SEQ ID NO: 4621336 - DNA, 15 bp, Homo sapiens
ccagtttctcagaag

SEQ ID NO: 4621337 - DNA, 15 bp, Homo sapiens
ccataaaagaagttt

SEQ ID NO: 4621338 - DNA, 13 bp, Homo sapiens
ccataaagaagca

SEQ ID NO: 4621339 - DNA, 20 bp, Homo sapiens
ccataattatgaaaactcat

SEQ ID NO: 4621340 - DNA, 13 bp, Homo sapiens
ccataattttgca

SEQ ID NO: 4621341 - DNA, 13 bp, Homo sapiens
ccataccttctcc

SEQ ID NO: 4621342 - DNA, 15 bp, Homo sapiens
ccataccttctccca

SEQ ID NO: 4621343 - DNA, 20 bp, Homo sapiens
ccataccttctcccaggcct

SEQ ID NO: 4621344 - DNA, 14 bp, Homo sapiens
ccatactgtagaca

SEQ ID NO: 4621345 - DNA, 17 bp, Homo sapiens
ccatagagatgagccca

SEQ ID NO: 4621346 - DNA, 22 bp, Homo sapiens
ccatagggtcggaggtgctgtc

SEQ ID NO: 4621347 - DNA, 19 bp, Homo sapiens
ccataggtttctctccctc

SEQ ID NO: 4621348 - DNA, 15 bp, Homo sapiens
ccatagtcacatggc

SEQ ID NO: 4621349 - DNA, 22 bp, Homo sapiens
ccatatgccttggggaggacaa

SEQ ID NO: 4621350 - DNA, 18 bp, Homo sapiens
ccatatttactaccttat

SEQ ID NO: 4621351 - DNA, 17 bp, Homo sapiens
ccatcaaaggaatataa

SEQ ID NO: 4621352 - DNA, 21 bp, Homo sapiens
ccatcaaaggaatataagaaa

SEQ ID NO: 4621353 - DNA, 19 bp, Homo sapiens
ccatcaactaaaacattat

SEQ ID NO: 4621354 - DNA, 20 bp, Homo sapiens
ccatcaactaaaacattata

SEQ ID NO: 4621355 - DNA, 15 bp, Homo sapiens
ccatcagccctgcta

SEQ ID NO: 4621356 - DNA, 17 bp, Homo sapiens
ccatcagccctgctaga

SEQ ID NO: 4621357 - DNA, 19 bp, Homo sapiens
ccatcagtgaaagaaactg

SEQ ID NO: 4621358 - DNA, 11 bp, Homo sapiens
ccatcatcctc

SEQ ID NO: 4621359 - DNA, 18 bp, Homo sapiens
ccatccacttacatatat

SEQ ID NO: 4621360 - DNA, 13 bp, Homo sapiens
ccatccagatgtg

SEQ ID NO: 4621361 - DNA, 16 bp, Homo sapiens
ccatccattaggccag

SEQ ID NO: 4621362 - DNA, 17 bp, Homo sapiens
ccatccattaggccagc

SEQ ID NO: 4621363 - DNA, 18 bp, Homo sapiens
ccatccattaggccagca

SEQ ID NO: 4621364 - DNA, 17 bp, Homo sapiens
ccatcccaaccagtgcc

SEQ ID NO: 4621365 - DNA, 18 bp, Homo sapiens
ccatcccaaccagtgcca

SEQ ID NO: 4621366 - DNA, 21 bp, Homo sapiens
ccatcccaaccagtgccaagg

SEQ ID NO: 4621367 - DNA, 22 bp, Homo sapiens
ccatcccaaccagtgccaagga

SEQ ID NO: 4621368 - DNA, 15 bp, Homo sapiens
ccatccccaccttca

SEQ ID NO: 4621369 - DNA, 16 bp, Homo sapiens
ccatcctcatccctga

SEQ ID NO: 4621370 - DNA, 21 bp, Homo sapiens
ccatctaagcattccacactg

SEQ ID NO: 4621371 - DNA, 10 bp, Homo sapiens
ccatctatca

SEQ ID NO: 4621372 - DNA, 12 bp, Homo sapiens
ccatctcaggag

SEQ ID NO: 4621373 - DNA, 23 bp, Homo sapiens
ccatctcaggagatggagggctt

SEQ ID NO: 4621374 - DNA, 20 bp, Homo sapiens
ccatctctcccttacccatc

SEQ ID NO: 4621375 - DNA, 18 bp, Homo sapiens
ccatctctctcttgcctg

SEQ ID NO: 4621376 - DNA, 12 bp, Homo sapiens
ccatctgggctc

SEQ ID NO: 4621377 - DNA, 14 bp, Homo sapiens
ccatcttaatcttt

SEQ ID NO: 4621378 - DNA, 15 bp, Homo sapiens
ccatcttaatcttta

SEQ ID NO: 4621379 - DNA, 21 bp, Homo sapiens
ccatcttaatctttattttat

SEQ ID NO: 4621380 - DNA, 11 bp, Homo sapiens
ccatcttgctt

SEQ ID NO: 4621381 - DNA, 19 bp, Homo sapiens
ccatcttgcttccaagacc

SEQ ID NO: 4621382 - DNA, 10 bp, Homo sapiens
ccatcttgtt

SEQ ID NO: 4621383 - DNA, 13 bp, Homo sapiens
ccatgaaccctgc

SEQ ID NO: 4621384 - DNA, 15 bp, Homo sapiens
ccatgaaccctgccc

SEQ ID NO: 4621385 - DNA, 16 bp, Homo sapiens
ccatgacaagaacaaa

SEQ ID NO: 4621386 - DNA, 21 bp, Homo sapiens
ccatgacctccagctttcctg

SEQ ID NO: 4621387 - DNA, 22 bp, Homo sapiens
ccatgacctccagctttcctgt

SEQ ID NO: 4621388 - DNA, 18 bp, Homo sapiens
ccatgagactgccctgcc

SEQ ID NO: 4621389 - DNA, 22 bp, Homo sapiens
ccatgagactgccctgcccagg

SEQ ID NO: 4621390 - DNA, 21 bp, Homo sapiens
ccatgagttggggtctggcag

SEQ ID NO: 4621391 - DNA, 23 bp, Homo sapiens
ccatgagttggggtctggcagcc

SEQ ID NO: 4621392 - DNA, 18 bp, Homo sapiens
ccatgatggccaggctga

SEQ ID NO: 4621393 - DNA, 20 bp, Homo sapiens
ccatgcatttcataaactaa

SEQ ID NO: 4621394 - DNA, 11 bp, Homo sapiens
ccatgccccca

SEQ ID NO: 4621395 - DNA, 20 bp, Homo sapiens
ccatgctgcaaaggagaagc

SEQ ID NO: 4621396 - DNA, 16 bp, Homo sapiens
ccatggacaggctggc

SEQ ID NO: 4621397 - DNA, 13 bp, Homo sapiens
ccatgggtctggc

SEQ ID NO: 4621398 - DNA, 15 bp, Homo sapiens
ccatgggtctggcta

SEQ ID NO: 4621399 - DNA, 16 bp, Homo sapiens
ccatgtagccacccaa

SEQ ID NO: 4621400 - DNA, 22 bp, Homo sapiens
ccatgtgattaatgttttcatt

SEQ ID NO: 4621401 - DNA, 13 bp, Homo sapiens
ccatgtgtacatt

SEQ ID NO: 4621402 - DNA, 16 bp, Homo sapiens
ccatgttacttctctg

SEQ ID NO: 4621403 - DNA, 19 bp, Homo sapiens
ccatgttacttctctgagt

SEQ ID NO: 4621404 - DNA, 21 bp, Homo sapiens
ccatgttagtaatggcagagc

SEQ ID NO: 4621405 - DNA, 22 bp, Homo sapiens
ccatgttcacaccgctgcactc

SEQ ID NO: 4621406 - DNA, 17 bp, Homo sapiens
ccatgttgtgcctccct

SEQ ID NO: 4621407 - DNA, 20 bp, Homo sapiens
ccatgttgtgcctccctggt

SEQ ID NO: 4621408 - DNA, 13 bp, Homo sapiens
ccattaatcttga

SEQ ID NO: 4621409 - DNA, 14 bp, Homo sapiens
ccattaatcttgat

SEQ ID NO: 4621410 - DNA, 17 bp, Homo sapiens
ccattagccagatttgt

SEQ ID NO: 4621411 - DNA, 19 bp, Homo sapiens
ccattagctttcaattccg

SEQ ID NO: 4621412 - DNA, 20 bp, Homo sapiens
ccattaggccagcaacgctt

SEQ ID NO: 4621413 - DNA, 13 bp, Homo sapiens
ccattcaattagt

SEQ ID NO: 4621414 - DNA, 15 bp, Homo sapiens
ccattcccatggagt

SEQ ID NO: 4621415 - DNA, 14 bp, Homo sapiens
ccattccctagcag

SEQ ID NO: 4621416 - DNA, 13 bp, Homo sapiens
ccattctccacag

SEQ ID NO: 4621417 - DNA, 15 bp, Homo sapiens
ccattctccacagca

SEQ ID NO: 4621418 - DNA, 19 bp, Homo sapiens
ccattgaagccgactctgg

SEQ ID NO: 4621419 - DNA, 16 bp, Homo sapiens
ccattgagtccctgct

SEQ ID NO: 4621420 - DNA, 17 bp, Homo sapiens
ccattgcctagctcttt

SEQ ID NO: 4621421 - DNA, 13 bp, Homo sapiens
ccattttctgtgg

SEQ ID NO: 4621422 - DNA, 16 bp, Homo sapiens
ccattttgcccttcca

SEQ ID NO: 4621423 - DNA, 23 bp, Homo sapiens
cccaaacccagtctcctctccat

SEQ ID NO: 4621424 - DNA, 19 bp, Homo sapiens
cccaaagcggtccctgtcc

SEQ ID NO: 4621425 - DNA, 19 bp, Homo sapiens
cccaaagcttgtaaatatg

SEQ ID NO: 4621426 - DNA, 13 bp, Homo sapiens
cccaaaggaaccg

SEQ ID NO: 4621427 - DNA, 15 bp, Homo sapiens
cccaaaggctgcagc

SEQ ID NO: 4621428 - DNA, 17 bp, Homo sapiens
cccaaaggtaggaaggt

SEQ ID NO: 4621429 - DNA, 20 bp, Homo sapiens
cccaaagtggtatagaaatg

SEQ ID NO: 4621430 - DNA, 15 bp, Homo sapiens
cccaaatccgaacct

SEQ ID NO: 4621431 - DNA, 23 bp, Homo sapiens
cccaaatccgaacctcctctgtg

SEQ ID NO: 4621432 - DNA, 15 bp, Homo sapiens
cccatccattaggcc

SEQ ID NO: 4621433 - DNA, 13 bp, Homo sapiens
cccatccccagcg

SEQ ID NO: 4621434 - DNA, 18 bp, Homo sapiens
cccatccccagcgattcc

SEQ ID NO: 4621435 - DNA, 18 bp, Homo sapiens
cccatcctcatccctgac

SEQ ID NO: 4621436 - DNA, 14 bp, Homo sapiens
cccatcctggggca

SEQ ID NO: 4621437 - DNA, 21 bp, Homo sapiens
cccatcctggggcagcactcc

SEQ ID NO: 4621438 - DNA, 22 bp, Homo sapiens
cccatctaagcattccacactg

SEQ ID NO: 4621439 - DNA, 16 bp, Homo sapiens
cccatctcactcttag

SEQ ID NO: 4621440 - DNA, 14 bp, Homo sapiens
cccatctcatgccc

SEQ ID NO: 4621441 - DNA, 14 bp, Homo sapiens
cccatctctccctt

SEQ ID NO: 4621442 - DNA, 14 bp, Homo sapiens
cccatgaaccctgc

SEQ ID NO: 4621443 - DNA, 22 bp, Homo sapiens
cccatgaacttaaaatgaaagt

SEQ ID NO: 4621444 - DNA, 14 bp, Homo sapiens
cccatgacctccag

SEQ ID NO: 4621445 - DNA, 15 bp, Homo sapiens
cccatgacctccagc

SEQ ID NO: 4621446 - DNA, 17 bp, Homo sapiens
cccatgtgtacattctg

SEQ ID NO: 4621447 - DNA, 22 bp, Homo sapiens
cccattaatcttgatcattccg

SEQ ID NO: 4621448 - DNA, 22 bp, Homo sapiens
cccattgctccattcactccca

SEQ ID NO: 4621449 - DNA, 17 bp, Homo sapiens
cccattgttcccttcct

SEQ ID NO: 4621450 - DNA, 13 bp, Homo sapiens
ccccaaagttgct

SEQ ID NO: 4621451 - DNA, 16 bp, Homo sapiens
ccccaacgaaaagcac

SEQ ID NO: 4621452 - DNA, 20 bp, Homo sapiens
ccccaacgaaaagcacatcc

SEQ ID NO: 4621453 - DNA, 17 bp, Homo sapiens
ccccaaggacccagccc

SEQ ID NO: 4621454 - DNA, 17 bp, Homo sapiens
ccccaagggccctggca

SEQ ID NO: 4621455 - DNA, 18 bp, Homo sapiens
ccccaagggccctggcac

SEQ ID NO: 4621456 - DNA, 17 bp, Homo sapiens
ccccaatcggactgcca

SEQ ID NO: 4621457 - DNA, 18 bp, Homo sapiens
ccccaatcggactgccaa

SEQ ID NO: 4621458 - DNA, 20 bp, Homo sapiens
ccccaatcggactgccaaat

SEQ ID NO: 4621459 - DNA, 19 bp, Homo sapiens
ccccaatgaccttagcccc

SEQ ID NO: 4621460 - DNA, 20 bp, Homo sapiens
ccccacaagctgtccctgca

SEQ ID NO: 4621461 - DNA, 22 bp, Homo sapiens
ccccacaagctgtccctgcagg

SEQ ID NO: 4621462 - DNA, 23 bp, Homo sapiens
ccccacaagctgtccctgcaggg

SEQ ID NO: 4621463 - DNA, 13 bp, Homo sapiens
ccccacaaggcct

SEQ ID NO: 4621464 - DNA, 21 bp, Homo sapiens
ccccacaaggcctggtctggg

SEQ ID NO: 4621465 - DNA, 11 bp, Homo sapiens
ccccacccctt

SEQ ID NO: 4621466 - DNA, 12 bp, Homo sapiens
ccccaccccttc

SEQ ID NO: 4621467 - DNA, 13 bp, Homo sapiens
ccccactctgctc

SEQ ID NO: 4621468 - DNA, 22 bp, Homo sapiens
ccccagagaaagcgcagatgct

SEQ ID NO: 4621469 - DNA, 12 bp, Homo sapiens
ccccagaggccc

SEQ ID NO: 4621470 - DNA, 23 bp, Homo sapiens
ccccagcccatccattaggccag

SEQ ID NO: 4621471 - DNA, 12 bp, Homo sapiens
ccccagccctgg

SEQ ID NO: 4621472 - DNA, 13 bp, Homo sapiens
ccccagcctgggc

SEQ ID NO: 4621473 - DNA, 13 bp, Homo sapiens
ccccagctccggc

SEQ ID NO: 4621474 - DNA, 13 bp, Homo sapiens
ccccagctgctct

SEQ ID NO: 4621475 - DNA, 11 bp, Homo sapiens
ccccagctggc

SEQ ID NO: 4621476 - DNA, 12 bp, Homo sapiens
ccccagctggcc

SEQ ID NO: 4621477 - DNA, 12 bp, Homo sapiens
ccccaggcagaa

SEQ ID NO: 4621478 - DNA, 14 bp, Homo sapiens
ccccaggccctact

SEQ ID NO: 4621479 - DNA, 11 bp, Homo sapiens
ccccagggcac

SEQ ID NO: 4621480 - DNA, 17 bp, Homo sapiens
ccccagggcacaggagc

SEQ ID NO: 4621481 - DNA, 22 bp, Homo sapiens
ccccagggcacaggagctacct

SEQ ID NO: 4621482 - DNA, 17 bp, Homo sapiens
ccccaggggcatgactg

SEQ ID NO: 4621483 - DNA, 17 bp, Homo sapiens
ccccaggtggaaggcag

SEQ ID NO: 4621484 - DNA, 15 bp, Homo sapiens
ccccagttcctatga

SEQ ID NO: 4621485 - DNA, 21 bp, Homo sapiens
ccccatagggtcggaggtgct

SEQ ID NO: 4621486 - DNA, 15 bp, Homo sapiens
ccccatcggccaaga

SEQ ID NO: 4621487 - DNA, 21 bp, Homo sapiens
ccccatctcatgcccctggct

SEQ ID NO: 4621488 - DNA, 23 bp, Homo sapiens
ccccatctcatgcccctggctgg

SEQ ID NO: 4621489 - DNA, 13 bp, Homo sapiens
ccccatctctcat

SEQ ID NO: 4621490 - DNA, 12 bp, Homo sapiens
ccccatctgtgt

SEQ ID NO: 4621491 - DNA, 16 bp, Homo sapiens
ccccatgaaccctgcc

SEQ ID NO: 4621492 - DNA, 13 bp, Homo sapiens
ccccatgacctcc

SEQ ID NO: 4621493 - DNA, 15 bp, Homo sapiens
ccccatgatgtaagt

SEQ ID NO: 4621494 - DNA, 21 bp, Homo sapiens
cccccaatgaccttagcccca

SEQ ID NO: 4621495 - DNA, 20 bp, Homo sapiens
cccccacaagctgtccctgc

SEQ ID NO: 4621496 - DNA, 22 bp, Homo sapiens
cccccacaagctgtccctgcag

SEQ ID NO: 4621497 - DNA, 11 bp, Homo sapiens
cccccaccctt

SEQ ID NO: 4621498 - DNA, 13 bp, Homo sapiens
cccccacccttgg

SEQ ID NO: 4621499 - DNA, 14 bp, Homo sapiens
cccccactccagct

SEQ ID NO: 4621500 - DNA, 13 bp, Homo sapiens
cccccagcctggg

SEQ ID NO: 4621501 - DNA, 21 bp, Homo sapiens
cccccagtcctccctagctct

SEQ ID NO: 4621502 - DNA, 12 bp, Homo sapiens
cccccctgctgc

SEQ ID NO: 4621503 - DNA, 19 bp, Homo sapiens
cccccctgctgcccagtgc

SEQ ID NO: 4621504 - DNA, 12 bp, Homo sapiens
ccccctccattc

SEQ ID NO: 4621505 - DNA, 18 bp, Homo sapiens
ccccctccattcccaccc

SEQ ID NO: 4621506 - DNA, 20 bp, Homo sapiens
ccccctccctgtcccagggc

SEQ ID NO: 4621507 - DNA, 20 bp, Homo sapiens
ccccctgcaacttccgctga

SEQ ID NO: 4621508 - DNA, 12 bp, Homo sapiens
ccccctgcctgg

SEQ ID NO: 4621509 - DNA, 11 bp, Homo sapiens
ccccctgggga

SEQ ID NO: 4621510 - DNA, 20 bp, Homo sapiens
ccccctttctctgcctggca

SEQ ID NO: 4621511 - DNA, 21 bp, Homo sapiens
ccccctttctctgcctggcaa

SEQ ID NO: 4621512 - DNA, 14 bp, Homo sapiens
ccccgacttcctga

SEQ ID NO: 4621513 - DNA, 12 bp, Homo sapiens
ccccgccacagc

SEQ ID NO: 4621514 - DNA, 15 bp, Homo sapiens
ccccgggatattata

SEQ ID NO: 4621515 - DNA, 15 bp, Homo sapiens
ccccgggctggagaa

SEQ ID NO: 4621516 - DNA, 18 bp, Homo sapiens
ccccgggctggagaaaga

SEQ ID NO: 4621517 - DNA, 21 bp, Homo sapiens
cccctaagtgcaaacacagca

SEQ ID NO: 4621518 - DNA, 16 bp, Homo sapiens
cccctagggactgtcc

SEQ ID NO: 4621519 - DNA, 20 bp, Homo sapiens
cccctagggactgtcctagc

SEQ ID NO: 4621520 - DNA, 13 bp, Homo sapiens
cccctcagagcat

SEQ ID NO: 4621521 - DNA, 15 bp, Homo sapiens
cccctccactgctgg

SEQ ID NO: 4621522 - DNA, 14 bp, Homo sapiens
cccctccagccaga

SEQ ID NO: 4621523 - DNA, 13 bp, Homo sapiens
cccctccaggaga

SEQ ID NO: 4621524 - DNA, 13 bp, Homo sapiens
cccctccattccc

SEQ ID NO: 4621525 - DNA, 19 bp, Homo sapiens
cccctccccatctgtgttc

SEQ ID NO: 4621526 - DNA, 22 bp, Homo sapiens
cccctcctccagcccctgtccc

SEQ ID NO: 4621527 - DNA, 15 bp, Homo sapiens
cccctgacctgtgag

SEQ ID NO: 4621528 - DNA, 22 bp, Homo sapiens
cccctgcaacttccgctgaggg

SEQ ID NO: 4621529 - DNA, 13 bp, Homo sapiens
cccctgctgccca

SEQ ID NO: 4621530 - DNA, 19 bp, Homo sapiens
cccctgcttccacctcacc

SEQ ID NO: 4621531 - DNA, 22 bp, Homo sapiens
cccctggctgggacgtggctca

SEQ ID NO: 4621532 - DNA, 19 bp, Homo sapiens
cccctgtaatcaggcaagg

SEQ ID NO: 4621533 - DNA, 22 bp, Homo sapiens
cccctgtgggactcatccttgc

SEQ ID NO: 4621534 - DNA, 16 bp, Homo sapiens
cccctgttttctgctg

SEQ ID NO: 4621535 - DNA, 12 bp, Homo sapiens
ccccttccccat

SEQ ID NO: 4621536 - DNA, 18 bp, Homo sapiens
ccccttcccctgggaact

SEQ ID NO: 4621537 - DNA, 21 bp, Homo sapiens
ccccttggaggagagagaccc

SEQ ID NO: 4621538 - DNA, 15 bp, Homo sapiens
cccctttctctgcct

SEQ ID NO: 4621539 - DNA, 17 bp, Homo sapiens
cccctttctctgcctgg

SEQ ID NO: 4621540 - DNA, 13 bp, Homo sapiens
cccgacagtgcca

SEQ ID NO: 4621541 - DNA, 19 bp, Homo sapiens
cccgacagtgccatcccca

SEQ ID NO: 4621542 - DNA, 16 bp, Homo sapiens
cccgacttcctgactc

SEQ ID NO: 4621543 - DNA, 16 bp, Homo sapiens
cccgagcagctgagca

SEQ ID NO: 4621544 - DNA, 18 bp, Homo sapiens
cccaacccgtggaggctg

SEQ ID NO: 4621545 - DNA, 19 bp, Homo sapiens
cccaacccgtggaggctgc

SEQ ID NO: 4621546 - DNA, 20 bp, Homo sapiens
cccaaccctggcttggggtc

SEQ ID NO: 4621547 - DNA, 16 bp, Homo sapiens
cccaacgaaaagcaca

SEQ ID NO: 4621548 - DNA, 17 bp, Homo sapiens
cccaactcccttctgct

SEQ ID NO: 4621549 - DNA, 22 bp, Homo sapiens
cccaactcccttctgcttgtcc

SEQ ID NO: 4621550 - DNA, 23 bp, Homo sapiens
cccaagagcaggaggtgcctgaa

SEQ ID NO: 4621551 - DNA, 23 bp, Homo sapiens
cccaagaggtcaaggctgcagtg

SEQ ID NO: 4621552 - DNA, 14 bp, Homo sapiens
cccaagatctgcca

SEQ ID NO: 4621553 - DNA, 12 bp, Homo sapiens
cccaagctagac

SEQ ID NO: 4621554 - DNA, 13 bp, Homo sapiens
cccaagctagact

SEQ ID NO: 4621555 - DNA, 16 bp, Homo sapiens
cccaagctagactgtg

SEQ ID NO: 4621556 - DNA, 20 bp, Homo sapiens
cccaaggacccagccctcgc

SEQ ID NO: 4621557 - DNA, 20 bp, Homo sapiens
cccaaggactgagggcagtg

SEQ ID NO: 4621558 - DNA, 19 bp, Homo sapiens
cccaaggagggggcctcat

SEQ ID NO: 4621559 - DNA, 22 bp, Homo sapiens
cccaaggagggggcctcattgt

SEQ ID NO: 4621560 - DNA, 18 bp, Homo sapiens
cccaaggcattgattgca

SEQ ID NO: 4621561 - DNA, 14 bp, Homo sapiens
cccaagtctcctag

SEQ ID NO: 4621562 - DNA, 15 bp, Homo sapiens
cccaatcggactgcc

SEQ ID NO: 4621563 - DNA, 17 bp, Homo sapiens
cccaatcggactgccaa

SEQ ID NO: 4621564 - DNA, 15 bp, Homo sapiens
cccaatggtgcttgg

SEQ ID NO: 4621565 - DNA, 20 bp, Homo sapiens
cccaatggtgcttggagggg

SEQ ID NO: 4621566 - DNA, 12 bp, Homo sapiens
cccacaaggcct

SEQ ID NO: 4621567 - DNA, 14 bp, Homo sapiens
cccacaaggcctgg

SEQ ID NO: 4621568 - DNA, 15 bp, Homo sapiens
cccacaaggcctggt

SEQ ID NO: 4621569 - DNA, 17 bp, Homo sapiens
cccacaaggcctggtct

SEQ ID NO: 4621570 - DNA, 18 bp, Homo sapiens
cccacatccctgggcctg

SEQ ID NO: 4621571 - DNA, 19 bp, Homo sapiens
cccacatccctgggcctgc

SEQ ID NO: 4621572 - DNA, 20 bp, Homo sapiens
cccacatccctgggcctgct

SEQ ID NO: 4621573 - DNA, 23 bp, Homo sapiens
cccacatccctgggcctgctgct

SEQ ID NO: 4621574 - DNA, 22 bp, Homo sapiens
cccacatgaggccatctcagga

SEQ ID NO: 4621575 - DNA, 16 bp, Homo sapiens
cccaccacgtctggct

SEQ ID NO: 4621576 - DNA, 23 bp, Homo sapiens
cccaccaggggaaggaaggaggg

SEQ ID NO: 4621577 - DNA, 18 bp, Homo sapiens
cccaccattcctgccttt

SEQ ID NO: 4621578 - DNA, 15 bp, Homo sapiens
cccacccacatgtga

SEQ ID NO: 4621579 - DNA, 15 bp, Homo sapiens
cccacccaggaaagg

SEQ ID NO: 4621580 - DNA, 15 bp, Homo sapiens
cccacccccaccccc

SEQ ID NO: 4621581 - DNA, 13 bp, Homo sapiens
cccaccccttccc

SEQ ID NO: 4621582 - DNA, 23 bp, Homo sapiens
cccaccccttggaggagagagac

SEQ ID NO: 4621583 - DNA, 13 bp, Homo sapiens
cccacccttgggc

SEQ ID NO: 4621584 - DNA, 19 bp, Homo sapiens
cccaccgggccactccttc

SEQ ID NO: 4621585 - DNA, 22 bp, Homo sapiens
cccaccgggccactccttcctg

SEQ ID NO: 4621586 - DNA, 15 bp, Homo sapiens
cccaccgtgggcagg

SEQ ID NO: 4621587 - DNA, 15 bp, Homo sapiens
cccacctcagcctcc

SEQ ID NO: 4621588 - DNA, 10 bp, Homo sapiens
cccacctgct

SEQ ID NO: 4621589 - DNA, 22 bp, Homo sapiens
cccacctgctagtcgcccctca

SEQ ID NO: 4621590 - DNA, 15 bp, Homo sapiens
cccactactgcagca

SEQ ID NO: 4621591 - DNA, 18 bp, Homo sapiens
cccactactgcagcacct

SEQ ID NO: 4621592 - DNA, 12 bp, Homo sapiens
cccactcccttg

SEQ ID NO: 4621593 - DNA, 16 bp, Homo sapiens
cccactccgccagcca

SEQ ID NO: 4621594 - DNA, 23 bp, Homo sapiens
cccactccgccagccacaggacc

SEQ ID NO: 4621595 - DNA, 15 bp, Homo sapiens
cccactctgctctga

SEQ ID NO: 4621596 - DNA, 13 bp, Homo sapiens
cccactgctcccc

SEQ ID NO: 4621597 - DNA, 18 bp, Homo sapiens
cccagacctgcctcttcc

SEQ ID NO: 4621598 - DNA, 22 bp, Homo sapiens
cccagacctgttagcagacagg

SEQ ID NO: 4621599 - DNA, 22 bp, Homo sapiens
cccagactactattttcttttt

SEQ ID NO: 4621600 - DNA, 19 bp, Homo sapiens
cccagagctcatcccccct

SEQ ID NO: 4621601 - DNA, 13 bp, Homo sapiens
cccagagctgtgc

SEQ ID NO: 4621602 - DNA, 15 bp, Homo sapiens
cccagaggccctgga

SEQ ID NO: 4621603 - DNA, 16 bp, Homo sapiens
cccagaggccctggag

SEQ ID NO: 4621604 - DNA, 12 bp, Homo sapiens
cccagcactttg

SEQ ID NO: 4621605 - DNA, 22 bp, Homo sapiens
cccagcagggtcttttcatctg

SEQ ID NO: 4621606 - DNA, 18 bp, Homo sapiens
cccagcatccctggagca

SEQ ID NO: 4621607 - DNA, 12 bp, Homo sapiens
cccagcatctcc

SEQ ID NO: 4621608 - DNA, 15 bp, Homo sapiens
cccagccccagagaa

SEQ ID NO: 4621609 - DNA, 15 bp, Homo sapiens
cccagccccttcccc

SEQ ID NO: 4621610 - DNA, 19 bp, Homo sapiens
cccagccccttcccctggg

SEQ ID NO: 4621611 - DNA, 21 bp, Homo sapiens
cccagccccttcccctgggaa

SEQ ID NO: 4621612 - DNA, 15 bp, Homo sapiens
cccagccctcgcctc

SEQ ID NO: 4621613 - DNA, 21 bp, Homo sapiens
cccagccctcgcctctgcgag

SEQ ID NO: 4621614 - DNA, 13 bp, Homo sapiens
cccagccctggga

SEQ ID NO: 4621615 - DNA, 14 bp, Homo sapiens
cccagccctgggaa

SEQ ID NO: 4621616 - DNA, 19 bp, Homo sapiens
cccagcctcacttcctttg

SEQ ID NO: 4621617 - DNA, 12 bp, Homo sapiens
cccagcctgggc

SEQ ID NO: 4621618 - DNA, 15 bp, Homo sapiens
cccagcctgggccta

SEQ ID NO: 4621619 - DNA, 23 bp, Homo sapiens
cccagcggacagtggcaggacag

SEQ ID NO: 4621620 - DNA, 17 bp, Homo sapiens
cccagctcccccaggca

SEQ ID NO: 4621621 - DNA, 17 bp, Homo sapiens
cccagctccggcctgtc

SEQ ID NO: 4621622 - DNA, 20 bp, Homo sapiens
cccagctggcccgtgacaga

SEQ ID NO: 4621623 - DNA, 22 bp, Homo sapiens
cccagctggcctggcccccagc

SEQ ID NO: 4621624 - DNA, 23 bp, Homo sapiens
cccagctggcctggcccccagct

SEQ ID NO: 4621625 - DNA, 17 bp, Homo sapiens
cccagctgggtcaggca

SEQ ID NO: 4621626 - DNA, 19 bp, Homo sapiens
cccagctgggtcaggcagg

SEQ ID NO: 4621627 - DNA, 18 bp, Homo sapiens
cccaggaaaaactggaag

SEQ ID NO: 4621628 - DNA, 15 bp, Homo sapiens
cccaggaaaggagga

SEQ ID NO: 4621629 - DNA, 16 bp, Homo sapiens
cccaggaaaggaggac

SEQ ID NO: 4621630 - DNA, 16 bp, Homo sapiens
cccaggacaagcatgg

SEQ ID NO: 4621631 - DNA, 18 bp, Homo sapiens
cccaggacctggctgcca

SEQ ID NO: 4621632 - DNA, 17 bp, Homo sapiens
cccaggatactggcaca

SEQ ID NO: 4621633 - DNA, 15 bp, Homo sapiens
cccaggcaaggaaca

SEQ ID NO: 4621634 - DNA, 23 bp, Homo sapiens
cccaggcagaaatagttgtctgt

SEQ ID NO: 4621635 - DNA, 13 bp, Homo sapiens
cccaggcagggct

SEQ ID NO: 4621636 - DNA, 14 bp, Homo sapiens
cccaggcagggcta

SEQ ID NO: 4621637 - DNA, 22 bp, Homo sapiens
cccaggccccatgacctccagc

SEQ ID NO: 4621638 - DNA, 17 bp, Homo sapiens
cccaggccctactaccc

SEQ ID NO: 4621639 - DNA, 13 bp, Homo sapiens
cccaggctggagt

SEQ ID NO: 4621640 - DNA, 17 bp, Homo sapiens
cccagggcacaggagct

SEQ ID NO: 4621641 - DNA, 20 bp, Homo sapiens
cccagggccctcccagccca

SEQ ID NO: 4621642 - DNA, 20 bp, Homo sapiens
cccagggtggagtgcagtgg

SEQ ID NO: 4621643 - DNA, 21 bp, Homo sapiens
cccaggtgagggaaggagaca

SEQ ID NO: 4621644 - DNA, 15 bp, Homo sapiens
cccaggtggcctgga

SEQ ID NO: 4621645 - DNA, 21 bp, Homo sapiens
cccagtacctagctggctctg

SEQ ID NO: 4621646 - DNA, 18 bp, Homo sapiens
cccagtgtttccacactt

SEQ ID NO: 4621647 - DNA, 16 bp, Homo sapiens
cccagtgttttctttg

SEQ ID NO: 4621648 - DNA, 21 bp, Homo sapiens
cccagttcatcaccatttcct

SEQ ID NO: 4621649 - DNA, 23 bp, Homo sapiens
cccatagggtcggaggtgctgtc

SEQ ID NO: 4621650 - DNA, 22 bp, Homo sapiens
cccatatattaccccttcatgt

SEQ ID NO: 4621651 - DNA, 20 bp, Homo sapiens
cccatcacctactcacacag

SEQ ID NO: 4621652 - DNA, 22 bp, Homo sapiens
cccatcacctactcacacaggc

SEQ ID NO: 4621653 - DNA, 13 bp, Homo sapiens
cccatccagggcc

SEQ ID NO: 4621654 - DNA, 14 bp, Homo sapiens
cccatccattaggc

SEQ ID NO: 4621655 - DNA, 19 bp, Homo sapiens
cccgagcagctgagcaggg

SEQ ID NO: 4621656 - DNA, 17 bp, Homo sapiens
cccgagggcagccccct

SEQ ID NO: 4621657 - DNA, 19 bp, Homo sapiens
cccgagggcagccccctcc

SEQ ID NO: 4621658 - DNA, 17 bp, Homo sapiens
cccgcagacctctggat

SEQ ID NO: 4621659 - DNA, 11 bp, Homo sapiens
cccgccagggc

SEQ ID NO: 4621660 - DNA, 16 bp, Homo sapiens
cccgcgcagctgccta

SEQ ID NO: 4621661 - DNA, 19 bp, Homo sapiens
cccggcaccccctgcagct

SEQ ID NO: 4621662 - DNA, 18 bp, Homo sapiens
cccgggatattatagaaa

SEQ ID NO: 4621663 - DNA, 14 bp, Homo sapiens
cccgggctggagaa

SEQ ID NO: 4621664 - DNA, 21 bp, Homo sapiens
cccggggtgcccacaggccgc

SEQ ID NO: 4621665 - DNA, 20 bp, Homo sapiens
cccggtgcagggcctggcat

SEQ ID NO: 4621666 - DNA, 19 bp, Homo sapiens
cccgtaagaccaccttccc

SEQ ID NO: 4621667 - DNA, 22 bp, Homo sapiens
cccgtgacagactcctgaggac

SEQ ID NO: 4621668 - DNA, 16 bp, Homo sapiens
cccgtgcatgctctgc

SEQ ID NO: 4621669 - DNA, 17 bp, Homo sapiens
cccgtggaggctgctcg

SEQ ID NO: 4621670 - DNA, 19 bp, Homo sapiens
ccctaactctgcccaccct

SEQ ID NO: 4621671 - DNA, 21 bp, Homo sapiens
ccctaagtgcaaacacagcat

SEQ ID NO: 4621672 - DNA, 14 bp, Homo sapiens
ccctagcaggaact

SEQ ID NO: 4621673 - DNA, 19 bp, Homo sapiens
ccctagctcttccccatct

SEQ ID NO: 4621674 - DNA, 20 bp, Homo sapiens
ccctagggactgtcctagcc

SEQ ID NO: 4621675 - DNA, 13 bp, Homo sapiens
ccctatggagagg

SEQ ID NO: 4621676 - DNA, 17 bp, Homo sapiens
ccctcagactgtcaggc

SEQ ID NO: 4621677 - DNA, 20 bp, Homo sapiens
ccctcagcaacatcccatct

SEQ ID NO: 4621678 - DNA, 17 bp, Homo sapiens
ccctcatctatgaggaa

SEQ ID NO: 4621679 - DNA, 12 bp, Homo sapiens
ccctcattaatg

SEQ ID NO: 4621680 - DNA, 20 bp, Homo sapiens
ccctccaatcctccccgctc

SEQ ID NO: 4621681 - DNA, 13 bp, Homo sapiens
ccctccaccagcc

SEQ ID NO: 4621682 - DNA, 18 bp, Homo sapiens
ccctccaccagcctgctg

SEQ ID NO: 4621683 - DNA, 15 bp, Homo sapiens
ccctccactgctggg

SEQ ID NO: 4621684 - DNA, 12 bp, Homo sapiens
ccctccaggaga

SEQ ID NO: 4621685 - DNA, 19 bp, Homo sapiens
ccctccattcccacccctc

SEQ ID NO: 4621686 - DNA, 16 bp, Homo sapiens
ccctccccatctgtgt

SEQ ID NO: 4621687 - DNA, 14 bp, Homo sapiens
ccctcccctgggac

SEQ ID NO: 4621688 - DNA, 14 bp, Homo sapiens
ccctccctagctct

SEQ ID NO: 4621689 - DNA, 13 bp, Homo sapiens
ccctccgccttct

SEQ ID NO: 4621690 - DNA, 23 bp, Homo sapiens
ccctcctgtgctgggggaatgag

SEQ ID NO: 4621691 - DNA, 14 bp, Homo sapiens
ccctccttctcctt

SEQ ID NO: 4621692 - DNA, 13 bp, Homo sapiens
ccctcgccccaaa

SEQ ID NO: 4621693 - DNA, 19 bp, Homo sapiens
ccctctagaaatttttcag

SEQ ID NO: 4621694 - DNA, 14 bp, Homo sapiens
ccctctccttccaa

SEQ ID NO: 4621695 - DNA, 15 bp, Homo sapiens
ccctctcgcctcatt

SEQ ID NO: 4621696 - DNA, 17 bp, Homo sapiens
ccctctcgcctcattac

SEQ ID NO: 4621697 - DNA, 15 bp, Homo sapiens
ccctctgcctgggat

SEQ ID NO: 4621698 - DNA, 18 bp, Homo sapiens
ccctcttctggtttccct

SEQ ID NO: 4621699 - DNA, 11 bp, Homo sapiens
ccctctttccc

SEQ ID NO: 4621700 - DNA, 18 bp, Homo sapiens
ccctctttccctgcgaga

SEQ ID NO: 4621701 - DNA, 20 bp, Homo sapiens
ccctgagaagctgctccagg

SEQ ID NO: 4621702 - DNA, 14 bp, Homo sapiens
ccctgaggagtctg

SEQ ID NO: 4621703 - DNA, 21 bp, Homo sapiens
ccctgaggagtctgaggtcct

SEQ ID NO: 4621704 - DNA, 12 bp, Homo sapiens
ccctgaggccta

SEQ ID NO: 4621705 - DNA, 16 bp, Homo sapiens
ccctgaggcctagact

SEQ ID NO: 4621706 - DNA, 20 bp, Homo sapiens
ccctgatgcaggtcagccca

SEQ ID NO: 4621707 - DNA, 19 bp, Homo sapiens
ccctgatgtgacattccat

SEQ ID NO: 4621708 - DNA, 13 bp, Homo sapiens
ccctgcaaacaga

SEQ ID NO: 4621709 - DNA, 24 bp, Homo sapiens
ccctgcaaacagaacagggtcatg

SEQ ID NO: 4621710 - DNA, 19 bp, Homo sapiens
ccctgcaacttccgctgag

SEQ ID NO: 4621711 - DNA, 21 bp, Homo sapiens
ccctgcaacttccgctgaggg

SEQ ID NO: 4621712 - DNA, 15 bp, Homo sapiens
ccctgcaccttcccc

SEQ ID NO: 4621713 - DNA, 14 bp, Homo sapiens
ccctgcagaaccca

SEQ ID NO: 4621714 - DNA, 14 bp, Homo sapiens
ccctgcagaccctg

SEQ ID NO: 4621715 - DNA, 17 bp, Homo sapiens
ccctgcagaccctgccc

SEQ ID NO: 4621716 - DNA, 22 bp, Homo sapiens
ccctgcccaggtatcctggggg

SEQ ID NO: 4621717 - DNA, 23 bp, Homo sapiens
ccctgcccaggtatcctggggga

SEQ ID NO: 4621718 - DNA, 21 bp, Homo sapiens
ccctgccccccctaagagaca

SEQ ID NO: 4621719 - DNA, 15 bp, Homo sapiens
ccctgcccctgtggg

SEQ ID NO: 4621720 - DNA, 19 bp, Homo sapiens
ccctgcccttcagcatcct

SEQ ID NO: 4621721 - DNA, 11 bp, Homo sapiens
ccctgcctcac

SEQ ID NO: 4621722 - DNA, 21 bp, Homo sapiens
ccctgcctcaggcctctgtgc

SEQ ID NO: 4621723 - DNA, 10 bp, Homo sapiens
ccctgcctgg

SEQ ID NO: 4621724 - DNA, 16 bp, Homo sapiens
ccctgcctggaggacc

SEQ ID NO: 4621725 - DNA, 17 bp, Homo sapiens
ccctgcctggaggacct

SEQ ID NO: 4621726 - DNA, 18 bp, Homo sapiens
ccctgcctggaggacctg

SEQ ID NO: 4621727 - DNA, 19 bp, Homo sapiens
ccctgcctggaggacctga

SEQ ID NO: 4621728 - DNA, 18 bp, Homo sapiens
ccctgccttaacctggga

SEQ ID NO: 4621729 - DNA, 22 bp, Homo sapiens
ccctgcgggtgaacaaagcagc

SEQ ID NO: 4621730 - DNA, 17 bp, Homo sapiens
ccctgctacctgttctt

SEQ ID NO: 4621731 - DNA, 11 bp, Homo sapiens
ccctgctgaat

SEQ ID NO: 4621732 - DNA, 12 bp, Homo sapiens
ccctgctgccca

SEQ ID NO: 4621733 - DNA, 17 bp, Homo sapiens
ccctgctgtgccatgct

SEQ ID NO: 4621734 - DNA, 17 bp, Homo sapiens
ccctgcttccacctcac

SEQ ID NO: 4621735 - DNA, 21 bp, Homo sapiens
ccctgcttccacctcacccca

SEQ ID NO: 4621736 - DNA, 18 bp, Homo sapiens
ccctggaccacgaggctg

SEQ ID NO: 4621737 - DNA, 18 bp, Homo sapiens
ccctggagggcaagccct

SEQ ID NO: 4621738 - DNA, 19 bp, Homo sapiens
ccctggagggcaagccctg

SEQ ID NO: 4621739 - DNA, 23 bp, Homo sapiens
ccctggagggcaagccctgccca

SEQ ID NO: 4621740 - DNA, 17 bp, Homo sapiens
ccctggaggtctccagg

SEQ ID NO: 4621741 - DNA, 19 bp, Homo sapiens
ccctggatcagcgtggcct

SEQ ID NO: 4621742 - DNA, 21 bp, Homo sapiens
ccctggatcagcgtggccttg

SEQ ID NO: 4621743 - DNA, 23 bp, Homo sapiens
ccctggatcagtcctttgatcag

SEQ ID NO: 4621744 - DNA, 21 bp, Homo sapiens
ccctggcacccccacaagctg

SEQ ID NO: 4621745 - DNA, 14 bp, Homo sapiens
ccctggccacagcc

SEQ ID NO: 4621746 - DNA, 23 bp, Homo sapiens
ccctggccacagccttccctctg

SEQ ID NO: 4621747 - DNA, 12 bp, Homo sapiens
ccctggccccct

SEQ ID NO: 4621748 - DNA, 13 bp, Homo sapiens
ccctggcccctcc

SEQ ID NO: 4621749 - DNA, 20 bp, Homo sapiens
ccctggccgagtccaagctg

SEQ ID NO: 4621750 - DNA, 14 bp, Homo sapiens
ccctggcctgaact

SEQ ID NO: 4621751 - DNA, 20 bp, Homo sapiens
ccctggcctgaactgaggag

SEQ ID NO: 4621752 - DNA, 16 bp, Homo sapiens
ccctgggcctgctgct

SEQ ID NO: 4621753 - DNA, 14 bp, Homo sapiens
ccctgggctgggga

SEQ ID NO: 4621754 - DNA, 16 bp, Homo sapiens
ccctgggctggggagg

SEQ ID NO: 4621755 - DNA, 19 bp, Homo sapiens
ccctgggctggggaggagg

SEQ ID NO: 4621756 - DNA, 23 bp, Homo sapiens
ccctggggatcacagcctcaccc

SEQ ID NO: 4621757 - DNA, 13 bp, Homo sapiens
ccctggggcctgt

SEQ ID NO: 4621758 - DNA, 23 bp, Homo sapiens
ccctgggggtttaagctctgccc

SEQ ID NO: 4621759 - DNA, 20 bp, Homo sapiens
ccctggtggtattttatttt

SEQ ID NO: 4621760 - DNA, 19 bp, Homo sapiens
ccctgtaatcaggcaagga

SEQ ID NO: 4621761 - DNA, 14 bp, Homo sapiens
ccctgtcccctagg

SEQ ID NO: 4621762 - DNA, 17 bp, Homo sapiens
ccctgtctctggctact

SEQ ID NO: 4621763 - DNA, 22 bp, Homo sapiens
ccctgtgcaacctcttggcctg

SEQ ID NO: 4621764 - DNA, 21 bp, Homo sapiens
ccctgtgtccacctgtgggtg

SEQ ID NO: 4621765 - DNA, 10 bp, Homo sapiens
ccctgtgtgt

SEQ ID NO: 4621766 - DNA, 15 bp, Homo sapiens
cctctcccaggcccc

SEQ ID NO: 4621767 - DNA, 18 bp, Homo sapiens
cctctcccaggccccatg

SEQ ID NO: 4621768 - DNA, 23 bp, Homo sapiens
cctctcccaggccccatgacctc

SEQ ID NO: 4621769 - DNA, 13 bp, Homo sapiens
cctctccttccaa

SEQ ID NO: 4621770 - DNA, 15 bp, Homo sapiens
cctctcgcctcatta

SEQ ID NO: 4621771 - DNA, 14 bp, Homo sapiens
cctctctccctgcc

SEQ ID NO: 4621772 - DNA, 18 bp, Homo sapiens
cctctctccctgcctcac

SEQ ID NO: 4621773 - DNA, 17 bp, Homo sapiens
cctctctcctggactgg

SEQ ID NO: 4621774 - DNA, 18 bp, Homo sapiens
cctctctcctggactggt

SEQ ID NO: 4621775 - DNA, 19 bp, Homo sapiens
cctctcttgattaagggct

SEQ ID NO: 4621776 - DNA, 17 bp, Homo sapiens
cctctgaggccagcctg

SEQ ID NO: 4621777 - DNA, 18 bp, Homo sapiens
cctctgaggccagcctgg

SEQ ID NO: 4621778 - DNA, 19 bp, Homo sapiens
cctctgaggccagcctggc

SEQ ID NO: 4621779 - DNA, 22 bp, Homo sapiens
cctctgaggccagcctggcctc

SEQ ID NO: 4621780 - DNA, 19 bp, Homo sapiens
cctctgcacaccctccaga

SEQ ID NO: 4621781 - DNA, 17 bp, Homo sapiens
cctctgcattgacctgg

SEQ ID NO: 4621782 - DNA, 14 bp, Homo sapiens
cctctgccagcagg

SEQ ID NO: 4621783 - DNA, 16 bp, Homo sapiens
cctctgccagcaggaa

SEQ ID NO: 4621784 - DNA, 19 bp, Homo sapiens
cctctgccagcaggaataa

SEQ ID NO: 4621785 - DNA, 16 bp, Homo sapiens
cctctgccccaagagc

SEQ ID NO: 4621786 - DNA, 13 bp, Homo sapiens
cctctgcctcctg

SEQ ID NO: 4621787 - DNA, 14 bp, Homo sapiens
cctctgcctcctgg

SEQ ID NO: 4621788 - DNA, 12 bp, Homo sapiens
cctctgcctggg

SEQ ID NO: 4621789 - DNA, 18 bp, Homo sapiens
cctctgcctgggatgccc

SEQ ID NO: 4621790 - DNA, 17 bp, Homo sapiens
cctctgggaccccagct

SEQ ID NO: 4621791 - DNA, 18 bp, Homo sapiens
cctctgggaccccagctg

SEQ ID NO: 4621792 - DNA, 21 bp, Homo sapiens
cctctgggaccccagctgctc

SEQ ID NO: 4621793 - DNA, 24 bp, Homo sapiens
cctctggtttgccggtggtgcagg

SEQ ID NO: 4621794 - DNA, 19 bp, Homo sapiens
cctctgtcagtcacagcca

SEQ ID NO: 4621795 - DNA, 15 bp, Homo sapiens
cctctgtctcgagcg

SEQ ID NO: 4621796 - DNA, 22 bp, Homo sapiens
cctctgtctcgagcgccctgca

SEQ ID NO: 4621797 - DNA, 20 bp, Homo sapiens
cctctgtcttggctttcatg

SEQ ID NO: 4621798 - DNA, 22 bp, Homo sapiens
cctctgtgaactgtgtgtgaat

SEQ ID NO: 4621799 - DNA, 21 bp, Homo sapiens
cctctgtgacccctccttgtc

SEQ ID NO: 4621800 - DNA, 22 bp, Homo sapiens
cctctgttcagtgtaaatagtt

SEQ ID NO: 4621801 - DNA, 16 bp, Homo sapiens
cctcttactaatgtaa

SEQ ID NO: 4621802 - DNA, 19 bp, Homo sapiens
cctcttattccaggagaag

SEQ ID NO: 4621803 - DNA, 15 bp, Homo sapiens
cctcttccccctgct

SEQ ID NO: 4621804 - DNA, 20 bp, Homo sapiens
cctcttctaaaatagcaata

SEQ ID NO: 4621805 - DNA, 21 bp, Homo sapiens
cctcttctaaaatagcaataa

SEQ ID NO: 4621806 - DNA, 22 bp, Homo sapiens
cctcttctaaaatagcaataac

SEQ ID NO: 4621807 - DNA, 20 bp, Homo sapiens
cctcttctggtttcccttta

SEQ ID NO: 4621808 - DNA, 13 bp, Homo sapiens
cctcttggcctga

SEQ ID NO: 4621809 - DNA, 15 bp, Homo sapiens
cctcttgtcagtgta

SEQ ID NO: 4621810 - DNA, 23 bp, Homo sapiens
cctctttgagaccccagtgcctg

SEQ ID NO: 4621811 - DNA, 23 bp, Homo sapiens
cctctttgtctaaaacaataaaa

SEQ ID NO: 4621812 - DNA, 16 bp, Homo sapiens
cctgaaagctgggagc

SEQ ID NO: 4621813 - DNA, 19 bp, Homo sapiens
cctgaaagctgggagcgtg

SEQ ID NO: 4621814 - DNA, 13 bp, Homo sapiens
cctgaaggcacag

SEQ ID NO: 4621815 - DNA, 22 bp, Homo sapiens
cctgaaggcacagctaaccact

SEQ ID NO: 4621816 - DNA, 13 bp, Homo sapiens
cctgacattgtct

SEQ ID NO: 4621817 - DNA, 14 bp, Homo sapiens
cctgaccaggatgg

SEQ ID NO: 4621818 - DNA, 22 bp, Homo sapiens
cctgaccaggatggagcaagct

SEQ ID NO: 4621819 - DNA, 23 bp, Homo sapiens
cctgacccgctcggacttactgc

SEQ ID NO: 4621820 - DNA, 19 bp, Homo sapiens
cctgacctaacctaggagg

SEQ ID NO: 4621821 - DNA, 22 bp, Homo sapiens
cctgacctgtgagcccagctgg

SEQ ID NO: 4621822 - DNA, 16 bp, Homo sapiens
cctgacggcgcctttt

SEQ ID NO: 4621823 - DNA, 15 bp, Homo sapiens
cctgagaagctgctc

SEQ ID NO: 4621824 - DNA, 14 bp, Homo sapiens
cctgagcccaggga

SEQ ID NO: 4621825 - DNA, 18 bp, Homo sapiens
cctgagcccagggaggcc

SEQ ID NO: 4621826 - DNA, 19 bp, Homo sapiens
cctgagcccagggaggccg

SEQ ID NO: 4621827 - DNA, 14 bp, Homo sapiens
cctgagcctgccga

SEQ ID NO: 4621828 - DNA, 15 bp, Homo sapiens
cctgagcctgccgag

SEQ ID NO: 4621829 - DNA, 14 bp, Homo sapiens
cctgaggacagaaa

SEQ ID NO: 4621830 - DNA, 17 bp, Homo sapiens
cctgaggacagaaagac

SEQ ID NO: 4621831 - DNA, 20 bp, Homo sapiens
cctgaggacagctgtcctct

SEQ ID NO: 4621832 - DNA, 13 bp, Homo sapiens
cctgaggagtctg

SEQ ID NO: 4621833 - DNA, 14 bp, Homo sapiens
cctgaggagtctga

SEQ ID NO: 4621834 - DNA, 20 bp, Homo sapiens
cctgaggagtctgaggtcct

SEQ ID NO: 4621835 - DNA, 21 bp, Homo sapiens
cctgaggagtctgaggtcctg

SEQ ID NO: 4621836 - DNA, 22 bp, Homo sapiens
cctgaggagtctgaggtcctga

SEQ ID NO: 4621837 - DNA, 18 bp, Homo sapiens
cctgaggcctagactctg

SEQ ID NO: 4621838 - DNA, 20 bp, Homo sapiens
cctgaggtcagggagtgctg

SEQ ID NO: 4621839 - DNA, 18 bp, Homo sapiens
cctgaggtgcccactccg

SEQ ID NO: 4621840 - DNA, 20 bp, Homo sapiens
cctgagtgacctccttctgc

SEQ ID NO: 4621841 - DNA, 14 bp, Homo sapiens
cctgatcagaggca

SEQ ID NO: 4621842 - DNA, 23 bp, Homo sapiens
cctgatcagaggcatttgagcag

SEQ ID NO: 4621843 - DNA, 15 bp, Homo sapiens
cctgatgcaggtcag

SEQ ID NO: 4621844 - DNA, 17 bp, Homo sapiens
cctgatgcaggtcagcc

SEQ ID NO: 4621845 - DNA, 21 bp, Homo sapiens
cctgatgctgacattcacctg

SEQ ID NO: 4621846 - DNA, 23 bp, Homo sapiens
cctgatgctgacattcacctgcc

SEQ ID NO: 4621847 - DNA, 18 bp, Homo sapiens
cctgattattttagctaa

SEQ ID NO: 4621848 - DNA, 16 bp, Homo sapiens
cctgattcaactaaaa

SEQ ID NO: 4621849 - DNA, 20 bp, Homo sapiens
cctgatttctacaactggag

SEQ ID NO: 4621850 - DNA, 18 bp, Homo sapiens
cctgcaacttccgctgag

SEQ ID NO: 4621851 - DNA, 19 bp, Homo sapiens
cctgcaacttccgctgagg

SEQ ID NO: 4621852 - DNA, 15 bp, Homo sapiens
cctgcaagatggaca

SEQ ID NO: 4621853 - DNA, 12 bp, Homo sapiens
cctgcacaggct

SEQ ID NO: 4621854 - DNA, 18 bp, Homo sapiens
cctgcacatcatgagcct

SEQ ID NO: 4621855 - DNA, 20 bp, Homo sapiens
cctgcacatcatgagccttc

SEQ ID NO: 4621856 - DNA, 22 bp, Homo sapiens
cctgcacatcatgagccttcag

SEQ ID NO: 4621857 - DNA, 18 bp, Homo sapiens
cctgcagaaggaaagaag

SEQ ID NO: 4621858 - DNA, 14 bp, Homo sapiens
cctgcagaccctgc

SEQ ID NO: 4621859 - DNA, 15 bp, Homo sapiens
cctgcagaccctgcc

SEQ ID NO: 4621860 - DNA, 17 bp, Homo sapiens
cctgcagaccctgccct

SEQ ID NO: 4621861 - DNA, 12 bp, Homo sapiens
cctgcagcttgt

SEQ ID NO: 4621862 - DNA, 23 bp, Homo sapiens
cctgcaggcaggaacaaacaggg

SEQ ID NO: 4621863 - DNA, 15 bp, Homo sapiens
cctgcagggcttctc

SEQ ID NO: 4621864 - DNA, 23 bp, Homo sapiens
cctgcattcttccgcaccctccc

SEQ ID NO: 4621865 - DNA, 14 bp, Homo sapiens
cctgccagccactg

SEQ ID NO: 4621866 - DNA, 16 bp, Homo sapiens
cctgccagccactgtc

SEQ ID NO: 4621867 - DNA, 13 bp, Homo sapiens
cctgccagcccag

SEQ ID NO: 4621868 - DNA, 15 bp, Homo sapiens
cctgccagcccagct

SEQ ID NO: 4621869 - DNA, 16 bp, Homo sapiens
cctgccagcccagctg

SEQ ID NO: 4621870 - DNA, 15 bp, Homo sapiens
cctgccagggtgagc

SEQ ID NO: 4621871 - DNA, 19 bp, Homo sapiens
cctgccagggtgagcaggg

SEQ ID NO: 4621872 - DNA, 14 bp, Homo sapiens
cctgccccaactcc

SEQ ID NO: 4621873 - DNA, 21 bp, Homo sapiens
cctgccccaactctcccctga

SEQ ID NO: 4621874 - DNA, 20 bp, Homo sapiens
cctgccccccctaagagaca

SEQ ID NO: 4621875 - DNA, 15 bp, Homo sapiens
cctgccccctgggga

SEQ ID NO: 4621876 - DNA, 13 bp, Homo sapiens
cctgcccctgtgg

SEQ ID NO: 4621877 - DNA, 12 bp, Homo sapiens
ccctgtgtgtgt

SEQ ID NO: 4621878 - DNA, 18 bp, Homo sapiens
ccctgtgttctttcccca

SEQ ID NO: 4621879 - DNA, 15 bp, Homo sapiens
cccttacagcctctg

SEQ ID NO: 4621880 - DNA, 18 bp, Homo sapiens
cccttacagcctctgact

SEQ ID NO: 4621881 - DNA, 17 bp, Homo sapiens
cccttacccatcttgct

SEQ ID NO: 4621882 - DNA, 18 bp, Homo sapiens
cccttacccatcttgctt

SEQ ID NO: 4621883 - DNA, 15 bp, Homo sapiens
cccttacctgtctct

SEQ ID NO: 4621884 - DNA, 20 bp, Homo sapiens
cccttacttgcttctctagc

SEQ ID NO: 4621885 - DNA, 20 bp, Homo sapiens
cccttcaagacgaggggcag

SEQ ID NO: 4621886 - DNA, 21 bp, Homo sapiens
cccttcatgtcctaaagaaga

SEQ ID NO: 4621887 - DNA, 11 bp, Homo sapiens
cccttccagga

SEQ ID NO: 4621888 - DNA, 14 bp, Homo sapiens
cccttccccatgaa

SEQ ID NO: 4621889 - DNA, 20 bp, Homo sapiens
cccttccccatgaaccctgc

SEQ ID NO: 4621890 - DNA, 21 bp, Homo sapiens
cccttcccccagcccatccat

SEQ ID NO: 4621891 - DNA, 19 bp, Homo sapiens
cccttccctataggaacag

SEQ ID NO: 4621892 - DNA, 19 bp, Homo sapiens
cccttcctcttcctgccct

SEQ ID NO: 4621893 - DNA, 21 bp, Homo sapiens
cccttcctcttcctgcccttg

SEQ ID NO: 4621894 - DNA, 20 bp, Homo sapiens
cccttcctggacagctgtgc

SEQ ID NO: 4621895 - DNA, 20 bp, Homo sapiens
cccttgaagttgtggaggag

SEQ ID NO: 4621896 - DNA, 18 bp, Homo sapiens
cccttgacatctggaaac

SEQ ID NO: 4621897 - DNA, 15 bp, Homo sapiens
cccttgctcatgagc

SEQ ID NO: 4621898 - DNA, 14 bp, Homo sapiens
cccttgctgggcct

SEQ ID NO: 4621899 - DNA, 21 bp, Homo sapiens
cccttgctgggcctgggggtt

SEQ ID NO: 4621900 - DNA, 13 bp, Homo sapiens
cccttgctttcct

SEQ ID NO: 4621901 - DNA, 17 bp, Homo sapiens
cccttgctttcctgggc

SEQ ID NO: 4621902 - DNA, 22 bp, Homo sapiens
cccttgctttcctgggcctttg

SEQ ID NO: 4621903 - DNA, 12 bp, Homo sapiens
cccttggaagag

SEQ ID NO: 4621904 - DNA, 21 bp, Homo sapiens
cccttggaggagagagacccc

SEQ ID NO: 4621905 - DNA, 10 bp, Homo sapiens
cccttgtggg

SEQ ID NO: 4621906 - DNA, 15 bp, Homo sapiens
ccctttatttctctt

SEQ ID NO: 4621907 - DNA, 17 bp, Homo sapiens
cccttttcattctcctc

SEQ ID NO: 4621908 - DNA, 13 bp, Homo sapiens
ccgaacctcctct

SEQ ID NO: 4621909 - DNA, 12 bp, Homo sapiens
ccgacagtgcca

SEQ ID NO: 4621910 - DNA, 23 bp, Homo sapiens
ccgaccttccctccgccttctcc

SEQ ID NO: 4621911 - DNA, 24 bp, Homo sapiens
ccgacgccgtcccaccagcttcac

SEQ ID NO: 4621912 - DNA, 13 bp, Homo sapiens
ccgactcacctgc

SEQ ID NO: 4621913 - DNA, 14 bp, Homo sapiens
ccgactcacctgcg

SEQ ID NO: 4621914 - DNA, 21 bp, Homo sapiens
ccgagagcctcgctttttcat

SEQ ID NO: 4621915 - DNA, 23 bp, Homo sapiens
ccgagcaaccgtggcccttcctg

SEQ ID NO: 4621916 - DNA, 16 bp, Homo sapiens
ccgagcagctgagcag

SEQ ID NO: 4621917 - DNA, 22 bp, Homo sapiens
ccgagcgggtgcaagcactcgg

SEQ ID NO: 4621918 - DNA, 19 bp, Homo sapiens
ccgagtagctgggattaca

SEQ ID NO: 4621919 - DNA, 15 bp, Homo sapiens
ccgagtccaagctgg

SEQ ID NO: 4621920 - DNA, 13 bp, Homo sapiens
ccgatgccaccgg

SEQ ID NO: 4621921 - DNA, 13 bp, Homo sapiens
ccgcacccggctc

SEQ ID NO: 4621922 - DNA, 23 bp, Homo sapiens
ccgcatgatgtttccctctcctt

SEQ ID NO: 4621923 - DNA, 13 bp, Homo sapiens
ccgccacggcctg

SEQ ID NO: 4621924 - DNA, 16 bp, Homo sapiens
ccgccacgtcccagca

SEQ ID NO: 4621925 - DNA, 12 bp, Homo sapiens
ccgccagggctg

SEQ ID NO: 4621926 - DNA, 17 bp, Homo sapiens
ccgccagggctggggac

SEQ ID NO: 4621927 - DNA, 14 bp, Homo sapiens
ccgccagtgtttct

SEQ ID NO: 4621928 - DNA, 20 bp, Homo sapiens
ccgcccccagccccctcctg

SEQ ID NO: 4621929 - DNA, 13 bp, Homo sapiens
ccgcctgaaggca

SEQ ID NO: 4621930 - DNA, 18 bp, Homo sapiens
ccgcctgaaggcacagct

SEQ ID NO: 4621931 - DNA, 22 bp, Homo sapiens
ccgcctggatgcggatggccgg

SEQ ID NO: 4621932 - DNA, 16 bp, Homo sapiens
ccgccttttcccccac

SEQ ID NO: 4621933 - DNA, 14 bp, Homo sapiens
ccgcgcagctgcct

SEQ ID NO: 4621934 - DNA, 17 bp, Homo sapiens
ccgcggcccgcgcagct

SEQ ID NO: 4621935 - DNA, 13 bp, Homo sapiens
ccgcgtctaccct

SEQ ID NO: 4621936 - DNA, 16 bp, Homo sapiens
ccgcgtctaccctggg

SEQ ID NO: 4621937 - DNA, 16 bp, Homo sapiens
ccgctacagtttttat

SEQ ID NO: 4621938 - DNA, 20 bp, Homo sapiens
ccgctcggacttactgcctg

SEQ ID NO: 4621939 - DNA, 18 bp, Homo sapiens
ccgctgaggggtctcgga

SEQ ID NO: 4621940 - DNA, 20 bp, Homo sapiens
ccgctggggaccggttccca

SEQ ID NO: 4621941 - DNA, 22 bp, Homo sapiens
ccgctggggaccggttcccaca

SEQ ID NO: 4621942 - DNA, 17 bp, Homo sapiens
ccggagcaaactctgct

SEQ ID NO: 4621943 - DNA, 21 bp, Homo sapiens
ccggcaccccctgcagcttgt

SEQ ID NO: 4621944 - DNA, 18 bp, Homo sapiens
ccggcagagctctacagg

SEQ ID NO: 4621945 - DNA, 23 bp, Homo sapiens
ccggcagagctctacaggcctgc

SEQ ID NO: 4621946 - DNA, 20 bp, Homo sapiens
ccggcagccagatggccccg

SEQ ID NO: 4621947 - DNA, 19 bp, Homo sapiens
ccgggccactccttcctgc

SEQ ID NO: 4621948 - DNA, 21 bp, Homo sapiens
ccgggccactccttcctgccc

SEQ ID NO: 4621949 - DNA, 11 bp, Homo sapiens
ccgggccaggc

SEQ ID NO: 4621950 - DNA, 23 bp, Homo sapiens
ccgggctctcatggtacttcctc

SEQ ID NO: 4621951 - DNA, 16 bp, Homo sapiens
ccgggctggagaaaga

SEQ ID NO: 4621952 - DNA, 18 bp, Homo sapiens
ccggggaactggccaagc

SEQ ID NO: 4621953 - DNA, 19 bp, Homo sapiens
ccggggaactggccaagct

SEQ ID NO: 4621954 - DNA, 20 bp, Homo sapiens
ccggggaactggccaagctg

SEQ ID NO: 4621955 - DNA, 20 bp, Homo sapiens
ccggggtgcccacaggccgc

SEQ ID NO: 4621956 - DNA, 13 bp, Homo sapiens
ccggtgcagggcc

SEQ ID NO: 4621957 - DNA, 14 bp, Homo sapiens
ccggtgcagggcct

SEQ ID NO: 4621958 - DNA, 18 bp, Homo sapiens
ccggtgcagggcctggca

SEQ ID NO: 4621959 - DNA, 20 bp, Homo sapiens
ccggtgcagggcctggcata

SEQ ID NO: 4621960 - DNA, 14 bp, Homo sapiens
ccggtgctgcagga

SEQ ID NO: 4621961 - DNA, 15 bp, Homo sapiens
ccggtggaaggcctt

SEQ ID NO: 4621962 - DNA, 17 bp, Homo sapiens
ccggttcccacaagcct

SEQ ID NO: 4621963 - DNA, 23 bp, Homo sapiens
ccgtaattgctttgtgcctttgg

SEQ ID NO: 4621964 - DNA, 14 bp, Homo sapiens
ccgtagagaatgtg

SEQ ID NO: 4621965 - DNA, 17 bp, Homo sapiens
ccgtcacccctgtttct

SEQ ID NO: 4621966 - DNA, 12 bp, Homo sapiens
ccgtcctggcac

SEQ ID NO: 4621967 - DNA, 20 bp, Homo sapiens
ccgtgacagactcctgagga

SEQ ID NO: 4621968 - DNA, 16 bp, Homo sapiens
ccgtgatctcccctca

SEQ ID NO: 4621969 - DNA, 12 bp, Homo sapiens
ccgtgcctggct

SEQ ID NO: 4621970 - DNA, 15 bp, Homo sapiens
ccgtggaggctgctc

SEQ ID NO: 4621971 - DNA, 17 bp, Homo sapiens
ccgtggcccttcctgga

SEQ ID NO: 4621972 - DNA, 22 bp, Homo sapiens
ccgtggcccttcctggacagct

SEQ ID NO: 4621973 - DNA, 19 bp, Homo sapiens
ccgtgggtgggcctggccc

SEQ ID NO: 4621974 - DNA, 22 bp, Homo sapiens
ccgtgggtgggcctggccctgc

SEQ ID NO: 4621975 - DNA, 23 bp, Homo sapiens
ccgtgggtgggcctggccctgct

SEQ ID NO: 4621976 - DNA, 19 bp, Homo sapiens
ccgttccccgctaggtcaa

SEQ ID NO: 4621977 - DNA, 13 bp, Homo sapiens
cctaaacctcagt

SEQ ID NO: 4621978 - DNA, 20 bp, Homo sapiens
cctaaagaaaaatatcttgg

SEQ ID NO: 4621979 - DNA, 16 bp, Homo sapiens
cctaacatgcaccttg

SEQ ID NO: 4621980 - DNA, 21 bp, Homo sapiens
cctaagatctcggtttgccaa

SEQ ID NO: 4621981 - DNA, 13 bp, Homo sapiens
cctaataattgta

SEQ ID NO: 4621982 - DNA, 20 bp, Homo sapiens
cctaatatcattttattcac

SEQ ID NO: 4621983 - DNA, 23 bp, Homo sapiens
cctaatatcattttattcacata

SEQ ID NO: 4621984 - DNA, 15 bp, Homo sapiens
cctaatgaggtagct

SEQ ID NO: 4621985 - DNA, 17 bp, Homo sapiens
cctaatgtgatcatatg

SEQ ID NO: 4621986 - DNA, 14 bp, Homo sapiens
cctacaagatttcc

SEQ ID NO: 4621987 - DNA, 15 bp, Homo sapiens
cctacacagggcctg

SEQ ID NO: 4621988 - DNA, 24 bp, Homo sapiens
cctgccctccacccacacctgccc

SEQ ID NO: 4621989 - DNA, 22 bp, Homo sapiens
cctgccctgctctgcccaggca

SEQ ID NO: 4621990 - DNA, 22 bp, Homo sapiens
cctgcccttgtttggggcagga

SEQ ID NO: 4621991 - DNA, 22 bp, Homo sapiens
cctgccgagcaaccgtggccct

SEQ ID NO: 4621992 - DNA, 17 bp, Homo sapiens
cctgcctcacatctccc

SEQ ID NO: 4621993 - DNA, 16 bp, Homo sapiens
cctgcctcagcctccc

SEQ ID NO: 4621994 - DNA, 14 bp, Homo sapiens
cctgcctggaggac

SEQ ID NO: 4621995 - DNA, 17 bp, Homo sapiens
cctgcctggaggacctg

SEQ ID NO: 4621996 - DNA, 20 bp, Homo sapiens
cctgcctggaggacctgagc

SEQ ID NO: 4621997 - DNA, 22 bp, Homo sapiens
cctgcctggaggacctgagcct

SEQ ID NO: 4621998 - DNA, 23 bp, Homo sapiens
cctgcctggaggacctgagcctg

SEQ ID NO: 4621999 - DNA, 14 bp, Homo sapiens
cctgcctgtactac

SEQ ID NO: 4622000 - DNA, 20 bp, Homo sapiens
cctgccttaacctgggacca

SEQ ID NO: 4622001 - DNA, 22 bp, Homo sapiens
cctgccttcttccttgaggggc

SEQ ID NO: 4622002 - DNA, 15 bp, Homo sapiens
cctgcctttaagcca

SEQ ID NO: 4622003 - DNA, 18 bp, Homo sapiens
cctgcgagacgcacacag

SEQ ID NO: 4622004 - DNA, 21 bp, Homo sapiens
cctgcgagacgcacacagctg

SEQ ID NO: 4622005 - DNA, 13 bp, Homo sapiens
cctgcgagggcag

SEQ ID NO: 4622006 - DNA, 17 bp, Homo sapiens
cctgcgcaagtgcctgg

SEQ ID NO: 4622007 - DNA, 19 bp, Homo sapiens
cctgctagacgcaccgcct

SEQ ID NO: 4622008 - DNA, 15 bp, Homo sapiens
cctgctattgcagaa

SEQ ID NO: 4622009 - DNA, 15 bp, Homo sapiens
cctgctcgctccctg

SEQ ID NO: 4622010 - DNA, 13 bp, Homo sapiens
cctgctctgccca

SEQ ID NO: 4622011 - DNA, 13 bp, Homo sapiens
cctgctgaatgcc

SEQ ID NO: 4622012 - DNA, 16 bp, Homo sapiens
cctgctgcccagtgca

SEQ ID NO: 4622013 - DNA, 15 bp, Homo sapiens
cctgctgcctgggta

SEQ ID NO: 4622014 - DNA, 22 bp, Homo sapiens
cctgctgcctgggtaggcccca

SEQ ID NO: 4622015 - DNA, 17 bp, Homo sapiens
cctgctgctgagaacct

SEQ ID NO: 4622016 - DNA, 21 bp, Homo sapiens
cctgctgctgagaacctggcc

SEQ ID NO: 4622017 - DNA, 23 bp, Homo sapiens
cctgctgctgagaacctggcctt

SEQ ID NO: 4622018 - DNA, 17 bp, Homo sapiens
cctgctggtacctgccc

SEQ ID NO: 4622019 - DNA, 19 bp, Homo sapiens
cctgctggtacctgccctc

SEQ ID NO: 4622020 - DNA, 22 bp, Homo sapiens
cctgctgtcacctcgctgggct

SEQ ID NO: 4622021 - DNA, 18 bp, Homo sapiens
cctgcttccacctcaccc

SEQ ID NO: 4622022 - DNA, 21 bp, Homo sapiens
cctgcttccacctcaccccac

SEQ ID NO: 4622023 - DNA, 17 bp, Homo sapiens
cctgctttctacgccaa

SEQ ID NO: 4622024 - DNA, 22 bp, Homo sapiens
cctggaagagccgagcacctgt

SEQ ID NO: 4622025 - DNA, 14 bp, Homo sapiens
cctggacagctgtg

SEQ ID NO: 4622026 - DNA, 20 bp, Homo sapiens
cctggacagctgtgcctcgc

SEQ ID NO: 4622027 - DNA, 21 bp, Homo sapiens
cctggacagctgtgcctcgct

SEQ ID NO: 4622028 - DNA, 22 bp, Homo sapiens
cctggacagctgtgcctcgctc

SEQ ID NO: 4622029 - DNA, 19 bp, Homo sapiens
cctggactggttatcttgt

SEQ ID NO: 4622030 - DNA, 13 bp, Homo sapiens
cctggacttgcct

SEQ ID NO: 4622031 - DNA, 18 bp, Homo sapiens
cctggagacaaggtgcta

SEQ ID NO: 4622032 - DNA, 18 bp, Homo sapiens
cctggagcaggagccccg

SEQ ID NO: 4622033 - DNA, 12 bp, Homo sapiens
cctggagccaga

SEQ ID NO: 4622034 - DNA, 14 bp, Homo sapiens
cctggaggacctga

SEQ ID NO: 4622035 - DNA, 19 bp, Homo sapiens
cctggaggacctgagcctg

SEQ ID NO: 4622036 - DNA, 20 bp, Homo sapiens
cctggaggacctgagcctgc

SEQ ID NO: 4622037 - DNA, 19 bp, Homo sapiens
cctggagggcaagccctgc

SEQ ID NO: 4622038 - DNA, 14 bp, Homo sapiens
cctggaggtgggca

SEQ ID NO: 4622039 - DNA, 16 bp, Homo sapiens
cctggatcagcgtggc

SEQ ID NO: 4622040 - DNA, 17 bp, Homo sapiens
cctggatcagcgtggcc

SEQ ID NO: 4622041 - DNA, 19 bp, Homo sapiens
cctggatcagcgtggcctt

SEQ ID NO: 4622042 - DNA, 20 bp, Homo sapiens
cctggatcagcgtggccttg

SEQ ID NO: 4622043 - DNA, 17 bp, Homo sapiens
cctggcacagaagagga

SEQ ID NO: 4622044 - DNA, 18 bp, Homo sapiens
cctggcacagaagaggag

SEQ ID NO: 4622045 - DNA, 18 bp, Homo sapiens
cctggcacccccacaagc

SEQ ID NO: 4622046 - DNA, 14 bp, Homo sapiens
cctggccacagcct

SEQ ID NO: 4622047 - DNA, 12 bp, Homo sapiens
cctggccccagg

SEQ ID NO: 4622048 - DNA, 13 bp, Homo sapiens
cctggccccagga

SEQ ID NO: 4622049 - DNA, 13 bp, Homo sapiens
cctggcccccagc

SEQ ID NO: 4622050 - DNA, 15 bp, Homo sapiens
cctggcctcagagct

SEQ ID NO: 4622051 - DNA, 13 bp, Homo sapiens
cctggcctcctgc

SEQ ID NO: 4622052 - DNA, 14 bp, Homo sapiens
cctggcctcctgcc

SEQ ID NO: 4622053 - DNA, 18 bp, Homo sapiens
cctggcctcctgcctcta

SEQ ID NO: 4622054 - DNA, 18 bp, Homo sapiens
cctggccttaaagaggga

SEQ ID NO: 4622055 - DNA, 12 bp, Homo sapiens
cctggctcagcc

SEQ ID NO: 4622056 - DNA, 18 bp, Homo sapiens
cctggctgattcagcatt

SEQ ID NO: 4622057 - DNA, 19 bp, Homo sapiens
cctggctgattcagcattt

SEQ ID NO: 4622058 - DNA, 12 bp, Homo sapiens
cctggctgccca

SEQ ID NO: 4622059 - DNA, 21 bp, Homo sapiens
cctggctgggacgtggctcag

SEQ ID NO: 4622060 - DNA, 22 bp, Homo sapiens
cctggcttcccatccccagcga

SEQ ID NO: 4622061 - DNA, 12 bp, Homo sapiens
cctgggaaaggg

SEQ ID NO: 4622062 - DNA, 18 bp, Homo sapiens
cctgggaccaacctgacc

SEQ ID NO: 4622063 - DNA, 17 bp, Homo sapiens
cctgggacctccccagc

SEQ ID NO: 4622064 - DNA, 20 bp, Homo sapiens
cctgggacctccccagccca

SEQ ID NO: 4622065 - DNA, 22 bp, Homo sapiens
cctgggacctccccagcccagg

SEQ ID NO: 4622066 - DNA, 20 bp, Homo sapiens
cctgggactttcccacccag

SEQ ID NO: 4622067 - DNA, 22 bp, Homo sapiens
cctgggactttcccacccagga

SEQ ID NO: 4622068 - DNA, 23 bp, Homo sapiens
cctgggaggcgggcgcactgcct

SEQ ID NO: 4622069 - DNA, 13 bp, Homo sapiens
cctgggatgccct

SEQ ID NO: 4622070 - DNA, 18 bp, Homo sapiens
cctgggatgcccttcccc

SEQ ID NO: 4622071 - DNA, 20 bp, Homo sapiens
cctgggatgcccttccccct

SEQ ID NO: 4622072 - DNA, 16 bp, Homo sapiens
cctgggattcaggaaa

SEQ ID NO: 4622073 - DNA, 14 bp, Homo sapiens
cctgggattctacc

SEQ ID NO: 4622074 - DNA, 15 bp, Homo sapiens
cctgggcaatggcca

SEQ ID NO: 4622075 - DNA, 17 bp, Homo sapiens
cctgggcaatggccagg

SEQ ID NO: 4622076 - DNA, 21 bp, Homo sapiens
cctgggcaatggccaggggcc

SEQ ID NO: 4622077 - DNA, 17 bp, Homo sapiens
cctgggcattgctttcc

SEQ ID NO: 4622078 - DNA, 21 bp, Homo sapiens
cctgggccctggggcctgtac

SEQ ID NO: 4622079 - DNA, 18 bp, Homo sapiens
cctgggcctatggagagc

SEQ ID NO: 4622080 - DNA, 22 bp, Homo sapiens
cctgggcctatggagagccctg

SEQ ID NO: 4622081 - DNA, 23 bp, Homo sapiens
cctgggcctatggagagccctgg

SEQ ID NO: 4622082 - DNA, 19 bp, Homo sapiens
cctgggcctgctgctgaga

SEQ ID NO: 4622083 - DNA, 22 bp, Homo sapiens
cctgggcctttgcaagatgctt

SEQ ID NO: 4622084 - DNA, 13 bp, Homo sapiens
cctgggctgggga

SEQ ID NO: 4622085 - DNA, 20 bp, Homo sapiens
cctgggctggggaggaggag

SEQ ID NO: 4622086 - DNA, 14 bp, Homo sapiens
cctggggatcacag

SEQ ID NO: 4622087 - DNA, 21 bp, Homo sapiens
cctggggatcacagcctcacc

SEQ ID NO: 4622088 - DNA, 17 bp, Homo sapiens
cctggggcagcactccc

SEQ ID NO: 4622089 - DNA, 14 bp, Homo sapiens
cctggggcctgaga

SEQ ID NO: 4622090 - DNA, 15 bp, Homo sapiens
cctggggcctgagag

SEQ ID NO: 4622091 - DNA, 16 bp, Homo sapiens
cctggggcctgagaga

SEQ ID NO: 4622092 - DNA, 13 bp, Homo sapiens
cctggggcctgta

SEQ ID NO: 4622093 - DNA, 16 bp, Homo sapiens
cctggggcctgtactg

SEQ ID NO: 4622094 - DNA, 19 bp, Homo sapiens
cctggggcctgtactgcct

SEQ ID NO: 4622095 - DNA, 22 bp, Homo sapiens
cctggggcctgtactgcctgct

SEQ ID NO: 4622096 - DNA, 21 bp, Homo sapiens
cctggggctctaacgcctgag

SEQ ID NO: 4622097 - DNA, 22 bp, Homo sapiens
cctggggctctaacgcctgagc

SEQ ID NO: 4622098 - DNA, 18 bp, Homo sapiens
cctacagcactactgggt

SEQ ID NO: 4622099 - DNA, 20 bp, Homo sapiens
cctacagcactactgggtgt

SEQ ID NO: 4622100 - DNA, 21 bp, Homo sapiens
cctaccgctggccctgccgtt

SEQ ID NO: 4622101 - DNA, 13 bp, Homo sapiens
cctacgctgaaga

SEQ ID NO: 4622102 - DNA, 21 bp, Homo sapiens
cctactacccattgttccctt

SEQ ID NO: 4622103 - DNA, 14 bp, Homo sapiens
cctactcacacagg

SEQ ID NO: 4622104 - DNA, 18 bp, Homo sapiens
cctactgagcatttgcac

SEQ ID NO: 4622105 - DNA, 20 bp, Homo sapiens
cctacttctcagtccccttc

SEQ ID NO: 4622106 - DNA, 11 bp, Homo sapiens
cctagagtgta

SEQ ID NO: 4622107 - DNA, 21 bp, Homo sapiens
cctagcagcaccgttctgtgc

SEQ ID NO: 4622108 - DNA, 13 bp, Homo sapiens
cctagcaggaact

SEQ ID NO: 4622109 - DNA, 21 bp, Homo sapiens
cctagccaggtctcctgggaa

SEQ ID NO: 4622110 - DNA, 19 bp, Homo sapiens
cctagctacttggcaggct

SEQ ID NO: 4622111 - DNA, 17 bp, Homo sapiens
cctagctggctctgtga

SEQ ID NO: 4622112 - DNA, 19 bp, Homo sapiens
cctaggagggctctgagcc

SEQ ID NO: 4622113 - DNA, 11 bp, Homo sapiens
cctaggccagg

SEQ ID NO: 4622114 - DNA, 15 bp, Homo sapiens
cctaggccaggtgca

SEQ ID NO: 4622115 - DNA, 14 bp, Homo sapiens
cctagggtgggaag

SEQ ID NO: 4622116 - DNA, 20 bp, Homo sapiens
cctagtaaaaccttgttcta

SEQ ID NO: 4622117 - DNA, 19 bp, Homo sapiens
cctagtaagtcaggacagc

SEQ ID NO: 4622118 - DNA, 18 bp, Homo sapiens
cctagtacaatcttggga

SEQ ID NO: 4622119 - DNA, 17 bp, Homo sapiens
cctataggaacagccca

SEQ ID NO: 4622120 - DNA, 13 bp, Homo sapiens
cctatatatttct

SEQ ID NO: 4622121 - DNA, 16 bp, Homo sapiens
cctatatcagggcctg

SEQ ID NO: 4622122 - DNA, 13 bp, Homo sapiens
cctatcatttatt

SEQ ID NO: 4622123 - DNA, 16 bp, Homo sapiens
cctatcctaaataaaa

SEQ ID NO: 4622124 - DNA, 17 bp, Homo sapiens
cctatcttaggtagtca

SEQ ID NO: 4622125 - DNA, 22 bp, Homo sapiens
cctatgatggatggcagactct

SEQ ID NO: 4622126 - DNA, 14 bp, Homo sapiens
cctatgcacatatg

SEQ ID NO: 4622127 - DNA, 14 bp, Homo sapiens
cctatggagagccc

SEQ ID NO: 4622128 - DNA, 22 bp, Homo sapiens
cctatggagagccctgggaccg

SEQ ID NO: 4622129 - DNA, 17 bp, Homo sapiens
cctatgtattttcctaa

SEQ ID NO: 4622130 - DNA, 20 bp, Homo sapiens
cctcaagccccatttcctca

SEQ ID NO: 4622131 - DNA, 19 bp, Homo sapiens
cctcaagtgatcctcccac

SEQ ID NO: 4622132 - DNA, 12 bp, Homo sapiens
cctcacaactcc

SEQ ID NO: 4622133 - DNA, 17 bp, Homo sapiens
cctcaccaaggaccttg

SEQ ID NO: 4622134 - DNA, 22 bp, Homo sapiens
cctcacccctgcccctgtggga

SEQ ID NO: 4622135 - DNA, 18 bp, Homo sapiens
cctcactccctaggccca

SEQ ID NO: 4622136 - DNA, 19 bp, Homo sapiens
cctcactgtagcaggttct

SEQ ID NO: 4622137 - DNA, 14 bp, Homo sapiens
cctcacttcctttg

SEQ ID NO: 4622138 - DNA, 15 bp, Homo sapiens
cctcacttcctttgc

SEQ ID NO: 4622139 - DNA, 13 bp, Homo sapiens
cctcagacattta

SEQ ID NO: 4622140 - DNA, 16 bp, Homo sapiens
cctcagagcttcctgg

SEQ ID NO: 4622141 - DNA, 11 bp, Homo sapiens
cctcagcctcc

SEQ ID NO: 4622142 - DNA, 14 bp, Homo sapiens
cctcagctgaatgc

SEQ ID NO: 4622143 - DNA, 18 bp, Homo sapiens
cctcagctggtcctgacc

SEQ ID NO: 4622144 - DNA, 22 bp, Homo sapiens
cctcaggcacccgtccccacac

SEQ ID NO: 4622145 - DNA, 19 bp, Homo sapiens
cctcaggcctctgtgccgc

SEQ ID NO: 4622146 - DNA, 15 bp, Homo sapiens
cctcaggtgccaacc

SEQ ID NO: 4622147 - DNA, 14 bp, Homo sapiens
cctcagtccctctt

SEQ ID NO: 4622148 - DNA, 20 bp, Homo sapiens
cctcagtgcaaaatgtcttg

SEQ ID NO: 4622149 - DNA, 15 bp, Homo sapiens
cctcattaatgacac

SEQ ID NO: 4622150 - DNA, 17 bp, Homo sapiens
cctcattaatgacactt

SEQ ID NO: 4622151 - DNA, 16 bp, Homo sapiens
cctcattactgtgagg

SEQ ID NO: 4622152 - DNA, 20 bp, Homo sapiens
cctccaatcctccccgctct

SEQ ID NO: 4622153 - DNA, 15 bp, Homo sapiens
cctccaccagcctgc

SEQ ID NO: 4622154 - DNA, 20 bp, Homo sapiens
cctccaccagcctgctgaca

SEQ ID NO: 4622155 - DNA, 21 bp, Homo sapiens
cctccaccttccattttcccc

SEQ ID NO: 4622156 - DNA, 14 bp, Homo sapiens
cctccactgctggg

SEQ ID NO: 4622157 - DNA, 13 bp, Homo sapiens
cctccagcctctg

SEQ ID NO: 4622158 - DNA, 14 bp, Homo sapiens
cctccagcctctgg

SEQ ID NO: 4622159 - DNA, 13 bp, Homo sapiens
cctccagctttcc

SEQ ID NO: 4622160 - DNA, 14 bp, Homo sapiens
cctccaggagagag

SEQ ID NO: 4622161 - DNA, 16 bp, Homo sapiens
cctccaggagagagcc

SEQ ID NO: 4622162 - DNA, 18 bp, Homo sapiens
cctccaggagagagccag

SEQ ID NO: 4622163 - DNA, 17 bp, Homo sapiens
cctccagggtgtgtgct

SEQ ID NO: 4622164 - DNA, 18 bp, Homo sapiens
cctccatctttttcttgg

SEQ ID NO: 4622165 - DNA, 15 bp, Homo sapiens
cctccattcccaccc

SEQ ID NO: 4622166 - DNA, 17 bp, Homo sapiens
cctccattcccacccct

SEQ ID NO: 4622167 - DNA, 21 bp, Homo sapiens
cctcccagcccattgctgcca

SEQ ID NO: 4622168 - DNA, 23 bp, Homo sapiens
cctcccagcccattgctgccaag

SEQ ID NO: 4622169 - DNA, 15 bp, Homo sapiens
cctcccatccagggc

SEQ ID NO: 4622170 - DNA, 22 bp, Homo sapiens
cctcccatcccgtaagaccacc

SEQ ID NO: 4622171 - DNA, 13 bp, Homo sapiens
cctcccctgggac

SEQ ID NO: 4622172 - DNA, 14 bp, Homo sapiens
cctcccctgggact

SEQ ID NO: 4622173 - DNA, 14 bp, Homo sapiens
cctccctcctttcc

SEQ ID NO: 4622174 - DNA, 15 bp, Homo sapiens
cctccctgcctcagg

SEQ ID NO: 4622175 - DNA, 12 bp, Homo sapiens
cctccctgctgt

SEQ ID NO: 4622176 - DNA, 19 bp, Homo sapiens
cctccgaaggggctctgag

SEQ ID NO: 4622177 - DNA, 13 bp, Homo sapiens
cctcctcactccc

SEQ ID NO: 4622178 - DNA, 17 bp, Homo sapiens
cctcctcactccctagg

SEQ ID NO: 4622179 - DNA, 19 bp, Homo sapiens
cctcctcactccctaggcc

SEQ ID NO: 4622180 - DNA, 16 bp, Homo sapiens
cctcctccagcccctg

SEQ ID NO: 4622181 - DNA, 18 bp, Homo sapiens
cctcctccctcctcactc

SEQ ID NO: 4622182 - DNA, 16 bp, Homo sapiens
cctcctctgccagcag

SEQ ID NO: 4622183 - DNA, 20 bp, Homo sapiens
cctcctctgccagcaggaat

SEQ ID NO: 4622184 - DNA, 19 bp, Homo sapiens
cctcctgagtagctgggat

SEQ ID NO: 4622185 - DNA, 21 bp, Homo sapiens
cctcctgagtagctgggatta

SEQ ID NO: 4622186 - DNA, 13 bp, Homo sapiens
cctcctgcctcta

SEQ ID NO: 4622187 - DNA, 23 bp, Homo sapiens
cctccttggctttatgcaaatac

SEQ ID NO: 4622188 - DNA, 17 bp, Homo sapiens
cctccttttcttcaccc

SEQ ID NO: 4622189 - DNA, 22 bp, Homo sapiens
cctcgcgggtgtcacattcctg

SEQ ID NO: 4622190 - DNA, 21 bp, Homo sapiens
cctcgctctgttacccagggt

SEQ ID NO: 4622191 - DNA, 19 bp, Homo sapiens
cctcgctgggctctaaggt

SEQ ID NO: 4622192 - DNA, 23 bp, Homo sapiens
cctcgctgttggagcaaaccatt

SEQ ID NO: 4622193 - DNA, 13 bp, Homo sapiens
cctcgctttttca

SEQ ID NO: 4622194 - DNA, 20 bp, Homo sapiens
cctcgggctggagcctccga

SEQ ID NO: 4622195 - DNA, 15 bp, Homo sapiens
cctcgtgaggggcaa

SEQ ID NO: 4622196 - DNA, 15 bp, Homo sapiens
cctcgttctccctgg

SEQ ID NO: 4622197 - DNA, 20 bp, Homo sapiens
cctcgttctccctgggaggc

SEQ ID NO: 4622198 - DNA, 17 bp, Homo sapiens
cctctactgggaaggct

SEQ ID NO: 4622199 - DNA, 17 bp, Homo sapiens
cctctatttattagcca

SEQ ID NO: 4622200 - DNA, 18 bp, Homo sapiens
cctctatttattagccaa

SEQ ID NO: 4622201 - DNA, 15 bp, Homo sapiens
cctctcaccttgtcc

SEQ ID NO: 4622202 - DNA, 14 bp, Homo sapiens
cctctcactgtgtc

SEQ ID NO: 4622203 - DNA, 16 bp, Homo sapiens
cctctcatttccagct

SEQ ID NO: 4622204 - DNA, 19 bp, Homo sapiens
cctctcatttccagcttct

SEQ ID NO: 4622205 - DNA, 17 bp, Homo sapiens
cctctccaccctcccag

SEQ ID NO: 4622206 - DNA, 20 bp, Homo sapiens
cctctccagtttgcacctgt

SEQ ID NO: 4622207 - DNA, 16 bp, Homo sapiens
cctctccataacccca

SEQ ID NO: 4622208 - DNA, 18 bp, Homo sapiens
cctctccataaccccacc

SEQ ID NO: 4622209 - DNA, 22 bp, Homo sapiens
cctctccataaccccacccttg

SEQ ID NO: 4622210 - DNA, 16 bp, Homo sapiens
cctggggctggcctcc

SEQ ID NO: 4622211 - DNA, 16 bp, Homo sapiens
cctgggggaagaggag

SEQ ID NO: 4622212 - DNA, 17 bp, Homo sapiens
cctgggggacagagcaa

SEQ ID NO: 4622213 - DNA, 12 bp, Homo sapiens
cctgggggcctg

SEQ ID NO: 4622214 - DNA, 15 bp, Homo sapiens
cctgggggcctggct

SEQ ID NO: 4622215 - DNA, 22 bp, Homo sapiens
cctgggggtttaagctctgccc

SEQ ID NO: 4622216 - DNA, 23 bp, Homo sapiens
cctgggggtttaagctctgcccc

SEQ ID NO: 4622217 - DNA, 18 bp, Homo sapiens
cctggggtgacccggcac

SEQ ID NO: 4622218 - DNA, 16 bp, Homo sapiens
cctgggtaggccccac

SEQ ID NO: 4622219 - DNA, 19 bp, Homo sapiens
cctgggtaggccccacaag

SEQ ID NO: 4622220 - DNA, 20 bp, Homo sapiens
cctgggtggctactctgtgc

SEQ ID NO: 4622221 - DNA, 23 bp, Homo sapiens
cctgggtggctactctgtgccag

SEQ ID NO: 4622222 - DNA, 13 bp, Homo sapiens
cctggtattttca

SEQ ID NO: 4622223 - DNA, 12 bp, Homo sapiens
cctggtctggga

SEQ ID NO: 4622224 - DNA, 22 bp, Homo sapiens
cctggtctggttgggcagccag

SEQ ID NO: 4622225 - DNA, 12 bp, Homo sapiens
cctggtgccacc

SEQ ID NO: 4622226 - DNA, 19 bp, Homo sapiens
cctggtggggcagctcctc

SEQ ID NO: 4622227 - DNA, 21 bp, Homo sapiens
cctggtggggcagctcctctg

SEQ ID NO: 4622228 - DNA, 20 bp, Homo sapiens
cctggtgtgaaggtcctgct

SEQ ID NO: 4622229 - DNA, 17 bp, Homo sapiens
cctggttctaggctgct

SEQ ID NO: 4622230 - DNA, 23 bp, Homo sapiens
cctggttctaggctgctgcacac

SEQ ID NO: 4622231 - DNA, 21 bp, Homo sapiens
cctgtaatcaggcaaggagga

SEQ ID NO: 4622232 - DNA, 22 bp, Homo sapiens
cctgtaatcccagtactttgga

SEQ ID NO: 4622233 - DNA, 13 bp, Homo sapiens
cctgtactgcctg

SEQ ID NO: 4622234 - DNA, 19 bp, Homo sapiens
cctgtagccttctgtagga

SEQ ID NO: 4622235 - DNA, 17 bp, Homo sapiens
cctgtatccaattttaa

SEQ ID NO: 4622236 - DNA, 22 bp, Homo sapiens
cctgtatgtcaataaacaacag

SEQ ID NO: 4622237 - DNA, 17 bp, Homo sapiens
cctgtcaccctgcagga

SEQ ID NO: 4622238 - DNA, 20 bp, Homo sapiens
cctgtcattgtattcagata

SEQ ID NO: 4622239 - DNA, 15 bp, Homo sapiens
cctgtccaagacagg

SEQ ID NO: 4622240 - DNA, 22 bp, Homo sapiens
cctgtcccacccccttccccca

SEQ ID NO: 4622241 - DNA, 15 bp, Homo sapiens
cctgtcccagggccc

SEQ ID NO: 4622242 - DNA, 14 bp, Homo sapiens
cctgtccccaccct

SEQ ID NO: 4622243 - DNA, 15 bp, Homo sapiens
cctgtcccctaggga

SEQ ID NO: 4622244 - DNA, 14 bp, Homo sapiens
cctgtccctctagt

SEQ ID NO: 4622245 - DNA, 22 bp, Homo sapiens
cctgtcctccaacaccaagcac

SEQ ID NO: 4622246 - DNA, 13 bp, Homo sapiens
cctgtctcagtga

SEQ ID NO: 4622247 - DNA, 13 bp, Homo sapiens
cctgtctcctggc

SEQ ID NO: 4622248 - DNA, 12 bp, Homo sapiens
cctgtctctctc

SEQ ID NO: 4622249 - DNA, 22 bp, Homo sapiens
cctgtctctggctactccctgg

SEQ ID NO: 4622250 - DNA, 17 bp, Homo sapiens
cctgtctgttacactgg

SEQ ID NO: 4622251 - DNA, 14 bp, Homo sapiens
cctgtgaacccagg

SEQ ID NO: 4622252 - DNA, 15 bp, Homo sapiens
cctgtgaacccagga

SEQ ID NO: 4622253 - DNA, 16 bp, Homo sapiens
cctgtgaacccaggac

SEQ ID NO: 4622254 - DNA, 19 bp, Homo sapiens
cctgtgaagagatccttcc

SEQ ID NO: 4622255 - DNA, 15 bp, Homo sapiens
cctgtgatgttttat

SEQ ID NO: 4622256 - DNA, 20 bp, Homo sapiens
cctgtgcatgtatgtcttgg

SEQ ID NO: 4622257 - DNA, 16 bp, Homo sapiens
cctgtgcgtcccagct

SEQ ID NO: 4622258 - DNA, 14 bp, Homo sapiens
cctgtgctggggga

SEQ ID NO: 4622259 - DNA, 12 bp, Homo sapiens
cctgtggctccc

SEQ ID NO: 4622260 - DNA, 15 bp, Homo sapiens
cctgtggctccctct

SEQ ID NO: 4622261 - DNA, 17 bp, Homo sapiens
cctgtggctccctctct

SEQ ID NO: 4622262 - DNA, 19 bp, Homo sapiens
cctgtggctccctctctcc

SEQ ID NO: 4622263 - DNA, 23 bp, Homo sapiens
cctgtgggactcatccttgccca

SEQ ID NO: 4622264 - DNA, 13 bp, Homo sapiens
cctgtgggagcct

SEQ ID NO: 4622265 - DNA, 14 bp, Homo sapiens
cctgtgggagcctc

SEQ ID NO: 4622266 - DNA, 17 bp, Homo sapiens
cctgtgggagcctcgca

SEQ ID NO: 4622267 - DNA, 17 bp, Homo sapiens
cctgtgggtgtagccag

SEQ ID NO: 4622268 - DNA, 18 bp, Homo sapiens
cctgtgggtgtagccagg

SEQ ID NO: 4622269 - DNA, 13 bp, Homo sapiens
cctgtgtagctgt

SEQ ID NO: 4622270 - DNA, 15 bp, Homo sapiens
cctgtgtagctgtga

SEQ ID NO: 4622271 - DNA, 22 bp, Homo sapiens
cctgtgtagctgtgacctgctg

SEQ ID NO: 4622272 - DNA, 18 bp, Homo sapiens
cctgtgtccacctgtggg

SEQ ID NO: 4622273 - DNA, 19 bp, Homo sapiens
cctgtgtgtactctgtcca

SEQ ID NO: 4622274 - DNA, 18 bp, Homo sapiens
cctgtgtgtgtgtgtgta

SEQ ID NO: 4622275 - DNA, 14 bp, Homo sapiens
cctgtgttctttcc

SEQ ID NO: 4622276 - DNA, 23 bp, Homo sapiens
cctgtgttctttccccaggggca

SEQ ID NO: 4622277 - DNA, 14 bp, Homo sapiens
cctgttaaaacaac

SEQ ID NO: 4622278 - DNA, 15 bp, Homo sapiens
cctgttagcagacag

SEQ ID NO: 4622279 - DNA, 16 bp, Homo sapiens
cctgttagctttccaa

SEQ ID NO: 4622280 - DNA, 18 bp, Homo sapiens
cctgttcatggcagatgt

SEQ ID NO: 4622281 - DNA, 17 bp, Homo sapiens
cctgttctgaaatgttc

SEQ ID NO: 4622282 - DNA, 19 bp, Homo sapiens
cctgttcttgggcctcagg

SEQ ID NO: 4622283 - DNA, 23 bp, Homo sapiens
cctgttcttgggcctcaggctct

SEQ ID NO: 4622284 - DNA, 14 bp, Homo sapiens
cctgtttccagggt

SEQ ID NO: 4622285 - DNA, 13 bp, Homo sapiens
ccttaaaagaagg

SEQ ID NO: 4622286 - DNA, 13 bp, Homo sapiens
ccttaacctggga

SEQ ID NO: 4622287 - DNA, 15 bp, Homo sapiens
ccttaacctgggacc

SEQ ID NO: 4622288 - DNA, 16 bp, Homo sapiens
ccttaacctgggacca

SEQ ID NO: 4622289 - DNA, 18 bp, Homo sapiens
ccttaagccctggccccc

SEQ ID NO: 4622290 - DNA, 20 bp, Homo sapiens
ccttaaggcacagtgggagc

SEQ ID NO: 4622291 - DNA, 14 bp, Homo sapiens
ccttaatcttgctt

SEQ ID NO: 4622292 - DNA, 21 bp, Homo sapiens
ccttacaatgtgaataatggc

SEQ ID NO: 4622293 - DNA, 18 bp, Homo sapiens
ccttacagcctctgactt

SEQ ID NO: 4622294 - DNA, 17 bp, Homo sapiens
ccttacctgtctctctc

SEQ ID NO: 4622295 - DNA, 19 bp, Homo sapiens
ccttacctgtctctctctt

SEQ ID NO: 4622296 - DNA, 17 bp, Homo sapiens
ccttacgtgagaaatag

SEQ ID NO: 4622297 - DNA, 15 bp, Homo sapiens
ccttactcctgtggg

SEQ ID NO: 4622298 - DNA, 20 bp, Homo sapiens
ccttacttgcttctctagct

SEQ ID NO: 4622299 - DNA, 15 bp, Homo sapiens
ccttagtgggccagg

SEQ ID NO: 4622300 - DNA, 22 bp, Homo sapiens
ccttagtgggccagggctgccc

SEQ ID NO: 4622301 - DNA, 23 bp, Homo sapiens
ccttataaacagataatgctttt

SEQ ID NO: 4622302 - DNA, 13 bp, Homo sapiens
ccttatcagagct

SEQ ID NO: 4622303 - DNA, 23 bp, Homo sapiens
ccttatcctagcctttgggcaca

SEQ ID NO: 4622304 - DNA, 19 bp, Homo sapiens
ccttattgctgtcctggag

SEQ ID NO: 4622305 - DNA, 21 bp, Homo sapiens
ccttcaagacgaggggcaggg

SEQ ID NO: 4622306 - DNA, 22 bp, Homo sapiens
ccttcaagacgaggggcaggga

SEQ ID NO: 4622307 - DNA, 23 bp, Homo sapiens
ccttcagacacatgctatgttct

SEQ ID NO: 4622308 - DNA, 21 bp, Homo sapiens
ccttcagcatcctcagttcct

SEQ ID NO: 4622309 - DNA, 12 bp, Homo sapiens
ccttcagtttat

SEQ ID NO: 4622310 - DNA, 13 bp, Homo sapiens
ccttcagtttatt

SEQ ID NO: 4622311 - DNA, 20 bp, Homo sapiens
ccttccaaataataaagtct

SEQ ID NO: 4622312 - DNA, 12 bp, Homo sapiens
ccttccacctca

SEQ ID NO: 4622313 - DNA, 20 bp, Homo sapiens
ccttccacctcacaactcct

SEQ ID NO: 4622314 - DNA, 11 bp, Homo sapiens
ccttccagcct

SEQ ID NO: 4622315 - DNA, 23 bp, Homo sapiens
ccttccatccttgactgaagcga

SEQ ID NO: 4622316 - DNA, 17 bp, Homo sapiens
ccttccattttccccca

SEQ ID NO: 4622317 - DNA, 23 bp, Homo sapiens
ccttccccatgaaccctgccctg

SEQ ID NO: 4622318 - DNA, 15 bp, Homo sapiens
ccttcccccagccca

SEQ ID NO: 4622319 - DNA, 13 bp, Homo sapiens
ccttcccctggga

SEQ ID NO: 4622320 - DNA, 15 bp, Homo sapiens
ccttcccctgggaac

SEQ ID NO: 4622321 - DNA, 13 bp, Homo sapiens
ccttcctcctgcc

SEQ ID NO: 4622322 - DNA, 20 bp, Homo sapiens
ccttcctcctgcctttctca

SEQ ID NO: 4622323 - DNA, 20 bp, Homo sapiens
ccttcctcttcctgcccttg

SEQ ID NO: 4622324 - DNA, 23 bp, Homo sapiens
ccttcctgccccaactccttcca

SEQ ID NO: 4622325 - DNA, 18 bp, Homo sapiens
ccttcctggacagctgtg

SEQ ID NO: 4622326 - DNA, 15 bp, Homo sapiens
ccttcgaaaggcctt

SEQ ID NO: 4622327 - DNA, 23 bp, Homo sapiens
ccttcgaaaggccttcagacaca

SEQ ID NO: 4622328 - DNA, 15 bp, Homo sapiens
ccttctcccaggcct

SEQ ID NO: 4622329 - DNA, 19 bp, Homo sapiens
ccttctcccaggcctctgc

SEQ ID NO: 4622330 - DNA, 13 bp, Homo sapiens
ccttctgaaatgt

SEQ ID NO: 4622331 - DNA, 18 bp, Homo sapiens
ccttctgaaatgtgaccc

SEQ ID NO: 4622332 - DNA, 20 bp, Homo sapiens
ccttctgcaaagtggcaggg

SEQ ID NO: 4622333 - DNA, 17 bp, Homo sapiens
ccttctgctcagctctg

SEQ ID NO: 4622334 - DNA, 16 bp, Homo sapiens
ccttctggccttgtaa

SEQ ID NO: 4622335 - DNA, 20 bp, Homo sapiens
ccttctttctagagagggaa

SEQ ID NO: 4622336 - DNA, 21 bp, Homo sapiens
ccttcttttcctaacatgcac

SEQ ID NO: 4622337 - DNA, 20 bp, Homo sapiens
ccttgaaccccctccctgtc

SEQ ID NO: 4622338 - DNA, 20 bp, Homo sapiens
ccttgactttgaactaatga

SEQ ID NO: 4622339 - DNA, 20 bp, Homo sapiens
ccttgaggggcagtttggga

SEQ ID NO: 4622340 - DNA, 12 bp, Homo sapiens
ccttgctcatga

SEQ ID NO: 4622341 - DNA, 20 bp, Homo sapiens
ccttgctgggcctgggggtt

SEQ ID NO: 4622342 - DNA, 13 bp, Homo sapiens
ccttgctttcctg

SEQ ID NO: 4622343 - DNA, 13 bp, Homo sapiens
ccttggagccccg

SEQ ID NO: 4622344 - DNA, 18 bp, Homo sapiens
ccttggaggagagagacc

SEQ ID NO: 4622345 - DNA, 19 bp, Homo sapiens
ccttggaggagagagaccc

SEQ ID NO: 4622346 - DNA, 16 bp, Homo sapiens
ccttggcatagacatg

SEQ ID NO: 4622347 - DNA, 23 bp, Homo sapiens
ccttggctttatgcaaatacaat

SEQ ID NO: 4622348 - DNA, 19 bp, Homo sapiens
ccttggggaggacaaaact

SEQ ID NO: 4622349 - DNA, 23 bp, Homo sapiens
ccttggggaggacaaaacttctt

SEQ ID NO: 4622350 - DNA, 14 bp, Homo sapiens
ccttgtccccatga

SEQ ID NO: 4622351 - DNA, 13 bp, Homo sapiens
ccttgttctattt

SEQ ID NO: 4622352 - DNA, 19 bp, Homo sapiens
ccttgtttggggcaggagt

SEQ ID NO: 4622353 - DNA, 20 bp, Homo sapiens
ccttgttttgaaaacctaaa

SEQ ID NO: 4622354 - DNA, 15 bp, Homo sapiens
cctttaaatatcatt

SEQ ID NO: 4622355 - DNA, 15 bp, Homo sapiens
cctttatttctcttc

SEQ ID NO: 4622356 - DNA, 22 bp, Homo sapiens
cctttcaattccaccagggcca

SEQ ID NO: 4622357 - DNA, 13 bp, Homo sapiens
cctttcctgtagc

SEQ ID NO: 4622358 - DNA, 17 bp, Homo sapiens
cctttctctgcctggca

SEQ ID NO: 4622359 - DNA, 17 bp, Homo sapiens
cctttgaggccccaact

SEQ ID NO: 4622360 - DNA, 17 bp, Homo sapiens
cctttgcccttcctcct

SEQ ID NO: 4622361 - DNA, 18 bp, Homo sapiens
ccttttaaagaagcttta

SEQ ID NO: 4622362 - DNA, 15 bp, Homo sapiens
ccttttaaggtttca

SEQ ID NO: 4622363 - DNA, 23 bp, Homo sapiens
ccttttcagcgatgtatgcagct

SEQ ID NO: 4622364 - DNA, 22 bp, Homo sapiens
ccttttggataagtttctattc

SEQ ID NO: 4622365 - DNA, 21 bp, Homo sapiens
cctttttcatttaactttata

SEQ ID NO: 4622366 - DNA, 14 bp, Homo sapiens
cctttttctgagat

SEQ ID NO: 4622367 - DNA, 14 bp, Homo sapiens
cctttttggcctgt

SEQ ID NO: 4622368 - DNA, 18 bp, Homo sapiens
cctttttggcctgtgatg

SEQ ID NO: 4622369 - DNA, 19 bp, Homo sapiens
cctttttggcctgtgatgt

SEQ ID NO: 4622370 - DNA, 13 bp, Homo sapiens
ccttttttaaaaa

SEQ ID NO: 4622371 - DNA, 17 bp, Homo sapiens
ccttttttaaaaatgca

SEQ ID NO: 4622372 - DNA, 21 bp, Homo sapiens
ccttttttgtcattttatgaa

SEQ ID NO: 4622373 - DNA, 21 bp, Homo sapiens
cgaaaggccttcagacacatg

SEQ ID NO: 4622374 - DNA, 19 bp, Homo sapiens
cgaactcctaacctcaagt

SEQ ID NO: 4622375 - DNA, 15 bp, Homo sapiens
cgaagagtcagcccc

SEQ ID NO: 4622376 - DNA, 16 bp, Homo sapiens
cgaagtctgctgctgt

SEQ ID NO: 4622377 - DNA, 18 bp, Homo sapiens
cgaatgacaaaatcatct

SEQ ID NO: 4622378 - DNA, 13 bp, Homo sapiens
cgacagacagcca

SEQ ID NO: 4622379 - DNA, 19 bp, Homo sapiens
cgacagggcctggagcccc

SEQ ID NO: 4622380 - DNA, 18 bp, Homo sapiens
cgacatacatgctacttt

SEQ ID NO: 4622381 - DNA, 20 bp, Homo sapiens
cgaccctgtcccctagggac

SEQ ID NO: 4622382 - DNA, 21 bp, Homo sapiens
cgaccctgtcccctagggact

SEQ ID NO: 4622383 - DNA, 15 bp, Homo sapiens
cgagacaacagcaca

SEQ ID NO: 4622384 - DNA, 11 bp, Homo sapiens
cgagaccccag

SEQ ID NO: 4622385 - DNA, 18 bp, Homo sapiens
cgagactttctcctggcc

SEQ ID NO: 4622386 - DNA, 23 bp, Homo sapiens
cgagagcctcgctttttcatcct

SEQ ID NO: 4622387 - DNA, 17 bp, Homo sapiens
cgagatcagtatttaac

SEQ ID NO: 4622388 - DNA, 11 bp, Homo sapiens
cgagcagctga

SEQ ID NO: 4622389 - DNA, 12 bp, Homo sapiens
cgagcagctgag

SEQ ID NO: 4622390 - DNA, 16 bp, Homo sapiens
cgagcagctgagcagg

SEQ ID NO: 4622391 - DNA, 19 bp, Homo sapiens
cgagcagctgagcagggcc

SEQ ID NO: 4622392 - DNA, 16 bp, Homo sapiens
cgagccacaagctgca

SEQ ID NO: 4622393 - DNA, 21 bp, Homo sapiens
cgagccacaagctgcactgtg

SEQ ID NO: 4622394 - DNA, 14 bp, Homo sapiens
cgagcgccctgcag

SEQ ID NO: 4622395 - DNA, 15 bp, Homo sapiens
cgagcgccctgcaga

SEQ ID NO: 4622396 - DNA, 23 bp, Homo sapiens
cgaggctgattcctctcatttcc

SEQ ID NO: 4622397 - DNA, 16 bp, Homo sapiens
cgagggcaacagggag

SEQ ID NO: 4622398 - DNA, 17 bp, Homo sapiens
cgagggcaacagggagc

SEQ ID NO: 4622399 - DNA, 18 bp, Homo sapiens
cgagggcaacagggagca

SEQ ID NO: 4622400 - DNA, 15 bp, Homo sapiens
cgaggggcagggaag

SEQ ID NO: 4622401 - DNA, 20 bp, Homo sapiens
cgagtcattcgttctgtgga

SEQ ID NO: 4622402 - DNA, 17 bp, Homo sapiens
cgagtggatgctgtgct

SEQ ID NO: 4622403 - DNA, 22 bp, Homo sapiens
cgatatttcgtttggtcttagg

SEQ ID NO: 4622404 - DNA, 15 bp, Homo sapiens
cgatctcggctcagt

SEQ ID NO: 4622405 - DNA, 16 bp, Homo sapiens
cgatgatggaaattag

SEQ ID NO: 4622406 - DNA, 20 bp, Homo sapiens
cgatgtatgcagctatctgg

SEQ ID NO: 4622407 - DNA, 15 bp, Homo sapiens
cgatgttgtcaagga

SEQ ID NO: 4622408 - DNA, 12 bp, Homo sapiens
cgattcccaagc

SEQ ID NO: 4622409 - DNA, 19 bp, Homo sapiens
cgattccctctcccaggcc

SEQ ID NO: 4622410 - DNA, 21 bp, Homo sapiens
cgattccctctcccaggcccc

SEQ ID NO: 4622411 - DNA, 18 bp, Homo sapiens
cgattctcctgcctcagc

SEQ ID NO: 4622412 - DNA, 13 bp, Homo sapiens
cgcaacccgtgcc

SEQ ID NO: 4622413 - DNA, 14 bp, Homo sapiens
cgcaacccgtgcca

SEQ ID NO: 4622414 - DNA, 19 bp, Homo sapiens
cgcaacccgtgccaagtcc

SEQ ID NO: 4622415 - DNA, 17 bp, Homo sapiens
cgcaagtcaagccgccc

SEQ ID NO: 4622416 - DNA, 15 bp, Homo sapiens
cgcaagtgcctggga

SEQ ID NO: 4622417 - DNA, 21 bp, Homo sapiens
cgcaccgcctgaaggcacagc

SEQ ID NO: 4622418 - DNA, 17 bp, Homo sapiens
cgcactggacagcatca

SEQ ID NO: 4622419 - DNA, 13 bp, Homo sapiens
cgcagacctctgg

SEQ ID NO: 4622420 - DNA, 19 bp, Homo sapiens
cgcagacctctggattagg

SEQ ID NO: 4622421 - DNA, 16 bp, Homo sapiens
cgcagccaccctgagg

SEQ ID NO: 4622422 - DNA, 12 bp, Homo sapiens
cgcagctgccta

SEQ ID NO: 4622423 - DNA, 24 bp, Homo sapiens
cgcaggaagacccaacacatggga

SEQ ID NO: 4622424 - DNA, 18 bp, Homo sapiens
cgcaggtatttagaagca

SEQ ID NO: 4622425 - DNA, 21 bp, Homo sapiens
cgcaggtatttagaagcagag

SEQ ID NO: 4622426 - DNA, 21 bp, Homo sapiens
cgcagtggggtcaagctgagc

SEQ ID NO: 4622427 - DNA, 22 bp, Homo sapiens
cgcatactgagaatctaggcca

SEQ ID NO: 4622428 - DNA, 19 bp, Homo sapiens
cgcatcttcccaacccctt

SEQ ID NO: 4622429 - DNA, 22 bp, Homo sapiens
cgcatgaccacccctctcgcct

SEQ ID NO: 4622430 - DNA, 18 bp, Homo sapiens
cgccaatgttatgccagc

SEQ ID NO: 4622431 - DNA, 22 bp, Homo sapiens
cgccaatgttatgccagctcca

SEQ ID NO: 4622432 - DNA, 12 bp, Homo sapiens
cgtaaggatgtg

SEQ ID NO: 4622433 - DNA, 15 bp, Homo sapiens
cgtaatcctcctgag

SEQ ID NO: 4622434 - DNA, 13 bp, Homo sapiens
cgtagagaatgtg

SEQ ID NO: 4622435 - DNA, 16 bp, Homo sapiens
cgtataggcatgtaaa

SEQ ID NO: 4622436 - DNA, 15 bp, Homo sapiens
cgtcaaagaaaatgc

SEQ ID NO: 4622437 - DNA, 17 bp, Homo sapiens
cgtcaaagaaaatgcct

SEQ ID NO: 4622438 - DNA, 16 bp, Homo sapiens
cgtcaccccagccctc

SEQ ID NO: 4622439 - DNA, 22 bp, Homo sapiens
cgtcagggagaggtcaccagct

SEQ ID NO: 4622440 - DNA, 15 bp, Homo sapiens
cgtcccagcatccct

SEQ ID NO: 4622441 - DNA, 19 bp, Homo sapiens
cgtcccagcatccctggag

SEQ ID NO: 4622442 - DNA, 22 bp, Homo sapiens
cgtccctatatcagggcctgag

SEQ ID NO: 4622443 - DNA, 16 bp, Homo sapiens
cgtccttactcctgtg

SEQ ID NO: 4622444 - DNA, 18 bp, Homo sapiens
cgtctggctccctgcccc

SEQ ID NO: 4622445 - DNA, 14 bp, Homo sapiens
cgtctgggagaaat

SEQ ID NO: 4622446 - DNA, 16 bp, Homo sapiens
cgtgacagactcctga

SEQ ID NO: 4622447 - DNA, 14 bp, Homo sapiens
cgtgagccaccgcg

SEQ ID NO: 4622448 - DNA, 23 bp, Homo sapiens
cgtgagctggggactcagggacc

SEQ ID NO: 4622449 - DNA, 22 bp, Homo sapiens
cgtgaggggcaagctaggcccc

SEQ ID NO: 4622450 - DNA, 16 bp, Homo sapiens
cgtgatgtggaggaag

SEQ ID NO: 4622451 - DNA, 20 bp, Homo sapiens
cgtgatgtggaggaagagcc

SEQ ID NO: 4622452 - DNA, 21 bp, Homo sapiens
cgtgatgtggaggaagagcca

SEQ ID NO: 4622453 - DNA, 23 bp, Homo sapiens
cgtgatgtggaggaagagccacc

SEQ ID NO: 4622454 - DNA, 18 bp, Homo sapiens
cgtgattttgctgtagaa

SEQ ID NO: 4622455 - DNA, 16 bp, Homo sapiens
cgtgccacccccagcc

SEQ ID NO: 4622456 - DNA, 22 bp, Homo sapiens
cgtgccgtgtgagtgtgacagg

SEQ ID NO: 4622457 - DNA, 15 bp, Homo sapiens
cgtggaacgtttttc

SEQ ID NO: 4622458 - DNA, 18 bp, Homo sapiens
cgtggagagctaggagca

SEQ ID NO: 4622459 - DNA, 19 bp, Homo sapiens
cgtggatgggcaaagcttg

SEQ ID NO: 4622460 - DNA, 15 bp, Homo sapiens
cgtggcccttcctgg

SEQ ID NO: 4622461 - DNA, 17 bp, Homo sapiens
cgtggcccttcctggac

SEQ ID NO: 4622462 - DNA, 18 bp, Homo sapiens
cgtggcccttcctggaca

SEQ ID NO: 4622463 - DNA, 21 bp, Homo sapiens
cgtggcctcgtgaggggcaag

SEQ ID NO: 4622464 - DNA, 23 bp, Homo sapiens
cgtggcctcgtgaggggcaagct

SEQ ID NO: 4622465 - DNA, 13 bp, Homo sapiens
cgtggccttgttc

SEQ ID NO: 4622466 - DNA, 15 bp, Homo sapiens
cgtggctctgctggc

SEQ ID NO: 4622467 - DNA, 14 bp, Homo sapiens
cgtggcttttccta

SEQ ID NO: 4622468 - DNA, 11 bp, Homo sapiens
cgtgggcagag

SEQ ID NO: 4622469 - DNA, 13 bp, Homo sapiens
cgtgggcagagga

SEQ ID NO: 4622470 - DNA, 22 bp, Homo sapiens
cgtgggtgggcctggccctgct

SEQ ID NO: 4622471 - DNA, 12 bp, Homo sapiens
cgtggtgtgaga

SEQ ID NO: 4622472 - DNA, 21 bp, Homo sapiens
cgtggtttgcctgaggctgta

SEQ ID NO: 4622473 - DNA, 18 bp, Homo sapiens
cgtggttttatgaagcta

SEQ ID NO: 4622474 - DNA, 16 bp, Homo sapiens
cgtgtatagtatctgt

SEQ ID NO: 4622475 - DNA, 18 bp, Homo sapiens
cgtgtgaaatctgtcttt

SEQ ID NO: 4622476 - DNA, 17 bp, Homo sapiens
cgtgtgagtgtgacagg

SEQ ID NO: 4622477 - DNA, 13 bp, Homo sapiens
cgttccagttccc

SEQ ID NO: 4622478 - DNA, 12 bp, Homo sapiens
cgttctccctgg

SEQ ID NO: 4622479 - DNA, 13 bp, Homo sapiens
cgttctccctggg

SEQ ID NO: 4622480 - DNA, 12 bp, Homo sapiens
cgttctgtgcac

SEQ ID NO: 4622481 - DNA, 15 bp, Homo sapiens
cgttgcacagctgtt

SEQ ID NO: 4622482 - DNA, 23 bp, Homo sapiens
cgtttagtgagttcgttttggag

SEQ ID NO: 4622483 - DNA, 19 bp, Homo sapiens
cgtttcaaagctttcctgt

SEQ ID NO: 4622484 - DNA, 20 bp, Homo sapiens
cgtttttattcctcttattg

SEQ ID NO: 4622485 - DNA, 14 bp, Homo sapiens
ctaaaaatattgtt

SEQ ID NO: 4622486 - DNA, 15 bp, Homo sapiens
ctaaaaatgaaaatt

SEQ ID NO: 4622487 - DNA, 12 bp, Homo sapiens
ctaaaacaataa

SEQ ID NO: 4622488 - DNA, 17 bp, Homo sapiens
ctaaaacaataaaattt

SEQ ID NO: 4622489 - DNA, 12 bp, Homo sapiens
ctaaacctcagt

SEQ ID NO: 4622490 - DNA, 19 bp, Homo sapiens
ctaaactactgattacttg

SEQ ID NO: 4622491 - DNA, 19 bp, Homo sapiens
ctaaactggtgtttttccc

SEQ ID NO: 4622492 - DNA, 12 bp, Homo sapiens
ctaaactttatt

SEQ ID NO: 4622493 - DNA, 22 bp, Homo sapiens
ctaaactttatttgtaaaccat

SEQ ID NO: 4622494 - DNA, 15 bp, Homo sapiens
ctaaagggcagggcc

SEQ ID NO: 4622495 - DNA, 17 bp, Homo sapiens
ctaaagggcagggccca

SEQ ID NO: 4622496 - DNA, 18 bp, Homo sapiens
ctaaagggcagggcccac

SEQ ID NO: 4622497 - DNA, 15 bp, Homo sapiens
ctaaataaacacgat

SEQ ID NO: 4622498 - DNA, 20 bp, Homo sapiens
ctaaataaacacgattttat

SEQ ID NO: 4622499 - DNA, 16 bp, Homo sapiens
ctaaataaagatattg

SEQ ID NO: 4622500 - DNA, 13 bp, Homo sapiens
ctaaatttcttct

SEQ ID NO: 4622501 - DNA, 13 bp, Homo sapiens
ctaacacaaggac

SEQ ID NO: 4622502 - DNA, 16 bp, Homo sapiens
ctaacactcagaagcc

SEQ ID NO: 4622503 - DNA, 15 bp, Homo sapiens
ctaacagggaaggca

SEQ ID NO: 4622504 - DNA, 17 bp, Homo sapiens
ctaacagggaaggcagg

SEQ ID NO: 4622505 - DNA, 16 bp, Homo sapiens
ctaacatgcaccttgc

SEQ ID NO: 4622506 - DNA, 17 bp, Homo sapiens
ctaacatgccctgttca

SEQ ID NO: 4622507 - DNA, 22 bp, Homo sapiens
ctaaccaaatctctcaaatctg

SEQ ID NO: 4622508 - DNA, 14 bp, Homo sapiens
ctaacctaggaggg

SEQ ID NO: 4622509 - DNA, 22 bp, Homo sapiens
ctaacctcaagtgatcctccca

SEQ ID NO: 4622510 - DNA, 12 bp, Homo sapiens
ctaacctgtgac

SEQ ID NO: 4622511 - DNA, 15 bp, Homo sapiens
ctaacgcctgagccc

SEQ ID NO: 4622512 - DNA, 17 bp, Homo sapiens
ctaacgcctgagcccag

SEQ ID NO: 4622513 - DNA, 18 bp, Homo sapiens
ctaacgcctgagcccagg

SEQ ID NO: 4622514 - DNA, 19 bp, Homo sapiens
ctaacgcctgagcccaggg

SEQ ID NO: 4622515 - DNA, 22 bp, Homo sapiens
ctaacgcctgagcccagggagg

SEQ ID NO: 4622516 - DNA, 16 bp, Homo sapiens
ctaactctgcccaccc

SEQ ID NO: 4622517 - DNA, 19 bp, Homo sapiens
ctaactctgcccaccctcc

SEQ ID NO: 4622518 - DNA, 18 bp, Homo sapiens
ctaactgtaaatcatgtt

SEQ ID NO: 4622519 - DNA, 21 bp, Homo sapiens
ctaagagacacatacagagtg

SEQ ID NO: 4622520 - DNA, 16 bp, Homo sapiens
ctaagcattccacact

SEQ ID NO: 4622521 - DNA, 12 bp, Homo sapiens
ctaagcccagga

SEQ ID NO: 4622522 - DNA, 17 bp, Homo sapiens
ctaagcccaggatctct

SEQ ID NO: 4622523 - DNA, 15 bp, Homo sapiens
ctaaggcttttattt

SEQ ID NO: 4622524 - DNA, 14 bp, Homo sapiens
ctaagggtgggtgc

SEQ ID NO: 4622525 - DNA, 15 bp, Homo sapiens
ctaaggtactgtggg

SEQ ID NO: 4622526 - DNA, 18 bp, Homo sapiens
ctaagtcgtgcactttct

SEQ ID NO: 4622527 - DNA, 19 bp, Homo sapiens
ctaagtgcaaacacagcat

SEQ ID NO: 4622528 - DNA, 12 bp, Homo sapiens
ctaataaagcca

SEQ ID NO: 4622529 - DNA, 14 bp, Homo sapiens
ctaataattgtatc

SEQ ID NO: 4622530 - DNA, 14 bp, Homo sapiens
ctaatagagtactt

SEQ ID NO: 4622531 - DNA, 20 bp, Homo sapiens
ctaatatacttgtaaaacca

SEQ ID NO: 4622532 - DNA, 19 bp, Homo sapiens
ctaatccctgggcattgct

SEQ ID NO: 4622533 - DNA, 22 bp, Homo sapiens
ctaatccctgggcattgctttc

SEQ ID NO: 4622534 - DNA, 23 bp, Homo sapiens
ctaatccctgggcattgctttcc

SEQ ID NO: 4622535 - DNA, 19 bp, Homo sapiens
ctaatgcaaattaaaacat

SEQ ID NO: 4622536 - DNA, 14 bp, Homo sapiens
ctaatgcatattta

SEQ ID NO: 4622537 - DNA, 15 bp, Homo sapiens
ctaatgcatatttat

SEQ ID NO: 4622538 - DNA, 19 bp, Homo sapiens
ctaatgcatatttataaga

SEQ ID NO: 4622539 - DNA, 21 bp, Homo sapiens
ctaatgcatatttataagaga

SEQ ID NO: 4622540 - DNA, 16 bp, Homo sapiens
ctaatgtaaaatgatt

SEQ ID NO: 4622541 - DNA, 23 bp, Homo sapiens
ctaatgtgaaaatcatcactcaa

SEQ ID NO: 4622542 - DNA, 18 bp, Homo sapiens
ctaattgtaagtgaaatt

SEQ ID NO: 4622543 - DNA, 21 bp, Homo sapiens
ctaattgtaagtgaaattaag

SEQ ID NO: 4622544 - DNA, 14 bp, Homo sapiens
cgccacggcctggc

SEQ ID NO: 4622545 - DNA, 16 bp, Homo sapiens
cgccacggcctggctg

SEQ ID NO: 4622546 - DNA, 22 bp, Homo sapiens
cgccagccacaggaccacctcc

SEQ ID NO: 4622547 - DNA, 23 bp, Homo sapiens
cgccaggctgaccacagcacagc

SEQ ID NO: 4622548 - DNA, 14 bp, Homo sapiens
cgccagggctgggg

SEQ ID NO: 4622549 - DNA, 21 bp, Homo sapiens
cgccagggctggggacagagg

SEQ ID NO: 4622550 - DNA, 15 bp, Homo sapiens
cgccagtgtttctga

SEQ ID NO: 4622551 - DNA, 14 bp, Homo sapiens
cgcccacctcagcc

SEQ ID NO: 4622552 - DNA, 17 bp, Homo sapiens
cgccccaaagttgctca

SEQ ID NO: 4622553 - DNA, 21 bp, Homo sapiens
cgccccaacccgtggaggctg

SEQ ID NO: 4622554 - DNA, 12 bp, Homo sapiens
cgcccctcagag

SEQ ID NO: 4622555 - DNA, 20 bp, Homo sapiens
cgccctgcagaccctgccct

SEQ ID NO: 4622556 - DNA, 12 bp, Homo sapiens
cgcccttcctct

SEQ ID NO: 4622557 - DNA, 16 bp, Homo sapiens
cgcctcattactgtga

SEQ ID NO: 4622558 - DNA, 18 bp, Homo sapiens
cgcctctgtgtacatgtg

SEQ ID NO: 4622559 - DNA, 15 bp, Homo sapiens
cgcctgaaggcacag

SEQ ID NO: 4622560 - DNA, 13 bp, Homo sapiens
cgcctgagcccag

SEQ ID NO: 4622561 - DNA, 16 bp, Homo sapiens
cgcctgagcccaggga

SEQ ID NO: 4622562 - DNA, 20 bp, Homo sapiens
cgcctgccaccacgctggcc

SEQ ID NO: 4622563 - DNA, 20 bp, Homo sapiens
cgccttctcccacatgaggc

SEQ ID NO: 4622564 - DNA, 14 bp, Homo sapiens
cgcctttttggcct

SEQ ID NO: 4622565 - DNA, 19 bp, Homo sapiens
cgctccccactctgctctg

SEQ ID NO: 4622566 - DNA, 18 bp, Homo sapiens
cgctgcttcgtgggatac

SEQ ID NO: 4622567 - DNA, 22 bp, Homo sapiens
cgctggggaccggttcccacaa

SEQ ID NO: 4622568 - DNA, 23 bp, Homo sapiens
cgctgtattttgagtttcagctg

SEQ ID NO: 4622569 - DNA, 16 bp, Homo sapiens
cgcttctctcttttaa

SEQ ID NO: 4622570 - DNA, 19 bp, Homo sapiens
cgcttctctcttttaaagt

SEQ ID NO: 4622571 - DNA, 12 bp, Homo sapiens
cgcttgtagaac

SEQ ID NO: 4622572 - DNA, 19 bp, Homo sapiens
cgcttgtagaactcactct

SEQ ID NO: 4622573 - DNA, 16 bp, Homo sapiens
cgctttgaaagaagca

SEQ ID NO: 4622574 - DNA, 15 bp, Homo sapiens
cggaaacaaaaatga

SEQ ID NO: 4622575 - DNA, 20 bp, Homo sapiens
cggaaccgcccaggatcaga

SEQ ID NO: 4622576 - DNA, 13 bp, Homo sapiens
cggacagtggcag

SEQ ID NO: 4622577 - DNA, 21 bp, Homo sapiens
cggacatgcttttctgccact

SEQ ID NO: 4622578 - DNA, 15 bp, Homo sapiens
cggacattctaatgc

SEQ ID NO: 4622579 - DNA, 17 bp, Homo sapiens
cggacattctaatgcat

SEQ ID NO: 4622580 - DNA, 17 bp, Homo sapiens
cggagcaaactctgctg

SEQ ID NO: 4622581 - DNA, 17 bp, Homo sapiens
cggagctgcccctctct

SEQ ID NO: 4622582 - DNA, 13 bp, Homo sapiens
cggagggagggga

SEQ ID NO: 4622583 - DNA, 15 bp, Homo sapiens
cggagggaggggagg

SEQ ID NO: 4622584 - DNA, 16 bp, Homo sapiens
cggagggatggagaaa

SEQ ID NO: 4622585 - DNA, 17 bp, Homo sapiens
cggagggatggagaaag

SEQ ID NO: 4622586 - DNA, 19 bp, Homo sapiens
cggaggggatccagccact

SEQ ID NO: 4622587 - DNA, 23 bp, Homo sapiens
cggaggtgctgtccccactgccc

SEQ ID NO: 4622588 - DNA, 19 bp, Homo sapiens
cggatctcacaggctgaga

SEQ ID NO: 4622589 - DNA, 20 bp, Homo sapiens
cggatgacaccctggcctga

SEQ ID NO: 4622590 - DNA, 15 bp, Homo sapiens
cggatgcgtgggcag

SEQ ID NO: 4622591 - DNA, 19 bp, Homo sapiens
cggatgcgtgggcagagga

SEQ ID NO: 4622592 - DNA, 17 bp, Homo sapiens
cggatttggggattagg

SEQ ID NO: 4622593 - DNA, 15 bp, Homo sapiens
cggcaccccctgcag

SEQ ID NO: 4622594 - DNA, 13 bp, Homo sapiens
cggcacctgggcc

SEQ ID NO: 4622595 - DNA, 22 bp, Homo sapiens
cggcacctgggccctggggcct

SEQ ID NO: 4622596 - DNA, 20 bp, Homo sapiens
cggcagagctctacaggcct

SEQ ID NO: 4622597 - DNA, 14 bp, Homo sapiens
cggcagcgggcgga

SEQ ID NO: 4622598 - DNA, 17 bp, Homo sapiens
cggccaaggtgccacca

SEQ ID NO: 4622599 - DNA, 23 bp, Homo sapiens
cggccaaggtgccaccaccctgc

SEQ ID NO: 4622600 - DNA, 14 bp, Homo sapiens
cggcccaagagccc

SEQ ID NO: 4622601 - DNA, 15 bp, Homo sapiens
cggcccaagagcccg

SEQ ID NO: 4622602 - DNA, 13 bp, Homo sapiens
cggccccatctct

SEQ ID NO: 4622603 - DNA, 19 bp, Homo sapiens
cggcccgcgcagctgccta

SEQ ID NO: 4622604 - DNA, 16 bp, Homo sapiens
cggccggccagcccct

SEQ ID NO: 4622605 - DNA, 23 bp, Homo sapiens
cggccggccagcccctggcccca

SEQ ID NO: 4622606 - DNA, 18 bp, Homo sapiens
cggcctgtgggtctctga

SEQ ID NO: 4622607 - DNA, 21 bp, Homo sapiens
cggctcagtgcaacctctgct

SEQ ID NO: 4622608 - DNA, 20 bp, Homo sapiens
cggctcggaggaagccccca

SEQ ID NO: 4622609 - DNA, 13 bp, Homo sapiens
cgggaaattcagt

SEQ ID NO: 4622610 - DNA, 21 bp, Homo sapiens
cgggcatccacgtagggggca

SEQ ID NO: 4622611 - DNA, 21 bp, Homo sapiens
cgggccactccttcctgcccc

SEQ ID NO: 4622612 - DNA, 14 bp, Homo sapiens
cgggccagtgctcc

SEQ ID NO: 4622613 - DNA, 18 bp, Homo sapiens
cgggccagtgctccagcc

SEQ ID NO: 4622614 - DNA, 21 bp, Homo sapiens
cgggccccatcctcatccctg

SEQ ID NO: 4622615 - DNA, 15 bp, Homo sapiens
cgggcctgctgtcac

SEQ ID NO: 4622616 - DNA, 15 bp, Homo sapiens
cgggcgcactgcctc

SEQ ID NO: 4622617 - DNA, 23 bp, Homo sapiens
cgggcggaggggatccagccact

SEQ ID NO: 4622618 - DNA, 12 bp, Homo sapiens
cgggctggagaa

SEQ ID NO: 4622619 - DNA, 18 bp, Homo sapiens
cgggctggagaaagagct

SEQ ID NO: 4622620 - DNA, 22 bp, Homo sapiens
cgggctggagaaagagctgcct

SEQ ID NO: 4622621 - DNA, 18 bp, Homo sapiens
cgggcttggcctcctgct

SEQ ID NO: 4622622 - DNA, 19 bp, Homo sapiens
cgggcttggcggctctagc

SEQ ID NO: 4622623 - DNA, 17 bp, Homo sapiens
cggggaactggccaagc

SEQ ID NO: 4622624 - DNA, 20 bp, Homo sapiens
cggggaactggccaagctga

SEQ ID NO: 4622625 - DNA, 23 bp, Homo sapiens
cggggaggcccccccagaagcaa

SEQ ID NO: 4622626 - DNA, 18 bp, Homo sapiens
cggggcctgtctcagtga

SEQ ID NO: 4622627 - DNA, 21 bp, Homo sapiens
cggggctctgggtgctgccct

SEQ ID NO: 4622628 - DNA, 13 bp, Homo sapiens
cgggggcaggccg

SEQ ID NO: 4622629 - DNA, 19 bp, Homo sapiens
cgggggcaggccgggcctg

SEQ ID NO: 4622630 - DNA, 15 bp, Homo sapiens
cggggtgcacaggag

SEQ ID NO: 4622631 - DNA, 16 bp, Homo sapiens
cggggtgcccacaggc

SEQ ID NO: 4622632 - DNA, 17 bp, Homo sapiens
cgggtgtcacattcctg

SEQ ID NO: 4622633 - DNA, 14 bp, Homo sapiens
cgggttcaagcttg

SEQ ID NO: 4622634 - DNA, 13 bp, Homo sapiens
cggtaactgtcct

SEQ ID NO: 4622635 - DNA, 15 bp, Homo sapiens
cggtaactgtcctgt

SEQ ID NO: 4622636 - DNA, 17 bp, Homo sapiens
cggtaactgtcctgtcc

SEQ ID NO: 4622637 - DNA, 21 bp, Homo sapiens
cggtagccagcacacagggca

SEQ ID NO: 4622638 - DNA, 17 bp, Homo sapiens
cggtcatagtttcctga

SEQ ID NO: 4622639 - DNA, 16 bp, Homo sapiens
cggtgcagggcctggc

SEQ ID NO: 4622640 - DNA, 14 bp, Homo sapiens
cggtgcagtctggg

SEQ ID NO: 4622641 - DNA, 16 bp, Homo sapiens
cggtgcagtctgggtg

SEQ ID NO: 4622642 - DNA, 18 bp, Homo sapiens
cggtgctaaaaatgaaaa

SEQ ID NO: 4622643 - DNA, 13 bp, Homo sapiens
cggtgctgcagga

SEQ ID NO: 4622644 - DNA, 16 bp, Homo sapiens
cggtgctgcaggagtg

SEQ ID NO: 4622645 - DNA, 17 bp, Homo sapiens
cggttcccacaagcctg

SEQ ID NO: 4622646 - DNA, 19 bp, Homo sapiens
cggttcccacaagcctgcc

SEQ ID NO: 4622647 - DNA, 23 bp, Homo sapiens
cggttcccacaagcctgcctcgc

SEQ ID NO: 4622648 - DNA, 21 bp, Homo sapiens
cggttggtgacttgtctgcct

SEQ ID NO: 4622649 - DNA, 14 bp, Homo sapiens
cggttgttctttcc

SEQ ID NO: 4622650 - DNA, 21 bp, Homo sapiens
cggttgttctttcctcacatt

SEQ ID NO: 4622651 - DNA, 17 bp, Homo sapiens
cggtttcagctagacaa

SEQ ID NO: 4622652 - DNA, 19 bp, Homo sapiens
cggtttcagctagacaatg

SEQ ID NO: 4622653 - DNA, 20 bp, Homo sapiens
cgtaaatcatattttagctg

SEQ ID NO: 4622654 - DNA, 14 bp, Homo sapiens
cgtaacggccttga

SEQ ID NO: 4622655 - DNA, 19 bp, Homo sapiens
ctaatttatactttaaagt

SEQ ID NO: 4622656 - DNA, 18 bp, Homo sapiens
ctaatttttgtattattt

SEQ ID NO: 4622657 - DNA, 19 bp, Homo sapiens
ctaatttttgtattatttt

SEQ ID NO: 4622658 - DNA, 13 bp, Homo sapiens
ctacaaagcagag

SEQ ID NO: 4622659 - DNA, 12 bp, Homo sapiens
ctacaagatttc

SEQ ID NO: 4622660 - DNA, 13 bp, Homo sapiens
ctacaagatttcc

SEQ ID NO: 4622661 - DNA, 18 bp, Homo sapiens
ctacacagggcctgctat

SEQ ID NO: 4622662 - DNA, 13 bp, Homo sapiens
ctacacattttta

SEQ ID NO: 4622663 - DNA, 13 bp, Homo sapiens
ctacaccactctg

SEQ ID NO: 4622664 - DNA, 16 bp, Homo sapiens
ctacaccactctggca

SEQ ID NO: 4622665 - DNA, 20 bp, Homo sapiens
ctacaccactctggcagcca

SEQ ID NO: 4622666 - DNA, 13 bp, Homo sapiens
ctacacccaaggt

SEQ ID NO: 4622667 - DNA, 14 bp, Homo sapiens
ctacaggcctgcag

SEQ ID NO: 4622668 - DNA, 19 bp, Homo sapiens
ctacaggcctgcagcccct

SEQ ID NO: 4622669 - DNA, 16 bp, Homo sapiens
ctacaggggccagaag

SEQ ID NO: 4622670 - DNA, 16 bp, Homo sapiens
ctacagtaatgaaatg

SEQ ID NO: 4622671 - DNA, 18 bp, Homo sapiens
ctacagtaatgaaatgtt

SEQ ID NO: 4622672 - DNA, 22 bp, Homo sapiens
ctacagtaatgaaatgtttact

SEQ ID NO: 4622673 - DNA, 13 bp, Homo sapiens
ctacagtgtacag

SEQ ID NO: 4622674 - DNA, 15 bp, Homo sapiens
ctacagtgtacagtc

SEQ ID NO: 4622675 - DNA, 23 bp, Homo sapiens
ctacataagtcctttcaattcca

SEQ ID NO: 4622676 - DNA, 18 bp, Homo sapiens
ctacatatgctgatcttt

SEQ ID NO: 4622677 - DNA, 14 bp, Homo sapiens
ctacattaaaatga

SEQ ID NO: 4622678 - DNA, 16 bp, Homo sapiens
ctacattaaaatgaca

SEQ ID NO: 4622679 - DNA, 24 bp, Homo sapiens
ctacattaaaatgacaaacatgat

SEQ ID NO: 4622680 - DNA, 19 bp, Homo sapiens
ctacattttttctaataaa

SEQ ID NO: 4622681 - DNA, 18 bp, Homo sapiens
ctacccagcgtggcctcc

SEQ ID NO: 4622682 - DNA, 12 bp, Homo sapiens
ctacccttttcc

SEQ ID NO: 4622683 - DNA, 15 bp, Homo sapiens
ctacccttttccttt

SEQ ID NO: 4622684 - DNA, 17 bp, Homo sapiens
ctacccttttccttttt

SEQ ID NO: 4622685 - DNA, 23 bp, Homo sapiens
ctaccgtaattgctttgtgcctt

SEQ ID NO: 4622686 - DNA, 14 bp, Homo sapiens
ctacctgagctaaa

SEQ ID NO: 4622687 - DNA, 18 bp, Homo sapiens
ctacctggaggaatgatt

SEQ ID NO: 4622688 - DNA, 22 bp, Homo sapiens
ctaccttatcactgcattattc

SEQ ID NO: 4622689 - DNA, 15 bp, Homo sapiens
ctacgtgtgaaatct

SEQ ID NO: 4622690 - DNA, 19 bp, Homo sapiens
ctacgtgtgaaatctgtct

SEQ ID NO: 4622691 - DNA, 21 bp, Homo sapiens
ctacgtgtgaaatctgtcttt

SEQ ID NO: 4622692 - DNA, 20 bp, Homo sapiens
ctactacccattgttccctt

SEQ ID NO: 4622693 - DNA, 13 bp, Homo sapiens
ctactcacacagg

SEQ ID NO: 4622694 - DNA, 23 bp, Homo sapiens
ctactcacacaggcatttcctgg

SEQ ID NO: 4622695 - DNA, 13 bp, Homo sapiens
ctactccctcttg

SEQ ID NO: 4622696 - DNA, 17 bp, Homo sapiens
ctactccctcttgtcag

SEQ ID NO: 4622697 - DNA, 15 bp, Homo sapiens
ctactccctggacca

SEQ ID NO: 4622698 - DNA, 18 bp, Homo sapiens
ctactccctggaccacga

SEQ ID NO: 4622699 - DNA, 20 bp, Homo sapiens
ctactccctggaccacgagg

SEQ ID NO: 4622700 - DNA, 15 bp, Homo sapiens
ctactccttccctaa

SEQ ID NO: 4622701 - DNA, 18 bp, Homo sapiens
ctactctgtgccagagcc

SEQ ID NO: 4622702 - DNA, 21 bp, Homo sapiens
ctactctgtgccagagcctgg

SEQ ID NO: 4622703 - DNA, 18 bp, Homo sapiens
ctactgacaacattataa

SEQ ID NO: 4622704 - DNA, 14 bp, Homo sapiens
ctactgagaacata

SEQ ID NO: 4622705 - DNA, 16 bp, Homo sapiens
ctactgattgaatgtt

SEQ ID NO: 4622706 - DNA, 13 bp, Homo sapiens
ctactgcagcacc

SEQ ID NO: 4622707 - DNA, 18 bp, Homo sapiens
ctactgcagcacctccag

SEQ ID NO: 4622708 - DNA, 14 bp, Homo sapiens
ctactgggaaggct

SEQ ID NO: 4622709 - DNA, 16 bp, Homo sapiens
ctactgggtgtcattt

SEQ ID NO: 4622710 - DNA, 18 bp, Homo sapiens
ctactgggtgtcatttca

SEQ ID NO: 4622711 - DNA, 21 bp, Homo sapiens
ctacttctcagtccccttcaa

SEQ ID NO: 4622712 - DNA, 14 bp, Homo sapiens
ctactttaaatcct

SEQ ID NO: 4622713 - DNA, 16 bp, Homo sapiens
ctactttctattcttt

SEQ ID NO: 4622714 - DNA, 23 bp, Homo sapiens
ctagaaaacattttttttttaaa

SEQ ID NO: 4622715 - DNA, 23 bp, Homo sapiens
ctagaaatgatccccagctgttt

SEQ ID NO: 4622716 - DNA, 13 bp, Homo sapiens
ctagaaattttca

SEQ ID NO: 4622717 - DNA, 18 bp, Homo sapiens
ctagaagcctaagaactg

SEQ ID NO: 4622718 - DNA, 20 bp, Homo sapiens
ctagaattctgtattggata

SEQ ID NO: 4622719 - DNA, 21 bp, Homo sapiens
ctagaccagggctgctctttc

SEQ ID NO: 4622720 - DNA, 22 bp, Homo sapiens
ctagactaccggacactcgtca

SEQ ID NO: 4622721 - DNA, 13 bp, Homo sapiens
ctagactgtgtct

SEQ ID NO: 4622722 - DNA, 18 bp, Homo sapiens
ctagacttagattcatta

SEQ ID NO: 4622723 - DNA, 21 bp, Homo sapiens
ctagacttagattcattaact

SEQ ID NO: 4622724 - DNA, 21 bp, Homo sapiens
ctagcaaccgcctcaaaatgt

SEQ ID NO: 4622725 - DNA, 23 bp, Homo sapiens
ctagcacactcttctcttgagca

SEQ ID NO: 4622726 - DNA, 20 bp, Homo sapiens
ctagcagcaccgttctgtgc

SEQ ID NO: 4622727 - DNA, 21 bp, Homo sapiens
ctagcagcaccgttctgtgca

SEQ ID NO: 4622728 - DNA, 22 bp, Homo sapiens
ctagcagtccccagctgagtga

SEQ ID NO: 4622729 - DNA, 21 bp, Homo sapiens
ctagcagttgttgaggggagg

SEQ ID NO: 4622730 - DNA, 16 bp, Homo sapiens
ctagccaaaccaggac

SEQ ID NO: 4622731 - DNA, 23 bp, Homo sapiens
ctagccagaattctaccctggaa

SEQ ID NO: 4622732 - DNA, 16 bp, Homo sapiens
ctagcccaaaggtaag

SEQ ID NO: 4622733 - DNA, 21 bp, Homo sapiens
ctagcccctcacttccagctt

SEQ ID NO: 4622734 - DNA, 20 bp, Homo sapiens
ctagcctgatgagattttta

SEQ ID NO: 4622735 - DNA, 19 bp, Homo sapiens
ctagcctgcattgagcttg

SEQ ID NO: 4622736 - DNA, 17 bp, Homo sapiens
ctagctacttggcaggc

SEQ ID NO: 4622737 - DNA, 22 bp, Homo sapiens
ctagctctctaggcctctccag

SEQ ID NO: 4622738 - DNA, 22 bp, Homo sapiens
ctagctcttccccatctcactc

SEQ ID NO: 4622739 - DNA, 23 bp, Homo sapiens
ctagctgagaagcaatgggtcac

SEQ ID NO: 4622740 - DNA, 16 bp, Homo sapiens
ctaggaagcttggctt

SEQ ID NO: 4622741 - DNA, 14 bp, Homo sapiens
ctaggaatggagga

SEQ ID NO: 4622742 - DNA, 19 bp, Homo sapiens
ctaggaatggaggagccag

SEQ ID NO: 4622743 - DNA, 21 bp, Homo sapiens
ctaggaatggaggagccaggc

SEQ ID NO: 4622744 - DNA, 15 bp, Homo sapiens
ctaggacacagttcc

SEQ ID NO: 4622745 - DNA, 13 bp, Homo sapiens
ctaggagcaaagc

SEQ ID NO: 4622746 - DNA, 16 bp, Homo sapiens
ctaggagggctctgag

SEQ ID NO: 4622747 - DNA, 15 bp, Homo sapiens
ctaggatactgctgc

SEQ ID NO: 4622748 - DNA, 22 bp, Homo sapiens
ctaggattggagtatgatttac

SEQ ID NO: 4622749 - DNA, 16 bp, Homo sapiens
ctaggcaggacctgtg

SEQ ID NO: 4622750 - DNA, 14 bp, Homo sapiens
ctaggcaggcaaga

SEQ ID NO: 4622751 - DNA, 20 bp, Homo sapiens
ctaggccaccccaacctctg

SEQ ID NO: 4622752 - DNA, 11 bp, Homo sapiens
ctaggccaggt

SEQ ID NO: 4622753 - DNA, 22 bp, Homo sapiens
ctaggccaggtgcaaccaggga

SEQ ID NO: 4622754 - DNA, 15 bp, Homo sapiens
ctaggcctctccagt

SEQ ID NO: 4622755 - DNA, 21 bp, Homo sapiens
ctaggcgtgtttgatgcgctt

SEQ ID NO: 4622756 - DNA, 22 bp, Homo sapiens
ctaggcgtgtttgatgcgcttt

SEQ ID NO: 4622757 - DNA, 14 bp, Homo sapiens
ctaggctgctgcac

SEQ ID NO: 4622758 - DNA, 15 bp, Homo sapiens
ctaggctgctgctgt

SEQ ID NO: 4622759 - DNA, 17 bp, Homo sapiens
ctagggaggaccaaagg

SEQ ID NO: 4622760 - DNA, 20 bp, Homo sapiens
ctaggggcttggtcctaggg

SEQ ID NO: 4622761 - DNA, 18 bp, Homo sapiens
ctagggtacatgtccaca

SEQ ID NO: 4622762 - DNA, 19 bp, Homo sapiens
ctagggttaggaggtcctt

SEQ ID NO: 4622763 - DNA, 22 bp, Homo sapiens
ctaggttatacaataacccagt

SEQ ID NO: 4622764 - DNA, 23 bp, Homo sapiens
ctaggttatacaataacccagtt

SEQ ID NO: 4622765 - DNA, 21 bp, Homo sapiens
ctcagaagcctgggggcctgg

SEQ ID NO: 4622766 - DNA, 23 bp, Homo sapiens
ctcagaagcctgggggcctggct

SEQ ID NO: 4622767 - DNA, 12 bp, Homo sapiens
ctcagaagtaaa

SEQ ID NO: 4622768 - DNA, 15 bp, Homo sapiens
ctcagaagtccctgt

SEQ ID NO: 4622769 - DNA, 16 bp, Homo sapiens
ctcagagcttcctggg

SEQ ID NO: 4622770 - DNA, 21 bp, Homo sapiens
ctcagagcttcctggggacca

SEQ ID NO: 4622771 - DNA, 17 bp, Homo sapiens
ctcagaggcgcactgtg

SEQ ID NO: 4622772 - DNA, 22 bp, Homo sapiens
ctcagcaggccaaacatggcca

SEQ ID NO: 4622773 - DNA, 17 bp, Homo sapiens
ctcagcagggctggtca

SEQ ID NO: 4622774 - DNA, 20 bp, Homo sapiens
ctcagcagggctggtcacct

SEQ ID NO: 4622775 - DNA, 23 bp, Homo sapiens
ctcagcagggctggtcacctccc

SEQ ID NO: 4622776 - DNA, 23 bp, Homo sapiens
ctcagctgaatgcctcctgtggg

SEQ ID NO: 4622777 - DNA, 16 bp, Homo sapiens
ctcagctgtcctgcag

SEQ ID NO: 4622778 - DNA, 13 bp, Homo sapiens
ctcagcttttgat

SEQ ID NO: 4622779 - DNA, 14 bp, Homo sapiens
ctcaggaattcagt

SEQ ID NO: 4622780 - DNA, 14 bp, Homo sapiens
ctcaggacacaggc

SEQ ID NO: 4622781 - DNA, 20 bp, Homo sapiens
ctcaggacacaggcctgtgt

SEQ ID NO: 4622782 - DNA, 22 bp, Homo sapiens
ctcaggagatggagggcttggc

SEQ ID NO: 4622783 - DNA, 14 bp, Homo sapiens
ctcaggctctgcac

SEQ ID NO: 4622784 - DNA, 11 bp, Homo sapiens
ctcagggaccg

SEQ ID NO: 4622785 - DNA, 17 bp, Homo sapiens
ctcagggaccggtgctg

SEQ ID NO: 4622786 - DNA, 22 bp, Homo sapiens
ctcagggaccggtgctgcagga

SEQ ID NO: 4622787 - DNA, 17 bp, Homo sapiens
ctcagggcctcaggcac

SEQ ID NO: 4622788 - DNA, 18 bp, Homo sapiens
ctcagggcctcaggcacc

SEQ ID NO: 4622789 - DNA, 15 bp, Homo sapiens
ctcagtccccttcaa

SEQ ID NO: 4622790 - DNA, 22 bp, Homo sapiens
ctcagtgaagtacacctgtgtg

SEQ ID NO: 4622791 - DNA, 21 bp, Homo sapiens
ctcagtgattcgcttttggta

SEQ ID NO: 4622792 - DNA, 22 bp, Homo sapiens
ctcagtgcaaaatgtcttgtgt

SEQ ID NO: 4622793 - DNA, 17 bp, Homo sapiens
ctcagtgcaacctctgc

SEQ ID NO: 4622794 - DNA, 16 bp, Homo sapiens
ctcagtgcatttgtgc

SEQ ID NO: 4622795 - DNA, 13 bp, Homo sapiens
ctcagtttctgcc

SEQ ID NO: 4622796 - DNA, 21 bp, Homo sapiens
ctcataattcctacagcacta

SEQ ID NO: 4622797 - DNA, 18 bp, Homo sapiens
ctcatagacactgatctg

SEQ ID NO: 4622798 - DNA, 10 bp, Homo sapiens
ctcatatatt

SEQ ID NO: 4622799 - DNA, 14 bp, Homo sapiens
ctcatcccccctgc

SEQ ID NO: 4622800 - DNA, 15 bp, Homo sapiens
ctcatcccccctgct

SEQ ID NO: 4622801 - DNA, 17 bp, Homo sapiens
ctcatcccccctgctgc

SEQ ID NO: 4622802 - DNA, 19 bp, Homo sapiens
ctcatcccccctgctgccc

SEQ ID NO: 4622803 - DNA, 19 bp, Homo sapiens
ctcatctatgaggaaaggt

SEQ ID NO: 4622804 - DNA, 20 bp, Homo sapiens
ctcatctatgaggaaaggtt

SEQ ID NO: 4622805 - DNA, 21 bp, Homo sapiens
ctcatctgtggagctgccaca

SEQ ID NO: 4622806 - DNA, 13 bp, Homo sapiens
ctcatgagctcct

SEQ ID NO: 4622807 - DNA, 17 bp, Homo sapiens
ctcatgagctcctgatc

SEQ ID NO: 4622808 - DNA, 21 bp, Homo sapiens
ctcatgagctcctgatcagag

SEQ ID NO: 4622809 - DNA, 16 bp, Homo sapiens
ctcatgatcaagatat

SEQ ID NO: 4622810 - DNA, 14 bp, Homo sapiens
ctcatgcccctggc

SEQ ID NO: 4622811 - DNA, 17 bp, Homo sapiens
ctcatgtcattatgaca

SEQ ID NO: 4622812 - DNA, 17 bp, Homo sapiens
ctcatgttttccattgt

SEQ ID NO: 4622813 - DNA, 15 bp, Homo sapiens
ctcattactgggcct

SEQ ID NO: 4622814 - DNA, 16 bp, Homo sapiens
ctcattactgggcctt

SEQ ID NO: 4622815 - DNA, 20 bp, Homo sapiens
ctcattctcagagtaaaata

SEQ ID NO: 4622816 - DNA, 14 bp, Homo sapiens
ctcattgtcacctc

SEQ ID NO: 4622817 - DNA, 19 bp, Homo sapiens
ctcattgtcacctctgtga

SEQ ID NO: 4622818 - DNA, 15 bp, Homo sapiens
ctcattgtgtctccc

SEQ ID NO: 4622819 - DNA, 17 bp, Homo sapiens
ctcattgtgtctcccgt

SEQ ID NO: 4622820 - DNA, 22 bp, Homo sapiens
ctcattgtgtctcccgtgcatg

SEQ ID NO: 4622821 - DNA, 16 bp, Homo sapiens
ctcatttccagcttct

SEQ ID NO: 4622822 - DNA, 15 bp, Homo sapiens
ctccaaaccttcaca

SEQ ID NO: 4622823 - DNA, 16 bp, Homo sapiens
ctccaaaccttcacac

SEQ ID NO: 4622824 - DNA, 21 bp, Homo sapiens
ctccaaaccttcacacacaga

SEQ ID NO: 4622825 - DNA, 16 bp, Homo sapiens
ctccaagcatttcatg

SEQ ID NO: 4622826 - DNA, 18 bp, Homo sapiens
ctccacaccattcaggtc

SEQ ID NO: 4622827 - DNA, 19 bp, Homo sapiens
ctccacagcaaccccaggc

SEQ ID NO: 4622828 - DNA, 13 bp, Homo sapiens
ctccaccactgtg

SEQ ID NO: 4622829 - DNA, 16 bp, Homo sapiens
ctccaccagcctgctg

SEQ ID NO: 4622830 - DNA, 17 bp, Homo sapiens
ctccaccagcctgctga

SEQ ID NO: 4622831 - DNA, 22 bp, Homo sapiens
ctccaccagcctgctgacagac

SEQ ID NO: 4622832 - DNA, 16 bp, Homo sapiens
ctccaccctccacctt

SEQ ID NO: 4622833 - DNA, 14 bp, Homo sapiens
ctccaccctcccag

SEQ ID NO: 4622834 - DNA, 18 bp, Homo sapiens
ctccaccctcccagacct

SEQ ID NO: 4622835 - DNA, 15 bp, Homo sapiens
ctccaccctggccga

SEQ ID NO: 4622836 - DNA, 18 bp, Homo sapiens
ctccactcagctgtcctg

SEQ ID NO: 4622837 - DNA, 11 bp, Homo sapiens
ctccactgctg

SEQ ID NO: 4622838 - DNA, 21 bp, Homo sapiens
ctccagatgcagggcagtcat

SEQ ID NO: 4622839 - DNA, 12 bp, Homo sapiens
ctccagcccctg

SEQ ID NO: 4622840 - DNA, 12 bp, Homo sapiens
ctccagcctggg

SEQ ID NO: 4622841 - DNA, 13 bp, Homo sapiens
ctccagcctgggg

SEQ ID NO: 4622842 - DNA, 16 bp, Homo sapiens
ctccagctttcctgta

SEQ ID NO: 4622843 - DNA, 23 bp, Homo sapiens
ctccaggattttaatttcaggaa

SEQ ID NO: 4622844 - DNA, 15 bp, Homo sapiens
ctccaggcctgcagc

SEQ ID NO: 4622845 - DNA, 17 bp, Homo sapiens
ctccaggcctgcagcag

SEQ ID NO: 4622846 - DNA, 17 bp, Homo sapiens
ctccaggggcctgcaga

SEQ ID NO: 4622847 - DNA, 18 bp, Homo sapiens
ctccaggggcctgcagaa

SEQ ID NO: 4622848 - DNA, 16 bp, Homo sapiens
ctccagggtacatgct

SEQ ID NO: 4622849 - DNA, 14 bp, Homo sapiens
ctccagtgccaaca

SEQ ID NO: 4622850 - DNA, 22 bp, Homo sapiens
ctccataaccccacccttgccc

SEQ ID NO: 4622851 - DNA, 20 bp, Homo sapiens
ctccataatttggtcatttg

SEQ ID NO: 4622852 - DNA, 23 bp, Homo sapiens
ctccatattaaaacatatgacca

SEQ ID NO: 4622853 - DNA, 19 bp, Homo sapiens
ctccatatttgatttctaa

SEQ ID NO: 4622854 - DNA, 17 bp, Homo sapiens
ctccatctttttcttgg

SEQ ID NO: 4622855 - DNA, 18 bp, Homo sapiens
ctccatctttttcttggg

SEQ ID NO: 4622856 - DNA, 19 bp, Homo sapiens
ctccatctttttcttgggt

SEQ ID NO: 4622857 - DNA, 15 bp, Homo sapiens
ctccattcactccca

SEQ ID NO: 4622858 - DNA, 17 bp, Homo sapiens
ctccattcccacccctc

SEQ ID NO: 4622859 - DNA, 24 bp, Homo sapiens
ctccattcccgtggaacgtttttc

SEQ ID NO: 4622860 - DNA, 13 bp, Homo sapiens
ctccattccctag

SEQ ID NO: 4622861 - DNA, 14 bp, Homo sapiens
ctccatttaagaca

SEQ ID NO: 4622862 - DNA, 15 bp, Homo sapiens
ctcccaaatgagcca

SEQ ID NO: 4622863 - DNA, 22 bp, Homo sapiens
ctcccaaccctgggctggggag

SEQ ID NO: 4622864 - DNA, 20 bp, Homo sapiens
ctcccaactcccttctgctt

SEQ ID NO: 4622865 - DNA, 17 bp, Homo sapiens
ctcccaagcccctgacc

SEQ ID NO: 4622866 - DNA, 18 bp, Homo sapiens
ctcccaatggtgcttgga

SEQ ID NO: 4622867 - DNA, 18 bp, Homo sapiens
ctcccacctagcagcacc

SEQ ID NO: 4622868 - DNA, 17 bp, Homo sapiens
ctcccagcaagacctca

SEQ ID NO: 4622869 - DNA, 15 bp, Homo sapiens
ctcccagcccattgc

SEQ ID NO: 4622870 - DNA, 20 bp, Homo sapiens
ctcccagcccattgctgcca

SEQ ID NO: 4622871 - DNA, 12 bp, Homo sapiens
ctcccaggcccc

SEQ ID NO: 4622872 - DNA, 16 bp, Homo sapiens
ctcccaggccccatga

SEQ ID NO: 4622873 - DNA, 21 bp, Homo sapiens
ctcccaggccccatgacctcc

SEQ ID NO: 4622874 - DNA, 20 bp, Homo sapiens
ctcccagggccatgaacttt

SEQ ID NO: 4622875 - DNA, 21 bp, Homo sapiens
ctcccagggccatgaactttg

SEQ ID NO: 4622876 - DNA, 18 bp, Homo sapiens
ctcccaggtgagaattca

SEQ ID NO: 4622877 - DNA, 14 bp, Homo sapiens
ctcccatccagggc

SEQ ID NO: 4622878 - DNA, 17 bp, Homo sapiens
ctcccatcctggggcag

SEQ ID NO: 4622879 - DNA, 18 bp, Homo sapiens
ctcccatcctggggcagc

SEQ ID NO: 4622880 - DNA, 16 bp, Homo sapiens
ctccccactctgctct

SEQ ID NO: 4622881 - DNA, 21 bp, Homo sapiens
ctccccactctgctctgatgc

SEQ ID NO: 4622882 - DNA, 22 bp, Homo sapiens
ctccccactctgctctgatgca

SEQ ID NO: 4622883 - DNA, 16 bp, Homo sapiens
ctccccagagctgtgc

SEQ ID NO: 4622884 - DNA, 22 bp, Homo sapiens
ctccccagagctgtgccagcag

SEQ ID NO: 4622885 - DNA, 23 bp, Homo sapiens
ctccccagagctgtgccagcagg

SEQ ID NO: 4622886 - DNA, 15 bp, Homo sapiens
ctccccagcccagga

SEQ ID NO: 4622887 - DNA, 14 bp, Homo sapiens
ctccccatctgtgt

SEQ ID NO: 4622888 - DNA, 13 bp, Homo sapiens
ctcccccaggcag

SEQ ID NO: 4622889 - DNA, 17 bp, Homo sapiens
ctccccctgctccccta

SEQ ID NO: 4622890 - DNA, 14 bp, Homo sapiens
ctcccctccccatc

SEQ ID NO: 4622891 - DNA, 17 bp, Homo sapiens
ctcccctccccatctgt

SEQ ID NO: 4622892 - DNA, 17 bp, Homo sapiens
ctcccctgacctgtgag

SEQ ID NO: 4622893 - DNA, 12 bp, Homo sapiens
ctcccctgggac

SEQ ID NO: 4622894 - DNA, 13 bp, Homo sapiens
ctcccctgggact

SEQ ID NO: 4622895 - DNA, 14 bp, Homo sapiens
ctcccgccaggagc

SEQ ID NO: 4622896 - DNA, 15 bp, Homo sapiens
ctccctagctctgaa

SEQ ID NO: 4622897 - DNA, 19 bp, Homo sapiens
ctccctagctcttccccat

SEQ ID NO: 4622898 - DNA, 16 bp, Homo sapiens
ctccctaggcccaagt

SEQ ID NO: 4622899 - DNA, 12 bp, Homo sapiens
ctccctcctttc

SEQ ID NO: 4622900 - DNA, 21 bp, Homo sapiens
ctccctctctcctggactggt

SEQ ID NO: 4622901 - DNA, 13 bp, Homo sapiens
ctccctgcctcac

SEQ ID NO: 4622902 - DNA, 13 bp, Homo sapiens
ctccctgtgtcca

SEQ ID NO: 4622903 - DNA, 20 bp, Homo sapiens
ctcccttacccatcttgctt

SEQ ID NO: 4622904 - DNA, 23 bp, Homo sapiens
ctcccttacccatcttgcttcca

SEQ ID NO: 4622905 - DNA, 22 bp, Homo sapiens
ctcccttcaagacgaggggcag

SEQ ID NO: 4622906 - DNA, 15 bp, Homo sapiens
ctccctttttgggta

SEQ ID NO: 4622907 - DNA, 20 bp, Homo sapiens
ctccgacgctgcctctcatt

SEQ ID NO: 4622908 - DNA, 16 bp, Homo sapiens
ctccgcatactgagaa

SEQ ID NO: 4622909 - DNA, 14 bp, Homo sapiens
ctccgccagccaca

SEQ ID NO: 4622910 - DNA, 16 bp, Homo sapiens
ctccgccagccacagg

SEQ ID NO: 4622911 - DNA, 19 bp, Homo sapiens
ctccgccagccacaggacc

SEQ ID NO: 4622912 - DNA, 15 bp, Homo sapiens
ctcctaggttttcct

SEQ ID NO: 4622913 - DNA, 15 bp, Homo sapiens
ctcctatatatttct

SEQ ID NO: 4622914 - DNA, 21 bp, Homo sapiens
ctcctcaatttttgtctcaga

SEQ ID NO: 4622915 - DNA, 15 bp, Homo sapiens
ctcctcacacaccct

SEQ ID NO: 4622916 - DNA, 10 bp, Homo sapiens
ctcctcactc

SEQ ID NO: 4622917 - DNA, 13 bp, Homo sapiens
ctcctcactccct

SEQ ID NO: 4622918 - DNA, 19 bp, Homo sapiens
ctcctcactccctaggccc

SEQ ID NO: 4622919 - DNA, 18 bp, Homo sapiens
ctcctccagcccctgtcc

SEQ ID NO: 4622920 - DNA, 15 bp, Homo sapiens
ctcctccattttcct

SEQ ID NO: 4622921 - DNA, 15 bp, Homo sapiens
ctcctcctcctccct

SEQ ID NO: 4622922 - DNA, 19 bp, Homo sapiens
ctcctccttggtgcctggc

SEQ ID NO: 4622923 - DNA, 20 bp, Homo sapiens
ctcctctccattttagccca

SEQ ID NO: 4622924 - DNA, 15 bp, Homo sapiens
ctcctctccctccca

SEQ ID NO: 4622925 - DNA, 15 bp, Homo sapiens
ctcctctctccctgc

SEQ ID NO: 4622926 - DNA, 23 bp, Homo sapiens
ctcctctgccagcaggaataaag

SEQ ID NO: 4622927 - DNA, 14 bp, Homo sapiens
ctcctgaggacagc

SEQ ID NO: 4622928 - DNA, 16 bp, Homo sapiens
ctcctgaggacagctg

SEQ ID NO: 4622929 - DNA, 21 bp, Homo sapiens
ctcctgaggacagctgtcctc

SEQ ID NO: 4622930 - DNA, 20 bp, Homo sapiens
ctcctgagtagctgggatta

SEQ ID NO: 4622931 - DNA, 16 bp, Homo sapiens
ctcctgatcagaggca

SEQ ID NO: 4622932 - DNA, 16 bp, Homo sapiens
ctcctgccagcccagc

SEQ ID NO: 4622933 - DNA, 19 bp, Homo sapiens
ctcctgccagcccagctgg

SEQ ID NO: 4622934 - DNA, 23 bp, Homo sapiens
ctcctgcccgcagacctctggat

SEQ ID NO: 4622935 - DNA, 22 bp, Homo sapiens
ctcctgcctctactgggaaggc

SEQ ID NO: 4622936 - DNA, 13 bp, Homo sapiens
ctcctgggaaagg

SEQ ID NO: 4622937 - DNA, 15 bp, Homo sapiens
ctcctggtgccacct

SEQ ID NO: 4622938 - DNA, 19 bp, Homo sapiens
ctcctgtccaaagtaggga

SEQ ID NO: 4622939 - DNA, 15 bp, Homo sapiens
ctcctgtgggagcct

SEQ ID NO: 4622940 - DNA, 17 bp, Homo sapiens
ctcctgtgggagcctcg

SEQ ID NO: 4622941 - DNA, 19 bp, Homo sapiens
ctcctgtgggagcctcgca

SEQ ID NO: 4622942 - DNA, 14 bp, Homo sapiens
ctccttcagttctg

SEQ ID NO: 4622943 - DNA, 15 bp, Homo sapiens
ctccttccatccttg

SEQ ID NO: 4622944 - DNA, 12 bp, Homo sapiens
ctccttccccag

SEQ ID NO: 4622945 - DNA, 20 bp, Homo sapiens
ctccttccctaatagctttt

SEQ ID NO: 4622946 - DNA, 13 bp, Homo sapiens
ctccttcctgccc

SEQ ID NO: 4622947 - DNA, 14 bp, Homo sapiens
ctccttccttccca

SEQ ID NO: 4622948 - DNA, 23 bp, Homo sapiens
ctccttctgcaaagtggcaggga

SEQ ID NO: 4622949 - DNA, 21 bp, Homo sapiens
ctccttggctttatgcaaata

SEQ ID NO: 4622950 - DNA, 23 bp, Homo sapiens
ctccttggctttatgcaaataca

SEQ ID NO: 4622951 - DNA, 14 bp, Homo sapiens
ctccttggtgcctg

SEQ ID NO: 4622952 - DNA, 19 bp, Homo sapiens
ctccttggtgcctggcctg

SEQ ID NO: 4622953 - DNA, 22 bp, Homo sapiens
ctccttggtgcctggcctggca

SEQ ID NO: 4622954 - DNA, 15 bp, Homo sapiens
ctcgaatttgaagag

SEQ ID NO: 4622955 - DNA, 19 bp, Homo sapiens
ctcgaatttgaagagattg

SEQ ID NO: 4622956 - DNA, 21 bp, Homo sapiens
ctcgaccctgtcccctaggga

SEQ ID NO: 4622957 - DNA, 22 bp, Homo sapiens
ctcgaccctgtcccctagggac

SEQ ID NO: 4622958 - DNA, 14 bp, Homo sapiens
ctcgatttctccag

SEQ ID NO: 4622959 - DNA, 12 bp, Homo sapiens
ctcgcaacccgt

SEQ ID NO: 4622960 - DNA, 21 bp, Homo sapiens
ctcgcaacccgtgccaagtcc

SEQ ID NO: 4622961 - DNA, 12 bp, Homo sapiens
ctcgcaggaaga

SEQ ID NO: 4622962 - DNA, 13 bp, Homo sapiens
ctcgcaggaagac

SEQ ID NO: 4622963 - DNA, 14 bp, Homo sapiens
ctcgcatcttccca

SEQ ID NO: 4622964 - DNA, 14 bp, Homo sapiens
ctcgccccaaagtt

SEQ ID NO: 4622965 - DNA, 20 bp, Homo sapiens
ctcgccctgcggtagatggg

SEQ ID NO: 4622966 - DNA, 17 bp, Homo sapiens
ctcgcctatcttaggta

SEQ ID NO: 4622967 - DNA, 13 bp, Homo sapiens
ctcgcctgaggga

SEQ ID NO: 4622968 - DNA, 15 bp, Homo sapiens
ctcgctccccactct

SEQ ID NO: 4622969 - DNA, 16 bp, Homo sapiens
ctcgctccccactctg

SEQ ID NO: 4622970 - DNA, 16 bp, Homo sapiens
ctcgctctgttaccca

SEQ ID NO: 4622971 - DNA, 14 bp, Homo sapiens
ctcgctgggctcta

SEQ ID NO: 4622972 - DNA, 21 bp, Homo sapiens
ctcgctttttcatccttcttt

SEQ ID NO: 4622973 - DNA, 19 bp, Homo sapiens
ctcggacttactgcctgac

SEQ ID NO: 4622974 - DNA, 23 bp, Homo sapiens
ctcggagggatggagaaagaagt

SEQ ID NO: 4622975 - DNA, 19 bp, Homo sapiens
ctcggatgacaccctggcc

SEQ ID NO: 4622976 - DNA, 18 bp, Homo sapiens
ctcggctcagtgcaacct

SEQ ID NO: 4622977 - DNA, 22 bp, Homo sapiens
ctcggctcagtgcaacctctgc

SEQ ID NO: 4622978 - DNA, 18 bp, Homo sapiens
ctcgggctggagcctccg

SEQ ID NO: 4622979 - DNA, 19 bp, Homo sapiens
ctcggggtgcacaggaggg

SEQ ID NO: 4622980 - DNA, 14 bp, Homo sapiens
ctcggggtgggggt

SEQ ID NO: 4622981 - DNA, 15 bp, Homo sapiens
ctcggtttgccaaaa

SEQ ID NO: 4622982 - DNA, 16 bp, Homo sapiens
ctcggtttgccaaaat

SEQ ID NO: 4622983 - DNA, 17 bp, Homo sapiens
ctcgtggtaggactgta

SEQ ID NO: 4622984 - DNA, 14 bp, Homo sapiens
ctcgttctccctgg

SEQ ID NO: 4622985 - DNA, 23 bp, Homo sapiens
ctctaaattaaagagaaaattga

SEQ ID NO: 4622986 - DNA, 15 bp, Homo sapiens
ctctaacgcctgagc

SEQ ID NO: 4622987 - DNA, 20 bp, Homo sapiens
ctctaacgcctgagcccagg

SEQ ID NO: 4622988 - DNA, 21 bp, Homo sapiens
ctctaacgcctgagcccaggg

SEQ ID NO: 4622989 - DNA, 22 bp, Homo sapiens
ctctaacgcctgagcccaggga

SEQ ID NO: 4622990 - DNA, 22 bp, Homo sapiens
ctctaagcccaggatctctttc

SEQ ID NO: 4622991 - DNA, 13 bp, Homo sapiens
ctctaatctggat

SEQ ID NO: 4622992 - DNA, 13 bp, Homo sapiens
ctctacaggcctg

SEQ ID NO: 4622993 - DNA, 17 bp, Homo sapiens
ctctacaggcctgcagc

SEQ ID NO: 4622994 - DNA, 20 bp, Homo sapiens
ctctacaggcctgcagcccc

SEQ ID NO: 4622995 - DNA, 17 bp, Homo sapiens
ctctaggcctctccagt

SEQ ID NO: 4622996 - DNA, 15 bp, Homo sapiens
ctctaggttatacaa

SEQ ID NO: 4622997 - DNA, 16 bp, Homo sapiens
ctctaggttatacaat

SEQ ID NO: 4622998 - DNA, 19 bp, Homo sapiens
ctctagtgggacagcccag

SEQ ID NO: 4622999 - DNA, 22 bp, Homo sapiens
ctctagtgggacagcccagagc

SEQ ID NO: 4623000 - DNA, 14 bp, Homo sapiens
ctctcaaagtataa

SEQ ID NO: 4623001 - DNA, 17 bp, Homo sapiens
ctctcacagctgagttg

SEQ ID NO: 4623002 - DNA, 19 bp, Homo sapiens
ctctcaccatgatgtgaag

SEQ ID NO: 4623003 - DNA, 22 bp, Homo sapiens
ctctcaccatgatgtgaagagt

SEQ ID NO: 4623004 - DNA, 21 bp, Homo sapiens
ctctcatggtacttcctctgt

SEQ ID NO: 4623005 - DNA, 13 bp, Homo sapiens
ctctcatttccag

SEQ ID NO: 4623006 - DNA, 14 bp, Homo sapiens
ctctcatttccagc

SEQ ID NO: 4623007 - DNA, 16 bp, Homo sapiens
ctctcatttccagctt

SEQ ID NO: 4623008 - DNA, 19 bp, Homo sapiens
ctctcatttccagcttctc

SEQ ID NO: 4623009 - DNA, 20 bp, Homo sapiens
ctctcatttccagcttctca

SEQ ID NO: 4623010 - DNA, 13 bp, Homo sapiens
ctctccataaccc

SEQ ID NO: 4623011 - DNA, 18 bp, Homo sapiens
ctctccataaccccaccc

SEQ ID NO: 4623012 - DNA, 21 bp, Homo sapiens
ctctccattcccgtggaacgt

SEQ ID NO: 4623013 - DNA, 19 bp, Homo sapiens
ctctccattttagcccagt

SEQ ID NO: 4623014 - DNA, 14 bp, Homo sapiens
ctctcccatcctgg

SEQ ID NO: 4623015 - DNA, 11 bp, Homo sapiens
ctctcccctcc

SEQ ID NO: 4623016 - DNA, 17 bp, Homo sapiens
ctctcccctccccatct

SEQ ID NO: 4623017 - DNA, 17 bp, Homo sapiens
ctctcccctgacctgtg

SEQ ID NO: 4623018 - DNA, 15 bp, Homo sapiens
ctctccctgcctcac

SEQ ID NO: 4623019 - DNA, 17 bp, Homo sapiens
ctctcgaccggccctgc

SEQ ID NO: 4623020 - DNA, 19 bp, Homo sapiens
ctctcgaccggccctgcat

SEQ ID NO: 4623021 - DNA, 15 bp, Homo sapiens
ctctctagaatgagc

SEQ ID NO: 4623022 - DNA, 19 bp, Homo sapiens
ctctctagaatgagcaaga

SEQ ID NO: 4623023 - DNA, 14 bp, Homo sapiens
ctctctaggcctct

SEQ ID NO: 4623024 - DNA, 18 bp, Homo sapiens
ctctctccctgcctcaca

SEQ ID NO: 4623025 - DNA, 13 bp, Homo sapiens
ctctctcttgcct

SEQ ID NO: 4623026 - DNA, 19 bp, Homo sapiens
ctctctgagtcctggccca

SEQ ID NO: 4623027 - DNA, 16 bp, Homo sapiens
ctctctgggcctcaga

SEQ ID NO: 4623028 - DNA, 20 bp, Homo sapiens
ctctctgggcctcagaggcc

SEQ ID NO: 4623029 - DNA, 21 bp, Homo sapiens
ctctctgttttgtgccagtgc

SEQ ID NO: 4623030 - DNA, 13 bp, Homo sapiens
ctctcttctccat

SEQ ID NO: 4623031 - DNA, 15 bp, Homo sapiens
ctctcttctccattc

SEQ ID NO: 4623032 - DNA, 18 bp, Homo sapiens
ctctcttgcctgagggga

SEQ ID NO: 4623033 - DNA, 13 bp, Homo sapiens
ctctcttttaaag

SEQ ID NO: 4623034 - DNA, 19 bp, Homo sapiens
ctctgaagaactctctgga

SEQ ID NO: 4623035 - DNA, 15 bp, Homo sapiens
ctctgaagggacccc

SEQ ID NO: 4623036 - DNA, 15 bp, Homo sapiens
ctctgaattttcaga

SEQ ID NO: 4623037 - DNA, 17 bp, Homo sapiens
ctctgaattttcagaga

SEQ ID NO: 4623038 - DNA, 13 bp, Homo sapiens
ctctgacaagctg

SEQ ID NO: 4623039 - DNA, 19 bp, Homo sapiens
ctctgacaagctggccaaa

SEQ ID NO: 4623040 - DNA, 23 bp, Homo sapiens
ctctgactagtagatttctatga

SEQ ID NO: 4623041 - DNA, 16 bp, Homo sapiens
ctctgagaagctctga

SEQ ID NO: 4623042 - DNA, 13 bp, Homo sapiens
ctctgagaggccc

SEQ ID NO: 4623043 - DNA, 10 bp, Homo sapiens
ctctgaggcg

SEQ ID NO: 4623044 - DNA, 22 bp, Homo sapiens
ctctgaggcgccccaacccgtg

SEQ ID NO: 4623045 - DNA, 23 bp, Homo sapiens
ctctgaggcgccccaacccgtgg

SEQ ID NO: 4623046 - DNA, 13 bp, Homo sapiens
ctctgagttctgg

SEQ ID NO: 4623047 - DNA, 21 bp, Homo sapiens
ctctgatagctgtttcaaatg

SEQ ID NO: 4623048 - DNA, 15 bp, Homo sapiens
ctctgatgcatcaga

SEQ ID NO: 4623049 - DNA, 20 bp, Homo sapiens
ctctgatgcatcagaaaggg

SEQ ID NO: 4623050 - DNA, 21 bp, Homo sapiens
ctctgcacagacaagcagccc

SEQ ID NO: 4623051 - DNA, 22 bp, Homo sapiens
ctctgcacagacaagcagccct

SEQ ID NO: 4623052 - DNA, 13 bp, Homo sapiens
ctctgcacatgtc

SEQ ID NO: 4623053 - DNA, 16 bp, Homo sapiens
ctctgcacatgtcttg

SEQ ID NO: 4623054 - DNA, 17 bp, Homo sapiens
ctctgcccaggcaagga

SEQ ID NO: 4623055 - DNA, 21 bp, Homo sapiens
ctctgcccaggcaaggaacag

SEQ ID NO: 4623056 - DNA, 16 bp, Homo sapiens
ctctgccccaagagca

SEQ ID NO: 4623057 - DNA, 11 bp, Homo sapiens
ctctgccccag

SEQ ID NO: 4623058 - DNA, 15 bp, Homo sapiens
ctctgccccaggccc

SEQ ID NO: 4623059 - DNA, 13 bp, Homo sapiens
ctctgccccttcc

SEQ ID NO: 4623060 - DNA, 15 bp, Homo sapiens
ctctgccccttgccc

SEQ ID NO: 4623061 - DNA, 17 bp, Homo sapiens
ctctgccgccgcccgct

SEQ ID NO: 4623062 - DNA, 12 bp, Homo sapiens
ctctgcctcctg

SEQ ID NO: 4623063 - DNA, 16 bp, Homo sapiens
ctctgcctcctgggtt

SEQ ID NO: 4623064 - DNA, 23 bp, Homo sapiens
ctctgcctcctgggttcacgtaa

SEQ ID NO: 4623065 - DNA, 11 bp, Homo sapiens
ctctgcctggc

SEQ ID NO: 4623066 - DNA, 12 bp, Homo sapiens
ctctgcctggca

SEQ ID NO: 4623067 - DNA, 17 bp, Homo sapiens
ctctgcctgggatgccc

SEQ ID NO: 4623068 - DNA, 18 bp, Homo sapiens
ctctgcctgggatgccct

SEQ ID NO: 4623069 - DNA, 23 bp, Homo sapiens
ctctgcctgggatgcccttcccc

SEQ ID NO: 4623070 - DNA, 14 bp, Homo sapiens
ctctgcctgtctgg

SEQ ID NO: 4623071 - DNA, 12 bp, Homo sapiens
ctctgctctgat

SEQ ID NO: 4623072 - DNA, 22 bp, Homo sapiens
ctctgcttccgttcctccccct

SEQ ID NO: 4623073 - DNA, 23 bp, Homo sapiens
ctctggaaaggaggaaggagcct

SEQ ID NO: 4623074 - DNA, 22 bp, Homo sapiens
ctctggaataaagttgcagatg

SEQ ID NO: 4623075 - DNA, 15 bp, Homo sapiens
ctctggactccacgg

SEQ ID NO: 4623076 - DNA, 13 bp, Homo sapiens
ctctggagaacag

SEQ ID NO: 4623077 - DNA, 18 bp, Homo sapiens
ctctggagaacagtggtt

SEQ ID NO: 4623078 - DNA, 17 bp, Homo sapiens
ctctggattaggtctct

SEQ ID NO: 4623079 - DNA, 13 bp, Homo sapiens
ctctggcagccac

SEQ ID NO: 4623080 - DNA, 17 bp, Homo sapiens
ctctggcagccacactt

SEQ ID NO: 4623081 - DNA, 22 bp, Homo sapiens
ctctggcagccacacttctcag

SEQ ID NO: 4623082 - DNA, 14 bp, Homo sapiens
ctctggccctggcc

SEQ ID NO: 4623083 - DNA, 16 bp, Homo sapiens
ctctggccctggccct

SEQ ID NO: 4623084 - DNA, 15 bp, Homo sapiens
ctctggctactccct

SEQ ID NO: 4623085 - DNA, 14 bp, Homo sapiens
ctctgggaccccag

SEQ ID NO: 4623086 - DNA, 18 bp, Homo sapiens
ctctgggaccccagctgc

SEQ ID NO: 4623087 - DNA, 16 bp, Homo sapiens
ctctgggtgctgccct

SEQ ID NO: 4623088 - DNA, 14 bp, Homo sapiens
ctctggtcctacca

SEQ ID NO: 4623089 - DNA, 19 bp, Homo sapiens
ctctgtcagtcacagccac

SEQ ID NO: 4623090 - DNA, 18 bp, Homo sapiens
ctctgtctcgagcgccct

SEQ ID NO: 4623091 - DNA, 20 bp, Homo sapiens
ctctgtctcgagcgccctgc

SEQ ID NO: 4623092 - DNA, 21 bp, Homo sapiens
ctctgtcttttggagaaccag

SEQ ID NO: 4623093 - DNA, 22 bp, Homo sapiens
ctctgtgaactgtgtgtgaatc

SEQ ID NO: 4623094 - DNA, 21 bp, Homo sapiens
ctctgtgaatccatgggtctg

SEQ ID NO: 4623095 - DNA, 14 bp, Homo sapiens
ctctgtgccagagc

SEQ ID NO: 4623096 - DNA, 19 bp, Homo sapiens
ctctgtgccagagcctggg

SEQ ID NO: 4623097 - DNA, 12 bp, Homo sapiens
ctctgtgtgtgt

SEQ ID NO: 4623098 - DNA, 22 bp, Homo sapiens
ctctgttacccagggtggagtg

SEQ ID NO: 4623099 - DNA, 18 bp, Homo sapiens
ctctgttcagtgtaaata

SEQ ID NO: 4623100 - DNA, 21 bp, Homo sapiens
ctctgttcatttcacacagtg

SEQ ID NO: 4623101 - DNA, 17 bp, Homo sapiens
ctctgttgactggctgt

SEQ ID NO: 4623102 - DNA, 13 bp, Homo sapiens
ctctgttgcctcc

SEQ ID NO: 4623103 - DNA, 15 bp, Homo sapiens
ctctgttgcctcctc

SEQ ID NO: 4623104 - DNA, 18 bp, Homo sapiens
ctctgttgcctcctctct

SEQ ID NO: 4623105 - DNA, 19 bp, Homo sapiens
ctcttacagtgtttggaca

SEQ ID NO: 4623106 - DNA, 21 bp, Homo sapiens
ctcttagagattttcatttta

SEQ ID NO: 4623107 - DNA, 16 bp, Homo sapiens
ctcttatttatagaat

SEQ ID NO: 4623108 - DNA, 21 bp, Homo sapiens
ctcttcagtgactcctgctgg

SEQ ID NO: 4623109 - DNA, 22 bp, Homo sapiens
ctcttcagtgactcctgctggt

SEQ ID NO: 4623110 - DNA, 23 bp, Homo sapiens
ctcttcagtgactcctgctggta

SEQ ID NO: 4623111 - DNA, 17 bp, Homo sapiens
ctcttccactccttctc

SEQ ID NO: 4623112 - DNA, 15 bp, Homo sapiens
ctcttcccccttcca

SEQ ID NO: 4623113 - DNA, 11 bp, Homo sapiens
ctcttcccttg

SEQ ID NO: 4623114 - DNA, 15 bp, Homo sapiens
ctcttcccttgctca

SEQ ID NO: 4623115 - DNA, 21 bp, Homo sapiens
ctcttctaaaatagcaataac

SEQ ID NO: 4623116 - DNA, 15 bp, Homo sapiens
ctcttctcagccact

SEQ ID NO: 4623117 - DNA, 17 bp, Homo sapiens
ctcttctccattcccta

SEQ ID NO: 4623118 - DNA, 20 bp, Homo sapiens
ctcttctccattccctagca

SEQ ID NO: 4623119 - DNA, 17 bp, Homo sapiens
ctcttctgactgccccc

SEQ ID NO: 4623120 - DNA, 20 bp, Homo sapiens
ctcttgaaatattcagaaat

SEQ ID NO: 4623121 - DNA, 21 bp, Homo sapiens
ctcttgaaatattcagaaatt

SEQ ID NO: 4623122 - DNA, 19 bp, Homo sapiens
ctcttgaataaaaataact

SEQ ID NO: 4623123 - DNA, 13 bp, Homo sapiens
ctcttgaggagct

SEQ ID NO: 4623124 - DNA, 18 bp, Homo sapiens
ctcttgattgatttttaa

SEQ ID NO: 4623125 - DNA, 18 bp, Homo sapiens
ctcttgatttcacatttc

SEQ ID NO: 4623126 - DNA, 15 bp, Homo sapiens
ctcttgctctcgacc

SEQ ID NO: 4623127 - DNA, 15 bp, Homo sapiens
ctcttggctggcttc

SEQ ID NO: 4623128 - DNA, 14 bp, Homo sapiens
ctcttgtaaagact

SEQ ID NO: 4623129 - DNA, 16 bp, Homo sapiens
ctcttgtaaagactgg

SEQ ID NO: 4623130 - DNA, 19 bp, Homo sapiens
ctcttgtcacccaggctgg

SEQ ID NO: 4623131 - DNA, 12 bp, Homo sapiens
ctcttgtgattt

SEQ ID NO: 4623132 - DNA, 22 bp, Homo sapiens
ctcttgtgatttctttaaaaga

SEQ ID NO: 4623133 - DNA, 21 bp, Homo sapiens
ctctttattttaaaaaacact

SEQ ID NO: 4623134 - DNA, 22 bp, Homo sapiens
ctctttattttcccctatcatt

SEQ ID NO: 4623135 - DNA, 16 bp, Homo sapiens
ctctttccaaattaaa

SEQ ID NO: 4623136 - DNA, 19 bp, Homo sapiens
ctctttccacttgccctgt

SEQ ID NO: 4623137 - DNA, 16 bp, Homo sapiens
ctctttccccaaggac

SEQ ID NO: 4623138 - DNA, 12 bp, Homo sapiens
ctctttccctgc

SEQ ID NO: 4623139 - DNA, 12 bp, Homo sapiens
ctctttctgttt

SEQ ID NO: 4623140 - DNA, 17 bp, Homo sapiens
ctctttctgtttcctgg

SEQ ID NO: 4623141 - DNA, 17 bp, Homo sapiens
ctctttctttctctttc

SEQ ID NO: 4623142 - DNA, 17 bp, Homo sapiens
ctctttgagaccccagt

SEQ ID NO: 4623143 - DNA, 19 bp, Homo sapiens
ctctttgagaccccagtgc

SEQ ID NO: 4623144 - DNA, 14 bp, Homo sapiens
ctctttgtctaaaa

SEQ ID NO: 4623145 - DNA, 15 bp, Homo sapiens
ctcttttaaagtatt

SEQ ID NO: 4623146 - DNA, 19 bp, Homo sapiens
ctcttttaatggcatttct

SEQ ID NO: 4623147 - DNA, 23 bp, Homo sapiens
ctgaaaagggcactcccaaccct

SEQ ID NO: 4623148 - DNA, 13 bp, Homo sapiens
ctgaaaatccaat

SEQ ID NO: 4623149 - DNA, 16 bp, Homo sapiens
ctgaaacaaaatgttt

SEQ ID NO: 4623150 - DNA, 18 bp, Homo sapiens
ctgaaatcaactctcttc

SEQ ID NO: 4623151 - DNA, 20 bp, Homo sapiens
ctgaaatgttcttaaatttt

SEQ ID NO: 4623152 - DNA, 12 bp, Homo sapiens
ctgaaccatgtg

SEQ ID NO: 4623153 - DNA, 16 bp, Homo sapiens
ctgaactacaagtgta

SEQ ID NO: 4623154 - DNA, 21 bp, Homo sapiens
ctgaagaaggaaggcctgagc

SEQ ID NO: 4623155 - DNA, 23 bp, Homo sapiens
ctgaagaaggaaggcctgagccc

SEQ ID NO: 4623156 - DNA, 16 bp, Homo sapiens
ctgaagcgaacatctt

SEQ ID NO: 4623157 - DNA, 17 bp, Homo sapiens
ctgaagcgaacatcttc

SEQ ID NO: 4623158 - DNA, 18 bp, Homo sapiens
ctgaagcgaacatcttca

SEQ ID NO: 4623159 - DNA, 22 bp, Homo sapiens
ctgaaggaaaagcaagaaacag

SEQ ID NO: 4623160 - DNA, 23 bp, Homo sapiens
ctgaaggaaaagcaagaaacagt

SEQ ID NO: 4623161 - DNA, 16 bp, Homo sapiens
ctgaaggcacagctaa

SEQ ID NO: 4623162 - DNA, 15 bp, Homo sapiens
ctgaaggcagtggca

SEQ ID NO: 4623163 - DNA, 20 bp, Homo sapiens
ctgaaggctttcagggcctc

SEQ ID NO: 4623164 - DNA, 17 bp, Homo sapiens
ctgaagggaactagagg

SEQ ID NO: 4623165 - DNA, 14 bp, Homo sapiens
ctgaagggaccccc

SEQ ID NO: 4623166 - DNA, 15 bp, Homo sapiens
ctgaagggggcggcc

SEQ ID NO: 4623167 - DNA, 16 bp, Homo sapiens
ctgaagggggcggcct

SEQ ID NO: 4623168 - DNA, 22 bp, Homo sapiens
ctgaataacctgcacaggcttg

SEQ ID NO: 4623169 - DNA, 14 bp, Homo sapiens
ctgaataatatcaa

SEQ ID NO: 4623170 - DNA, 17 bp, Homo sapiens
ctgaatagttcaggaga

SEQ ID NO: 4623171 - DNA, 16 bp, Homo sapiens
ctgaatataaagctta

SEQ ID NO: 4623172 - DNA, 14 bp, Homo sapiens
ctgaatcatgtctg

SEQ ID NO: 4623173 - DNA, 15 bp, Homo sapiens
ctgaatgcctcctgt

SEQ ID NO: 4623174 - DNA, 17 bp, Homo sapiens
ctgaatgcctcctgtgg

SEQ ID NO: 4623175 - DNA, 19 bp, Homo sapiens
ctgaatgcctcctgtgggg

SEQ ID NO: 4623176 - DNA, 20 bp, Homo sapiens
ctgaatgcctcctgtgggga

SEQ ID NO: 4623177 - DNA, 23 bp, Homo sapiens
ctgaatgtggtttcaatctaatt

SEQ ID NO: 4623178 - DNA, 17 bp, Homo sapiens
ctgaatgtttgtgtctg

SEQ ID NO: 4623179 - DNA, 20 bp, Homo sapiens
ctgaatgtttgtgtctgtgg

SEQ ID NO: 4623180 - DNA, 17 bp, Homo sapiens
ctgaattgtcagatgtg

SEQ ID NO: 4623181 - DNA, 20 bp, Homo sapiens
ctgacaagctggccaaagtc

SEQ ID NO: 4623182 - DNA, 23 bp, Homo sapiens
ctgacaggcagcctggacataga

SEQ ID NO: 4623183 - DNA, 15 bp, Homo sapiens
ctgacagtagctctt

SEQ ID NO: 4623184 - DNA, 18 bp, Homo sapiens
ctgacagtagctcttaga

SEQ ID NO: 4623185 - DNA, 17 bp, Homo sapiens
ctgacattcacctgccc

SEQ ID NO: 4623186 - DNA, 18 bp, Homo sapiens
ctgaccaatattgtacag

SEQ ID NO: 4623187 - DNA, 19 bp, Homo sapiens
ctgaccaatattgtacagt

SEQ ID NO: 4623188 - DNA, 14 bp, Homo sapiens
ctgacccagcatct

SEQ ID NO: 4623189 - DNA, 18 bp, Homo sapiens
ctgacccagcatctccca

SEQ ID NO: 4623190 - DNA, 15 bp, Homo sapiens
ctgaccggtgctttt

SEQ ID NO: 4623191 - DNA, 17 bp, Homo sapiens
ctgaccggtgcttttat

SEQ ID NO: 4623192 - DNA, 15 bp, Homo sapiens
ctgacctaacctagg

SEQ ID NO: 4623193 - DNA, 16 bp, Homo sapiens
ctgacctaacctagga

SEQ ID NO: 4623194 - DNA, 16 bp, Homo sapiens
ctgaccttgatgagct

SEQ ID NO: 4623195 - DNA, 22 bp, Homo sapiens
ctgacggcgcctttttggcctg

SEQ ID NO: 4623196 - DNA, 15 bp, Homo sapiens
ctgactctccaggga

SEQ ID NO: 4623197 - DNA, 14 bp, Homo sapiens
ctgactgaaggaaa

SEQ ID NO: 4623198 - DNA, 15 bp, Homo sapiens
ctgactgaaggaaaa

SEQ ID NO: 4623199 - DNA, 14 bp, Homo sapiens
ctgactgccaagcc

SEQ ID NO: 4623200 - DNA, 18 bp, Homo sapiens
ctgactgccaagccagat

SEQ ID NO: 4623201 - DNA, 20 bp, Homo sapiens
ctgactggattcattctcat

SEQ ID NO: 4623202 - DNA, 21 bp, Homo sapiens
ctgactggccaaacccttgct

SEQ ID NO: 4623203 - DNA, 13 bp, Homo sapiens
ctgacttcactag

SEQ ID NO: 4623204 - DNA, 23 bp, Homo sapiens
ctgacttcatctcccacctagca

SEQ ID NO: 4623205 - DNA, 20 bp, Homo sapiens
ctgacttggggagatggagt

SEQ ID NO: 4623206 - DNA, 20 bp, Homo sapiens
ctgacttggttctgaagcca

SEQ ID NO: 4623207 - DNA, 12 bp, Homo sapiens
ctgagaaaaaaa

SEQ ID NO: 4623208 - DNA, 17 bp, Homo sapiens
ctgagaacctggccttc

SEQ ID NO: 4623209 - DNA, 20 bp, Homo sapiens
ctgagaactcgttcacctcc

SEQ ID NO: 4623210 - DNA, 14 bp, Homo sapiens
ctgagaagctgctc

SEQ ID NO: 4623211 - DNA, 22 bp, Homo sapiens
ctgcactttccaatgccacaga

SEQ ID NO: 4623212 - DNA, 15 bp, Homo sapiens
ctgcagaacccacca

SEQ ID NO: 4623213 - DNA, 15 bp, Homo sapiens
ctgcagaccctgccc

SEQ ID NO: 4623214 - DNA, 18 bp, Homo sapiens
ctgcagcaaacactccac

SEQ ID NO: 4623215 - DNA, 14 bp, Homo sapiens
ctgcagcacctcca

SEQ ID NO: 4623216 - DNA, 15 bp, Homo sapiens
ctgcagcacctccag

SEQ ID NO: 4623217 - DNA, 17 bp, Homo sapiens
ctgcagcacctccaggc

SEQ ID NO: 4623218 - DNA, 21 bp, Homo sapiens
ctgcagcaggagtggtgcaga

SEQ ID NO: 4623219 - DNA, 18 bp, Homo sapiens
ctgcagcttgtagccagc

SEQ ID NO: 4623220 - DNA, 20 bp, Homo sapiens
ctgcagcttgtagccagccg

SEQ ID NO: 4623221 - DNA, 15 bp, Homo sapiens
ctgcaggacttgcca

SEQ ID NO: 4623222 - DNA, 15 bp, Homo sapiens
ctgcagggaggagtg

SEQ ID NO: 4623223 - DNA, 14 bp, Homo sapiens
ctgcagggccatct

SEQ ID NO: 4623224 - DNA, 23 bp, Homo sapiens
ctgcagggccatctgactgccaa

SEQ ID NO: 4623225 - DNA, 15 bp, Homo sapiens
ctgcagttttgctat

SEQ ID NO: 4623226 - DNA, 16 bp, Homo sapiens
ctgcagttttgctatc

SEQ ID NO: 4623227 - DNA, 21 bp, Homo sapiens
ctgcagttttgctatctgggc

SEQ ID NO: 4623228 - DNA, 17 bp, Homo sapiens
ctgcatatatgtctctt

SEQ ID NO: 4623229 - DNA, 13 bp, Homo sapiens
ctgcatctgtctg

SEQ ID NO: 4623230 - DNA, 14 bp, Homo sapiens
ctgcatctgtctgc

SEQ ID NO: 4623231 - DNA, 15 bp, Homo sapiens
ctgcatctgtctgct

SEQ ID NO: 4623232 - DNA, 16 bp, Homo sapiens
ctgcatctgtctgctc

SEQ ID NO: 4623233 - DNA, 22 bp, Homo sapiens
ctgcatctgtctgctctgcata

SEQ ID NO: 4623234 - DNA, 13 bp, Homo sapiens
ctgcatcttgggg

SEQ ID NO: 4623235 - DNA, 14 bp, Homo sapiens
ctgcatcttgggga

SEQ ID NO: 4623236 - DNA, 16 bp, Homo sapiens
ctgcatcttggggaca

SEQ ID NO: 4623237 - DNA, 19 bp, Homo sapiens
ctgcatcttggggacatct

SEQ ID NO: 4623238 - DNA, 18 bp, Homo sapiens
ctgcatggtcaagcctct

SEQ ID NO: 4623239 - DNA, 15 bp, Homo sapiens
ctgcattattctctt

SEQ ID NO: 4623240 - DNA, 19 bp, Homo sapiens
ctgcattctctcccatcct

SEQ ID NO: 4623241 - DNA, 20 bp, Homo sapiens
ctgcattctctcccatcctg

SEQ ID NO: 4623242 - DNA, 19 bp, Homo sapiens
ctgcattgagcatattttc

SEQ ID NO: 4623243 - DNA, 23 bp, Homo sapiens
ctgcattgagcttgcatgcttgc

SEQ ID NO: 4623244 - DNA, 14 bp, Homo sapiens
ctgccaagccagat

SEQ ID NO: 4623245 - DNA, 20 bp, Homo sapiens
ctgccaaggtggagggaagg

SEQ ID NO: 4623246 - DNA, 15 bp, Homo sapiens
ctgccaccacgctgg

SEQ ID NO: 4623247 - DNA, 21 bp, Homo sapiens
ctgccagacctgcatggtcaa

SEQ ID NO: 4623248 - DNA, 13 bp, Homo sapiens
ctgccagcaggaa

SEQ ID NO: 4623249 - DNA, 14 bp, Homo sapiens
ctgccagcaggaat

SEQ ID NO: 4623250 - DNA, 15 bp, Homo sapiens
ctgccagcaggaata

SEQ ID NO: 4623251 - DNA, 20 bp, Homo sapiens
ctgccagcaggaataaagac

SEQ ID NO: 4623252 - DNA, 13 bp, Homo sapiens
ctgccagcccagc

SEQ ID NO: 4623253 - DNA, 21 bp, Homo sapiens
ctgccaggagggacaaaggag

SEQ ID NO: 4623254 - DNA, 22 bp, Homo sapiens
ctgccaggagggacaaaggagc

SEQ ID NO: 4623255 - DNA, 14 bp, Homo sapiens
ctgccaggctgttt

SEQ ID NO: 4623256 - DNA, 21 bp, Homo sapiens
ctgccatctcacctcctgctg

SEQ ID NO: 4623257 - DNA, 20 bp, Homo sapiens
ctgccattctgcatgagctg

SEQ ID NO: 4623258 - DNA, 12 bp, Homo sapiens
ctgcccaccctc

SEQ ID NO: 4623259 - DNA, 18 bp, Homo sapiens
ctgcccaggcaaggaaca

SEQ ID NO: 4623260 - DNA, 22 bp, Homo sapiens
ctgcccagtgcaaaccacttct

SEQ ID NO: 4623261 - DNA, 16 bp, Homo sapiens
ctgcccatggacaggc

SEQ ID NO: 4623262 - DNA, 13 bp, Homo sapiens
ctgccccaactct

SEQ ID NO: 4623263 - DNA, 13 bp, Homo sapiens
ctgccccaagagc

SEQ ID NO: 4623264 - DNA, 17 bp, Homo sapiens
ctgccccccctaagaga

SEQ ID NO: 4623265 - DNA, 18 bp, Homo sapiens
ctgccccccctaagagac

SEQ ID NO: 4623266 - DNA, 13 bp, Homo sapiens
ctgccccctgggg

SEQ ID NO: 4623267 - DNA, 15 bp, Homo sapiens
ctgccccctggggat

SEQ ID NO: 4623268 - DNA, 19 bp, Homo sapiens
ctgccccgtagagaatgtg

SEQ ID NO: 4623269 - DNA, 13 bp, Homo sapiens
ctgcccctctctg

SEQ ID NO: 4623270 - DNA, 15 bp, Homo sapiens
ctgcccctctctggg

SEQ ID NO: 4623271 - DNA, 22 bp, Homo sapiens
ctgcccctctctgggcctcaga

SEQ ID NO: 4623272 - DNA, 16 bp, Homo sapiens
ctgccccttaacccca

SEQ ID NO: 4623273 - DNA, 15 bp, Homo sapiens
ctgcccgagggcagc

SEQ ID NO: 4623274 - DNA, 17 bp, Homo sapiens
ctgcccgcagacctctg

SEQ ID NO: 4623275 - DNA, 20 bp, Homo sapiens
ctgcccgcagacctctggat

SEQ ID NO: 4623276 - DNA, 22 bp, Homo sapiens
ctgccctaactctgcccaccct

SEQ ID NO: 4623277 - DNA, 20 bp, Homo sapiens
ctgccctcattactgggcct

SEQ ID NO: 4623278 - DNA, 15 bp, Homo sapiens
ctgccctctatttat

SEQ ID NO: 4623279 - DNA, 19 bp, Homo sapiens
ctgccctgagaagctgctc

SEQ ID NO: 4623280 - DNA, 21 bp, Homo sapiens
ctgccctgctctgcccaggca

SEQ ID NO: 4623281 - DNA, 17 bp, Homo sapiens
ctgccctgttagctttc

SEQ ID NO: 4623282 - DNA, 19 bp, Homo sapiens
ctgccctgttagctttcca

SEQ ID NO: 4623283 - DNA, 10 bp, Homo sapiens
ctgcccttga

SEQ ID NO: 4623284 - DNA, 22 bp, Homo sapiens
ctgcccttgaaccccctccctg

SEQ ID NO: 4623285 - DNA, 23 bp, Homo sapiens
ctgcccttgtttggggcaggagt

SEQ ID NO: 4623286 - DNA, 19 bp, Homo sapiens
ctgccgccgcccgctgggg

SEQ ID NO: 4623287 - DNA, 20 bp, Homo sapiens
ctgccgccgcccgctgggga

SEQ ID NO: 4623288 - DNA, 18 bp, Homo sapiens
ctgcctagagtgtagcct

SEQ ID NO: 4623289 - DNA, 21 bp, Homo sapiens
ctgcctagagtgtagcctaaa

SEQ ID NO: 4623290 - DNA, 16 bp, Homo sapiens
ctgcctcaggcctctg

SEQ ID NO: 4623291 - DNA, 17 bp, Homo sapiens
ctgcctcaggcctctgt

SEQ ID NO: 4623292 - DNA, 12 bp, Homo sapiens
ctgcctcctgct

SEQ ID NO: 4623293 - DNA, 13 bp, Homo sapiens
ctgcctcctgggt

SEQ ID NO: 4623294 - DNA, 15 bp, Homo sapiens
ctgcctctactggga

SEQ ID NO: 4623295 - DNA, 19 bp, Homo sapiens
ctgcctctatttttgttgg

SEQ ID NO: 4623296 - DNA, 22 bp, Homo sapiens
ctgcctctcacagctgagttgt

SEQ ID NO: 4623297 - DNA, 19 bp, Homo sapiens
ctgcctctcattggcacca

SEQ ID NO: 4623298 - DNA, 20 bp, Homo sapiens
ctgcctggagacaaggtgct

SEQ ID NO: 4623299 - DNA, 21 bp, Homo sapiens
ctgcctggaggacctgagcct

SEQ ID NO: 4623300 - DNA, 22 bp, Homo sapiens
ctgcctggaggacctgagcctg

SEQ ID NO: 4623301 - DNA, 23 bp, Homo sapiens
ctgcctggaggacctgagcctgc

SEQ ID NO: 4623302 - DNA, 20 bp, Homo sapiens
ctgcctgggatgcccttccc

SEQ ID NO: 4623303 - DNA, 21 bp, Homo sapiens
ctgcctgggatgcccttcccc

SEQ ID NO: 4623304 - DNA, 22 bp, Homo sapiens
ctgcctgggatgcccttccccc

SEQ ID NO: 4623305 - DNA, 16 bp, Homo sapiens
ctgcctgggtaggccc

SEQ ID NO: 4623306 - DNA, 18 bp, Homo sapiens
ctgcctgggtaggcccca

SEQ ID NO: 4623307 - DNA, 21 bp, Homo sapiens
ctgcctggttctaggctgctg

SEQ ID NO: 4623308 - DNA, 15 bp, Homo sapiens
ctgcctgtgggcttc

SEQ ID NO: 4623309 - DNA, 18 bp, Homo sapiens
ctgccttaacctgggacc

SEQ ID NO: 4623310 - DNA, 21 bp, Homo sapiens
ctgccttcggagggaaattgt

SEQ ID NO: 4623311 - DNA, 23 bp, Homo sapiens
ctgccttcttccttgaggggcag

SEQ ID NO: 4623312 - DNA, 17 bp, Homo sapiens
ctgcctttaagccaaag

SEQ ID NO: 4623313 - DNA, 20 bp, Homo sapiens
ctgcctttaagccaaagaaa

SEQ ID NO: 4623314 - DNA, 23 bp, Homo sapiens
ctgcctttaagccaaagaaacaa

SEQ ID NO: 4623315 - DNA, 12 bp, Homo sapiens
ctgcctttctca

SEQ ID NO: 4623316 - DNA, 22 bp, Homo sapiens
ctgcgagacgcacacagctgag

SEQ ID NO: 4623317 - DNA, 23 bp, Homo sapiens
ctgcgagacgcacacagctgagc

SEQ ID NO: 4623318 - DNA, 15 bp, Homo sapiens
ctgcgagggcagcgg

SEQ ID NO: 4623319 - DNA, 17 bp, Homo sapiens
ctgcgcaccaggctgag

SEQ ID NO: 4623320 - DNA, 16 bp, Homo sapiens
ctgcgcttcagtaaca

SEQ ID NO: 4623321 - DNA, 16 bp, Homo sapiens
ctgcggagcaagagga

SEQ ID NO: 4623322 - DNA, 23 bp, Homo sapiens
ctgagaagctgctccaggcctgc

SEQ ID NO: 4623323 - DNA, 16 bp, Homo sapiens
ctgagaatgatggttt

SEQ ID NO: 4623324 - DNA, 14 bp, Homo sapiens
ctgagaccacagag

SEQ ID NO: 4623325 - DNA, 23 bp, Homo sapiens
ctgagacgccacggagggctggg

SEQ ID NO: 4623326 - DNA, 13 bp, Homo sapiens
ctgagaggccctg

SEQ ID NO: 4623327 - DNA, 16 bp, Homo sapiens
ctgagaggccctggat

SEQ ID NO: 4623328 - DNA, 19 bp, Homo sapiens
ctgagatatggcattgcac

SEQ ID NO: 4623329 - DNA, 22 bp, Homo sapiens
ctgagatttaacccctccactg

SEQ ID NO: 4623330 - DNA, 17 bp, Homo sapiens
ctgagcaatctgaccct

SEQ ID NO: 4623331 - DNA, 15 bp, Homo sapiens
ctgagcactgccagg

SEQ ID NO: 4623332 - DNA, 18 bp, Homo sapiens
ctgagcactgccaggagg

SEQ ID NO: 4623333 - DNA, 12 bp, Homo sapiens
ctgagcacttag

SEQ ID NO: 4623334 - DNA, 16 bp, Homo sapiens
ctgagcagggccgggg

SEQ ID NO: 4623335 - DNA, 21 bp, Homo sapiens
ctgagcagggccggggaactg

SEQ ID NO: 4623336 - DNA, 23 bp, Homo sapiens
ctgagcagggccggggaactggc

SEQ ID NO: 4623337 - DNA, 14 bp, Homo sapiens
ctgagccaaccttg

SEQ ID NO: 4623338 - DNA, 22 bp, Homo sapiens
ctgagcccctttgcctgtcaag

SEQ ID NO: 4623339 - DNA, 13 bp, Homo sapiens
ctgagcctgccga

SEQ ID NO: 4623340 - DNA, 14 bp, Homo sapiens
ctgagcctgccgag

SEQ ID NO: 4623341 - DNA, 16 bp, Homo sapiens
ctgagcctgccgagca

SEQ ID NO: 4623342 - DNA, 17 bp, Homo sapiens
ctgagctcacaaggcag

SEQ ID NO: 4623343 - DNA, 23 bp, Homo sapiens
ctgagctcacaaggcagcaaggc

SEQ ID NO: 4623344 - DNA, 15 bp, Homo sapiens
ctgagctctgagagg

SEQ ID NO: 4623345 - DNA, 16 bp, Homo sapiens
ctgagctctgagaggc

SEQ ID NO: 4623346 - DNA, 22 bp, Homo sapiens
ctgagctctgagaggccctgga

SEQ ID NO: 4623347 - DNA, 13 bp, Homo sapiens
ctgagctggcttc

SEQ ID NO: 4623348 - DNA, 21 bp, Homo sapiens
ctgaggacagaaagaccctga

SEQ ID NO: 4623349 - DNA, 13 bp, Homo sapiens
ctgaggacagctg

SEQ ID NO: 4623350 - DNA, 17 bp, Homo sapiens
ctgaggagatgaccagg

SEQ ID NO: 4623351 - DNA, 22 bp, Homo sapiens
ctgaggagatgaccagggatgc

SEQ ID NO: 4623352 - DNA, 12 bp, Homo sapiens
ctgaggagtctg

SEQ ID NO: 4623353 - DNA, 16 bp, Homo sapiens
ctgaggagtctgaggt

SEQ ID NO: 4623354 - DNA, 17 bp, Homo sapiens
ctgaggagtctgaggtc

SEQ ID NO: 4623355 - DNA, 18 bp, Homo sapiens
ctgaggagtctgaggtcc

SEQ ID NO: 4623356 - DNA, 12 bp, Homo sapiens
ctgaggccacac

SEQ ID NO: 4623357 - DNA, 20 bp, Homo sapiens
ctgaggccacactcagcaca

SEQ ID NO: 4623358 - DNA, 21 bp, Homo sapiens
ctgaggccacactcagcacaa

SEQ ID NO: 4623359 - DNA, 12 bp, Homo sapiens
ctgaggccagcc

SEQ ID NO: 4623360 - DNA, 15 bp, Homo sapiens
ctgaggccagcctgg

SEQ ID NO: 4623361 - DNA, 19 bp, Homo sapiens
ctgaggccagcctggcctc

SEQ ID NO: 4623362 - DNA, 22 bp, Homo sapiens
ctgaggccagcctggcctcctg

SEQ ID NO: 4623363 - DNA, 11 bp, Homo sapiens
ctgaggcccac

SEQ ID NO: 4623364 - DNA, 17 bp, Homo sapiens
ctgaggcctagactctg

SEQ ID NO: 4623365 - DNA, 18 bp, Homo sapiens
ctgaggctggcacaggac

SEQ ID NO: 4623366 - DNA, 19 bp, Homo sapiens
ctgagggaagagtagctgt

SEQ ID NO: 4623367 - DNA, 21 bp, Homo sapiens
ctgagggcagttcgcagccac

SEQ ID NO: 4623368 - DNA, 13 bp, Homo sapiens
ctgagggggagcc

SEQ ID NO: 4623369 - DNA, 19 bp, Homo sapiens
ctgaggggtctataggttt

SEQ ID NO: 4623370 - DNA, 14 bp, Homo sapiens
ctgaggtcagggag

SEQ ID NO: 4623371 - DNA, 13 bp, Homo sapiens
ctgaggtcctgag

SEQ ID NO: 4623372 - DNA, 15 bp, Homo sapiens
ctgaggtcctgagca

SEQ ID NO: 4623373 - DNA, 19 bp, Homo sapiens
ctgaggtcctgagcactgc

SEQ ID NO: 4623374 - DNA, 21 bp, Homo sapiens
ctgaggtcctgagcactgcca

SEQ ID NO: 4623375 - DNA, 16 bp, Homo sapiens
ctgaggtgcccactcc

SEQ ID NO: 4623376 - DNA, 18 bp, Homo sapiens
ctgaggtgcccactccgc

SEQ ID NO: 4623377 - DNA, 18 bp, Homo sapiens
ctgaggtgcccaggagaa

SEQ ID NO: 4623378 - DNA, 14 bp, Homo sapiens
ctgagtcctggccc

SEQ ID NO: 4623379 - DNA, 18 bp, Homo sapiens
ctgagtctatgttcaaag

SEQ ID NO: 4623380 - DNA, 23 bp, Homo sapiens
ctgagtgacctccttctgcaaag

SEQ ID NO: 4623381 - DNA, 17 bp, Homo sapiens
ctgagtgcaagttcatg

SEQ ID NO: 4623382 - DNA, 15 bp, Homo sapiens
ctgagtggcttcact

SEQ ID NO: 4623383 - DNA, 21 bp, Homo sapiens
ctgagtggcttcactcctgct

SEQ ID NO: 4623384 - DNA, 23 bp, Homo sapiens
ctgagtggcttcactcctgctgt

SEQ ID NO: 4623385 - DNA, 22 bp, Homo sapiens
ctgagttttagttggtctttcc

SEQ ID NO: 4623386 - DNA, 21 bp, Homo sapiens
ctgataagcttcctagaaagt

SEQ ID NO: 4623387 - DNA, 19 bp, Homo sapiens
ctgatagctgtttcaaatg

SEQ ID NO: 4623388 - DNA, 21 bp, Homo sapiens
ctgatagctgtttcaaatgtg

SEQ ID NO: 4623389 - DNA, 13 bp, Homo sapiens
ctgatcagaggca

SEQ ID NO: 4623390 - DNA, 15 bp, Homo sapiens
ctgatctggctgcag

SEQ ID NO: 4623391 - DNA, 17 bp, Homo sapiens
ctgatcttttaaaatca

SEQ ID NO: 4623392 - DNA, 17 bp, Homo sapiens
ctgatgagatttttaaa

SEQ ID NO: 4623393 - DNA, 14 bp, Homo sapiens
ctgatgcaggtcag

SEQ ID NO: 4623394 - DNA, 19 bp, Homo sapiens
ctgatgcaggtcagcccat

SEQ ID NO: 4623395 - DNA, 23 bp, Homo sapiens
ctgatgcatcagaaagggagggc

SEQ ID NO: 4623396 - DNA, 17 bp, Homo sapiens
ctgattaaatatttgaa

SEQ ID NO: 4623397 - DNA, 19 bp, Homo sapiens
ctgattaaatatttgaaga

SEQ ID NO: 4623398 - DNA, 17 bp, Homo sapiens
ctgattcaactaaaaaa

SEQ ID NO: 4623399 - DNA, 13 bp, Homo sapiens
ctgattcagcatt

SEQ ID NO: 4623400 - DNA, 14 bp, Homo sapiens
ctgattcagcattt

SEQ ID NO: 4623401 - DNA, 16 bp, Homo sapiens
ctgattcagcattttt

SEQ ID NO: 4623402 - DNA, 18 bp, Homo sapiens
ctgattgctcccaggatc

SEQ ID NO: 4623403 - DNA, 19 bp, Homo sapiens
ctgcaaaattaaatctaga

SEQ ID NO: 4623404 - DNA, 17 bp, Homo sapiens
ctgcaaagtggcaggga

SEQ ID NO: 4623405 - DNA, 18 bp, Homo sapiens
ctgcaaagtggcagggac

SEQ ID NO: 4623406 - DNA, 17 bp, Homo sapiens
ctgcaacctctgcctcc

SEQ ID NO: 4623407 - DNA, 19 bp, Homo sapiens
ctgcaacctctgcctcctg

SEQ ID NO: 4623408 - DNA, 18 bp, Homo sapiens
ctgcaacttccgctgagg

SEQ ID NO: 4623409 - DNA, 23 bp, Homo sapiens
ctgcaacttccgctgaggggtct

SEQ ID NO: 4623410 - DNA, 13 bp, Homo sapiens
ctgcaagatggac

SEQ ID NO: 4623411 - DNA, 16 bp, Homo sapiens
ctgcaatacattaaaa

SEQ ID NO: 4623412 - DNA, 20 bp, Homo sapiens
ctgcaatacattaaaataac

SEQ ID NO: 4623413 - DNA, 15 bp, Homo sapiens
ctgcacaccaaggcc

SEQ ID NO: 4623414 - DNA, 20 bp, Homo sapiens
ctgcacaccaaggccctgca

SEQ ID NO: 4623415 - DNA, 21 bp, Homo sapiens
ctgcacaccaaggccctgcat

SEQ ID NO: 4623416 - DNA, 23 bp, Homo sapiens
ctgcacaccaaggccctgcatct

SEQ ID NO: 4623417 - DNA, 12 bp, Homo sapiens
ctgcacactctc

SEQ ID NO: 4623418 - DNA, 17 bp, Homo sapiens
ctgcacactctcttctc

SEQ ID NO: 4623419 - DNA, 17 bp, Homo sapiens
ctgcacactgcacattt

SEQ ID NO: 4623420 - DNA, 19 bp, Homo sapiens
ctgcacagacaagcagccc

SEQ ID NO: 4623421 - DNA, 15 bp, Homo sapiens
ctgcacagagcaagt

SEQ ID NO: 4623422 - DNA, 21 bp, Homo sapiens
ctgcacagagcaagtcctcac

SEQ ID NO: 4623423 - DNA, 23 bp, Homo sapiens
ctgcacatgaatcccacccacat

SEQ ID NO: 4623424 - DNA, 14 bp, Homo sapiens
ctgcacatgtcttg

SEQ ID NO: 4623425 - DNA, 16 bp, Homo sapiens
ctgcacatgtcttgta

SEQ ID NO: 4623426 - DNA, 16 bp, Homo sapiens
ctgcacctagaacctc

SEQ ID NO: 4623427 - DNA, 22 bp, Homo sapiens
ctgcaccttcactctccagggt

SEQ ID NO: 4623428 - DNA, 23 bp, Homo sapiens
ctgcaccttcactctccagggta

SEQ ID NO: 4623429 - DNA, 14 bp, Homo sapiens
ctgcaccttcccca

SEQ ID NO: 4623430 - DNA, 14 bp, Homo sapiens
ctgcactcaagctt

SEQ ID NO: 4623431 - DNA, 15 bp, Homo sapiens
ctgcactccagcctg

SEQ ID NO: 4623432 - DNA, 17 bp, Homo sapiens
ctgcactccagcctggg

SEQ ID NO: 4623433 - DNA, 15 bp, Homo sapiens
ctagtacaatcttgg

SEQ ID NO: 4623434 - DNA, 16 bp, Homo sapiens
ctagtacaatcttggg

SEQ ID NO: 4623435 - DNA, 16 bp, Homo sapiens
ctagtcgcccctcaga

SEQ ID NO: 4623436 - DNA, 17 bp, Homo sapiens
ctagtcgcccctcagag

SEQ ID NO: 4623437 - DNA, 19 bp, Homo sapiens
ctagtcgcccctcagagca

SEQ ID NO: 4623438 - DNA, 17 bp, Homo sapiens
ctagtgacccacatgcc

SEQ ID NO: 4623439 - DNA, 22 bp, Homo sapiens
ctagtgctttccttttttaaaa

SEQ ID NO: 4623440 - DNA, 17 bp, Homo sapiens
ctagtgggacagcccag

SEQ ID NO: 4623441 - DNA, 20 bp, Homo sapiens
ctagtgggttgacctttaaa

SEQ ID NO: 4623442 - DNA, 15 bp, Homo sapiens
ctagttctttcctcc

SEQ ID NO: 4623443 - DNA, 21 bp, Homo sapiens
ctagttctttcctccccctgc

SEQ ID NO: 4623444 - DNA, 20 bp, Homo sapiens
ctataaatttaagaaaacaa

SEQ ID NO: 4623445 - DNA, 14 bp, Homo sapiens
ctatagttgcagcc

SEQ ID NO: 4623446 - DNA, 20 bp, Homo sapiens
ctatagttgcagcccaagga

SEQ ID NO: 4623447 - DNA, 20 bp, Homo sapiens
ctatataatatatcatcttt

SEQ ID NO: 4623448 - DNA, 16 bp, Homo sapiens
ctatataatttatttc

SEQ ID NO: 4623449 - DNA, 14 bp, Homo sapiens
ctatatcagggcct

SEQ ID NO: 4623450 - DNA, 22 bp, Homo sapiens
ctatatcagggcctgagtgacc

SEQ ID NO: 4623451 - DNA, 23 bp, Homo sapiens
ctatatctggagtgagaggcccc

SEQ ID NO: 4623452 - DNA, 14 bp, Homo sapiens
ctatatgtacttgt

SEQ ID NO: 4623453 - DNA, 21 bp, Homo sapiens
ctatatgtacttgtcaaagaa

SEQ ID NO: 4623454 - DNA, 18 bp, Homo sapiens
ctatcaccagtgcatcac

SEQ ID NO: 4623455 - DNA, 14 bp, Homo sapiens
ctatcactgcatta

SEQ ID NO: 4623456 - DNA, 14 bp, Homo sapiens
ctatcatatgaaga

SEQ ID NO: 4623457 - DNA, 23 bp, Homo sapiens
ctatcatttattggatgggtggg

SEQ ID NO: 4623458 - DNA, 15 bp, Homo sapiens
ctatctgtggaaagc

SEQ ID NO: 4623459 - DNA, 24 bp, Homo sapiens
ctatcttaggtagtcatgctgtgc

SEQ ID NO: 4623460 - DNA, 14 bp, Homo sapiens
ctatgaggaaaggt

SEQ ID NO: 4623461 - DNA, 20 bp, Homo sapiens
ctatgatccttttttgtcat

SEQ ID NO: 4623462 - DNA, 18 bp, Homo sapiens
ctatgatggatggcagac

SEQ ID NO: 4623463 - DNA, 13 bp, Homo sapiens
ctatgcacatatg

SEQ ID NO: 4623464 - DNA, 18 bp, Homo sapiens
ctatgcacatatggactc

SEQ ID NO: 4623465 - DNA, 21 bp, Homo sapiens
ctatgcacatatggactctgc

SEQ ID NO: 4623466 - DNA, 19 bp, Homo sapiens
ctatgcccagggaataaga

SEQ ID NO: 4623467 - DNA, 11 bp, Homo sapiens
ctatggagagc

SEQ ID NO: 4623468 - DNA, 21 bp, Homo sapiens
ctatggagaggcttccctaca

SEQ ID NO: 4623469 - DNA, 13 bp, Homo sapiens
ctatgtagtcata

SEQ ID NO: 4623470 - DNA, 16 bp, Homo sapiens
ctatgtagtcataata

SEQ ID NO: 4623471 - DNA, 11 bp, Homo sapiens
ctatgtgattt

SEQ ID NO: 4623472 - DNA, 19 bp, Homo sapiens
ctatgtgattttaactctg

SEQ ID NO: 4623473 - DNA, 20 bp, Homo sapiens
ctatgtgattttaactctgt

SEQ ID NO: 4623474 - DNA, 22 bp, Homo sapiens
ctatgtgattttaactctgtct

SEQ ID NO: 4623475 - DNA, 21 bp, Homo sapiens
ctatgttagtataagcttttc

SEQ ID NO: 4623476 - DNA, 20 bp, Homo sapiens
ctatgttcaaagactgtgaa

SEQ ID NO: 4623477 - DNA, 19 bp, Homo sapiens
ctatgttctgtcttcccaa

SEQ ID NO: 4623478 - DNA, 23 bp, Homo sapiens
ctatgtttgtatttggaatattt

SEQ ID NO: 4623479 - DNA, 18 bp, Homo sapiens
ctattaaaatattttgga

SEQ ID NO: 4623480 - DNA, 19 bp, Homo sapiens
ctattaaccttttttgtct

SEQ ID NO: 4623481 - DNA, 14 bp, Homo sapiens
ctattaatcaagag

SEQ ID NO: 4623482 - DNA, 21 bp, Homo sapiens
ctattagatacacttcttaaa

SEQ ID NO: 4623483 - DNA, 22 bp, Homo sapiens
ctattagatacacttcttaaat

SEQ ID NO: 4623484 - DNA, 13 bp, Homo sapiens
ctattcatggcta

SEQ ID NO: 4623485 - DNA, 17 bp, Homo sapiens
ctattccccagcagggt

SEQ ID NO: 4623486 - DNA, 14 bp, Homo sapiens
ctattctagagctt

SEQ ID NO: 4623487 - DNA, 18 bp, Homo sapiens
ctattctagagcttttat

SEQ ID NO: 4623488 - DNA, 12 bp, Homo sapiens
ctattctgtcag

SEQ ID NO: 4623489 - DNA, 19 bp, Homo sapiens
ctattctgtcagtgttaaa

SEQ ID NO: 4623490 - DNA, 17 bp, Homo sapiens
ctattgaaaatatatat

SEQ ID NO: 4623491 - DNA, 19 bp, Homo sapiens
ctatttacaagatggactt

SEQ ID NO: 4623492 - DNA, 16 bp, Homo sapiens
ctatttattagccaac

SEQ ID NO: 4623493 - DNA, 16 bp, Homo sapiens
ctatttattcctgtta

SEQ ID NO: 4623494 - DNA, 14 bp, Homo sapiens
ctatttgaacaagt

SEQ ID NO: 4623495 - DNA, 12 bp, Homo sapiens
ctatttgaagaa

SEQ ID NO: 4623496 - DNA, 12 bp, Homo sapiens
ctattttcataa

SEQ ID NO: 4623497 - DNA, 13 bp, Homo sapiens
ctattttcataat

SEQ ID NO: 4623498 - DNA, 13 bp, Homo sapiens
ctatttttgttgg

SEQ ID NO: 4623499 - DNA, 14 bp, Homo sapiens
ctatttttgttggg

SEQ ID NO: 4623500 - DNA, 13 bp, Homo sapiens
ctcaaaaatgaga

SEQ ID NO: 4623501 - DNA, 18 bp, Homo sapiens
ctcaaacctccaaaagcc

SEQ ID NO: 4623502 - DNA, 22 bp, Homo sapiens
ctcaaaggccagacctgcagac

SEQ ID NO: 4623503 - DNA, 22 bp, Homo sapiens
ctcaaatgcagtatttttgttg

SEQ ID NO: 4623504 - DNA, 16 bp, Homo sapiens
ctcaacggtctggcag

SEQ ID NO: 4623505 - DNA, 18 bp, Homo sapiens
ctcaacggtctggcaggg

SEQ ID NO: 4623506 - DNA, 11 bp, Homo sapiens
ctcaagctttc

SEQ ID NO: 4623507 - DNA, 13 bp, Homo sapiens
ctcaagctttccc

SEQ ID NO: 4623508 - DNA, 15 bp, Homo sapiens
ctcaagtgtcacctc

SEQ ID NO: 4623509 - DNA, 16 bp, Homo sapiens
ctcaatttttgtctca

SEQ ID NO: 4623510 - DNA, 18 bp, Homo sapiens
ctcaatttttgtctcaga

SEQ ID NO: 4623511 - DNA, 18 bp, Homo sapiens
ctcacaaaatcactttaa

SEQ ID NO: 4623512 - DNA, 13 bp, Homo sapiens
ctcacaaggcagc

SEQ ID NO: 4623513 - DNA, 14 bp, Homo sapiens
ctcacaaggcagca

SEQ ID NO: 4623514 - DNA, 16 bp, Homo sapiens
ctcacaaggcagcaag

SEQ ID NO: 4623515 - DNA, 19 bp, Homo sapiens
ctcacaaggcagcaaggcc

SEQ ID NO: 4623516 - DNA, 21 bp, Homo sapiens
ctcacaaggcagcaaggcccg

SEQ ID NO: 4623517 - DNA, 15 bp, Homo sapiens
ctcacacaccctgag

SEQ ID NO: 4623518 - DNA, 16 bp, Homo sapiens
ctcacacaccctgagg

SEQ ID NO: 4623519 - DNA, 21 bp, Homo sapiens
ctcacacaggcatttcctggg

SEQ ID NO: 4623520 - DNA, 12 bp, Homo sapiens
ctcacaggctga

SEQ ID NO: 4623521 - DNA, 20 bp, Homo sapiens
ctcacagtacagcatgtgcc

SEQ ID NO: 4623522 - DNA, 22 bp, Homo sapiens
ctcacagtacagcatgtgcctt

SEQ ID NO: 4623523 - DNA, 13 bp, Homo sapiens
ctcacataagccc

SEQ ID NO: 4623524 - DNA, 17 bp, Homo sapiens
ctcacccctcccctggg

SEQ ID NO: 4623525 - DNA, 18 bp, Homo sapiens
ctcacccctcccctggga

SEQ ID NO: 4623526 - DNA, 18 bp, Homo sapiens
ctcacccctgcccctgtg

SEQ ID NO: 4623527 - DNA, 22 bp, Homo sapiens
ctcaccgactcacctgcgcaag

SEQ ID NO: 4623528 - DNA, 14 bp, Homo sapiens
ctcacctcctgctg

SEQ ID NO: 4623529 - DNA, 19 bp, Homo sapiens
ctcacctgcgcaagtgcct

SEQ ID NO: 4623530 - DNA, 21 bp, Homo sapiens
ctcacctgtactattgcagac

SEQ ID NO: 4623531 - DNA, 12 bp, Homo sapiens
ctcactctgggc

SEQ ID NO: 4623532 - DNA, 22 bp, Homo sapiens
ctcactcttgtcacccaggctg

SEQ ID NO: 4623533 - DNA, 21 bp, Homo sapiens
ctcactgaaaacatctggaag

SEQ ID NO: 4623534 - DNA, 23 bp, Homo sapiens
ctcactgaaacatggctgtgttt

SEQ ID NO: 4623535 - DNA, 20 bp, Homo sapiens
ctcactgcaacctctgcctc

SEQ ID NO: 4623536 - DNA, 10 bp, Homo sapiens
ctcactgtga

SEQ ID NO: 4623537 - DNA, 18 bp, Homo sapiens
ctcactgtgttactgctt

SEQ ID NO: 4623538 - DNA, 13 bp, Homo sapiens
ctcacttcctttg

SEQ ID NO: 4623539 - DNA, 18 bp, Homo sapiens
ctcacttcctttgccctt

SEQ ID NO: 4623540 - DNA, 22 bp, Homo sapiens
ctcacttcctttgcccttcctc

SEQ ID NO: 4623541 - DNA, 13 bp, Homo sapiens
ctcagaagcctgg

SEQ ID NO: 4623542 - DNA, 17 bp, Homo sapiens
ctcagaagcctgggggc

SEQ ID NO: 4623543 - DNA, 20 bp, Homo sapiens
ctcagaagcctgggggcctg

SEQ ID NO: 4623544 - DNA, 22 bp, Homo sapiens
ctgcgggggcaggccgggcctg

SEQ ID NO: 4623545 - DNA, 13 bp, Homo sapiens
ctgctacctgttc

SEQ ID NO: 4623546 - DNA, 22 bp, Homo sapiens
ctgctattctagagcttttatt

SEQ ID NO: 4623547 - DNA, 23 bp, Homo sapiens
ctgctattctagagcttttattt

SEQ ID NO: 4623548 - DNA, 14 bp, Homo sapiens
ctgctcagctctgg

SEQ ID NO: 4623549 - DNA, 19 bp, Homo sapiens
ctgctccaggcctgcagca

SEQ ID NO: 4623550 - DNA, 20 bp, Homo sapiens
ctgctccccagcagcggaac

SEQ ID NO: 4623551 - DNA, 16 bp, Homo sapiens
ctgctcctcctggcct

SEQ ID NO: 4623552 - DNA, 18 bp, Homo sapiens
ctgctcggggtgcacagg

SEQ ID NO: 4623553 - DNA, 23 bp, Homo sapiens
ctgctcggggtgcacaggagggg

SEQ ID NO: 4623554 - DNA, 15 bp, Homo sapiens
ctgctctaagcccag

SEQ ID NO: 4623555 - DNA, 16 bp, Homo sapiens
ctgctctagtgggaca

SEQ ID NO: 4623556 - DNA, 23 bp, Homo sapiens
ctgctctagtgggacagcccaga

SEQ ID NO: 4623557 - DNA, 18 bp, Homo sapiens
ctgctctgatgcatcaga

SEQ ID NO: 4623558 - DNA, 15 bp, Homo sapiens
ctgctctgcccaggc

SEQ ID NO: 4623559 - DNA, 21 bp, Homo sapiens
ctgctctgcccaggcaaggaa

SEQ ID NO: 4623560 - DNA, 22 bp, Homo sapiens
ctgctctggaataaagttgcag

SEQ ID NO: 4623561 - DNA, 21 bp, Homo sapiens
ctgctctttattgcagaatgt

SEQ ID NO: 4623562 - DNA, 16 bp, Homo sapiens
ctgctctttccacttg

SEQ ID NO: 4623563 - DNA, 13 bp, Homo sapiens
ctgctgagaacct

SEQ ID NO: 4623564 - DNA, 18 bp, Homo sapiens
ctgctgagaacctggcct

SEQ ID NO: 4623565 - DNA, 20 bp, Homo sapiens
ctgctgagaacctggccttc

SEQ ID NO: 4623566 - DNA, 16 bp, Homo sapiens
ctgctgagctctgaga

SEQ ID NO: 4623567 - DNA, 18 bp, Homo sapiens
ctgctgagctctgagagg

SEQ ID NO: 4623568 - DNA, 22 bp, Homo sapiens
ctgctgagctctgagaggccct

SEQ ID NO: 4623569 - DNA, 12 bp, Homo sapiens
ctgctgcacacc

SEQ ID NO: 4623570 - DNA, 21 bp, Homo sapiens
ctgctgcacaccaaggccctg

SEQ ID NO: 4623571 - DNA, 23 bp, Homo sapiens
ctgctgcctgggtaggccccaca

SEQ ID NO: 4623572 - DNA, 17 bp, Homo sapiens
ctgctgctgagaacctg

SEQ ID NO: 4623573 - DNA, 23 bp, Homo sapiens
ctgctgctgagaacctggccttc

SEQ ID NO: 4623574 - DNA, 15 bp, Homo sapiens
ctgctggccggagca

SEQ ID NO: 4623575 - DNA, 16 bp, Homo sapiens
ctgctggccggagcaa

SEQ ID NO: 4623576 - DNA, 21 bp, Homo sapiens
ctgctggtacctgccctctat

SEQ ID NO: 4623577 - DNA, 17 bp, Homo sapiens
ctgctgtaaatttggct

SEQ ID NO: 4623578 - DNA, 22 bp, Homo sapiens
ctgctgtcacctcgctgggctc

SEQ ID NO: 4623579 - DNA, 23 bp, Homo sapiens
ctgctgtcacctcgctgggctct

SEQ ID NO: 4623580 - DNA, 22 bp, Homo sapiens
ctgctgtcctgtttctgtcaag

SEQ ID NO: 4623581 - DNA, 16 bp, Homo sapiens
ctgctgtttacaacat

SEQ ID NO: 4623582 - DNA, 18 bp, Homo sapiens
ctgcttccacctcacccc

SEQ ID NO: 4623583 - DNA, 20 bp, Homo sapiens
ctgcttccgttcctccccct

SEQ ID NO: 4623584 - DNA, 23 bp, Homo sapiens
ctgcttccgttcctccccctgct

SEQ ID NO: 4623585 - DNA, 13 bp, Homo sapiens
ctgcttcctgtga

SEQ ID NO: 4623586 - DNA, 17 bp, Homo sapiens
ctgcttcctgtgacagt

SEQ ID NO: 4623587 - DNA, 19 bp, Homo sapiens
ctgcttctccatggccacc

SEQ ID NO: 4623588 - DNA, 19 bp, Homo sapiens
ctgcttgctcccaagcccc

SEQ ID NO: 4623589 - DNA, 22 bp, Homo sapiens
ctgcttggggggtgatgagggc

SEQ ID NO: 4623590 - DNA, 22 bp, Homo sapiens
ctgctttctccattgtaaacca

SEQ ID NO: 4623591 - DNA, 13 bp, Homo sapiens
ctgctttgcaaag

SEQ ID NO: 4623592 - DNA, 20 bp, Homo sapiens
ctgctttgggaagccgtgct

SEQ ID NO: 4623593 - DNA, 17 bp, Homo sapiens
ctgcttttcctctgcct

SEQ ID NO: 4623594 - DNA, 18 bp, Homo sapiens
ctggaaacttctgtaagg

SEQ ID NO: 4623595 - DNA, 17 bp, Homo sapiens
ctggaacaaattatttt

SEQ ID NO: 4623596 - DNA, 13 bp, Homo sapiens
ctggaagccttcc

SEQ ID NO: 4623597 - DNA, 22 bp, Homo sapiens
ctggacagatcaggctagccct

SEQ ID NO: 4623598 - DNA, 15 bp, Homo sapiens
ctggacagctgtgcc

SEQ ID NO: 4623599 - DNA, 18 bp, Homo sapiens
ctggacataacattttca

SEQ ID NO: 4623600 - DNA, 14 bp, Homo sapiens
ctggacggaagtgg

SEQ ID NO: 4623601 - DNA, 22 bp, Homo sapiens
ctggactgctattctagagctt

SEQ ID NO: 4623602 - DNA, 19 bp, Homo sapiens
ctggactggaggcccctgg

SEQ ID NO: 4623603 - DNA, 16 bp, Homo sapiens
ctggacttgcctctgc

SEQ ID NO: 4623604 - DNA, 12 bp, Homo sapiens
ctggagaaagag

SEQ ID NO: 4623605 - DNA, 16 bp, Homo sapiens
ctggagaaagagctgc

SEQ ID NO: 4623606 - DNA, 12 bp, Homo sapiens
ctggagaaggac

SEQ ID NO: 4623607 - DNA, 16 bp, Homo sapiens
ctggagacaaggtgct

SEQ ID NO: 4623608 - DNA, 16 bp, Homo sapiens
ctggagagaagtggaa

SEQ ID NO: 4623609 - DNA, 14 bp, Homo sapiens
ctggagcaggagcc

SEQ ID NO: 4623610 - DNA, 16 bp, Homo sapiens
ctggagcaggagcccc

SEQ ID NO: 4623611 - DNA, 17 bp, Homo sapiens
ctggagcaggagccccg

SEQ ID NO: 4623612 - DNA, 13 bp, Homo sapiens
ctggagccccatc

SEQ ID NO: 4623613 - DNA, 14 bp, Homo sapiens
ctggagctcatctg

SEQ ID NO: 4623614 - DNA, 21 bp, Homo sapiens
ctggagctcatctgcaaaagg

SEQ ID NO: 4623615 - DNA, 18 bp, Homo sapiens
ctggaggaacacttgatg

SEQ ID NO: 4623616 - DNA, 22 bp, Homo sapiens
ctggaggaatacattttattct

SEQ ID NO: 4623617 - DNA, 15 bp, Homo sapiens
ctggaggacctgagc

SEQ ID NO: 4623618 - DNA, 16 bp, Homo sapiens
ctggaggacctgagcc

SEQ ID NO: 4623619 - DNA, 19 bp, Homo sapiens
ctggagggcaagccctgcc

SEQ ID NO: 4623620 - DNA, 17 bp, Homo sapiens
ctggaggggagaggtca

SEQ ID NO: 4623621 - DNA, 23 bp, Homo sapiens
ctggaggggagaggtcagccttg

SEQ ID NO: 4623622 - DNA, 16 bp, Homo sapiens
ctggaggtctccaggg

SEQ ID NO: 4623623 - DNA, 18 bp, Homo sapiens
ctggaggtctccaggggc

SEQ ID NO: 4623624 - DNA, 23 bp, Homo sapiens
ctggaggtctccaggggcctgca

SEQ ID NO: 4623625 - DNA, 24 bp, Homo sapiens
ctggaggtctccaggggcctgcag

SEQ ID NO: 4623626 - DNA, 14 bp, Homo sapiens
ctggaggtgtggga

SEQ ID NO: 4623627 - DNA, 16 bp, Homo sapiens
ctggagtgagaggccc

SEQ ID NO: 4623628 - DNA, 17 bp, Homo sapiens
ctggagtgagaggcccc

SEQ ID NO: 4623629 - DNA, 14 bp, Homo sapiens
ctggatcagcgtgg

SEQ ID NO: 4623630 - DNA, 17 bp, Homo sapiens
ctggatcagtcctttga

SEQ ID NO: 4623631 - DNA, 21 bp, Homo sapiens
ctggatcagtcctttgatcag

SEQ ID NO: 4623632 - DNA, 22 bp, Homo sapiens
ctggatgagaaacagctcagcc

SEQ ID NO: 4623633 - DNA, 23 bp, Homo sapiens
ctggcaaaggctggctgtgtata

SEQ ID NO: 4623634 - DNA, 20 bp, Homo sapiens
ctggcaacatcttacttgtc

SEQ ID NO: 4623635 - DNA, 23 bp, Homo sapiens
ctggcagccacacttctcaggac

SEQ ID NO: 4623636 - DNA, 22 bp, Homo sapiens
ctggcagcctcccatccagggc

SEQ ID NO: 4623637 - DNA, 19 bp, Homo sapiens
ctggcataatttttacagt

SEQ ID NO: 4623638 - DNA, 17 bp, Homo sapiens
ctggcatggtggctccc

SEQ ID NO: 4623639 - DNA, 19 bp, Homo sapiens
ctggcatggtggctcccgc

SEQ ID NO: 4623640 - DNA, 18 bp, Homo sapiens
ctggccaaacccttgctt

SEQ ID NO: 4623641 - DNA, 14 bp, Homo sapiens
ctggccaagctgag

SEQ ID NO: 4623642 - DNA, 15 bp, Homo sapiens
ctggccaagctgagg

SEQ ID NO: 4623643 - DNA, 21 bp, Homo sapiens
ctggccaagctgaggtgccca

SEQ ID NO: 4623644 - DNA, 23 bp, Homo sapiens
ctggccacagccttccctctgca

SEQ ID NO: 4623645 - DNA, 13 bp, Homo sapiens
ctggcccccagct

SEQ ID NO: 4623646 - DNA, 15 bp, Homo sapiens
ctggcccccatcagc

SEQ ID NO: 4623647 - DNA, 19 bp, Homo sapiens
ctggcccccatcagccctg

SEQ ID NO: 4623648 - DNA, 21 bp, Homo sapiens
ctggcccccatcagccctgct

SEQ ID NO: 4623649 - DNA, 12 bp, Homo sapiens
ctggcccctcca

SEQ ID NO: 4623650 - DNA, 16 bp, Homo sapiens
ctggcccgtgacagac

SEQ ID NO: 4623651 - DNA, 11 bp, Homo sapiens
ctggccctgct

SEQ ID NO: 4623652 - DNA, 21 bp, Homo sapiens
ctggccgcccccagccccctc

SEQ ID NO: 4623653 - DNA, 13 bp, Homo sapiens
ctggcctcagagc

SEQ ID NO: 4623654 - DNA, 12 bp, Homo sapiens
ctggtgccacct

SEQ ID NO: 4623655 - DNA, 13 bp, Homo sapiens
ctggtgctactgt

SEQ ID NO: 4623656 - DNA, 17 bp, Homo sapiens
ctggtggggcagctcct

SEQ ID NO: 4623657 - DNA, 20 bp, Homo sapiens
ctggtgttcaccaaaaccaa

SEQ ID NO: 4623658 - DNA, 14 bp, Homo sapiens
ctggttaatttata

SEQ ID NO: 4623659 - DNA, 13 bp, Homo sapiens
ctggttccttcct

SEQ ID NO: 4623660 - DNA, 19 bp, Homo sapiens
ctggttccttccttagttt

SEQ ID NO: 4623661 - DNA, 15 bp, Homo sapiens
ctggttctaggctgc

SEQ ID NO: 4623662 - DNA, 17 bp, Homo sapiens
ctggttctaggctgctg

SEQ ID NO: 4623663 - DNA, 19 bp, Homo sapiens
ctggttctaggctgctgca

SEQ ID NO: 4623664 - DNA, 21 bp, Homo sapiens
ctggttctaggctgctgcaca

SEQ ID NO: 4623665 - DNA, 17 bp, Homo sapiens
ctggttgggcagccaga

SEQ ID NO: 4623666 - DNA, 14 bp, Homo sapiens
ctggtttcccttta

SEQ ID NO: 4623667 - DNA, 14 bp, Homo sapiens
ctggtttttcagtt

SEQ ID NO: 4623668 - DNA, 15 bp, Homo sapiens
ctggtttttcagttt

SEQ ID NO: 4623669 - DNA, 16 bp, Homo sapiens
ctggtttttcagtttt

SEQ ID NO: 4623670 - DNA, 13 bp, Homo sapiens
ctgtaaactgaat

SEQ ID NO: 4623671 - DNA, 12 bp, Homo sapiens
ctgtaaagccag

SEQ ID NO: 4623672 - DNA, 17 bp, Homo sapiens
ctgtaaatttggcttct

SEQ ID NO: 4623673 - DNA, 17 bp, Homo sapiens
ctgtaactgagagaaag

SEQ ID NO: 4623674 - DNA, 16 bp, Homo sapiens
ctgtaagggcagtgcc

SEQ ID NO: 4623675 - DNA, 15 bp, Homo sapiens
ctgtaatatttagct

SEQ ID NO: 4623676 - DNA, 15 bp, Homo sapiens
ctgtaatcaaaagga

SEQ ID NO: 4623677 - DNA, 16 bp, Homo sapiens
ctgtaatcaggcaagg

SEQ ID NO: 4623678 - DNA, 20 bp, Homo sapiens
ctgtaatcatttgtttacat

SEQ ID NO: 4623679 - DNA, 18 bp, Homo sapiens
ctgtaatcccagtacttt

SEQ ID NO: 4623680 - DNA, 14 bp, Homo sapiens
ctgtaatcctagct

SEQ ID NO: 4623681 - DNA, 19 bp, Homo sapiens
ctgtaatttttctgggaag

SEQ ID NO: 4623682 - DNA, 15 bp, Homo sapiens
ctgtacatatgtaaa

SEQ ID NO: 4623683 - DNA, 17 bp, Homo sapiens
ctgtactactctaggga

SEQ ID NO: 4623684 - DNA, 12 bp, Homo sapiens
ctgtactgcctg

SEQ ID NO: 4623685 - DNA, 16 bp, Homo sapiens
ctgtactgcctgcttg

SEQ ID NO: 4623686 - DNA, 17 bp, Homo sapiens
ctgtactgcctgcttgg

SEQ ID NO: 4623687 - DNA, 13 bp, Homo sapiens
ctgtactggccaa

SEQ ID NO: 4623688 - DNA, 16 bp, Homo sapiens
ctgtactgggccatgt

SEQ ID NO: 4623689 - DNA, 19 bp, Homo sapiens
ctgtagaatagcctgtggc

SEQ ID NO: 4623690 - DNA, 13 bp, Homo sapiens
ctgtagacactct

SEQ ID NO: 4623691 - DNA, 18 bp, Homo sapiens
ctgtagcaggttctaggc

SEQ ID NO: 4623692 - DNA, 18 bp, Homo sapiens
ctgtagcttctcttgctc

SEQ ID NO: 4623693 - DNA, 20 bp, Homo sapiens
ctgtagtaaactatttatct

SEQ ID NO: 4623694 - DNA, 18 bp, Homo sapiens
ctgtagtgagatagcatt

SEQ ID NO: 4623695 - DNA, 15 bp, Homo sapiens
ctgtatactgaaggt

SEQ ID NO: 4623696 - DNA, 23 bp, Homo sapiens
ctgtatactgaaggtctgacagt

SEQ ID NO: 4623697 - DNA, 16 bp, Homo sapiens
ctgtatccccagtgcc

SEQ ID NO: 4623698 - DNA, 17 bp, Homo sapiens
ctgtatggcactctgta

SEQ ID NO: 4623699 - DNA, 17 bp, Homo sapiens
ctgtattacagctttca

SEQ ID NO: 4623700 - DNA, 15 bp, Homo sapiens
ctgtatttgttccca

SEQ ID NO: 4623701 - DNA, 15 bp, Homo sapiens
ctgtattttgagttt

SEQ ID NO: 4623702 - DNA, 19 bp, Homo sapiens
ctgtcaaatctagtttcct

SEQ ID NO: 4623703 - DNA, 16 bp, Homo sapiens
ctgtcaagttgtacat

SEQ ID NO: 4623704 - DNA, 18 bp, Homo sapiens
ctgtcaccctgcaggact

SEQ ID NO: 4623705 - DNA, 15 bp, Homo sapiens
ctgtcacttgctgct

SEQ ID NO: 4623706 - DNA, 20 bp, Homo sapiens
ctgtcacttgctgctttttc

SEQ ID NO: 4623707 - DNA, 17 bp, Homo sapiens
ctgtcagtgttaaagat

SEQ ID NO: 4623708 - DNA, 14 bp, Homo sapiens
ctgtcatctgtgca

SEQ ID NO: 4623709 - DNA, 15 bp, Homo sapiens
ctgtcattgtattca

SEQ ID NO: 4623710 - DNA, 20 bp, Homo sapiens
ctgtccagttcctttagaaa

SEQ ID NO: 4623711 - DNA, 22 bp, Homo sapiens
ctgtcccagggccctcccagcc

SEQ ID NO: 4623712 - DNA, 16 bp, Homo sapiens
ctgtcccctagggact

SEQ ID NO: 4623713 - DNA, 17 bp, Homo sapiens
ctgtcccctagggactg

SEQ ID NO: 4623714 - DNA, 13 bp, Homo sapiens
ctgtccctgcagg

SEQ ID NO: 4623715 - DNA, 17 bp, Homo sapiens
ctgtcctagccaggtct

SEQ ID NO: 4623716 - DNA, 15 bp, Homo sapiens
ctgtcctccaacacc

SEQ ID NO: 4623717 - DNA, 22 bp, Homo sapiens
ctgtcctgctcattatgccact

SEQ ID NO: 4623718 - DNA, 19 bp, Homo sapiens
ctgtccttcttagaatgtt

SEQ ID NO: 4623719 - DNA, 21 bp, Homo sapiens
ctgtcgccacacgcctctgtg

SEQ ID NO: 4623720 - DNA, 23 bp, Homo sapiens
ctgtcgccacacgcctctgtgta

SEQ ID NO: 4623721 - DNA, 13 bp, Homo sapiens
ctgtcgctgcttc

SEQ ID NO: 4623722 - DNA, 17 bp, Homo sapiens
ctgtcgctgcttcgtgg

SEQ ID NO: 4623723 - DNA, 16 bp, Homo sapiens
ctgtctaacctgtgac

SEQ ID NO: 4623724 - DNA, 14 bp, Homo sapiens
ctgtctacctggtc

SEQ ID NO: 4623725 - DNA, 12 bp, Homo sapiens
ctgtctcagtga

SEQ ID NO: 4623726 - DNA, 15 bp, Homo sapiens
ctgtctcagtgattc

SEQ ID NO: 4623727 - DNA, 19 bp, Homo sapiens
ctgtctcagtgattcgctt

SEQ ID NO: 4623728 - DNA, 18 bp, Homo sapiens
ctgtctcgagcgccctgc

SEQ ID NO: 4623729 - DNA, 19 bp, Homo sapiens
ctgtctcgagcgccctgca

SEQ ID NO: 4623730 - DNA, 21 bp, Homo sapiens
ctgtctcgagcgccctgcaga

SEQ ID NO: 4623731 - DNA, 12 bp, Homo sapiens
ctgtctctctct

SEQ ID NO: 4623732 - DNA, 19 bp, Homo sapiens
ctgtctctgaagtactaac

SEQ ID NO: 4623733 - DNA, 13 bp, Homo sapiens
ctgtctctggcta

SEQ ID NO: 4623734 - DNA, 20 bp, Homo sapiens
ctgtctgaagcccaaagcct

SEQ ID NO: 4623735 - DNA, 21 bp, Homo sapiens
ctgtctgaagcccaaagcctg

SEQ ID NO: 4623736 - DNA, 23 bp, Homo sapiens
ctgtctgaagcccaaagcctgag

SEQ ID NO: 4623737 - DNA, 15 bp, Homo sapiens
ctgtctgttacactg

SEQ ID NO: 4623738 - DNA, 16 bp, Homo sapiens
ctgtcttagactgcta

SEQ ID NO: 4623739 - DNA, 17 bp, Homo sapiens
ctgtcttgttcattttg

SEQ ID NO: 4623740 - DNA, 21 bp, Homo sapiens
ctgtcttgttcattttgagta

SEQ ID NO: 4623741 - DNA, 22 bp, Homo sapiens
ctgtctttgcggggcctgtctc

SEQ ID NO: 4623742 - DNA, 19 bp, Homo sapiens
ctgtgaacagcttgctgtc

SEQ ID NO: 4623743 - DNA, 17 bp, Homo sapiens
ctgtgaacccaggacaa

SEQ ID NO: 4623744 - DNA, 19 bp, Homo sapiens
ctgtgaacctgggcactcc

SEQ ID NO: 4623745 - DNA, 15 bp, Homo sapiens
ctgtgaactgtgtgt

SEQ ID NO: 4623746 - DNA, 20 bp, Homo sapiens
ctgtgaactgtgtgtgaatc

SEQ ID NO: 4623747 - DNA, 23 bp, Homo sapiens
ctgtgaagcattcgagacagaac

SEQ ID NO: 4623748 - DNA, 16 bp, Homo sapiens
ctgtgaagtccttcac

SEQ ID NO: 4623749 - DNA, 24 bp, Homo sapiens
ctgtgaagtccttcacctcactga

SEQ ID NO: 4623750 - DNA, 19 bp, Homo sapiens
ctgtgaatccatgggtctg

SEQ ID NO: 4623751 - DNA, 23 bp, Homo sapiens
ctgtgaatccatgggtctggcta

SEQ ID NO: 4623752 - DNA, 17 bp, Homo sapiens
ctgtgacccccagctcc

SEQ ID NO: 4623753 - DNA, 18 bp, Homo sapiens
ctgtgacctgctgagctc

SEQ ID NO: 4623754 - DNA, 23 bp, Homo sapiens
ctgtgacctgctgagctctgaga

SEQ ID NO: 4623755 - DNA, 15 bp, Homo sapiens
ctgtgagcccagctg

SEQ ID NO: 4623756 - DNA, 17 bp, Homo sapiens
ctgtgagcccagctggg

SEQ ID NO: 4623757 - DNA, 18 bp, Homo sapiens
ctgtgaggagtctgggtc

SEQ ID NO: 4623758 - DNA, 23 bp, Homo sapiens
ctgtgatacagttttgagtaaaa

SEQ ID NO: 4623759 - DNA, 16 bp, Homo sapiens
ctgtgatatgccatag

SEQ ID NO: 4623760 - DNA, 19 bp, Homo sapiens
ctgtgcacaaaacccagac

SEQ ID NO: 4623761 - DNA, 23 bp, Homo sapiens
ctgtgccacacttcgctcttgag

SEQ ID NO: 4623762 - DNA, 14 bp, Homo sapiens
ctgtgccagagcct

SEQ ID NO: 4623763 - DNA, 22 bp, Homo sapiens
ctgtgccagagcctggggctct

SEQ ID NO: 4623764 - DNA, 19 bp, Homo sapiens
ctgtgcccatggcttctgg

SEQ ID NO: 4623765 - DNA, 17 bp, Homo sapiens
ctggcctcagagcttcc

SEQ ID NO: 4623766 - DNA, 20 bp, Homo sapiens
ctggcctcagagcttcctgg

SEQ ID NO: 4623767 - DNA, 22 bp, Homo sapiens
ctggcctcagagcttcctgggg

SEQ ID NO: 4623768 - DNA, 13 bp, Homo sapiens
ctggcctcctgcc

SEQ ID NO: 4623769 - DNA, 16 bp, Homo sapiens
ctggcctcctgcctct

SEQ ID NO: 4623770 - DNA, 18 bp, Homo sapiens
ctggcctgaactgaggag

SEQ ID NO: 4623771 - DNA, 16 bp, Homo sapiens
ctggcctggcacacat

SEQ ID NO: 4623772 - DNA, 20 bp, Homo sapiens
ctggccttgggccctctggt

SEQ ID NO: 4623773 - DNA, 23 bp, Homo sapiens
ctggctactccctggaccacgag

SEQ ID NO: 4623774 - DNA, 15 bp, Homo sapiens
ctggctagagggccc

SEQ ID NO: 4623775 - DNA, 18 bp, Homo sapiens
ctggctagagggcccaaa

SEQ ID NO: 4623776 - DNA, 22 bp, Homo sapiens
ctggctagagggcccaaagctt

SEQ ID NO: 4623777 - DNA, 16 bp, Homo sapiens
ctggctcacagtacag

SEQ ID NO: 4623778 - DNA, 17 bp, Homo sapiens
ctggctcacagtacagc

SEQ ID NO: 4623779 - DNA, 21 bp, Homo sapiens
ctggctcagcctcaaatgcag

SEQ ID NO: 4623780 - DNA, 18 bp, Homo sapiens
ctggctcccagggccatg

SEQ ID NO: 4623781 - DNA, 16 bp, Homo sapiens
ctggctccctgcccct

SEQ ID NO: 4623782 - DNA, 21 bp, Homo sapiens
ctggctccctgccccttaacc

SEQ ID NO: 4623783 - DNA, 17 bp, Homo sapiens
ctggctgattcagcatt

SEQ ID NO: 4623784 - DNA, 19 bp, Homo sapiens
ctggctgggacgtggctca

SEQ ID NO: 4623785 - DNA, 21 bp, Homo sapiens
ctggctgggacgtggctcagc

SEQ ID NO: 4623786 - DNA, 21 bp, Homo sapiens
ctggcttcagcccccaccagg

SEQ ID NO: 4623787 - DNA, 20 bp, Homo sapiens
ctggcttggggtcaagaaac

SEQ ID NO: 4623788 - DNA, 20 bp, Homo sapiens
ctgggaaccactcccaccac

SEQ ID NO: 4623789 - DNA, 19 bp, Homo sapiens
ctgggaagtcctagcccct

SEQ ID NO: 4623790 - DNA, 16 bp, Homo sapiens
ctgggacaagcaggcc

SEQ ID NO: 4623791 - DNA, 14 bp, Homo sapiens
ctgggaccaacctg

SEQ ID NO: 4623792 - DNA, 18 bp, Homo sapiens
ctgggaccaacctgacct

SEQ ID NO: 4623793 - DNA, 16 bp, Homo sapiens
ctgggaccccagctgc

SEQ ID NO: 4623794 - DNA, 17 bp, Homo sapiens
ctgggaccgctacacca

SEQ ID NO: 4623795 - DNA, 20 bp, Homo sapiens
ctgggaccgctacaccactc

SEQ ID NO: 4623796 - DNA, 22 bp, Homo sapiens
ctgggaccgctacaccactctg

SEQ ID NO: 4623797 - DNA, 24 bp, Homo sapiens
ctgggaccgctacaccactctggc

SEQ ID NO: 4623798 - DNA, 18 bp, Homo sapiens
ctgggacctccccagccc

SEQ ID NO: 4623799 - DNA, 20 bp, Homo sapiens
ctgggacctccccagcccag

SEQ ID NO: 4623800 - DNA, 18 bp, Homo sapiens
ctgggagaaattgacaga

SEQ ID NO: 4623801 - DNA, 21 bp, Homo sapiens
ctgggagcgtgggctcagcag

SEQ ID NO: 4623802 - DNA, 11 bp, Homo sapiens
ctgggagcttc

SEQ ID NO: 4623803 - DNA, 16 bp, Homo sapiens
ctgggagtagctagtt

SEQ ID NO: 4623804 - DNA, 15 bp, Homo sapiens
ctgggatgcccttcc

SEQ ID NO: 4623805 - DNA, 16 bp, Homo sapiens
ctgggatgcccttccc

SEQ ID NO: 4623806 - DNA, 18 bp, Homo sapiens
ctgggatgcccttccccc

SEQ ID NO: 4623807 - DNA, 20 bp, Homo sapiens
ctgggatgcccttccccctt

SEQ ID NO: 4623808 - DNA, 22 bp, Homo sapiens
ctgggattacaggcgcctgcca

SEQ ID NO: 4623809 - DNA, 22 bp, Homo sapiens
ctgggattcaggaaaaggcctg

SEQ ID NO: 4623810 - DNA, 17 bp, Homo sapiens
ctgggcaatggccaggg

SEQ ID NO: 4623811 - DNA, 12 bp, Homo sapiens
ctgggcattgct

SEQ ID NO: 4623812 - DNA, 12 bp, Homo sapiens
ctgggccactgg

SEQ ID NO: 4623813 - DNA, 15 bp, Homo sapiens
ctgggccactgggga

SEQ ID NO: 4623814 - DNA, 16 bp, Homo sapiens
ctgggccactggggac

SEQ ID NO: 4623815 - DNA, 17 bp, Homo sapiens
ctgggccactggggact

SEQ ID NO: 4623816 - DNA, 20 bp, Homo sapiens
ctgggccatgttgtgcctcc

SEQ ID NO: 4623817 - DNA, 20 bp, Homo sapiens
ctgggccattctccacagca

SEQ ID NO: 4623818 - DNA, 18 bp, Homo sapiens
ctgggccctctttccctg

SEQ ID NO: 4623819 - DNA, 19 bp, Homo sapiens
ctgggccctctttccctgc

SEQ ID NO: 4623820 - DNA, 12 bp, Homo sapiens
ctgggccctggg

SEQ ID NO: 4623821 - DNA, 13 bp, Homo sapiens
ctgggccctgggg

SEQ ID NO: 4623822 - DNA, 20 bp, Homo sapiens
ctgggccctggggcctgtac

SEQ ID NO: 4623823 - DNA, 16 bp, Homo sapiens
ctgggcctatggagag

SEQ ID NO: 4623824 - DNA, 17 bp, Homo sapiens
ctgggcctgctgctgag

SEQ ID NO: 4623825 - DNA, 22 bp, Homo sapiens
ctgggcctgctgctgagaacct

SEQ ID NO: 4623826 - DNA, 16 bp, Homo sapiens
ctgggcctttgcaaga

SEQ ID NO: 4623827 - DNA, 23 bp, Homo sapiens
ctgggcctttgcaagatgcttgg

SEQ ID NO: 4623828 - DNA, 17 bp, Homo sapiens
ctgggctcaagctttcc

SEQ ID NO: 4623829 - DNA, 23 bp, Homo sapiens
ctgggctctggactccacggatg

SEQ ID NO: 4623830 - DNA, 14 bp, Homo sapiens
ctgggctgggccct

SEQ ID NO: 4623831 - DNA, 12 bp, Homo sapiens
ctgggctgggga

SEQ ID NO: 4623832 - DNA, 15 bp, Homo sapiens
ctgggctgtgggcaa

SEQ ID NO: 4623833 - DNA, 13 bp, Homo sapiens
ctggggactcagg

SEQ ID NO: 4623834 - DNA, 17 bp, Homo sapiens
ctggggacttgtgtctg

SEQ ID NO: 4623835 - DNA, 18 bp, Homo sapiens
ctggggacttgtgtctgc

SEQ ID NO: 4623836 - DNA, 23 bp, Homo sapiens
ctggggactttatttatttctag

SEQ ID NO: 4623837 - DNA, 14 bp, Homo sapiens
ctggggaggaggag

SEQ ID NO: 4623838 - DNA, 18 bp, Homo sapiens
ctggggaggaggagagag

SEQ ID NO: 4623839 - DNA, 19 bp, Homo sapiens
ctggggaggaggagagagt

SEQ ID NO: 4623840 - DNA, 20 bp, Homo sapiens
ctggggaggaggagagagtc

SEQ ID NO: 4623841 - DNA, 21 bp, Homo sapiens
ctggggatcacagcctcaccc

SEQ ID NO: 4623842 - DNA, 12 bp, Homo sapiens
ctggggatgcgc

SEQ ID NO: 4623843 - DNA, 14 bp, Homo sapiens
ctggggccaggccc

SEQ ID NO: 4623844 - DNA, 15 bp, Homo sapiens
ctggggccaggcccc

SEQ ID NO: 4623845 - DNA, 17 bp, Homo sapiens
ctggggcctgagagaat

SEQ ID NO: 4623846 - DNA, 16 bp, Homo sapiens
ctggggcctgtactgc

SEQ ID NO: 4623847 - DNA, 19 bp, Homo sapiens
ctggggctctaacgcctga

SEQ ID NO: 4623848 - DNA, 20 bp, Homo sapiens
ctggggctctaacgcctgag

SEQ ID NO: 4623849 - DNA, 21 bp, Homo sapiens
ctggggctctaacgcctgagc

SEQ ID NO: 4623850 - DNA, 23 bp, Homo sapiens
ctggggctctaacgcctgagccc

SEQ ID NO: 4623851 - DNA, 14 bp, Homo sapiens
ctggggctggcctc

SEQ ID NO: 4623852 - DNA, 21 bp, Homo sapiens
ctgggggaatgagcccagaga

SEQ ID NO: 4623853 - DNA, 15 bp, Homo sapiens
ctgggggcctggctg

SEQ ID NO: 4623854 - DNA, 18 bp, Homo sapiens
ctgggggcctggctggct

SEQ ID NO: 4623855 - DNA, 19 bp, Homo sapiens
ctgggggtttaagctctgc

SEQ ID NO: 4623856 - DNA, 20 bp, Homo sapiens
ctgggtaaaagcagggcagc

SEQ ID NO: 4623857 - DNA, 13 bp, Homo sapiens
ctgggtaggcccc

SEQ ID NO: 4623858 - DNA, 14 bp, Homo sapiens
ctgggtaggcccca

SEQ ID NO: 4623859 - DNA, 19 bp, Homo sapiens
ctgggtaggccccacaagg

SEQ ID NO: 4623860 - DNA, 19 bp, Homo sapiens
ctgggtcagacccatctct

SEQ ID NO: 4623861 - DNA, 13 bp, Homo sapiens
ctgggtgatctgc

SEQ ID NO: 4623862 - DNA, 13 bp, Homo sapiens
ctgggtgctgccc

SEQ ID NO: 4623863 - DNA, 18 bp, Homo sapiens
ctgggtgtgactgattcc

SEQ ID NO: 4623864 - DNA, 21 bp, Homo sapiens
ctgggttcacgtaatcctcct

SEQ ID NO: 4623865 - DNA, 19 bp, Homo sapiens
ctggtaagcgatttgaaac

SEQ ID NO: 4623866 - DNA, 13 bp, Homo sapiens
ctggtacctgccc

SEQ ID NO: 4623867 - DNA, 21 bp, Homo sapiens
ctggtactattgtgaccacag

SEQ ID NO: 4623868 - DNA, 16 bp, Homo sapiens
ctggtaggttgggaca

SEQ ID NO: 4623869 - DNA, 22 bp, Homo sapiens
ctggtaggttgggacaccaggg

SEQ ID NO: 4623870 - DNA, 15 bp, Homo sapiens
ctggtcaacctcctg

SEQ ID NO: 4623871 - DNA, 14 bp, Homo sapiens
ctggtcacctccca

SEQ ID NO: 4623872 - DNA, 16 bp, Homo sapiens
ctggtcagctgcccca

SEQ ID NO: 4623873 - DNA, 13 bp, Homo sapiens
ctggtcctgacca

SEQ ID NO: 4623874 - DNA, 14 bp, Homo sapiens
ctggtcctgaccag

SEQ ID NO: 4623875 - DNA, 21 bp, Homo sapiens
ctggtcctgaccaggatggag

SEQ ID NO: 4623876 - DNA, 11 bp, Homo sapiens
ctgtgccccac

SEQ ID NO: 4623877 - DNA, 14 bp, Homo sapiens
ctgtgccccaccac

SEQ ID NO: 4623878 - DNA, 15 bp, Homo sapiens
ctgtgcctccataat

SEQ ID NO: 4623879 - DNA, 17 bp, Homo sapiens
ctgtgcctcgctcccca

SEQ ID NO: 4623880 - DNA, 23 bp, Homo sapiens
ctgtgcctcgctccccactctgc

SEQ ID NO: 4623881 - DNA, 19 bp, Homo sapiens
ctgtgcgtcccagctgaag

SEQ ID NO: 4623882 - DNA, 20 bp, Homo sapiens
ctgtgctacgtgtgaaatct

SEQ ID NO: 4623883 - DNA, 22 bp, Homo sapiens
ctgtgctcaaaaatgagagtga

SEQ ID NO: 4623884 - DNA, 23 bp, Homo sapiens
ctgtgctcaaaaatgagagtgac

SEQ ID NO: 4623885 - DNA, 23 bp, Homo sapiens
ctgtgctccatatttgatttcta

SEQ ID NO: 4623886 - DNA, 19 bp, Homo sapiens
ctgtgctccatggctgcca

SEQ ID NO: 4623887 - DNA, 13 bp, Homo sapiens
ctgtgctggggga

SEQ ID NO: 4623888 - DNA, 19 bp, Homo sapiens
ctgtggaaggcctccctct

SEQ ID NO: 4623889 - DNA, 16 bp, Homo sapiens
ctgtggagctgccaca

SEQ ID NO: 4623890 - DNA, 18 bp, Homo sapiens
ctgtggagctgccacaga

SEQ ID NO: 4623891 - DNA, 19 bp, Homo sapiens
ctgtggagctgccacagag

SEQ ID NO: 4623892 - DNA, 20 bp, Homo sapiens
ctgtggagctgccacagaga

SEQ ID NO: 4623893 - DNA, 18 bp, Homo sapiens
ctgtggccaagttcttag

SEQ ID NO: 4623894 - DNA, 13 bp, Homo sapiens
ctgtggctccctc

SEQ ID NO: 4623895 - DNA, 22 bp, Homo sapiens
ctgtggctccctctctcctgga

SEQ ID NO: 4623896 - DNA, 14 bp, Homo sapiens
ctgtggggaaaggg

SEQ ID NO: 4623897 - DNA, 19 bp, Homo sapiens
ctgtggggtggacctggga

SEQ ID NO: 4623898 - DNA, 20 bp, Homo sapiens
ctgtggtctggtgttccagc

SEQ ID NO: 4623899 - DNA, 20 bp, Homo sapiens
ctgtggtgacttctgctgct

SEQ ID NO: 4623900 - DNA, 22 bp, Homo sapiens
ctgtggtgacttctgctgctgg

SEQ ID NO: 4623901 - DNA, 16 bp, Homo sapiens
ctgtgtacaaagaaat

SEQ ID NO: 4623902 - DNA, 21 bp, Homo sapiens
ctgtgtacatgtgtgcagagc

SEQ ID NO: 4623903 - DNA, 22 bp, Homo sapiens
ctgtgtacatgtgtgcagagca

SEQ ID NO: 4623904 - DNA, 17 bp, Homo sapiens
ctgtgtagctgtgacct

SEQ ID NO: 4623905 - DNA, 14 bp, Homo sapiens
ctgtgtagttccct

SEQ ID NO: 4623906 - DNA, 16 bp, Homo sapiens
ctgtgtagttccctct

SEQ ID NO: 4623907 - DNA, 18 bp, Homo sapiens
ctgtgtagttccctctgc

SEQ ID NO: 4623908 - DNA, 19 bp, Homo sapiens
ctgtgtagttccctctgcc

SEQ ID NO: 4623909 - DNA, 22 bp, Homo sapiens
ctgtgtagttccctctgcctgg

SEQ ID NO: 4623910 - DNA, 23 bp, Homo sapiens
ctgtgtagttccctctgcctggg

SEQ ID NO: 4623911 - DNA, 18 bp, Homo sapiens
ctgtgtctgaatcatgtc

SEQ ID NO: 4623912 - DNA, 20 bp, Homo sapiens
ctgtgtctgaatcatgtctg

SEQ ID NO: 4623913 - DNA, 19 bp, Homo sapiens
ctgtgtctgagtggcttca

SEQ ID NO: 4623914 - DNA, 23 bp, Homo sapiens
ctgtgtgctcctccttggtgcct

SEQ ID NO: 4623915 - DNA, 16 bp, Homo sapiens
ctgtgttatgaaaata

SEQ ID NO: 4623916 - DNA, 11 bp, Homo sapiens
ctgtgtttcaa

SEQ ID NO: 4623917 - DNA, 19 bp, Homo sapiens
ctgtgtttcaaatggactg

SEQ ID NO: 4623918 - DNA, 23 bp, Homo sapiens
ctgttaaggacccttttaagcat

SEQ ID NO: 4623919 - DNA, 13 bp, Homo sapiens
ctgttaatgtgga

SEQ ID NO: 4623920 - DNA, 21 bp, Homo sapiens
ctgttaatgtggactggaaca

SEQ ID NO: 4623921 - DNA, 16 bp, Homo sapiens
ctgttaatttttctta

SEQ ID NO: 4623922 - DNA, 13 bp, Homo sapiens
ctgttacactgga

SEQ ID NO: 4623923 - DNA, 22 bp, Homo sapiens
ctgttagtgttaaaaatctagt

SEQ ID NO: 4623924 - DNA, 16 bp, Homo sapiens
ctgttcagtaataaaa

SEQ ID NO: 4623925 - DNA, 14 bp, Homo sapiens
ctgttcatacagtt

SEQ ID NO: 4623926 - DNA, 15 bp, Homo sapiens
ctgttcatctgtgca

SEQ ID NO: 4623927 - DNA, 15 bp, Homo sapiens
ctgttccagattcct

SEQ ID NO: 4623928 - DNA, 19 bp, Homo sapiens
ctgttccctatggagaggc

SEQ ID NO: 4623929 - DNA, 15 bp, Homo sapiens
ctgttctgagaaggt

SEQ ID NO: 4623930 - DNA, 22 bp, Homo sapiens
ctgttgaaacttacactgtttc

SEQ ID NO: 4623931 - DNA, 15 bp, Homo sapiens
ctgttgactggctgt

SEQ ID NO: 4623932 - DNA, 12 bp, Homo sapiens
ctgttgagggcc

SEQ ID NO: 4623933 - DNA, 12 bp, Homo sapiens
ctgttgcatggg

SEQ ID NO: 4623934 - DNA, 19 bp, Homo sapiens
ctgttgcctcctctctccc

SEQ ID NO: 4623935 - DNA, 22 bp, Homo sapiens
ctgttgcctcctctctccctgc

SEQ ID NO: 4623936 - DNA, 17 bp, Homo sapiens
ctgttggagcaaaccat

SEQ ID NO: 4623937 - DNA, 18 bp, Homo sapiens
ctgttggagcaaaccatt

SEQ ID NO: 4623938 - DNA, 14 bp, Homo sapiens
ctgtttacaacatc

SEQ ID NO: 4623939 - DNA, 18 bp, Homo sapiens
ctgtttacaacatcacca

SEQ ID NO: 4623940 - DNA, 19 bp, Homo sapiens
ctgtttacatccagagttc

SEQ ID NO: 4623941 - DNA, 15 bp, Homo sapiens
ctgtttagttttaca

SEQ ID NO: 4623942 - DNA, 18 bp, Homo sapiens
ctgtttcatctcagcttt

SEQ ID NO: 4623943 - DNA, 14 bp, Homo sapiens
ctgtttccagggtc

SEQ ID NO: 4623944 - DNA, 19 bp, Homo sapiens
ctgtttcctgacattgtct

SEQ ID NO: 4623945 - DNA, 12 bp, Homo sapiens
ctgtttctaaga

SEQ ID NO: 4623946 - DNA, 21 bp, Homo sapiens
ctgttttagtgtttatgttta

SEQ ID NO: 4623947 - DNA, 19 bp, Homo sapiens
ctgttttattactgtttct

SEQ ID NO: 4623948 - DNA, 12 bp, Homo sapiens
ctgttttctgct

SEQ ID NO: 4623949 - DNA, 15 bp, Homo sapiens
ctgttttctgctgtt

SEQ ID NO: 4623950 - DNA, 19 bp, Homo sapiens
ctgttttctgctgtttaca

SEQ ID NO: 4623951 - DNA, 16 bp, Homo sapiens
ctgttttgtaaagtcc

SEQ ID NO: 4623952 - DNA, 12 bp, Homo sapiens
cttaaaaaggaa

SEQ ID NO: 4623953 - DNA, 13 bp, Homo sapiens
cttaaaaaggaac

SEQ ID NO: 4623954 - DNA, 15 bp, Homo sapiens
cttaaaaatacttct

SEQ ID NO: 4623955 - DNA, 19 bp, Homo sapiens
cttaaaactttattaaaag

SEQ ID NO: 4623956 - DNA, 11 bp, Homo sapiens
cttaaaatgga

SEQ ID NO: 4623957 - DNA, 19 bp, Homo sapiens
cttaaaatgtgtacagtga

SEQ ID NO: 4623958 - DNA, 22 bp, Homo sapiens
cttaaagagggacaggctgaag

SEQ ID NO: 4623959 - DNA, 13 bp, Homo sapiens
cttaaaggggaga

SEQ ID NO: 4623960 - DNA, 19 bp, Homo sapiens
cttaaatattgtaatatga

SEQ ID NO: 4623961 - DNA, 21 bp, Homo sapiens
cttaaccccaaggactgaggg

SEQ ID NO: 4623962 - DNA, 14 bp, Homo sapiens
cttaacctgggacc

SEQ ID NO: 4623963 - DNA, 18 bp, Homo sapiens
cttaacttattacctcag

SEQ ID NO: 4623964 - DNA, 11 bp, Homo sapiens
cttaactttat

SEQ ID NO: 4623965 - DNA, 19 bp, Homo sapiens
cttaagaactgcttcatgt

SEQ ID NO: 4623966 - DNA, 20 bp, Homo sapiens
cttaagaactgcttcatgtg

SEQ ID NO: 4623967 - DNA, 15 bp, Homo sapiens
cttaagattaatttt

SEQ ID NO: 4623968 - DNA, 14 bp, Homo sapiens
cttaagccctggcc

SEQ ID NO: 4623969 - DNA, 16 bp, Homo sapiens
cttaagccctggcccc

SEQ ID NO: 4623970 - DNA, 18 bp, Homo sapiens
cttaagctcccctgcctt

SEQ ID NO: 4623971 - DNA, 10 bp, Homo sapiens
cttaatcttc

SEQ ID NO: 4623972 - DNA, 22 bp, Homo sapiens
cttaatcttctctcttgattga

SEQ ID NO: 4623973 - DNA, 13 bp, Homo sapiens
cttaatcttgctt

SEQ ID NO: 4623974 - DNA, 22 bp, Homo sapiens
cttaatctttattttattattc

SEQ ID NO: 4623975 - DNA, 18 bp, Homo sapiens
cttaatttgtaaacttct

SEQ ID NO: 4623976 - DNA, 15 bp, Homo sapiens
cttacaatgtgaata

SEQ ID NO: 4623977 - DNA, 15 bp, Homo sapiens
cttacccatcttgct

SEQ ID NO: 4623978 - DNA, 19 bp, Homo sapiens
cttacccatcttgcttcca

SEQ ID NO: 4623979 - DNA, 17 bp, Homo sapiens
cttacctgtctctctct

SEQ ID NO: 4623980 - DNA, 15 bp, Homo sapiens
cttactaatgtaaaa

SEQ ID NO: 4623981 - DNA, 12 bp, Homo sapiens
cttactcctgtg

SEQ ID NO: 4623982 - DNA, 15 bp, Homo sapiens
cttactcctgtggga

SEQ ID NO: 4623983 - DNA, 20 bp, Homo sapiens
cttactctctgcttccgttc

SEQ ID NO: 4623984 - DNA, 12 bp, Homo sapiens
cttactgcctga

SEQ ID NO: 4623985 - DNA, 20 bp, Homo sapiens
cttacttttattattttaat

SEQ ID NO: 4623986 - DNA, 14 bp, Homo sapiens
cttagaaagggaag

SEQ ID NO: 4623987 - DNA, 15 bp, Homo sapiens
cttagaaagggaagg

SEQ ID NO: 4623988 - DNA, 20 bp, Homo sapiens
cttagacctgccagccactg

SEQ ID NO: 4623989 - DNA, 17 bp, Homo sapiens
cttagagattttcattt

SEQ ID NO: 4623990 - DNA, 16 bp, Homo sapiens
cttagaggttctgcct

SEQ ID NO: 4623991 - DNA, 19 bp, Homo sapiens
cttagagtgtagctgtaag

SEQ ID NO: 4623992 - DNA, 19 bp, Homo sapiens
cttagccccattgctccat

SEQ ID NO: 4623993 - DNA, 11 bp, Homo sapiens
cttagctttac

SEQ ID NO: 4623994 - DNA, 13 bp, Homo sapiens
cttagctttacat

SEQ ID NO: 4623995 - DNA, 15 bp, Homo sapiens
cttagctttacattt

SEQ ID NO: 4623996 - DNA, 15 bp, Homo sapiens
cttagtcatggtgtt

SEQ ID NO: 4623997 - DNA, 17 bp, Homo sapiens
cttagtccagttgtgtt

SEQ ID NO: 4623998 - DNA, 22 bp, Homo sapiens
cttagtttcaaagtgtctcatt

SEQ ID NO: 4623999 - DNA, 22 bp, Homo sapiens
cttatacaacagcaaaccctga

SEQ ID NO: 4624000 - DNA, 18 bp, Homo sapiens
cttatatgccaagctaat

SEQ ID NO: 4624001 - DNA, 12 bp, Homo sapiens
cttatcagagct

SEQ ID NO: 4624002 - DNA, 18 bp, Homo sapiens
cttatcctagcctttggg

SEQ ID NO: 4624003 - DNA, 19 bp, Homo sapiens
cttatctcgaatttgaaga

SEQ ID NO: 4624004 - DNA, 20 bp, Homo sapiens
cttatctcgaatttgaagag

SEQ ID NO: 4624005 - DNA, 15 bp, Homo sapiens
cttatgcaaaatgga

SEQ ID NO: 4624006 - DNA, 16 bp, Homo sapiens
cttatgcaaaatggaa

SEQ ID NO: 4624007 - DNA, 14 bp, Homo sapiens
cttatgtgaaaaat

SEQ ID NO: 4624008 - DNA, 20 bp, Homo sapiens
cttattgaaaaaaaaaatgt

SEQ ID NO: 4624009 - DNA, 17 bp, Homo sapiens
cttattggaaatgtact

SEQ ID NO: 4624010 - DNA, 11 bp, Homo sapiens
cttatttctgc

SEQ ID NO: 4624011 - DNA, 17 bp, Homo sapiens
cttatttctgctctgga

SEQ ID NO: 4624012 - DNA, 21 bp, Homo sapiens
cttattttcagtgcatcatta

SEQ ID NO: 4624013 - DNA, 24 bp, Homo sapiens
cttcaacagaccccctctagaaat

SEQ ID NO: 4624014 - DNA, 12 bp, Homo sapiens
cttcaacatgac

SEQ ID NO: 4624015 - DNA, 16 bp, Homo sapiens
cttcaacttttctctt

SEQ ID NO: 4624016 - DNA, 18 bp, Homo sapiens
cttcaagatgagcctggg

SEQ ID NO: 4624017 - DNA, 19 bp, Homo sapiens
cttcaagatgagcctgggc

SEQ ID NO: 4624018 - DNA, 22 bp, Homo sapiens
cttcaagatgagcctgggctca

SEQ ID NO: 4624019 - DNA, 16 bp, Homo sapiens
cttcaatgacttctaa

SEQ ID NO: 4624020 - DNA, 16 bp, Homo sapiens
cttcacctcctttcaa

SEQ ID NO: 4624021 - DNA, 21 bp, Homo sapiens
cttcacctctgggaccccagc

SEQ ID NO: 4624022 - DNA, 22 bp, Homo sapiens
cttcacctctgggaccccagct

SEQ ID NO: 4624023 - DNA, 15 bp, Homo sapiens
cttcacctcttccac

SEQ ID NO: 4624024 - DNA, 16 bp, Homo sapiens
cttcacctcttccact

SEQ ID NO: 4624025 - DNA, 21 bp, Homo sapiens
cttcacctgattcaactaaaa

SEQ ID NO: 4624026 - DNA, 18 bp, Homo sapiens
cttcacgaagtgttgcat

SEQ ID NO: 4624027 - DNA, 19 bp, Homo sapiens
cttcacgaagtgttgcatg

SEQ ID NO: 4624028 - DNA, 20 bp, Homo sapiens
cttcacgaagtgttgcatgg

SEQ ID NO: 4624029 - DNA, 14 bp, Homo sapiens
cttcactcctgctg

SEQ ID NO: 4624030 - DNA, 18 bp, Homo sapiens
cttcagacacatgctatg

SEQ ID NO: 4624031 - DNA, 15 bp, Homo sapiens
cttcagcatcctcag

SEQ ID NO: 4624032 - DNA, 16 bp, Homo sapiens
cttcagcgtaaaatgg

SEQ ID NO: 4624033 - DNA, 15 bp, Homo sapiens
cttcagtcagggttt

SEQ ID NO: 4624034 - DNA, 18 bp, Homo sapiens
cttcagtcatcagccagc

SEQ ID NO: 4624035 - DNA, 14 bp, Homo sapiens
cttcagtgactcct

SEQ ID NO: 4624036 - DNA, 18 bp, Homo sapiens
cttcagtgactcctgctg

SEQ ID NO: 4624037 - DNA, 19 bp, Homo sapiens
cttcagtgactcctgctgg

SEQ ID NO: 4624038 - DNA, 15 bp, Homo sapiens
cttcagttctgcttg

SEQ ID NO: 4624039 - DNA, 14 bp, Homo sapiens
cttcagtttatttc

SEQ ID NO: 4624040 - DNA, 22 bp, Homo sapiens
cttcagtttatttccactattt

SEQ ID NO: 4624041 - DNA, 20 bp, Homo sapiens
cttcatctcccacctagcag

SEQ ID NO: 4624042 - DNA, 14 bp, Homo sapiens
cttcatgtcctaaa

SEQ ID NO: 4624043 - DNA, 17 bp, Homo sapiens
cttcatttcaatcattg

SEQ ID NO: 4624044 - DNA, 21 bp, Homo sapiens
cttcatttctctttttatctc

SEQ ID NO: 4624045 - DNA, 15 bp, Homo sapiens
cttcatttggaggaa

SEQ ID NO: 4624046 - DNA, 18 bp, Homo sapiens
cttcatttttaagaaagg

SEQ ID NO: 4624047 - DNA, 20 bp, Homo sapiens
cttccaaataataaagtcta

SEQ ID NO: 4624048 - DNA, 14 bp, Homo sapiens
cttccacctcaccc

SEQ ID NO: 4624049 - DNA, 18 bp, Homo sapiens
cttccacctccagcctct

SEQ ID NO: 4624050 - DNA, 22 bp, Homo sapiens
cttccagctagtgacccacatg

SEQ ID NO: 4624051 - DNA, 12 bp, Homo sapiens
cttccagttttg

SEQ ID NO: 4624052 - DNA, 15 bp, Homo sapiens
cttccatgctcccaa

SEQ ID NO: 4624053 - DNA, 14 bp, Homo sapiens
cttccattttcccc

SEQ ID NO: 4624054 - DNA, 23 bp, Homo sapiens
cttccattttcccccactactgc

SEQ ID NO: 4624055 - DNA, 14 bp, Homo sapiens
cttcccaaacccag

SEQ ID NO: 4624056 - DNA, 20 bp, Homo sapiens
cttcccaaacccagtctcct

SEQ ID NO: 4624057 - DNA, 14 bp, Homo sapiens
cttcccatccccag

SEQ ID NO: 4624058 - DNA, 17 bp, Homo sapiens
cttcccatccccagcga

SEQ ID NO: 4624059 - DNA, 12 bp, Homo sapiens
cttccccagctc

SEQ ID NO: 4624060 - DNA, 19 bp, Homo sapiens
cttccccatgaaccctgcc

SEQ ID NO: 4624061 - DNA, 22 bp, Homo sapiens
cttccccctttctctgcctggc

SEQ ID NO: 4624062 - DNA, 12 bp, Homo sapiens
cttcccctggga

SEQ ID NO: 4624063 - DNA, 23 bp, Homo sapiens
cttcccctgggaactctcctggc

SEQ ID NO: 4624064 - DNA, 16 bp, Homo sapiens
cttccctataggaaca

SEQ ID NO: 4624065 - DNA, 17 bp, Homo sapiens
cttccctataggaacag

SEQ ID NO: 4624066 - DNA, 16 bp, Homo sapiens
cttccctctgcattga

SEQ ID NO: 4624067 - DNA, 22 bp, Homo sapiens
cttccctctgcattgacctgga

SEQ ID NO: 4624068 - DNA, 19 bp, Homo sapiens
cttcccttgctcatgagct

SEQ ID NO: 4624069 - DNA, 22 bp, Homo sapiens
cttcccttgctcatgagctcct

SEQ ID NO: 4624070 - DNA, 12 bp, Homo sapiens
cttccgctgagg

SEQ ID NO: 4624071 - DNA, 21 bp, Homo sapiens
cttccgctttgaaagaagcaa

SEQ ID NO: 4624072 - DNA, 17 bp, Homo sapiens
cttcctagtaagtcagg

SEQ ID NO: 4624073 - DNA, 15 bp, Homo sapiens
cttcctcagcaggcc

SEQ ID NO: 4624074 - DNA, 17 bp, Homo sapiens
cttcctcagcaggccaa

SEQ ID NO: 4624075 - DNA, 18 bp, Homo sapiens
cttcctcttcctgccctt

SEQ ID NO: 4624076 - DNA, 20 bp, Homo sapiens
cttcctgcaggcaggaacaa

SEQ ID NO: 4624077 - DNA, 10 bp, Homo sapiens
cttcctgccc

SEQ ID NO: 4624078 - DNA, 11 bp, Homo sapiens
cttcctgccct

SEQ ID NO: 4624079 - DNA, 16 bp, Homo sapiens
cttcctgcccttgaac

SEQ ID NO: 4624080 - DNA, 16 bp, Homo sapiens
cttcctggacagctgt

SEQ ID NO: 4624081 - DNA, 14 bp, Homo sapiens
cttcctgtggctcc

SEQ ID NO: 4624082 - DNA, 22 bp, Homo sapiens
cttcctgtggctccctctctcc

SEQ ID NO: 4624083 - DNA, 16 bp, Homo sapiens
cttccttaccgtgggc

SEQ ID NO: 4624084 - DNA, 22 bp, Homo sapiens
cttccttagtttcaaagtgtct

SEQ ID NO: 4624085 - DNA, 17 bp, Homo sapiens
cttccttggttcatgct

SEQ ID NO: 4624086 - DNA, 15 bp, Homo sapiens
cttcgaaaggccttc

SEQ ID NO: 4624087 - DNA, 17 bp, Homo sapiens
cttcgaaaggccttcag

SEQ ID NO: 4624088 - DNA, 20 bp, Homo sapiens
cttcgaaaggccttcagaca

SEQ ID NO: 4624089 - DNA, 13 bp, Homo sapiens
cttcgctgaaatt

SEQ ID NO: 4624090 - DNA, 17 bp, Homo sapiens
cttcggacagacatatg

SEQ ID NO: 4624091 - DNA, 22 bp, Homo sapiens
cttcggagggaaattgtaaatc

SEQ ID NO: 4624092 - DNA, 13 bp, Homo sapiens
cttctaaagaagt

SEQ ID NO: 4624093 - DNA, 14 bp, Homo sapiens
cttctaatttatat

SEQ ID NO: 4624094 - DNA, 16 bp, Homo sapiens
cttctattaatcaaga

SEQ ID NO: 4624095 - DNA, 19 bp, Homo sapiens
cttctcaggacacaggcct

SEQ ID NO: 4624096 - DNA, 20 bp, Homo sapiens
cttctcaggacacaggcctg

SEQ ID NO: 4624097 - DNA, 21 bp, Homo sapiens
cttctcaggacacaggcctgt

SEQ ID NO: 4624098 - DNA, 18 bp, Homo sapiens
cttctcagtttctgcctg

SEQ ID NO: 4624099 - DNA, 23 bp, Homo sapiens
cttctcagtttctgcctgggcaa

SEQ ID NO: 4624100 - DNA, 12 bp, Homo sapiens
cttctccatgct

SEQ ID NO: 4624101 - DNA, 14 bp, Homo sapiens
cttctccatgctgc

SEQ ID NO: 4624102 - DNA, 15 bp, Homo sapiens
cttctccatgctgca

SEQ ID NO: 4624103 - DNA, 15 bp, Homo sapiens
cttctccattcccta

SEQ ID NO: 4624104 - DNA, 16 bp, Homo sapiens
cttctccattccctag

SEQ ID NO: 4624105 - DNA, 15 bp, Homo sapiens
cttctcccaggcctc

SEQ ID NO: 4624106 - DNA, 16 bp, Homo sapiens
cttctcccaggcctct

SEQ ID NO: 4624107 - DNA, 17 bp, Homo sapiens
cttctcccaggcctctg

SEQ ID NO: 4624108 - DNA, 20 bp, Homo sapiens
cttctcccaggcctctgccc

SEQ ID NO: 4624109 - DNA, 23 bp, Homo sapiens
cttctctcactgtgttactgctt

SEQ ID NO: 4624110 - DNA, 13 bp, Homo sapiens
cttctctctcacc

SEQ ID NO: 4624111 - DNA, 15 bp, Homo sapiens
cttctctctcaccag

SEQ ID NO: 4624112 - DNA, 14 bp, Homo sapiens
cttctctgtgtgca

SEQ ID NO: 4624113 - DNA, 16 bp, Homo sapiens
cttctgaaatgtgacc

SEQ ID NO: 4624114 - DNA, 16 bp, Homo sapiens
cttctgcaaagtggca

SEQ ID NO: 4624115 - DNA, 20 bp, Homo sapiens
cttctgcaaagtggcaggga

SEQ ID NO: 4624116 - DNA, 15 bp, Homo sapiens
cttctgctcagctct

SEQ ID NO: 4624117 - DNA, 12 bp, Homo sapiens
cttctgctgctg

SEQ ID NO: 4624118 - DNA, 16 bp, Homo sapiens
cttctggcttcagccc

SEQ ID NO: 4624119 - DNA, 15 bp, Homo sapiens
cttctgtattttaat

SEQ ID NO: 4624120 - DNA, 20 bp, Homo sapiens
cttctgttgtcaccttcacc

SEQ ID NO: 4624121 - DNA, 21 bp, Homo sapiens
cttctgttgtcaccttcacct

SEQ ID NO: 4624122 - DNA, 13 bp, Homo sapiens
cttcttatcctta

SEQ ID NO: 4624123 - DNA, 18 bp, Homo sapiens
cttcttcacctcttccac

SEQ ID NO: 4624124 - DNA, 15 bp, Homo sapiens
cttcttcctgaagct

SEQ ID NO: 4624125 - DNA, 13 bp, Homo sapiens
cttcttgtcagac

SEQ ID NO: 4624126 - DNA, 14 bp, Homo sapiens
cttcttgtcagaca

SEQ ID NO: 4624127 - DNA, 20 bp, Homo sapiens
cttcttgtcagacataaagc

SEQ ID NO: 4624128 - DNA, 20 bp, Homo sapiens
cttctttcccttagtgactc

SEQ ID NO: 4624129 - DNA, 22 bp, Homo sapiens
cttgaaaccaattaagcagctt

SEQ ID NO: 4624130 - DNA, 21 bp, Homo sapiens
cttgaaacctgttaaaacaac

SEQ ID NO: 4624131 - DNA, 17 bp, Homo sapiens
cttgaaagaattttcct

SEQ ID NO: 4624132 - DNA, 14 bp, Homo sapiens
cttgaagggttact

SEQ ID NO: 4624133 - DNA, 18 bp, Homo sapiens
cttgaagtacttaacata

SEQ ID NO: 4624134 - DNA, 20 bp, Homo sapiens
cttgaagttgtggaggaggt

SEQ ID NO: 4624135 - DNA, 17 bp, Homo sapiens
cttgaatgtggtctcag

SEQ ID NO: 4624136 - DNA, 19 bp, Homo sapiens
cttgaatgtggtctcagga

SEQ ID NO: 4624137 - DNA, 21 bp, Homo sapiens
cttgacagactgtagcttctc

SEQ ID NO: 4624138 - DNA, 18 bp, Homo sapiens
cttgacatgtagcttctt

SEQ ID NO: 4624139 - DNA, 20 bp, Homo sapiens
cttgagcaagttccttctgg

SEQ ID NO: 4624140 - DNA, 14 bp, Homo sapiens
cttgagctgtctga

SEQ ID NO: 4624141 - DNA, 23 bp, Homo sapiens
cttgaggagctcaacggtctggc

SEQ ID NO: 4624142 - DNA, 15 bp, Homo sapiens
cttgatcattccggt

SEQ ID NO: 4624143 - DNA, 20 bp, Homo sapiens
cttgatccccttgatagatg

SEQ ID NO: 4624144 - DNA, 23 bp, Homo sapiens
cttgatgccatatgccttgggga

SEQ ID NO: 4624145 - DNA, 14 bp, Homo sapiens
cttgattgattttt

SEQ ID NO: 4624146 - DNA, 13 bp, Homo sapiens
cttgcacccgcaa

SEQ ID NO: 4624147 - DNA, 15 bp, Homo sapiens
cttgcccaccccacc

SEQ ID NO: 4624148 - DNA, 18 bp, Homo sapiens
cttgcccaggtgagggaa

SEQ ID NO: 4624149 - DNA, 14 bp, Homo sapiens
cttgcctccatctt

SEQ ID NO: 4624150 - DNA, 21 bp, Homo sapiens
cttgcctccatctttttcttg

SEQ ID NO: 4624151 - DNA, 21 bp, Homo sapiens
cttgcctgaggggaaagagag

SEQ ID NO: 4624152 - DNA, 19 bp, Homo sapiens
cttgcctgtttcttctcta

SEQ ID NO: 4624153 - DNA, 17 bp, Homo sapiens
cttgctcatgagctcct

SEQ ID NO: 4624154 - DNA, 18 bp, Homo sapiens
cttgctcatgagctcctg

SEQ ID NO: 4624155 - DNA, 23 bp, Homo sapiens
cttgctcatgagctcctgatcag

SEQ ID NO: 4624156 - DNA, 19 bp, Homo sapiens
cttgctcccaagcccctga

SEQ ID NO: 4624157 - DNA, 22 bp, Homo sapiens
cttgctcccaagcccctgaccc

SEQ ID NO: 4624158 - DNA, 18 bp, Homo sapiens
cttgctcccaatggtgct

SEQ ID NO: 4624159 - DNA, 22 bp, Homo sapiens
cttgctcccaatggtgcttgga

SEQ ID NO: 4624160 - DNA, 20 bp, Homo sapiens
cttgctccctgtgtccacct

SEQ ID NO: 4624161 - DNA, 22 bp, Homo sapiens
cttgctctcgaccggccctgca

SEQ ID NO: 4624162 - DNA, 20 bp, Homo sapiens
cttgctgctttttctgcgct

SEQ ID NO: 4624163 - DNA, 23 bp, Homo sapiens
cttgctgtatgacccctggccac

SEQ ID NO: 4624164 - DNA, 17 bp, Homo sapiens
cttgcttacatcctctg

SEQ ID NO: 4624165 - DNA, 15 bp, Homo sapiens
cttgcttggaagcca

SEQ ID NO: 4624166 - DNA, 16 bp, Homo sapiens
cttgcttggaagccag

SEQ ID NO: 4624167 - DNA, 19 bp, Homo sapiens
cttgctttcaattgacaaa

SEQ ID NO: 4624168 - DNA, 16 bp, Homo sapiens
cttgctttcctgggcc

SEQ ID NO: 4624169 - DNA, 19 bp, Homo sapiens
cttgctttcctgggccttt

SEQ ID NO: 4624170 - DNA, 13 bp, Homo sapiens
cttgctttcttta

SEQ ID NO: 4624171 - DNA, 17 bp, Homo sapiens
cttgctttctttagaat

SEQ ID NO: 4624172 - DNA, 21 bp, Homo sapiens
cttggaaagaaacaaccgttg

SEQ ID NO: 4624173 - DNA, 12 bp, Homo sapiens
cttggaagccag

SEQ ID NO: 4624174 - DNA, 15 bp, Homo sapiens
cttggaagccaggta

SEQ ID NO: 4624175 - DNA, 23 bp, Homo sapiens
cttggagaatgtgagaagccagc

SEQ ID NO: 4624176 - DNA, 10 bp, Homo sapiens
cttggaggag

SEQ ID NO: 4624177 - DNA, 16 bp, Homo sapiens
cttggaggagagagac

SEQ ID NO: 4624178 - DNA, 12 bp, Homo sapiens
cttggaggaggg

SEQ ID NO: 4624179 - DNA, 13 bp, Homo sapiens
cttggcaggctga

SEQ ID NO: 4624180 - DNA, 14 bp, Homo sapiens
cttggcaggctgag

SEQ ID NO: 4624181 - DNA, 16 bp, Homo sapiens
cttggcaggctgaggt

SEQ ID NO: 4624182 - DNA, 22 bp, Homo sapiens
cttggcaggctgaggtgagaag

SEQ ID NO: 4624183 - DNA, 14 bp, Homo sapiens
cttggcctcctgct

SEQ ID NO: 4624184 - DNA, 19 bp, Homo sapiens
cttggcttaatcattttca

SEQ ID NO: 4624185 - DNA, 18 bp, Homo sapiens
cttggctttatgcaaata

SEQ ID NO: 4624186 - DNA, 14 bp, Homo sapiens
cttggctttcatgt

SEQ ID NO: 4624187 - DNA, 11 bp, Homo sapiens
cttgggaaata

SEQ ID NO: 4624188 - DNA, 18 bp, Homo sapiens
cttgggcacccccagcct

SEQ ID NO: 4624189 - DNA, 12 bp, Homo sapiens
cttgggcagagt

SEQ ID NO: 4624190 - DNA, 15 bp, Homo sapiens
cttgggccctctggt

SEQ ID NO: 4624191 - DNA, 21 bp, Homo sapiens
cttgggccgtccccatttgca

SEQ ID NO: 4624192 - DNA, 22 bp, Homo sapiens
cttgggctgacccagcatctcc

SEQ ID NO: 4624193 - DNA, 15 bp, Homo sapiens
cttggggacatctct

SEQ ID NO: 4624194 - DNA, 22 bp, Homo sapiens
cttggggccactttcagagccc

SEQ ID NO: 4624195 - DNA, 11 bp, Homo sapiens
cttggtcctag

SEQ ID NO: 4624196 - DNA, 13 bp, Homo sapiens
cttggttcatgct

SEQ ID NO: 4624197 - DNA, 19 bp, Homo sapiens
cttggtttctctctacagt

SEQ ID NO: 4624198 - DNA, 22 bp, Homo sapiens
cttggtttgtggcgtctccctc

SEQ ID NO: 4624199 - DNA, 23 bp, Homo sapiens
cttggtttgtggcgtctccctcg

SEQ ID NO: 4624200 - DNA, 13 bp, Homo sapiens
cttgtaaagactg

SEQ ID NO: 4624201 - DNA, 23 bp, Homo sapiens
cttgtagaaaaatccctccacct

SEQ ID NO: 4624202 - DNA, 18 bp, Homo sapiens
cttgtagaactcactctg

SEQ ID NO: 4624203 - DNA, 19 bp, Homo sapiens
cttgtagaactcactctgg

SEQ ID NO: 4624204 - DNA, 20 bp, Homo sapiens
cttgtagaactcactctggg

SEQ ID NO: 4624205 - DNA, 21 bp, Homo sapiens
cttgtagaactcactctgggc

SEQ ID NO: 4624206 - DNA, 21 bp, Homo sapiens
cttgtagccagccggggcgag

SEQ ID NO: 4624207 - DNA, 17 bp, Homo sapiens
cttgtattaagttgtta

SEQ ID NO: 4624208 - DNA, 16 bp, Homo sapiens
cttgtcagacataaag

SEQ ID NO: 4624209 - DNA, 20 bp, Homo sapiens
cttgtcagttccaaacagac

SEQ ID NO: 4624210 - DNA, 13 bp, Homo sapiens
cttgtccagctga

SEQ ID NO: 4624211 - DNA, 21 bp, Homo sapiens
cttgtcccaaatccgccagtg

SEQ ID NO: 4624212 - DNA, 22 bp, Homo sapiens
cttgtccctcagcaacatccca

SEQ ID NO: 4624213 - DNA, 19 bp, Homo sapiens
cttgtcctttgaggcccca

SEQ ID NO: 4624214 - DNA, 21 bp, Homo sapiens
cttgtcctttgaggccccaac

SEQ ID NO: 4624215 - DNA, 20 bp, Homo sapiens
cttgtctcccagctcagggc

SEQ ID NO: 4624216 - DNA, 13 bp, Homo sapiens
cttgtctgcctcc

SEQ ID NO: 4624217 - DNA, 15 bp, Homo sapiens
cttgtctgcctcctg

SEQ ID NO: 4624218 - DNA, 19 bp, Homo sapiens
cttgtctgcctcctgcttt

SEQ ID NO: 4624219 - DNA, 20 bp, Homo sapiens
cttgtctgcctcctgctttg

SEQ ID NO: 4624220 - DNA, 23 bp, Homo sapiens
cttgtgatttctttaaaagaatg

SEQ ID NO: 4624221 - DNA, 16 bp, Homo sapiens
cttgtggataagtggc

SEQ ID NO: 4624222 - DNA, 17 bp, Homo sapiens
cttgtggataagtggct

SEQ ID NO: 4624223 - DNA, 20 bp, Homo sapiens
cttgtggttgtgtgtgttct

SEQ ID NO: 4624224 - DNA, 21 bp, Homo sapiens
cttgtggttgtgtgtgttctg

SEQ ID NO: 4624225 - DNA, 18 bp, Homo sapiens
cttgtgtatttctctgtg

SEQ ID NO: 4624226 - DNA, 21 bp, Homo sapiens
cttgtgtatttctctgtgaat

SEQ ID NO: 4624227 - DNA, 15 bp, Homo sapiens
cttgttcagcaggct

SEQ ID NO: 4624228 - DNA, 17 bp, Homo sapiens
cttgttctatttttcaa

SEQ ID NO: 4624229 - DNA, 19 bp, Homo sapiens
cttgtttggggcaggagta

SEQ ID NO: 4624230 - DNA, 21 bp, Homo sapiens
ctttaaaaaaaaatcttgtgt

SEQ ID NO: 4624231 - DNA, 15 bp, Homo sapiens
ctttaaagtatttct

SEQ ID NO: 4624232 - DNA, 12 bp, Homo sapiens
ctttaaatatca

SEQ ID NO: 4624233 - DNA, 21 bp, Homo sapiens
ctttaaatatcattctttgta

SEQ ID NO: 4624234 - DNA, 19 bp, Homo sapiens
ctttaaatcctaccaaagt

SEQ ID NO: 4624235 - DNA, 22 bp, Homo sapiens
ctttaaattgttcctctttgtt

SEQ ID NO: 4624236 - DNA, 21 bp, Homo sapiens
ctttaataaattgcttactga

SEQ ID NO: 4624237 - DNA, 19 bp, Homo sapiens
ctttaattctctttcaaag

SEQ ID NO: 4624238 - DNA, 15 bp, Homo sapiens
ctttaattttcttgt

SEQ ID NO: 4624239 - DNA, 21 bp, Homo sapiens
ctttacaaactgaagataatg

SEQ ID NO: 4624240 - DNA, 16 bp, Homo sapiens
ctttacattttcagta

SEQ ID NO: 4624241 - DNA, 15 bp, Homo sapiens
ctttactattaaaat

SEQ ID NO: 4624242 - DNA, 13 bp, Homo sapiens
ctttactggccat

SEQ ID NO: 4624243 - DNA, 18 bp, Homo sapiens
ctttagaatttttaccca

SEQ ID NO: 4624244 - DNA, 19 bp, Homo sapiens
ctttagaatttttacccaa

SEQ ID NO: 4624245 - DNA, 12 bp, Homo sapiens
ctttagctctct

SEQ ID NO: 4624246 - DNA, 22 bp, Homo sapiens
ctttaggccatgggtggaaagt

SEQ ID NO: 4624247 - DNA, 15 bp, Homo sapiens
ctttagtttttgtga

SEQ ID NO: 4624248 - DNA, 18 bp, Homo sapiens
ctttatacagttgaattt

SEQ ID NO: 4624249 - DNA, 15 bp, Homo sapiens
ctttatgcaaataca

SEQ ID NO: 4624250 - DNA, 22 bp, Homo sapiens
ctttatgcaaatacaatcagcc

SEQ ID NO: 4624251 - DNA, 23 bp, Homo sapiens
ctttatgtacaggatgctttggt

SEQ ID NO: 4624252 - DNA, 21 bp, Homo sapiens
ctttattaaaagaatgagtga

SEQ ID NO: 4624253 - DNA, 13 bp, Homo sapiens
ctttatttgtaaa

SEQ ID NO: 4624254 - DNA, 14 bp, Homo sapiens
ctttattttattat

SEQ ID NO: 4624255 - DNA, 17 bp, Homo sapiens
ctttattttattattca

SEQ ID NO: 4624256 - DNA, 21 bp, Homo sapiens
ctttattttcccctatcattt

SEQ ID NO: 4624257 - DNA, 19 bp, Homo sapiens
ctttcaattccaccagggc

SEQ ID NO: 4624258 - DNA, 14 bp, Homo sapiens
ctttcaattgacaa

SEQ ID NO: 4624259 - DNA, 13 bp, Homo sapiens
ctttcacctgggt

SEQ ID NO: 4624260 - DNA, 14 bp, Homo sapiens
ctttcacctgggtg

SEQ ID NO: 4624261 - DNA, 13 bp, Homo sapiens
ctttcagggcctc

SEQ ID NO: 4624262 - DNA, 14 bp, Homo sapiens
ctttcagtactttt

SEQ ID NO: 4624263 - DNA, 21 bp, Homo sapiens
ctttcagtacttttttaaata

SEQ ID NO: 4624264 - DNA, 13 bp, Homo sapiens
ctttccaaattaa

SEQ ID NO: 4624265 - DNA, 15 bp, Homo sapiens
ctttccaaattaaaa

SEQ ID NO: 4624266 - DNA, 19 bp, Homo sapiens
ctttccaaattaaaacaaa

SEQ ID NO: 4624267 - DNA, 15 bp, Homo sapiens
ctttccaatagaaag

SEQ ID NO: 4624268 - DNA, 15 bp, Homo sapiens
ctttcccacccagga

SEQ ID NO: 4624269 - DNA, 16 bp, Homo sapiens
ctttcccacccaggaa

SEQ ID NO: 4624270 - DNA, 18 bp, Homo sapiens
ctttccccaaggacccag

SEQ ID NO: 4624271 - DNA, 20 bp, Homo sapiens
ctttccccacctcttacagt

SEQ ID NO: 4624272 - DNA, 15 bp, Homo sapiens
ctttcccttatcaaa

SEQ ID NO: 4624273 - DNA, 13 bp, Homo sapiens
ctttcctcacatt

SEQ ID NO: 4624274 - DNA, 17 bp, Homo sapiens
ctttcctccccctgcaa

SEQ ID NO: 4624275 - DNA, 19 bp, Homo sapiens
ctttcctccccctgcaact

SEQ ID NO: 4624276 - DNA, 21 bp, Homo sapiens
ctttcctggaagtcaaataaa

SEQ ID NO: 4624277 - DNA, 13 bp, Homo sapiens
ctttcctgggcct

SEQ ID NO: 4624278 - DNA, 21 bp, Homo sapiens
ctttcctgtgtgtactctgtc

SEQ ID NO: 4624279 - DNA, 13 bp, Homo sapiens
ctttcctgtttcc

SEQ ID NO: 4624280 - DNA, 17 bp, Homo sapiens
ctttcctgtttccaggg

SEQ ID NO: 4624281 - DNA, 18 bp, Homo sapiens
ctttcctgtttccagggt

SEQ ID NO: 4624282 - DNA, 13 bp, Homo sapiens
ctttcctgtttct

SEQ ID NO: 4624283 - DNA, 13 bp, Homo sapiens
ctttccttgttca

SEQ ID NO: 4624284 - DNA, 15 bp, Homo sapiens
ctttccttgttcagc

SEQ ID NO: 4624285 - DNA, 16 bp, Homo sapiens
ctttcctttcaataaa

SEQ ID NO: 4624286 - DNA, 18 bp, Homo sapiens
ctttcctttcaataaagt

SEQ ID NO: 4624287 - DNA, 19 bp, Homo sapiens
ctttcctttcaataaagtt

SEQ ID NO: 4624288 - DNA, 14 bp, Homo sapiens
ctttcctttgccct

SEQ ID NO: 4624289 - DNA, 18 bp, Homo sapiens
ctttccttttttaaaaat

SEQ ID NO: 4624290 - DNA, 15 bp, Homo sapiens
ctttcggagctcctg

SEQ ID NO: 4624291 - DNA, 14 bp, Homo sapiens
ctttctaatgctga

SEQ ID NO: 4624292 - DNA, 12 bp, Homo sapiens
ctttctcctggc

SEQ ID NO: 4624293 - DNA, 17 bp, Homo sapiens
ctttctcctggcccctg

SEQ ID NO: 4624294 - DNA, 23 bp, Homo sapiens
ctttctcctggcccctgcctgct

SEQ ID NO: 4624295 - DNA, 14 bp, Homo sapiens
ctttctctgcctgg

SEQ ID NO: 4624296 - DNA, 12 bp, Homo sapiens
ctttctgggctc

SEQ ID NO: 4624297 - DNA, 14 bp, Homo sapiens
ctttctgggctctg

SEQ ID NO: 4624298 - DNA, 15 bp, Homo sapiens
ctttctgggctctgg

SEQ ID NO: 4624299 - DNA, 16 bp, Homo sapiens
ctttctgggctctgga

SEQ ID NO: 4624300 - DNA, 13 bp, Homo sapiens
ctttctttctctt

SEQ ID NO: 4624301 - DNA, 13 bp, Homo sapiens
ctttgaaagaagc

SEQ ID NO: 4624302 - DNA, 14 bp, Homo sapiens
ctttgaaagaagca

SEQ ID NO: 4624303 - DNA, 20 bp, Homo sapiens
ctttgagaccccagtgcctg

SEQ ID NO: 4624304 - DNA, 22 bp, Homo sapiens
ctttgagaccccagtgcctgca

SEQ ID NO: 4624305 - DNA, 16 bp, Homo sapiens
ctttgagatctgggga

SEQ ID NO: 4624306 - DNA, 18 bp, Homo sapiens
ctttgagatctggggagg

SEQ ID NO: 4624307 - DNA, 18 bp, Homo sapiens
ctttgaggccccaactca

SEQ ID NO: 4624308 - DNA, 15 bp, Homo sapiens
ctttgcaaagacccg

SEQ ID NO: 4624309 - DNA, 14 bp, Homo sapiens
ctttgcccttcctc

SEQ ID NO: 4624310 - DNA, 15 bp, Homo sapiens
ctttgcccttcctcc

SEQ ID NO: 4624311 - DNA, 18 bp, Homo sapiens
ctttgcccttcctcctgc

SEQ ID NO: 4624312 - DNA, 16 bp, Homo sapiens
ctttgcggggcctgtc

SEQ ID NO: 4624313 - DNA, 19 bp, Homo sapiens
ctttgcggggcctgtctca

SEQ ID NO: 4624314 - DNA, 17 bp, Homo sapiens
ctttgctccttcagttc

SEQ ID NO: 4624315 - DNA, 16 bp, Homo sapiens
ctttgctggaagaaac

SEQ ID NO: 4624316 - DNA, 19 bp, Homo sapiens
ctttggaaaatgcattgta

SEQ ID NO: 4624317 - DNA, 16 bp, Homo sapiens
ctttggaaagccaagg

SEQ ID NO: 4624318 - DNA, 23 bp, Homo sapiens
ctttggacagctgactgaatgca

SEQ ID NO: 4624319 - DNA, 16 bp, Homo sapiens
ctttggagttggaatt

SEQ ID NO: 4624320 - DNA, 14 bp, Homo sapiens
ctttggcagagttc

SEQ ID NO: 4624321 - DNA, 23 bp, Homo sapiens
gaaagggcacttaatttgtaaac

SEQ ID NO: 4624322 - DNA, 13 bp, Homo sapiens
gaaagtcccccct

SEQ ID NO: 4624323 - DNA, 16 bp, Homo sapiens
gaaataaaaggaagcc

SEQ ID NO: 4624324 - DNA, 16 bp, Homo sapiens
gaaataacaaaatgga

SEQ ID NO: 4624325 - DNA, 22 bp, Homo sapiens
gaaatacccatgttacttctct

SEQ ID NO: 4624326 - DNA, 21 bp, Homo sapiens
gaaatagttattttaatacct

SEQ ID NO: 4624327 - DNA, 19 bp, Homo sapiens
gaaatattaaaccctggat

SEQ ID NO: 4624328 - DNA, 18 bp, Homo sapiens
gaaatattcttattactc

SEQ ID NO: 4624329 - DNA, 21 bp, Homo sapiens
gaaatccatactgtagacact

SEQ ID NO: 4624330 - DNA, 22 bp, Homo sapiens
gaaatctgtatctgtagtgaga

SEQ ID NO: 4624331 - DNA, 13 bp, Homo sapiens
gaaatctgtcttt

SEQ ID NO: 4624332 - DNA, 14 bp, Homo sapiens
gaaatcttttaaaa

SEQ ID NO: 4624333 - DNA, 15 bp, Homo sapiens
gaaatgcatatttgc

SEQ ID NO: 4624334 - DNA, 15 bp, Homo sapiens
gaaatgctgggctga

SEQ ID NO: 4624335 - DNA, 23 bp, Homo sapiens
gaaatgctggtttttcagttttc

SEQ ID NO: 4624336 - DNA, 18 bp, Homo sapiens
gaaatgtacttttggata

SEQ ID NO: 4624337 - DNA, 12 bp, Homo sapiens
gaaatgttctta

SEQ ID NO: 4624338 - DNA, 19 bp, Homo sapiens
gaaatgtttaataaagctt

SEQ ID NO: 4624339 - DNA, 19 bp, Homo sapiens
gaaattaacacaaaggaag

SEQ ID NO: 4624340 - DNA, 17 bp, Homo sapiens
gaaattagccacatgta

SEQ ID NO: 4624341 - DNA, 11 bp, Homo sapiens
gaaatttgaat

SEQ ID NO: 4624342 - DNA, 22 bp, Homo sapiens
gaacaaaactgttcttttgcat

SEQ ID NO: 4624343 - DNA, 14 bp, Homo sapiens
gaacaaatgtctta

SEQ ID NO: 4624344 - DNA, 13 bp, Homo sapiens
gaacaagaaatgg

SEQ ID NO: 4624345 - DNA, 14 bp, Homo sapiens
gaacacggccacat

SEQ ID NO: 4624346 - DNA, 22 bp, Homo sapiens
gaacactatggttaaccctctc

SEQ ID NO: 4624347 - DNA, 17 bp, Homo sapiens
gaacagataatccctgt

SEQ ID NO: 4624348 - DNA, 14 bp, Homo sapiens
gaacagcccagcac

SEQ ID NO: 4624349 - DNA, 22 bp, Homo sapiens
gaacaggaggtgtgaatgcacg

SEQ ID NO: 4624350 - DNA, 21 bp, Homo sapiens
gaacaggttcttaaaaaggaa

SEQ ID NO: 4624351 - DNA, 23 bp, Homo sapiens
gaacatacatgatacatttttat

SEQ ID NO: 4624352 - DNA, 17 bp, Homo sapiens
gaacatcacattcctct

SEQ ID NO: 4624353 - DNA, 21 bp, Homo sapiens
gaacatcccttattagttaca

SEQ ID NO: 4624354 - DNA, 15 bp, Homo sapiens
gaacatctcttgaaa

SEQ ID NO: 4624355 - DNA, 17 bp, Homo sapiens
gaacatctcttgaaacc

SEQ ID NO: 4624356 - DNA, 16 bp, Homo sapiens
gaacatcttcatataa

SEQ ID NO: 4624357 - DNA, 21 bp, Homo sapiens
gaacatgaactcatcattttt

SEQ ID NO: 4624358 - DNA, 17 bp, Homo sapiens
gaacattcagctctgga

SEQ ID NO: 4624359 - DNA, 18 bp, Homo sapiens
gaacattcagctctggag

SEQ ID NO: 4624360 - DNA, 13 bp, Homo sapiens
gaacccaggacaa

SEQ ID NO: 4624361 - DNA, 16 bp, Homo sapiens
gaacccaggacaagca

SEQ ID NO: 4624362 - DNA, 19 bp, Homo sapiens
gaaccccctccctgtccca

SEQ ID NO: 4624363 - DNA, 15 bp, Homo sapiens
gaaccctccccacca

SEQ ID NO: 4624364 - DNA, 18 bp, Homo sapiens
gaaccctgccctgctctg

SEQ ID NO: 4624365 - DNA, 17 bp, Homo sapiens
gaacctcggggtggggg

SEQ ID NO: 4624366 - DNA, 11 bp, Homo sapiens
gaacctggcct

SEQ ID NO: 4624367 - DNA, 16 bp, Homo sapiens
gaacctggccttcagt

SEQ ID NO: 4624368 - DNA, 17 bp, Homo sapiens
gaacctgggcactccgc

SEQ ID NO: 4624369 - DNA, 18 bp, Homo sapiens
gaaccttgttatttctca

SEQ ID NO: 4624370 - DNA, 13 bp, Homo sapiens
gaacgtggtttgc

SEQ ID NO: 4624371 - DNA, 18 bp, Homo sapiens
gaactagcatatagccat

SEQ ID NO: 4624372 - DNA, 21 bp, Homo sapiens
gaactagcatatagccattga

SEQ ID NO: 4624373 - DNA, 15 bp, Homo sapiens
gaactagtaaacata

SEQ ID NO: 4624374 - DNA, 19 bp, Homo sapiens
gaactagttttactttgaa

SEQ ID NO: 4624375 - DNA, 15 bp, Homo sapiens
gaactcactctgggc

SEQ ID NO: 4624376 - DNA, 23 bp, Homo sapiens
gaactcctaaacctttgcccctg

SEQ ID NO: 4624377 - DNA, 14 bp, Homo sapiens
gaactctcctcttt

SEQ ID NO: 4624378 - DNA, 14 bp, Homo sapiens
gaactctcctggcc

SEQ ID NO: 4624379 - DNA, 11 bp, Homo sapiens
gaactgaggag

SEQ ID NO: 4624380 - DNA, 21 bp, Homo sapiens
gaactgaggagatgaccaggg

SEQ ID NO: 4624381 - DNA, 23 bp, Homo sapiens
gaactgaggagatgaccagggat

SEQ ID NO: 4624382 - DNA, 20 bp, Homo sapiens
gaactgattgctcccaggat

SEQ ID NO: 4624383 - DNA, 13 bp, Homo sapiens
gaacttaaaatga

SEQ ID NO: 4624384 - DNA, 19 bp, Homo sapiens
gaagaaacacgtggtcatg

SEQ ID NO: 4624385 - DNA, 17 bp, Homo sapiens
gaagaaagaggtgaccc

SEQ ID NO: 4624386 - DNA, 23 bp, Homo sapiens
gaagaaagaggtgaccccagggc

SEQ ID NO: 4624387 - DNA, 17 bp, Homo sapiens
gaagaaagggtgttttt

SEQ ID NO: 4624388 - DNA, 22 bp, Homo sapiens
gaagaactagcatatagccatt

SEQ ID NO: 4624389 - DNA, 16 bp, Homo sapiens
gaagaatacccaggaa

SEQ ID NO: 4624390 - DNA, 18 bp, Homo sapiens
gaagaatacccaggaaga

SEQ ID NO: 4624391 - DNA, 15 bp, Homo sapiens
gaagaatcacgattt

SEQ ID NO: 4624392 - DNA, 19 bp, Homo sapiens
gaagaattttatttttctg

SEQ ID NO: 4624393 - DNA, 22 bp, Homo sapiens
gaagaattttatttttctgtgg

SEQ ID NO: 4624394 - DNA, 22 bp, Homo sapiens
gaagagagggacaggcactcca

SEQ ID NO: 4624395 - DNA, 22 bp, Homo sapiens
gaagagatcccaggaggtgcag

SEQ ID NO: 4624396 - DNA, 17 bp, Homo sapiens
gaagagccacctgcaag

SEQ ID NO: 4624397 - DNA, 18 bp, Homo sapiens
gaagagccacctgcaaga

SEQ ID NO: 4624398 - DNA, 16 bp, Homo sapiens
gaagagccgagcacct

SEQ ID NO: 4624399 - DNA, 23 bp, Homo sapiens
gaagaggagatgtgatcaggccc

SEQ ID NO: 4624400 - DNA, 13 bp, Homo sapiens
gaagaggagtcaa

SEQ ID NO: 4624401 - DNA, 19 bp, Homo sapiens
gaagagggaaatgtacact

SEQ ID NO: 4624402 - DNA, 20 bp, Homo sapiens
gaagagggggaggggaagct

SEQ ID NO: 4624403 - DNA, 21 bp, Homo sapiens
gaagataacgccttccctaag

SEQ ID NO: 4624404 - DNA, 16 bp, Homo sapiens
gaagattgggccgcct

SEQ ID NO: 4624405 - DNA, 14 bp, Homo sapiens
gaagcaacatttta

SEQ ID NO: 4624406 - DNA, 16 bp, Homo sapiens
gaagcacagctcctgc

SEQ ID NO: 4624407 - DNA, 20 bp, Homo sapiens
gaagcacagctcctgccagg

SEQ ID NO: 4624408 - DNA, 14 bp, Homo sapiens
gaagcagagggaca

SEQ ID NO: 4624409 - DNA, 19 bp, Homo sapiens
gaagcaggttcccaagctc

SEQ ID NO: 4624410 - DNA, 22 bp, Homo sapiens
gaagcatgaataacatttaaat

SEQ ID NO: 4624411 - DNA, 22 bp, Homo sapiens
gaagcattggtttttttttgat

SEQ ID NO: 4624412 - DNA, 17 bp, Homo sapiens
gaagcatttggtggcct

SEQ ID NO: 4624413 - DNA, 17 bp, Homo sapiens
gaagcattttttataat

SEQ ID NO: 4624414 - DNA, 23 bp, Homo sapiens
gaagcattttttataattttcta

SEQ ID NO: 4624415 - DNA, 11 bp, Homo sapiens
gaagccagcca

SEQ ID NO: 4624416 - DNA, 14 bp, Homo sapiens
gaagccagccacag

SEQ ID NO: 4624417 - DNA, 14 bp, Homo sapiens
gaagccaggtacag

SEQ ID NO: 4624418 - DNA, 19 bp, Homo sapiens
gaagccaggtacaggagag

SEQ ID NO: 4624419 - DNA, 14 bp, Homo sapiens
gaagcccaaagcct

SEQ ID NO: 4624420 - DNA, 18 bp, Homo sapiens
gaagcccaaagcctgagg

SEQ ID NO: 4624421 - DNA, 22 bp, Homo sapiens
gaagcccaaagcctgaggacag

SEQ ID NO: 4624422 - DNA, 15 bp, Homo sapiens
gaagccgactctggc

SEQ ID NO: 4624423 - DNA, 16 bp, Homo sapiens
gaagccgactctggcc

SEQ ID NO: 4624424 - DNA, 21 bp, Homo sapiens
gaagccgactctggccctggc

SEQ ID NO: 4624425 - DNA, 19 bp, Homo sapiens
gaagcctgcctggaagagc

SEQ ID NO: 4624426 - DNA, 18 bp, Homo sapiens
gaagcctgggggcctggc

SEQ ID NO: 4624427 - DNA, 13 bp, Homo sapiens
gaagcgaacatct

SEQ ID NO: 4624428 - DNA, 16 bp, Homo sapiens
gaagcgaacatcttca

SEQ ID NO: 4624429 - DNA, 20 bp, Homo sapiens
gaagcgaacatcttcatata

SEQ ID NO: 4624430 - DNA, 22 bp, Homo sapiens
gaagcgaacatcttcatataaa

SEQ ID NO: 4624431 - DNA, 17 bp, Homo sapiens
gaagctaacagggaagg

SEQ ID NO: 4624432 - DNA, 21 bp, Homo sapiens
ctttgggcacaattcctgtgc

SEQ ID NO: 4624433 - DNA, 22 bp, Homo sapiens
ctttgggcacaattcctgtgct

SEQ ID NO: 4624434 - DNA, 23 bp, Homo sapiens
ctttgggcacaattcctgtgctc

SEQ ID NO: 4624435 - DNA, 19 bp, Homo sapiens
ctttggtaaaacagtttca

SEQ ID NO: 4624436 - DNA, 14 bp, Homo sapiens
ctttggtccttcaa

SEQ ID NO: 4624437 - DNA, 19 bp, Homo sapiens
ctttggttatatttagctc

SEQ ID NO: 4624438 - DNA, 21 bp, Homo sapiens
ctttgtactaatacagggagc

SEQ ID NO: 4624439 - DNA, 20 bp, Homo sapiens
ctttgtagactgtttcacat

SEQ ID NO: 4624440 - DNA, 13 bp, Homo sapiens
ctttgtatcttaa

SEQ ID NO: 4624441 - DNA, 17 bp, Homo sapiens
ctttgtatcttaaatct

SEQ ID NO: 4624442 - DNA, 23 bp, Homo sapiens
ctttgtcttggaaccaccagtct

SEQ ID NO: 4624443 - DNA, 23 bp, Homo sapiens
ctttgtggtttagttataaaagg

SEQ ID NO: 4624444 - DNA, 14 bp, Homo sapiens
ctttgtgttcattt

SEQ ID NO: 4624445 - DNA, 18 bp, Homo sapiens
ctttgtgttcatttcatt

SEQ ID NO: 4624446 - DNA, 11 bp, Homo sapiens
ctttgtgttgg

SEQ ID NO: 4624447 - DNA, 15 bp, Homo sapiens
ctttgttcagcctgc

SEQ ID NO: 4624448 - DNA, 23 bp, Homo sapiens
ctttgtttacatgagttcaaata

SEQ ID NO: 4624449 - DNA, 22 bp, Homo sapiens
ctttgtttatgaagaaagatac

SEQ ID NO: 4624450 - DNA, 15 bp, Homo sapiens
cttttaaagaagctt

SEQ ID NO: 4624451 - DNA, 18 bp, Homo sapiens
cttttaaagaagctttat

SEQ ID NO: 4624452 - DNA, 18 bp, Homo sapiens
cttttaaggtttcaacaa

SEQ ID NO: 4624453 - DNA, 15 bp, Homo sapiens
cttttactaagcact

SEQ ID NO: 4624454 - DNA, 21 bp, Homo sapiens
cttttagtaaagtcaaggaga

SEQ ID NO: 4624455 - DNA, 22 bp, Homo sapiens
cttttagtagagacagtgtttc

SEQ ID NO: 4624456 - DNA, 16 bp, Homo sapiens
cttttataaggaaact

SEQ ID NO: 4624457 - DNA, 20 bp, Homo sapiens
cttttataattaatgtttgt

SEQ ID NO: 4624458 - DNA, 15 bp, Homo sapiens
cttttattgtaaagt

SEQ ID NO: 4624459 - DNA, 15 bp, Homo sapiens
cttttcacaaacatt

SEQ ID NO: 4624460 - DNA, 16 bp, Homo sapiens
cttttcacaaacatta

SEQ ID NO: 4624461 - DNA, 20 bp, Homo sapiens
cttttcacaaacattagtat

SEQ ID NO: 4624462 - DNA, 20 bp, Homo sapiens
cttttcacattaggctgttg

SEQ ID NO: 4624463 - DNA, 23 bp, Homo sapiens
cttttcagcgatgtatgcagcta

SEQ ID NO: 4624464 - DNA, 17 bp, Homo sapiens
cttttcatctgggaaag

SEQ ID NO: 4624465 - DNA, 17 bp, Homo sapiens
cttttcattctctttta

SEQ ID NO: 4624466 - DNA, 19 bp, Homo sapiens
cttttccactccattgtcg

SEQ ID NO: 4624467 - DNA, 15 bp, Homo sapiens
cttttcccccaccct

SEQ ID NO: 4624468 - DNA, 14 bp, Homo sapiens
cttttcctctgcct

SEQ ID NO: 4624469 - DNA, 17 bp, Homo sapiens
cttttcttgataggcct

SEQ ID NO: 4624470 - DNA, 14 bp, Homo sapiens
cttttgaaatctgt

SEQ ID NO: 4624471 - DNA, 24 bp, Homo sapiens
cttttggtatttgtttgtagcttt

SEQ ID NO: 4624472 - DNA, 17 bp, Homo sapiens
cttttgtgtctatgatg

SEQ ID NO: 4624473 - DNA, 18 bp, Homo sapiens
ctttttattttaggcact

SEQ ID NO: 4624474 - DNA, 15 bp, Homo sapiens
ctttttcattttcca

SEQ ID NO: 4624475 - DNA, 13 bp, Homo sapiens
ctttttcttgggt

SEQ ID NO: 4624476 - DNA, 21 bp, Homo sapiens
ctttttgttgtaaaacaaaat

SEQ ID NO: 4624477 - DNA, 12 bp, Homo sapiens
cttttttatgtt

SEQ ID NO: 4624478 - DNA, 12 bp, Homo sapiens
cttttttcaaaa

SEQ ID NO: 4624479 - DNA, 21 bp, Homo sapiens
cttttttgtcttattgaaaaa

SEQ ID NO: 4624480 - DNA, 22 bp, Homo sapiens
cttttttgtttgtttctttgtg

SEQ ID NO: 4624481 - DNA, 15 bp, Homo sapiens
ctttttttctactgt

SEQ ID NO: 4624482 - DNA, 14 bp, Homo sapiens
cttttttttaagtt

SEQ ID NO: 4624483 - DNA, 18 bp, Homo sapiens
gaaaaaaagctgcaaaaa

SEQ ID NO: 4624484 - DNA, 20 bp, Homo sapiens
gaaaaaaatgtacatttatt

SEQ ID NO: 4624485 - DNA, 12 bp, Homo sapiens
gaaaaaatattt

SEQ ID NO: 4624486 - DNA, 15 bp, Homo sapiens
gaaaaaatattttaa

SEQ ID NO: 4624487 - DNA, 17 bp, Homo sapiens
gaaaaagctgcttctta

SEQ ID NO: 4624488 - DNA, 15 bp, Homo sapiens
gaaaaataaaatgtt

SEQ ID NO: 4624489 - DNA, 16 bp, Homo sapiens
gaaaaatatcttggcc

SEQ ID NO: 4624490 - DNA, 12 bp, Homo sapiens
gaaaacagaaac

SEQ ID NO: 4624491 - DNA, 12 bp, Homo sapiens
gaaaacatctgg

SEQ ID NO: 4624492 - DNA, 13 bp, Homo sapiens
gaaaacctgttca

SEQ ID NO: 4624493 - DNA, 13 bp, Homo sapiens
gaaaactgtgttg

SEQ ID NO: 4624494 - DNA, 19 bp, Homo sapiens
gaaaactgtgttgccacag

SEQ ID NO: 4624495 - DNA, 21 bp, Homo sapiens
gaaaaggcagcacgtggtttt

SEQ ID NO: 4624496 - DNA, 12 bp, Homo sapiens
gaaaaggcctgg

SEQ ID NO: 4624497 - DNA, 13 bp, Homo sapiens
gaaaaggcctggg

SEQ ID NO: 4624498 - DNA, 14 bp, Homo sapiens
gaaaagtaattttg

SEQ ID NO: 4624499 - DNA, 12 bp, Homo sapiens
gaaaatatatat

SEQ ID NO: 4624500 - DNA, 22 bp, Homo sapiens
gaaaatatatattatatacata

SEQ ID NO: 4624501 - DNA, 15 bp, Homo sapiens
gaaaatgacttattt

SEQ ID NO: 4624502 - DNA, 21 bp, Homo sapiens
gaaaatgcattgtatcgatgt

SEQ ID NO: 4624503 - DNA, 15 bp, Homo sapiens
gaaaatgtatccaag

SEQ ID NO: 4624504 - DNA, 23 bp, Homo sapiens
gaaaatttacaaaatttattctc

SEQ ID NO: 4624505 - DNA, 23 bp, Homo sapiens
gaaacaaaaatgatcctcagtgc

SEQ ID NO: 4624506 - DNA, 13 bp, Homo sapiens
gaaacaaagaagg

SEQ ID NO: 4624507 - DNA, 16 bp, Homo sapiens
gaaacaccacttaatc

SEQ ID NO: 4624508 - DNA, 12 bp, Homo sapiens
gaaacagccagc

SEQ ID NO: 4624509 - DNA, 15 bp, Homo sapiens
gaaacagccagcaag

SEQ ID NO: 4624510 - DNA, 16 bp, Homo sapiens
gaaacagcctgtgtct

SEQ ID NO: 4624511 - DNA, 17 bp, Homo sapiens
gaaacagcctgtgtctt

SEQ ID NO: 4624512 - DNA, 12 bp, Homo sapiens
gaaacagttcca

SEQ ID NO: 4624513 - DNA, 18 bp, Homo sapiens
gaaacagtttcttgcttg

SEQ ID NO: 4624514 - DNA, 19 bp, Homo sapiens
gaaacatgcagctcttcaa

SEQ ID NO: 4624515 - DNA, 19 bp, Homo sapiens
gaaacatttatatttttat

SEQ ID NO: 4624516 - DNA, 17 bp, Homo sapiens
gaaaccaagagacacaa

SEQ ID NO: 4624517 - DNA, 19 bp, Homo sapiens
gaaaccaattaagcagctt

SEQ ID NO: 4624518 - DNA, 14 bp, Homo sapiens
gaaactaaacagaa

SEQ ID NO: 4624519 - DNA, 17 bp, Homo sapiens
gaaactaaacagaaaac

SEQ ID NO: 4624520 - DNA, 18 bp, Homo sapiens
gaaactaaacagaaaact

SEQ ID NO: 4624521 - DNA, 18 bp, Homo sapiens
gaaactgccacatacacc

SEQ ID NO: 4624522 - DNA, 12 bp, Homo sapiens
gaaacttctgta

SEQ ID NO: 4624523 - DNA, 11 bp, Homo sapiens
gaaagaagcaa

SEQ ID NO: 4624524 - DNA, 14 bp, Homo sapiens
gaaagaagcaagac

SEQ ID NO: 4624525 - DNA, 17 bp, Homo sapiens
gaaagaagggggccctg

SEQ ID NO: 4624526 - DNA, 19 bp, Homo sapiens
gaaagaagggggccctgct

SEQ ID NO: 4624527 - DNA, 21 bp, Homo sapiens
gaaagaattatttgccttctg

SEQ ID NO: 4624528 - DNA, 21 bp, Homo sapiens
gaaagacatccataaagaagc

SEQ ID NO: 4624529 - DNA, 15 bp, Homo sapiens
gaaagagagaagcca

SEQ ID NO: 4624530 - DNA, 16 bp, Homo sapiens
gaaagagctgcctgga

SEQ ID NO: 4624531 - DNA, 17 bp, Homo sapiens
gaaagagctgcctggat

SEQ ID NO: 4624532 - DNA, 23 bp, Homo sapiens
gaaagatactaatagagtactta

SEQ ID NO: 4624533 - DNA, 21 bp, Homo sapiens
gaaagcatgcattgaaaaatt

SEQ ID NO: 4624534 - DNA, 18 bp, Homo sapiens
gaaagctgggagcgtggg

SEQ ID NO: 4624535 - DNA, 12 bp, Homo sapiens
gaaaggaagcaa

SEQ ID NO: 4624536 - DNA, 20 bp, Homo sapiens
gaaaggaggaccagtcagga

SEQ ID NO: 4624537 - DNA, 21 bp, Homo sapiens
gaaaggaggaccagtcaggat

SEQ ID NO: 4624538 - DNA, 14 bp, Homo sapiens
gaaaggccttcaga

SEQ ID NO: 4624539 - DNA, 20 bp, Homo sapiens
gaaaggccttcagacacatg

SEQ ID NO: 4624540 - DNA, 16 bp, Homo sapiens
gaaagggacccacctg

SEQ ID NO: 4624541 - DNA, 14 bp, Homo sapiens
gaaagggagggctc

SEQ ID NO: 4624542 - DNA, 19 bp, Homo sapiens
gaaagggagggctctgagg

SEQ ID NO: 4624543 - DNA, 22 bp, Homo sapiens
gaaagggcacttaatttgtaaa

SEQ ID NO: 4624544 - DNA, 21 bp, Homo sapiens
gacaaaacttcttgtcagaca

SEQ ID NO: 4624545 - DNA, 18 bp, Homo sapiens
gacaaaggagcctgtgaa

SEQ ID NO: 4624546 - DNA, 13 bp, Homo sapiens
gacaaataagttt

SEQ ID NO: 4624547 - DNA, 16 bp, Homo sapiens
gacaacacagcctata

SEQ ID NO: 4624548 - DNA, 12 bp, Homo sapiens
gacaagacagag

SEQ ID NO: 4624549 - DNA, 17 bp, Homo sapiens
gacaagacagaggggag

SEQ ID NO: 4624550 - DNA, 22 bp, Homo sapiens
gacaagctggccaaagtcactt

SEQ ID NO: 4624551 - DNA, 14 bp, Homo sapiens
gacaataacttctt

SEQ ID NO: 4624552 - DNA, 22 bp, Homo sapiens
gacaatagagggccacggggag

SEQ ID NO: 4624553 - DNA, 18 bp, Homo sapiens
gacaatgatttggccagg

SEQ ID NO: 4624554 - DNA, 12 bp, Homo sapiens
gacacagataat

SEQ ID NO: 4624555 - DNA, 13 bp, Homo sapiens
gacacaggcctgt

SEQ ID NO: 4624556 - DNA, 14 bp, Homo sapiens
gacacaggcctgtg

SEQ ID NO: 4624557 - DNA, 15 bp, Homo sapiens
gacacagttcctggg

SEQ ID NO: 4624558 - DNA, 16 bp, Homo sapiens
gacacagttcctggga

SEQ ID NO: 4624559 - DNA, 18 bp, Homo sapiens
gacacatatgaacacaga

SEQ ID NO: 4624560 - DNA, 19 bp, Homo sapiens
gacacatgctatgttctgt

SEQ ID NO: 4624561 - DNA, 16 bp, Homo sapiens
gacacattgactcctt

SEQ ID NO: 4624562 - DNA, 15 bp, Homo sapiens
gacactctgacaagc

SEQ ID NO: 4624563 - DNA, 13 bp, Homo sapiens
gacactgtacaag

SEQ ID NO: 4624564 - DNA, 21 bp, Homo sapiens
gacacttatctcactgtttta

SEQ ID NO: 4624565 - DNA, 20 bp, Homo sapiens
gacagaaagaccctgatgca

SEQ ID NO: 4624566 - DNA, 15 bp, Homo sapiens
gacagaagtctcctc

SEQ ID NO: 4624567 - DNA, 16 bp, Homo sapiens
gacagaagtctcctca

SEQ ID NO: 4624568 - DNA, 17 bp, Homo sapiens
gacagaagtctcctcaa

SEQ ID NO: 4624569 - DNA, 12 bp, Homo sapiens
gacagacagcca

SEQ ID NO: 4624570 - DNA, 15 bp, Homo sapiens
gacagacagccaggt

SEQ ID NO: 4624571 - DNA, 13 bp, Homo sapiens
gacagacgagaca

SEQ ID NO: 4624572 - DNA, 23 bp, Homo sapiens
gacagacgagacaacagcacaca

SEQ ID NO: 4624573 - DNA, 20 bp, Homo sapiens
gacagagcaagaccctgcct

SEQ ID NO: 4624574 - DNA, 21 bp, Homo sapiens
gacagagcaagaccctgcctc

SEQ ID NO: 4624575 - DNA, 14 bp, Homo sapiens
gacagaggatgtgg

SEQ ID NO: 4624576 - DNA, 16 bp, Homo sapiens
gacagaggggagcagt

SEQ ID NO: 4624577 - DNA, 24 bp, Homo sapiens
gacagaggggagcagtggccatca

SEQ ID NO: 4624578 - DNA, 14 bp, Homo sapiens
gacagatcaagctg

SEQ ID NO: 4624579 - DNA, 17 bp, Homo sapiens
gacagatcaagctgtga

SEQ ID NO: 4624580 - DNA, 20 bp, Homo sapiens
gacagatcaagctgtgagac

SEQ ID NO: 4624581 - DNA, 12 bp, Homo sapiens
gacagcaggcag

SEQ ID NO: 4624582 - DNA, 14 bp, Homo sapiens
gacagcaggcagcg

SEQ ID NO: 4624583 - DNA, 18 bp, Homo sapiens
gacagcctccccctgtcc

SEQ ID NO: 4624584 - DNA, 18 bp, Homo sapiens
gacagctccaccctggcc

SEQ ID NO: 4624585 - DNA, 19 bp, Homo sapiens
gacagctgactgaatgcag

SEQ ID NO: 4624586 - DNA, 14 bp, Homo sapiens
gacagctgtgcctc

SEQ ID NO: 4624587 - DNA, 15 bp, Homo sapiens
gacaggaccctcagg

SEQ ID NO: 4624588 - DNA, 19 bp, Homo sapiens
gacaggactaacactcaga

SEQ ID NO: 4624589 - DNA, 21 bp, Homo sapiens
gacaggactaacactcagaag

SEQ ID NO: 4624590 - DNA, 22 bp, Homo sapiens
gacaggactaacactcagaagc

SEQ ID NO: 4624591 - DNA, 17 bp, Homo sapiens
gacaggagaagagagga

SEQ ID NO: 4624592 - DNA, 23 bp, Homo sapiens
gacaggctgaagagagggacagg

SEQ ID NO: 4624593 - DNA, 22 bp, Homo sapiens
gacaggctggctccagatgcag

SEQ ID NO: 4624594 - DNA, 20 bp, Homo sapiens
gacagggaacagtatttcca

SEQ ID NO: 4624595 - DNA, 10 bp, Homo sapiens
gacagggcca

SEQ ID NO: 4624596 - DNA, 20 bp, Homo sapiens
gacagggccagtggggcctg

SEQ ID NO: 4624597 - DNA, 15 bp, Homo sapiens
gacagggcctggagc

SEQ ID NO: 4624598 - DNA, 14 bp, Homo sapiens
gacagtagctctta

SEQ ID NO: 4624599 - DNA, 16 bp, Homo sapiens
gacagtagctcttaga

SEQ ID NO: 4624600 - DNA, 20 bp, Homo sapiens
gacagtcctttcccaccatt

SEQ ID NO: 4624601 - DNA, 14 bp, Homo sapiens
gacagtgccatccc

SEQ ID NO: 4624602 - DNA, 20 bp, Homo sapiens
gacagtgccatccccacctt

SEQ ID NO: 4624603 - DNA, 23 bp, Homo sapiens
gacagtgtttcgtcatgttggcc

SEQ ID NO: 4624604 - DNA, 18 bp, Homo sapiens
gacagttcagagatcagg

SEQ ID NO: 4624605 - DNA, 14 bp, Homo sapiens
gacagtttccaaat

SEQ ID NO: 4624606 - DNA, 14 bp, Homo sapiens
gacataaaatttaa

SEQ ID NO: 4624607 - DNA, 12 bp, Homo sapiens
gacataaagcca

SEQ ID NO: 4624608 - DNA, 18 bp, Homo sapiens
gacataaagccatgtttc

SEQ ID NO: 4624609 - DNA, 20 bp, Homo sapiens
gacataggtcataaagcatt

SEQ ID NO: 4624610 - DNA, 17 bp, Homo sapiens
gacatcattgtcagcct

SEQ ID NO: 4624611 - DNA, 19 bp, Homo sapiens
gacatcattgtcagccttg

SEQ ID NO: 4624612 - DNA, 12 bp, Homo sapiens
gacatcttaaat

SEQ ID NO: 4624613 - DNA, 14 bp, Homo sapiens
gacatgagatcagg

SEQ ID NO: 4624614 - DNA, 17 bp, Homo sapiens
gacatgcccaaaactta

SEQ ID NO: 4624615 - DNA, 15 bp, Homo sapiens
gacatgtagcttctt

SEQ ID NO: 4624616 - DNA, 17 bp, Homo sapiens
gacatgtagcttcttct

SEQ ID NO: 4624617 - DNA, 15 bp, Homo sapiens
gacattcacctgccc

SEQ ID NO: 4624618 - DNA, 17 bp, Homo sapiens
gacattccatgacgaca

SEQ ID NO: 4624619 - DNA, 12 bp, Homo sapiens
gacattctaatg

SEQ ID NO: 4624620 - DNA, 15 bp, Homo sapiens
gacattctaatgcat

SEQ ID NO: 4624621 - DNA, 16 bp, Homo sapiens
gacattctaatgcata

SEQ ID NO: 4624622 - DNA, 18 bp, Homo sapiens
gacattctaatgcatatt

SEQ ID NO: 4624623 - DNA, 23 bp, Homo sapiens
gacattcttagctgtaacttaac

SEQ ID NO: 4624624 - DNA, 14 bp, Homo sapiens
gacattcttttaat

SEQ ID NO: 4624625 - DNA, 14 bp, Homo sapiens
gaccaacctgacct

SEQ ID NO: 4624626 - DNA, 15 bp, Homo sapiens
gaccaagatttacca

SEQ ID NO: 4624627 - DNA, 19 bp, Homo sapiens
gaccaatattaccatctta

SEQ ID NO: 4624628 - DNA, 18 bp, Homo sapiens
gaccaatattgtacagtt

SEQ ID NO: 4624629 - DNA, 19 bp, Homo sapiens
gaccaatattgtacagttt

SEQ ID NO: 4624630 - DNA, 21 bp, Homo sapiens
gaccaatattgtacagttttt

SEQ ID NO: 4624631 - DNA, 18 bp, Homo sapiens
gaccacacattttatgag

SEQ ID NO: 4624632 - DNA, 20 bp, Homo sapiens
gaccacacattttatgagag

SEQ ID NO: 4624633 - DNA, 12 bp, Homo sapiens
gaccacagcaca

SEQ ID NO: 4624634 - DNA, 15 bp, Homo sapiens
gaccacagcacagcc

SEQ ID NO: 4624635 - DNA, 13 bp, Homo sapiens
gaccacccctctc

SEQ ID NO: 4624636 - DNA, 22 bp, Homo sapiens
gaccacctcctctgccagcagg

SEQ ID NO: 4624637 - DNA, 22 bp, Homo sapiens
gaccaccttcccttcctcagca

SEQ ID NO: 4624638 - DNA, 13 bp, Homo sapiens
gaccacggctcga

SEQ ID NO: 4624639 - DNA, 14 bp, Homo sapiens
gaccaggatggagc

SEQ ID NO: 4624640 - DNA, 19 bp, Homo sapiens
gaccagggatgctgggctg

SEQ ID NO: 4624641 - DNA, 21 bp, Homo sapiens
gaccagtcaggatgaggcccc

SEQ ID NO: 4624642 - DNA, 15 bp, Homo sapiens
gaccagtctgaccct

SEQ ID NO: 4624643 - DNA, 16 bp, Homo sapiens
gaccattgagtccctg

SEQ ID NO: 4624644 - DNA, 18 bp, Homo sapiens
gaccatttgtagtgagcg

SEQ ID NO: 4624645 - DNA, 14 bp, Homo sapiens
gacccacatgccat

SEQ ID NO: 4624646 - DNA, 23 bp, Homo sapiens
gacccacatgccatttgtactga

SEQ ID NO: 4624647 - DNA, 11 bp, Homo sapiens
gacccacctgc

SEQ ID NO: 4624648 - DNA, 23 bp, Homo sapiens
gacccacgcagagaagccccggg

SEQ ID NO: 4624649 - DNA, 17 bp, Homo sapiens
gacccagcatctcccag

SEQ ID NO: 4624650 - DNA, 18 bp, Homo sapiens
gacccagcatctcccagc

SEQ ID NO: 4624651 - DNA, 19 bp, Homo sapiens
gacccagcatctcccagca

SEQ ID NO: 4624652 - DNA, 10 bp, Homo sapiens
gacccagccc

SEQ ID NO: 4624653 - DNA, 17 bp, Homo sapiens
gacccagccccttcccc

SEQ ID NO: 4624654 - DNA, 14 bp, Homo sapiens
gacccagccctcgc

SEQ ID NO: 4624655 - DNA, 21 bp, Homo sapiens
gacccatctctcccttaccca

SEQ ID NO: 4624656 - DNA, 22 bp, Homo sapiens
gaagctaacagggaaggcaggc

SEQ ID NO: 4624657 - DNA, 21 bp, Homo sapiens
gaagctatattagctgaaaca

SEQ ID NO: 4624658 - DNA, 19 bp, Homo sapiens
gaagctcttcaatagctaa

SEQ ID NO: 4624659 - DNA, 18 bp, Homo sapiens
gaagctgacgaacttcca

SEQ ID NO: 4624660 - DNA, 19 bp, Homo sapiens
gaagctgacgaacttccat

SEQ ID NO: 4624661 - DNA, 16 bp, Homo sapiens
gaagcttactctctgc

SEQ ID NO: 4624662 - DNA, 15 bp, Homo sapiens
gaagcttggaggagg

SEQ ID NO: 4624663 - DNA, 23 bp, Homo sapiens
gaagcttggcttcctcttcttgt

SEQ ID NO: 4624664 - DNA, 21 bp, Homo sapiens
gaaggaaagaagggggccctg

SEQ ID NO: 4624665 - DNA, 22 bp, Homo sapiens
gaaggaaagaagggggccctgc

SEQ ID NO: 4624666 - DNA, 14 bp, Homo sapiens
gaaggacaggaccc

SEQ ID NO: 4624667 - DNA, 12 bp, Homo sapiens
gaaggagacagg

SEQ ID NO: 4624668 - DNA, 22 bp, Homo sapiens
gaaggaggaatgctggactgga

SEQ ID NO: 4624669 - DNA, 19 bp, Homo sapiens
gaaggaggccaaccagccc

SEQ ID NO: 4624670 - DNA, 21 bp, Homo sapiens
gaaggaggccaaccagcccga

SEQ ID NO: 4624671 - DNA, 16 bp, Homo sapiens
gaaggagtttaaaagg

SEQ ID NO: 4624672 - DNA, 12 bp, Homo sapiens
gaaggcacagct

SEQ ID NO: 4624673 - DNA, 20 bp, Homo sapiens
gaaggcagacagcaggcagc

SEQ ID NO: 4624674 - DNA, 21 bp, Homo sapiens
gaaggcattggcatctgcttt

SEQ ID NO: 4624675 - DNA, 18 bp, Homo sapiens
gaaggcctcgcaggaaga

SEQ ID NO: 4624676 - DNA, 19 bp, Homo sapiens
gaaggctacttcggggctg

SEQ ID NO: 4624677 - DNA, 17 bp, Homo sapiens
gaaggctttcagggcct

SEQ ID NO: 4624678 - DNA, 15 bp, Homo sapiens
gaagggaagagacag

SEQ ID NO: 4624679 - DNA, 19 bp, Homo sapiens
gaagggagtctctcttcca

SEQ ID NO: 4624680 - DNA, 14 bp, Homo sapiens
gaagggggcggcct

SEQ ID NO: 4624681 - DNA, 15 bp, Homo sapiens
gaagggggctctgcc

SEQ ID NO: 4624682 - DNA, 21 bp, Homo sapiens
gaaggtctttgttatgacagt

SEQ ID NO: 4624683 - DNA, 13 bp, Homo sapiens
gaaggtggtggca

SEQ ID NO: 4624684 - DNA, 20 bp, Homo sapiens
gaagtaaattaaacattttt

SEQ ID NO: 4624685 - DNA, 15 bp, Homo sapiens
gaagtaacagacaca

SEQ ID NO: 4624686 - DNA, 16 bp, Homo sapiens
gaagtacacctgtgtg

SEQ ID NO: 4624687 - DNA, 17 bp, Homo sapiens
gaagtacacctgtgtgg

SEQ ID NO: 4624688 - DNA, 19 bp, Homo sapiens
gaagtatttatcaggagaa

SEQ ID NO: 4624689 - DNA, 23 bp, Homo sapiens
gaagtcaaataaatgtttccccc

SEQ ID NO: 4624690 - DNA, 16 bp, Homo sapiens
gaagtgaggaagccag

SEQ ID NO: 4624691 - DNA, 15 bp, Homo sapiens
gaagtgcgtgaatgt

SEQ ID NO: 4624692 - DNA, 23 bp, Homo sapiens
gaagtggagacagtcctttccca

SEQ ID NO: 4624693 - DNA, 15 bp, Homo sapiens
gaagtgttgcatgga

SEQ ID NO: 4624694 - DNA, 13 bp, Homo sapiens
gaagtttgtagcc

SEQ ID NO: 4624695 - DNA, 18 bp, Homo sapiens
gaataaacgcagaagagg

SEQ ID NO: 4624696 - DNA, 15 bp, Homo sapiens
gaataaagttgcaga

SEQ ID NO: 4624697 - DNA, 14 bp, Homo sapiens
gaataacatttaaa

SEQ ID NO: 4624698 - DNA, 17 bp, Homo sapiens
gaataacatttaaattc

SEQ ID NO: 4624699 - DNA, 13 bp, Homo sapiens
gaataacctgcac

SEQ ID NO: 4624700 - DNA, 20 bp, Homo sapiens
gaataatgaaaataaaacac

SEQ ID NO: 4624701 - DNA, 14 bp, Homo sapiens
gaatacattttatt

SEQ ID NO: 4624702 - DNA, 16 bp, Homo sapiens
gaatacccaggaagac

SEQ ID NO: 4624703 - DNA, 16 bp, Homo sapiens
gaatactcttgaaagg

SEQ ID NO: 4624704 - DNA, 13 bp, Homo sapiens
gaatacttatttt

SEQ ID NO: 4624705 - DNA, 15 bp, Homo sapiens
gaatacttattttca

SEQ ID NO: 4624706 - DNA, 13 bp, Homo sapiens
gaatataaagctt

SEQ ID NO: 4624707 - DNA, 17 bp, Homo sapiens
gaatatcattgatttta

SEQ ID NO: 4624708 - DNA, 22 bp, Homo sapiens
gaatatgcaaggcggtacacta

SEQ ID NO: 4624709 - DNA, 19 bp, Homo sapiens
gaatattcatggatggctc

SEQ ID NO: 4624710 - DNA, 12 bp, Homo sapiens
gaatatttgaat

SEQ ID NO: 4624711 - DNA, 15 bp, Homo sapiens
gaatatttgaataat

SEQ ID NO: 4624712 - DNA, 15 bp, Homo sapiens
gaatattttgatgca

SEQ ID NO: 4624713 - DNA, 19 bp, Homo sapiens
gaatattttgatgcagata

SEQ ID NO: 4624714 - DNA, 23 bp, Homo sapiens
gaatattttgttttgtgcagaga

SEQ ID NO: 4624715 - DNA, 18 bp, Homo sapiens
gaatcagtaggaccaggc

SEQ ID NO: 4624716 - DNA, 18 bp, Homo sapiens
gaatcatacttaacattt

SEQ ID NO: 4624717 - DNA, 22 bp, Homo sapiens
gaatcatgtctgtatccccagt

SEQ ID NO: 4624718 - DNA, 14 bp, Homo sapiens
gaatccatgggtct

SEQ ID NO: 4624719 - DNA, 20 bp, Homo sapiens
gaatcctgctcacaaaatca

SEQ ID NO: 4624720 - DNA, 16 bp, Homo sapiens
gaatcgattcccaagc

SEQ ID NO: 4624721 - DNA, 21 bp, Homo sapiens
gaatcgtccctatatcagggc

SEQ ID NO: 4624722 - DNA, 16 bp, Homo sapiens
gaatgaaattaacaca

SEQ ID NO: 4624723 - DNA, 20 bp, Homo sapiens
gaatgaaattaacacaaagg

SEQ ID NO: 4624724 - DNA, 14 bp, Homo sapiens
gaatgaagttctgc

SEQ ID NO: 4624725 - DNA, 14 bp, Homo sapiens
gaatgacagccttt

SEQ ID NO: 4624726 - DNA, 19 bp, Homo sapiens
gaatgacccttttgtgtct

SEQ ID NO: 4624727 - DNA, 13 bp, Homo sapiens
gaatgacttactt

SEQ ID NO: 4624728 - DNA, 17 bp, Homo sapiens
gaatgagagcgacacag

SEQ ID NO: 4624729 - DNA, 13 bp, Homo sapiens
gaatgagcccaga

SEQ ID NO: 4624730 - DNA, 16 bp, Homo sapiens
gaatgagcccagagaa

SEQ ID NO: 4624731 - DNA, 20 bp, Homo sapiens
gaatgagcccagagaacagc

SEQ ID NO: 4624732 - DNA, 18 bp, Homo sapiens
gaatgatttttcattggc

SEQ ID NO: 4624733 - DNA, 14 bp, Homo sapiens
gaatgcacgtttca

SEQ ID NO: 4624734 - DNA, 17 bp, Homo sapiens
gaatgcataatgtttaa

SEQ ID NO: 4624735 - DNA, 18 bp, Homo sapiens
gaatgcccccagctggcc

SEQ ID NO: 4624736 - DNA, 14 bp, Homo sapiens
gaatgcctcctgtg

SEQ ID NO: 4624737 - DNA, 18 bp, Homo sapiens
gaatgctggactggaggc

SEQ ID NO: 4624738 - DNA, 23 bp, Homo sapiens
gaatgctggactggaggcccctg

SEQ ID NO: 4624739 - DNA, 15 bp, Homo sapiens
gaatggaggagccag

SEQ ID NO: 4624740 - DNA, 22 bp, Homo sapiens
gaatggataaaataatgctgca

SEQ ID NO: 4624741 - DNA, 24 bp, Homo sapiens
gaatggggaagggagtctctcttc

SEQ ID NO: 4624742 - DNA, 11 bp, Homo sapiens
gaatgtagtta

SEQ ID NO: 4624743 - DNA, 20 bp, Homo sapiens
gaatgtgggcactggcccag

SEQ ID NO: 4624744 - DNA, 21 bp, Homo sapiens
gaatgtgggcactggcccagg

SEQ ID NO: 4624745 - DNA, 13 bp, Homo sapiens
gaatgtgggctat

SEQ ID NO: 4624746 - DNA, 16 bp, Homo sapiens
gaatgttgtacttgaa

SEQ ID NO: 4624747 - DNA, 13 bp, Homo sapiens
gaatgtttgtgtc

SEQ ID NO: 4624748 - DNA, 19 bp, Homo sapiens
gaatgtttgtgtctgtggt

SEQ ID NO: 4624749 - DNA, 20 bp, Homo sapiens
gaattaagttatctttaaaa

SEQ ID NO: 4624750 - DNA, 15 bp, Homo sapiens
gaattactttgtgtt

SEQ ID NO: 4624751 - DNA, 20 bp, Homo sapiens
gaattatacagacctaatat

SEQ ID NO: 4624752 - DNA, 13 bp, Homo sapiens
gaattcagtgcct

SEQ ID NO: 4624753 - DNA, 20 bp, Homo sapiens
gaattcatactctgttgcct

SEQ ID NO: 4624754 - DNA, 22 bp, Homo sapiens
gaattcatactctgttgcctcc

SEQ ID NO: 4624755 - DNA, 20 bp, Homo sapiens
gaattccttcgaaaggcctt

SEQ ID NO: 4624756 - DNA, 22 bp, Homo sapiens
gaattccttcgaaaggccttca

SEQ ID NO: 4624757 - DNA, 21 bp, Homo sapiens
gaattctaccctggaaaagtg

SEQ ID NO: 4624758 - DNA, 20 bp, Homo sapiens
gaatttcagtgggtctctgt

SEQ ID NO: 4624759 - DNA, 17 bp, Homo sapiens
gaatttcccacataccc

SEQ ID NO: 4624760 - DNA, 15 bp, Homo sapiens
gaatttggggcagga

SEQ ID NO: 4624761 - DNA, 15 bp, Homo sapiens
gaatttgttctcttt

SEQ ID NO: 4624762 - DNA, 16 bp, Homo sapiens
gaattttcaaggcctt

SEQ ID NO: 4624763 - DNA, 15 bp, Homo sapiens
gaattttccagacct

SEQ ID NO: 4624764 - DNA, 17 bp, Homo sapiens
gaattttctgtgttttg

SEQ ID NO: 4624765 - DNA, 18 bp, Homo sapiens
gacaaaaaatgttttaaa

SEQ ID NO: 4624766 - DNA, 13 bp, Homo sapiens
gacaaaacttctt

SEQ ID NO: 4624767 - DNA, 12 bp, Homo sapiens
gaccccagctgc

SEQ ID NO: 4624768 - DNA, 14 bp, Homo sapiens
gaccccagctgctc

SEQ ID NO: 4624769 - DNA, 14 bp, Homo sapiens
gaccccagggcaca

SEQ ID NO: 4624770 - DNA, 19 bp, Homo sapiens
gaccccagggcacaggagc

SEQ ID NO: 4624771 - DNA, 16 bp, Homo sapiens
gaccccagtgcctgca

SEQ ID NO: 4624772 - DNA, 13 bp, Homo sapiens
gacccccagctcc

SEQ ID NO: 4624773 - DNA, 11 bp, Homo sapiens
gacccctcctt

SEQ ID NO: 4624774 - DNA, 12 bp, Homo sapiens
gacccctggcca

SEQ ID NO: 4624775 - DNA, 15 bp, Homo sapiens
gacccctggccacag

SEQ ID NO: 4624776 - DNA, 17 bp, Homo sapiens
gacccctggccacagcc

SEQ ID NO: 4624777 - DNA, 20 bp, Homo sapiens
gacccctggccacagccttc

SEQ ID NO: 4624778 - DNA, 13 bp, Homo sapiens
gacccctgggagc

SEQ ID NO: 4624779 - DNA, 15 bp, Homo sapiens
gacccgcaacaagta

SEQ ID NO: 4624780 - DNA, 17 bp, Homo sapiens
gacccggcaccccctgc

SEQ ID NO: 4624781 - DNA, 19 bp, Homo sapiens
gacccggcaccccctgcag

SEQ ID NO: 4624782 - DNA, 15 bp, Homo sapiens
gaccctgatgcaggt

SEQ ID NO: 4624783 - DNA, 23 bp, Homo sapiens
gaccctgatgcaggtcagcccat

SEQ ID NO: 4624784 - DNA, 18 bp, Homo sapiens
gaccctgcaaacagaaca

SEQ ID NO: 4624785 - DNA, 14 bp, Homo sapiens
gaccctgtccccta

SEQ ID NO: 4624786 - DNA, 18 bp, Homo sapiens
gaccctgtcccctaggga

SEQ ID NO: 4624787 - DNA, 17 bp, Homo sapiens
gacccttacagcctctg

SEQ ID NO: 4624788 - DNA, 16 bp, Homo sapiens
gaccctttttggacta

SEQ ID NO: 4624789 - DNA, 20 bp, Homo sapiens
gaccgctacaccactctggc

SEQ ID NO: 4624790 - DNA, 13 bp, Homo sapiens
gaccggcagagct

SEQ ID NO: 4624791 - DNA, 15 bp, Homo sapiens
gaccggcggctcgga

SEQ ID NO: 4624792 - DNA, 15 bp, Homo sapiens
gaccggtgcttttat

SEQ ID NO: 4624793 - DNA, 22 bp, Homo sapiens
gaccggtgcttttattgtaaag

SEQ ID NO: 4624794 - DNA, 14 bp, Homo sapiens
gacctaacctagga

SEQ ID NO: 4624795 - DNA, 17 bp, Homo sapiens
gacctataactgcccag

SEQ ID NO: 4624796 - DNA, 13 bp, Homo sapiens
gacctcagaagta

SEQ ID NO: 4624797 - DNA, 20 bp, Homo sapiens
gacctcctcttcccccttcc

SEQ ID NO: 4624798 - DNA, 23 bp, Homo sapiens
gacctctggattaggtctctgtt

SEQ ID NO: 4624799 - DNA, 11 bp, Homo sapiens
gacctgagcct

SEQ ID NO: 4624800 - DNA, 13 bp, Homo sapiens
gacctgagcctgc

SEQ ID NO: 4624801 - DNA, 15 bp, Homo sapiens
gacctgagcctgccg

SEQ ID NO: 4624802 - DNA, 18 bp, Homo sapiens
gacctgagcctgccgagc

SEQ ID NO: 4624803 - DNA, 19 bp, Homo sapiens
gacctgcatggtcaagcct

SEQ ID NO: 4624804 - DNA, 22 bp, Homo sapiens
gacctgccagccactgtcaccg

SEQ ID NO: 4624805 - DNA, 11 bp, Homo sapiens
gacctgctgag

SEQ ID NO: 4624806 - DNA, 14 bp, Homo sapiens
gacctgctgagctc

SEQ ID NO: 4624807 - DNA, 11 bp, Homo sapiens
gacctggaggg

SEQ ID NO: 4624808 - DNA, 15 bp, Homo sapiens
gacctggaggggaga

SEQ ID NO: 4624809 - DNA, 22 bp, Homo sapiens
gacctgggacaagcaggccgcc

SEQ ID NO: 4624810 - DNA, 16 bp, Homo sapiens
gacctgtctcctggcg

SEQ ID NO: 4624811 - DNA, 14 bp, Homo sapiens
gacgaacttccatg

SEQ ID NO: 4624812 - DNA, 20 bp, Homo sapiens
gacgagacaacagcacacag

SEQ ID NO: 4624813 - DNA, 12 bp, Homo sapiens
gacgggagggga

SEQ ID NO: 4624814 - DNA, 14 bp, Homo sapiens
gacgtggctcagcc

SEQ ID NO: 4624815 - DNA, 18 bp, Homo sapiens
gacgtggtctagaccagg

SEQ ID NO: 4624816 - DNA, 19 bp, Homo sapiens
gacgtggtctagaccaggg

SEQ ID NO: 4624817 - DNA, 22 bp, Homo sapiens
gacgtggtctagaccagggctg

SEQ ID NO: 4624818 - DNA, 20 bp, Homo sapiens
gacgttaggcatttcctgct

SEQ ID NO: 4624819 - DNA, 21 bp, Homo sapiens
gactaacactcagaagcctgg

SEQ ID NO: 4624820 - DNA, 22 bp, Homo sapiens
gactaacactcagaagcctggg

SEQ ID NO: 4624821 - DNA, 15 bp, Homo sapiens
gactaattttacatg

SEQ ID NO: 4624822 - DNA, 19 bp, Homo sapiens
gactagcaggctactggga

SEQ ID NO: 4624823 - DNA, 16 bp, Homo sapiens
gactagccagaattct

SEQ ID NO: 4624824 - DNA, 15 bp, Homo sapiens
gactagtagatttct

SEQ ID NO: 4624825 - DNA, 15 bp, Homo sapiens
gactattcatggcta

SEQ ID NO: 4624826 - DNA, 23 bp, Homo sapiens
gactcacctgcgcaagtgcctgg

SEQ ID NO: 4624827 - DNA, 23 bp, Homo sapiens
gactcagggcagcgccaggctga

SEQ ID NO: 4624828 - DNA, 14 bp, Homo sapiens
gactcagttttttg

SEQ ID NO: 4624829 - DNA, 12 bp, Homo sapiens
gactcccttgct

SEQ ID NO: 4624830 - DNA, 18 bp, Homo sapiens
gactcctgaggacagctg

SEQ ID NO: 4624831 - DNA, 20 bp, Homo sapiens
gactcctgaggacagctgtc

SEQ ID NO: 4624832 - DNA, 17 bp, Homo sapiens
gactcctgctggtacct

SEQ ID NO: 4624833 - DNA, 15 bp, Homo sapiens
gactctgcacatgtc

SEQ ID NO: 4624834 - DNA, 12 bp, Homo sapiens
gactctggccct

SEQ ID NO: 4624835 - DNA, 19 bp, Homo sapiens
gactctgtctacctggtct

SEQ ID NO: 4624836 - DNA, 19 bp, Homo sapiens
gactcttgggccgtcccca

SEQ ID NO: 4624837 - DNA, 14 bp, Homo sapiens
gactgaaggaaaag

SEQ ID NO: 4624838 - DNA, 22 bp, Homo sapiens
gactgaccaatattgtacagtt

SEQ ID NO: 4624839 - DNA, 19 bp, Homo sapiens
gactgaccttgatgagctg

SEQ ID NO: 4624840 - DNA, 15 bp, Homo sapiens
gactgagaacttttt

SEQ ID NO: 4624841 - DNA, 17 bp, Homo sapiens
gactgaggcatccgtga

SEQ ID NO: 4624842 - DNA, 12 bp, Homo sapiens
gactgagggcag

SEQ ID NO: 4624843 - DNA, 13 bp, Homo sapiens
gactgattttaat

SEQ ID NO: 4624844 - DNA, 21 bp, Homo sapiens
gactgcaaagccagtgctgtc

SEQ ID NO: 4624845 - DNA, 11 bp, Homo sapiens
gactgccaaat

SEQ ID NO: 4624846 - DNA, 15 bp, Homo sapiens
gactgccctgcccag

SEQ ID NO: 4624847 - DNA, 20 bp, Homo sapiens
gactgggccccacatggctt

SEQ ID NO: 4624848 - DNA, 19 bp, Homo sapiens
gactggtgtcataaacttt

SEQ ID NO: 4624849 - DNA, 16 bp, Homo sapiens
gactggttatcttgtt

SEQ ID NO: 4624850 - DNA, 18 bp, Homo sapiens
gactgtacattatgaaga

SEQ ID NO: 4624851 - DNA, 20 bp, Homo sapiens
gactgtcctagccaggtctc

SEQ ID NO: 4624852 - DNA, 13 bp, Homo sapiens
gactgtcgccaca

SEQ ID NO: 4624853 - DNA, 22 bp, Homo sapiens
gactgtcgccacacgcctctgt

SEQ ID NO: 4624854 - DNA, 19 bp, Homo sapiens
gactgtgtaactttctctt

SEQ ID NO: 4624855 - DNA, 11 bp, Homo sapiens
gactgtgtctg

SEQ ID NO: 4624856 - DNA, 19 bp, Homo sapiens
gactgttacagactgaaag

SEQ ID NO: 4624857 - DNA, 18 bp, Homo sapiens
gactgttagttgtccaca

SEQ ID NO: 4624858 - DNA, 14 bp, Homo sapiens
gactgtttcatagt

SEQ ID NO: 4624859 - DNA, 17 bp, Homo sapiens
gacttactgcctgacct

SEQ ID NO: 4624860 - DNA, 17 bp, Homo sapiens
gacttatttctgctctg

SEQ ID NO: 4624861 - DNA, 22 bp, Homo sapiens
gacttcactaggcattgtgatg

SEQ ID NO: 4624862 - DNA, 17 bp, Homo sapiens
gacttctaatttatatt

SEQ ID NO: 4624863 - DNA, 20 bp, Homo sapiens
gacttcttacacataaagca

SEQ ID NO: 4624864 - DNA, 16 bp, Homo sapiens
gacttcttcctctaga

SEQ ID NO: 4624865 - DNA, 15 bp, Homo sapiens
gacttcttgcttcag

SEQ ID NO: 4624866 - DNA, 18 bp, Homo sapiens
gacttgaaggagtttaaa

SEQ ID NO: 4624867 - DNA, 14 bp, Homo sapiens
gacttgggcacccc

SEQ ID NO: 4624868 - DNA, 20 bp, Homo sapiens
gacttgggcacccccagcct

SEQ ID NO: 4624869 - DNA, 12 bp, Homo sapiens
gacttgtctgcc

SEQ ID NO: 4624870 - DNA, 15 bp, Homo sapiens
gacttgtctgcctcc

SEQ ID NO: 4624871 - DNA, 17 bp, Homo sapiens
gacttgtctgcctcctg

SEQ ID NO: 4624872 - DNA, 19 bp, Homo sapiens
gacttgtgacggtgtacct

SEQ ID NO: 4624873 - DNA, 20 bp, Homo sapiens
gactttacaaacctttgttt

SEQ ID NO: 4624874 - DNA, 21 bp, Homo sapiens
gactttatctaatacctctgt

SEQ ID NO: 4624875 - DNA, 14 bp, Homo sapiens
gactttcccaccca

SEQ ID NO: 4624876 - DNA, 18 bp, Homo sapiens
gactttgggataggaaaa

SEQ ID NO: 4624877 - DNA, 16 bp, Homo sapiens
gactttttataaaatg

SEQ ID NO: 4624878 - DNA, 16 bp, Homo sapiens
gagaaaaaggtgccat

SEQ ID NO: 4624879 - DNA, 18 bp, Homo sapiens
gagaaaatataaggactt

SEQ ID NO: 4624880 - DNA, 18 bp, Homo sapiens
gagaaaatctgcatgttt

SEQ ID NO: 4624881 - DNA, 14 bp, Homo sapiens
gagaaacagctcag

SEQ ID NO: 4624882 - DNA, 13 bp, Homo sapiens
gagaaagagagaa

SEQ ID NO: 4624883 - DNA, 19 bp, Homo sapiens
gagaaagagagaagccagc

SEQ ID NO: 4624884 - DNA, 23 bp, Homo sapiens
gagaaagagagaagccagccaca

SEQ ID NO: 4624885 - DNA, 14 bp, Homo sapiens
gagaaagagctgcc

SEQ ID NO: 4624886 - DNA, 17 bp, Homo sapiens
gagaacagtggttgcct

SEQ ID NO: 4624887 - DNA, 20 bp, Homo sapiens
gagaacagtggttgcctggg

SEQ ID NO: 4624888 - DNA, 23 bp, Homo sapiens
gagaacagtggttgcctgggggc

SEQ ID NO: 4624889 - DNA, 15 bp, Homo sapiens
gagaacctggccttc

SEQ ID NO: 4624890 - DNA, 21 bp, Homo sapiens
gagaactcgttcacctccaag

SEQ ID NO: 4624891 - DNA, 14 bp, Homo sapiens
gagaagattttata

SEQ ID NO: 4624892 - DNA, 13 bp, Homo sapiens
gagaagctcttca

SEQ ID NO: 4624893 - DNA, 19 bp, Homo sapiens
gagaaggagtgccatacct

SEQ ID NO: 4624894 - DNA, 17 bp, Homo sapiens
gagaagggggctctgcc

SEQ ID NO: 4624895 - DNA, 19 bp, Homo sapiens
gagaagggggctctgcccc

SEQ ID NO: 4624896 - DNA, 21 bp, Homo sapiens
gagaagggggctctgccccag

SEQ ID NO: 4624897 - DNA, 15 bp, Homo sapiens
gagaagttgtgaaag

SEQ ID NO: 4624898 - DNA, 20 bp, Homo sapiens
gagaagtttaacaagtattt

SEQ ID NO: 4624899 - DNA, 19 bp, Homo sapiens
gagaagtttgtagccaggt

SEQ ID NO: 4624900 - DNA, 18 bp, Homo sapiens
gagaatgagagcgacaca

SEQ ID NO: 4624901 - DNA, 19 bp, Homo sapiens
gagaatgagagcgacacag

SEQ ID NO: 4624902 - DNA, 14 bp, Homo sapiens
gagaatgtgtgtag

SEQ ID NO: 4624903 - DNA, 22 bp, Homo sapiens
gagaatgtgtgtgtgtggcagg

SEQ ID NO: 4624904 - DNA, 23 bp, Homo sapiens
gagaatgtgtgtgtgtggcaggg

SEQ ID NO: 4624905 - DNA, 17 bp, Homo sapiens
gagaatgtgtttcaaaa

SEQ ID NO: 4624906 - DNA, 16 bp, Homo sapiens
gagacaacagcacaca

SEQ ID NO: 4624907 - DNA, 17 bp, Homo sapiens
gagacaacagcacacag

SEQ ID NO: 4624908 - DNA, 11 bp, Homo sapiens
gagacacagga

SEQ ID NO: 4624909 - DNA, 18 bp, Homo sapiens
gagacacatacagagtgg

SEQ ID NO: 4624910 - DNA, 17 bp, Homo sapiens
gagacagtcctttccca

SEQ ID NO: 4624911 - DNA, 21 bp, Homo sapiens
gagaccacacaccctttggga

SEQ ID NO: 4624912 - DNA, 16 bp, Homo sapiens
gagacccagccccttc

SEQ ID NO: 4624913 - DNA, 16 bp, Homo sapiens
gagaccccgcacccgg

SEQ ID NO: 4624914 - DNA, 13 bp, Homo sapiens
gagacctcagaag

SEQ ID NO: 4624915 - DNA, 18 bp, Homo sapiens
gagacctcagaagtaaag

SEQ ID NO: 4624916 - DNA, 18 bp, Homo sapiens
gagacggtgttttgccat

SEQ ID NO: 4624917 - DNA, 19 bp, Homo sapiens
gagactgccctgcccaggt

SEQ ID NO: 4624918 - DNA, 19 bp, Homo sapiens
gagactttacaaacctttg

SEQ ID NO: 4624919 - DNA, 19 bp, Homo sapiens
gagactttccgactgcttt

SEQ ID NO: 4624920 - DNA, 13 bp, Homo sapiens
gagagaaagagag

SEQ ID NO: 4624921 - DNA, 19 bp, Homo sapiens
gagagaaagagagaagcca

SEQ ID NO: 4624922 - DNA, 16 bp, Homo sapiens
gagagaagccagccac

SEQ ID NO: 4624923 - DNA, 17 bp, Homo sapiens
gagagaagccagccaca

SEQ ID NO: 4624924 - DNA, 16 bp, Homo sapiens
gagagaattggctcaa

SEQ ID NO: 4624925 - DNA, 15 bp, Homo sapiens
gagagaccccgcacc

SEQ ID NO: 4624926 - DNA, 15 bp, Homo sapiens
gagagagagtgtgtg

SEQ ID NO: 4624927 - DNA, 20 bp, Homo sapiens
gagagatgggccaggcagag

SEQ ID NO: 4624928 - DNA, 16 bp, Homo sapiens
gagagccaggatgccc

SEQ ID NO: 4624929 - DNA, 18 bp, Homo sapiens
gagagccaggatgcccag

SEQ ID NO: 4624930 - DNA, 16 bp, Homo sapiens
gagagcctcgcttttt

SEQ ID NO: 4624931 - DNA, 22 bp, Homo sapiens
gagagctaggagcaaagcctgt

SEQ ID NO: 4624932 - DNA, 10 bp, Homo sapiens
gagaggcccc

SEQ ID NO: 4624933 - DNA, 16 bp, Homo sapiens
gagaggcccccaccct

SEQ ID NO: 4624934 - DNA, 12 bp, Homo sapiens
gagaggccctgg

SEQ ID NO: 4624935 - DNA, 11 bp, Homo sapiens
gagaggtcagc

SEQ ID NO: 4624936 - DNA, 15 bp, Homo sapiens
gagaggtcagccttg

SEQ ID NO: 4624937 - DNA, 14 bp, Homo sapiens
gagagtacctgtgt

SEQ ID NO: 4624938 - DNA, 12 bp, Homo sapiens
gagagtctgaga

SEQ ID NO: 4624939 - DNA, 19 bp, Homo sapiens
gagagttgtgatggagggg

SEQ ID NO: 4624940 - DNA, 18 bp, Homo sapiens
gagataaatagaaatttt

SEQ ID NO: 4624941 - DNA, 19 bp, Homo sapiens
gagataagtaggctggttt

SEQ ID NO: 4624942 - DNA, 18 bp, Homo sapiens
gagatacttatgcaagat

SEQ ID NO: 4624943 - DNA, 16 bp, Homo sapiens
gagatagcattgtgaa

SEQ ID NO: 4624944 - DNA, 19 bp, Homo sapiens
gagatatttaggaaaatgc

SEQ ID NO: 4624945 - DNA, 23 bp, Homo sapiens
gagatatttcaagctcatgtcat

SEQ ID NO: 4624946 - DNA, 14 bp, Homo sapiens
gagatcagggcctg

SEQ ID NO: 4624947 - DNA, 18 bp, Homo sapiens
gagatcccttaagaagtt

SEQ ID NO: 4624948 - DNA, 18 bp, Homo sapiens
gagatctgctgtcctgtt

SEQ ID NO: 4624949 - DNA, 14 bp, Homo sapiens
gagatctggggagg

SEQ ID NO: 4624950 - DNA, 17 bp, Homo sapiens
gagatgaccagggatgc

SEQ ID NO: 4624951 - DNA, 18 bp, Homo sapiens
gagatgaccagggatgct

SEQ ID NO: 4624952 - DNA, 16 bp, Homo sapiens
gagatggagtctcact

SEQ ID NO: 4624953 - DNA, 18 bp, Homo sapiens
gagatgtgatcaggcccc

SEQ ID NO: 4624954 - DNA, 21 bp, Homo sapiens
gagattgtactgttcatacag

SEQ ID NO: 4624955 - DNA, 20 bp, Homo sapiens
gagcaaaatcaacatgactg

SEQ ID NO: 4624956 - DNA, 12 bp, Homo sapiens
gagcaaagcctg

SEQ ID NO: 4624957 - DNA, 14 bp, Homo sapiens
gagcaaagcctgtt

SEQ ID NO: 4624958 - DNA, 22 bp, Homo sapiens
gagcaaagcctgttcatggcag

SEQ ID NO: 4624959 - DNA, 20 bp, Homo sapiens
gagcaaccgtggcccttcct

SEQ ID NO: 4624960 - DNA, 21 bp, Homo sapiens
gagcaaccgtggcccttcctg

SEQ ID NO: 4624961 - DNA, 22 bp, Homo sapiens
gagcaaccgtggcccttcctgg

SEQ ID NO: 4624962 - DNA, 23 bp, Homo sapiens
gagcaaccgtggcccttcctgga

SEQ ID NO: 4624963 - DNA, 17 bp, Homo sapiens
gagcaacggccccagcg

SEQ ID NO: 4624964 - DNA, 14 bp, Homo sapiens
gagcaagctcttcc

SEQ ID NO: 4624965 - DNA, 22 bp, Homo sapiens
gagcacaagaggagatccaggg

SEQ ID NO: 4624966 - DNA, 13 bp, Homo sapiens
gagcacctgtctg

SEQ ID NO: 4624967 - DNA, 12 bp, Homo sapiens
gagcactgccag

SEQ ID NO: 4624968 - DNA, 13 bp, Homo sapiens
gagcactgccagg

SEQ ID NO: 4624969 - DNA, 19 bp, Homo sapiens
gagcactgccaggagggac

SEQ ID NO: 4624970 - DNA, 20 bp, Homo sapiens
gagcactgccaggagggaca

SEQ ID NO: 4624971 - DNA, 19 bp, Homo sapiens
gagcactgcgcgctatccc

SEQ ID NO: 4624972 - DNA, 22 bp, Homo sapiens
gagcagaatgttgtacttgaaa

SEQ ID NO: 4624973 - DNA, 17 bp, Homo sapiens
gagcagacaggctacaa

SEQ ID NO: 4624974 - DNA, 15 bp, Homo sapiens
gagcagatcttggaa

SEQ ID NO: 4624975 - DNA, 14 bp, Homo sapiens
gagcagccctggcc

SEQ ID NO: 4624976 - DNA, 15 bp, Homo sapiens
gagcagccctggccc

SEQ ID NO: 4624977 - DNA, 16 bp, Homo sapiens
gagcagccctggcccc

SEQ ID NO: 4624978 - DNA, 18 bp, Homo sapiens
gagcagctccaccactgt

SEQ ID NO: 4624979 - DNA, 20 bp, Homo sapiens
gagcagctgaataacctgca

SEQ ID NO: 4624980 - DNA, 17 bp, Homo sapiens
gagcagctgagcagggc

SEQ ID NO: 4624981 - DNA, 20 bp, Homo sapiens
gagcaggagccccgccacag

SEQ ID NO: 4624982 - DNA, 15 bp, Homo sapiens
gagcaggaggtgcct

SEQ ID NO: 4624983 - DNA, 15 bp, Homo sapiens
gagcagggccgggga

SEQ ID NO: 4624984 - DNA, 22 bp, Homo sapiens
gagcagggccggggaactggcc

SEQ ID NO: 4624985 - DNA, 23 bp, Homo sapiens
gagcaggttccccaagggccctg

SEQ ID NO: 4624986 - DNA, 17 bp, Homo sapiens
gagcagtggccatcatc

SEQ ID NO: 4624987 - DNA, 13 bp, Homo sapiens
gagcatcatgcct

SEQ ID NO: 4624988 - DNA, 18 bp, Homo sapiens
gagcatcatgcctctgag

SEQ ID NO: 4624989 - DNA, 20 bp, Homo sapiens
gagcatcatgcctctgaggc

SEQ ID NO: 4624990 - DNA, 13 bp, Homo sapiens
aaaaaaaaatgtt

SEQ ID NO: 4624991 - DNA, 12 bp, Homo sapiens
aaaaaaagctgc

SEQ ID NO: 4624992 - DNA, 16 bp, Homo sapiens
aaaaacaaatgttcat

SEQ ID NO: 4624993 - DNA, 21 bp, Homo sapiens
aaaaacagcattgctttctga

SEQ ID NO: 4624994 - DNA, 14 bp, Homo sapiens
aaaaactctttatt

SEQ ID NO: 4624995 - DNA, 12 bp, Homo sapiens
aaaaactttatt

SEQ ID NO: 4624996 - DNA, 13 bp, Homo sapiens
aaaaagaatagaa

SEQ ID NO: 4624997 - DNA, 21 bp, Homo sapiens
aaaaagatgatcgctgtattt

SEQ ID NO: 4624998 - DNA, 20 bp, Homo sapiens
aaaaagctgcaaaaattata

SEQ ID NO: 4624999 - DNA, 15 bp, Homo sapiens
aaaaagtattatttt

SEQ ID NO: 4625000 - DNA, 15 bp, Homo sapiens
aaaaataaaatgttt

SEQ ID NO: 4625001 - DNA, 23 bp, Homo sapiens
aaaaatattgtttctgcattcat

SEQ ID NO: 4625002 - DNA, 22 bp, Homo sapiens
aaaaatattttctctgtacttt

SEQ ID NO: 4625003 - DNA, 23 bp, Homo sapiens
aaaaatctagtgggttgaccttt

SEQ ID NO: 4625004 - DNA, 23 bp, Homo sapiens
aaaaatgcaaatcctatgtgatt

SEQ ID NO: 4625005 - DNA, 17 bp, Homo sapiens
aaaaattacatatataa

SEQ ID NO: 4625006 - DNA, 22 bp, Homo sapiens
aaaaattacatatataaaacta

SEQ ID NO: 4625007 - DNA, 17 bp, Homo sapiens
aaaaattatatattgca

SEQ ID NO: 4625008 - DNA, 23 bp, Homo sapiens
aaaaattggttttatttttttct

SEQ ID NO: 4625009 - DNA, 12 bp, Homo sapiens
aaaacaaaattt

SEQ ID NO: 4625010 - DNA, 16 bp, Homo sapiens
aaaacatctagcccaa

SEQ ID NO: 4625011 - DNA, 21 bp, Homo sapiens
aaaacattttttaatagaata

SEQ ID NO: 4625012 - DNA, 15 bp, Homo sapiens
aaaacctacatattc

SEQ ID NO: 4625013 - DNA, 23 bp, Homo sapiens
aaaactaaggcttttatttctgt

SEQ ID NO: 4625014 - DNA, 14 bp, Homo sapiens
aaaactcactgtga

SEQ ID NO: 4625015 - DNA, 12 bp, Homo sapiens
aaaactcatgat

SEQ ID NO: 4625016 - DNA, 20 bp, Homo sapiens
aaaactcccaatacaaagat

SEQ ID NO: 4625017 - DNA, 22 bp, Homo sapiens
aaaactcccaatacaaagatga

SEQ ID NO: 4625018 - DNA, 20 bp, Homo sapiens
aaaactgttcttttgcattt

SEQ ID NO: 4625019 - DNA, 16 bp, Homo sapiens
aaaacttaaatattgt

SEQ ID NO: 4625020 - DNA, 10 bp, Homo sapiens
aaaacttctt

SEQ ID NO: 4625021 - DNA, 11 bp, Homo sapiens
aaaagaaatat

SEQ ID NO: 4625022 - DNA, 13 bp, Homo sapiens
aaaagaaatccag

SEQ ID NO: 4625023 - DNA, 13 bp, Homo sapiens
aaaagaaatgcaa

SEQ ID NO: 4625024 - DNA, 17 bp, Homo sapiens
aaaagaaggaccctttt

SEQ ID NO: 4625025 - DNA, 11 bp, Homo sapiens
aaaagaatgac

SEQ ID NO: 4625026 - DNA, 18 bp, Homo sapiens
aaaagcaggactgtgcct

SEQ ID NO: 4625027 - DNA, 18 bp, Homo sapiens
aaaagcttaatgattctg

SEQ ID NO: 4625028 - DNA, 14 bp, Homo sapiens
aaaaggaaacttcc

SEQ ID NO: 4625029 - DNA, 14 bp, Homo sapiens
aaaaggcagcacgt

SEQ ID NO: 4625030 - DNA, 21 bp, Homo sapiens
aaaaggcctcttgtaaagact

SEQ ID NO: 4625031 - DNA, 22 bp, Homo sapiens
aaaaggcctcttgtaaagactg

SEQ ID NO: 4625032 - DNA, 19 bp, Homo sapiens
aaaagggtcttgggaaata

SEQ ID NO: 4625033 - DNA, 13 bp, Homo sapiens
aaaagtaattttg

SEQ ID NO: 4625034 - DNA, 15 bp, Homo sapiens
aaaagtaattttgtc

SEQ ID NO: 4625035 - DNA, 20 bp, Homo sapiens
aaaagtattattttccaaaa

SEQ ID NO: 4625036 - DNA, 16 bp, Homo sapiens
aaaagtggcctctttg

SEQ ID NO: 4625037 - DNA, 23 bp, Homo sapiens
aaaagtttcctaggatgtcatgt

SEQ ID NO: 4625038 - DNA, 13 bp, Homo sapiens
aaaataaaacaca

SEQ ID NO: 4625039 - DNA, 14 bp, Homo sapiens
aaaataaaacacac

SEQ ID NO: 4625040 - DNA, 16 bp, Homo sapiens
aaaataaaatgtttca

SEQ ID NO: 4625041 - DNA, 22 bp, Homo sapiens
aaaataaaggaaaatgacttgt

SEQ ID NO: 4625042 - DNA, 22 bp, Homo sapiens
aaaataaaggataactctgtat

SEQ ID NO: 4625043 - DNA, 21 bp, Homo sapiens
aaaatacacgtttatcttaca

SEQ ID NO: 4625044 - DNA, 21 bp, Homo sapiens
aaaatacttctttttcattat

SEQ ID NO: 4625045 - DNA, 17 bp, Homo sapiens
aaaatagaaaaagtgga

SEQ ID NO: 4625046 - DNA, 18 bp, Homo sapiens
aaaatagaataattcttt

SEQ ID NO: 4625047 - DNA, 17 bp, Homo sapiens
aaaatagagcaaaatca

SEQ ID NO: 4625048 - DNA, 16 bp, Homo sapiens
aaaatataaattgtac

SEQ ID NO: 4625049 - DNA, 20 bp, Homo sapiens
aaaatataaattgtacattt

SEQ ID NO: 4625050 - DNA, 21 bp, Homo sapiens
aaaatatatattatatacata

SEQ ID NO: 4625051 - DNA, 16 bp, Homo sapiens
aaaatatcataaagca

SEQ ID NO: 4625052 - DNA, 14 bp, Homo sapiens
aaaatatgtaattt

SEQ ID NO: 4625053 - DNA, 22 bp, Homo sapiens
aaaatattactcagtttatgtt

SEQ ID NO: 4625054 - DNA, 23 bp, Homo sapiens
aaaatattactctagtttattct

SEQ ID NO: 4625055 - DNA, 11 bp, Homo sapiens
aaaatattgtt

SEQ ID NO: 4625056 - DNA, 14 bp, Homo sapiens
aaaatattgtttct

SEQ ID NO: 4625057 - DNA, 10 bp, Homo sapiens
aaaatcaaga

SEQ ID NO: 4625058 - DNA, 12 bp, Homo sapiens
aaaatcaagagt

SEQ ID NO: 4625059 - DNA, 16 bp, Homo sapiens
aaaatcaagagtgaga

SEQ ID NO: 4625060 - DNA, 24 bp, Homo sapiens
aaaatcaagagtgagatgtagaaa

SEQ ID NO: 4625061 - DNA, 14 bp, Homo sapiens
aaaatcatcactca

SEQ ID NO: 4625062 - DNA, 22 bp, Homo sapiens
aaaatcatgatccttgtgttca

SEQ ID NO: 4625063 - DNA, 15 bp, Homo sapiens
aaaatgaaaattgta

SEQ ID NO: 4625064 - DNA, 22 bp, Homo sapiens
aaaatgagagtgacggctggca

SEQ ID NO: 4625065 - DNA, 22 bp, Homo sapiens
aaaatgatttgtagtggaaaca

SEQ ID NO: 4625066 - DNA, 14 bp, Homo sapiens
aaaatgcaaatcct

SEQ ID NO: 4625067 - DNA, 20 bp, Homo sapiens
aaaatgcaaatcctatgtga

SEQ ID NO: 4625068 - DNA, 23 bp, Homo sapiens
aaaatggacatggtggctttgtt

SEQ ID NO: 4625069 - DNA, 15 bp, Homo sapiens
aaaatgtcttgtgta

SEQ ID NO: 4625070 - DNA, 14 bp, Homo sapiens
aaaatgtgtacagt

SEQ ID NO: 4625071 - DNA, 16 bp, Homo sapiens
aaaatgtgtacagtga

SEQ ID NO: 4625072 - DNA, 16 bp, Homo sapiens
aaaatgttctcaaata

SEQ ID NO: 4625073 - DNA, 22 bp, Homo sapiens
aaaatgttgagaagcgttttta

SEQ ID NO: 4625074 - DNA, 22 bp, Homo sapiens
aaaatgtttcattatgcacttt

SEQ ID NO: 4625075 - DNA, 15 bp, Homo sapiens
aaaatgttttttgat

SEQ ID NO: 4625076 - DNA, 16 bp, Homo sapiens
aaaatgttttttgata

SEQ ID NO: 4625077 - DNA, 14 bp, Homo sapiens
aaaattcagctcct

SEQ ID NO: 4625078 - DNA, 23 bp, Homo sapiens
aaaattgaactaatttatacttt

SEQ ID NO: 4625079 - DNA, 15 bp, Homo sapiens
aaaatttttcttttc

SEQ ID NO: 4625080 - DNA, 18 bp, Homo sapiens
aaaattttttttcatgtt

SEQ ID NO: 4625081 - DNA, 19 bp, Homo sapiens
aaaattttttttcatgttt

SEQ ID NO: 4625082 - DNA, 14 bp, Homo sapiens
aaacaaaatgtttt

SEQ ID NO: 4625083 - DNA, 15 bp, Homo sapiens
aaacaaaatttgact

SEQ ID NO: 4625084 - DNA, 15 bp, Homo sapiens
aaacaacagctgaag

SEQ ID NO: 4625085 - DNA, 22 bp, Homo sapiens
aaacaagtatataatttacttt

SEQ ID NO: 4625086 - DNA, 19 bp, Homo sapiens
aaacaagtggatgttttta

SEQ ID NO: 4625087 - DNA, 14 bp, Homo sapiens
aaacacacctcgtg

SEQ ID NO: 4625088 - DNA, 23 bp, Homo sapiens
aaacacagcttacaatcgcaaat

SEQ ID NO: 4625089 - DNA, 16 bp, Homo sapiens
aaacaccacttaatct

SEQ ID NO: 4625090 - DNA, 15 bp, Homo sapiens
aaacacgtggtcatg

SEQ ID NO: 4625091 - DNA, 20 bp, Homo sapiens
aaacactccaccctccacct

SEQ ID NO: 4625092 - DNA, 12 bp, Homo sapiens
aaacagaacagg

SEQ ID NO: 4625093 - DNA, 21 bp, Homo sapiens
aaacagagtggcctccctgct

SEQ ID NO: 4625094 - DNA, 14 bp, Homo sapiens
aaacagcattgctt

SEQ ID NO: 4625095 - DNA, 18 bp, Homo sapiens
aaacagcattgctttctg

SEQ ID NO: 4625096 - DNA, 14 bp, Homo sapiens
aaacagccagcaag

SEQ ID NO: 4625097 - DNA, 11 bp, Homo sapiens
aaacagctcag

SEQ ID NO: 4625098 - DNA, 13 bp, Homo sapiens
aaacagctcagcc

SEQ ID NO: 4625099 - DNA, 11 bp, Homo sapiens
aaacagttcca

SEQ ID NO: 4625100 - DNA, 23 bp, Homo sapiens
aaacagttgctgtgaactttcat

SEQ ID NO: 4625101 - DNA, 21 bp, Homo sapiens
aaacagtttcatctaaatgaa

SEQ ID NO: 4625102 - DNA, 15 bp, Homo sapiens
aaacataatgaaaat

SEQ ID NO: 4625103 - DNA, 14 bp, Homo sapiens
aaacatatttcatt

SEQ ID NO: 4625104 - DNA, 16 bp, Homo sapiens
aaacatcataaatctt

SEQ ID NO: 4625105 - DNA, 11 bp, Homo sapiens
aaacatctgga

SEQ ID NO: 4625106 - DNA, 16 bp, Homo sapiens
aaacatgctagtgata

SEQ ID NO: 4625107 - DNA, 17 bp, Homo sapiens
aaacattcgtgagctgg

SEQ ID NO: 4625108 - DNA, 17 bp, Homo sapiens
aaacattgtaaatattt

SEQ ID NO: 4625109 - DNA, 23 bp, Homo sapiens
aaacattgtaaatatttactctt

SEQ ID NO: 4625110 - DNA, 16 bp, Homo sapiens
aaacattttatcatta

SEQ ID NO: 4625111 - DNA, 20 bp, Homo sapiens
aaaccaaacttgttcattta

SEQ ID NO: 4625112 - DNA, 21 bp, Homo sapiens
aaaccacaaggctgttgcatg

SEQ ID NO: 4625113 - DNA, 12 bp, Homo sapiens
aaaccacagcag

SEQ ID NO: 4625114 - DNA, 13 bp, Homo sapiens
aaaccacagcagg

SEQ ID NO: 4625115 - DNA, 11 bp, Homo sapiens
aaaccagaacc

SEQ ID NO: 4625116 - DNA, 14 bp, Homo sapiens
aaaccattgtaact

SEQ ID NO: 4625117 - DNA, 15 bp, Homo sapiens
aaaccattgtaacta

SEQ ID NO: 4625118 - DNA, 16 bp, Homo sapiens
aaacctacatattcca

SEQ ID NO: 4625119 - DNA, 11 bp, Homo sapiens
aaacctctgtt

SEQ ID NO: 4625120 - DNA, 14 bp, Homo sapiens
aaacctctgttcag

SEQ ID NO: 4625121 - DNA, 16 bp, Homo sapiens
aaacctctgttcagtg

SEQ ID NO: 4625122 - DNA, 17 bp, Homo sapiens
aaacctctgttcagtgt

SEQ ID NO: 4625123 - DNA, 17 bp, Homo sapiens
aaacctgttaaaacaac

SEQ ID NO: 4625124 - DNA, 20 bp, Homo sapiens
aaaccttcacacacagactg

SEQ ID NO: 4625125 - DNA, 15 bp, Homo sapiens
aaaccttgttctatt

SEQ ID NO: 4625126 - DNA, 22 bp, Homo sapiens
aaaccttgttctatttttcaat

SEQ ID NO: 4625127 - DNA, 15 bp, Homo sapiens
aaacctttgtttcaa

SEQ ID NO: 4625128 - DNA, 13 bp, Homo sapiens
aaacgagactttc

SEQ ID NO: 4625129 - DNA, 17 bp, Homo sapiens
aaacgtatgcatgtgaa

SEQ ID NO: 4625130 - DNA, 18 bp, Homo sapiens
aaactaatcaccatattg

SEQ ID NO: 4625131 - DNA, 15 bp, Homo sapiens
aaactatctggccat

SEQ ID NO: 4625132 - DNA, 11 bp, Homo sapiens
aaactatttat

SEQ ID NO: 4625133 - DNA, 13 bp, Homo sapiens
aaactcactgtga

SEQ ID NO: 4625134 - DNA, 17 bp, Homo sapiens
aaactcccaatacaaag

SEQ ID NO: 4625135 - DNA, 15 bp, Homo sapiens
aaactcctgacctca

SEQ ID NO: 4625136 - DNA, 12 bp, Homo sapiens
aaactctgctgt

SEQ ID NO: 4625137 - DNA, 13 bp, Homo sapiens
aaactctttattt

SEQ ID NO: 4625138 - DNA, 13 bp, Homo sapiens
aaactgaaccaca

SEQ ID NO: 4625139 - DNA, 13 bp, Homo sapiens
aaactgactatca

SEQ ID NO: 4625140 - DNA, 15 bp, Homo sapiens
aaactggaattcttt

SEQ ID NO: 4625141 - DNA, 13 bp, Homo sapiens
aaactgtatgctc

SEQ ID NO: 4625142 - DNA, 12 bp, Homo sapiens
aaactgttcttt

SEQ ID NO: 4625143 - DNA, 16 bp, Homo sapiens
aaacttaaatattgta

SEQ ID NO: 4625144 - DNA, 16 bp, Homo sapiens
aaacttacactgtttc

SEQ ID NO: 4625145 - DNA, 23 bp, Homo sapiens
aaacttacactgtttcatctcag

SEQ ID NO: 4625146 - DNA, 17 bp, Homo sapiens
aaacttctgaagactga

SEQ ID NO: 4625147 - DNA, 16 bp, Homo sapiens
aaacttgctgagctgt

SEQ ID NO: 4625148 - DNA, 16 bp, Homo sapiens
aaacttggaatcaagg

SEQ ID NO: 4625149 - DNA, 12 bp, Homo sapiens
aaacttgttcat

SEQ ID NO: 4625150 - DNA, 13 bp, Homo sapiens
aaacttgttcatt

SEQ ID NO: 4625151 - DNA, 12 bp, Homo sapiens
aaagaaaatatt

SEQ ID NO: 4625152 - DNA, 18 bp, Homo sapiens
aaagaaacaagctgtgca

SEQ ID NO: 4625153 - DNA, 12 bp, Homo sapiens
aaagaaacacca

SEQ ID NO: 4625154 - DNA, 22 bp, Homo sapiens
aaagaaacaccacttaatcttc

SEQ ID NO: 4625155 - DNA, 17 bp, Homo sapiens
aaagaaactgaggccca

SEQ ID NO: 4625156 - DNA, 18 bp, Homo sapiens
aaagaaattcgcatgttt

SEQ ID NO: 4625157 - DNA, 16 bp, Homo sapiens
aaagaacatacatgat

SEQ ID NO: 4625158 - DNA, 12 bp, Homo sapiens
aaagaagcttta

SEQ ID NO: 4625159 - DNA, 19 bp, Homo sapiens
aaagaaggtcaaactgtgg

SEQ ID NO: 4625160 - DNA, 20 bp, Homo sapiens
aaagaatatgactttttata

SEQ ID NO: 4625161 - DNA, 13 bp, Homo sapiens
aaagaatattttg

SEQ ID NO: 4625162 - DNA, 20 bp, Homo sapiens
aaagaatattttgatgcaga

SEQ ID NO: 4625163 - DNA, 18 bp, Homo sapiens
aaagacaaaagtctgtct

SEQ ID NO: 4625164 - DNA, 12 bp, Homo sapiens
aaagacagaaaa

SEQ ID NO: 4625165 - DNA, 15 bp, Homo sapiens
aaagacaggctctgt

SEQ ID NO: 4625166 - DNA, 19 bp, Homo sapiens
aaagacatccataaagaag

SEQ ID NO: 4625167 - DNA, 17 bp, Homo sapiens
aaagacattttttaaaa

SEQ ID NO: 4625168 - DNA, 16 bp, Homo sapiens
aaagacccgggagctg

SEQ ID NO: 4625169 - DNA, 21 bp, Homo sapiens
aaagaccctgatgcaggtcag

SEQ ID NO: 4625170 - DNA, 16 bp, Homo sapiens
aaagactggttttctg

SEQ ID NO: 4625171 - DNA, 18 bp, Homo sapiens
aaagactgtgaacagctt

SEQ ID NO: 4625172 - DNA, 19 bp, Homo sapiens
aaagacttgtaatattttt

SEQ ID NO: 4625173 - DNA, 20 bp, Homo sapiens
aaagagagatgggccaggca

SEQ ID NO: 4625174 - DNA, 14 bp, Homo sapiens
aaagagatacagag

SEQ ID NO: 4625175 - DNA, 19 bp, Homo sapiens
aaagaggagaaaatttata

SEQ ID NO: 4625176 - DNA, 22 bp, Homo sapiens
aaagaggcccaagtgcaaaaga

SEQ ID NO: 4625177 - DNA, 19 bp, Homo sapiens
aaagagtgtggcaaaataa

SEQ ID NO: 4625178 - DNA, 22 bp, Homo sapiens
aaagatcatttataatactgtt

SEQ ID NO: 4625179 - DNA, 23 bp, Homo sapiens
aaagcagagatcgacagacagcc

SEQ ID NO: 4625180 - DNA, 13 bp, Homo sapiens
aaagcagggcagc

SEQ ID NO: 4625181 - DNA, 21 bp, Homo sapiens
aaagcatattgtaccccctca

SEQ ID NO: 4625182 - DNA, 15 bp, Homo sapiens
aaagccaaacaaaac

SEQ ID NO: 4625183 - DNA, 19 bp, Homo sapiens
aaagccaaacaaaactgaa

SEQ ID NO: 4625184 - DNA, 14 bp, Homo sapiens
aaagccagggtctc

SEQ ID NO: 4625185 - DNA, 17 bp, Homo sapiens
aaagccagtgctgtctg

SEQ ID NO: 4625186 - DNA, 14 bp, Homo sapiens
aaagccctgtgctc

SEQ ID NO: 4625187 - DNA, 17 bp, Homo sapiens
aaagcctgttcatggca

SEQ ID NO: 4625188 - DNA, 23 bp, Homo sapiens
aaagcctttaaattgttcctctt

SEQ ID NO: 4625189 - DNA, 23 bp, Homo sapiens
aaagccttttgctttatgcttga

SEQ ID NO: 4625190 - DNA, 22 bp, Homo sapiens
aaagctatggtgagatgcagct

SEQ ID NO: 4625191 - DNA, 18 bp, Homo sapiens
aaagctgcaaaaattata

SEQ ID NO: 4625192 - DNA, 14 bp, Homo sapiens
aaaggaagccaaag

SEQ ID NO: 4625193 - DNA, 23 bp, Homo sapiens
aaaggagcctgtgaacccaggac

SEQ ID NO: 4625194 - DNA, 13 bp, Homo sapiens
aaaggaggaccag

SEQ ID NO: 4625195 - DNA, 14 bp, Homo sapiens
aaaggccaaacctc

SEQ ID NO: 4625196 - DNA, 15 bp, Homo sapiens
aaaggccaaacctct

SEQ ID NO: 4625197 - DNA, 17 bp, Homo sapiens
aaaggccaaacctctgt

SEQ ID NO: 4625198 - DNA, 17 bp, Homo sapiens
aaaggccagacctgcag

SEQ ID NO: 4625199 - DNA, 13 bp, Homo sapiens
aaaggcctcttgt

SEQ ID NO: 4625200 - DNA, 13 bp, Homo sapiens
aaaggcctggggt

SEQ ID NO: 4625201 - DNA, 22 bp, Homo sapiens
aaaggctattttcagatgaaat

SEQ ID NO: 4625202 - DNA, 16 bp, Homo sapiens
aaagggaactgaacat

SEQ ID NO: 4625203 - DNA, 21 bp, Homo sapiens
aaagggaactgaacattccag

SEQ ID NO: 4625204 - DNA, 11 bp, Homo sapiens
aaagggaagta

SEQ ID NO: 4625205 - DNA, 24 bp, Homo sapiens
aaagggaagtaacagacacacgat

SEQ ID NO: 4625206 - DNA, 15 bp, Homo sapiens
aaagggaatcatttt

SEQ ID NO: 4625207 - DNA, 14 bp, Homo sapiens
aaagggacactttt

SEQ ID NO: 4625208 - DNA, 17 bp, Homo sapiens
aaagggacccacctgct

SEQ ID NO: 4625209 - DNA, 17 bp, Homo sapiens
aaagggagatgtcagga

SEQ ID NO: 4625210 - DNA, 17 bp, Homo sapiens
aaagggagggctctgag

SEQ ID NO: 4625211 - DNA, 17 bp, Homo sapiens
aaagggcacttaatttg

SEQ ID NO: 4625212 - DNA, 12 bp, Homo sapiens
aaagggcagggc

SEQ ID NO: 4625213 - DNA, 13 bp, Homo sapiens
aaagggcagggcc

SEQ ID NO: 4625214 - DNA, 15 bp, Homo sapiens
aaagggcagggccca

SEQ ID NO: 4625215 - DNA, 19 bp, Homo sapiens
aaagggtgaagctatttat

SEQ ID NO: 4625216 - DNA, 22 bp, Homo sapiens
aaaggtacgattatacttgaga

SEQ ID NO: 4625217 - DNA, 17 bp, Homo sapiens
aaaggtgtagaaaaggt

SEQ ID NO: 4625218 - DNA, 17 bp, Homo sapiens
aaagtaatgatctcaaa

SEQ ID NO: 4625219 - DNA, 12 bp, Homo sapiens
aaagtaatgtaa

SEQ ID NO: 4625220 - DNA, 15 bp, Homo sapiens
aaagtaattttgtca

SEQ ID NO: 4625221 - DNA, 14 bp, Homo sapiens
aaagtactctttaa

SEQ ID NO: 4625222 - DNA, 16 bp, Homo sapiens
aaagtactctttaaca

SEQ ID NO: 4625223 - DNA, 18 bp, Homo sapiens
aaagtagggatgcggatc

SEQ ID NO: 4625224 - DNA, 11 bp, Homo sapiens
aaagtataatc

SEQ ID NO: 4625225 - DNA, 14 bp, Homo sapiens
aaagtattatcatt

SEQ ID NO: 4625226 - DNA, 21 bp, Homo sapiens
aaagtatttataaaaatataa

SEQ ID NO: 4625227 - DNA, 23 bp, Homo sapiens
aaagtatttataaaaatataaat

SEQ ID NO: 4625228 - DNA, 23 bp, Homo sapiens
aaagtcaaaaaattatttgctat

SEQ ID NO: 4625229 - DNA, 18 bp, Homo sapiens
aaagtctgtctttcctga

SEQ ID NO: 4625230 - DNA, 22 bp, Homo sapiens
aaagtgacatttgctttcggta

SEQ ID NO: 4625231 - DNA, 23 bp, Homo sapiens
aaagtgctttgacttcttgcttc

SEQ ID NO: 4625232 - DNA, 16 bp, Homo sapiens
aaagtggtatagaaat

SEQ ID NO: 4625233 - DNA, 20 bp, Homo sapiens
aaagtggtatagaaatgctg

SEQ ID NO: 4625234 - DNA, 18 bp, Homo sapiens
aaagtgtctcattctcag

SEQ ID NO: 4625235 - DNA, 16 bp, Homo sapiens
aaagttaactgacttc

SEQ ID NO: 4625236 - DNA, 20 bp, Homo sapiens
aaagttaactgacttcacta

SEQ ID NO: 4625237 - DNA, 18 bp, Homo sapiens
aaagttagcctttgaatg

SEQ ID NO: 4625238 - DNA, 19 bp, Homo sapiens
aaagttctgtgtaaacaga

SEQ ID NO: 4625239 - DNA, 22 bp, Homo sapiens
aaagttgtaaaatagaaaaagt

SEQ ID NO: 4625240 - DNA, 13 bp, Homo sapiens
aaagttgttgcat

SEQ ID NO: 4625241 - DNA, 18 bp, Homo sapiens
aaagtttaaataccagta

SEQ ID NO: 4625242 - DNA, 17 bp, Homo sapiens
aaataaaaatatgtaat

SEQ ID NO: 4625243 - DNA, 12 bp, Homo sapiens
aaataaaacaca

SEQ ID NO: 4625244 - DNA, 17 bp, Homo sapiens
aaataaaaggaagccaa

SEQ ID NO: 4625245 - DNA, 19 bp, Homo sapiens
aaataaaatgaaaattgta

SEQ ID NO: 4625246 - DNA, 14 bp, Homo sapiens
aaataaaatgtttc

SEQ ID NO: 4625247 - DNA, 16 bp, Homo sapiens
aaataaaggataactc

SEQ ID NO: 4625248 - DNA, 13 bp, Homo sapiens
aaataaatgtttc

SEQ ID NO: 4625249 - DNA, 16 bp, Homo sapiens
aaataagtaatatctt

SEQ ID NO: 4625250 - DNA, 14 bp, Homo sapiens
aaataagtttttgc

SEQ ID NO: 4625251 - DNA, 13 bp, Homo sapiens
aaataattttagt

SEQ ID NO: 4625252 - DNA, 14 bp, Homo sapiens
aaatacgagaaaat

SEQ ID NO: 4625253 - DNA, 16 bp, Homo sapiens
aaatacgtattacaaa

SEQ ID NO: 4625254 - DNA, 13 bp, Homo sapiens
aaatagaataatt

SEQ ID NO: 4625255 - DNA, 14 bp, Homo sapiens
aaatagaataattc

SEQ ID NO: 4625256 - DNA, 18 bp, Homo sapiens
aaatagaataattctttt

SEQ ID NO: 4625257 - DNA, 20 bp, Homo sapiens
aaatagttattttaatacct

SEQ ID NO: 4625258 - DNA, 18 bp, Homo sapiens
aaatagttgtctgtgctt

SEQ ID NO: 4625259 - DNA, 19 bp, Homo sapiens
aaatataaattgtacattt

SEQ ID NO: 4625260 - DNA, 12 bp, Homo sapiens
aaatatatatta

SEQ ID NO: 4625261 - DNA, 13 bp, Homo sapiens
aaatatcataaag

SEQ ID NO: 4625262 - DNA, 14 bp, Homo sapiens
aaatatcttggcct

SEQ ID NO: 4625263 - DNA, 17 bp, Homo sapiens
aaatatgtcgtagaatt

SEQ ID NO: 4625264 - DNA, 15 bp, Homo sapiens
aaatattcagaaatt

SEQ ID NO: 4625265 - DNA, 16 bp, Homo sapiens
aaatattgtaatatga

SEQ ID NO: 4625266 - DNA, 15 bp, Homo sapiens
aaatattgtttctgc

SEQ ID NO: 4625267 - DNA, 22 bp, Homo sapiens
aaatattgtttctgcattcatt

SEQ ID NO: 4625268 - DNA, 16 bp, Homo sapiens
aaatatttactctttg

SEQ ID NO: 4625269 - DNA, 21 bp, Homo sapiens
aaatatttactctttgcaaac

SEQ ID NO: 4625270 - DNA, 13 bp, Homo sapiens
aaatattttctat

SEQ ID NO: 4625271 - DNA, 17 bp, Homo sapiens
aaatattttctatttta

SEQ ID NO: 4625272 - DNA, 12 bp, Homo sapiens
aaatattttctc

SEQ ID NO: 4625273 - DNA, 21 bp, Homo sapiens
aaatattttctctgtactttt

SEQ ID NO: 4625274 - DNA, 14 bp, Homo sapiens
aaatattttggatg

SEQ ID NO: 4625275 - DNA, 21 bp, Homo sapiens
aaatattttgttaacttttgt

SEQ ID NO: 4625276 - DNA, 21 bp, Homo sapiens
aaatcaaaactcacaagtgct

SEQ ID NO: 4625277 - DNA, 17 bp, Homo sapiens
aaatcacagaaaattta

SEQ ID NO: 4625278 - DNA, 23 bp, Homo sapiens
aaatcatgttgatcatgtacttt

SEQ ID NO: 4625279 - DNA, 17 bp, Homo sapiens
aaatccacccatatgtt

SEQ ID NO: 4625280 - DNA, 12 bp, Homo sapiens
aaatcccacatc

SEQ ID NO: 4625281 - DNA, 20 bp, Homo sapiens
aaatccccttcgctgaaatt

SEQ ID NO: 4625282 - DNA, 16 bp, Homo sapiens
aaatccgccagtgttt

SEQ ID NO: 4625283 - DNA, 20 bp, Homo sapiens
aaatccgccagtgtttctga

SEQ ID NO: 4625284 - DNA, 21 bp, Homo sapiens
aaatccgccagtgtttctgaa

SEQ ID NO: 4625285 - DNA, 13 bp, Homo sapiens
aaatctaccactg

SEQ ID NO: 4625286 - DNA, 16 bp, Homo sapiens
aaatctagacattctt

SEQ ID NO: 4625287 - DNA, 19 bp, Homo sapiens
aaatctccccagtagagaa

SEQ ID NO: 4625288 - DNA, 20 bp, Homo sapiens
aaatctggagctggcactgt

SEQ ID NO: 4625289 - DNA, 17 bp, Homo sapiens
aaatctgtaacaggtat

SEQ ID NO: 4625290 - DNA, 19 bp, Homo sapiens
aaatctgtaacaggtattt

SEQ ID NO: 4625291 - DNA, 16 bp, Homo sapiens
aaatcttggcaatatt

SEQ ID NO: 4625292 - DNA, 14 bp, Homo sapiens
aaatgaaaattgta

SEQ ID NO: 4625293 - DNA, 16 bp, Homo sapiens
aaatgaaacaatgaaa

SEQ ID NO: 4625294 - DNA, 17 bp, Homo sapiens
aaatgacttatttctgc

SEQ ID NO: 4625295 - DNA, 19 bp, Homo sapiens
aaatgagaatgacagcctt

SEQ ID NO: 4625296 - DNA, 12 bp, Homo sapiens
aaatgatagata

SEQ ID NO: 4625297 - DNA, 23 bp, Homo sapiens
aaatgatccccagctgtttatgc

SEQ ID NO: 4625298 - DNA, 16 bp, Homo sapiens
aaatgatttgtggaaa

SEQ ID NO: 4625299 - DNA, 21 bp, Homo sapiens
aaatgcaaatcctatgtgatt

SEQ ID NO: 4625300 - DNA, 12 bp, Homo sapiens
aaatgcattgta

SEQ ID NO: 4625301 - DNA, 20 bp, Homo sapiens
aaatgcattgtatcgatgtt

SEQ ID NO: 4625302 - DNA, 13 bp, Homo sapiens
aaatgctctctca

SEQ ID NO: 4625303 - DNA, 20 bp, Homo sapiens
aaatggaacgctaatgaaac

SEQ ID NO: 4625304 - DNA, 22 bp, Homo sapiens
aaatggacaaggcctaattttt

SEQ ID NO: 4625305 - DNA, 21 bp, Homo sapiens
aaatggctgtaatcatttgtt

SEQ ID NO: 4625306 - DNA, 22 bp, Homo sapiens
aaatgtaattaactgtaaactt

SEQ ID NO: 4625307 - DNA, 18 bp, Homo sapiens
aaatgtacatttattcat

SEQ ID NO: 4625308 - DNA, 15 bp, Homo sapiens
aaatgtacttttgga

SEQ ID NO: 4625309 - DNA, 15 bp, Homo sapiens
aaatgtcttaatttt

SEQ ID NO: 4625310 - DNA, 17 bp, Homo sapiens
aaatgtcttgtgtattt

SEQ ID NO: 4625311 - DNA, 23 bp, Homo sapiens
aaatgtcttgtgtatttctctgt

SEQ ID NO: 4625312 - DNA, 16 bp, Homo sapiens
aaatgtgtacagtgaa

SEQ ID NO: 4625313 - DNA, 13 bp, Homo sapiens
aaatgttctcaaa

SEQ ID NO: 4625314 - DNA, 12 bp, Homo sapiens
aaatgtttcatt

SEQ ID NO: 4625315 - DNA, 15 bp, Homo sapiens
aaatgtttcccccac

SEQ ID NO: 4625316 - DNA, 16 bp, Homo sapiens
aaatgtttcccccact

SEQ ID NO: 4625317 - DNA, 19 bp, Homo sapiens
aaatgtttggatggtttgt

SEQ ID NO: 4625318 - DNA, 15 bp, Homo sapiens
aaattaaaacaaata

SEQ ID NO: 4625319 - DNA, 22 bp, Homo sapiens
aaattaaaacaaatatacattt

SEQ ID NO: 4625320 - DNA, 18 bp, Homo sapiens
aaattaaaacatatttca

SEQ ID NO: 4625321 - DNA, 12 bp, Homo sapiens
aaattaaatcta

SEQ ID NO: 4625322 - DNA, 11 bp, Homo sapiens
aaattaacaca

SEQ ID NO: 4625323 - DNA, 12 bp, Homo sapiens
aaattaactttt

SEQ ID NO: 4625324 - DNA, 23 bp, Homo sapiens
aaattaacttttttgtggcaatt

SEQ ID NO: 4625325 - DNA, 12 bp, Homo sapiens
aaattaagcatt

SEQ ID NO: 4625326 - DNA, 16 bp, Homo sapiens
aaattacctttaattt

SEQ ID NO: 4625327 - DNA, 21 bp, Homo sapiens
aaattacctttaattttaatg

SEQ ID NO: 4625328 - DNA, 13 bp, Homo sapiens
aaattatttgaaa

SEQ ID NO: 4625329 - DNA, 24 bp, Homo sapiens
aaattcatttttaagatagaacac

SEQ ID NO: 4625330 - DNA, 13 bp, Homo sapiens
aaattgtacattt

SEQ ID NO: 4625331 - DNA, 15 bp, Homo sapiens
aaattgttcctcttt

SEQ ID NO: 4625332 - DNA, 21 bp, Homo sapiens
aaattgttcctctttgtttat

SEQ ID NO: 4625333 - DNA, 21 bp, Homo sapiens
aaatttaagaaaacaagtata

SEQ ID NO: 4625334 - DNA, 16 bp, Homo sapiens
aaatttactttacaca

SEQ ID NO: 4625335 - DNA, 15 bp, Homo sapiens
aaatttcattgcact

SEQ ID NO: 4625336 - DNA, 16 bp, Homo sapiens
aaatttgaataagcag

SEQ ID NO: 4625337 - DNA, 20 bp, Homo sapiens
aaatttgaataagcagaaca

SEQ ID NO: 4625338 - DNA, 20 bp, Homo sapiens
aaatttgaatgggtccattt

SEQ ID NO: 4625339 - DNA, 22 bp, Homo sapiens
aaatttgatttacatatattat

SEQ ID NO: 4625340 - DNA, 21 bp, Homo sapiens
aaattttgctatcaacaataa

SEQ ID NO: 4625341 - DNA, 22 bp, Homo sapiens
aaattttttttcatgttttaac

SEQ ID NO: 4625342 - DNA, 23 bp, Homo sapiens
aaattttttttcatgttttaaca

SEQ ID NO: 4625343 - DNA, 17 bp, Homo sapiens
aaattttttttgtttca

SEQ ID NO: 4625344 - DNA, 17 bp, Homo sapiens
aaattttttttttaata

SEQ ID NO: 4625345 - DNA, 14 bp, Homo sapiens
aacaaaactgttct

SEQ ID NO: 4625346 - DNA, 18 bp, Homo sapiens
aacaaaactgttcttttg

SEQ ID NO: 4625347 - DNA, 24 bp, Homo sapiens
aacaaaatttgactaattttacat

SEQ ID NO: 4625348 - DNA, 13 bp, Homo sapiens
aacaaagaaggtt

SEQ ID NO: 4625349 - DNA, 21 bp, Homo sapiens
aacaaagccaaacaaaactga

SEQ ID NO: 4625350 - DNA, 22 bp, Homo sapiens
aacaaatatacattttctaaat

SEQ ID NO: 4625351 - DNA, 15 bp, Homo sapiens
aacaaatttcattgc

SEQ ID NO: 4625352 - DNA, 19 bp, Homo sapiens
aacaacaattggtaaaact

SEQ ID NO: 4625353 - DNA, 15 bp, Homo sapiens
aacaacgtgagagaa

SEQ ID NO: 4625354 - DNA, 12 bp, Homo sapiens
aacaagaaatgg

SEQ ID NO: 4625355 - DNA, 19 bp, Homo sapiens
aacaagaccccgtctcaaa

SEQ ID NO: 4625356 - DNA, 19 bp, Homo sapiens
aacaagtcgatgaactatt

SEQ ID NO: 4625357 - DNA, 23 bp, Homo sapiens
aacaagtgaaataacaaaatgga

SEQ ID NO: 4625358 - DNA, 22 bp, Homo sapiens
aacaagtggatgtttttaatga

SEQ ID NO: 4625359 - DNA, 14 bp, Homo sapiens
aacaataaaatttt

SEQ ID NO: 4625360 - DNA, 22 bp, Homo sapiens
aacaatccatgtgattaatgtt

SEQ ID NO: 4625361 - DNA, 23 bp, Homo sapiens
aacaatccatgtgattaatgttt

SEQ ID NO: 4625362 - DNA, 24 bp, Homo sapiens
aacaattggtaaaactcactgtga

SEQ ID NO: 4625363 - DNA, 18 bp, Homo sapiens
aacacaaaacttgaaaga

SEQ ID NO: 4625364 - DNA, 18 bp, Homo sapiens
aacacactgttgtttagt

SEQ ID NO: 4625365 - DNA, 19 bp, Homo sapiens
aacacagataattttttct

SEQ ID NO: 4625366 - DNA, 18 bp, Homo sapiens
aacaccaagcacagcagc

SEQ ID NO: 4625367 - DNA, 21 bp, Homo sapiens
aacaccaagcacagcagcctg

SEQ ID NO: 4625368 - DNA, 20 bp, Homo sapiens
aacactcagaagcctggggg

SEQ ID NO: 4625369 - DNA, 22 bp, Homo sapiens
aacacttgcccatgctatttgt

SEQ ID NO: 4625370 - DNA, 17 bp, Homo sapiens
aacagaacagggtcatg

SEQ ID NO: 4625371 - DNA, 15 bp, Homo sapiens
aacagaacttttcct

SEQ ID NO: 4625372 - DNA, 18 bp, Homo sapiens
aacagagtggcctccctg

SEQ ID NO: 4625373 - DNA, 21 bp, Homo sapiens
aacagagtggcctccctgctg

SEQ ID NO: 4625374 - DNA, 22 bp, Homo sapiens
aacagatgcaatgtgctactga

SEQ ID NO: 4625375 - DNA, 16 bp, Homo sapiens
aacagatgtttgtttt

SEQ ID NO: 4625376 - DNA, 13 bp, Homo sapiens
aacagcacacagg

SEQ ID NO: 4625377 - DNA, 17 bp, Homo sapiens
aacagcacacaggcagc

SEQ ID NO: 4625378 - DNA, 18 bp, Homo sapiens
aacagcacacaggcagcc

SEQ ID NO: 4625379 - DNA, 19 bp, Homo sapiens
aacagcacacaggcagcca

SEQ ID NO: 4625380 - DNA, 15 bp, Homo sapiens
aacagcattgctttc

SEQ ID NO: 4625381 - DNA, 17 bp, Homo sapiens
aacagcattgctttctg

SEQ ID NO: 4625382 - DNA, 18 bp, Homo sapiens
aacagccaagattttcct

SEQ ID NO: 4625383 - DNA, 12 bp, Homo sapiens
aacagcctgtgt

SEQ ID NO: 4625384 - DNA, 20 bp, Homo sapiens
aacagcgaagtagcttgctc

SEQ ID NO: 4625385 - DNA, 20 bp, Homo sapiens
aacagctggaggaatacatt

SEQ ID NO: 4625386 - DNA, 15 bp, Homo sapiens
aacagcttgctgtca

SEQ ID NO: 4625387 - DNA, 19 bp, Homo sapiens
aacaggaggtgtgaatgca

SEQ ID NO: 4625388 - DNA, 15 bp, Homo sapiens
aacagggaaggcagg

SEQ ID NO: 4625389 - DNA, 22 bp, Homo sapiens
aacagggaaggcaggcagggct

SEQ ID NO: 4625390 - DNA, 23 bp, Homo sapiens
aacagggaaggcaggcagggctc

SEQ ID NO: 4625391 - DNA, 16 bp, Homo sapiens
aacagggccacataga

SEQ ID NO: 4625392 - DNA, 16 bp, Homo sapiens
aacagtttcttgcttg

SEQ ID NO: 4625393 - DNA, 21 bp, Homo sapiens
aacataaccattacagggagc

SEQ ID NO: 4625394 - DNA, 16 bp, Homo sapiens
aacataagctaaatca

SEQ ID NO: 4625395 - DNA, 19 bp, Homo sapiens
aacataagctaaatcatat

SEQ ID NO: 4625396 - DNA, 12 bp, Homo sapiens
aacataatgaaa

SEQ ID NO: 4625397 - DNA, 14 bp, Homo sapiens
aacatatttcattt

SEQ ID NO: 4625398 - DNA, 22 bp, Homo sapiens
aacatatttcattttaacatga

SEQ ID NO: 4625399 - DNA, 20 bp, Homo sapiens
aacatcaccagtgccacgtc

SEQ ID NO: 4625400 - DNA, 21 bp, Homo sapiens
aacatcaccagtgccacgtca

SEQ ID NO: 4625401 - DNA, 15 bp, Homo sapiens
aacatcttacttgtc

SEQ ID NO: 4625402 - DNA, 20 bp, Homo sapiens
aacatcttacttgtcctttg

SEQ ID NO: 4625403 - DNA, 15 bp, Homo sapiens
aacatcttcatataa

SEQ ID NO: 4625404 - DNA, 17 bp, Homo sapiens
aacatgatactgctgct

SEQ ID NO: 4625405 - DNA, 14 bp, Homo sapiens
aacatgatttcaaa

SEQ ID NO: 4625406 - DNA, 16 bp, Homo sapiens
aacatgcactgatgtt

SEQ ID NO: 4625407 - DNA, 23 bp, Homo sapiens
aacatgcagctcttcaacatgac

SEQ ID NO: 4625408 - DNA, 14 bp, Homo sapiens
aacatgcatacttt

SEQ ID NO: 4625409 - DNA, 17 bp, Homo sapiens
aacatgcatactttatt

SEQ ID NO: 4625410 - DNA, 19 bp, Homo sapiens
aacatgtagggcaagagga

SEQ ID NO: 4625411 - DNA, 15 bp, Homo sapiens
aacatgtcagtttta

SEQ ID NO: 4625412 - DNA, 22 bp, Homo sapiens
aacattggacagaaaatgcaat

SEQ ID NO: 4625413 - DNA, 19 bp, Homo sapiens
aacattttttttttaaatc

SEQ ID NO: 4625414 - DNA, 23 bp, Homo sapiens
aacattttttttttaaatcaagt

SEQ ID NO: 4625415 - DNA, 18 bp, Homo sapiens
aaccaaacttgttcattt

SEQ ID NO: 4625416 - DNA, 19 bp, Homo sapiens
aaccaaacttgttcattta

SEQ ID NO: 4625417 - DNA, 13 bp, Homo sapiens
aaccaacatcttt

SEQ ID NO: 4625418 - DNA, 15 bp, Homo sapiens
aaccagaaggccctt

SEQ ID NO: 4625419 - DNA, 20 bp, Homo sapiens
aaccagcccgacagtgccat

SEQ ID NO: 4625420 - DNA, 19 bp, Homo sapiens
aaccaggggacactttgtt

SEQ ID NO: 4625421 - DNA, 16 bp, Homo sapiens
aaccagtgccaaggac

SEQ ID NO: 4625422 - DNA, 13 bp, Homo sapiens
aaccagttaaagc

SEQ ID NO: 4625423 - DNA, 18 bp, Homo sapiens
aaccattgtaactattaa

SEQ ID NO: 4625424 - DNA, 23 bp, Homo sapiens
aacccagacctgttagcagacag

SEQ ID NO: 4625425 - DNA, 13 bp, Homo sapiens
aacccagttactt

SEQ ID NO: 4625426 - DNA, 14 bp, Homo sapiens
aacccagttacttt

SEQ ID NO: 4625427 - DNA, 21 bp, Homo sapiens
aacccagttacttttttacac

SEQ ID NO: 4625428 - DNA, 19 bp, Homo sapiens
aaccccaaggactgagggc

SEQ ID NO: 4625429 - DNA, 17 bp, Homo sapiens
aacccctccactgctgg

SEQ ID NO: 4625430 - DNA, 23 bp, Homo sapiens
aacccgagtcattcgttctgtgg

SEQ ID NO: 4625431 - DNA, 13 bp, Homo sapiens
aacccgtggaggc

SEQ ID NO: 4625432 - DNA, 15 bp, Homo sapiens
aacccgtggaggctg

SEQ ID NO: 4625433 - DNA, 18 bp, Homo sapiens
aacccgtggaggctgctc

SEQ ID NO: 4625434 - DNA, 20 bp, Homo sapiens
aaccctgtatccaattttaa

SEQ ID NO: 4625435 - DNA, 20 bp, Homo sapiens
aacccttgctttcctgggcc

SEQ ID NO: 4625436 - DNA, 16 bp, Homo sapiens
aaccgcctcaaaatgt

SEQ ID NO: 4625437 - DNA, 13 bp, Homo sapiens
aacctaaatactg

SEQ ID NO: 4625438 - DNA, 16 bp, Homo sapiens
aacctaggagggctct

SEQ ID NO: 4625439 - DNA, 19 bp, Homo sapiens
aacctattaaaatacattt

SEQ ID NO: 4625440 - DNA, 12 bp, Homo sapiens
aacctcaaacca

SEQ ID NO: 4625441 - DNA, 16 bp, Homo sapiens
aacctctgcctcctgg

SEQ ID NO: 4625442 - DNA, 20 bp, Homo sapiens
aacctctgcttcccaggttc

SEQ ID NO: 4625443 - DNA, 18 bp, Homo sapiens
aacctctgttccccaccc

SEQ ID NO: 4625444 - DNA, 22 bp, Homo sapiens
aacctgaaaagatgttgtgtct

SEQ ID NO: 4625445 - DNA, 15 bp, Homo sapiens
aacctgcacaggctt

SEQ ID NO: 4625446 - DNA, 12 bp, Homo sapiens
aacctggccttc

SEQ ID NO: 4625447 - DNA, 10 bp, Homo sapiens
aacctgggac

SEQ ID NO: 4625448 - DNA, 21 bp, Homo sapiens
aacctgggaccaacctgacct

SEQ ID NO: 4625449 - DNA, 23 bp, Homo sapiens
aacctgggcttaagttttacttg

SEQ ID NO: 4625450 - DNA, 18 bp, Homo sapiens
aacctggggtgaatactt

SEQ ID NO: 4625451 - DNA, 23 bp, Homo sapiens
aacctggggtgaatacttatttt

SEQ ID NO: 4625452 - DNA, 22 bp, Homo sapiens
aacctgtattactgaataatat

SEQ ID NO: 4625453 - DNA, 19 bp, Homo sapiens
aacctgttcttagagtgta

SEQ ID NO: 4625454 - DNA, 19 bp, Homo sapiens
aaccttcacacacagactg

SEQ ID NO: 4625455 - DNA, 17 bp, Homo sapiens
aaccttgttatttctca

SEQ ID NO: 4625456 - DNA, 18 bp, Homo sapiens
aaccttgttatttctcag

SEQ ID NO: 4625457 - DNA, 16 bp, Homo sapiens
aaccttgttctatttt

SEQ ID NO: 4625458 - DNA, 17 bp, Homo sapiens
aaccttgttctattttt

SEQ ID NO: 4625459 - DNA, 23 bp, Homo sapiens
aaccttgttctatttttcaatca

SEQ ID NO: 4625460 - DNA, 12 bp, Homo sapiens
aaccttttttgt

SEQ ID NO: 4625461 - DNA, 11 bp, Homo sapiens
aacgcctgagc

SEQ ID NO: 4625462 - DNA, 12 bp, Homo sapiens
aacgcctgagcc

SEQ ID NO: 4625463 - DNA, 19 bp, Homo sapiens
aacgctctctactctgctt

SEQ ID NO: 4625464 - DNA, 13 bp, Homo sapiens
aacggccccagcg

SEQ ID NO: 4625465 - DNA, 13 bp, Homo sapiens
aacggtctggcag

SEQ ID NO: 4625466 - DNA, 14 bp, Homo sapiens
aacggtctggcagg

SEQ ID NO: 4625467 - DNA, 18 bp, Homo sapiens
aacgtgaaacttatagtt

SEQ ID NO: 4625468 - DNA, 14 bp, Homo sapiens
aacgtgatacattt

SEQ ID NO: 4625469 - DNA, 15 bp, Homo sapiens
aacgtggctctgctg

SEQ ID NO: 4625470 - DNA, 23 bp, Homo sapiens
aactaatccttctggcagattca

SEQ ID NO: 4625471 - DNA, 15 bp, Homo sapiens
aactacctgagctaa

SEQ ID NO: 4625472 - DNA, 16 bp, Homo sapiens
aactacggttgggaga

SEQ ID NO: 4625473 - DNA, 20 bp, Homo sapiens
aactacttgcatttgatttt

SEQ ID NO: 4625474 - DNA, 23 bp, Homo sapiens
aactatgagcttgctcattaatt

SEQ ID NO: 4625475 - DNA, 16 bp, Homo sapiens
aactatgttcctaaca

SEQ ID NO: 4625476 - DNA, 20 bp, Homo sapiens
aactatgttcctaacaaaat

SEQ ID NO: 4625477 - DNA, 12 bp, Homo sapiens
aactattaacct

SEQ ID NO: 4625478 - DNA, 20 bp, Homo sapiens
aactattaaccttttttgtc

SEQ ID NO: 4625479 - DNA, 21 bp, Homo sapiens
aactattaaccttttttgtct

SEQ ID NO: 4625480 - DNA, 20 bp, Homo sapiens
aactatttatctgtgttttt

SEQ ID NO: 4625481 - DNA, 23 bp, Homo sapiens
aactatttatctgtgtttttgaa

SEQ ID NO: 4625482 - DNA, 18 bp, Homo sapiens
aactcaagtgtcacctcc

SEQ ID NO: 4625483 - DNA, 12 bp, Homo sapiens
aactcactctgg

SEQ ID NO: 4625484 - DNA, 16 bp, Homo sapiens
aactccctccaccagc

SEQ ID NO: 4625485 - DNA, 20 bp, Homo sapiens
aactccctccaccagcctgc

SEQ ID NO: 4625486 - DNA, 21 bp, Homo sapiens
aactccctccaccagcctgct

SEQ ID NO: 4625487 - DNA, 22 bp, Homo sapiens
aactcctcacacaccctgaggt

SEQ ID NO: 4625488 - DNA, 13 bp, Homo sapiens
aactctcccctcc

SEQ ID NO: 4625489 - DNA, 14 bp, Homo sapiens
aactctcccctccc

SEQ ID NO: 4625490 - DNA, 13 bp, Homo sapiens
aactctcctcttt

SEQ ID NO: 4625491 - DNA, 15 bp, Homo sapiens
aactctgcccaccct

SEQ ID NO: 4625492 - DNA, 18 bp, Homo sapiens
aactctgtattacagctt

SEQ ID NO: 4625493 - DNA, 17 bp, Homo sapiens
aactctgtcttcacctg

SEQ ID NO: 4625494 - DNA, 12 bp, Homo sapiens
aactgaaaatga

SEQ ID NO: 4625495 - DNA, 12 bp, Homo sapiens
aactgaatataa

SEQ ID NO: 4625496 - DNA, 18 bp, Homo sapiens
aactgactatcataaaat

SEQ ID NO: 4625497 - DNA, 13 bp, Homo sapiens
aactgagagaaag

SEQ ID NO: 4625498 - DNA, 19 bp, Homo sapiens
aactgaggagatgaccagg

SEQ ID NO: 4625499 - DNA, 13 bp, Homo sapiens
aactgattcataa

SEQ ID NO: 4625500 - DNA, 23 bp, Homo sapiens
aactgattgctcccaggatctcc

SEQ ID NO: 4625501 - DNA, 17 bp, Homo sapiens
aactggaaacaaaacag

SEQ ID NO: 4625502 - DNA, 18 bp, Homo sapiens
aactggaaacaaaacaga

SEQ ID NO: 4625503 - DNA, 16 bp, Homo sapiens
aactggccaagctgag

SEQ ID NO: 4625504 - DNA, 21 bp, Homo sapiens
aactggccaagctgaggtgcc

SEQ ID NO: 4625505 - DNA, 18 bp, Homo sapiens
aactggcctaaatttctt

SEQ ID NO: 4625506 - DNA, 15 bp, Homo sapiens
aactggccttttgat

SEQ ID NO: 4625507 - DNA, 18 bp, Homo sapiens
aactggctttcctgctgg

SEQ ID NO: 4625508 - DNA, 20 bp, Homo sapiens
aactggtaagcgatttgaaa

SEQ ID NO: 4625509 - DNA, 12 bp, Homo sapiens
aactgtaaatca

SEQ ID NO: 4625510 - DNA, 16 bp, Homo sapiens
aactgtaccatgtgct

SEQ ID NO: 4625511 - DNA, 19 bp, Homo sapiens
aactgtcccaaggaggggg

SEQ ID NO: 4625512 - DNA, 11 bp, Homo sapiens
aactgtcctgt

SEQ ID NO: 4625513 - DNA, 13 bp, Homo sapiens
aactgtgtgtgaa

SEQ ID NO: 4625514 - DNA, 17 bp, Homo sapiens
aactgtgtgtgaatctg

SEQ ID NO: 4625515 - DNA, 15 bp, Homo sapiens
aactgtttccctgct

SEQ ID NO: 4625516 - DNA, 17 bp, Homo sapiens
aactgtttccctgctga

SEQ ID NO: 4625517 - DNA, 21 bp, Homo sapiens
aacttaaatattgtaatatga

SEQ ID NO: 4625518 - DNA, 23 bp, Homo sapiens
aacttaatgttcttatgcaaaat

SEQ ID NO: 4625519 - DNA, 14 bp, Homo sapiens
aacttacttagtgt

SEQ ID NO: 4625520 - DNA, 14 bp, Homo sapiens
aacttccgctgagg

SEQ ID NO: 4625521 - DNA, 13 bp, Homo sapiens
aacttctaaagaa

SEQ ID NO: 4625522 - DNA, 14 bp, Homo sapiens
aacttctgaagact

SEQ ID NO: 4625523 - DNA, 14 bp, Homo sapiens
aacttcttgtcaga

SEQ ID NO: 4625524 - DNA, 22 bp, Homo sapiens
aacttgcattctggcataattt

SEQ ID NO: 4625525 - DNA, 16 bp, Homo sapiens
aacttgcctccatctt

SEQ ID NO: 4625526 - DNA, 18 bp, Homo sapiens
aacttgcctccatctttt

SEQ ID NO: 4625527 - DNA, 23 bp, Homo sapiens
aacttgcctccatctttttcttg

SEQ ID NO: 4625528 - DNA, 14 bp, Homo sapiens
aacttggaatcaag

SEQ ID NO: 4625529 - DNA, 20 bp, Homo sapiens
aacttggctttcctgtttct

SEQ ID NO: 4625530 - DNA, 14 bp, Homo sapiens
aacttgttcattta

SEQ ID NO: 4625531 - DNA, 20 bp, Homo sapiens
aactttaattctctttcaaa

SEQ ID NO: 4625532 - DNA, 14 bp, Homo sapiens
aactttattaaaag

SEQ ID NO: 4625533 - DNA, 19 bp, Homo sapiens
aactttattaaaagaatga

SEQ ID NO: 4625534 - DNA, 16 bp, Homo sapiens
aactttatttgtaaac

SEQ ID NO: 4625535 - DNA, 23 bp, Homo sapiens
aactttctaagagggttcttgct

SEQ ID NO: 4625536 - DNA, 13 bp, Homo sapiens
aacttttgggagc

SEQ ID NO: 4625537 - DNA, 23 bp, Homo sapiens
aacttttgtttttttttgtttgt

SEQ ID NO: 4625538 - DNA, 14 bp, Homo sapiens
aagaaaaaaatgta

SEQ ID NO: 4625539 - DNA, 11 bp, Homo sapiens
aagaaaatatc

SEQ ID NO: 4625540 - DNA, 12 bp, Homo sapiens
aagaaaatttac

SEQ ID NO: 4625541 - DNA, 17 bp, Homo sapiens
aagaaacaagctgtgca

SEQ ID NO: 4625542 - DNA, 24 bp, Homo sapiens
aagaaactaaaaatatagcaaatg

SEQ ID NO: 4625543 - DNA, 17 bp, Homo sapiens
aagaaagcctaaaattg

SEQ ID NO: 4625544 - DNA, 18 bp, Homo sapiens
aagaaagggacccacctg

SEQ ID NO: 4625545 - DNA, 20 bp, Homo sapiens
aagaaagggacccacctgct

SEQ ID NO: 4625546 - DNA, 21 bp, Homo sapiens
aagaaataaaaggaagccaaa

SEQ ID NO: 4625547 - DNA, 23 bp, Homo sapiens
aagaaataaaaggaagccaaaga

SEQ ID NO: 4625548 - DNA, 13 bp, Homo sapiens
aagaaatgtctta

SEQ ID NO: 4625549 - DNA, 17 bp, Homo sapiens
aagaaattcgcatgttt

SEQ ID NO: 4625550 - DNA, 21 bp, Homo sapiens
aagaacgttttttcctcagtg

SEQ ID NO: 4625551 - DNA, 15 bp, Homo sapiens
aagaactccagagtc

SEQ ID NO: 4625552 - DNA, 14 bp, Homo sapiens
aagaagacattttc

SEQ ID NO: 4625553 - DNA, 16 bp, Homo sapiens
aagaagcaaggaacca

SEQ ID NO: 4625554 - DNA, 22 bp, Homo sapiens
aagaaggaaagaaccgaagagc

SEQ ID NO: 4625555 - DNA, 15 bp, Homo sapiens
aagaagtggagacag

SEQ ID NO: 4625556 - DNA, 12 bp, Homo sapiens
aagaatacttga

SEQ ID NO: 4625557 - DNA, 14 bp, Homo sapiens
aagaatattttgat

SEQ ID NO: 4625558 - DNA, 15 bp, Homo sapiens
aagaatattttgatg

SEQ ID NO: 4625559 - DNA, 15 bp, Homo sapiens
aagaatgaaaaatat

SEQ ID NO: 4625560 - DNA, 22 bp, Homo sapiens
aagaatgaaaaatataatgttg

SEQ ID NO: 4625561 - DNA, 18 bp, Homo sapiens
aagaatgactatataatt

SEQ ID NO: 4625562 - DNA, 22 bp, Homo sapiens
aagaatgagcctacgctgaaga

SEQ ID NO: 4625563 - DNA, 13 bp, Homo sapiens
aagaattactttg

SEQ ID NO: 4625564 - DNA, 20 bp, Homo sapiens
aagaattatttgccttctga

SEQ ID NO: 4625565 - DNA, 17 bp, Homo sapiens
aagaatttggggcagga

SEQ ID NO: 4625566 - DNA, 17 bp, Homo sapiens
aagaattttatttttct

SEQ ID NO: 4625567 - DNA, 19 bp, Homo sapiens
aagaattttatttttctgt

SEQ ID NO: 4625568 - DNA, 16 bp, Homo sapiens
aagacagaggggagca

SEQ ID NO: 4625569 - DNA, 17 bp, Homo sapiens
aagacagaggggagcag

SEQ ID NO: 4625570 - DNA, 21 bp, Homo sapiens
aagacagggctcatttttgca

SEQ ID NO: 4625571 - DNA, 18 bp, Homo sapiens
aagaccaccttcccttcc

SEQ ID NO: 4625572 - DNA, 14 bp, Homo sapiens
aagacccggccagg

SEQ ID NO: 4625573 - DNA, 16 bp, Homo sapiens
aagacctcatctgtgg

SEQ ID NO: 4625574 - DNA, 20 bp, Homo sapiens
aagacgaggggcagggaagg

SEQ ID NO: 4625575 - DNA, 14 bp, Homo sapiens
aagacgggagggga

SEQ ID NO: 4625576 - DNA, 16 bp, Homo sapiens
aagacgtgattttgct

SEQ ID NO: 4625577 - DNA, 15 bp, Homo sapiens
aagacgtggtctaga

SEQ ID NO: 4625578 - DNA, 20 bp, Homo sapiens
aagacgtggtctagaccagg

SEQ ID NO: 4625579 - DNA, 15 bp, Homo sapiens
aagactgagaacttt

SEQ ID NO: 4625580 - DNA, 13 bp, Homo sapiens
aagactgggcccc

SEQ ID NO: 4625581 - DNA, 18 bp, Homo sapiens
aagactgggccccacatg

SEQ ID NO: 4625582 - DNA, 20 bp, Homo sapiens
aagactggttttctgccaat

SEQ ID NO: 4625583 - DNA, 21 bp, Homo sapiens
aagactgtgaacagcttgctg

SEQ ID NO: 4625584 - DNA, 14 bp, Homo sapiens
aagactttgtgact

SEQ ID NO: 4625585 - DNA, 17 bp, Homo sapiens
aagagagaaagaagata

SEQ ID NO: 4625586 - DNA, 20 bp, Homo sapiens
aagagagaagccagccacag

SEQ ID NO: 4625587 - DNA, 18 bp, Homo sapiens
aagagagggacaggcact

SEQ ID NO: 4625588 - DNA, 13 bp, Homo sapiens
aagagattgctga

SEQ ID NO: 4625589 - DNA, 16 bp, Homo sapiens
aagagcaaacaaaagt

SEQ ID NO: 4625590 - DNA, 12 bp, Homo sapiens
aagagccacctg

SEQ ID NO: 4625591 - DNA, 13 bp, Homo sapiens
aagagccacctgc

SEQ ID NO: 4625592 - DNA, 15 bp, Homo sapiens
aagagccacctgcaa

SEQ ID NO: 4625593 - DNA, 12 bp, Homo sapiens
aagagctgcctg

SEQ ID NO: 4625594 - DNA, 14 bp, Homo sapiens
aagagctgcctgga

SEQ ID NO: 4625595 - DNA, 17 bp, Homo sapiens
aagagctgcctggatga

SEQ ID NO: 4625596 - DNA, 21 bp, Homo sapiens
aagagctgcctggatgagaaa

SEQ ID NO: 4625597 - DNA, 22 bp, Homo sapiens
aagaggagatgtgatcaggccc

SEQ ID NO: 4625598 - DNA, 22 bp, Homo sapiens
aagaggtgaccccagggcacag

SEQ ID NO: 4625599 - DNA, 20 bp, Homo sapiens
aagagtggagagaagctctt

SEQ ID NO: 4625600 - DNA, 12 bp, Homo sapiens
aagagtgtggca

SEQ ID NO: 4625601 - DNA, 20 bp, Homo sapiens
aagatactaatagagtactt

SEQ ID NO: 4625602 - DNA, 12 bp, Homo sapiens
aagatatatgtg

SEQ ID NO: 4625603 - DNA, 19 bp, Homo sapiens
aagatatatgtgtatacat

SEQ ID NO: 4625604 - DNA, 20 bp, Homo sapiens
aagatatatgtgtatacata

SEQ ID NO: 4625605 - DNA, 22 bp, Homo sapiens
aagatatgccactaacttctaa

SEQ ID NO: 4625606 - DNA, 15 bp, Homo sapiens
aagatattgatcaaa

SEQ ID NO: 4625607 - DNA, 19 bp, Homo sapiens
aagatattgatcaaatata

SEQ ID NO: 4625608 - DNA, 22 bp, Homo sapiens
aagatcagaacattcagctctg

SEQ ID NO: 4625609 - DNA, 13 bp, Homo sapiens
aagatcatttata

SEQ ID NO: 4625610 - DNA, 17 bp, Homo sapiens
aagatctgccagacctg

SEQ ID NO: 4625611 - DNA, 15 bp, Homo sapiens
aagatgaacagactg

SEQ ID NO: 4625612 - DNA, 12 bp, Homo sapiens
aagatgagcctg

SEQ ID NO: 4625613 - DNA, 17 bp, Homo sapiens
aagatgtacctggtgga

SEQ ID NO: 4625614 - DNA, 18 bp, Homo sapiens
aagattaatctttaaacc

SEQ ID NO: 4625615 - DNA, 17 bp, Homo sapiens
aagattactttttcttt

SEQ ID NO: 4625616 - DNA, 18 bp, Homo sapiens
aagatttccttaaaatct

SEQ ID NO: 4625617 - DNA, 21 bp, Homo sapiens
aagatttgatgggccacaact

SEQ ID NO: 4625618 - DNA, 19 bp, Homo sapiens
aagattttcctcttgtgat

SEQ ID NO: 4625619 - DNA, 20 bp, Homo sapiens
aagcaagtatatttatttct

SEQ ID NO: 4625620 - DNA, 17 bp, Homo sapiens
aagcaataaagaagagt

SEQ ID NO: 4625621 - DNA, 23 bp, Homo sapiens
aagcacaatcactaaactttatt

SEQ ID NO: 4625622 - DNA, 20 bp, Homo sapiens
aagcaccagtgggactgtgg

SEQ ID NO: 4625623 - DNA, 21 bp, Homo sapiens
aagcaccgaggttgcattcta

SEQ ID NO: 4625624 - DNA, 18 bp, Homo sapiens
aagcactgtgtttatatg

SEQ ID NO: 4625625 - DNA, 18 bp, Homo sapiens
aagcagaacatactgttc

SEQ ID NO: 4625626 - DNA, 12 bp, Homo sapiens
aagcagacagct

SEQ ID NO: 4625627 - DNA, 23 bp, Homo sapiens
aagcagagatcgacagacagcca

SEQ ID NO: 4625628 - DNA, 14 bp, Homo sapiens
aagcagagggacaa

SEQ ID NO: 4625629 - DNA, 15 bp, Homo sapiens
aagcagggcagcagg

SEQ ID NO: 4625630 - DNA, 20 bp, Homo sapiens
aagcataaagcaattgtgaa

SEQ ID NO: 4625631 - DNA, 20 bp, Homo sapiens
aagcataaagttacctacat

SEQ ID NO: 4625632 - DNA, 15 bp, Homo sapiens
aagcatatagagatg

SEQ ID NO: 4625633 - DNA, 22 bp, Homo sapiens
aagcatgaataacatttaaatt

SEQ ID NO: 4625634 - DNA, 16 bp, Homo sapiens
aagcatgcattgaaaa

SEQ ID NO: 4625635 - DNA, 17 bp, Homo sapiens
aagcatggtcccacatc

SEQ ID NO: 4625636 - DNA, 22 bp, Homo sapiens
aagcatggtcccacatccctgg

SEQ ID NO: 4625637 - DNA, 18 bp, Homo sapiens
aagcatggtgtcagtttt

SEQ ID NO: 4625638 - DNA, 23 bp, Homo sapiens
aagcattccacactgcagggagg

SEQ ID NO: 4625639 - DNA, 12 bp, Homo sapiens
aagcatttcatg

SEQ ID NO: 4625640 - DNA, 16 bp, Homo sapiens
aagcatttcatgaaaa

SEQ ID NO: 4625641 - DNA, 21 bp, Homo sapiens
aagcatttcatgaaaaagctg

SEQ ID NO: 4625642 - DNA, 12 bp, Homo sapiens
aagcattttgaa

SEQ ID NO: 4625643 - DNA, 16 bp, Homo sapiens
aagcattttgaaacaa

SEQ ID NO: 4625644 - DNA, 20 bp, Homo sapiens
aagcattttgaaacaaagta

SEQ ID NO: 4625645 - DNA, 14 bp, Homo sapiens
aagccaaaatggga

SEQ ID NO: 4625646 - DNA, 11 bp, Homo sapiens
aagccaaagaa

SEQ ID NO: 4625647 - DNA, 14 bp, Homo sapiens
aagccaaagaaaca

SEQ ID NO: 4625648 - DNA, 18 bp, Homo sapiens
aagccaaagaaacaagct

SEQ ID NO: 4625649 - DNA, 23 bp, Homo sapiens
aagccaaagaaacaagctgtgca

SEQ ID NO: 4625650 - DNA, 14 bp, Homo sapiens
aagccagccacaga

SEQ ID NO: 4625651 - DNA, 19 bp, Homo sapiens
aagccagccacagacccct

SEQ ID NO: 4625652 - DNA, 21 bp, Homo sapiens
aagccagccacagacccctgg

SEQ ID NO: 4625653 - DNA, 19 bp, Homo sapiens
aagccagggtctctccctc

SEQ ID NO: 4625654 - DNA, 23 bp, Homo sapiens
aagccagttggatctctggttgt

SEQ ID NO: 4625655 - DNA, 18 bp, Homo sapiens
aagccatgtataaatgtg

SEQ ID NO: 4625656 - DNA, 20 bp, Homo sapiens
aagccatgtataaatgtgat

SEQ ID NO: 4625657 - DNA, 21 bp, Homo sapiens
aagccatgtataaatgtgata

SEQ ID NO: 4625658 - DNA, 15 bp, Homo sapiens
aagccatttcttata

SEQ ID NO: 4625659 - DNA, 13 bp, Homo sapiens
aagcccaaagcct

SEQ ID NO: 4625660 - DNA, 15 bp, Homo sapiens
aagcccaggatctct

SEQ ID NO: 4625661 - DNA, 16 bp, Homo sapiens
aagccccatttcctca

SEQ ID NO: 4625662 - DNA, 14 bp, Homo sapiens
aagcccccaccgtg

SEQ ID NO: 4625663 - DNA, 14 bp, Homo sapiens
aagcccctgggccc

SEQ ID NO: 4625664 - DNA, 18 bp, Homo sapiens
aagccccttatttttagc

SEQ ID NO: 4625665 - DNA, 20 bp, Homo sapiens
aagcctgcctcgccttgtgt

SEQ ID NO: 4625666 - DNA, 17 bp, Homo sapiens
aagcctgcctggaagag

SEQ ID NO: 4625667 - DNA, 16 bp, Homo sapiens
aagcctgggggcctgg

SEQ ID NO: 4625668 - DNA, 18 bp, Homo sapiens
aagcctgggggcctggct

SEQ ID NO: 4625669 - DNA, 19 bp, Homo sapiens
aagcctgggggcctggctg

SEQ ID NO: 4625670 - DNA, 15 bp, Homo sapiens
aagcgaacatcttca

SEQ ID NO: 4625671 - DNA, 18 bp, Homo sapiens
aagcgaacatcttcatat

SEQ ID NO: 4625672 - DNA, 22 bp, Homo sapiens
aagcgaacatcttcatataaac

SEQ ID NO: 4625673 - DNA, 14 bp, Homo sapiens
aagcgattctcctg

SEQ ID NO: 4625674 - DNA, 15 bp, Homo sapiens
aagcgattctcctgc

SEQ ID NO: 4625675 - DNA, 20 bp, Homo sapiens
aagcgattctcctgcctcag

SEQ ID NO: 4625676 - DNA, 14 bp, Homo sapiens
aagcgatttgaaac

SEQ ID NO: 4625677 - DNA, 15 bp, Homo sapiens
aagcgatttgaaaca

SEQ ID NO: 4625678 - DNA, 17 bp, Homo sapiens
aagcgatttgaaacact

SEQ ID NO: 4625679 - DNA, 15 bp, Homo sapiens
aagcgttaagggcag

SEQ ID NO: 4625680 - DNA, 15 bp, Homo sapiens
aagctaggccccaga

SEQ ID NO: 4625681 - DNA, 23 bp, Homo sapiens
aagctatggtgagatgcagctgg

SEQ ID NO: 4625682 - DNA, 23 bp, Homo sapiens
aagctcagaggcgcactgtgacc

SEQ ID NO: 4625683 - DNA, 14 bp, Homo sapiens
aagctcccctgcct

SEQ ID NO: 4625684 - DNA, 16 bp, Homo sapiens
aagctcccctgcctta

SEQ ID NO: 4625685 - DNA, 13 bp, Homo sapiens
aagctctgcccct

SEQ ID NO: 4625686 - DNA, 15 bp, Homo sapiens
aagctctgccccttc

SEQ ID NO: 4625687 - DNA, 21 bp, Homo sapiens
aagctcttcccttgctcatga

SEQ ID NO: 4625688 - DNA, 20 bp, Homo sapiens
aagctgacgaacttccatgg

SEQ ID NO: 4625689 - DNA, 18 bp, Homo sapiens
aagctgaggtgcccagga

SEQ ID NO: 4625690 - DNA, 12 bp, Homo sapiens
aagctgcactgt

SEQ ID NO: 4625691 - DNA, 16 bp, Homo sapiens
aagctgcctcaaggaa

SEQ ID NO: 4625692 - DNA, 16 bp, Homo sapiens
aagctgctccaggcct

SEQ ID NO: 4625693 - DNA, 12 bp, Homo sapiens
aagctgtccctg

SEQ ID NO: 4625694 - DNA, 20 bp, Homo sapiens
aagctgtccctgcagggcca

SEQ ID NO: 4625695 - DNA, 21 bp, Homo sapiens
aagctgtccctgcagggccat

SEQ ID NO: 4625696 - DNA, 14 bp, Homo sapiens
aagcttaatgattc

SEQ ID NO: 4625697 - DNA, 14 bp, Homo sapiens
aagcttggaggagg

SEQ ID NO: 4625698 - DNA, 17 bp, Homo sapiens
aagctttcctgtttcca

SEQ ID NO: 4625699 - DNA, 22 bp, Homo sapiens
aagctttcctgtttccagggtc

SEQ ID NO: 4625700 - DNA, 11 bp, Homo sapiens
aagcttttatt

SEQ ID NO: 4625701 - DNA, 17 bp, Homo sapiens
aagcttttatttcttgt

SEQ ID NO: 4625702 - DNA, 17 bp, Homo sapiens
aagcttttgtctgtagg

SEQ ID NO: 4625703 - DNA, 20 bp, Homo sapiens
aaggaaaacgtgaacaaact

SEQ ID NO: 4625704 - DNA, 15 bp, Homo sapiens
aaggaaatatatttt

SEQ ID NO: 4625705 - DNA, 21 bp, Homo sapiens
aaggaacagaagtgaggatga

SEQ ID NO: 4625706 - DNA, 12 bp, Homo sapiens
aaggaagcagaa

SEQ ID NO: 4625707 - DNA, 16 bp, Homo sapiens
aaggaaggagggcaca

SEQ ID NO: 4625708 - DNA, 17 bp, Homo sapiens
aaggaaggcctgagccc

SEQ ID NO: 4625709 - DNA, 15 bp, Homo sapiens
aaggaagtttgattt

SEQ ID NO: 4625710 - DNA, 17 bp, Homo sapiens
aaggaagtttgattttt

SEQ ID NO: 4625711 - DNA, 18 bp, Homo sapiens
aaggacaggaccctcagg

SEQ ID NO: 4625712 - DNA, 21 bp, Homo sapiens
aaggacagttcagagatcagg

SEQ ID NO: 4625713 - DNA, 23 bp, Homo sapiens
aaggacataaaatttaaaaactt

SEQ ID NO: 4625714 - DNA, 13 bp, Homo sapiens
aaggacccagccc

SEQ ID NO: 4625715 - DNA, 15 bp, Homo sapiens
aaggacccttttaag

SEQ ID NO: 4625716 - DNA, 16 bp, Homo sapiens
aaggacccttttaagc

SEQ ID NO: 4625717 - DNA, 22 bp, Homo sapiens
aaggacccttttaagcatgtga

SEQ ID NO: 4625718 - DNA, 15 bp, Homo sapiens
aaggactgagggcag

SEQ ID NO: 4625719 - DNA, 23 bp, Homo sapiens
aaggagaagcacagctcctgcca

SEQ ID NO: 4625720 - DNA, 16 bp, Homo sapiens
aaggagaaggctggag

SEQ ID NO: 4625721 - DNA, 18 bp, Homo sapiens
aaggagcctaggccaggt

SEQ ID NO: 4625722 - DNA, 19 bp, Homo sapiens
aaggagcctaggccaggtg

SEQ ID NO: 4625723 - DNA, 12 bp, Homo sapiens
aaggagcctgtg

SEQ ID NO: 4625724 - DNA, 21 bp, Homo sapiens
aaggagcctgtgaacccagga

SEQ ID NO: 4625725 - DNA, 16 bp, Homo sapiens
aaggaggccaaccagc

SEQ ID NO: 4625726 - DNA, 19 bp, Homo sapiens
aaggaggccaaccagcccg

SEQ ID NO: 4625727 - DNA, 23 bp, Homo sapiens
aaggaggccaaccagcccgacag

SEQ ID NO: 4625728 - DNA, 19 bp, Homo sapiens
aaggagggggcctcattgt

SEQ ID NO: 4625729 - DNA, 21 bp, Homo sapiens
aaggagggggcctcattgtgt

SEQ ID NO: 4625730 - DNA, 20 bp, Homo sapiens
aaggagtgccataccttctc

SEQ ID NO: 4625731 - DNA, 10 bp, Homo sapiens
aaggatgtgt

SEQ ID NO: 4625732 - DNA, 17 bp, Homo sapiens
aaggcacagtgggagct

SEQ ID NO: 4625733 - DNA, 19 bp, Homo sapiens
aaggcacagtgggagctga

SEQ ID NO: 4625734 - DNA, 14 bp, Homo sapiens
aaggcaggcagggc

SEQ ID NO: 4625735 - DNA, 19 bp, Homo sapiens
aaggcaggtgggcagacag

SEQ ID NO: 4625736 - DNA, 16 bp, Homo sapiens
aaggcagtggcagggg

SEQ ID NO: 4625737 - DNA, 13 bp, Homo sapiens
aaggcattttatt

SEQ ID NO: 4625738 - DNA, 16 bp, Homo sapiens
aaggccaaaatcaaga

SEQ ID NO: 4625739 - DNA, 18 bp, Homo sapiens
aaggccaaaatcaagagt

SEQ ID NO: 4625740 - DNA, 17 bp, Homo sapiens
aaggccaaacctctgtt

SEQ ID NO: 4625741 - DNA, 18 bp, Homo sapiens
aaggccagacctgcagac

SEQ ID NO: 4625742 - DNA, 19 bp, Homo sapiens
aaggcccgagcagctgagc

SEQ ID NO: 4625743 - DNA, 21 bp, Homo sapiens
aaggcccgagcagctgagcag

SEQ ID NO: 4625744 - DNA, 18 bp, Homo sapiens
aaggcctcgcaggaagac

SEQ ID NO: 4625745 - DNA, 17 bp, Homo sapiens
aaggcctggggtgaccc

SEQ ID NO: 4625746 - DNA, 21 bp, Homo sapiens
aaggcctggggtgacccggca

SEQ ID NO: 4625747 - DNA, 15 bp, Homo sapiens
aaggctatgtaaaca

SEQ ID NO: 4625748 - DNA, 16 bp, Homo sapiens
aaggcttctctctcac

SEQ ID NO: 4625749 - DNA, 17 bp, Homo sapiens
aaggcttctctctcacc

SEQ ID NO: 4625750 - DNA, 22 bp, Homo sapiens
aaggctttcagggcctccagcc

SEQ ID NO: 4625751 - DNA, 13 bp, Homo sapiens
aagggacaggaga

SEQ ID NO: 4625752 - DNA, 13 bp, Homo sapiens
aagggacccacct

SEQ ID NO: 4625753 - DNA, 14 bp, Homo sapiens
aagggagggctctg

SEQ ID NO: 4625754 - DNA, 14 bp, Homo sapiens
aagggcactcccaa

SEQ ID NO: 4625755 - DNA, 14 bp, Homo sapiens
aagggcacttaatt

SEQ ID NO: 4625756 - DNA, 11 bp, Homo sapiens
aagggcagtgc

SEQ ID NO: 4625757 - DNA, 14 bp, Homo sapiens
aagggcattttacc

SEQ ID NO: 4625758 - DNA, 15 bp, Homo sapiens
aagggcattttaccc

SEQ ID NO: 4625759 - DNA, 12 bp, Homo sapiens
aagggccctggc

SEQ ID NO: 4625760 - DNA, 13 bp, Homo sapiens
aagggccctggca

SEQ ID NO: 4625761 - DNA, 12 bp, Homo sapiens
aaggggcaaatt

SEQ ID NO: 4625762 - DNA, 14 bp, Homo sapiens
aaggggcaaatttt

SEQ ID NO: 4625763 - DNA, 18 bp, Homo sapiens
aaggggcaaatttttatt

SEQ ID NO: 4625764 - DNA, 18 bp, Homo sapiens
aaggggctatcctgggac

SEQ ID NO: 4625765 - DNA, 19 bp, Homo sapiens
aaggggctatcctgggacc

SEQ ID NO: 4625766 - DNA, 19 bp, Homo sapiens
aagggggctctgccccagg

SEQ ID NO: 4625767 - DNA, 22 bp, Homo sapiens
aagggggctctgccccaggccc

SEQ ID NO: 4625768 - DNA, 15 bp, Homo sapiens
aaggggttggggtga

SEQ ID NO: 4625769 - DNA, 22 bp, Homo sapiens
aaggggttggggtgacagtcat

SEQ ID NO: 4625770 - DNA, 16 bp, Homo sapiens
aagggtcttgggaaat

SEQ ID NO: 4625771 - DNA, 16 bp, Homo sapiens
aagggtgggtgctcag

SEQ ID NO: 4625772 - DNA, 18 bp, Homo sapiens
aagggtgggtgctcagaa

SEQ ID NO: 4625773 - DNA, 19 bp, Homo sapiens
aagggtgggtgctcagaat

SEQ ID NO: 4625774 - DNA, 19 bp, Homo sapiens
aagggtttttagagaatgt

SEQ ID NO: 4625775 - DNA, 21 bp, Homo sapiens
aaggtaagctcaggatatggc

SEQ ID NO: 4625776 - DNA, 11 bp, Homo sapiens
aaggtactgtg

SEQ ID NO: 4625777 - DNA, 13 bp, Homo sapiens
aaggtcagaacag

SEQ ID NO: 4625778 - DNA, 14 bp, Homo sapiens
aaggtgctaacata

SEQ ID NO: 4625779 - DNA, 13 bp, Homo sapiens
aaggtggagggaa

SEQ ID NO: 4625780 - DNA, 15 bp, Homo sapiens
aaggtggagggaagg

SEQ ID NO: 4625781 - DNA, 14 bp, Homo sapiens
aaggtgtgatggtc

SEQ ID NO: 4625782 - DNA, 21 bp, Homo sapiens
aaggtttcaacaaatttcatt

SEQ ID NO: 4625783 - DNA, 22 bp, Homo sapiens
aaggtttcaacaaatttcattg

SEQ ID NO: 4625784 - DNA, 23 bp, Homo sapiens
aaggtttcaacaaatttcattgc

SEQ ID NO: 4625785 - DNA, 13 bp, Homo sapiens
aaggtttttagca

SEQ ID NO: 4625786 - DNA, 19 bp, Homo sapiens
aagtaaaagatcaggttat

SEQ ID NO: 4625787 - DNA, 17 bp, Homo sapiens
aagtaatgaagaatcac

SEQ ID NO: 4625788 - DNA, 19 bp, Homo sapiens
aagtaatgacttagaaact

SEQ ID NO: 4625789 - DNA, 20 bp, Homo sapiens
aagtaatgacttagaaactg

SEQ ID NO: 4625790 - DNA, 14 bp, Homo sapiens
aagtacacctgtgt

SEQ ID NO: 4625791 - DNA, 20 bp, Homo sapiens
aagtagggatgcggatcctg

SEQ ID NO: 4625792 - DNA, 14 bp, Homo sapiens
aagtagtaattgca

SEQ ID NO: 4625793 - DNA, 17 bp, Homo sapiens
aagtagtccttggcata

SEQ ID NO: 4625794 - DNA, 14 bp, Homo sapiens
aagtataatctttc

SEQ ID NO: 4625795 - DNA, 18 bp, Homo sapiens
aagtataatctttctata

SEQ ID NO: 4625796 - DNA, 23 bp, Homo sapiens
aagtatatcatgtaaagaaatgt

SEQ ID NO: 4625797 - DNA, 16 bp, Homo sapiens
aagtatattcttattg

SEQ ID NO: 4625798 - DNA, 21 bp, Homo sapiens
aagtatattcttattggaaat

SEQ ID NO: 4625799 - DNA, 15 bp, Homo sapiens
aagtatggtgtgttc

SEQ ID NO: 4625800 - DNA, 17 bp, Homo sapiens
aagtattatcattgctc

SEQ ID NO: 4625801 - DNA, 16 bp, Homo sapiens
aagtatttataaaaat

SEQ ID NO: 4625802 - DNA, 14 bp, Homo sapiens
aagtatttattccc

SEQ ID NO: 4625803 - DNA, 18 bp, Homo sapiens
aagtattttgtgtttgga

SEQ ID NO: 4625804 - DNA, 14 bp, Homo sapiens
aagtcaaaaaatta

SEQ ID NO: 4625805 - DNA, 17 bp, Homo sapiens
aagtcaaataaatgttt

SEQ ID NO: 4625806 - DNA, 19 bp, Homo sapiens
aagtcaaataaatgtttcc

SEQ ID NO: 4625807 - DNA, 22 bp, Homo sapiens
aagtcaaataaatgtttccccc

SEQ ID NO: 4625808 - DNA, 15 bp, Homo sapiens
aagtccaggtcctgg

SEQ ID NO: 4625809 - DNA, 17 bp, Homo sapiens
aagtccaggtcctggtg

SEQ ID NO: 4625810 - DNA, 18 bp, Homo sapiens
aagtccaggtcctggtgg

SEQ ID NO: 4625811 - DNA, 12 bp, Homo sapiens
aagtcctagccc

SEQ ID NO: 4625812 - DNA, 19 bp, Homo sapiens
aagtcgtccttactcctgt

SEQ ID NO: 4625813 - DNA, 20 bp, Homo sapiens
aagtcgtccttactcctgtg

SEQ ID NO: 4625814 - DNA, 17 bp, Homo sapiens
aagtcgtgcactttctc

SEQ ID NO: 4625815 - DNA, 18 bp, Homo sapiens
aagtcgtgcactttctcg

SEQ ID NO: 4625816 - DNA, 20 bp, Homo sapiens
aagtcgtgcactttctcggt

SEQ ID NO: 4625817 - DNA, 11 bp, Homo sapiens
aagtgaaatta

SEQ ID NO: 4625818 - DNA, 20 bp, Homo sapiens
aagtgagagacctctgccta

SEQ ID NO: 4625819 - DNA, 18 bp, Homo sapiens
aagtgagatggtatgaaa

SEQ ID NO: 4625820 - DNA, 19 bp, Homo sapiens
aagtgagatggtatgaaat

SEQ ID NO: 4625821 - DNA, 17 bp, Homo sapiens
aagtgaggatgagaccc

SEQ ID NO: 4625822 - DNA, 17 bp, Homo sapiens
aagtgaggtgacactcc

SEQ ID NO: 4625823 - DNA, 11 bp, Homo sapiens
aagtgcctggg

SEQ ID NO: 4625824 - DNA, 12 bp, Homo sapiens
aagtgcctggga

SEQ ID NO: 4625825 - DNA, 14 bp, Homo sapiens
aagtgctcagtgaa

SEQ ID NO: 4625826 - DNA, 18 bp, Homo sapiens
aagtgctcagtgaagtac

SEQ ID NO: 4625827 - DNA, 13 bp, Homo sapiens
aagtggcctcttt

SEQ ID NO: 4625828 - DNA, 17 bp, Homo sapiens
aagtggtatagaaatgc

SEQ ID NO: 4625829 - DNA, 15 bp, Homo sapiens
aagtgtaaaaaatgt

SEQ ID NO: 4625830 - DNA, 12 bp, Homo sapiens
aagtgtaaatga

SEQ ID NO: 4625831 - DNA, 14 bp, Homo sapiens
aagtgtaggccacc

SEQ ID NO: 4625832 - DNA, 18 bp, Homo sapiens
aagtgtcacctccttccc

SEQ ID NO: 4625833 - DNA, 19 bp, Homo sapiens
aagtgtcacctccttcccc

SEQ ID NO: 4625834 - DNA, 18 bp, Homo sapiens
aagtgtctcattctcaga

SEQ ID NO: 4625835 - DNA, 19 bp, Homo sapiens
aagtgtctcattctcagag

SEQ ID NO: 4625836 - DNA, 21 bp, Homo sapiens
aagttaactgacttcactagg

SEQ ID NO: 4625837 - DNA, 14 bp, Homo sapiens
aagttacacatttt

SEQ ID NO: 4625838 - DNA, 23 bp, Homo sapiens
aagttagaaggcttaagaactgc

SEQ ID NO: 4625839 - DNA, 17 bp, Homo sapiens
aagttagcctttgaatg

SEQ ID NO: 4625840 - DNA, 17 bp, Homo sapiens
aagttcatgctttgttc

SEQ ID NO: 4625841 - DNA, 14 bp, Homo sapiens
aagttccaagtcca

SEQ ID NO: 4625842 - DNA, 21 bp, Homo sapiens
aagttgctcaccgactcacct

SEQ ID NO: 4625843 - DNA, 22 bp, Homo sapiens
aagttgctcaccgactcacctg

SEQ ID NO: 4625844 - DNA, 15 bp, Homo sapiens
aagttgtaaaataga

SEQ ID NO: 4625845 - DNA, 13 bp, Homo sapiens
aagttgtggagga

SEQ ID NO: 4625846 - DNA, 14 bp, Homo sapiens
aagttgtggaggag

SEQ ID NO: 4625847 - DNA, 17 bp, Homo sapiens
aagttgtggaggaggtg

SEQ ID NO: 4625848 - DNA, 15 bp, Homo sapiens
aagttgttaataaaa

SEQ ID NO: 4625849 - DNA, 15 bp, Homo sapiens
aagttgttgcattcc

SEQ ID NO: 4625850 - DNA, 11 bp, Homo sapiens
aagtttaaata

SEQ ID NO: 4625851 - DNA, 17 bp, Homo sapiens
aagtttaaataccagta

SEQ ID NO: 4625852 - DNA, 18 bp, Homo sapiens
aagtttaacaagtattta

SEQ ID NO: 4625853 - DNA, 14 bp, Homo sapiens
aagtttaattgact

SEQ ID NO: 4625854 - DNA, 12 bp, Homo sapiens
aagtttcagttg

SEQ ID NO: 4625855 - DNA, 15 bp, Homo sapiens
aataaaacacacctc

SEQ ID NO: 4625856 - DNA, 21 bp, Homo sapiens
aataaaaggaagccaaagagt

SEQ ID NO: 4625857 - DNA, 19 bp, Homo sapiens
aataaaatatcataaagca

SEQ ID NO: 4625858 - DNA, 14 bp, Homo sapiens
aataaaatgaaaat

SEQ ID NO: 4625859 - DNA, 22 bp, Homo sapiens
aataaaattttttttcatgttt

SEQ ID NO: 4625860 - DNA, 17 bp, Homo sapiens
aataaacgcagaagagg

SEQ ID NO: 4625861 - DNA, 14 bp, Homo sapiens
aataaagcaatgtg

SEQ ID NO: 4625862 - DNA, 16 bp, Homo sapiens
aataaagccatttctt

SEQ ID NO: 4625863 - DNA, 12 bp, Homo sapiens
aataaagcttta

SEQ ID NO: 4625864 - DNA, 15 bp, Homo sapiens
aataaagttgcagat

SEQ ID NO: 4625865 - DNA, 13 bp, Homo sapiens
aataaagttgttg

SEQ ID NO: 4625866 - DNA, 16 bp, Homo sapiens
aataaagttgttgcat

SEQ ID NO: 4625867 - DNA, 17 bp, Homo sapiens
aataaagttgttgcatt

SEQ ID NO: 4625868 - DNA, 18 bp, Homo sapiens
aataaagttgttgcattc

SEQ ID NO: 4625869 - DNA, 16 bp, Homo sapiens
aataaatgtttccccc

SEQ ID NO: 4625870 - DNA, 14 bp, Homo sapiens
aataaattctgact

SEQ ID NO: 4625871 - DNA, 21 bp, Homo sapiens
aataaattctgacttatgaat

SEQ ID NO: 4625872 - DNA, 13 bp, Homo sapiens
aataaattgctta

SEQ ID NO: 4625873 - DNA, 20 bp, Homo sapiens
aataacatttaaattccaca

SEQ ID NO: 4625874 - DNA, 16 bp, Homo sapiens
aataacccagttactt

SEQ ID NO: 4625875 - DNA, 14 bp, Homo sapiens
aataagcagaacat

SEQ ID NO: 4625876 - DNA, 13 bp, Homo sapiens
aataagtaatatc

SEQ ID NO: 4625877 - DNA, 22 bp, Homo sapiens
aataatcagaaaagtaattttg

SEQ ID NO: 4625878 - DNA, 16 bp, Homo sapiens
aataatccctgtaata

SEQ ID NO: 4625879 - DNA, 21 bp, Homo sapiens
aataatgttaaccaaggaaat

SEQ ID NO: 4625880 - DNA, 12 bp, Homo sapiens
aataattattat

SEQ ID NO: 4625881 - DNA, 17 bp, Homo sapiens
aataattcatattcttc

SEQ ID NO: 4625882 - DNA, 13 bp, Homo sapiens
aatacagacaaag

SEQ ID NO: 4625883 - DNA, 17 bp, Homo sapiens
aatacattaacggtgct

SEQ ID NO: 4625884 - DNA, 15 bp, Homo sapiens
aatacattttattct

SEQ ID NO: 4625885 - DNA, 16 bp, Homo sapiens
aatacctctgtgtgct

SEQ ID NO: 4625886 - DNA, 23 bp, Homo sapiens
aatacgacactgaaatatgtgaa

SEQ ID NO: 4625887 - DNA, 20 bp, Homo sapiens
aatactacccatagaaaact

SEQ ID NO: 4625888 - DNA, 14 bp, Homo sapiens
aatactcttgaaag

SEQ ID NO: 4625889 - DNA, 20 bp, Homo sapiens
aatactgcacactgcacatt

SEQ ID NO: 4625890 - DNA, 19 bp, Homo sapiens
aatactgtatgccttctgt

SEQ ID NO: 4625891 - DNA, 13 bp, Homo sapiens
aatagaaattttc

SEQ ID NO: 4625892 - DNA, 17 bp, Homo sapiens
aatagaataattctttt

SEQ ID NO: 4625893 - DNA, 20 bp, Homo sapiens
aatagatgtgcccttttata

SEQ ID NO: 4625894 - DNA, 18 bp, Homo sapiens
aatagatttttttttcca

SEQ ID NO: 4625895 - DNA, 14 bp, Homo sapiens
aatagcctgtggcc

SEQ ID NO: 4625896 - DNA, 15 bp, Homo sapiens
aatagctgaaaaggg

SEQ ID NO: 4625897 - DNA, 15 bp, Homo sapiens
aatagctttgtagtt

SEQ ID NO: 4625898 - DNA, 20 bp, Homo sapiens
aatagttactccagtgccaa

SEQ ID NO: 4625899 - DNA, 22 bp, Homo sapiens
aatagttagatctaccctgcct

SEQ ID NO: 4625900 - DNA, 14 bp, Homo sapiens
aatagttgtctgtg

SEQ ID NO: 4625901 - DNA, 16 bp, Homo sapiens
aatagttgtctgtgct

SEQ ID NO: 4625902 - DNA, 20 bp, Homo sapiens
aatagttgtctgtgcttcct

SEQ ID NO: 4625903 - DNA, 14 bp, Homo sapiens
aatagtttatctta

SEQ ID NO: 4625904 - DNA, 12 bp, Homo sapiens
aatataagaaaa

SEQ ID NO: 4625905 - DNA, 22 bp, Homo sapiens
aatataagtctatactaatgct

SEQ ID NO: 4625906 - DNA, 12 bp, Homo sapiens
aatataatgttg

SEQ ID NO: 4625907 - DNA, 23 bp, Homo sapiens
aatataattttggtaattttgat

SEQ ID NO: 4625908 - DNA, 18 bp, Homo sapiens
aatatacattttctaaat

SEQ ID NO: 4625909 - DNA, 20 bp, Homo sapiens
aatatactcagggattcctt

SEQ ID NO: 4625910 - DNA, 19 bp, Homo sapiens
aatatagaaagttgatatt

SEQ ID NO: 4625911 - DNA, 23 bp, Homo sapiens
aatatatattaagtgtgccaaat

SEQ ID NO: 4625912 - DNA, 18 bp, Homo sapiens
aatatatattatatacat

SEQ ID NO: 4625913 - DNA, 14 bp, Homo sapiens
aatatatattttgt

SEQ ID NO: 4625914 - DNA, 17 bp, Homo sapiens
aatatattgctgcattt

SEQ ID NO: 4625915 - DNA, 16 bp, Homo sapiens
aatatattttaccata

SEQ ID NO: 4625916 - DNA, 19 bp, Homo sapiens
aatatattttatcttggta

SEQ ID NO: 4625917 - DNA, 16 bp, Homo sapiens
aatatcaaataaaata

SEQ ID NO: 4625918 - DNA, 14 bp, Homo sapiens
aatatcaatcaagc

SEQ ID NO: 4625919 - DNA, 13 bp, Homo sapiens
aatatcataaagc

SEQ ID NO: 4625920 - DNA, 14 bp, Homo sapiens
aatatcataaagca

SEQ ID NO: 4625921 - DNA, 19 bp, Homo sapiens
aatatcatttataaaggga

SEQ ID NO: 4625922 - DNA, 13 bp, Homo sapiens
aatatcattttat

SEQ ID NO: 4625923 - DNA, 14 bp, Homo sapiens
aatatcattttatt

SEQ ID NO: 4625924 - DNA, 16 bp, Homo sapiens
aatatcattttattca

SEQ ID NO: 4625925 - DNA, 12 bp, Homo sapiens
aatatgacagat

SEQ ID NO: 4625926 - DNA, 19 bp, Homo sapiens
aatatgactttttataaaa

SEQ ID NO: 4625927 - DNA, 17 bp, Homo sapiens
aatatgagtacaaatgc

SEQ ID NO: 4625928 - DNA, 22 bp, Homo sapiens
aatatggaaatcttttacattt

SEQ ID NO: 4625929 - DNA, 14 bp, Homo sapiens
aatatggatttgtt

SEQ ID NO: 4625930 - DNA, 17 bp, Homo sapiens
aatatggggatagtctg

SEQ ID NO: 4625931 - DNA, 23 bp, Homo sapiens
aatatggggatagtctgggtcag

SEQ ID NO: 4625932 - DNA, 17 bp, Homo sapiens
aatatgtcgtagaattc

SEQ ID NO: 4625933 - DNA, 20 bp, Homo sapiens
aatatgtttaaaataaaatg

SEQ ID NO: 4625934 - DNA, 15 bp, Homo sapiens
aatatgtttagtttt

SEQ ID NO: 4625935 - DNA, 17 bp, Homo sapiens
aatattaccatcttaat

SEQ ID NO: 4625936 - DNA, 18 bp, Homo sapiens
aatattactctagtttat

SEQ ID NO: 4625937 - DNA, 13 bp, Homo sapiens
aatattcagaaat

SEQ ID NO: 4625938 - DNA, 11 bp, Homo sapiens
aatattcatgg

SEQ ID NO: 4625939 - DNA, 12 bp, Homo sapiens
aatattccaagc

SEQ ID NO: 4625940 - DNA, 17 bp, Homo sapiens
aatattgtaatatgaca

SEQ ID NO: 4625941 - DNA, 20 bp, Homo sapiens
aatattgtaatatgacagat

SEQ ID NO: 4625942 - DNA, 13 bp, Homo sapiens
aatattgtacagt

SEQ ID NO: 4625943 - DNA, 15 bp, Homo sapiens
aatattgtacagttt

SEQ ID NO: 4625944 - DNA, 15 bp, Homo sapiens
aatattgtttctgca

SEQ ID NO: 4625945 - DNA, 17 bp, Homo sapiens
aatatttactctttgca

SEQ ID NO: 4625946 - DNA, 18 bp, Homo sapiens
aatatttactctttgcaa

SEQ ID NO: 4625947 - DNA, 14 bp, Homo sapiens
aatatttagctgta

SEQ ID NO: 4625948 - DNA, 20 bp, Homo sapiens
aatatttgaataatgacaga

SEQ ID NO: 4625949 - DNA, 19 bp, Homo sapiens
aatattttctctgtacttt

SEQ ID NO: 4625950 - DNA, 14 bp, Homo sapiens
aatattttgttctt

SEQ ID NO: 4625951 - DNA, 16 bp, Homo sapiens
aatatttttatataca

SEQ ID NO: 4625952 - DNA, 18 bp, Homo sapiens
aatatttttatatacaga

SEQ ID NO: 4625953 - DNA, 23 bp, Homo sapiens
aatatttttatatacagaggaaa

SEQ ID NO: 4625954 - DNA, 15 bp, Homo sapiens
aatcaagagaaactt

SEQ ID NO: 4625955 - DNA, 15 bp, Homo sapiens
aatcaagtattttgt

SEQ ID NO: 4625956 - DNA, 16 bp, Homo sapiens
aatcaatataatctga

SEQ ID NO: 4625957 - DNA, 17 bp, Homo sapiens
aatcacagaaaatttaa

SEQ ID NO: 4625958 - DNA, 20 bp, Homo sapiens
aatcacgtaaagctagaaat

SEQ ID NO: 4625959 - DNA, 14 bp, Homo sapiens
aatcactaaacttt

SEQ ID NO: 4625960 - DNA, 20 bp, Homo sapiens
aatcagaaaagtaattttgt

SEQ ID NO: 4625961 - DNA, 17 bp, Homo sapiens
aatcagcccagtgcaaa

SEQ ID NO: 4625962 - DNA, 18 bp, Homo sapiens
aatcaggcaaggaggagg

SEQ ID NO: 4625963 - DNA, 19 bp, Homo sapiens
aatcagtaggaccaggcca

SEQ ID NO: 4625964 - DNA, 13 bp, Homo sapiens
aatcagttctgtg

SEQ ID NO: 4625965 - DNA, 14 bp, Homo sapiens
aatcagttctgtgt

SEQ ID NO: 4625966 - DNA, 14 bp, Homo sapiens
aatcatacaaactc

SEQ ID NO: 4625967 - DNA, 19 bp, Homo sapiens
aatcatacaaactctcacc

SEQ ID NO: 4625968 - DNA, 14 bp, Homo sapiens
aatcatcaaaaagt

SEQ ID NO: 4625969 - DNA, 15 bp, Homo sapiens
aatcatctttgtgaa

SEQ ID NO: 4625970 - DNA, 14 bp, Homo sapiens
aatcattatttgag

SEQ ID NO: 4625971 - DNA, 14 bp, Homo sapiens
aatcatttattcat

SEQ ID NO: 4625972 - DNA, 11 bp, Homo sapiens
aatcattttaa

SEQ ID NO: 4625973 - DNA, 14 bp, Homo sapiens
aatcattttatgct

SEQ ID NO: 4625974 - DNA, 13 bp, Homo sapiens
aatcattttcatt

SEQ ID NO: 4625975 - DNA, 13 bp, Homo sapiens
aatcatttttgta

SEQ ID NO: 4625976 - DNA, 22 bp, Homo sapiens
aatccattttaggtgataaaat

SEQ ID NO: 4625977 - DNA, 18 bp, Homo sapiens
aatcccacccacatgtga

SEQ ID NO: 4625978 - DNA, 18 bp, Homo sapiens
aatccccaacatgcactg

SEQ ID NO: 4625979 - DNA, 14 bp, Homo sapiens
aatcctaccaaagt

SEQ ID NO: 4625980 - DNA, 14 bp, Homo sapiens
aatcctatgtgatt

SEQ ID NO: 4625981 - DNA, 16 bp, Homo sapiens
aatcctccccgctctg

SEQ ID NO: 4625982 - DNA, 23 bp, Homo sapiens
aatcctcttctaaaatagcaata

SEQ ID NO: 4625983 - DNA, 11 bp, Homo sapiens
aatcctggctg

SEQ ID NO: 4625984 - DNA, 15 bp, Homo sapiens
aatcggactgccaaa

SEQ ID NO: 4625985 - DNA, 23 bp, Homo sapiens
aatcgtccctatatcagggcctg

SEQ ID NO: 4625986 - DNA, 16 bp, Homo sapiens
aatctagacattcttt

SEQ ID NO: 4625987 - DNA, 16 bp, Homo sapiens
aatctaggccacccca

SEQ ID NO: 4625988 - DNA, 14 bp, Homo sapiens
aatctagtttccta

SEQ ID NO: 4625989 - DNA, 17 bp, Homo sapiens
aatctatttcacttatt

SEQ ID NO: 4625990 - DNA, 23 bp, Homo sapiens
aatctatttcacttattttggct

SEQ ID NO: 4625991 - DNA, 17 bp, Homo sapiens
aatctctctctcttttt

SEQ ID NO: 4625992 - DNA, 11 bp, Homo sapiens
aatctctgcct

SEQ ID NO: 4625993 - DNA, 15 bp, Homo sapiens
aatctgcatgtttga

SEQ ID NO: 4625994 - DNA, 22 bp, Homo sapiens
aatctggatgttaagaatgaag

SEQ ID NO: 4625995 - DNA, 19 bp, Homo sapiens
aatctgtgtacaaagaaat

SEQ ID NO: 4625996 - DNA, 18 bp, Homo sapiens
aatcttagtgaatgggaa

SEQ ID NO: 4625997 - DNA, 13 bp, Homo sapiens
aatcttatacaac

SEQ ID NO: 4625998 - DNA, 19 bp, Homo sapiens
aatcttcagtattttctcc

SEQ ID NO: 4625999 - DNA, 15 bp, Homo sapiens
aatcttctctcttga

SEQ ID NO: 4626000 - DNA, 17 bp, Homo sapiens
aatcttctctcttgatt

SEQ ID NO: 4626001 - DNA, 22 bp, Homo sapiens
aatcttctctcttgattgattt

SEQ ID NO: 4626002 - DNA, 15 bp, Homo sapiens
aatcttgatcattcc

SEQ ID NO: 4626003 - DNA, 15 bp, Homo sapiens
aatcttgctttcttt

SEQ ID NO: 4626004 - DNA, 13 bp, Homo sapiens
aatctttatttta

SEQ ID NO: 4626005 - DNA, 15 bp, Homo sapiens
aatctttattttatt

SEQ ID NO: 4626006 - DNA, 21 bp, Homo sapiens
aatcttttaaaaattcaaatg

SEQ ID NO: 4626007 - DNA, 15 bp, Homo sapiens
aatcttttacatttt

SEQ ID NO: 4626008 - DNA, 21 bp, Homo sapiens
aatcttttttagcataaaatt

SEQ ID NO: 4626009 - DNA, 13 bp, Homo sapiens
aatgaaaaatata

SEQ ID NO: 4626010 - DNA, 13 bp, Homo sapiens
aatgaaaattgta

SEQ ID NO: 4626011 - DNA, 22 bp, Homo sapiens
aatgaaatagttattttaatac

SEQ ID NO: 4626012 - DNA, 15 bp, Homo sapiens
aatgaaatgtttact

SEQ ID NO: 4626013 - DNA, 23 bp, Homo sapiens
aatgaaatgtttactaagtggac

SEQ ID NO: 4626014 - DNA, 17 bp, Homo sapiens
aatgaacatctcttgaa

SEQ ID NO: 4626015 - DNA, 12 bp, Homo sapiens
aatgaagaaagt

SEQ ID NO: 4626016 - DNA, 22 bp, Homo sapiens
aatgaagaaagtcaaaaaatta

SEQ ID NO: 4626017 - DNA, 13 bp, Homo sapiens
aatgacttagaaa

SEQ ID NO: 4626018 - DNA, 15 bp, Homo sapiens
aatgacttatttctg

SEQ ID NO: 4626019 - DNA, 20 bp, Homo sapiens
aatgacttatttctgctctg

SEQ ID NO: 4626020 - DNA, 22 bp, Homo sapiens
aatgacttatttctgctctgga

SEQ ID NO: 4626021 - DNA, 13 bp, Homo sapiens
aatgacttctaat

SEQ ID NO: 4626022 - DNA, 17 bp, Homo sapiens
aatgagcaagactgggc

SEQ ID NO: 4626023 - DNA, 13 bp, Homo sapiens
aatgataaaatag

SEQ ID NO: 4626024 - DNA, 18 bp, Homo sapiens
aatgatagttgattttca

SEQ ID NO: 4626025 - DNA, 12 bp, Homo sapiens
aatgatgataac

SEQ ID NO: 4626026 - DNA, 16 bp, Homo sapiens
aatgattatcttgaaa

SEQ ID NO: 4626027 - DNA, 20 bp, Homo sapiens
aatgatttgtgtttctttat

SEQ ID NO: 4626028 - DNA, 13 bp, Homo sapiens
aatgatttttaaa

SEQ ID NO: 4626029 - DNA, 23 bp, Homo sapiens
aatgcaaattaaaacatatttca

SEQ ID NO: 4626030 - DNA, 19 bp, Homo sapiens
aatgcaaatttctataaat

SEQ ID NO: 4626031 - DNA, 19 bp, Homo sapiens
aatgcactgtttttaatct

SEQ ID NO: 4626032 - DNA, 14 bp, Homo sapiens
aatgcatatttata

SEQ ID NO: 4626033 - DNA, 15 bp, Homo sapiens
aatgcatatttataa

SEQ ID NO: 4626034 - DNA, 18 bp, Homo sapiens
aatgcatgagtaaaaaaa

SEQ ID NO: 4626035 - DNA, 13 bp, Homo sapiens
aatgcattattga

SEQ ID NO: 4626036 - DNA, 12 bp, Homo sapiens
aatgcattgtat

SEQ ID NO: 4626037 - DNA, 19 bp, Homo sapiens
aatgcctagagatatttca

SEQ ID NO: 4626038 - DNA, 23 bp, Homo sapiens
aatgcctagagatatttcaagct

SEQ ID NO: 4626039 - DNA, 17 bp, Homo sapiens
aatgcctcctgtgggga

SEQ ID NO: 4626040 - DNA, 19 bp, Homo sapiens
aatgcctcgctcccttcaa

SEQ ID NO: 4626041 - DNA, 20 bp, Homo sapiens
aatgccttaaaatggaattg

SEQ ID NO: 4626042 - DNA, 19 bp, Homo sapiens
aatgctaagaatgcattat

SEQ ID NO: 4626043 - DNA, 20 bp, Homo sapiens
aatgctctggggtcttttta

SEQ ID NO: 4626044 - DNA, 14 bp, Homo sapiens
aatgctggactgga

SEQ ID NO: 4626045 - DNA, 22 bp, Homo sapiens
aatgctggactggaggcccctg

SEQ ID NO: 4626046 - DNA, 23 bp, Homo sapiens
aatgctggactggaggcccctgg

SEQ ID NO: 4626047 - DNA, 22 bp, Homo sapiens
aatgctggcaaaggctggctgt

SEQ ID NO: 4626048 - DNA, 15 bp, Homo sapiens
aatggaaattttgct

SEQ ID NO: 4626049 - DNA, 14 bp, Homo sapiens
aatggacatggtgg

SEQ ID NO: 4626050 - DNA, 23 bp, Homo sapiens
aatggactgttacagactgaaag

SEQ ID NO: 4626051 - DNA, 17 bp, Homo sapiens
aatggaggtcccagccc

SEQ ID NO: 4626052 - DNA, 18 bp, Homo sapiens
aatggaggtcccagccct

SEQ ID NO: 4626053 - DNA, 22 bp, Homo sapiens
aatggattcatggagtagcctg

SEQ ID NO: 4626054 - DNA, 11 bp, Homo sapiens
aatggcagagc

SEQ ID NO: 4626055 - DNA, 19 bp, Homo sapiens
aatggccaggggccaggag

SEQ ID NO: 4626056 - DNA, 14 bp, Homo sapiens
aatgtaaaatgatt

SEQ ID NO: 4626057 - DNA, 16 bp, Homo sapiens
aatgtaagcatacttt

SEQ ID NO: 4626058 - DNA, 16 bp, Homo sapiens
aatgtaatagggaaaa

SEQ ID NO: 4626059 - DNA, 17 bp, Homo sapiens
aatgtacactttttaca

SEQ ID NO: 4626060 - DNA, 23 bp, Homo sapiens
aatgtacactttttacagcagca

SEQ ID NO: 4626061 - DNA, 17 bp, Homo sapiens
aatgtacagttgaaata

SEQ ID NO: 4626062 - DNA, 10 bp, Homo sapiens
aatgtatctt

SEQ ID NO: 4626063 - DNA, 11 bp, Homo sapiens
aatgtatctta

SEQ ID NO: 4626064 - DNA, 15 bp, Homo sapiens
aatgtatcttaaagg

SEQ ID NO: 4626065 - DNA, 22 bp, Homo sapiens
aatgtatcttaaaggacataaa

SEQ ID NO: 4626066 - DNA, 15 bp, Homo sapiens
aatgtattgattcaa

SEQ ID NO: 4626067 - DNA, 19 bp, Homo sapiens
aatgtattgattcaacagg

SEQ ID NO: 4626068 - DNA, 15 bp, Homo sapiens
aatgtcataacaggc

SEQ ID NO: 4626069 - DNA, 23 bp, Homo sapiens
aatgtcatggccttgaaacagtt

SEQ ID NO: 4626070 - DNA, 15 bp, Homo sapiens
aatgtgaactctccc

SEQ ID NO: 4626071 - DNA, 21 bp, Homo sapiens
aatgtgaactctcccctcccc

SEQ ID NO: 4626072 - DNA, 18 bp, Homo sapiens
aatgtgaggcaataagaa

SEQ ID NO: 4626073 - DNA, 17 bp, Homo sapiens
aatgtggcagctgtctc

SEQ ID NO: 4626074 - DNA, 12 bp, Homo sapiens
aatgtgggctat

SEQ ID NO: 4626075 - DNA, 16 bp, Homo sapiens
aatgtggtctcaggat

SEQ ID NO: 4626076 - DNA, 13 bp, Homo sapiens
aatgtgtaagaac

SEQ ID NO: 4626077 - DNA, 14 bp, Homo sapiens
aatgtgtacagtga

SEQ ID NO: 4626078 - DNA, 18 bp, Homo sapiens
aatgtgtattttatatga

SEQ ID NO: 4626079 - DNA, 15 bp, Homo sapiens
aatgttagagacttt

SEQ ID NO: 4626080 - DNA, 21 bp, Homo sapiens
aatgttagagtttaattttgt

SEQ ID NO: 4626081 - DNA, 20 bp, Homo sapiens
aatgttcttatgcaaaatgg

SEQ ID NO: 4626082 - DNA, 21 bp, Homo sapiens
aatgttcttatgcaaaatgga

SEQ ID NO: 4626083 - DNA, 16 bp, Homo sapiens
aatgtttaataaagct

SEQ ID NO: 4626084 - DNA, 13 bp, Homo sapiens
aatgtttgtgggt

SEQ ID NO: 4626085 - DNA, 15 bp, Homo sapiens
aatgtttgtgtctgt

SEQ ID NO: 4626086 - DNA, 20 bp, Homo sapiens
aatgttttcattatgttcat

SEQ ID NO: 4626087 - DNA, 21 bp, Homo sapiens
aatgttttcattatgttcatg

SEQ ID NO: 4626088 - DNA, 19 bp, Homo sapiens
aattaaaacaaatatacat

SEQ ID NO: 4626089 - DNA, 21 bp, Homo sapiens
aattaaaacatatttcatttt

SEQ ID NO: 4626090 - DNA, 16 bp, Homo sapiens
aattaagcattttgaa

SEQ ID NO: 4626091 - DNA, 23 bp, Homo sapiens
aattaagcattttgaaacaaagt

SEQ ID NO: 4626092 - DNA, 14 bp, Homo sapiens
aattaagttatctt

SEQ ID NO: 4626093 - DNA, 15 bp, Homo sapiens
aattacaattttatc

SEQ ID NO: 4626094 - DNA, 16 bp, Homo sapiens
aattacacttgtcttt

SEQ ID NO: 4626095 - DNA, 24 bp, Homo sapiens
aattacatggaacttttctgtaat

SEQ ID NO: 4626096 - DNA, 16 bp, Homo sapiens
aattactactaggtaa

SEQ ID NO: 4626097 - DNA, 22 bp, Homo sapiens
aattactactaggtaataataa

SEQ ID NO: 4626098 - DNA, 17 bp, Homo sapiens
aattagtggtcataaaa

SEQ ID NO: 4626099 - DNA, 20 bp, Homo sapiens
aattatacagacctaatatc

SEQ ID NO: 4626100 - DNA, 14 bp, Homo sapiens
aattatactacttt

SEQ ID NO: 4626101 - DNA, 17 bp, Homo sapiens
aattatatattgcaagg

SEQ ID NO: 4626102 - DNA, 14 bp, Homo sapiens
aattcacccactcc

SEQ ID NO: 4626103 - DNA, 12 bp, Homo sapiens
aattcagctcct

SEQ ID NO: 4626104 - DNA, 16 bp, Homo sapiens
aattcagtgccttcaa

SEQ ID NO: 4626105 - DNA, 13 bp, Homo sapiens
aattcatactctg

SEQ ID NO: 4626106 - DNA, 15 bp, Homo sapiens
aattcatactctgtt

SEQ ID NO: 4626107 - DNA, 19 bp, Homo sapiens
aattcatactctgttgcct

SEQ ID NO: 4626108 - DNA, 14 bp, Homo sapiens
aattccaagaaaat

SEQ ID NO: 4626109 - DNA, 18 bp, Homo sapiens
aattccaagaaaatatca

SEQ ID NO: 4626110 - DNA, 18 bp, Homo sapiens
aattccacagattatcaa

SEQ ID NO: 4626111 - DNA, 15 bp, Homo sapiens
aattcgcatgtttaa

SEQ ID NO: 4626112 - DNA, 22 bp, Homo sapiens
aattcgcatgtttaatgtgaac

SEQ ID NO: 4626113 - DNA, 22 bp, Homo sapiens
aattcggttgggtaccatgctt

SEQ ID NO: 4626114 - DNA, 14 bp, Homo sapiens
aattctaacccaag

SEQ ID NO: 4626115 - DNA, 21 bp, Homo sapiens
aattctaacccaagacatgac

SEQ ID NO: 4626116 - DNA, 22 bp, Homo sapiens
aattctacacctcctttaagat

SEQ ID NO: 4626117 - DNA, 19 bp, Homo sapiens
aattctgtttttaatgcta

SEQ ID NO: 4626118 - DNA, 21 bp, Homo sapiens
aattctgtttttaatgctatt

SEQ ID NO: 4626119 - DNA, 20 bp, Homo sapiens
aattcttcagcgtaaaatgg

SEQ ID NO: 4626120 - DNA, 15 bp, Homo sapiens
aattgacaaatgatg

SEQ ID NO: 4626121 - DNA, 17 bp, Homo sapiens
aattgactcttatttat

SEQ ID NO: 4626122 - DNA, 14 bp, Homo sapiens
aattgacttattta

SEQ ID NO: 4626123 - DNA, 20 bp, Homo sapiens
aattgcaaaaacatagaaat

SEQ ID NO: 4626124 - DNA, 20 bp, Homo sapiens
aattgctaatacccagttac

SEQ ID NO: 4626125 - DNA, 16 bp, Homo sapiens
aattgctttgtgcctt

SEQ ID NO: 4626126 - DNA, 18 bp, Homo sapiens
aattggcagtggcagaga

SEQ ID NO: 4626127 - DNA, 20 bp, Homo sapiens
aattggtaaaactcactgtg

SEQ ID NO: 4626128 - DNA, 21 bp, Homo sapiens
aattggtgctatttgaagaaa

SEQ ID NO: 4626129 - DNA, 20 bp, Homo sapiens
aattgtaaatcctgtgtttc

SEQ ID NO: 4626130 - DNA, 13 bp, Homo sapiens
aattgttcctctt

SEQ ID NO: 4626131 - DNA, 19 bp, Homo sapiens
aattgttttacctgttctg

SEQ ID NO: 4626132 - DNA, 18 bp, Homo sapiens
aatttaaaaacttaaata

SEQ ID NO: 4626133 - DNA, 14 bp, Homo sapiens
aatttaatactttt

SEQ ID NO: 4626134 - DNA, 15 bp, Homo sapiens
aatttaatacttttc

SEQ ID NO: 4626135 - DNA, 17 bp, Homo sapiens
aatttactttgtagact

SEQ ID NO: 4626136 - DNA, 16 bp, Homo sapiens
aatttatattatccat

SEQ ID NO: 4626137 - DNA, 16 bp, Homo sapiens
aatttcaaaatacatt

SEQ ID NO: 4626138 - DNA, 22 bp, Homo sapiens
aatttcaaaatacatttgtaag

SEQ ID NO: 4626139 - DNA, 12 bp, Homo sapiens
aatttcattgca

SEQ ID NO: 4626140 - DNA, 15 bp, Homo sapiens
aatttcattgcactt

SEQ ID NO: 4626141 - DNA, 22 bp, Homo sapiens
aatttcattgcactttcctttc

SEQ ID NO: 4626142 - DNA, 22 bp, Homo sapiens
aatttcctggtgtgaaggtcct

SEQ ID NO: 4626143 - DNA, 16 bp, Homo sapiens
aatttgactaatttta

SEQ ID NO: 4626144 - DNA, 17 bp, Homo sapiens
aatttgactaattttac

SEQ ID NO: 4626145 - DNA, 15 bp, Homo sapiens
aatttgcatccagca

SEQ ID NO: 4626146 - DNA, 18 bp, Homo sapiens
aatttggcttctgttgtc

SEQ ID NO: 4626147 - DNA, 23 bp, Homo sapiens
aatttgtaaaaacagcattgctt

SEQ ID NO: 4626148 - DNA, 14 bp, Homo sapiens
aatttgtaaacttc

SEQ ID NO: 4626149 - DNA, 16 bp, Homo sapiens
aatttgtaaacttctg

SEQ ID NO: 4626150 - DNA, 16 bp, Homo sapiens
aattttaatgctgttt

SEQ ID NO: 4626151 - DNA, 14 bp, Homo sapiens
aattttatttttct

SEQ ID NO: 4626152 - DNA, 14 bp, Homo sapiens
aattttcaaggcct

SEQ ID NO: 4626153 - DNA, 12 bp, Homo sapiens
aattttcagcat

SEQ ID NO: 4626154 - DNA, 11 bp, Homo sapiens
aattttgcata

SEQ ID NO: 4626155 - DNA, 19 bp, Homo sapiens
aatttttaaaaatacactt

SEQ ID NO: 4626156 - DNA, 21 bp, Homo sapiens
aatttttcttttcttgatttt

SEQ ID NO: 4626157 - DNA, 12 bp, Homo sapiens
aatttttgtatt

SEQ ID NO: 4626158 - DNA, 17 bp, Homo sapiens
aatttttgtattatttt

SEQ ID NO: 4626159 - DNA, 17 bp, Homo sapiens
aatttttgtctcagaag

SEQ ID NO: 4626160 - DNA, 13 bp, Homo sapiens
aattttttttcat

SEQ ID NO: 4626161 - DNA, 14 bp, Homo sapiens
aattttttttcatg

SEQ ID NO: 4626162 - DNA, 14 bp, Homo sapiens
acaaaaaatgtaat

SEQ ID NO: 4626163 - DNA, 14 bp, Homo sapiens
acaaaaaatgtttt

SEQ ID NO: 4626164 - DNA, 19 bp, Homo sapiens
acaaaactgttcttttgca

SEQ ID NO: 4626165 - DNA, 12 bp, Homo sapiens
acaaaacttctt

SEQ ID NO: 4626166 - DNA, 18 bp, Homo sapiens
acaaaacttcttgtcaga

SEQ ID NO: 4626167 - DNA, 19 bp, Homo sapiens
acaaaacttcttgtcagac

SEQ ID NO: 4626168 - DNA, 20 bp, Homo sapiens
acaaaacttcttgtcagaca

SEQ ID NO: 4626169 - DNA, 14 bp, Homo sapiens
acaaaacttgaaag

SEQ ID NO: 4626170 - DNA, 21 bp, Homo sapiens
acaaaagtctgtctttcctga

SEQ ID NO: 4626171 - DNA, 20 bp, Homo sapiens
acaaaatccagctatgaata

SEQ ID NO: 4626172 - DNA, 17 bp, Homo sapiens
acaaaatgttttttgat

SEQ ID NO: 4626173 - DNA, 23 bp, Homo sapiens
acaaacctgaaaagatgttgtgt

SEQ ID NO: 4626174 - DNA, 19 bp, Homo sapiens
acaaactgaagataatgaa

SEQ ID NO: 4626175 - DNA, 17 bp, Homo sapiens
acaaagacaaaagtctg

SEQ ID NO: 4626176 - DNA, 12 bp, Homo sapiens
acaaagcagcca

SEQ ID NO: 4626177 - DNA, 13 bp, Homo sapiens
acaaagcagccac

SEQ ID NO: 4626178 - DNA, 14 bp, Homo sapiens
acaaagcagccacg

SEQ ID NO: 4626179 - DNA, 13 bp, Homo sapiens
acaaaggagcctg

SEQ ID NO: 4626180 - DNA, 15 bp, Homo sapiens
acaaaggagcctgtg

SEQ ID NO: 4626181 - DNA, 16 bp, Homo sapiens
acaaaggagcctgtga

SEQ ID NO: 4626182 - DNA, 20 bp, Homo sapiens
acaaatacaaagtggaaact

SEQ ID NO: 4626183 - DNA, 19 bp, Homo sapiens
acaaatacatgtgtatatt

SEQ ID NO: 4626184 - DNA, 13 bp, Homo sapiens
acaaatcttcagt

SEQ ID NO: 4626185 - DNA, 21 bp, Homo sapiens
acaaatgttcatatttattga

SEQ ID NO: 4626186 - DNA, 19 bp, Homo sapiens
acaaattgactcttattta

SEQ ID NO: 4626187 - DNA, 15 bp, Homo sapiens
acaaatttcattgca

SEQ ID NO: 4626188 - DNA, 16 bp, Homo sapiens
acaaatttcattgcac

SEQ ID NO: 4626189 - DNA, 15 bp, Homo sapiens
acaacaataactttt

SEQ ID NO: 4626190 - DNA, 14 bp, Homo sapiens
acaacaatccttct

SEQ ID NO: 4626191 - DNA, 18 bp, Homo sapiens
acaacaattggtaaaact

SEQ ID NO: 4626192 - DNA, 14 bp, Homo sapiens
acaacagcacacag

SEQ ID NO: 4626193 - DNA, 16 bp, Homo sapiens
acaacagctgaagcac

SEQ ID NO: 4626194 - DNA, 18 bp, Homo sapiens
acaaccagaaggccctta

SEQ ID NO: 4626195 - DNA, 16 bp, Homo sapiens
acaacgtgagagaaag

SEQ ID NO: 4626196 - DNA, 11 bp, Homo sapiens
acaagaaatgg

SEQ ID NO: 4626197 - DNA, 11 bp, Homo sapiens
acaagaatgtc

SEQ ID NO: 4626198 - DNA, 19 bp, Homo sapiens
acaagacagaggggagcag

SEQ ID NO: 4626199 - DNA, 23 bp, Homo sapiens
acaagacagaggggagcagtggc

SEQ ID NO: 4626200 - DNA, 19 bp, Homo sapiens
acaagaccccgtctcaaaa

SEQ ID NO: 4626201 - DNA, 14 bp, Homo sapiens
acaagataccaggc

SEQ ID NO: 4626202 - DNA, 14 bp, Homo sapiens
acaagcagcccttg

SEQ ID NO: 4626203 - DNA, 20 bp, Homo sapiens
acaagctggccaaagtcact

SEQ ID NO: 4626204 - DNA, 23 bp, Homo sapiens
acaagctggccaaagtcacttcc

SEQ ID NO: 4626205 - DNA, 15 bp, Homo sapiens
acaaggcagcaaggc

SEQ ID NO: 4626206 - DNA, 16 bp, Homo sapiens
acaaggcagcaaggcc

SEQ ID NO: 4626207 - DNA, 21 bp, Homo sapiens
acaaggcagcaaggcccgagc

SEQ ID NO: 4626208 - DNA, 11 bp, Homo sapiens
acaaggcctgg

SEQ ID NO: 4626209 - DNA, 15 bp, Homo sapiens
acaaggcctggtctg

SEQ ID NO: 4626210 - DNA, 15 bp, Homo sapiens
acaaggctgttgcat

SEQ ID NO: 4626211 - DNA, 21 bp, Homo sapiens
acaaggtaggctgcaaaatta

SEQ ID NO: 4626212 - DNA, 12 bp, Homo sapiens
acaaggtgctaa

SEQ ID NO: 4626213 - DNA, 15 bp, Homo sapiens
acaaggtgctaacat

SEQ ID NO: 4626214 - DNA, 15 bp, Homo sapiens
acaagtatataattt

SEQ ID NO: 4626215 - DNA, 16 bp, Homo sapiens
acaagtatttattccc

SEQ ID NO: 4626216 - DNA, 17 bp, Homo sapiens
acaagtatttattccca

SEQ ID NO: 4626217 - DNA, 15 bp, Homo sapiens
acaagtgctcctgaa

SEQ ID NO: 4626218 - DNA, 17 bp, Homo sapiens
acaagtggatgttttta

SEQ ID NO: 4626219 - DNA, 22 bp, Homo sapiens
acaataaaattttttttcatgt

SEQ ID NO: 4626220 - DNA, 19 bp, Homo sapiens
acaataacccagttacttt

SEQ ID NO: 4626221 - DNA, 20 bp, Homo sapiens
acaataacccagttactttt

SEQ ID NO: 4626222 - DNA, 21 bp, Homo sapiens
acaataagcgttaagggcaga

SEQ ID NO: 4626223 - DNA, 21 bp, Homo sapiens
acaataattctggagatactg

SEQ ID NO: 4626224 - DNA, 23 bp, Homo sapiens
acaatagttcttagctttgaaac

SEQ ID NO: 4626225 - DNA, 16 bp, Homo sapiens
acaatcacattaacat

SEQ ID NO: 4626226 - DNA, 16 bp, Homo sapiens
acaatcactaaacttt

SEQ ID NO: 4626227 - DNA, 20 bp, Homo sapiens
acaatcactaaactttattt

SEQ ID NO: 4626228 - DNA, 18 bp, Homo sapiens
acaatccatgtgattaat

SEQ ID NO: 4626229 - DNA, 23 bp, Homo sapiens
acaatccatgtgattaatgtttt

SEQ ID NO: 4626230 - DNA, 15 bp, Homo sapiens
acaatccgagcagtg

SEQ ID NO: 4626231 - DNA, 16 bp, Homo sapiens
acaatcctagtgcttt

SEQ ID NO: 4626232 - DNA, 17 bp, Homo sapiens
acaatcctagtgctttc

SEQ ID NO: 4626233 - DNA, 17 bp, Homo sapiens
acaatctatggcttatt

SEQ ID NO: 4626234 - DNA, 12 bp, Homo sapiens
acaatcttggga

SEQ ID NO: 4626235 - DNA, 21 bp, Homo sapiens
acaatgttgtcctcctgttca

SEQ ID NO: 4626236 - DNA, 15 bp, Homo sapiens
acaattcctgtgctc

SEQ ID NO: 4626237 - DNA, 15 bp, Homo sapiens
acaattctgttttta

SEQ ID NO: 4626238 - DNA, 17 bp, Homo sapiens
acaattctgtttttaat

SEQ ID NO: 4626239 - DNA, 21 bp, Homo sapiens
acaattctgtttttaatgcta

SEQ ID NO: 4626240 - DNA, 15 bp, Homo sapiens
acaattggtaaaact

SEQ ID NO: 4626241 - DNA, 22 bp, Homo sapiens
acaattggtaaaactcactgtg

SEQ ID NO: 4626242 - DNA, 22 bp, Homo sapiens
acaatttggtcttagctttaca

SEQ ID NO: 4626243 - DNA, 23 bp, Homo sapiens
acaatttggtcttagctttacat

SEQ ID NO: 4626244 - DNA, 17 bp, Homo sapiens
acacaaagagatattta

SEQ ID NO: 4626245 - DNA, 13 bp, Homo sapiens
acacaaaggaagt

SEQ ID NO: 4626246 - DNA, 22 bp, Homo sapiens
acacacccatgtaaccactgca

SEQ ID NO: 4626247 - DNA, 13 bp, Homo sapiens
acacactgttgtt

SEQ ID NO: 4626248 - DNA, 14 bp, Homo sapiens
acacagaaaccaat

SEQ ID NO: 4626249 - DNA, 13 bp, Homo sapiens
acacagcatgggt

SEQ ID NO: 4626250 - DNA, 17 bp, Homo sapiens
acacagctgagcactta

SEQ ID NO: 4626251 - DNA, 16 bp, Homo sapiens
acacaggcagccagcc

SEQ ID NO: 4626252 - DNA, 23 bp, Homo sapiens
acacaggcatttcctgggtggct

SEQ ID NO: 4626253 - DNA, 12 bp, Homo sapiens
acacaggcctgt

SEQ ID NO: 4626254 - DNA, 22 bp, Homo sapiens
acacaggcctgtgtagctgtga

SEQ ID NO: 4626255 - DNA, 11 bp, Homo sapiens
acacagggcag

SEQ ID NO: 4626256 - DNA, 11 bp, Homo sapiens
acacagggcct

SEQ ID NO: 4626257 - DNA, 14 bp, Homo sapiens
acacagggcctgct

SEQ ID NO: 4626258 - DNA, 22 bp, Homo sapiens
acacagtgaaacgcaattttac

SEQ ID NO: 4626259 - DNA, 22 bp, Homo sapiens
acacagtgctgaccagacagcc

SEQ ID NO: 4626260 - DNA, 20 bp, Homo sapiens
acacagtgtgaataaagtgc

SEQ ID NO: 4626261 - DNA, 15 bp, Homo sapiens
acacagttcctggga

SEQ ID NO: 4626262 - DNA, 18 bp, Homo sapiens
acacagttcctgggaaca

SEQ ID NO: 4626263 - DNA, 17 bp, Homo sapiens
acacatgctatgttctg

SEQ ID NO: 4626264 - DNA, 22 bp, Homo sapiens
acacattgactcctttccaata

SEQ ID NO: 4626265 - DNA, 19 bp, Homo sapiens
acacattggaattgatgtc

SEQ ID NO: 4626266 - DNA, 14 bp, Homo sapiens
acacatttaattca

SEQ ID NO: 4626267 - DNA, 19 bp, Homo sapiens
acacatttttaaattgtta

SEQ ID NO: 4626268 - DNA, 14 bp, Homo sapiens
acaccaagcacagc

SEQ ID NO: 4626269 - DNA, 21 bp, Homo sapiens
acaccaagcacagcagcctgg

SEQ ID NO: 4626270 - DNA, 13 bp, Homo sapiens
acaccaaggccct

SEQ ID NO: 4626271 - DNA, 15 bp, Homo sapiens
acaccacttaatctt

SEQ ID NO: 4626272 - DNA, 15 bp, Homo sapiens
acacccaccccctgc

SEQ ID NO: 4626273 - DNA, 11 bp, Homo sapiens
acacccaggaa

SEQ ID NO: 4626274 - DNA, 13 bp, Homo sapiens
acaccctggcctg

SEQ ID NO: 4626275 - DNA, 14 bp, Homo sapiens
acaccctggcctga

SEQ ID NO: 4626276 - DNA, 18 bp, Homo sapiens
acaccgttcattcaggca

SEQ ID NO: 4626277 - DNA, 19 bp, Homo sapiens
acacgagccacaagctgca

SEQ ID NO: 4626278 - DNA, 20 bp, Homo sapiens
acacggccacatcaaagagg

SEQ ID NO: 4626279 - DNA, 14 bp, Homo sapiens
acactaaccaaatc

SEQ ID NO: 4626280 - DNA, 20 bp, Homo sapiens
acactacattttttctaata

SEQ ID NO: 4626281 - DNA, 22 bp, Homo sapiens
acactccaccctccaccttcca

SEQ ID NO: 4626282 - DNA, 15 bp, Homo sapiens
acactcccccctcca

SEQ ID NO: 4626283 - DNA, 17 bp, Homo sapiens
acactcccccctccatt

SEQ ID NO: 4626284 - DNA, 14 bp, Homo sapiens
acactctcttctcc

SEQ ID NO: 4626285 - DNA, 23 bp, Homo sapiens
acactctcttctccattccctag

SEQ ID NO: 4626286 - DNA, 15 bp, Homo sapiens
acactgataaaagtt

SEQ ID NO: 4626287 - DNA, 14 bp, Homo sapiens
acactgcagacttg

SEQ ID NO: 4626288 - DNA, 17 bp, Homo sapiens
acacttcgctcttgagg

SEQ ID NO: 4626289 - DNA, 16 bp, Homo sapiens
acacttctcaggacac

SEQ ID NO: 4626290 - DNA, 22 bp, Homo sapiens
acacttctcaggacacaggcct

SEQ ID NO: 4626291 - DNA, 20 bp, Homo sapiens
acactttttacagcagcaat

SEQ ID NO: 4626292 - DNA, 22 bp, Homo sapiens
acactttttacagcagcaatat

SEQ ID NO: 4626293 - DNA, 17 bp, Homo sapiens
acagaaaatacgagaaa

SEQ ID NO: 4626294 - DNA, 17 bp, Homo sapiens
acagaaaatttaactta

SEQ ID NO: 4626295 - DNA, 21 bp, Homo sapiens
acagaaaccaagagacacaat

SEQ ID NO: 4626296 - DNA, 16 bp, Homo sapiens
acagaaactatatgca

SEQ ID NO: 4626297 - DNA, 15 bp, Homo sapiens
acagaaatggactgg

SEQ ID NO: 4626298 - DNA, 14 bp, Homo sapiens
acagaacaggaggt

SEQ ID NO: 4626299 - DNA, 23 bp, Homo sapiens
acagaacaggaggtgtgaatgca

SEQ ID NO: 4626300 - DNA, 15 bp, Homo sapiens
acagaacagggtcat

SEQ ID NO: 4626301 - DNA, 17 bp, Homo sapiens
acagaaccttgttattt

SEQ ID NO: 4626302 - DNA, 16 bp, Homo sapiens
acagaactggaggcag

SEQ ID NO: 4626303 - DNA, 16 bp, Homo sapiens
acagaagcctgtttca

SEQ ID NO: 4626304 - DNA, 23 bp, Homo sapiens
acagaagtgaggatgagacccag

SEQ ID NO: 4626305 - DNA, 18 bp, Homo sapiens
acagacaaagcataatca

SEQ ID NO: 4626306 - DNA, 13 bp, Homo sapiens
acagacaagcagc

SEQ ID NO: 4626307 - DNA, 16 bp, Homo sapiens
acagacccctgggagc

SEQ ID NO: 4626308 - DNA, 16 bp, Homo sapiens
acagacctaatatcat

SEQ ID NO: 4626309 - DNA, 18 bp, Homo sapiens
acagacctaatatcattt

SEQ ID NO: 4626310 - DNA, 22 bp, Homo sapiens
acagacctaatatcattttatt

SEQ ID NO: 4626311 - DNA, 18 bp, Homo sapiens
acagacgagacaacagca

SEQ ID NO: 4626312 - DNA, 20 bp, Homo sapiens
acagactgttgtccctgcac

SEQ ID NO: 4626313 - DNA, 13 bp, Homo sapiens
acagagagaatga

SEQ ID NO: 4626314 - DNA, 22 bp, Homo sapiens
acagaggacccttacgtgagaa

SEQ ID NO: 4626315 - DNA, 23 bp, Homo sapiens
acagaggcgaggggacagcccag

SEQ ID NO: 4626316 - DNA, 14 bp, Homo sapiens
acagagggagttta

SEQ ID NO: 4626317 - DNA, 22 bp, Homo sapiens
acagataaagaaactgaggccc

SEQ ID NO: 4626318 - DNA, 15 bp, Homo sapiens
acagataataatggg

SEQ ID NO: 4626319 - DNA, 22 bp, Homo sapiens
acagataataatgggtttcttt

SEQ ID NO: 4626320 - DNA, 19 bp, Homo sapiens
acagatagatgttgctctt

SEQ ID NO: 4626321 - DNA, 15 bp, Homo sapiens
acagatcaagctgtg

SEQ ID NO: 4626322 - DNA, 16 bp, Homo sapiens
acagatcaagctgtga

SEQ ID NO: 4626323 - DNA, 20 bp, Homo sapiens
acagatgtaaaagacttttt

SEQ ID NO: 4626324 - DNA, 23 bp, Homo sapiens
acagattaacctgaaagaacata

SEQ ID NO: 4626325 - DNA, 20 bp, Homo sapiens
acagattatcacattaattt

SEQ ID NO: 4626326 - DNA, 21 bp, Homo sapiens
acagattatcacattaattta

SEQ ID NO: 4626327 - DNA, 16 bp, Homo sapiens
acagatttttttgtaa

SEQ ID NO: 4626328 - DNA, 13 bp, Homo sapiens
acagcaaaccctg

SEQ ID NO: 4626329 - DNA, 18 bp, Homo sapiens
acagcactactgggtgtc

SEQ ID NO: 4626330 - DNA, 19 bp, Homo sapiens
acagcactactgggtgtca

SEQ ID NO: 4626331 - DNA, 20 bp, Homo sapiens
acagcactactgggtgtcat

SEQ ID NO: 4626332 - DNA, 22 bp, Homo sapiens
acagcactactgggtgtcattt

SEQ ID NO: 4626333 - DNA, 12 bp, Homo sapiens
acagcagcaata

SEQ ID NO: 4626334 - DNA, 16 bp, Homo sapiens
acagcagcaatatttt

SEQ ID NO: 4626335 - DNA, 12 bp, Homo sapiens
acagcattgctt

SEQ ID NO: 4626336 - DNA, 13 bp, Homo sapiens
acagcattgcttt

SEQ ID NO: 4626337 - DNA, 21 bp, Homo sapiens
acagccaacacgcacctgcct

SEQ ID NO: 4626338 - DNA, 13 bp, Homo sapiens
acagccaagtgcc

SEQ ID NO: 4626339 - DNA, 18 bp, Homo sapiens
acagccaagtgccaaatg

SEQ ID NO: 4626340 - DNA, 14 bp, Homo sapiens
acagccagcaagag

SEQ ID NO: 4626341 - DNA, 18 bp, Homo sapiens
acagcccagcgccatcct

SEQ ID NO: 4626342 - DNA, 19 bp, Homo sapiens
acagcccagcgccatcctg

SEQ ID NO: 4626343 - DNA, 21 bp, Homo sapiens
acagcctaaagctaaaaatat

SEQ ID NO: 4626344 - DNA, 12 bp, Homo sapiens
acagcctcaccc

SEQ ID NO: 4626345 - DNA, 17 bp, Homo sapiens
acagcctcacccctgcc

SEQ ID NO: 4626346 - DNA, 18 bp, Homo sapiens
acagcctgtgtctttaaa

SEQ ID NO: 4626347 - DNA, 21 bp, Homo sapiens
acagccttccctctgcattga

SEQ ID NO: 4626348 - DNA, 12 bp, Homo sapiens
acagctcagcag

SEQ ID NO: 4626349 - DNA, 17 bp, Homo sapiens
acagctcagccagtggg

SEQ ID NO: 4626350 - DNA, 20 bp, Homo sapiens
acagctcagccagtggggat

SEQ ID NO: 4626351 - DNA, 17 bp, Homo sapiens
acagctgactgaatgca

SEQ ID NO: 4626352 - DNA, 18 bp, Homo sapiens
acagctgactgaatgcag

SEQ ID NO: 4626353 - DNA, 14 bp, Homo sapiens
acagctgagcactt

SEQ ID NO: 4626354 - DNA, 17 bp, Homo sapiens
acagctgagttgttgag

SEQ ID NO: 4626355 - DNA, 22 bp, Homo sapiens
acagctggaggaatacatttta

SEQ ID NO: 4626356 - DNA, 17 bp, Homo sapiens
acagctgtgcctcgctc

SEQ ID NO: 4626357 - DNA, 12 bp, Homo sapiens
acagctgtttga

SEQ ID NO: 4626358 - DNA, 16 bp, Homo sapiens
acagctgtttgaaatg

SEQ ID NO: 4626359 - DNA, 13 bp, Homo sapiens
acagcttcagcta

SEQ ID NO: 4626360 - DNA, 22 bp, Homo sapiens
acagcttgctgtcacttcttca

SEQ ID NO: 4626361 - DNA, 15 bp, Homo sapiens
acagcttttcttgat

SEQ ID NO: 4626362 - DNA, 16 bp, Homo sapiens
acagcttttcttgata

SEQ ID NO: 4626363 - DNA, 12 bp, Homo sapiens
acaggaaaagag

SEQ ID NO: 4626364 - DNA, 22 bp, Homo sapiens
acaggacatgcggtagccagca

SEQ ID NO: 4626365 - DNA, 14 bp, Homo sapiens
acaggaccacctcc

SEQ ID NO: 4626366 - DNA, 16 bp, Homo sapiens
acaggaccctcaggaa

SEQ ID NO: 4626367 - DNA, 21 bp, Homo sapiens
acaggactaacactcagaagc

SEQ ID NO: 4626368 - DNA, 18 bp, Homo sapiens
acaggactggttccttcc

SEQ ID NO: 4626369 - DNA, 14 bp, Homo sapiens
acaggagctacctg

SEQ ID NO: 4626370 - DNA, 23 bp, Homo sapiens
acaggagctacctgtgtggacag

SEQ ID NO: 4626371 - DNA, 19 bp, Homo sapiens
acaggaggtgtgaatgcac

SEQ ID NO: 4626372 - DNA, 13 bp, Homo sapiens
acaggatgaggtc

SEQ ID NO: 4626373 - DNA, 12 bp, Homo sapiens
acaggcactcca

SEQ ID NO: 4626374 - DNA, 16 bp, Homo sapiens
acaggcagcctggaca

SEQ ID NO: 4626375 - DNA, 22 bp, Homo sapiens
acaggcagcctggacatagaga

SEQ ID NO: 4626376 - DNA, 18 bp, Homo sapiens
acaggcatttcctgggtg

SEQ ID NO: 4626377 - DNA, 18 bp, Homo sapiens
acaggctacaaagcagag

SEQ ID NO: 4626378 - DNA, 12 bp, Homo sapiens
acaggctgaaga

SEQ ID NO: 4626379 - DNA, 15 bp, Homo sapiens
acaggctgagaactc

SEQ ID NO: 4626380 - DNA, 15 bp, Homo sapiens
acagggaaggcaggc

SEQ ID NO: 4626381 - DNA, 21 bp, Homo sapiens
acagggaaggcaggcagggct

SEQ ID NO: 4626382 - DNA, 22 bp, Homo sapiens
acagggaaggcaggcagggctc

SEQ ID NO: 4626383 - DNA, 23 bp, Homo sapiens
acagggaaggcaggcagggctct

SEQ ID NO: 4626384 - DNA, 23 bp, Homo sapiens
acagggccagtggggcctgtgga

SEQ ID NO: 4626385 - DNA, 16 bp, Homo sapiens
acagggctcatttttg

SEQ ID NO: 4626386 - DNA, 17 bp, Homo sapiens
acaggggccagaagatg

SEQ ID NO: 4626387 - DNA, 23 bp, Homo sapiens
acaggggccagaagatgaacaga

SEQ ID NO: 4626388 - DNA, 17 bp, Homo sapiens
acaggtattttgtttct

SEQ ID NO: 4626389 - DNA, 21 bp, Homo sapiens
acaggtcaccattatgctggt

SEQ ID NO: 4626390 - DNA, 16 bp, Homo sapiens
acaggtgtgtgggcca

SEQ ID NO: 4626391 - DNA, 20 bp, Homo sapiens
acaggttcttaaaaaggaac

SEQ ID NO: 4626392 - DNA, 21 bp, Homo sapiens
acaggttcttaaaaaggaaca

SEQ ID NO: 4626393 - DNA, 13 bp, Homo sapiens
acagtaatgaaat

SEQ ID NO: 4626394 - DNA, 18 bp, Homo sapiens
acagtagaactgtctgtg

SEQ ID NO: 4626395 - DNA, 13 bp, Homo sapiens
acagtagctctta

SEQ ID NO: 4626396 - DNA, 12 bp, Homo sapiens
acagtatttcca

SEQ ID NO: 4626397 - DNA, 12 bp, Homo sapiens
acagtcacctca

SEQ ID NO: 4626398 - DNA, 15 bp, Homo sapiens
acagtcacctcacaa

SEQ ID NO: 4626399 - DNA, 16 bp, Homo sapiens
acagtcactaatatag

SEQ ID NO: 4626400 - DNA, 18 bp, Homo sapiens
acagtcatcatcagggcc

SEQ ID NO: 4626401 - DNA, 17 bp, Homo sapiens
acagtgaatattgcttt

SEQ ID NO: 4626402 - DNA, 14 bp, Homo sapiens
acagtgccatcccc

SEQ ID NO: 4626403 - DNA, 20 bp, Homo sapiens
acagtgctgaccagacagcc

SEQ ID NO: 4626404 - DNA, 20 bp, Homo sapiens
acagtggcaggacaggaaaa

SEQ ID NO: 4626405 - DNA, 14 bp, Homo sapiens
acagtgggaaatat

SEQ ID NO: 4626406 - DNA, 14 bp, Homo sapiens
acagtgggagctga

SEQ ID NO: 4626407 - DNA, 17 bp, Homo sapiens
acagtgggagctgagct

SEQ ID NO: 4626408 - DNA, 18 bp, Homo sapiens
acagtgggagctgagctg

SEQ ID NO: 4626409 - DNA, 16 bp, Homo sapiens
acagtggttgcctggg

SEQ ID NO: 4626410 - DNA, 13 bp, Homo sapiens
acagtgtacagtc

SEQ ID NO: 4626411 - DNA, 13 bp, Homo sapiens
acagtgtatgggg

SEQ ID NO: 4626412 - DNA, 13 bp, Homo sapiens
acagttcctggga

SEQ ID NO: 4626413 - DNA, 21 bp, Homo sapiens
acagttcctgggaacatcaca

SEQ ID NO: 4626414 - DNA, 15 bp, Homo sapiens
acagttgaattttaa

SEQ ID NO: 4626415 - DNA, 20 bp, Homo sapiens
acagttgtgataatagcatt

SEQ ID NO: 4626416 - DNA, 13 bp, Homo sapiens
acagtttcatcta

SEQ ID NO: 4626417 - DNA, 14 bp, Homo sapiens
acagtttccaaatt

SEQ ID NO: 4626418 - DNA, 13 bp, Homo sapiens
acataaaatttaa

SEQ ID NO: 4626419 - DNA, 17 bp, Homo sapiens
acataagctaaatcata

SEQ ID NO: 4626420 - DNA, 23 bp, Homo sapiens
acataagctaaatcatattagta

SEQ ID NO: 4626421 - DNA, 13 bp, Homo sapiens
acatacaagaaaa

SEQ ID NO: 4626422 - DNA, 16 bp, Homo sapiens
acatacaagaaaatgt

SEQ ID NO: 4626423 - DNA, 15 bp, Homo sapiens
acatacagagtgggc

SEQ ID NO: 4626424 - DNA, 23 bp, Homo sapiens
acatacagagtgggccccgggct

SEQ ID NO: 4626425 - DNA, 19 bp, Homo sapiens
acatacatgatacattttt

SEQ ID NO: 4626426 - DNA, 19 bp, Homo sapiens
acatacgggctttaatagt

SEQ ID NO: 4626427 - DNA, 12 bp, Homo sapiens
acatagaaatgg

SEQ ID NO: 4626428 - DNA, 22 bp, Homo sapiens
acatagaaatggaaattttgct

SEQ ID NO: 4626429 - DNA, 23 bp, Homo sapiens
acatagagagggagaagaagtca

SEQ ID NO: 4626430 - DNA, 19 bp, Homo sapiens
acataggtcataaagcatt

SEQ ID NO: 4626431 - DNA, 21 bp, Homo sapiens
acatataaagcactatacaga

SEQ ID NO: 4626432 - DNA, 15 bp, Homo sapiens
acatatataaaacta

SEQ ID NO: 4626433 - DNA, 21 bp, Homo sapiens
acatatatttttaaaaaatga

SEQ ID NO: 4626434 - DNA, 14 bp, Homo sapiens
acatatcagaatag

SEQ ID NO: 4626435 - DNA, 19 bp, Homo sapiens
acatatgcaccttgtgtct

SEQ ID NO: 4626436 - DNA, 23 bp, Homo sapiens
acatatggactctgcacatgaat

SEQ ID NO: 4626437 - DNA, 23 bp, Homo sapiens
acatatgtcttactactttaaat

SEQ ID NO: 4626438 - DNA, 19 bp, Homo sapiens
acatatttatataacgtga

SEQ ID NO: 4626439 - DNA, 12 bp, Homo sapiens
acatatttcatt

SEQ ID NO: 4626440 - DNA, 16 bp, Homo sapiens
acatatttcattttaa

SEQ ID NO: 4626441 - DNA, 23 bp, Homo sapiens
acatatttcattttaacatgatt

SEQ ID NO: 4626442 - DNA, 21 bp, Homo sapiens
acatatttgatagatttttct

SEQ ID NO: 4626443 - DNA, 21 bp, Homo sapiens
acatcaattaattaaatgaac

SEQ ID NO: 4626444 - DNA, 15 bp, Homo sapiens
acatcaccagtgcca

SEQ ID NO: 4626445 - DNA, 13 bp, Homo sapiens
acatcatgagcct

SEQ ID NO: 4626446 - DNA, 17 bp, Homo sapiens
acatcattgtcagcctt

SEQ ID NO: 4626447 - DNA, 16 bp, Homo sapiens
acatccaaagcagaca

SEQ ID NO: 4626448 - DNA, 17 bp, Homo sapiens
acatccaaagcagacag

SEQ ID NO: 4626449 - DNA, 15 bp, Homo sapiens
acatccacacacagt

SEQ ID NO: 4626450 - DNA, 18 bp, Homo sapiens
acatccagagatgactat

SEQ ID NO: 4626451 - DNA, 15 bp, Homo sapiens
acatccattctacat

SEQ ID NO: 4626452 - DNA, 15 bp, Homo sapiens
acatccctgggcctg

SEQ ID NO: 4626453 - DNA, 20 bp, Homo sapiens
acatccctgggcctgctgct

SEQ ID NO: 4626454 - DNA, 21 bp, Homo sapiens
acatcccttattagttacaaa

SEQ ID NO: 4626455 - DNA, 22 bp, Homo sapiens
acatcctctgatagctgtttca

SEQ ID NO: 4626456 - DNA, 16 bp, Homo sapiens
acatctatagagataa

SEQ ID NO: 4626457 - DNA, 18 bp, Homo sapiens
acatctcccttccacctc

SEQ ID NO: 4626458 - DNA, 13 bp, Homo sapiens
acatctcttgaaa

SEQ ID NO: 4626459 - DNA, 21 bp, Homo sapiens
acatctcttgaaacctgttaa

SEQ ID NO: 4626460 - DNA, 23 bp, Homo sapiens
acatctctttgaattttctgtgt

SEQ ID NO: 4626461 - DNA, 17 bp, Homo sapiens
acatctgcacactctct

SEQ ID NO: 4626462 - DNA, 22 bp, Homo sapiens
acatctgcacactctcttctcc

SEQ ID NO: 4626463 - DNA, 21 bp, Homo sapiens
acatgacatccagagatgact

SEQ ID NO: 4626464 - DNA, 23 bp, Homo sapiens
acatgagatcagggcctgccccc

SEQ ID NO: 4626465 - DNA, 19 bp, Homo sapiens
acatgagttcaaatacttt

SEQ ID NO: 4626466 - DNA, 12 bp, Homo sapiens
acatgcaacaga

SEQ ID NO: 4626467 - DNA, 15 bp, Homo sapiens
acatgcaccttgctc

SEQ ID NO: 4626468 - DNA, 18 bp, Homo sapiens
acatgccatttgtactga

SEQ ID NO: 4626469 - DNA, 21 bp, Homo sapiens
acatgccatttgtactgaccc

SEQ ID NO: 4626470 - DNA, 18 bp, Homo sapiens
acatgcggtagccagcac

SEQ ID NO: 4626471 - DNA, 16 bp, Homo sapiens
acatggccagactccc

SEQ ID NO: 4626472 - DNA, 19 bp, Homo sapiens
acatggccagactcccttg

SEQ ID NO: 4626473 - DNA, 21 bp, Homo sapiens
acatggccagactcccttgct

SEQ ID NO: 4626474 - DNA, 20 bp, Homo sapiens
acatgtacactacatttttt

SEQ ID NO: 4626475 - DNA, 13 bp, Homo sapiens
acatgtcttgtac

SEQ ID NO: 4626476 - DNA, 16 bp, Homo sapiens
acatgtcttgtacatg

SEQ ID NO: 4626477 - DNA, 20 bp, Homo sapiens
acatgtgtagcctgtgcatg

SEQ ID NO: 4626478 - DNA, 14 bp, Homo sapiens
acatgtgtgcagag

SEQ ID NO: 4626479 - DNA, 17 bp, Homo sapiens
acatgttaaacttactt

SEQ ID NO: 4626480 - DNA, 14 bp, Homo sapiens
acattaaaataact

SEQ ID NO: 4626481 - DNA, 18 bp, Homo sapiens
acattaaaatgacaaaca

SEQ ID NO: 4626482 - DNA, 19 bp, Homo sapiens
acattaaaatgacaaacat

SEQ ID NO: 4626483 - DNA, 20 bp, Homo sapiens
acattaaaatgacaaacatg

SEQ ID NO: 4626484 - DNA, 16 bp, Homo sapiens
acattaacggtgctaa

SEQ ID NO: 4626485 - DNA, 16 bp, Homo sapiens
acattaactccctcca

SEQ ID NO: 4626486 - DNA, 20 bp, Homo sapiens
acattaactccctccaccag

SEQ ID NO: 4626487 - DNA, 22 bp, Homo sapiens
acattaactccctccaccagcc

SEQ ID NO: 4626488 - DNA, 17 bp, Homo sapiens
acattaatttaattact

SEQ ID NO: 4626489 - DNA, 13 bp, Homo sapiens
acattcacctgcc

SEQ ID NO: 4626490 - DNA, 16 bp, Homo sapiens
acattcagctctggag

SEQ ID NO: 4626491 - DNA, 16 bp, Homo sapiens
acattccatgacgaca

SEQ ID NO: 4626492 - DNA, 11 bp, Homo sapiens
acattctaatg

SEQ ID NO: 4626493 - DNA, 13 bp, Homo sapiens
acattctaatgca

SEQ ID NO: 4626494 - DNA, 15 bp, Homo sapiens
acattctacagttgt

SEQ ID NO: 4626495 - DNA, 17 bp, Homo sapiens
acattctagctgagaag

SEQ ID NO: 4626496 - DNA, 12 bp, Homo sapiens
acattctcacat

SEQ ID NO: 4626497 - DNA, 20 bp, Homo sapiens
acattcttggcttaatcatt

SEQ ID NO: 4626498 - DNA, 22 bp, Homo sapiens
acattcttggcttaatcatttt

SEQ ID NO: 4626499 - DNA, 23 bp, Homo sapiens
acattcttggcttaatcattttc

SEQ ID NO: 4626500 - DNA, 18 bp, Homo sapiens
acattgcactcatcatat

SEQ ID NO: 4626501 - DNA, 23 bp, Homo sapiens
acattggagtctcatttgggcta

SEQ ID NO: 4626502 - DNA, 16 bp, Homo sapiens
acattgtaaatattta

SEQ ID NO: 4626503 - DNA, 22 bp, Homo sapiens
acattgtctcctatatatttct

SEQ ID NO: 4626504 - DNA, 20 bp, Homo sapiens
acattgttctttccggccaa

SEQ ID NO: 4626505 - DNA, 22 bp, Homo sapiens
acatttactttaatttccttga

SEQ ID NO: 4626506 - DNA, 13 bp, Homo sapiens
acatttatatatt

SEQ ID NO: 4626507 - DNA, 15 bp, Homo sapiens
acatttatttttata

SEQ ID NO: 4626508 - DNA, 21 bp, Homo sapiens
acatttcacaggctaatggga

SEQ ID NO: 4626509 - DNA, 15 bp, Homo sapiens
acatttcattgtaca

SEQ ID NO: 4626510 - DNA, 21 bp, Homo sapiens
acatttcattgtacaagtatt

SEQ ID NO: 4626511 - DNA, 18 bp, Homo sapiens
acatttcttaaaacttta

SEQ ID NO: 4626512 - DNA, 20 bp, Homo sapiens
acatttgatgcatgtctttt

SEQ ID NO: 4626513 - DNA, 21 bp, Homo sapiens
acatttggaaaagacagaaaa

SEQ ID NO: 4626514 - DNA, 19 bp, Homo sapiens
acatttggataaacaacat

SEQ ID NO: 4626515 - DNA, 21 bp, Homo sapiens
acatttgggttggttccaagt

SEQ ID NO: 4626516 - DNA, 19 bp, Homo sapiens
acattttatcattaaaaat

SEQ ID NO: 4626517 - DNA, 12 bp, Homo sapiens
acattttctctt

SEQ ID NO: 4626518 - DNA, 16 bp, Homo sapiens
acattttgagctattt

SEQ ID NO: 4626519 - DNA, 20 bp, Homo sapiens
acattttgagctatttcctt

SEQ ID NO: 4626520 - DNA, 22 bp, Homo sapiens
acattttgagctatttccttcc

SEQ ID NO: 4626521 - DNA, 16 bp, Homo sapiens
acattttgtaaaatat

SEQ ID NO: 4626522 - DNA, 15 bp, Homo sapiens
acattttgttgcagg

SEQ ID NO: 4626523 - DNA, 13 bp, Homo sapiens
accaacctgacct

SEQ ID NO: 4626524 - DNA, 22 bp, Homo sapiens
accaacctgacctaacctagga

SEQ ID NO: 4626525 - DNA, 20 bp, Homo sapiens
accaagaagcctttcctgta

SEQ ID NO: 4626526 - DNA, 22 bp, Homo sapiens
accaaggccctgcatctgtctg

SEQ ID NO: 4626527 - DNA, 17 bp, Homo sapiens
accaatattgtacagtt

SEQ ID NO: 4626528 - DNA, 19 bp, Homo sapiens
accaatattgtacagtttt

SEQ ID NO: 4626529 - DNA, 21 bp, Homo sapiens
accaatgtacccaccgggcca

SEQ ID NO: 4626530 - DNA, 15 bp, Homo sapiens
accaatgtcataaca

SEQ ID NO: 4626531 - DNA, 17 bp, Homo sapiens
accaattcacccactcc

SEQ ID NO: 4626532 - DNA, 14 bp, Homo sapiens
accacagcaggatc

SEQ ID NO: 4626533 - DNA, 19 bp, Homo sapiens
accacatagcatgaggcca

SEQ ID NO: 4626534 - DNA, 21 bp, Homo sapiens
accacctcctctgccagcagg

SEQ ID NO: 4626535 - DNA, 13 bp, Homo sapiens
accaccttccctt

SEQ ID NO: 4626536 - DNA, 16 bp, Homo sapiens
accaccttcccttcct

SEQ ID NO: 4626537 - DNA, 20 bp, Homo sapiens
accacgaggctgattcctct

SEQ ID NO: 4626538 - DNA, 23 bp, Homo sapiens
accacgctggccaatttttgtac

SEQ ID NO: 4626539 - DNA, 23 bp, Homo sapiens
accacgtctggctccctgcccct

SEQ ID NO: 4626540 - DNA, 15 bp, Homo sapiens
accactcaaaggcca

SEQ ID NO: 4626541 - DNA, 14 bp, Homo sapiens
accactctggcagc

SEQ ID NO: 4626542 - DNA, 16 bp, Homo sapiens
accactctggcagcca

SEQ ID NO: 4626543 - DNA, 18 bp, Homo sapiens
accactctggcagccaca

SEQ ID NO: 4626544 - DNA, 16 bp, Homo sapiens
accactgtgcacttag

SEQ ID NO: 4626545 - DNA, 15 bp, Homo sapiens
accacttaatcttct

SEQ ID NO: 4626546 - DNA, 15 bp, Homo sapiens
accacttcgcacaca

SEQ ID NO: 4626547 - DNA, 20 bp, Homo sapiens
accacttctccatgctgcaa

SEQ ID NO: 4626548 - DNA, 22 bp, Homo sapiens
accagaaggcccttaactatca

SEQ ID NO: 4626549 - DNA, 15 bp, Homo sapiens
accagcccagatgtt

SEQ ID NO: 4626550 - DNA, 19 bp, Homo sapiens
accagcccgacagtgccat

SEQ ID NO: 4626551 - DNA, 21 bp, Homo sapiens
accagcccgacagtgccatcc

SEQ ID NO: 4626552 - DNA, 16 bp, Homo sapiens
accagctgctgtgccc

SEQ ID NO: 4626553 - DNA, 22 bp, Homo sapiens
accaggactagggctggagtga

SEQ ID NO: 4626554 - DNA, 19 bp, Homo sapiens
accaggatggagcaagctc

SEQ ID NO: 4626555 - DNA, 19 bp, Homo sapiens
accaggctggagtgcagtg

SEQ ID NO: 4626556 - DNA, 13 bp, Homo sapiens
accagggatgctg

SEQ ID NO: 4626557 - DNA, 15 bp, Homo sapiens
accagggatgctggg

SEQ ID NO: 4626558 - DNA, 23 bp, Homo sapiens
accagggatgctgggctgggccc

SEQ ID NO: 4626559 - DNA, 20 bp, Homo sapiens
accagggatgtctgttgaaa

SEQ ID NO: 4626560 - DNA, 18 bp, Homo sapiens
accagggctgctctttcc

SEQ ID NO: 4626561 - DNA, 18 bp, Homo sapiens
accaggggaaggaaggag

SEQ ID NO: 4626562 - DNA, 23 bp, Homo sapiens
accaggggaaggaaggagggcac

SEQ ID NO: 4626563 - DNA, 16 bp, Homo sapiens
accaggggaggagcct

SEQ ID NO: 4626564 - DNA, 23 bp, Homo sapiens
accatataaagggggagggaaat

SEQ ID NO: 4626565 - DNA, 17 bp, Homo sapiens
accatatgtccactgtt

SEQ ID NO: 4626566 - DNA, 18 bp, Homo sapiens
accatcttaatctttatt

SEQ ID NO: 4626567 - DNA, 22 bp, Homo sapiens
accatcttaatctttattttat

SEQ ID NO: 4626568 - DNA, 15 bp, Homo sapiens
accattcagtcaagt

SEQ ID NO: 4626569 - DNA, 14 bp, Homo sapiens
accattcctgcctt

SEQ ID NO: 4626570 - DNA, 19 bp, Homo sapiens
accattcctgcctttaagc

SEQ ID NO: 4626571 - DNA, 23 bp, Homo sapiens
accattctaggtgtttcaacaga

SEQ ID NO: 4626572 - DNA, 15 bp, Homo sapiens
accattggaatggac

SEQ ID NO: 4626573 - DNA, 16 bp, Homo sapiens
accatttgtagtgagc

SEQ ID NO: 4626574 - DNA, 17 bp, Homo sapiens
acccaaaagtcacccag

SEQ ID NO: 4626575 - DNA, 16 bp, Homo sapiens
acccaagacatgacat

SEQ ID NO: 4626576 - DNA, 18 bp, Homo sapiens
acccaccgggccactcct

SEQ ID NO: 4626577 - DNA, 23 bp, Homo sapiens
acccaccgggccactccttcctg

SEQ ID NO: 4626578 - DNA, 14 bp, Homo sapiens
acccacctgctagt

SEQ ID NO: 4626579 - DNA, 22 bp, Homo sapiens
acccagacctgttagcagacag

SEQ ID NO: 4626580 - DNA, 22 bp, Homo sapiens
acccagcatctcccagcaagac

SEQ ID NO: 4626581 - DNA, 13 bp, Homo sapiens
acccagccccttc

SEQ ID NO: 4626582 - DNA, 15 bp, Homo sapiens
acccagccccttccc

SEQ ID NO: 4626583 - DNA, 22 bp, Homo sapiens
acccagccccttcccctgggaa

SEQ ID NO: 4626584 - DNA, 15 bp, Homo sapiens
acccaggaaaggagg

SEQ ID NO: 4626585 - DNA, 20 bp, Homo sapiens
acccaggaaaggaggaccag

SEQ ID NO: 4626586 - DNA, 15 bp, Homo sapiens
acccaggaatgaccc

SEQ ID NO: 4626587 - DNA, 14 bp, Homo sapiens
acccaggacaagca

SEQ ID NO: 4626588 - DNA, 16 bp, Homo sapiens
acccaggctggagtgc

SEQ ID NO: 4626589 - DNA, 17 bp, Homo sapiens
acccagggacactccaa

SEQ ID NO: 4626590 - DNA, 19 bp, Homo sapiens
acccagggtggagtgcagt

SEQ ID NO: 4626591 - DNA, 21 bp, Homo sapiens
acccagggtggagtgcagtgg

SEQ ID NO: 4626592 - DNA, 15 bp, Homo sapiens
acccagtagcccaga

SEQ ID NO: 4626593 - DNA, 17 bp, Homo sapiens
acccagtctcctctcca

SEQ ID NO: 4626594 - DNA, 18 bp, Homo sapiens
acccagtctcctctccat

SEQ ID NO: 4626595 - DNA, 21 bp, Homo sapiens
acccagttacttttttacact

SEQ ID NO: 4626596 - DNA, 14 bp, Homo sapiens
acccatatgttaaa

SEQ ID NO: 4626597 - DNA, 21 bp, Homo sapiens
acccatctatacaaaaaattt

SEQ ID NO: 4626598 - DNA, 23 bp, Homo sapiens
acccatgcacactcatgcacaca

SEQ ID NO: 4626599 - DNA, 18 bp, Homo sapiens
acccatgttacttctctg

SEQ ID NO: 4626600 - DNA, 19 bp, Homo sapiens
acccatgttacttctctga

SEQ ID NO: 4626601 - DNA, 18 bp, Homo sapiens
accccaacctctgttccc

SEQ ID NO: 4626602 - DNA, 21 bp, Homo sapiens
accccaaggactgagggcagt

SEQ ID NO: 4626603 - DNA, 15 bp, Homo sapiens
accccacccccaccc

SEQ ID NO: 4626604 - DNA, 16 bp, Homo sapiens
accccacccttgccca

SEQ ID NO: 4626605 - DNA, 18 bp, Homo sapiens
accccacccttgcccacc

SEQ ID NO: 4626606 - DNA, 22 bp, Homo sapiens
accccacccttgcccaccccac

SEQ ID NO: 4626607 - DNA, 14 bp, Homo sapiens
accccagctgctct

SEQ ID NO: 4626608 - DNA, 16 bp, Homo sapiens
accccagggcacagga

SEQ ID NO: 4626609 - DNA, 18 bp, Homo sapiens
accccagggcacaggagc

SEQ ID NO: 4626610 - DNA, 14 bp, Homo sapiens
accccagtcaagct

SEQ ID NO: 4626611 - DNA, 19 bp, Homo sapiens
accccagtcaagctcctag

SEQ ID NO: 4626612 - DNA, 23 bp, Homo sapiens
accccatagggtcggaggtgctg

SEQ ID NO: 4626613 - DNA, 23 bp, Homo sapiens
accccatcacctactcacacagg

SEQ ID NO: 4626614 - DNA, 18 bp, Homo sapiens
acccccacaagctgtccc

SEQ ID NO: 4626615 - DNA, 10 bp, Homo sapiens
acccccacca

SEQ ID NO: 4626616 - DNA, 13 bp, Homo sapiens
acccccagcctgg

SEQ ID NO: 4626617 - DNA, 14 bp, Homo sapiens
acccccagcctggg

SEQ ID NO: 4626618 - DNA, 15 bp, Homo sapiens
acccccagcctgggc

SEQ ID NO: 4626619 - DNA, 13 bp, Homo sapiens
acccccagtcctc

SEQ ID NO: 4626620 - DNA, 18 bp, Homo sapiens
acccccagtcctccctag

SEQ ID NO: 4626621 - DNA, 14 bp, Homo sapiens
acccccagttccta

SEQ ID NO: 4626622 - DNA, 18 bp, Homo sapiens
acccccccccaatcggac

SEQ ID NO: 4626623 - DNA, 12 bp, Homo sapiens
acccccttcccc

SEQ ID NO: 4626624 - DNA, 16 bp, Homo sapiens
accccgcacccggctc

SEQ ID NO: 4626625 - DNA, 13 bp, Homo sapiens
accccggggtgag

SEQ ID NO: 4626626 - DNA, 21 bp, Homo sapiens
accccggggtgcccacaggcc

SEQ ID NO: 4626627 - DNA, 13 bp, Homo sapiens
acccctccactgc

SEQ ID NO: 4626628 - DNA, 14 bp, Homo sapiens
acccctccactgct

SEQ ID NO: 4626629 - DNA, 12 bp, Homo sapiens
acccctccccat

SEQ ID NO: 4626630 - DNA, 18 bp, Homo sapiens
acccctcccctgggactt

SEQ ID NO: 4626631 - DNA, 22 bp, Homo sapiens
acccctcccctgggactttccc

SEQ ID NO: 4626632 - DNA, 14 bp, Homo sapiens
acccctctcgcctc

SEQ ID NO: 4626633 - DNA, 17 bp, Homo sapiens
acccctctcgcctcatt

SEQ ID NO: 4626634 - DNA, 17 bp, Homo sapiens
acccctggccacagcct

SEQ ID NO: 4626635 - DNA, 13 bp, Homo sapiens
acccctgtttctg

SEQ ID NO: 4626636 - DNA, 19 bp, Homo sapiens
accccttaagccctggccc

SEQ ID NO: 4626637 - DNA, 18 bp, Homo sapiens
accccttaatcttgcttt

SEQ ID NO: 4626638 - DNA, 20 bp, Homo sapiens
accccttggaggagagagac

SEQ ID NO: 4626639 - DNA, 16 bp, Homo sapiens
acccggcaccccctgc

SEQ ID NO: 4626640 - DNA, 18 bp, Homo sapiens
acccggcaccccctgcag

SEQ ID NO: 4626641 - DNA, 17 bp, Homo sapiens
acccggctcgtgtattt

SEQ ID NO: 4626642 - DNA, 22 bp, Homo sapiens
acccggctcgtgtatttattac

SEQ ID NO: 4626643 - DNA, 15 bp, Homo sapiens
acccgtccccacacg

SEQ ID NO: 4626644 - DNA, 18 bp, Homo sapiens
acccgtccccacacgagg

SEQ ID NO: 4626645 - DNA, 18 bp, Homo sapiens
acccgtgccaagtccagg

SEQ ID NO: 4626646 - DNA, 15 bp, Homo sapiens
acccgtggaggctgc

SEQ ID NO: 4626647 - DNA, 12 bp, Homo sapiens
acccgttccaaa

SEQ ID NO: 4626648 - DNA, 18 bp, Homo sapiens
accctcatacacagaaac

SEQ ID NO: 4626649 - DNA, 21 bp, Homo sapiens
accctccactcagctgtcctg

SEQ ID NO: 4626650 - DNA, 15 bp, Homo sapiens
accctccagagacaa

SEQ ID NO: 4626651 - DNA, 20 bp, Homo sapiens
accctcccatgagactgccc

SEQ ID NO: 4626652 - DNA, 19 bp, Homo sapiens
accctccccttttttcttc

SEQ ID NO: 4626653 - DNA, 13 bp, Homo sapiens
accctgaggagtc

SEQ ID NO: 4626654 - DNA, 23 bp, Homo sapiens
accctgaggagtctgaggtcctg

SEQ ID NO: 4626655 - DNA, 23 bp, Homo sapiens
accctgaggtcagggagtgctgg

SEQ ID NO: 4626656 - DNA, 22 bp, Homo sapiens
accctgatgcaggtcagcccat

SEQ ID NO: 4626657 - DNA, 20 bp, Homo sapiens
accctgccccccctaagaga

SEQ ID NO: 4626658 - DNA, 11 bp, Homo sapiens
accctgccctg

SEQ ID NO: 4626659 - DNA, 23 bp, Homo sapiens
accctgccctgctctgcccaggc

SEQ ID NO: 4626660 - DNA, 17 bp, Homo sapiens
accctggaaaatgaatc

SEQ ID NO: 4626661 - DNA, 16 bp, Homo sapiens
accctgggctggggag

SEQ ID NO: 4626662 - DNA, 22 bp, Homo sapiens
accctgggctggggaggaggag

SEQ ID NO: 4626663 - DNA, 17 bp, Homo sapiens
accctggtggtatttta

SEQ ID NO: 4626664 - DNA, 21 bp, Homo sapiens
accctggtggtattttatttt

SEQ ID NO: 4626665 - DNA, 15 bp, Homo sapiens
acccttaaaagaagg

SEQ ID NO: 4626666 - DNA, 17 bp, Homo sapiens
acccttattgctgtcct

SEQ ID NO: 4626667 - DNA, 14 bp, Homo sapiens
acccttgctttcct

SEQ ID NO: 4626668 - DNA, 21 bp, Homo sapiens
acccttgggcagagtcctgcc

SEQ ID NO: 4626669 - DNA, 23 bp, Homo sapiens
acccttgggcagagtcctgcctt

SEQ ID NO: 4626670 - DNA, 13 bp, Homo sapiens
acccttttaagca

SEQ ID NO: 4626671 - DNA, 13 bp, Homo sapiens
acccttttccttt

SEQ ID NO: 4626672 - DNA, 18 bp, Homo sapiens
acccttttccttttttgg

SEQ ID NO: 4626673 - DNA, 20 bp, Homo sapiens
accgccacgtcccagcatcc

SEQ ID NO: 4626674 - DNA, 20 bp, Homo sapiens
accgcccagcggcttgcctg

SEQ ID NO: 4626675 - DNA, 20 bp, Homo sapiens
accgcctgaaggcacagcta

SEQ ID NO: 4626676 - DNA, 20 bp, Homo sapiens
accgctacaccactctggca

SEQ ID NO: 4626677 - DNA, 15 bp, Homo sapiens
accggtgcttttatt

SEQ ID NO: 4626678 - DNA, 15 bp, Homo sapiens
accgtaattgctttg

SEQ ID NO: 4626679 - DNA, 17 bp, Homo sapiens
accgtggcccttcctgg

SEQ ID NO: 4626680 - DNA, 20 bp, Homo sapiens
accgtggcccttcctggaca

SEQ ID NO: 4626681 - DNA, 16 bp, Homo sapiens
acctaagtaattctct

SEQ ID NO: 4626682 - DNA, 17 bp, Homo sapiens
acctaataattgtatct

SEQ ID NO: 4626683 - DNA, 18 bp, Homo sapiens
acctaataattgtatcta

SEQ ID NO: 4626684 - DNA, 13 bp, Homo sapiens
acctaatatcatt

SEQ ID NO: 4626685 - DNA, 16 bp, Homo sapiens
acctaatatcatttta

SEQ ID NO: 4626686 - DNA, 18 bp, Homo sapiens
acctaatatcattttatt

SEQ ID NO: 4626687 - DNA, 21 bp, Homo sapiens
acctaatatcattttattcac

SEQ ID NO: 4626688 - DNA, 20 bp, Homo sapiens
acctacatatgctgatcttt

SEQ ID NO: 4626689 - DNA, 22 bp, Homo sapiens
acctacatatgctgatctttta

SEQ ID NO: 4626690 - DNA, 23 bp, Homo sapiens
acctacatatgctgatcttttaa

SEQ ID NO: 4626691 - DNA, 21 bp, Homo sapiens
acctagcagcaccgttctgtg

SEQ ID NO: 4626692 - DNA, 19 bp, Homo sapiens
acctcaagccccatttcct

SEQ ID NO: 4626693 - DNA, 12 bp, Homo sapiens
acctcagcctcc

SEQ ID NO: 4626694 - DNA, 13 bp, Homo sapiens
acctcagcctccc

SEQ ID NO: 4626695 - DNA, 22 bp, Homo sapiens
acctcagttattacatgtaatt

SEQ ID NO: 4626696 - DNA, 19 bp, Homo sapiens
acctcataaaaatctagca

SEQ ID NO: 4626697 - DNA, 21 bp, Homo sapiens
acctcatctgtggagctgcca

SEQ ID NO: 4626698 - DNA, 18 bp, Homo sapiens
acctccaagcatttcatg

SEQ ID NO: 4626699 - DNA, 11 bp, Homo sapiens
acctccagcct

SEQ ID NO: 4626700 - DNA, 22 bp, Homo sapiens
acctccatactcaagctgtctc

SEQ ID NO: 4626701 - DNA, 23 bp, Homo sapiens
acctccatactcaagctgtctct

SEQ ID NO: 4626702 - DNA, 15 bp, Homo sapiens
acctcccaccaacat

SEQ ID NO: 4626703 - DNA, 15 bp, Homo sapiens
acctccctcctttcc

SEQ ID NO: 4626704 - DNA, 16 bp, Homo sapiens
acctcctctgccagca

SEQ ID NO: 4626705 - DNA, 20 bp, Homo sapiens
acctcctctgccagcaggaa

SEQ ID NO: 4626706 - DNA, 14 bp, Homo sapiens
acctcctgctgggc

SEQ ID NO: 4626707 - DNA, 13 bp, Homo sapiens
acctcgtgatcta

SEQ ID NO: 4626708 - DNA, 16 bp, Homo sapiens
acctctgcctcctggg

SEQ ID NO: 4626709 - DNA, 19 bp, Homo sapiens
acctctgggaccccagctg

SEQ ID NO: 4626710 - DNA, 22 bp, Homo sapiens
acctctgtcttggctttcatgt

SEQ ID NO: 4626711 - DNA, 12 bp, Homo sapiens
acctctgtgtgc

SEQ ID NO: 4626712 - DNA, 14 bp, Homo sapiens
acctctgttcagtg

SEQ ID NO: 4626713 - DNA, 15 bp, Homo sapiens
acctctgttcagtgt

SEQ ID NO: 4626714 - DNA, 22 bp, Homo sapiens
acctctgttcagtgtaaatagt

SEQ ID NO: 4626715 - DNA, 23 bp, Homo sapiens
acctctgttcatttcacacagtg

SEQ ID NO: 4626716 - DNA, 11 bp, Homo sapiens
acctcttccac

SEQ ID NO: 4626717 - DNA, 22 bp, Homo sapiens
acctgaaaagatgttgtgtctt

SEQ ID NO: 4626718 - DNA, 20 bp, Homo sapiens
acctgacactaaccagagtc

SEQ ID NO: 4626719 - DNA, 14 bp, Homo sapiens
acctgagcctgccg

SEQ ID NO: 4626720 - DNA, 17 bp, Homo sapiens
acctgagcctgccgagc

SEQ ID NO: 4626721 - DNA, 22 bp, Homo sapiens
acctgagctaaataaagatatt

SEQ ID NO: 4626722 - DNA, 19 bp, Homo sapiens
acctgattcaactaaaaaa

SEQ ID NO: 4626723 - DNA, 19 bp, Homo sapiens
acctgcacaggcttgctgt

SEQ ID NO: 4626724 - DNA, 18 bp, Homo sapiens
acctgcatggtcaagcct

SEQ ID NO: 4626725 - DNA, 19 bp, Homo sapiens
acctgcatggtcaagcctc

SEQ ID NO: 4626726 - DNA, 15 bp, Homo sapiens
acctgccaagagtca

SEQ ID NO: 4626727 - DNA, 18 bp, Homo sapiens
acctgccagccactgtca

SEQ ID NO: 4626728 - DNA, 20 bp, Homo sapiens
acctgccagccactgtcacc

SEQ ID NO: 4626729 - DNA, 16 bp, Homo sapiens
acctgcgcaagtgcct

SEQ ID NO: 4626730 - DNA, 15 bp, Homo sapiens
acctgctatcagcag

SEQ ID NO: 4626731 - DNA, 12 bp, Homo sapiens
acctgctgagct

SEQ ID NO: 4626732 - DNA, 18 bp, Homo sapiens
acctgctgagctctgaga

SEQ ID NO: 4626733 - DNA, 19 bp, Homo sapiens
acctgctgagctctgagag

SEQ ID NO: 4626734 - DNA, 21 bp, Homo sapiens
acctgctgagctctgagaggc

SEQ ID NO: 4626735 - DNA, 21 bp, Homo sapiens
acctggagaaggaagctgcct

SEQ ID NO: 4626736 - DNA, 16 bp, Homo sapiens
acctggaggggagagg

SEQ ID NO: 4626737 - DNA, 19 bp, Homo sapiens
acctgggacaagcaggccg

SEQ ID NO: 4626738 - DNA, 20 bp, Homo sapiens
acctgggacaagcaggccgc

SEQ ID NO: 4626739 - DNA, 23 bp, Homo sapiens
acctgggcactccgcgccgatgc

SEQ ID NO: 4626740 - DNA, 15 bp, Homo sapiens
acctgggccctgggg

SEQ ID NO: 4626741 - DNA, 23 bp, Homo sapiens
acctgggccctggggcctgtact

SEQ ID NO: 4626742 - DNA, 23 bp, Homo sapiens
acctgggcttaagttttacttga

SEQ ID NO: 4626743 - DNA, 23 bp, Homo sapiens
acctgtatgtcaataaacaacag

SEQ ID NO: 4626744 - DNA, 17 bp, Homo sapiens
acctgtcaccctgcagg

SEQ ID NO: 4626745 - DNA, 18 bp, Homo sapiens
acctgtcaccctgcagga

SEQ ID NO: 4626746 - DNA, 22 bp, Homo sapiens
acctgtccccaccctccactca

SEQ ID NO: 4626747 - DNA, 17 bp, Homo sapiens
acctgtctcctggcggt

SEQ ID NO: 4626748 - DNA, 14 bp, Homo sapiens
acctgtctctctct

SEQ ID NO: 4626749 - DNA, 18 bp, Homo sapiens
acctgtctctctcttctc

SEQ ID NO: 4626750 - DNA, 17 bp, Homo sapiens
acctgtggccaagttct

SEQ ID NO: 4626751 - DNA, 18 bp, Homo sapiens
acctgtggccaagttctt

SEQ ID NO: 4626752 - DNA, 16 bp, Homo sapiens
acctgtgtggacagga

SEQ ID NO: 4626753 - DNA, 19 bp, Homo sapiens
acctgtgtggacaggacta

SEQ ID NO: 4626754 - DNA, 14 bp, Homo sapiens
acctgttctgaaat

SEQ ID NO: 4626755 - DNA, 18 bp, Homo sapiens
acctgttcttagagtgta

SEQ ID NO: 4626756 - DNA, 20 bp, Homo sapiens
acctgttcttagagtgtagc

SEQ ID NO: 4626757 - DNA, 19 bp, Homo sapiens
accttaaaatgtgtacagt

SEQ ID NO: 4626758 - DNA, 21 bp, Homo sapiens
accttaattttacagcccttg

SEQ ID NO: 4626759 - DNA, 22 bp, Homo sapiens
accttatttgctaatcaaagcc

SEQ ID NO: 4626760 - DNA, 20 bp, Homo sapiens
accttcaatgacttctaatt

SEQ ID NO: 4626761 - DNA, 17 bp, Homo sapiens
accttcacacacagact

SEQ ID NO: 4626762 - DNA, 18 bp, Homo sapiens
accttcacctcggaggga

SEQ ID NO: 4626763 - DNA, 18 bp, Homo sapiens
accttcactctccagggt

SEQ ID NO: 4626764 - DNA, 15 bp, Homo sapiens
accttctcccaggcc

SEQ ID NO: 4626765 - DNA, 22 bp, Homo sapiens
accttctcccaggcctctgccc

SEQ ID NO: 4626766 - DNA, 18 bp, Homo sapiens
accttggaatcgtcccta

SEQ ID NO: 4626767 - DNA, 15 bp, Homo sapiens
accttgtgtctgtac

SEQ ID NO: 4626768 - DNA, 22 bp, Homo sapiens
accttgttatttctcagacttt

SEQ ID NO: 4626769 - DNA, 17 bp, Homo sapiens
accttgttctatttttc

SEQ ID NO: 4626770 - DNA, 11 bp, Homo sapiens
acctttaaata

SEQ ID NO: 4626771 - DNA, 16 bp, Homo sapiens
acctttaaatatcatt

SEQ ID NO: 4626772 - DNA, 22 bp, Homo sapiens
acctttaaatatcattctttgt

SEQ ID NO: 4626773 - DNA, 18 bp, Homo sapiens
acctttatatctgtcttt

SEQ ID NO: 4626774 - DNA, 14 bp, Homo sapiens
acgaacttccatgg

SEQ ID NO: 4626775 - DNA, 14 bp, Homo sapiens
acgaagtgttgcat

SEQ ID NO: 4626776 - DNA, 17 bp, Homo sapiens
acgagaaaatctgcatg

SEQ ID NO: 4626777 - DNA, 19 bp, Homo sapiens
acgagacaacagcacacag

SEQ ID NO: 4626778 - DNA, 12 bp, Homo sapiens
acgagccacaag

SEQ ID NO: 4626779 - DNA, 14 bp, Homo sapiens
acgagccacaagct

SEQ ID NO: 4626780 - DNA, 15 bp, Homo sapiens
acgagccacaagctg

SEQ ID NO: 4626781 - DNA, 17 bp, Homo sapiens
acgagccacaagctgca

SEQ ID NO: 4626782 - DNA, 21 bp, Homo sapiens
acgagccacaagctgcactgt

SEQ ID NO: 4626783 - DNA, 22 bp, Homo sapiens
acgagccacaagctgcactgtg

SEQ ID NO: 4626784 - DNA, 22 bp, Homo sapiens
acgaggctgattcctctcattt

SEQ ID NO: 4626785 - DNA, 19 bp, Homo sapiens
acgagttaatgatggcaga

SEQ ID NO: 4626786 - DNA, 19 bp, Homo sapiens
acgatatttcgtttggtct

SEQ ID NO: 4626787 - DNA, 23 bp, Homo sapiens
acgatatttcgtttggtcttagg

SEQ ID NO: 4626788 - DNA, 23 bp, Homo sapiens
acgcaccgcctgaaggcacagct

SEQ ID NO: 4626789 - DNA, 14 bp, Homo sapiens
acgcacctgcctca

SEQ ID NO: 4626790 - DNA, 15 bp, Homo sapiens
acgcacctgcctcag

SEQ ID NO: 4626791 - DNA, 13 bp, Homo sapiens
acgcactggacag

SEQ ID NO: 4626792 - DNA, 22 bp, Homo sapiens
acgcactggacagcatcagaaa

SEQ ID NO: 4626793 - DNA, 20 bp, Homo sapiens
acgcaggtatttagaagcag

SEQ ID NO: 4626794 - DNA, 20 bp, Homo sapiens
acgccaatgttatgccagct

SEQ ID NO: 4626795 - DNA, 22 bp, Homo sapiens
acgcccgagagcctcgcttttt

SEQ ID NO: 4626796 - DNA, 19 bp, Homo sapiens
acgccgtcccaccagcttc

SEQ ID NO: 4626797 - DNA, 22 bp, Homo sapiens
acgcctcactgaaacatggctg

SEQ ID NO: 4626798 - DNA, 18 bp, Homo sapiens
acgcctcttgttcatgtc

SEQ ID NO: 4626799 - DNA, 17 bp, Homo sapiens
acgcctgagcccaggga

SEQ ID NO: 4626800 - DNA, 20 bp, Homo sapiens
acgcctgagcccagggaggc

SEQ ID NO: 4626801 - DNA, 20 bp, Homo sapiens
acgcttgtagaactcactct

SEQ ID NO: 4626802 - DNA, 21 bp, Homo sapiens
acgcttgtagaactcactctg

SEQ ID NO: 4626803 - DNA, 14 bp, Homo sapiens
acggaggaacagat

SEQ ID NO: 4626804 - DNA, 14 bp, Homo sapiens
acggatctgctggg

SEQ ID NO: 4626805 - DNA, 20 bp, Homo sapiens
acggcacctgggccctgggg

SEQ ID NO: 4626806 - DNA, 13 bp, Homo sapiens
acggccacatcaa

SEQ ID NO: 4626807 - DNA, 12 bp, Homo sapiens
acggccccagcg

SEQ ID NO: 4626808 - DNA, 12 bp, Homo sapiens
acggcctggctg

SEQ ID NO: 4626809 - DNA, 17 bp, Homo sapiens
acggcctggctggtggg

SEQ ID NO: 4626810 - DNA, 18 bp, Homo sapiens
acggctcgatttctccag

SEQ ID NO: 4626811 - DNA, 22 bp, Homo sapiens
acggctggcatggtggctcccg

SEQ ID NO: 4626812 - DNA, 16 bp, Homo sapiens
acgggaggggaggcat

SEQ ID NO: 4626813 - DNA, 20 bp, Homo sapiens
acgggtcagtattaaggttt

SEQ ID NO: 4626814 - DNA, 15 bp, Homo sapiens
acggtctggcagggc

SEQ ID NO: 4626815 - DNA, 18 bp, Homo sapiens
acggtctgttcttgaagc

SEQ ID NO: 4626816 - DNA, 17 bp, Homo sapiens
acgtaaagctagaaatg

SEQ ID NO: 4626817 - DNA, 16 bp, Homo sapiens
acgtagggggcagggg

SEQ ID NO: 4626818 - DNA, 13 bp, Homo sapiens
acgtcaatgcata

SEQ ID NO: 4626819 - DNA, 20 bp, Homo sapiens
acgtcccagcatccctggag

SEQ ID NO: 4626820 - DNA, 18 bp, Homo sapiens
acgtctggctccctgccc

SEQ ID NO: 4626821 - DNA, 21 bp, Homo sapiens
acgtctggctccctgcccctt

SEQ ID NO: 4626822 - DNA, 14 bp, Homo sapiens
acgtgagagaaaga

SEQ ID NO: 4626823 - DNA, 20 bp, Homo sapiens
acgtgatcctctcacctcag

SEQ ID NO: 4626824 - DNA, 14 bp, Homo sapiens
acgtggctctgctg

SEQ ID NO: 4626825 - DNA, 16 bp, Homo sapiens
acgtgtatagtatctg

SEQ ID NO: 4626826 - DNA, 16 bp, Homo sapiens
acgtgtgaaatctgtc

SEQ ID NO: 4626827 - DNA, 17 bp, Homo sapiens
acgtgtgaaatctgtct

SEQ ID NO: 4626828 - DNA, 18 bp, Homo sapiens
actaaaacattatatgta

SEQ ID NO: 4626829 - DNA, 19 bp, Homo sapiens
actaaactttatttgtaaa

SEQ ID NO: 4626830 - DNA, 17 bp, Homo sapiens
actaagaggtgggagga

SEQ ID NO: 4626831 - DNA, 20 bp, Homo sapiens
actaaggagtaatctgtgta

SEQ ID NO: 4626832 - DNA, 18 bp, Homo sapiens
actaaggcttttatttct

SEQ ID NO: 4626833 - DNA, 18 bp, Homo sapiens
actaatataaaatgagta

SEQ ID NO: 4626834 - DNA, 16 bp, Homo sapiens
actaatgtaaaatgat

SEQ ID NO: 4626835 - DNA, 19 bp, Homo sapiens
actaatgtttgaacaaagc

SEQ ID NO: 4626836 - DNA, 15 bp, Homo sapiens
actaattttacatgt

SEQ ID NO: 4626837 - DNA, 18 bp, Homo sapiens
actacacatttttaaatt

SEQ ID NO: 4626838 - DNA, 21 bp, Homo sapiens
actacacatttttaaattgtt

SEQ ID NO: 4626839 - DNA, 20 bp, Homo sapiens
actacattttttctaataaa

SEQ ID NO: 4626840 - DNA, 15 bp, Homo sapiens
actaccttatcactg

SEQ ID NO: 4626841 - DNA, 17 bp, Homo sapiens
actacgcactggacagc

SEQ ID NO: 4626842 - DNA, 13 bp, Homo sapiens
actactattcaaa

SEQ ID NO: 4626843 - DNA, 23 bp, Homo sapiens
actactgggtgtcatttcattcc

SEQ ID NO: 4626844 - DNA, 17 bp, Homo sapiens
actacttgggagcaccg

SEQ ID NO: 4626845 - DNA, 13 bp, Homo sapiens
actactttaaatc

SEQ ID NO: 4626846 - DNA, 16 bp, Homo sapiens
actagacacagataat

SEQ ID NO: 4626847 - DNA, 16 bp, Homo sapiens
actaggattgacattc

SEQ ID NO: 4626848 - DNA, 15 bp, Homo sapiens
actaggtaataataa

SEQ ID NO: 4626849 - DNA, 22 bp, Homo sapiens
actaggtaataataatgggaga

SEQ ID NO: 4626850 - DNA, 13 bp, Homo sapiens
actagttacacat

SEQ ID NO: 4626851 - DNA, 21 bp, Homo sapiens
actatataatttatttccact

SEQ ID NO: 4626852 - DNA, 12 bp, Homo sapiens
actatctgggtg

SEQ ID NO: 4626853 - DNA, 15 bp, Homo sapiens
actattaaaatattt

SEQ ID NO: 4626854 - DNA, 18 bp, Homo sapiens
actattaaaatattttgg

SEQ ID NO: 4626855 - DNA, 20 bp, Homo sapiens
actattccccagcagggtct

SEQ ID NO: 4626856 - DNA, 20 bp, Homo sapiens
actattgcagacctgtcacc

SEQ ID NO: 4626857 - DNA, 18 bp, Homo sapiens
actatttttatattaaag

SEQ ID NO: 4626858 - DNA, 17 bp, Homo sapiens
actatttttttcttaaa

SEQ ID NO: 4626859 - DNA, 21 bp, Homo sapiens
actcaaatatgagtacaaatg

SEQ ID NO: 4626860 - DNA, 17 bp, Homo sapiens
actcaagtgtcacctcc

SEQ ID NO: 4626861 - DNA, 23 bp, Homo sapiens
actcacacaggcatttcctgggt

SEQ ID NO: 4626862 - DNA, 16 bp, Homo sapiens
actcacctgcgcaagt

SEQ ID NO: 4626863 - DNA, 14 bp, Homo sapiens
actcactctgggct

SEQ ID NO: 4626864 - DNA, 15 bp, Homo sapiens
actcactctgggctg

SEQ ID NO: 4626865 - DNA, 16 bp, Homo sapiens
actcagaagcctgggg

SEQ ID NO: 4626866 - DNA, 18 bp, Homo sapiens
actcagctgtcctgcagc

SEQ ID NO: 4626867 - DNA, 11 bp, Homo sapiens
actcaggcaga

SEQ ID NO: 4626868 - DNA, 16 bp, Homo sapiens
actcagggattccttc

SEQ ID NO: 4626869 - DNA, 22 bp, Homo sapiens
actcagggcagcgccaggctga

SEQ ID NO: 4626870 - DNA, 20 bp, Homo sapiens
actcagtttatgttgtacaa

SEQ ID NO: 4626871 - DNA, 13 bp, Homo sapiens
actcagttttttg

SEQ ID NO: 4626872 - DNA, 18 bp, Homo sapiens
actcatagacactgatct

SEQ ID NO: 4626873 - DNA, 14 bp, Homo sapiens
actcatcctctttt

SEQ ID NO: 4626874 - DNA, 21 bp, Homo sapiens
actcatctttcattaaaggct

SEQ ID NO: 4626875 - DNA, 21 bp, Homo sapiens
actcatgatcaagatatatgt

SEQ ID NO: 4626876 - DNA, 16 bp, Homo sapiens
actcattctatgaaca

SEQ ID NO: 4626877 - DNA, 14 bp, Homo sapiens
actccaaacctgtc

SEQ ID NO: 4626878 - DNA, 12 bp, Homo sapiens
actccattgtcg

SEQ ID NO: 4626879 - DNA, 16 bp, Homo sapiens
actcccaatacaaaga

SEQ ID NO: 4626880 - DNA, 14 bp, Homo sapiens
actcccaccacagg

SEQ ID NO: 4626881 - DNA, 18 bp, Homo sapiens
actccccagagctgtgcc

SEQ ID NO: 4626882 - DNA, 15 bp, Homo sapiens
actcccccagcccca

SEQ ID NO: 4626883 - DNA, 14 bp, Homo sapiens
actccctaggccca

SEQ ID NO: 4626884 - DNA, 20 bp, Homo sapiens
actccctccaccagcctgct

SEQ ID NO: 4626885 - DNA, 22 bp, Homo sapiens
actccctccaccagcctgctga

SEQ ID NO: 4626886 - DNA, 20 bp, Homo sapiens
actcccttgaagttgtggag

SEQ ID NO: 4626887 - DNA, 16 bp, Homo sapiens
actccgaggtggttca

SEQ ID NO: 4626888 - DNA, 21 bp, Homo sapiens
actccgccagccacaggacca

SEQ ID NO: 4626889 - DNA, 16 bp, Homo sapiens
actccgcgccgatgcc

SEQ ID NO: 4626890 - DNA, 21 bp, Homo sapiens
actcctacatgatgttatgta

SEQ ID NO: 4626891 - DNA, 23 bp, Homo sapiens
actcctgagtgaggtgttgcagc

SEQ ID NO: 4626892 - DNA, 13 bp, Homo sapiens
actcctgctggta

SEQ ID NO: 4626893 - DNA, 15 bp, Homo sapiens
actcctgctggtacc

SEQ ID NO: 4626894 - DNA, 14 bp, Homo sapiens
actcctgctgtaaa

SEQ ID NO: 4626895 - DNA, 12 bp, Homo sapiens
actccttcctgc

SEQ ID NO: 4626896 - DNA, 20 bp, Homo sapiens
actcctttttcaaatgagtt

SEQ ID NO: 4626897 - DNA, 22 bp, Homo sapiens
actcgttcacctccaagcattt

SEQ ID NO: 4626898 - DNA, 15 bp, Homo sapiens
actctacacagctca

SEQ ID NO: 4626899 - DNA, 12 bp, Homo sapiens
actctagatggc

SEQ ID NO: 4626900 - DNA, 12 bp, Homo sapiens
actctaggttat

SEQ ID NO: 4626901 - DNA, 15 bp, Homo sapiens
actctaggttataca

SEQ ID NO: 4626902 - DNA, 16 bp, Homo sapiens
actctaggttatacaa

SEQ ID NO: 4626903 - DNA, 12 bp, Homo sapiens
actctcccctcc

SEQ ID NO: 4626904 - DNA, 21 bp, Homo sapiens
actctcccctccccatctgtg

SEQ ID NO: 4626905 - DNA, 19 bp, Homo sapiens
actctcctctttttttaaa

SEQ ID NO: 4626906 - DNA, 17 bp, Homo sapiens
actctcgcatcttccca

SEQ ID NO: 4626907 - DNA, 23 bp, Homo sapiens
actctctgttttagtgtttatgt

SEQ ID NO: 4626908 - DNA, 20 bp, Homo sapiens
actctcttctccattcccta

SEQ ID NO: 4626909 - DNA, 12 bp, Homo sapiens
actctgaagctg

SEQ ID NO: 4626910 - DNA, 23 bp, Homo sapiens
actctgaagctgacgaacttcca

SEQ ID NO: 4626911 - DNA, 22 bp, Homo sapiens
actctgacaagctggccaaagt

SEQ ID NO: 4626912 - DNA, 19 bp, Homo sapiens
actctgcacatgtcttgta

SEQ ID NO: 4626913 - DNA, 14 bp, Homo sapiens
actctgcccaccct

SEQ ID NO: 4626914 - DNA, 15 bp, Homo sapiens
actctgcccaccctc

SEQ ID NO: 4626915 - DNA, 16 bp, Homo sapiens
actctgcccaccctcc

SEQ ID NO: 4626916 - DNA, 12 bp, Homo sapiens
actctgctctga

SEQ ID NO: 4626917 - DNA, 14 bp, Homo sapiens
actctgctctgatg

SEQ ID NO: 4626918 - DNA, 9 bp, Homo sapiens
actctgctg

SEQ ID NO: 4626919 - DNA, 12 bp, Homo sapiens
actctgggctgt

SEQ ID NO: 4626920 - DNA, 18 bp, Homo sapiens
actctgtcttcacctgat

SEQ ID NO: 4626921 - DNA, 14 bp, Homo sapiens
actctgtgccagag

SEQ ID NO: 4626922 - DNA, 16 bp, Homo sapiens
actctgtgccagagcc

SEQ ID NO: 4626923 - DNA, 18 bp, Homo sapiens
actctgtgccagagcctg

SEQ ID NO: 4626924 - DNA, 20 bp, Homo sapiens
actctgtgccagagcctggg

SEQ ID NO: 4626925 - DNA, 22 bp, Homo sapiens
actctgtgccagagcctggggc

SEQ ID NO: 4626926 - DNA, 12 bp, Homo sapiens
actctgttcctg

SEQ ID NO: 4626927 - DNA, 14 bp, Homo sapiens
actctgttgcctcc

SEQ ID NO: 4626928 - DNA, 15 bp, Homo sapiens
actctgttgcctcct

SEQ ID NO: 4626929 - DNA, 18 bp, Homo sapiens
actctgttgcctcctctc

SEQ ID NO: 4626930 - DNA, 20 bp, Homo sapiens
actctgttgcctcctctctc

SEQ ID NO: 4626931 - DNA, 23 bp, Homo sapiens
actctgttgcctcctctctccct

SEQ ID NO: 4626932 - DNA, 15 bp, Homo sapiens
actcttatttataga

SEQ ID NO: 4626933 - DNA, 20 bp, Homo sapiens
actcttatttatagaattta

SEQ ID NO: 4626934 - DNA, 20 bp, Homo sapiens
actcttcagtgactcctgct

SEQ ID NO: 4626935 - DNA, 15 bp, Homo sapiens
actcttctgactgcc

SEQ ID NO: 4626936 - DNA, 20 bp, Homo sapiens
actcttgatttcacatttct

SEQ ID NO: 4626937 - DNA, 15 bp, Homo sapiens
actcttgctcctgct

SEQ ID NO: 4626938 - DNA, 16 bp, Homo sapiens
actcttgtcacccagg

SEQ ID NO: 4626939 - DNA, 19 bp, Homo sapiens
actcttgtcacccaggctg

SEQ ID NO: 4626940 - DNA, 20 bp, Homo sapiens
actcttgtcacccaggctgg

SEQ ID NO: 4626941 - DNA, 21 bp, Homo sapiens
actcttgttgaagtgctgttt

SEQ ID NO: 4626942 - DNA, 20 bp, Homo sapiens
actctttaataaattgctta

SEQ ID NO: 4626943 - DNA, 17 bp, Homo sapiens
actctttctaatgctga

SEQ ID NO: 4626944 - DNA, 15 bp, Homo sapiens
actgaaaacatctgg

SEQ ID NO: 4626945 - DNA, 17 bp, Homo sapiens
actgaaacatggctgtg

SEQ ID NO: 4626946 - DNA, 15 bp, Homo sapiens
actgaagcgaacatc

SEQ ID NO: 4626947 - DNA, 16 bp, Homo sapiens
actgaagcgaacatct

SEQ ID NO: 4626948 - DNA, 20 bp, Homo sapiens
actgaaggctttcagggcct

SEQ ID NO: 4626949 - DNA, 14 bp, Homo sapiens
actgaatagttcag

SEQ ID NO: 4626950 - DNA, 23 bp, Homo sapiens
actgaatagttcaggagacttta

SEQ ID NO: 4626951 - DNA, 18 bp, Homo sapiens
actgaatataaagcttaa

SEQ ID NO: 4626952 - DNA, 11 bp, Homo sapiens
actgaatgcag

SEQ ID NO: 4626953 - DNA, 21 bp, Homo sapiens
actgacaggcagcctggacat

SEQ ID NO: 4626954 - DNA, 20 bp, Homo sapiens
actgaccaatattgtacagt

SEQ ID NO: 4626955 - DNA, 18 bp, Homo sapiens
actgactatcataaaatc

SEQ ID NO: 4626956 - DNA, 13 bp, Homo sapiens
actgacttcacta

SEQ ID NO: 4626957 - DNA, 22 bp, Homo sapiens
actgacttcactaggcattgtg

SEQ ID NO: 4626958 - DNA, 12 bp, Homo sapiens
actgagaacttt

SEQ ID NO: 4626959 - DNA, 15 bp, Homo sapiens
actgagcatttgcac

SEQ ID NO: 4626960 - DNA, 20 bp, Homo sapiens
actgaggagatgaccaggga

SEQ ID NO: 4626961 - DNA, 23 bp, Homo sapiens
actgaggagatgaccagggatgc

SEQ ID NO: 4626962 - DNA, 20 bp, Homo sapiens
actgaggaggaggctgcaca

SEQ ID NO: 4626963 - DNA, 21 bp, Homo sapiens
actgaggcatccgtgaggcag

SEQ ID NO: 4626964 - DNA, 16 bp, Homo sapiens
actgagggcagtgccc

SEQ ID NO: 4626965 - DNA, 17 bp, Homo sapiens
actgataatcacactgc

SEQ ID NO: 4626966 - DNA, 17 bp, Homo sapiens
actgattaaatatttga

SEQ ID NO: 4626967 - DNA, 20 bp, Homo sapiens
actgattaaatatttgaaga

SEQ ID NO: 4626968 - DNA, 23 bp, Homo sapiens
actgattacttgtaattatgaaa

SEQ ID NO: 4626969 - DNA, 19 bp, Homo sapiens
actgattgctcccaggatc

SEQ ID NO: 4626970 - DNA, 20 bp, Homo sapiens
actgattgctcccaggatct

SEQ ID NO: 4626971 - DNA, 21 bp, Homo sapiens
actgattgctcccaggatctc

SEQ ID NO: 4626972 - DNA, 13 bp, Homo sapiens
actgattgtttca

SEQ ID NO: 4626973 - DNA, 16 bp, Homo sapiens
actgcaacctctgcct

SEQ ID NO: 4626974 - DNA, 20 bp, Homo sapiens
actgcaacctctgcctcctg

SEQ ID NO: 4626975 - DNA, 21 bp, Homo sapiens
actgcaacctctgcctcctgg

SEQ ID NO: 4626976 - DNA, 14 bp, Homo sapiens
actgcactccagcc

SEQ ID NO: 4626977 - DNA, 17 bp, Homo sapiens
actgcactccagcctgg

SEQ ID NO: 4626978 - DNA, 18 bp, Homo sapiens
actgcactccagcctggg

SEQ ID NO: 4626979 - DNA, 12 bp, Homo sapiens
actgcagcacct

SEQ ID NO: 4626980 - DNA, 18 bp, Homo sapiens
actgcagcacctccaggc

SEQ ID NO: 4626981 - DNA, 22 bp, Homo sapiens
actgcagcacctccaggcctgt

SEQ ID NO: 4626982 - DNA, 14 bp, Homo sapiens
actgcagcagaaag

SEQ ID NO: 4626983 - DNA, 13 bp, Homo sapiens
actgcagggagga

SEQ ID NO: 4626984 - DNA, 14 bp, Homo sapiens
actgcagggaggag

SEQ ID NO: 4626985 - DNA, 16 bp, Homo sapiens
actgcattatcttgct

SEQ ID NO: 4626986 - DNA, 13 bp, Homo sapiens
actgccaagccag

SEQ ID NO: 4626987 - DNA, 15 bp, Homo sapiens
actgccaagccagat

SEQ ID NO: 4626988 - DNA, 17 bp, Homo sapiens
actgccaagccagattc

SEQ ID NO: 4626989 - DNA, 15 bp, Homo sapiens
actgccaggagggac

SEQ ID NO: 4626990 - DNA, 21 bp, Homo sapiens
actgccaggagggacaaagga

SEQ ID NO: 4626991 - DNA, 17 bp, Homo sapiens
actgccaggctgtttca

SEQ ID NO: 4626992 - DNA, 14 bp, Homo sapiens
actgcccagcggac

SEQ ID NO: 4626993 - DNA, 23 bp, Homo sapiens
actgcccagcggacagtggcagg

SEQ ID NO: 4626994 - DNA, 16 bp, Homo sapiens
actgccccctcctgtg

SEQ ID NO: 4626995 - DNA, 12 bp, Homo sapiens
actgccctgccc

SEQ ID NO: 4626996 - DNA, 15 bp, Homo sapiens
actgccctgcccagg

SEQ ID NO: 4626997 - DNA, 16 bp, Homo sapiens
actgcctataatctta

SEQ ID NO: 4626998 - DNA, 21 bp, Homo sapiens
actgcctataatcttatacaa

SEQ ID NO: 4626999 - DNA, 22 bp, Homo sapiens
actgcctctcacagctgagttg

SEQ ID NO: 4627000 - DNA, 16 bp, Homo sapiens
actgcctttggcagag

SEQ ID NO: 4627001 - DNA, 12 bp, Homo sapiens
actgctcctcct

SEQ ID NO: 4627002 - DNA, 22 bp, Homo sapiens
actgctctttattgcagaatgt

SEQ ID NO: 4627003 - DNA, 15 bp, Homo sapiens
actgctgcttgtcaa

SEQ ID NO: 4627004 - DNA, 18 bp, Homo sapiens
actggaaacaaaacagaa

SEQ ID NO: 4627005 - DNA, 17 bp, Homo sapiens
actggaagccttccccc

SEQ ID NO: 4627006 - DNA, 17 bp, Homo sapiens
actggacagcatcagaa

SEQ ID NO: 4627007 - DNA, 16 bp, Homo sapiens
actggaggagagaaga

SEQ ID NO: 4627008 - DNA, 18 bp, Homo sapiens
actggaggagagaagaat

SEQ ID NO: 4627009 - DNA, 17 bp, Homo sapiens
actggccaagctgaggt

SEQ ID NO: 4627010 - DNA, 19 bp, Homo sapiens
actggccaagctgaggtgc

SEQ ID NO: 4627011 - DNA, 20 bp, Homo sapiens
actggcccctaggctgctgc

SEQ ID NO: 4627012 - DNA, 14 bp, Homo sapiens
actggcctaaattt

SEQ ID NO: 4627013 - DNA, 15 bp, Homo sapiens
actggcttcagcaag

SEQ ID NO: 4627014 - DNA, 19 bp, Homo sapiens
actggctttcctgctggtc

SEQ ID NO: 4627015 - DNA, 19 bp, Homo sapiens
actgggccccacatggctt

SEQ ID NO: 4627016 - DNA, 16 bp, Homo sapiens
actggggactttattt

SEQ ID NO: 4627017 - DNA, 20 bp, Homo sapiens
actgggtaaaagcagggcag

SEQ ID NO: 4627018 - DNA, 14 bp, Homo sapiens
actgggtgtcattt

SEQ ID NO: 4627019 - DNA, 20 bp, Homo sapiens
actgggtgtcatttcattcc

SEQ ID NO: 4627020 - DNA, 13 bp, Homo sapiens
actggttatcttg

SEQ ID NO: 4627021 - DNA, 16 bp, Homo sapiens
actggttatcttgtta

SEQ ID NO: 4627022 - DNA, 13 bp, Homo sapiens
actggttccttcc

SEQ ID NO: 4627023 - DNA, 20 bp, Homo sapiens
actggttccttccttagttt

SEQ ID NO: 4627024 - DNA, 15 bp, Homo sapiens
actggttttctgcca

SEQ ID NO: 4627025 - DNA, 19 bp, Homo sapiens
actggttttctgccaatga

SEQ ID NO: 4627026 - DNA, 16 bp, Homo sapiens
actgtacattatgaag

SEQ ID NO: 4627027 - DNA, 17 bp, Homo sapiens
actgtacattatgaaga

SEQ ID NO: 4627028 - DNA, 21 bp, Homo sapiens
actgtaccatgtgctacaggg

SEQ ID NO: 4627029 - DNA, 19 bp, Homo sapiens
actgtagacactctgacaa

SEQ ID NO: 4627030 - DNA, 15 bp, Homo sapiens
actgtagcaggttct

SEQ ID NO: 4627031 - DNA, 12 bp, Homo sapiens
actgtatgctca

SEQ ID NO: 4627032 - DNA, 13 bp, Homo sapiens
actgtcacttgct

SEQ ID NO: 4627033 - DNA, 18 bp, Homo sapiens
actgtcacttgctgcttt

SEQ ID NO: 4627034 - DNA, 18 bp, Homo sapiens
actgtcagttctctggga

SEQ ID NO: 4627035 - DNA, 23 bp, Homo sapiens
actgtcagttctctgggaagtgg

SEQ ID NO: 4627036 - DNA, 18 bp, Homo sapiens
actgtcccaaggaggggg

SEQ ID NO: 4627037 - DNA, 14 bp, Homo sapiens
actgtcctagccag

SEQ ID NO: 4627038 - DNA, 20 bp, Homo sapiens
actgtgaacagcttgctgtc

SEQ ID NO: 4627039 - DNA, 15 bp, Homo sapiens
actgtgatttatctt

SEQ ID NO: 4627040 - DNA, 20 bp, Homo sapiens
actgtgcctccataatttgg

SEQ ID NO: 4627041 - DNA, 20 bp, Homo sapiens
actgtggaaggcctccctct

SEQ ID NO: 4627042 - DNA, 22 bp, Homo sapiens
actgtggccttggtctaacttt

SEQ ID NO: 4627043 - DNA, 18 bp, Homo sapiens
actgtggtgacttctgct

SEQ ID NO: 4627044 - DNA, 20 bp, Homo sapiens
actgtgtctgaatcatgtct

SEQ ID NO: 4627045 - DNA, 19 bp, Homo sapiens
actgtgttactgctttgca

SEQ ID NO: 4627046 - DNA, 21 bp, Homo sapiens
actgtgttactgctttgcaaa

SEQ ID NO: 4627047 - DNA, 18 bp, Homo sapiens
actgtgtttcaaatggac

SEQ ID NO: 4627048 - DNA, 18 bp, Homo sapiens
actgttacagactgaaag

SEQ ID NO: 4627049 - DNA, 17 bp, Homo sapiens
actgttccagattccta

SEQ ID NO: 4627050 - DNA, 17 bp, Homo sapiens
actgttgcctttgctct

SEQ ID NO: 4627051 - DNA, 20 bp, Homo sapiens
actgtttcatagttttctaa

SEQ ID NO: 4627052 - DNA, 21 bp, Homo sapiens
actgtttcatagttttctaaa

SEQ ID NO: 4627053 - DNA, 17 bp, Homo sapiens
actgtttcatctcagct

SEQ ID NO: 4627054 - DNA, 18 bp, Homo sapiens
actgtttcatctcagctt

SEQ ID NO: 4627055 - DNA, 12 bp, Homo sapiens
actgtttctaaa

SEQ ID NO: 4627056 - DNA, 17 bp, Homo sapiens
actgttttaaaatgtga

SEQ ID NO: 4627057 - DNA, 14 bp, Homo sapiens
acttaaatattgta

SEQ ID NO: 4627058 - DNA, 15 bp, Homo sapiens
acttaaatattgtaa

SEQ ID NO: 4627059 - DNA, 22 bp, Homo sapiens
acttaaatattgtaatatgaca

SEQ ID NO: 4627060 - DNA, 21 bp, Homo sapiens
acttaacagatgcaatgtgct

SEQ ID NO: 4627061 - DNA, 20 bp, Homo sapiens
acttaacatttcattgtaca

SEQ ID NO: 4627062 - DNA, 14 bp, Homo sapiens
acttaatatactca

SEQ ID NO: 4627063 - DNA, 11 bp, Homo sapiens
acttaatcttc

SEQ ID NO: 4627064 - DNA, 13 bp, Homo sapiens
acttaatttgtaa

SEQ ID NO: 4627065 - DNA, 17 bp, Homo sapiens
acttaatttgtaaactt

SEQ ID NO: 4627066 - DNA, 21 bp, Homo sapiens
acttaatttgtaaacttctga

SEQ ID NO: 4627067 - DNA, 19 bp, Homo sapiens
acttacatatatttttaaa

SEQ ID NO: 4627068 - DNA, 20 bp, Homo sapiens
acttactgcctgaccttgga

SEQ ID NO: 4627069 - DNA, 22 bp, Homo sapiens
acttagaaggattgaacttctt

SEQ ID NO: 4627070 - DNA, 14 bp, Homo sapiens
acttagacctgcca

SEQ ID NO: 4627071 - DNA, 14 bp, Homo sapiens
acttagccatgatg

SEQ ID NO: 4627072 - DNA, 17 bp, Homo sapiens
acttatagttaatattt

SEQ ID NO: 4627073 - DNA, 20 bp, Homo sapiens
acttatctcgaatttgaaga

SEQ ID NO: 4627074 - DNA, 21 bp, Homo sapiens
acttatctcgaatttgaagag

SEQ ID NO: 4627075 - DNA, 15 bp, Homo sapiens
acttattacctcagg

SEQ ID NO: 4627076 - DNA, 19 bp, Homo sapiens
acttcaagatgagcctggg

SEQ ID NO: 4627077 - DNA, 19 bp, Homo sapiens
acttcataagatattcttt

SEQ ID NO: 4627078 - DNA, 20 bp, Homo sapiens
acttcataagatattcttta

SEQ ID NO: 4627079 - DNA, 24 bp, Homo sapiens
acttcataagatattctttacaaa

SEQ ID NO: 4627080 - DNA, 23 bp, Homo sapiens
acttcatttttaagaaaggaagc

SEQ ID NO: 4627081 - DNA, 15 bp, Homo sapiens
acttccacctccagc

SEQ ID NO: 4627082 - DNA, 16 bp, Homo sapiens
acttccacctccagcc

SEQ ID NO: 4627083 - DNA, 17 bp, Homo sapiens
acttccagcttgcctgt

SEQ ID NO: 4627084 - DNA, 13 bp, Homo sapiens
acttccccaagat

SEQ ID NO: 4627085 - DNA, 22 bp, Homo sapiens
acttccgctgaggggtctcgga

SEQ ID NO: 4627086 - DNA, 11 bp, Homo sapiens
acttcctctgt

SEQ ID NO: 4627087 - DNA, 13 bp, Homo sapiens
acttcctctgtga

SEQ ID NO: 4627088 - DNA, 18 bp, Homo sapiens
acttcctctgtgaactgt

SEQ ID NO: 4627089 - DNA, 22 bp, Homo sapiens
acttcctctgtgaactgtgtgt

SEQ ID NO: 4627090 - DNA, 22 bp, Homo sapiens
acttccttattgggacttttct

SEQ ID NO: 4627091 - DNA, 13 bp, Homo sapiens
acttcgcacacac

SEQ ID NO: 4627092 - DNA, 15 bp, Homo sapiens
acttcgcacacaccc

SEQ ID NO: 4627093 - DNA, 16 bp, Homo sapiens
acttcgcacacaccca

SEQ ID NO: 4627094 - DNA, 16 bp, Homo sapiens
acttctagctcattta

SEQ ID NO: 4627095 - DNA, 19 bp, Homo sapiens
acttctagctcatttaaca

SEQ ID NO: 4627096 - DNA, 15 bp, Homo sapiens
acttctcagtcccct

SEQ ID NO: 4627097 - DNA, 22 bp, Homo sapiens
acttctctgtgtgcacacccat

SEQ ID NO: 4627098 - DNA, 18 bp, Homo sapiens
acttctgaagactgagaa

SEQ ID NO: 4627099 - DNA, 21 bp, Homo sapiens
acttctgaagactgagaactt

SEQ ID NO: 4627100 - DNA, 16 bp, Homo sapiens
acttcttacacataaa

SEQ ID NO: 4627101 - DNA, 18 bp, Homo sapiens
acttcttcacctcttcca

SEQ ID NO: 4627102 - DNA, 12 bp, Homo sapiens
acttcttgtcag

SEQ ID NO: 4627103 - DNA, 15 bp, Homo sapiens
acttcttgtcagaca

SEQ ID NO: 4627104 - DNA, 19 bp, Homo sapiens
acttcttgtcagacataaa

SEQ ID NO: 4627105 - DNA, 21 bp, Homo sapiens
acttcttgtcagacataaagc

SEQ ID NO: 4627106 - DNA, 19 bp, Homo sapiens
acttgacatgtagcttctt

SEQ ID NO: 4627107 - DNA, 15 bp, Homo sapiens
acttgactcttgaat

SEQ ID NO: 4627108 - DNA, 14 bp, Homo sapiens
acttgagctgtctg

SEQ ID NO: 4627109 - DNA, 19 bp, Homo sapiens
acttgaggatcatatgaat

SEQ ID NO: 4627110 - DNA, 16 bp, Homo sapiens
acttgagggaccaata

SEQ ID NO: 4627111 - DNA, 17 bp, Homo sapiens
acttgcatgaatgattt

SEQ ID NO: 4627112 - DNA, 15 bp, Homo sapiens
acttgcccaggtcac

SEQ ID NO: 4627113 - DNA, 16 bp, Homo sapiens
acttgcctccatcttt

SEQ ID NO: 4627114 - DNA, 23 bp, Homo sapiens
acttgcctccatctttttcttgg

SEQ ID NO: 4627115 - DNA, 13 bp, Homo sapiens
acttgcctctgca

SEQ ID NO: 4627116 - DNA, 22 bp, Homo sapiens
acttgctttatgccttcttatt

SEQ ID NO: 4627117 - DNA, 14 bp, Homo sapiens
acttgctttcaatt

SEQ ID NO: 4627118 - DNA, 19 bp, Homo sapiens
acttggctttcctgtttct

SEQ ID NO: 4627119 - DNA, 13 bp, Homo sapiens
acttgggcacccc

SEQ ID NO: 4627120 - DNA, 17 bp, Homo sapiens
acttgggcacccccagc

SEQ ID NO: 4627121 - DNA, 22 bp, Homo sapiens
acttgtaatatttttatataca

SEQ ID NO: 4627122 - DNA, 13 bp, Homo sapiens
acttgtcaaagaa

SEQ ID NO: 4627123 - DNA, 14 bp, Homo sapiens
acttgtcaaagaag

SEQ ID NO: 4627124 - DNA, 17 bp, Homo sapiens
acttgtccccaaatccg

SEQ ID NO: 4627125 - DNA, 14 bp, Homo sapiens
acttgtctgcctcc

SEQ ID NO: 4627126 - DNA, 17 bp, Homo sapiens
acttgtctgcctcctgc

SEQ ID NO: 4627127 - DNA, 21 bp, Homo sapiens
acttgtgaaacgtctggactg

SEQ ID NO: 4627128 - DNA, 19 bp, Homo sapiens
actttaaatcctaccaaag

SEQ ID NO: 4627129 - DNA, 20 bp, Homo sapiens
actttaaatcctaccaaagt

SEQ ID NO: 4627130 - DNA, 19 bp, Homo sapiens
actttacaaacctttgttt

SEQ ID NO: 4627131 - DNA, 15 bp, Homo sapiens
actttacagaaatgg

SEQ ID NO: 4627132 - DNA, 14 bp, Homo sapiens
actttattaaaaga

SEQ ID NO: 4627133 - DNA, 18 bp, Homo sapiens
actttatttatttctagt

SEQ ID NO: 4627134 - DNA, 14 bp, Homo sapiens
actttatttgtaaa

SEQ ID NO: 4627135 - DNA, 19 bp, Homo sapiens
actttatttgtaaaccatt

SEQ ID NO: 4627136 - DNA, 21 bp, Homo sapiens
actttcagagcccccagccct

SEQ ID NO: 4627137 - DNA, 22 bp, Homo sapiens
actttcagagcccccagccctg

SEQ ID NO: 4627138 - DNA, 16 bp, Homo sapiens
actttcagtaaacata

SEQ ID NO: 4627139 - DNA, 17 bp, Homo sapiens
actttcagtaaacataa

SEQ ID NO: 4627140 - DNA, 16 bp, Homo sapiens
actttccaatgccaca

SEQ ID NO: 4627141 - DNA, 14 bp, Homo sapiens
actttcccacccag

SEQ ID NO: 4627142 - DNA, 15 bp, Homo sapiens
actttcctttcaata

SEQ ID NO: 4627143 - DNA, 20 bp, Homo sapiens
actttcctttcaataaagtt

SEQ ID NO: 4627144 - DNA, 22 bp, Homo sapiens
actttcctttcaataaagttgt

SEQ ID NO: 4627145 - DNA, 12 bp, Homo sapiens
actttctcctgg

SEQ ID NO: 4627146 - DNA, 17 bp, Homo sapiens
actttggctgaactaca

SEQ ID NO: 4627147 - DNA, 12 bp, Homo sapiens
actttgtaaata

SEQ ID NO: 4627148 - DNA, 18 bp, Homo sapiens
actttgtagactgtttca

SEQ ID NO: 4627149 - DNA, 23 bp, Homo sapiens
actttgtggagagaatgtgtgtg

SEQ ID NO: 4627150 - DNA, 17 bp, Homo sapiens
acttttagaaatgcata

SEQ ID NO: 4627151 - DNA, 17 bp, Homo sapiens
acttttagtagagacag

SEQ ID NO: 4627152 - DNA, 13 bp, Homo sapiens
acttttatgtttt

SEQ ID NO: 4627153 - DNA, 10 bp, Homo sapiens
acttttcatt

SEQ ID NO: 4627154 - DNA, 14 bp, Homo sapiens
acttttgtgtgaaa

SEQ ID NO: 4627155 - DNA, 20 bp, Homo sapiens
acttttgttctactccttcc

SEQ ID NO: 4627156 - DNA, 16 bp, Homo sapiens
actttttagattattc

SEQ ID NO: 4627157 - DNA, 14 bp, Homo sapiens
actttttcttgtat

SEQ ID NO: 4627158 - DNA, 17 bp, Homo sapiens
actttttcttgtattca

SEQ ID NO: 4627159 - DNA, 15 bp, Homo sapiens
actttttctttatgt

SEQ ID NO: 4627160 - DNA, 11 bp, Homo sapiens
actttttgatg

SEQ ID NO: 4627161 - DNA, 23 bp, Homo sapiens
actttttgatggaattaaatgtg

SEQ ID NO: 4627162 - DNA, 20 bp, Homo sapiens
acttttttacactgataaaa

SEQ ID NO: 4627163 - DNA, 20 bp, Homo sapiens
acttttttgtggcaattagt

SEQ ID NO: 4627164 - DNA, 18 bp, Homo sapiens
acttttttttagttcaat

SEQ ID NO: 4627165 - DNA, 16 bp, Homo sapiens
agaaaaaaatgtacat

SEQ ID NO: 4627166 - DNA, 15 bp, Homo sapiens
agaaaaagtaaaaga

SEQ ID NO: 4627167 - DNA, 19 bp, Homo sapiens
agaaaactcccaatacaaa

SEQ ID NO: 4627168 - DNA, 16 bp, Homo sapiens
agaaaagtaatgaaga

SEQ ID NO: 4627169 - DNA, 10 bp, Homo sapiens
agaaaatatt

SEQ ID NO: 4627170 - DNA, 16 bp, Homo sapiens
agaaaatctgcatgtt

SEQ ID NO: 4627171 - DNA, 19 bp, Homo sapiens
agaaaatgacttatttctg

SEQ ID NO: 4627172 - DNA, 16 bp, Homo sapiens
agaaaattcagctcct

SEQ ID NO: 4627173 - DNA, 21 bp, Homo sapiens
agaaaatttacaaaatttatt

SEQ ID NO: 4627174 - DNA, 14 bp, Homo sapiens
agaaacaagctgtg

SEQ ID NO: 4627175 - DNA, 20 bp, Homo sapiens
agaaacaccacttaatcttc

SEQ ID NO: 4627176 - DNA, 22 bp, Homo sapiens
agaaacagagtggcctccctgc

SEQ ID NO: 4627177 - DNA, 13 bp, Homo sapiens
agaaacagctcag

SEQ ID NO: 4627178 - DNA, 13 bp, Homo sapiens
agaaacattgtaa

SEQ ID NO: 4627179 - DNA, 16 bp, Homo sapiens
agaaactaaacagaaa

SEQ ID NO: 4627180 - DNA, 15 bp, Homo sapiens
agaaagaagtggaga

SEQ ID NO: 4627181 - DNA, 16 bp, Homo sapiens
agaaagagagaagcca

SEQ ID NO: 4627182 - DNA, 22 bp, Homo sapiens
agaaagagagaagccagccaca

SEQ ID NO: 4627183 - DNA, 17 bp, Homo sapiens
agaaagagctgcctgga

SEQ ID NO: 4627184 - DNA, 12 bp, Homo sapiens
agaaagggaccc

SEQ ID NO: 4627185 - DNA, 14 bp, Homo sapiens
agaaagggagggct

SEQ ID NO: 4627186 - DNA, 18 bp, Homo sapiens
agaaagggagggctctga

SEQ ID NO: 4627187 - DNA, 19 bp, Homo sapiens
agaaagggagggctctgag

SEQ ID NO: 4627188 - DNA, 14 bp, Homo sapiens
agaaagtgacattt

SEQ ID NO: 4627189 - DNA, 22 bp, Homo sapiens
agaaagttctgtgtaaacagaa

SEQ ID NO: 4627190 - DNA, 17 bp, Homo sapiens
agaaataaaaggaagcc

SEQ ID NO: 4627191 - DNA, 18 bp, Homo sapiens
agaaataaaaggaagcca

SEQ ID NO: 4627192 - DNA, 23 bp, Homo sapiens
agaaataatccctgtaatattta

SEQ ID NO: 4627193 - DNA, 17 bp, Homo sapiens
agaaatagttgtctgtg

SEQ ID NO: 4627194 - DNA, 20 bp, Homo sapiens
agaaatagttgtctgtgctt

SEQ ID NO: 4627195 - DNA, 13 bp, Homo sapiens
agaaatgcatatt

SEQ ID NO: 4627196 - DNA, 15 bp, Homo sapiens
agaaatgcatatttg

SEQ ID NO: 4627197 - DNA, 22 bp, Homo sapiens
agaaatgcatatttgccacaaa

SEQ ID NO: 4627198 - DNA, 13 bp, Homo sapiens
agaaattttcaag

SEQ ID NO: 4627199 - DNA, 17 bp, Homo sapiens
agaaatttttcagatgc

SEQ ID NO: 4627200 - DNA, 14 bp, Homo sapiens
agaacaagaaatgg

SEQ ID NO: 4627201 - DNA, 19 bp, Homo sapiens
agaacacaaaacttgaaag

SEQ ID NO: 4627202 - DNA, 18 bp, Homo sapiens
agaacaggaggtgtgaat

SEQ ID NO: 4627203 - DNA, 22 bp, Homo sapiens
agaacaggaggtgtgaatgcac

SEQ ID NO: 4627204 - DNA, 21 bp, Homo sapiens
agaacagggtcatgtttgcag

SEQ ID NO: 4627205 - DNA, 12 bp, Homo sapiens
agaacaggtttt

SEQ ID NO: 4627206 - DNA, 19 bp, Homo sapiens
agaacagtggttgcctggg

SEQ ID NO: 4627207 - DNA, 20 bp, Homo sapiens
agaacagtggttgcctgggg

SEQ ID NO: 4627208 - DNA, 14 bp, Homo sapiens
agaacatactgttc

SEQ ID NO: 4627209 - DNA, 15 bp, Homo sapiens
agaacattcagctct

SEQ ID NO: 4627210 - DNA, 22 bp, Homo sapiens
agaacccagtgtttccacactt

SEQ ID NO: 4627211 - DNA, 12 bp, Homo sapiens
agaacctggcct

SEQ ID NO: 4627212 - DNA, 19 bp, Homo sapiens
agaactagccaaaccagga

SEQ ID NO: 4627213 - DNA, 21 bp, Homo sapiens
agaactagccaaaccaggacc

SEQ ID NO: 4627214 - DNA, 13 bp, Homo sapiens
agaactggaggca

SEQ ID NO: 4627215 - DNA, 22 bp, Homo sapiens
agaacttcaagatgagcctggg

SEQ ID NO: 4627216 - DNA, 23 bp, Homo sapiens
agaacttcaagatgagcctgggc

SEQ ID NO: 4627217 - DNA, 20 bp, Homo sapiens
agaactttattaagtaaaat

SEQ ID NO: 4627218 - DNA, 22 bp, Homo sapiens
agaactttattaagtaaaatcc

SEQ ID NO: 4627219 - DNA, 16 bp, Homo sapiens
agaagaacaagaaatg

SEQ ID NO: 4627220 - DNA, 16 bp, Homo sapiens
agaagaagtcagagag

SEQ ID NO: 4627221 - DNA, 17 bp, Homo sapiens
agaagaagtcagagagg

SEQ ID NO: 4627222 - DNA, 21 bp, Homo sapiens
agaagaattttatttttctgt

SEQ ID NO: 4627223 - DNA, 16 bp, Homo sapiens
agaagacattttctct

SEQ ID NO: 4627224 - DNA, 22 bp, Homo sapiens
agaagacgtggtctagaccagg

SEQ ID NO: 4627225 - DNA, 19 bp, Homo sapiens
agaagagaggaaataacag

SEQ ID NO: 4627226 - DNA, 13 bp, Homo sapiens
agaagagggggag

SEQ ID NO: 4627227 - DNA, 17 bp, Homo sapiens
agaagagtcaacattga

SEQ ID NO: 4627228 - DNA, 20 bp, Homo sapiens
agaagatcaacgcctcactg

SEQ ID NO: 4627229 - DNA, 19 bp, Homo sapiens
agaagatggcacttataac

SEQ ID NO: 4627230 - DNA, 17 bp, Homo sapiens
agaagattgggccgcct

SEQ ID NO: 4627231 - DNA, 22 bp, Homo sapiens
agaagcaagacacgtggcctcg

SEQ ID NO: 4627232 - DNA, 11 bp, Homo sapiens
agaagccagcc

SEQ ID NO: 4627233 - DNA, 14 bp, Homo sapiens
agaagcctgggggc

SEQ ID NO: 4627234 - DNA, 16 bp, Homo sapiens
agaagcgtttttaacc

SEQ ID NO: 4627235 - DNA, 18 bp, Homo sapiens
agaagcgtttttaacctg

SEQ ID NO: 4627236 - DNA, 13 bp, Homo sapiens
agaagctgctcca

SEQ ID NO: 4627237 - DNA, 19 bp, Homo sapiens
agaagctgctccaggcctg

SEQ ID NO: 4627238 - DNA, 22 bp, Homo sapiens
agaagctgctccaggcctgcag

SEQ ID NO: 4627239 - DNA, 23 bp, Homo sapiens
agaagctttagcttcattttact

SEQ ID NO: 4627240 - DNA, 17 bp, Homo sapiens
agaaggaaggcctgagc

SEQ ID NO: 4627241 - DNA, 23 bp, Homo sapiens
agaaggacatgagatcagggcct

SEQ ID NO: 4627242 - DNA, 22 bp, Homo sapiens
agaaggaggaatgctggactgg

SEQ ID NO: 4627243 - DNA, 23 bp, Homo sapiens
agaaggcattggcatctgctttt

SEQ ID NO: 4627244 - DNA, 14 bp, Homo sapiens
agaaggctggagaa

SEQ ID NO: 4627245 - DNA, 17 bp, Homo sapiens
agaaggcttaagaactg

SEQ ID NO: 4627246 - DNA, 18 bp, Homo sapiens
agaaggggcgtcataaat

SEQ ID NO: 4627247 - DNA, 14 bp, Homo sapiens
agaagggggccctg

SEQ ID NO: 4627248 - DNA, 17 bp, Homo sapiens
agaagggggccctgcta

SEQ ID NO: 4627249 - DNA, 18 bp, Homo sapiens
agaaggttaccaagaagc

SEQ ID NO: 4627250 - DNA, 17 bp, Homo sapiens
agaagtatttatcagga

SEQ ID NO: 4627251 - DNA, 22 bp, Homo sapiens
agaagtcagagagggtgacaag

SEQ ID NO: 4627252 - DNA, 18 bp, Homo sapiens
agaagttcaaaatcatgt

SEQ ID NO: 4627253 - DNA, 20 bp, Homo sapiens
agaagttgaggattgttgaa

SEQ ID NO: 4627254 - DNA, 21 bp, Homo sapiens
agaagtttcagttgtccttaa

SEQ ID NO: 4627255 - DNA, 16 bp, Homo sapiens
agaagtttgtagccag

SEQ ID NO: 4627256 - DNA, 18 bp, Homo sapiens
agaagtttgtagccaggt

SEQ ID NO: 4627257 - DNA, 15 bp, Homo sapiens
agaataaggcaggca

SEQ ID NO: 4627258 - DNA, 16 bp, Homo sapiens
agaataaggcaggcat

SEQ ID NO: 4627259 - DNA, 21 bp, Homo sapiens
agaatacccaggaagactttg

SEQ ID NO: 4627260 - DNA, 20 bp, Homo sapiens
agaatcagtaggaccaggcc

SEQ ID NO: 4627261 - DNA, 21 bp, Homo sapiens
agaatctaggccaccccaacc

SEQ ID NO: 4627262 - DNA, 22 bp, Homo sapiens
agaatctaggccaccccaacct

SEQ ID NO: 4627263 - DNA, 16 bp, Homo sapiens
agaatgaagccattta

SEQ ID NO: 4627264 - DNA, 21 bp, Homo sapiens
agaatgagagcgacacagacg

SEQ ID NO: 4627265 - DNA, 21 bp, Homo sapiens
agaatgagcctacgctgaaga

SEQ ID NO: 4627266 - DNA, 22 bp, Homo sapiens
agaatgagtgaagtattgctga

SEQ ID NO: 4627267 - DNA, 19 bp, Homo sapiens
agaatgccactttggctga

SEQ ID NO: 4627268 - DNA, 23 bp, Homo sapiens
agaatggataaaataatgctgca

SEQ ID NO: 4627269 - DNA, 21 bp, Homo sapiens
agaatgtgtgtgtgtggcagg

SEQ ID NO: 4627270 - DNA, 16 bp, Homo sapiens
agaatgttgtacttga

SEQ ID NO: 4627271 - DNA, 18 bp, Homo sapiens
agaattatacagacctaa

SEQ ID NO: 4627272 - DNA, 18 bp, Homo sapiens
agaattatttgccttctg

SEQ ID NO: 4627273 - DNA, 16 bp, Homo sapiens
agaattgcacatctaa

SEQ ID NO: 4627274 - DNA, 16 bp, Homo sapiens
agaattggctcaataa

SEQ ID NO: 4627275 - DNA, 16 bp, Homo sapiens
agaatttggggcagga

SEQ ID NO: 4627276 - DNA, 22 bp, Homo sapiens
agaattttcctgagacaaattt

SEQ ID NO: 4627277 - DNA, 22 bp, Homo sapiens
agacaaaagtctgtctttcctg

SEQ ID NO: 4627278 - DNA, 17 bp, Homo sapiens
agacaacagcacacagg

SEQ ID NO: 4627279 - DNA, 19 bp, Homo sapiens
agacaacaggtaaaacagg

SEQ ID NO: 4627280 - DNA, 13 bp, Homo sapiens
agacaaggtgcta

SEQ ID NO: 4627281 - DNA, 15 bp, Homo sapiens
agacaaggtgctaac

SEQ ID NO: 4627282 - DNA, 14 bp, Homo sapiens
agacacagataata

SEQ ID NO: 4627283 - DNA, 15 bp, Homo sapiens
agacacagataataa

SEQ ID NO: 4627284 - DNA, 18 bp, Homo sapiens
agacaccctaatgtggca

SEQ ID NO: 4627285 - DNA, 19 bp, Homo sapiens
agacacgtggcctcgtgag

SEQ ID NO: 4627286 - DNA, 16 bp, Homo sapiens
agacactcaaatatga

SEQ ID NO: 4627287 - DNA, 14 bp, Homo sapiens
agacactctgacaa

SEQ ID NO: 4627288 - DNA, 18 bp, Homo sapiens
agacactctgacaagctg

SEQ ID NO: 4627289 - DNA, 22 bp, Homo sapiens
agacagaaaactaaaaaggaag

SEQ ID NO: 4627290 - DNA, 17 bp, Homo sapiens
agacagaaccttgttat

SEQ ID NO: 4627291 - DNA, 16 bp, Homo sapiens
agacagaagtctcctc

SEQ ID NO: 4627292 - DNA, 17 bp, Homo sapiens
agacagaagtctcctca

SEQ ID NO: 4627293 - DNA, 12 bp, Homo sapiens
agacagaatctc

SEQ ID NO: 4627294 - DNA, 18 bp, Homo sapiens
agacagcaggcagcgcca

SEQ ID NO: 4627295 - DNA, 14 bp, Homo sapiens
agacagccaggtag

SEQ ID NO: 4627296 - DNA, 22 bp, Homo sapiens
agacagccaggtagttggaact

SEQ ID NO: 4627297 - DNA, 17 bp, Homo sapiens
agacagctccaccctgg

SEQ ID NO: 4627298 - DNA, 14 bp, Homo sapiens
agacaggatgaggt

SEQ ID NO: 4627299 - DNA, 20 bp, Homo sapiens
agacagggctcatttttgca

SEQ ID NO: 4627300 - DNA, 15 bp, Homo sapiens
agacagtcctttccc

SEQ ID NO: 4627301 - DNA, 22 bp, Homo sapiens
agacagtgtttcgtcatgttgg

SEQ ID NO: 4627302 - DNA, 12 bp, Homo sapiens
agacataaagcc

SEQ ID NO: 4627303 - DNA, 14 bp, Homo sapiens
agacatcattgtca

SEQ ID NO: 4627304 - DNA, 20 bp, Homo sapiens
agacatcattgtcagccttg

SEQ ID NO: 4627305 - DNA, 21 bp, Homo sapiens
agacatcattgtcagccttgc

SEQ ID NO: 4627306 - DNA, 17 bp, Homo sapiens
agacatgcccaaaactt

SEQ ID NO: 4627307 - DNA, 22 bp, Homo sapiens
agacccaacacatgggacctat

SEQ ID NO: 4627308 - DNA, 14 bp, Homo sapiens
agacccagcccctt

SEQ ID NO: 4627309 - DNA, 17 bp, Homo sapiens
agacccagccccttccc

SEQ ID NO: 4627310 - DNA, 15 bp, Homo sapiens
agaccccagtgcctg

SEQ ID NO: 4627311 - DNA, 18 bp, Homo sapiens
agaccccgcacccggctc

SEQ ID NO: 4627312 - DNA, 13 bp, Homo sapiens
agacccctgggag

SEQ ID NO: 4627313 - DNA, 20 bp, Homo sapiens
agaccctgcaaacagaacag

SEQ ID NO: 4627314 - DNA, 21 bp, Homo sapiens
agaccctgcaaacagaacagg

SEQ ID NO: 4627315 - DNA, 21 bp, Homo sapiens
agacctcatctgtggagctgc

SEQ ID NO: 4627316 - DNA, 11 bp, Homo sapiens
agacctctgga

SEQ ID NO: 4627317 - DNA, 12 bp, Homo sapiens
agacctctggat

SEQ ID NO: 4627318 - DNA, 20 bp, Homo sapiens
agacctctggttaatttata

SEQ ID NO: 4627319 - DNA, 14 bp, Homo sapiens
agacctgccagcca

SEQ ID NO: 4627320 - DNA, 23 bp, Homo sapiens
agacctgccagccactgtcaccg

SEQ ID NO: 4627321 - DNA, 18 bp, Homo sapiens
agacctgttagcagacag

SEQ ID NO: 4627322 - DNA, 13 bp, Homo sapiens
agacgcagagcaa

SEQ ID NO: 4627323 - DNA, 18 bp, Homo sapiens
agacgggaggggaggcat

SEQ ID NO: 4627324 - DNA, 21 bp, Homo sapiens
agacggtgttttgccatgttg

SEQ ID NO: 4627325 - DNA, 17 bp, Homo sapiens
agactcagttttttgta

SEQ ID NO: 4627326 - DNA, 20 bp, Homo sapiens
agactcctgaggacagctgt

SEQ ID NO: 4627327 - DNA, 17 bp, Homo sapiens
agactcgcctatcttag

SEQ ID NO: 4627328 - DNA, 18 bp, Homo sapiens
agactcgcctatcttagg

SEQ ID NO: 4627329 - DNA, 19 bp, Homo sapiens
agactctaggttatacaat

SEQ ID NO: 4627330 - DNA, 19 bp, Homo sapiens
agactctcgcatcttccca

SEQ ID NO: 4627331 - DNA, 23 bp, Homo sapiens
agactctcgcatcttcccaaccc

SEQ ID NO: 4627332 - DNA, 16 bp, Homo sapiens
agactcttgctcctgc

SEQ ID NO: 4627333 - DNA, 17 bp, Homo sapiens
agactctttaataaatt

SEQ ID NO: 4627334 - DNA, 12 bp, Homo sapiens
agactgaccaat

SEQ ID NO: 4627335 - DNA, 13 bp, Homo sapiens
agactgagaactt

SEQ ID NO: 4627336 - DNA, 15 bp, Homo sapiens
agactggttttctgc

SEQ ID NO: 4627337 - DNA, 18 bp, Homo sapiens
agactgtacattatgaag

SEQ ID NO: 4627338 - DNA, 18 bp, Homo sapiens
agactgtagcttctcttg

SEQ ID NO: 4627339 - DNA, 19 bp, Homo sapiens
agactgtagcttctcttgc

SEQ ID NO: 4627340 - DNA, 21 bp, Homo sapiens
agactgtagcttctcttgctc

SEQ ID NO: 4627341 - DNA, 15 bp, Homo sapiens
agactgtgaacttga

SEQ ID NO: 4627342 - DNA, 22 bp, Homo sapiens
agactgtgaacttgactgggtg

SEQ ID NO: 4627343 - DNA, 15 bp, Homo sapiens
agacttactattaca

SEQ ID NO: 4627344 - DNA, 16 bp, Homo sapiens
agacttgtgcatccct

SEQ ID NO: 4627345 - DNA, 17 bp, Homo sapiens
agactttatgtagtttt

SEQ ID NO: 4627346 - DNA, 14 bp, Homo sapiens
agactttggaaaat

SEQ ID NO: 4627347 - DNA, 21 bp, Homo sapiens
agactttgtgttcatttcatt

SEQ ID NO: 4627348 - DNA, 13 bp, Homo sapiens
agagaaagagaga

SEQ ID NO: 4627349 - DNA, 14 bp, Homo sapiens
agagaaagagagaa

SEQ ID NO: 4627350 - DNA, 15 bp, Homo sapiens
agagaaagagagaag

SEQ ID NO: 4627351 - DNA, 17 bp, Homo sapiens
agagaaagagagaagcc

SEQ ID NO: 4627352 - DNA, 14 bp, Homo sapiens
agagaaagcgcaga

SEQ ID NO: 4627353 - DNA, 12 bp, Homo sapiens
agagaagaatga

SEQ ID NO: 4627354 - DNA, 13 bp, Homo sapiens
agagaagccagcc

SEQ ID NO: 4627355 - DNA, 15 bp, Homo sapiens
agagaagccagccac

SEQ ID NO: 4627356 - DNA, 19 bp, Homo sapiens
agagaagccagccacagac

SEQ ID NO: 4627357 - DNA, 12 bp, Homo sapiens
agagaatgagag

SEQ ID NO: 4627358 - DNA, 23 bp, Homo sapiens
agagaatgagagcgacacagacg

SEQ ID NO: 4627359 - DNA, 12 bp, Homo sapiens
agagaatgtgtg

SEQ ID NO: 4627360 - DNA, 20 bp, Homo sapiens
agagaatgtgtgtgtgtggc

SEQ ID NO: 4627361 - DNA, 15 bp, Homo sapiens
agagaattggctcaa

SEQ ID NO: 4627362 - DNA, 19 bp, Homo sapiens
agagacacatacagagtgg

SEQ ID NO: 4627363 - DNA, 22 bp, Homo sapiens
agagacacatacagagtgggcc

SEQ ID NO: 4627364 - DNA, 16 bp, Homo sapiens
agagacactcccccct

SEQ ID NO: 4627365 - DNA, 21 bp, Homo sapiens
agagacactcccccctccatt

SEQ ID NO: 4627366 - DNA, 14 bp, Homo sapiens
agagaccacacatt

SEQ ID NO: 4627367 - DNA, 15 bp, Homo sapiens
agagaccacacattt

SEQ ID NO: 4627368 - DNA, 15 bp, Homo sapiens
agagaccccgcaccc

SEQ ID NO: 4627369 - DNA, 19 bp, Homo sapiens
agagaccccgcacccggct

SEQ ID NO: 4627370 - DNA, 15 bp, Homo sapiens
agagacctctgccta

SEQ ID NO: 4627371 - DNA, 14 bp, Homo sapiens
agagagaatgagag

SEQ ID NO: 4627372 - DNA, 17 bp, Homo sapiens
agagagaccccgcaccc

SEQ ID NO: 4627373 - DNA, 22 bp, Homo sapiens
agagagaccccgcacccggctc

SEQ ID NO: 4627374 - DNA, 17 bp, Homo sapiens
agagagggaattctctt

SEQ ID NO: 4627375 - DNA, 16 bp, Homo sapiens
agagagggagaagaag

SEQ ID NO: 4627376 - DNA, 14 bp, Homo sapiens
agagagtgtgtgtt

SEQ ID NO: 4627377 - DNA, 21 bp, Homo sapiens
agagatatttaggaaaatgct

SEQ ID NO: 4627378 - DNA, 16 bp, Homo sapiens
agagatcccaggaggt

SEQ ID NO: 4627379 - DNA, 20 bp, Homo sapiens
agagatcccaggaggtgcag

SEQ ID NO: 4627380 - DNA, 22 bp, Homo sapiens
agagatcccttaagaagttaga

SEQ ID NO: 4627381 - DNA, 16 bp, Homo sapiens
agagcaaaagggagga

SEQ ID NO: 4627382 - DNA, 19 bp, Homo sapiens
agagcaagtcctcactctt

SEQ ID NO: 4627383 - DNA, 15 bp, Homo sapiens
agagcacctgtagct

SEQ ID NO: 4627384 - DNA, 16 bp, Homo sapiens
agagcacttgagctgt

SEQ ID NO: 4627385 - DNA, 15 bp, Homo sapiens
agagcagacaggcta

SEQ ID NO: 4627386 - DNA, 18 bp, Homo sapiens
agagcaggaggtgcctga

SEQ ID NO: 4627387 - DNA, 15 bp, Homo sapiens
agagcatcatgcctc

SEQ ID NO: 4627388 - DNA, 21 bp, Homo sapiens
agagcatcatgcctctgaggc

SEQ ID NO: 4627389 - DNA, 14 bp, Homo sapiens
agagcatgaaattt

SEQ ID NO: 4627390 - DNA, 15 bp, Homo sapiens
agagcatgatgggag

SEQ ID NO: 4627391 - DNA, 16 bp, Homo sapiens
agagcatgatgggagg

SEQ ID NO: 4627392 - DNA, 10 bp, Homo sapiens
agagccacct

SEQ ID NO: 4627393 - DNA, 13 bp, Homo sapiens
agagcccccagcc

SEQ ID NO: 4627394 - DNA, 16 bp, Homo sapiens
agagcccccagccctg

SEQ ID NO: 4627395 - DNA, 15 bp, Homo sapiens
agagcccctcctcca

SEQ ID NO: 4627396 - DNA, 12 bp, Homo sapiens
agagccctggga

SEQ ID NO: 4627397 - DNA, 19 bp, Homo sapiens
agagcctcgctttttcatc

SEQ ID NO: 4627398 - DNA, 14 bp, Homo sapiens
agagccttgacaat

SEQ ID NO: 4627399 - DNA, 10 bp, Homo sapiens
agagcgtcct

SEQ ID NO: 4627400 - DNA, 13 bp, Homo sapiens
agagcgtccttgg

SEQ ID NO: 4627401 - DNA, 17 bp, Homo sapiens
agagctaagggtgggtg

SEQ ID NO: 4627402 - DNA, 23 bp, Homo sapiens
agagctaagggtgggtgctcaga

SEQ ID NO: 4627403 - DNA, 16 bp, Homo sapiens
agagctagaaaaataa

SEQ ID NO: 4627404 - DNA, 17 bp, Homo sapiens
agagctagaaaaataaa

SEQ ID NO: 4627405 - DNA, 20 bp, Homo sapiens
agagctagaaaaataaaatg

SEQ ID NO: 4627406 - DNA, 13 bp, Homo sapiens
agagctaggagca

SEQ ID NO: 4627407 - DNA, 19 bp, Homo sapiens
agagctaggagcaaagcct

SEQ ID NO: 4627408 - DNA, 20 bp, Homo sapiens
agagctcatcccccctgctg

SEQ ID NO: 4627409 - DNA, 21 bp, Homo sapiens
agagctcatcccccctgctgc

SEQ ID NO: 4627410 - DNA, 16 bp, Homo sapiens
agagctctacaggcct

SEQ ID NO: 4627411 - DNA, 17 bp, Homo sapiens
agagctgcctggatgag

SEQ ID NO: 4627412 - DNA, 11 bp, Homo sapiens
agagctgtgcc

SEQ ID NO: 4627413 - DNA, 13 bp, Homo sapiens
agagcttcctggg

SEQ ID NO: 4627414 - DNA, 14 bp, Homo sapiens
agagcttcctgggg

SEQ ID NO: 4627415 - DNA, 14 bp, Homo sapiens
agaggaaatctgta

SEQ ID NO: 4627416 - DNA, 19 bp, Homo sapiens
agaggaaattcaaatccct

SEQ ID NO: 4627417 - DNA, 15 bp, Homo sapiens
agaggaccggcggct

SEQ ID NO: 4627418 - DNA, 23 bp, Homo sapiens
agaggagatgtgatcaggcccca

SEQ ID NO: 4627419 - DNA, 16 bp, Homo sapiens
agaggatgaaggaagg

SEQ ID NO: 4627420 - DNA, 17 bp, Homo sapiens
agaggatgaaggaaggg

SEQ ID NO: 4627421 - DNA, 21 bp, Homo sapiens
agaggatgtggcctggttcaa

SEQ ID NO: 4627422 - DNA, 20 bp, Homo sapiens
agaggattgcttgagcccag

SEQ ID NO: 4627423 - DNA, 19 bp, Homo sapiens
agaggcagcatgcttgggc

SEQ ID NO: 4627424 - DNA, 22 bp, Homo sapiens
agaggcagcatgcttgggctga

SEQ ID NO: 4627425 - DNA, 23 bp, Homo sapiens
agaggccctggaggtctccaggg

SEQ ID NO: 4627426 - DNA, 15 bp, Homo sapiens
agaggccctggatca

SEQ ID NO: 4627427 - DNA, 15 bp, Homo sapiens
agaggcgagaggtga

SEQ ID NO: 4627428 - DNA, 22 bp, Homo sapiens
agaggcttccctacacagggcc

SEQ ID NO: 4627429 - DNA, 20 bp, Homo sapiens
agagggacaaccagaaggcc

SEQ ID NO: 4627430 - DNA, 18 bp, Homo sapiens
agagggacaggctgaaga

SEQ ID NO: 4627431 - DNA, 23 bp, Homo sapiens
agagggagtttaatacaggaaat

SEQ ID NO: 4627432 - DNA, 18 bp, Homo sapiens
agagggcagactgtgaac

SEQ ID NO: 4627433 - DNA, 19 bp, Homo sapiens
agagggccacggggaggcc

SEQ ID NO: 4627434 - DNA, 15 bp, Homo sapiens
agagggccgggcaga

SEQ ID NO: 4627435 - DNA, 17 bp, Homo sapiens
agaggggtcacacccac

SEQ ID NO: 4627436 - DNA, 19 bp, Homo sapiens
agaggggtcacacccaccc

SEQ ID NO: 4627437 - DNA, 14 bp, Homo sapiens
agaggtcaccagct

SEQ ID NO: 4627438 - DNA, 13 bp, Homo sapiens
agaggtctccaaa

SEQ ID NO: 4627439 - DNA, 18 bp, Homo sapiens
agaggtgaccccagggca

SEQ ID NO: 4627440 - DNA, 24 bp, Homo sapiens
agaggtgaccccagggcacaggag

SEQ ID NO: 4627441 - DNA, 17 bp, Homo sapiens
agagtaaattgctctgt

SEQ ID NO: 4627442 - DNA, 16 bp, Homo sapiens
agagtacttaatatac

SEQ ID NO: 4627443 - DNA, 17 bp, Homo sapiens
agagtacttaatatact

SEQ ID NO: 4627444 - DNA, 13 bp, Homo sapiens
agagtcctgcctt

SEQ ID NO: 4627445 - DNA, 21 bp, Homo sapiens
agagtctaatagtctttgcca

SEQ ID NO: 4627446 - DNA, 12 bp, Homo sapiens
agagtggcctcc

SEQ ID NO: 4627447 - DNA, 14 bp, Homo sapiens
agagtggcctccct

SEQ ID NO: 4627448 - DNA, 18 bp, Homo sapiens
agagtgggccccgggctg

SEQ ID NO: 4627449 - DNA, 23 bp, Homo sapiens
agagtgtagcctaaagggcaggg

SEQ ID NO: 4627450 - DNA, 12 bp, Homo sapiens
agagtgtagctg

SEQ ID NO: 4627451 - DNA, 16 bp, Homo sapiens
agagtgtagctgtaag

SEQ ID NO: 4627452 - DNA, 20 bp, Homo sapiens
agagtgtagctgtaagggca

SEQ ID NO: 4627453 - DNA, 17 bp, Homo sapiens
agagtgtggcaaaataa

SEQ ID NO: 4627454 - DNA, 18 bp, Homo sapiens
agagttgtgatggagggg

SEQ ID NO: 4627455 - DNA, 19 bp, Homo sapiens
agagtttggaattattgta

SEQ ID NO: 4627456 - DNA, 17 bp, Homo sapiens
agataaaactctagcag

SEQ ID NO: 4627457 - DNA, 23 bp, Homo sapiens
agataagcttttggtaatattca

SEQ ID NO: 4627458 - DNA, 15 bp, Homo sapiens
agataatatttttgt

SEQ ID NO: 4627459 - DNA, 23 bp, Homo sapiens
agataatcaagggcactgtgata

SEQ ID NO: 4627460 - DNA, 13 bp, Homo sapiens
agataatccctgt

SEQ ID NO: 4627461 - DNA, 13 bp, Homo sapiens
agataatgctttt

SEQ ID NO: 4627462 - DNA, 12 bp, Homo sapiens
agataatttgaa

SEQ ID NO: 4627463 - DNA, 22 bp, Homo sapiens
agatagaaatagttggttccta

SEQ ID NO: 4627464 - DNA, 22 bp, Homo sapiens
agatagaacacaaaacttgaaa

SEQ ID NO: 4627465 - DNA, 17 bp, Homo sapiens
agatagatgttgctctt

SEQ ID NO: 4627466 - DNA, 14 bp, Homo sapiens
agatagcattgtga

SEQ ID NO: 4627467 - DNA, 22 bp, Homo sapiens
agatatgccactaacttctaaa

SEQ ID NO: 4627468 - DNA, 19 bp, Homo sapiens
agatattgatcaaatatag

SEQ ID NO: 4627469 - DNA, 20 bp, Homo sapiens
agatatttaggaaaatgctt

SEQ ID NO: 4627470 - DNA, 17 bp, Homo sapiens
agatatttcaagctcat

SEQ ID NO: 4627471 - DNA, 16 bp, Homo sapiens
agatcaacgcctcact

SEQ ID NO: 4627472 - DNA, 18 bp, Homo sapiens
agatcaagctgtgagaca

SEQ ID NO: 4627473 - DNA, 23 bp, Homo sapiens
agatcacagccccacccttgtcc

SEQ ID NO: 4627474 - DNA, 18 bp, Homo sapiens
agatcagaaagtgacatt

SEQ ID NO: 4627475 - DNA, 17 bp, Homo sapiens
agatcaggatcagcttt

SEQ ID NO: 4627476 - DNA, 21 bp, Homo sapiens
agatcaggctagccctgccct

SEQ ID NO: 4627477 - DNA, 17 bp, Homo sapiens
agatcagggcctgcccc

SEQ ID NO: 4627478 - DNA, 18 bp, Homo sapiens
agatcagggcctgccccc

SEQ ID NO: 4627479 - DNA, 21 bp, Homo sapiens
agatcagggcctgccccctgg

SEQ ID NO: 4627480 - DNA, 16 bp, Homo sapiens
agatcatatacgtgaa

SEQ ID NO: 4627481 - DNA, 15 bp, Homo sapiens
agatcattgccatca

SEQ ID NO: 4627482 - DNA, 21 bp, Homo sapiens
agatcatttataatactgttt

SEQ ID NO: 4627483 - DNA, 14 bp, Homo sapiens
agatcccaggaggt

SEQ ID NO: 4627484 - DNA, 20 bp, Homo sapiens
agatcccaggaggtgcagtg

SEQ ID NO: 4627485 - DNA, 16 bp, Homo sapiens
agatccctgcagaacc

SEQ ID NO: 4627486 - DNA, 16 bp, Homo sapiens
agatcccttaagaagt

SEQ ID NO: 4627487 - DNA, 15 bp, Homo sapiens
agatccttccttttg

SEQ ID NO: 4627488 - DNA, 13 bp, Homo sapiens
agatcgacagaca

SEQ ID NO: 4627489 - DNA, 13 bp, Homo sapiens
agatctgcatctg

SEQ ID NO: 4627490 - DNA, 15 bp, Homo sapiens
agatctgccagacct

SEQ ID NO: 4627491 - DNA, 20 bp, Homo sapiens
agatctgccagacctgcatg

SEQ ID NO: 4627492 - DNA, 15 bp, Homo sapiens
agatctggggaggca

SEQ ID NO: 4627493 - DNA, 16 bp, Homo sapiens
agatctggggaggcag

SEQ ID NO: 4627494 - DNA, 11 bp, Homo sapiens
agatgagccca

SEQ ID NO: 4627495 - DNA, 13 bp, Homo sapiens
agatgaggccctg

SEQ ID NO: 4627496 - DNA, 16 bp, Homo sapiens
agatgatacatccaaa

SEQ ID NO: 4627497 - DNA, 20 bp, Homo sapiens
agatgatacatccaaagcag

SEQ ID NO: 4627498 - DNA, 17 bp, Homo sapiens
agatgatcgctgtattt

SEQ ID NO: 4627499 - DNA, 21 bp, Homo sapiens
agatgattatatattgttgtt

SEQ ID NO: 4627500 - DNA, 19 bp, Homo sapiens
agatgcaatgtgctactga

SEQ ID NO: 4627501 - DNA, 13 bp, Homo sapiens
agatgcagctgga

SEQ ID NO: 4627502 - DNA, 15 bp, Homo sapiens
agatgcagctggaaa

SEQ ID NO: 4627503 - DNA, 23 bp, Homo sapiens
agatgccccctccaggagagagc

SEQ ID NO: 4627504 - DNA, 14 bp, Homo sapiens
agatgcccttgctg

SEQ ID NO: 4627505 - DNA, 21 bp, Homo sapiens
agatgcccttgctgggcctgg

SEQ ID NO: 4627506 - DNA, 23 bp, Homo sapiens
agatgcccttgctgggcctgggg

SEQ ID NO: 4627507 - DNA, 19 bp, Homo sapiens
agatgctagcacatgccct

SEQ ID NO: 4627508 - DNA, 21 bp, Homo sapiens
agatgcttggttgtgttgagg

SEQ ID NO: 4627509 - DNA, 17 bp, Homo sapiens
agatggaagcttactct

SEQ ID NO: 4627510 - DNA, 17 bp, Homo sapiens
agatggacacgagccac

SEQ ID NO: 4627511 - DNA, 23 bp, Homo sapiens
agatggacacgagccacaagctg

SEQ ID NO: 4627512 - DNA, 15 bp, Homo sapiens
agatggagtctcact

SEQ ID NO: 4627513 - DNA, 19 bp, Homo sapiens
agatggagttcttgtgcca

SEQ ID NO: 4627514 - DNA, 14 bp, Homo sapiens
agatggctttcagg

SEQ ID NO: 4627515 - DNA, 17 bp, Homo sapiens
agatgggccaggcagag

SEQ ID NO: 4627516 - DNA, 14 bp, Homo sapiens
agatgtaggaggga

SEQ ID NO: 4627517 - DNA, 16 bp, Homo sapiens
agatgtaggagggact

SEQ ID NO: 4627518 - DNA, 18 bp, Homo sapiens
agatgtgatcaggcccca

SEQ ID NO: 4627519 - DNA, 22 bp, Homo sapiens
agatgtgatcaggccccacccc

SEQ ID NO: 4627520 - DNA, 17 bp, Homo sapiens
agatgttgctctttcac

SEQ ID NO: 4627521 - DNA, 22 bp, Homo sapiens
agatgtttggatattttttggt

SEQ ID NO: 4627522 - DNA, 17 bp, Homo sapiens
agatgttttacgtctgg

SEQ ID NO: 4627523 - DNA, 21 bp, Homo sapiens
agattcaaatctcttgctttc

SEQ ID NO: 4627524 - DNA, 20 bp, Homo sapiens
agattgttggtgaattttca

SEQ ID NO: 4627525 - DNA, 18 bp, Homo sapiens
agatttaagttcctgctg

SEQ ID NO: 4627526 - DNA, 21 bp, Homo sapiens
agatttaagttcctgctgcct

SEQ ID NO: 4627527 - DNA, 12 bp, Homo sapiens
agatttcaagat

SEQ ID NO: 4627528 - DNA, 14 bp, Homo sapiens
agattttcatgcaa

SEQ ID NO: 4627529 - DNA, 15 bp, Homo sapiens
agattttcattttag

SEQ ID NO: 4627530 - DNA, 19 bp, Homo sapiens
agattttcattttagtgta

SEQ ID NO: 4627531 - DNA, 18 bp, Homo sapiens
agattttcctccattttt

SEQ ID NO: 4627532 - DNA, 17 bp, Homo sapiens
agattttcctcttgtga

SEQ ID NO: 4627533 - DNA, 20 bp, Homo sapiens
agattttcctcttgtgattt

SEQ ID NO: 4627534 - DNA, 23 bp, Homo sapiens
agattttgttttgttggacattt

SEQ ID NO: 4627535 - DNA, 17 bp, Homo sapiens
agcaaacctagccccca

SEQ ID NO: 4627536 - DNA, 13 bp, Homo sapiens
agcaaactctgct

SEQ ID NO: 4627537 - DNA, 15 bp, Homo sapiens
agcaaactctgctgt

SEQ ID NO: 4627538 - DNA, 15 bp, Homo sapiens
agcaaattttcagca

SEQ ID NO: 4627539 - DNA, 21 bp, Homo sapiens
agcaaccgtggcccttcctgg

SEQ ID NO: 4627540 - DNA, 23 bp, Homo sapiens
agcaaccgtggcccttcctggac

SEQ ID NO: 4627541 - DNA, 16 bp, Homo sapiens
agcaactaatgtttga

SEQ ID NO: 4627542 - DNA, 21 bp, Homo sapiens
agcaactaatgtttgaacaaa

SEQ ID NO: 4627543 - DNA, 17 bp, Homo sapiens
agcaagacacgtggcct

SEQ ID NO: 4627544 - DNA, 19 bp, Homo sapiens
agcaagacctcatctgtgg

SEQ ID NO: 4627545 - DNA, 16 bp, Homo sapiens
agcaagagggaacaaa

SEQ ID NO: 4627546 - DNA, 12 bp, Homo sapiens
agcaaggcccga

SEQ ID NO: 4627547 - DNA, 17 bp, Homo sapiens
agcaaggcccgagcagc

SEQ ID NO: 4627548 - DNA, 19 bp, Homo sapiens
agcaaggcccgagcagctg

SEQ ID NO: 4627549 - DNA, 14 bp, Homo sapiens
agcaagtcagggtt

SEQ ID NO: 4627550 - DNA, 15 bp, Homo sapiens
agcaatcattttatg

SEQ ID NO: 4627551 - DNA, 22 bp, Homo sapiens
agcaatttaactagacacagat

SEQ ID NO: 4627552 - DNA, 19 bp, Homo sapiens
agcacaatcactaaacttt

SEQ ID NO: 4627553 - DNA, 16 bp, Homo sapiens
agcacacaggcagcca

SEQ ID NO: 4627554 - DNA, 14 bp, Homo sapiens
agcacacagggcag

SEQ ID NO: 4627555 - DNA, 12 bp, Homo sapiens
agcacagccaac

SEQ ID NO: 4627556 - DNA, 19 bp, Homo sapiens
agcacagctcctgccaggg

SEQ ID NO: 4627557 - DNA, 15 bp, Homo sapiens
agcacaggctggcag

SEQ ID NO: 4627558 - DNA, 22 bp, Homo sapiens
agcaccagtgggactgtggtga

SEQ ID NO: 4627559 - DNA, 15 bp, Homo sapiens
agcacctacagtgta

SEQ ID NO: 4627560 - DNA, 19 bp, Homo sapiens
agcacctacagtgtacagt

SEQ ID NO: 4627561 - DNA, 16 bp, Homo sapiens
agcactactgggtgtc

SEQ ID NO: 4627562 - DNA, 18 bp, Homo sapiens
agcactactgggtgtcat

SEQ ID NO: 4627563 - DNA, 22 bp, Homo sapiens
agcactccccagagctgtgcca

SEQ ID NO: 4627564 - DNA, 23 bp, Homo sapiens
agcactccccagagctgtgccag

SEQ ID NO: 4627565 - DNA, 12 bp, Homo sapiens
agcactgccagg

SEQ ID NO: 4627566 - DNA, 13 bp, Homo sapiens
agcactgccagga

SEQ ID NO: 4627567 - DNA, 15 bp, Homo sapiens
agcactgccaggagg

SEQ ID NO: 4627568 - DNA, 16 bp, Homo sapiens
agcactgccaggaggg

SEQ ID NO: 4627569 - DNA, 23 bp, Homo sapiens
agcacttagacctgccagccact

SEQ ID NO: 4627570 - DNA, 17 bp, Homo sapiens
agcacttgagctgtctg

SEQ ID NO: 4627571 - DNA, 18 bp, Homo sapiens
agcacttgagctgtctga

SEQ ID NO: 4627572 - DNA, 19 bp, Homo sapiens
agcacttgcttacatcctc

SEQ ID NO: 4627573 - DNA, 21 bp, Homo sapiens
agcacttgcttacatcctctg

SEQ ID NO: 4627574 - DNA, 16 bp, Homo sapiens
agcacttgtccagctg

SEQ ID NO: 4627575 - DNA, 20 bp, Homo sapiens
agcagaaaacctgttcaggc

SEQ ID NO: 4627576 - DNA, 17 bp, Homo sapiens
agcagaacatactgttc

SEQ ID NO: 4627577 - DNA, 20 bp, Homo sapiens
agcagaatgttgtacttgaa

SEQ ID NO: 4627578 - DNA, 21 bp, Homo sapiens
agcagagatcgacagacagcc

SEQ ID NO: 4627579 - DNA, 16 bp, Homo sapiens
agcagcaatattttgt

SEQ ID NO: 4627580 - DNA, 18 bp, Homo sapiens
agcagcaatattttgtat

SEQ ID NO: 4627581 - DNA, 18 bp, Homo sapiens
agcagcaccgttctgtgc

SEQ ID NO: 4627582 - DNA, 18 bp, Homo sapiens
agcagcacttagacctgc

SEQ ID NO: 4627583 - DNA, 13 bp, Homo sapiens
agcagcagcactt

SEQ ID NO: 4627584 - DNA, 18 bp, Homo sapiens
agcagccagccctgcctg

SEQ ID NO: 4627585 - DNA, 21 bp, Homo sapiens
agcagccagccctgcctggag

SEQ ID NO: 4627586 - DNA, 23 bp, Homo sapiens
agcagccagccctgcctggagga

SEQ ID NO: 4627587 - DNA, 13 bp, Homo sapiens
agcagcccttgct

SEQ ID NO: 4627588 - DNA, 16 bp, Homo sapiens
agcagctccaccactg

SEQ ID NO: 4627589 - DNA, 22 bp, Homo sapiens
agcagctgaataacctgcacag

SEQ ID NO: 4627590 - DNA, 13 bp, Homo sapiens
agcagctgagcag

SEQ ID NO: 4627591 - DNA, 17 bp, Homo sapiens
agcagctgagcagggcc

SEQ ID NO: 4627592 - DNA, 10 bp, Homo sapiens
agcaggaata

SEQ ID NO: 4627593 - DNA, 13 bp, Homo sapiens
agcaggaataaag

SEQ ID NO: 4627594 - DNA, 15 bp, Homo sapiens
agcaggagagaaatt

SEQ ID NO: 4627595 - DNA, 20 bp, Homo sapiens
agcaggaggctttctgggct

SEQ ID NO: 4627596 - DNA, 21 bp, Homo sapiens
agcaggaggctttctgggctc

SEQ ID NO: 4627597 - DNA, 22 bp, Homo sapiens
agcaggaggctttctgggctct

SEQ ID NO: 4627598 - DNA, 13 bp, Homo sapiens
agcaggagtggtg

SEQ ID NO: 4627599 - DNA, 14 bp, Homo sapiens
agcagggccgggga

SEQ ID NO: 4627600 - DNA, 16 bp, Homo sapiens
agcagggctggtcacc

SEQ ID NO: 4627601 - DNA, 23 bp, Homo sapiens
agcagggctggtcacctcccatc

SEQ ID NO: 4627602 - DNA, 17 bp, Homo sapiens
agcaggggggctgtgcc

SEQ ID NO: 4627603 - DNA, 18 bp, Homo sapiens
agcagggtcttttcatct

SEQ ID NO: 4627604 - DNA, 22 bp, Homo sapiens
agcagggtcttttcatctggga

SEQ ID NO: 4627605 - DNA, 18 bp, Homo sapiens
agcaggttcccaagctca

SEQ ID NO: 4627606 - DNA, 18 bp, Homo sapiens
agcaggttccccaagggc

SEQ ID NO: 4627607 - DNA, 19 bp, Homo sapiens
agcagtgtgaagtacaata

SEQ ID NO: 4627608 - DNA, 20 bp, Homo sapiens
agcagttctcctgcctcagc

SEQ ID NO: 4627609 - DNA, 14 bp, Homo sapiens
agcataaaatgaaa

SEQ ID NO: 4627610 - DNA, 22 bp, Homo sapiens
agcatactttgtaaataggatt

SEQ ID NO: 4627611 - DNA, 16 bp, Homo sapiens
agcatatcgtttaatt

SEQ ID NO: 4627612 - DNA, 16 bp, Homo sapiens
agcatattttcttact

SEQ ID NO: 4627613 - DNA, 15 bp, Homo sapiens
agcatcatgcctctg

SEQ ID NO: 4627614 - DNA, 23 bp, Homo sapiens
agcatcatgcctctgaggccagc

SEQ ID NO: 4627615 - DNA, 15 bp, Homo sapiens
agcatcctcagttcc

SEQ ID NO: 4627616 - DNA, 22 bp, Homo sapiens
agcatcctgcccgagggcagcc

SEQ ID NO: 4627617 - DNA, 12 bp, Homo sapiens
agcatctcccag

SEQ ID NO: 4627618 - DNA, 14 bp, Homo sapiens
agcatctcccagca

SEQ ID NO: 4627619 - DNA, 17 bp, Homo sapiens
agcatctcccagcaaga

SEQ ID NO: 4627620 - DNA, 20 bp, Homo sapiens
agcatgaataacatttaaat

SEQ ID NO: 4627621 - DNA, 21 bp, Homo sapiens
agcatgatgggaggtgtgcca

SEQ ID NO: 4627622 - DNA, 20 bp, Homo sapiens
agcatgcttgggctgaccca

SEQ ID NO: 4627623 - DNA, 20 bp, Homo sapiens
agcatggagagaggcctgtg

SEQ ID NO: 4627624 - DNA, 17 bp, Homo sapiens
agcatggcggcacacat

SEQ ID NO: 4627625 - DNA, 17 bp, Homo sapiens
agcatgggtccagaaga

SEQ ID NO: 4627626 - DNA, 19 bp, Homo sapiens
agcatgtgatgttgtctta

SEQ ID NO: 4627627 - DNA, 16 bp, Homo sapiens
agcatgtgccttaatg

SEQ ID NO: 4627628 - DNA, 21 bp, Homo sapiens
agcattccacactgcagggag

SEQ ID NO: 4627629 - DNA, 23 bp, Homo sapiens
agcattgttttcttttacagact

SEQ ID NO: 4627630 - DNA, 22 bp, Homo sapiens
agcatttagttacaacctgaag

SEQ ID NO: 4627631 - DNA, 18 bp, Homo sapiens
agcatttcatgaaaaagc

SEQ ID NO: 4627632 - DNA, 17 bp, Homo sapiens
agcatttgcacctctgt

SEQ ID NO: 4627633 - DNA, 14 bp, Homo sapiens
agcattttgaaaca

SEQ ID NO: 4627634 - DNA, 18 bp, Homo sapiens
agcattttgaaacaaagt

SEQ ID NO: 4627635 - DNA, 14 bp, Homo sapiens
agcattttttatca

SEQ ID NO: 4627636 - DNA, 11 bp, Homo sapiens
agccaaagagt

SEQ ID NO: 4627637 - DNA, 21 bp, Homo sapiens
agccaactgctaatgcaaatt

SEQ ID NO: 4627638 - DNA, 22 bp, Homo sapiens
agccaagattttcctcttgtga

SEQ ID NO: 4627639 - DNA, 18 bp, Homo sapiens
agccaagtgccaaatgct

SEQ ID NO: 4627640 - DNA, 17 bp, Homo sapiens
agccacacttctcagga

SEQ ID NO: 4627641 - DNA, 18 bp, Homo sapiens
agccacagacccctggga

SEQ ID NO: 4627642 - DNA, 20 bp, Homo sapiens
agccacagacccctgggagc

SEQ ID NO: 4627643 - DNA, 11 bp, Homo sapiens
agccacaggac

SEQ ID NO: 4627644 - DNA, 12 bp, Homo sapiens
agccacaggacc

SEQ ID NO: 4627645 - DNA, 13 bp, Homo sapiens
agccacaggacca

SEQ ID NO: 4627646 - DNA, 14 bp, Homo sapiens
agccacaggaccac

SEQ ID NO: 4627647 - DNA, 15 bp, Homo sapiens
agccacaggaccacc

SEQ ID NO: 4627648 - DNA, 17 bp, Homo sapiens
agccacaggaccacctc

SEQ ID NO: 4627649 - DNA, 18 bp, Homo sapiens
agccacaggaccacctcc

SEQ ID NO: 4627650 - DNA, 21 bp, Homo sapiens
agccacatgtacactacattt

SEQ ID NO: 4627651 - DNA, 14 bp, Homo sapiens
agccaccctgagga

SEQ ID NO: 4627652 - DNA, 19 bp, Homo sapiens
agccaccctgaggagtctg

SEQ ID NO: 4627653 - DNA, 20 bp, Homo sapiens
agccaccctgaggagtctga

SEQ ID NO: 4627654 - DNA, 14 bp, Homo sapiens
agccacttccccct

SEQ ID NO: 4627655 - DNA, 17 bp, Homo sapiens
agccacttccccctctt

SEQ ID NO: 4627656 - DNA, 20 bp, Homo sapiens
agccacttctggcttcagcc

SEQ ID NO: 4627657 - DNA, 21 bp, Homo sapiens
agccagaacgtggctctgctg

SEQ ID NO: 4627658 - DNA, 12 bp, Homo sapiens
agccagaattct

SEQ ID NO: 4627659 - DNA, 20 bp, Homo sapiens
agccagaattctaccctgga

SEQ ID NO: 4627660 - DNA, 17 bp, Homo sapiens
agccagagacagaggat

SEQ ID NO: 4627661 - DNA, 17 bp, Homo sapiens
agccagcacacagggca

SEQ ID NO: 4627662 - DNA, 11 bp, Homo sapiens
agccagccaca

SEQ ID NO: 4627663 - DNA, 20 bp, Homo sapiens
agccagccctgcctggagga

SEQ ID NO: 4627664 - DNA, 24 bp, Homo sapiens
agccagccctgcctggaggacctg

SEQ ID NO: 4627665 - DNA, 20 bp, Homo sapiens
agccaggagcagccctggcc

SEQ ID NO: 4627666 - DNA, 22 bp, Homo sapiens
agccaggagcagccctggcccc

SEQ ID NO: 4627667 - DNA, 19 bp, Homo sapiens
agccaggaggcctgctagg

SEQ ID NO: 4627668 - DNA, 16 bp, Homo sapiens
agccaggatgcccaga

SEQ ID NO: 4627669 - DNA, 19 bp, Homo sapiens
agccaggatgcccagatga

SEQ ID NO: 4627670 - DNA, 15 bp, Homo sapiens
agccaggccaggaga

SEQ ID NO: 4627671 - DNA, 12 bp, Homo sapiens
agccaggcccca

SEQ ID NO: 4627672 - DNA, 20 bp, Homo sapiens
agccaggccccaccccttcc

SEQ ID NO: 4627673 - DNA, 19 bp, Homo sapiens
agccaggtacaggagaggc

SEQ ID NO: 4627674 - DNA, 20 bp, Homo sapiens
agccaggtacaggagaggca

SEQ ID NO: 4627675 - DNA, 22 bp, Homo sapiens
agccaggtacaggagaggcagc

SEQ ID NO: 4627676 - DNA, 19 bp, Homo sapiens
agccaggtatggctctgca

SEQ ID NO: 4627677 - DNA, 18 bp, Homo sapiens
agccaggtctcctgggaa

SEQ ID NO: 4627678 - DNA, 19 bp, Homo sapiens
agccaggtctcctgggaaa

SEQ ID NO: 4627679 - DNA, 18 bp, Homo sapiens
agccagttggatctctgg

SEQ ID NO: 4627680 - DNA, 16 bp, Homo sapiens
agccataattttgcat

SEQ ID NO: 4627681 - DNA, 22 bp, Homo sapiens
agccataattttgcatactgaa

SEQ ID NO: 4627682 - DNA, 15 bp, Homo sapiens
agccatgtataaatg

SEQ ID NO: 4627683 - DNA, 16 bp, Homo sapiens
agccatgtataaatgt

SEQ ID NO: 4627684 - DNA, 17 bp, Homo sapiens
agccatgtataaatgtg

SEQ ID NO: 4627685 - DNA, 18 bp, Homo sapiens
agccatgtataaatgtga

SEQ ID NO: 4627686 - DNA, 13 bp, Homo sapiens
agccatttcttat

SEQ ID NO: 4627687 - DNA, 14 bp, Homo sapiens
agcccaaggacagt

SEQ ID NO: 4627688 - DNA, 22 bp, Homo sapiens
agcccagatgttttacgtctgg

SEQ ID NO: 4627689 - DNA, 15 bp, Homo sapiens
agcccagcggcccaa

SEQ ID NO: 4627690 - DNA, 16 bp, Homo sapiens
agcccagctgggtcag

SEQ ID NO: 4627691 - DNA, 15 bp, Homo sapiens
agcccatggaggcag

SEQ ID NO: 4627692 - DNA, 23 bp, Homo sapiens
agcccatggaggcagatgccctt

SEQ ID NO: 4627693 - DNA, 15 bp, Homo sapiens
agcccattaatcttg

SEQ ID NO: 4627694 - DNA, 19 bp, Homo sapiens
agccccacccttgtccctc

SEQ ID NO: 4627695 - DNA, 17 bp, Homo sapiens
agccccatcggccaaga

SEQ ID NO: 4627696 - DNA, 22 bp, Homo sapiens
agccccattgctccattcactc

SEQ ID NO: 4627697 - DNA, 18 bp, Homo sapiens
agcccccaccaggggaag

SEQ ID NO: 4627698 - DNA, 14 bp, Homo sapiens
agcccccagccctg

SEQ ID NO: 4627699 - DNA, 22 bp, Homo sapiens
agcccccagccctgggaaccac

SEQ ID NO: 4627700 - DNA, 13 bp, Homo sapiens
agccccctcccta

SEQ ID NO: 4627701 - DNA, 14 bp, Homo sapiens
agccccgacttcct

SEQ ID NO: 4627702 - DNA, 13 bp, Homo sapiens
agcccctcctcca

SEQ ID NO: 4627703 - DNA, 14 bp, Homo sapiens
agcccctgacccgc

SEQ ID NO: 4627704 - DNA, 18 bp, Homo sapiens
agcccctgttttctgctg

SEQ ID NO: 4627705 - DNA, 15 bp, Homo sapiens
agccccttcccctgg

SEQ ID NO: 4627706 - DNA, 17 bp, Homo sapiens
agccccttcccctggga

SEQ ID NO: 4627707 - DNA, 22 bp, Homo sapiens
agccccttctgctcagctctgg

SEQ ID NO: 4627708 - DNA, 15 bp, Homo sapiens
agcccgacagtgcca

SEQ ID NO: 4627709 - DNA, 19 bp, Homo sapiens
agcccgtgccacccccagc

SEQ ID NO: 4627710 - DNA, 18 bp, Homo sapiens
agccctcagacatttata

SEQ ID NO: 4627711 - DNA, 17 bp, Homo sapiens
agccctcagctggtcct

SEQ ID NO: 4627712 - DNA, 23 bp, Homo sapiens
agccctgagtttcaagtatcctt

SEQ ID NO: 4627713 - DNA, 13 bp, Homo sapiens
agccctgcctgga

SEQ ID NO: 4627714 - DNA, 15 bp, Homo sapiens
agccctgcctggagg

SEQ ID NO: 4627715 - DNA, 16 bp, Homo sapiens
agccctgcctggagga

SEQ ID NO: 4627716 - DNA, 17 bp, Homo sapiens
agccctgcctggaggac

SEQ ID NO: 4627717 - DNA, 19 bp, Homo sapiens
agccctgcctggaggacct

SEQ ID NO: 4627718 - DNA, 21 bp, Homo sapiens
agccctgcctggaggacctga

SEQ ID NO: 4627719 - DNA, 23 bp, Homo sapiens
agccctgcctggaggacctgagc

SEQ ID NO: 4627720 - DNA, 14 bp, Homo sapiens
agccctggccccca

SEQ ID NO: 4627721 - DNA, 17 bp, Homo sapiens
agccctggcccctccaa

SEQ ID NO: 4627722 - DNA, 14 bp, Homo sapiens
agccctgggaacca

SEQ ID NO: 4627723 - DNA, 16 bp, Homo sapiens
agccctgggaaccact

SEQ ID NO: 4627724 - DNA, 20 bp, Homo sapiens
agccctgggaaccactccca

SEQ ID NO: 4627725 - DNA, 11 bp, Homo sapiens
agccctgggac

SEQ ID NO: 4627726 - DNA, 13 bp, Homo sapiens
agccctgggaccg

SEQ ID NO: 4627727 - DNA, 15 bp, Homo sapiens
agccctgggaccgct

SEQ ID NO: 4627728 - DNA, 20 bp, Homo sapiens
agccctgggaccgctacacc

SEQ ID NO: 4627729 - DNA, 17 bp, Homo sapiens
agcccttgcattgcaga

SEQ ID NO: 4627730 - DNA, 18 bp, Homo sapiens
agccgactctggccctgg

SEQ ID NO: 4627731 - DNA, 18 bp, Homo sapiens
agccggtaactgtcctgt

SEQ ID NO: 4627732 - DNA, 20 bp, Homo sapiens
agccggtaactgtcctgtcc

SEQ ID NO: 4627733 - DNA, 12 bp, Homo sapiens
agcctaagggat

SEQ ID NO: 4627734 - DNA, 16 bp, Homo sapiens
agcctaagggatcctg

SEQ ID NO: 4627735 - DNA, 22 bp, Homo sapiens
agcctaatccctgggcattgct

SEQ ID NO: 4627736 - DNA, 19 bp, Homo sapiens
agcctaccgctggccctgc

SEQ ID NO: 4627737 - DNA, 20 bp, Homo sapiens
agcctaccgctggccctgcc

SEQ ID NO: 4627738 - DNA, 14 bp, Homo sapiens
agcctaggccaggt

SEQ ID NO: 4627739 - DNA, 11 bp, Homo sapiens
agcctatggca

SEQ ID NO: 4627740 - DNA, 22 bp, Homo sapiens
agcctcaaaacgggtcagtatt

SEQ ID NO: 4627741 - DNA, 13 bp, Homo sapiens
agcctcacccctg

SEQ ID NO: 4627742 - DNA, 17 bp, Homo sapiens
agcctcacccctgcccc

SEQ ID NO: 4627743 - DNA, 23 bp, Homo sapiens
agcctcgcaacccgtgccaagtc

SEQ ID NO: 4627744 - DNA, 23 bp, Homo sapiens
agcctcgctctgttacccagggt

SEQ ID NO: 4627745 - DNA, 16 bp, Homo sapiens
agcctctttttgatac

SEQ ID NO: 4627746 - DNA, 23 bp, Homo sapiens
agcctgaggacagaaagaccctg

SEQ ID NO: 4627747 - DNA, 23 bp, Homo sapiens
agcctgaggtgcccactccgcca

SEQ ID NO: 4627748 - DNA, 18 bp, Homo sapiens
agcctgatgagattttta

SEQ ID NO: 4627749 - DNA, 23 bp, Homo sapiens
agcctgcattgagcttgcatgct

SEQ ID NO: 4627750 - DNA, 18 bp, Homo sapiens
agcctgcctcgccttgtg

SEQ ID NO: 4627751 - DNA, 11 bp, Homo sapiens
agcctgctgac

SEQ ID NO: 4627752 - DNA, 18 bp, Homo sapiens
agcctgctgacagacact

SEQ ID NO: 4627753 - DNA, 16 bp, Homo sapiens
agcctggactgtttca

SEQ ID NO: 4627754 - DNA, 11 bp, Homo sapiens
agcctggcctc

SEQ ID NO: 4627755 - DNA, 19 bp, Homo sapiens
agcctggcctcctgcctct

SEQ ID NO: 4627756 - DNA, 20 bp, Homo sapiens
agcctggcctcctgcctcta

SEQ ID NO: 4627757 - DNA, 17 bp, Homo sapiens
agcctggctgcccatca

SEQ ID NO: 4627758 - DNA, 12 bp, Homo sapiens
agcctgggccta

SEQ ID NO: 4627759 - DNA, 21 bp, Homo sapiens
agcctgggcctatggagagcc

SEQ ID NO: 4627760 - DNA, 23 bp, Homo sapiens
agcctgggcctatggagagccct

SEQ ID NO: 4627761 - DNA, 23 bp, Homo sapiens
agcctggggctctaacgcctgag

SEQ ID NO: 4627762 - DNA, 15 bp, Homo sapiens
agcctgggggcctgg

SEQ ID NO: 4627763 - DNA, 23 bp, Homo sapiens
agcctgggggcctggctggctga

SEQ ID NO: 4627764 - DNA, 17 bp, Homo sapiens
agcctgtgaacccagga

SEQ ID NO: 4627765 - DNA, 20 bp, Homo sapiens
agcctgtgaacccaggacaa

SEQ ID NO: 4627766 - DNA, 22 bp, Homo sapiens
agcctgtgaacccaggacaagc

SEQ ID NO: 4627767 - DNA, 18 bp, Homo sapiens
agcctgtgcgtcccagct

SEQ ID NO: 4627768 - DNA, 23 bp, Homo sapiens
agcctgtgcgtcccagctgaagg

SEQ ID NO: 4627769 - DNA, 14 bp, Homo sapiens
agcctgttcatggc

SEQ ID NO: 4627770 - DNA, 13 bp, Homo sapiens
agccttccagttt

SEQ ID NO: 4627771 - DNA, 15 bp, Homo sapiens
agccttccagttttg

SEQ ID NO: 4627772 - DNA, 18 bp, Homo sapiens
agccttccctctgcattg

SEQ ID NO: 4627773 - DNA, 24 bp, Homo sapiens
agccttccctctgcattgacctgg

SEQ ID NO: 4627774 - DNA, 12 bp, Homo sapiens
agccttcggaca

SEQ ID NO: 4627775 - DNA, 15 bp, Homo sapiens
agccttctgtaggaa

SEQ ID NO: 4627776 - DNA, 12 bp, Homo sapiens
agcctttaaatt

SEQ ID NO: 4627777 - DNA, 23 bp, Homo sapiens
agcctttgtggtttagttataaa

SEQ ID NO: 4627778 - DNA, 16 bp, Homo sapiens
agcgaacatcttcata

SEQ ID NO: 4627779 - DNA, 17 bp, Homo sapiens
agcgaacatcttcatat

SEQ ID NO: 4627780 - DNA, 18 bp, Homo sapiens
agcgaagacccggccagg

SEQ ID NO: 4627781 - DNA, 16 bp, Homo sapiens
agcgatgtatgcagct

SEQ ID NO: 4627782 - DNA, 15 bp, Homo sapiens
agcgatttgaaacac

SEQ ID NO: 4627783 - DNA, 12 bp, Homo sapiens
agcgccctgcag

SEQ ID NO: 4627784 - DNA, 13 bp, Homo sapiens
agcgccctgcaga

SEQ ID NO: 4627785 - DNA, 17 bp, Homo sapiens
agcgccctgcagaccct

SEQ ID NO: 4627786 - DNA, 18 bp, Homo sapiens
agcgccctgcagaccctg

SEQ ID NO: 4627787 - DNA, 23 bp, Homo sapiens
agcgccctgcagaccctgccctt

SEQ ID NO: 4627788 - DNA, 12 bp, Homo sapiens
agcgcccttcct

SEQ ID NO: 4627789 - DNA, 13 bp, Homo sapiens
agcgcccttcctc

SEQ ID NO: 4627790 - DNA, 15 bp, Homo sapiens
agcgcccttcctctc

SEQ ID NO: 4627791 - DNA, 16 bp, Homo sapiens
agcgcccttcctctcc

SEQ ID NO: 4627792 - DNA, 20 bp, Homo sapiens
agcggacagtggcaggacag

SEQ ID NO: 4627793 - DNA, 22 bp, Homo sapiens
agcggccggccagcccctggcc

SEQ ID NO: 4627794 - DNA, 17 bp, Homo sapiens
agcgggagcctccctgc

SEQ ID NO: 4627795 - DNA, 22 bp, Homo sapiens
agcgggcggaggggatccagcc

SEQ ID NO: 4627796 - DNA, 18 bp, Homo sapiens
agcgtcaaagaaaatgcc

SEQ ID NO: 4627797 - DNA, 15 bp, Homo sapiens
agcgtccttggctgc

SEQ ID NO: 4627798 - DNA, 17 bp, Homo sapiens
agcgttaagggcagagt

SEQ ID NO: 4627799 - DNA, 13 bp, Homo sapiens
agctaacagggaa

SEQ ID NO: 4627800 - DNA, 16 bp, Homo sapiens
agctaaggacatttcc

SEQ ID NO: 4627801 - DNA, 16 bp, Homo sapiens
agctaagggtgggtgc

SEQ ID NO: 4627802 - DNA, 21 bp, Homo sapiens
agctaataatgttaaccaagg

SEQ ID NO: 4627803 - DNA, 16 bp, Homo sapiens
agctaatttatagcaa

SEQ ID NO: 4627804 - DNA, 13 bp, Homo sapiens
agctaatttttgt

SEQ ID NO: 4627805 - DNA, 18 bp, Homo sapiens
agctacctgtgtggacag

SEQ ID NO: 4627806 - DNA, 19 bp, Homo sapiens
agctacctgtgtggacagg

SEQ ID NO: 4627807 - DNA, 18 bp, Homo sapiens
agctactgagaacataaa

SEQ ID NO: 4627808 - DNA, 17 bp, Homo sapiens
agctagaaaacattttt

SEQ ID NO: 4627809 - DNA, 12 bp, Homo sapiens
agctagactgtg

SEQ ID NO: 4627810 - DNA, 16 bp, Homo sapiens
agctagactgtgtctg

SEQ ID NO: 4627811 - DNA, 17 bp, Homo sapiens
agctagactgtgtctga

SEQ ID NO: 4627812 - DNA, 17 bp, Homo sapiens
agctaggagcaaagcct

SEQ ID NO: 4627813 - DNA, 18 bp, Homo sapiens
agctaggagcaaagcctg

SEQ ID NO: 4627814 - DNA, 20 bp, Homo sapiens
agctaggagcaaagcctgtt

SEQ ID NO: 4627815 - DNA, 15 bp, Homo sapiens
agctaggccccagag

SEQ ID NO: 4627816 - DNA, 17 bp, Homo sapiens
agctaggccccagaggc

SEQ ID NO: 4627817 - DNA, 18 bp, Homo sapiens
agctagtgacccacatgc

SEQ ID NO: 4627818 - DNA, 17 bp, Homo sapiens
agctatagttgcagccc

SEQ ID NO: 4627819 - DNA, 21 bp, Homo sapiens
agctatagttgcagcccaagg

SEQ ID NO: 4627820 - DNA, 22 bp, Homo sapiens
agctatctggtcaacctcctgg

SEQ ID NO: 4627821 - DNA, 19 bp, Homo sapiens
agctatttccttccagcct

SEQ ID NO: 4627822 - DNA, 18 bp, Homo sapiens
agctcaacggtctggcag

SEQ ID NO: 4627823 - DNA, 21 bp, Homo sapiens
agctcaacggtctggcagggc

SEQ ID NO: 4627824 - DNA, 18 bp, Homo sapiens
agctcacaaggcagcaag

SEQ ID NO: 4627825 - DNA, 19 bp, Homo sapiens
agctcacaaggcagcaagg

SEQ ID NO: 4627826 - DNA, 22 bp, Homo sapiens
agctcagaggcgcactgtgacc

SEQ ID NO: 4627827 - DNA, 24 bp, Homo sapiens
agctcagcagacatccacacacag

SEQ ID NO: 4627828 - DNA, 16 bp, Homo sapiens
agctcaggatatggct

SEQ ID NO: 4627829 - DNA, 16 bp, Homo sapiens
agctcaggtgcctttg

SEQ ID NO: 4627830 - DNA, 22 bp, Homo sapiens
agctcatcccccctgctgccca

SEQ ID NO: 4627831 - DNA, 14 bp, Homo sapiens
agctcatgtcatta

SEQ ID NO: 4627832 - DNA, 18 bp, Homo sapiens
agctcatgtcattatgac

SEQ ID NO: 4627833 - DNA, 21 bp, Homo sapiens
agctcatgtcattatgacatt

SEQ ID NO: 4627834 - DNA, 13 bp, Homo sapiens
agctccaccactg

SEQ ID NO: 4627835 - DNA, 14 bp, Homo sapiens
agctccaccactgt

SEQ ID NO: 4627836 - DNA, 15 bp, Homo sapiens
agctccaccactgtg

SEQ ID NO: 4627837 - DNA, 16 bp, Homo sapiens
agctccaccactgtgc

SEQ ID NO: 4627838 - DNA, 19 bp, Homo sapiens
agctccaccactgtgcact

SEQ ID NO: 4627839 - DNA, 19 bp, Homo sapiens
agctccatgttctcccaaa

SEQ ID NO: 4627840 - DNA, 18 bp, Homo sapiens
agctcccccaggcagaaa

SEQ ID NO: 4627841 - DNA, 13 bp, Homo sapiens
agctcccctgcct

SEQ ID NO: 4627842 - DNA, 23 bp, Homo sapiens
agctcccctgccttaacctggga

SEQ ID NO: 4627843 - DNA, 12 bp, Homo sapiens
agctcccttccg

SEQ ID NO: 4627844 - DNA, 13 bp, Homo sapiens
agctcctgatcag

SEQ ID NO: 4627845 - DNA, 15 bp, Homo sapiens
agctctacaggcctg

SEQ ID NO: 4627846 - DNA, 20 bp, Homo sapiens
agctctacaggcctgcagcc

SEQ ID NO: 4627847 - DNA, 18 bp, Homo sapiens
agctctattgatactctt

SEQ ID NO: 4627848 - DNA, 13 bp, Homo sapiens
agctctctaggcc

SEQ ID NO: 4627849 - DNA, 17 bp, Homo sapiens
agctctctaggcctctc

SEQ ID NO: 4627850 - DNA, 18 bp, Homo sapiens
agctctctaggcctctcc

SEQ ID NO: 4627851 - DNA, 22 bp, Homo sapiens
agctctgaaatcaactctcttc

SEQ ID NO: 4627852 - DNA, 12 bp, Homo sapiens
agctctgcccct

SEQ ID NO: 4627853 - DNA, 16 bp, Homo sapiens
agctctgccccttccc

SEQ ID NO: 4627854 - DNA, 12 bp, Homo sapiens
agctctggagaa

SEQ ID NO: 4627855 - DNA, 13 bp, Homo sapiens
agctctggagaac

SEQ ID NO: 4627856 - DNA, 20 bp, Homo sapiens
agctcttcaatagctaagca

SEQ ID NO: 4627857 - DNA, 23 bp, Homo sapiens
agctcttcccttgctcatgagct

SEQ ID NO: 4627858 - DNA, 22 bp, Homo sapiens
agctcttttttgtttgtttctt

SEQ ID NO: 4627859 - DNA, 21 bp, Homo sapiens
agctgaaaagggcactcccaa

SEQ ID NO: 4627860 - DNA, 19 bp, Homo sapiens
agctgaataacctgcacag

SEQ ID NO: 4627861 - DNA, 14 bp, Homo sapiens
agctgaattatatt

SEQ ID NO: 4627862 - DNA, 15 bp, Homo sapiens
agctgactgaatgca

SEQ ID NO: 4627863 - DNA, 17 bp, Homo sapiens
agctgagcgccaggatg

SEQ ID NO: 4627864 - DNA, 19 bp, Homo sapiens
agctgagctcacaaggcag

SEQ ID NO: 4627865 - DNA, 20 bp, Homo sapiens
agctgagctcacaaggcagc

SEQ ID NO: 4627866 - DNA, 13 bp, Homo sapiens
agctgagctggct

SEQ ID NO: 4627867 - DNA, 12 bp, Homo sapiens
agctgaggcagg

SEQ ID NO: 4627868 - DNA, 12 bp, Homo sapiens
agctgaggtgcc

SEQ ID NO: 4627869 - DNA, 17 bp, Homo sapiens
agctgaggtgcccagga

SEQ ID NO: 4627870 - DNA, 18 bp, Homo sapiens
agctgaggtgcccaggag

SEQ ID NO: 4627871 - DNA, 19 bp, Homo sapiens
agctgaggtgcccaggaga

SEQ ID NO: 4627872 - DNA, 16 bp, Homo sapiens
agctgcactgtgaacc

SEQ ID NO: 4627873 - DNA, 16 bp, Homo sapiens
agctgcgggggcaggc

SEQ ID NO: 4627874 - DNA, 18 bp, Homo sapiens
agctgcgggggcaggccg

SEQ ID NO: 4627875 - DNA, 18 bp, Homo sapiens
agctgctccaggcctgca

SEQ ID NO: 4627876 - DNA, 19 bp, Homo sapiens
agctgctccaggcctgcag

SEQ ID NO: 4627877 - DNA, 13 bp, Homo sapiens
agctgctccccag

SEQ ID NO: 4627878 - DNA, 14 bp, Homo sapiens
agctgctgaggccc

SEQ ID NO: 4627879 - DNA, 15 bp, Homo sapiens
agctgctgtgcccca

SEQ ID NO: 4627880 - DNA, 13 bp, Homo sapiens
agctggaaggggc

SEQ ID NO: 4627881 - DNA, 18 bp, Homo sapiens
agctggaaggggccacgt

SEQ ID NO: 4627882 - DNA, 13 bp, Homo sapiens
agctggccaaagt

SEQ ID NO: 4627883 - DNA, 14 bp, Homo sapiens
agctggctctgtga

SEQ ID NO: 4627884 - DNA, 20 bp, Homo sapiens
agctggctctgtgagggtgc

SEQ ID NO: 4627885 - DNA, 17 bp, Homo sapiens
agctggggactcaggga

SEQ ID NO: 4627886 - DNA, 14 bp, Homo sapiens
agctggtcctgacc

SEQ ID NO: 4627887 - DNA, 13 bp, Homo sapiens
agctgtaagggca

SEQ ID NO: 4627888 - DNA, 15 bp, Homo sapiens
agctgtaagggcagt

SEQ ID NO: 4627889 - DNA, 18 bp, Homo sapiens
agctgtaagggcagtgcc

SEQ ID NO: 4627890 - DNA, 16 bp, Homo sapiens
agctgtccctgcaggg

SEQ ID NO: 4627891 - DNA, 13 bp, Homo sapiens
agctgtctgaagc

SEQ ID NO: 4627892 - DNA, 22 bp, Homo sapiens
agctgtctgaagcccaaagcct

SEQ ID NO: 4627893 - DNA, 15 bp, Homo sapiens
agctgtgacctgctg

SEQ ID NO: 4627894 - DNA, 16 bp, Homo sapiens
agctgtgacctgctga

SEQ ID NO: 4627895 - DNA, 15 bp, Homo sapiens
agctgtgcacaaagt

SEQ ID NO: 4627896 - DNA, 20 bp, Homo sapiens
agctgtgcacaaagtggcat

SEQ ID NO: 4627897 - DNA, 14 bp, Homo sapiens
agctgtgcaggcat

SEQ ID NO: 4627898 - DNA, 15 bp, Homo sapiens
agctgtgccagcagg

SEQ ID NO: 4627899 - DNA, 16 bp, Homo sapiens
agctgttagggctgaa

SEQ ID NO: 4627900 - DNA, 16 bp, Homo sapiens
agctgtttgaaatgtt

SEQ ID NO: 4627901 - DNA, 21 bp, Homo sapiens
agcttacaatcgcaaatcaaa

SEQ ID NO: 4627902 - DNA, 23 bp, Homo sapiens
agcttactctctgcttccgttcc

SEQ ID NO: 4627903 - DNA, 16 bp, Homo sapiens
agcttatgtgacatgg

SEQ ID NO: 4627904 - DNA, 16 bp, Homo sapiens
agcttcctggggacca

SEQ ID NO: 4627905 - DNA, 19 bp, Homo sapiens
agcttcctggggaccaaga

SEQ ID NO: 4627906 - DNA, 17 bp, Homo sapiens
agcttcttcgttcctgc

SEQ ID NO: 4627907 - DNA, 14 bp, Homo sapiens
agcttggaggaggg

SEQ ID NO: 4627908 - DNA, 23 bp, Homo sapiens
agcttggcttcctcttcttgttg

SEQ ID NO: 4627909 - DNA, 14 bp, Homo sapiens
agcttgtaaatatg

SEQ ID NO: 4627910 - DNA, 16 bp, Homo sapiens
agcttgtagccagccg

SEQ ID NO: 4627911 - DNA, 23 bp, Homo sapiens
agcttgtatgtaaggaggtttgt

SEQ ID NO: 4627912 - DNA, 23 bp, Homo sapiens
agcttgtccaggttgatcttgaa

SEQ ID NO: 4627913 - DNA, 18 bp, Homo sapiens
agctttccaaggaagcag

SEQ ID NO: 4627914 - DNA, 20 bp, Homo sapiens
agctttccaaggaagcagaa

SEQ ID NO: 4627915 - DNA, 20 bp, Homo sapiens
agctttcccgcccagcctca

SEQ ID NO: 4627916 - DNA, 21 bp, Homo sapiens
agctttcctggaagtcaaata

SEQ ID NO: 4627917 - DNA, 15 bp, Homo sapiens
agctttcctgtttcc

SEQ ID NO: 4627918 - DNA, 12 bp, Homo sapiens
agctttgaaact

SEQ ID NO: 4627919 - DNA, 22 bp, Homo sapiens
agctttgaaactccatgcaaac

SEQ ID NO: 4627920 - DNA, 21 bp, Homo sapiens
agctttgaaggctggattcta

SEQ ID NO: 4627921 - DNA, 17 bp, Homo sapiens
agctttgctccttcagt

SEQ ID NO: 4627922 - DNA, 16 bp, Homo sapiens
agctttgtatgtttat

SEQ ID NO: 4627923 - DNA, 15 bp, Homo sapiens
agctttttattattt

SEQ ID NO: 4627924 - DNA, 12 bp, Homo sapiens
aggaaaagcaag

SEQ ID NO: 4627925 - DNA, 17 bp, Homo sapiens
aggaaaatgacttgtaa

SEQ ID NO: 4627926 - DNA, 20 bp, Homo sapiens
aggaaaatgtattgattcaa

SEQ ID NO: 4627927 - DNA, 13 bp, Homo sapiens
aggaaacatttta

SEQ ID NO: 4627928 - DNA, 14 bp, Homo sapiens
aggaaagaaccgaa

SEQ ID NO: 4627929 - DNA, 19 bp, Homo sapiens
aggaaagaagggggccctg

SEQ ID NO: 4627930 - DNA, 17 bp, Homo sapiens
aggaaagagagacccca

SEQ ID NO: 4627931 - DNA, 15 bp, Homo sapiens
aggaaagcatgcatt

SEQ ID NO: 4627932 - DNA, 10 bp, Homo sapiens
aggaaaggag

SEQ ID NO: 4627933 - DNA, 19 bp, Homo sapiens
aggaaataacagagagaat

SEQ ID NO: 4627934 - DNA, 20 bp, Homo sapiens
aggaaataacagagagaatg

SEQ ID NO: 4627935 - DNA, 17 bp, Homo sapiens
aggaacagaagtgagga

SEQ ID NO: 4627936 - DNA, 20 bp, Homo sapiens
aggaacagaagtgaggatga

SEQ ID NO: 4627937 - DNA, 23 bp, Homo sapiens
aggaacagaagtgaggatgagac

SEQ ID NO: 4627938 - DNA, 12 bp, Homo sapiens
aggaacagccca

SEQ ID NO: 4627939 - DNA, 13 bp, Homo sapiens
aggaacagcccag

SEQ ID NO: 4627940 - DNA, 23 bp, Homo sapiens
aggaaccacaccaatgcaacatt

SEQ ID NO: 4627941 - DNA, 14 bp, Homo sapiens
aggaaccgcccagt

SEQ ID NO: 4627942 - DNA, 20 bp, Homo sapiens
aggaactagtaaacatatgt

SEQ ID NO: 4627943 - DNA, 16 bp, Homo sapiens
aggaagaacgtttttt

SEQ ID NO: 4627944 - DNA, 15 bp, Homo sapiens
aggaagactttgtga

SEQ ID NO: 4627945 - DNA, 11 bp, Homo sapiens
aggaagagcca

SEQ ID NO: 4627946 - DNA, 17 bp, Homo sapiens
aggaagagccacctgca

SEQ ID NO: 4627947 - DNA, 19 bp, Homo sapiens
aggaagagccacctgcaag

SEQ ID NO: 4627948 - DNA, 12 bp, Homo sapiens
aggaagcagaag

SEQ ID NO: 4627949 - DNA, 14 bp, Homo sapiens
aggaagcagaagac

SEQ ID NO: 4627950 - DNA, 22 bp, Homo sapiens
aggaagcagaagacgggagggg

SEQ ID NO: 4627951 - DNA, 14 bp, Homo sapiens
aggaaggagggcac

SEQ ID NO: 4627952 - DNA, 19 bp, Homo sapiens
aggaaggccaaaatcaaga

SEQ ID NO: 4627953 - DNA, 17 bp, Homo sapiens
aggaaggcctgagcccc

SEQ ID NO: 4627954 - DNA, 11 bp, Homo sapiens
aggaataaaga

SEQ ID NO: 4627955 - DNA, 12 bp, Homo sapiens
aggaataaagac

SEQ ID NO: 4627956 - DNA, 13 bp, Homo sapiens
aggaatacatttt

SEQ ID NO: 4627957 - DNA, 16 bp, Homo sapiens
aggaatagaagcaaat

SEQ ID NO: 4627958 - DNA, 20 bp, Homo sapiens
aggaatgacccttttgtgtc

SEQ ID NO: 4627959 - DNA, 16 bp, Homo sapiens
aggaatgctggactgg

SEQ ID NO: 4627960 - DNA, 14 bp, Homo sapiens
aggaatgcttccga

SEQ ID NO: 4627961 - DNA, 17 bp, Homo sapiens
aggaatggaggagccag

SEQ ID NO: 4627962 - DNA, 22 bp, Homo sapiens
aggaatggaggagccaggcccc

SEQ ID NO: 4627963 - DNA, 16 bp, Homo sapiens
aggaatgtgggctatg

SEQ ID NO: 4627964 - DNA, 16 bp, Homo sapiens
aggaattcagtgcctt

SEQ ID NO: 4627965 - DNA, 17 bp, Homo sapiens
aggaatttgcatccagc

SEQ ID NO: 4627966 - DNA, 21 bp, Homo sapiens
aggaatttgcatccagcagca

SEQ ID NO: 4627967 - DNA, 16 bp, Homo sapiens
aggacaaaacttcttg

SEQ ID NO: 4627968 - DNA, 15 bp, Homo sapiens
aggacacagttcctg

SEQ ID NO: 4627969 - DNA, 18 bp, Homo sapiens
aggacacagttcctggga

SEQ ID NO: 4627970 - DNA, 21 bp, Homo sapiens
aggacacagttcctgggaaca

SEQ ID NO: 4627971 - DNA, 15 bp, Homo sapiens
aggacagctgtcctc

SEQ ID NO: 4627972 - DNA, 17 bp, Homo sapiens
aggacaggaccctcagg

SEQ ID NO: 4627973 - DNA, 18 bp, Homo sapiens
aggacaggaccctcagga

SEQ ID NO: 4627974 - DNA, 16 bp, Homo sapiens
aggacataaaatttaa

SEQ ID NO: 4627975 - DNA, 22 bp, Homo sapiens
aggacataaaatttaaaaactt

SEQ ID NO: 4627976 - DNA, 21 bp, Homo sapiens
aggacatagcctgcaaagctg

SEQ ID NO: 4627977 - DNA, 20 bp, Homo sapiens
aggacatcttaaatctaaac

SEQ ID NO: 4627978 - DNA, 15 bp, Homo sapiens
aggacatttcccagg

SEQ ID NO: 4627979 - DNA, 12 bp, Homo sapiens
aggaccaggcca

SEQ ID NO: 4627980 - DNA, 20 bp, Homo sapiens
aggaccagtcaggatgaggc

SEQ ID NO: 4627981 - DNA, 15 bp, Homo sapiens
aggacccagccctcg

SEQ ID NO: 4627982 - DNA, 23 bp, Homo sapiens
aggaccccttaatcttgctttct

SEQ ID NO: 4627983 - DNA, 20 bp, Homo sapiens
aggaccctcaggaattcagt

SEQ ID NO: 4627984 - DNA, 20 bp, Homo sapiens
aggacccttacgtgagaaat

SEQ ID NO: 4627985 - DNA, 17 bp, Homo sapiens
aggacccttttaagcat

SEQ ID NO: 4627986 - DNA, 18 bp, Homo sapiens
aggacctcctcttccccc

SEQ ID NO: 4627987 - DNA, 19 bp, Homo sapiens
aggacctcctcttccccct

SEQ ID NO: 4627988 - DNA, 13 bp, Homo sapiens
aggacctgagcct

SEQ ID NO: 4627989 - DNA, 19 bp, Homo sapiens
aggacctgagcctgccgag

SEQ ID NO: 4627990 - DNA, 16 bp, Homo sapiens
aggacctggctgccat

SEQ ID NO: 4627991 - DNA, 17 bp, Homo sapiens
aggacctggctgccata

SEQ ID NO: 4627992 - DNA, 20 bp, Homo sapiens
aggactaacactcagaagcc

SEQ ID NO: 4627993 - DNA, 22 bp, Homo sapiens
aggactaacactcagaagcctg

SEQ ID NO: 4627994 - DNA, 23 bp, Homo sapiens
aggactaacactcagaagcctgg

SEQ ID NO: 4627995 - DNA, 18 bp, Homo sapiens
aggactcccaaccctggc

SEQ ID NO: 4627996 - DNA, 20 bp, Homo sapiens
aggactcccaaccctggctt

SEQ ID NO: 4627997 - DNA, 12 bp, Homo sapiens
aggactgtgcct

SEQ ID NO: 4627998 - DNA, 23 bp, Homo sapiens
aggacttgccacccccagttcct

SEQ ID NO: 4627999 - DNA, 16 bp, Homo sapiens
aggagaaggctggaga

SEQ ID NO: 4628000 - DNA, 17 bp, Homo sapiens
aggagaaggctggagaa

SEQ ID NO: 4628001 - DNA, 18 bp, Homo sapiens
aggagaaggctggagaag

SEQ ID NO: 4628002 - DNA, 21 bp, Homo sapiens
aggagaagggggctctgcccc

SEQ ID NO: 4628003 - DNA, 14 bp, Homo sapiens
aggagacaggatga

SEQ ID NO: 4628004 - DNA, 19 bp, Homo sapiens
aggagacccgccccagggc

SEQ ID NO: 4628005 - DNA, 14 bp, Homo sapiens
aggagagaagaatg

SEQ ID NO: 4628006 - DNA, 11 bp, Homo sapiens
aggagagagac

SEQ ID NO: 4628007 - DNA, 14 bp, Homo sapiens
aggagagagacccc

SEQ ID NO: 4628008 - DNA, 13 bp, Homo sapiens
aggagagagccag

SEQ ID NO: 4628009 - DNA, 13 bp, Homo sapiens
aggagaggcagca

SEQ ID NO: 4628010 - DNA, 14 bp, Homo sapiens
aggagatgaccagg

SEQ ID NO: 4628011 - DNA, 18 bp, Homo sapiens
aggagatgaccagggatg

SEQ ID NO: 4628012 - DNA, 19 bp, Homo sapiens
aggagatgaccagggatgc

SEQ ID NO: 4628013 - DNA, 21 bp, Homo sapiens
aggagatgtgatcaggcccca

SEQ ID NO: 4628014 - DNA, 14 bp, Homo sapiens
aggagcaaagcctg

SEQ ID NO: 4628015 - DNA, 15 bp, Homo sapiens
aggagcaaagcctgt

SEQ ID NO: 4628016 - DNA, 13 bp, Homo sapiens
aggagcagccctg

SEQ ID NO: 4628017 - DNA, 14 bp, Homo sapiens
aggagcagccctgg

SEQ ID NO: 4628018 - DNA, 15 bp, Homo sapiens
aggagcagccctggc

SEQ ID NO: 4628019 - DNA, 13 bp, Homo sapiens
aggagccaggccc

SEQ ID NO: 4628020 - DNA, 15 bp, Homo sapiens
aggagccaggcccca

SEQ ID NO: 4628021 - DNA, 18 bp, Homo sapiens
aggagccaggccccaccc

SEQ ID NO: 4628022 - DNA, 16 bp, Homo sapiens
aggagcctaggccagg

SEQ ID NO: 4628023 - DNA, 18 bp, Homo sapiens
aggagcctgtgaacccag

SEQ ID NO: 4628024 - DNA, 19 bp, Homo sapiens
aggagcctgtgaacccagg

SEQ ID NO: 4628025 - DNA, 22 bp, Homo sapiens
aggagcctgtgaacccaggaca

SEQ ID NO: 4628026 - DNA, 13 bp, Homo sapiens
aggagcctgtgcg

SEQ ID NO: 4628027 - DNA, 16 bp, Homo sapiens
aggagctacctgtgtg

SEQ ID NO: 4628028 - DNA, 18 bp, Homo sapiens
aggagctcaacggtctgg

SEQ ID NO: 4628029 - DNA, 17 bp, Homo sapiens
aggagctctcaatttta

SEQ ID NO: 4628030 - DNA, 14 bp, Homo sapiens
aggaggaccagtca

SEQ ID NO: 4628031 - DNA, 13 bp, Homo sapiens
aggaggagctctc

SEQ ID NO: 4628032 - DNA, 15 bp, Homo sapiens
aggaggatgtccctg

SEQ ID NO: 4628033 - DNA, 20 bp, Homo sapiens
aggaggatgtccctgggcca

SEQ ID NO: 4628034 - DNA, 17 bp, Homo sapiens
aggaggccaaccagccc

SEQ ID NO: 4628035 - DNA, 16 bp, Homo sapiens
aggaggcctgcacagg

SEQ ID NO: 4628036 - DNA, 17 bp, Homo sapiens
aggaggctttctgggct

SEQ ID NO: 4628037 - DNA, 21 bp, Homo sapiens
aggaggctttctgggctctgg

SEQ ID NO: 4628038 - DNA, 23 bp, Homo sapiens
aggaggctttctgggctctggac

SEQ ID NO: 4628039 - DNA, 19 bp, Homo sapiens
aggagggactgtcgctgct

SEQ ID NO: 4628040 - DNA, 17 bp, Homo sapiens
aggagggggcctcattg

SEQ ID NO: 4628041 - DNA, 18 bp, Homo sapiens
aggagggggcctcattgt

SEQ ID NO: 4628042 - DNA, 23 bp, Homo sapiens
aggaggtgaaagaaagggaccca

SEQ ID NO: 4628043 - DNA, 14 bp, Homo sapiens
aggaggtttgtata

SEQ ID NO: 4628044 - DNA, 13 bp, Homo sapiens
aggagtagctgag

SEQ ID NO: 4628045 - DNA, 14 bp, Homo sapiens
aggagtagctgagc

SEQ ID NO: 4628046 - DNA, 16 bp, Homo sapiens
aggagtcagatgaggc

SEQ ID NO: 4628047 - DNA, 15 bp, Homo sapiens
aggagtctgaggtcc

SEQ ID NO: 4628048 - DNA, 19 bp, Homo sapiens
aggagtctgaggtcctgag

SEQ ID NO: 4628049 - DNA, 22 bp, Homo sapiens
aggagtgccataccttctccca

SEQ ID NO: 4628050 - DNA, 14 bp, Homo sapiens
aggagtggtgcaga

SEQ ID NO: 4628051 - DNA, 18 bp, Homo sapiens
aggagtgtcctgcccatg

SEQ ID NO: 4628052 - DNA, 15 bp, Homo sapiens
aggataaagccactt

SEQ ID NO: 4628053 - DNA, 13 bp, Homo sapiens
aggataagaaagc

SEQ ID NO: 4628054 - DNA, 22 bp, Homo sapiens
aggataagaaagcctaaaattg

SEQ ID NO: 4628055 - DNA, 20 bp, Homo sapiens
aggatagtagttaaataact

SEQ ID NO: 4628056 - DNA, 22 bp, Homo sapiens
aggatatccttatcagagctaa

SEQ ID NO: 4628057 - DNA, 17 bp, Homo sapiens
aggatcaattgtaatat

SEQ ID NO: 4628058 - DNA, 13 bp, Homo sapiens
aggatgaaggaag

SEQ ID NO: 4628059 - DNA, 15 bp, Homo sapiens
aggatgaaggaaggg

SEQ ID NO: 4628060 - DNA, 16 bp, Homo sapiens
aggatgagacccagcc

SEQ ID NO: 4628061 - DNA, 13 bp, Homo sapiens
aggatgaggcccc

SEQ ID NO: 4628062 - DNA, 19 bp, Homo sapiens
aggatgaggtctcgaccct

SEQ ID NO: 4628063 - DNA, 23 bp, Homo sapiens
aggatgaggtctcgaccctgtcc

SEQ ID NO: 4628064 - DNA, 19 bp, Homo sapiens
aggatggaacacggccaca

SEQ ID NO: 4628065 - DNA, 19 bp, Homo sapiens
aggatggagcaagctcttc

SEQ ID NO: 4628066 - DNA, 19 bp, Homo sapiens
aggattgaacttctttgaa

SEQ ID NO: 4628067 - DNA, 20 bp, Homo sapiens
aggattgttgaatctatttc

SEQ ID NO: 4628068 - DNA, 16 bp, Homo sapiens
aggattttaatttcag

SEQ ID NO: 4628069 - DNA, 14 bp, Homo sapiens
aggcaaggaacaga

SEQ ID NO: 4628070 - DNA, 14 bp, Homo sapiens
aggcaaggaggagg

SEQ ID NO: 4628071 - DNA, 20 bp, Homo sapiens
aggcaataagaattactttg

SEQ ID NO: 4628072 - DNA, 17 bp, Homo sapiens
aggcacagtgggagctg

SEQ ID NO: 4628073 - DNA, 19 bp, Homo sapiens
aggcacagtgggagctgag

SEQ ID NO: 4628074 - DNA, 21 bp, Homo sapiens
aggcacagtgggagctgagct

SEQ ID NO: 4628075 - DNA, 22 bp, Homo sapiens
aggcacagtgggagctgagctg

SEQ ID NO: 4628076 - DNA, 23 bp, Homo sapiens
aggcacagtgggagctgagctgg

SEQ ID NO: 4628077 - DNA, 22 bp, Homo sapiens
aggcacccgtccccacacgagg

SEQ ID NO: 4628078 - DNA, 14 bp, Homo sapiens
aggcaccgccacgt

SEQ ID NO: 4628079 - DNA, 22 bp, Homo sapiens
aggcaccgccacgtcccagcat

SEQ ID NO: 4628080 - DNA, 19 bp, Homo sapiens
aggcagaaatagttgtctg

SEQ ID NO: 4628081 - DNA, 20 bp, Homo sapiens
aggcagaaatagttgtctgt

SEQ ID NO: 4628082 - DNA, 21 bp, Homo sapiens
aggcagaaatagttgtctgtg

SEQ ID NO: 4628083 - DNA, 20 bp, Homo sapiens
aggcagaagcttggaggagg

SEQ ID NO: 4628084 - DNA, 13 bp, Homo sapiens
aggcagacagcag

SEQ ID NO: 4628085 - DNA, 19 bp, Homo sapiens
aggcagacagcaggcagcg

SEQ ID NO: 4628086 - DNA, 22 bp, Homo sapiens
aggcagacagcaggcagcgcca

SEQ ID NO: 4628087 - DNA, 14 bp, Homo sapiens
aggcagagaacaga

SEQ ID NO: 4628088 - DNA, 18 bp, Homo sapiens
aggcagagaacagaactg

SEQ ID NO: 4628089 - DNA, 17 bp, Homo sapiens
aggcagatgcccttgct

SEQ ID NO: 4628090 - DNA, 19 bp, Homo sapiens
aggcagcatgcttgggctg

SEQ ID NO: 4628091 - DNA, 20 bp, Homo sapiens
aggcagccagccgtggccag

SEQ ID NO: 4628092 - DNA, 14 bp, Homo sapiens
aggcaggcagggct

SEQ ID NO: 4628093 - DNA, 20 bp, Homo sapiens
aggcaggcagggctctcctg

SEQ ID NO: 4628094 - DNA, 22 bp, Homo sapiens
aggcagggctctcctggcttcc

SEQ ID NO: 4628095 - DNA, 18 bp, Homo sapiens
aggcataagatgacttag

SEQ ID NO: 4628096 - DNA, 21 bp, Homo sapiens
aggcatggtcccttaaggcac

SEQ ID NO: 4628097 - DNA, 19 bp, Homo sapiens
aggcattgacataggtcat

SEQ ID NO: 4628098 - DNA, 20 bp, Homo sapiens
aggcattgacataggtcata

SEQ ID NO: 4628099 - DNA, 18 bp, Homo sapiens
aggcattggcatctgctt

SEQ ID NO: 4628100 - DNA, 17 bp, Homo sapiens
aggccaaacatggccag

SEQ ID NO: 4628101 - DNA, 16 bp, Homo sapiens
aggccaaacctctgtt

SEQ ID NO: 4628102 - DNA, 17 bp, Homo sapiens
aggccaaacctctgttc

SEQ ID NO: 4628103 - DNA, 19 bp, Homo sapiens
aggccaaccagcccgacag

SEQ ID NO: 4628104 - DNA, 15 bp, Homo sapiens
aggccaccccaacct

SEQ ID NO: 4628105 - DNA, 12 bp, Homo sapiens
aggccagacctg

SEQ ID NO: 4628106 - DNA, 13 bp, Homo sapiens
aggccagcctggc

SEQ ID NO: 4628107 - DNA, 14 bp, Homo sapiens
aggccagcctggcc

SEQ ID NO: 4628108 - DNA, 16 bp, Homo sapiens
aggccagcctggcctc

SEQ ID NO: 4628109 - DNA, 22 bp, Homo sapiens
aggccagcctggcctcctgcct

SEQ ID NO: 4628110 - DNA, 23 bp, Homo sapiens
aggccagtggactctgaggactc

SEQ ID NO: 4628111 - DNA, 15 bp, Homo sapiens
aggccatctcaggag

SEQ ID NO: 4628112 - DNA, 22 bp, Homo sapiens
aggccatctgggctcctccagg

SEQ ID NO: 4628113 - DNA, 15 bp, Homo sapiens
aggcccaagtctcct

SEQ ID NO: 4628114 - DNA, 20 bp, Homo sapiens
aggcccactgtgtctaggca

SEQ ID NO: 4628115 - DNA, 15 bp, Homo sapiens
aggccccacaaggcc

SEQ ID NO: 4628116 - DNA, 17 bp, Homo sapiens
aggccccacaaggcctg

SEQ ID NO: 4628117 - DNA, 17 bp, Homo sapiens
aggccccagaggccctg

SEQ ID NO: 4628118 - DNA, 19 bp, Homo sapiens
aggccccagaggccctgga

SEQ ID NO: 4628119 - DNA, 13 bp, Homo sapiens
aggccccatggag

SEQ ID NO: 4628120 - DNA, 13 bp, Homo sapiens
aggcccccaccct

SEQ ID NO: 4628121 - DNA, 18 bp, Homo sapiens
aggcccccccagaagcaa

SEQ ID NO: 4628122 - DNA, 21 bp, Homo sapiens
aggcccccccagaagcaagat

SEQ ID NO: 4628123 - DNA, 23 bp, Homo sapiens
aggccccgccttttcccccaccc

SEQ ID NO: 4628124 - DNA, 21 bp, Homo sapiens
aggcccctgtctcagggtgag

SEQ ID NO: 4628125 - DNA, 14 bp, Homo sapiens
aggcccgagcagct

SEQ ID NO: 4628126 - DNA, 17 bp, Homo sapiens
aggccctcctgtgctgg

SEQ ID NO: 4628127 - DNA, 22 bp, Homo sapiens
aggccctgcatctgtctgctct

SEQ ID NO: 4628128 - DNA, 21 bp, Homo sapiens
aggccctggaggtctccaggg

SEQ ID NO: 4628129 - DNA, 18 bp, Homo sapiens
aggccctgtctctggcta

SEQ ID NO: 4628130 - DNA, 19 bp, Homo sapiens
aggcctaatttttttttgt

SEQ ID NO: 4628131 - DNA, 16 bp, Homo sapiens
aggcctagactctgtc

SEQ ID NO: 4628132 - DNA, 21 bp, Homo sapiens
aggcctagactctgtctacct

SEQ ID NO: 4628133 - DNA, 17 bp, Homo sapiens
aggcctagtacaatctt

SEQ ID NO: 4628134 - DNA, 21 bp, Homo sapiens
aggcctagtacaatcttggga

SEQ ID NO: 4628135 - DNA, 13 bp, Homo sapiens
aggcctcgcagga

SEQ ID NO: 4628136 - DNA, 17 bp, Homo sapiens
aggcctcgcaggaagac

SEQ ID NO: 4628137 - DNA, 21 bp, Homo sapiens
aggcctctccagtttgcacct

SEQ ID NO: 4628138 - DNA, 23 bp, Homo sapiens
aggcctctccagtttgcacctgt

SEQ ID NO: 4628139 - DNA, 24 bp, Homo sapiens
aggcctctccagtttgcacctgtc

SEQ ID NO: 4628140 - DNA, 11 bp, Homo sapiens
aggcctctgcc

SEQ ID NO: 4628141 - DNA, 13 bp, Homo sapiens
aggcctctgcccc

SEQ ID NO: 4628142 - DNA, 14 bp, Homo sapiens
aggcctgagcccct

SEQ ID NO: 4628143 - DNA, 13 bp, Homo sapiens
aggcctgcacagg

SEQ ID NO: 4628144 - DNA, 15 bp, Homo sapiens
aggcctgcagcccct

SEQ ID NO: 4628145 - DNA, 19 bp, Homo sapiens
aggcctgcagcccctaagt

SEQ ID NO: 4628146 - DNA, 12 bp, Homo sapiens
aggcctggtctg

SEQ ID NO: 4628147 - DNA, 19 bp, Homo sapiens
aggcctgtgctagaagctc

SEQ ID NO: 4628148 - DNA, 21 bp, Homo sapiens
aggcctgtgtagctgtgacct

SEQ ID NO: 4628149 - DNA, 22 bp, Homo sapiens
aggcctgtgtagctgtgacctg

SEQ ID NO: 4628150 - DNA, 20 bp, Homo sapiens
aggcctgttgctatagagcc

SEQ ID NO: 4628151 - DNA, 18 bp, Homo sapiens
aggccttatgagggtcct

SEQ ID NO: 4628152 - DNA, 11 bp, Homo sapiens
aggccttcagt

SEQ ID NO: 4628153 - DNA, 20 bp, Homo sapiens
aggccttcagtttatttcca

SEQ ID NO: 4628154 - DNA, 22 bp, Homo sapiens
aggcgaggggacagcccagcgc

SEQ ID NO: 4628155 - DNA, 22 bp, Homo sapiens
aggcgccccaacccgtggaggc

SEQ ID NO: 4628156 - DNA, 15 bp, Homo sapiens
aggctaccagaagag

SEQ ID NO: 4628157 - DNA, 17 bp, Homo sapiens
aggctacttcggggctg

SEQ ID NO: 4628158 - DNA, 22 bp, Homo sapiens
aggctcactgcaacttctgcct

SEQ ID NO: 4628159 - DNA, 20 bp, Homo sapiens
aggctcagtggtgggagaga

SEQ ID NO: 4628160 - DNA, 12 bp, Homo sapiens
aggctctgaagg

SEQ ID NO: 4628161 - DNA, 14 bp, Homo sapiens
aggctgaagagagg

SEQ ID NO: 4628162 - DNA, 19 bp, Homo sapiens
aggctgaagagagggacag

SEQ ID NO: 4628163 - DNA, 13 bp, Homo sapiens
aggctgaccacag

SEQ ID NO: 4628164 - DNA, 16 bp, Homo sapiens
aggctgaccacagcac

SEQ ID NO: 4628165 - DNA, 18 bp, Homo sapiens
aggctgaccacagcacag

SEQ ID NO: 4628166 - DNA, 18 bp, Homo sapiens
aggctgaggctggcacag

SEQ ID NO: 4628167 - DNA, 21 bp, Homo sapiens
aggctgcaaaattaaatctag

SEQ ID NO: 4628168 - DNA, 17 bp, Homo sapiens
aggctgctcggggtgca

SEQ ID NO: 4628169 - DNA, 20 bp, Homo sapiens
aggctgctcggggtgcacag

SEQ ID NO: 4628170 - DNA, 21 bp, Homo sapiens
aggctgctcggggtgcacagg

SEQ ID NO: 4628171 - DNA, 22 bp, Homo sapiens
aggctgctcggggtgcacagga

SEQ ID NO: 4628172 - DNA, 23 bp, Homo sapiens
aggctgctcggggtgcacaggag

SEQ ID NO: 4628173 - DNA, 14 bp, Homo sapiens
aggctgctgcacac

SEQ ID NO: 4628174 - DNA, 21 bp, Homo sapiens
aggctgctgcacaccaaggcc

SEQ ID NO: 4628175 - DNA, 23 bp, Homo sapiens
aggctgctgcacaccaaggccct

SEQ ID NO: 4628176 - DNA, 19 bp, Homo sapiens
aggctggctccagatgcag

SEQ ID NO: 4628177 - DNA, 22 bp, Homo sapiens
aggctggtttcaaactcctgac

SEQ ID NO: 4628178 - DNA, 21 bp, Homo sapiens
aggctgtaactgagagaaaga

SEQ ID NO: 4628179 - DNA, 15 bp, Homo sapiens
aggcttccctacaca

SEQ ID NO: 4628180 - DNA, 16 bp, Homo sapiens
aggcttccctacacag

SEQ ID NO: 4628181 - DNA, 19 bp, Homo sapiens
aggcttccctacacagggc

SEQ ID NO: 4628182 - DNA, 23 bp, Homo sapiens
aggcttccctacacagggcctgc

SEQ ID NO: 4628183 - DNA, 13 bp, Homo sapiens
aggcttctctctc

SEQ ID NO: 4628184 - DNA, 18 bp, Homo sapiens
aggcttctctctcaccag

SEQ ID NO: 4628185 - DNA, 16 bp, Homo sapiens
aggcttctctgttcta

SEQ ID NO: 4628186 - DNA, 23 bp, Homo sapiens
aggcttgctgtatgacccctggc

SEQ ID NO: 4628187 - DNA, 21 bp, Homo sapiens
aggctttctgggctctggact

SEQ ID NO: 4628188 - DNA, 19 bp, Homo sapiens
aggctttctgggtgtgact

SEQ ID NO: 4628189 - DNA, 10 bp, Homo sapiens
agggaaaagg

SEQ ID NO: 4628190 - DNA, 19 bp, Homo sapiens
agggaaatctgtaaagcca

SEQ ID NO: 4628191 - DNA, 20 bp, Homo sapiens
agggaaatctgtaaagccag

SEQ ID NO: 4628192 - DNA, 20 bp, Homo sapiens
agggaaggataaagccactt

SEQ ID NO: 4628193 - DNA, 12 bp, Homo sapiens
agggaaggcagg

SEQ ID NO: 4628194 - DNA, 15 bp, Homo sapiens
agggaaggcaggcag

SEQ ID NO: 4628195 - DNA, 16 bp, Homo sapiens
agggaaggcaggcagg

SEQ ID NO: 4628196 - DNA, 16 bp, Homo sapiens
agggacaaaggagcct

SEQ ID NO: 4628197 - DNA, 17 bp, Homo sapiens
agggacaaaggagcctg

SEQ ID NO: 4628198 - DNA, 19 bp, Homo sapiens
agggacaaaggagcctgtg

SEQ ID NO: 4628199 - DNA, 22 bp, Homo sapiens
agggacaagtggactcagggca

SEQ ID NO: 4628200 - DNA, 17 bp, Homo sapiens
agggacaggctgaagag

SEQ ID NO: 4628201 - DNA, 23 bp, Homo sapiens
agggaccaatattaccatcttaa

SEQ ID NO: 4628202 - DNA, 22 bp, Homo sapiens
agggaccggtgctgcaggagtg

SEQ ID NO: 4628203 - DNA, 18 bp, Homo sapiens
agggagaggtcaccagct

SEQ ID NO: 4628204 - DNA, 20 bp, Homo sapiens
agggagaggtcaccagctgc

SEQ ID NO: 4628205 - DNA, 21 bp, Homo sapiens
agggagcaagtccttcccttt

SEQ ID NO: 4628206 - DNA, 15 bp, Homo sapiens
agggagctgcagggg

SEQ ID NO: 4628207 - DNA, 21 bp, Homo sapiens
agggaggagcaacggccccag

SEQ ID NO: 4628208 - DNA, 20 bp, Homo sapiens
agggagggctctgaggcgcc

SEQ ID NO: 4628209 - DNA, 16 bp, Homo sapiens
agggaggggtggtatt

SEQ ID NO: 4628210 - DNA, 22 bp, Homo sapiens
agggaggtgaatactcttgaaa

SEQ ID NO: 4628211 - DNA, 23 bp, Homo sapiens
agggagtgctggctcacagtaca

SEQ ID NO: 4628212 - DNA, 17 bp, Homo sapiens
agggagtgtactcccag

SEQ ID NO: 4628213 - DNA, 21 bp, Homo sapiens
agggatgcggatcctgctggg

SEQ ID NO: 4628214 - DNA, 14 bp, Homo sapiens
agggatgctgggct

SEQ ID NO: 4628215 - DNA, 16 bp, Homo sapiens
agggatgctgggctgg

SEQ ID NO: 4628216 - DNA, 17 bp, Homo sapiens
agggatgctgggctggg

SEQ ID NO: 4628217 - DNA, 14 bp, Homo sapiens
agggatggagaaag

SEQ ID NO: 4628218 - DNA, 20 bp, Homo sapiens
agggatgtctgttgaaataa

SEQ ID NO: 4628219 - DNA, 15 bp, Homo sapiens
agggcaagaggatga

SEQ ID NO: 4628220 - DNA, 13 bp, Homo sapiens
agggcacaggagc

SEQ ID NO: 4628221 - DNA, 14 bp, Homo sapiens
agggcacaggagct

SEQ ID NO: 4628222 - DNA, 22 bp, Homo sapiens
agggcacattaactccctccac

SEQ ID NO: 4628223 - DNA, 13 bp, Homo sapiens
agggcactgggct

SEQ ID NO: 4628224 - DNA, 18 bp, Homo sapiens
agggcactgggctgttgt

SEQ ID NO: 4628225 - DNA, 18 bp, Homo sapiens
agggcactgtgatacagt

SEQ ID NO: 4628226 - DNA, 20 bp, Homo sapiens
agggcactgtgatacagttt

SEQ ID NO: 4628227 - DNA, 12 bp, Homo sapiens
agggcagcagcc

SEQ ID NO: 4628228 - DNA, 19 bp, Homo sapiens
agggcagcagccagccctg

SEQ ID NO: 4628229 - DNA, 20 bp, Homo sapiens
agggcagcagccagccctgc

SEQ ID NO: 4628230 - DNA, 21 bp, Homo sapiens
agggcagcagccagccctgcc

SEQ ID NO: 4628231 - DNA, 22 bp, Homo sapiens
agggcagcagccagccctgcct

SEQ ID NO: 4628232 - DNA, 17 bp, Homo sapiens
agggcagccccctccct

SEQ ID NO: 4628233 - DNA, 23 bp, Homo sapiens
agggcagcgggagcctccctgcc

SEQ ID NO: 4628234 - DNA, 14 bp, Homo sapiens
agggcagggcccac

SEQ ID NO: 4628235 - DNA, 18 bp, Homo sapiens
agggcagggcccacgtgt

SEQ ID NO: 4628236 - DNA, 19 bp, Homo sapiens
agggcagggcccacgtgta

SEQ ID NO: 4628237 - DNA, 21 bp, Homo sapiens
agggcagtgcccatgtgtaca

SEQ ID NO: 4628238 - DNA, 23 bp, Homo sapiens
agggcagttcgcagccaccctga

SEQ ID NO: 4628239 - DNA, 15 bp, Homo sapiens
agggccagtggggcc

SEQ ID NO: 4628240 - DNA, 20 bp, Homo sapiens
agggccagtggggcctgtgg

SEQ ID NO: 4628241 - DNA, 23 bp, Homo sapiens
agggccagtggggcctgtggaat

SEQ ID NO: 4628242 - DNA, 19 bp, Homo sapiens
agggccattttggtgctta

SEQ ID NO: 4628243 - DNA, 14 bp, Homo sapiens
agggccctcccagc

SEQ ID NO: 4628244 - DNA, 16 bp, Homo sapiens
agggccgggcagaggg

SEQ ID NO: 4628245 - DNA, 18 bp, Homo sapiens
agggccgggcagaggggc

SEQ ID NO: 4628246 - DNA, 20 bp, Homo sapiens
agggccgggcagaggggcag

SEQ ID NO: 4628247 - DNA, 19 bp, Homo sapiens
agggccggggaactggcca

SEQ ID NO: 4628248 - DNA, 22 bp, Homo sapiens
agggccggggaactggccaagc

SEQ ID NO: 4628249 - DNA, 15 bp, Homo sapiens
agggcctccagccct

SEQ ID NO: 4628250 - DNA, 13 bp, Homo sapiens
agggcctggagcc

SEQ ID NO: 4628251 - DNA, 21 bp, Homo sapiens
agggcctggagccccatcggc

SEQ ID NO: 4628252 - DNA, 17 bp, Homo sapiens
agggcctggggaaacca

SEQ ID NO: 4628253 - DNA, 16 bp, Homo sapiens
agggcctggggcctga

SEQ ID NO: 4628254 - DNA, 17 bp, Homo sapiens
agggcctggtccctggg

SEQ ID NO: 4628255 - DNA, 23 bp, Homo sapiens
agggctctcaaagtataatcttt

SEQ ID NO: 4628256 - DNA, 12 bp, Homo sapiens
agggctctcctg

SEQ ID NO: 4628257 - DNA, 12 bp, Homo sapiens
agggctctgagg

SEQ ID NO: 4628258 - DNA, 13 bp, Homo sapiens
agggctctgaggc

SEQ ID NO: 4628259 - DNA, 15 bp, Homo sapiens
agggctggggacaga

SEQ ID NO: 4628260 - DNA, 17 bp, Homo sapiens
agggctggggatgcgcc

SEQ ID NO: 4628261 - DNA, 19 bp, Homo sapiens
agggctggggatgcgcctg

SEQ ID NO: 4628262 - DNA, 18 bp, Homo sapiens
agggctgtcatctgtgca

SEQ ID NO: 4628263 - DNA, 18 bp, Homo sapiens
agggcttacggccctggc

SEQ ID NO: 4628264 - DNA, 19 bp, Homo sapiens
agggcttacggccctggcc

SEQ ID NO: 4628265 - DNA, 20 bp, Homo sapiens
agggcttacggccctggcct

SEQ ID NO: 4628266 - DNA, 21 bp, Homo sapiens
agggcttggcccagcgccaag

SEQ ID NO: 4628267 - DNA, 23 bp, Homo sapiens
aggggaagagggaaatgtacact

SEQ ID NO: 4628268 - DNA, 20 bp, Homo sapiens
aggggaaggaaggagggcac

SEQ ID NO: 4628269 - DNA, 15 bp, Homo sapiens
aggggacactttgtt

SEQ ID NO: 4628270 - DNA, 23 bp, Homo sapiens
aggggacagcccagcgccatcct

SEQ ID NO: 4628271 - DNA, 19 bp, Homo sapiens
aggggagacctcagaagta

SEQ ID NO: 4628272 - DNA, 14 bp, Homo sapiens
aggggagaggggtc

SEQ ID NO: 4628273 - DNA, 14 bp, Homo sapiens
aggggatccagcca

SEQ ID NO: 4628274 - DNA, 15 bp, Homo sapiens
aggggatccagccac

SEQ ID NO: 4628275 - DNA, 18 bp, Homo sapiens
aggggcaagctaggcccc

SEQ ID NO: 4628276 - DNA, 19 bp, Homo sapiens
aggggcaagctaggcccca

SEQ ID NO: 4628277 - DNA, 21 bp, Homo sapiens
aggggccacgtggatgggcaa

SEQ ID NO: 4628278 - DNA, 17 bp, Homo sapiens
aggggccagaagatgaa

SEQ ID NO: 4628279 - DNA, 12 bp, Homo sapiens
aggggcctgcag

SEQ ID NO: 4628280 - DNA, 20 bp, Homo sapiens
aggggccttagggcactggg

SEQ ID NO: 4628281 - DNA, 21 bp, Homo sapiens
aggggccttagggcactgggc

SEQ ID NO: 4628282 - DNA, 19 bp, Homo sapiens
aggggctatcctgggacct

SEQ ID NO: 4628283 - DNA, 22 bp, Homo sapiens
aggggctgactctccagggagc

SEQ ID NO: 4628284 - DNA, 18 bp, Homo sapiens
aggggctggggacttgtg

SEQ ID NO: 4628285 - DNA, 19 bp, Homo sapiens
aggggcttggtcctagggt

SEQ ID NO: 4628286 - DNA, 21 bp, Homo sapiens
agggggagccccttctgctca

SEQ ID NO: 4628287 - DNA, 23 bp, Homo sapiens
agggggagccggtaactgtcctg

SEQ ID NO: 4628288 - DNA, 19 bp, Homo sapiens
agggggcaggggcaggggc

SEQ ID NO: 4628289 - DNA, 13 bp, Homo sapiens
agggggccccgcc

SEQ ID NO: 4628290 - DNA, 19 bp, Homo sapiens
agggggccccgccagggct

SEQ ID NO: 4628291 - DNA, 23 bp, Homo sapiens
agggggccccgccagggctgggg

SEQ ID NO: 4628292 - DNA, 14 bp, Homo sapiens
agggggccctgcta

SEQ ID NO: 4628293 - DNA, 15 bp, Homo sapiens
agggggccctgctac

SEQ ID NO: 4628294 - DNA, 17 bp, Homo sapiens
agggggccctggggcct

SEQ ID NO: 4628295 - DNA, 16 bp, Homo sapiens
agggggctctgcccca

SEQ ID NO: 4628296 - DNA, 18 bp, Homo sapiens
agggggctctgccccagg

SEQ ID NO: 4628297 - DNA, 21 bp, Homo sapiens
agggggctctgccccaggccc

SEQ ID NO: 4628298 - DNA, 16 bp, Homo sapiens
agggggggctccctgg

SEQ ID NO: 4628299 - DNA, 15 bp, Homo sapiens
agggggtcgtggaga

SEQ ID NO: 4628300 - DNA, 17 bp, Homo sapiens
agggggtcgtggagagc

SEQ ID NO: 4628301 - DNA, 19 bp, Homo sapiens
agggggtcgtggagagcta

SEQ ID NO: 4628302 - DNA, 22 bp, Homo sapiens
aggggtcacacccaccccctgc

SEQ ID NO: 4628303 - DNA, 18 bp, Homo sapiens
aggggttggggtgacagt

SEQ ID NO: 4628304 - DNA, 15 bp, Homo sapiens
agggtcaagcctctt

SEQ ID NO: 4628305 - DNA, 18 bp, Homo sapiens
agggtcagccagggcctg

SEQ ID NO: 4628306 - DNA, 16 bp, Homo sapiens
agggtcggaggtgctg

SEQ ID NO: 4628307 - DNA, 16 bp, Homo sapiens
agggtctccttccttc

SEQ ID NO: 4628308 - DNA, 13 bp, Homo sapiens
agggtctgtgtga

SEQ ID NO: 4628309 - DNA, 15 bp, Homo sapiens
agggtctgtgtgaat

SEQ ID NO: 4628310 - DNA, 14 bp, Homo sapiens
agggtcttgggaaa

SEQ ID NO: 4628311 - DNA, 16 bp, Homo sapiens
agggtcttgggaaata

SEQ ID NO: 4628312 - DNA, 14 bp, Homo sapiens
agggtgctgactgg

SEQ ID NO: 4628313 - DNA, 16 bp, Homo sapiens
agggtgggaaggggct

SEQ ID NO: 4628314 - DNA, 12 bp, Homo sapiens
agggtgtgtgct

SEQ ID NO: 4628315 - DNA, 15 bp, Homo sapiens
agggtttgggcagag

SEQ ID NO: 4628316 - DNA, 14 bp, Homo sapiens
agggtttttagaga

SEQ ID NO: 4628317 - DNA, 14 bp, Homo sapiens
aggtaaaacagggc

SEQ ID NO: 4628318 - DNA, 13 bp, Homo sapiens
aggtaactggctt

SEQ ID NO: 4628319 - DNA, 22 bp, Homo sapiens
aggtaactggctttcctgctgg

SEQ ID NO: 4628320 - DNA, 18 bp, Homo sapiens
aggtaaggaaaaggattt

SEQ ID NO: 4628321 - DNA, 20 bp, Homo sapiens
aggtaagttgctattttcat

SEQ ID NO: 4628322 - DNA, 18 bp, Homo sapiens
aggtacaggagaggcagc

SEQ ID NO: 4628323 - DNA, 22 bp, Homo sapiens
aggtacaggagaggcagcatgc

SEQ ID NO: 4628324 - DNA, 16 bp, Homo sapiens
aggtactagaatgctt

SEQ ID NO: 4628325 - DNA, 14 bp, Homo sapiens
aggtactattctga

SEQ ID NO: 4628326 - DNA, 17 bp, Homo sapiens
aggtactgtggggtgga

SEQ ID NO: 4628327 - DNA, 12 bp, Homo sapiens
aggtagcctatt

SEQ ID NO: 4628328 - DNA, 22 bp, Homo sapiens
aggtagctatagttgcagccca

SEQ ID NO: 4628329 - DNA, 21 bp, Homo sapiens
aggtatcctgggggaagagga

SEQ ID NO: 4628330 - DNA, 23 bp, Homo sapiens
aggtatggctctgcacccctctg

SEQ ID NO: 4628331 - DNA, 18 bp, Homo sapiens
aggtattattatctttaa

SEQ ID NO: 4628332 - DNA, 17 bp, Homo sapiens
aggtatttagaagcaga

SEQ ID NO: 4628333 - DNA, 19 bp, Homo sapiens
aggtatttagaagcagagg

SEQ ID NO: 4628334 - DNA, 20 bp, Homo sapiens
aggtattttgtttcttttaa

SEQ ID NO: 4628335 - DNA, 15 bp, Homo sapiens
aggtcaccagctgct

SEQ ID NO: 4628336 - DNA, 17 bp, Homo sapiens
aggtcaccagctgctgt

SEQ ID NO: 4628337 - DNA, 18 bp, Homo sapiens
aggtcaccaggggaggag

SEQ ID NO: 4628338 - DNA, 20 bp, Homo sapiens
aggtcagggagtgctggctc

SEQ ID NO: 4628339 - DNA, 16 bp, Homo sapiens
aggtcccagccctggg

SEQ ID NO: 4628340 - DNA, 17 bp, Homo sapiens
aggtcccagccctgggg

SEQ ID NO: 4628341 - DNA, 13 bp, Homo sapiens
aggtcctctgtca

SEQ ID NO: 4628342 - DNA, 14 bp, Homo sapiens
aggtcctctgtcag

SEQ ID NO: 4628343 - DNA, 19 bp, Homo sapiens
aggtcctctgtcagtcaca

SEQ ID NO: 4628344 - DNA, 23 bp, Homo sapiens
aggtcctctgtcagtcacagcca

SEQ ID NO: 4628345 - DNA, 17 bp, Homo sapiens
aggtcctgagcactgcc

SEQ ID NO: 4628346 - DNA, 20 bp, Homo sapiens
aggtcctgagcactgccagg

SEQ ID NO: 4628347 - DNA, 19 bp, Homo sapiens
aggtcctggtggggcagct

SEQ ID NO: 4628348 - DNA, 22 bp, Homo sapiens
aggtcctggtggggcagctcct

SEQ ID NO: 4628349 - DNA, 18 bp, Homo sapiens
aggtctccaggggcctgc

SEQ ID NO: 4628350 - DNA, 13 bp, Homo sapiens
aggtctcctggga

SEQ ID NO: 4628351 - DNA, 14 bp, Homo sapiens
aggtctcctgggaa

SEQ ID NO: 4628352 - DNA, 16 bp, Homo sapiens
aggtctcgaccctgtc

SEQ ID NO: 4628353 - DNA, 17 bp, Homo sapiens
aggtctcgaccctgtcc

SEQ ID NO: 4628354 - DNA, 22 bp, Homo sapiens
aggtctcgaccctgtcccctag

SEQ ID NO: 4628355 - DNA, 20 bp, Homo sapiens
aggtctgacagtagctctta

SEQ ID NO: 4628356 - DNA, 23 bp, Homo sapiens
aggtcttcctgtggctccctctc

SEQ ID NO: 4628357 - DNA, 19 bp, Homo sapiens
aggtgaaagaaagggaccc

SEQ ID NO: 4628358 - DNA, 23 bp, Homo sapiens
aggtgaaagaaagggacccacct

SEQ ID NO: 4628359 - DNA, 23 bp, Homo sapiens
aggtgaattaattaaacattgtg

SEQ ID NO: 4628360 - DNA, 15 bp, Homo sapiens
aggtgaccccagggc

SEQ ID NO: 4628361 - DNA, 16 bp, Homo sapiens
aggtgaccccagggca

SEQ ID NO: 4628362 - DNA, 17 bp, Homo sapiens
aggtgaccccagggcac

SEQ ID NO: 4628363 - DNA, 21 bp, Homo sapiens
aggtgaccccagggcacagga

SEQ ID NO: 4628364 - DNA, 13 bp, Homo sapiens
aggtgagaattca

SEQ ID NO: 4628365 - DNA, 13 bp, Homo sapiens
aggtgagctactt

SEQ ID NO: 4628366 - DNA, 14 bp, Homo sapiens
aggtgagctacttt

SEQ ID NO: 4628367 - DNA, 13 bp, Homo sapiens
aggtgccaaccca

SEQ ID NO: 4628368 - DNA, 13 bp, Homo sapiens
aggtgccaccacc

SEQ ID NO: 4628369 - DNA, 14 bp, Homo sapiens
aggtgccaccaccc

SEQ ID NO: 4628370 - DNA, 19 bp, Homo sapiens
aggtgccaccaccctgccc

SEQ ID NO: 4628371 - DNA, 20 bp, Homo sapiens
aggtgccaccaccctgcccc

SEQ ID NO: 4628372 - DNA, 19 bp, Homo sapiens
aggtgcccactccgccagc

SEQ ID NO: 4628373 - DNA, 13 bp, Homo sapiens
aggtgcccaggag

SEQ ID NO: 4628374 - DNA, 16 bp, Homo sapiens
aggtgccgctacagtt

SEQ ID NO: 4628375 - DNA, 20 bp, Homo sapiens
aggtgcctgaaagctgggag

SEQ ID NO: 4628376 - DNA, 15 bp, Homo sapiens
aggtgctgtccccac

SEQ ID NO: 4628377 - DNA, 22 bp, Homo sapiens
aggtgctgtccccactgcccca

SEQ ID NO: 4628378 - DNA, 23 bp, Homo sapiens
aggtgctgtccccactgccccac

SEQ ID NO: 4628379 - DNA, 16 bp, Homo sapiens
aggtggaaggcagaca

SEQ ID NO: 4628380 - DNA, 18 bp, Homo sapiens
aggtggcccttcccggca

SEQ ID NO: 4628381 - DNA, 21 bp, Homo sapiens
aggtggggtagtgccgcagtg

SEQ ID NO: 4628382 - DNA, 14 bp, Homo sapiens
aggtggttcagaca

SEQ ID NO: 4628383 - DNA, 22 bp, Homo sapiens
aggtggttcagacaagacagag

SEQ ID NO: 4628384 - DNA, 19 bp, Homo sapiens
aggtgtgaacagctttgta

SEQ ID NO: 4628385 - DNA, 12 bp, Homo sapiens
aggtgtgaatgc

SEQ ID NO: 4628386 - DNA, 13 bp, Homo sapiens
aggtgtgaatgca

SEQ ID NO: 4628387 - DNA, 19 bp, Homo sapiens
aggtgtgccagaaagtccc

SEQ ID NO: 4628388 - DNA, 17 bp, Homo sapiens
aggtgtgggagggaaga

SEQ ID NO: 4628389 - DNA, 20 bp, Homo sapiens
aggtgttacagaggaccctt

SEQ ID NO: 4628390 - DNA, 23 bp, Homo sapiens
aggtgttacagaggacccttacg

SEQ ID NO: 4628391 - DNA, 18 bp, Homo sapiens
aggtgttgcagcccaaag

SEQ ID NO: 4628392 - DNA, 22 bp, Homo sapiens
aggtgttttttatgaagtgcgt

SEQ ID NO: 4628393 - DNA, 20 bp, Homo sapiens
aggttacagattatcacatt

SEQ ID NO: 4628394 - DNA, 21 bp, Homo sapiens
aggttacagattatcacatta

SEQ ID NO: 4628395 - DNA, 15 bp, Homo sapiens
aggttaccaagaagc

SEQ ID NO: 4628396 - DNA, 18 bp, Homo sapiens
aggttagcatcctgcccg

SEQ ID NO: 4628397 - DNA, 19 bp, Homo sapiens
aggttatacaataacccag

SEQ ID NO: 4628398 - DNA, 21 bp, Homo sapiens
aggttatacaataacccagtt

SEQ ID NO: 4628399 - DNA, 22 bp, Homo sapiens
aggttatacaataacccagtta

SEQ ID NO: 4628400 - DNA, 15 bp, Homo sapiens
aggttcccaagctca

SEQ ID NO: 4628401 - DNA, 20 bp, Homo sapiens
aggttccccaagggccctgg

SEQ ID NO: 4628402 - DNA, 16 bp, Homo sapiens
aggttcttcttcctga

SEQ ID NO: 4628403 - DNA, 23 bp, Homo sapiens
aggttcttcttcctgaagctgag

SEQ ID NO: 4628404 - DNA, 19 bp, Homo sapiens
aggttggggtgtactagtt

SEQ ID NO: 4628405 - DNA, 21 bp, Homo sapiens
aggtttcaacaaatttcattg

SEQ ID NO: 4628406 - DNA, 22 bp, Homo sapiens
aggtttcaacaaatttcattgc

SEQ ID NO: 4628407 - DNA, 16 bp, Homo sapiens
aggtttctctccctcc

SEQ ID NO: 4628408 - DNA, 22 bp, Homo sapiens
aggttttcaaccggaaggaggc

SEQ ID NO: 4628409 - DNA, 23 bp, Homo sapiens
aggttttggatcttgaatgtggt

SEQ ID NO: 4628410 - DNA, 14 bp, Homo sapiens
agtaaactatttat

SEQ ID NO: 4628411 - DNA, 17 bp, Homo sapiens
agtaaagcagaggatgc

SEQ ID NO: 4628412 - DNA, 16 bp, Homo sapiens
agtaaagtcaaggaga

SEQ ID NO: 4628413 - DNA, 18 bp, Homo sapiens
agtaaagtcaaggagaaa

SEQ ID NO: 4628414 - DNA, 17 bp, Homo sapiens
agtaaataaaattaaca

SEQ ID NO: 4628415 - DNA, 14 bp, Homo sapiens
agtaaattgctctg

SEQ ID NO: 4628416 - DNA, 15 bp, Homo sapiens
agtaaattgctctgt

SEQ ID NO: 4628417 - DNA, 21 bp, Homo sapiens
agtaacactgtgatttatctt

SEQ ID NO: 4628418 - DNA, 18 bp, Homo sapiens
agtaacatgcatacttta

SEQ ID NO: 4628419 - DNA, 20 bp, Homo sapiens
agtaacatgcatactttatt

SEQ ID NO: 4628420 - DNA, 20 bp, Homo sapiens
agtaaccaaggccctgtctc

SEQ ID NO: 4628421 - DNA, 14 bp, Homo sapiens
agtaagtcaggaca

SEQ ID NO: 4628422 - DNA, 22 bp, Homo sapiens
agtaatatattctgaagcaaca

SEQ ID NO: 4628423 - DNA, 21 bp, Homo sapiens
agtaatctgtgtacaaagaaa

SEQ ID NO: 4628424 - DNA, 13 bp, Homo sapiens
agtaatgaagaat

SEQ ID NO: 4628425 - DNA, 15 bp, Homo sapiens
agtaatgatctcaaa

SEQ ID NO: 4628426 - DNA, 13 bp, Homo sapiens
agtaatggcagag

SEQ ID NO: 4628427 - DNA, 13 bp, Homo sapiens
agtacaaatgcct

SEQ ID NO: 4628428 - DNA, 22 bp, Homo sapiens
agtacaaatgccttaaaatgga

SEQ ID NO: 4628429 - DNA, 19 bp, Homo sapiens
agtacacttttatgagctt

SEQ ID NO: 4628430 - DNA, 18 bp, Homo sapiens
agtacaggtgcatattaa

SEQ ID NO: 4628431 - DNA, 12 bp, Homo sapiens
agtacctgtcca

SEQ ID NO: 4628432 - DNA, 15 bp, Homo sapiens
agtactctttaacat

SEQ ID NO: 4628433 - DNA, 22 bp, Homo sapiens
agtactctttaacatacaagaa

SEQ ID NO: 4628434 - DNA, 13 bp, Homo sapiens
agtacttaacata

SEQ ID NO: 4628435 - DNA, 18 bp, Homo sapiens
agtacttaatatactcag

SEQ ID NO: 4628436 - DNA, 23 bp, Homo sapiens
agtacttgagggaccaatattac

SEQ ID NO: 4628437 - DNA, 19 bp, Homo sapiens
agtactttggaaagccaag

SEQ ID NO: 4628438 - DNA, 16 bp, Homo sapiens
agtactttgtgcattc

SEQ ID NO: 4628439 - DNA, 13 bp, Homo sapiens
agtacttttttaa

SEQ ID NO: 4628440 - DNA, 15 bp, Homo sapiens
agtacttttttaaat

SEQ ID NO: 4628441 - DNA, 14 bp, Homo sapiens
agtagagacagtgt

SEQ ID NO: 4628442 - DNA, 15 bp, Homo sapiens
agtagatttctatga

SEQ ID NO: 4628443 - DNA, 22 bp, Homo sapiens
agtagcctaacacactccaaga

SEQ ID NO: 4628444 - DNA, 19 bp, Homo sapiens
agtagctagtttgcttttt

SEQ ID NO: 4628445 - DNA, 14 bp, Homo sapiens
agtagcttgctccc

SEQ ID NO: 4628446 - DNA, 17 bp, Homo sapiens
agtagcttgctccctgt

SEQ ID NO: 4628447 - DNA, 15 bp, Homo sapiens
agtaggaccaggcca

SEQ ID NO: 4628448 - DNA, 17 bp, Homo sapiens
agtaggaccaggccacc

SEQ ID NO: 4628449 - DNA, 13 bp, Homo sapiens
agtataagaaatg

SEQ ID NO: 4628450 - DNA, 14 bp, Homo sapiens
agtatagtgcaaat

SEQ ID NO: 4628451 - DNA, 19 bp, Homo sapiens
agtatattatatggcagga

SEQ ID NO: 4628452 - DNA, 21 bp, Homo sapiens
agtatattcttattggaaatg

SEQ ID NO: 4628453 - DNA, 12 bp, Homo sapiens
agtatctgtata

SEQ ID NO: 4628454 - DNA, 17 bp, Homo sapiens
agtatgccactgcactc

SEQ ID NO: 4628455 - DNA, 15 bp, Homo sapiens
agtatggtgtgttca

SEQ ID NO: 4628456 - DNA, 19 bp, Homo sapiens
agtattaatactacccata

SEQ ID NO: 4628457 - DNA, 14 bp, Homo sapiens
agtattattttcca

SEQ ID NO: 4628458 - DNA, 15 bp, Homo sapiens
agtattattttccaa

SEQ ID NO: 4628459 - DNA, 18 bp, Homo sapiens
agtattattttccaaaag

SEQ ID NO: 4628460 - DNA, 12 bp, Homo sapiens
agtatttaacta

SEQ ID NO: 4628461 - DNA, 18 bp, Homo sapiens
agtatttataaaaatata

SEQ ID NO: 4628462 - DNA, 20 bp, Homo sapiens
agtatttataaaaatataaa

SEQ ID NO: 4628463 - DNA, 22 bp, Homo sapiens
agtatttataaaaatataaatt

SEQ ID NO: 4628464 - DNA, 12 bp, Homo sapiens
agtatttattcc

SEQ ID NO: 4628465 - DNA, 23 bp, Homo sapiens
agtatttctgttcctttttgtaa

SEQ ID NO: 4628466 - DNA, 16 bp, Homo sapiens
agtattttctccactt

SEQ ID NO: 4628467 - DNA, 15 bp, Homo sapiens
agtcaaataaatgtt

SEQ ID NO: 4628468 - DNA, 22 bp, Homo sapiens
agtcaaataaatgtttccccca

SEQ ID NO: 4628469 - DNA, 13 bp, Homo sapiens
agtcaagctccta

SEQ ID NO: 4628470 - DNA, 19 bp, Homo sapiens
agtcaattctgtgtggtat

SEQ ID NO: 4628471 - DNA, 21 bp, Homo sapiens
agtcacagccgtttgaatata

SEQ ID NO: 4628472 - DNA, 16 bp, Homo sapiens
agtcactaatatagta

SEQ ID NO: 4628473 - DNA, 19 bp, Homo sapiens
agtcacttactattgttgc

SEQ ID NO: 4628474 - DNA, 15 bp, Homo sapiens
agtcacttccccaag

SEQ ID NO: 4628475 - DNA, 24 bp, Homo sapiens
agtcagaaaattggcagtggcaga

SEQ ID NO: 4628476 - DNA, 19 bp, Homo sapiens
agtcagatgaggccctgca

SEQ ID NO: 4628477 - DNA, 20 bp, Homo sapiens
agtcagccccgacttcctga

SEQ ID NO: 4628478 - DNA, 21 bp, Homo sapiens
agtcagccccgacttcctgac

SEQ ID NO: 4628479 - DNA, 15 bp, Homo sapiens
agtcaggatgaggcc

SEQ ID NO: 4628480 - DNA, 18 bp, Homo sapiens
agtcaggatgaggccccg

SEQ ID NO: 4628481 - DNA, 23 bp, Homo sapiens
agtcagggtttgtcagaggaaca

SEQ ID NO: 4628482 - DNA, 10 bp, Homo sapiens
agtcataata

SEQ ID NO: 4628483 - DNA, 14 bp, Homo sapiens
agtcatcatcaggg

SEQ ID NO: 4628484 - DNA, 19 bp, Homo sapiens
agtcatcatcagggcctgg

SEQ ID NO: 4628485 - DNA, 22 bp, Homo sapiens
agtcatcatcagggcctggggc

SEQ ID NO: 4628486 - DNA, 15 bp, Homo sapiens
agtcatggtgttgcg

SEQ ID NO: 4628487 - DNA, 17 bp, Homo sapiens
agtcatggtgttgcgta

SEQ ID NO: 4628488 - DNA, 17 bp, Homo sapiens
agtcattcgttctgtgg

SEQ ID NO: 4628489 - DNA, 18 bp, Homo sapiens
agtcattttattttgtaa

SEQ ID NO: 4628490 - DNA, 16 bp, Homo sapiens
agtccaggtcctggtg

SEQ ID NO: 4628491 - DNA, 22 bp, Homo sapiens
agtcccccctcgccccaaagtt

SEQ ID NO: 4628492 - DNA, 12 bp, Homo sapiens
agtccctcttct

SEQ ID NO: 4628493 - DNA, 19 bp, Homo sapiens
agtcccttttcattctcct

SEQ ID NO: 4628494 - DNA, 22 bp, Homo sapiens
agtccgtgtggatccaatgtta

SEQ ID NO: 4628495 - DNA, 16 bp, Homo sapiens
agtcctatagtcgtgg

SEQ ID NO: 4628496 - DNA, 18 bp, Homo sapiens
agtcctcactcttcaagg

SEQ ID NO: 4628497 - DNA, 12 bp, Homo sapiens
agtcctccctag

SEQ ID NO: 4628498 - DNA, 11 bp, Homo sapiens
agtcctgcctt

SEQ ID NO: 4628499 - DNA, 23 bp, Homo sapiens
agtcctgccttcttccttgaggg

SEQ ID NO: 4628500 - DNA, 16 bp, Homo sapiens
agtcctttcaattcca

SEQ ID NO: 4628501 - DNA, 22 bp, Homo sapiens
agtcctttcccaccattcctgc

SEQ ID NO: 4628502 - DNA, 19 bp, Homo sapiens
agtcgcccctcagagcatg

SEQ ID NO: 4628503 - DNA, 12 bp, Homo sapiens
agtcgggcatga

SEQ ID NO: 4628504 - DNA, 17 bp, Homo sapiens
agtcgggcatgagtctg

SEQ ID NO: 4628505 - DNA, 20 bp, Homo sapiens
agtcgggcatgagtctgttt

SEQ ID NO: 4628506 - DNA, 17 bp, Homo sapiens
agtcgtccttactcctg

SEQ ID NO: 4628507 - DNA, 11 bp, Homo sapiens
agtctaccaaa

SEQ ID NO: 4628508 - DNA, 23 bp, Homo sapiens
agtctagtccgtcctggcacaga

SEQ ID NO: 4628509 - DNA, 13 bp, Homo sapiens
agtctatgttcaa

SEQ ID NO: 4628510 - DNA, 15 bp, Homo sapiens
agtctcactcttgtc

SEQ ID NO: 4628511 - DNA, 16 bp, Homo sapiens
agtctcactcttgtca

SEQ ID NO: 4628512 - DNA, 19 bp, Homo sapiens
agtctcattgtcacctctg

SEQ ID NO: 4628513 - DNA, 17 bp, Homo sapiens
agtctcatttgggctag

SEQ ID NO: 4628514 - DNA, 20 bp, Homo sapiens
agtctcatttgggctagact

SEQ ID NO: 4628515 - DNA, 15 bp, Homo sapiens
agtctcccttttata

SEQ ID NO: 4628516 - DNA, 21 bp, Homo sapiens
agtctcctaggggcttggtcc

SEQ ID NO: 4628517 - DNA, 22 bp, Homo sapiens
agtctcctaggggcttggtcct

SEQ ID NO: 4628518 - DNA, 11 bp, Homo sapiens
agtctgaagat

SEQ ID NO: 4628519 - DNA, 15 bp, Homo sapiens
agtctgaggtcctga

SEQ ID NO: 4628520 - DNA, 17 bp, Homo sapiens
agtctgaggtcctgagc

SEQ ID NO: 4628521 - DNA, 20 bp, Homo sapiens
agtctgaggtcctgagcact

SEQ ID NO: 4628522 - DNA, 10 bp, Homo sapiens
agtctgggtc

SEQ ID NO: 4628523 - DNA, 13 bp, Homo sapiens
agtctgggtcaga

SEQ ID NO: 4628524 - DNA, 17 bp, Homo sapiens
agtctgggtcagaccca

SEQ ID NO: 4628525 - DNA, 19 bp, Homo sapiens
agtctgggtccatcctggt

SEQ ID NO: 4628526 - DNA, 16 bp, Homo sapiens
agtctgtctttcctga

SEQ ID NO: 4628527 - DNA, 18 bp, Homo sapiens
agtctgtttcccaagcta

SEQ ID NO: 4628528 - DNA, 22 bp, Homo sapiens
agtcttagggatttattttcaa

SEQ ID NO: 4628529 - DNA, 19 bp, Homo sapiens
agtcttgatctagatacag

SEQ ID NO: 4628530 - DNA, 18 bp, Homo sapiens
agtcttgtattaagttgt

SEQ ID NO: 4628531 - DNA, 14 bp, Homo sapiens
agtctttctcctct

SEQ ID NO: 4628532 - DNA, 16 bp, Homo sapiens
agtctttctcctcttt

SEQ ID NO: 4628533 - DNA, 18 bp, Homo sapiens
agtctttctcctctttga

SEQ ID NO: 4628534 - DNA, 13 bp, Homo sapiens
agtctttgtttac

SEQ ID NO: 4628535 - DNA, 22 bp, Homo sapiens
agtgaaaatcttggagaccctg

SEQ ID NO: 4628536 - DNA, 20 bp, Homo sapiens
agtgaaattaagcattttga

SEQ ID NO: 4628537 - DNA, 20 bp, Homo sapiens
agtgaatacattaacggtgc

SEQ ID NO: 4628538 - DNA, 22 bp, Homo sapiens
agtgaatggggaagggagtctc

SEQ ID NO: 4628539 - DNA, 22 bp, Homo sapiens
agtgactcctgctggtacctgc

SEQ ID NO: 4628540 - DNA, 16 bp, Homo sapiens
agtgagatagcattgt

SEQ ID NO: 4628541 - DNA, 22 bp, Homo sapiens
agtgagatttaagttcctgctg

SEQ ID NO: 4628542 - DNA, 14 bp, Homo sapiens
agtgagctgagaca

SEQ ID NO: 4628543 - DNA, 18 bp, Homo sapiens
agtgaggatgagacccag

SEQ ID NO: 4628544 - DNA, 15 bp, Homo sapiens
agtgaggcaggagaa

SEQ ID NO: 4628545 - DNA, 13 bp, Homo sapiens
agtgcaaaatgtc

SEQ ID NO: 4628546 - DNA, 15 bp, Homo sapiens
agtgcaaaatgtctt

SEQ ID NO: 4628547 - DNA, 16 bp, Homo sapiens
agtgcaaaatgtcttg

SEQ ID NO: 4628548 - DNA, 15 bp, Homo sapiens
agtgcaaacacagca

SEQ ID NO: 4628549 - DNA, 13 bp, Homo sapiens
agtgcaacctctg

SEQ ID NO: 4628550 - DNA, 17 bp, Homo sapiens
agtgcaagttcatgtgt

SEQ ID NO: 4628551 - DNA, 18 bp, Homo sapiens
agtgcaattccaagaaaa

SEQ ID NO: 4628552 - DNA, 18 bp, Homo sapiens
agtgcaggggatggggtg

SEQ ID NO: 4628553 - DNA, 15 bp, Homo sapiens
agtgcatcacatctg

SEQ ID NO: 4628554 - DNA, 16 bp, Homo sapiens
agtgccaacaatccta

SEQ ID NO: 4628555 - DNA, 12 bp, Homo sapiens
agtgccaaggac

SEQ ID NO: 4628556 - DNA, 19 bp, Homo sapiens
agtgccataccttctccca

SEQ ID NO: 4628557 - DNA, 23 bp, Homo sapiens
agtgccataccttctcccaggcc

SEQ ID NO: 4628558 - DNA, 22 bp, Homo sapiens
agtgcctgcacatcatgagcct

SEQ ID NO: 4628559 - DNA, 19 bp, Homo sapiens
agtgctttccttttttaaa

SEQ ID NO: 4628560 - DNA, 23 bp, Homo sapiens
agtgctttgacttcttgcttcag

SEQ ID NO: 4628561 - DNA, 16 bp, Homo sapiens
agtggaaacatttata

SEQ ID NO: 4628562 - DNA, 21 bp, Homo sapiens
agtggagacagtcctttccca

SEQ ID NO: 4628563 - DNA, 21 bp, Homo sapiens
agtggagggggcaagctttgc

SEQ ID NO: 4628564 - DNA, 16 bp, Homo sapiens
agtggatgctgtgcta

SEQ ID NO: 4628565 - DNA, 21 bp, Homo sapiens
agtggatgtttttaatgacca

SEQ ID NO: 4628566 - DNA, 13 bp, Homo sapiens
agtggcaggacag

SEQ ID NO: 4628567 - DNA, 11 bp, Homo sapiens
agtggcaggga

SEQ ID NO: 4628568 - DNA, 18 bp, Homo sapiens
agtggcaggggagcaggt

SEQ ID NO: 4628569 - DNA, 16 bp, Homo sapiens
agtggccatcatcctc

SEQ ID NO: 4628570 - DNA, 23 bp, Homo sapiens
agtggcgccatctcggctcactg

SEQ ID NO: 4628571 - DNA, 22 bp, Homo sapiens
agtggctatttctttatattta

SEQ ID NO: 4628572 - DNA, 22 bp, Homo sapiens
agtgggacagcccagagcctgg

SEQ ID NO: 4628573 - DNA, 21 bp, Homo sapiens
agtgggagagtacctgtgtgt

SEQ ID NO: 4628574 - DNA, 17 bp, Homo sapiens
agtgggagctgagctgg

SEQ ID NO: 4628575 - DNA, 15 bp, Homo sapiens
agtgggccagggctg

SEQ ID NO: 4628576 - DNA, 12 bp, Homo sapiens
agtggggagagt

SEQ ID NO: 4628577 - DNA, 13 bp, Homo sapiens
agtggggcctgtg

SEQ ID NO: 4628578 - DNA, 13 bp, Homo sapiens
agtggggctctct

SEQ ID NO: 4628579 - DNA, 15 bp, Homo sapiens
agtggggctctctga

SEQ ID NO: 4628580 - DNA, 18 bp, Homo sapiens
agtggggtcaagctgagc

SEQ ID NO: 4628581 - DNA, 22 bp, Homo sapiens
agtggggtcaagctgagctggc

SEQ ID NO: 4628582 - DNA, 14 bp, Homo sapiens
agtggtatagaaat

SEQ ID NO: 4628583 - DNA, 15 bp, Homo sapiens
agtggtatagaaatg

SEQ ID NO: 4628584 - DNA, 14 bp, Homo sapiens
agtgtaaaaaatgt

SEQ ID NO: 4628585 - DNA, 15 bp, Homo sapiens
agtgtacagtcttgt

SEQ ID NO: 4628586 - DNA, 23 bp, Homo sapiens
agtgtaccgcgtctaccctggga

SEQ ID NO: 4628587 - DNA, 15 bp, Homo sapiens
agtgtactcccaggg

SEQ ID NO: 4628588 - DNA, 18 bp, Homo sapiens
agtgtagacacaggtcac

SEQ ID NO: 4628589 - DNA, 12 bp, Homo sapiens
agtgtagcctaa

SEQ ID NO: 4628590 - DNA, 18 bp, Homo sapiens
agtgtagcctaaagggca

SEQ ID NO: 4628591 - DNA, 12 bp, Homo sapiens
agtgtagctgta

SEQ ID NO: 4628592 - DNA, 21 bp, Homo sapiens
agtgtagctgtaagggcagtg

SEQ ID NO: 4628593 - DNA, 20 bp, Homo sapiens
agtgtagttaaggagcctaa

SEQ ID NO: 4628594 - DNA, 17 bp, Homo sapiens
agtgtcacctccttccc

SEQ ID NO: 4628595 - DNA, 20 bp, Homo sapiens
agtgtcatataaactcattt

SEQ ID NO: 4628596 - DNA, 15 bp, Homo sapiens
agtgtcctgcccatg

SEQ ID NO: 4628597 - DNA, 18 bp, Homo sapiens
agtgtgaataaagtgctg

SEQ ID NO: 4628598 - DNA, 14 bp, Homo sapiens
agtgtgacagggcc

SEQ ID NO: 4628599 - DNA, 18 bp, Homo sapiens
agtgtgacagtttccaaa

SEQ ID NO: 4628600 - DNA, 15 bp, Homo sapiens
agtgtggcaaaataa

SEQ ID NO: 4628601 - DNA, 21 bp, Homo sapiens
agtgttactgcctataatctt

SEQ ID NO: 4628602 - DNA, 20 bp, Homo sapiens
agtgtttatgtttaaaagaa

SEQ ID NO: 4628603 - DNA, 15 bp, Homo sapiens
agtgtttctgaatgt

SEQ ID NO: 4628604 - DNA, 17 bp, Homo sapiens
agtgtttctgaatgttt

SEQ ID NO: 4628605 - DNA, 13 bp, Homo sapiens
agtgtttgtggga

SEQ ID NO: 4628606 - DNA, 21 bp, Homo sapiens
agtgtttttacctctgtcttg

SEQ ID NO: 4628607 - DNA, 11 bp, Homo sapiens
agttaaagcca

SEQ ID NO: 4628608 - DNA, 14 bp, Homo sapiens
agttaatattttgt

SEQ ID NO: 4628609 - DNA, 21 bp, Homo sapiens
agttaatattttgttcttatt

SEQ ID NO: 4628610 - DNA, 21 bp, Homo sapiens
agttaattggatgttcactgc

SEQ ID NO: 4628611 - DNA, 20 bp, Homo sapiens
agttagagcccattaatctt

SEQ ID NO: 4628612 - DNA, 22 bp, Homo sapiens
agttagagcccattaatcttga

SEQ ID NO: 4628613 - DNA, 14 bp, Homo sapiens
agttaggggcctta

SEQ ID NO: 4628614 - DNA, 16 bp, Homo sapiens
agttatcaaaaagtat

SEQ ID NO: 4628615 - DNA, 14 bp, Homo sapiens
agttatctattgaa

SEQ ID NO: 4628616 - DNA, 14 bp, Homo sapiens
agttatttccaagt

SEQ ID NO: 4628617 - DNA, 14 bp, Homo sapiens
agttcaaatacttt

SEQ ID NO: 4628618 - DNA, 19 bp, Homo sapiens
agttcaataaatgtctgtt

SEQ ID NO: 4628619 - DNA, 19 bp, Homo sapiens
agttccaaacagacaaaac

SEQ ID NO: 4628620 - DNA, 20 bp, Homo sapiens
agttccaagtccaataagac

SEQ ID NO: 4628621 - DNA, 13 bp, Homo sapiens
agttccctctgcc

SEQ ID NO: 4628622 - DNA, 15 bp, Homo sapiens
agttccctctgcctg

SEQ ID NO: 4628623 - DNA, 17 bp, Homo sapiens
agttccctctgcctggg

SEQ ID NO: 4628624 - DNA, 18 bp, Homo sapiens
agttccctctgcctggga

SEQ ID NO: 4628625 - DNA, 13 bp, Homo sapiens
agttcctgggaac

SEQ ID NO: 4628626 - DNA, 14 bp, Homo sapiens
agttcgcagccacc

SEQ ID NO: 4628627 - DNA, 16 bp, Homo sapiens
agttctctgggaagtg

SEQ ID NO: 4628628 - DNA, 22 bp, Homo sapiens
agttctgcttgctcccaagccc

SEQ ID NO: 4628629 - DNA, 20 bp, Homo sapiens
agttctgtgtaaacagaagc

SEQ ID NO: 4628630 - DNA, 12 bp, Homo sapiens
agttctgtgtgg

SEQ ID NO: 4628631 - DNA, 19 bp, Homo sapiens
agttctgtgtggtgcattc

SEQ ID NO: 4628632 - DNA, 23 bp, Homo sapiens
agttctgtgtggtgcattcctga

SEQ ID NO: 4628633 - DNA, 18 bp, Homo sapiens
agttcttcatttggagga

SEQ ID NO: 4628634 - DNA, 20 bp, Homo sapiens
agttcttcatttggaggaat

SEQ ID NO: 4628635 - DNA, 21 bp, Homo sapiens
agttcttcatttggaggaatc

SEQ ID NO: 4628636 - DNA, 13 bp, Homo sapiens
agttcttgtgcca

SEQ ID NO: 4628637 - DNA, 13 bp, Homo sapiens
agttctttcctcc

SEQ ID NO: 4628638 - DNA, 18 bp, Homo sapiens
agttctttcctccccctg

SEQ ID NO: 4628639 - DNA, 20 bp, Homo sapiens
agttctttcctccccctgca

SEQ ID NO: 4628640 - DNA, 15 bp, Homo sapiens
agttgatgtgtcttt

SEQ ID NO: 4628641 - DNA, 18 bp, Homo sapiens
agttgatttagtgttttt

SEQ ID NO: 4628642 - DNA, 19 bp, Homo sapiens
agttgcagcccaaggacag

SEQ ID NO: 4628643 - DNA, 20 bp, Homo sapiens
agttgcagcccaaggacagt

SEQ ID NO: 4628644 - DNA, 19 bp, Homo sapiens
agttgcatttagcttcttt

SEQ ID NO: 4628645 - DNA, 23 bp, Homo sapiens
agttgctcaccgactcacctgcg

SEQ ID NO: 4628646 - DNA, 21 bp, Homo sapiens
agttgctgtgaactttcatgt

SEQ ID NO: 4628647 - DNA, 16 bp, Homo sapiens
agttgctgtgtgtctg

SEQ ID NO: 4628648 - DNA, 20 bp, Homo sapiens
agttgtccacaaatcttcag

SEQ ID NO: 4628649 - DNA, 12 bp, Homo sapiens
agttgtctgtgc

SEQ ID NO: 4628650 - DNA, 13 bp, Homo sapiens
agttgtcttatgt

SEQ ID NO: 4628651 - DNA, 15 bp, Homo sapiens
agttgtgatggaggg

SEQ ID NO: 4628652 - DNA, 14 bp, Homo sapiens
agttgtgcttgagc

SEQ ID NO: 4628653 - DNA, 12 bp, Homo sapiens
agttgtggagga

SEQ ID NO: 4628654 - DNA, 14 bp, Homo sapiens
agttgtggaggagg

SEQ ID NO: 4628655 - DNA, 20 bp, Homo sapiens
agtttaaataccagtacttg

SEQ ID NO: 4628656 - DNA, 17 bp, Homo sapiens
agtttaacaagtattta

SEQ ID NO: 4628657 - DNA, 22 bp, Homo sapiens
agtttatttccactattttcaa

SEQ ID NO: 4628658 - DNA, 17 bp, Homo sapiens
agtttcaaagtgtctca

SEQ ID NO: 4628659 - DNA, 20 bp, Homo sapiens
agtttctcaaaacccttaaa

SEQ ID NO: 4628660 - DNA, 15 bp, Homo sapiens
agtttctcagaagtc

SEQ ID NO: 4628661 - DNA, 23 bp, Homo sapiens
agtttctgcaaagtgtatgtgac

SEQ ID NO: 4628662 - DNA, 16 bp, Homo sapiens
agtttctgcctgggca

SEQ ID NO: 4628663 - DNA, 18 bp, Homo sapiens
agtttcttgcttggaagc

SEQ ID NO: 4628664 - DNA, 13 bp, Homo sapiens
agtttgatttttg

SEQ ID NO: 4628665 - DNA, 16 bp, Homo sapiens
agtttgcacctgtccc

SEQ ID NO: 4628666 - DNA, 22 bp, Homo sapiens
agtttggaattattgtagacat

SEQ ID NO: 4628667 - DNA, 18 bp, Homo sapiens
agtttgtagaactttatt

SEQ ID NO: 4628668 - DNA, 15 bp, Homo sapiens
agtttgtagccaggt

SEQ ID NO: 4628669 - DNA, 14 bp, Homo sapiens
agttttacatttta

SEQ ID NO: 4628670 - DNA, 15 bp, Homo sapiens
agttttacattttaa

SEQ ID NO: 4628671 - DNA, 21 bp, Homo sapiens
agtttttaaaatatattgctg

SEQ ID NO: 4628672 - DNA, 13 bp, Homo sapiens
ataaaaatatgta

SEQ ID NO: 4628673 - DNA, 17 bp, Homo sapiens
ataaaaattacatatat

SEQ ID NO: 4628674 - DNA, 20 bp, Homo sapiens
ataaaactaaggcttttatt

SEQ ID NO: 4628675 - DNA, 15 bp, Homo sapiens
ataaaagtacatgtt

SEQ ID NO: 4628676 - DNA, 21 bp, Homo sapiens
ataaaagtacatgttaaactt

SEQ ID NO: 4628677 - DNA, 15 bp, Homo sapiens
ataaaatagaataat

SEQ ID NO: 4628678 - DNA, 19 bp, Homo sapiens
ataaaatagaataattctt

SEQ ID NO: 4628679 - DNA, 21 bp, Homo sapiens
ataaaatagaataattctttt

SEQ ID NO: 4628680 - DNA, 14 bp, Homo sapiens
ataaaatatcataa

SEQ ID NO: 4628681 - DNA, 16 bp, Homo sapiens
ataaaatatcataaag

SEQ ID NO: 4628682 - DNA, 14 bp, Homo sapiens
ataaaatgaacatc

SEQ ID NO: 4628683 - DNA, 23 bp, Homo sapiens
ataaaatgaacatctcttgaaac

SEQ ID NO: 4628684 - DNA, 18 bp, Homo sapiens
ataaaatgatttgtggaa

SEQ ID NO: 4628685 - DNA, 15 bp, Homo sapiens
ataaaattttttaaa

SEQ ID NO: 4628686 - DNA, 16 bp, Homo sapiens
ataaacacgattttat

SEQ ID NO: 4628687 - DNA, 13 bp, Homo sapiens
ataaacagataat

SEQ ID NO: 4628688 - DNA, 14 bp, Homo sapiens
ataaactcatttat

SEQ ID NO: 4628689 - DNA, 22 bp, Homo sapiens
ataaactgactatcataaaatc

SEQ ID NO: 4628690 - DNA, 13 bp, Homo sapiens
ataaagatcattt

SEQ ID NO: 4628691 - DNA, 16 bp, Homo sapiens
ataaagcaatgtgttt

SEQ ID NO: 4628692 - DNA, 16 bp, Homo sapiens
ataaagccacttctgg

SEQ ID NO: 4628693 - DNA, 10 bp, Homo sapiens
ataaagcttt

SEQ ID NO: 4628694 - DNA, 12 bp, Homo sapiens
ataaagctttat

SEQ ID NO: 4628695 - DNA, 15 bp, Homo sapiens
ataaagctttataaa

SEQ ID NO: 4628696 - DNA, 19 bp, Homo sapiens
ataaaggataactctgtat

SEQ ID NO: 4628697 - DNA, 13 bp, Homo sapiens
ataaagggaagaa

SEQ ID NO: 4628698 - DNA, 22 bp, Homo sapiens
ataaaggtgaggggaagacaaa

SEQ ID NO: 4628699 - DNA, 12 bp, Homo sapiens
ataaagtacaaa

SEQ ID NO: 4628700 - DNA, 17 bp, Homo sapiens
ataaagtacaaatgaag

SEQ ID NO: 4628701 - DNA, 23 bp, Homo sapiens
ataaagtgctgcggagcaagagg

SEQ ID NO: 4628702 - DNA, 16 bp, Homo sapiens
ataaagttacctacat

SEQ ID NO: 4628703 - DNA, 20 bp, Homo sapiens
ataaatacagcatacttcaa

SEQ ID NO: 4628704 - DNA, 23 bp, Homo sapiens
ataaatcacagaaaatttaactt

SEQ ID NO: 4628705 - DNA, 15 bp, Homo sapiens
ataaatgtctgttga

SEQ ID NO: 4628706 - DNA, 12 bp, Homo sapiens
ataaatgtttcc

SEQ ID NO: 4628707 - DNA, 13 bp, Homo sapiens
ataaattgtacat

SEQ ID NO: 4628708 - DNA, 15 bp, Homo sapiens
ataaatttaagaaaa

SEQ ID NO: 4628709 - DNA, 17 bp, Homo sapiens
ataaatttaagaaaaca

SEQ ID NO: 4628710 - DNA, 19 bp, Homo sapiens
ataaatttaagaaaacaag

SEQ ID NO: 4628711 - DNA, 22 bp, Homo sapiens
ataaattttttttgtttcatat

SEQ ID NO: 4628712 - DNA, 14 bp, Homo sapiens
ataacagagagaat

SEQ ID NO: 4628713 - DNA, 12 bp, Homo sapiens
ataacatttaaa

SEQ ID NO: 4628714 - DNA, 17 bp, Homo sapiens
ataacatttaaattcca

SEQ ID NO: 4628715 - DNA, 20 bp, Homo sapiens
ataaccaaagcccaaagtgg

SEQ ID NO: 4628716 - DNA, 20 bp, Homo sapiens
ataacctgcacaggcttgct

SEQ ID NO: 4628717 - DNA, 16 bp, Homo sapiens
ataacgtgatacattt

SEQ ID NO: 4628718 - DNA, 13 bp, Homo sapiens
ataactgcccagc

SEQ ID NO: 4628719 - DNA, 23 bp, Homo sapiens
ataactgcccagcggacagtggc

SEQ ID NO: 4628720 - DNA, 15 bp, Homo sapiens
ataagaattactttg

SEQ ID NO: 4628721 - DNA, 17 bp, Homo sapiens
ataagatattctttaca

SEQ ID NO: 4628722 - DNA, 14 bp, Homo sapiens
ataagcagaacata

SEQ ID NO: 4628723 - DNA, 21 bp, Homo sapiens
ataagctatcacctagcagcc

SEQ ID NO: 4628724 - DNA, 13 bp, Homo sapiens
ataagtaaaccta

SEQ ID NO: 4628725 - DNA, 21 bp, Homo sapiens
ataagtagtaaatcagaaagt

SEQ ID NO: 4628726 - DNA, 22 bp, Homo sapiens
ataagtagtaaatcagaaagta

SEQ ID NO: 4628727 - DNA, 18 bp, Homo sapiens
ataagtggctgtttcatc

SEQ ID NO: 4628728 - DNA, 19 bp, Homo sapiens
ataagtgtacgattcttaa

SEQ ID NO: 4628729 - DNA, 16 bp, Homo sapiens
ataagtttctattctg

SEQ ID NO: 4628730 - DNA, 13 bp, Homo sapiens
ataatatcaaata

SEQ ID NO: 4628731 - DNA, 14 bp, Homo sapiens
ataatatcaaataa

SEQ ID NO: 4628732 - DNA, 17 bp, Homo sapiens
ataatatcaaataaaat

SEQ ID NO: 4628733 - DNA, 19 bp, Homo sapiens
ataatatcaaataaaatat

SEQ ID NO: 4628734 - DNA, 13 bp, Homo sapiens
ataatatcattta

SEQ ID NO: 4628735 - DNA, 22 bp, Homo sapiens
ataatatgtttagttttacatt

SEQ ID NO: 4628736 - DNA, 21 bp, Homo sapiens
ataatatttttgtatttctct

SEQ ID NO: 4628737 - DNA, 22 bp, Homo sapiens
ataatatttttgtatttctcta

SEQ ID NO: 4628738 - DNA, 14 bp, Homo sapiens
ataatcagtaaata

SEQ ID NO: 4628739 - DNA, 14 bp, Homo sapiens
ataatcttatacaa

SEQ ID NO: 4628740 - DNA, 17 bp, Homo sapiens
ataatgaaaatattttt

SEQ ID NO: 4628741 - DNA, 12 bp, Homo sapiens
ataatgacagat

SEQ ID NO: 4628742 - DNA, 18 bp, Homo sapiens
ataatgttaaccaaggaa

SEQ ID NO: 4628743 - DNA, 18 bp, Homo sapiens
ataatgtttaaatagcat

SEQ ID NO: 4628744 - DNA, 13 bp, Homo sapiens
ataattaatgctt

SEQ ID NO: 4628745 - DNA, 13 bp, Homo sapiens
ataattatgaaaa

SEQ ID NO: 4628746 - DNA, 14 bp, Homo sapiens
ataattatgaaaac

SEQ ID NO: 4628747 - DNA, 16 bp, Homo sapiens
ataattcctacagcac

SEQ ID NO: 4628748 - DNA, 19 bp, Homo sapiens
ataattcctacagcactac

SEQ ID NO: 4628749 - DNA, 16 bp, Homo sapiens
ataattggtgctattt

SEQ ID NO: 4628750 - DNA, 18 bp, Homo sapiens
ataattggtgctatttga

SEQ ID NO: 4628751 - DNA, 15 bp, Homo sapiens
ataatttgaaaaagt

SEQ ID NO: 4628752 - DNA, 14 bp, Homo sapiens
ataatttggtcatt

SEQ ID NO: 4628753 - DNA, 15 bp, Homo sapiens
ataattttctaagtc

SEQ ID NO: 4628754 - DNA, 12 bp, Homo sapiens
ataattttgcat

SEQ ID NO: 4628755 - DNA, 15 bp, Homo sapiens
ataattttgcatact

SEQ ID NO: 4628756 - DNA, 21 bp, Homo sapiens
ataattttgcatactgaaaat

SEQ ID NO: 4628757 - DNA, 14 bp, Homo sapiens
ataattttttctta

SEQ ID NO: 4628758 - DNA, 13 bp, Homo sapiens
atacaaactctca

SEQ ID NO: 4628759 - DNA, 18 bp, Homo sapiens
atacaaactctcaccatg

SEQ ID NO: 4628760 - DNA, 17 bp, Homo sapiens
atacaaagatgactggt

SEQ ID NO: 4628761 - DNA, 21 bp, Homo sapiens
atacaatcagcccagtgcaaa

SEQ ID NO: 4628762 - DNA, 14 bp, Homo sapiens
atacaccacaaaaa

SEQ ID NO: 4628763 - DNA, 15 bp, Homo sapiens
atacactatgaaatt

SEQ ID NO: 4628764 - DNA, 17 bp, Homo sapiens
atacactatgaaattca

SEQ ID NO: 4628765 - DNA, 20 bp, Homo sapiens
atacagacctaatatcattt

SEQ ID NO: 4628766 - DNA, 21 bp, Homo sapiens
atacagaggaaatctgtaaca

SEQ ID NO: 4628767 - DNA, 16 bp, Homo sapiens
atacagcatacttcaa

SEQ ID NO: 4628768 - DNA, 11 bp, Homo sapiens
atacaggaaat

SEQ ID NO: 4628769 - DNA, 20 bp, Homo sapiens
atacatacatgtatctggtt

SEQ ID NO: 4628770 - DNA, 15 bp, Homo sapiens
atacatgatacattt

SEQ ID NO: 4628771 - DNA, 16 bp, Homo sapiens
atacatgatacatttt

SEQ ID NO: 4628772 - DNA, 14 bp, Homo sapiens
atacatgctacttt

SEQ ID NO: 4628773 - DNA, 18 bp, Homo sapiens
atacatggtttaaagtca

SEQ ID NO: 4628774 - DNA, 14 bp, Homo sapiens
atacatgtgtatat

SEQ ID NO: 4628775 - DNA, 19 bp, Homo sapiens
atacattaacggtgctaaa

SEQ ID NO: 4628776 - DNA, 23 bp, Homo sapiens
atacatttgtaagtgtaaaaaat

SEQ ID NO: 4628777 - DNA, 13 bp, Homo sapiens
atacattttctaa

SEQ ID NO: 4628778 - DNA, 14 bp, Homo sapiens
ataccagtacttga

SEQ ID NO: 4628779 - DNA, 13 bp, Homo sapiens
atacccaggaaga

SEQ ID NO: 4628780 - DNA, 13 bp, Homo sapiens
atacctctgtgtg

SEQ ID NO: 4628781 - DNA, 20 bp, Homo sapiens
atacctgggatactgtgccc

SEQ ID NO: 4628782 - DNA, 13 bp, Homo sapiens
ataccttctccca

SEQ ID NO: 4628783 - DNA, 14 bp, Homo sapiens
ataccttctcccag

SEQ ID NO: 4628784 - DNA, 22 bp, Homo sapiens
ataccttctcccaggcctctgc

SEQ ID NO: 4628785 - DNA, 23 bp, Homo sapiens
ataccttctcccaggcctctgcc

SEQ ID NO: 4628786 - DNA, 16 bp, Homo sapiens
atacctttaaatatca

SEQ ID NO: 4628787 - DNA, 13 bp, Homo sapiens
atacgataaataa

SEQ ID NO: 4628788 - DNA, 16 bp, Homo sapiens
atactacccatagaaa

SEQ ID NO: 4628789 - DNA, 16 bp, Homo sapiens
atactctgttgcctcc

SEQ ID NO: 4628790 - DNA, 19 bp, Homo sapiens
atactctgttgcctcctct

SEQ ID NO: 4628791 - DNA, 21 bp, Homo sapiens
atactctgttgcctcctctct

SEQ ID NO: 4628792 - DNA, 23 bp, Homo sapiens
atactctgttgcctcctctctcc

SEQ ID NO: 4628793 - DNA, 18 bp, Homo sapiens
atactgacagaagttatt

SEQ ID NO: 4628794 - DNA, 14 bp, Homo sapiens
atactgctgcttgt

SEQ ID NO: 4628795 - DNA, 18 bp, Homo sapiens
atactgctgcttgtcaaa

SEQ ID NO: 4628796 - DNA, 18 bp, Homo sapiens
atactgtaatcaaaagga

SEQ ID NO: 4628797 - DNA, 19 bp, Homo sapiens
atactgtacatgaaagtag

SEQ ID NO: 4628798 - DNA, 12 bp, Homo sapiens
atactgtagaca

SEQ ID NO: 4628799 - DNA, 17 bp, Homo sapiens
atactgttctcaacata

SEQ ID NO: 4628800 - DNA, 13 bp, Homo sapiens
atacttaacattt

SEQ ID NO: 4628801 - DNA, 14 bp, Homo sapiens
atacttaacatttc

SEQ ID NO: 4628802 - DNA, 15 bp, Homo sapiens
atacttaacatttca

SEQ ID NO: 4628803 - DNA, 14 bp, Homo sapiens
atacttattttcag

SEQ ID NO: 4628804 - DNA, 23 bp, Homo sapiens
atacttattttcagtgcatcatt

SEQ ID NO: 4628805 - DNA, 16 bp, Homo sapiens
atacttctttttcatt

SEQ ID NO: 4628806 - DNA, 17 bp, Homo sapiens
atacttctttttcatta

SEQ ID NO: 4628807 - DNA, 17 bp, Homo sapiens
atacttgaagaaacaga

SEQ ID NO: 4628808 - DNA, 19 bp, Homo sapiens
atacttggctgcttcctgt

SEQ ID NO: 4628809 - DNA, 13 bp, Homo sapiens
atagaaaaggaac

SEQ ID NO: 4628810 - DNA, 12 bp, Homo sapiens
atagaaatggaa

SEQ ID NO: 4628811 - DNA, 21 bp, Homo sapiens
atagagagggagaagaagtca

SEQ ID NO: 4628812 - DNA, 15 bp, Homo sapiens
atagagatgagccca

SEQ ID NO: 4628813 - DNA, 20 bp, Homo sapiens
atagagcaaaatcaacatga

SEQ ID NO: 4628814 - DNA, 18 bp, Homo sapiens
atagatgataaaagagaa

SEQ ID NO: 4628815 - DNA, 15 bp, Homo sapiens
atagattaggtttgc

SEQ ID NO: 4628816 - DNA, 16 bp, Homo sapiens
atagcaacaacaattg

SEQ ID NO: 4628817 - DNA, 14 bp, Homo sapiens
atagcaactaatgt

SEQ ID NO: 4628818 - DNA, 23 bp, Homo sapiens
atagcaactaatgtttgaacaaa

SEQ ID NO: 4628819 - DNA, 16 bp, Homo sapiens
atagcaagatattgat

SEQ ID NO: 4628820 - DNA, 17 bp, Homo sapiens
atagcaataactgaaaa

SEQ ID NO: 4628821 - DNA, 21 bp, Homo sapiens
atagcataaaatgaaatgcta

SEQ ID NO: 4628822 - DNA, 16 bp, Homo sapiens
atagcattgtgaactg

SEQ ID NO: 4628823 - DNA, 22 bp, Homo sapiens
atagcattgttttcttttacag

SEQ ID NO: 4628824 - DNA, 14 bp, Homo sapiens
atagcatttttgta

SEQ ID NO: 4628825 - DNA, 15 bp, Homo sapiens
atagcatttttgtaa

SEQ ID NO: 4628826 - DNA, 16 bp, Homo sapiens
atagctactaaatata

SEQ ID NO: 4628827 - DNA, 19 bp, Homo sapiens
atagctgtttcaaatgtgc

SEQ ID NO: 4628828 - DNA, 19 bp, Homo sapiens
ataggaagacgcagagcaa

SEQ ID NO: 4628829 - DNA, 18 bp, Homo sapiens
ataggaagatatgccact

SEQ ID NO: 4628830 - DNA, 14 bp, Homo sapiens
ataggaaggaaact

SEQ ID NO: 4628831 - DNA, 17 bp, Homo sapiens
ataggagccccaggcag

SEQ ID NO: 4628832 - DNA, 23 bp, Homo sapiens
ataggaggagctctcaattttat

SEQ ID NO: 4628833 - DNA, 21 bp, Homo sapiens
ataggcctagtacaatcttgg

SEQ ID NO: 4628834 - DNA, 17 bp, Homo sapiens
ataggctagacttagat

SEQ ID NO: 4628835 - DNA, 22 bp, Homo sapiens
atagggaaaattctaacccagg

SEQ ID NO: 4628836 - DNA, 15 bp, Homo sapiens
atagggagaatattt

SEQ ID NO: 4628837 - DNA, 15 bp, Homo sapiens
ataggggattttaaa

SEQ ID NO: 4628838 - DNA, 18 bp, Homo sapiens
ataggtcataaagcattg

SEQ ID NO: 4628839 - DNA, 18 bp, Homo sapiens
atagtgtcatataaactc

SEQ ID NO: 4628840 - DNA, 18 bp, Homo sapiens
atagtgttttattataaa

SEQ ID NO: 4628841 - DNA, 16 bp, Homo sapiens
atagttaatattttgt

SEQ ID NO: 4628842 - DNA, 20 bp, Homo sapiens
atagttactccagtgccaac

SEQ ID NO: 4628843 - DNA, 21 bp, Homo sapiens
atagttcttagctttgaaact

SEQ ID NO: 4628844 - DNA, 22 bp, Homo sapiens
atagttgtcagtattattctac

SEQ ID NO: 4628845 - DNA, 13 bp, Homo sapiens
atagtttatctta

SEQ ID NO: 4628846 - DNA, 20 bp, Homo sapiens
atagtttatcttatactcct

SEQ ID NO: 4628847 - DNA, 14 bp, Homo sapiens
atataaactcattt

SEQ ID NO: 4628848 - DNA, 16 bp, Homo sapiens
atataaactcatttat

SEQ ID NO: 4628849 - DNA, 13 bp, Homo sapiens
atataaattgtac

SEQ ID NO: 4628850 - DNA, 14 bp, Homo sapiens
atataaattgtaca

SEQ ID NO: 4628851 - DNA, 22 bp, Homo sapiens
atataagtctatactaatgctt

SEQ ID NO: 4628852 - DNA, 18 bp, Homo sapiens
atataatttactttgtag

SEQ ID NO: 4628853 - DNA, 21 bp, Homo sapiens
atataatttactttgtagact

SEQ ID NO: 4628854 - DNA, 22 bp, Homo sapiens
atataattttggtaattttgat

SEQ ID NO: 4628855 - DNA, 14 bp, Homo sapiens
atatacagaggaaa

SEQ ID NO: 4628856 - DNA, 13 bp, Homo sapiens
atatacattttct

SEQ ID NO: 4628857 - DNA, 15 bp, Homo sapiens
atatacattttctaa

SEQ ID NO: 4628858 - DNA, 12 bp, Homo sapiens
atatacattttt

SEQ ID NO: 4628859 - DNA, 20 bp, Homo sapiens
atatacgtgaaaattatttg

SEQ ID NO: 4628860 - DNA, 19 bp, Homo sapiens
atatactcagggattcctt

SEQ ID NO: 4628861 - DNA, 18 bp, Homo sapiens
atatactgttcttcattt

SEQ ID NO: 4628862 - DNA, 18 bp, Homo sapiens
atataggttcttttctct

SEQ ID NO: 4628863 - DNA, 15 bp, Homo sapiens
atatatgtgtataca

SEQ ID NO: 4628864 - DNA, 20 bp, Homo sapiens
atatattaccccttcatgtc

SEQ ID NO: 4628865 - DNA, 20 bp, Homo sapiens
atatattacggaggaacaga

SEQ ID NO: 4628866 - DNA, 12 bp, Homo sapiens
atatattatata

SEQ ID NO: 4628867 - DNA, 16 bp, Homo sapiens
atatattatatacata

SEQ ID NO: 4628868 - DNA, 13 bp, Homo sapiens
atatatttctatt

SEQ ID NO: 4628869 - DNA, 23 bp, Homo sapiens
atatatttctattattaattgca

SEQ ID NO: 4628870 - DNA, 21 bp, Homo sapiens
atatattttaccatacattta

SEQ ID NO: 4628871 - DNA, 14 bp, Homo sapiens
atatcaaataaaat

SEQ ID NO: 4628872 - DNA, 15 bp, Homo sapiens
atatcactaaataaa

SEQ ID NO: 4628873 - DNA, 16 bp, Homo sapiens
atatcactaaataaac

SEQ ID NO: 4628874 - DNA, 23 bp, Homo sapiens
atatcactaaataaacacgattt

SEQ ID NO: 4628875 - DNA, 16 bp, Homo sapiens
atatcagcacatattt

SEQ ID NO: 4628876 - DNA, 14 bp, Homo sapiens
atatcagggcctga

SEQ ID NO: 4628877 - DNA, 18 bp, Homo sapiens
atatcagggcctgagtga

SEQ ID NO: 4628878 - DNA, 14 bp, Homo sapiens
atatcataaagcat

SEQ ID NO: 4628879 - DNA, 18 bp, Homo sapiens
atatcatgtaaagaaatg

SEQ ID NO: 4628880 - DNA, 21 bp, Homo sapiens
atatcatgtaaagaaatgtct

SEQ ID NO: 4628881 - DNA, 19 bp, Homo sapiens
atatcattctttgtatctt

SEQ ID NO: 4628882 - DNA, 20 bp, Homo sapiens
atatcattttaaaaacttta

SEQ ID NO: 4628883 - DNA, 13 bp, Homo sapiens
atatcattttatt

SEQ ID NO: 4628884 - DNA, 18 bp, Homo sapiens
atatcggctcacaaagag

SEQ ID NO: 4628885 - DNA, 19 bp, Homo sapiens
atatcggctcacaaagaga

SEQ ID NO: 4628886 - DNA, 17 bp, Homo sapiens
atatctatatgtacttg

SEQ ID NO: 4628887 - DNA, 13 bp, Homo sapiens
atatctctatttg

SEQ ID NO: 4628888 - DNA, 14 bp, Homo sapiens
atatctctatttga

SEQ ID NO: 4628889 - DNA, 21 bp, Homo sapiens
atatctggagtgagaggcccc

SEQ ID NO: 4628890 - DNA, 22 bp, Homo sapiens
atatctggagtgagaggccccc

SEQ ID NO: 4628891 - DNA, 15 bp, Homo sapiens
atatgagtacaaatg

SEQ ID NO: 4628892 - DNA, 23 bp, Homo sapiens
atatggaaatcttttacattttt

SEQ ID NO: 4628893 - DNA, 21 bp, Homo sapiens
atatggggatagtctgggtca

SEQ ID NO: 4628894 - DNA, 21 bp, Homo sapiens
atatgtaatttcaaaatacat

SEQ ID NO: 4628895 - DNA, 16 bp, Homo sapiens
atatgtattataggag

SEQ ID NO: 4628896 - DNA, 15 bp, Homo sapiens
atatgtcactagaat

SEQ ID NO: 4628897 - DNA, 17 bp, Homo sapiens
atatgtcactagaatgg

SEQ ID NO: 4628898 - DNA, 16 bp, Homo sapiens
atatgtccactgttct

SEQ ID NO: 4628899 - DNA, 18 bp, Homo sapiens
atatgtccactgttctgt

SEQ ID NO: 4628900 - DNA, 19 bp, Homo sapiens
atatgtcgtagaattcctt

SEQ ID NO: 4628901 - DNA, 21 bp, Homo sapiens
atatgtcgtagaattccttcg

SEQ ID NO: 4628902 - DNA, 22 bp, Homo sapiens
atatgtcttgcaaagcctttaa

SEQ ID NO: 4628903 - DNA, 17 bp, Homo sapiens
atatgtgacattcctga

SEQ ID NO: 4628904 - DNA, 15 bp, Homo sapiens
atatgtgtatacata

SEQ ID NO: 4628905 - DNA, 20 bp, Homo sapiens
atatgtgtatacatacatgt

SEQ ID NO: 4628906 - DNA, 20 bp, Homo sapiens
atatgtttagttttacattt

SEQ ID NO: 4628907 - DNA, 23 bp, Homo sapiens
atatgtttagttttacattttaa

SEQ ID NO: 4628908 - DNA, 22 bp, Homo sapiens
atattaagtgtgccaaatcagt

SEQ ID NO: 4628909 - DNA, 19 bp, Homo sapiens
atattacctctcttggaaa

SEQ ID NO: 4628910 - DNA, 23 bp, Homo sapiens
atattactctagtttattctaat

SEQ ID NO: 4628911 - DNA, 15 bp, Homo sapiens
atattagctgaaaca

SEQ ID NO: 4628912 - DNA, 13 bp, Homo sapiens
atattatagaaaa

SEQ ID NO: 4628913 - DNA, 14 bp, Homo sapiens
atattatatacata

SEQ ID NO: 4628914 - DNA, 18 bp, Homo sapiens
atattatgtttatttcat

SEQ ID NO: 4628915 - DNA, 20 bp, Homo sapiens
atattcaactcataagactt

SEQ ID NO: 4628916 - DNA, 13 bp, Homo sapiens
atattcagaaatt

SEQ ID NO: 4628917 - DNA, 16 bp, Homo sapiens
atattccttttaaaga

SEQ ID NO: 4628918 - DNA, 24 bp, Homo sapiens
atattctgaagcaacattttagct

SEQ ID NO: 4628919 - DNA, 18 bp, Homo sapiens
atattgtaatatgacaga

SEQ ID NO: 4628920 - DNA, 19 bp, Homo sapiens
atattgtaatatgacagat

SEQ ID NO: 4628921 - DNA, 20 bp, Homo sapiens
atattgtaatatgacagata

SEQ ID NO: 4628922 - DNA, 13 bp, Homo sapiens
atattgtacagtt

SEQ ID NO: 4628923 - DNA, 16 bp, Homo sapiens
atattgtcatatcagc

SEQ ID NO: 4628924 - DNA, 17 bp, Homo sapiens
atattgttggcacagaa

SEQ ID NO: 4628925 - DNA, 19 bp, Homo sapiens
atattgtttctgcattcat

SEQ ID NO: 4628926 - DNA, 16 bp, Homo sapiens
atatttactctttgca

SEQ ID NO: 4628927 - DNA, 17 bp, Homo sapiens
atatttactctttgcaa

SEQ ID NO: 4628928 - DNA, 18 bp, Homo sapiens
atatttactctttgcaaa

SEQ ID NO: 4628929 - DNA, 19 bp, Homo sapiens
atatttactctttgcaaac

SEQ ID NO: 4628930 - DNA, 14 bp, Homo sapiens
atatttataagaga

SEQ ID NO: 4628931 - DNA, 13 bp, Homo sapiens
atatttattgatt

SEQ ID NO: 4628932 - DNA, 14 bp, Homo sapiens
atatttattgatta

SEQ ID NO: 4628933 - DNA, 11 bp, Homo sapiens
atatttattgt

SEQ ID NO: 4628934 - DNA, 20 bp, Homo sapiens
atatttcaagctcatgtcat

SEQ ID NO: 4628935 - DNA, 13 bp, Homo sapiens
atatttgatttct

SEQ ID NO: 4628936 - DNA, 18 bp, Homo sapiens
atatttgatttctaattg

SEQ ID NO: 4628937 - DNA, 14 bp, Homo sapiens
atattttaatcatt

SEQ ID NO: 4628938 - DNA, 13 bp, Homo sapiens
atattttctattt

SEQ ID NO: 4628939 - DNA, 18 bp, Homo sapiens
atattttgatgcagataa

SEQ ID NO: 4628940 - DNA, 20 bp, Homo sapiens
atattttgtatattatgttt

SEQ ID NO: 4628941 - DNA, 17 bp, Homo sapiens
atatttttataataaac

SEQ ID NO: 4628942 - DNA, 19 bp, Homo sapiens
atcaaaactcacaagtgct

SEQ ID NO: 4628943 - DNA, 22 bp, Homo sapiens
atcaaagagcacttgagctgtc

SEQ ID NO: 4628944 - DNA, 16 bp, Homo sapiens
atcaaaggaatataag

SEQ ID NO: 4628945 - DNA, 17 bp, Homo sapiens
atcaaaggaatataaga

SEQ ID NO: 4628946 - DNA, 21 bp, Homo sapiens
atcaaataaaatatcataaag

SEQ ID NO: 4628947 - DNA, 16 bp, Homo sapiens
atcaaatatagaaagt

SEQ ID NO: 4628948 - DNA, 20 bp, Homo sapiens
atcaaatctaccactgtatg

SEQ ID NO: 4628949 - DNA, 13 bp, Homo sapiens
atcaagagaaact

SEQ ID NO: 4628950 - DNA, 13 bp, Homo sapiens
atcaagatatatg

SEQ ID NO: 4628951 - DNA, 16 bp, Homo sapiens
atcaagatatatgtgt

SEQ ID NO: 4628952 - DNA, 21 bp, Homo sapiens
atcaagccatgtataaatgtg

SEQ ID NO: 4628953 - DNA, 23 bp, Homo sapiens
atcacagccccacccttgtccct

SEQ ID NO: 4628954 - DNA, 15 bp, Homo sapiens
atcacagcctcaccc

SEQ ID NO: 4628955 - DNA, 16 bp, Homo sapiens
atcacagcctcacccc

SEQ ID NO: 4628956 - DNA, 23 bp, Homo sapiens
atcacagcctcacccctgcccct

SEQ ID NO: 4628957 - DNA, 21 bp, Homo sapiens
atcaccagtgcatcacatctg

SEQ ID NO: 4628958 - DNA, 18 bp, Homo sapiens
atcaccagtgccacgtca

SEQ ID NO: 4628959 - DNA, 19 bp, Homo sapiens
atcacctactcacacaggc

SEQ ID NO: 4628960 - DNA, 15 bp, Homo sapiens
atcactaaactttat

SEQ ID NO: 4628961 - DNA, 21 bp, Homo sapiens
atcactaaactttatttgtaa

SEQ ID NO: 4628962 - DNA, 16 bp, Homo sapiens
atcactcaagatgcct

SEQ ID NO: 4628963 - DNA, 16 bp, Homo sapiens
atcactctgtgtctga

SEQ ID NO: 4628964 - DNA, 15 bp, Homo sapiens
atcagaaagggaggg

SEQ ID NO: 4628965 - DNA, 21 bp, Homo sapiens
atcagaaagggagggctctga

SEQ ID NO: 4628966 - DNA, 22 bp, Homo sapiens
atcagaaagtaacaatctatgg

SEQ ID NO: 4628967 - DNA, 17 bp, Homo sapiens
atcagaaatcctctgtt

SEQ ID NO: 4628968 - DNA, 19 bp, Homo sapiens
atcagaacattcagctctg

SEQ ID NO: 4628969 - DNA, 20 bp, Homo sapiens
atcagaacattcagctctgg

SEQ ID NO: 4628970 - DNA, 21 bp, Homo sapiens
atcagaacattcagctctgga

SEQ ID NO: 4628971 - DNA, 15 bp, Homo sapiens
atcagattgcatgtg

SEQ ID NO: 4628972 - DNA, 15 bp, Homo sapiens
atcagcacatatttt

SEQ ID NO: 4628973 - DNA, 17 bp, Homo sapiens
atcagcccagtgcaaac

SEQ ID NO: 4628974 - DNA, 24 bp, Homo sapiens
atcagccctgcccttcagcatcct

SEQ ID NO: 4628975 - DNA, 13 bp, Homo sapiens
atcagccctgcta

SEQ ID NO: 4628976 - DNA, 12 bp, Homo sapiens
atcagcgtggcc

SEQ ID NO: 4628977 - DNA, 21 bp, Homo sapiens
atcagcgtggccttgttctgt

SEQ ID NO: 4628978 - DNA, 19 bp, Homo sapiens
atcagctgttaaccatttg

SEQ ID NO: 4628979 - DNA, 13 bp, Homo sapiens
atcaggatcagct

SEQ ID NO: 4628980 - DNA, 21 bp, Homo sapiens
atcaggatccagtctggaaaa

SEQ ID NO: 4628981 - DNA, 14 bp, Homo sapiens
atcaggcaaggagg

SEQ ID NO: 4628982 - DNA, 18 bp, Homo sapiens
atcaggcaaggaggagga

SEQ ID NO: 4628983 - DNA, 10 bp, Homo sapiens
atcaggcccc

SEQ ID NO: 4628984 - DNA, 12 bp, Homo sapiens
atcaggccccac

SEQ ID NO: 4628985 - DNA, 13 bp, Homo sapiens
atcaggccccacc

SEQ ID NO: 4628986 - DNA, 13 bp, Homo sapiens
atcaggctagccc

SEQ ID NO: 4628987 - DNA, 16 bp, Homo sapiens
atcagggcctgagtga

SEQ ID NO: 4628988 - DNA, 22 bp, Homo sapiens
atcagggcctgccccctgggga

SEQ ID NO: 4628989 - DNA, 23 bp, Homo sapiens
atcagggcctggggcctgagaga

SEQ ID NO: 4628990 - DNA, 16 bp, Homo sapiens
atcagtaggaccaggc

SEQ ID NO: 4628991 - DNA, 19 bp, Homo sapiens
atcagtaggaccaggccac

SEQ ID NO: 4628992 - DNA, 14 bp, Homo sapiens
atcagtcctttgat

SEQ ID NO: 4628993 - DNA, 15 bp, Homo sapiens
atcagttctgtgtgg

SEQ ID NO: 4628994 - DNA, 22 bp, Homo sapiens
atcagttctgtgtggtgcattc

SEQ ID NO: 4628995 - DNA, 14 bp, Homo sapiens
atcataaaatcaaa

SEQ ID NO: 4628996 - DNA, 21 bp, Homo sapiens
atcataaatcttcttattaaa

SEQ ID NO: 4628997 - DNA, 15 bp, Homo sapiens
atcatacaaactctc

SEQ ID NO: 4628998 - DNA, 19 bp, Homo sapiens
atcatacttaacatttcat

SEQ ID NO: 4628999 - DNA, 21 bp, Homo sapiens
atcatatgaattagccaaaag

SEQ ID NO: 4629000 - DNA, 20 bp, Homo sapiens
atcatattttgttgtgcact

SEQ ID NO: 4629001 - DNA, 17 bp, Homo sapiens
atcatcctgcagacaga

SEQ ID NO: 4629002 - DNA, 18 bp, Homo sapiens
atcatgagccttcagtca

SEQ ID NO: 4629003 - DNA, 16 bp, Homo sapiens
atcatgcctctgaggc

SEQ ID NO: 4629004 - DNA, 19 bp, Homo sapiens
atcatgcctctgaggccag

SEQ ID NO: 4629005 - DNA, 20 bp, Homo sapiens
atcatgcctctgaggccagc

SEQ ID NO: 4629006 - DNA, 22 bp, Homo sapiens
atcatgcctctgaggccagcct

SEQ ID NO: 4629007 - DNA, 23 bp, Homo sapiens
atcatgcctctgaggccagcctg

SEQ ID NO: 4629008 - DNA, 18 bp, Homo sapiens
atcatgtaaagaaatgtc

SEQ ID NO: 4629009 - DNA, 16 bp, Homo sapiens
atcatgttgatcatgt

SEQ ID NO: 4629010 - DNA, 19 bp, Homo sapiens
atcatgttgatcatgtact

SEQ ID NO: 4629011 - DNA, 14 bp, Homo sapiens
atcattaaaaatta

SEQ ID NO: 4629012 - DNA, 20 bp, Homo sapiens
atcattaaaaattaccttta

SEQ ID NO: 4629013 - DNA, 12 bp, Homo sapiens
atcattactgtt

SEQ ID NO: 4629014 - DNA, 12 bp, Homo sapiens
atcattatttga

SEQ ID NO: 4629015 - DNA, 13 bp, Homo sapiens
atcattatttgag

SEQ ID NO: 4629016 - DNA, 14 bp, Homo sapiens
atcattatttgaga

SEQ ID NO: 4629017 - DNA, 20 bp, Homo sapiens
atcattctttgtatcttaaa

SEQ ID NO: 4629018 - DNA, 23 bp, Homo sapiens
atcattgctcccctgatagaaga

SEQ ID NO: 4629019 - DNA, 17 bp, Homo sapiens
atcattggagtttagga

SEQ ID NO: 4629020 - DNA, 15 bp, Homo sapiens
atcatttattggatg

SEQ ID NO: 4629021 - DNA, 14 bp, Homo sapiens
atcattttaaaaac

SEQ ID NO: 4629022 - DNA, 17 bp, Homo sapiens
atcattttaaaaacttt

SEQ ID NO: 4629023 - DNA, 20 bp, Homo sapiens
atcattttaaaaactttatt

SEQ ID NO: 4629024 - DNA, 15 bp, Homo sapiens
atcattttattcaca

SEQ ID NO: 4629025 - DNA, 17 bp, Homo sapiens
atcattttattcacata

SEQ ID NO: 4629026 - DNA, 24 bp, Homo sapiens
atcattttattcacatatgtctta

SEQ ID NO: 4629027 - DNA, 20 bp, Homo sapiens
atcatttttgtaggaagcat

SEQ ID NO: 4629028 - DNA, 16 bp, Homo sapiens
atccaaggaaacatgc

SEQ ID NO: 4629029 - DNA, 18 bp, Homo sapiens
atccaaggaaacatttta

SEQ ID NO: 4629030 - DNA, 19 bp, Homo sapiens
atccaaggaaacattttat

SEQ ID NO: 4629031 - DNA, 22 bp, Homo sapiens
atccacgtagggggcaggggca

SEQ ID NO: 4629032 - DNA, 12 bp, Homo sapiens
atccagccactt

SEQ ID NO: 4629033 - DNA, 23 bp, Homo sapiens
atccagtcattttattttgtaat

SEQ ID NO: 4629034 - DNA, 18 bp, Homo sapiens
atccagtctatcattgtt

SEQ ID NO: 4629035 - DNA, 12 bp, Homo sapiens
atccagtctgaa

SEQ ID NO: 4629036 - DNA, 14 bp, Homo sapiens
atccagtctggaaa

SEQ ID NO: 4629037 - DNA, 13 bp, Homo sapiens
atccataaagaag

SEQ ID NO: 4629038 - DNA, 14 bp, Homo sapiens
atccataaagaagc

SEQ ID NO: 4629039 - DNA, 17 bp, Homo sapiens
atccataaagaagcaat

SEQ ID NO: 4629040 - DNA, 20 bp, Homo sapiens
atccatactgtagacactct

SEQ ID NO: 4629041 - DNA, 13 bp, Homo sapiens
atccatccatctc

SEQ ID NO: 4629042 - DNA, 23 bp, Homo sapiens
atccatccatctctctcttgcct

SEQ ID NO: 4629043 - DNA, 15 bp, Homo sapiens
atccatcctctgaga

SEQ ID NO: 4629044 - DNA, 14 bp, Homo sapiens
atccatctctctct

SEQ ID NO: 4629045 - DNA, 15 bp, Homo sapiens
atcccaaccagtgcc

SEQ ID NO: 4629046 - DNA, 19 bp, Homo sapiens
atcccaaccagtgccaagg

SEQ ID NO: 4629047 - DNA, 20 bp, Homo sapiens
atcccacccacatgtgacac

SEQ ID NO: 4629048 - DNA, 20 bp, Homo sapiens
atcccagtactttggaaagc

SEQ ID NO: 4629049 - DNA, 19 bp, Homo sapiens
atccccaccttcacctcgg

SEQ ID NO: 4629050 - DNA, 13 bp, Homo sapiens
atccccagtgccc

SEQ ID NO: 4629051 - DNA, 16 bp, Homo sapiens
atccccagtgcccggt

SEQ ID NO: 4629052 - DNA, 15 bp, Homo sapiens
atcccccaatgacct

SEQ ID NO: 4629053 - DNA, 14 bp, Homo sapiens
atcccccctgctgc

SEQ ID NO: 4629054 - DNA, 20 bp, Homo sapiens
atccctattagatacacttc

SEQ ID NO: 4629055 - DNA, 12 bp, Homo sapiens
atccctctccat

SEQ ID NO: 4629056 - DNA, 22 bp, Homo sapiens
atccctctccataaccccaccc

SEQ ID NO: 4629057 - DNA, 18 bp, Homo sapiens
atccctgactggccaaac

SEQ ID NO: 4629058 - DNA, 11 bp, Homo sapiens
atccctgcaga

SEQ ID NO: 4629059 - DNA, 17 bp, Homo sapiens
atccctgggcattgctt

SEQ ID NO: 4629060 - DNA, 21 bp, Homo sapiens
atccctgggcctgctgctgag

SEQ ID NO: 4629061 - DNA, 15 bp, Homo sapiens
atccgcccacctcag

SEQ ID NO: 4629062 - DNA, 20 bp, Homo sapiens
atcctagctacttggcaggc

SEQ ID NO: 4629063 - DNA, 23 bp, Homo sapiens
atcctagctacttggcaggctga

SEQ ID NO: 4629064 - DNA, 15 bp, Homo sapiens
atcctatatagaatg

SEQ ID NO: 4629065 - DNA, 19 bp, Homo sapiens
atcctcagtgcaaaatgtc

SEQ ID NO: 4629066 - DNA, 19 bp, Homo sapiens
atcctcagttcctgcagca

SEQ ID NO: 4629067 - DNA, 14 bp, Homo sapiens
atcctcatccctga

SEQ ID NO: 4629068 - DNA, 23 bp, Homo sapiens
atcctcccgccaggagcttcttc

SEQ ID NO: 4629069 - DNA, 12 bp, Homo sapiens
atcctcctgagt

SEQ ID NO: 4629070 - DNA, 20 bp, Homo sapiens
atcctcctgagtagctggga

SEQ ID NO: 4629071 - DNA, 18 bp, Homo sapiens
atcctcttttaatggcat

SEQ ID NO: 4629072 - DNA, 18 bp, Homo sapiens
atcctgcccgagggcagc

SEQ ID NO: 4629073 - DNA, 23 bp, Homo sapiens
atcctgctggggccgccacggcc

SEQ ID NO: 4629074 - DNA, 20 bp, Homo sapiens
atcctggctgtcgagaaaca

SEQ ID NO: 4629075 - DNA, 17 bp, Homo sapiens
atcctgggacctcccca

SEQ ID NO: 4629076 - DNA, 14 bp, Homo sapiens
atcctgggggaaga

SEQ ID NO: 4629077 - DNA, 18 bp, Homo sapiens
atcctgggggaagaggag

SEQ ID NO: 4629078 - DNA, 20 bp, Homo sapiens
atccttatcagagctaaggg

SEQ ID NO: 4629079 - DNA, 23 bp, Homo sapiens
atccttcaaggtggcagctgtta

SEQ ID NO: 4629080 - DNA, 19 bp, Homo sapiens
atccttcattatccacccc

SEQ ID NO: 4629081 - DNA, 14 bp, Homo sapiens
atccttccattcca

SEQ ID NO: 4629082 - DNA, 13 bp, Homo sapiens
atccttctttcct

SEQ ID NO: 4629083 - DNA, 14 bp, Homo sapiens
atccttctttcctt

SEQ ID NO: 4629084 - DNA, 23 bp, Homo sapiens
atccttgggccataattatgaaa

SEQ ID NO: 4629085 - DNA, 18 bp, Homo sapiens
atccttttatctcacaaa

SEQ ID NO: 4629086 - DNA, 17 bp, Homo sapiens
atccttttttgtcattt

SEQ ID NO: 4629087 - DNA, 19 bp, Homo sapiens
atcgaagggtttttagaga

SEQ ID NO: 4629088 - DNA, 13 bp, Homo sapiens
atcgatgttatgt

SEQ ID NO: 4629089 - DNA, 20 bp, Homo sapiens
atcgattcccaagctccctt

SEQ ID NO: 4629090 - DNA, 16 bp, Homo sapiens
atcgctgtattttgag

SEQ ID NO: 4629091 - DNA, 15 bp, Homo sapiens
atcggaaagctcttc

SEQ ID NO: 4629092 - DNA, 16 bp, Homo sapiens
atcggacattctaatg

SEQ ID NO: 4629093 - DNA, 19 bp, Homo sapiens
atcggacattctaatgcat

SEQ ID NO: 4629094 - DNA, 20 bp, Homo sapiens
atcggacattctaatgcata

SEQ ID NO: 4629095 - DNA, 21 bp, Homo sapiens
atcgtccctatatcagggcct

SEQ ID NO: 4629096 - DNA, 22 bp, Homo sapiens
atctaactgatgagtaaactga

SEQ ID NO: 4629097 - DNA, 13 bp, Homo sapiens
atctaatatgaag

SEQ ID NO: 4629098 - DNA, 15 bp, Homo sapiens
atctaatgtgaaaat

SEQ ID NO: 4629099 - DNA, 21 bp, Homo sapiens
atctacagtaatgaaatgttt

SEQ ID NO: 4629100 - DNA, 23 bp, Homo sapiens
atctacagtaatgaaatgtttac

SEQ ID NO: 4629101 - DNA, 16 bp, Homo sapiens
atctacattaaaatga

SEQ ID NO: 4629102 - DNA, 17 bp, Homo sapiens
atctacattaaaatgac

SEQ ID NO: 4629103 - DNA, 23 bp, Homo sapiens
atctacattaaaatgacaaacat

SEQ ID NO: 4629104 - DNA, 23 bp, Homo sapiens
atctataagtagtaaatcagaaa

SEQ ID NO: 4629105 - DNA, 21 bp, Homo sapiens
atctatatgtacttgtcaaag

SEQ ID NO: 4629106 - DNA, 15 bp, Homo sapiens
atctatcactgcatt

SEQ ID NO: 4629107 - DNA, 16 bp, Homo sapiens
atctatcactgcatta

SEQ ID NO: 4629108 - DNA, 18 bp, Homo sapiens
atctattgaaaatatata

SEQ ID NO: 4629109 - DNA, 20 bp, Homo sapiens
atctattgaaaatatatatt

SEQ ID NO: 4629110 - DNA, 19 bp, Homo sapiens
atctattgtttctcctctg

SEQ ID NO: 4629111 - DNA, 16 bp, Homo sapiens
atctcacaaataagta

SEQ ID NO: 4629112 - DNA, 17 bp, Homo sapiens
atctcacctcctgctgg

SEQ ID NO: 4629113 - DNA, 15 bp, Homo sapiens
atctcagcttttgat

SEQ ID NO: 4629114 - DNA, 21 bp, Homo sapiens
atctcaggagatggagggctt

SEQ ID NO: 4629115 - DNA, 21 bp, Homo sapiens
atctcatgcccctggctggga

SEQ ID NO: 4629116 - DNA, 19 bp, Homo sapiens
atctcccacctagcagcac

SEQ ID NO: 4629117 - DNA, 22 bp, Homo sapiens
atctccccagtagagaaacatt

SEQ ID NO: 4629118 - DNA, 16 bp, Homo sapiens
atctcctgccagccca

SEQ ID NO: 4629119 - DNA, 21 bp, Homo sapiens
atctcctgccagcccagctgg

SEQ ID NO: 4629120 - DNA, 16 bp, Homo sapiens
atctcgaatttgaaga

SEQ ID NO: 4629121 - DNA, 17 bp, Homo sapiens
atctcgaatttgaagag

SEQ ID NO: 4629122 - DNA, 14 bp, Homo sapiens
atctcggctcactg

SEQ ID NO: 4629123 - DNA, 15 bp, Homo sapiens
atctctcaaatctgt

SEQ ID NO: 4629124 - DNA, 17 bp, Homo sapiens
atctctcaaatctgtta

SEQ ID NO: 4629125 - DNA, 19 bp, Homo sapiens
atctctcaaatctgttatc

SEQ ID NO: 4629126 - DNA, 23 bp, Homo sapiens
atctctctcttgcctgaggggaa

SEQ ID NO: 4629127 - DNA, 23 bp, Homo sapiens
atctctttctttctctttctgtt

SEQ ID NO: 4629128 - DNA, 15 bp, Homo sapiens
atctctttgaatttt

SEQ ID NO: 4629129 - DNA, 10 bp, Homo sapiens
atctcttttc

SEQ ID NO: 4629130 - DNA, 12 bp, Homo sapiens
atctgactgcca

SEQ ID NO: 4629131 - DNA, 15 bp, Homo sapiens
atctgactgccaagc

SEQ ID NO: 4629132 - DNA, 21 bp, Homo sapiens
atctgcaaaaggcctcttgta

SEQ ID NO: 4629133 - DNA, 12 bp, Homo sapiens
atctgcatgttt

SEQ ID NO: 4629134 - DNA, 19 bp, Homo sapiens
atctgccagacctgcatgg

SEQ ID NO: 4629135 - DNA, 20 bp, Homo sapiens
atctggagctggcactgtgg

SEQ ID NO: 4629136 - DNA, 22 bp, Homo sapiens
atctggctgcagttttgctatc

SEQ ID NO: 4629137 - DNA, 12 bp, Homo sapiens
atctggggaggc

SEQ ID NO: 4629138 - DNA, 23 bp, Homo sapiens
atctggggaggcaggcattcctg

SEQ ID NO: 4629139 - DNA, 21 bp, Homo sapiens
atctgggtgcatgatcttgag

SEQ ID NO: 4629140 - DNA, 14 bp, Homo sapiens
atctgtaaagccag

SEQ ID NO: 4629141 - DNA, 15 bp, Homo sapiens
atctgtaatcctagc

SEQ ID NO: 4629142 - DNA, 21 bp, Homo sapiens
atctgtctttgcggggcctgt

SEQ ID NO: 4629143 - DNA, 23 bp, Homo sapiens
atctgtctttgcggggcctgtct

SEQ ID NO: 4629144 - DNA, 16 bp, Homo sapiens
atctgtgcactgccca

SEQ ID NO: 4629145 - DNA, 21 bp, Homo sapiens
atctgtgccatagaacaagat

SEQ ID NO: 4629146 - DNA, 16 bp, Homo sapiens
atctgtgtacaaagaa

SEQ ID NO: 4629147 - DNA, 14 bp, Homo sapiens
atctgtttaaagca

SEQ ID NO: 4629148 - DNA, 13 bp, Homo sapiens
atctgtttttaaa

SEQ ID NO: 4629149 - DNA, 18 bp, Homo sapiens
atcttaatctttatttta

SEQ ID NO: 4629150 - DNA, 21 bp, Homo sapiens
atcttaggtagtcatgctgtg

SEQ ID NO: 4629151 - DNA, 21 bp, Homo sapiens
atcttccccaacgaaaagcac

SEQ ID NO: 4629152 - DNA, 16 bp, Homo sapiens
atcttctctcttgatt

SEQ ID NO: 4629153 - DNA, 15 bp, Homo sapiens
atcttgatcattccg

SEQ ID NO: 4629154 - DNA, 13 bp, Homo sapiens
atcttgctttctt

SEQ ID NO: 4629155 - DNA, 17 bp, Homo sapiens
atcttggagaccctgca

SEQ ID NO: 4629156 - DNA, 22 bp, Homo sapiens
atcttgggaacagggttactgt

SEQ ID NO: 4629157 - DNA, 18 bp, Homo sapiens
atcttggtagtacatttt

SEQ ID NO: 4629158 - DNA, 22 bp, Homo sapiens
atcttgttattattgttaataa

SEQ ID NO: 4629159 - DNA, 14 bp, Homo sapiens
atcttgtttcattt

SEQ ID NO: 4629160 - DNA, 22 bp, Homo sapiens
atctttaattccttatcctagc

SEQ ID NO: 4629161 - DNA, 19 bp, Homo sapiens
atcttttttagcataaaat

SEQ ID NO: 4629162 - DNA, 16 bp, Homo sapiens
atgaaaaagctgcttc

SEQ ID NO: 4629163 - DNA, 18 bp, Homo sapiens
atgaaaatattttttaca

SEQ ID NO: 4629164 - DNA, 11 bp, Homo sapiens
atgaaaattgt

SEQ ID NO: 4629165 - DNA, 15 bp, Homo sapiens
atgaaaattgtatta

SEQ ID NO: 4629166 - DNA, 16 bp, Homo sapiens
atgaaacaatgaaatt

SEQ ID NO: 4629167 - DNA, 12 bp, Homo sapiens
atgaaacacagc

SEQ ID NO: 4629168 - DNA, 20 bp, Homo sapiens
atgaaatagttattttaata

SEQ ID NO: 4629169 - DNA, 16 bp, Homo sapiens
atgaaatccttttcct

SEQ ID NO: 4629170 - DNA, 15 bp, Homo sapiens
atgaaattttttagt

SEQ ID NO: 4629171 - DNA, 12 bp, Homo sapiens
atgaacacagac

SEQ ID NO: 4629172 - DNA, 12 bp, Homo sapiens
atgaaccctgcc

SEQ ID NO: 4629173 - DNA, 13 bp, Homo sapiens
atgaaccctgccc

SEQ ID NO: 4629174 - DNA, 15 bp, Homo sapiens
atgaaccctgccctg

SEQ ID NO: 4629175 - DNA, 20 bp, Homo sapiens
atgaactattccccagcagg

SEQ ID NO: 4629176 - DNA, 17 bp, Homo sapiens
atgaagaaagatactaa

SEQ ID NO: 4629177 - DNA, 20 bp, Homo sapiens
atgaagaatacccaggaaga

SEQ ID NO: 4629178 - DNA, 19 bp, Homo sapiens
atgaagaatcacgatttca

SEQ ID NO: 4629179 - DNA, 16 bp, Homo sapiens
atgaagtgcgtgaatg

SEQ ID NO: 4629180 - DNA, 20 bp, Homo sapiens
atgaagtgcgtgaatgtatg

SEQ ID NO: 4629181 - DNA, 16 bp, Homo sapiens
atgaataacatttaaa

SEQ ID NO: 4629182 - DNA, 13 bp, Homo sapiens
atgaattcatact

SEQ ID NO: 4629183 - DNA, 14 bp, Homo sapiens
atgacaaaaaatgt

SEQ ID NO: 4629184 - DNA, 17 bp, Homo sapiens
atgacacagttatcaaa

SEQ ID NO: 4629185 - DNA, 15 bp, Homo sapiens
atgacaccctggcct

SEQ ID NO: 4629186 - DNA, 16 bp, Homo sapiens
atgacatttcttaaaa

SEQ ID NO: 4629187 - DNA, 23 bp, Homo sapiens
atgaccacccctctcgcctcatt

SEQ ID NO: 4629188 - DNA, 17 bp, Homo sapiens
atgaccagggatgctgg

SEQ ID NO: 4629189 - DNA, 18 bp, Homo sapiens
atgaccagggatgctggg

SEQ ID NO: 4629190 - DNA, 22 bp, Homo sapiens
atgaccagggatgctgggctgg

SEQ ID NO: 4629191 - DNA, 14 bp, Homo sapiens
atgacccctggcca

SEQ ID NO: 4629192 - DNA, 15 bp, Homo sapiens
atgacccctggccac

SEQ ID NO: 4629193 - DNA, 17 bp, Homo sapiens
atgacccctggccacag

SEQ ID NO: 4629194 - DNA, 22 bp, Homo sapiens
atgacccctggccacagccttc

SEQ ID NO: 4629195 - DNA, 23 bp, Homo sapiens
atgacccctggccacagccttcc

SEQ ID NO: 4629196 - DNA, 18 bp, Homo sapiens
atgacccttttgtgtcta

SEQ ID NO: 4629197 - DNA, 20 bp, Homo sapiens
atgacgccagataaaatgtt

SEQ ID NO: 4629198 - DNA, 23 bp, Homo sapiens
atgacgccagataaaatgttcag

SEQ ID NO: 4629199 - DNA, 22 bp, Homo sapiens
atgactatataatttatttcca

SEQ ID NO: 4629200 - DNA, 18 bp, Homo sapiens
atgacttatttctgctct

SEQ ID NO: 4629201 - DNA, 20 bp, Homo sapiens
atgacttatttctgctctgg

SEQ ID NO: 4629202 - DNA, 18 bp, Homo sapiens
atgacttgggcaccccca

SEQ ID NO: 4629203 - DNA, 20 bp, Homo sapiens
atgacttgggcacccccagc

SEQ ID NO: 4629204 - DNA, 21 bp, Homo sapiens
atgagactttccgactgcttt

SEQ ID NO: 4629205 - DNA, 20 bp, Homo sapiens
atgagatcagggcctgcccc

SEQ ID NO: 4629206 - DNA, 20 bp, Homo sapiens
atgagatctaatgtgaaaat

SEQ ID NO: 4629207 - DNA, 21 bp, Homo sapiens
atgagcccaccctgctgagat

SEQ ID NO: 4629208 - DNA, 11 bp, Homo sapiens
atgagcccaga

SEQ ID NO: 4629209 - DNA, 21 bp, Homo sapiens
atgaggaggatgtccctgggc

SEQ ID NO: 4629210 - DNA, 20 bp, Homo sapiens
atgaggccatctcaggagat

SEQ ID NO: 4629211 - DNA, 23 bp, Homo sapiens
atgagggaaatctgtaaagccag

SEQ ID NO: 4629212 - DNA, 22 bp, Homo sapiens
atgaggtcaccaggggaggagc

SEQ ID NO: 4629213 - DNA, 20 bp, Homo sapiens
atgaggtctcgaccctgtcc

SEQ ID NO: 4629214 - DNA, 21 bp, Homo sapiens
atgaggtctcgaccctgtccc

SEQ ID NO: 4629215 - DNA, 16 bp, Homo sapiens
atgaggtgccacccag

SEQ ID NO: 4629216 - DNA, 19 bp, Homo sapiens
atgagtctgtttcccaagc

SEQ ID NO: 4629217 - DNA, 19 bp, Homo sapiens
atgagtgaagtattgctga

SEQ ID NO: 4629218 - DNA, 20 bp, Homo sapiens
atgagtgaagtattgctgaa

SEQ ID NO: 4629219 - DNA, 21 bp, Homo sapiens
atgagtggaaattaagacttt

SEQ ID NO: 4629220 - DNA, 16 bp, Homo sapiens
atgagttcaaatactt

SEQ ID NO: 4629221 - DNA, 19 bp, Homo sapiens
atgagttcaaatacttttg

SEQ ID NO: 4629222 - DNA, 12 bp, Homo sapiens
atgataaaatag

SEQ ID NO: 4629223 - DNA, 14 bp, Homo sapiens
atgataaaatagcc

SEQ ID NO: 4629224 - DNA, 15 bp, Homo sapiens
atgatccttttttgt

SEQ ID NO: 4629225 - DNA, 17 bp, Homo sapiens
atgatctctctagcttt

SEQ ID NO: 4629226 - DNA, 23 bp, Homo sapiens
atgatcttgagtataagaaatgc

SEQ ID NO: 4629227 - DNA, 20 bp, Homo sapiens
atgatgaaaacctacatatt

SEQ ID NO: 4629228 - DNA, 17 bp, Homo sapiens
atgatgacaaaaaatgt

SEQ ID NO: 4629229 - DNA, 13 bp, Homo sapiens
atgatgttgctgt

SEQ ID NO: 4629230 - DNA, 22 bp, Homo sapiens
atgatgtttccctctccttcca

SEQ ID NO: 4629231 - DNA, 13 bp, Homo sapiens
atgattatcttga

SEQ ID NO: 4629232 - DNA, 16 bp, Homo sapiens
atgatttaaaaacaac

SEQ ID NO: 4629233 - DNA, 15 bp, Homo sapiens
atgatttggccaggc

SEQ ID NO: 4629234 - DNA, 22 bp, Homo sapiens
atgattttggaactgtgtttca

SEQ ID NO: 4629235 - DNA, 16 bp, Homo sapiens
atgcaaatacaatcag

SEQ ID NO: 4629236 - DNA, 19 bp, Homo sapiens
atgcaaatcctatgtgatt

SEQ ID NO: 4629237 - DNA, 19 bp, Homo sapiens
atgcaaatttctataaatt

SEQ ID NO: 4629238 - DNA, 14 bp, Homo sapiens
atgcaacagaagtg

SEQ ID NO: 4629239 - DNA, 18 bp, Homo sapiens
atgcaatgcttcattatt

SEQ ID NO: 4629240 - DNA, 18 bp, Homo sapiens
atgcacatatggactctg

SEQ ID NO: 4629241 - DNA, 21 bp, Homo sapiens
atgcacatatggactctgcac

SEQ ID NO: 4629242 - DNA, 18 bp, Homo sapiens
atgcacttttagaaatgc

SEQ ID NO: 4629243 - DNA, 21 bp, Homo sapiens
atgcacttttagaaatgcata

SEQ ID NO: 4629244 - DNA, 17 bp, Homo sapiens
atgcagaaccacaaaca

SEQ ID NO: 4629245 - DNA, 19 bp, Homo sapiens
atgcagaaccacaaacaat

SEQ ID NO: 4629246 - DNA, 17 bp, Homo sapiens
atgcagaggtctccaaa

SEQ ID NO: 4629247 - DNA, 16 bp, Homo sapiens
atgcagataaaatatt

SEQ ID NO: 4629248 - DNA, 15 bp, Homo sapiens
atgcaggtcagccca

SEQ ID NO: 4629249 - DNA, 24 bp, Homo sapiens
atgcaggtcagcccatggaggcag

SEQ ID NO: 4629250 - DNA, 18 bp, Homo sapiens
atgcatcagaaagggagg

SEQ ID NO: 4629251 - DNA, 20 bp, Homo sapiens
atgcatcagaaagggagggc

SEQ ID NO: 4629252 - DNA, 13 bp, Homo sapiens
atgcatgtgaaga

SEQ ID NO: 4629253 - DNA, 17 bp, Homo sapiens
atgcattgaaaaatttc

SEQ ID NO: 4629254 - DNA, 17 bp, Homo sapiens
atgccacacctggcctt

SEQ ID NO: 4629255 - DNA, 16 bp, Homo sapiens
atgccacagacaactc

SEQ ID NO: 4629256 - DNA, 23 bp, Homo sapiens
atgccaccggcctgtgggtctct

SEQ ID NO: 4629257 - DNA, 20 bp, Homo sapiens
atgccactaacttctaaaga

SEQ ID NO: 4629258 - DNA, 14 bp, Homo sapiens
atgccactgcactc

SEQ ID NO: 4629259 - DNA, 20 bp, Homo sapiens
atgccacttccttttaactg

SEQ ID NO: 4629260 - DNA, 19 bp, Homo sapiens
atgccatccagatgtgtgc

SEQ ID NO: 4629261 - DNA, 12 bp, Homo sapiens
atgccccagtcg

SEQ ID NO: 4629262 - DNA, 14 bp, Homo sapiens
atgcccccagctgg

SEQ ID NO: 4629263 - DNA, 16 bp, Homo sapiens
atgcccctggctggga

SEQ ID NO: 4629264 - DNA, 11 bp, Homo sapiens
atgcccttccc

SEQ ID NO: 4629265 - DNA, 19 bp, Homo sapiens
atgcccttgctgggcctgg

SEQ ID NO: 4629266 - DNA, 16 bp, Homo sapiens
atgcctagagatattt

SEQ ID NO: 4629267 - DNA, 17 bp, Homo sapiens
atgcctagagatatttc

SEQ ID NO: 4629268 - DNA, 20 bp, Homo sapiens
atgcctagagatatttcaag

SEQ ID NO: 4629269 - DNA, 16 bp, Homo sapiens
atgcctcactaatttt

SEQ ID NO: 4629270 - DNA, 23 bp, Homo sapiens
atgcctcactaatttttgtatta

SEQ ID NO: 4629271 - DNA, 17 bp, Homo sapiens
atgcctctgaggccagc

SEQ ID NO: 4629272 - DNA, 12 bp, Homo sapiens
atgcctgcccat

SEQ ID NO: 4629273 - DNA, 19 bp, Homo sapiens
atgcctgcccattagagaa

SEQ ID NO: 4629274 - DNA, 16 bp, Homo sapiens
atgccttaaaatggaa

SEQ ID NO: 4629275 - DNA, 18 bp, Homo sapiens
atgccttaaaatggaatt

SEQ ID NO: 4629276 - DNA, 19 bp, Homo sapiens
atgccttaaaatggaattg

SEQ ID NO: 4629277 - DNA, 15 bp, Homo sapiens
atgccttctgtattt

SEQ ID NO: 4629278 - DNA, 14 bp, Homo sapiens
atgccttcttattg

SEQ ID NO: 4629279 - DNA, 17 bp, Homo sapiens
atgcggatcctgctggg

SEQ ID NO: 4629280 - DNA, 14 bp, Homo sapiens
atgcggtagccagc

SEQ ID NO: 4629281 - DNA, 15 bp, Homo sapiens
atgcggtagccagca

SEQ ID NO: 4629282 - DNA, 20 bp, Homo sapiens
atgcggtagccagcacacag

SEQ ID NO: 4629283 - DNA, 22 bp, Homo sapiens
atgcgtgagatgggtgtacaaa

SEQ ID NO: 4629284 - DNA, 14 bp, Homo sapiens
atgcgtgggcagag

SEQ ID NO: 4629285 - DNA, 17 bp, Homo sapiens
atgcgtgggcagaggaa

SEQ ID NO: 4629286 - DNA, 14 bp, Homo sapiens
atgcgtttcatgta

SEQ ID NO: 4629287 - DNA, 21 bp, Homo sapiens
atgctaagaatgcattattga

SEQ ID NO: 4629288 - DNA, 14 bp, Homo sapiens
atgctagagaatca

SEQ ID NO: 4629289 - DNA, 15 bp, Homo sapiens
atgctatttgaacaa

SEQ ID NO: 4629290 - DNA, 14 bp, Homo sapiens
atgctcactttatt

SEQ ID NO: 4629291 - DNA, 17 bp, Homo sapiens
atgctcactttattatc

SEQ ID NO: 4629292 - DNA, 18 bp, Homo sapiens
atgctcccaactcccttc

SEQ ID NO: 4629293 - DNA, 12 bp, Homo sapiens
atgctctgcagc

SEQ ID NO: 4629294 - DNA, 22 bp, Homo sapiens
atgctctgcagcattgaagtat

SEQ ID NO: 4629295 - DNA, 20 bp, Homo sapiens
atgctcttgaaatattcaga

SEQ ID NO: 4629296 - DNA, 19 bp, Homo sapiens
atgctgacattcacctgcc

SEQ ID NO: 4629297 - DNA, 22 bp, Homo sapiens
atgctgacattcacctgcccca

SEQ ID NO: 4629298 - DNA, 17 bp, Homo sapiens
atgctgacttcacttat

SEQ ID NO: 4629299 - DNA, 12 bp, Homo sapiens
atgctgcagtgg

SEQ ID NO: 4629300 - DNA, 13 bp, Homo sapiens
atgctgctttttc

SEQ ID NO: 4629301 - DNA, 20 bp, Homo sapiens
atgctggactggaggcccct

SEQ ID NO: 4629302 - DNA, 22 bp, Homo sapiens
atgctggactggaggcccctgg

SEQ ID NO: 4629303 - DNA, 14 bp, Homo sapiens
atgctggaggcaga

SEQ ID NO: 4629304 - DNA, 14 bp, Homo sapiens
atgctgggccactg

SEQ ID NO: 4629305 - DNA, 13 bp, Homo sapiens
atgctgtgcattt

SEQ ID NO: 4629306 - DNA, 18 bp, Homo sapiens
atgctgtgctaaatatca

SEQ ID NO: 4629307 - DNA, 13 bp, Homo sapiens
atgctgtgctacg

SEQ ID NO: 4629308 - DNA, 15 bp, Homo sapiens
atgctgtgctacgtg

SEQ ID NO: 4629309 - DNA, 18 bp, Homo sapiens
atgctgtgctacgtgtga

SEQ ID NO: 4629310 - DNA, 16 bp, Homo sapiens
atgctgtttatgaatt

SEQ ID NO: 4629311 - DNA, 17 bp, Homo sapiens
atgcttgcataagagct

SEQ ID NO: 4629312 - DNA, 21 bp, Homo sapiens
atggaaaacgctctctactct

SEQ ID NO: 4629313 - DNA, 21 bp, Homo sapiens
atggaaatcttttacattttt

SEQ ID NO: 4629314 - DNA, 13 bp, Homo sapiens
atggaaattagcc

SEQ ID NO: 4629315 - DNA, 16 bp, Homo sapiens
atggaaattagccaca

SEQ ID NO: 4629316 - DNA, 16 bp, Homo sapiens
caattgacaaatgatg

SEQ ID NO: 4629317 - DNA, 21 bp, Homo sapiens
caattggattggaatgcagag

SEQ ID NO: 4629318 - DNA, 20 bp, Homo sapiens
caattgggagctgccaagag

SEQ ID NO: 4629319 - DNA, 21 bp, Homo sapiens
caattggtaaaactcactgtg

SEQ ID NO: 4629320 - DNA, 23 bp, Homo sapiens
caattgttttacctgttctgaaa

SEQ ID NO: 4629321 - DNA, 19 bp, Homo sapiens
caatttgtaaaaacagcat

SEQ ID NO: 4629322 - DNA, 12 bp, Homo sapiens
caattttatgta

SEQ ID NO: 4629323 - DNA, 22 bp, Homo sapiens
caatttttacacaaacctgaaa

SEQ ID NO: 4629324 - DNA, 18 bp, Homo sapiens
caatttttgtctcagaag

SEQ ID NO: 4629325 - DNA, 16 bp, Homo sapiens
cacaaaacccagacct

SEQ ID NO: 4629326 - DNA, 16 bp, Homo sapiens
cacaaaacttgaaaga

SEQ ID NO: 4629327 - DNA, 15 bp, Homo sapiens
cacaaagagatattt

SEQ ID NO: 4629328 - DNA, 17 bp, Homo sapiens
cacaaagagatatttag

SEQ ID NO: 4629329 - DNA, 20 bp, Homo sapiens
cacaaataagtaatatcttt

SEQ ID NO: 4629330 - DNA, 18 bp, Homo sapiens
cacaaccaccattcagtc

SEQ ID NO: 4629331 - DNA, 17 bp, Homo sapiens
cacaacttagtgtaata

SEQ ID NO: 4629332 - DNA, 19 bp, Homo sapiens
cacaagctgcactgtgaac

SEQ ID NO: 4629333 - DNA, 20 bp, Homo sapiens
cacaagctgcactgtgaacc

SEQ ID NO: 4629334 - DNA, 18 bp, Homo sapiens
cacaagctgtccctgcag

SEQ ID NO: 4629335 - DNA, 22 bp, Homo sapiens
cacaaggcagcaaggcccgagc

SEQ ID NO: 4629336 - DNA, 16 bp, Homo sapiens
cacaaggcctggtctg

SEQ ID NO: 4629337 - DNA, 21 bp, Homo sapiens
cacaatcactaaactttattt

SEQ ID NO: 4629338 - DNA, 13 bp, Homo sapiens
cacaattcctgtg

SEQ ID NO: 4629339 - DNA, 15 bp, Homo sapiens
cacaattcctgtgct

SEQ ID NO: 4629340 - DNA, 18 bp, Homo sapiens
cacacaccctgaggtcag

SEQ ID NO: 4629341 - DNA, 14 bp, Homo sapiens
cacacagctgagca

SEQ ID NO: 4629342 - DNA, 16 bp, Homo sapiens
cacacagctgagcact

SEQ ID NO: 4629343 - DNA, 12 bp, Homo sapiens
cacacaggcagc

SEQ ID NO: 4629344 - DNA, 20 bp, Homo sapiens
cacacaggcagccagccgtg

SEQ ID NO: 4629345 - DNA, 19 bp, Homo sapiens
cacacaggcatttcctggg

SEQ ID NO: 4629346 - DNA, 16 bp, Homo sapiens
cacacatttaattcag

SEQ ID NO: 4629347 - DNA, 14 bp, Homo sapiens
cacacattttatga

SEQ ID NO: 4629348 - DNA, 14 bp, Homo sapiens
cacaccaaggccct

SEQ ID NO: 4629349 - DNA, 15 bp, Homo sapiens
cacaccaaggccctg

SEQ ID NO: 4629350 - DNA, 16 bp, Homo sapiens
cacaccatatgtccac

SEQ ID NO: 4629351 - DNA, 22 bp, Homo sapiens
cacaccctgaggtcagggagtg

SEQ ID NO: 4629352 - DNA, 12 bp, Homo sapiens
cacacctcgtgg

SEQ ID NO: 4629353 - DNA, 20 bp, Homo sapiens
cacacctggccttaaagagg

SEQ ID NO: 4629354 - DNA, 20 bp, Homo sapiens
cacacgatgttgtcaaggat

SEQ ID NO: 4629355 - DNA, 20 bp, Homo sapiens
cacacggttttggcagctga

SEQ ID NO: 4629356 - DNA, 19 bp, Homo sapiens
cacactgcagggaggagtg

SEQ ID NO: 4629357 - DNA, 21 bp, Homo sapiens
cacagaacaggaggtgtgaat

SEQ ID NO: 4629358 - DNA, 15 bp, Homo sapiens
cacagaagaggagtc

SEQ ID NO: 4629359 - DNA, 21 bp, Homo sapiens
cacagacaagcagcccttgct

SEQ ID NO: 4629360 - DNA, 23 bp, Homo sapiens
cacagagaagtttgtagccaggt

SEQ ID NO: 4629361 - DNA, 19 bp, Homo sapiens
cacagagcaagtcctcact

SEQ ID NO: 4629362 - DNA, 21 bp, Homo sapiens
cacagagcaagtcctcactct

SEQ ID NO: 4629363 - DNA, 17 bp, Homo sapiens
cacagatctgcatctga

SEQ ID NO: 4629364 - DNA, 18 bp, Homo sapiens
cacagcaaccccaggctg

SEQ ID NO: 4629365 - DNA, 16 bp, Homo sapiens
cacagcatgggtccag

SEQ ID NO: 4629366 - DNA, 23 bp, Homo sapiens
cacagccgtttgaatatatttta

SEQ ID NO: 4629367 - DNA, 21 bp, Homo sapiens
cacagcctataggccaatgca

SEQ ID NO: 4629368 - DNA, 12 bp, Homo sapiens
cacagcctcacc

SEQ ID NO: 4629369 - DNA, 13 bp, Homo sapiens
cacagcctcaccc

SEQ ID NO: 4629370 - DNA, 18 bp, Homo sapiens
cacagcctcacccctgcc

SEQ ID NO: 4629371 - DNA, 19 bp, Homo sapiens
cacagcctcacccctgccc

SEQ ID NO: 4629372 - DNA, 12 bp, Homo sapiens
cacagccttccc

SEQ ID NO: 4629373 - DNA, 19 bp, Homo sapiens
cacagccttccctctgcat

SEQ ID NO: 4629374 - DNA, 23 bp, Homo sapiens
cacagccttccctctgcattgac

SEQ ID NO: 4629375 - DNA, 13 bp, Homo sapiens
cacagccttcgga

SEQ ID NO: 4629376 - DNA, 21 bp, Homo sapiens
cacagccttcggacagacata

SEQ ID NO: 4629377 - DNA, 22 bp, Homo sapiens
cacagctaaccacttcgcacac

SEQ ID NO: 4629378 - DNA, 14 bp, Homo sapiens
cacagctcctgcca

SEQ ID NO: 4629379 - DNA, 15 bp, Homo sapiens
cacagctcctgccag

SEQ ID NO: 4629380 - DNA, 16 bp, Homo sapiens
cacagctgagcactta

SEQ ID NO: 4629381 - DNA, 15 bp, Homo sapiens
cacagctgtttgaaa

SEQ ID NO: 4629382 - DNA, 21 bp, Homo sapiens
cacagctgtttgaaatgttta

SEQ ID NO: 4629383 - DNA, 22 bp, Homo sapiens
cacaggacatgcggtagccagc

SEQ ID NO: 4629384 - DNA, 22 bp, Homo sapiens
cacaggaccacctcctctgcca

SEQ ID NO: 4629385 - DNA, 16 bp, Homo sapiens
cacaggagctacctgt

SEQ ID NO: 4629386 - DNA, 12 bp, Homo sapiens
cacaggaggggg

SEQ ID NO: 4629387 - DNA, 23 bp, Homo sapiens
cacaggagggggtcgtggagagc

SEQ ID NO: 4629388 - DNA, 20 bp, Homo sapiens
cacaggcatttcctgggtgg

SEQ ID NO: 4629389 - DNA, 17 bp, Homo sapiens
cacaggctgagaactcg

SEQ ID NO: 4629390 - DNA, 20 bp, Homo sapiens
cacagggagtgcacatatcc

SEQ ID NO: 4629391 - DNA, 20 bp, Homo sapiens
cacagggcctgctattgcag

SEQ ID NO: 4629392 - DNA, 15 bp, Homo sapiens
cacaggtagcctatt

SEQ ID NO: 4629393 - DNA, 19 bp, Homo sapiens
cacagtacagcatgtgcct

SEQ ID NO: 4629394 - DNA, 17 bp, Homo sapiens
cacagtaccggattctc

SEQ ID NO: 4629395 - DNA, 18 bp, Homo sapiens
cacagtaccggattctct

SEQ ID NO: 4629396 - DNA, 13 bp, Homo sapiens
cacagtagaactg

SEQ ID NO: 4629397 - DNA, 13 bp, Homo sapiens
cacagtgtgaata

SEQ ID NO: 4629398 - DNA, 19 bp, Homo sapiens
cacataagcccagttcatc

SEQ ID NO: 4629399 - DNA, 16 bp, Homo sapiens
cacataggaaactttt

SEQ ID NO: 4629400 - DNA, 19 bp, Homo sapiens
cacatatccaggcaccagg

SEQ ID NO: 4629401 - DNA, 18 bp, Homo sapiens
cacatatgaacacagaca

SEQ ID NO: 4629402 - DNA, 19 bp, Homo sapiens
cacatatgcaccttgtgtc

SEQ ID NO: 4629403 - DNA, 22 bp, Homo sapiens
cacatatgcaccttgtgtctgt

SEQ ID NO: 4629404 - DNA, 13 bp, Homo sapiens
cacatcaaagagg

SEQ ID NO: 4629405 - DNA, 21 bp, Homo sapiens
cacatcatgagccttcagtca

SEQ ID NO: 4629406 - DNA, 21 bp, Homo sapiens
cacatccaggcaatggcctaa

SEQ ID NO: 4629407 - DNA, 16 bp, Homo sapiens
cacatccctgggcctg

SEQ ID NO: 4629408 - DNA, 21 bp, Homo sapiens
cacatccctgggcctgctgct

SEQ ID NO: 4629409 - DNA, 12 bp, Homo sapiens
cacatctccctt

SEQ ID NO: 4629410 - DNA, 18 bp, Homo sapiens
cacatctgcacactctct

SEQ ID NO: 4629411 - DNA, 24 bp, Homo sapiens
cacatctgtaatcctagctacttg

SEQ ID NO: 4629412 - DNA, 24 bp, Homo sapiens
cacatgaatcccacccacatgtga

SEQ ID NO: 4629413 - DNA, 21 bp, Homo sapiens
cacatgacgccagataaaatg

SEQ ID NO: 4629414 - DNA, 23 bp, Homo sapiens
cacatgacgccagataaaatgtt

SEQ ID NO: 4629415 - DNA, 15 bp, Homo sapiens
cacatgaggccatct

SEQ ID NO: 4629416 - DNA, 18 bp, Homo sapiens
cacatgccctaatgtctg

SEQ ID NO: 4629417 - DNA, 19 bp, Homo sapiens
cacatgccctaatgtctgt

SEQ ID NO: 4629418 - DNA, 20 bp, Homo sapiens
cacatgccctaatgtctgta

SEQ ID NO: 4629419 - DNA, 19 bp, Homo sapiens
cacatgctatgttctgtct

SEQ ID NO: 4629420 - DNA, 21 bp, Homo sapiens
cacatgctatgttctgtcttc

SEQ ID NO: 4629421 - DNA, 17 bp, Homo sapiens
cacattaacattttgag

SEQ ID NO: 4629422 - DNA, 23 bp, Homo sapiens
cacattatttattaaaaatgttc

SEQ ID NO: 4629423 - DNA, 13 bp, Homo sapiens
caccaaactgcct

SEQ ID NO: 4629424 - DNA, 16 bp, Homo sapiens
caccaagcacagcagc

SEQ ID NO: 4629425 - DNA, 23 bp, Homo sapiens
caccaagcagtggcctttttctg

SEQ ID NO: 4629426 - DNA, 13 bp, Homo sapiens
caccaaggccctg

SEQ ID NO: 4629427 - DNA, 18 bp, Homo sapiens
caccaagggacaggagaa

SEQ ID NO: 4629428 - DNA, 10 bp, Homo sapiens
caccaagggc

SEQ ID NO: 4629429 - DNA, 15 bp, Homo sapiens
caccactctggcagc

SEQ ID NO: 4629430 - DNA, 21 bp, Homo sapiens
caccactctggcagccacact

SEQ ID NO: 4629431 - DNA, 11 bp, Homo sapiens
caccacttaat

SEQ ID NO: 4629432 - DNA, 14 bp, Homo sapiens
caccacttaatctt

SEQ ID NO: 4629433 - DNA, 22 bp, Homo sapiens
caccagcctgctgacagacact

SEQ ID NO: 4629434 - DNA, 13 bp, Homo sapiens
caccagcttcact

SEQ ID NO: 4629435 - DNA, 16 bp, Homo sapiens
caccaggactagggct

SEQ ID NO: 4629436 - DNA, 23 bp, Homo sapiens
caccaggctgagccgaagctgcg

SEQ ID NO: 4629437 - DNA, 15 bp, Homo sapiens
caccagggaagaaga

SEQ ID NO: 4629438 - DNA, 18 bp, Homo sapiens
caccagggccagagcagc

SEQ ID NO: 4629439 - DNA, 19 bp, Homo sapiens
caccagggccagagcagct

SEQ ID NO: 4629440 - DNA, 22 bp, Homo sapiens
caccagggccagagcagctcca

SEQ ID NO: 4629441 - DNA, 22 bp, Homo sapiens
caccagtgcatcacatctgcac

SEQ ID NO: 4629442 - DNA, 23 bp, Homo sapiens
caccagtgccacgtcatgagcgt

SEQ ID NO: 4629443 - DNA, 18 bp, Homo sapiens
caccatgatgtgaagagt

SEQ ID NO: 4629444 - DNA, 19 bp, Homo sapiens
cacccaatcaagggaagaa

SEQ ID NO: 4629445 - DNA, 18 bp, Homo sapiens
cacccaccccctgcctgg

SEQ ID NO: 4629446 - DNA, 20 bp, Homo sapiens
cacccaggctggagtgcagt

SEQ ID NO: 4629447 - DNA, 16 bp, Homo sapiens
cacccatgcacactca

SEQ ID NO: 4629448 - DNA, 19 bp, Homo sapiens
cacccatgtaaccactgca

SEQ ID NO: 4629449 - DNA, 15 bp, Homo sapiens
caccccaccctccct

SEQ ID NO: 4629450 - DNA, 19 bp, Homo sapiens
cacccccacaagctgtccc

SEQ ID NO: 4629451 - DNA, 23 bp, Homo sapiens
cacccccacaagctgtccctgca

SEQ ID NO: 4629452 - DNA, 15 bp, Homo sapiens
cacccccaccaaggg

SEQ ID NO: 4629453 - DNA, 16 bp, Homo sapiens
cacccccagcctgggc

SEQ ID NO: 4629454 - DNA, 12 bp, Homo sapiens
caccccctgcag

SEQ ID NO: 4629455 - DNA, 19 bp, Homo sapiens
caccccctgcctggttcta

SEQ ID NO: 4629456 - DNA, 14 bp, Homo sapiens
cacccctcccctgg

SEQ ID NO: 4629457 - DNA, 15 bp, Homo sapiens
cacccctcccctggg

SEQ ID NO: 4629458 - DNA, 17 bp, Homo sapiens
cacccctcccctgggac

SEQ ID NO: 4629459 - DNA, 17 bp, Homo sapiens
cacccctctcgcctcat

SEQ ID NO: 4629460 - DNA, 19 bp, Homo sapiens
cacccctctcgcctcatta

SEQ ID NO: 4629461 - DNA, 19 bp, Homo sapiens
cacccctgcccctgtggga

SEQ ID NO: 4629462 - DNA, 20 bp, Homo sapiens
cacccctgcccctgtgggac

SEQ ID NO: 4629463 - DNA, 22 bp, Homo sapiens
cacccctgcccctgtgggactc

SEQ ID NO: 4629464 - DNA, 14 bp, Homo sapiens
caccccttccctat

SEQ ID NO: 4629465 - DNA, 18 bp, Homo sapiens
caccccttccctatagga

SEQ ID NO: 4629466 - DNA, 15 bp, Homo sapiens
cacccgtccccacac

SEQ ID NO: 4629467 - DNA, 16 bp, Homo sapiens
cacccgtccccacacg

SEQ ID NO: 4629468 - DNA, 22 bp, Homo sapiens
cacccgtccccacacgagggcc

SEQ ID NO: 4629469 - DNA, 20 bp, Homo sapiens
caccctaatgtggcagctgt

SEQ ID NO: 4629470 - DNA, 15 bp, Homo sapiens
caccctccactcagc

SEQ ID NO: 4629471 - DNA, 16 bp, Homo sapiens
caccctccagagacaa

SEQ ID NO: 4629472 - DNA, 17 bp, Homo sapiens
caccctccctagctctg

SEQ ID NO: 4629473 - DNA, 16 bp, Homo sapiens
caccctgaggagtctg

SEQ ID NO: 4629474 - DNA, 18 bp, Homo sapiens
caccctgaggagtctgag

SEQ ID NO: 4629475 - DNA, 21 bp, Homo sapiens
caccctgaggagtctgaggtc

SEQ ID NO: 4629476 - DNA, 12 bp, Homo sapiens
caccctggcctg

SEQ ID NO: 4629477 - DNA, 16 bp, Homo sapiens
caccctggcctgaact

SEQ ID NO: 4629478 - DNA, 19 bp, Homo sapiens
caccgccacgtcccagcat

SEQ ID NO: 4629479 - DNA, 22 bp, Homo sapiens
caccggccccatttacccaact

SEQ ID NO: 4629480 - DNA, 23 bp, Homo sapiens
caccgggccactccttcctgccc

SEQ ID NO: 4629481 - DNA, 14 bp, Homo sapiens
caccgtgcctggct

SEQ ID NO: 4629482 - DNA, 14 bp, Homo sapiens
caccgttctgtgca

SEQ ID NO: 4629483 - DNA, 13 bp, Homo sapiens
cacctacagtgta

SEQ ID NO: 4629484 - DNA, 17 bp, Homo sapiens
cacctacagtgtacagt

SEQ ID NO: 4629485 - DNA, 17 bp, Homo sapiens
cacctactcacacaggc

SEQ ID NO: 4629486 - DNA, 18 bp, Homo sapiens
cacctactcacacaggca

SEQ ID NO: 4629487 - DNA, 14 bp, Homo sapiens
cacctagcagcctc

SEQ ID NO: 4629488 - DNA, 17 bp, Homo sapiens
cacctagcagcctcaaa

SEQ ID NO: 4629489 - DNA, 11 bp, Homo sapiens
cacctcacccc

SEQ ID NO: 4629490 - DNA, 14 bp, Homo sapiens
cacctcaccccact

SEQ ID NO: 4629491 - DNA, 13 bp, Homo sapiens
cacctccagcctc

SEQ ID NO: 4629492 - DNA, 15 bp, Homo sapiens
cacctccagcctctg

SEQ ID NO: 4629493 - DNA, 18 bp, Homo sapiens
cacctccaggcctgttgc

SEQ ID NO: 4629494 - DNA, 15 bp, Homo sapiens
cacctcctgctgggc

SEQ ID NO: 4629495 - DNA, 17 bp, Homo sapiens
cacctcctgctgggcag

SEQ ID NO: 4629496 - DNA, 20 bp, Homo sapiens
cacctccttccccagctccc

SEQ ID NO: 4629497 - DNA, 17 bp, Homo sapiens
cacctctgggaccccag

SEQ ID NO: 4629498 - DNA, 20 bp, Homo sapiens
cacctctgtgacccctcctt

SEQ ID NO: 4629499 - DNA, 18 bp, Homo sapiens
cacctgattcaactaaaa

SEQ ID NO: 4629500 - DNA, 15 bp, Homo sapiens
cacctgccccaactc

SEQ ID NO: 4629501 - DNA, 16 bp, Homo sapiens
cacctgccccaactct

SEQ ID NO: 4629502 - DNA, 16 bp, Homo sapiens
cacctgcgcaagtgcc

SEQ ID NO: 4629503 - DNA, 22 bp, Homo sapiens
cacctgcgcaagtgcctgggat

SEQ ID NO: 4629504 - DNA, 22 bp, Homo sapiens
cacctgctagtcgcccctcaga

SEQ ID NO: 4629505 - DNA, 23 bp, Homo sapiens
cacctggccttaaagagggacag

SEQ ID NO: 4629506 - DNA, 19 bp, Homo sapiens
cacctgggccctggggcct

SEQ ID NO: 4629507 - DNA, 11 bp, Homo sapiens
cacctgtctgg

SEQ ID NO: 4629508 - DNA, 10 bp, Homo sapiens
cacctgtggg

SEQ ID NO: 4629509 - DNA, 20 bp, Homo sapiens
cacctgtgggtgtagccagg

SEQ ID NO: 4629510 - DNA, 22 bp, Homo sapiens
cacctgtgggtgtagccaggta

SEQ ID NO: 4629511 - DNA, 21 bp, Homo sapiens
caccttcaatgacttctaatt

SEQ ID NO: 4629512 - DNA, 18 bp, Homo sapiens
caccttccattttccccc

SEQ ID NO: 4629513 - DNA, 14 bp, Homo sapiens
caccttcccttcct

SEQ ID NO: 4629514 - DNA, 16 bp, Homo sapiens
caccttcccttcctca

SEQ ID NO: 4629515 - DNA, 19 bp, Homo sapiens
caccttcccttcctcagca

SEQ ID NO: 4629516 - DNA, 17 bp, Homo sapiens
caccttgtgtctgtaca

SEQ ID NO: 4629517 - DNA, 21 bp, Homo sapiens
caccttgtgtctgtacacgtg

SEQ ID NO: 4629518 - DNA, 20 bp, Homo sapiens
caccttttcagcgatgtatg

SEQ ID NO: 4629519 - DNA, 15 bp, Homo sapiens
cacgaagtgttgcat

SEQ ID NO: 4629520 - DNA, 18 bp, Homo sapiens
cacgaagtgttgcatgga

SEQ ID NO: 4629521 - DNA, 13 bp, Homo sapiens
cacgagccacaag

SEQ ID NO: 4629522 - DNA, 16 bp, Homo sapiens
cacgagccacaagctg

SEQ ID NO: 4629523 - DNA, 18 bp, Homo sapiens
cacgagccacaagctgca

SEQ ID NO: 4629524 - DNA, 20 bp, Homo sapiens
cacgagccacaagctgcact

SEQ ID NO: 4629525 - DNA, 22 bp, Homo sapiens
cacgagccacaagctgcactgt

SEQ ID NO: 4629526 - DNA, 12 bp, Homo sapiens
cacgcacctgcc

SEQ ID NO: 4629527 - DNA, 16 bp, Homo sapiens
cacgcacctgcctcag

SEQ ID NO: 4629528 - DNA, 18 bp, Homo sapiens
cacgctttcagcgaatga

SEQ ID NO: 4629529 - DNA, 18 bp, Homo sapiens
cacggaggcctcgagcag

SEQ ID NO: 4629530 - DNA, 20 bp, Homo sapiens
cacggcacctgggccctggg

SEQ ID NO: 4629531 - DNA, 21 bp, Homo sapiens
cacggcacctgggccctgggg

SEQ ID NO: 4629532 - DNA, 22 bp, Homo sapiens
cacggcacctgggccctggggc

SEQ ID NO: 4629533 - DNA, 13 bp, Homo sapiens
cacggccacatca

SEQ ID NO: 4629534 - DNA, 15 bp, Homo sapiens
cacggccctccttct

SEQ ID NO: 4629535 - DNA, 13 bp, Homo sapiens
cacggcctggctg

SEQ ID NO: 4629536 - DNA, 18 bp, Homo sapiens
cacgggacggaagtgctt

SEQ ID NO: 4629537 - DNA, 18 bp, Homo sapiens
cacggttttggcagctga

SEQ ID NO: 4629538 - DNA, 15 bp, Homo sapiens
cacgtaatcctcctg

SEQ ID NO: 4629539 - DNA, 19 bp, Homo sapiens
cacgtagggggcaggggca

SEQ ID NO: 4629540 - DNA, 17 bp, Homo sapiens
cacgtctggctccctgc

SEQ ID NO: 4629541 - DNA, 19 bp, Homo sapiens
cacgtgtatagtatctgta

SEQ ID NO: 4629542 - DNA, 15 bp, Homo sapiens
cactaaactttattt

SEQ ID NO: 4629543 - DNA, 14 bp, Homo sapiens
cactaacttctaaa

SEQ ID NO: 4629544 - DNA, 18 bp, Homo sapiens
cactaatttttgtattat

SEQ ID NO: 4629545 - DNA, 18 bp, Homo sapiens
cactacgcactggacagc

SEQ ID NO: 4629546 - DNA, 21 bp, Homo sapiens
cactacgcactggacagcatc

SEQ ID NO: 4629547 - DNA, 12 bp, Homo sapiens
cactactgcagc

SEQ ID NO: 4629548 - DNA, 13 bp, Homo sapiens
cactactgcagca

SEQ ID NO: 4629549 - DNA, 16 bp, Homo sapiens
cactactgcagcacct

SEQ ID NO: 4629550 - DNA, 19 bp, Homo sapiens
cactagaatggataaaata

SEQ ID NO: 4629551 - DNA, 23 bp, Homo sapiens
cactagtgcaattccaagaaaat

SEQ ID NO: 4629552 - DNA, 17 bp, Homo sapiens
cactatctgggtgcatg

SEQ ID NO: 4629553 - DNA, 17 bp, Homo sapiens
cactatgggtgagcata

SEQ ID NO: 4629554 - DNA, 23 bp, Homo sapiens
cactcaaaggccagacctgcaga

SEQ ID NO: 4629555 - DNA, 23 bp, Homo sapiens
cactcagaagcctgggggcctgg

SEQ ID NO: 4629556 - DNA, 23 bp, Homo sapiens
cactcagccggcagccagatggc

SEQ ID NO: 4629557 - DNA, 22 bp, Homo sapiens
cactcagctgtcctgcagcaaa

SEQ ID NO: 4629558 - DNA, 12 bp, Homo sapiens
cactccaccctc

SEQ ID NO: 4629559 - DNA, 14 bp, Homo sapiens
cactcccaaccctg

SEQ ID NO: 4629560 - DNA, 12 bp, Homo sapiens
cactcccaccac

SEQ ID NO: 4629561 - DNA, 20 bp, Homo sapiens
cactcccaggtgagaattca

SEQ ID NO: 4629562 - DNA, 23 bp, Homo sapiens
cactccccagagctgtgccagca

SEQ ID NO: 4629563 - DNA, 22 bp, Homo sapiens
cactcccccctccattcccacc

SEQ ID NO: 4629564 - DNA, 17 bp, Homo sapiens
cactccgccagccacag

SEQ ID NO: 4629565 - DNA, 18 bp, Homo sapiens
cactccgccagccacagg

SEQ ID NO: 4629566 - DNA, 20 bp, Homo sapiens
cactccgccagccacaggac

SEQ ID NO: 4629567 - DNA, 11 bp, Homo sapiens
cactcctgctg

SEQ ID NO: 4629568 - DNA, 13 bp, Homo sapiens
cactccttcctgc

SEQ ID NO: 4629569 - DNA, 21 bp, Homo sapiens
cactccttcctgccccaactc

SEQ ID NO: 4629570 - DNA, 12 bp, Homo sapiens
cactctagaaaa

SEQ ID NO: 4629571 - DNA, 13 bp, Homo sapiens
cactctcttctcc

SEQ ID NO: 4629572 - DNA, 13 bp, Homo sapiens
cactctgacaagc

SEQ ID NO: 4629573 - DNA, 15 bp, Homo sapiens
cactctgacaagctg

SEQ ID NO: 4629574 - DNA, 13 bp, Homo sapiens
cactctgctctga

SEQ ID NO: 4629575 - DNA, 15 bp, Homo sapiens
cactctgctctgatg

SEQ ID NO: 4629576 - DNA, 17 bp, Homo sapiens
cactctgctctgatgca

SEQ ID NO: 4629577 - DNA, 12 bp, Homo sapiens
cactctggcagc

SEQ ID NO: 4629578 - DNA, 23 bp, Homo sapiens
cactctgtgtctgagtggcttca

SEQ ID NO: 4629579 - DNA, 12 bp, Homo sapiens
cactctgttcct

SEQ ID NO: 4629580 - DNA, 21 bp, Homo sapiens
cactcttcagtgactcctgct

SEQ ID NO: 4629581 - DNA, 23 bp, Homo sapiens
cactcttcagtgactcctgctgg

SEQ ID NO: 4629582 - DNA, 21 bp, Homo sapiens
cactcttgtcacccaggctgg

SEQ ID NO: 4629583 - DNA, 16 bp, Homo sapiens
cactgaaaacatctgg

SEQ ID NO: 4629584 - DNA, 22 bp, Homo sapiens
cactgaaggctttcagggcctc

SEQ ID NO: 4629585 - DNA, 19 bp, Homo sapiens
cactgcaacctctgcctcc

SEQ ID NO: 4629586 - DNA, 23 bp, Homo sapiens
cactgcaacctctgcctcctggg

SEQ ID NO: 4629587 - DNA, 15 bp, Homo sapiens
cactgcactccagcc

SEQ ID NO: 4629588 - DNA, 14 bp, Homo sapiens
cactgcagcagaaa

SEQ ID NO: 4629589 - DNA, 19 bp, Homo sapiens
cactgcattattctctttt

SEQ ID NO: 4629590 - DNA, 14 bp, Homo sapiens
cactgccaggaggg

SEQ ID NO: 4629591 - DNA, 13 bp, Homo sapiens
cactgccccacgt

SEQ ID NO: 4629592 - DNA, 19 bp, Homo sapiens
cactgccccacgttgtccc

SEQ ID NO: 4629593 - DNA, 14 bp, Homo sapiens
cactgcctctcaca

SEQ ID NO: 4629594 - DNA, 12 bp, Homo sapiens
cactggacagca

SEQ ID NO: 4629595 - DNA, 21 bp, Homo sapiens
cactggtaggttgggacacca

SEQ ID NO: 4629596 - DNA, 22 bp, Homo sapiens
cactgtgacccccagctccggc

SEQ ID NO: 4629597 - DNA, 18 bp, Homo sapiens
cactgtgatacagttttg

SEQ ID NO: 4629598 - DNA, 16 bp, Homo sapiens
cactgtgatttatctt

SEQ ID NO: 4629599 - DNA, 21 bp, Homo sapiens
cactgtggaaggcctccctct

SEQ ID NO: 4629600 - DNA, 20 bp, Homo sapiens
cactgtgtttatatgtcttg

SEQ ID NO: 4629601 - DNA, 18 bp, Homo sapiens
cactgtttgtttttattt

SEQ ID NO: 4629602 - DNA, 14 bp, Homo sapiens
cactgtttttaatc

SEQ ID NO: 4629603 - DNA, 15 bp, Homo sapiens
cactgtttttaatct

SEQ ID NO: 4629604 - DNA, 13 bp, Homo sapiens
cacttaatcttct

SEQ ID NO: 4629605 - DNA, 14 bp, Homo sapiens
cacttaatcttctc

SEQ ID NO: 4629606 - DNA, 21 bp, Homo sapiens
cacttaatcttctctcttgat

SEQ ID NO: 4629607 - DNA, 17 bp, Homo sapiens
cacttaatttgtaaact

SEQ ID NO: 4629608 - DNA, 18 bp, Homo sapiens
cacttaatttgtaaactt

SEQ ID NO: 4629609 - DNA, 22 bp, Homo sapiens
cacttaatttgtaaacttctga

SEQ ID NO: 4629610 - DNA, 13 bp, Homo sapiens
cacttacatatat

SEQ ID NO: 4629611 - DNA, 18 bp, Homo sapiens
cacttagacctgccagcc

SEQ ID NO: 4629612 - DNA, 13 bp, Homo sapiens
cacttcattttta

SEQ ID NO: 4629613 - DNA, 15 bp, Homo sapiens
cacttccacctccag

SEQ ID NO: 4629614 - DNA, 19 bp, Homo sapiens
cacttccacctccagcctc

SEQ ID NO: 4629615 - DNA, 21 bp, Homo sapiens
cacttccccctcttcttctga

SEQ ID NO: 4629616 - DNA, 23 bp, Homo sapiens
cacttcctttgcccttcctcctg

SEQ ID NO: 4629617 - DNA, 14 bp, Homo sapiens
cacttcgctcttga

SEQ ID NO: 4629618 - DNA, 21 bp, Homo sapiens
cacttcgctcttgaggagctc

SEQ ID NO: 4629619 - DNA, 14 bp, Homo sapiens
cacttctcaggaca

SEQ ID NO: 4629620 - DNA, 14 bp, Homo sapiens
cacttctccatgct

SEQ ID NO: 4629621 - DNA, 15 bp, Homo sapiens
cacttctccatgctg

SEQ ID NO: 4629622 - DNA, 12 bp, Homo sapiens
cacttctggctt

SEQ ID NO: 4629623 - DNA, 19 bp, Homo sapiens
cacttcttcacctcttcca

SEQ ID NO: 4629624 - DNA, 18 bp, Homo sapiens
cacttgccctgtgttctt

SEQ ID NO: 4629625 - DNA, 22 bp, Homo sapiens
cacttgccctgtgttctttccc

SEQ ID NO: 4629626 - DNA, 23 bp, Homo sapiens
cacttgccctgtgttctttcccc

SEQ ID NO: 4629627 - DNA, 14 bp, Homo sapiens
cacttgctgctttt

SEQ ID NO: 4629628 - DNA, 12 bp, Homo sapiens
cacttgcttctt

SEQ ID NO: 4629629 - DNA, 23 bp, Homo sapiens
cacttgtccagctgagcgccagg

SEQ ID NO: 4629630 - DNA, 20 bp, Homo sapiens
cacttgtccccaaatccgaa

SEQ ID NO: 4629631 - DNA, 19 bp, Homo sapiens
cacttgtgattataaaatt

SEQ ID NO: 4629632 - DNA, 21 bp, Homo sapiens
cactttcagagcccccagccc

SEQ ID NO: 4629633 - DNA, 21 bp, Homo sapiens
cactttccaatgccacagaca

SEQ ID NO: 4629634 - DNA, 16 bp, Homo sapiens
cactttcctttcaata

SEQ ID NO: 4629635 - DNA, 21 bp, Homo sapiens
cactttcctttcaataaagtt

SEQ ID NO: 4629636 - DNA, 20 bp, Homo sapiens
cactttttacagcagcaata

SEQ ID NO: 4629637 - DNA, 21 bp, Homo sapiens
cagaaaagaaagttcatgctt

SEQ ID NO: 4629638 - DNA, 16 bp, Homo sapiens
cagaaaatgcaatgac

SEQ ID NO: 4629639 - DNA, 22 bp, Homo sapiens
cagaaaattggcagtggcagag

SEQ ID NO: 4629640 - DNA, 14 bp, Homo sapiens
cagaaaatttaact

SEQ ID NO: 4629641 - DNA, 14 bp, Homo sapiens
cagaaacagcatat

SEQ ID NO: 4629642 - DNA, 15 bp, Homo sapiens
cagaaaccattctag

SEQ ID NO: 4629643 - DNA, 13 bp, Homo sapiens
cagaaagaccctg

SEQ ID NO: 4629644 - DNA, 14 bp, Homo sapiens
cagaaagaccctga

SEQ ID NO: 4629645 - DNA, 18 bp, Homo sapiens
cagaaagaccctgatgca

SEQ ID NO: 4629646 - DNA, 19 bp, Homo sapiens
cagaaatattcttattact

SEQ ID NO: 4629647 - DNA, 12 bp, Homo sapiens
cagaacagggtc

SEQ ID NO: 4629648 - DNA, 18 bp, Homo sapiens
cagaacatactgttctca

SEQ ID NO: 4629649 - DNA, 16 bp, Homo sapiens
cagaacattcagctct

SEQ ID NO: 4629650 - DNA, 17 bp, Homo sapiens
cagaacattcagctctg

SEQ ID NO: 4629651 - DNA, 18 bp, Homo sapiens
cagaacattcagctctgg

SEQ ID NO: 4629652 - DNA, 23 bp, Homo sapiens
cagaacattcagctctggagaac

SEQ ID NO: 4629653 - DNA, 16 bp, Homo sapiens
cagaaccacaaacaat

SEQ ID NO: 4629654 - DNA, 16 bp, Homo sapiens
cagaaccttgttattt

SEQ ID NO: 4629655 - DNA, 19 bp, Homo sapiens
cagaacgtggctctgctgg

SEQ ID NO: 4629656 - DNA, 17 bp, Homo sapiens
cagaacttgaagggtta

SEQ ID NO: 4629657 - DNA, 17 bp, Homo sapiens
cagaagacgggagggga

SEQ ID NO: 4629658 - DNA, 20 bp, Homo sapiens
cagaagacgggaggggaggc

SEQ ID NO: 4629659 - DNA, 22 bp, Homo sapiens
cagaagacgggaggggaggcat

SEQ ID NO: 4629660 - DNA, 22 bp, Homo sapiens
cagaagacgtggtctagaccag

SEQ ID NO: 4629661 - DNA, 23 bp, Homo sapiens
cagaagacttctatggaccacaa

SEQ ID NO: 4629662 - DNA, 18 bp, Homo sapiens
cagaagaggggcagcttt

SEQ ID NO: 4629663 - DNA, 16 bp, Homo sapiens
cagaagagggggaggg

SEQ ID NO: 4629664 - DNA, 18 bp, Homo sapiens
cagaagattgggccgcct

SEQ ID NO: 4629665 - DNA, 14 bp, Homo sapiens
cagaagcctggggg

SEQ ID NO: 4629666 - DNA, 21 bp, Homo sapiens
cagaagcctgggggcctggct

SEQ ID NO: 4629667 - DNA, 22 bp, Homo sapiens
cagaagcctgggggcctggctg

SEQ ID NO: 4629668 - DNA, 23 bp, Homo sapiens
cagaagcctgggggcctggctgg

SEQ ID NO: 4629669 - DNA, 15 bp, Homo sapiens
cagaagcttggagga

SEQ ID NO: 4629670 - DNA, 17 bp, Homo sapiens
cagaagcttggaggagg

SEQ ID NO: 4629671 - DNA, 20 bp, Homo sapiens
cagaaggagaaggctggaga

SEQ ID NO: 4629672 - DNA, 22 bp, Homo sapiens
cagaaggccgatggggaaggag

SEQ ID NO: 4629673 - DNA, 14 bp, Homo sapiens
cagaagtccctgtt

SEQ ID NO: 4629674 - DNA, 15 bp, Homo sapiens
cagaagtctcctcaa

SEQ ID NO: 4629675 - DNA, 20 bp, Homo sapiens
cagaagtgaggatgagaccc

SEQ ID NO: 4629676 - DNA, 21 bp, Homo sapiens
cagaagtgaggatgagaccca

SEQ ID NO: 4629677 - DNA, 22 bp, Homo sapiens
cagaagtgaggatgagacccag

SEQ ID NO: 4629678 - DNA, 14 bp, Homo sapiens
cagaatgaagccat

SEQ ID NO: 4629679 - DNA, 19 bp, Homo sapiens
cagacaagacagaggggag

SEQ ID NO: 4629680 - DNA, 20 bp, Homo sapiens
cagacaagacagaggggagc

SEQ ID NO: 4629681 - DNA, 14 bp, Homo sapiens
cagacaagcagccc

SEQ ID NO: 4629682 - DNA, 16 bp, Homo sapiens
cagacaagcagccctt

SEQ ID NO: 4629683 - DNA, 17 bp, Homo sapiens
cagacaagcagcccttg

SEQ ID NO: 4629684 - DNA, 19 bp, Homo sapiens
cagacaagcagcccttgct

SEQ ID NO: 4629685 - DNA, 20 bp, Homo sapiens
cagacaagcagcccttgctt

SEQ ID NO: 4629686 - DNA, 13 bp, Homo sapiens
cagacacatgcta

SEQ ID NO: 4629687 - DNA, 16 bp, Homo sapiens
cagacactaactttgt

SEQ ID NO: 4629688 - DNA, 18 bp, Homo sapiens
cagacagaagtctcctca

SEQ ID NO: 4629689 - DNA, 15 bp, Homo sapiens
cagacaggccccgtg

SEQ ID NO: 4629690 - DNA, 14 bp, Homo sapiens
cagacataaagcca

SEQ ID NO: 4629691 - DNA, 14 bp, Homo sapiens
cagacccctgggag

SEQ ID NO: 4629692 - DNA, 17 bp, Homo sapiens
cagacccctgggagctt

SEQ ID NO: 4629693 - DNA, 19 bp, Homo sapiens
cagacccctgggagcttcc

SEQ ID NO: 4629694 - DNA, 17 bp, Homo sapiens
cagacctaaagcaagcc

SEQ ID NO: 4629695 - DNA, 20 bp, Homo sapiens
cagacctatatctggagtga

SEQ ID NO: 4629696 - DNA, 13 bp, Homo sapiens
cagacctctggat

SEQ ID NO: 4629697 - DNA, 16 bp, Homo sapiens
cagacctgcctcttcc

SEQ ID NO: 4629698 - DNA, 13 bp, Homo sapiens
cagacctgtcacc

SEQ ID NO: 4629699 - DNA, 23 bp, Homo sapiens
cagacgagacaacagcacacagg

SEQ ID NO: 4629700 - DNA, 14 bp, Homo sapiens
cagacgcccagatt

SEQ ID NO: 4629701 - DNA, 16 bp, Homo sapiens
cagactactattttct

SEQ ID NO: 4629702 - DNA, 23 bp, Homo sapiens
cagactatcgtaacctggtgcct

SEQ ID NO: 4629703 - DNA, 17 bp, Homo sapiens
cagactcaagagaaact

SEQ ID NO: 4629704 - DNA, 19 bp, Homo sapiens
cagactcagttttttgtaa

SEQ ID NO: 4629705 - DNA, 20 bp, Homo sapiens
cagactcagttttttgtaac

SEQ ID NO: 4629706 - DNA, 16 bp, Homo sapiens
cagactcctgaggaca

SEQ ID NO: 4629707 - DNA, 20 bp, Homo sapiens
cagactcctgaggacagctg

SEQ ID NO: 4629708 - DNA, 13 bp, Homo sapiens
cagactcctgagt

SEQ ID NO: 4629709 - DNA, 19 bp, Homo sapiens
cagactctaggttatacaa

SEQ ID NO: 4629710 - DNA, 22 bp, Homo sapiens
cagactgtagcttctcttgctc

SEQ ID NO: 4629711 - DNA, 19 bp, Homo sapiens
cagactgtcaggcaagccc

SEQ ID NO: 4629712 - DNA, 18 bp, Homo sapiens
cagactgttgtccctgca

SEQ ID NO: 4629713 - DNA, 22 bp, Homo sapiens
cagactttggaaaatgcattgt

SEQ ID NO: 4629714 - DNA, 20 bp, Homo sapiens
cagactttgtgttcatttca

SEQ ID NO: 4629715 - DNA, 21 bp, Homo sapiens
cagactttgtgttcatttcat

SEQ ID NO: 4629716 - DNA, 22 bp, Homo sapiens
cagactttgtgttcatttcatt

SEQ ID NO: 4629717 - DNA, 15 bp, Homo sapiens
cagagaaagcgcaga

SEQ ID NO: 4629718 - DNA, 17 bp, Homo sapiens
cagagaacagaactgga

SEQ ID NO: 4629719 - DNA, 12 bp, Homo sapiens
cagagaaggcta

SEQ ID NO: 4629720 - DNA, 17 bp, Homo sapiens
cagagaagtttgtagcc

SEQ ID NO: 4629721 - DNA, 14 bp, Homo sapiens
cagagacaacaggt

SEQ ID NO: 4629722 - DNA, 22 bp, Homo sapiens
cagagacaacaggtaaaacagg

SEQ ID NO: 4629723 - DNA, 22 bp, Homo sapiens
cagagacagaggatgtggcctg

SEQ ID NO: 4629724 - DNA, 23 bp, Homo sapiens
cagagagaatgagagcgacacag

SEQ ID NO: 4629725 - DNA, 22 bp, Homo sapiens
cagagagaggggagaagcctgg

SEQ ID NO: 4629726 - DNA, 17 bp, Homo sapiens
cagagagggtgacaaga

SEQ ID NO: 4629727 - DNA, 18 bp, Homo sapiens
cagagagggtgacaagat

SEQ ID NO: 4629728 - DNA, 16 bp, Homo sapiens
cagagataaagacctt

SEQ ID NO: 4629729 - DNA, 17 bp, Homo sapiens
cagagatcaggatcagc

SEQ ID NO: 4629730 - DNA, 18 bp, Homo sapiens
cagagatcgacagacagc

SEQ ID NO: 4629731 - DNA, 14 bp, Homo sapiens
cagagcacctgtag

SEQ ID NO: 4629732 - DNA, 22 bp, Homo sapiens
cagagcatgatgggaggtgtgc

SEQ ID NO: 4629733 - DNA, 16 bp, Homo sapiens
cagagcccccagccct

SEQ ID NO: 4629734 - DNA, 16 bp, Homo sapiens
cagagcccctcctcca

SEQ ID NO: 4629735 - DNA, 14 bp, Homo sapiens
cagagcctcgctct

SEQ ID NO: 4629736 - DNA, 11 bp, Homo sapiens
cagagcctggg

SEQ ID NO: 4629737 - DNA, 21 bp, Homo sapiens
cagagctaagggtgggtgctc

SEQ ID NO: 4629738 - DNA, 13 bp, Homo sapiens
cagagctctacag

SEQ ID NO: 4629739 - DNA, 14 bp, Homo sapiens
cagagctctacagg

SEQ ID NO: 4629740 - DNA, 18 bp, Homo sapiens
cagagctctacaggcctg

SEQ ID NO: 4629741 - DNA, 16 bp, Homo sapiens
cagagctgtgccagca

SEQ ID NO: 4629742 - DNA, 18 bp, Homo sapiens
cagagctgtgccagcagg

SEQ ID NO: 4629743 - DNA, 14 bp, Homo sapiens
cagagcttcctggg

SEQ ID NO: 4629744 - DNA, 20 bp, Homo sapiens
cagagcttcctggggaccaa

SEQ ID NO: 4629745 - DNA, 23 bp, Homo sapiens
cagagcttcctggggaccaagat

SEQ ID NO: 4629746 - DNA, 19 bp, Homo sapiens
cagaggactcccaaccctg

SEQ ID NO: 4629747 - DNA, 15 bp, Homo sapiens
cagaggagcccagcg

SEQ ID NO: 4629748 - DNA, 18 bp, Homo sapiens
cagaggatgtggcctggt

SEQ ID NO: 4629749 - DNA, 13 bp, Homo sapiens
cagaggccctgga

SEQ ID NO: 4629750 - DNA, 15 bp, Homo sapiens
cagaggccctggagg

SEQ ID NO: 4629751 - DNA, 21 bp, Homo sapiens
cagaggctcgaggggctcagg

SEQ ID NO: 4629752 - DNA, 20 bp, Homo sapiens
cagagggacaaccagaaggc

SEQ ID NO: 4629753 - DNA, 21 bp, Homo sapiens
cagagggacaaccagaaggcc

SEQ ID NO: 4629754 - DNA, 12 bp, Homo sapiens
cagagggagttt

SEQ ID NO: 4629755 - DNA, 11 bp, Homo sapiens
cagaggggagc

SEQ ID NO: 4629756 - DNA, 13 bp, Homo sapiens
cagaggggagcag

SEQ ID NO: 4629757 - DNA, 16 bp, Homo sapiens
cagaggggagcagtgg

SEQ ID NO: 4629758 - DNA, 19 bp, Homo sapiens
cagaggggagcagtggcca

SEQ ID NO: 4629759 - DNA, 18 bp, Homo sapiens
cagagtaaattgctctgt

SEQ ID NO: 4629760 - DNA, 15 bp, Homo sapiens
cagagtcagcacagg

SEQ ID NO: 4629761 - DNA, 20 bp, Homo sapiens
cagagtccgggagaatgctg

SEQ ID NO: 4629762 - DNA, 23 bp, Homo sapiens
cagagtggcctccctgctgtgcc

SEQ ID NO: 4629763 - DNA, 22 bp, Homo sapiens
cagagtgggccccgggctggag

SEQ ID NO: 4629764 - DNA, 18 bp, Homo sapiens
cagagtgtacaaattgtc

SEQ ID NO: 4629765 - DNA, 15 bp, Homo sapiens
cagataaaatatttt

SEQ ID NO: 4629766 - DNA, 14 bp, Homo sapiens
cagataaaatgttc

SEQ ID NO: 4629767 - DNA, 17 bp, Homo sapiens
cagataaaatgttcagt

SEQ ID NO: 4629768 - DNA, 23 bp, Homo sapiens
cagataaagaaactgaggcccac

SEQ ID NO: 4629769 - DNA, 20 bp, Homo sapiens
cagataacctaataattgta

SEQ ID NO: 4629770 - DNA, 13 bp, Homo sapiens
cagatctgcatct

SEQ ID NO: 4629771 - DNA, 19 bp, Homo sapiens
cagatgaactgactgaagg

SEQ ID NO: 4629772 - DNA, 20 bp, Homo sapiens
cagatgaactgactgaagga

SEQ ID NO: 4629773 - DNA, 15 bp, Homo sapiens
cagatgcaatgtgct

SEQ ID NO: 4629774 - DNA, 17 bp, Homo sapiens
cagatgcagggcagtca

SEQ ID NO: 4629775 - DNA, 17 bp, Homo sapiens
cagatgcttctgggaga

SEQ ID NO: 4629776 - DNA, 14 bp, Homo sapiens
cagatggaaaggag

SEQ ID NO: 4629777 - DNA, 21 bp, Homo sapiens
cagatggaagcttactctctg

SEQ ID NO: 4629778 - DNA, 19 bp, Homo sapiens
cagatggctttcagggcag

SEQ ID NO: 4629779 - DNA, 15 bp, Homo sapiens
cagatgtaggaggga

SEQ ID NO: 4629780 - DNA, 18 bp, Homo sapiens
cagatgtaggagggactg

SEQ ID NO: 4629781 - DNA, 17 bp, Homo sapiens
cagatgttttacgtctg

SEQ ID NO: 4629782 - DNA, 12 bp, Homo sapiens
cagattcctatg

SEQ ID NO: 4629783 - DNA, 18 bp, Homo sapiens
cagattgcatgtgactct

SEQ ID NO: 4629784 - DNA, 20 bp, Homo sapiens
cagattgcatgtgactctga

SEQ ID NO: 4629785 - DNA, 23 bp, Homo sapiens
cagattgcatgtgactctgaagc

SEQ ID NO: 4629786 - DNA, 19 bp, Homo sapiens
cagattttggttggttttt

SEQ ID NO: 4629787 - DNA, 23 bp, Homo sapiens
cagattttttgaaccatccactt

SEQ ID NO: 4629788 - DNA, 19 bp, Homo sapiens
cagatttttttgtaagggg

SEQ ID NO: 4629789 - DNA, 17 bp, Homo sapiens
cagcaaccccaggctga

SEQ ID NO: 4629790 - DNA, 22 bp, Homo sapiens
cagcaaggcccgagcagctgag

SEQ ID NO: 4629791 - DNA, 15 bp, Homo sapiens
cagcaagtcagggtt

SEQ ID NO: 4629792 - DNA, 13 bp, Homo sapiens
cagcacaaggcca

SEQ ID NO: 4629793 - DNA, 15 bp, Homo sapiens
cagcacacaggcagc

SEQ ID NO: 4629794 - DNA, 18 bp, Homo sapiens
cagcaccgttctgtgcac

SEQ ID NO: 4629795 - DNA, 15 bp, Homo sapiens
cagcacctacagtgt

SEQ ID NO: 4629796 - DNA, 12 bp, Homo sapiens
cagcactcccca

SEQ ID NO: 4629797 - DNA, 18 bp, Homo sapiens
cagcactccccagagctg

SEQ ID NO: 4629798 - DNA, 20 bp, Homo sapiens
cagcactccccagagctgtg

SEQ ID NO: 4629799 - DNA, 16 bp, Homo sapiens
cagcacttagacctgc

SEQ ID NO: 4629800 - DNA, 15 bp, Homo sapiens
cagcacttgtccagc

SEQ ID NO: 4629801 - DNA, 19 bp, Homo sapiens
cagcagaaaacctgttcag

SEQ ID NO: 4629802 - DNA, 14 bp, Homo sapiens
cagcagcagcactt

SEQ ID NO: 4629803 - DNA, 12 bp, Homo sapiens
cagcagccagcc

SEQ ID NO: 4629804 - DNA, 18 bp, Homo sapiens
cagcagccagccctgcct

SEQ ID NO: 4629805 - DNA, 22 bp, Homo sapiens
cagcagccagccctgcctggag

SEQ ID NO: 4629806 - DNA, 17 bp, Homo sapiens
cagcagcggaaccgccc

SEQ ID NO: 4629807 - DNA, 11 bp, Homo sapiens
cagcaggaata

SEQ ID NO: 4629808 - DNA, 19 bp, Homo sapiens
cagcaggaggctttctggg

SEQ ID NO: 4629809 - DNA, 18 bp, Homo sapiens
cagcaggatcgaagggtt

SEQ ID NO: 4629810 - DNA, 13 bp, Homo sapiens
cagcaggcagcgc

SEQ ID NO: 4629811 - DNA, 19 bp, Homo sapiens
cagcaggccaaacatggcc

SEQ ID NO: 4629812 - DNA, 15 bp, Homo sapiens
cagcagggaacaaaa

SEQ ID NO: 4629813 - DNA, 18 bp, Homo sapiens
cagcagggctggtcacct

SEQ ID NO: 4629814 - DNA, 22 bp, Homo sapiens
cagcagggctggtcacctccca

SEQ ID NO: 4629815 - DNA, 19 bp, Homo sapiens
cagcaggggggctgtgcca

SEQ ID NO: 4629816 - DNA, 22 bp, Homo sapiens
cagcagggtcttttcatctggg

SEQ ID NO: 4629817 - DNA, 16 bp, Homo sapiens
cagcatatcgtttaat

SEQ ID NO: 4629818 - DNA, 19 bp, Homo sapiens
cagcatatcgtttaatttt

SEQ ID NO: 4629819 - DNA, 19 bp, Homo sapiens
cagcatccctggagcagga

SEQ ID NO: 4629820 - DNA, 20 bp, Homo sapiens
cagcatccctggagcaggag

SEQ ID NO: 4629821 - DNA, 22 bp, Homo sapiens
cagcatccctggagcaggagcc

SEQ ID NO: 4629822 - DNA, 21 bp, Homo sapiens
cagcatctaaagcagcaggtc

SEQ ID NO: 4629823 - DNA, 14 bp, Homo sapiens
cagcatggagagag

SEQ ID NO: 4629824 - DNA, 17 bp, Homo sapiens
cagcatgggtccagaag

SEQ ID NO: 4629825 - DNA, 13 bp, Homo sapiens
cagcattttttat

SEQ ID NO: 4629826 - DNA, 22 bp, Homo sapiens
cagcattttttatcaggcagga

SEQ ID NO: 4629827 - DNA, 16 bp, Homo sapiens
cagccaagattttcct

SEQ ID NO: 4629828 - DNA, 16 bp, Homo sapiens
cagccacacttctcag

SEQ ID NO: 4629829 - DNA, 19 bp, Homo sapiens
cagccacacttctcaggac

SEQ ID NO: 4629830 - DNA, 13 bp, Homo sapiens
cagccacagaccc

SEQ ID NO: 4629831 - DNA, 20 bp, Homo sapiens
cagccacagacccctgggag

SEQ ID NO: 4629832 - DNA, 21 bp, Homo sapiens
cagccacagacccctgggagc

SEQ ID NO: 4629833 - DNA, 13 bp, Homo sapiens
cagccacaggacc

SEQ ID NO: 4629834 - DNA, 16 bp, Homo sapiens
cagccacaggaccacc

SEQ ID NO: 4629835 - DNA, 12 bp, Homo sapiens
cagccaccctga

SEQ ID NO: 4629836 - DNA, 16 bp, Homo sapiens
cagccaccctgaggag

SEQ ID NO: 4629837 - DNA, 21 bp, Homo sapiens
cagccaccctgaggagtctga

SEQ ID NO: 4629838 - DNA, 15 bp, Homo sapiens
cagccactgtcaccg

SEQ ID NO: 4629839 - DNA, 18 bp, Homo sapiens
cagccactgtcaccgagc

SEQ ID NO: 4629840 - DNA, 23 bp, Homo sapiens
cagccagaacgtggctctgctgg

SEQ ID NO: 4629841 - DNA, 19 bp, Homo sapiens
cagccagaggcatctgagg

SEQ ID NO: 4629842 - DNA, 12 bp, Homo sapiens
cagccagccctg

SEQ ID NO: 4629843 - DNA, 19 bp, Homo sapiens
cagccagccctgcctggag

SEQ ID NO: 4629844 - DNA, 22 bp, Homo sapiens
cagccagccctgcctggaggac

SEQ ID NO: 4629845 - DNA, 17 bp, Homo sapiens
cagcccaaggacagttc

SEQ ID NO: 4629846 - DNA, 15 bp, Homo sapiens
cagcccagagcctgg

SEQ ID NO: 4629847 - DNA, 12 bp, Homo sapiens
cagcccagctgg

SEQ ID NO: 4629848 - DNA, 16 bp, Homo sapiens
cagcccatggaggcag

SEQ ID NO: 4629849 - DNA, 17 bp, Homo sapiens
cagcccatggaggcaga

SEQ ID NO: 4629850 - DNA, 14 bp, Homo sapiens
cagccccacccttg

SEQ ID NO: 4629851 - DNA, 18 bp, Homo sapiens
cagccccgacttcctgac

SEQ ID NO: 4629852 - DNA, 22 bp, Homo sapiens
cagccccgacttcctgactctc

SEQ ID NO: 4629853 - DNA, 16 bp, Homo sapiens
cagccccttcccctgg

SEQ ID NO: 4629854 - DNA, 18 bp, Homo sapiens
cagccccttcccctggga

SEQ ID NO: 4629855 - DNA, 16 bp, Homo sapiens
cagcccgacagtgcca

SEQ ID NO: 4629856 - DNA, 15 bp, Homo sapiens
cagccctcgcctctg

SEQ ID NO: 4629857 - DNA, 18 bp, Homo sapiens
cagccctctcactgtgtc

SEQ ID NO: 4629858 - DNA, 15 bp, Homo sapiens
cagccctgcctggag

SEQ ID NO: 4629859 - DNA, 12 bp, Homo sapiens
cagccctgctag

SEQ ID NO: 4629860 - DNA, 13 bp, Homo sapiens
cagccctgctaga

SEQ ID NO: 4629861 - DNA, 20 bp, Homo sapiens
cagccctggcccccatcagc

SEQ ID NO: 4629862 - DNA, 20 bp, Homo sapiens
cagccctgggaaccactccc

SEQ ID NO: 4629863 - DNA, 11 bp, Homo sapiens
cagccctgggg

SEQ ID NO: 4629864 - DNA, 17 bp, Homo sapiens
cagccggggcgagtggc

SEQ ID NO: 4629865 - DNA, 21 bp, Homo sapiens
cagccgtttgaatatatttta

SEQ ID NO: 4629866 - DNA, 14 bp, Homo sapiens
cagcctagcacagg

SEQ ID NO: 4629867 - DNA, 14 bp, Homo sapiens
cagcctcacccctg

SEQ ID NO: 4629868 - DNA, 15 bp, Homo sapiens
cagcctcacccctgc

SEQ ID NO: 4629869 - DNA, 19 bp, Homo sapiens
cagcctcccatccagggcc

SEQ ID NO: 4629870 - DNA, 20 bp, Homo sapiens
cagcctcccatccagggccc

SEQ ID NO: 4629871 - DNA, 14 bp, Homo sapiens
cagcctgaggtgcc

SEQ ID NO: 4629872 - DNA, 19 bp, Homo sapiens
cagcctgaggtgcccactc

SEQ ID NO: 4629873 - DNA, 23 bp, Homo sapiens
cagcctgaggtgcccactccgcc

SEQ ID NO: 4629874 - DNA, 13 bp, Homo sapiens
cagcctgctgaca

SEQ ID NO: 4629875 - DNA, 20 bp, Homo sapiens
cagcctgctgacagacacta

SEQ ID NO: 4629876 - DNA, 16 bp, Homo sapiens
cagcctggacatagag

SEQ ID NO: 4629877 - DNA, 13 bp, Homo sapiens
cagcctggcctcc

SEQ ID NO: 4629878 - DNA, 15 bp, Homo sapiens
cagcctggcctcctg

SEQ ID NO: 4629879 - DNA, 17 bp, Homo sapiens
cagcctggcctcctgcc

SEQ ID NO: 4629880 - DNA, 18 bp, Homo sapiens
cagcctggcctcctgcct

SEQ ID NO: 4629881 - DNA, 17 bp, Homo sapiens
cagcctgggcctatgga

SEQ ID NO: 4629882 - DNA, 22 bp, Homo sapiens
cagcctgggcctatggagagcc

SEQ ID NO: 4629883 - DNA, 16 bp, Homo sapiens
cagccttccctctgca

SEQ ID NO: 4629884 - DNA, 18 bp, Homo sapiens
cagcgaagtagcttgctc

SEQ ID NO: 4629885 - DNA, 13 bp, Homo sapiens
cagcgaatgacaa

SEQ ID NO: 4629886 - DNA, 16 bp, Homo sapiens
cagcgcatcctgcagg

SEQ ID NO: 4629887 - DNA, 19 bp, Homo sapiens
cagcgccaggctgaccaca

SEQ ID NO: 4629888 - DNA, 20 bp, Homo sapiens
cagcgccaggctgaccacag

SEQ ID NO: 4629889 - DNA, 13 bp, Homo sapiens
cagcgccatcctg

SEQ ID NO: 4629890 - DNA, 13 bp, Homo sapiens
cagcgcccttcct

SEQ ID NO: 4629891 - DNA, 14 bp, Homo sapiens
cagcgcccttcctc

SEQ ID NO: 4629892 - DNA, 16 bp, Homo sapiens
cagcgcccttcctctc

SEQ ID NO: 4629893 - DNA, 17 bp, Homo sapiens
cagcggcccaagagccc

SEQ ID NO: 4629894 - DNA, 18 bp, Homo sapiens
cagcggcccaagagcccg

SEQ ID NO: 4629895 - DNA, 18 bp, Homo sapiens
cagcgggagcctccctgc

SEQ ID NO: 4629896 - DNA, 17 bp, Homo sapiens
cagcgggcggaggggat

SEQ ID NO: 4629897 - DNA, 18 bp, Homo sapiens
cagcgtggccttgttctg

SEQ ID NO: 4629898 - DNA, 18 bp, Homo sapiens
cagctagaaaacattttt

SEQ ID NO: 4629899 - DNA, 15 bp, Homo sapiens
cagctcagccagtgg

SEQ ID NO: 4629900 - DNA, 14 bp, Homo sapiens
cagctccaccactg

SEQ ID NO: 4629901 - DNA, 16 bp, Homo sapiens
cagctccaccactgtg

SEQ ID NO: 4629902 - DNA, 21 bp, Homo sapiens
cagctccaccactgtgcactt

SEQ ID NO: 4629903 - DNA, 15 bp, Homo sapiens
cagctccaccctggc

SEQ ID NO: 4629904 - DNA, 19 bp, Homo sapiens
cagctccatgttctcccaa

SEQ ID NO: 4629905 - DNA, 13 bp, Homo sapiens
cagctcccccagg

SEQ ID NO: 4629906 - DNA, 16 bp, Homo sapiens
cagctcccccaggcag

SEQ ID NO: 4629907 - DNA, 17 bp, Homo sapiens
cagctcccccaggcaga

SEQ ID NO: 4629908 - DNA, 18 bp, Homo sapiens
cagctcccccaggcagaa

SEQ ID NO: 4629909 - DNA, 13 bp, Homo sapiens
cagctcctgccag

SEQ ID NO: 4629910 - DNA, 14 bp, Homo sapiens
cagctcctgccagg

SEQ ID NO: 4629911 - DNA, 11 bp, Homo sapiens
cagctcctttc

SEQ ID NO: 4629912 - DNA, 21 bp, Homo sapiens
cagctcctttctgtcctggag

SEQ ID NO: 4629913 - DNA, 11 bp, Homo sapiens
cagctctggag

SEQ ID NO: 4629914 - DNA, 15 bp, Homo sapiens
cagctctggagaaca

SEQ ID NO: 4629915 - DNA, 23 bp, Homo sapiens
cagctctgggccattctccacag

SEQ ID NO: 4629916 - DNA, 19 bp, Homo sapiens
cagctgaataacctgcaca

SEQ ID NO: 4629917 - DNA, 17 bp, Homo sapiens
cagctgactgaatgcag

SEQ ID NO: 4629918 - DNA, 23 bp, Homo sapiens
cagctgacttggttctgaagcca

SEQ ID NO: 4629919 - DNA, 22 bp, Homo sapiens
cagctgagcacttagcaggcac

SEQ ID NO: 4629920 - DNA, 13 bp, Homo sapiens
cagctgagcaggg

SEQ ID NO: 4629921 - DNA, 22 bp, Homo sapiens
cagctgctctaagcccaggatc

SEQ ID NO: 4629922 - DNA, 15 bp, Homo sapiens
cagctgctgtgcccc

SEQ ID NO: 4629923 - DNA, 16 bp, Homo sapiens
cagctgctgtgcccca

SEQ ID NO: 4629924 - DNA, 12 bp, Homo sapiens
cagctggaaact

SEQ ID NO: 4629925 - DNA, 17 bp, Homo sapiens
cagctggcccgtgacag

SEQ ID NO: 4629926 - DNA, 21 bp, Homo sapiens
cagctggcctggcccccagct

SEQ ID NO: 4629927 - DNA, 20 bp, Homo sapiens
cagctggtcctgaccaggat

SEQ ID NO: 4629928 - DNA, 12 bp, Homo sapiens
cagctgtgcctc

SEQ ID NO: 4629929 - DNA, 17 bp, Homo sapiens
cagctgtgcctcgctcc

SEQ ID NO: 4629930 - DNA, 21 bp, Homo sapiens
cagctgtttatgcatagataa

SEQ ID NO: 4629931 - DNA, 13 bp, Homo sapiens
cagctgtttgaaa

SEQ ID NO: 4629932 - DNA, 14 bp, Homo sapiens
cagctgtttgaaat

SEQ ID NO: 4629933 - DNA, 21 bp, Homo sapiens
cagcttcaacttttctcttta

SEQ ID NO: 4629934 - DNA, 21 bp, Homo sapiens
cagcttcacctctgggacccc

SEQ ID NO: 4629935 - DNA, 22 bp, Homo sapiens
cagcttcactctctccgtctgt

SEQ ID NO: 4629936 - DNA, 18 bp, Homo sapiens
cagcttctcagtttctgc

SEQ ID NO: 4629937 - DNA, 23 bp, Homo sapiens
cagcttctcagtttctgcctggg

SEQ ID NO: 4629938 - DNA, 19 bp, Homo sapiens
cagcttgatcaaaggcaca

SEQ ID NO: 4629939 - DNA, 15 bp, Homo sapiens
cagcttgtagccagc

SEQ ID NO: 4629940 - DNA, 23 bp, Homo sapiens
cagcttgtatgcaatggattttc

SEQ ID NO: 4629941 - DNA, 21 bp, Homo sapiens
cagcttttcttgataggccta

SEQ ID NO: 4629942 - DNA, 15 bp, Homo sapiens
caggaaaaggcctgg

SEQ ID NO: 4629943 - DNA, 13 bp, Homo sapiens
caggaaagccagg

SEQ ID NO: 4629944 - DNA, 14 bp, Homo sapiens
caggaacaaacagg

SEQ ID NO: 4629945 - DNA, 15 bp, Homo sapiens
caggaacaaacaggg

SEQ ID NO: 4629946 - DNA, 19 bp, Homo sapiens
caggaacttctagctcatt

SEQ ID NO: 4629947 - DNA, 22 bp, Homo sapiens
caggaagacccaacacatggga

SEQ ID NO: 4629948 - DNA, 12 bp, Homo sapiens
caggaagacttt

SEQ ID NO: 4629949 - DNA, 12 bp, Homo sapiens
caggaattcagt

SEQ ID NO: 4629950 - DNA, 17 bp, Homo sapiens
caggacacaggcctgtg

SEQ ID NO: 4629951 - DNA, 18 bp, Homo sapiens
caggacacaggcctgtgt

SEQ ID NO: 4629952 - DNA, 19 bp, Homo sapiens
caggacacaggcctgtgta

SEQ ID NO: 4629953 - DNA, 12 bp, Homo sapiens
caggaccacctc

SEQ ID NO: 4629954 - DNA, 22 bp, Homo sapiens
caggaccacctcctctgccagc

SEQ ID NO: 4629955 - DNA, 13 bp, Homo sapiens
caggaccctcagg

SEQ ID NO: 4629956 - DNA, 18 bp, Homo sapiens
caggacctggctgccata

SEQ ID NO: 4629957 - DNA, 17 bp, Homo sapiens
caggacctgtggccaag

SEQ ID NO: 4629958 - DNA, 21 bp, Homo sapiens
caggactaacactcagaagcc

SEQ ID NO: 4629959 - DNA, 20 bp, Homo sapiens
caggactggttccttcctta

SEQ ID NO: 4629960 - DNA, 13 bp, Homo sapiens
caggactgtgcct

SEQ ID NO: 4629961 - DNA, 15 bp, Homo sapiens
caggagaagaacaag

SEQ ID NO: 4629962 - DNA, 14 bp, Homo sapiens
caggagaagagagg

SEQ ID NO: 4629963 - DNA, 19 bp, Homo sapiens
caggagaatagcttttact

SEQ ID NO: 4629964 - DNA, 21 bp, Homo sapiens
caggagactttacaaaccttt

SEQ ID NO: 4629965 - DNA, 14 bp, Homo sapiens
caggagagagccag

SEQ ID NO: 4629966 - DNA, 21 bp, Homo sapiens
caggagagagccaggatgccc

SEQ ID NO: 4629967 - DNA, 13 bp, Homo sapiens
caggagaggcagc

SEQ ID NO: 4629968 - DNA, 23 bp, Homo sapiens
caggagaggcagcatgcttgggc

SEQ ID NO: 4629969 - DNA, 17 bp, Homo sapiens
caggagatggagggctt

SEQ ID NO: 4629970 - DNA, 20 bp, Homo sapiens
caggagctactgagaacata

SEQ ID NO: 4629971 - DNA, 18 bp, Homo sapiens
caggaggctttctgggct

SEQ ID NO: 4629972 - DNA, 20 bp, Homo sapiens
caggaggctttctgggctct

SEQ ID NO: 4629973 - DNA, 19 bp, Homo sapiens
caggagggacaaaggagcc

SEQ ID NO: 4629974 - DNA, 20 bp, Homo sapiens
caggagggacaaaggagcct

SEQ ID NO: 4629975 - DNA, 21 bp, Homo sapiens
caggagggacaaaggagcctg

SEQ ID NO: 4629976 - DNA, 23 bp, Homo sapiens
caggagggggtcgtggagagcta

SEQ ID NO: 4629977 - DNA, 22 bp, Homo sapiens
caggagggtatggtgctgctct

SEQ ID NO: 4629978 - DNA, 18 bp, Homo sapiens
caggagtagctgagctca

SEQ ID NO: 4629979 - DNA, 20 bp, Homo sapiens
caggagtagctgagctcaca

SEQ ID NO: 4629980 - DNA, 14 bp, Homo sapiens
caggagtgtcctgc

SEQ ID NO: 4629981 - DNA, 23 bp, Homo sapiens
caggagtgtcctgcccatgcccc

SEQ ID NO: 4629982 - DNA, 21 bp, Homo sapiens
caggagttcaataaatgtctg

SEQ ID NO: 4629983 - DNA, 22 bp, Homo sapiens
caggatatccttatcagagcta

SEQ ID NO: 4629984 - DNA, 23 bp, Homo sapiens
caggatcagattgcatgtgactc

SEQ ID NO: 4629985 - DNA, 19 bp, Homo sapiens
caggatctcctgccagccc

SEQ ID NO: 4629986 - DNA, 20 bp, Homo sapiens
caggatctcctgccagccca

SEQ ID NO: 4629987 - DNA, 23 bp, Homo sapiens
caggatctcctgccagcccagct

SEQ ID NO: 4629988 - DNA, 21 bp, Homo sapiens
caggatctctttccccaagga

SEQ ID NO: 4629989 - DNA, 14 bp, Homo sapiens
caggatgaggcccc

SEQ ID NO: 4629990 - DNA, 20 bp, Homo sapiens
caggatgaggccccgccttt

SEQ ID NO: 4629991 - DNA, 23 bp, Homo sapiens
caggatgaggccccgccttttcc

SEQ ID NO: 4629992 - DNA, 17 bp, Homo sapiens
caggatgcccagatgaa

SEQ ID NO: 4629993 - DNA, 13 bp, Homo sapiens
caggatggagcaa

SEQ ID NO: 4629994 - DNA, 22 bp, Homo sapiens
caggatggagcaagctcttccc

SEQ ID NO: 4629995 - DNA, 22 bp, Homo sapiens
caggattttaatttcaggaaaa

SEQ ID NO: 4629996 - DNA, 13 bp, Homo sapiens
caggcaagcccgg

SEQ ID NO: 4629997 - DNA, 14 bp, Homo sapiens
caggcaaggaggag

SEQ ID NO: 4629998 - DNA, 15 bp, Homo sapiens
caggcaatggcctaa

SEQ ID NO: 4629999 - DNA, 22 bp, Homo sapiens
caggcaatggcctaaacttcag

SEQ ID NO: 4630000 - DNA, 17 bp, Homo sapiens
caggcacccgtccccac

SEQ ID NO: 4630001 - DNA, 21 bp, Homo sapiens
caggcaccgccacgtcccagc

SEQ ID NO: 4630002 - DNA, 22 bp, Homo sapiens
caggcaccgccacgtcccagca

SEQ ID NO: 4630003 - DNA, 23 bp, Homo sapiens
caggcagaaatagttgtctgtgc

SEQ ID NO: 4630004 - DNA, 15 bp, Homo sapiens
caggcagggctagta

SEQ ID NO: 4630005 - DNA, 12 bp, Homo sapiens
caggcagggctc

SEQ ID NO: 4630006 - DNA, 13 bp, Homo sapiens
caggcagggctct

SEQ ID NO: 4630007 - DNA, 14 bp, Homo sapiens
caggcagggctctc

SEQ ID NO: 4630008 - DNA, 15 bp, Homo sapiens
caggcagggctctcc

SEQ ID NO: 4630009 - DNA, 20 bp, Homo sapiens
caggcagggctctcctggct

SEQ ID NO: 4630010 - DNA, 15 bp, Homo sapiens
caggcagggtgcagt

SEQ ID NO: 4630011 - DNA, 18 bp, Homo sapiens
caggcattcctgaaggga

SEQ ID NO: 4630012 - DNA, 21 bp, Homo sapiens
caggcattcctgaagggaact

SEQ ID NO: 4630013 - DNA, 17 bp, Homo sapiens
caggcatttcctgggtg

SEQ ID NO: 4630014 - DNA, 10 bp, Homo sapiens
caggccccac

SEQ ID NO: 4630015 - DNA, 16 bp, Homo sapiens
caggccccacccctgt

SEQ ID NO: 4630016 - DNA, 19 bp, Homo sapiens
caggccccaccccttccct

SEQ ID NO: 4630017 - DNA, 16 bp, Homo sapiens
caggccccatgacctc

SEQ ID NO: 4630018 - DNA, 22 bp, Homo sapiens
caggcctagtaaccaaggccct

SEQ ID NO: 4630019 - DNA, 19 bp, Homo sapiens
caggcctcacccctcccct

SEQ ID NO: 4630020 - DNA, 14 bp, Homo sapiens
caggcctctgcccc

SEQ ID NO: 4630021 - DNA, 22 bp, Homo sapiens
caggcctgcagcaggagtggtg

SEQ ID NO: 4630022 - DNA, 16 bp, Homo sapiens
caggcctgcagcccct

SEQ ID NO: 4630023 - DNA, 17 bp, Homo sapiens
caggcctgcagccccta

SEQ ID NO: 4630024 - DNA, 21 bp, Homo sapiens
caggcctgtgtagctgtgacc

SEQ ID NO: 4630025 - DNA, 23 bp, Homo sapiens
caggcctgttgctatagagccta

SEQ ID NO: 4630026 - DNA, 17 bp, Homo sapiens
caggctagccctgccct

SEQ ID NO: 4630027 - DNA, 14 bp, Homo sapiens
caggctctgcacag

SEQ ID NO: 4630028 - DNA, 17 bp, Homo sapiens
caggctctgcacagaca

SEQ ID NO: 4630029 - DNA, 16 bp, Homo sapiens
caggctgaagagaggg

SEQ ID NO: 4630030 - DNA, 21 bp, Homo sapiens
caggctgaccacagcacagcc

SEQ ID NO: 4630031 - DNA, 22 bp, Homo sapiens
caggctgaccacagcacagcca

SEQ ID NO: 4630032 - DNA, 15 bp, Homo sapiens
caggctggcagttgg

SEQ ID NO: 4630033 - DNA, 18 bp, Homo sapiens
caggctgggctctgcctg

SEQ ID NO: 4630034 - DNA, 23 bp, Homo sapiens
caggctgggctctgcctgtctgg

SEQ ID NO: 4630035 - DNA, 22 bp, Homo sapiens
caggctggtttcaaactcctga

SEQ ID NO: 4630036 - DNA, 15 bp, Homo sapiens
cagggaaggacagga

SEQ ID NO: 4630037 - DNA, 18 bp, Homo sapiens
cagggaaggacaggaccc

SEQ ID NO: 4630038 - DNA, 16 bp, Homo sapiens
cagggaaggcaggcag

SEQ ID NO: 4630039 - DNA, 20 bp, Homo sapiens
cagggacactccaactctac

SEQ ID NO: 4630040 - DNA, 17 bp, Homo sapiens
cagggaccggcagagct

SEQ ID NO: 4630041 - DNA, 15 bp, Homo sapiens
cagggaccggtgctg

SEQ ID NO: 4630042 - DNA, 18 bp, Homo sapiens
cagggaccggtgctgcag

SEQ ID NO: 4630043 - DNA, 19 bp, Homo sapiens
cagggaccggtgctgcagg

SEQ ID NO: 4630044 - DNA, 20 bp, Homo sapiens
cagggaccggtgctgcagga

SEQ ID NO: 4630045 - DNA, 20 bp, Homo sapiens
cagggagaggtcaccagctg

SEQ ID NO: 4630046 - DNA, 17 bp, Homo sapiens
cagggagcacctgtctg

SEQ ID NO: 4630047 - DNA, 18 bp, Homo sapiens
cagggagcacctgtctgg

SEQ ID NO: 4630048 - DNA, 21 bp, Homo sapiens
cagggagcggccggccagccc

SEQ ID NO: 4630049 - DNA, 14 bp, Homo sapiens
cagggagctgcagg

SEQ ID NO: 4630050 - DNA, 15 bp, Homo sapiens
cagggagctgggaca

SEQ ID NO: 4630051 - DNA, 15 bp, Homo sapiens
cagggaggccgaagc

SEQ ID NO: 4630052 - DNA, 17 bp, Homo sapiens
cagggagtgctggctca

SEQ ID NO: 4630053 - DNA, 14 bp, Homo sapiens
cagggattctctca

SEQ ID NO: 4630054 - DNA, 14 bp, Homo sapiens
cagggcacaggagc

SEQ ID NO: 4630055 - DNA, 15 bp, Homo sapiens
cagggcacaggagct

SEQ ID NO: 4630056 - DNA, 22 bp, Homo sapiens
cagggcacaggagctacctgtg

SEQ ID NO: 4630057 - DNA, 15 bp, Homo sapiens
cagggcacaggccat

SEQ ID NO: 4630058 - DNA, 16 bp, Homo sapiens
cagggcagcaggaggc

SEQ ID NO: 4630059 - DNA, 17 bp, Homo sapiens
cagggcagcgccaggct

SEQ ID NO: 4630060 - DNA, 16 bp, Homo sapiens
cagggccagtggggcc

SEQ ID NO: 4630061 - DNA, 18 bp, Homo sapiens
cagggccagtggggcctg

SEQ ID NO: 4630062 - DNA, 23 bp, Homo sapiens
cagggccatctgactgccaagcc

SEQ ID NO: 4630063 - DNA, 14 bp, Homo sapiens
cagggcccacgtgt

SEQ ID NO: 4630064 - DNA, 15 bp, Homo sapiens
cagggccctcccagc

SEQ ID NO: 4630065 - DNA, 14 bp, Homo sapiens
cagggcctcaggca

SEQ ID NO: 4630066 - DNA, 23 bp, Homo sapiens
cagggcctccagccctctcactg

SEQ ID NO: 4630067 - DNA, 18 bp, Homo sapiens
cagggcctgagtgacctc

SEQ ID NO: 4630068 - DNA, 20 bp, Homo sapiens
cagggcctgagtgacctcct

SEQ ID NO: 4630069 - DNA, 17 bp, Homo sapiens
cagggcctgccccctgg

SEQ ID NO: 4630070 - DNA, 20 bp, Homo sapiens
cagggcctgccccctgggga

SEQ ID NO: 4630071 - DNA, 12 bp, Homo sapiens
cagggcctgggg

SEQ ID NO: 4630072 - DNA, 15 bp, Homo sapiens
cagggcctggggcct

SEQ ID NO: 4630073 - DNA, 22 bp, Homo sapiens
cagggcctggggcctgagagaa

SEQ ID NO: 4630074 - DNA, 18 bp, Homo sapiens
cagggctctcctggcttc

SEQ ID NO: 4630075 - DNA, 23 bp, Homo sapiens
cagggctgccctgagaagctgct

SEQ ID NO: 4630076 - DNA, 15 bp, Homo sapiens
cagggctggggacag

SEQ ID NO: 4630077 - DNA, 20 bp, Homo sapiens
cagggctggggacagagggt

SEQ ID NO: 4630078 - DNA, 18 bp, Homo sapiens
cagggctggtcacctccc

SEQ ID NO: 4630079 - DNA, 21 bp, Homo sapiens
cagggctggtcacctcccatc

SEQ ID NO: 4630080 - DNA, 23 bp, Homo sapiens
cagggcttacggccctggccttg

SEQ ID NO: 4630081 - DNA, 13 bp, Homo sapiens
caggggaggagcc

SEQ ID NO: 4630082 - DNA, 17 bp, Homo sapiens
caggggaggagcctgtg

SEQ ID NO: 4630083 - DNA, 16 bp, Homo sapiens
caggggatggggtggg

SEQ ID NO: 4630084 - DNA, 21 bp, Homo sapiens
caggggatggggtggggggac

SEQ ID NO: 4630085 - DNA, 17 bp, Homo sapiens
caggggccaggagtggg

SEQ ID NO: 4630086 - DNA, 23 bp, Homo sapiens
caggggccaggagtggggagagt

SEQ ID NO: 4630087 - DNA, 13 bp, Homo sapiens
caggggcctgcag

SEQ ID NO: 4630088 - DNA, 21 bp, Homo sapiens
cagggggccccgccagggctg

SEQ ID NO: 4630089 - DNA, 23 bp, Homo sapiens
cagggggccccgccagggctggg

SEQ ID NO: 4630090 - DNA, 13 bp, Homo sapiens
caggggggctgtg

SEQ ID NO: 4630091 - DNA, 15 bp, Homo sapiens
caggggggctgtgcc

SEQ ID NO: 4630092 - DNA, 17 bp, Homo sapiens
caggggggctgtgccaa

SEQ ID NO: 4630093 - DNA, 22 bp, Homo sapiens
caggggggctgtgccaacctgt

SEQ ID NO: 4630094 - DNA, 14 bp, Homo sapiens
cagggtacctcaag

SEQ ID NO: 4630095 - DNA, 17 bp, Homo sapiens
cagggtacctcaagccc

SEQ ID NO: 4630096 - DNA, 19 bp, Homo sapiens
cagggtacctcaagcccca

SEQ ID NO: 4630097 - DNA, 18 bp, Homo sapiens
cagggtctccttccttcc

SEQ ID NO: 4630098 - DNA, 21 bp, Homo sapiens
cagggtctctccctcaggtgt

SEQ ID NO: 4630099 - DNA, 22 bp, Homo sapiens
cagggtctgagtgcaagttcat

SEQ ID NO: 4630100 - DNA, 17 bp, Homo sapiens
cagggtcttttcatctg

SEQ ID NO: 4630101 - DNA, 20 bp, Homo sapiens
cagggtgcagtatcatgccc

SEQ ID NO: 4630102 - DNA, 18 bp, Homo sapiens
cagggtggagtgcagtgg

SEQ ID NO: 4630103 - DNA, 13 bp, Homo sapiens
cagggtgtgtgct

SEQ ID NO: 4630104 - DNA, 20 bp, Homo sapiens
caggtaaaacagggccacat

SEQ ID NO: 4630105 - DNA, 23 bp, Homo sapiens
caggtaaaacagggccacataga

SEQ ID NO: 4630106 - DNA, 17 bp, Homo sapiens
caggtaagtctggtttt

SEQ ID NO: 4630107 - DNA, 17 bp, Homo sapiens
caggtacaggagaggca

SEQ ID NO: 4630108 - DNA, 18 bp, Homo sapiens
caggtagacctgtctcct

SEQ ID NO: 4630109 - DNA, 17 bp, Homo sapiens
caggtatttcagaagga

SEQ ID NO: 4630110 - DNA, 19 bp, Homo sapiens
caggtatttcagaaggaga

SEQ ID NO: 4630111 - DNA, 20 bp, Homo sapiens
caggtattttgtttctttta

SEQ ID NO: 4630112 - DNA, 14 bp, Homo sapiens
caggtcaccaagca

SEQ ID NO: 4630113 - DNA, 19 bp, Homo sapiens
caggtcagcccatggaggc

SEQ ID NO: 4630114 - DNA, 20 bp, Homo sapiens
caggtcagcccatggaggca

SEQ ID NO: 4630115 - DNA, 13 bp, Homo sapiens
caggtcctggtgg

SEQ ID NO: 4630116 - DNA, 16 bp, Homo sapiens
caggtctcctgggaaa

SEQ ID NO: 4630117 - DNA, 22 bp, Homo sapiens
caggtctcctgggaaagggaga

SEQ ID NO: 4630118 - DNA, 14 bp, Homo sapiens
caggtgagaattca

SEQ ID NO: 4630119 - DNA, 14 bp, Homo sapiens
caggtgagggaagg

SEQ ID NO: 4630120 - DNA, 17 bp, Homo sapiens
caggtgagggaaggaga

SEQ ID NO: 4630121 - DNA, 22 bp, Homo sapiens
caggtgagggaaggagacagga

SEQ ID NO: 4630122 - DNA, 14 bp, Homo sapiens
caggtgatccgccc

SEQ ID NO: 4630123 - DNA, 15 bp, Homo sapiens
caggtgcaaccaggg

SEQ ID NO: 4630124 - DNA, 19 bp, Homo sapiens
caggtggaaggcagacagc

SEQ ID NO: 4630125 - DNA, 23 bp, Homo sapiens
caggtggcacttccacctccagc

SEQ ID NO: 4630126 - DNA, 15 bp, Homo sapiens
caggtgggcagacag

SEQ ID NO: 4630127 - DNA, 16 bp, Homo sapiens
caggtgggcagacagt

SEQ ID NO: 4630128 - DNA, 21 bp, Homo sapiens
caggtgttttttatgaagtgc

SEQ ID NO: 4630129 - DNA, 17 bp, Homo sapiens
caggttcccaagctcag

SEQ ID NO: 4630130 - DNA, 15 bp, Homo sapiens
caggttgatcttgaa

SEQ ID NO: 4630131 - DNA, 21 bp, Homo sapiens
cagtactaagggaacaatcca

SEQ ID NO: 4630132 - DNA, 18 bp, Homo sapiens
cagtactttggaaagcca

SEQ ID NO: 4630133 - DNA, 21 bp, Homo sapiens
cagtactttggaaagccaagg

SEQ ID NO: 4630134 - DNA, 18 bp, Homo sapiens
cagtactttgtgcattct

SEQ ID NO: 4630135 - DNA, 21 bp, Homo sapiens
cagtacttttttaaatatttt

SEQ ID NO: 4630136 - DNA, 11 bp, Homo sapiens
cagtagagaaa

SEQ ID NO: 4630137 - DNA, 16 bp, Homo sapiens
cagtagagaaacattt

SEQ ID NO: 4630138 - DNA, 12 bp, Homo sapiens
cagtagctctta

SEQ ID NO: 4630139 - DNA, 13 bp, Homo sapiens
cagtaggaccagg

SEQ ID NO: 4630140 - DNA, 16 bp, Homo sapiens
cagtaggaccaggcca

SEQ ID NO: 4630141 - DNA, 17 bp, Homo sapiens
cagtatttaactaatta

SEQ ID NO: 4630142 - DNA, 13 bp, Homo sapiens
cagtcacagccac

SEQ ID NO: 4630143 - DNA, 14 bp, Homo sapiens
cagtcacagccacc

SEQ ID NO: 4630144 - DNA, 18 bp, Homo sapiens
cagtcactgggagaggtt

SEQ ID NO: 4630145 - DNA, 18 bp, Homo sapiens
cagtcaggatgaggcccc

SEQ ID NO: 4630146 - DNA, 17 bp, Homo sapiens
cagtcatcatcagggcc

SEQ ID NO: 4630147 - DNA, 23 bp, Homo sapiens
cagtcatcatcagggcctggggc

SEQ ID NO: 4630148 - DNA, 22 bp, Homo sapiens
cagtcattcagcagcaaatttt

SEQ ID NO: 4630149 - DNA, 15 bp, Homo sapiens
cagtcccgcgtgcaa

SEQ ID NO: 4630150 - DNA, 12 bp, Homo sapiens
cagtcgtgatgt

SEQ ID NO: 4630151 - DNA, 15 bp, Homo sapiens
cagtctagtccgtcc

SEQ ID NO: 4630152 - DNA, 20 bp, Homo sapiens
cagtctagtccgtcctggca

SEQ ID NO: 4630153 - DNA, 22 bp, Homo sapiens
cagtctagtccgtcctggcaca

SEQ ID NO: 4630154 - DNA, 14 bp, Homo sapiens
cagtctcctctcca

SEQ ID NO: 4630155 - DNA, 18 bp, Homo sapiens
cagtctcctctccatttt

SEQ ID NO: 4630156 - DNA, 12 bp, Homo sapiens
cagtctgaccct

SEQ ID NO: 4630157 - DNA, 22 bp, Homo sapiens
cagtctgatccatccatctctc

SEQ ID NO: 4630158 - DNA, 17 bp, Homo sapiens
cagtcttgtattaagtt

SEQ ID NO: 4630159 - DNA, 15 bp, Homo sapiens
cagtctttcccccag

SEQ ID NO: 4630160 - DNA, 16 bp, Homo sapiens
cagtgaacaaatgtct

SEQ ID NO: 4630161 - DNA, 17 bp, Homo sapiens
cagtgaacttggctttc

SEQ ID NO: 4630162 - DNA, 24 bp, Homo sapiens
cagtgaaggtctttgttatgacag

SEQ ID NO: 4630163 - DNA, 14 bp, Homo sapiens
cagtgactcctgct

SEQ ID NO: 4630164 - DNA, 19 bp, Homo sapiens
cagtgcaaaatgtcttgtg

SEQ ID NO: 4630165 - DNA, 14 bp, Homo sapiens
cagtgcaacctctg

SEQ ID NO: 4630166 - DNA, 19 bp, Homo sapiens
cagtgcaacctctgcttcc

SEQ ID NO: 4630167 - DNA, 18 bp, Homo sapiens
cagtgcagtttcttttca

SEQ ID NO: 4630168 - DNA, 16 bp, Homo sapiens
cagtgcatcacatctg

SEQ ID NO: 4630169 - DNA, 12 bp, Homo sapiens
cagtgccaagga

SEQ ID NO: 4630170 - DNA, 18 bp, Homo sapiens
cagtgccatccccacctt

SEQ ID NO: 4630171 - DNA, 15 bp, Homo sapiens
cagtgcccatgtgta

SEQ ID NO: 4630172 - DNA, 17 bp, Homo sapiens
cagtgcccatgtgtaca

SEQ ID NO: 4630173 - DNA, 21 bp, Homo sapiens
cagtgcccggtgcagggcctg

SEQ ID NO: 4630174 - DNA, 22 bp, Homo sapiens
cagtgcccggtgcagggcctgg

SEQ ID NO: 4630175 - DNA, 13 bp, Homo sapiens
cagtgctgtctgg

SEQ ID NO: 4630176 - DNA, 17 bp, Homo sapiens
cagtggactctgaggac

SEQ ID NO: 4630177 - DNA, 16 bp, Homo sapiens
cagtggcaggggagca

SEQ ID NO: 4630178 - DNA, 17 bp, Homo sapiens
cagtggcaggggagcag

SEQ ID NO: 4630179 - DNA, 20 bp, Homo sapiens
cagtggcgcattctaggctc

SEQ ID NO: 4630180 - DNA, 18 bp, Homo sapiens
cagtggggctctctgagt

SEQ ID NO: 4630181 - DNA, 13 bp, Homo sapiens
cagtggggtcaag

SEQ ID NO: 4630182 - DNA, 18 bp, Homo sapiens
cagtggggtcaagctgag

SEQ ID NO: 4630183 - DNA, 19 bp, Homo sapiens
cagtggggtcaagctgagc

SEQ ID NO: 4630184 - DNA, 20 bp, Homo sapiens
cagtgggtctctgtgtgtgt

SEQ ID NO: 4630185 - DNA, 19 bp, Homo sapiens
cagtggtgcgatctcggct

SEQ ID NO: 4630186 - DNA, 17 bp, Homo sapiens
cagtgtcacttgactct

SEQ ID NO: 4630187 - DNA, 15 bp, Homo sapiens
cagtgtctagtttct

SEQ ID NO: 4630188 - DNA, 20 bp, Homo sapiens
cagtgtttcgtcatgttggc

SEQ ID NO: 4630189 - DNA, 16 bp, Homo sapiens
cagtgtttctgaatgt

SEQ ID NO: 4630190 - DNA, 20 bp, Homo sapiens
cagttacttatgatttaaaa

SEQ ID NO: 4630191 - DNA, 23 bp, Homo sapiens
cagttagagcccattaatcttga

SEQ ID NO: 4630192 - DNA, 15 bp, Homo sapiens
cagttattacatgta

SEQ ID NO: 4630193 - DNA, 14 bp, Homo sapiens
cagttcaactttca

SEQ ID NO: 4630194 - DNA, 19 bp, Homo sapiens
cagttcagagatcaggatc

SEQ ID NO: 4630195 - DNA, 23 bp, Homo sapiens
cagttcatcaccatttcctcctt

SEQ ID NO: 4630196 - DNA, 19 bp, Homo sapiens
cagttcatcgattttctat

SEQ ID NO: 4630197 - DNA, 21 bp, Homo sapiens
cagttcctatgacacagttat

SEQ ID NO: 4630198 - DNA, 14 bp, Homo sapiens
cagttcctgcagca

SEQ ID NO: 4630199 - DNA, 21 bp, Homo sapiens
cagttcctgcagcagagcctg

SEQ ID NO: 4630200 - DNA, 15 bp, Homo sapiens
cagttcctttagaaa

SEQ ID NO: 4630201 - DNA, 18 bp, Homo sapiens
cagttcgcagccaccctg

SEQ ID NO: 4630202 - DNA, 22 bp, Homo sapiens
cagttcgcagccaccctgagga

SEQ ID NO: 4630203 - DNA, 12 bp, Homo sapiens
cagttctctggg

SEQ ID NO: 4630204 - DNA, 13 bp, Homo sapiens
cagttctgtgtgg

SEQ ID NO: 4630205 - DNA, 13 bp, Homo sapiens
cagttgctgtgaa

SEQ ID NO: 4630206 - DNA, 17 bp, Homo sapiens
cagttggatctctggtt

SEQ ID NO: 4630207 - DNA, 21 bp, Homo sapiens
cagttgtcttatgtgaaaaat

SEQ ID NO: 4630208 - DNA, 20 bp, Homo sapiens
cagtttatttccactatttt

SEQ ID NO: 4630209 - DNA, 22 bp, Homo sapiens
cagtttcttgcttggaagccag

SEQ ID NO: 4630210 - DNA, 18 bp, Homo sapiens
cagtttgcacctgtcccc

SEQ ID NO: 4630211 - DNA, 21 bp, Homo sapiens
cagttttgtggattaaacctt

SEQ ID NO: 4630212 - DNA, 13 bp, Homo sapiens
cagtttttattaa

SEQ ID NO: 4630213 - DNA, 15 bp, Homo sapiens
cagtttttattgctt

SEQ ID NO: 4630214 - DNA, 21 bp, Homo sapiens
cataaaatagaataattcttt

SEQ ID NO: 4630215 - DNA, 22 bp, Homo sapiens
cataaaattttctactcttttt

SEQ ID NO: 4630216 - DNA, 11 bp, Homo sapiens
cataaagaagc

SEQ ID NO: 4630217 - DNA, 22 bp, Homo sapiens
cataaagccatgtttcctcttt

SEQ ID NO: 4630218 - DNA, 20 bp, Homo sapiens
cataaatcttcttattaaat

SEQ ID NO: 4630219 - DNA, 12 bp, Homo sapiens
cataaccccacc

SEQ ID NO: 4630220 - DNA, 20 bp, Homo sapiens
cataaccccacccttgccca

SEQ ID NO: 4630221 - DNA, 20 bp, Homo sapiens
cataactcacacccctgccc

SEQ ID NO: 4630222 - DNA, 13 bp, Homo sapiens
cataagatattct

SEQ ID NO: 4630223 - DNA, 21 bp, Homo sapiens
cataagatattctttacaaac

SEQ ID NO: 4630224 - DNA, 22 bp, Homo sapiens
cataagctatcacctagcagcc

SEQ ID NO: 4630225 - DNA, 19 bp, Homo sapiens
cataatcagtaaatagtgt

SEQ ID NO: 4630226 - DNA, 21 bp, Homo sapiens
cataattatgaaaactcatga

SEQ ID NO: 4630227 - DNA, 22 bp, Homo sapiens
cataattatgaaaactcatgat

SEQ ID NO: 4630228 - DNA, 16 bp, Homo sapiens
cataattcctacagca

SEQ ID NO: 4630229 - DNA, 12 bp, Homo sapiens
cataattttgca

SEQ ID NO: 4630230 - DNA, 14 bp, Homo sapiens
cataattttgcata

SEQ ID NO: 4630231 - DNA, 22 bp, Homo sapiens
cataattttgcatactgaaaat

SEQ ID NO: 4630232 - DNA, 17 bp, Homo sapiens
catacaagaaaatgtat

SEQ ID NO: 4630233 - DNA, 15 bp, Homo sapiens
catacagagtgggcc

SEQ ID NO: 4630234 - DNA, 22 bp, Homo sapiens
catacagagtgggccccgggct

SEQ ID NO: 4630235 - DNA, 22 bp, Homo sapiens
catacatgtatctggtttgtca

SEQ ID NO: 4630236 - DNA, 22 bp, Homo sapiens
cataccaattccaactttcagg

SEQ ID NO: 4630237 - DNA, 14 bp, Homo sapiens
cataccttctccca

SEQ ID NO: 4630238 - DNA, 15 bp, Homo sapiens
cataccttctcccag

SEQ ID NO: 4630239 - DNA, 13 bp, Homo sapiens
catactacccttt

SEQ ID NO: 4630240 - DNA, 24 bp, Homo sapiens
catagaaaacttgacatgtagctt

SEQ ID NO: 4630241 - DNA, 18 bp, Homo sapiens
catagagagggagaagaa

SEQ ID NO: 4630242 - DNA, 19 bp, Homo sapiens
catagagagggagaagaag

SEQ ID NO: 4630243 - DNA, 16 bp, Homo sapiens
catagagatgagccca

SEQ ID NO: 4630244 - DNA, 19 bp, Homo sapiens
catagcctaatccctgggc

SEQ ID NO: 4630245 - DNA, 18 bp, Homo sapiens
cataggtttctctccctc

SEQ ID NO: 4630246 - DNA, 21 bp, Homo sapiens
catagtatcttcactgtgtta

SEQ ID NO: 4630247 - DNA, 14 bp, Homo sapiens
catagtctttgttt

SEQ ID NO: 4630248 - DNA, 18 bp, Homo sapiens
catagtctttgtttacat

SEQ ID NO: 4630249 - DNA, 18 bp, Homo sapiens
catagttatgtgattttc

SEQ ID NO: 4630250 - DNA, 19 bp, Homo sapiens
catagttgagattgtactg

SEQ ID NO: 4630251 - DNA, 13 bp, Homo sapiens
catagttttctaa

SEQ ID NO: 4630252 - DNA, 14 bp, Homo sapiens
catatagagatgaa

SEQ ID NO: 4630253 - DNA, 20 bp, Homo sapiens
catatagagatgaagtttgt

SEQ ID NO: 4630254 - DNA, 17 bp, Homo sapiens
catatcagaataggaag

SEQ ID NO: 4630255 - DNA, 20 bp, Homo sapiens
catatgaattagccaaaaga

SEQ ID NO: 4630256 - DNA, 23 bp, Homo sapiens
catatgaccattgagtccctgct

SEQ ID NO: 4630257 - DNA, 19 bp, Homo sapiens
catatgaggacctttatat

SEQ ID NO: 4630258 - DNA, 13 bp, Homo sapiens
catatgatctgtt

SEQ ID NO: 4630259 - DNA, 16 bp, Homo sapiens
catatgcaccttgtgt

SEQ ID NO: 4630260 - DNA, 19 bp, Homo sapiens
catatgcaccttgtgtctg

SEQ ID NO: 4630261 - DNA, 21 bp, Homo sapiens
catatgcaccttgtgtctgta

SEQ ID NO: 4630262 - DNA, 23 bp, Homo sapiens
catatgcaccttgtgtctgtaca

SEQ ID NO: 4630263 - DNA, 22 bp, Homo sapiens
catatgccttggggaggacaaa

SEQ ID NO: 4630264 - DNA, 17 bp, Homo sapiens
catatggactctgcaca

SEQ ID NO: 4630265 - DNA, 13 bp, Homo sapiens
catatgtaaacat

SEQ ID NO: 4630266 - DNA, 14 bp, Homo sapiens
catatgtaaacata

SEQ ID NO: 4630267 - DNA, 15 bp, Homo sapiens
catatgtaaacataa

SEQ ID NO: 4630268 - DNA, 16 bp, Homo sapiens
catatgtcactagaat

SEQ ID NO: 4630269 - DNA, 22 bp, Homo sapiens
catatgtcttactactttaaat

SEQ ID NO: 4630270 - DNA, 17 bp, Homo sapiens
catatttactaccttat

SEQ ID NO: 4630271 - DNA, 17 bp, Homo sapiens
catatttataagagaag

SEQ ID NO: 4630272 - DNA, 16 bp, Homo sapiens
catatttgatttctaa

SEQ ID NO: 4630273 - DNA, 18 bp, Homo sapiens
catattttaatcattatt

SEQ ID NO: 4630274 - DNA, 17 bp, Homo sapiens
catattttagctgcacg

SEQ ID NO: 4630275 - DNA, 19 bp, Homo sapiens
catattttcttacttttat

SEQ ID NO: 4630276 - DNA, 14 bp, Homo sapiens
catcacatctgcac

SEQ ID NO: 4630277 - DNA, 19 bp, Homo sapiens
catcacatctgcacactct

SEQ ID NO: 4630278 - DNA, 22 bp, Homo sapiens
catcaccagtgccacgtcatga

SEQ ID NO: 4630279 - DNA, 18 bp, Homo sapiens
catcaccatttcctcctt

SEQ ID NO: 4630280 - DNA, 14 bp, Homo sapiens
catcacctactcac

SEQ ID NO: 4630281 - DNA, 21 bp, Homo sapiens
catcacctactcacacaggca

SEQ ID NO: 4630282 - DNA, 11 bp, Homo sapiens
catcagccctg

SEQ ID NO: 4630283 - DNA, 12 bp, Homo sapiens
catcagccctgc

SEQ ID NO: 4630284 - DNA, 13 bp, Homo sapiens
catcagccctgct

SEQ ID NO: 4630285 - DNA, 12 bp, Homo sapiens
catcagggcctg

SEQ ID NO: 4630286 - DNA, 13 bp, Homo sapiens
catcagggcctgg

SEQ ID NO: 4630287 - DNA, 15 bp, Homo sapiens
catcagggcctgggg

SEQ ID NO: 4630288 - DNA, 18 bp, Homo sapiens
catcagggcctggggcct

SEQ ID NO: 4630289 - DNA, 22 bp, Homo sapiens
catcagggcctggggcctgaga

SEQ ID NO: 4630290 - DNA, 20 bp, Homo sapiens
catcatagtaaaagaaatga

SEQ ID NO: 4630291 - DNA, 13 bp, Homo sapiens
catcatgcctctg

SEQ ID NO: 4630292 - DNA, 15 bp, Homo sapiens
catcatgcctctgag

SEQ ID NO: 4630293 - DNA, 18 bp, Homo sapiens
catcatgcctctgaggcc

SEQ ID NO: 4630294 - DNA, 22 bp, Homo sapiens
catcatgtggccccacccaatc

SEQ ID NO: 4630295 - DNA, 19 bp, Homo sapiens
catcattactgttccagat

SEQ ID NO: 4630296 - DNA, 18 bp, Homo sapiens
catcattgtcagccttgc

SEQ ID NO: 4630297 - DNA, 16 bp, Homo sapiens
catccaaagcagacag

SEQ ID NO: 4630298 - DNA, 21 bp, Homo sapiens
catccaaagcagacagctcca

SEQ ID NO: 4630299 - DNA, 20 bp, Homo sapiens
catccacaactaatgaggga

SEQ ID NO: 4630300 - DNA, 21 bp, Homo sapiens
catccacttacatatattttt

SEQ ID NO: 4630301 - DNA, 11 bp, Homo sapiens
catccagcagc

SEQ ID NO: 4630302 - DNA, 17 bp, Homo sapiens
catccagcagcagcact

SEQ ID NO: 4630303 - DNA, 18 bp, Homo sapiens
catccagcagcagcactt

SEQ ID NO: 4630304 - DNA, 21 bp, Homo sapiens
catccagggcccccatctcat

SEQ ID NO: 4630305 - DNA, 14 bp, Homo sapiens
catccatctctctc

SEQ ID NO: 4630306 - DNA, 19 bp, Homo sapiens
catccatctctctcttgcc

SEQ ID NO: 4630307 - DNA, 20 bp, Homo sapiens
catccatctctctcttgcct

SEQ ID NO: 4630308 - DNA, 18 bp, Homo sapiens
catccatgttccgagaag

SEQ ID NO: 4630309 - DNA, 17 bp, Homo sapiens
catccattaggccagca

SEQ ID NO: 4630310 - DNA, 15 bp, Homo sapiens
catcccactgactgt

SEQ ID NO: 4630311 - DNA, 18 bp, Homo sapiens
catcccagtttctcagaa

SEQ ID NO: 4630312 - DNA, 22 bp, Homo sapiens
catcccgtaagaccaccttccc

SEQ ID NO: 4630313 - DNA, 19 bp, Homo sapiens
catccctggagcaggagcc

SEQ ID NO: 4630314 - DNA, 20 bp, Homo sapiens
catccctggagcaggagccc

SEQ ID NO: 4630315 - DNA, 15 bp, Homo sapiens
catccctgggcctgc

SEQ ID NO: 4630316 - DNA, 17 bp, Homo sapiens
catccctgggcctgctg

SEQ ID NO: 4630317 - DNA, 20 bp, Homo sapiens
catccctgggcctgctgctg

SEQ ID NO: 4630318 - DNA, 17 bp, Homo sapiens
catcctcatccctgact

SEQ ID NO: 4630319 - DNA, 16 bp, Homo sapiens
catcctcccgccagga

SEQ ID NO: 4630320 - DNA, 18 bp, Homo sapiens
catcctcccgccaggagc

SEQ ID NO: 4630321 - DNA, 14 bp, Homo sapiens
catcctcttttaat

SEQ ID NO: 4630322 - DNA, 23 bp, Homo sapiens
catcctcttttaatggcatttct

SEQ ID NO: 4630323 - DNA, 13 bp, Homo sapiens
catcctgcccgag

SEQ ID NO: 4630324 - DNA, 20 bp, Homo sapiens
catcctggggcagcactccc

SEQ ID NO: 4630325 - DNA, 23 bp, Homo sapiens
catccttgactttgaactaatga

SEQ ID NO: 4630326 - DNA, 16 bp, Homo sapiens
catccttgcccaggtg

SEQ ID NO: 4630327 - DNA, 20 bp, Homo sapiens
catctaaattctgataattt

SEQ ID NO: 4630328 - DNA, 19 bp, Homo sapiens
catctaagcattccacact

SEQ ID NO: 4630329 - DNA, 19 bp, Homo sapiens
catctagggaatgggactg

SEQ ID NO: 4630330 - DNA, 13 bp, Homo sapiens
catctatcactgc

SEQ ID NO: 4630331 - DNA, 17 bp, Homo sapiens
catctcacctcctgctg

SEQ ID NO: 4630332 - DNA, 18 bp, Homo sapiens
catctcacctcctgctgg

SEQ ID NO: 4630333 - DNA, 16 bp, Homo sapiens
catctcagcttttgat

SEQ ID NO: 4630334 - DNA, 22 bp, Homo sapiens
catctcaggagatggagggctt

SEQ ID NO: 4630335 - DNA, 15 bp, Homo sapiens
catctcccttccacc

SEQ ID NO: 4630336 - DNA, 16 bp, Homo sapiens
catctcccttccacct

SEQ ID NO: 4630337 - DNA, 20 bp, Homo sapiens
catctcccttccacctcaca

SEQ ID NO: 4630338 - DNA, 20 bp, Homo sapiens
catctctcccttacccatct

SEQ ID NO: 4630339 - DNA, 22 bp, Homo sapiens
catctcttgaaacctgttaaaa

SEQ ID NO: 4630340 - DNA, 15 bp, Homo sapiens
catctctttgaattt

SEQ ID NO: 4630341 - DNA, 14 bp, Homo sapiens
catctctttgtaca

SEQ ID NO: 4630342 - DNA, 13 bp, Homo sapiens
catctgactgcca

SEQ ID NO: 4630343 - DNA, 16 bp, Homo sapiens
catctgactgccaagc

SEQ ID NO: 4630344 - DNA, 20 bp, Homo sapiens
catctgactgccaagccaga

SEQ ID NO: 4630345 - DNA, 22 bp, Homo sapiens
catctgcaaaaggcctcttgta

SEQ ID NO: 4630346 - DNA, 15 bp, Homo sapiens
catctgcacactctc

SEQ ID NO: 4630347 - DNA, 21 bp, Homo sapiens
catctggaaggggatcccacc

SEQ ID NO: 4630348 - DNA, 17 bp, Homo sapiens
catctgggctcctccag

SEQ ID NO: 4630349 - DNA, 18 bp, Homo sapiens
catctgtaatcctagcta

SEQ ID NO: 4630350 - DNA, 18 bp, Homo sapiens
catctgtctgctctgcat

SEQ ID NO: 4630351 - DNA, 14 bp, Homo sapiens
catctgtgcaccac

SEQ ID NO: 4630352 - DNA, 15 bp, Homo sapiens
catctgtggagctgc

SEQ ID NO: 4630353 - DNA, 14 bp, Homo sapiens
catcttaatcttta

SEQ ID NO: 4630354 - DNA, 15 bp, Homo sapiens
catcttacttgtcct

SEQ ID NO: 4630355 - DNA, 15 bp, Homo sapiens
catcttcatataaac

SEQ ID NO: 4630356 - DNA, 14 bp, Homo sapiens
catcttcccaaccc

SEQ ID NO: 4630357 - DNA, 14 bp, Homo sapiens
catcttgcttccaa

SEQ ID NO: 4630358 - DNA, 18 bp, Homo sapiens
catcttggggacatctct

SEQ ID NO: 4630359 - DNA, 20 bp, Homo sapiens
catcttggggacatctcttt

SEQ ID NO: 4630360 - DNA, 20 bp, Homo sapiens
catcttgtttcatttgcttg

SEQ ID NO: 4630361 - DNA, 14 bp, Homo sapiens
catctttaattcct

SEQ ID NO: 4630362 - DNA, 22 bp, Homo sapiens
catctttgtgaaggcctcgcag

SEQ ID NO: 4630363 - DNA, 16 bp, Homo sapiens
catctttttcttgggt

SEQ ID NO: 4630364 - DNA, 17 bp, Homo sapiens
catctttttcttgggtg

SEQ ID NO: 4630365 - DNA, 18 bp, Homo sapiens
catgaactcatcattttt

SEQ ID NO: 4630366 - DNA, 15 bp, Homo sapiens
catgaagctgttgtg

SEQ ID NO: 4630367 - DNA, 18 bp, Homo sapiens
catgaataacatttaaat

SEQ ID NO: 4630368 - DNA, 19 bp, Homo sapiens
catgaataacatttaaatt

SEQ ID NO: 4630369 - DNA, 22 bp, Homo sapiens
catgaataacatttaaattcca

SEQ ID NO: 4630370 - DNA, 14 bp, Homo sapiens
catgaattcatact

SEQ ID NO: 4630371 - DNA, 18 bp, Homo sapiens
catgaattcatactctgt

SEQ ID NO: 4630372 - DNA, 20 bp, Homo sapiens
catgaattcatactctgttg

SEQ ID NO: 4630373 - DNA, 23 bp, Homo sapiens
catgaattcatactctgttgcct

SEQ ID NO: 4630374 - DNA, 17 bp, Homo sapiens
catgaccacatagcatg

SEQ ID NO: 4630375 - DNA, 14 bp, Homo sapiens
catgacctccagct

SEQ ID NO: 4630376 - DNA, 22 bp, Homo sapiens
catgacctccagctttcctgta

SEQ ID NO: 4630377 - DNA, 22 bp, Homo sapiens
catgacgccagataaaatgttc

SEQ ID NO: 4630378 - DNA, 16 bp, Homo sapiens
catgactgtcgccaca

SEQ ID NO: 4630379 - DNA, 15 bp, Homo sapiens
catgagactgccctg

SEQ ID NO: 4630380 - DNA, 21 bp, Homo sapiens
catgagactgccctgcccagg

SEQ ID NO: 4630381 - DNA, 19 bp, Homo sapiens
catgagatcagggcctgcc

SEQ ID NO: 4630382 - DNA, 20 bp, Homo sapiens
catgagatcagggcctgccc

SEQ ID NO: 4630383 - DNA, 22 bp, Homo sapiens
catgagatcagggcctgccccc

SEQ ID NO: 4630384 - DNA, 16 bp, Homo sapiens
catgagccttcagtca

SEQ ID NO: 4630385 - DNA, 21 bp, Homo sapiens
catgagcgtcaaagaaaatgc

SEQ ID NO: 4630386 - DNA, 13 bp, Homo sapiens
catgagctcctga

SEQ ID NO: 4630387 - DNA, 16 bp, Homo sapiens
catgagctcctgatca

SEQ ID NO: 4630388 - DNA, 20 bp, Homo sapiens
catgagctcctgatcagagg

SEQ ID NO: 4630389 - DNA, 21 bp, Homo sapiens
catgagctcctgatcagaggc

SEQ ID NO: 4630390 - DNA, 20 bp, Homo sapiens
catgagctgatcagcctgtg

SEQ ID NO: 4630391 - DNA, 22 bp, Homo sapiens
catgagtctgtttcccaagcta

SEQ ID NO: 4630392 - DNA, 16 bp, Homo sapiens
catgatactgctgctt

SEQ ID NO: 4630393 - DNA, 21 bp, Homo sapiens
catgatactgctgcttgtcaa

SEQ ID NO: 4630394 - DNA, 22 bp, Homo sapiens
catgatactgctgcttgtcaaa

SEQ ID NO: 4630395 - DNA, 20 bp, Homo sapiens
catgatcaagatatatgtgt

SEQ ID NO: 4630396 - DNA, 17 bp, Homo sapiens
catgatggcaacagaaa

SEQ ID NO: 4630397 - DNA, 20 bp, Homo sapiens
catgatgggaggtgtgccag

SEQ ID NO: 4630398 - DNA, 22 bp, Homo sapiens
catgatgtgaagagtttcacaa

SEQ ID NO: 4630399 - DNA, 15 bp, Homo sapiens
catgatgtttccctc

SEQ ID NO: 4630400 - DNA, 16 bp, Homo sapiens
catgcaacagaagtga

SEQ ID NO: 4630401 - DNA, 16 bp, Homo sapiens
catgcaccctcataca

SEQ ID NO: 4630402 - DNA, 20 bp, Homo sapiens
catgcaccctcatacacaga

SEQ ID NO: 4630403 - DNA, 15 bp, Homo sapiens
catgcatactttatt

SEQ ID NO: 4630404 - DNA, 16 bp, Homo sapiens
catgcatactttattg

SEQ ID NO: 4630405 - DNA, 13 bp, Homo sapiens
catgccccagtcg

SEQ ID NO: 4630406 - DNA, 15 bp, Homo sapiens
catgcccctggctgg

SEQ ID NO: 4630407 - DNA, 16 bp, Homo sapiens
catgcccctggctggg

SEQ ID NO: 4630408 - DNA, 18 bp, Homo sapiens
catgccctgtgcaacctc

SEQ ID NO: 4630409 - DNA, 19 bp, Homo sapiens
catgccctgtgcaacctct

SEQ ID NO: 4630410 - DNA, 23 bp, Homo sapiens
catgccctgtgcaacctcttggc

SEQ ID NO: 4630411 - DNA, 18 bp, Homo sapiens
catgcctcactaattttt

SEQ ID NO: 4630412 - DNA, 15 bp, Homo sapiens
catgcctctgaggcc

SEQ ID NO: 4630413 - DNA, 18 bp, Homo sapiens
catgcctggtattttcaa

SEQ ID NO: 4630414 - DNA, 16 bp, Homo sapiens
catgcctgtcctttca

SEQ ID NO: 4630415 - DNA, 21 bp, Homo sapiens
catgcctgtcctttcagtctg

SEQ ID NO: 4630416 - DNA, 16 bp, Homo sapiens
catgcggtagccagca

SEQ ID NO: 4630417 - DNA, 17 bp, Homo sapiens
catgcggtagccagcac

SEQ ID NO: 4630418 - DNA, 21 bp, Homo sapiens
catgcggtagccagcacacag

SEQ ID NO: 4630419 - DNA, 22 bp, Homo sapiens
catgcgtgggtggggagggagg

SEQ ID NO: 4630420 - DNA, 23 bp, Homo sapiens
catgcgtgggtggggagggaggt

SEQ ID NO: 4630421 - DNA, 21 bp, Homo sapiens
catgctatgttctgtcttccc

SEQ ID NO: 4630422 - DNA, 22 bp, Homo sapiens
catgctatttgttcttcaagaa

SEQ ID NO: 4630423 - DNA, 13 bp, Homo sapiens
catgctcccaact

SEQ ID NO: 4630424 - DNA, 15 bp, Homo sapiens
catgctcccaactcc

SEQ ID NO: 4630425 - DNA, 13 bp, Homo sapiens
catgctgcagtgg

SEQ ID NO: 4630426 - DNA, 19 bp, Homo sapiens
catgctgggccactgggga

SEQ ID NO: 4630427 - DNA, 14 bp, Homo sapiens
catgctgtgcattt

SEQ ID NO: 4630428 - DNA, 18 bp, Homo sapiens
catgcttgggctgaccca

SEQ ID NO: 4630429 - DNA, 23 bp, Homo sapiens
catgcttgggctgacccagcatc

SEQ ID NO: 4630430 - DNA, 15 bp, Homo sapiens
catgcttttctgcca

SEQ ID NO: 4630431 - DNA, 22 bp, Homo sapiens
catggaggcagatgcccttgct

SEQ ID NO: 4630432 - DNA, 17 bp, Homo sapiens
catggaggccctcctgt

SEQ ID NO: 4630433 - DNA, 20 bp, Homo sapiens
catggaggccctcctgtgct

SEQ ID NO: 4630434 - DNA, 18 bp, Homo sapiens
catggagtagcctggact

SEQ ID NO: 4630435 - DNA, 13 bp, Homo sapiens
catggatggctca

SEQ ID NO: 4630436 - DNA, 22 bp, Homo sapiens
catggatgttttagccattgtt

SEQ ID NO: 4630437 - DNA, 18 bp, Homo sapiens
catggccaccttttcagc

SEQ ID NO: 4630438 - DNA, 19 bp, Homo sapiens
catggccagactcccttgc

SEQ ID NO: 4630439 - DNA, 19 bp, Homo sapiens
catggcctatgcacatatg

SEQ ID NO: 4630440 - DNA, 15 bp, Homo sapiens
catggcggcacacat

SEQ ID NO: 4630441 - DNA, 18 bp, Homo sapiens
catggcggcacacatctg

SEQ ID NO: 4630442 - DNA, 18 bp, Homo sapiens
catggctaatttaacacc

SEQ ID NO: 4630443 - DNA, 17 bp, Homo sapiens
catggctgtgtttgcag

SEQ ID NO: 4630444 - DNA, 20 bp, Homo sapiens
catggctgtgtttgcagcct

SEQ ID NO: 4630445 - DNA, 18 bp, Homo sapiens
catgggacctataactgc

SEQ ID NO: 4630446 - DNA, 22 bp, Homo sapiens
catggggattgcagagtgacca

SEQ ID NO: 4630447 - DNA, 15 bp, Homo sapiens
catgggtccagaaga

SEQ ID NO: 4630448 - DNA, 23 bp, Homo sapiens
catgggtctggctagagggccca

SEQ ID NO: 4630449 - DNA, 15 bp, Homo sapiens
catggtacttcctct

SEQ ID NO: 4630450 - DNA, 17 bp, Homo sapiens
catggtacttcctctgt

SEQ ID NO: 4630451 - DNA, 19 bp, Homo sapiens
catggtcaagcctcttatg

SEQ ID NO: 4630452 - DNA, 15 bp, Homo sapiens
catggtcccacatcc

SEQ ID NO: 4630453 - DNA, 19 bp, Homo sapiens
catggtcccacatccctgg

SEQ ID NO: 4630454 - DNA, 13 bp, Homo sapiens
catggtgttgcgt

SEQ ID NO: 4630455 - DNA, 16 bp, Homo sapiens
catgtaaagaaatgtc

SEQ ID NO: 4630456 - DNA, 21 bp, Homo sapiens
catgtaaagaaatgtcttaat

SEQ ID NO: 4630457 - DNA, 17 bp, Homo sapiens
catgtaaccactgcact

SEQ ID NO: 4630458 - DNA, 15 bp, Homo sapiens
catgtataaatgtga

SEQ ID NO: 4630459 - DNA, 19 bp, Homo sapiens
catgtctgtatccccagtg

SEQ ID NO: 4630460 - DNA, 21 bp, Homo sapiens
catgtctgtatccccagtgcc

SEQ ID NO: 4630461 - DNA, 22 bp, Homo sapiens
catgtctgtatccccagtgccc

SEQ ID NO: 4630462 - DNA, 14 bp, Homo sapiens
catgtctgttcttc

SEQ ID NO: 4630463 - DNA, 13 bp, Homo sapiens
catgtcttgtaca

SEQ ID NO: 4630464 - DNA, 23 bp, Homo sapiens
catgtcttgtacatgtgtagcct

SEQ ID NO: 4630465 - DNA, 17 bp, Homo sapiens
catgtgactctgaagct

SEQ ID NO: 4630466 - DNA, 12 bp, Homo sapiens
catgtgattaat

SEQ ID NO: 4630467 - DNA, 22 bp, Homo sapiens
catgtgtacattctgcctagag

SEQ ID NO: 4630468 - DNA, 14 bp, Homo sapiens
catgtgtagcctgt

SEQ ID NO: 4630469 - DNA, 18 bp, Homo sapiens
catgtgtatattcctttt

SEQ ID NO: 4630470 - DNA, 14 bp, Homo sapiens
catgtgtgcagagc

SEQ ID NO: 4630471 - DNA, 16 bp, Homo sapiens
catgtgtgcagagcag

SEQ ID NO: 4630472 - DNA, 12 bp, Homo sapiens
catgtgtggaaa

SEQ ID NO: 4630473 - DNA, 18 bp, Homo sapiens
catgttacttctctgagt

SEQ ID NO: 4630474 - DNA, 20 bp, Homo sapiens
catgttagtaatggcagagc

SEQ ID NO: 4630475 - DNA, 13 bp, Homo sapiens
catgttgatttct

SEQ ID NO: 4630476 - DNA, 21 bp, Homo sapiens
catgttggccaggctggtctt

SEQ ID NO: 4630477 - DNA, 21 bp, Homo sapiens
catgttggccaggctggtttc

SEQ ID NO: 4630478 - DNA, 13 bp, Homo sapiens
catgttgtgcctc

SEQ ID NO: 4630479 - DNA, 19 bp, Homo sapiens
catgtttaatgtgaactct

SEQ ID NO: 4630480 - DNA, 16 bp, Homo sapiens
catgttttaacaaaaa

SEQ ID NO: 4630481 - DNA, 17 bp, Homo sapiens
catgttttaacaaaaac

SEQ ID NO: 4630482 - DNA, 15 bp, Homo sapiens
cattaaaatgacaaa

SEQ ID NO: 4630483 - DNA, 18 bp, Homo sapiens
cattaaaatgacaaacat

SEQ ID NO: 4630484 - DNA, 22 bp, Homo sapiens
cattaaaatgacaaacatgata

SEQ ID NO: 4630485 - DNA, 21 bp, Homo sapiens
cattaaaggcttctctctcac

SEQ ID NO: 4630486 - DNA, 15 bp, Homo sapiens
cattaacattttgag

SEQ ID NO: 4630487 - DNA, 16 bp, Homo sapiens
cattaacattttgagc

SEQ ID NO: 4630488 - DNA, 13 bp, Homo sapiens
cattaacattttt

SEQ ID NO: 4630489 - DNA, 13 bp, Homo sapiens
cattaactccctc

SEQ ID NO: 4630490 - DNA, 19 bp, Homo sapiens
cattaactccctccaccag

SEQ ID NO: 4630491 - DNA, 21 bp, Homo sapiens
cattaactccctccaccagcc

SEQ ID NO: 4630492 - DNA, 22 bp, Homo sapiens
cattaactccctccaccagcct

SEQ ID NO: 4630493 - DNA, 20 bp, Homo sapiens
cattaatcttgatcattccg

SEQ ID NO: 4630494 - DNA, 16 bp, Homo sapiens
cattaatggcatatgg

SEQ ID NO: 4630495 - DNA, 17 bp, Homo sapiens
cattaatttcaaaattt

SEQ ID NO: 4630496 - DNA, 21 bp, Homo sapiens
cattacagggcacaggccatg

SEQ ID NO: 4630497 - DNA, 11 bp, Homo sapiens
cattacttgaa

SEQ ID NO: 4630498 - DNA, 15 bp, Homo sapiens
cattacttgaatgta

SEQ ID NO: 4630499 - DNA, 18 bp, Homo sapiens
cattacttgctttcaatt

SEQ ID NO: 4630500 - DNA, 19 bp, Homo sapiens
cattagccagatttgtctt

SEQ ID NO: 4630501 - DNA, 18 bp, Homo sapiens
cattagtatagtctccct

SEQ ID NO: 4630502 - DNA, 20 bp, Homo sapiens
cattagtatagtctcccttt

SEQ ID NO: 4630503 - DNA, 14 bp, Homo sapiens
cattatcttgctca

SEQ ID NO: 4630504 - DNA, 13 bp, Homo sapiens
cattatgaagaat

SEQ ID NO: 4630505 - DNA, 14 bp, Homo sapiens
cattatgacatttc

SEQ ID NO: 4630506 - DNA, 20 bp, Homo sapiens
cattatgacatttcttaaaa

SEQ ID NO: 4630507 - DNA, 15 bp, Homo sapiens
cattatgttcatgta

SEQ ID NO: 4630508 - DNA, 12 bp, Homo sapiens
cattattctctt

SEQ ID NO: 4630509 - DNA, 15 bp, Homo sapiens
cattattctctttta

SEQ ID NO: 4630510 - DNA, 17 bp, Homo sapiens
cattatttattaaaaat

SEQ ID NO: 4630511 - DNA, 20 bp, Homo sapiens
cattatttattaaaaatgtt

SEQ ID NO: 4630512 - DNA, 21 bp, Homo sapiens
cattatttattaaaaatgttc

SEQ ID NO: 4630513 - DNA, 21 bp, Homo sapiens
cattcaattagtggtcataaa

SEQ ID NO: 4630514 - DNA, 19 bp, Homo sapiens
cattcacctgccccaactc

SEQ ID NO: 4630515 - DNA, 13 bp, Homo sapiens
cattcagaaaaaa

SEQ ID NO: 4630516 - DNA, 13 bp, Homo sapiens
cattcatttttat

SEQ ID NO: 4630517 - DNA, 15 bp, Homo sapiens
cattccatctagttt

SEQ ID NO: 4630518 - DNA, 13 bp, Homo sapiens
cattccattgcct

SEQ ID NO: 4630519 - DNA, 16 bp, Homo sapiens
cattccattgcctagc

SEQ ID NO: 4630520 - DNA, 21 bp, Homo sapiens
cattccattgcctagctcttt

SEQ ID NO: 4630521 - DNA, 12 bp, Homo sapiens
cattcccacccc

SEQ ID NO: 4630522 - DNA, 15 bp, Homo sapiens
cattcctgcctttaa

SEQ ID NO: 4630523 - DNA, 15 bp, Homo sapiens
cattcgtgagctggg

SEQ ID NO: 4630524 - DNA, 19 bp, Homo sapiens
cattcgtgagctggggact

SEQ ID NO: 4630525 - DNA, 23 bp, Homo sapiens
cattcgtgagctggggactcagg

SEQ ID NO: 4630526 - DNA, 15 bp, Homo sapiens
cattctaatgcatat

SEQ ID NO: 4630527 - DNA, 19 bp, Homo sapiens
cattctacagttgtgataa

SEQ ID NO: 4630528 - DNA, 20 bp, Homo sapiens
cattctagataaccttgttt

SEQ ID NO: 4630529 - DNA, 19 bp, Homo sapiens
cattctcataattcctaca

SEQ ID NO: 4630530 - DNA, 17 bp, Homo sapiens
cattctccacagcaacc

SEQ ID NO: 4630531 - DNA, 21 bp, Homo sapiens
cattctctcccatcctggggc

SEQ ID NO: 4630532 - DNA, 14 bp, Homo sapiens
cattctgcctagag

SEQ ID NO: 4630533 - DNA, 19 bp, Homo sapiens
cattcttttgccacatccc

SEQ ID NO: 4630534 - DNA, 18 bp, Homo sapiens
cattgaagccgactctgg

SEQ ID NO: 4630535 - DNA, 21 bp, Homo sapiens
cattgacataggtcataaagc

SEQ ID NO: 4630536 - DNA, 20 bp, Homo sapiens
cattgacctggaggggagag

SEQ ID NO: 4630537 - DNA, 21 bp, Homo sapiens
cattgacctggaggggagagg

SEQ ID NO: 4630538 - DNA, 23 bp, Homo sapiens
cattgacctggaggggagaggtc

SEQ ID NO: 4630539 - DNA, 20 bp, Homo sapiens
cattgactttcagtaaacat

SEQ ID NO: 4630540 - DNA, 22 bp, Homo sapiens
cattgactttcagtaaacataa

SEQ ID NO: 4630541 - DNA, 17 bp, Homo sapiens
cattgatcataaactga

SEQ ID NO: 4630542 - DNA, 12 bp, Homo sapiens
cattgcactttc

SEQ ID NO: 4630543 - DNA, 13 bp, Homo sapiens
cattgcactttcc

SEQ ID NO: 4630544 - DNA, 15 bp, Homo sapiens
cattgcactttcctt

SEQ ID NO: 4630545 - DNA, 18 bp, Homo sapiens
cattgcactttcctttca

SEQ ID NO: 4630546 - DNA, 13 bp, Homo sapiens
cattgcagcttca

SEQ ID NO: 4630547 - DNA, 23 bp, Homo sapiens
cattgctgccaaggtggagggaa

SEQ ID NO: 4630548 - DNA, 15 bp, Homo sapiens
cattgctttctgaaa

SEQ ID NO: 4630549 - DNA, 21 bp, Homo sapiens
cattggacagaaaatgcaatg

SEQ ID NO: 4630550 - DNA, 23 bp, Homo sapiens
cattgggcagcgcccttcctctc

SEQ ID NO: 4630551 - DNA, 14 bp, Homo sapiens
cattgtacaagtat

SEQ ID NO: 4630552 - DNA, 18 bp, Homo sapiens
cattgtacaagtattaca

SEQ ID NO: 4630553 - DNA, 22 bp, Homo sapiens
cattgtcgtataggcatgtaaa

SEQ ID NO: 4630554 - DNA, 14 bp, Homo sapiens
cattgtttgaaaca

SEQ ID NO: 4630555 - DNA, 18 bp, Homo sapiens
cattgtttgaaacaaaga

SEQ ID NO: 4630556 - DNA, 20 bp, Homo sapiens
cattgtttgaaacaaagaag

SEQ ID NO: 4630557 - DNA, 18 bp, Homo sapiens
cattgttttcttttacag

SEQ ID NO: 4630558 - DNA, 13 bp, Homo sapiens
catttaaattcca

SEQ ID NO: 4630559 - DNA, 14 bp, Homo sapiens
catttacaacccgg

SEQ ID NO: 4630560 - DNA, 19 bp, Homo sapiens
catttagagggtgaaggag

SEQ ID NO: 4630561 - DNA, 20 bp, Homo sapiens
catttagagggtgaaggaga

SEQ ID NO: 4630562 - DNA, 12 bp, Homo sapiens
catttagataat

SEQ ID NO: 4630563 - DNA, 16 bp, Homo sapiens
catttcacaggctaat

SEQ ID NO: 4630564 - DNA, 17 bp, Homo sapiens
catttcatgaaaaagct

SEQ ID NO: 4630565 - DNA, 20 bp, Homo sapiens
catttcatgaaaaagctgct

SEQ ID NO: 4630566 - DNA, 13 bp, Homo sapiens
catttcattccat

SEQ ID NO: 4630567 - DNA, 21 bp, Homo sapiens
catttcattccattgcctagc

SEQ ID NO: 4630568 - DNA, 21 bp, Homo sapiens
catttccagcttctcagtttc

SEQ ID NO: 4630569 - DNA, 19 bp, Homo sapiens
catttcctgagaccacaga

SEQ ID NO: 4630570 - DNA, 12 bp, Homo sapiens
catttcctgggt

SEQ ID NO: 4630571 - DNA, 20 bp, Homo sapiens
catttcctgggtggctactc

SEQ ID NO: 4630572 - DNA, 21 bp, Homo sapiens
catttcctgggtggctactct

SEQ ID NO: 4630573 - DNA, 12 bp, Homo sapiens
catttctcatgt

SEQ ID NO: 4630574 - DNA, 13 bp, Homo sapiens
catttctctttaa

SEQ ID NO: 4630575 - DNA, 14 bp, Homo sapiens
catttctctttaaa

SEQ ID NO: 4630576 - DNA, 13 bp, Homo sapiens
catttgagcagct

SEQ ID NO: 4630577 - DNA, 14 bp, Homo sapiens
catttgagcagctg

SEQ ID NO: 4630578 - DNA, 15 bp, Homo sapiens
catttgagcagctga

SEQ ID NO: 4630579 - DNA, 20 bp, Homo sapiens
catttgatgcatgtctttta

SEQ ID NO: 4630580 - DNA, 19 bp, Homo sapiens
catttggaaaagacagaaa

SEQ ID NO: 4630581 - DNA, 13 bp, Homo sapiens
catttggaggaat

SEQ ID NO: 4630582 - DNA, 21 bp, Homo sapiens
catttgtgctagaaattttca

SEQ ID NO: 4630583 - DNA, 20 bp, Homo sapiens
catttgtttacatttgatgc

SEQ ID NO: 4630584 - DNA, 17 bp, Homo sapiens
cattttaaaaactttat

SEQ ID NO: 4630585 - DNA, 20 bp, Homo sapiens
cattttaaaaactttattgg

SEQ ID NO: 4630586 - DNA, 12 bp, Homo sapiens
cattttagccca

SEQ ID NO: 4630587 - DNA, 18 bp, Homo sapiens
cattttatcattaaaaat

SEQ ID NO: 4630588 - DNA, 20 bp, Homo sapiens
cattttatcattaaaaatta

SEQ ID NO: 4630589 - DNA, 22 bp, Homo sapiens
cattttattcacatatgtctta

SEQ ID NO: 4630590 - DNA, 11 bp, Homo sapiens
cattttattct

SEQ ID NO: 4630591 - DNA, 17 bp, Homo sapiens
cattttattttgtaata

SEQ ID NO: 4630592 - DNA, 21 bp, Homo sapiens
cattttcccccactactgcag

SEQ ID NO: 4630593 - DNA, 23 bp, Homo sapiens
cattttctaaataaaaatatgta

SEQ ID NO: 4630594 - DNA, 14 bp, Homo sapiens
cattttctcttaga

SEQ ID NO: 4630595 - DNA, 18 bp, Homo sapiens
cattttgagctatttcct

SEQ ID NO: 4630596 - DNA, 13 bp, Homo sapiens
cattttgtaaaat

SEQ ID NO: 4630597 - DNA, 19 bp, Homo sapiens
cattttgtggaattttgag

SEQ ID NO: 4630598 - DNA, 21 bp, Homo sapiens
catttttaagatagaacacaa

SEQ ID NO: 4630599 - DNA, 18 bp, Homo sapiens
catttttcagatataaaa

SEQ ID NO: 4630600 - DNA, 17 bp, Homo sapiens
catttttgcttcctagt

SEQ ID NO: 4630601 - DNA, 11 bp, Homo sapiens
catttttgtaa

SEQ ID NO: 4630602 - DNA, 14 bp, Homo sapiens
cattttttaggaca

SEQ ID NO: 4630603 - DNA, 21 bp, Homo sapiens
cattttttataattttctaag

SEQ ID NO: 4630604 - DNA, 13 bp, Homo sapiens
cattttttcagtc

SEQ ID NO: 4630605 - DNA, 14 bp, Homo sapiens
cattttttttttca

SEQ ID NO: 4630606 - DNA, 19 bp, Homo sapiens
ccaaaaatgtgtaagaaca

SEQ ID NO: 4630607 - DNA, 18 bp, Homo sapiens
ccaaacagcaagaagctg

SEQ ID NO: 4630608 - DNA, 17 bp, Homo sapiens
ccaaacctctgttcagt

SEQ ID NO: 4630609 - DNA, 14 bp, Homo sapiens
ccaaacctgtcttg

SEQ ID NO: 4630610 - DNA, 14 bp, Homo sapiens
ccaaactgttctga

SEQ ID NO: 4630611 - DNA, 21 bp, Homo sapiens
ccaaactgttctgagaaggtg

SEQ ID NO: 4630612 - DNA, 16 bp, Homo sapiens
ccaaacttgttcattt

SEQ ID NO: 4630613 - DNA, 15 bp, Homo sapiens
ccaaagaaacaagct

SEQ ID NO: 4630614 - DNA, 19 bp, Homo sapiens
ccaaagaaacaagctgtgc

SEQ ID NO: 4630615 - DNA, 20 bp, Homo sapiens
ccaaagaaacaagctgtgca

SEQ ID NO: 4630616 - DNA, 14 bp, Homo sapiens
ccaaagcagacagc

SEQ ID NO: 4630617 - DNA, 17 bp, Homo sapiens
ccaaagcctgaggacag

SEQ ID NO: 4630618 - DNA, 22 bp, Homo sapiens
ccaaagcctgaggacagaaaga

SEQ ID NO: 4630619 - DNA, 16 bp, Homo sapiens
ccaaagcggtccctgt

SEQ ID NO: 4630620 - DNA, 17 bp, Homo sapiens
ccaaagcttgtaaatat

SEQ ID NO: 4630621 - DNA, 20 bp, Homo sapiens
ccaaaggaaccgcccagtgc

SEQ ID NO: 4630622 - DNA, 20 bp, Homo sapiens
ccaaagggatggtattgaga

SEQ ID NO: 4630623 - DNA, 22 bp, Homo sapiens
ccaaaggtaagttgctattttc

SEQ ID NO: 4630624 - DNA, 19 bp, Homo sapiens
ccaaagtggtatagaaatg

SEQ ID NO: 4630625 - DNA, 17 bp, Homo sapiens
ccaaatccgaacctcct

SEQ ID NO: 4630626 - DNA, 19 bp, Homo sapiens
ccaaatccgccagtgtttc

SEQ ID NO: 4630627 - DNA, 17 bp, Homo sapiens
ccaacaccaagcacagc

SEQ ID NO: 4630628 - DNA, 21 bp, Homo sapiens
ccaacacgcacctgcctcagg

SEQ ID NO: 4630629 - DNA, 21 bp, Homo sapiens
ccaacatgcactgatgttgtg

SEQ ID NO: 4630630 - DNA, 20 bp, Homo sapiens
ccaaccagcccgacagtgcc

SEQ ID NO: 4630631 - DNA, 22 bp, Homo sapiens
ccaaccagcccgacagtgccat

SEQ ID NO: 4630632 - DNA, 17 bp, Homo sapiens
ccaaccagtgccaagga

SEQ ID NO: 4630633 - DNA, 18 bp, Homo sapiens
ccaaccagtgccaaggac

SEQ ID NO: 4630634 - DNA, 14 bp, Homo sapiens
ccaacccgtggagg

SEQ ID NO: 4630635 - DNA, 19 bp, Homo sapiens
ccaaccctgggctggggag

SEQ ID NO: 4630636 - DNA, 22 bp, Homo sapiens
ccaacctctgttccccacccag

SEQ ID NO: 4630637 - DNA, 21 bp, Homo sapiens
ccaacctgttcttagagtgta

SEQ ID NO: 4630638 - DNA, 23 bp, Homo sapiens
ccaaccttgctcttggggaaggg

SEQ ID NO: 4630639 - DNA, 24 bp, Homo sapiens
ccaacggcaagggaacaagtactt

SEQ ID NO: 4630640 - DNA, 13 bp, Homo sapiens
ccaactattctca

SEQ ID NO: 4630641 - DNA, 14 bp, Homo sapiens
ccaactcccttctg

SEQ ID NO: 4630642 - DNA, 12 bp, Homo sapiens
ccaactccttcc

SEQ ID NO: 4630643 - DNA, 16 bp, Homo sapiens
ccaactccttccagct

SEQ ID NO: 4630644 - DNA, 15 bp, Homo sapiens
ccaagaatacttgaa

SEQ ID NO: 4630645 - DNA, 22 bp, Homo sapiens
ccaagaccatttgtagtgagcg

SEQ ID NO: 4630646 - DNA, 14 bp, Homo sapiens
ccaagagcaggagg

SEQ ID NO: 4630647 - DNA, 22 bp, Homo sapiens
ccaagagcccgtgccaccccca

SEQ ID NO: 4630648 - DNA, 14 bp, Homo sapiens
ccaagatctgccag

SEQ ID NO: 4630649 - DNA, 22 bp, Homo sapiens
ccaagattttcctcttgtgatt

SEQ ID NO: 4630650 - DNA, 12 bp, Homo sapiens
ccaagcacagca

SEQ ID NO: 4630651 - DNA, 13 bp, Homo sapiens
ccaagcacagcag

SEQ ID NO: 4630652 - DNA, 17 bp, Homo sapiens
ccaagcacagcagcctg

SEQ ID NO: 4630653 - DNA, 20 bp, Homo sapiens
ccaagcagtggcctttttct

SEQ ID NO: 4630654 - DNA, 16 bp, Homo sapiens
ccaagccagattctct

SEQ ID NO: 4630655 - DNA, 20 bp, Homo sapiens
ccaagccagattctcttgaa

SEQ ID NO: 4630656 - DNA, 17 bp, Homo sapiens
ccaagccgaccttccct

SEQ ID NO: 4630657 - DNA, 23 bp, Homo sapiens
ccaagccgaccttccctccgcct

SEQ ID NO: 4630658 - DNA, 16 bp, Homo sapiens
ccaagctagactgtgt

SEQ ID NO: 4630659 - DNA, 17 bp, Homo sapiens
ccaagctagactgtgtc

SEQ ID NO: 4630660 - DNA, 11 bp, Homo sapiens
ccaagctccct

SEQ ID NO: 4630661 - DNA, 17 bp, Homo sapiens
ccaagctgaggtgccca

SEQ ID NO: 4630662 - DNA, 21 bp, Homo sapiens
ccaagctgaggtgcccaggag

SEQ ID NO: 4630663 - DNA, 18 bp, Homo sapiens
ccaaggacagttcagaga

SEQ ID NO: 4630664 - DNA, 19 bp, Homo sapiens
ccaaggacagttcagagat

SEQ ID NO: 4630665 - DNA, 13 bp, Homo sapiens
ccaaggacccagc

SEQ ID NO: 4630666 - DNA, 16 bp, Homo sapiens
ccaaggacccagccct

SEQ ID NO: 4630667 - DNA, 20 bp, Homo sapiens
ccaaggacctcctcttcccc

SEQ ID NO: 4630668 - DNA, 22 bp, Homo sapiens
ccaaggacctcctcttccccct

SEQ ID NO: 4630669 - DNA, 13 bp, Homo sapiens
ccaaggagggggc

SEQ ID NO: 4630670 - DNA, 23 bp, Homo sapiens
ccaaggccctgcatctgtctgct

SEQ ID NO: 4630671 - DNA, 18 bp, Homo sapiens
ccaagggacaggagaaga

SEQ ID NO: 4630672 - DNA, 18 bp, Homo sapiens
ccaagtccaggtcctggt

SEQ ID NO: 4630673 - DNA, 13 bp, Homo sapiens
ccaagtgcgtgcc

SEQ ID NO: 4630674 - DNA, 20 bp, Homo sapiens
ccaagttgtgcttgagccag

SEQ ID NO: 4630675 - DNA, 14 bp, Homo sapiens
ccaatacagtctag

SEQ ID NO: 4630676 - DNA, 14 bp, Homo sapiens
ccaatggtgcttgg

SEQ ID NO: 4630677 - DNA, 20 bp, Homo sapiens
ccaatgttagagactttttt

SEQ ID NO: 4630678 - DNA, 20 bp, Homo sapiens
ccaattcacccactcccttg

SEQ ID NO: 4630679 - DNA, 22 bp, Homo sapiens
ccacaaatgggaaaaccagact

SEQ ID NO: 4630680 - DNA, 15 bp, Homo sapiens
ccacaactgtcttag

SEQ ID NO: 4630681 - DNA, 15 bp, Homo sapiens
ccacaagcctgcctc

SEQ ID NO: 4630682 - DNA, 16 bp, Homo sapiens
ccacaagcctgcctcg

SEQ ID NO: 4630683 - DNA, 20 bp, Homo sapiens
ccacaagcctgcctcgcctt

SEQ ID NO: 4630684 - DNA, 11 bp, Homo sapiens
ccacaagctgc

SEQ ID NO: 4630685 - DNA, 15 bp, Homo sapiens
ccacaagctgcactg

SEQ ID NO: 4630686 - DNA, 17 bp, Homo sapiens
ccacaagctgcactgtg

SEQ ID NO: 4630687 - DNA, 15 bp, Homo sapiens
ccacaaggcctggtc

SEQ ID NO: 4630688 - DNA, 16 bp, Homo sapiens
ccacaaggcctggtct

SEQ ID NO: 4630689 - DNA, 20 bp, Homo sapiens
ccacaaggcctggtctggga

SEQ ID NO: 4630690 - DNA, 13 bp, Homo sapiens
ccacaagtgtcta

SEQ ID NO: 4630691 - DNA, 14 bp, Homo sapiens
ccacacctggcctt

SEQ ID NO: 4630692 - DNA, 18 bp, Homo sapiens
ccacactgcagggaggag

SEQ ID NO: 4630693 - DNA, 19 bp, Homo sapiens
ccacactgcagggaggagt

SEQ ID NO: 4630694 - DNA, 19 bp, Homo sapiens
ccacacttcgctcttgagg

SEQ ID NO: 4630695 - DNA, 14 bp, Homo sapiens
ccacacttctcagg

SEQ ID NO: 4630696 - DNA, 18 bp, Homo sapiens
ccacacttctcaggacac

SEQ ID NO: 4630697 - DNA, 23 bp, Homo sapiens
ccacagaaaagaaagttcatgct

SEQ ID NO: 4630698 - DNA, 17 bp, Homo sapiens
ccacagacccctgggag

SEQ ID NO: 4630699 - DNA, 20 bp, Homo sapiens
ccacagcaaccccaggctga

SEQ ID NO: 4630700 - DNA, 14 bp, Homo sapiens
ccacagcacagcca

SEQ ID NO: 4630701 - DNA, 13 bp, Homo sapiens
ccacagccttccc

SEQ ID NO: 4630702 - DNA, 19 bp, Homo sapiens
ccacagccttcggacagac

SEQ ID NO: 4630703 - DNA, 13 bp, Homo sapiens
ccacaggaccacc

SEQ ID NO: 4630704 - DNA, 18 bp, Homo sapiens
ccacaggaccacctcctc

SEQ ID NO: 4630705 - DNA, 15 bp, Homo sapiens
ccacaggccctggct

SEQ ID NO: 4630706 - DNA, 18 bp, Homo sapiens
ccacatccctgggcctgc

SEQ ID NO: 4630707 - DNA, 19 bp, Homo sapiens
ccacatccctgggcctgct

SEQ ID NO: 4630708 - DNA, 20 bp, Homo sapiens
ccacatccctgggcctgctg

SEQ ID NO: 4630709 - DNA, 23 bp, Homo sapiens
ccacatggcttagagaggcttga

SEQ ID NO: 4630710 - DNA, 14 bp, Homo sapiens
ccaccaccctgccc

SEQ ID NO: 4630711 - DNA, 14 bp, Homo sapiens
ccaccagcacctta

SEQ ID NO: 4630712 - DNA, 14 bp, Homo sapiens
ccaccagcctgctg

SEQ ID NO: 4630713 - DNA, 16 bp, Homo sapiens
ccaccagcctgctgac

SEQ ID NO: 4630714 - DNA, 14 bp, Homo sapiens
ccaccagggccaga

SEQ ID NO: 4630715 - DNA, 15 bp, Homo sapiens
ccaccaggggaagga

SEQ ID NO: 4630716 - DNA, 16 bp, Homo sapiens
ccaccaggggaaggaa

SEQ ID NO: 4630717 - DNA, 19 bp, Homo sapiens
ccaccaggggaaggaagga

SEQ ID NO: 4630718 - DNA, 22 bp, Homo sapiens
ccaccagtctagtccgtcctgg

SEQ ID NO: 4630719 - DNA, 12 bp, Homo sapiens
ccaccattcctg

SEQ ID NO: 4630720 - DNA, 21 bp, Homo sapiens
ccacccaggaaaggaggacca

SEQ ID NO: 4630721 - DNA, 16 bp, Homo sapiens
ccacccagtagcccag

SEQ ID NO: 4630722 - DNA, 16 bp, Homo sapiens
ccaccccctgcctggt

SEQ ID NO: 4630723 - DNA, 14 bp, Homo sapiens
ccacccctccccat

SEQ ID NO: 4630724 - DNA, 19 bp, Homo sapiens
ccacccctctcgcctcatt

SEQ ID NO: 4630725 - DNA, 23 bp, Homo sapiens
ccacccctgtaatcaggcaagga

SEQ ID NO: 4630726 - DNA, 19 bp, Homo sapiens
ccaccccttggaggagaga

SEQ ID NO: 4630727 - DNA, 21 bp, Homo sapiens
ccaccccttggaggagagaga

SEQ ID NO: 4630728 - DNA, 17 bp, Homo sapiens
ccaccctccaccttcca

SEQ ID NO: 4630729 - DNA, 22 bp, Homo sapiens
ccaccctcccagacctgcctct

SEQ ID NO: 4630730 - DNA, 15 bp, Homo sapiens
ccaccctgaggagtc

SEQ ID NO: 4630731 - DNA, 21 bp, Homo sapiens
ccaccctgaggagtctgaggt

SEQ ID NO: 4630732 - DNA, 21 bp, Homo sapiens
ccaccctgccccccctaagag

SEQ ID NO: 4630733 - DNA, 21 bp, Homo sapiens
ccaccctggccgagtccaagc

SEQ ID NO: 4630734 - DNA, 22 bp, Homo sapiens
ccaccctggccgagtccaagct

SEQ ID NO: 4630735 - DNA, 14 bp, Homo sapiens
ccaccgggccactc

SEQ ID NO: 4630736 - DNA, 22 bp, Homo sapiens
ccaccgggccactccttcctgc

SEQ ID NO: 4630737 - DNA, 23 bp, Homo sapiens
ccacctacttttctttcctcaga

SEQ ID NO: 4630738 - DNA, 13 bp, Homo sapiens
ccacctagcagca

SEQ ID NO: 4630739 - DNA, 14 bp, Homo sapiens
ccacctagcagcac

SEQ ID NO: 4630740 - DNA, 18 bp, Homo sapiens
ccacctcagaccccgggg

SEQ ID NO: 4630741 - DNA, 11 bp, Homo sapiens
ccacctcagcc

SEQ ID NO: 4630742 - DNA, 13 bp, Homo sapiens
ccacctcagcctc

SEQ ID NO: 4630743 - DNA, 14 bp, Homo sapiens
ccacctccagcctc

SEQ ID NO: 4630744 - DNA, 16 bp, Homo sapiens
ccacctccagcctctg

SEQ ID NO: 4630745 - DNA, 16 bp, Homo sapiens
ccacctcggcctccca

SEQ ID NO: 4630746 - DNA, 24 bp, Homo sapiens
ccacctggagaaggaagctgcctg

SEQ ID NO: 4630747 - DNA, 19 bp, Homo sapiens
ccaccttcccttcctcagc

SEQ ID NO: 4630748 - DNA, 14 bp, Homo sapiens
ccaccttttcagcg

SEQ ID NO: 4630749 - DNA, 17 bp, Homo sapiens
ccacggatgcgtgggca

SEQ ID NO: 4630750 - DNA, 19 bp, Homo sapiens
ccacggatgcgtgggcaga

SEQ ID NO: 4630751 - DNA, 20 bp, Homo sapiens
ccacggatgcgtgggcagag

SEQ ID NO: 4630752 - DNA, 21 bp, Homo sapiens
ccacggatgcgtgggcagagg

SEQ ID NO: 4630753 - DNA, 22 bp, Homo sapiens
ccacggatgcgtgggcagagga

SEQ ID NO: 4630754 - DNA, 15 bp, Homo sapiens
ccacggcctggctgg

SEQ ID NO: 4630755 - DNA, 15 bp, Homo sapiens
ccacggtttcagcta

SEQ ID NO: 4630756 - DNA, 22 bp, Homo sapiens
ccacgtcctccaagctcacgac

SEQ ID NO: 4630757 - DNA, 12 bp, Homo sapiens
ccacgtctggct

SEQ ID NO: 4630758 - DNA, 22 bp, Homo sapiens
ccacgtctggctccctgcccct

SEQ ID NO: 4630759 - DNA, 12 bp, Homo sapiens
ccactaaaaata

SEQ ID NO: 4630760 - DNA, 13 bp, Homo sapiens
ccactaaaaatat

SEQ ID NO: 4630761 - DNA, 13 bp, Homo sapiens
ccactactgcagc

SEQ ID NO: 4630762 - DNA, 14 bp, Homo sapiens
ccactactgcagca

SEQ ID NO: 4630763 - DNA, 20 bp, Homo sapiens
ccactactgcagcacctcca

SEQ ID NO: 4630764 - DNA, 14 bp, Homo sapiens
ccactatctgggtg

SEQ ID NO: 4630765 - DNA, 14 bp, Homo sapiens
ccactcaaaggcca

SEQ ID NO: 4630766 - DNA, 15 bp, Homo sapiens
ccactcaaaggccag

SEQ ID NO: 4630767 - DNA, 12 bp, Homo sapiens
ccactccgccag

SEQ ID NO: 4630768 - DNA, 18 bp, Homo sapiens
ccactccgccagccacag

SEQ ID NO: 4630769 - DNA, 21 bp, Homo sapiens
ccactccgccagccacaggac

SEQ ID NO: 4630770 - DNA, 23 bp, Homo sapiens
ccactccgccagccacaggacca

SEQ ID NO: 4630771 - DNA, 17 bp, Homo sapiens
ccactccttctctcact

SEQ ID NO: 4630772 - DNA, 13 bp, Homo sapiens
ccactctgctctg

SEQ ID NO: 4630773 - DNA, 15 bp, Homo sapiens
ccactctggcagcca

SEQ ID NO: 4630774 - DNA, 19 bp, Homo sapiens
ccactctggcagccacact

SEQ ID NO: 4630775 - DNA, 21 bp, Homo sapiens
ccactctggcagccacacttc

SEQ ID NO: 4630776 - DNA, 17 bp, Homo sapiens
ccactgcactccagcct

SEQ ID NO: 4630777 - DNA, 21 bp, Homo sapiens
ccactgcactccagcctgggg

SEQ ID NO: 4630778 - DNA, 13 bp, Homo sapiens
ccacttaatcttc

SEQ ID NO: 4630779 - DNA, 23 bp, Homo sapiens
ccacttaatcttctctcttgatt

SEQ ID NO: 4630780 - DNA, 19 bp, Homo sapiens
ccacttctggcttcagccc

SEQ ID NO: 4630781 - DNA, 15 bp, Homo sapiens
ccacttgccctgtgt

SEQ ID NO: 4630782 - DNA, 20 bp, Homo sapiens
ccacttgtcccactatctgg

SEQ ID NO: 4630783 - DNA, 13 bp, Homo sapiens
ccactttcagagc

SEQ ID NO: 4630784 - DNA, 22 bp, Homo sapiens
ccactttcagagcccccagccc

SEQ ID NO: 4630785 - DNA, 18 bp, Homo sapiens
ccagaaagtcccccctcg

SEQ ID NO: 4630786 - DNA, 19 bp, Homo sapiens
ccagaaagtcccccctcgc

SEQ ID NO: 4630787 - DNA, 22 bp, Homo sapiens
ccagaaagtcccccctcgcccc

SEQ ID NO: 4630788 - DNA, 16 bp, Homo sapiens
ccagaacccagtgttt

SEQ ID NO: 4630789 - DNA, 19 bp, Homo sapiens
ccagaacgtggctctgctg

SEQ ID NO: 4630790 - DNA, 19 bp, Homo sapiens
ccagaagatgaacagactg

SEQ ID NO: 4630791 - DNA, 21 bp, Homo sapiens
ccagacctatatctggagtga

SEQ ID NO: 4630792 - DNA, 14 bp, Homo sapiens
ccagacctgcagac

SEQ ID NO: 4630793 - DNA, 21 bp, Homo sapiens
ccagacctgcctcttccccct

SEQ ID NO: 4630794 - DNA, 21 bp, Homo sapiens
ccagacctgttagcagacagg

SEQ ID NO: 4630795 - DNA, 23 bp, Homo sapiens
ccagactaacatgtcagttttat

SEQ ID NO: 4630796 - DNA, 15 bp, Homo sapiens
ccagactcccttgct

SEQ ID NO: 4630797 - DNA, 19 bp, Homo sapiens
ccagagaaactgccacata

SEQ ID NO: 4630798 - DNA, 16 bp, Homo sapiens
ccagagaaagcgcaga

SEQ ID NO: 4630799 - DNA, 14 bp, Homo sapiens
ccagagcagctcca

SEQ ID NO: 4630800 - DNA, 11 bp, Homo sapiens
ccagagccaaa

SEQ ID NO: 4630801 - DNA, 20 bp, Homo sapiens
ccagagcctggggctctaac

SEQ ID NO: 4630802 - DNA, 20 bp, Homo sapiens
ccagagctacccgcagagtt

SEQ ID NO: 4630803 - DNA, 22 bp, Homo sapiens
ccagagctcatcccccctgctg

SEQ ID NO: 4630804 - DNA, 23 bp, Homo sapiens
ccagagctcatcccccctgctgc

SEQ ID NO: 4630805 - DNA, 12 bp, Homo sapiens
ccagaggagccc

SEQ ID NO: 4630806 - DNA, 16 bp, Homo sapiens
ccagaggagcccagcg

SEQ ID NO: 4630807 - DNA, 12 bp, Homo sapiens
ccagaggccctg

SEQ ID NO: 4630808 - DNA, 16 bp, Homo sapiens
ccagaggccctggagg

SEQ ID NO: 4630809 - DNA, 16 bp, Homo sapiens
ccagatgaactgactg

SEQ ID NO: 4630810 - DNA, 15 bp, Homo sapiens
ccagatgcagggcag

SEQ ID NO: 4630811 - DNA, 15 bp, Homo sapiens
ccagattctcttgaa

SEQ ID NO: 4630812 - DNA, 13 bp, Homo sapiens
ccagcaagacctc

SEQ ID NO: 4630813 - DNA, 23 bp, Homo sapiens
ccagcaaggcagaagcttggagg

SEQ ID NO: 4630814 - DNA, 16 bp, Homo sapiens
ccagcacttgtccagc

SEQ ID NO: 4630815 - DNA, 12 bp, Homo sapiens
ccagcagcagca

SEQ ID NO: 4630816 - DNA, 15 bp, Homo sapiens
ccagcagcagcactt

SEQ ID NO: 4630817 - DNA, 18 bp, Homo sapiens
ccagcaggaataaagact

SEQ ID NO: 4630818 - DNA, 23 bp, Homo sapiens
ccagcagggtcttttcatctggg

SEQ ID NO: 4630819 - DNA, 18 bp, Homo sapiens
ccagcaggtgctgacttc

SEQ ID NO: 4630820 - DNA, 14 bp, Homo sapiens
ccagcatccctgga

SEQ ID NO: 4630821 - DNA, 15 bp, Homo sapiens
ccagcatccctggag

SEQ ID NO: 4630822 - DNA, 16 bp, Homo sapiens
ccagcatccctggagc

SEQ ID NO: 4630823 - DNA, 17 bp, Homo sapiens
ccagcatccctggagca

SEQ ID NO: 4630824 - DNA, 9 bp, Homo sapiens
ccagccaca

SEQ ID NO: 4630825 - DNA, 17 bp, Homo sapiens
ccagccacagacccctg

SEQ ID NO: 4630826 - DNA, 20 bp, Homo sapiens
ccagccacagacccctggga

SEQ ID NO: 4630827 - DNA, 23 bp, Homo sapiens
ccagccacagacccctgggagct

SEQ ID NO: 4630828 - DNA, 12 bp, Homo sapiens
ccagccacagga

SEQ ID NO: 4630829 - DNA, 15 bp, Homo sapiens
ccagccacaggacca

SEQ ID NO: 4630830 - DNA, 13 bp, Homo sapiens
ccagcccagctgg

SEQ ID NO: 4630831 - DNA, 22 bp, Homo sapiens
ccagcccatccattaggccagc

SEQ ID NO: 4630832 - DNA, 13 bp, Homo sapiens
ccagcccctggcc

SEQ ID NO: 4630833 - DNA, 11 bp, Homo sapiens
ccagcccctgt

SEQ ID NO: 4630834 - DNA, 18 bp, Homo sapiens
ccagccccttcccctggg

SEQ ID NO: 4630835 - DNA, 22 bp, Homo sapiens
ccagccccttcccctgggaact

SEQ ID NO: 4630836 - DNA, 20 bp, Homo sapiens
ccagccctctcactgtgtcc

SEQ ID NO: 4630837 - DNA, 16 bp, Homo sapiens
ccagccctgcctggag

SEQ ID NO: 4630838 - DNA, 14 bp, Homo sapiens
ccagccctgggaac

SEQ ID NO: 4630839 - DNA, 16 bp, Homo sapiens
ccagccgtggccagag

SEQ ID NO: 4630840 - DNA, 18 bp, Homo sapiens
ccagcctcacttcctttg

SEQ ID NO: 4630841 - DNA, 15 bp, Homo sapiens
ccagcctgaggtgcc

SEQ ID NO: 4630842 - DNA, 16 bp, Homo sapiens
ccagcctgaggtgccc

SEQ ID NO: 4630843 - DNA, 17 bp, Homo sapiens
ccagcctgctgacagac

SEQ ID NO: 4630844 - DNA, 15 bp, Homo sapiens
ccagcctggcctcct

SEQ ID NO: 4630845 - DNA, 16 bp, Homo sapiens
ccagcctggcctcctg

SEQ ID NO: 4630846 - DNA, 18 bp, Homo sapiens
ccagcctggcctcctgcc

SEQ ID NO: 4630847 - DNA, 20 bp, Homo sapiens
ccagcctggcctcctgcctc

SEQ ID NO: 4630848 - DNA, 12 bp, Homo sapiens
ccagcctgggcc

SEQ ID NO: 4630849 - DNA, 21 bp, Homo sapiens
ccagcctgggcctatggagag

SEQ ID NO: 4630850 - DNA, 22 bp, Homo sapiens
ccagcctgggcctatggagagc

SEQ ID NO: 4630851 - DNA, 23 bp, Homo sapiens
ccagcctgggggacagagcaaga

SEQ ID NO: 4630852 - DNA, 18 bp, Homo sapiens
ccagcgattccctctccc

SEQ ID NO: 4630853 - DNA, 22 bp, Homo sapiens
ccagcgattccctctcccaggc

SEQ ID NO: 4630854 - DNA, 23 bp, Homo sapiens
ccagcgattccctctcccaggcc

SEQ ID NO: 4630855 - DNA, 21 bp, Homo sapiens
ccagcggacagtggcaggaca

SEQ ID NO: 4630856 - DNA, 17 bp, Homo sapiens
ccagcggcccaagagcc

SEQ ID NO: 4630857 - DNA, 22 bp, Homo sapiens
ccagctagtgacccacatgcca

SEQ ID NO: 4630858 - DNA, 15 bp, Homo sapiens
ccagctcccccaggc

SEQ ID NO: 4630859 - DNA, 18 bp, Homo sapiens
ccagctcccccaggcaga

SEQ ID NO: 4630860 - DNA, 20 bp, Homo sapiens
ccagctccggcctgtcctcc

SEQ ID NO: 4630861 - DNA, 17 bp, Homo sapiens
ccagctgaaggcagtgg

SEQ ID NO: 4630862 - DNA, 15 bp, Homo sapiens
ccagctgagcgccag

SEQ ID NO: 4630863 - DNA, 15 bp, Homo sapiens
ccagctgagtgagtg

SEQ ID NO: 4630864 - DNA, 21 bp, Homo sapiens
ccagctgagtgagtgggagag

SEQ ID NO: 4630865 - DNA, 14 bp, Homo sapiens
ccagctgctctaag

SEQ ID NO: 4630866 - DNA, 16 bp, Homo sapiens
ccagctgctgtgcccc

SEQ ID NO: 4630867 - DNA, 18 bp, Homo sapiens
ccagctgctgtgccccac

SEQ ID NO: 4630868 - DNA, 21 bp, Homo sapiens
ccagctgctgtgccccaccac

SEQ ID NO: 4630869 - DNA, 17 bp, Homo sapiens
ccagctgggtcaggcag

SEQ ID NO: 4630870 - DNA, 18 bp, Homo sapiens
ccagctgggtcaggcagg

SEQ ID NO: 4630871 - DNA, 16 bp, Homo sapiens
ccagcttcacctctgg

SEQ ID NO: 4630872 - DNA, 23 bp, Homo sapiens
ccagcttctcagtttctgcctgg

SEQ ID NO: 4630873 - DNA, 18 bp, Homo sapiens
ccaggaaaggaggaccag

SEQ ID NO: 4630874 - DNA, 22 bp, Homo sapiens
ccaggaaggccaaaatcaagag

SEQ ID NO: 4630875 - DNA, 23 bp, Homo sapiens
ccaggacaagcatggtcccacat

SEQ ID NO: 4630876 - DNA, 15 bp, Homo sapiens
ccaggacctggctgc

SEQ ID NO: 4630877 - DNA, 17 bp, Homo sapiens
ccaggacctggctgcca

SEQ ID NO: 4630878 - DNA, 17 bp, Homo sapiens
ccaggagagagccagga

SEQ ID NO: 4630879 - DNA, 14 bp, Homo sapiens
ccaggagcagccct

SEQ ID NO: 4630880 - DNA, 15 bp, Homo sapiens
ccaggagcagccctg

SEQ ID NO: 4630881 - DNA, 20 bp, Homo sapiens
ccaggagcagccctggcccc

SEQ ID NO: 4630882 - DNA, 16 bp, Homo sapiens
ccaggagggacaaagg

SEQ ID NO: 4630883 - DNA, 21 bp, Homo sapiens
ccaggagggacaaaggagcct

SEQ ID NO: 4630884 - DNA, 22 bp, Homo sapiens
ccaggagggacaaaggagcctg

SEQ ID NO: 4630885 - DNA, 16 bp, Homo sapiens
ccaggaggtgcagtgg

SEQ ID NO: 4630886 - DNA, 15 bp, Homo sapiens
ccaggatactggcac

SEQ ID NO: 4630887 - DNA, 17 bp, Homo sapiens
ccaggatactggcacag

SEQ ID NO: 4630888 - DNA, 14 bp, Homo sapiens
ccaggatctcctgc

SEQ ID NO: 4630889 - DNA, 14 bp, Homo sapiens
ccaggatctctttc

SEQ ID NO: 4630890 - DNA, 14 bp, Homo sapiens
ccaggatgcccaga

SEQ ID NO: 4630891 - DNA, 19 bp, Homo sapiens
ccaggatggagcaagctct

SEQ ID NO: 4630892 - DNA, 15 bp, Homo sapiens
ccaggcaaggaacag

SEQ ID NO: 4630893 - DNA, 19 bp, Homo sapiens
ccaggcagaaatagttgtc

SEQ ID NO: 4630894 - DNA, 17 bp, Homo sapiens
ccaggcagagaacagaa

SEQ ID NO: 4630895 - DNA, 15 bp, Homo sapiens
ccaggccccatgacc

SEQ ID NO: 4630896 - DNA, 23 bp, Homo sapiens
ccaggccccatgacctccagctt

SEQ ID NO: 4630897 - DNA, 14 bp, Homo sapiens
ccaggccccatgga

SEQ ID NO: 4630898 - DNA, 16 bp, Homo sapiens
ccaggccccatggagg

SEQ ID NO: 4630899 - DNA, 19 bp, Homo sapiens
ccaggccccatggagggta

SEQ ID NO: 4630900 - DNA, 19 bp, Homo sapiens
ccaggcctgggtgatctgc

SEQ ID NO: 4630901 - DNA, 13 bp, Homo sapiens
ccaggcctgttgc

SEQ ID NO: 4630902 - DNA, 13 bp, Homo sapiens
ccaggctgaagca

SEQ ID NO: 4630903 - DNA, 15 bp, Homo sapiens
ccaggctgaccacag

SEQ ID NO: 4630904 - DNA, 23 bp, Homo sapiens
ccaggctgggctctgcctgtctg

SEQ ID NO: 4630905 - DNA, 13 bp, Homo sapiens
ccagggatgctgg

SEQ ID NO: 4630906 - DNA, 17 bp, Homo sapiens
ccagggatgctgggctg

SEQ ID NO: 4630907 - DNA, 19 bp, Homo sapiens
ccagggatgctgggctggg

SEQ ID NO: 4630908 - DNA, 20 bp, Homo sapiens
ccagggatgctgggctgggc

SEQ ID NO: 4630909 - DNA, 21 bp, Homo sapiens
ccagggatgtctgttgaaata

SEQ ID NO: 4630910 - DNA, 15 bp, Homo sapiens
ccagggcacaggagc

SEQ ID NO: 4630911 - DNA, 16 bp, Homo sapiens
ccagggcacaggagct

SEQ ID NO: 4630912 - DNA, 12 bp, Homo sapiens
ccagggccagag

SEQ ID NO: 4630913 - DNA, 18 bp, Homo sapiens
ccagggccatgaactttg

SEQ ID NO: 4630914 - DNA, 17 bp, Homo sapiens
ccagggcccccatctca

SEQ ID NO: 4630915 - DNA, 18 bp, Homo sapiens
ccagggccctcccagccc

SEQ ID NO: 4630916 - DNA, 14 bp, Homo sapiens
ccagggccgggctt

SEQ ID NO: 4630917 - DNA, 15 bp, Homo sapiens
ccagggctcttctca

SEQ ID NO: 4630918 - DNA, 15 bp, Homo sapiens
ccagggctgccctga

SEQ ID NO: 4630919 - DNA, 17 bp, Homo sapiens
ccagggctgccctgaga

SEQ ID NO: 4630920 - DNA, 14 bp, Homo sapiens
ccagggctgctctt

SEQ ID NO: 4630921 - DNA, 18 bp, Homo sapiens
ccagggctgctctttcca

SEQ ID NO: 4630922 - DNA, 14 bp, Homo sapiens
ccagggctggggac

SEQ ID NO: 4630923 - DNA, 19 bp, Homo sapiens
ccagggctggggacagagg

SEQ ID NO: 4630924 - DNA, 22 bp, Homo sapiens
ccagggcttacggccctggcct

SEQ ID NO: 4630925 - DNA, 16 bp, Homo sapiens
ccaggggcctgcagaa

SEQ ID NO: 4630926 - DNA, 20 bp, Homo sapiens
ccaggggcctgcagaaggaa

SEQ ID NO: 4630927 - DNA, 21 bp, Homo sapiens
ccaggggcctgcagaaggaaa

SEQ ID NO: 4630928 - DNA, 15 bp, Homo sapiens
ccagggtgagcaggg

SEQ ID NO: 4630929 - DNA, 14 bp, Homo sapiens
ccagggtgtgtgct

SEQ ID NO: 4630930 - DNA, 18 bp, Homo sapiens
ccaggtacaggagaggca

SEQ ID NO: 4630931 - DNA, 19 bp, Homo sapiens
ccaggtatccaaaaatgtg

SEQ ID NO: 4630932 - DNA, 17 bp, Homo sapiens
ccaggtatcctggggga

SEQ ID NO: 4630933 - DNA, 20 bp, Homo sapiens
ccaggtatcctgggggaaga

SEQ ID NO: 4630934 - DNA, 14 bp, Homo sapiens
ccaggtatggctct

SEQ ID NO: 4630935 - DNA, 13 bp, Homo sapiens
ccaggtcctggtg

SEQ ID NO: 4630936 - DNA, 14 bp, Homo sapiens
ccaggtcctggtgg

SEQ ID NO: 4630937 - DNA, 15 bp, Homo sapiens
ccaggtcctggtggg

SEQ ID NO: 4630938 - DNA, 15 bp, Homo sapiens
ccaggtgagggaagg

SEQ ID NO: 4630939 - DNA, 16 bp, Homo sapiens
ccaggtgagggaagga

SEQ ID NO: 4630940 - DNA, 19 bp, Homo sapiens
ccaggtggaaggcagacag

SEQ ID NO: 4630941 - DNA, 23 bp, Homo sapiens
ccaggtggcacttccacctccag

SEQ ID NO: 4630942 - DNA, 23 bp, Homo sapiens
ccaggttcaagcgattctcctgc

SEQ ID NO: 4630943 - DNA, 16 bp, Homo sapiens
ccaggttgatcttgaa

SEQ ID NO: 4630944 - DNA, 18 bp, Homo sapiens
ccagtacctagctggctc

SEQ ID NO: 4630945 - DNA, 14 bp, Homo sapiens
ccagtactttggaa

SEQ ID NO: 4630946 - DNA, 17 bp, Homo sapiens
ccagtagttataaagtc

SEQ ID NO: 4630947 - DNA, 17 bp, Homo sapiens
ccagtcattttattttg

SEQ ID NO: 4630948 - DNA, 21 bp, Homo sapiens
ccagtcattttattttgtaat

SEQ ID NO: 4630949 - DNA, 22 bp, Homo sapiens
ccagtcgtgatgtggaggaaga

SEQ ID NO: 4630950 - DNA, 16 bp, Homo sapiens
ccagtctagtccgtcc

SEQ ID NO: 4630951 - DNA, 13 bp, Homo sapiens
ccagtctgaccct

SEQ ID NO: 4630952 - DNA, 20 bp, Homo sapiens
ccagtctggaaaacagaaac

SEQ ID NO: 4630953 - DNA, 13 bp, Homo sapiens
ccagtgcatcaca

SEQ ID NO: 4630954 - DNA, 19 bp, Homo sapiens
ccagtgcatcacatctgca

SEQ ID NO: 4630955 - DNA, 22 bp, Homo sapiens
ccagtgcatcacatctgcacac

SEQ ID NO: 4630956 - DNA, 13 bp, Homo sapiens
ccagtgccaagga

SEQ ID NO: 4630957 - DNA, 19 bp, Homo sapiens
ccagtgcccggtgcagggc

SEQ ID NO: 4630958 - DNA, 20 bp, Homo sapiens
ccagtgcccggtgcagggcc

SEQ ID NO: 4630959 - DNA, 21 bp, Homo sapiens
ccagtgcccggtgcagggcct

SEQ ID NO: 4630960 - DNA, 14 bp, Homo sapiens
ccagtgctgtctgg

SEQ ID NO: 4630961 - DNA, 15 bp, Homo sapiens
ccagtggaaaacaaa

SEQ ID NO: 4630962 - DNA, 14 bp, Homo sapiens
ccagtggggcctgt

SEQ ID NO: 4630963 - DNA, 18 bp, Homo sapiens
ccagttcctatgacacag

SEQ ID NO: 4630964 - DNA, 17 bp, Homo sapiens
ccagttggatctctggt

SEQ ID NO: 4630965 - DNA, 19 bp, Homo sapiens
ccagttgtgttgacacata

SEQ ID NO: 4630966 - DNA, 23 bp, Homo sapiens
ccagttttgtggattaaaccttt

SEQ ID NO: 4630967 - DNA, 18 bp, Homo sapiens
ccataccttctcccaggc

SEQ ID NO: 4630968 - DNA, 17 bp, Homo sapiens
ccatactgtagacactc

SEQ ID NO: 4630969 - DNA, 18 bp, Homo sapiens
ccatactgtagacactct

SEQ ID NO: 4630970 - DNA, 19 bp, Homo sapiens
ccatactgtagacactctg

SEQ ID NO: 4630971 - DNA, 20 bp, Homo sapiens
ccatagaaaacttgacatgt

SEQ ID NO: 4630972 - DNA, 11 bp, Homo sapiens
ccatagaaaag

SEQ ID NO: 4630973 - DNA, 20 bp, Homo sapiens
ccataggtttctctccctcc

SEQ ID NO: 4630974 - DNA, 21 bp, Homo sapiens
ccatatattaccccttcatgt

SEQ ID NO: 4630975 - DNA, 13 bp, Homo sapiens
ccatatgtccact

SEQ ID NO: 4630976 - DNA, 15 bp, Homo sapiens
ccatcacatgaccac

SEQ ID NO: 4630977 - DNA, 21 bp, Homo sapiens
ccatcacctactcacacaggc

SEQ ID NO: 4630978 - DNA, 15 bp, Homo sapiens
ccatcagtgaaagaa

SEQ ID NO: 4630979 - DNA, 16 bp, Homo sapiens
ccatcagtgaaagaaa

SEQ ID NO: 4630980 - DNA, 16 bp, Homo sapiens
ccatccagatgtgtgc

SEQ ID NO: 4630981 - DNA, 23 bp, Homo sapiens
ccatcccaaccagtgccaaggac

SEQ ID NO: 4630982 - DNA, 13 bp, Homo sapiens
ccatccccagcga

SEQ ID NO: 4630983 - DNA, 18 bp, Homo sapiens
ccatcccgtaagaccacc

SEQ ID NO: 4630984 - DNA, 19 bp, Homo sapiens
ccatcccgtaagaccacct

SEQ ID NO: 4630985 - DNA, 17 bp, Homo sapiens
ccatcctcatccctgac

SEQ ID NO: 4630986 - DNA, 21 bp, Homo sapiens
ccatcctggggcagcactccc

SEQ ID NO: 4630987 - DNA, 15 bp, Homo sapiens
ccatcggccaagaat

SEQ ID NO: 4630988 - DNA, 17 bp, Homo sapiens
ccatctaggtcctggct

SEQ ID NO: 4630989 - DNA, 18 bp, Homo sapiens
ccatctaggtcctggctg

SEQ ID NO: 4630990 - DNA, 18 bp, Homo sapiens
ccatctagtttttggaaa

SEQ ID NO: 4630991 - DNA, 15 bp, Homo sapiens
ccatctatcactgca

SEQ ID NO: 4630992 - DNA, 18 bp, Homo sapiens
ccatctcacctcctgctg

SEQ ID NO: 4630993 - DNA, 21 bp, Homo sapiens
ccatctcacctcctgctgggc

SEQ ID NO: 4630994 - DNA, 13 bp, Homo sapiens
ccatctcactctt

SEQ ID NO: 4630995 - DNA, 14 bp, Homo sapiens
ccatctcaggagat

SEQ ID NO: 4630996 - DNA, 15 bp, Homo sapiens
ccatctctctcttgc

SEQ ID NO: 4630997 - DNA, 14 bp, Homo sapiens
ccatctgactgcca

SEQ ID NO: 4630998 - DNA, 21 bp, Homo sapiens
ccatctgactgccaagccaga

SEQ ID NO: 4630999 - DNA, 14 bp, Homo sapiens
ccatctgtgttcta

SEQ ID NO: 4631000 - DNA, 12 bp, Homo sapiens
ccatcttaatct

SEQ ID NO: 4631001 - DNA, 13 bp, Homo sapiens
ccatcttaatctt

SEQ ID NO: 4631002 - DNA, 17 bp, Homo sapiens
ccatcttaatctttatt

SEQ ID NO: 4631003 - DNA, 15 bp, Homo sapiens
ccatgacctccagct

SEQ ID NO: 4631004 - DNA, 15 bp, Homo sapiens
ccatgagactgccct

SEQ ID NO: 4631005 - DNA, 22 bp, Homo sapiens
ccatgagttggggtctggcagc

SEQ ID NO: 4631006 - DNA, 21 bp, Homo sapiens
ccatgatggcaacagaaacca

SEQ ID NO: 4631007 - DNA, 13 bp, Homo sapiens
ccatgatggccag

SEQ ID NO: 4631008 - DNA, 13 bp, Homo sapiens
ccatgcaaaccat

SEQ ID NO: 4631009 - DNA, 23 bp, Homo sapiens
ccatgcacactcatgcacacaga

SEQ ID NO: 4631010 - DNA, 21 bp, Homo sapiens
ccatgcaccctcatacacaga

SEQ ID NO: 4631011 - DNA, 11 bp, Homo sapiens
ccatgcatttc

SEQ ID NO: 4631012 - DNA, 19 bp, Homo sapiens
ccatgctcccaactccctt

SEQ ID NO: 4631013 - DNA, 12 bp, Homo sapiens
ccatgctgggcc

SEQ ID NO: 4631014 - DNA, 19 bp, Homo sapiens
ccatgcttacgtgatcctc

SEQ ID NO: 4631015 - DNA, 18 bp, Homo sapiens
ccatggacaggctggctc

SEQ ID NO: 4631016 - DNA, 19 bp, Homo sapiens
ccatggacaggctggctcc

SEQ ID NO: 4631017 - DNA, 17 bp, Homo sapiens
ccatggaggcagatgcc

SEQ ID NO: 4631018 - DNA, 21 bp, Homo sapiens
ccatggaggcagatgcccttg

SEQ ID NO: 4631019 - DNA, 16 bp, Homo sapiens
ccatgggtctggctag

SEQ ID NO: 4631020 - DNA, 17 bp, Homo sapiens
ccatgtaaccactgcac

SEQ ID NO: 4631021 - DNA, 17 bp, Homo sapiens
ccatgtgattaatgttt

SEQ ID NO: 4631022 - DNA, 23 bp, Homo sapiens
ccatgtgctacaggggccagaag

SEQ ID NO: 4631023 - DNA, 19 bp, Homo sapiens
ccatgttggccaggctggt

SEQ ID NO: 4631024 - DNA, 22 bp, Homo sapiens
ccatgttgtgcctccctggtga

SEQ ID NO: 4631025 - DNA, 14 bp, Homo sapiens
ccattaacattttt

SEQ ID NO: 4631026 - DNA, 21 bp, Homo sapiens
ccattaatcttgatcattccg

SEQ ID NO: 4631027 - DNA, 14 bp, Homo sapiens
ccattaggccagca

SEQ ID NO: 4631028 - DNA, 15 bp, Homo sapiens
ccattcactcccagg

SEQ ID NO: 4631029 - DNA, 22 bp, Homo sapiens
ccattccatctagtttttggaa

SEQ ID NO: 4631030 - DNA, 18 bp, Homo sapiens
ccattctccacagcaacc

SEQ ID NO: 4631031 - DNA, 15 bp, Homo sapiens
ccattctgcatgagc

SEQ ID NO: 4631032 - DNA, 14 bp, Homo sapiens
ccattgagtccctg

SEQ ID NO: 4631033 - DNA, 13 bp, Homo sapiens
ccattgctccatt

SEQ ID NO: 4631034 - DNA, 19 bp, Homo sapiens
ccattgctccattcactcc

SEQ ID NO: 4631035 - DNA, 14 bp, Homo sapiens
ccattgctgccaag

SEQ ID NO: 4631036 - DNA, 21 bp, Homo sapiens
ccattgttcccttcctcttcc

SEQ ID NO: 4631037 - DNA, 13 bp, Homo sapiens
ccatttcctgaga

SEQ ID NO: 4631038 - DNA, 12 bp, Homo sapiens
ccatttctcatg

SEQ ID NO: 4631039 - DNA, 13 bp, Homo sapiens
ccatttgtactga

SEQ ID NO: 4631040 - DNA, 18 bp, Homo sapiens
ccatttgttgagccccag

SEQ ID NO: 4631041 - DNA, 22 bp, Homo sapiens
ccattttcccccactactgcag

SEQ ID NO: 4631042 - DNA, 15 bp, Homo sapiens
cccaaagcctgagga

SEQ ID NO: 4631043 - DNA, 17 bp, Homo sapiens
cccaaagcttgtaaata

SEQ ID NO: 4631044 - DNA, 17 bp, Homo sapiens
cccaaatccgccagtgt

SEQ ID NO: 4631045 - DNA, 18 bp, Homo sapiens
cccaaccagtgccaagga

SEQ ID NO: 4631046 - DNA, 23 bp, Homo sapiens
cccaaccccttaagccctggccc

SEQ ID NO: 4631047 - DNA, 22 bp, Homo sapiens
cccaactcaagtgtcacctcct

SEQ ID NO: 4631048 - DNA, 14 bp, Homo sapiens
cccaactcccttct

SEQ ID NO: 4631049 - DNA, 15 bp, Homo sapiens
cccaactccttccag

SEQ ID NO: 4631050 - DNA, 18 bp, Homo sapiens
cccaagagcatcatgcct

SEQ ID NO: 4631051 - DNA, 20 bp, Homo sapiens
cccaagagcatcatgcctct

SEQ ID NO: 4631052 - DNA, 21 bp, Homo sapiens
cccaagagcatcatgcctctg

SEQ ID NO: 4631053 - DNA, 15 bp, Homo sapiens
cccaagatctgccag

SEQ ID NO: 4631054 - DNA, 19 bp, Homo sapiens
cccaagatctgccagacct

SEQ ID NO: 4631055 - DNA, 18 bp, Homo sapiens
cccaaggacccagccctc

SEQ ID NO: 4631056 - DNA, 15 bp, Homo sapiens
cccaaggactgaggg

SEQ ID NO: 4631057 - DNA, 12 bp, Homo sapiens
cccaagggccct

SEQ ID NO: 4631058 - DNA, 15 bp, Homo sapiens
cccaagggccctggc

SEQ ID NO: 4631059 - DNA, 16 bp, Homo sapiens
cccaatacaaagatga

SEQ ID NO: 4631060 - DNA, 19 bp, Homo sapiens
cccaatcggactgccaaat

SEQ ID NO: 4631061 - DNA, 13 bp, Homo sapiens
cccaatggtgctt

SEQ ID NO: 4631062 - DNA, 14 bp, Homo sapiens
cccaatgtttaaaa

SEQ ID NO: 4631063 - DNA, 16 bp, Homo sapiens
cccacaagcctgcctc

SEQ ID NO: 4631064 - DNA, 17 bp, Homo sapiens
cccacaagctgtccctg

SEQ ID NO: 4631065 - DNA, 20 bp, Homo sapiens
cccacaagctgtccctgcag

SEQ ID NO: 4631066 - DNA, 16 bp, Homo sapiens
cccacaaggcctggtc

SEQ ID NO: 4631067 - DNA, 21 bp, Homo sapiens
cccacaaggcctggtctggga

SEQ ID NO: 4631068 - DNA, 17 bp, Homo sapiens
cccacagaaagccagga

SEQ ID NO: 4631069 - DNA, 15 bp, Homo sapiens
cccacatccctgggc

SEQ ID NO: 4631070 - DNA, 21 bp, Homo sapiens
cccacatccctgggcctgctg

SEQ ID NO: 4631071 - DNA, 20 bp, Homo sapiens
cccacatgaggccatctcag

SEQ ID NO: 4631072 - DNA, 19 bp, Homo sapiens
cccacatgtgacacatatg

SEQ ID NO: 4631073 - DNA, 14 bp, Homo sapiens
cccaccagcttcac

SEQ ID NO: 4631074 - DNA, 21 bp, Homo sapiens
cccacccaaaagtcacccagg

SEQ ID NO: 4631075 - DNA, 16 bp, Homo sapiens
cccacccttgggcaga

SEQ ID NO: 4631076 - DNA, 23 bp, Homo sapiens
cccaccgggccactccttcctgc

SEQ ID NO: 4631077 - DNA, 17 bp, Homo sapiens
cccaccgtgggcaggga

SEQ ID NO: 4631078 - DNA, 19 bp, Homo sapiens
cccaccgtgggcagggagc

SEQ ID NO: 4631079 - DNA, 14 bp, Homo sapiens
cccacctcagcctc

SEQ ID NO: 4631080 - DNA, 16 bp, Homo sapiens
cccacggtttcagcta

SEQ ID NO: 4631081 - DNA, 17 bp, Homo sapiens
cccacggtttcagctag

SEQ ID NO: 4631082 - DNA, 22 bp, Homo sapiens
cccactccgccagccacaggac

SEQ ID NO: 4631083 - DNA, 14 bp, Homo sapiens
cccactctgctctg

SEQ ID NO: 4631084 - DNA, 18 bp, Homo sapiens
cccactctgctctgatgc

SEQ ID NO: 4631085 - DNA, 19 bp, Homo sapiens
cccactctgctctgatgca

SEQ ID NO: 4631086 - DNA, 18 bp, Homo sapiens
cccagaacttcaagatga

SEQ ID NO: 4631087 - DNA, 21 bp, Homo sapiens
cccagagaaagcgcagatgct

SEQ ID NO: 4631088 - DNA, 20 bp, Homo sapiens
cccagagcctggctgcccat

SEQ ID NO: 4631089 - DNA, 23 bp, Homo sapiens
cccagagctcatcccccctgctg

SEQ ID NO: 4631090 - DNA, 18 bp, Homo sapiens
cccagagctgtgccagca

SEQ ID NO: 4631091 - DNA, 18 bp, Homo sapiens
cccagaggagcccagcgg

SEQ ID NO: 4631092 - DNA, 14 bp, Homo sapiens
cccagaggccctgg

SEQ ID NO: 4631093 - DNA, 21 bp, Homo sapiens
cccagatgttttacgtctggg

SEQ ID NO: 4631094 - DNA, 15 bp, Homo sapiens
cccagcaagacctca

SEQ ID NO: 4631095 - DNA, 19 bp, Homo sapiens
cccagcaagacctcatctg

SEQ ID NO: 4631096 - DNA, 20 bp, Homo sapiens
cccagcatccctggagcagg

SEQ ID NO: 4631097 - DNA, 18 bp, Homo sapiens
cccagcccattgctgcca

SEQ ID NO: 4631098 - DNA, 17 bp, Homo sapiens
cccagccccttcccctg

SEQ ID NO: 4631099 - DNA, 20 bp, Homo sapiens
cccagccccttcccctggga

SEQ ID NO: 4631100 - DNA, 22 bp, Homo sapiens
cccagccccttcccctgggaac

SEQ ID NO: 4631101 - DNA, 12 bp, Homo sapiens
cccagccctggg

SEQ ID NO: 4631102 - DNA, 18 bp, Homo sapiens
cccagcctcacttccttt

SEQ ID NO: 4631103 - DNA, 10 bp, Homo sapiens
cccagcctgg

SEQ ID NO: 4631104 - DNA, 13 bp, Homo sapiens
cccagcctgggcc

SEQ ID NO: 4631105 - DNA, 16 bp, Homo sapiens
cccagcctgggcctat

SEQ ID NO: 4631106 - DNA, 18 bp, Homo sapiens
cccagcctgggcctatgg

SEQ ID NO: 4631107 - DNA, 19 bp, Homo sapiens
cccagcctgggcctatgga

SEQ ID NO: 4631108 - DNA, 23 bp, Homo sapiens
cccagcgattccctctcccaggc

SEQ ID NO: 4631109 - DNA, 15 bp, Homo sapiens
cccagcgtggcctcc

SEQ ID NO: 4631110 - DNA, 14 bp, Homo sapiens
cccagctcccccag

SEQ ID NO: 4631111 - DNA, 14 bp, Homo sapiens
cccagctgaaggca

SEQ ID NO: 4631112 - DNA, 20 bp, Homo sapiens
cccagctgctctaagcccag

SEQ ID NO: 4631113 - DNA, 11 bp, Homo sapiens
cccagctggcc

SEQ ID NO: 4631114 - DNA, 20 bp, Homo sapiens
cccagctggcctggccccca

SEQ ID NO: 4631115 - DNA, 14 bp, Homo sapiens
cccagcttcacctc

SEQ ID NO: 4631116 - DNA, 20 bp, Homo sapiens
cccagcttcacctctgggac

SEQ ID NO: 4631117 - DNA, 14 bp, Homo sapiens
cccaggaaaggagg

SEQ ID NO: 4631118 - DNA, 21 bp, Homo sapiens
cccaggacaagcatggtccca

SEQ ID NO: 4631119 - DNA, 16 bp, Homo sapiens
cccaggacctggctgc

SEQ ID NO: 4631120 - DNA, 23 bp, Homo sapiens
cccaggatcagattgcatgtgac

SEQ ID NO: 4631121 - DNA, 12 bp, Homo sapiens
cccaggatctcc

SEQ ID NO: 4631122 - DNA, 22 bp, Homo sapiens
cccaggatctcctgccagccca

SEQ ID NO: 4631123 - DNA, 16 bp, Homo sapiens
cccaggcaaggaacag

SEQ ID NO: 4631124 - DNA, 14 bp, Homo sapiens
cccaggccccatga

SEQ ID NO: 4631125 - DNA, 16 bp, Homo sapiens
cccaggccccatgacc

SEQ ID NO: 4631126 - DNA, 17 bp, Homo sapiens
cccaggccccatgacct

SEQ ID NO: 4631127 - DNA, 17 bp, Homo sapiens
cccaggcctctgcccca

SEQ ID NO: 4631128 - DNA, 11 bp, Homo sapiens
cccagggcaca

SEQ ID NO: 4631129 - DNA, 13 bp, Homo sapiens
cccagggcacagg

SEQ ID NO: 4631130 - DNA, 18 bp, Homo sapiens
cccagggcacaggagcta

SEQ ID NO: 4631131 - DNA, 18 bp, Homo sapiens
cccagggtggagtgcagt

SEQ ID NO: 4631132 - DNA, 19 bp, Homo sapiens
cccagggtggagtgcagtg

SEQ ID NO: 4631133 - DNA, 22 bp, Homo sapiens
cccaggtatcctgggggaagag

SEQ ID NO: 4631134 - DNA, 19 bp, Homo sapiens
cccaggtgagggaaggaga

SEQ ID NO: 4631135 - DNA, 23 bp, Homo sapiens
cccaggtggaaggcagacagcag

SEQ ID NO: 4631136 - DNA, 14 bp, Homo sapiens
cccagtctcctctc

SEQ ID NO: 4631137 - DNA, 22 bp, Homo sapiens
cccagtgcccggtgcagggcct

SEQ ID NO: 4631138 - DNA, 12 bp, Homo sapiens
cccagttacttt

SEQ ID NO: 4631139 - DNA, 15 bp, Homo sapiens
cccagttcttcattt

SEQ ID NO: 4631140 - DNA, 14 bp, Homo sapiens
cccatcatgtggcc

SEQ ID NO: 4631141 - DNA, 22 bp, Homo sapiens
cccatcccgtaagaccaccttc

SEQ ID NO: 4631142 - DNA, 13 bp, Homo sapiens
cccatctcactct

SEQ ID NO: 4631143 - DNA, 14 bp, Homo sapiens
cccatctcactctt

SEQ ID NO: 4631144 - DNA, 21 bp, Homo sapiens
cccatctcatgcccctggctg

SEQ ID NO: 4631145 - DNA, 12 bp, Homo sapiens
cccatctgtgtt

SEQ ID NO: 4631146 - DNA, 13 bp, Homo sapiens
cccatctgtgttc

SEQ ID NO: 4631147 - DNA, 15 bp, Homo sapiens
cccatctgtgttcta

SEQ ID NO: 4631148 - DNA, 21 bp, Homo sapiens
cccatcttgcttccaagacca

SEQ ID NO: 4631149 - DNA, 16 bp, Homo sapiens
cccatgacctccagct

SEQ ID NO: 4631150 - DNA, 15 bp, Homo sapiens
cccatggacaggctg

SEQ ID NO: 4631151 - DNA, 22 bp, Homo sapiens
cccatggaggcagatgcccttg

SEQ ID NO: 4631152 - DNA, 12 bp, Homo sapiens
cccatggagggt

SEQ ID NO: 4631153 - DNA, 14 bp, Homo sapiens
cccatgtaaccact

SEQ ID NO: 4631154 - DNA, 21 bp, Homo sapiens
cccatgtgtacattctgccta

SEQ ID NO: 4631155 - DNA, 14 bp, Homo sapiens
cccattgctccatt

SEQ ID NO: 4631156 - DNA, 18 bp, Homo sapiens
cccattgttcccttcctc

SEQ ID NO: 4631157 - DNA, 18 bp, Homo sapiens
cccatttcctcacactaa

SEQ ID NO: 4631158 - DNA, 19 bp, Homo sapiens
ccccaaaggaaccgcccag

SEQ ID NO: 4631159 - DNA, 11 bp, Homo sapiens
ccccaaatccg

SEQ ID NO: 4631160 - DNA, 23 bp, Homo sapiens
ccccaacccgtggaggctgctcg

SEQ ID NO: 4631161 - DNA, 16 bp, Homo sapiens
ccccaactccttccag

SEQ ID NO: 4631162 - DNA, 17 bp, Homo sapiens
ccccaactccttccagc

SEQ ID NO: 4631163 - DNA, 16 bp, Homo sapiens
ccccaagatctgccag

SEQ ID NO: 4631164 - DNA, 16 bp, Homo sapiens
ccccaagggccctggc

SEQ ID NO: 4631165 - DNA, 20 bp, Homo sapiens
ccccaagggccctggcaccc

SEQ ID NO: 4631166 - DNA, 19 bp, Homo sapiens
ccccaatcggactgccaaa

SEQ ID NO: 4631167 - DNA, 18 bp, Homo sapiens
ccccaatgtgacctgggg

SEQ ID NO: 4631168 - DNA, 13 bp, Homo sapiens
ccccacccagttc

SEQ ID NO: 4631169 - DNA, 12 bp, Homo sapiens
ccccacccctgt

SEQ ID NO: 4631170 - DNA, 15 bp, Homo sapiens
ccccaccccttccct

SEQ ID NO: 4631171 - DNA, 19 bp, Homo sapiens
ccccactactgcagcacct

SEQ ID NO: 4631172 - DNA, 21 bp, Homo sapiens
ccccactactgcagcacctcc

SEQ ID NO: 4631173 - DNA, 23 bp, Homo sapiens
ccccactactgcagcacctccag

SEQ ID NO: 4631174 - DNA, 12 bp, Homo sapiens
ccccactctgct

SEQ ID NO: 4631175 - DNA, 17 bp, Homo sapiens
ccccactctgctctgat

SEQ ID NO: 4631176 - DNA, 13 bp, Homo sapiens
ccccactgcccca

SEQ ID NO: 4631177 - DNA, 13 bp, Homo sapiens
ccccagccctggc

SEQ ID NO: 4631178 - DNA, 17 bp, Homo sapiens
ccccagccctggcccct

SEQ ID NO: 4631179 - DNA, 21 bp, Homo sapiens
ccccagccctggcccctccaa

SEQ ID NO: 4631180 - DNA, 15 bp, Homo sapiens
ccccagccctgggaa

SEQ ID NO: 4631181 - DNA, 12 bp, Homo sapiens
ccccagcctggg

SEQ ID NO: 4631182 - DNA, 19 bp, Homo sapiens
ccccagctcccccaggcag

SEQ ID NO: 4631183 - DNA, 11 bp, Homo sapiens
ccccagctccg

SEQ ID NO: 4631184 - DNA, 22 bp, Homo sapiens
ccccaggccctactacccattg

SEQ ID NO: 4631185 - DNA, 15 bp, Homo sapiens
ccccagggcacagga

SEQ ID NO: 4631186 - DNA, 16 bp, Homo sapiens
ccccagggcacaggag

SEQ ID NO: 4631187 - DNA, 23 bp, Homo sapiens
ccccagggcacaggagctacctg

SEQ ID NO: 4631188 - DNA, 11 bp, Homo sapiens
ccccaggggca

SEQ ID NO: 4631189 - DNA, 12 bp, Homo sapiens
ccccagtgcccg

SEQ ID NO: 4631190 - DNA, 22 bp, Homo sapiens
ccccagtgcccggtgcagggcc

SEQ ID NO: 4631191 - DNA, 23 bp, Homo sapiens
ccccagtgcccggtgcagggcct

SEQ ID NO: 4631192 - DNA, 15 bp, Homo sapiens
ccccatcagccctgc

SEQ ID NO: 4631193 - DNA, 16 bp, Homo sapiens
ccccatcagccctgct

SEQ ID NO: 4631194 - DNA, 17 bp, Homo sapiens
ccccatcagccctgcta

SEQ ID NO: 4631195 - DNA, 14 bp, Homo sapiens
ccccatcctcatcc

SEQ ID NO: 4631196 - DNA, 16 bp, Homo sapiens
ccccatcctcatccct

SEQ ID NO: 4631197 - DNA, 19 bp, Homo sapiens
ccccatcctcatccctgac

SEQ ID NO: 4631198 - DNA, 20 bp, Homo sapiens
ccccatctaggtcctggctg

SEQ ID NO: 4631199 - DNA, 21 bp, Homo sapiens
ccccatctaggtcctggctgg

SEQ ID NO: 4631200 - DNA, 13 bp, Homo sapiens
ccccatctcactc

SEQ ID NO: 4631201 - DNA, 14 bp, Homo sapiens
ccccatctcactct

SEQ ID NO: 4631202 - DNA, 13 bp, Homo sapiens
ccccatctgtgtt

SEQ ID NO: 4631203 - DNA, 16 bp, Homo sapiens
ccccatctgtgttcta

SEQ ID NO: 4631204 - DNA, 17 bp, Homo sapiens
ccccattagctttcaat

SEQ ID NO: 4631205 - DNA, 16 bp, Homo sapiens
ccccattgctccattc

SEQ ID NO: 4631206 - DNA, 13 bp, Homo sapiens
ccccatttcctca

SEQ ID NO: 4631207 - DNA, 16 bp, Homo sapiens
ccccatttcctcacac

SEQ ID NO: 4631208 - DNA, 15 bp, Homo sapiens
ccccattttctgtgg

SEQ ID NO: 4631209 - DNA, 15 bp, Homo sapiens
cccccagccctggcc

SEQ ID NO: 4631210 - DNA, 16 bp, Homo sapiens
cccccagccctgggaa

SEQ ID NO: 4631211 - DNA, 12 bp, Homo sapiens
cccccagcctgg

SEQ ID NO: 4631212 - DNA, 15 bp, Homo sapiens
cccccagctccggcc

SEQ ID NO: 4631213 - DNA, 12 bp, Homo sapiens
cccccagctggc

SEQ ID NO: 4631214 - DNA, 14 bp, Homo sapiens
cccccatcagccct

SEQ ID NO: 4631215 - DNA, 13 bp, Homo sapiens
cccccctgctgcc

SEQ ID NO: 4631216 - DNA, 13 bp, Homo sapiens
ccccctaagagac

SEQ ID NO: 4631217 - DNA, 11 bp, Homo sapiens
ccccctgcagc

SEQ ID NO: 4631218 - DNA, 23 bp, Homo sapiens
ccccctgcagcttgtagccagcc

SEQ ID NO: 4631219 - DNA, 15 bp, Homo sapiens
ccccctttctctgcc

SEQ ID NO: 4631220 - DNA, 11 bp, Homo sapiens
ccccgaagagt

SEQ ID NO: 4631221 - DNA, 16 bp, Homo sapiens
ccccgacttcctgact

SEQ ID NO: 4631222 - DNA, 13 bp, Homo sapiens
ccccgccagggct

SEQ ID NO: 4631223 - DNA, 14 bp, Homo sapiens
ccccgccagggctg

SEQ ID NO: 4631224 - DNA, 16 bp, Homo sapiens
ccccgccagggctggg

SEQ ID NO: 4631225 - DNA, 17 bp, Homo sapiens
ccccgggatattataga

SEQ ID NO: 4631226 - DNA, 20 bp, Homo sapiens
ccccgggctggagaaagagc

SEQ ID NO: 4631227 - DNA, 13 bp, Homo sapiens
ccccgtcagggag

SEQ ID NO: 4631228 - DNA, 17 bp, Homo sapiens
ccccgtgggccatggca

SEQ ID NO: 4631229 - DNA, 21 bp, Homo sapiens
cccctcacttccagcttgcct

SEQ ID NO: 4631230 - DNA, 13 bp, Homo sapiens
cccctccccatct

SEQ ID NO: 4631231 - DNA, 15 bp, Homo sapiens
cccctccccatctgt

SEQ ID NO: 4631232 - DNA, 15 bp, Homo sapiens
cccctcccctgggac

SEQ ID NO: 4631233 - DNA, 13 bp, Homo sapiens
cccctctctgggc

SEQ ID NO: 4631234 - DNA, 14 bp, Homo sapiens
cccctgatagaaga

SEQ ID NO: 4631235 - DNA, 23 bp, Homo sapiens
cccctgcagcttgtagccagccg

SEQ ID NO: 4631236 - DNA, 20 bp, Homo sapiens
cccctgccttaacctgggac

SEQ ID NO: 4631237 - DNA, 11 bp, Homo sapiens
cccctggccac

SEQ ID NO: 4631238 - DNA, 14 bp, Homo sapiens
cccctggccacagc

SEQ ID NO: 4631239 - DNA, 16 bp, Homo sapiens
cccctggccacagcct

SEQ ID NO: 4631240 - DNA, 17 bp, Homo sapiens
cccctgggaactctcct

SEQ ID NO: 4631241 - DNA, 22 bp, Homo sapiens
ccccttaatcttgctttcttta

SEQ ID NO: 4631242 - DNA, 23 bp, Homo sapiens
ccccttcacgtttgcagttgatg

SEQ ID NO: 4631243 - DNA, 14 bp, Homo sapiens
ccccttcccctggg

SEQ ID NO: 4631244 - DNA, 16 bp, Homo sapiens
ccccttcccctgggaa

SEQ ID NO: 4631245 - DNA, 19 bp, Homo sapiens
ccccttcgtgtgtccatgt

SEQ ID NO: 4631246 - DNA, 14 bp, Homo sapiens
ccccttctgctcag

SEQ ID NO: 4631247 - DNA, 20 bp, Homo sapiens
ccccttctgctcagctctgg

SEQ ID NO: 4631248 - DNA, 22 bp, Homo sapiens
ccccttggaggagagagacccc

SEQ ID NO: 4631249 - DNA, 17 bp, Homo sapiens
ccccttttaaggtttca

SEQ ID NO: 4631250 - DNA, 12 bp, Homo sapiens
cccgaagttcag

SEQ ID NO: 4631251 - DNA, 23 bp, Homo sapiens
cccgacagtgccatccccacctt

SEQ ID NO: 4631252 - DNA, 15 bp, Homo sapiens
cccgagcagctgagc

SEQ ID NO: 4631253 - DNA, 13 bp, Homo sapiens
cccgagggcagcc

SEQ ID NO: 4631254 - DNA, 21 bp, Homo sapiens
cccgagggcagccccctccct

SEQ ID NO: 4631255 - DNA, 21 bp, Homo sapiens
cccgagtcattcgttctgtgg

SEQ ID NO: 4631256 - DNA, 14 bp, Homo sapiens
cccgcagacctctg

SEQ ID NO: 4631257 - DNA, 12 bp, Homo sapiens
cccgccagggct

SEQ ID NO: 4631258 - DNA, 13 bp, Homo sapiens
cccgccagggctg

SEQ ID NO: 4631259 - DNA, 15 bp, Homo sapiens
cccgccagggctggg

SEQ ID NO: 4631260 - DNA, 16 bp, Homo sapiens
cccgccagggctgggg

SEQ ID NO: 4631261 - DNA, 21 bp, Homo sapiens
cccgcccagaggagcccagcg

SEQ ID NO: 4631262 - DNA, 14 bp, Homo sapiens
cccgcccagcctca

SEQ ID NO: 4631263 - DNA, 22 bp, Homo sapiens
cccgccttttcccccaccctcc

SEQ ID NO: 4631264 - DNA, 23 bp, Homo sapiens
cccgctctgccgccgcccgctgg

SEQ ID NO: 4631265 - DNA, 22 bp, Homo sapiens
cccggagctgcccctctctggg

SEQ ID NO: 4631266 - DNA, 17 bp, Homo sapiens
cccggcaccccctgcag

SEQ ID NO: 4631267 - DNA, 18 bp, Homo sapiens
cccggcaccccctgcagc

SEQ ID NO: 4631268 - DNA, 19 bp, Homo sapiens
cccggctcgtgtatttatt

SEQ ID NO: 4631269 - DNA, 21 bp, Homo sapiens
cccgggctggagaaagagctg

SEQ ID NO: 4631270 - DNA, 23 bp, Homo sapiens
cccggggtgagggggggctccct

SEQ ID NO: 4631271 - DNA, 15 bp, Homo sapiens
cccggtgcagggcct

SEQ ID NO: 4631272 - DNA, 16 bp, Homo sapiens
cccggtgcagggcctg

SEQ ID NO: 4631273 - DNA, 14 bp, Homo sapiens
cccgtaagaccacc

SEQ ID NO: 4631274 - DNA, 24 bp, Homo sapiens
cccgtaagaccaccttcccttcct

SEQ ID NO: 4631275 - DNA, 12 bp, Homo sapiens
cccgtcagggag

SEQ ID NO: 4631276 - DNA, 13 bp, Homo sapiens
cccgtccccacac

SEQ ID NO: 4631277 - DNA, 15 bp, Homo sapiens
cccgtccccacacga

SEQ ID NO: 4631278 - DNA, 18 bp, Homo sapiens
cccgtgacagactcctga

SEQ ID NO: 4631279 - DNA, 22 bp, Homo sapiens
cccgtgccaagtccaggtcctg

SEQ ID NO: 4631280 - DNA, 23 bp, Homo sapiens
cccgtgggtgggcctggccctgc

SEQ ID NO: 4631281 - DNA, 14 bp, Homo sapiens
ccctaccctggact

SEQ ID NO: 4631282 - DNA, 21 bp, Homo sapiens
ccctagcaggaacttctagct

SEQ ID NO: 4631283 - DNA, 21 bp, Homo sapiens
ccctagctataccagcagaaa

SEQ ID NO: 4631284 - DNA, 14 bp, Homo sapiens
ccctagctcttccc

SEQ ID NO: 4631285 - DNA, 16 bp, Homo sapiens
ccctagggactgtcct

SEQ ID NO: 4631286 - DNA, 15 bp, Homo sapiens
ccctataggaacagc

SEQ ID NO: 4631287 - DNA, 15 bp, Homo sapiens
ccctatatcagggcc

SEQ ID NO: 4631288 - DNA, 22 bp, Homo sapiens
ccctatatcagggcctgagtga

SEQ ID NO: 4631289 - DNA, 13 bp, Homo sapiens
ccctatgctgtgc

SEQ ID NO: 4631290 - DNA, 22 bp, Homo sapiens
ccctcacaacagtcacctcaca

SEQ ID NO: 4631291 - DNA, 13 bp, Homo sapiens
ccctcacttccag

SEQ ID NO: 4631292 - DNA, 17 bp, Homo sapiens
ccctcagctggtcctga

SEQ ID NO: 4631293 - DNA, 15 bp, Homo sapiens
ccctcaggaattcag

SEQ ID NO: 4631294 - DNA, 16 bp, Homo sapiens
ccctcatacctacacc

SEQ ID NO: 4631295 - DNA, 17 bp, Homo sapiens
ccctcattactgggcct

SEQ ID NO: 4631296 - DNA, 21 bp, Homo sapiens
ccctccaatcctccccgctct

SEQ ID NO: 4631297 - DNA, 11 bp, Homo sapiens
ccctccaccag

SEQ ID NO: 4631298 - DNA, 15 bp, Homo sapiens
ccctccaccagcctg

SEQ ID NO: 4631299 - DNA, 19 bp, Homo sapiens
ccctccaccagcctgctga

SEQ ID NO: 4631300 - DNA, 20 bp, Homo sapiens
ccctccaccagcctgctgac

SEQ ID NO: 4631301 - DNA, 12 bp, Homo sapiens
ccctccaccttc

SEQ ID NO: 4631302 - DNA, 15 bp, Homo sapiens
ccctccaccttccat

SEQ ID NO: 4631303 - DNA, 23 bp, Homo sapiens
ccctccaggagagagccaggatg

SEQ ID NO: 4631304 - DNA, 17 bp, Homo sapiens
ccctcccagcccattgc

SEQ ID NO: 4631305 - DNA, 21 bp, Homo sapiens
ccctcccatgagactgccctg

SEQ ID NO: 4631306 - DNA, 15 bp, Homo sapiens
ccctcccctgggact

SEQ ID NO: 4631307 - DNA, 18 bp, Homo sapiens
ccctcctccagcccctgt

SEQ ID NO: 4631308 - DNA, 19 bp, Homo sapiens
ccctcctgtgctgggggaa

SEQ ID NO: 4631309 - DNA, 15 bp, Homo sapiens
ccctcctttcctttg

SEQ ID NO: 4631310 - DNA, 15 bp, Homo sapiens
ccctcgccccaaagt

SEQ ID NO: 4631311 - DNA, 21 bp, Homo sapiens
ccctcgccccaaagttgctca

SEQ ID NO: 4631312 - DNA, 18 bp, Homo sapiens
ccctctatttattagcca

SEQ ID NO: 4631313 - DNA, 18 bp, Homo sapiens
ccctctccataaccccac

SEQ ID NO: 4631314 - DNA, 12 bp, Homo sapiens
ccctctcccagg

SEQ ID NO: 4631315 - DNA, 13 bp, Homo sapiens
ccctctcccaggc

SEQ ID NO: 4631316 - DNA, 14 bp, Homo sapiens
ccctctcccaggcc

SEQ ID NO: 4631317 - DNA, 20 bp, Homo sapiens
ccctctcccaggccccatga

SEQ ID NO: 4631318 - DNA, 13 bp, Homo sapiens
ccctctctgggcc

SEQ ID NO: 4631319 - DNA, 14 bp, Homo sapiens
ccctctctgggcct

SEQ ID NO: 4631320 - DNA, 19 bp, Homo sapiens
ccctctctgggcctcagag

SEQ ID NO: 4631321 - DNA, 18 bp, Homo sapiens
ccctctgcattgacctgg

SEQ ID NO: 4631322 - DNA, 20 bp, Homo sapiens
ccctctgcctgggatgccct

SEQ ID NO: 4631323 - DNA, 16 bp, Homo sapiens
ccctctttccctgcga

SEQ ID NO: 4631324 - DNA, 22 bp, Homo sapiens
ccctgagatttaacccctccac

SEQ ID NO: 4631325 - DNA, 19 bp, Homo sapiens
ccctgaggagtctgaggtc

SEQ ID NO: 4631326 - DNA, 22 bp, Homo sapiens
ccctgaggagtctgaggtcctg

SEQ ID NO: 4631327 - DNA, 15 bp, Homo sapiens
ccctgatgcaggtca

SEQ ID NO: 4631328 - DNA, 22 bp, Homo sapiens
ccctgcaaacagaacagggtca

SEQ ID NO: 4631329 - DNA, 23 bp, Homo sapiens
ccctgcaacttccgctgaggggt

SEQ ID NO: 4631330 - DNA, 13 bp, Homo sapiens
ccctgcagaccct

SEQ ID NO: 4631331 - DNA, 19 bp, Homo sapiens
ccctgcagaccctgccctt

SEQ ID NO: 4631332 - DNA, 18 bp, Homo sapiens
ccctgcagcccccactca

SEQ ID NO: 4631333 - DNA, 19 bp, Homo sapiens
ccctgcagcttgtagccag

SEQ ID NO: 4631334 - DNA, 20 bp, Homo sapiens
ccctgcagcttgtagccagc

SEQ ID NO: 4631335 - DNA, 22 bp, Homo sapiens
ccctgcagcttgtagccagccg

SEQ ID NO: 4631336 - DNA, 18 bp, Homo sapiens
ccctgcaggacttgccac

SEQ ID NO: 4631337 - DNA, 22 bp, Homo sapiens
ccctgcagggccatctgactgc

SEQ ID NO: 4631338 - DNA, 16 bp, Homo sapiens
ccctgcatctgtctgc

SEQ ID NO: 4631339 - DNA, 22 bp, Homo sapiens
ccctgcattcttccgcaccctc

SEQ ID NO: 4631340 - DNA, 13 bp, Homo sapiens
ccctgcccacaga

SEQ ID NO: 4631341 - DNA, 20 bp, Homo sapiens
ccctgcccacagaaagccag

SEQ ID NO: 4631342 - DNA, 20 bp, Homo sapiens
ccctgcccaggtatcctggg

SEQ ID NO: 4631343 - DNA, 18 bp, Homo sapiens
ccctgcccctgtgggact

SEQ ID NO: 4631344 - DNA, 14 bp, Homo sapiens
ccctgccctgctct

SEQ ID NO: 4631345 - DNA, 10 bp, Homo sapiens
ccctgcctca

SEQ ID NO: 4631346 - DNA, 14 bp, Homo sapiens
ccctgcctcacatc

SEQ ID NO: 4631347 - DNA, 12 bp, Homo sapiens
ccctgcctggag

SEQ ID NO: 4631348 - DNA, 13 bp, Homo sapiens
ccctgcctggagg

SEQ ID NO: 4631349 - DNA, 15 bp, Homo sapiens
ccctgcctggaggac

SEQ ID NO: 4631350 - DNA, 15 bp, Homo sapiens
ccctgctctgcccag

SEQ ID NO: 4631351 - DNA, 13 bp, Homo sapiens
ccctgctgaatgc

SEQ ID NO: 4631352 - DNA, 16 bp, Homo sapiens
ccctggaccacgaggc

SEQ ID NO: 4631353 - DNA, 13 bp, Homo sapiens
ccctggagcagga

SEQ ID NO: 4631354 - DNA, 13 bp, Homo sapiens
ccctggagccaga

SEQ ID NO: 4631355 - DNA, 15 bp, Homo sapiens
ccctggagggcaagc

SEQ ID NO: 4631356 - DNA, 20 bp, Homo sapiens
ccctggatcagcgtggcctt

SEQ ID NO: 4631357 - DNA, 15 bp, Homo sapiens
ccctggccacagcct

SEQ ID NO: 4631358 - DNA, 14 bp, Homo sapiens
ccctggccccagga

SEQ ID NO: 4631359 - DNA, 21 bp, Homo sapiens
ccctggcccccatcagccctg

SEQ ID NO: 4631360 - DNA, 22 bp, Homo sapiens
ccctggcccccatcagccctgc

SEQ ID NO: 4631361 - DNA, 16 bp, Homo sapiens
ccctggccccctgagt

SEQ ID NO: 4631362 - DNA, 21 bp, Homo sapiens
ccctggcctgaactgaggaga

SEQ ID NO: 4631363 - DNA, 23 bp, Homo sapiens
ccctggctgggacgtggctcagc

SEQ ID NO: 4631364 - DNA, 19 bp, Homo sapiens
ccctgggaactctcctggc

SEQ ID NO: 4631365 - DNA, 21 bp, Homo sapiens
ccctgggaactctcctggcct

SEQ ID NO: 4631366 - DNA, 19 bp, Homo sapiens
ccctgggactttcccaccc

SEQ ID NO: 4631367 - DNA, 21 bp, Homo sapiens
ccctgggactttcccacccag

SEQ ID NO: 4631368 - DNA, 16 bp, Homo sapiens
ccctgggccagggtct

SEQ ID NO: 4631369 - DNA, 13 bp, Homo sapiens
ccctgggcctgct

SEQ ID NO: 4631370 - DNA, 14 bp, Homo sapiens
ccctgggcctgctg

SEQ ID NO: 4631371 - DNA, 19 bp, Homo sapiens
ccctgggcctgctgctgag

SEQ ID NO: 4631372 - DNA, 20 bp, Homo sapiens
ccctgggcctgctgctgaga

SEQ ID NO: 4631373 - DNA, 17 bp, Homo sapiens
ccctggggcctgtactg

SEQ ID NO: 4631374 - DNA, 21 bp, Homo sapiens
ccctggggcctgtactgcctg

SEQ ID NO: 4631375 - DNA, 22 bp, Homo sapiens
ccctgggggtttaagctctgcc

SEQ ID NO: 4631376 - DNA, 21 bp, Homo sapiens
ccctgtaatcaggcaaggagg

SEQ ID NO: 4631377 - DNA, 22 bp, Homo sapiens
ccctgtaatcaggcaaggagga

SEQ ID NO: 4631378 - DNA, 23 bp, Homo sapiens
ccctgtaatcaggcaaggaggag

SEQ ID NO: 4631379 - DNA, 14 bp, Homo sapiens
ccctgtcccagggc

SEQ ID NO: 4631380 - DNA, 17 bp, Homo sapiens
ccctgtcccagggccct

SEQ ID NO: 4631381 - DNA, 22 bp, Homo sapiens
ccctgtccctctagtgccttct

SEQ ID NO: 4631382 - DNA, 22 bp, Homo sapiens
ccctgtgggactcatccttgcc

SEQ ID NO: 4631383 - DNA, 19 bp, Homo sapiens
ccctgtgtccacctgtggg

SEQ ID NO: 4631384 - DNA, 14 bp, Homo sapiens
cccttaaaggggag

SEQ ID NO: 4631385 - DNA, 21 bp, Homo sapiens
cccttaaggcacagtgggagc

SEQ ID NO: 4631386 - DNA, 19 bp, Homo sapiens
cccttacagcctctgactt

SEQ ID NO: 4631387 - DNA, 17 bp, Homo sapiens
cccttattagttacaaa

SEQ ID NO: 4631388 - DNA, 20 bp, Homo sapiens
cccttccaaataataaagtc

SEQ ID NO: 4631389 - DNA, 12 bp, Homo sapiens
cccttccacctc

SEQ ID NO: 4631390 - DNA, 21 bp, Homo sapiens
cccttccacctcacaactcct

SEQ ID NO: 4631391 - DNA, 12 bp, Homo sapiens
cccttccccatg

SEQ ID NO: 4631392 - DNA, 16 bp, Homo sapiens
cccttccccctttctc

SEQ ID NO: 4631393 - DNA, 14 bp, Homo sapiens
cccttcccctggga

SEQ ID NO: 4631394 - DNA, 15 bp, Homo sapiens
cccttcccctgggaa

SEQ ID NO: 4631395 - DNA, 18 bp, Homo sapiens
cccttcctcctgcctttc

SEQ ID NO: 4631396 - DNA, 18 bp, Homo sapiens
cccttcctctccaccctc

SEQ ID NO: 4631397 - DNA, 20 bp, Homo sapiens
cccttcctcttcctgccctt

SEQ ID NO: 4631398 - DNA, 11 bp, Homo sapiens
cccttcctgga

SEQ ID NO: 4631399 - DNA, 14 bp, Homo sapiens
cccttcctggacag

SEQ ID NO: 4631400 - DNA, 19 bp, Homo sapiens
cccttcctggacagctgtg

SEQ ID NO: 4631401 - DNA, 22 bp, Homo sapiens
cccttcctggacagctgtgcct

SEQ ID NO: 4631402 - DNA, 14 bp, Homo sapiens
cccttctgctcagc

SEQ ID NO: 4631403 - DNA, 15 bp, Homo sapiens
cccttgctgggcctg

SEQ ID NO: 4631404 - DNA, 18 bp, Homo sapiens
cccttgctgggcctgggg

SEQ ID NO: 4631405 - DNA, 14 bp, Homo sapiens
cccttggaggagag

SEQ ID NO: 4631406 - DNA, 20 bp, Homo sapiens
cccttgggcagagtcctgcc

SEQ ID NO: 4631407 - DNA, 14 bp, Homo sapiens
ccctttctctgcct

SEQ ID NO: 4631408 - DNA, 16 bp, Homo sapiens
ccctttctctgcctgg

SEQ ID NO: 4631409 - DNA, 17 bp, Homo sapiens
ccctttctctgcctggc

SEQ ID NO: 4631410 - DNA, 18 bp, Homo sapiens
ccctttctctgcctggca

SEQ ID NO: 4631411 - DNA, 19 bp, Homo sapiens
ccctttgagatctggggag

SEQ ID NO: 4631412 - DNA, 11 bp, Homo sapiens
cccttttcctt

SEQ ID NO: 4631413 - DNA, 13 bp, Homo sapiens
cccttttcctttt

SEQ ID NO: 4631414 - DNA, 15 bp, Homo sapiens
ccctttttggactag

SEQ ID NO: 4631415 - DNA, 15 bp, Homo sapiens
ccgaacctcctctgt

SEQ ID NO: 4631416 - DNA, 16 bp, Homo sapiens
ccgaacctcctctgtg

SEQ ID NO: 4631417 - DNA, 17 bp, Homo sapiens
ccgaagagcaaacaaaa

SEQ ID NO: 4631418 - DNA, 16 bp, Homo sapiens
ccgaaggggctctgag

SEQ ID NO: 4631419 - DNA, 14 bp, Homo sapiens
ccgactctggccct

SEQ ID NO: 4631420 - DNA, 13 bp, Homo sapiens
ccgagaagaacag

SEQ ID NO: 4631421 - DNA, 21 bp, Homo sapiens
ccgagaagcacttgagcatga

SEQ ID NO: 4631422 - DNA, 16 bp, Homo sapiens
ccgagcaaccgtggcc

SEQ ID NO: 4631423 - DNA, 18 bp, Homo sapiens
ccgagcaaccgtggccct

SEQ ID NO: 4631424 - DNA, 14 bp, Homo sapiens
ccgagcagctgagc

SEQ ID NO: 4631425 - DNA, 20 bp, Homo sapiens
ccgagggcagccccctccct

SEQ ID NO: 4631426 - DNA, 15 bp, Homo sapiens
ccgaggtggttcaga

SEQ ID NO: 4631427 - DNA, 19 bp, Homo sapiens
ccgagtcattcgttctgtg

SEQ ID NO: 4631428 - DNA, 13 bp, Homo sapiens
ccgagtccaagct

SEQ ID NO: 4631429 - DNA, 11 bp, Homo sapiens
ccgatgccacc

SEQ ID NO: 4631430 - DNA, 19 bp, Homo sapiens
ccgatgccaccggcctgtg

SEQ ID NO: 4631431 - DNA, 11 bp, Homo sapiens
ccgccacagcc

SEQ ID NO: 4631432 - DNA, 14 bp, Homo sapiens
ccgccacagccttc

SEQ ID NO: 4631433 - DNA, 17 bp, Homo sapiens
ccgccacggcctggctg

SEQ ID NO: 4631434 - DNA, 14 bp, Homo sapiens
ccgccacgtcccag

SEQ ID NO: 4631435 - DNA, 14 bp, Homo sapiens
ccgccagccacagg

SEQ ID NO: 4631436 - DNA, 15 bp, Homo sapiens
ccgccagccacagga

SEQ ID NO: 4631437 - DNA, 16 bp, Homo sapiens
ccgccagccacaggac

SEQ ID NO: 4631438 - DNA, 17 bp, Homo sapiens
ccgccagccacaggacc

SEQ ID NO: 4631439 - DNA, 15 bp, Homo sapiens
ccgccagggctgggg

SEQ ID NO: 4631440 - DNA, 15 bp, Homo sapiens
ccgcccacctcagcc

SEQ ID NO: 4631441 - DNA, 20 bp, Homo sapiens
ccgcccagaggagcccagcg

SEQ ID NO: 4631442 - DNA, 13 bp, Homo sapiens
ccgcccagcctca

SEQ ID NO: 4631443 - DNA, 14 bp, Homo sapiens
ccgcccagcctcac

SEQ ID NO: 4631444 - DNA, 15 bp, Homo sapiens
ccgccgcccgctggg

SEQ ID NO: 4631445 - DNA, 17 bp, Homo sapiens
ccgcctctcctccatct

SEQ ID NO: 4631446 - DNA, 19 bp, Homo sapiens
ccgccttctcccacatgag

SEQ ID NO: 4631447 - DNA, 19 bp, Homo sapiens
ccgccttttcccccaccct

SEQ ID NO: 4631448 - DNA, 17 bp, Homo sapiens
ccgcgccgatgccaccg

SEQ ID NO: 4631449 - DNA, 21 bp, Homo sapiens
ccgcggcccgcgcagctgcct

SEQ ID NO: 4631450 - DNA, 15 bp, Homo sapiens
ccgcgtctaccctgg

SEQ ID NO: 4631451 - DNA, 17 bp, Homo sapiens
ccgcgtctaccctggga

SEQ ID NO: 4631452 - DNA, 17 bp, Homo sapiens
ccgcgtgcaaaggaaag

SEQ ID NO: 4631453 - DNA, 19 bp, Homo sapiens
ccgctacaccactctggca

SEQ ID NO: 4631454 - DNA, 20 bp, Homo sapiens
ccgctacaccactctggcag

SEQ ID NO: 4631455 - DNA, 20 bp, Homo sapiens
ccgctagtgcttgtggagat

SEQ ID NO: 4631456 - DNA, 22 bp, Homo sapiens
ccgctagtgcttgtggagatca

SEQ ID NO: 4631457 - DNA, 12 bp, Homo sapiens
ccgctggccctg

SEQ ID NO: 4631458 - DNA, 21 bp, Homo sapiens
ccgctggggaccggttcccac

SEQ ID NO: 4631459 - DNA, 18 bp, Homo sapiens
ccggagcaaactctgctg

SEQ ID NO: 4631460 - DNA, 19 bp, Homo sapiens
ccggagctgcccctctctg

SEQ ID NO: 4631461 - DNA, 17 bp, Homo sapiens
ccggagtccctgcaggt

SEQ ID NO: 4631462 - DNA, 14 bp, Homo sapiens
ccggcaccccctgc

SEQ ID NO: 4631463 - DNA, 17 bp, Homo sapiens
ccggcaccccctgcagc

SEQ ID NO: 4631464 - DNA, 18 bp, Homo sapiens
ccggcaccccctgcagct

SEQ ID NO: 4631465 - DNA, 20 bp, Homo sapiens
ccggcaccccctgcagcttg

SEQ ID NO: 4631466 - DNA, 12 bp, Homo sapiens
ccggcagagctc

SEQ ID NO: 4631467 - DNA, 13 bp, Homo sapiens
ccggcagagctct

SEQ ID NO: 4631468 - DNA, 22 bp, Homo sapiens
ccggcagagctctacaggcctg

SEQ ID NO: 4631469 - DNA, 16 bp, Homo sapiens
ccggcagccagatggc

SEQ ID NO: 4631470 - DNA, 20 bp, Homo sapiens
ccggcagcgggcggagggga

SEQ ID NO: 4631471 - DNA, 11 bp, Homo sapiens
ccggccagccc

SEQ ID NO: 4631472 - DNA, 21 bp, Homo sapiens
ccggctccccctccagccaga

SEQ ID NO: 4631473 - DNA, 17 bp, Homo sapiens
ccgggatattatagaaa

SEQ ID NO: 4631474 - DNA, 13 bp, Homo sapiens
ccgggctggagaa

SEQ ID NO: 4631475 - DNA, 15 bp, Homo sapiens
ccggggaactggcca

SEQ ID NO: 4631476 - DNA, 16 bp, Homo sapiens
ccggggaactggccaa

SEQ ID NO: 4631477 - DNA, 22 bp, Homo sapiens
ccggggctctgggtgctgccct

SEQ ID NO: 4631478 - DNA, 19 bp, Homo sapiens
ccggtgcagggcctggcat

SEQ ID NO: 4631479 - DNA, 15 bp, Homo sapiens
ccggtgctgcaggag

SEQ ID NO: 4631480 - DNA, 13 bp, Homo sapiens
ccggttcccacaa

SEQ ID NO: 4631481 - DNA, 19 bp, Homo sapiens
ccgtaagaccaccttccct

SEQ ID NO: 4631482 - DNA, 22 bp, Homo sapiens
ccgtaagaccaccttcccttcc

SEQ ID NO: 4631483 - DNA, 22 bp, Homo sapiens
ccgtaattgctttgtgcctttg

SEQ ID NO: 4631484 - DNA, 16 bp, Homo sapiens
ccgtcagggagaggtc

SEQ ID NO: 4631485 - DNA, 14 bp, Homo sapiens
ccgtcctggcacag

SEQ ID NO: 4631486 - DNA, 23 bp, Homo sapiens
ccgtgaaggcttctctgttctac

SEQ ID NO: 4631487 - DNA, 22 bp, Homo sapiens
ccgtgacagactcctgaggaca

SEQ ID NO: 4631488 - DNA, 21 bp, Homo sapiens
ccgtgccaagtccaggtcctg

SEQ ID NO: 4631489 - DNA, 12 bp, Homo sapiens
ccgtggaggctg

SEQ ID NO: 4631490 - DNA, 17 bp, Homo sapiens
ccgtgggtgggcctggc

SEQ ID NO: 4631491 - DNA, 20 bp, Homo sapiens
ccgtgtgagtgtgacagggc

SEQ ID NO: 4631492 - DNA, 21 bp, Homo sapiens
ccgtgtgagtgtgacagggcc

SEQ ID NO: 4631493 - DNA, 22 bp, Homo sapiens
ccgtgtgagtgtgacagggcca

SEQ ID NO: 4631494 - DNA, 14 bp, Homo sapiens
ccgttcacatgtgt

SEQ ID NO: 4631495 - DNA, 23 bp, Homo sapiens
ccgttggaaacataaccattaca

SEQ ID NO: 4631496 - DNA, 22 bp, Homo sapiens
cctaaagaaaaatatcttggcc

SEQ ID NO: 4631497 - DNA, 14 bp, Homo sapiens
cctaaagggcaggg

SEQ ID NO: 4631498 - DNA, 18 bp, Homo sapiens
cctaaagggcagggccca

SEQ ID NO: 4631499 - DNA, 18 bp, Homo sapiens
cctaactctgcccaccct

SEQ ID NO: 4631500 - DNA, 19 bp, Homo sapiens
cctaagtgcaaacacagca

SEQ ID NO: 4631501 - DNA, 21 bp, Homo sapiens
cctaataattgtatctacatt

SEQ ID NO: 4631502 - DNA, 11 bp, Homo sapiens
cctaatatcat

SEQ ID NO: 4631503 - DNA, 14 bp, Homo sapiens
cctaatatcatttt

SEQ ID NO: 4631504 - DNA, 16 bp, Homo sapiens
cctaatatcattttat

SEQ ID NO: 4631505 - DNA, 17 bp, Homo sapiens
cctaatatcattttatt

SEQ ID NO: 4631506 - DNA, 21 bp, Homo sapiens
cctacaccattatcttggaaa

SEQ ID NO: 4631507 - DNA, 12 bp, Homo sapiens
cctacagcacta

SEQ ID NO: 4631508 - DNA, 19 bp, Homo sapiens
cctacagcactactgggtg

SEQ ID NO: 4631509 - DNA, 20 bp, Homo sapiens
cctacagtgtacagtcttgt

SEQ ID NO: 4631510 - DNA, 16 bp, Homo sapiens
cctaccgctggccctg

SEQ ID NO: 4631511 - DNA, 22 bp, Homo sapiens
cctaccgctggccctgccgttt

SEQ ID NO: 4631512 - DNA, 24 bp, Homo sapiens
cctactacccattgttcccttcct

SEQ ID NO: 4631513 - DNA, 15 bp, Homo sapiens
cctactcacacaggc

SEQ ID NO: 4631514 - DNA, 16 bp, Homo sapiens
cctactcacacaggca

SEQ ID NO: 4631515 - DNA, 13 bp, Homo sapiens
cctagcagcctca

SEQ ID NO: 4631516 - DNA, 19 bp, Homo sapiens
cctagcaggaacttctagc

SEQ ID NO: 4631517 - DNA, 18 bp, Homo sapiens
cctagccaggtctcctgg

SEQ ID NO: 4631518 - DNA, 19 bp, Homo sapiens
cctagccaggtctcctggg

SEQ ID NO: 4631519 - DNA, 13 bp, Homo sapiens
cctagctggctct

SEQ ID NO: 4631520 - DNA, 20 bp, Homo sapiens
cctaggagggctctgagcca

SEQ ID NO: 4631521 - DNA, 15 bp, Homo sapiens
cctagggactgtcct

SEQ ID NO: 4631522 - DNA, 13 bp, Homo sapiens
cctagggtgggaa

SEQ ID NO: 4631523 - DNA, 16 bp, Homo sapiens
cctagtaaaaccttgt

SEQ ID NO: 4631524 - DNA, 22 bp, Homo sapiens
cctagtaaaaccttgttctatt

SEQ ID NO: 4631525 - DNA, 16 bp, Homo sapiens
cctagtaaccaaggcc

SEQ ID NO: 4631526 - DNA, 22 bp, Homo sapiens
cctagtaaccaaggccctgtct

SEQ ID NO: 4631527 - DNA, 14 bp, Homo sapiens
cctagtacaatctt

SEQ ID NO: 4631528 - DNA, 18 bp, Homo sapiens
cctataggaacagcccag

SEQ ID NO: 4631529 - DNA, 15 bp, Homo sapiens
cctatatatttctat

SEQ ID NO: 4631530 - DNA, 15 bp, Homo sapiens
cctatgatggatggc

SEQ ID NO: 4631531 - DNA, 12 bp, Homo sapiens
cctatgctgtgc

SEQ ID NO: 4631532 - DNA, 13 bp, Homo sapiens
cctatggagagcc

SEQ ID NO: 4631533 - DNA, 17 bp, Homo sapiens
cctatggagagccctgg

SEQ ID NO: 4631534 - DNA, 14 bp, Homo sapiens
cctatggagaggct

SEQ ID NO: 4631535 - DNA, 13 bp, Homo sapiens
cctcacaactcct

SEQ ID NO: 4631536 - DNA, 20 bp, Homo sapiens
cctcacaactccttccatcc

SEQ ID NO: 4631537 - DNA, 23 bp, Homo sapiens
cctcacacaccctgaggtcaggg

SEQ ID NO: 4631538 - DNA, 15 bp, Homo sapiens
cctcacactttgcca

SEQ ID NO: 4631539 - DNA, 14 bp, Homo sapiens
cctcacatctccct

SEQ ID NO: 4631540 - DNA, 17 bp, Homo sapiens
cctcacccctcccctgg

SEQ ID NO: 4631541 - DNA, 18 bp, Homo sapiens
cctcacccctcccctggg

SEQ ID NO: 4631542 - DNA, 19 bp, Homo sapiens
cctcacccctcccctggga

SEQ ID NO: 4631543 - DNA, 13 bp, Homo sapiens
cctcacccctgcc

SEQ ID NO: 4631544 - DNA, 19 bp, Homo sapiens
cctcacccctgcccctgtg

SEQ ID NO: 4631545 - DNA, 20 bp, Homo sapiens
cctcactgaaaacatctgga

SEQ ID NO: 4631546 - DNA, 12 bp, Homo sapiens
cctcagagcttc

SEQ ID NO: 4631547 - DNA, 15 bp, Homo sapiens
cctcagagcttcctg

SEQ ID NO: 4631548 - DNA, 14 bp, Homo sapiens
cctcagctggtcct

SEQ ID NO: 4631549 - DNA, 10 bp, Homo sapiens
cctcaggaat

SEQ ID NO: 4631550 - DNA, 19 bp, Homo sapiens
cctcaggagtttctatagg

SEQ ID NO: 4631551 - DNA, 18 bp, Homo sapiens
cctcaggcacccgtcccc

SEQ ID NO: 4631552 - DNA, 14 bp, Homo sapiens
cctcaggctctgca

SEQ ID NO: 4631553 - DNA, 17 bp, Homo sapiens
cctcagtgcaaaatgtc

SEQ ID NO: 4631554 - DNA, 22 bp, Homo sapiens
cctcagtgcaaaatgtcttgtg

SEQ ID NO: 4631555 - DNA, 23 bp, Homo sapiens
cctcagtgcaaaatgtcttgtgt

SEQ ID NO: 4631556 - DNA, 24 bp, Homo sapiens
cctcagtgcaaaatgtcttgtgta

SEQ ID NO: 4631557 - DNA, 13 bp, Homo sapiens
cctcatccctgac

SEQ ID NO: 4631558 - DNA, 16 bp, Homo sapiens
cctcatctatgaggaa

SEQ ID NO: 4631559 - DNA, 15 bp, Homo sapiens
cctcatctgtggagc

SEQ ID NO: 4631560 - DNA, 18 bp, Homo sapiens
cctcatctgtggagctgc

SEQ ID NO: 4631561 - DNA, 16 bp, Homo sapiens
cctccaccagcctgct

SEQ ID NO: 4631562 - DNA, 17 bp, Homo sapiens
cctccaccagcctgctg

SEQ ID NO: 4631563 - DNA, 12 bp, Homo sapiens
cctccactgctg

SEQ ID NO: 4631564 - DNA, 18 bp, Homo sapiens
cctccagcccctgtccca

SEQ ID NO: 4631565 - DNA, 17 bp, Homo sapiens
cctccagctttcctgta

SEQ ID NO: 4631566 - DNA, 13 bp, Homo sapiens
cctccaggcctgt

SEQ ID NO: 4631567 - DNA, 17 bp, Homo sapiens
cctccaggcctgttgct

SEQ ID NO: 4631568 - DNA, 21 bp, Homo sapiens
cctccatactcaagctgtctc

SEQ ID NO: 4631569 - DNA, 21 bp, Homo sapiens
cctcccatgagactgccctgc

SEQ ID NO: 4631570 - DNA, 22 bp, Homo sapiens
cctcccatgagactgccctgcc

SEQ ID NO: 4631571 - DNA, 14 bp, Homo sapiens
cctccccagcccag

SEQ ID NO: 4631572 - DNA, 15 bp, Homo sapiens
cctccccagcccagg

SEQ ID NO: 4631573 - DNA, 16 bp, Homo sapiens
cctccccatctgtgtt

SEQ ID NO: 4631574 - DNA, 12 bp, Homo sapiens
cctccccctgca

SEQ ID NO: 4631575 - DNA, 13 bp, Homo sapiens
cctccccctgcaa

SEQ ID NO: 4631576 - DNA, 20 bp, Homo sapiens
cctcccgggttcaagcttgt

SEQ ID NO: 4631577 - DNA, 13 bp, Homo sapiens
cctccctcctcac

SEQ ID NO: 4631578 - DNA, 13 bp, Homo sapiens
cctccctcctttc

SEQ ID NO: 4631579 - DNA, 20 bp, Homo sapiens
cctccctggtgagagggccg

SEQ ID NO: 4631580 - DNA, 15 bp, Homo sapiens
cctccctgtcccagg

SEQ ID NO: 4631581 - DNA, 17 bp, Homo sapiens
cctccgccttctcccac

SEQ ID NO: 4631582 - DNA, 15 bp, Homo sapiens
cctcctcactcccta

SEQ ID NO: 4631583 - DNA, 19 bp, Homo sapiens
cctcctctctccctgcctc

SEQ ID NO: 4631584 - DNA, 21 bp, Homo sapiens
cctcctctctccctgcctcac

SEQ ID NO: 4631585 - DNA, 19 bp, Homo sapiens
cctcctctgccagcaggaa

SEQ ID NO: 4631586 - DNA, 22 bp, Homo sapiens
cctcctctgccagcaggaataa

SEQ ID NO: 4631587 - DNA, 18 bp, Homo sapiens
cctcctgcctctactggg

SEQ ID NO: 4631588 - DNA, 13 bp, Homo sapiens
cctcctgctgggc

SEQ ID NO: 4631589 - DNA, 14 bp, Homo sapiens
cctcctgctttggg

SEQ ID NO: 4631590 - DNA, 18 bp, Homo sapiens
cctcctgctttgggaaga

SEQ ID NO: 4631591 - DNA, 17 bp, Homo sapiens
cctcctgggttcacgta

SEQ ID NO: 4631592 - DNA, 13 bp, Homo sapiens
cctccttctcctt

SEQ ID NO: 4631593 - DNA, 23 bp, Homo sapiens
cctccttcttttcctaacatgca

SEQ ID NO: 4631594 - DNA, 17 bp, Homo sapiens
cctcgacagggcctgga

SEQ ID NO: 4631595 - DNA, 23 bp, Homo sapiens
cctcgcaacccgtgccaagtcca

SEQ ID NO: 4631596 - DNA, 13 bp, Homo sapiens
cctcgccttgtgt

SEQ ID NO: 4631597 - DNA, 19 bp, Homo sapiens
cctcgctccccactctgct

SEQ ID NO: 4631598 - DNA, 22 bp, Homo sapiens
cctcgctccccactctgctctg

SEQ ID NO: 4631599 - DNA, 15 bp, Homo sapiens
cctcgctcccttcaa

SEQ ID NO: 4631600 - DNA, 19 bp, Homo sapiens
cctcgctctgttacccagg

SEQ ID NO: 4631601 - DNA, 14 bp, Homo sapiens
cctcgctttttcat

SEQ ID NO: 4631602 - DNA, 15 bp, Homo sapiens
cctcgctttttcatc

SEQ ID NO: 4631603 - DNA, 19 bp, Homo sapiens
cctcgctttttcatccttc

SEQ ID NO: 4631604 - DNA, 21 bp, Homo sapiens
cctcgctttttcatccttctt

SEQ ID NO: 4631605 - DNA, 16 bp, Homo sapiens
cctcggagggatggag

SEQ ID NO: 4631606 - DNA, 22 bp, Homo sapiens
cctcggagggatggagaaagaa

SEQ ID NO: 4631607 - DNA, 23 bp, Homo sapiens
cctcgtgaggggcaagctaggcc

SEQ ID NO: 4631608 - DNA, 17 bp, Homo sapiens
cctcgttctccctggga

SEQ ID NO: 4631609 - DNA, 16 bp, Homo sapiens
cctctactgggaaggc

SEQ ID NO: 4631610 - DNA, 13 bp, Homo sapiens
cctctatttatta

SEQ ID NO: 4631611 - DNA, 19 bp, Homo sapiens
cctctatttattagccaac

SEQ ID NO: 4631612 - DNA, 21 bp, Homo sapiens
cctctatttattagccaactg

SEQ ID NO: 4631613 - DNA, 22 bp, Homo sapiens
cctctcatttccagcttctcag

SEQ ID NO: 4631614 - DNA, 22 bp, Homo sapiens
cctctccaccctcccagacctg

SEQ ID NO: 4631615 - DNA, 23 bp, Homo sapiens
cctctccagtttgcacctgtccc

SEQ ID NO: 4631616 - DNA, 16 bp, Homo sapiens
cctctcccaggcccca

SEQ ID NO: 4631617 - DNA, 17 bp, Homo sapiens
cctctcccaggccccat

SEQ ID NO: 4631618 - DNA, 23 bp, Homo sapiens
cctctccgtttattataaactgt

SEQ ID NO: 4631619 - DNA, 15 bp, Homo sapiens
cctctctccctgcct

SEQ ID NO: 4631620 - DNA, 20 bp, Homo sapiens
cctctctccctgcctcacat

SEQ ID NO: 4631621 - DNA, 22 bp, Homo sapiens
cctctctccctgcctcacatct

SEQ ID NO: 4631622 - DNA, 13 bp, Homo sapiens
cctctctgggcct

SEQ ID NO: 4631623 - DNA, 16 bp, Homo sapiens
cctctctgggcctcag

SEQ ID NO: 4631624 - DNA, 22 bp, Homo sapiens
cctctgacttaagctgcctcaa

SEQ ID NO: 4631625 - DNA, 14 bp, Homo sapiens
cctctgaggccagc

SEQ ID NO: 4631626 - DNA, 15 bp, Homo sapiens
cctctgaggccagcc

SEQ ID NO: 4631627 - DNA, 20 bp, Homo sapiens
cctctgaggccagcctggcc

SEQ ID NO: 4631628 - DNA, 20 bp, Homo sapiens
cctctgatagctgtttcaaa

SEQ ID NO: 4631629 - DNA, 20 bp, Homo sapiens
cctctgcacaccctccagag

SEQ ID NO: 4631630 - DNA, 20 bp, Homo sapiens
cctctgccagcaggaataaa

SEQ ID NO: 4631631 - DNA, 22 bp, Homo sapiens
cctctgccagcaggaataaaga

SEQ ID NO: 4631632 - DNA, 17 bp, Homo sapiens
cctctgccccaagagca

SEQ ID NO: 4631633 - DNA, 16 bp, Homo sapiens
cctctgcctcctgggt

SEQ ID NO: 4631634 - DNA, 14 bp, Homo sapiens
cctctgcctgggat

SEQ ID NO: 4631635 - DNA, 13 bp, Homo sapiens
cctctgcttccca

SEQ ID NO: 4631636 - DNA, 16 bp, Homo sapiens
cctctgggaccccagc

SEQ ID NO: 4631637 - DNA, 19 bp, Homo sapiens
cctctgggaccccagctgc

SEQ ID NO: 4631638 - DNA, 21 bp, Homo sapiens
cctctgtcagtcacagccacc

SEQ ID NO: 4631639 - DNA, 18 bp, Homo sapiens
cctctgtctcgagcgccc

SEQ ID NO: 4631640 - DNA, 17 bp, Homo sapiens
cctctgtgaactgtgtg

SEQ ID NO: 4631641 - DNA, 22 bp, Homo sapiens
cctctgtgtacatgtgtgcaga

SEQ ID NO: 4631642 - DNA, 15 bp, Homo sapiens
cctctgttccccacc

SEQ ID NO: 4631643 - DNA, 15 bp, Homo sapiens
cctcttcccccttcc

SEQ ID NO: 4631644 - DNA, 13 bp, Homo sapiens
cctcttcctgccc

SEQ ID NO: 4631645 - DNA, 16 bp, Homo sapiens
cctcttcctgcccttg

SEQ ID NO: 4631646 - DNA, 22 bp, Homo sapiens
cctcttgtcagtgtagacacag

SEQ ID NO: 4631647 - DNA, 16 bp, Homo sapiens
cctctttccctgcgag

SEQ ID NO: 4631648 - DNA, 18 bp, Homo sapiens
cctctttgagaccccagt

SEQ ID NO: 4631649 - DNA, 15 bp, Homo sapiens
cctctttgtctaaaa

SEQ ID NO: 4631650 - DNA, 22 bp, Homo sapiens
cctctttgtctaaaacaataaa

SEQ ID NO: 4631651 - DNA, 14 bp, Homo sapiens
cctgaaagctggga

SEQ ID NO: 4631652 - DNA, 20 bp, Homo sapiens
cctgaaagggcacttaattt

SEQ ID NO: 4631653 - DNA, 18 bp, Homo sapiens
cctgaaggcacagctaac

SEQ ID NO: 4631654 - DNA, 13 bp, Homo sapiens
cctgaagggaact

SEQ ID NO: 4631655 - DNA, 14 bp, Homo sapiens
cctgacctgtgagc

SEQ ID NO: 4631656 - DNA, 19 bp, Homo sapiens
cctgacctgtgagcccagc

SEQ ID NO: 4631657 - DNA, 20 bp, Homo sapiens
cctgacctgtgagcccagct

SEQ ID NO: 4631658 - DNA, 15 bp, Homo sapiens
cctgaccttggaatc

SEQ ID NO: 4631659 - DNA, 16 bp, Homo sapiens
cctgagaagctgctcc

SEQ ID NO: 4631660 - DNA, 23 bp, Homo sapiens
cctgagaagctgctccaggcctg

SEQ ID NO: 4631661 - DNA, 18 bp, Homo sapiens
cctgagagaattggctca

SEQ ID NO: 4631662 - DNA, 14 bp, Homo sapiens
cctgagcactgcca

SEQ ID NO: 4631663 - DNA, 18 bp, Homo sapiens
cctgagcactgccaggag

SEQ ID NO: 4631664 - DNA, 20 bp, Homo sapiens
cctgagcactgccaggaggg

SEQ ID NO: 4631665 - DNA, 13 bp, Homo sapiens
cctgagcccaggg

SEQ ID NO: 4631666 - DNA, 16 bp, Homo sapiens
cctgagcccagggagg

SEQ ID NO: 4631667 - DNA, 17 bp, Homo sapiens
cctgagcccagggaggc

SEQ ID NO: 4631668 - DNA, 10 bp, Homo sapiens
cctgagcccc

SEQ ID NO: 4631669 - DNA, 13 bp, Homo sapiens
cctgagcctgccg

SEQ ID NO: 4631670 - DNA, 16 bp, Homo sapiens
cctgagcctgccgagc

SEQ ID NO: 4631671 - DNA, 21 bp, Homo sapiens
cctgagcctgccgagcaaccg

SEQ ID NO: 4631672 - DNA, 23 bp, Homo sapiens
cctgagcctgccgagcaaccgtg

SEQ ID NO: 4631673 - DNA, 22 bp, Homo sapiens
cctgaggacagaaagaccctga

SEQ ID NO: 4631674 - DNA, 16 bp, Homo sapiens
cctgaggacagctgtc

SEQ ID NO: 4631675 - DNA, 17 bp, Homo sapiens
cctgaggacagctgtcc

SEQ ID NO: 4631676 - DNA, 19 bp, Homo sapiens
cctgaggagtctgaggtcc

SEQ ID NO: 4631677 - DNA, 13 bp, Homo sapiens
cctgaggcctaga

SEQ ID NO: 4631678 - DNA, 19 bp, Homo sapiens
cctgagggaagagtagctg

SEQ ID NO: 4631679 - DNA, 17 bp, Homo sapiens
cctgaggtgcccactcc

SEQ ID NO: 4631680 - DNA, 21 bp, Homo sapiens
cctgagtagctgggattacag

SEQ ID NO: 4631681 - DNA, 14 bp, Homo sapiens
cctgatcagaccac

SEQ ID NO: 4631682 - DNA, 18 bp, Homo sapiens
cctgatcagaccacggct

SEQ ID NO: 4631683 - DNA, 13 bp, Homo sapiens
cctgatcagaggc

SEQ ID NO: 4631684 - DNA, 16 bp, Homo sapiens
cctgatgagattttta

SEQ ID NO: 4631685 - DNA, 18 bp, Homo sapiens
cctgcaaacagaacaggg

SEQ ID NO: 4631686 - DNA, 21 bp, Homo sapiens
cctgcaaacagaacagggtca

SEQ ID NO: 4631687 - DNA, 20 bp, Homo sapiens
cctgcaacttccgctgaggg

SEQ ID NO: 4631688 - DNA, 22 bp, Homo sapiens
cctgcacaggcttgctgtatga

SEQ ID NO: 4631689 - DNA, 21 bp, Homo sapiens
cctgcagcaaacactccaccc

SEQ ID NO: 4631690 - DNA, 14 bp, Homo sapiens
cctgcagcagagcc

SEQ ID NO: 4631691 - DNA, 14 bp, Homo sapiens
cctgcagcccctaa

SEQ ID NO: 4631692 - DNA, 17 bp, Homo sapiens
cctgcagcccctaagtg

SEQ ID NO: 4631693 - DNA, 16 bp, Homo sapiens
cctgcagcttgtagcc

SEQ ID NO: 4631694 - DNA, 20 bp, Homo sapiens
cctgcagcttgtagccagcc

SEQ ID NO: 4631695 - DNA, 21 bp, Homo sapiens
cctgcagggccatctgactgc

SEQ ID NO: 4631696 - DNA, 14 bp, Homo sapiens
cctgcatctgtctg

SEQ ID NO: 4631697 - DNA, 18 bp, Homo sapiens
cctgcatctgtctgctct

SEQ ID NO: 4631698 - DNA, 19 bp, Homo sapiens
cctgcatctgtctgctctg

SEQ ID NO: 4631699 - DNA, 20 bp, Homo sapiens
cctgcatggtcaagcctctt

SEQ ID NO: 4631700 - DNA, 12 bp, Homo sapiens
cctgccagccac

SEQ ID NO: 4631701 - DNA, 12 bp, Homo sapiens
cctgcccacaga

SEQ ID NO: 4631702 - DNA, 21 bp, Homo sapiens
cctgcccacagaaagccagga

SEQ ID NO: 4631703 - DNA, 21 bp, Homo sapiens
cctgcccaggtatcctggggg

SEQ ID NO: 4631704 - DNA, 22 bp, Homo sapiens
cctgccccaactccttccagct

SEQ ID NO: 4631705 - DNA, 19 bp, Homo sapiens
cctgccccccctaagagac

SEQ ID NO: 4631706 - DNA, 11 bp, Homo sapiens
cctgccccctg

SEQ ID NO: 4631707 - DNA, 14 bp, Homo sapiens
cctgccccctgggg

SEQ ID NO: 4631708 - DNA, 15 bp, Homo sapiens
cctgcccgagggcag

SEQ ID NO: 4631709 - DNA, 18 bp, Homo sapiens
cctgcccgagggcagccc

SEQ ID NO: 4631710 - DNA, 18 bp, Homo sapiens
cctgcccgcagacctctg

SEQ ID NO: 4631711 - DNA, 15 bp, Homo sapiens
cctgccctctattta

SEQ ID NO: 4631712 - DNA, 19 bp, Homo sapiens
cctgccctctatttattag

SEQ ID NO: 4631713 - DNA, 18 bp, Homo sapiens
cctgccctgttagctttc

SEQ ID NO: 4631714 - DNA, 20 bp, Homo sapiens
cctgccctgttagctttcca

SEQ ID NO: 4631715 - DNA, 16 bp, Homo sapiens
cctgcccttcagcatc

SEQ ID NO: 4631716 - DNA, 17 bp, Homo sapiens
cctgcccttcagcatcc

SEQ ID NO: 4631717 - DNA, 22 bp, Homo sapiens
cctgccgtttcccctccttggc

SEQ ID NO: 4631718 - DNA, 9 bp, Homo sapiens
cctgcctca

SEQ ID NO: 4631719 - DNA, 19 bp, Homo sapiens
cctgcctcacatctccctt

SEQ ID NO: 4631720 - DNA, 13 bp, Homo sapiens
cctgcctcgcctt

SEQ ID NO: 4631721 - DNA, 16 bp, Homo sapiens
cctgcctcgccttgtg

SEQ ID NO: 4631722 - DNA, 12 bp, Homo sapiens
cctgcctctact

SEQ ID NO: 4631723 - DNA, 12 bp, Homo sapiens
cctgcctggagg

SEQ ID NO: 4631724 - DNA, 17 bp, Homo sapiens
cctgccttaacctggga

SEQ ID NO: 4631725 - DNA, 19 bp, Homo sapiens
cctgccttaacctgggacc

SEQ ID NO: 4631726 - DNA, 13 bp, Homo sapiens
cctgcctttctca

SEQ ID NO: 4631727 - DNA, 13 bp, Homo sapiens
cctgcgagacgca

SEQ ID NO: 4631728 - DNA, 23 bp, Homo sapiens
cctgcgagacgcacacagctgag

SEQ ID NO: 4631729 - DNA, 18 bp, Homo sapiens
cctgcgcaagtgcctggg

SEQ ID NO: 4631730 - DNA, 23 bp, Homo sapiens
cctgcggtagatgggagggaggc

SEQ ID NO: 4631731 - DNA, 18 bp, Homo sapiens
cctgctagacgcaccgcc

SEQ ID NO: 4631732 - DNA, 18 bp, Homo sapiens
cctgctagtcgcccctca

SEQ ID NO: 4631733 - DNA, 20 bp, Homo sapiens
cctgctagtcgcccctcaga

SEQ ID NO: 4631734 - DNA, 21 bp, Homo sapiens
cctgctagtcgcccctcagag

SEQ ID NO: 4631735 - DNA, 23 bp, Homo sapiens
cctgctcattatgccacttcctt

SEQ ID NO: 4631736 - DNA, 22 bp, Homo sapiens
cctgctctagtgggacagccca

SEQ ID NO: 4631737 - DNA, 21 bp, Homo sapiens
cctgctctgcccaggcaagga

SEQ ID NO: 4631738 - DNA, 12 bp, Homo sapiens
cctgctgaatgc

SEQ ID NO: 4631739 - DNA, 23 bp, Homo sapiens
cctgctgaatgcctcgctccctt

SEQ ID NO: 4631740 - DNA, 14 bp, Homo sapiens
cctgctgacagaca

SEQ ID NO: 4631741 - DNA, 12 bp, Homo sapiens
cctgctgagctc

SEQ ID NO: 4631742 - DNA, 14 bp, Homo sapiens
cctgctgagctctg

SEQ ID NO: 4631743 - DNA, 15 bp, Homo sapiens
cctgctgagctctga

SEQ ID NO: 4631744 - DNA, 16 bp, Homo sapiens
cctgctgagctctgag

SEQ ID NO: 4631745 - DNA, 18 bp, Homo sapiens
cctgctgagctctgagag

SEQ ID NO: 4631746 - DNA, 19 bp, Homo sapiens
cctgctgagctctgagagg

SEQ ID NO: 4631747 - DNA, 13 bp, Homo sapiens
cctgctgcccagt

SEQ ID NO: 4631748 - DNA, 11 bp, Homo sapiens
cctgctgcctg

SEQ ID NO: 4631749 - DNA, 13 bp, Homo sapiens
cctgctgcctggg

SEQ ID NO: 4631750 - DNA, 20 bp, Homo sapiens
cctgctgcctgggtaggccc

SEQ ID NO: 4631751 - DNA, 14 bp, Homo sapiens
cctgctgctgagaa

SEQ ID NO: 4631752 - DNA, 16 bp, Homo sapiens
cctgctggggccgcca

SEQ ID NO: 4631753 - DNA, 16 bp, Homo sapiens
cctgctggtacctgcc

SEQ ID NO: 4631754 - DNA, 22 bp, Homo sapiens
cctgctgtgccatgctgggcca

SEQ ID NO: 4631755 - DNA, 19 bp, Homo sapiens
cctgcttccacctcacccc

SEQ ID NO: 4631756 - DNA, 21 bp, Homo sapiens
cctgcttctggggttggaagt

SEQ ID NO: 4631757 - DNA, 15 bp, Homo sapiens
cctgctttgggaaga

SEQ ID NO: 4631758 - DNA, 20 bp, Homo sapiens
cctggaagtcaaataaatgt

SEQ ID NO: 4631759 - DNA, 21 bp, Homo sapiens
cctggaagtcaaataaatgtt

SEQ ID NO: 4631760 - DNA, 13 bp, Homo sapiens
cctggacagctgt

SEQ ID NO: 4631761 - DNA, 18 bp, Homo sapiens
cctggacagctgtgcctc

SEQ ID NO: 4631762 - DNA, 19 bp, Homo sapiens
cctggacattttttcagtc

SEQ ID NO: 4631763 - DNA, 17 bp, Homo sapiens
cctggagaaggaagctg

SEQ ID NO: 4631764 - DNA, 22 bp, Homo sapiens
cctggagaaggaagctgcctgg

SEQ ID NO: 4631765 - DNA, 14 bp, Homo sapiens
cctggagcaggagc

SEQ ID NO: 4631766 - DNA, 17 bp, Homo sapiens
cctggagcaggagcccc

SEQ ID NO: 4631767 - DNA, 13 bp, Homo sapiens
cctggaggacctg

SEQ ID NO: 4631768 - DNA, 17 bp, Homo sapiens
cctggaggacctgagcc

SEQ ID NO: 4631769 - DNA, 18 bp, Homo sapiens
cctggaggacctgagcct

SEQ ID NO: 4631770 - DNA, 17 bp, Homo sapiens
cctggagggcaagccct

SEQ ID NO: 4631771 - DNA, 18 bp, Homo sapiens
cctggagggcaagccctg

SEQ ID NO: 4631772 - DNA, 23 bp, Homo sapiens
cctggagggcaagccctgcccac

SEQ ID NO: 4631773 - DNA, 15 bp, Homo sapiens
cctggaggggagagg

SEQ ID NO: 4631774 - DNA, 21 bp, Homo sapiens
cctggaggggagaggtcagcc

SEQ ID NO: 4631775 - DNA, 19 bp, Homo sapiens
cctggaggggctggggact

SEQ ID NO: 4631776 - DNA, 16 bp, Homo sapiens
cctggaggtctccagg

SEQ ID NO: 4631777 - DNA, 14 bp, Homo sapiens
cctggatcagcgtg

SEQ ID NO: 4631778 - DNA, 18 bp, Homo sapiens
cctggatcagcgtggcct

SEQ ID NO: 4631779 - DNA, 20 bp, Homo sapiens
cctggatgagaaacagctca

SEQ ID NO: 4631780 - DNA, 12 bp, Homo sapiens
cctggcacacat

SEQ ID NO: 4631781 - DNA, 21 bp, Homo sapiens
cctggcacacatcaggagttc

SEQ ID NO: 4631782 - DNA, 20 bp, Homo sapiens
cctggcacagaagaggagtc

SEQ ID NO: 4631783 - DNA, 21 bp, Homo sapiens
cctggcacagaagaggagtca

SEQ ID NO: 4631784 - DNA, 23 bp, Homo sapiens
cctggcacccccacaagctgtcc

SEQ ID NO: 4631785 - DNA, 22 bp, Homo sapiens
cctggcagacttgcccaggtca

SEQ ID NO: 4631786 - DNA, 13 bp, Homo sapiens
cctggccacagcc

SEQ ID NO: 4631787 - DNA, 16 bp, Homo sapiens
cctggccacagccttc

SEQ ID NO: 4631788 - DNA, 17 bp, Homo sapiens
cctggccacagccttcc

SEQ ID NO: 4631789 - DNA, 15 bp, Homo sapiens
cctggccccctgagt

SEQ ID NO: 4631790 - DNA, 17 bp, Homo sapiens
cctggcccctccaatcc

SEQ ID NO: 4631791 - DNA, 18 bp, Homo sapiens
cctggcccttacttgctt

SEQ ID NO: 4631792 - DNA, 19 bp, Homo sapiens
cctggccgagtccaagctg

SEQ ID NO: 4631793 - DNA, 13 bp, Homo sapiens
cctggcctcagag

SEQ ID NO: 4631794 - DNA, 16 bp, Homo sapiens
cctggcctcagagctt

SEQ ID NO: 4631795 - DNA, 20 bp, Homo sapiens
cctggcctcagagcttcctg

SEQ ID NO: 4631796 - DNA, 21 bp, Homo sapiens
cctggcctcagagcttcctgg

SEQ ID NO: 4631797 - DNA, 22 bp, Homo sapiens
cctggcctcagagcttcctggg

SEQ ID NO: 4631798 - DNA, 15 bp, Homo sapiens
cctggcctcctgcct

SEQ ID NO: 4631799 - DNA, 16 bp, Homo sapiens
cctggcctcctgcctc

SEQ ID NO: 4631800 - DNA, 21 bp, Homo sapiens
cctggcctcctgcctctactg

SEQ ID NO: 4631801 - DNA, 17 bp, Homo sapiens
cctggcctgaactgagg

SEQ ID NO: 4631802 - DNA, 21 bp, Homo sapiens
cctggcctgaactgaggagat

SEQ ID NO: 4631803 - DNA, 13 bp, Homo sapiens
cctggcctggcac

SEQ ID NO: 4631804 - DNA, 19 bp, Homo sapiens
cctggcctggcacacatca

SEQ ID NO: 4631805 - DNA, 11 bp, Homo sapiens
cctggccttca

SEQ ID NO: 4631806 - DNA, 13 bp, Homo sapiens
cctggctggctga

SEQ ID NO: 4631807 - DNA, 22 bp, Homo sapiens
cctggctgggacgtggctcagc

SEQ ID NO: 4631808 - DNA, 24 bp, Homo sapiens
cctggctgggacgtggctcagcca

SEQ ID NO: 4631809 - DNA, 15 bp, Homo sapiens
cctggcttcccatcc

SEQ ID NO: 4631810 - DNA, 19 bp, Homo sapiens
cctggcttcccatccccag

SEQ ID NO: 4631811 - DNA, 20 bp, Homo sapiens
cctggcttcccatccccagc

SEQ ID NO: 4631812 - DNA, 23 bp, Homo sapiens
cctggcttcccatccccagcgat

SEQ ID NO: 4631813 - DNA, 18 bp, Homo sapiens
cctgggaaagggagatgt

SEQ ID NO: 4631814 - DNA, 20 bp, Homo sapiens
cctgggaactctcctggcct

SEQ ID NO: 4631815 - DNA, 22 bp, Homo sapiens
cctgggacaagcaggccgccct

SEQ ID NO: 4631816 - DNA, 23 bp, Homo sapiens
cctgggacaagcaggccgccctc

SEQ ID NO: 4631817 - DNA, 21 bp, Homo sapiens
cctgggacctccccagcccag

SEQ ID NO: 4631818 - DNA, 14 bp, Homo sapiens
cctgggatgccctt

SEQ ID NO: 4631819 - DNA, 17 bp, Homo sapiens
cctgggatgcccttccc

SEQ ID NO: 4631820 - DNA, 22 bp, Homo sapiens
cctgggatgcccttcccccttt

SEQ ID NO: 4631821 - DNA, 23 bp, Homo sapiens
cctgggcactccgcgccgatgcc

SEQ ID NO: 4631822 - DNA, 15 bp, Homo sapiens
cctgggccagggtct

SEQ ID NO: 4631823 - DNA, 16 bp, Homo sapiens
cctgggccagggtctg

SEQ ID NO: 4631824 - DNA, 15 bp, Homo sapiens
cctgggccctggggc

SEQ ID NO: 4631825 - DNA, 16 bp, Homo sapiens
cctgggccctggggcc

SEQ ID NO: 4631826 - DNA, 17 bp, Homo sapiens
cctgggccctggggcct

SEQ ID NO: 4631827 - DNA, 18 bp, Homo sapiens
cctgggccctggggcctg

SEQ ID NO: 4631828 - DNA, 19 bp, Homo sapiens
cctgggcctatggagagcc

SEQ ID NO: 4631829 - DNA, 20 bp, Homo sapiens
cctgggcctgctgctgagaa

SEQ ID NO: 4631830 - DNA, 19 bp, Homo sapiens
cctgggctggggaggagga

SEQ ID NO: 4631831 - DNA, 15 bp, Homo sapiens
cctgggcttaagttt

SEQ ID NO: 4631832 - DNA, 12 bp, Homo sapiens
cctggggaccaa

SEQ ID NO: 4631833 - DNA, 19 bp, Homo sapiens
cctggggatcacagcctca

SEQ ID NO: 4631834 - DNA, 22 bp, Homo sapiens
cctggggatcacagcctcaccc

SEQ ID NO: 4631835 - DNA, 15 bp, Homo sapiens
cctggggcagcactc

SEQ ID NO: 4631836 - DNA, 14 bp, Homo sapiens
cctggggcctgtac

SEQ ID NO: 4631837 - DNA, 20 bp, Homo sapiens
cctggggcctgtactgcctg

SEQ ID NO: 4631838 - DNA, 19 bp, Homo sapiens
cctgggggcctggctggct

SEQ ID NO: 4631839 - DNA, 21 bp, Homo sapiens
cctgggggcttttgccactcc

SEQ ID NO: 4631840 - DNA, 22 bp, Homo sapiens
cctgggggttttccaagccctc

SEQ ID NO: 4631841 - DNA, 21 bp, Homo sapiens
cctggggtgaatacttatttt

SEQ ID NO: 4631842 - DNA, 13 bp, Homo sapiens
cctgggtaggccc

SEQ ID NO: 4631843 - DNA, 15 bp, Homo sapiens
cctgggtaggcccca

SEQ ID NO: 4631844 - DNA, 23 bp, Homo sapiens
cctgggtaggccccacaaggcct

SEQ ID NO: 4631845 - DNA, 19 bp, Homo sapiens
cctgggtcaaaaaaaagaa

SEQ ID NO: 4631846 - DNA, 18 bp, Homo sapiens
cctgggtgatctgctgct

SEQ ID NO: 4631847 - DNA, 15 bp, Homo sapiens
cctgggtggctactc

SEQ ID NO: 4631848 - DNA, 19 bp, Homo sapiens
cctgggtggctactctgtg

SEQ ID NO: 4631849 - DNA, 16 bp, Homo sapiens
cctggtccctgggagg

SEQ ID NO: 4631850 - DNA, 13 bp, Homo sapiens
cctggtgccacct

SEQ ID NO: 4631851 - DNA, 13 bp, Homo sapiens
cctggtggggcag

SEQ ID NO: 4631852 - DNA, 15 bp, Homo sapiens
cctggtggggcagct

SEQ ID NO: 4631853 - DNA, 16 bp, Homo sapiens
cctggtggggcagctc

SEQ ID NO: 4631854 - DNA, 18 bp, Homo sapiens
cctggtggggcagctcct

SEQ ID NO: 4631855 - DNA, 19 bp, Homo sapiens
cctggttctaggctgctgc

SEQ ID NO: 4631856 - DNA, 19 bp, Homo sapiens
cctgtaatcaggcaaggag

SEQ ID NO: 4631857 - DNA, 19 bp, Homo sapiens
cctgtaatcccagtacttt

SEQ ID NO: 4631858 - DNA, 15 bp, Homo sapiens
cctgtactgcctgct

SEQ ID NO: 4631859 - DNA, 17 bp, Homo sapiens
cctgtactgcctgcttg

SEQ ID NO: 4631860 - DNA, 20 bp, Homo sapiens
cctgtagaatagcctgtggc

SEQ ID NO: 4631861 - DNA, 16 bp, Homo sapiens
cctgtagccttctgta

SEQ ID NO: 4631862 - DNA, 20 bp, Homo sapiens
cctgtagttgcgtggactct

SEQ ID NO: 4631863 - DNA, 23 bp, Homo sapiens
cctgtagttgcgtggactctgca

SEQ ID NO: 4631864 - DNA, 22 bp, Homo sapiens
cctgtatttgttcccaagagca

SEQ ID NO: 4631865 - DNA, 23 bp, Homo sapiens
cctgtccaagacagggctcattt

SEQ ID NO: 4631866 - DNA, 12 bp, Homo sapiens
cctgtcccaccc

SEQ ID NO: 4631867 - DNA, 16 bp, Homo sapiens
cctgtcccaccccctt

SEQ ID NO: 4631868 - DNA, 17 bp, Homo sapiens
cctgtccccaccctcca

SEQ ID NO: 4631869 - DNA, 19 bp, Homo sapiens
cctgtccccaccctccact

SEQ ID NO: 4631870 - DNA, 13 bp, Homo sapiens
cctgtccctctag

SEQ ID NO: 4631871 - DNA, 13 bp, Homo sapiens
cctgtcctccaac

SEQ ID NO: 4631872 - DNA, 21 bp, Homo sapiens
cctgtcctccaacaccaagca

SEQ ID NO: 4631873 - DNA, 14 bp, Homo sapiens
cctgtctcagctgt

SEQ ID NO: 4631874 - DNA, 15 bp, Homo sapiens
cctgtctcagctgtt

SEQ ID NO: 4631875 - DNA, 15 bp, Homo sapiens
cctgtctctctcttc

SEQ ID NO: 4631876 - DNA, 14 bp, Homo sapiens
cctgtctctggcta

SEQ ID NO: 4631877 - DNA, 18 bp, Homo sapiens
cctgtgaacccaggacaa

SEQ ID NO: 4631878 - DNA, 19 bp, Homo sapiens
cctgtgaccagtctgaccc

SEQ ID NO: 4631879 - DNA, 15 bp, Homo sapiens
cctgtgagcccagct

SEQ ID NO: 4631880 - DNA, 14 bp, Homo sapiens
cctgtgcatgtatg

SEQ ID NO: 4631881 - DNA, 23 bp, Homo sapiens
cctgtgccacacttcgctcttga

SEQ ID NO: 4631882 - DNA, 16 bp, Homo sapiens
cctgtgctagaagctc

SEQ ID NO: 4631883 - DNA, 15 bp, Homo sapiens
cctgtgggagcctcg

SEQ ID NO: 4631884 - DNA, 14 bp, Homo sapiens
cctgtgtagctgtg

SEQ ID NO: 4631885 - DNA, 20 bp, Homo sapiens
cctgtgtagctgtgacctgc

SEQ ID NO: 4631886 - DNA, 17 bp, Homo sapiens
cctgtgtccacctgtgg

SEQ ID NO: 4631887 - DNA, 19 bp, Homo sapiens
cctgtgtccacctgtgggt

SEQ ID NO: 4631888 - DNA, 22 bp, Homo sapiens
cctgtgtctttaaatgctgctt

SEQ ID NO: 4631889 - DNA, 20 bp, Homo sapiens
cctgtgtgtactctgtccag

SEQ ID NO: 4631890 - DNA, 22 bp, Homo sapiens
cctgtgtgtgttgccctggcat

SEQ ID NO: 4631891 - DNA, 23 bp, Homo sapiens
cctgtgtttcattacttgaatgt

SEQ ID NO: 4631892 - DNA, 16 bp, Homo sapiens
cctgttagcagacagg

SEQ ID NO: 4631893 - DNA, 13 bp, Homo sapiens
cctgttagctttc

SEQ ID NO: 4631894 - DNA, 14 bp, Homo sapiens
cctgttagctttcc

SEQ ID NO: 4631895 - DNA, 16 bp, Homo sapiens
cctgttcttagagtgt

SEQ ID NO: 4631896 - DNA, 21 bp, Homo sapiens
cctgttcttagagtgtagctg

SEQ ID NO: 4631897 - DNA, 19 bp, Homo sapiens
cctgttgctatagagccta

SEQ ID NO: 4631898 - DNA, 22 bp, Homo sapiens
ccttaaagagggacaggctgaa

SEQ ID NO: 4631899 - DNA, 17 bp, Homo sapiens
ccttaaagagtgtggca

SEQ ID NO: 4631900 - DNA, 14 bp, Homo sapiens
ccttaaccccaagg

SEQ ID NO: 4631901 - DNA, 16 bp, Homo sapiens
ccttaaccccaaggac

SEQ ID NO: 4631902 - DNA, 22 bp, Homo sapiens
ccttaatgcttcatatgaggag

SEQ ID NO: 4631903 - DNA, 12 bp, Homo sapiens
ccttacactccc

SEQ ID NO: 4631904 - DNA, 14 bp, Homo sapiens
ccttacagcctctg

SEQ ID NO: 4631905 - DNA, 17 bp, Homo sapiens
ccttacccatcttgctt

SEQ ID NO: 4631906 - DNA, 15 bp, Homo sapiens
ccttaccgtcttgat

SEQ ID NO: 4631907 - DNA, 12 bp, Homo sapiens
ccttactcctgt

SEQ ID NO: 4631908 - DNA, 13 bp, Homo sapiens
ccttactcctgtg

SEQ ID NO: 4631909 - DNA, 14 bp, Homo sapiens
ccttactcctgtgg

SEQ ID NO: 4631910 - DNA, 22 bp, Homo sapiens
ccttactcctgtgggagcctcg

SEQ ID NO: 4631911 - DNA, 16 bp, Homo sapiens
ccttaggcctctgaga

SEQ ID NO: 4631912 - DNA, 19 bp, Homo sapiens
ccttagtgggccagggctg

SEQ ID NO: 4631913 - DNA, 14 bp, Homo sapiens
ccttatcctagcct

SEQ ID NO: 4631914 - DNA, 13 bp, Homo sapiens
ccttatttttagc

SEQ ID NO: 4631915 - DNA, 22 bp, Homo sapiens
ccttatttttagccataatttt

SEQ ID NO: 4631916 - DNA, 19 bp, Homo sapiens
ccttcagttctgcttgctc

SEQ ID NO: 4631917 - DNA, 13 bp, Homo sapiens
ccttccacctcac

SEQ ID NO: 4631918 - DNA, 12 bp, Homo sapiens
ccttccagcctt

SEQ ID NO: 4631919 - DNA, 13 bp, Homo sapiens
ccttccagccttt

SEQ ID NO: 4631920 - DNA, 23 bp, Homo sapiens
ccttccagctagtgacccacatg

SEQ ID NO: 4631921 - DNA, 23 bp, Homo sapiens
ccttccatagcctaatccctggg

SEQ ID NO: 4631922 - DNA, 20 bp, Homo sapiens
ccttccattttcccccacta

SEQ ID NO: 4631923 - DNA, 11 bp, Homo sapiens
ccttccccagc

SEQ ID NO: 4631924 - DNA, 13 bp, Homo sapiens
ccttccccagctc

SEQ ID NO: 4631925 - DNA, 17 bp, Homo sapiens
ccttcccccagcccatc

SEQ ID NO: 4631926 - DNA, 24 bp, Homo sapiens
ccttccccctttctctgcctggca

SEQ ID NO: 4631927 - DNA, 13 bp, Homo sapiens
ccttcctggacag

SEQ ID NO: 4631928 - DNA, 17 bp, Homo sapiens
ccttcctggacagctgt

SEQ ID NO: 4631929 - DNA, 20 bp, Homo sapiens
ccttcctggacagctgtgcc

SEQ ID NO: 4631930 - DNA, 22 bp, Homo sapiens
ccttcctggacagctgtgcctc

SEQ ID NO: 4631931 - DNA, 14 bp, Homo sapiens
ccttcgaaaggcct

SEQ ID NO: 4631932 - DNA, 16 bp, Homo sapiens
ccttctctcactgtgt

SEQ ID NO: 4631933 - DNA, 17 bp, Homo sapiens
ccttctgaaatgtgacc

SEQ ID NO: 4631934 - DNA, 14 bp, Homo sapiens
ccttctgcttgtcc

SEQ ID NO: 4631935 - DNA, 16 bp, Homo sapiens
ccttgaaacagttcca

SEQ ID NO: 4631936 - DNA, 22 bp, Homo sapiens
ccttgactgaagcgaacatctt

SEQ ID NO: 4631937 - DNA, 15 bp, Homo sapiens
ccttgcccaccccac

SEQ ID NO: 4631938 - DNA, 11 bp, Homo sapiens
ccttgcccagg

SEQ ID NO: 4631939 - DNA, 23 bp, Homo sapiens
ccttgcccaggtgagggaaggag

SEQ ID NO: 4631940 - DNA, 18 bp, Homo sapiens
ccttgctcatgagctcct

SEQ ID NO: 4631941 - DNA, 19 bp, Homo sapiens
ccttgctcatgagctcctg

SEQ ID NO: 4631942 - DNA, 16 bp, Homo sapiens
ccttgctcttggggaa

SEQ ID NO: 4631943 - DNA, 17 bp, Homo sapiens
ccttgctggaaaaccca

SEQ ID NO: 4631944 - DNA, 15 bp, Homo sapiens
ccttgctgggcctgg

SEQ ID NO: 4631945 - DNA, 16 bp, Homo sapiens
ccttgctgggcctggg

SEQ ID NO: 4631946 - DNA, 15 bp, Homo sapiens
ccttgctttcctggg

SEQ ID NO: 4631947 - DNA, 19 bp, Homo sapiens
ccttgctttcctgggcctt

SEQ ID NO: 4631948 - DNA, 15 bp, Homo sapiens
ccttgctttcggagc

SEQ ID NO: 4631949 - DNA, 23 bp, Homo sapiens
ccttgctttttgctgtgtagttc

SEQ ID NO: 4631950 - DNA, 15 bp, Homo sapiens
ccttggcttgtgtta

SEQ ID NO: 4631951 - DNA, 21 bp, Homo sapiens
ccttggctttatgcaaataca

SEQ ID NO: 4631952 - DNA, 17 bp, Homo sapiens
ccttgggccctctggtt

SEQ ID NO: 4631953 - DNA, 22 bp, Homo sapiens
ccttggggaggacaaaacttct

SEQ ID NO: 4631954 - DNA, 20 bp, Homo sapiens
ccttgtattctgaggatgtt

SEQ ID NO: 4631955 - DNA, 18 bp, Homo sapiens
ccttgtcagggtctcctt

SEQ ID NO: 4631956 - DNA, 19 bp, Homo sapiens
ccttgtcagggtctccttc

SEQ ID NO: 4631957 - DNA, 22 bp, Homo sapiens
ccttgtcagggtctccttcctt

SEQ ID NO: 4631958 - DNA, 23 bp, Homo sapiens
ccttgtgttcagctctttccaaa

SEQ ID NO: 4631959 - DNA, 11 bp, Homo sapiens
ccttgttctgt

SEQ ID NO: 4631960 - DNA, 11 bp, Homo sapiens
cctttaaatat

SEQ ID NO: 4631961 - DNA, 18 bp, Homo sapiens
cctttaaatatcattctt

SEQ ID NO: 4631962 - DNA, 14 bp, Homo sapiens
cctttaagccaaag

SEQ ID NO: 4631963 - DNA, 22 bp, Homo sapiens
cctttaagccaaagaaacaagc

SEQ ID NO: 4631964 - DNA, 23 bp, Homo sapiens
cctttaagccaaagaaacaagct

SEQ ID NO: 4631965 - DNA, 15 bp, Homo sapiens
cctttaattttcttg

SEQ ID NO: 4631966 - DNA, 15 bp, Homo sapiens
cctttcaataaagtt

SEQ ID NO: 4631967 - DNA, 21 bp, Homo sapiens
cctttcaattccaccagggcc

SEQ ID NO: 4631968 - DNA, 22 bp, Homo sapiens
cctttcagtgcagtttcttttc

SEQ ID NO: 4631969 - DNA, 18 bp, Homo sapiens
cctttcccaccattcctg

SEQ ID NO: 4631970 - DNA, 22 bp, Homo sapiens
cctttcccaccattcctgcctt

SEQ ID NO: 4631971 - DNA, 24 bp, Homo sapiens
cctttcctgtgtgtactctgtcca

SEQ ID NO: 4631972 - DNA, 16 bp, Homo sapiens
cctttcgaaagcaatg

SEQ ID NO: 4631973 - DNA, 14 bp, Homo sapiens
cctttctctgcctg

SEQ ID NO: 4631974 - DNA, 15 bp, Homo sapiens
cctttctctgcctgg

SEQ ID NO: 4631975 - DNA, 18 bp, Homo sapiens
cctttctctgcctggcaa

SEQ ID NO: 4631976 - DNA, 14 bp, Homo sapiens
cctttctggctctc

SEQ ID NO: 4631977 - DNA, 19 bp, Homo sapiens
cctttgagatctggggagg

SEQ ID NO: 4631978 - DNA, 20 bp, Homo sapiens
cctttgagatctggggaggc

SEQ ID NO: 4631979 - DNA, 22 bp, Homo sapiens
cctttgagatctggggaggcag

SEQ ID NO: 4631980 - DNA, 20 bp, Homo sapiens
cctttgcaagatgcttggtt

SEQ ID NO: 4631981 - DNA, 24 bp, Homo sapiens
cctttgcccttcctcctgcctttc

SEQ ID NO: 4631982 - DNA, 13 bp, Homo sapiens
cctttgctcttat

SEQ ID NO: 4631983 - DNA, 22 bp, Homo sapiens
cctttgggcacggccctccttc

SEQ ID NO: 4631984 - DNA, 14 bp, Homo sapiens
cctttgtagctact

SEQ ID NO: 4631985 - DNA, 13 bp, Homo sapiens
cctttgtcttgga

SEQ ID NO: 4631986 - DNA, 19 bp, Homo sapiens
ccttttaaagaagctttat

SEQ ID NO: 4631987 - DNA, 24 bp, Homo sapiens
ccttttaaggtttcaacaaatttc

SEQ ID NO: 4631988 - DNA, 16 bp, Homo sapiens
ccttttcattctcctc

SEQ ID NO: 4631989 - DNA, 12 bp, Homo sapiens
ccttttccatgc

SEQ ID NO: 4631990 - DNA, 14 bp, Homo sapiens
ccttttcctttttt

SEQ ID NO: 4631991 - DNA, 11 bp, Homo sapiens
cctttttaagg

SEQ ID NO: 4631992 - DNA, 18 bp, Homo sapiens
cctttttctgagatgctc

SEQ ID NO: 4631993 - DNA, 14 bp, Homo sapiens
cctttttggactag

SEQ ID NO: 4631994 - DNA, 16 bp, Homo sapiens
cctttttggactagcc

SEQ ID NO: 4631995 - DNA, 20 bp, Homo sapiens
cctttttggactagccagaa

SEQ ID NO: 4631996 - DNA, 23 bp, Homo sapiens
cctttttggcctgtgatgtttta

SEQ ID NO: 4631997 - DNA, 14 bp, Homo sapiens
ccttttttcttttt

SEQ ID NO: 4631998 - DNA, 14 bp, Homo sapiens
ccttttttgaacca

SEQ ID NO: 4631999 - DNA, 19 bp, Homo sapiens
ccttttttgtcttattgaa

SEQ ID NO: 4632000 - DNA, 19 bp, Homo sapiens
cgaaaggccttcagacaca

SEQ ID NO: 4632001 - DNA, 15 bp, Homo sapiens
cgaacatcttcatat

SEQ ID NO: 4632002 - DNA, 15 bp, Homo sapiens
cgaacctcctctgtg

SEQ ID NO: 4632003 - DNA, 17 bp, Homo sapiens
cgaagctaacagggaag

SEQ ID NO: 4632004 - DNA, 22 bp, Homo sapiens
cgaagctaacagggaaggcagg

SEQ ID NO: 4632005 - DNA, 15 bp, Homo sapiens
cgaagtagcttgctc

SEQ ID NO: 4632006 - DNA, 21 bp, Homo sapiens
cgaagtagcttgctccctgtg

SEQ ID NO: 4632007 - DNA, 13 bp, Homo sapiens
cgaagtgttgcat

SEQ ID NO: 4632008 - DNA, 19 bp, Homo sapiens
cgaatggggtagaaacatt

SEQ ID NO: 4632009 - DNA, 23 bp, Homo sapiens
cgaatggggtagaaacattgtaa

SEQ ID NO: 4632010 - DNA, 13 bp, Homo sapiens
cgactcacctgcg

SEQ ID NO: 4632011 - DNA, 16 bp, Homo sapiens
cgactctggccctggc

SEQ ID NO: 4632012 - DNA, 18 bp, Homo sapiens
cgactctggccctggccc

SEQ ID NO: 4632013 - DNA, 19 bp, Homo sapiens
cgagaaaatctgcatgttt

SEQ ID NO: 4632014 - DNA, 20 bp, Homo sapiens
cgagaatgaacatatttgat

SEQ ID NO: 4632015 - DNA, 18 bp, Homo sapiens
cgagacaacagcacacag

SEQ ID NO: 4632016 - DNA, 20 bp, Homo sapiens
cgagacaacagcacacaggc

SEQ ID NO: 4632017 - DNA, 20 bp, Homo sapiens
cgagagcctcgctttttcat

SEQ ID NO: 4632018 - DNA, 15 bp, Homo sapiens
cgagcaaccgtggcc

SEQ ID NO: 4632019 - DNA, 22 bp, Homo sapiens
cgagcaaccgtggcccttcctg

SEQ ID NO: 4632020 - DNA, 14 bp, Homo sapiens
cgagcagctgagca

SEQ ID NO: 4632021 - DNA, 19 bp, Homo sapiens
cgagccacaagctgcactg

SEQ ID NO: 4632022 - DNA, 22 bp, Homo sapiens
cgagccacaagctgcactgtga

SEQ ID NO: 4632023 - DNA, 13 bp, Homo sapiens
cgagcgccctgca

SEQ ID NO: 4632024 - DNA, 20 bp, Homo sapiens
cgagcgccctgcagaccctg

SEQ ID NO: 4632025 - DNA, 21 bp, Homo sapiens
cgaggctgattcctctcattt

SEQ ID NO: 4632026 - DNA, 17 bp, Homo sapiens
cgagggcagcgggagcc

SEQ ID NO: 4632027 - DNA, 13 bp, Homo sapiens
cgaggggcaggga

SEQ ID NO: 4632028 - DNA, 19 bp, Homo sapiens
cgagtcattcgttctgtgg

SEQ ID NO: 4632029 - DNA, 14 bp, Homo sapiens
cgagtccaagctgg

SEQ ID NO: 4632030 - DNA, 14 bp, Homo sapiens
cgatgccaccggcc

SEQ ID NO: 4632031 - DNA, 17 bp, Homo sapiens
cgatggggaaggagaag

SEQ ID NO: 4632032 - DNA, 20 bp, Homo sapiens
cgatgttgtcaaggatggtt

SEQ ID NO: 4632033 - DNA, 17 bp, Homo sapiens
cgattccctctcccagg

SEQ ID NO: 4632034 - DNA, 12 bp, Homo sapiens
cgatttgaaaca

SEQ ID NO: 4632035 - DNA, 22 bp, Homo sapiens
cgcaacccgtgccaagtccagg

SEQ ID NO: 4632036 - DNA, 14 bp, Homo sapiens
cgcaacgctctgcg

SEQ ID NO: 4632037 - DNA, 16 bp, Homo sapiens
cgcaccctccctagct

SEQ ID NO: 4632038 - DNA, 16 bp, Homo sapiens
cgcactggacagcatc

SEQ ID NO: 4632039 - DNA, 22 bp, Homo sapiens
cgcactgtgacccccagctccg

SEQ ID NO: 4632040 - DNA, 15 bp, Homo sapiens
cgcagacctctggat

SEQ ID NO: 4632041 - DNA, 11 bp, Homo sapiens
cgcagccaccc

SEQ ID NO: 4632042 - DNA, 14 bp, Homo sapiens
cgcagccaccctga

SEQ ID NO: 4632043 - DNA, 22 bp, Homo sapiens
cgcaggtatttagaagcagagg

SEQ ID NO: 4632044 - DNA, 19 bp, Homo sapiens
cgcatgatgtttccctctc

SEQ ID NO: 4632045 - DNA, 14 bp, Homo sapiens
cgcatgtttaatgt

SEQ ID NO: 4632046 - DNA, 16 bp, Homo sapiens
cgcatgtttaatgtga

SEQ ID NO: 4632047 - DNA, 20 bp, Homo sapiens
cgccaatgttatgccagctc

SEQ ID NO: 4632048 - DNA, 19 bp, Homo sapiens
cgccacggcctggctggtg

SEQ ID NO: 4632049 - DNA, 21 bp, Homo sapiens
cgccacgtcccagcatccctg

SEQ ID NO: 4632050 - DNA, 11 bp, Homo sapiens
cgccagccaca

SEQ ID NO: 4632051 - DNA, 23 bp, Homo sapiens
cgccaggagcttcttcgttcctg

SEQ ID NO: 4632052 - DNA, 17 bp, Homo sapiens
cgccaggctgaccacag

SEQ ID NO: 4632053 - DNA, 20 bp, Homo sapiens
cgccaggctgaccacagcac

SEQ ID NO: 4632054 - DNA, 21 bp, Homo sapiens
cgccaggctgaccacagcaca

SEQ ID NO: 4632055 - DNA, 11 bp, Homo sapiens
cgccagggctg

SEQ ID NO: 4632056 - DNA, 14 bp, Homo sapiens
cgccagtgtttctg

SEQ ID NO: 4632057 - DNA, 17 bp, Homo sapiens
cgcccaggatcagattg

SEQ ID NO: 4632058 - DNA, 23 bp, Homo sapiens
cgcccaggatcagattgcatgtg

SEQ ID NO: 4632059 - DNA, 20 bp, Homo sapiens
cgcccaggctggagtgcagt

SEQ ID NO: 4632060 - DNA, 21 bp, Homo sapiens
cgccccagggccgggcttggc

SEQ ID NO: 4632061 - DNA, 14 bp, Homo sapiens
cgcccctcagagca

SEQ ID NO: 4632062 - DNA, 11 bp, Homo sapiens
cgccctgcaga

SEQ ID NO: 4632063 - DNA, 12 bp, Homo sapiens
cgccctgcagac

SEQ ID NO: 4632064 - DNA, 21 bp, Homo sapiens
cgccctgcagaccctgccctt

SEQ ID NO: 4632065 - DNA, 16 bp, Homo sapiens
cgccgatgccaccggc

SEQ ID NO: 4632066 - DNA, 14 bp, Homo sapiens
cgcctatcttaggt

SEQ ID NO: 4632067 - DNA, 15 bp, Homo sapiens
cgcctgagcccaggg

SEQ ID NO: 4632068 - DNA, 17 bp, Homo sapiens
cgcctgagcccagggag

SEQ ID NO: 4632069 - DNA, 20 bp, Homo sapiens
cgcctgagcccagggaggcc

SEQ ID NO: 4632070 - DNA, 21 bp, Homo sapiens
cgcctgagcccagggaggccg

SEQ ID NO: 4632071 - DNA, 16 bp, Homo sapiens
cgcctttttggcctgt

SEQ ID NO: 4632072 - DNA, 18 bp, Homo sapiens
cgcctttttggcctgtga

SEQ ID NO: 4632073 - DNA, 14 bp, Homo sapiens
cgcgcagctgccta

SEQ ID NO: 4632074 - DNA, 16 bp, Homo sapiens
cgcgcagctgcctagg

SEQ ID NO: 4632075 - DNA, 15 bp, Homo sapiens
cgcgccgatgccacc

SEQ ID NO: 4632076 - DNA, 18 bp, Homo sapiens
cgcgccgatgccaccggc

SEQ ID NO: 4632077 - DNA, 20 bp, Homo sapiens
cgcggcccgcgcagctgcct

SEQ ID NO: 4632078 - DNA, 16 bp, Homo sapiens
cgctacaccactctgg

SEQ ID NO: 4632079 - DNA, 19 bp, Homo sapiens
cgctctgccgccgcccgct

SEQ ID NO: 4632080 - DNA, 18 bp, Homo sapiens
cgctgaggggtctcggat

SEQ ID NO: 4632081 - DNA, 20 bp, Homo sapiens
cgctggggaccggttcccac

SEQ ID NO: 4632082 - DNA, 23 bp, Homo sapiens
cgcttgtagaactcactctgggc

SEQ ID NO: 4632083 - DNA, 14 bp, Homo sapiens
cgctttgaaagaag

SEQ ID NO: 4632084 - DNA, 20 bp, Homo sapiens
cgctttttcatccttctttc

SEQ ID NO: 4632085 - DNA, 23 bp, Homo sapiens
cggaaacaaaaatgatcctcagt

SEQ ID NO: 4632086 - DNA, 13 bp, Homo sapiens
cggaaggaggcca

SEQ ID NO: 4632087 - DNA, 16 bp, Homo sapiens
cggacattctaatgca

SEQ ID NO: 4632088 - DNA, 18 bp, Homo sapiens
cggacattctaatgcata

SEQ ID NO: 4632089 - DNA, 13 bp, Homo sapiens
cggactgccaaat

SEQ ID NO: 4632090 - DNA, 16 bp, Homo sapiens
cggacttactgcctga

SEQ ID NO: 4632091 - DNA, 12 bp, Homo sapiens
cggagctcctgt

SEQ ID NO: 4632092 - DNA, 19 bp, Homo sapiens
cggagctgcccctctctgg

SEQ ID NO: 4632093 - DNA, 22 bp, Homo sapiens
cggagctgcccctctctgggcc

SEQ ID NO: 4632094 - DNA, 12 bp, Homo sapiens
cggagggagggg

SEQ ID NO: 4632095 - DNA, 15 bp, Homo sapiens
cggaggggatccagc

SEQ ID NO: 4632096 - DNA, 17 bp, Homo sapiens
cggaggggatccagcca

SEQ ID NO: 4632097 - DNA, 12 bp, Homo sapiens
cggatcctgctg

SEQ ID NO: 4632098 - DNA, 16 bp, Homo sapiens
cggatgcgtgggcaga

SEQ ID NO: 4632099 - DNA, 12 bp, Homo sapiens
cggcaacatcaa

SEQ ID NO: 4632100 - DNA, 17 bp, Homo sapiens
cggcacctgggccctgg

SEQ ID NO: 4632101 - DNA, 15 bp, Homo sapiens
cggccccagcgcgca

SEQ ID NO: 4632102 - DNA, 18 bp, Homo sapiens
cggccctcatctatgagg

SEQ ID NO: 4632103 - DNA, 19 bp, Homo sapiens
cggcctatgacttgggcac

SEQ ID NO: 4632104 - DNA, 16 bp, Homo sapiens
cggcctggctggtggg

SEQ ID NO: 4632105 - DNA, 21 bp, Homo sapiens
cggcctgtcctccaacaccaa

SEQ ID NO: 4632106 - DNA, 12 bp, Homo sapiens
cggcctgtgggt

SEQ ID NO: 4632107 - DNA, 19 bp, Homo sapiens
cggcctgtgggtctctgaa

SEQ ID NO: 4632108 - DNA, 16 bp, Homo sapiens
cggccttgatcccctt

SEQ ID NO: 4632109 - DNA, 19 bp, Homo sapiens
cggctcagtgcaacctctg

SEQ ID NO: 4632110 - DNA, 18 bp, Homo sapiens
cggctcccacggagcatc

SEQ ID NO: 4632111 - DNA, 16 bp, Homo sapiens
cggctcggaggaagcc

SEQ ID NO: 4632112 - DNA, 16 bp, Homo sapiens
cggctcgtgtatttat

SEQ ID NO: 4632113 - DNA, 14 bp, Homo sapiens
cggctctagcccca

SEQ ID NO: 4632114 - DNA, 18 bp, Homo sapiens
cggctggaaatgctgggc

SEQ ID NO: 4632115 - DNA, 18 bp, Homo sapiens
cggctttttgccatctgt

SEQ ID NO: 4632116 - DNA, 18 bp, Homo sapiens
cgggagccgctggcagaa

SEQ ID NO: 4632117 - DNA, 15 bp, Homo sapiens
cgggagcctccctgc

SEQ ID NO: 4632118 - DNA, 11 bp, Homo sapiens
cgggaggggag

SEQ ID NO: 4632119 - DNA, 15 bp, Homo sapiens
cgggaggggaggcat

SEQ ID NO: 4632120 - DNA, 15 bp, Homo sapiens
cgggatattatagaa

SEQ ID NO: 4632121 - DNA, 19 bp, Homo sapiens
cgggccactccttcctgcc

SEQ ID NO: 4632122 - DNA, 20 bp, Homo sapiens
cgggccactccttcctgccc

SEQ ID NO: 4632123 - DNA, 22 bp, Homo sapiens
cgggccactccttcctgcccca

SEQ ID NO: 4632124 - DNA, 15 bp, Homo sapiens
cgggcggagggaggg

SEQ ID NO: 4632125 - DNA, 20 bp, Homo sapiens
cgggctttaatagtcacctt

SEQ ID NO: 4632126 - DNA, 15 bp, Homo sapiens
cggggaactggccaa

SEQ ID NO: 4632127 - DNA, 22 bp, Homo sapiens
cggggaactggccaagctgagg

SEQ ID NO: 4632128 - DNA, 13 bp, Homo sapiens
cggggaagtgctc

SEQ ID NO: 4632129 - DNA, 15 bp, Homo sapiens
cggggcctgtctcag

SEQ ID NO: 4632130 - DNA, 17 bp, Homo sapiens
cggggcctgtctcagtg

SEQ ID NO: 4632131 - DNA, 12 bp, Homo sapiens
cggggtccctgg

SEQ ID NO: 4632132 - DNA, 22 bp, Homo sapiens
cggggtgagggggggctccctg

SEQ ID NO: 4632133 - DNA, 16 bp, Homo sapiens
cggggtgcacaggagg

SEQ ID NO: 4632134 - DNA, 19 bp, Homo sapiens
cgggtccatagagatgagc

SEQ ID NO: 4632135 - DNA, 18 bp, Homo sapiens
cggtccaagcctgcaact

SEQ ID NO: 4632136 - DNA, 18 bp, Homo sapiens
cggtctggcagggcagca

SEQ ID NO: 4632137 - DNA, 19 bp, Homo sapiens
cggtgctaaaaatgaaaat

SEQ ID NO: 4632138 - DNA, 14 bp, Homo sapiens
cggtgctgcaggag

SEQ ID NO: 4632139 - DNA, 14 bp, Homo sapiens
cggttatttaagca

SEQ ID NO: 4632140 - DNA, 22 bp, Homo sapiens
cggttcactcttctcagccact

SEQ ID NO: 4632141 - DNA, 17 bp, Homo sapiens
cggttttggcagctgac

SEQ ID NO: 4632142 - DNA, 12 bp, Homo sapiens
cgtaaaatggtg

SEQ ID NO: 4632143 - DNA, 17 bp, Homo sapiens
cgtaaagctagaaatga

SEQ ID NO: 4632144 - DNA, 14 bp, Homo sapiens
cgtaatcctcctga

SEQ ID NO: 4632145 - DNA, 16 bp, Homo sapiens
cgtaatcctcctgagt

SEQ ID NO: 4632146 - DNA, 12 bp, Homo sapiens
cgtacacagaga

SEQ ID NO: 4632147 - DNA, 13 bp, Homo sapiens
cgtacacagagaa

SEQ ID NO: 4632148 - DNA, 14 bp, Homo sapiens
cgtagggggcaggg

SEQ ID NO: 4632149 - DNA, 18 bp, Homo sapiens
cgtatccaccttgcaccc

SEQ ID NO: 4632150 - DNA, 20 bp, Homo sapiens
cgtccctatatcagggcctg

SEQ ID NO: 4632151 - DNA, 15 bp, Homo sapiens
cgtcctccaagctca

SEQ ID NO: 4632152 - DNA, 15 bp, Homo sapiens
cgtcctggcacagaa

SEQ ID NO: 4632153 - DNA, 17 bp, Homo sapiens
cgtccttactcctgtgg

SEQ ID NO: 4632154 - DNA, 21 bp, Homo sapiens
cgtccttactcctgtgggagc

SEQ ID NO: 4632155 - DNA, 14 bp, Homo sapiens
cgtctggctccctg

SEQ ID NO: 4632156 - DNA, 21 bp, Homo sapiens
cgtgagagaaagagagaagcc

SEQ ID NO: 4632157 - DNA, 18 bp, Homo sapiens
cgtgagctggggactcag

SEQ ID NO: 4632158 - DNA, 19 bp, Homo sapiens
cgtgagctggggactcagg

SEQ ID NO: 4632159 - DNA, 20 bp, Homo sapiens
cgtgaggggcaagctaggcc

SEQ ID NO: 4632160 - DNA, 13 bp, Homo sapiens
cgtgatacatttg

SEQ ID NO: 4632161 - DNA, 18 bp, Homo sapiens
cgtgatccacccacctcg

SEQ ID NO: 4632162 - DNA, 17 bp, Homo sapiens
cgtgcatgctctgcagc

SEQ ID NO: 4632163 - DNA, 20 bp, Homo sapiens
cgtgccaagtccaggtcctg

SEQ ID NO: 4632164 - DNA, 12 bp, Homo sapiens
cgtgcctggctg

SEQ ID NO: 4632165 - DNA, 17 bp, Homo sapiens
cgtgcgggaaattcagt

SEQ ID NO: 4632166 - DNA, 20 bp, Homo sapiens
cgtggaacgtttttcctgtt

SEQ ID NO: 4632167 - DNA, 19 bp, Homo sapiens
cgtggagagctaggagcaa

SEQ ID NO: 4632168 - DNA, 13 bp, Homo sapiens
cgtggaggctgct

SEQ ID NO: 4632169 - DNA, 15 bp, Homo sapiens
cgtggaggctgctcg

SEQ ID NO: 4632170 - DNA, 15 bp, Homo sapiens
cgtggccacaaaaac

SEQ ID NO: 4632171 - DNA, 13 bp, Homo sapiens
cgtggccagaggc

SEQ ID NO: 4632172 - DNA, 14 bp, Homo sapiens
cgtggctcagccag

SEQ ID NO: 4632173 - DNA, 13 bp, Homo sapiens
cgtggctctgctg

SEQ ID NO: 4632174 - DNA, 12 bp, Homo sapiens
cgtgggcagagg

SEQ ID NO: 4632175 - DNA, 18 bp, Homo sapiens
cgtgggctcagcagggct

SEQ ID NO: 4632176 - DNA, 17 bp, Homo sapiens
cgtggtcatgaatagaa

SEQ ID NO: 4632177 - DNA, 10 bp, Homo sapiens
cgtggtttgc

SEQ ID NO: 4632178 - DNA, 14 bp, Homo sapiens
cgtgtgaaatctgt

SEQ ID NO: 4632179 - DNA, 16 bp, Homo sapiens
cgtgtgaaatctgtct

SEQ ID NO: 4632180 - DNA, 17 bp, Homo sapiens
cgtgtgaaatctgtctt

SEQ ID NO: 4632181 - DNA, 15 bp, Homo sapiens
cgtgtgagtgtgaca

SEQ ID NO: 4632182 - DNA, 17 bp, Homo sapiens
cgtgtgtccatgtgttc

SEQ ID NO: 4632183 - DNA, 18 bp, Homo sapiens
cgtgttccgcttctctct

SEQ ID NO: 4632184 - DNA, 15 bp, Homo sapiens
cgttaagggcagagt

SEQ ID NO: 4632185 - DNA, 19 bp, Homo sapiens
cgttaggcatttcctgctg

SEQ ID NO: 4632186 - DNA, 20 bp, Homo sapiens
cgttaggcatttcctgctga

SEQ ID NO: 4632187 - DNA, 23 bp, Homo sapiens
cgttcacctccaagcatttcatg

SEQ ID NO: 4632188 - DNA, 16 bp, Homo sapiens
cgttcctccccctgct

SEQ ID NO: 4632189 - DNA, 13 bp, Homo sapiens
cgtttcccctcct

SEQ ID NO: 4632190 - DNA, 18 bp, Homo sapiens
cgtttggtcttaggtctt

SEQ ID NO: 4632191 - DNA, 22 bp, Homo sapiens
cgtttggtcttaggtcttcctg

SEQ ID NO: 4632192 - DNA, 17 bp, Homo sapiens
ctaaaaaaaaaaaagta

SEQ ID NO: 4632193 - DNA, 16 bp, Homo sapiens
ctaaaaaggaagaaaa

SEQ ID NO: 4632194 - DNA, 20 bp, Homo sapiens
ctaaaaatatagcaaatgca

SEQ ID NO: 4632195 - DNA, 13 bp, Homo sapiens
ctaaaagacaggc

SEQ ID NO: 4632196 - DNA, 13 bp, Homo sapiens
ctaaactttattt

SEQ ID NO: 4632197 - DNA, 16 bp, Homo sapiens
ctaaactttatttgta

SEQ ID NO: 4632198 - DNA, 23 bp, Homo sapiens
ctaaactttatttgtaaaccatt

SEQ ID NO: 4632199 - DNA, 21 bp, Homo sapiens
ctaaagaaaaatatcttggcc

SEQ ID NO: 4632200 - DNA, 18 bp, Homo sapiens
ctaaagctaaaaatatta

SEQ ID NO: 4632201 - DNA, 23 bp, Homo sapiens
ctaaaggctaaacatatggcttt

SEQ ID NO: 4632202 - DNA, 22 bp, Homo sapiens
ctaaaggggactagacagttag

SEQ ID NO: 4632203 - DNA, 17 bp, Homo sapiens
ctaaataaaaaaagaca

SEQ ID NO: 4632204 - DNA, 18 bp, Homo sapiens
ctaaataaaaatatgtaa

SEQ ID NO: 4632205 - DNA, 23 bp, Homo sapiens
ctaacactcagaagcctgggggc

SEQ ID NO: 4632206 - DNA, 14 bp, Homo sapiens
ctaacagggaaggc

SEQ ID NO: 4632207 - DNA, 16 bp, Homo sapiens
ctaacagggaaggcag

SEQ ID NO: 4632208 - DNA, 18 bp, Homo sapiens
ctaacatgcaccttgctc

SEQ ID NO: 4632209 - DNA, 20 bp, Homo sapiens
ctaacatgcaccttgctccc

SEQ ID NO: 4632210 - DNA, 16 bp, Homo sapiens
ctaaccacggttattt

SEQ ID NO: 4632211 - DNA, 20 bp, Homo sapiens
ctaaccacttcgcacacacc

SEQ ID NO: 4632212 - DNA, 14 bp, Homo sapiens
ctaacgccagcaca

SEQ ID NO: 4632213 - DNA, 12 bp, Homo sapiens
ctaacgcctgag

SEQ ID NO: 4632214 - DNA, 13 bp, Homo sapiens
ctaacgcctgagc

SEQ ID NO: 4632215 - DNA, 14 bp, Homo sapiens
ctaacgcctgagcc

SEQ ID NO: 4632216 - DNA, 15 bp, Homo sapiens
ctaactaaataccat

SEQ ID NO: 4632217 - DNA, 16 bp, Homo sapiens
ctaactaaataccatt

SEQ ID NO: 4632218 - DNA, 18 bp, Homo sapiens
ctaactgatgagtaaact

SEQ ID NO: 4632219 - DNA, 22 bp, Homo sapiens
ctaactggaaacaaaacagaag

SEQ ID NO: 4632220 - DNA, 23 bp, Homo sapiens
ctaactggaaacaaaacagaagg

SEQ ID NO: 4632221 - DNA, 15 bp, Homo sapiens
ctaacttctaaagaa

SEQ ID NO: 4632222 - DNA, 17 bp, Homo sapiens
ctaacttttgtgtgaaa

SEQ ID NO: 4632223 - DNA, 18 bp, Homo sapiens
ctaagaatttttttttaa

SEQ ID NO: 4632224 - DNA, 14 bp, Homo sapiens
ctaagaggtgggag

SEQ ID NO: 4632225 - DNA, 20 bp, Homo sapiens
ctaagcactgtgtttatatg

SEQ ID NO: 4632226 - DNA, 20 bp, Homo sapiens
ctaagcattccacactgcag

SEQ ID NO: 4632227 - DNA, 13 bp, Homo sapiens
ctaagcccaggat

SEQ ID NO: 4632228 - DNA, 14 bp, Homo sapiens
ctaagcccaggatc

SEQ ID NO: 4632229 - DNA, 16 bp, Homo sapiens
ctaagcccaggatctc

SEQ ID NO: 4632230 - DNA, 16 bp, Homo sapiens
ctaaggacatttccca

SEQ ID NO: 4632231 - DNA, 20 bp, Homo sapiens
ctaagggtgggtgctcagaa

SEQ ID NO: 4632232 - DNA, 16 bp, Homo sapiens
ctaaggtactgtgggg

SEQ ID NO: 4632233 - DNA, 15 bp, Homo sapiens
ctaagtgcaaacaca

SEQ ID NO: 4632234 - DNA, 18 bp, Homo sapiens
ctaagttttcaaatttgt

SEQ ID NO: 4632235 - DNA, 15 bp, Homo sapiens
ctaataattgtatct

SEQ ID NO: 4632236 - DNA, 17 bp, Homo sapiens
ctaataattgtatctac

SEQ ID NO: 4632237 - DNA, 18 bp, Homo sapiens
ctaataattgtatctaca

SEQ ID NO: 4632238 - DNA, 16 bp, Homo sapiens
ctaatacctctgtgtg

SEQ ID NO: 4632239 - DNA, 15 bp, Homo sapiens
ctaatagctttttaa

SEQ ID NO: 4632240 - DNA, 11 bp, Homo sapiens
ctaatatcatt

SEQ ID NO: 4632241 - DNA, 15 bp, Homo sapiens
ctaatatcattttat

SEQ ID NO: 4632242 - DNA, 17 bp, Homo sapiens
ctaatatcattttattc

SEQ ID NO: 4632243 - DNA, 19 bp, Homo sapiens
ctaatatcattttattcac

SEQ ID NO: 4632244 - DNA, 20 bp, Homo sapiens
ctaatatcattttattcaca

SEQ ID NO: 4632245 - DNA, 19 bp, Homo sapiens
ctaatcaaagccagggtct

SEQ ID NO: 4632246 - DNA, 16 bp, Homo sapiens
ctaatgcaaattaaaa

SEQ ID NO: 4632247 - DNA, 13 bp, Homo sapiens
ctaatgcatattt

SEQ ID NO: 4632248 - DNA, 22 bp, Homo sapiens
ctaatgcatatttataagagaa

SEQ ID NO: 4632249 - DNA, 13 bp, Homo sapiens
ctaatgtgatcat

SEQ ID NO: 4632250 - DNA, 17 bp, Homo sapiens
ctaatgtgatcatatga

SEQ ID NO: 4632251 - DNA, 18 bp, Homo sapiens
ctaattaaccttactaat

SEQ ID NO: 4632252 - DNA, 13 bp, Homo sapiens
ctaatttaacacc

SEQ ID NO: 4632253 - DNA, 16 bp, Homo sapiens
ctaatttatattatcc

SEQ ID NO: 4632254 - DNA, 19 bp, Homo sapiens
ctaatttatattatccata

SEQ ID NO: 4632255 - DNA, 20 bp, Homo sapiens
ctaattttacatgtttataa

SEQ ID NO: 4632256 - DNA, 18 bp, Homo sapiens
ctaatttttttttgtagt

SEQ ID NO: 4632257 - DNA, 19 bp, Homo sapiens
ctacaactggagttttttt

SEQ ID NO: 4632258 - DNA, 15 bp, Homo sapiens
ctacacagctcagca

SEQ ID NO: 4632259 - DNA, 14 bp, Homo sapiens
ctacacagggcctg

SEQ ID NO: 4632260 - DNA, 17 bp, Homo sapiens
ctacacagggcctgcta

SEQ ID NO: 4632261 - DNA, 14 bp, Homo sapiens
ctacacatttttaa

SEQ ID NO: 4632262 - DNA, 21 bp, Homo sapiens
ctacaccactctggcagccac

SEQ ID NO: 4632263 - DNA, 22 bp, Homo sapiens
ctacaccactctggcagccaca

SEQ ID NO: 4632264 - DNA, 15 bp, Homo sapiens
ctacagcactactgg

SEQ ID NO: 4632265 - DNA, 22 bp, Homo sapiens
ctacagcactactgggtgtcat

SEQ ID NO: 4632266 - DNA, 14 bp, Homo sapiens
ctacagtaatgaaa

SEQ ID NO: 4632267 - DNA, 11 bp, Homo sapiens
ctacagtgcca

SEQ ID NO: 4632268 - DNA, 19 bp, Homo sapiens
ctacagtgccaactcctca

SEQ ID NO: 4632269 - DNA, 16 bp, Homo sapiens
ctacagtgtacagtct

SEQ ID NO: 4632270 - DNA, 20 bp, Homo sapiens
ctacagtgtacagtcttgta

SEQ ID NO: 4632271 - DNA, 22 bp, Homo sapiens
ctacagtttttatttagcatgg

SEQ ID NO: 4632272 - DNA, 16 bp, Homo sapiens
ctacataagtcctttc

SEQ ID NO: 4632273 - DNA, 12 bp, Homo sapiens
ctacattaaaat

SEQ ID NO: 4632274 - DNA, 15 bp, Homo sapiens
ctacattaaaatgac

SEQ ID NO: 4632275 - DNA, 17 bp, Homo sapiens
ctacattaaaatgacaa

SEQ ID NO: 4632276 - DNA, 13 bp, Homo sapiens
ctaccctggactt

SEQ ID NO: 4632277 - DNA, 16 bp, Homo sapiens
ctacccttttcctttt

SEQ ID NO: 4632278 - DNA, 15 bp, Homo sapiens
ctaccgctggccctg

SEQ ID NO: 4632279 - DNA, 16 bp, Homo sapiens
ctaccgtaattgcttt

SEQ ID NO: 4632280 - DNA, 21 bp, Homo sapiens
ctacgccaatgttatgccagc

SEQ ID NO: 4632281 - DNA, 23 bp, Homo sapiens
ctacgtatttttctgacttttac

SEQ ID NO: 4632282 - DNA, 20 bp, Homo sapiens
ctacgtgtgaaatctgtctt

SEQ ID NO: 4632283 - DNA, 19 bp, Homo sapiens
ctactacccattgttccct

SEQ ID NO: 4632284 - DNA, 22 bp, Homo sapiens
ctactacccattgttcccttcc

SEQ ID NO: 4632285 - DNA, 12 bp, Homo sapiens
ctactattttct

SEQ ID NO: 4632286 - DNA, 16 bp, Homo sapiens
ctactccctggaccac

SEQ ID NO: 4632287 - DNA, 22 bp, Homo sapiens
ctactccctggaccacgaggct

SEQ ID NO: 4632288 - DNA, 13 bp, Homo sapiens
ctactctgtgcca

SEQ ID NO: 4632289 - DNA, 17 bp, Homo sapiens
ctactctgtgccagagc

SEQ ID NO: 4632290 - DNA, 21 bp, Homo sapiens
ctactgagaacataaaatctt

SEQ ID NO: 4632291 - DNA, 21 bp, Homo sapiens
ctactgagcatttgcacctct

SEQ ID NO: 4632292 - DNA, 17 bp, Homo sapiens
ctactgattacttgtaa

SEQ ID NO: 4632293 - DNA, 19 bp, Homo sapiens
ctactgcagcacctccagg

SEQ ID NO: 4632294 - DNA, 20 bp, Homo sapiens
ctactgcagcacctccaggc

SEQ ID NO: 4632295 - DNA, 14 bp, Homo sapiens
ctactgggtgtcat

SEQ ID NO: 4632296 - DNA, 15 bp, Homo sapiens
ctactgtttgatttg

SEQ ID NO: 4632297 - DNA, 23 bp, Homo sapiens
ctactgttttaatttatactggc

SEQ ID NO: 4632298 - DNA, 19 bp, Homo sapiens
ctacttcaggaacaccccc

SEQ ID NO: 4632299 - DNA, 19 bp, Homo sapiens
ctacttctcagtccccttc

SEQ ID NO: 4632300 - DNA, 16 bp, Homo sapiens
ctacttggcaggctga

SEQ ID NO: 4632301 - DNA, 19 bp, Homo sapiens
ctacttggcaggctgaggt

SEQ ID NO: 4632302 - DNA, 20 bp, Homo sapiens
ctactttaaatcctaccaaa

SEQ ID NO: 4632303 - DNA, 21 bp, Homo sapiens
ctactttaaatcctaccaaag

SEQ ID NO: 4632304 - DNA, 17 bp, Homo sapiens
ctagaaaaataaaatgt

SEQ ID NO: 4632305 - DNA, 20 bp, Homo sapiens
ctagaaaaataaaatgtttc

SEQ ID NO: 4632306 - DNA, 12 bp, Homo sapiens
ctagaaattttc

SEQ ID NO: 4632307 - DNA, 19 bp, Homo sapiens
ctagaagcctaagaactgt

SEQ ID NO: 4632308 - DNA, 16 bp, Homo sapiens
ctagaagctccatgga

SEQ ID NO: 4632309 - DNA, 14 bp, Homo sapiens
ctagaatcatactt

SEQ ID NO: 4632310 - DNA, 22 bp, Homo sapiens
ctagacaatgatttggccaggc

SEQ ID NO: 4632311 - DNA, 13 bp, Homo sapiens
ctagacacagata

SEQ ID NO: 4632312 - DNA, 14 bp, Homo sapiens
ctagaccagggctg

SEQ ID NO: 4632313 - DNA, 18 bp, Homo sapiens
ctagaccagggctgctct

SEQ ID NO: 4632314 - DNA, 22 bp, Homo sapiens
ctagaccagggctgctctttcc

SEQ ID NO: 4632315 - DNA, 14 bp, Homo sapiens
ctagactgtgtctg

SEQ ID NO: 4632316 - DNA, 19 bp, Homo sapiens
ctagacttagattcattaa

SEQ ID NO: 4632317 - DNA, 14 bp, Homo sapiens
ctagagcttttatt

SEQ ID NO: 4632318 - DNA, 20 bp, Homo sapiens
ctagaggtgttacagaggac

SEQ ID NO: 4632319 - DNA, 23 bp, Homo sapiens
ctagaggtgttacagaggaccct

SEQ ID NO: 4632320 - DNA, 13 bp, Homo sapiens
ctagagtgtagcc

SEQ ID NO: 4632321 - DNA, 21 bp, Homo sapiens
ctagatacaggactggttcct

SEQ ID NO: 4632322 - DNA, 21 bp, Homo sapiens
ctagcaaacagatgtttgttt

SEQ ID NO: 4632323 - DNA, 13 bp, Homo sapiens
ctagcacatgccc

SEQ ID NO: 4632324 - DNA, 12 bp, Homo sapiens
ctagcagcaccg

SEQ ID NO: 4632325 - DNA, 19 bp, Homo sapiens
ctagcagcaccgttctgtg

SEQ ID NO: 4632326 - DNA, 20 bp, Homo sapiens
ctagcaggaacttctagctc

SEQ ID NO: 4632327 - DNA, 15 bp, Homo sapiens
ctagcagtccccagc

SEQ ID NO: 4632328 - DNA, 20 bp, Homo sapiens
ctagccaaaccaggaccctg

SEQ ID NO: 4632329 - DNA, 21 bp, Homo sapiens
ctagccagaattctaccctgg

SEQ ID NO: 4632330 - DNA, 18 bp, Homo sapiens
ctagccaggtctcctggg

SEQ ID NO: 4632331 - DNA, 19 bp, Homo sapiens
ctagccaggtctcctggga

SEQ ID NO: 4632332 - DNA, 16 bp, Homo sapiens
ctagcctttgggcaca

SEQ ID NO: 4632333 - DNA, 14 bp, Homo sapiens
ctagctatatatgg

SEQ ID NO: 4632334 - DNA, 15 bp, Homo sapiens
ctagctctctaggcc

SEQ ID NO: 4632335 - DNA, 19 bp, Homo sapiens
ctagctctgaaatcaactc

SEQ ID NO: 4632336 - DNA, 21 bp, Homo sapiens
ctagctctgaaatcaactctc

SEQ ID NO: 4632337 - DNA, 12 bp, Homo sapiens
ctagctcttccc

SEQ ID NO: 4632338 - DNA, 15 bp, Homo sapiens
ctaggaatggaggag

SEQ ID NO: 4632339 - DNA, 20 bp, Homo sapiens
ctaggaatggaggagccagg

SEQ ID NO: 4632340 - DNA, 19 bp, Homo sapiens
ctaggacacagttcctggg

SEQ ID NO: 4632341 - DNA, 20 bp, Homo sapiens
ctaggacacagttcctggga

SEQ ID NO: 4632342 - DNA, 20 bp, Homo sapiens
ctaggagcaaagcctgttca

SEQ ID NO: 4632343 - DNA, 19 bp, Homo sapiens
ctaggaggctgtgggtttt

SEQ ID NO: 4632344 - DNA, 14 bp, Homo sapiens
ctaggagggctctg

SEQ ID NO: 4632345 - DNA, 22 bp, Homo sapiens
ctaggatgtcatgtctgcttgt

SEQ ID NO: 4632346 - DNA, 14 bp, Homo sapiens
ctaggccaggtgca

SEQ ID NO: 4632347 - DNA, 15 bp, Homo sapiens
ctaggccccagaggc

SEQ ID NO: 4632348 - DNA, 16 bp, Homo sapiens
ctaggccccagaggcc

SEQ ID NO: 4632349 - DNA, 18 bp, Homo sapiens
ctaggccccagaggccct

SEQ ID NO: 4632350 - DNA, 23 bp, Homo sapiens
ctaggccccagaggccctggagg

SEQ ID NO: 4632351 - DNA, 23 bp, Homo sapiens
ctaggcttcccaggctgggctct

SEQ ID NO: 4632352 - DNA, 14 bp, Homo sapiens
ctagggtgggaagg

SEQ ID NO: 4632353 - DNA, 18 bp, Homo sapiens
ctagggtgggaaggggct

SEQ ID NO: 4632354 - DNA, 14 bp, Homo sapiens
ctaggttatacaat

SEQ ID NO: 4632355 - DNA, 17 bp, Homo sapiens
ctaggttatacaataac

SEQ ID NO: 4632356 - DNA, 18 bp, Homo sapiens
ctagtaaaaccttgttct

SEQ ID NO: 4632357 - DNA, 15 bp, Homo sapiens
ctagtaaccaaggcc

SEQ ID NO: 4632358 - DNA, 18 bp, Homo sapiens
ctagtaaccaaggccctg

SEQ ID NO: 4632359 - DNA, 20 bp, Homo sapiens
ctagtaaccaaggccctgtc

SEQ ID NO: 4632360 - DNA, 22 bp, Homo sapiens
ctagtaaccaaggccctgtctc

SEQ ID NO: 4632361 - DNA, 23 bp, Homo sapiens
ctagtaaccaaggccctgtctct

SEQ ID NO: 4632362 - DNA, 22 bp, Homo sapiens
ctagtaagtcaggacagcttgt

SEQ ID NO: 4632363 - DNA, 17 bp, Homo sapiens
ctagtacaatcttggga

SEQ ID NO: 4632364 - DNA, 13 bp, Homo sapiens
ctagtacactttt

SEQ ID NO: 4632365 - DNA, 20 bp, Homo sapiens
ctagtatgccctgtaatttt

SEQ ID NO: 4632366 - DNA, 14 bp, Homo sapiens
ctagtcattgtcat

SEQ ID NO: 4632367 - DNA, 14 bp, Homo sapiens
ctagtccgtcctgg

SEQ ID NO: 4632368 - DNA, 17 bp, Homo sapiens
ctagtccgtcctggcac

SEQ ID NO: 4632369 - DNA, 22 bp, Homo sapiens
ctagtcgcccctcagagcatga

SEQ ID NO: 4632370 - DNA, 16 bp, Homo sapiens
ctagtgcttgtggaga

SEQ ID NO: 4632371 - DNA, 21 bp, Homo sapiens
ctagtgctttccttttttaaa

SEQ ID NO: 4632372 - DNA, 23 bp, Homo sapiens
ctagtgctttccttttttaaaaa

SEQ ID NO: 4632373 - DNA, 13 bp, Homo sapiens
ctagtgggacagc

SEQ ID NO: 4632374 - DNA, 18 bp, Homo sapiens
ctagtgggacagcccaga

SEQ ID NO: 4632375 - DNA, 23 bp, Homo sapiens
ctagtgggacagcccagagcctg

SEQ ID NO: 4632376 - DNA, 16 bp, Homo sapiens
ctagtttcctggttcc

SEQ ID NO: 4632377 - DNA, 16 bp, Homo sapiens
ctagttttactttgaa

SEQ ID NO: 4632378 - DNA, 14 bp, Homo sapiens
ctagtttttggaaa

SEQ ID NO: 4632379 - DNA, 23 bp, Homo sapiens
ctataagtgagatggtatgaaat

SEQ ID NO: 4632380 - DNA, 19 bp, Homo sapiens
ctataatcccagcactttg

SEQ ID NO: 4632381 - DNA, 15 bp, Homo sapiens
ctataatcttataca

SEQ ID NO: 4632382 - DNA, 16 bp, Homo sapiens
ctataatcttatacaa

SEQ ID NO: 4632383 - DNA, 16 bp, Homo sapiens
ctatagagcctacctg

SEQ ID NO: 4632384 - DNA, 16 bp, Homo sapiens
ctataggaacagccca

SEQ ID NO: 4632385 - DNA, 16 bp, Homo sapiens
ctatagttgcagccca

SEQ ID NO: 4632386 - DNA, 14 bp, Homo sapiens
ctatataatttatt

SEQ ID NO: 4632387 - DNA, 20 bp, Homo sapiens
ctatataatttatttccact

SEQ ID NO: 4632388 - DNA, 18 bp, Homo sapiens
ctatatcgagagtgtgtg

SEQ ID NO: 4632389 - DNA, 15 bp, Homo sapiens
ctatcaacaataaaa

SEQ ID NO: 4632390 - DNA, 14 bp, Homo sapiens
ctatcaccagtgca

SEQ ID NO: 4632391 - DNA, 15 bp, Homo sapiens
ctatcaccagtgcat

SEQ ID NO: 4632392 - DNA, 22 bp, Homo sapiens
ctatcaccagtgcatcacatct

SEQ ID NO: 4632393 - DNA, 17 bp, Homo sapiens
ctatcctaaataaaaaa

SEQ ID NO: 4632394 - DNA, 11 bp, Homo sapiens
ctatcctggga

SEQ ID NO: 4632395 - DNA, 14 bp, Homo sapiens
ctatcctgggacct

SEQ ID NO: 4632396 - DNA, 13 bp, Homo sapiens
ctatctctttctt

SEQ ID NO: 4632397 - DNA, 21 bp, Homo sapiens
ctatctggtcaacctcctgga

SEQ ID NO: 4632398 - DNA, 21 bp, Homo sapiens
ctatgacctcgccctccacaa

SEQ ID NO: 4632399 - DNA, 16 bp, Homo sapiens
ctatgacttgggcacc

SEQ ID NO: 4632400 - DNA, 20 bp, Homo sapiens
ctatgacttgggcaccccca

SEQ ID NO: 4632401 - DNA, 23 bp, Homo sapiens
ctatgacttgggcacccccagcc

SEQ ID NO: 4632402 - DNA, 21 bp, Homo sapiens
ctatgatggatggcagactct

SEQ ID NO: 4632403 - DNA, 13 bp, Homo sapiens
ctatgctttagaa

SEQ ID NO: 4632404 - DNA, 18 bp, Homo sapiens
ctatggagagccctggga

SEQ ID NO: 4632405 - DNA, 19 bp, Homo sapiens
ctatggagagccctgggac

SEQ ID NO: 4632406 - DNA, 21 bp, Homo sapiens
ctatggagagccctgggaccg

SEQ ID NO: 4632407 - DNA, 18 bp, Homo sapiens
ctatggagaggcttccct

SEQ ID NO: 4632408 - DNA, 14 bp, Homo sapiens
ctatggatggcttc

SEQ ID NO: 4632409 - DNA, 15 bp, Homo sapiens
ctatggatggcttct

SEQ ID NO: 4632410 - DNA, 16 bp, Homo sapiens
ctatggcttatttcta

SEQ ID NO: 4632411 - DNA, 21 bp, Homo sapiens
ctatggcttatttctatgaca

SEQ ID NO: 4632412 - DNA, 20 bp, Homo sapiens
ctatggtgagatgcagctgg

SEQ ID NO: 4632413 - DNA, 21 bp, Homo sapiens
ctatggtgagatgcagctgga

SEQ ID NO: 4632414 - DNA, 19 bp, Homo sapiens
ctatgtagtcataataaat

SEQ ID NO: 4632415 - DNA, 18 bp, Homo sapiens
ctatgtgattttaactct

SEQ ID NO: 4632416 - DNA, 21 bp, Homo sapiens
ctatgtgattttaactctgtc

SEQ ID NO: 4632417 - DNA, 18 bp, Homo sapiens
ctatgttctgtcttccca

SEQ ID NO: 4632418 - DNA, 12 bp, Homo sapiens
ctatgtttgtat

SEQ ID NO: 4632419 - DNA, 13 bp, Homo sapiens
ctatgtttgtatt

SEQ ID NO: 4632420 - DNA, 13 bp, Homo sapiens
ctattaatcaaga

SEQ ID NO: 4632421 - DNA, 15 bp, Homo sapiens
ctattaatcaagaga

SEQ ID NO: 4632422 - DNA, 17 bp, Homo sapiens
ctattacttttctgttt

SEQ ID NO: 4632423 - DNA, 17 bp, Homo sapiens
ctattagatacacttct

SEQ ID NO: 4632424 - DNA, 20 bp, Homo sapiens
ctattagatacacttcttaa

SEQ ID NO: 4632425 - DNA, 15 bp, Homo sapiens
ctattctagcctgca

SEQ ID NO: 4632426 - DNA, 23 bp, Homo sapiens
ctattctagcctgcattgagctt

SEQ ID NO: 4632427 - DNA, 15 bp, Homo sapiens
ctattgaaaatatat

SEQ ID NO: 4632428 - DNA, 20 bp, Homo sapiens
ctatttatgccttgatgatt

SEQ ID NO: 4632429 - DNA, 15 bp, Homo sapiens
ctatttattagccaa

SEQ ID NO: 4632430 - DNA, 15 bp, Homo sapiens
ctatttattcctgtt

SEQ ID NO: 4632431 - DNA, 15 bp, Homo sapiens
ctatttccttccagc

SEQ ID NO: 4632432 - DNA, 21 bp, Homo sapiens
ctatttctttatatttatcca

SEQ ID NO: 4632433 - DNA, 13 bp, Homo sapiens
ctatttgaagaaa

SEQ ID NO: 4632434 - DNA, 14 bp, Homo sapiens
ctatttgaagaaaa

SEQ ID NO: 4632435 - DNA, 23 bp, Homo sapiens
ctattttaagactgattttaata

SEQ ID NO: 4632436 - DNA, 13 bp, Homo sapiens
ctattttcaaaga

SEQ ID NO: 4632437 - DNA, 15 bp, Homo sapiens
ctattttctttttta

SEQ ID NO: 4632438 - DNA, 17 bp, Homo sapiens
ctcaaaacgggtcagta

SEQ ID NO: 4632439 - DNA, 19 bp, Homo sapiens
ctcaaaacgggtcagtatt

SEQ ID NO: 4632440 - DNA, 19 bp, Homo sapiens
ctcaaagtatgcaatgctt

SEQ ID NO: 4632441 - DNA, 14 bp, Homo sapiens
ctcaacatactgta

SEQ ID NO: 4632442 - DNA, 19 bp, Homo sapiens
ctcaacggtctggcagggc

SEQ ID NO: 4632443 - DNA, 18 bp, Homo sapiens
ctcaagtgatcctcccac

SEQ ID NO: 4632444 - DNA, 14 bp, Homo sapiens
ctcaagtgtcacct

SEQ ID NO: 4632445 - DNA, 21 bp, Homo sapiens
ctcaagtgtcacctccttccc

SEQ ID NO: 4632446 - DNA, 22 bp, Homo sapiens
ctcaagtgtcacctccttcccc

SEQ ID NO: 4632447 - DNA, 13 bp, Homo sapiens
ctcaataaagatt

SEQ ID NO: 4632448 - DNA, 20 bp, Homo sapiens
ctcaatgtggaaaaaatatt

SEQ ID NO: 4632449 - DNA, 17 bp, Homo sapiens
ctcaatttttgtctcag

SEQ ID NO: 4632450 - DNA, 22 bp, Homo sapiens
ctcacaaccaccattcagtcaa

SEQ ID NO: 4632451 - DNA, 13 bp, Homo sapiens
ctcacaactcctt

SEQ ID NO: 4632452 - DNA, 23 bp, Homo sapiens
ctcacaacttagtgtaatatacc

SEQ ID NO: 4632453 - DNA, 17 bp, Homo sapiens
ctcacacaccctgaggt

SEQ ID NO: 4632454 - DNA, 22 bp, Homo sapiens
ctcacacaggcatttcctgggt

SEQ ID NO: 4632455 - DNA, 18 bp, Homo sapiens
ctcacacccctgccccca

SEQ ID NO: 4632456 - DNA, 14 bp, Homo sapiens
ctcacaggctgaga

SEQ ID NO: 4632457 - DNA, 13 bp, Homo sapiens
ctcacagtacagc

SEQ ID NO: 4632458 - DNA, 21 bp, Homo sapiens
ctcacataagcccagttcatc

SEQ ID NO: 4632459 - DNA, 19 bp, Homo sapiens
ctcacccctcccctgggac

SEQ ID NO: 4632460 - DNA, 21 bp, Homo sapiens
ctcacccctcccctgggactt

SEQ ID NO: 4632461 - DNA, 13 bp, Homo sapiens
ctcacccctgccc

SEQ ID NO: 4632462 - DNA, 16 bp, Homo sapiens
ctcacccctgcccctg

SEQ ID NO: 4632463 - DNA, 20 bp, Homo sapiens
ctcacccctgcccctgtggg

SEQ ID NO: 4632464 - DNA, 21 bp, Homo sapiens
ctcacccctgcccctgtggga

SEQ ID NO: 4632465 - DNA, 15 bp, Homo sapiens
ctcacctagcctgat

SEQ ID NO: 4632466 - DNA, 22 bp, Homo sapiens
ctcacctgcgcaagtgcctggg

SEQ ID NO: 4632467 - DNA, 14 bp, Homo sapiens
ctcactctgggctg

SEQ ID NO: 4632468 - DNA, 15 bp, Homo sapiens
ctcactctgggctgt

SEQ ID NO: 4632469 - DNA, 12 bp, Homo sapiens
ctcactgtgatc

SEQ ID NO: 4632470 - DNA, 17 bp, Homo sapiens
ctcactgtgttactgct

SEQ ID NO: 4632471 - DNA, 21 bp, Homo sapiens
ctcactgtgttactgctttgc

SEQ ID NO: 4632472 - DNA, 21 bp, Homo sapiens
ctcactgtttgtttttattta

SEQ ID NO: 4632473 - DNA, 22 bp, Homo sapiens
ctcactgttttataattagtcg

SEQ ID NO: 4632474 - DNA, 21 bp, Homo sapiens
ctcacttcctttgcccttcct

SEQ ID NO: 4632475 - DNA, 16 bp, Homo sapiens
ctcactttattatccc

SEQ ID NO: 4632476 - DNA, 22 bp, Homo sapiens
ctcagaaagatttgatgggcca

SEQ ID NO: 4632477 - DNA, 14 bp, Homo sapiens
ctcagaagcctggg

SEQ ID NO: 4632478 - DNA, 15 bp, Homo sapiens
ctcagaagcctgggg

SEQ ID NO: 4632479 - DNA, 22 bp, Homo sapiens
ctcagaagtgaaaatcttggag

SEQ ID NO: 4632480 - DNA, 17 bp, Homo sapiens
ctcagaataaggcaggc

SEQ ID NO: 4632481 - DNA, 19 bp, Homo sapiens
ctcagaataaggcaggcat

SEQ ID NO: 4632482 - DNA, 14 bp, Homo sapiens
ctcagacatttata

SEQ ID NO: 4632483 - DNA, 14 bp, Homo sapiens
ctcagagcatgatg

SEQ ID NO: 4632484 - DNA, 23 bp, Homo sapiens
ctcagagcatgatgggaggtgtg

SEQ ID NO: 4632485 - DNA, 12 bp, Homo sapiens
ctcagagcttcc

SEQ ID NO: 4632486 - DNA, 13 bp, Homo sapiens
ctcagagcttcct

SEQ ID NO: 4632487 - DNA, 11 bp, Homo sapiens
ctcagccagca

SEQ ID NO: 4632488 - DNA, 13 bp, Homo sapiens
ctcagccagcact

SEQ ID NO: 4632489 - DNA, 16 bp, Homo sapiens
ctcagcctagcacagg

SEQ ID NO: 4632490 - DNA, 14 bp, Homo sapiens
ctcagctctgggcc

SEQ ID NO: 4632491 - DNA, 17 bp, Homo sapiens
ctcagctggtcctgacc

SEQ ID NO: 4632492 - DNA, 19 bp, Homo sapiens
ctcagctggtcctgaccag

SEQ ID NO: 4632493 - DNA, 21 bp, Homo sapiens
ctcagctggtcctgaccagga

SEQ ID NO: 4632494 - DNA, 17 bp, Homo sapiens
ctcagctgtcctgcagc

SEQ ID NO: 4632495 - DNA, 19 bp, Homo sapiens
ctcagctgtcctgcagcaa

SEQ ID NO: 4632496 - DNA, 21 bp, Homo sapiens
ctcaggaattcagtgccttca

SEQ ID NO: 4632497 - DNA, 19 bp, Homo sapiens
ctcaggacacaggcctgtg

SEQ ID NO: 4632498 - DNA, 21 bp, Homo sapiens
ctcaggacacaggcctgtgta

SEQ ID NO: 4632499 - DNA, 16 bp, Homo sapiens
ctcaggagatggaggg

SEQ ID NO: 4632500 - DNA, 20 bp, Homo sapiens
ctcaggatatccttatcaga

SEQ ID NO: 4632501 - DNA, 22 bp, Homo sapiens
ctcaggcacccgtccccacacg

SEQ ID NO: 4632502 - DNA, 18 bp, Homo sapiens
ctcaggcctctgtgccgc

SEQ ID NO: 4632503 - DNA, 19 bp, Homo sapiens
ctcaggctctgcacagaca

SEQ ID NO: 4632504 - DNA, 20 bp, Homo sapiens
ctcagggaccggtgctgcag

SEQ ID NO: 4632505 - DNA, 10 bp, Homo sapiens
ctcagggcag

SEQ ID NO: 4632506 - DNA, 16 bp, Homo sapiens
ctcaggggctctaggg

SEQ ID NO: 4632507 - DNA, 16 bp, Homo sapiens
ctcaggggtgtgcctg

SEQ ID NO: 4632508 - DNA, 21 bp, Homo sapiens
ctcagtgcaaaatgtcttgtg

SEQ ID NO: 4632509 - DNA, 15 bp, Homo sapiens
ctcagtgcaacctct

SEQ ID NO: 4632510 - DNA, 23 bp, Homo sapiens
ctcagtgcaacctctgcttccca

SEQ ID NO: 4632511 - DNA, 15 bp, Homo sapiens
ctcagttttttgtaa

SEQ ID NO: 4632512 - DNA, 16 bp, Homo sapiens
ctcataaatttacttt

SEQ ID NO: 4632513 - DNA, 12 bp, Homo sapiens
ctcataattcct

SEQ ID NO: 4632514 - DNA, 14 bp, Homo sapiens
ctcatagacactga

SEQ ID NO: 4632515 - DNA, 14 bp, Homo sapiens
ctcatagaggaaat

SEQ ID NO: 4632516 - DNA, 13 bp, Homo sapiens
ctcatccttgccc

SEQ ID NO: 4632517 - DNA, 17 bp, Homo sapiens
ctcatccttgcccaggt

SEQ ID NO: 4632518 - DNA, 15 bp, Homo sapiens
ctcatctatgaggaa

SEQ ID NO: 4632519 - DNA, 16 bp, Homo sapiens
ctcatctgtggagctg

SEQ ID NO: 4632520 - DNA, 17 bp, Homo sapiens
ctcatctgtggagctgc

SEQ ID NO: 4632521 - DNA, 22 bp, Homo sapiens
ctcatctttcattaaaggcttc

SEQ ID NO: 4632522 - DNA, 14 bp, Homo sapiens
ctcatctttttact

SEQ ID NO: 4632523 - DNA, 14 bp, Homo sapiens
ctcatgagctcctg

SEQ ID NO: 4632524 - DNA, 23 bp, Homo sapiens
ctcatgagctcctgatcagaggc

SEQ ID NO: 4632525 - DNA, 14 bp, Homo sapiens
ctcatgatcaagat

SEQ ID NO: 4632526 - DNA, 16 bp, Homo sapiens
ctcatgcccctggctg

SEQ ID NO: 4632527 - DNA, 17 bp, Homo sapiens
ctcatgcccctggctgg

SEQ ID NO: 4632528 - DNA, 16 bp, Homo sapiens
ctcatggtacttcctc

SEQ ID NO: 4632529 - DNA, 19 bp, Homo sapiens
ctcatgtcattatgacatt

SEQ ID NO: 4632530 - DNA, 21 bp, Homo sapiens
ctcatgttttccattgtttga

SEQ ID NO: 4632531 - DNA, 16 bp, Homo sapiens
ctcattaatgacactt

SEQ ID NO: 4632532 - DNA, 18 bp, Homo sapiens
ctcattactgggccttag

SEQ ID NO: 4632533 - DNA, 15 bp, Homo sapiens
ctcatttccagcttc

SEQ ID NO: 4632534 - DNA, 14 bp, Homo sapiens
ctccaaactgatta

SEQ ID NO: 4632535 - DNA, 14 bp, Homo sapiens
ctccaagcatttca

SEQ ID NO: 4632536 - DNA, 15 bp, Homo sapiens
ctccaagcatttcat

SEQ ID NO: 4632537 - DNA, 19 bp, Homo sapiens
ctccaatcctccccgctct

SEQ ID NO: 4632538 - DNA, 14 bp, Homo sapiens
ctccaccactgtgc

SEQ ID NO: 4632539 - DNA, 15 bp, Homo sapiens
ctccaccactgtgca

SEQ ID NO: 4632540 - DNA, 16 bp, Homo sapiens
ctccaccactgtgcac

SEQ ID NO: 4632541 - DNA, 10 bp, Homo sapiens
ctccaccagc

SEQ ID NO: 4632542 - DNA, 14 bp, Homo sapiens
ctccaccagcctgc

SEQ ID NO: 4632543 - DNA, 15 bp, Homo sapiens
ctccaccagcctgct

SEQ ID NO: 4632544 - DNA, 15 bp, Homo sapiens
ctccaccctccacct

SEQ ID NO: 4632545 - DNA, 14 bp, Homo sapiens
ctccaccctggccg

SEQ ID NO: 4632546 - DNA, 20 bp, Homo sapiens
ctccacggatgcgtgggcag

SEQ ID NO: 4632547 - DNA, 21 bp, Homo sapiens
ctccactcagctgtcctgcag

SEQ ID NO: 4632548 - DNA, 12 bp, Homo sapiens
ctccactgctgg

SEQ ID NO: 4632549 - DNA, 18 bp, Homo sapiens
ctccacttcatttttaag

SEQ ID NO: 4632550 - DNA, 23 bp, Homo sapiens
ctccacttcatttttaagaaagg

SEQ ID NO: 4632551 - DNA, 16 bp, Homo sapiens
ctccagcccctgtccc

SEQ ID NO: 4632552 - DNA, 13 bp, Homo sapiens
ctccagctttcct

SEQ ID NO: 4632553 - DNA, 19 bp, Homo sapiens
ctccaggagagagccagga

SEQ ID NO: 4632554 - DNA, 22 bp, Homo sapiens
ctccaggcctgcagcaggagtg

SEQ ID NO: 4632555 - DNA, 17 bp, Homo sapiens
ctccagggatggcccct

SEQ ID NO: 4632556 - DNA, 14 bp, Homo sapiens
ctccaggggcctgc

SEQ ID NO: 4632557 - DNA, 19 bp, Homo sapiens
ctccaggggcctgcagaag

SEQ ID NO: 4632558 - DNA, 21 bp, Homo sapiens
ctccaggggcctgcagaagga

SEQ ID NO: 4632559 - DNA, 16 bp, Homo sapiens
ctccagtttgcacctg

SEQ ID NO: 4632560 - DNA, 17 bp, Homo sapiens
ctccagtttgcacctgt

SEQ ID NO: 4632561 - DNA, 20 bp, Homo sapiens
ctccagtttgcacctgtccc

SEQ ID NO: 4632562 - DNA, 20 bp, Homo sapiens
ctccataaagtacaaatgaa

SEQ ID NO: 4632563 - DNA, 17 bp, Homo sapiens
ctccataggagggaagg

SEQ ID NO: 4632564 - DNA, 23 bp, Homo sapiens
ctccataggagggaaggagcagt

SEQ ID NO: 4632565 - DNA, 18 bp, Homo sapiens
ctccatcctttgtcttgg

SEQ ID NO: 4632566 - DNA, 14 bp, Homo sapiens
ctccatctttttct

SEQ ID NO: 4632567 - DNA, 15 bp, Homo sapiens
ctccatctttttctt

SEQ ID NO: 4632568 - DNA, 18 bp, Homo sapiens
ctccatgctgcaaaggag

SEQ ID NO: 4632569 - DNA, 17 bp, Homo sapiens
ctccattcactcccagg

SEQ ID NO: 4632570 - DNA, 16 bp, Homo sapiens
ctccattcccacccct

SEQ ID NO: 4632571 - DNA, 15 bp, Homo sapiens
ctccattccctagca

SEQ ID NO: 4632572 - DNA, 20 bp, Homo sapiens
ctccatttaagacacattga

SEQ ID NO: 4632573 - DNA, 21 bp, Homo sapiens
ctccattttagcccagtgttt

SEQ ID NO: 4632574 - DNA, 17 bp, Homo sapiens
ctccatttttatttctt

SEQ ID NO: 4632575 - DNA, 14 bp, Homo sapiens
ctcccaaccctggc

SEQ ID NO: 4632576 - DNA, 13 bp, Homo sapiens
ctcccaactccct

SEQ ID NO: 4632577 - DNA, 15 bp, Homo sapiens
ctcccaactcccttc

SEQ ID NO: 4632578 - DNA, 18 bp, Homo sapiens
ctcccaagcccctgaccc

SEQ ID NO: 4632579 - DNA, 19 bp, Homo sapiens
ctcccaatggtgcttggag

SEQ ID NO: 4632580 - DNA, 20 bp, Homo sapiens
ctcccacggagcatctcaga

SEQ ID NO: 4632581 - DNA, 20 bp, Homo sapiens
ctcccagacctgcctcttcc

SEQ ID NO: 4632582 - DNA, 23 bp, Homo sapiens
ctcccagcaagacctcatctgtg

SEQ ID NO: 4632583 - DNA, 16 bp, Homo sapiens
ctcccagcccattgct

SEQ ID NO: 4632584 - DNA, 17 bp, Homo sapiens
ctcccagcccattgctg

SEQ ID NO: 4632585 - DNA, 22 bp, Homo sapiens
ctcccagcccattgctgccaag

SEQ ID NO: 4632586 - DNA, 12 bp, Homo sapiens
ctcccaggatct

SEQ ID NO: 4632587 - DNA, 15 bp, Homo sapiens
ctcccaggccccatg

SEQ ID NO: 4632588 - DNA, 15 bp, Homo sapiens
ctcccaggcctctgc

SEQ ID NO: 4632589 - DNA, 15 bp, Homo sapiens
ctcccatcctggggc

SEQ ID NO: 4632590 - DNA, 18 bp, Homo sapiens
ctcccatgagactgccct

SEQ ID NO: 4632591 - DNA, 23 bp, Homo sapiens
ctccccaaagtgctgggattaca

SEQ ID NO: 4632592 - DNA, 14 bp, Homo sapiens
ctccccacctccca

SEQ ID NO: 4632593 - DNA, 12 bp, Homo sapiens
ctccccactctg

SEQ ID NO: 4632594 - DNA, 13 bp, Homo sapiens
ctccccactctgc

SEQ ID NO: 4632595 - DNA, 19 bp, Homo sapiens
ctccccactctgctctgat

SEQ ID NO: 4632596 - DNA, 13 bp, Homo sapiens
ctccccagagctg

SEQ ID NO: 4632597 - DNA, 15 bp, Homo sapiens
ctccccagagctgtg

SEQ ID NO: 4632598 - DNA, 13 bp, Homo sapiens
ctccccagcccag

SEQ ID NO: 4632599 - DNA, 18 bp, Homo sapiens
ctccccagcccaggaaaa

SEQ ID NO: 4632600 - DNA, 15 bp, Homo sapiens
ctccccatctgtgtt

SEQ ID NO: 4632601 - DNA, 16 bp, Homo sapiens
ctccccatctgtgttc

SEQ ID NO: 4632602 - DNA, 18 bp, Homo sapiens
ctcccccctccattccca

SEQ ID NO: 4632603 - DNA, 12 bp, Homo sapiens
ctccccctgcaa

SEQ ID NO: 4632604 - DNA, 17 bp, Homo sapiens
ctccccgataaagaatg

SEQ ID NO: 4632605 - DNA, 21 bp, Homo sapiens
ctcccctcacacacaaattga

SEQ ID NO: 4632606 - DNA, 19 bp, Homo sapiens
ctcccctccccatctgtgt

SEQ ID NO: 4632607 - DNA, 20 bp, Homo sapiens
ctcccctccccatctgtgtt

SEQ ID NO: 4632608 - DNA, 16 bp, Homo sapiens
ctcccctgacctgtga

SEQ ID NO: 4632609 - DNA, 12 bp, Homo sapiens
ctcccctgcctt

SEQ ID NO: 4632610 - DNA, 13 bp, Homo sapiens
ctcccctgcctta

SEQ ID NO: 4632611 - DNA, 22 bp, Homo sapiens
ctcccctgccttaacctgggac

SEQ ID NO: 4632612 - DNA, 20 bp, Homo sapiens
ctccccttttttcttctatt

SEQ ID NO: 4632613 - DNA, 20 bp, Homo sapiens
ctcccgccaggagcttcttc

SEQ ID NO: 4632614 - DNA, 20 bp, Homo sapiens
ctcccgtgcatgctctgcag

SEQ ID NO: 4632615 - DNA, 12 bp, Homo sapiens
ctccctagctct

SEQ ID NO: 4632616 - DNA, 12 bp, Homo sapiens
ctccctaggccc

SEQ ID NO: 4632617 - DNA, 19 bp, Homo sapiens
ctccctccaccagcctgct

SEQ ID NO: 4632618 - DNA, 13 bp, Homo sapiens
ctccctcctttcc

SEQ ID NO: 4632619 - DNA, 15 bp, Homo sapiens
ctccctctctcctgg

SEQ ID NO: 4632620 - DNA, 18 bp, Homo sapiens
ctccctctctcctggact

SEQ ID NO: 4632621 - DNA, 10 bp, Homo sapiens
ctccctgcct

SEQ ID NO: 4632622 - DNA, 12 bp, Homo sapiens
ctccctgcctca

SEQ ID NO: 4632623 - DNA, 16 bp, Homo sapiens
ctccctgcctcacatc

SEQ ID NO: 4632624 - DNA, 18 bp, Homo sapiens
ctccctgcctcacatctc

SEQ ID NO: 4632625 - DNA, 20 bp, Homo sapiens
ctccctgcctcacatctccc

SEQ ID NO: 4632626 - DNA, 23 bp, Homo sapiens
ctccctgctgtgccatgctgggc

SEQ ID NO: 4632627 - DNA, 18 bp, Homo sapiens
ctccctggaccacgaggc

SEQ ID NO: 4632628 - DNA, 17 bp, Homo sapiens
ctccctgtcccagggcc

SEQ ID NO: 4632629 - DNA, 21 bp, Homo sapiens
ctccctgtgtccacctgtggg

SEQ ID NO: 4632630 - DNA, 15 bp, Homo sapiens
ctcccttacccatct

SEQ ID NO: 4632631 - DNA, 17 bp, Homo sapiens
ctcccttacccatcttg

SEQ ID NO: 4632632 - DNA, 19 bp, Homo sapiens
ctcccttacccatcttgct

SEQ ID NO: 4632633 - DNA, 16 bp, Homo sapiens
ctcccttctgcttgtc

SEQ ID NO: 4632634 - DNA, 21 bp, Homo sapiens
ctcccttgaagttgtggagga

SEQ ID NO: 4632635 - DNA, 19 bp, Homo sapiens
ctcccttttaatcctggct

SEQ ID NO: 4632636 - DNA, 22 bp, Homo sapiens
ctcccttttataattaatgttt

SEQ ID NO: 4632637 - DNA, 15 bp, Homo sapiens
ctccgaaggggctct

SEQ ID NO: 4632638 - DNA, 15 bp, Homo sapiens
ctccgccagccacag

SEQ ID NO: 4632639 - DNA, 17 bp, Homo sapiens
ctccgccagccacagga

SEQ ID NO: 4632640 - DNA, 18 bp, Homo sapiens
ctccgccagccacaggac

SEQ ID NO: 4632641 - DNA, 16 bp, Homo sapiens
ctccgcgccgatgcca

SEQ ID NO: 4632642 - DNA, 17 bp, Homo sapiens
ctcctagtatgccctgt

SEQ ID NO: 4632643 - DNA, 19 bp, Homo sapiens
ctcctagtatgccctgtaa

SEQ ID NO: 4632644 - DNA, 14 bp, Homo sapiens
ctcctatatatttc

SEQ ID NO: 4632645 - DNA, 17 bp, Homo sapiens
ctcctatatatttctat

SEQ ID NO: 4632646 - DNA, 18 bp, Homo sapiens
ctcctatatatttctatt

SEQ ID NO: 4632647 - DNA, 17 bp, Homo sapiens
ctcctcacacaccctga

SEQ ID NO: 4632648 - DNA, 19 bp, Homo sapiens
ctcctcacacaccctgagg

SEQ ID NO: 4632649 - DNA, 17 bp, Homo sapiens
ctcctcagtccctcttc

SEQ ID NO: 4632650 - DNA, 21 bp, Homo sapiens
ctcctcagtccctcttctggt

SEQ ID NO: 4632651 - DNA, 13 bp, Homo sapiens
ctcctccagggtg

SEQ ID NO: 4632652 - DNA, 12 bp, Homo sapiens
ctcctccctcct

SEQ ID NO: 4632653 - DNA, 21 bp, Homo sapiens
ctcctctccattttagcccag

SEQ ID NO: 4632654 - DNA, 14 bp, Homo sapiens
ctcctctctccctg

SEQ ID NO: 4632655 - DNA, 21 bp, Homo sapiens
ctcctctgccagcaggaataa

SEQ ID NO: 4632656 - DNA, 18 bp, Homo sapiens
ctcctctgtgaagcattc

SEQ ID NO: 4632657 - DNA, 19 bp, Homo sapiens
ctcctcttcccccttccaa

SEQ ID NO: 4632658 - DNA, 20 bp, Homo sapiens
ctcctctttgagaccccagt

SEQ ID NO: 4632659 - DNA, 22 bp, Homo sapiens
ctcctctttgagaccccagtgc

SEQ ID NO: 4632660 - DNA, 17 bp, Homo sapiens
ctcctgacctcaggtga

SEQ ID NO: 4632661 - DNA, 19 bp, Homo sapiens
ctcctgaggacagctgtcc

SEQ ID NO: 4632662 - DNA, 14 bp, Homo sapiens
ctcctgagtagctg

SEQ ID NO: 4632663 - DNA, 19 bp, Homo sapiens
ctcctgagtagctgggatt

SEQ ID NO: 4632664 - DNA, 15 bp, Homo sapiens
ctcctgatcagaggc

SEQ ID NO: 4632665 - DNA, 18 bp, Homo sapiens
ctcctgccagcccagctg

SEQ ID NO: 4632666 - DNA, 12 bp, Homo sapiens
ctcctgcctcta

SEQ ID NO: 4632667 - DNA, 12 bp, Homo sapiens
ctcctgctggta

SEQ ID NO: 4632668 - DNA, 15 bp, Homo sapiens
ctcctgctggtacct

SEQ ID NO: 4632669 - DNA, 17 bp, Homo sapiens
ctcctgctggtacctgc

SEQ ID NO: 4632670 - DNA, 20 bp, Homo sapiens
ctcctgctggtacctgccct

SEQ ID NO: 4632671 - DNA, 23 bp, Homo sapiens
ctcctgctgtaaatttggcttct

SEQ ID NO: 4632672 - DNA, 19 bp, Homo sapiens
ctcctgcttctcctgatcc

SEQ ID NO: 4632673 - DNA, 20 bp, Homo sapiens
ctcctggactggttatcttg

SEQ ID NO: 4632674 - DNA, 14 bp, Homo sapiens
ctcctggcttccca

SEQ ID NO: 4632675 - DNA, 13 bp, Homo sapiens
ctcctgtgctggg

SEQ ID NO: 4632676 - DNA, 16 bp, Homo sapiens
ctcctgtggggaaagg

SEQ ID NO: 4632677 - DNA, 15 bp, Homo sapiens
ctccttcagttctgc

SEQ ID NO: 4632678 - DNA, 17 bp, Homo sapiens
ctccttcagttctgctt

SEQ ID NO: 4632679 - DNA, 23 bp, Homo sapiens
ctccttcagttctgcttgctccc

SEQ ID NO: 4632680 - DNA, 14 bp, Homo sapiens
ctccttccccagct

SEQ ID NO: 4632681 - DNA, 16 bp, Homo sapiens
ctccttccccagctcc

SEQ ID NO: 4632682 - DNA, 21 bp, Homo sapiens
ctccttcctgccccaactcct

SEQ ID NO: 4632683 - DNA, 13 bp, Homo sapiens
ctccttcttttcc

SEQ ID NO: 4632684 - DNA, 14 bp, Homo sapiens
ctccttcttttcct

SEQ ID NO: 4632685 - DNA, 20 bp, Homo sapiens
ctccttggctttatgcaaat

SEQ ID NO: 4632686 - DNA, 15 bp, Homo sapiens
ctccttggtgcctgg

SEQ ID NO: 4632687 - DNA, 20 bp, Homo sapiens
ctccttgtcagggtctcctt

SEQ ID NO: 4632688 - DNA, 21 bp, Homo sapiens
ctccttgtcagggtctccttc

SEQ ID NO: 4632689 - DNA, 23 bp, Homo sapiens
ctccttgtcagggtctccttcct

SEQ ID NO: 4632690 - DNA, 14 bp, Homo sapiens
ctcgaatttgaaga

SEQ ID NO: 4632691 - DNA, 16 bp, Homo sapiens
ctcgaatttgaagaga

SEQ ID NO: 4632692 - DNA, 12 bp, Homo sapiens
ctcgaccctgtc

SEQ ID NO: 4632693 - DNA, 14 bp, Homo sapiens
ctcgagcagagaga

SEQ ID NO: 4632694 - DNA, 16 bp, Homo sapiens
ctcgagcgccctgcag

SEQ ID NO: 4632695 - DNA, 17 bp, Homo sapiens
ctcgagcgccctgcaga

SEQ ID NO: 4632696 - DNA, 20 bp, Homo sapiens
ctcgagcgccctgcagaccc

SEQ ID NO: 4632697 - DNA, 16 bp, Homo sapiens
ctcgcaacccgtgcca

SEQ ID NO: 4632698 - DNA, 14 bp, Homo sapiens
ctcgccccagcagg

SEQ ID NO: 4632699 - DNA, 14 bp, Homo sapiens
ctcgcctatcttag

SEQ ID NO: 4632700 - DNA, 21 bp, Homo sapiens
ctcgcgggtgtcacattcctg

SEQ ID NO: 4632701 - DNA, 21 bp, Homo sapiens
ctcgctccccactctgctctg

SEQ ID NO: 4632702 - DNA, 23 bp, Homo sapiens
ctcgctccccactctgctctgat

SEQ ID NO: 4632703 - DNA, 15 bp, Homo sapiens
ctcggacttactgcc

SEQ ID NO: 4632704 - DNA, 20 bp, Homo sapiens
ctcggacttactgcctgacc

SEQ ID NO: 4632705 - DNA, 13 bp, Homo sapiens
ctcggaggaagcc

SEQ ID NO: 4632706 - DNA, 21 bp, Homo sapiens
ctcggagggatggagaaagaa

SEQ ID NO: 4632707 - DNA, 21 bp, Homo sapiens
ctcggatgacaccctggcctg

SEQ ID NO: 4632708 - DNA, 23 bp, Homo sapiens
ctcggcctcccaaaatgctggga

SEQ ID NO: 4632709 - DNA, 19 bp, Homo sapiens
ctcgggctggagcctccga

SEQ ID NO: 4632710 - DNA, 14 bp, Homo sapiens
ctcggggtccctgg

SEQ ID NO: 4632711 - DNA, 15 bp, Homo sapiens
ctcggggtgcacagg

SEQ ID NO: 4632712 - DNA, 16 bp, Homo sapiens
ctcggggtgcacagga

SEQ ID NO: 4632713 - DNA, 14 bp, Homo sapiens
ctcgtgaggggcaa

SEQ ID NO: 4632714 - DNA, 15 bp, Homo sapiens
ctcgtgaggggcaag

SEQ ID NO: 4632715 - DNA, 21 bp, Homo sapiens
ctcgtggtaggactgtagaaa

SEQ ID NO: 4632716 - DNA, 13 bp, Homo sapiens
ctctaacgcctga

SEQ ID NO: 4632717 - DNA, 15 bp, Homo sapiens
ctctaagcccaggat

SEQ ID NO: 4632718 - DNA, 17 bp, Homo sapiens
ctctaagcccaggatct

SEQ ID NO: 4632719 - DNA, 16 bp, Homo sapiens
ctctaaggtactgtgg

SEQ ID NO: 4632720 - DNA, 18 bp, Homo sapiens
ctctaatctggatgttaa

SEQ ID NO: 4632721 - DNA, 23 bp, Homo sapiens
ctctacagatggcatacctgtgc

SEQ ID NO: 4632722 - DNA, 12 bp, Homo sapiens
ctctacaggcct

SEQ ID NO: 4632723 - DNA, 15 bp, Homo sapiens
ctctactccctcttg

SEQ ID NO: 4632724 - DNA, 22 bp, Homo sapiens
ctctactccctcttgtcagtgt

SEQ ID NO: 4632725 - DNA, 12 bp, Homo sapiens
ctctactgggaa

SEQ ID NO: 4632726 - DNA, 16 bp, Homo sapiens
ctctactgggaaggct

SEQ ID NO: 4632727 - DNA, 19 bp, Homo sapiens
ctctactgggaaggctact

SEQ ID NO: 4632728 - DNA, 12 bp, Homo sapiens
ctctagaaattt

SEQ ID NO: 4632729 - DNA, 17 bp, Homo sapiens
ctctagatggcaacatt

SEQ ID NO: 4632730 - DNA, 17 bp, Homo sapiens
ctctagctctctaggcc

SEQ ID NO: 4632731 - DNA, 19 bp, Homo sapiens
ctctagggagtatgctgga

SEQ ID NO: 4632732 - DNA, 13 bp, Homo sapiens
ctctagtgggaca

SEQ ID NO: 4632733 - DNA, 20 bp, Homo sapiens
ctctagtgggacagcccaga

SEQ ID NO: 4632734 - DNA, 23 bp, Homo sapiens
ctctatgttagtataagcttttc

SEQ ID NO: 4632735 - DNA, 19 bp, Homo sapiens
ctctatttattagccaact

SEQ ID NO: 4632736 - DNA, 20 bp, Homo sapiens
ctctatttattagccaactg

SEQ ID NO: 4632737 - DNA, 14 bp, Homo sapiens
ctctatttgagaat

SEQ ID NO: 4632738 - DNA, 20 bp, Homo sapiens
ctctattttcataatcagta

SEQ ID NO: 4632739 - DNA, 15 bp, Homo sapiens
ctctcactgtgtccc

SEQ ID NO: 4632740 - DNA, 20 bp, Homo sapiens
ctctcactgtgttactgctt

SEQ ID NO: 4632741 - DNA, 20 bp, Homo sapiens
ctctcatggtacttcctctg

SEQ ID NO: 4632742 - DNA, 22 bp, Homo sapiens
ctctcatggtacttcctctgtg

SEQ ID NO: 4632743 - DNA, 17 bp, Homo sapiens
ctctcatttccagcttc

SEQ ID NO: 4632744 - DNA, 18 bp, Homo sapiens
ctctcatttccagcttct

SEQ ID NO: 4632745 - DNA, 14 bp, Homo sapiens
ctctcccaggcccc

SEQ ID NO: 4632746 - DNA, 19 bp, Homo sapiens
ctctcccaggccccatgac

SEQ ID NO: 4632747 - DNA, 21 bp, Homo sapiens
ctctcccaggccccatgacct

SEQ ID NO: 4632748 - DNA, 16 bp, Homo sapiens
ctctcccatcctgggg

SEQ ID NO: 4632749 - DNA, 18 bp, Homo sapiens
ctctcccatcctggggca

SEQ ID NO: 4632750 - DNA, 14 bp, Homo sapiens
ctctcccatttcct

SEQ ID NO: 4632751 - DNA, 21 bp, Homo sapiens
ctctcccctccccatctgtgt

SEQ ID NO: 4632752 - DNA, 13 bp, Homo sapiens
ctctccctgcctc

SEQ ID NO: 4632753 - DNA, 14 bp, Homo sapiens
ctctccctgcctca

SEQ ID NO: 4632754 - DNA, 14 bp, Homo sapiens
ctctccctgcgcac

SEQ ID NO: 4632755 - DNA, 14 bp, Homo sapiens
ctctcccttaccca

SEQ ID NO: 4632756 - DNA, 12 bp, Homo sapiens
ctctcctggctt

SEQ ID NO: 4632757 - DNA, 16 bp, Homo sapiens
ctctcgcatcttccca

SEQ ID NO: 4632758 - DNA, 13 bp, Homo sapiens
ctctctacagtgc

SEQ ID NO: 4632759 - DNA, 15 bp, Homo sapiens
ctctctacagtgcca

SEQ ID NO: 4632760 - DNA, 13 bp, Homo sapiens
ctctctccctgcc

SEQ ID NO: 4632761 - DNA, 16 bp, Homo sapiens
ctctctccctgcctca

SEQ ID NO: 4632762 - DNA, 17 bp, Homo sapiens
ctctctccctgcctcac

SEQ ID NO: 4632763 - DNA, 21 bp, Homo sapiens
ctctctccctgcctcacatct

SEQ ID NO: 4632764 - DNA, 15 bp, Homo sapiens
ctctctcctggactg

SEQ ID NO: 4632765 - DNA, 16 bp, Homo sapiens
ctctctcctggactgg

SEQ ID NO: 4632766 - DNA, 14 bp, Homo sapiens
ctctctcttgcctg

SEQ ID NO: 4632767 - DNA, 18 bp, Homo sapiens
ctctctgagtcctggccc

SEQ ID NO: 4632768 - DNA, 20 bp, Homo sapiens
ctctctggaagcccctgggc

SEQ ID NO: 4632769 - DNA, 16 bp, Homo sapiens
ctctcttgattgattt

SEQ ID NO: 4632770 - DNA, 18 bp, Homo sapiens
ctctcttgattgattttt

SEQ ID NO: 4632771 - DNA, 19 bp, Homo sapiens
ctctgaatttgagatacaa

SEQ ID NO: 4632772 - DNA, 18 bp, Homo sapiens
ctctgaattttcagagac

SEQ ID NO: 4632773 - DNA, 22 bp, Homo sapiens
ctctgacaagctggccaaagtc

SEQ ID NO: 4632774 - DNA, 19 bp, Homo sapiens
ctctgactagtagatttct

SEQ ID NO: 4632775 - DNA, 15 bp, Homo sapiens
ctctgagaccacaga

SEQ ID NO: 4632776 - DNA, 14 bp, Homo sapiens
ctctgagaggccct

SEQ ID NO: 4632777 - DNA, 17 bp, Homo sapiens
ctctgagccaaccttgc

SEQ ID NO: 4632778 - DNA, 18 bp, Homo sapiens
ctctgaggccagcctggc

SEQ ID NO: 4632779 - DNA, 21 bp, Homo sapiens
ctctgaggcgccccaacccgt

SEQ ID NO: 4632780 - DNA, 15 bp, Homo sapiens
ctctgagtcctggcc

SEQ ID NO: 4632781 - DNA, 17 bp, Homo sapiens
ctctgagtcctggccca

SEQ ID NO: 4632782 - DNA, 20 bp, Homo sapiens
ctctgatagctgtttcaaat

SEQ ID NO: 4632783 - DNA, 20 bp, Homo sapiens
ctctgcacagacaagcagcc

SEQ ID NO: 4632784 - DNA, 15 bp, Homo sapiens
ctctgcacatgtctt

SEQ ID NO: 4632785 - DNA, 10 bp, Homo sapiens
ctctgcattg

SEQ ID NO: 4632786 - DNA, 16 bp, Homo sapiens
ctctgcattgacctgg

SEQ ID NO: 4632787 - DNA, 23 bp, Homo sapiens
ctctgcattgagcatattttctt

SEQ ID NO: 4632788 - DNA, 11 bp, Homo sapiens
ctctgcccctt

SEQ ID NO: 4632789 - DNA, 14 bp, Homo sapiens
ctctgccccttccc

SEQ ID NO: 4632790 - DNA, 17 bp, Homo sapiens
ctctgccccttccccat

SEQ ID NO: 4632791 - DNA, 23 bp, Homo sapiens
ctctgccctcattactgggcctt

SEQ ID NO: 4632792 - DNA, 13 bp, Homo sapiens
ctctgcctcctgg

SEQ ID NO: 4632793 - DNA, 13 bp, Homo sapiens
ctctgcctggcaa

SEQ ID NO: 4632794 - DNA, 11 bp, Homo sapiens
ctctgcctggg

SEQ ID NO: 4632795 - DNA, 13 bp, Homo sapiens
ctctgcctgggat

SEQ ID NO: 4632796 - DNA, 19 bp, Homo sapiens
ctctgcctgggatgccctt

SEQ ID NO: 4632797 - DNA, 22 bp, Homo sapiens
ctctgcctgggatgcccttccc

SEQ ID NO: 4632798 - DNA, 18 bp, Homo sapiens
ctctgcgagaatgaacat

SEQ ID NO: 4632799 - DNA, 14 bp, Homo sapiens
ctctgcttcccagg

SEQ ID NO: 4632800 - DNA, 23 bp, Homo sapiens
ctctggaactgattgctcccagg

SEQ ID NO: 4632801 - DNA, 21 bp, Homo sapiens
ctctggaataaagttgcagat

SEQ ID NO: 4632802 - DNA, 13 bp, Homo sapiens
ctctggccctggc

SEQ ID NO: 4632803 - DNA, 18 bp, Homo sapiens
ctctggctactccctgga

SEQ ID NO: 4632804 - DNA, 19 bp, Homo sapiens
ctctggctactccctggac

SEQ ID NO: 4632805 - DNA, 17 bp, Homo sapiens
ctctgggaccccagctg

SEQ ID NO: 4632806 - DNA, 17 bp, Homo sapiens
ctctgggtgctgccctg

SEQ ID NO: 4632807 - DNA, 11 bp, Homo sapiens
ctctgtacttt

SEQ ID NO: 4632808 - DNA, 13 bp, Homo sapiens
ctctgtatatata

SEQ ID NO: 4632809 - DNA, 20 bp, Homo sapiens
ctctgtcagtcacagccacc

SEQ ID NO: 4632810 - DNA, 16 bp, Homo sapiens
ctctgtctacctggtc

SEQ ID NO: 4632811 - DNA, 13 bp, Homo sapiens
ctctgtctcgagc

SEQ ID NO: 4632812 - DNA, 23 bp, Homo sapiens
ctctgtctcgagcgccctgcaga

SEQ ID NO: 4632813 - DNA, 17 bp, Homo sapiens
ctctgtcttcacctgat

SEQ ID NO: 4632814 - DNA, 17 bp, Homo sapiens
ctctgtgaactgtgtgt

SEQ ID NO: 4632815 - DNA, 18 bp, Homo sapiens
ctctgtgaagcattcgag

SEQ ID NO: 4632816 - DNA, 22 bp, Homo sapiens
ctctgtgaatccatgggtctgg

SEQ ID NO: 4632817 - DNA, 17 bp, Homo sapiens
ctctgtgagggtgctga

SEQ ID NO: 4632818 - DNA, 20 bp, Homo sapiens
ctctgtgcacttatttatga

SEQ ID NO: 4632819 - DNA, 17 bp, Homo sapiens
ctctgtgccagagcctg

SEQ ID NO: 4632820 - DNA, 18 bp, Homo sapiens
ctctgtgccagagcctgg

SEQ ID NO: 4632821 - DNA, 20 bp, Homo sapiens
ctctgtgccagagcctgggg

SEQ ID NO: 4632822 - DNA, 14 bp, Homo sapiens
ctctgttcagtgta

SEQ ID NO: 4632823 - DNA, 17 bp, Homo sapiens
ctctgttcagtgtaaat

SEQ ID NO: 4632824 - DNA, 16 bp, Homo sapiens
ctctgttccccaccca

SEQ ID NO: 4632825 - DNA, 14 bp, Homo sapiens
ctctgttcctggct

SEQ ID NO: 4632826 - DNA, 13 bp, Homo sapiens
ctctgttgactgg

SEQ ID NO: 4632827 - DNA, 21 bp, Homo sapiens
ctctgttgcctcctctctccc

SEQ ID NO: 4632828 - DNA, 21 bp, Homo sapiens
ctcttacagtgtttggacagg

SEQ ID NO: 4632829 - DNA, 21 bp, Homo sapiens
ctcttagactcgcctatctta

SEQ ID NO: 4632830 - DNA, 22 bp, Homo sapiens
ctcttagactcgcctatcttag

SEQ ID NO: 4632831 - DNA, 19 bp, Homo sapiens
ctcttagagattttcattt

SEQ ID NO: 4632832 - DNA, 13 bp, Homo sapiens
ctcttagctatgt

SEQ ID NO: 4632833 - DNA, 17 bp, Homo sapiens
ctcttagttatgtgacg

SEQ ID NO: 4632834 - DNA, 20 bp, Homo sapiens
ctcttatgggggtgtttcta

SEQ ID NO: 4632835 - DNA, 21 bp, Homo sapiens
ctcttattgggatatcatttt

SEQ ID NO: 4632836 - DNA, 22 bp, Homo sapiens
ctcttatttatagaatttaata

SEQ ID NO: 4632837 - DNA, 23 bp, Homo sapiens
ctcttatttatagaatttaatat

SEQ ID NO: 4632838 - DNA, 20 bp, Homo sapiens
ctcttcaaggaggcccactg

SEQ ID NO: 4632839 - DNA, 17 bp, Homo sapiens
ctcttcagtgactcctg

SEQ ID NO: 4632840 - DNA, 20 bp, Homo sapiens
ctcttcagtgactcctgctg

SEQ ID NO: 4632841 - DNA, 23 bp, Homo sapiens
ctcttcatggcatcttcaatatg

SEQ ID NO: 4632842 - DNA, 13 bp, Homo sapiens
ctcttccccatct

SEQ ID NO: 4632843 - DNA, 19 bp, Homo sapiens
ctcttccccatctcactct

SEQ ID NO: 4632844 - DNA, 16 bp, Homo sapiens
ctcttcccttgctcat

SEQ ID NO: 4632845 - DNA, 12 bp, Homo sapiens
ctcttcctgccc

SEQ ID NO: 4632846 - DNA, 24 bp, Homo sapiens
ctcttcggtcgtatccaccttgca

SEQ ID NO: 4632847 - DNA, 18 bp, Homo sapiens
ctcttctacccttttcct

SEQ ID NO: 4632848 - DNA, 14 bp, Homo sapiens
ctcttctcagccac

SEQ ID NO: 4632849 - DNA, 21 bp, Homo sapiens
ctcttctggtttccctttatt

SEQ ID NO: 4632850 - DNA, 14 bp, Homo sapiens
ctcttcttctgaag

SEQ ID NO: 4632851 - DNA, 15 bp, Homo sapiens
ctcttcttctgaaga

SEQ ID NO: 4632852 - DNA, 12 bp, Homo sapiens
ctcttgaaacct

SEQ ID NO: 4632853 - DNA, 18 bp, Homo sapiens
ctcttgaaatattcagaa

SEQ ID NO: 4632854 - DNA, 16 bp, Homo sapiens
ctcttgattaagggct

SEQ ID NO: 4632855 - DNA, 21 bp, Homo sapiens
ctcttgattgatttttaaagt

SEQ ID NO: 4632856 - DNA, 23 bp, Homo sapiens
ctcttgcacacacggttttggca

SEQ ID NO: 4632857 - DNA, 17 bp, Homo sapiens
ctcttgctcctgcttct

SEQ ID NO: 4632858 - DNA, 16 bp, Homo sapiens
ctcttggcctgatcag

SEQ ID NO: 4632859 - DNA, 20 bp, Homo sapiens
ctcttggggaaggggacaga

SEQ ID NO: 4632860 - DNA, 15 bp, Homo sapiens
ctcttgtaaagactg

SEQ ID NO: 4632861 - DNA, 17 bp, Homo sapiens
ctcttgtgatttcttta

SEQ ID NO: 4632862 - DNA, 18 bp, Homo sapiens
ctcttgttaccatgtatg

SEQ ID NO: 4632863 - DNA, 15 bp, Homo sapiens
ctctttaaccctccc

SEQ ID NO: 4632864 - DNA, 14 bp, Homo sapiens
ctctttaataaatt

SEQ ID NO: 4632865 - DNA, 17 bp, Homo sapiens
ctctttaataaattgct

SEQ ID NO: 4632866 - DNA, 13 bp, Homo sapiens
ctctttccaaatt

SEQ ID NO: 4632867 - DNA, 15 bp, Homo sapiens
ctctttccacttgcc

SEQ ID NO: 4632868 - DNA, 20 bp, Homo sapiens
ctctttccacttgccctgtg

SEQ ID NO: 4632869 - DNA, 15 bp, Homo sapiens
ctctttctgtttcct

SEQ ID NO: 4632870 - DNA, 19 bp, Homo sapiens
ctctttctttctctttctg

SEQ ID NO: 4632871 - DNA, 12 bp, Homo sapiens
ctctttgaattt

SEQ ID NO: 4632872 - DNA, 20 bp, Homo sapiens
ctctttgaattttctgtgtt

SEQ ID NO: 4632873 - DNA, 16 bp, Homo sapiens
ctctttgtctaaaaca

SEQ ID NO: 4632874 - DNA, 22 bp, Homo sapiens
ctcttttcctttggtccttcaa

SEQ ID NO: 4632875 - DNA, 14 bp, Homo sapiens
ctctttttgttttt

SEQ ID NO: 4632876 - DNA, 21 bp, Homo sapiens
ctcttttttgtttgtttcttt

SEQ ID NO: 4632877 - DNA, 22 bp, Homo sapiens
ctctttttttttttttttttgg

SEQ ID NO: 4632878 - DNA, 14 bp, Homo sapiens
ctgaaaagggcact

SEQ ID NO: 4632879 - DNA, 17 bp, Homo sapiens
ctgaaaagggcactccc

SEQ ID NO: 4632880 - DNA, 20 bp, Homo sapiens
ctgaaaagggcactcccaac

SEQ ID NO: 4632881 - DNA, 13 bp, Homo sapiens
ctgaaaatgaaag

SEQ ID NO: 4632882 - DNA, 15 bp, Homo sapiens
ctgaaacaaaatgtt

SEQ ID NO: 4632883 - DNA, 21 bp, Homo sapiens
ctgaaacttgctgagctgttt

SEQ ID NO: 4632884 - DNA, 15 bp, Homo sapiens
ctgaaatgttcttaa

SEQ ID NO: 4632885 - DNA, 19 bp, Homo sapiens
ctgaaattgcttatttttg

SEQ ID NO: 4632886 - DNA, 23 bp, Homo sapiens
ctgaactgaggagatgaccaggg

SEQ ID NO: 4632887 - DNA, 17 bp, Homo sapiens
ctgaagaactctctgga

SEQ ID NO: 4632888 - DNA, 19 bp, Homo sapiens
ctgaagaaggaaggcctga

SEQ ID NO: 4632889 - DNA, 17 bp, Homo sapiens
ctgaagactgagaactt

SEQ ID NO: 4632890 - DNA, 21 bp, Homo sapiens
ctgaagactgagaactttttt

SEQ ID NO: 4632891 - DNA, 16 bp, Homo sapiens
ctgaagcaacatttta

SEQ ID NO: 4632892 - DNA, 21 bp, Homo sapiens
ctgaagcaggttcccaagctc

SEQ ID NO: 4632893 - DNA, 16 bp, Homo sapiens
ctgaagcccaaagcct

SEQ ID NO: 4632894 - DNA, 19 bp, Homo sapiens
ctgaagcccaaagcctgag

SEQ ID NO: 4632895 - DNA, 21 bp, Homo sapiens
ctgaagcccaaagcctgagga

SEQ ID NO: 4632896 - DNA, 23 bp, Homo sapiens
ctgaagcgaacatcttcatataa

SEQ ID NO: 4632897 - DNA, 13 bp, Homo sapiens
ctgaaggcacagc

SEQ ID NO: 4632898 - DNA, 16 bp, Homo sapiens
ctgaaggcagtggcag

SEQ ID NO: 4632899 - DNA, 17 bp, Homo sapiens
ctgaaggcagtggcagg

SEQ ID NO: 4632900 - DNA, 20 bp, Homo sapiens
ctgaaggcagtggcagggga

SEQ ID NO: 4632901 - DNA, 13 bp, Homo sapiens
ctgaaggctttca

SEQ ID NO: 4632902 - DNA, 18 bp, Homo sapiens
ctgaaggctttcagggcc

SEQ ID NO: 4632903 - DNA, 15 bp, Homo sapiens
ctgaagggaactaga

SEQ ID NO: 4632904 - DNA, 20 bp, Homo sapiens
ctgaagggaactagaggtgt

SEQ ID NO: 4632905 - DNA, 16 bp, Homo sapiens
ctgaagtactaacaca

SEQ ID NO: 4632906 - DNA, 17 bp, Homo sapiens
ctgaagtactaacacaa

SEQ ID NO: 4632907 - DNA, 12 bp, Homo sapiens
ctgaatcttctg

SEQ ID NO: 4632908 - DNA, 16 bp, Homo sapiens
ctgaatgcataatgtt

SEQ ID NO: 4632909 - DNA, 23 bp, Homo sapiens
ctgaatgcctcgctcccttcaag

SEQ ID NO: 4632910 - DNA, 16 bp, Homo sapiens
ctgaatgtttgtgtct

SEQ ID NO: 4632911 - DNA, 21 bp, Homo sapiens
ctgaattgtcagatgtggagt

SEQ ID NO: 4632912 - DNA, 16 bp, Homo sapiens
ctgacaagctggccaa

SEQ ID NO: 4632913 - DNA, 23 bp, Homo sapiens
ctgacaagctggccaaagtcact

SEQ ID NO: 4632914 - DNA, 17 bp, Homo sapiens
ctgacactaaccagagt

SEQ ID NO: 4632915 - DNA, 16 bp, Homo sapiens
ctgacagtagctctta

SEQ ID NO: 4632916 - DNA, 23 bp, Homo sapiens
ctgacatgaagctgttgtgtgag

SEQ ID NO: 4632917 - DNA, 16 bp, Homo sapiens
ctgacattcacctgcc

SEQ ID NO: 4632918 - DNA, 20 bp, Homo sapiens
ctgaccaatattgtacagtt

SEQ ID NO: 4632919 - DNA, 21 bp, Homo sapiens
ctgaccaatattgtacagttt

SEQ ID NO: 4632920 - DNA, 15 bp, Homo sapiens
ctgaccacagcacag

SEQ ID NO: 4632921 - DNA, 23 bp, Homo sapiens
ctgaccaggatggagcaagctct

SEQ ID NO: 4632922 - DNA, 13 bp, Homo sapiens
ctgacccagcatc

SEQ ID NO: 4632923 - DNA, 21 bp, Homo sapiens
ctgacccagcatctcccagca

SEQ ID NO: 4632924 - DNA, 15 bp, Homo sapiens
ctgaccccatcacct

SEQ ID NO: 4632925 - DNA, 17 bp, Homo sapiens
ctgaccctatgggtcta

SEQ ID NO: 4632926 - DNA, 20 bp, Homo sapiens
ctgacccttacagcctctga

SEQ ID NO: 4632927 - DNA, 22 bp, Homo sapiens
ctgacccttacagcctctgact

SEQ ID NO: 4632928 - DNA, 20 bp, Homo sapiens
ctgacctgtgagcccagctg

SEQ ID NO: 4632929 - DNA, 21 bp, Homo sapiens
ctgacgaacttccatggccct

SEQ ID NO: 4632930 - DNA, 24 bp, Homo sapiens
ctgacgcccgagagcctcgctttt

SEQ ID NO: 4632931 - DNA, 22 bp, Homo sapiens
ctgactcctcagtccctcttct

SEQ ID NO: 4632932 - DNA, 14 bp, Homo sapiens
ctgactctcacctg

SEQ ID NO: 4632933 - DNA, 13 bp, Homo sapiens
ctgactgaatgca

SEQ ID NO: 4632934 - DNA, 14 bp, Homo sapiens
ctgactgaatgcag

SEQ ID NO: 4632935 - DNA, 16 bp, Homo sapiens
ctgactgccaagccag

SEQ ID NO: 4632936 - DNA, 17 bp, Homo sapiens
ctgacttcatctcccac

SEQ ID NO: 4632937 - DNA, 21 bp, Homo sapiens
ctgacttggggagatggagtt

SEQ ID NO: 4632938 - DNA, 22 bp, Homo sapiens
ctgacttggggagatggagttc

SEQ ID NO: 4632939 - DNA, 16 bp, Homo sapiens
ctgacttggttctgaa

SEQ ID NO: 4632940 - DNA, 17 bp, Homo sapiens
ctgacttggttctgaag

SEQ ID NO: 4632941 - DNA, 15 bp, Homo sapiens
ctgagaacctggcct

SEQ ID NO: 4632942 - DNA, 16 bp, Homo sapiens
ctgagaacctggcctt

SEQ ID NO: 4632943 - DNA, 19 bp, Homo sapiens
ctgagaacctggccttcag

SEQ ID NO: 4632944 - DNA, 20 bp, Homo sapiens
ctgagaacctggccttcagt

SEQ ID NO: 4632945 - DNA, 15 bp, Homo sapiens
ctgagaagctgctcc

SEQ ID NO: 4632946 - DNA, 17 bp, Homo sapiens
ctgagaagctgctccag

SEQ ID NO: 4632947 - DNA, 18 bp, Homo sapiens
ctgagaagctgctccagg

SEQ ID NO: 4632948 - DNA, 18 bp, Homo sapiens
ctgagaatctaggccacc

SEQ ID NO: 4632949 - DNA, 12 bp, Homo sapiens
ctgagaccacag

SEQ ID NO: 4632950 - DNA, 16 bp, Homo sapiens
ctgagaccacagaggc

SEQ ID NO: 4632951 - DNA, 20 bp, Homo sapiens
ctgagagaattggctcaata

SEQ ID NO: 4632952 - DNA, 15 bp, Homo sapiens
ctgagaggccctgga

SEQ ID NO: 4632953 - DNA, 21 bp, Homo sapiens
ctgagataagtaggctggttt

SEQ ID NO: 4632954 - DNA, 14 bp, Homo sapiens
ctgagatgctcact

SEQ ID NO: 4632955 - DNA, 19 bp, Homo sapiens
ctgagatttaacccctcca

SEQ ID NO: 4632956 - DNA, 13 bp, Homo sapiens
ctgagcactgcca

SEQ ID NO: 4632957 - DNA, 15 bp, Homo sapiens
ctgagcacttagcag

SEQ ID NO: 4632958 - DNA, 20 bp, Homo sapiens
ctgagcacttagcaggcacc

SEQ ID NO: 4632959 - DNA, 17 bp, Homo sapiens
ctgagcagggccgggga

SEQ ID NO: 4632960 - DNA, 20 bp, Homo sapiens
ctgagcatactcaacaaaac

SEQ ID NO: 4632961 - DNA, 15 bp, Homo sapiens
ctgagccaaccttgc

SEQ ID NO: 4632962 - DNA, 14 bp, Homo sapiens
ctgagcccagggag

SEQ ID NO: 4632963 - DNA, 15 bp, Homo sapiens
ctgagcccagggagg

SEQ ID NO: 4632964 - DNA, 17 bp, Homo sapiens
ctgagcccagggaggcc

SEQ ID NO: 4632965 - DNA, 12 bp, Homo sapiens
ctgagcctgccg

SEQ ID NO: 4632966 - DNA, 15 bp, Homo sapiens
ctgagcctgccgagc

SEQ ID NO: 4632967 - DNA, 19 bp, Homo sapiens
ctgagcctgccgagcaacc

SEQ ID NO: 4632968 - DNA, 18 bp, Homo sapiens
ctgagctcacaaggcagc

SEQ ID NO: 4632969 - DNA, 19 bp, Homo sapiens
ctgagctcacaaggcagca

SEQ ID NO: 4632970 - DNA, 12 bp, Homo sapiens
ctgagctctgag

SEQ ID NO: 4632971 - DNA, 13 bp, Homo sapiens
ctgagctctgaga

SEQ ID NO: 4632972 - DNA, 14 bp, Homo sapiens
ctgagctctgagag

SEQ ID NO: 4632973 - DNA, 17 bp, Homo sapiens
ctgagctctgagaggcc

SEQ ID NO: 4632974 - DNA, 18 bp, Homo sapiens
ctgagctctgagaggccc

SEQ ID NO: 4632975 - DNA, 19 bp, Homo sapiens
ctgagctctgagaggccct

SEQ ID NO: 4632976 - DNA, 20 bp, Homo sapiens
ctgagctctgagaggccctg

SEQ ID NO: 4632977 - DNA, 14 bp, Homo sapiens
ctgagctggaaggg

SEQ ID NO: 4632978 - DNA, 12 bp, Homo sapiens
ctgagctggctt

SEQ ID NO: 4632979 - DNA, 14 bp, Homo sapiens
ctgagctggcttcg

SEQ ID NO: 4632980 - DNA, 16 bp, Homo sapiens
ctgagctggcttcgga

SEQ ID NO: 4632981 - DNA, 15 bp, Homo sapiens
ctgaggacagaaaga

SEQ ID NO: 4632982 - DNA, 19 bp, Homo sapiens
ctgaggacagaaagaccct

SEQ ID NO: 4632983 - DNA, 20 bp, Homo sapiens
ctgaggacagaaagaccctg

SEQ ID NO: 4632984 - DNA, 14 bp, Homo sapiens
ctgaggacagctgt

SEQ ID NO: 4632985 - DNA, 15 bp, Homo sapiens
ctgaggacagctgtc

SEQ ID NO: 4632986 - DNA, 19 bp, Homo sapiens
ctgaggagatgaccaggga

SEQ ID NO: 4632987 - DNA, 20 bp, Homo sapiens
ctgaggagatgaccagggat

SEQ ID NO: 4632988 - DNA, 11 bp, Homo sapiens
ctgaggatgtt

SEQ ID NO: 4632989 - DNA, 22 bp, Homo sapiens
ctgaggcatccgtgaggcaggg

SEQ ID NO: 4632990 - DNA, 23 bp, Homo sapiens
ctgaggcatccgtgaggcaggga

SEQ ID NO: 4632991 - DNA, 14 bp, Homo sapiens
ctgaggccagcctg

SEQ ID NO: 4632992 - DNA, 16 bp, Homo sapiens
ctgaggccagcctggc

SEQ ID NO: 4632993 - DNA, 20 bp, Homo sapiens
ctgaggccagcctggcctcc

SEQ ID NO: 4632994 - DNA, 15 bp, Homo sapiens
ctgaggcctagactc

SEQ ID NO: 4632995 - DNA, 11 bp, Homo sapiens
ctgaggctggc

SEQ ID NO: 4632996 - DNA, 17 bp, Homo sapiens
ctgaggctggcacagga

SEQ ID NO: 4632997 - DNA, 13 bp, Homo sapiens
ctgagggcagtgc

SEQ ID NO: 4632998 - DNA, 18 bp, Homo sapiens
ctgagggcagtgcccttt

SEQ ID NO: 4632999 - DNA, 19 bp, Homo sapiens
ctgagggcagttcgcagcc

SEQ ID NO: 4633000 - DNA, 14 bp, Homo sapiens
ctgaggtcctgagc

SEQ ID NO: 4633001 - DNA, 16 bp, Homo sapiens
ctgaggtcctgagcac

SEQ ID NO: 4633002 - DNA, 13 bp, Homo sapiens
ctgaggtgcccag

SEQ ID NO: 4633003 - DNA, 16 bp, Homo sapiens
ctgaggtgcccaggag

SEQ ID NO: 4633004 - DNA, 15 bp, Homo sapiens
ctgagtagctgggat

SEQ ID NO: 4633005 - DNA, 20 bp, Homo sapiens
ctgagtagctgggattacag

SEQ ID NO: 4633006 - DNA, 13 bp, Homo sapiens
ctgagtcctggcc

SEQ ID NO: 4633007 - DNA, 15 bp, Homo sapiens
ctgagtcctggccca

SEQ ID NO: 4633008 - DNA, 23 bp, Homo sapiens
ctgagtctatgttcaaagactgt

SEQ ID NO: 4633009 - DNA, 18 bp, Homo sapiens
ctgagtgacctccttctg

SEQ ID NO: 4633010 - DNA, 14 bp, Homo sapiens
ctgagtgagtggga

SEQ ID NO: 4633011 - DNA, 13 bp, Homo sapiens
ctgagtggcttca

SEQ ID NO: 4633012 - DNA, 19 bp, Homo sapiens
ctgagtggcttcactcctg

SEQ ID NO: 4633013 - DNA, 17 bp, Homo sapiens
ctgatcagaccacggct

SEQ ID NO: 4633014 - DNA, 12 bp, Homo sapiens
ctgatcagaggc

SEQ ID NO: 4633015 - DNA, 16 bp, Homo sapiens
ctgatccatccatctc

SEQ ID NO: 4633016 - DNA, 22 bp, Homo sapiens
ctgatccatccatctctctctt

SEQ ID NO: 4633017 - DNA, 13 bp, Homo sapiens
ctgatcttttaaa

SEQ ID NO: 4633018 - DNA, 22 bp, Homo sapiens
ctgatgcaggtcagcccatgga

SEQ ID NO: 4633019 - DNA, 21 bp, Homo sapiens
ctgatgcatcagaaagggagg

SEQ ID NO: 4633020 - DNA, 15 bp, Homo sapiens
ctgatggagccttcc

SEQ ID NO: 4633021 - DNA, 20 bp, Homo sapiens
ctgattaaatatttgaagag

SEQ ID NO: 4633022 - DNA, 21 bp, Homo sapiens
ctgattacttgtaattatgaa

SEQ ID NO: 4633023 - DNA, 14 bp, Homo sapiens
ctgattattttagc

SEQ ID NO: 4633024 - DNA, 14 bp, Homo sapiens
ctgattcctctcat

SEQ ID NO: 4633025 - DNA, 21 bp, Homo sapiens
ctgattgctcccaggatctcc

SEQ ID NO: 4633026 - DNA, 14 bp, Homo sapiens
ctgcaaacagaaca

SEQ ID NO: 4633027 - DNA, 16 bp, Homo sapiens
ctgcaaacagaacagg

SEQ ID NO: 4633028 - DNA, 19 bp, Homo sapiens
ctgcaaacagaacagggtc

SEQ ID NO: 4633029 - DNA, 20 bp, Homo sapiens
ctgcaaacagaacagggtca

SEQ ID NO: 4633030 - DNA, 13 bp, Homo sapiens
ctgcaaagtggca

SEQ ID NO: 4633031 - DNA, 18 bp, Homo sapiens
ctgcaacctctgcctcct

SEQ ID NO: 4633032 - DNA, 20 bp, Homo sapiens
ctgcaacctctgcctcctgg

SEQ ID NO: 4633033 - DNA, 16 bp, Homo sapiens
ctgcaacttccgctga

SEQ ID NO: 4633034 - DNA, 17 bp, Homo sapiens
ctgcaatacattaaaat

SEQ ID NO: 4633035 - DNA, 18 bp, Homo sapiens
ctgcacactctcttctcc

SEQ ID NO: 4633036 - DNA, 18 bp, Homo sapiens
ctgcacagacaagcagcc

SEQ ID NO: 4633037 - DNA, 23 bp, Homo sapiens
ctgcacagagcaagtcctcactc

SEQ ID NO: 4633038 - DNA, 12 bp, Homo sapiens
ctgcacaggctt

SEQ ID NO: 4633039 - DNA, 18 bp, Homo sapiens
ctgcacctagaacctccc

SEQ ID NO: 4633040 - DNA, 14 bp, Homo sapiens
ctgcactccagcct

SEQ ID NO: 4633041 - DNA, 20 bp, Homo sapiens
ctgcactttccaatgccaca

SEQ ID NO: 4633042 - DNA, 23 bp, Homo sapiens
ctgcactttccaatgccacagac

SEQ ID NO: 4633043 - DNA, 13 bp, Homo sapiens
ctgcagaacccac

SEQ ID NO: 4633044 - DNA, 17 bp, Homo sapiens
ctgcagaaggaaagaag

SEQ ID NO: 4633045 - DNA, 23 bp, Homo sapiens
ctgcagaaggaaagaagggggcc

SEQ ID NO: 4633046 - DNA, 14 bp, Homo sapiens
ctgcagaccctgcc

SEQ ID NO: 4633047 - DNA, 15 bp, Homo sapiens
ctgcagacgcccaga

SEQ ID NO: 4633048 - DNA, 20 bp, Homo sapiens
ctgcagcaaacactccaccc

SEQ ID NO: 4633049 - DNA, 13 bp, Homo sapiens
ctgcagcagagcc

SEQ ID NO: 4633050 - DNA, 20 bp, Homo sapiens
ctgcagcaggagtggtgcag

SEQ ID NO: 4633051 - DNA, 11 bp, Homo sapiens
ctgcagcttgt

SEQ ID NO: 4633052 - DNA, 16 bp, Homo sapiens
ctgcagcttgtagcca

SEQ ID NO: 4633053 - DNA, 17 bp, Homo sapiens
ctgcagcttgtagccag

SEQ ID NO: 4633054 - DNA, 16 bp, Homo sapiens
ctgcagggcttctcct

SEQ ID NO: 4633055 - DNA, 21 bp, Homo sapiens
ctgcaggttcttcttcctgaa

SEQ ID NO: 4633056 - DNA, 21 bp, Homo sapiens
ctgcatctgtctgctctgcat

SEQ ID NO: 4633057 - DNA, 16 bp, Homo sapiens
ctgcatggtcaagcct

SEQ ID NO: 4633058 - DNA, 16 bp, Homo sapiens
ctgcattatcttgctc

SEQ ID NO: 4633059 - DNA, 17 bp, Homo sapiens
ctgcattattctctttt

SEQ ID NO: 4633060 - DNA, 15 bp, Homo sapiens
ctgcattcattttta

SEQ ID NO: 4633061 - DNA, 14 bp, Homo sapiens
ctgcattctctccc

SEQ ID NO: 4633062 - DNA, 16 bp, Homo sapiens
ctgcattctctcccat

SEQ ID NO: 4633063 - DNA, 21 bp, Homo sapiens
ctgcattctctcccatcctgg

SEQ ID NO: 4633064 - DNA, 19 bp, Homo sapiens
ctgcattgacctggagggg

SEQ ID NO: 4633065 - DNA, 21 bp, Homo sapiens
ctgccaagagtcaacaggtca

SEQ ID NO: 4633066 - DNA, 17 bp, Homo sapiens
ctgccaagccagattct

SEQ ID NO: 4633067 - DNA, 22 bp, Homo sapiens
ctgccaagccagattctcttga

SEQ ID NO: 4633068 - DNA, 21 bp, Homo sapiens
ctgccaaggtggagggaagga

SEQ ID NO: 4633069 - DNA, 23 bp, Homo sapiens
ctgccacagagaagtttgtagcc

SEQ ID NO: 4633070 - DNA, 12 bp, Homo sapiens
ctgccactctgc

SEQ ID NO: 4633071 - DNA, 17 bp, Homo sapiens
ctgccagacctgcatgg

SEQ ID NO: 4633072 - DNA, 20 bp, Homo sapiens
ctgccagacctgcatggtca

SEQ ID NO: 4633073 - DNA, 16 bp, Homo sapiens
ctgccagcaggaataa

SEQ ID NO: 4633074 - DNA, 17 bp, Homo sapiens
ctgccagcaggaataaa

SEQ ID NO: 4633075 - DNA, 13 bp, Homo sapiens
ctgccagccactg

SEQ ID NO: 4633076 - DNA, 19 bp, Homo sapiens
ctgccagccactgtcaccg

SEQ ID NO: 4633077 - DNA, 14 bp, Homo sapiens
ctgccagcccagct

SEQ ID NO: 4633078 - DNA, 19 bp, Homo sapiens
ctgccagcctgaggtgccc

SEQ ID NO: 4633079 - DNA, 18 bp, Homo sapiens
ctgccaggagggacaaag

SEQ ID NO: 4633080 - DNA, 23 bp, Homo sapiens
ctgccaggagggacaaaggagcc

SEQ ID NO: 4633081 - DNA, 22 bp, Homo sapiens
ctgcccacagaaagccaggagc

SEQ ID NO: 4633082 - DNA, 14 bp, Homo sapiens
ctgcccaggcaagg

SEQ ID NO: 4633083 - DNA, 20 bp, Homo sapiens
ctgcccagtgcaaaccactt

SEQ ID NO: 4633084 - DNA, 12 bp, Homo sapiens
ctgccccaactc

SEQ ID NO: 4633085 - DNA, 15 bp, Homo sapiens
ctgccccaactcctt

SEQ ID NO: 4633086 - DNA, 20 bp, Homo sapiens
ctgccccaactccttccagc

SEQ ID NO: 4633087 - DNA, 17 bp, Homo sapiens
ctgcccctaccctggac

SEQ ID NO: 4633088 - DNA, 21 bp, Homo sapiens
ctgcccctaccctggacttgc

SEQ ID NO: 4633089 - DNA, 14 bp, Homo sapiens
ctgcccctctctgg

SEQ ID NO: 4633090 - DNA, 23 bp, Homo sapiens
ctgcccctctctgggcctcagag

SEQ ID NO: 4633091 - DNA, 20 bp, Homo sapiens
ctgcccgagggcagccccct

SEQ ID NO: 4633092 - DNA, 18 bp, Homo sapiens
ctgcccgcagacctctgg

SEQ ID NO: 4633093 - DNA, 19 bp, Homo sapiens
ctgcccgcagacctctgga

SEQ ID NO: 4633094 - DNA, 22 bp, Homo sapiens
ctgccctccacccacacctgcc

SEQ ID NO: 4633095 - DNA, 20 bp, Homo sapiens
ctgccctctatttattagcc

SEQ ID NO: 4633096 - DNA, 21 bp, Homo sapiens
ctgccctgagaagctgctcca

SEQ ID NO: 4633097 - DNA, 17 bp, Homo sapiens
ctgccctgctctgccca

SEQ ID NO: 4633098 - DNA, 21 bp, Homo sapiens
ctgcccttgaaccccctccct

SEQ ID NO: 4633099 - DNA, 22 bp, Homo sapiens
ctgcccttgtttggggcaggag

SEQ ID NO: 4633100 - DNA, 16 bp, Homo sapiens
ctgccgagcaaccgtg

SEQ ID NO: 4633101 - DNA, 15 bp, Homo sapiens
ctgccgccgcccgct

SEQ ID NO: 4633102 - DNA, 15 bp, Homo sapiens
ctgcctagagtgtag

SEQ ID NO: 4633103 - DNA, 20 bp, Homo sapiens
ctgcctagagtgtagcctaa

SEQ ID NO: 4633104 - DNA, 23 bp, Homo sapiens
ctgcctagagtgtagcctaaagg

SEQ ID NO: 4633105 - DNA, 17 bp, Homo sapiens
ctgcctagtgggagtta

SEQ ID NO: 4633106 - DNA, 22 bp, Homo sapiens
ctgcctataatcttatacaaca

SEQ ID NO: 4633107 - DNA, 24 bp, Homo sapiens
ctgcctcacatctcccttccacct

SEQ ID NO: 4633108 - DNA, 18 bp, Homo sapiens
ctgcctcagcctcccgag

SEQ ID NO: 4633109 - DNA, 11 bp, Homo sapiens
ctgcctcagga

SEQ ID NO: 4633110 - DNA, 14 bp, Homo sapiens
ctgcctcctgcttt

SEQ ID NO: 4633111 - DNA, 15 bp, Homo sapiens
ctgcctcctgctttg

SEQ ID NO: 4633112 - DNA, 15 bp, Homo sapiens
ctgcctcgccttgtg

SEQ ID NO: 4633113 - DNA, 16 bp, Homo sapiens
ctgcctcgccttgtgt

SEQ ID NO: 4633114 - DNA, 19 bp, Homo sapiens
ctgcctctactgggaaggc

SEQ ID NO: 4633115 - DNA, 22 bp, Homo sapiens
ctgcctcttccccctgcttcca

SEQ ID NO: 4633116 - DNA, 12 bp, Homo sapiens
ctgcctgcttgg

SEQ ID NO: 4633117 - DNA, 13 bp, Homo sapiens
ctgcctgcttggg

SEQ ID NO: 4633118 - DNA, 12 bp, Homo sapiens
ctgcctggagga

SEQ ID NO: 4633119 - DNA, 15 bp, Homo sapiens
ctgcctggaggacct

SEQ ID NO: 4633120 - DNA, 18 bp, Homo sapiens
ctgcctggaggacctgag

SEQ ID NO: 4633121 - DNA, 19 bp, Homo sapiens
ctgcctggatgagaaacag

SEQ ID NO: 4633122 - DNA, 10 bp, Homo sapiens
ctgcctggca

SEQ ID NO: 4633123 - DNA, 11 bp, Homo sapiens
ctgcctggcaa

SEQ ID NO: 4633124 - DNA, 12 bp, Homo sapiens
ctgcctggcaac

SEQ ID NO: 4633125 - DNA, 16 bp, Homo sapiens
ctgcctgggatgccct

SEQ ID NO: 4633126 - DNA, 19 bp, Homo sapiens
ctgcctgggcaatggccag

SEQ ID NO: 4633127 - DNA, 20 bp, Homo sapiens
ctgcctgggcaatggccagg

SEQ ID NO: 4633128 - DNA, 22 bp, Homo sapiens
ctgcctgggcaatggccagggg

SEQ ID NO: 4633129 - DNA, 17 bp, Homo sapiens
ctgcctgggtaggcccc

SEQ ID NO: 4633130 - DNA, 19 bp, Homo sapiens
ctgcctgggtaggccccac

SEQ ID NO: 4633131 - DNA, 22 bp, Homo sapiens
ctgcctgggtaggccccacaag

SEQ ID NO: 4633132 - DNA, 19 bp, Homo sapiens
ctgcctggttctaggctgc

SEQ ID NO: 4633133 - DNA, 17 bp, Homo sapiens
ctgccttaaacacacat

SEQ ID NO: 4633134 - DNA, 17 bp, Homo sapiens
ctgccttaacctgggac

SEQ ID NO: 4633135 - DNA, 19 bp, Homo sapiens
ctgcctttaagccaaagaa

SEQ ID NO: 4633136 - DNA, 18 bp, Homo sapiens
ctgcctttggcagagttc

SEQ ID NO: 4633137 - DNA, 13 bp, Homo sapiens
ctgcgcaagtgcc

SEQ ID NO: 4633138 - DNA, 14 bp, Homo sapiens
ctgcgcaagtgcct

SEQ ID NO: 4633139 - DNA, 16 bp, Homo sapiens
ctgcgcaagtgcctgg

SEQ ID NO: 4633140 - DNA, 18 bp, Homo sapiens
ctgcgcaagtgcctggga

SEQ ID NO: 4633141 - DNA, 23 bp, Homo sapiens
ctgcgcaagtgcctgggattcta

SEQ ID NO: 4633142 - DNA, 15 bp, Homo sapiens
ctgcgcgttcctccg

SEQ ID NO: 4633143 - DNA, 23 bp, Homo sapiens
ctgcggaatcttcttactaagct

SEQ ID NO: 4633144 - DNA, 20 bp, Homo sapiens
ctgcggatactcttggagag

SEQ ID NO: 4633145 - DNA, 22 bp, Homo sapiens
ctgcgggtgaacaaagcagcca

SEQ ID NO: 4633146 - DNA, 23 bp, Homo sapiens
ctgcgggtgaacaaagcagccac

SEQ ID NO: 4633147 - DNA, 22 bp, Homo sapiens
ctgcggtagatgggagggaggc

SEQ ID NO: 4633148 - DNA, 20 bp, Homo sapiens
ctgctaatgcaaattaaaac

SEQ ID NO: 4633149 - DNA, 23 bp, Homo sapiens
ctgctaatgcaaattaaaacata

SEQ ID NO: 4633150 - DNA, 22 bp, Homo sapiens
ctgctacattataatgtacaga

SEQ ID NO: 4633151 - DNA, 16 bp, Homo sapiens
ctgctagacgcaccgc

SEQ ID NO: 4633152 - DNA, 17 bp, Homo sapiens
ctgctagctttctcctt

SEQ ID NO: 4633153 - DNA, 21 bp, Homo sapiens
ctgctagtcgcccctcagagc

SEQ ID NO: 4633154 - DNA, 18 bp, Homo sapiens
ctgctattctagagcttt

SEQ ID NO: 4633155 - DNA, 12 bp, Homo sapiens
ctgctattgcag

SEQ ID NO: 4633156 - DNA, 22 bp, Homo sapiens
ctgctattgcagaatgaagcca

SEQ ID NO: 4633157 - DNA, 16 bp, Homo sapiens
ctgctcagctctgggc

SEQ ID NO: 4633158 - DNA, 14 bp, Homo sapiens
ctgctccaggcctg

SEQ ID NO: 4633159 - DNA, 15 bp, Homo sapiens
ctgctccaggcctgc

SEQ ID NO: 4633160 - DNA, 13 bp, Homo sapiens
ctgctcggggtgc

SEQ ID NO: 4633161 - DNA, 20 bp, Homo sapiens
ctgctcggggtgcacaggag

SEQ ID NO: 4633162 - DNA, 16 bp, Homo sapiens
ctgctctaagcccagg

SEQ ID NO: 4633163 - DNA, 17 bp, Homo sapiens
ctgctctaagcccagga

SEQ ID NO: 4633164 - DNA, 18 bp, Homo sapiens
ctgctctaagcccaggat

SEQ ID NO: 4633165 - DNA, 21 bp, Homo sapiens
ctgctctagtgggacagccca

SEQ ID NO: 4633166 - DNA, 16 bp, Homo sapiens
ctgctctttattgcag

SEQ ID NO: 4633167 - DNA, 17 bp, Homo sapiens
ctgctctttccacttgc

SEQ ID NO: 4633168 - DNA, 16 bp, Homo sapiens
ctgctgaatgcctcgc

SEQ ID NO: 4633169 - DNA, 12 bp, Homo sapiens
ctgctgagaacc

SEQ ID NO: 4633170 - DNA, 14 bp, Homo sapiens
ctgctgagaacctg

SEQ ID NO: 4633171 - DNA, 14 bp, Homo sapiens
ctgctgagctctga

SEQ ID NO: 4633172 - DNA, 15 bp, Homo sapiens
ctgctgagctctgag

SEQ ID NO: 4633173 - DNA, 19 bp, Homo sapiens
ctgctgagctctgagaggc

SEQ ID NO: 4633174 - DNA, 23 bp, Homo sapiens
ctgctgagctctgagaggccctg

SEQ ID NO: 4633175 - DNA, 12 bp, Homo sapiens
ctgctgaggccc

SEQ ID NO: 4633176 - DNA, 17 bp, Homo sapiens
ctgctgcacaccaaggc

SEQ ID NO: 4633177 - DNA, 18 bp, Homo sapiens
ctgctgcacaccaaggcc

SEQ ID NO: 4633178 - DNA, 21 bp, Homo sapiens
ctgctgcctgggtaggcccca

SEQ ID NO: 4633179 - DNA, 13 bp, Homo sapiens
ctgctgctgagaa

SEQ ID NO: 4633180 - DNA, 19 bp, Homo sapiens
ctgctgctgagaacctggc

SEQ ID NO: 4633181 - DNA, 16 bp, Homo sapiens
ctgctgctgagacgcc

SEQ ID NO: 4633182 - DNA, 16 bp, Homo sapiens
ctgctgctgtgcagca

SEQ ID NO: 4633183 - DNA, 19 bp, Homo sapiens
ctgctggggccgccacggc

SEQ ID NO: 4633184 - DNA, 21 bp, Homo sapiens
ctgctgggggtgagctgtact

SEQ ID NO: 4633185 - DNA, 15 bp, Homo sapiens
ctgctggtacctgcc

SEQ ID NO: 4633186 - DNA, 19 bp, Homo sapiens
ctgctggtacctgccctct

SEQ ID NO: 4633187 - DNA, 16 bp, Homo sapiens
ctgctgtgcagcatgg

SEQ ID NO: 4633188 - DNA, 17 bp, Homo sapiens
ctgctgtgccatgctgg

SEQ ID NO: 4633189 - DNA, 19 bp, Homo sapiens
ctgctgtgccatgctgggc

SEQ ID NO: 4633190 - DNA, 21 bp, Homo sapiens
ctgctgtgccccaccacgtct

SEQ ID NO: 4633191 - DNA, 14 bp, Homo sapiens
ctgctgtttacaac

SEQ ID NO: 4633192 - DNA, 13 bp, Homo sapiens
ctgcttcatgtga

SEQ ID NO: 4633193 - DNA, 16 bp, Homo sapiens
ctgcttcatgtgaaca

SEQ ID NO: 4633194 - DNA, 17 bp, Homo sapiens
ctgcttccacctcaccc

SEQ ID NO: 4633195 - DNA, 19 bp, Homo sapiens
ctgcttccacctcacccca

SEQ ID NO: 4633196 - DNA, 22 bp, Homo sapiens
ctgcttccacctcaccccactt

SEQ ID NO: 4633197 - DNA, 12 bp, Homo sapiens
ctgcttcccagg

SEQ ID NO: 4633198 - DNA, 23 bp, Homo sapiens
ctgcttcccaggttcaagcgatt

SEQ ID NO: 4633199 - DNA, 19 bp, Homo sapiens
ctgcttggggggtgatgag

SEQ ID NO: 4633200 - DNA, 21 bp, Homo sapiens
ctgcttggggggtgatgaggg

SEQ ID NO: 4633201 - DNA, 16 bp, Homo sapiens
ctgctttctccattgt

SEQ ID NO: 4633202 - DNA, 21 bp, Homo sapiens
ctgctttgggaagactgaggc

SEQ ID NO: 4633203 - DNA, 15 bp, Homo sapiens
ctgcttttcctctgc

SEQ ID NO: 4633204 - DNA, 18 bp, Homo sapiens
ctggaaaagtgttaggga

SEQ ID NO: 4633205 - DNA, 20 bp, Homo sapiens
ctggaaacaaaacagaaggg

SEQ ID NO: 4633206 - DNA, 17 bp, Homo sapiens
ctggaaataatatcatt

SEQ ID NO: 4633207 - DNA, 21 bp, Homo sapiens
ctggaactgattgctcccagg

SEQ ID NO: 4633208 - DNA, 22 bp, Homo sapiens
ctggaactgattgctcccagga

SEQ ID NO: 4633209 - DNA, 19 bp, Homo sapiens
ctggaagaaactaaaaata

SEQ ID NO: 4633210 - DNA, 17 bp, Homo sapiens
ctggaagcccctgggcc

SEQ ID NO: 4633211 - DNA, 13 bp, Homo sapiens
ctggaaggggcca

SEQ ID NO: 4633212 - DNA, 18 bp, Homo sapiens
ctggaagtcaaataaatg

SEQ ID NO: 4633213 - DNA, 20 bp, Homo sapiens
ctggaagtcaaataaatgtt

SEQ ID NO: 4633214 - DNA, 21 bp, Homo sapiens
ctggaagtcaaataaatgttt

SEQ ID NO: 4633215 - DNA, 16 bp, Homo sapiens
ctggaataaagttgca

SEQ ID NO: 4633216 - DNA, 16 bp, Homo sapiens
ctggacagcatcagaa

SEQ ID NO: 4633217 - DNA, 18 bp, Homo sapiens
ctggacagcatcagaaat

SEQ ID NO: 4633218 - DNA, 18 bp, Homo sapiens
ctggacagctgtgcctcg

SEQ ID NO: 4633219 - DNA, 17 bp, Homo sapiens
ctggacatagagaggga

SEQ ID NO: 4633220 - DNA, 17 bp, Homo sapiens
ctggacggaagtggtgg

SEQ ID NO: 4633221 - DNA, 23 bp, Homo sapiens
ctggactgctattctagagcttt

SEQ ID NO: 4633222 - DNA, 18 bp, Homo sapiens
ctggactggttatcttgt

SEQ ID NO: 4633223 - DNA, 15 bp, Homo sapiens
ctggacttgcctctg

SEQ ID NO: 4633224 - DNA, 13 bp, Homo sapiens
ctggagaaagagc

SEQ ID NO: 4633225 - DNA, 17 bp, Homo sapiens
ctggagaaagagctgcc

SEQ ID NO: 4633226 - DNA, 20 bp, Homo sapiens
ctggagaaagagctgcctgg

SEQ ID NO: 4633227 - DNA, 21 bp, Homo sapiens
ctggagaaagagctgcctgga

SEQ ID NO: 4633228 - DNA, 22 bp, Homo sapiens
ctggagaaagagctgcctggat

SEQ ID NO: 4633229 - DNA, 21 bp, Homo sapiens
ctggagaacagtggttgcctg

SEQ ID NO: 4633230 - DNA, 17 bp, Homo sapiens
ctggagaaggacatgag

SEQ ID NO: 4633231 - DNA, 17 bp, Homo sapiens
ctggagacaaggtgcta

SEQ ID NO: 4633232 - DNA, 14 bp, Homo sapiens
ctggagatcagcat

SEQ ID NO: 4633233 - DNA, 23 bp, Homo sapiens
ctggagcctccgacgctgcctct

SEQ ID NO: 4633234 - DNA, 16 bp, Homo sapiens
ctggagctggcactgt

SEQ ID NO: 4633235 - DNA, 12 bp, Homo sapiens
ctggaggacctg

SEQ ID NO: 4633236 - DNA, 17 bp, Homo sapiens
ctggaggacctgagcct

SEQ ID NO: 4633237 - DNA, 19 bp, Homo sapiens
ctggaggacctgagcctgc

SEQ ID NO: 4633238 - DNA, 22 bp, Homo sapiens
ctggaggacctgagcctgccga

SEQ ID NO: 4633239 - DNA, 13 bp, Homo sapiens
ctggaggagagaa

SEQ ID NO: 4633240 - DNA, 22 bp, Homo sapiens
ctggaggagggtttgggcagag

SEQ ID NO: 4633241 - DNA, 23 bp, Homo sapiens
ctggaggagggtttgggcagagc

SEQ ID NO: 4633242 - DNA, 21 bp, Homo sapiens
ctggaggcagagggcaaggga

SEQ ID NO: 4633243 - DNA, 22 bp, Homo sapiens
ctggaggcagtccatctaggga

SEQ ID NO: 4633244 - DNA, 19 bp, Homo sapiens
ctggaggcccctggagcca

SEQ ID NO: 4633245 - DNA, 20 bp, Homo sapiens
ctggaggcccctggagccag

SEQ ID NO: 4633246 - DNA, 18 bp, Homo sapiens
ctggagggcaagccctgc

SEQ ID NO: 4633247 - DNA, 18 bp, Homo sapiens
ctggaggggagaggtcag

SEQ ID NO: 4633248 - DNA, 22 bp, Homo sapiens
ctggaggggagaggtcagcctt

SEQ ID NO: 4633249 - DNA, 15 bp, Homo sapiens
ctggaggtctccagg

SEQ ID NO: 4633250 - DNA, 14 bp, Homo sapiens
ctggagtgcagtgg

SEQ ID NO: 4633251 - DNA, 13 bp, Homo sapiens
ctggatcagcgtg

SEQ ID NO: 4633252 - DNA, 19 bp, Homo sapiens
ctggatcagcgtggccttg

SEQ ID NO: 4633253 - DNA, 15 bp, Homo sapiens
ctggatgagaaacag

SEQ ID NO: 4633254 - DNA, 13 bp, Homo sapiens
ctggcacagaggt

SEQ ID NO: 4633255 - DNA, 17 bp, Homo sapiens
ctggcacccccacaagc

SEQ ID NO: 4633256 - DNA, 12 bp, Homo sapiens
ctggcagccaca

SEQ ID NO: 4633257 - DNA, 14 bp, Homo sapiens
ctggcagccacact

SEQ ID NO: 4633258 - DNA, 22 bp, Homo sapiens
ctggcagccacacttctcagga

SEQ ID NO: 4633259 - DNA, 12 bp, Homo sapiens
ctggcagcctcc

SEQ ID NO: 4633260 - DNA, 14 bp, Homo sapiens
ctggcagcctccca

SEQ ID NO: 4633261 - DNA, 20 bp, Homo sapiens
ctggcagcctcccatccagg

SEQ ID NO: 4633262 - DNA, 13 bp, Homo sapiens
ctggcagggcagc

SEQ ID NO: 4633263 - DNA, 15 bp, Homo sapiens
ctggcagggcagcag

SEQ ID NO: 4633264 - DNA, 13 bp, Homo sapiens
ctggcatagagta

SEQ ID NO: 4633265 - DNA, 13 bp, Homo sapiens
ctggcattgaaat

SEQ ID NO: 4633266 - DNA, 16 bp, Homo sapiens
ctggccaagctgaggt

SEQ ID NO: 4633267 - DNA, 23 bp, Homo sapiens
ctggccaagctgaggtgcccagg

SEQ ID NO: 4633268 - DNA, 13 bp, Homo sapiens
ctggccacagcct

SEQ ID NO: 4633269 - DNA, 14 bp, Homo sapiens
ctggccacagcctt

SEQ ID NO: 4633270 - DNA, 15 bp, Homo sapiens
ctggccacagccttc

SEQ ID NO: 4633271 - DNA, 13 bp, Homo sapiens
ctggccccaggac

SEQ ID NO: 4633272 - DNA, 16 bp, Homo sapiens
ctggccccaggacctg

SEQ ID NO: 4633273 - DNA, 20 bp, Homo sapiens
ctggccccaggacctggctg

SEQ ID NO: 4633274 - DNA, 21 bp, Homo sapiens
ctggccccaggacctggctgc

SEQ ID NO: 4633275 - DNA, 18 bp, Homo sapiens
ctggcccccatcagccct

SEQ ID NO: 4633276 - DNA, 22 bp, Homo sapiens
ctggcccccatcagccctgcta

SEQ ID NO: 4633277 - DNA, 13 bp, Homo sapiens
ctggcccctccaa

SEQ ID NO: 4633278 - DNA, 19 bp, Homo sapiens
ctggcccttacttgcttct

SEQ ID NO: 4633279 - DNA, 21 bp, Homo sapiens
ctggccggagcaaactctgct

SEQ ID NO: 4633280 - DNA, 21 bp, Homo sapiens
ctggccggggctctgggtgct

SEQ ID NO: 4633281 - DNA, 21 bp, Homo sapiens
ctggcctaaatttcttctggt

SEQ ID NO: 4633282 - DNA, 11 bp, Homo sapiens
ctggcctcaga

SEQ ID NO: 4633283 - DNA, 12 bp, Homo sapiens
ctggcctcagag

SEQ ID NO: 4633284 - DNA, 14 bp, Homo sapiens
ctggcctcagagct

SEQ ID NO: 4633285 - DNA, 15 bp, Homo sapiens
ctggcctcagagctt

SEQ ID NO: 4633286 - DNA, 23 bp, Homo sapiens
ctggcctcagagcttcctgggga

SEQ ID NO: 4633287 - DNA, 15 bp, Homo sapiens
ctggcctcctgcctc

SEQ ID NO: 4633288 - DNA, 16 bp, Homo sapiens
ctggcctcttgatagt

SEQ ID NO: 4633289 - DNA, 21 bp, Homo sapiens
ctggcctgaactgaggagatg

SEQ ID NO: 4633290 - DNA, 14 bp, Homo sapiens
ctggcctggcacac

SEQ ID NO: 4633291 - DNA, 17 bp, Homo sapiens
ctggcctggcacacatc

SEQ ID NO: 4633292 - DNA, 18 bp, Homo sapiens
ctggcctggcccccagct

SEQ ID NO: 4633293 - DNA, 20 bp, Homo sapiens
ctggccttaaagagggacag

SEQ ID NO: 4633294 - DNA, 16 bp, Homo sapiens
ctggccttgggccctc

SEQ ID NO: 4633295 - DNA, 15 bp, Homo sapiens
ctggctactccctgg

SEQ ID NO: 4633296 - DNA, 19 bp, Homo sapiens
ctggctcacagtacagcat

SEQ ID NO: 4633297 - DNA, 21 bp, Homo sapiens
ctggctccagatgcagggcag

SEQ ID NO: 4633298 - DNA, 15 bp, Homo sapiens
ctggctcccagggcc

SEQ ID NO: 4633299 - DNA, 16 bp, Homo sapiens
ctggctcccagggcca

SEQ ID NO: 4633300 - DNA, 13 bp, Homo sapiens
ctggctccctgcc

SEQ ID NO: 4633301 - DNA, 14 bp, Homo sapiens
ctggctccctgccc

SEQ ID NO: 4633302 - DNA, 23 bp, Homo sapiens
ctggctgagggcagttcgcagcc

SEQ ID NO: 4633303 - DNA, 19 bp, Homo sapiens
ctggctgattcagcatttt

SEQ ID NO: 4633304 - DNA, 20 bp, Homo sapiens
ctggctgattcagcattttt

SEQ ID NO: 4633305 - DNA, 16 bp, Homo sapiens
ctggctggctgagggc

SEQ ID NO: 4633306 - DNA, 12 bp, Homo sapiens
ctggctgggacg

SEQ ID NO: 4633307 - DNA, 23 bp, Homo sapiens
ctggctggtgggaaggccggcag

SEQ ID NO: 4633308 - DNA, 19 bp, Homo sapiens
ctggcttacctatctgtgg

SEQ ID NO: 4633309 - DNA, 20 bp, Homo sapiens
ctggcttcagcccccaccag

SEQ ID NO: 4633310 - DNA, 22 bp, Homo sapiens
ctggcttcccatccccagcgat

SEQ ID NO: 4633311 - DNA, 19 bp, Homo sapiens
ctgggaaagacatccataa

SEQ ID NO: 4633312 - DNA, 16 bp, Homo sapiens
ctgggaaccactccca

SEQ ID NO: 4633313 - DNA, 18 bp, Homo sapiens
ctgggaaccactcccacc

SEQ ID NO: 4633314 - DNA, 18 bp, Homo sapiens
ctgggaactctcctggcc

SEQ ID NO: 4633315 - DNA, 16 bp, Homo sapiens
ctgggaagtcctagcc

SEQ ID NO: 4633316 - DNA, 17 bp, Homo sapiens
ctgggacaagcaggccg

SEQ ID NO: 4633317 - DNA, 21 bp, Homo sapiens
ctgggacaagcaggccgccct

SEQ ID NO: 4633318 - DNA, 15 bp, Homo sapiens
ctgggaccccagctg

SEQ ID NO: 4633319 - DNA, 16 bp, Homo sapiens
ctgggaccgctacacc

SEQ ID NO: 4633320 - DNA, 21 bp, Homo sapiens
ctgggacgtggctcagccagc

SEQ ID NO: 4633321 - DNA, 21 bp, Homo sapiens
ctgggactttcccacccagga

SEQ ID NO: 4633322 - DNA, 17 bp, Homo sapiens
ctgggaggcgggcgcac

SEQ ID NO: 4633323 - DNA, 20 bp, Homo sapiens
ctgggattacaggcgcctgc

SEQ ID NO: 4633324 - DNA, 19 bp, Homo sapiens
ctgggattacaggtgtgca

SEQ ID NO: 4633325 - DNA, 12 bp, Homo sapiens
ctgggcaatggc

SEQ ID NO: 4633326 - DNA, 21 bp, Homo sapiens
ctgggcaatggccaggggcca

SEQ ID NO: 4633327 - DNA, 14 bp, Homo sapiens
ctgggcattgcttt

SEQ ID NO: 4633328 - DNA, 16 bp, Homo sapiens
ctgggcattgctttcc

SEQ ID NO: 4633329 - DNA, 17 bp, Homo sapiens
ctgggcattgctttcca

SEQ ID NO: 4633330 - DNA, 14 bp, Homo sapiens
ctgggccagggtct

SEQ ID NO: 4633331 - DNA, 15 bp, Homo sapiens
ctgggccagggtctg

SEQ ID NO: 4633332 - DNA, 19 bp, Homo sapiens
ctgggccattctccacagc

SEQ ID NO: 4633333 - DNA, 22 bp, Homo sapiens
ctgggccattctccacagcaac

SEQ ID NO: 4633334 - DNA, 13 bp, Homo sapiens
ctgggcccatgaa

SEQ ID NO: 4633335 - DNA, 16 bp, Homo sapiens
ctgggccctctttccc

SEQ ID NO: 4633336 - DNA, 22 bp, Homo sapiens
ctgggccctctttccctgcgag

SEQ ID NO: 4633337 - DNA, 15 bp, Homo sapiens
ctgggccctggggcc

SEQ ID NO: 4633338 - DNA, 17 bp, Homo sapiens
ctgggccctggggcctg

SEQ ID NO: 4633339 - DNA, 18 bp, Homo sapiens
ctgggccctggggcctgt

SEQ ID NO: 4633340 - DNA, 12 bp, Homo sapiens
ctgggcctatgg

SEQ ID NO: 4633341 - DNA, 17 bp, Homo sapiens
ctgggcctatggagagc

SEQ ID NO: 4633342 - DNA, 18 bp, Homo sapiens
ctgggcctatggagagcc

SEQ ID NO: 4633343 - DNA, 19 bp, Homo sapiens
ctgggcctatggagagccc

SEQ ID NO: 4633344 - DNA, 21 bp, Homo sapiens
ctgggcctatggagagccctg

SEQ ID NO: 4633345 - DNA, 18 bp, Homo sapiens
ctgggcctgctgctgaga

SEQ ID NO: 4633346 - DNA, 15 bp, Homo sapiens
ctgggctcaagcttt

SEQ ID NO: 4633347 - DNA, 20 bp, Homo sapiens
ctgggctctaaggtactgtg

SEQ ID NO: 4633348 - DNA, 11 bp, Homo sapiens
ctgggctctgg

SEQ ID NO: 4633349 - DNA, 15 bp, Homo sapiens
ctgggctctggactc

SEQ ID NO: 4633350 - DNA, 17 bp, Homo sapiens
ctgggctctggactcca

SEQ ID NO: 4633351 - DNA, 22 bp, Homo sapiens
ctgggctgtaacgtggcactgg

SEQ ID NO: 4633352 - DNA, 13 bp, Homo sapiens
ctggggaccaaga

SEQ ID NO: 4633353 - DNA, 19 bp, Homo sapiens
ctggggaccggttcccaca

SEQ ID NO: 4633354 - DNA, 15 bp, Homo sapiens
ctggggactcaggga

SEQ ID NO: 4633355 - DNA, 17 bp, Homo sapiens
ctggggactcagggacc

SEQ ID NO: 4633356 - DNA, 13 bp, Homo sapiens
ctggggacttgtg

SEQ ID NO: 4633357 - DNA, 21 bp, Homo sapiens
ctggggactttatttatttct

SEQ ID NO: 4633358 - DNA, 16 bp, Homo sapiens
ctggggaggaggagag

SEQ ID NO: 4633359 - DNA, 18 bp, Homo sapiens
ctggggcagcactcccca

SEQ ID NO: 4633360 - DNA, 13 bp, Homo sapiens
ctggggccaggcc

SEQ ID NO: 4633361 - DNA, 13 bp, Homo sapiens
ctggggccgccac

SEQ ID NO: 4633362 - DNA, 21 bp, Homo sapiens
ctggggccgccacggcctggc

SEQ ID NO: 4633363 - DNA, 14 bp, Homo sapiens
ctggggcctgtact

SEQ ID NO: 4633364 - DNA, 17 bp, Homo sapiens
ctggggcctgtactgcc

SEQ ID NO: 4633365 - DNA, 20 bp, Homo sapiens
ctggggcctgtactgcctgc

SEQ ID NO: 4633366 - DNA, 22 bp, Homo sapiens
ctggggcctgtactgcctgctt

SEQ ID NO: 4633367 - DNA, 18 bp, Homo sapiens
ctggggctagggggagcc

SEQ ID NO: 4633368 - DNA, 18 bp, Homo sapiens
ctggggctggcctcccaa

SEQ ID NO: 4633369 - DNA, 14 bp, Homo sapiens
ctggggctgtgtta

SEQ ID NO: 4633370 - DNA, 13 bp, Homo sapiens
ctgggggcctggc

SEQ ID NO: 4633371 - DNA, 23 bp, Homo sapiens
ctgggggcctggctggctgaggg

SEQ ID NO: 4633372 - DNA, 20 bp, Homo sapiens
ctgggggcttttgccactcc

SEQ ID NO: 4633373 - DNA, 20 bp, Homo sapiens
ctggggtgaatacttatttt

SEQ ID NO: 4633374 - DNA, 23 bp, Homo sapiens
ctgggtaaaagcagggcagcagg

SEQ ID NO: 4633375 - DNA, 12 bp, Homo sapiens
ctgggtaggccc

SEQ ID NO: 4633376 - DNA, 16 bp, Homo sapiens
ctgggtaggccccaca

SEQ ID NO: 4633377 - DNA, 23 bp, Homo sapiens
ctgggtaggccccacaaggcctg

SEQ ID NO: 4633378 - DNA, 16 bp, Homo sapiens
ctgggtatgcgtttca

SEQ ID NO: 4633379 - DNA, 14 bp, Homo sapiens
ctgggtccatcctg

SEQ ID NO: 4633380 - DNA, 16 bp, Homo sapiens
ctgggtccatcctggt

SEQ ID NO: 4633381 - DNA, 14 bp, Homo sapiens
ctgggtgagaccca

SEQ ID NO: 4633382 - DNA, 17 bp, Homo sapiens
ctgggtgatctgctgct

SEQ ID NO: 4633383 - DNA, 20 bp, Homo sapiens
ctgggtgcatgatcttgagc

SEQ ID NO: 4633384 - DNA, 17 bp, Homo sapiens
ctgggtggctactctgt

SEQ ID NO: 4633385 - DNA, 22 bp, Homo sapiens
ctgggtggctactctgtgccag

SEQ ID NO: 4633386 - DNA, 20 bp, Homo sapiens
ctgggtgtcatttcattcca

SEQ ID NO: 4633387 - DNA, 21 bp, Homo sapiens
ctgggtgtcatttcattccat

SEQ ID NO: 4633388 - DNA, 16 bp, Homo sapiens
ctggtacctgccctct

SEQ ID NO: 4633389 - DNA, 17 bp, Homo sapiens
ctggtaggttgggacac

SEQ ID NO: 4633390 - DNA, 16 bp, Homo sapiens
ctggtcaacctcctgg

SEQ ID NO: 4633391 - DNA, 13 bp, Homo sapiens
ctggtcacctccc

SEQ ID NO: 4633392 - DNA, 20 bp, Homo sapiens
ctggtccgtgcgggaaattc

SEQ ID NO: 4633393 - DNA, 18 bp, Homo sapiens
ctggtcttgaactcctgg

SEQ ID NO: 4633394 - DNA, 22 bp, Homo sapiens
ctggtgagagggccgggcagag

SEQ ID NO: 4633395 - DNA, 23 bp, Homo sapiens
ctggtgagagggccgggcagagg

SEQ ID NO: 4633396 - DNA, 20 bp, Homo sapiens
ctggtggggcagctcctctg

SEQ ID NO: 4633397 - DNA, 16 bp, Homo sapiens
ctggtgtcataaactt

SEQ ID NO: 4633398 - DNA, 17 bp, Homo sapiens
ctggtgtctgctttctc

SEQ ID NO: 4633399 - DNA, 23 bp, Homo sapiens
ctggtgtgaggaccatgctgtga

SEQ ID NO: 4633400 - DNA, 17 bp, Homo sapiens
ctggttaccactctttt

SEQ ID NO: 4633401 - DNA, 21 bp, Homo sapiens
ctggttatcttgttattattg

SEQ ID NO: 4633402 - DNA, 17 bp, Homo sapiens
ctggttccttccttagt

SEQ ID NO: 4633403 - DNA, 14 bp, Homo sapiens
ctggttctaggctg

SEQ ID NO: 4633404 - DNA, 16 bp, Homo sapiens
ctggttctaggctgct

SEQ ID NO: 4633405 - DNA, 18 bp, Homo sapiens
ctggttctaggctgctgc

SEQ ID NO: 4633406 - DNA, 17 bp, Homo sapiens
ctggtttccctttattt

SEQ ID NO: 4633407 - DNA, 20 bp, Homo sapiens
ctgtaaacttggaatcaagg

SEQ ID NO: 4633408 - DNA, 18 bp, Homo sapiens
ctgtaaatttggcttctg

SEQ ID NO: 4633409 - DNA, 13 bp, Homo sapiens
ctgtaagggcagt

SEQ ID NO: 4633410 - DNA, 14 bp, Homo sapiens
ctgtaagggcagtg

SEQ ID NO: 4633411 - DNA, 18 bp, Homo sapiens
ctgtaagggcagtgccca

SEQ ID NO: 4633412 - DNA, 12 bp, Homo sapiens
ctgtaaggggca

SEQ ID NO: 4633413 - DNA, 21 bp, Homo sapiens
ctgtaatcccagtactttgga

SEQ ID NO: 4633414 - DNA, 22 bp, Homo sapiens
ctgtaatcccagtactttggaa

SEQ ID NO: 4633415 - DNA, 16 bp, Homo sapiens
ctgtaattgtgtgtga

SEQ ID NO: 4633416 - DNA, 16 bp, Homo sapiens
ctgtacattatgaaga

SEQ ID NO: 4633417 - DNA, 23 bp, Homo sapiens
ctgtaccatgtgctacaggggcc

SEQ ID NO: 4633418 - DNA, 16 bp, Homo sapiens
ctgtactattgcagac

SEQ ID NO: 4633419 - DNA, 14 bp, Homo sapiens
ctgtactgcctgct

SEQ ID NO: 4633420 - DNA, 18 bp, Homo sapiens
ctgtactgcctgcttggg

SEQ ID NO: 4633421 - DNA, 20 bp, Homo sapiens
ctgtagacactctgacaagc

SEQ ID NO: 4633422 - DNA, 21 bp, Homo sapiens
ctgtagacactctgacaagct

SEQ ID NO: 4633423 - DNA, 15 bp, Homo sapiens
ctgtagacaggaaag

SEQ ID NO: 4633424 - DNA, 22 bp, Homo sapiens
ctgtagtgagatagcattgtga

SEQ ID NO: 4633425 - DNA, 17 bp, Homo sapiens
ctgtatactgaaggtct

SEQ ID NO: 4633426 - DNA, 21 bp, Homo sapiens
ctgtatactgaaggtctgaca

SEQ ID NO: 4633427 - DNA, 15 bp, Homo sapiens
ctgtatccccagtgc

SEQ ID NO: 4633428 - DNA, 17 bp, Homo sapiens
ctgtatccccagtgccc

SEQ ID NO: 4633429 - DNA, 14 bp, Homo sapiens
ctgtatgacccctg

SEQ ID NO: 4633430 - DNA, 19 bp, Homo sapiens
ctgtatgacccctggccac

SEQ ID NO: 4633431 - DNA, 20 bp, Homo sapiens
ctgtatgacccctggccaca

SEQ ID NO: 4633432 - DNA, 21 bp, Homo sapiens
ctgtatgacccctggccacag

SEQ ID NO: 4633433 - DNA, 18 bp, Homo sapiens
ctgtatgggagcttaact

SEQ ID NO: 4633434 - DNA, 14 bp, Homo sapiens
ctgtattacagctt

SEQ ID NO: 4633435 - DNA, 21 bp, Homo sapiens
ctgtattactgaataatatca

SEQ ID NO: 4633436 - DNA, 23 bp, Homo sapiens
ctgtattactgaataatatcaaa

SEQ ID NO: 4633437 - DNA, 15 bp, Homo sapiens
ctgtcaccctgcagg

SEQ ID NO: 4633438 - DNA, 18 bp, Homo sapiens
ctgtcacctcgctgggct

SEQ ID NO: 4633439 - DNA, 19 bp, Homo sapiens
ctgtcacctcgctgggctc

SEQ ID NO: 4633440 - DNA, 17 bp, Homo sapiens
ctgtcacttcttcacct

SEQ ID NO: 4633441 - DNA, 23 bp, Homo sapiens
ctgtcacttcttcacctcttcca

SEQ ID NO: 4633442 - DNA, 17 bp, Homo sapiens
ctgtcacttgctgcttt

SEQ ID NO: 4633443 - DNA, 15 bp, Homo sapiens
ctgtcagtcacagcc

SEQ ID NO: 4633444 - DNA, 18 bp, Homo sapiens
ctgtcagtcacagccacc

SEQ ID NO: 4633445 - DNA, 22 bp, Homo sapiens
ctgtcagtgttaaagattttgt

SEQ ID NO: 4633446 - DNA, 21 bp, Homo sapiens
ctgtcatctgtgcactgccca

SEQ ID NO: 4633447 - DNA, 17 bp, Homo sapiens
ctgtcccaaggaggggg

SEQ ID NO: 4633448 - DNA, 17 bp, Homo sapiens
ctgtccccactgcccca

SEQ ID NO: 4633449 - DNA, 22 bp, Homo sapiens
ctgtcctagccaggtctcctgg

SEQ ID NO: 4633450 - DNA, 23 bp, Homo sapiens
ctgtcctccaacaccaagcacag

SEQ ID NO: 4633451 - DNA, 14 bp, Homo sapiens
ctgtcctgtcctgc

SEQ ID NO: 4633452 - DNA, 16 bp, Homo sapiens
ctgtcctgtcctgctc

SEQ ID NO: 4633453 - DNA, 16 bp, Homo sapiens
ctgtcctttcagtctg

SEQ ID NO: 4633454 - DNA, 21 bp, Homo sapiens
ctgtcctttcagtctgatcca

SEQ ID NO: 4633455 - DNA, 14 bp, Homo sapiens
ctgtcgctgcttcg

SEQ ID NO: 4633456 - DNA, 15 bp, Homo sapiens
ctgtctaacctgtga

SEQ ID NO: 4633457 - DNA, 12 bp, Homo sapiens
ctgtctcctggc

SEQ ID NO: 4633458 - DNA, 23 bp, Homo sapiens
ctgtctcgagcgccctgcagacc

SEQ ID NO: 4633459 - DNA, 11 bp, Homo sapiens
ctgtctctctc

SEQ ID NO: 4633460 - DNA, 16 bp, Homo sapiens
ctgtctgctctgcata

SEQ ID NO: 4633461 - DNA, 14 bp, Homo sapiens
ctgtctgtgaacag

SEQ ID NO: 4633462 - DNA, 16 bp, Homo sapiens
ctgtcttgttcatttt

SEQ ID NO: 4633463 - DNA, 17 bp, Homo sapiens
ctgtctttgcggggcct

SEQ ID NO: 4633464 - DNA, 17 bp, Homo sapiens
ctgtgaacagcttgctg

SEQ ID NO: 4633465 - DNA, 14 bp, Homo sapiens
ctgtgaacccagga

SEQ ID NO: 4633466 - DNA, 16 bp, Homo sapiens
ctgtgaacccaggaca

SEQ ID NO: 4633467 - DNA, 22 bp, Homo sapiens
ctgtgaacccaggacaagcatg

SEQ ID NO: 4633468 - DNA, 18 bp, Homo sapiens
ctgtgaatccatgggtct

SEQ ID NO: 4633469 - DNA, 22 bp, Homo sapiens
ctgtgaatccatgggtctggct

SEQ ID NO: 4633470 - DNA, 23 bp, Homo sapiens
ctgtgaccagtctgacccttaca

SEQ ID NO: 4633471 - DNA, 15 bp, Homo sapiens
ctgtgacccccagct

SEQ ID NO: 4633472 - DNA, 18 bp, Homo sapiens
ctgtgacccccagctccg

SEQ ID NO: 4633473 - DNA, 21 bp, Homo sapiens
ctgtgacccccagctccggcc

SEQ ID NO: 4633474 - DNA, 14 bp, Homo sapiens
ctgtgacctgctga

SEQ ID NO: 4633475 - DNA, 16 bp, Homo sapiens
ctgtgaggagtctggg

SEQ ID NO: 4633476 - DNA, 23 bp, Homo sapiens
ctgtgaggccatacttgtgaaac

SEQ ID NO: 4633477 - DNA, 20 bp, Homo sapiens
ctgtgatcaatatttttata

SEQ ID NO: 4633478 - DNA, 20 bp, Homo sapiens
ctgtgcacaaaacccagacc

SEQ ID NO: 4633479 - DNA, 14 bp, Homo sapiens
ctgtgcactgccca

SEQ ID NO: 4633480 - DNA, 21 bp, Homo sapiens
ctgtgcacttagccatgatgg

SEQ ID NO: 4633481 - DNA, 16 bp, Homo sapiens
ctgtgcatgtatgtct

SEQ ID NO: 4633482 - DNA, 12 bp, Homo sapiens
ctgtgccaacct

SEQ ID NO: 4633483 - DNA, 22 bp, Homo sapiens
ctgtgccacacttcgctcttga

SEQ ID NO: 4633484 - DNA, 13 bp, Homo sapiens
ctgtgccagagcc

SEQ ID NO: 4633485 - DNA, 17 bp, Homo sapiens
ctgtgccagagcctggg

SEQ ID NO: 4633486 - DNA, 19 bp, Homo sapiens
ctgtgccagagcctggggc

SEQ ID NO: 4633487 - DNA, 21 bp, Homo sapiens
ctgtgccagagcctggggctc

SEQ ID NO: 4633488 - DNA, 11 bp, Homo sapiens
ctgtgccagca

SEQ ID NO: 4633489 - DNA, 15 bp, Homo sapiens
ctgtgccatgctggg

SEQ ID NO: 4633490 - DNA, 16 bp, Homo sapiens
ctgtgccatgctgggc

SEQ ID NO: 4633491 - DNA, 17 bp, Homo sapiens
ctgtgcctgattatttt

SEQ ID NO: 4633492 - DNA, 16 bp, Homo sapiens
ctgtgcgtcccagctg

SEQ ID NO: 4633493 - DNA, 17 bp, Homo sapiens
ctgtgctacgtgtgaaa

SEQ ID NO: 4633494 - DNA, 17 bp, Homo sapiens
ctgtgctagaagctcca

SEQ ID NO: 4633495 - DNA, 14 bp, Homo sapiens
ctgtgcttccttgg

SEQ ID NO: 4633496 - DNA, 22 bp, Homo sapiens
ctgtgcttccttggttcatgct

SEQ ID NO: 4633497 - DNA, 21 bp, Homo sapiens
ctgtggaatgagtgtgcatgg

SEQ ID NO: 4633498 - DNA, 22 bp, Homo sapiens
ctgtggagctgccacagagaag

SEQ ID NO: 4633499 - DNA, 19 bp, Homo sapiens
ctgtggctccctctctcct

SEQ ID NO: 4633500 - DNA, 21 bp, Homo sapiens
ctgtggctccctctctcctgg

SEQ ID NO: 4633501 - DNA, 13 bp, Homo sapiens
ctgtgggagcctc

SEQ ID NO: 4633502 - DNA, 21 bp, Homo sapiens
ctgtggggtggacctgggaca

SEQ ID NO: 4633503 - DNA, 16 bp, Homo sapiens
ctgtgggtctctgaag

SEQ ID NO: 4633504 - DNA, 18 bp, Homo sapiens
ctgtggtgacttctgctg

SEQ ID NO: 4633505 - DNA, 14 bp, Homo sapiens
ctgtggttgcagtc

SEQ ID NO: 4633506 - DNA, 20 bp, Homo sapiens
ctgtggttgcagtctttccc

SEQ ID NO: 4633507 - DNA, 19 bp, Homo sapiens
ctgtggttttattacaaat

SEQ ID NO: 4633508 - DNA, 22 bp, Homo sapiens
ctgtggttttattacaaatgca

SEQ ID NO: 4633509 - DNA, 14 bp, Homo sapiens
ctgtgtacaaagaa

SEQ ID NO: 4633510 - DNA, 15 bp, Homo sapiens
ctgtgtagctgtgac

SEQ ID NO: 4633511 - DNA, 16 bp, Homo sapiens
ctgtgtagctgtgacc

SEQ ID NO: 4633512 - DNA, 18 bp, Homo sapiens
ctgtgtagctgtgacctg

SEQ ID NO: 4633513 - DNA, 22 bp, Homo sapiens
ctgtgtagctgtgacctgctga

SEQ ID NO: 4633514 - DNA, 21 bp, Homo sapiens
ctgtgtagttccctctgcctg

SEQ ID NO: 4633515 - DNA, 17 bp, Homo sapiens
ctgtgtccacctgtggg

SEQ ID NO: 4633516 - DNA, 16 bp, Homo sapiens
ctgtgtccctctctct

SEQ ID NO: 4633517 - DNA, 16 bp, Homo sapiens
ctgtgtctgaatcatg

SEQ ID NO: 4633518 - DNA, 21 bp, Homo sapiens
ctgtgtctgaatcatgtctgt

SEQ ID NO: 4633519 - DNA, 19 bp, Homo sapiens
ctgtgtctttaaatgctgc

SEQ ID NO: 4633520 - DNA, 20 bp, Homo sapiens
ctgtgtctttaaatgctgct

SEQ ID NO: 4633521 - DNA, 21 bp, Homo sapiens
ctgtgtctttaaatgctgctt

SEQ ID NO: 4633522 - DNA, 14 bp, Homo sapiens
ctgtgtgaatgtgg

SEQ ID NO: 4633523 - DNA, 17 bp, Homo sapiens
ctgtgtgaatgtgggca

SEQ ID NO: 4633524 - DNA, 17 bp, Homo sapiens
ctgtgtggcagttaatt

SEQ ID NO: 4633525 - DNA, 15 bp, Homo sapiens
ctgtgtggtgcattc

SEQ ID NO: 4633526 - DNA, 22 bp, Homo sapiens
ctgtgtggtgcattcctgaagt

SEQ ID NO: 4633527 - DNA, 13 bp, Homo sapiens
ctgtgtgtctgtc

SEQ ID NO: 4633528 - DNA, 14 bp, Homo sapiens
ctgtgttactgctt

SEQ ID NO: 4633529 - DNA, 15 bp, Homo sapiens
ctgtgttactgcttt

SEQ ID NO: 4633530 - DNA, 16 bp, Homo sapiens
ctgtgttactgctttg

SEQ ID NO: 4633531 - DNA, 14 bp, Homo sapiens
ctgtgttctttccc

SEQ ID NO: 4633532 - DNA, 22 bp, Homo sapiens
ctgtgttgccacagtagaactg

SEQ ID NO: 4633533 - DNA, 19 bp, Homo sapiens
ctgtgtttgatttgtctca

SEQ ID NO: 4633534 - DNA, 21 bp, Homo sapiens
ctgtgtttgatttgtctcata

SEQ ID NO: 4633535 - DNA, 13 bp, Homo sapiens
ctgttaaaacaac

SEQ ID NO: 4633536 - DNA, 13 bp, Homo sapiens
ctgttaaccattt

SEQ ID NO: 4633537 - DNA, 15 bp, Homo sapiens
ctgttagcagacagg

SEQ ID NO: 4633538 - DNA, 12 bp, Homo sapiens
ctgttcaatact

SEQ ID NO: 4633539 - DNA, 14 bp, Homo sapiens
ctgttcacagcttt

SEQ ID NO: 4633540 - DNA, 16 bp, Homo sapiens
ctgttcacagcttttc

SEQ ID NO: 4633541 - DNA, 17 bp, Homo sapiens
ctgttcatacactaacc

SEQ ID NO: 4633542 - DNA, 11 bp, Homo sapiens
ctgttccctat

SEQ ID NO: 4633543 - DNA, 21 bp, Homo sapiens
ctgttcctggctcagcctcaa

SEQ ID NO: 4633544 - DNA, 18 bp, Homo sapiens
ctgttctgaaatgttctt

SEQ ID NO: 4633545 - DNA, 18 bp, Homo sapiens
ctgttcttaagacgtgat

SEQ ID NO: 4633546 - DNA, 15 bp, Homo sapiens
ctgttcttagagtgt

SEQ ID NO: 4633547 - DNA, 19 bp, Homo sapiens
ctgttcttagagtgtagct

SEQ ID NO: 4633548 - DNA, 14 bp, Homo sapiens
ctgttcttttgcat

SEQ ID NO: 4633549 - DNA, 13 bp, Homo sapiens
ctgttgagggcct

SEQ ID NO: 4633550 - DNA, 20 bp, Homo sapiens
ctgttgcctcctctctccct

SEQ ID NO: 4633551 - DNA, 23 bp, Homo sapiens
ctgttgcctcctctctccctgcc

SEQ ID NO: 4633552 - DNA, 17 bp, Homo sapiens
ctgttgtcaccttcacc

SEQ ID NO: 4633553 - DNA, 21 bp, Homo sapiens
ctgttgtcaccttcacctcct

SEQ ID NO: 4633554 - DNA, 23 bp, Homo sapiens
ctgttgtcaccttcacctccttt

SEQ ID NO: 4633555 - DNA, 13 bp, Homo sapiens
ctgtttacaacat

SEQ ID NO: 4633556 - DNA, 16 bp, Homo sapiens
ctgtttcatagttttc

SEQ ID NO: 4633557 - DNA, 21 bp, Homo sapiens
ctgtttcatagttttctaaat

SEQ ID NO: 4633558 - DNA, 17 bp, Homo sapiens
ctgtttcatctcagctt

SEQ ID NO: 4633559 - DNA, 19 bp, Homo sapiens
ctgtttcatctcagctttt

SEQ ID NO: 4633560 - DNA, 20 bp, Homo sapiens
ctgtttcatctcagcttttg

SEQ ID NO: 4633561 - DNA, 13 bp, Homo sapiens
ctgtttccagggt

SEQ ID NO: 4633562 - DNA, 15 bp, Homo sapiens
ctgtttccagggtct

SEQ ID NO: 4633563 - DNA, 15 bp, Homo sapiens
ctgtttccctgctga

SEQ ID NO: 4633564 - DNA, 20 bp, Homo sapiens
ctgtttcctgacattgtctc

SEQ ID NO: 4633565 - DNA, 16 bp, Homo sapiens
ctgtttcctggcctca

SEQ ID NO: 4633566 - DNA, 11 bp, Homo sapiens
ctgtttctaag

SEQ ID NO: 4633567 - DNA, 14 bp, Homo sapiens
ctgtttctaagaaa

SEQ ID NO: 4633568 - DNA, 18 bp, Homo sapiens
ctgtttctaagaaaatgt

SEQ ID NO: 4633569 - DNA, 23 bp, Homo sapiens
ctgttttaatttatactggcatg

SEQ ID NO: 4633570 - DNA, 17 bp, Homo sapiens
ctgttttataattagtc

SEQ ID NO: 4633571 - DNA, 15 bp, Homo sapiens
ctgttttcaagtgta

SEQ ID NO: 4633572 - DNA, 13 bp, Homo sapiens
ctgttttctgctg

SEQ ID NO: 4633573 - DNA, 14 bp, Homo sapiens
ctgttttctgctgt

SEQ ID NO: 4633574 - DNA, 14 bp, Homo sapiens
ctgttttgaaaagt

SEQ ID NO: 4633575 - DNA, 14 bp, Homo sapiens
ctgttttgtaaagt

SEQ ID NO: 4633576 - DNA, 14 bp, Homo sapiens
cttaaaatggaatt

SEQ ID NO: 4633577 - DNA, 15 bp, Homo sapiens
cttaaagagggacag

SEQ ID NO: 4633578 - DNA, 15 bp, Homo sapiens
cttaaagagtgtggc

SEQ ID NO: 4633579 - DNA, 21 bp, Homo sapiens
cttaaagagtgtggcaaaata

SEQ ID NO: 4633580 - DNA, 14 bp, Homo sapiens
cttaaagcaaacta

SEQ ID NO: 4633581 - DNA, 15 bp, Homo sapiens
cttaaatattgtaat

SEQ ID NO: 4633582 - DNA, 22 bp, Homo sapiens
cttaaatattgtaatatgacag

SEQ ID NO: 4633583 - DNA, 21 bp, Homo sapiens
cttaaatttgatttacatata

SEQ ID NO: 4633584 - DNA, 20 bp, Homo sapiens
cttaacatacacgttaactg

SEQ ID NO: 4633585 - DNA, 23 bp, Homo sapiens
cttaacatacacgttaactgcag

SEQ ID NO: 4633586 - DNA, 13 bp, Homo sapiens
cttaacctgggac

SEQ ID NO: 4633587 - DNA, 19 bp, Homo sapiens
cttaactggcctaaatttc

SEQ ID NO: 4633588 - DNA, 20 bp, Homo sapiens
cttaagattaattttctctt

SEQ ID NO: 4633589 - DNA, 13 bp, Homo sapiens
cttaagccctggc

SEQ ID NO: 4633590 - DNA, 19 bp, Homo sapiens
cttaagtatatcatgtaaa

SEQ ID NO: 4633591 - DNA, 20 bp, Homo sapiens
cttaagtatatcatgtaaag

SEQ ID NO: 4633592 - DNA, 15 bp, Homo sapiens
cttaagttttacttg

SEQ ID NO: 4633593 - DNA, 14 bp, Homo sapiens
cttaatcattttca

SEQ ID NO: 4633594 - DNA, 20 bp, Homo sapiens
cttaatcattttcattccta

SEQ ID NO: 4633595 - DNA, 16 bp, Homo sapiens
cttaatcttctctctt

SEQ ID NO: 4633596 - DNA, 18 bp, Homo sapiens
cttaatcttctctcttga

SEQ ID NO: 4633597 - DNA, 19 bp, Homo sapiens
cttaatcttctctcttgat

SEQ ID NO: 4633598 - DNA, 14 bp, Homo sapiens
cttaatcttgcttt

SEQ ID NO: 4633599 - DNA, 16 bp, Homo sapiens
cttaatcttgctttct

SEQ ID NO: 4633600 - DNA, 20 bp, Homo sapiens
cttaatcttgctttctttag

SEQ ID NO: 4633601 - DNA, 13 bp, Homo sapiens
cttaatctttatt

SEQ ID NO: 4633602 - DNA, 18 bp, Homo sapiens
cttaatctttattttatt

SEQ ID NO: 4633603 - DNA, 12 bp, Homo sapiens
cttaatttgtaa

SEQ ID NO: 4633604 - DNA, 15 bp, Homo sapiens
cttaatttgtaaact

SEQ ID NO: 4633605 - DNA, 16 bp, Homo sapiens
cttaatttgtaaactt

SEQ ID NO: 4633606 - DNA, 13 bp, Homo sapiens
cttaattttacag

SEQ ID NO: 4633607 - DNA, 14 bp, Homo sapiens
cttaattttacagc

SEQ ID NO: 4633608 - DNA, 17 bp, Homo sapiens
cttacaatcgcaaatca

SEQ ID NO: 4633609 - DNA, 23 bp, Homo sapiens
cttacactcccccagccccagag

SEQ ID NO: 4633610 - DNA, 19 bp, Homo sapiens
cttacactgtttcatctca

SEQ ID NO: 4633611 - DNA, 15 bp, Homo sapiens
cttacagcctctgac

SEQ ID NO: 4633612 - DNA, 19 bp, Homo sapiens
cttaccattaacatttttt

SEQ ID NO: 4633613 - DNA, 16 bp, Homo sapiens
cttacctgtctctctc

SEQ ID NO: 4633614 - DNA, 15 bp, Homo sapiens
cttacggccctggcc

SEQ ID NO: 4633615 - DNA, 16 bp, Homo sapiens
cttacggccctggcct

SEQ ID NO: 4633616 - DNA, 17 bp, Homo sapiens
cttacggccctggcctt

SEQ ID NO: 4633617 - DNA, 12 bp, Homo sapiens
cttactaggaag

SEQ ID NO: 4633618 - DNA, 16 bp, Homo sapiens
cttactcctgtgggag

SEQ ID NO: 4633619 - DNA, 19 bp, Homo sapiens
cttacttggaactgaaggg

SEQ ID NO: 4633620 - DNA, 14 bp, Homo sapiens
cttagacctgccag

SEQ ID NO: 4633621 - DNA, 15 bp, Homo sapiens
cttagacctgccagc

SEQ ID NO: 4633622 - DNA, 17 bp, Homo sapiens
cttagaggttctgcctc

SEQ ID NO: 4633623 - DNA, 16 bp, Homo sapiens
cttagagtgtagctgt

SEQ ID NO: 4633624 - DNA, 13 bp, Homo sapiens
cttagccatgatg

SEQ ID NO: 4633625 - DNA, 18 bp, Homo sapiens
cttagccccattgctcca

SEQ ID NO: 4633626 - DNA, 14 bp, Homo sapiens
cttagctttacatt

SEQ ID NO: 4633627 - DNA, 16 bp, Homo sapiens
cttagctttacatttt

SEQ ID NO: 4633628 - DNA, 13 bp, Homo sapiens
cttagggcactgg

SEQ ID NO: 4633629 - DNA, 23 bp, Homo sapiens
cttaggtagtcatgctgtgcatt

SEQ ID NO: 4633630 - DNA, 19 bp, Homo sapiens
cttaggtcgcgctcttgca

SEQ ID NO: 4633631 - DNA, 16 bp, Homo sapiens
cttaggtcttcctgtg

SEQ ID NO: 4633632 - DNA, 18 bp, Homo sapiens
cttaggtcttcctgtggc

SEQ ID NO: 4633633 - DNA, 18 bp, Homo sapiens
cttagtaagtaatatcaa

SEQ ID NO: 4633634 - DNA, 16 bp, Homo sapiens
cttagtccagttgtgt

SEQ ID NO: 4633635 - DNA, 23 bp, Homo sapiens
cttagtccagttgtgttgacaca

SEQ ID NO: 4633636 - DNA, 15 bp, Homo sapiens
cttagtgactcttga

SEQ ID NO: 4633637 - DNA, 14 bp, Homo sapiens
cttagtgggccagg

SEQ ID NO: 4633638 - DNA, 21 bp, Homo sapiens
cttagtgggccagggctgccc

SEQ ID NO: 4633639 - DNA, 22 bp, Homo sapiens
cttataaactatttttttctta

SEQ ID NO: 4633640 - DNA, 17 bp, Homo sapiens
cttatagttaatatttt

SEQ ID NO: 4633641 - DNA, 19 bp, Homo sapiens
cttatagttaatattttgt

SEQ ID NO: 4633642 - DNA, 22 bp, Homo sapiens
cttatccttgggccataattat

SEQ ID NO: 4633643 - DNA, 23 bp, Homo sapiens
cttatgattcagattgttatcta

SEQ ID NO: 4633644 - DNA, 15 bp, Homo sapiens
cttatgtacagaaaa

SEQ ID NO: 4633645 - DNA, 21 bp, Homo sapiens
cttattaatcatacaaactct

SEQ ID NO: 4633646 - DNA, 14 bp, Homo sapiens
cttattcttaactt

SEQ ID NO: 4633647 - DNA, 22 bp, Homo sapiens
cttattgaaaaaaaaaatgttg

SEQ ID NO: 4633648 - DNA, 19 bp, Homo sapiens
cttattgggatatcatttt

SEQ ID NO: 4633649 - DNA, 23 bp, Homo sapiens
cttcaacagaccccctctagaaa

SEQ ID NO: 4633650 - DNA, 18 bp, Homo sapiens
cttcaagacgaggggcag

SEQ ID NO: 4633651 - DNA, 20 bp, Homo sapiens
cttcaagatgagcctgggct

SEQ ID NO: 4633652 - DNA, 21 bp, Homo sapiens
cttcaagatgagcctgggctc

SEQ ID NO: 4633653 - DNA, 13 bp, Homo sapiens
cttcacctcttcc

SEQ ID NO: 4633654 - DNA, 14 bp, Homo sapiens
cttcacctcttcca

SEQ ID NO: 4633655 - DNA, 14 bp, Homo sapiens
cttcactctccagg

SEQ ID NO: 4633656 - DNA, 20 bp, Homo sapiens
cttcagacacatgctatgtt

SEQ ID NO: 4633657 - DNA, 20 bp, Homo sapiens
cttcagcaagttagaactag

SEQ ID NO: 4633658 - DNA, 14 bp, Homo sapiens
cttcagcccccacc

SEQ ID NO: 4633659 - DNA, 15 bp, Homo sapiens
cttcagcccccacca

SEQ ID NO: 4633660 - DNA, 23 bp, Homo sapiens
cttcagcggatttggggattagg

SEQ ID NO: 4633661 - DNA, 17 bp, Homo sapiens
cttcagcgtaaaatggt

SEQ ID NO: 4633662 - DNA, 21 bp, Homo sapiens
cttcagtcagggtttgtcaga

SEQ ID NO: 4633663 - DNA, 15 bp, Homo sapiens
cttcagtgactcctg

SEQ ID NO: 4633664 - DNA, 21 bp, Homo sapiens
cttcagtgactcctgctggta

SEQ ID NO: 4633665 - DNA, 15 bp, Homo sapiens
cttcagttctctact

SEQ ID NO: 4633666 - DNA, 18 bp, Homo sapiens
cttcagttctctactccc

SEQ ID NO: 4633667 - DNA, 19 bp, Homo sapiens
cttcagttctctactccct

SEQ ID NO: 4633668 - DNA, 22 bp, Homo sapiens
cttcagttctctactccctctt

SEQ ID NO: 4633669 - DNA, 19 bp, Homo sapiens
cttcagttctgcttgctcc

SEQ ID NO: 4633670 - DNA, 21 bp, Homo sapiens
cttcataagatattctttaca

SEQ ID NO: 4633671 - DNA, 19 bp, Homo sapiens
cttcatctcccacctagca

SEQ ID NO: 4633672 - DNA, 17 bp, Homo sapiens
cttcatgtcctaaagaa

SEQ ID NO: 4633673 - DNA, 18 bp, Homo sapiens
cttcatgtcctaaagaag

SEQ ID NO: 4633674 - DNA, 13 bp, Homo sapiens
cttcatgtgaaca

SEQ ID NO: 4633675 - DNA, 15 bp, Homo sapiens
cttcatttcaatcat

SEQ ID NO: 4633676 - DNA, 16 bp, Homo sapiens
cttcatttcaatcatt

SEQ ID NO: 4633677 - DNA, 23 bp, Homo sapiens
cttcatttttaagaaaggaagca

SEQ ID NO: 4633678 - DNA, 17 bp, Homo sapiens
cttccaaataataaagt

SEQ ID NO: 4633679 - DNA, 19 bp, Homo sapiens
cttccaaataataaagtct

SEQ ID NO: 4633680 - DNA, 21 bp, Homo sapiens
cttccaacaaaagaaggtcaa

SEQ ID NO: 4633681 - DNA, 18 bp, Homo sapiens
cttccacctcacaactcc

SEQ ID NO: 4633682 - DNA, 18 bp, Homo sapiens
cttccacctcaccccact

SEQ ID NO: 4633683 - DNA, 16 bp, Homo sapiens
cttccagctagtgacc

SEQ ID NO: 4633684 - DNA, 16 bp, Homo sapiens
cttccaggaggacata

SEQ ID NO: 4633685 - DNA, 20 bp, Homo sapiens
cttccaggtggcccttcccg

SEQ ID NO: 4633686 - DNA, 19 bp, Homo sapiens
cttccatcccaaccagtgc

SEQ ID NO: 4633687 - DNA, 22 bp, Homo sapiens
cttccatcccaaccagtgccaa

SEQ ID NO: 4633688 - DNA, 13 bp, Homo sapiens
cttccatgctccc

SEQ ID NO: 4633689 - DNA, 14 bp, Homo sapiens
cttccatgctccca

SEQ ID NO: 4633690 - DNA, 17 bp, Homo sapiens
cttccatgctcccaact

SEQ ID NO: 4633691 - DNA, 22 bp, Homo sapiens
cttccattttcccccactactg

SEQ ID NO: 4633692 - DNA, 22 bp, Homo sapiens
cttccccagctcccccaggcag

SEQ ID NO: 4633693 - DNA, 23 bp, Homo sapiens
cttccccagctcccccaggcaga

SEQ ID NO: 4633694 - DNA, 20 bp, Homo sapiens
cttccccctcttcttctgaa

SEQ ID NO: 4633695 - DNA, 18 bp, Homo sapiens
cttccccctgcttccacc

SEQ ID NO: 4633696 - DNA, 13 bp, Homo sapiens
cttcccccttcca

SEQ ID NO: 4633697 - DNA, 11 bp, Homo sapiens
cttcccctggg

SEQ ID NO: 4633698 - DNA, 14 bp, Homo sapiens
cttcccctgggaac

SEQ ID NO: 4633699 - DNA, 15 bp, Homo sapiens
cttcccctgggaact

SEQ ID NO: 4633700 - DNA, 22 bp, Homo sapiens
cttcccctgggaactctcctgg

SEQ ID NO: 4633701 - DNA, 19 bp, Homo sapiens
cttccctaatagcttttta

SEQ ID NO: 4633702 - DNA, 20 bp, Homo sapiens
cttccctaatagctttttaa

SEQ ID NO: 4633703 - DNA, 16 bp, Homo sapiens
cttccctacacagggc

SEQ ID NO: 4633704 - DNA, 17 bp, Homo sapiens
cttccctacacagggcc

SEQ ID NO: 4633705 - DNA, 22 bp, Homo sapiens
cttccctataggaacagcccag

SEQ ID NO: 4633706 - DNA, 13 bp, Homo sapiens
cttccctctgcat

SEQ ID NO: 4633707 - DNA, 15 bp, Homo sapiens
cttccctctgcattg

SEQ ID NO: 4633708 - DNA, 21 bp, Homo sapiens
cttccctctgcattgacctgg

SEQ ID NO: 4633709 - DNA, 14 bp, Homo sapiens
cttcccttcctcag

SEQ ID NO: 4633710 - DNA, 16 bp, Homo sapiens
cttcccttcctcagca

SEQ ID NO: 4633711 - DNA, 17 bp, Homo sapiens
cttcccttgctcatgag

SEQ ID NO: 4633712 - DNA, 13 bp, Homo sapiens
cttccgctgaggg

SEQ ID NO: 4633713 - DNA, 14 bp, Homo sapiens
cttccgctgagggg

SEQ ID NO: 4633714 - DNA, 16 bp, Homo sapiens
cttccgctgaggggtc

SEQ ID NO: 4633715 - DNA, 17 bp, Homo sapiens
cttccgctttgaaagaa

SEQ ID NO: 4633716 - DNA, 19 bp, Homo sapiens
cttccgctttgaaagaagc

SEQ ID NO: 4633717 - DNA, 20 bp, Homo sapiens
cttccgctttgaaagaagca

SEQ ID NO: 4633718 - DNA, 18 bp, Homo sapiens
cttcctagaaagttctgt

SEQ ID NO: 4633719 - DNA, 13 bp, Homo sapiens
cttcctagtaagt

SEQ ID NO: 4633720 - DNA, 16 bp, Homo sapiens
cttcctcagcaggcca

SEQ ID NO: 4633721 - DNA, 12 bp, Homo sapiens
cttcctctgtga

SEQ ID NO: 4633722 - DNA, 16 bp, Homo sapiens
cttcctcttcctgccc

SEQ ID NO: 4633723 - DNA, 13 bp, Homo sapiens
cttcctgaagctg

SEQ ID NO: 4633724 - DNA, 12 bp, Homo sapiens
cttcctgactct

SEQ ID NO: 4633725 - DNA, 19 bp, Homo sapiens
cttcctgactctcacctgt

SEQ ID NO: 4633726 - DNA, 13 bp, Homo sapiens
cttcctgcccttg

SEQ ID NO: 4633727 - DNA, 15 bp, Homo sapiens
cttcctggacagctg

SEQ ID NO: 4633728 - DNA, 21 bp, Homo sapiens
cttcctggacagctgtgcctc

SEQ ID NO: 4633729 - DNA, 10 bp, Homo sapiens
cttcctgtgg

SEQ ID NO: 4633730 - DNA, 13 bp, Homo sapiens
cttcctgtggctc

SEQ ID NO: 4633731 - DNA, 15 bp, Homo sapiens
cttcctgtggctccc

SEQ ID NO: 4633732 - DNA, 16 bp, Homo sapiens
cttccttgaggggcag

SEQ ID NO: 4633733 - DNA, 13 bp, Homo sapiens
cttcctttgccct

SEQ ID NO: 4633734 - DNA, 19 bp, Homo sapiens
cttcctttgcccttcctcc

SEQ ID NO: 4633735 - DNA, 20 bp, Homo sapiens
cttcctttgcccttcctcct

SEQ ID NO: 4633736 - DNA, 13 bp, Homo sapiens
cttccttttaact

SEQ ID NO: 4633737 - DNA, 14 bp, Homo sapiens
cttcgaaaggcctt

SEQ ID NO: 4633738 - DNA, 18 bp, Homo sapiens
cttcgaaaggccttcaga

SEQ ID NO: 4633739 - DNA, 14 bp, Homo sapiens
cttcggggctggga

SEQ ID NO: 4633740 - DNA, 15 bp, Homo sapiens
cttcggggctgggaa

SEQ ID NO: 4633741 - DNA, 18 bp, Homo sapiens
cttctaaaatagcaataa

SEQ ID NO: 4633742 - DNA, 17 bp, Homo sapiens
cttctacccttttcctt

SEQ ID NO: 4633743 - DNA, 20 bp, Homo sapiens
cttctacccttttccttttt

SEQ ID NO: 4633744 - DNA, 15 bp, Homo sapiens
cttctaggaatggag

SEQ ID NO: 4633745 - DNA, 22 bp, Homo sapiens
cttctaggatagctaactgtaa

SEQ ID NO: 4633746 - DNA, 16 bp, Homo sapiens
cttctatcagactcag

SEQ ID NO: 4633747 - DNA, 20 bp, Homo sapiens
cttctatcagactcagtttt

SEQ ID NO: 4633748 - DNA, 18 bp, Homo sapiens
cttctattaatcaagaga

SEQ ID NO: 4633749 - DNA, 19 bp, Homo sapiens
cttctattaatcaagagaa

SEQ ID NO: 4633750 - DNA, 22 bp, Homo sapiens
cttctcacacacaactgtccat

SEQ ID NO: 4633751 - DNA, 22 bp, Homo sapiens
cttctcaggacacaggcctgtg

SEQ ID NO: 4633752 - DNA, 23 bp, Homo sapiens
cttctcaggacacaggcctgtgt

SEQ ID NO: 4633753 - DNA, 15 bp, Homo sapiens
cttctcagtttctgc

SEQ ID NO: 4633754 - DNA, 21 bp, Homo sapiens
cttctcagtttctgcctgggc

SEQ ID NO: 4633755 - DNA, 17 bp, Homo sapiens
cttctccattccctagc

SEQ ID NO: 4633756 - DNA, 13 bp, Homo sapiens
cttctcccaggcc

SEQ ID NO: 4633757 - DNA, 21 bp, Homo sapiens
cttctcccaggcctctgcccc

SEQ ID NO: 4633758 - DNA, 19 bp, Homo sapiens
cttctgaagatcagaacat

SEQ ID NO: 4633759 - DNA, 21 bp, Homo sapiens
cttctgactgccccctcctgt

SEQ ID NO: 4633760 - DNA, 22 bp, Homo sapiens
cttctgactgccccctcctgtg

SEQ ID NO: 4633761 - DNA, 18 bp, Homo sapiens
cttctgcaaagtggcagg

SEQ ID NO: 4633762 - DNA, 21 bp, Homo sapiens
cttctgcaaagtggcagggac

SEQ ID NO: 4633763 - DNA, 14 bp, Homo sapiens
cttctgctcagctc

SEQ ID NO: 4633764 - DNA, 16 bp, Homo sapiens
cttctgctcagctctg

SEQ ID NO: 4633765 - DNA, 18 bp, Homo sapiens
cttctgctcagctctggg

SEQ ID NO: 4633766 - DNA, 11 bp, Homo sapiens
cttctgctgct

SEQ ID NO: 4633767 - DNA, 23 bp, Homo sapiens
cttctgcttgtcccaaatccgcc

SEQ ID NO: 4633768 - DNA, 19 bp, Homo sapiens
cttctggtttccctttatt

SEQ ID NO: 4633769 - DNA, 22 bp, Homo sapiens
cttctgtggaagtagctttgaa

SEQ ID NO: 4633770 - DNA, 23 bp, Homo sapiens
cttctgtggaagtagctttgaac

SEQ ID NO: 4633771 - DNA, 19 bp, Homo sapiens
cttctgttgtcaccttcac

SEQ ID NO: 4633772 - DNA, 21 bp, Homo sapiens
cttcttaaatacaatcacatt

SEQ ID NO: 4633773 - DNA, 22 bp, Homo sapiens
cttcttacttggaactgaaggg

SEQ ID NO: 4633774 - DNA, 14 bp, Homo sapiens
cttcttagaatgtt

SEQ ID NO: 4633775 - DNA, 15 bp, Homo sapiens
cttcttatccttaca

SEQ ID NO: 4633776 - DNA, 17 bp, Homo sapiens
cttcttatccttacact

SEQ ID NO: 4633777 - DNA, 13 bp, Homo sapiens
cttcttcacctct

SEQ ID NO: 4633778 - DNA, 14 bp, Homo sapiens
cttcttcacctctt

SEQ ID NO: 4633779 - DNA, 17 bp, Homo sapiens
cttcttcacctcttcca

SEQ ID NO: 4633780 - DNA, 14 bp, Homo sapiens
cttcttcgttcctg

SEQ ID NO: 4633781 - DNA, 14 bp, Homo sapiens
cttcttctgaaaga

SEQ ID NO: 4633782 - DNA, 16 bp, Homo sapiens
cttcttctgaaagaat

SEQ ID NO: 4633783 - DNA, 21 bp, Homo sapiens
cttcttgtcagacataaagcc

SEQ ID NO: 4633784 - DNA, 21 bp, Homo sapiens
cttctttagaccctcgggccc

SEQ ID NO: 4633785 - DNA, 14 bp, Homo sapiens
cttcttttcctaac

SEQ ID NO: 4633786 - DNA, 19 bp, Homo sapiens
cttgaaagaagttttatgc

SEQ ID NO: 4633787 - DNA, 14 bp, Homo sapiens
cttgaaagaatttt

SEQ ID NO: 4633788 - DNA, 16 bp, Homo sapiens
cttgaaatattcagaa

SEQ ID NO: 4633789 - DNA, 19 bp, Homo sapiens
cttgaaatattcagaaatt

SEQ ID NO: 4633790 - DNA, 14 bp, Homo sapiens
cttgaaccccctcc

SEQ ID NO: 4633791 - DNA, 16 bp, Homo sapiens
cttgaaccccctccct

SEQ ID NO: 4633792 - DNA, 17 bp, Homo sapiens
cttgaagaaacagagtg

SEQ ID NO: 4633793 - DNA, 17 bp, Homo sapiens
cttgaagtacttaacat

SEQ ID NO: 4633794 - DNA, 18 bp, Homo sapiens
cttgaatgtggtctcagg

SEQ ID NO: 4633795 - DNA, 23 bp, Homo sapiens
cttgacagactgtagcttctctt

SEQ ID NO: 4633796 - DNA, 12 bp, Homo sapiens
cttgagctgtct

SEQ ID NO: 4633797 - DNA, 20 bp, Homo sapiens
cttgagctgtctgaagccca

SEQ ID NO: 4633798 - DNA, 13 bp, Homo sapiens
cttgaggagctca

SEQ ID NO: 4633799 - DNA, 12 bp, Homo sapiens
cttgaggggcag

SEQ ID NO: 4633800 - DNA, 22 bp, Homo sapiens
cttgaggggcagtttgggaagg

SEQ ID NO: 4633801 - DNA, 13 bp, Homo sapiens
cttgatcattccg

SEQ ID NO: 4633802 - DNA, 21 bp, Homo sapiens
cttgattgatttttaaagttt

SEQ ID NO: 4633803 - DNA, 17 bp, Homo sapiens
cttgatttcacatttct

SEQ ID NO: 4633804 - DNA, 19 bp, Homo sapiens
cttgcaaagcctttaaatt

SEQ ID NO: 4633805 - DNA, 15 bp, Homo sapiens
cttgcaatagtttgc

SEQ ID NO: 4633806 - DNA, 18 bp, Homo sapiens
cttgcacccgcaagtcaa

SEQ ID NO: 4633807 - DNA, 13 bp, Homo sapiens
cttgcatgcttgc

SEQ ID NO: 4633808 - DNA, 14 bp, Homo sapiens
cttgcattgcagag

SEQ ID NO: 4633809 - DNA, 16 bp, Homo sapiens
cttgccacccccagtt

SEQ ID NO: 4633810 - DNA, 18 bp, Homo sapiens
cttgccatttgtagcttt

SEQ ID NO: 4633811 - DNA, 23 bp, Homo sapiens
cttgcccaggtcaccaagcagtg

SEQ ID NO: 4633812 - DNA, 21 bp, Homo sapiens
cttgcccaggtgagggaagga

SEQ ID NO: 4633813 - DNA, 17 bp, Homo sapiens
cttgccgcgcctggctt

SEQ ID NO: 4633814 - DNA, 22 bp, Homo sapiens
cttgcctgaggggaaagagaga

SEQ ID NO: 4633815 - DNA, 13 bp, Homo sapiens
cttgctatgatga

SEQ ID NO: 4633816 - DNA, 19 bp, Homo sapiens
cttgctcattcttcagttc

SEQ ID NO: 4633817 - DNA, 21 bp, Homo sapiens
cttgctcccaatggtgcttgg

SEQ ID NO: 4633818 - DNA, 16 bp, Homo sapiens
cttgctgggcctgggg

SEQ ID NO: 4633819 - DNA, 21 bp, Homo sapiens
cttgctgtatgacccctggcc

SEQ ID NO: 4633820 - DNA, 12 bp, Homo sapiens
cttgctgtcact

SEQ ID NO: 4633821 - DNA, 15 bp, Homo sapiens
cttgcttccaagacc

SEQ ID NO: 4633822 - DNA, 16 bp, Homo sapiens
cttgcttccaagacca

SEQ ID NO: 4633823 - DNA, 19 bp, Homo sapiens
cttgcttctctagctctct

SEQ ID NO: 4633824 - DNA, 17 bp, Homo sapiens
cttgcttggaagccagg

SEQ ID NO: 4633825 - DNA, 15 bp, Homo sapiens
cttgctttcaattga

SEQ ID NO: 4633826 - DNA, 17 bp, Homo sapiens
cttgctttcctgggcct

SEQ ID NO: 4633827 - DNA, 24 bp, Homo sapiens
cttgctttcggagctcctgtccaa

SEQ ID NO: 4633828 - DNA, 13 bp, Homo sapiens
cttggacactgta

SEQ ID NO: 4633829 - DNA, 14 bp, Homo sapiens
cttggaggagagag

SEQ ID NO: 4633830 - DNA, 16 bp, Homo sapiens
cttggagggggaagag

SEQ ID NO: 4633831 - DNA, 17 bp, Homo sapiens
cttggagggggaagaga

SEQ ID NO: 4633832 - DNA, 16 bp, Homo sapiens
cttggcatgcatcttt

SEQ ID NO: 4633833 - DNA, 17 bp, Homo sapiens
cttggcatgcatcttta

SEQ ID NO: 4633834 - DNA, 16 bp, Homo sapiens
cttggctgcttcctgt

SEQ ID NO: 4633835 - DNA, 17 bp, Homo sapiens
cttggctgcttcctgtg

SEQ ID NO: 4633836 - DNA, 15 bp, Homo sapiens
cttggctttcatgtt

SEQ ID NO: 4633837 - DNA, 12 bp, Homo sapiens
cttgggaaatat

SEQ ID NO: 4633838 - DNA, 17 bp, Homo sapiens
cttgggcacccccagcc

SEQ ID NO: 4633839 - DNA, 20 bp, Homo sapiens
cttgggcacccccagcctgg

SEQ ID NO: 4633840 - DNA, 20 bp, Homo sapiens
cttgggcagagtcctgcctt

SEQ ID NO: 4633841 - DNA, 14 bp, Homo sapiens
cttgggccctctgg

SEQ ID NO: 4633842 - DNA, 17 bp, Homo sapiens
cttgggcctcaggctct

SEQ ID NO: 4633843 - DNA, 14 bp, Homo sapiens
cttgggctgaccca

SEQ ID NO: 4633844 - DNA, 16 bp, Homo sapiens
cttgggctgacccagc

SEQ ID NO: 4633845 - DNA, 17 bp, Homo sapiens
cttgggctgacccagca

SEQ ID NO: 4633846 - DNA, 17 bp, Homo sapiens
cttggggaaggggacag

SEQ ID NO: 4633847 - DNA, 19 bp, Homo sapiens
cttggggaggacaaaactt

SEQ ID NO: 4633848 - DNA, 23 bp, Homo sapiens
cttggggaggacaaaacttcttg

SEQ ID NO: 4633849 - DNA, 13 bp, Homo sapiens
cttggggggtgat

SEQ ID NO: 4633850 - DNA, 24 bp, Homo sapiens
cttggggggtgatgagggcagcag

SEQ ID NO: 4633851 - DNA, 19 bp, Homo sapiens
cttggttcatgcttctact

SEQ ID NO: 4633852 - DNA, 14 bp, Homo sapiens
cttggttctgaagc

SEQ ID NO: 4633853 - DNA, 15 bp, Homo sapiens
cttggttctgaagcc

SEQ ID NO: 4633854 - DNA, 15 bp, Homo sapiens
cttgtaaagactggt

SEQ ID NO: 4633855 - DNA, 13 bp, Homo sapiens
cttgtaaatatgg

SEQ ID NO: 4633856 - DNA, 20 bp, Homo sapiens
cttgtacatgtgtagcctgt

SEQ ID NO: 4633857 - DNA, 23 bp, Homo sapiens
cttgtacatgtgtagcctgtgca

SEQ ID NO: 4633858 - DNA, 22 bp, Homo sapiens
cttgtacccccaggtggaaggc

SEQ ID NO: 4633859 - DNA, 17 bp, Homo sapiens
cttgtagaactcactct

SEQ ID NO: 4633860 - DNA, 23 bp, Homo sapiens
cttgtagaactcactctgggctg

SEQ ID NO: 4633861 - DNA, 13 bp, Homo sapiens
cttgtagccagcc

SEQ ID NO: 4633862 - DNA, 21 bp, Homo sapiens
cttgtatgtaaggaggtttgt

SEQ ID NO: 4633863 - DNA, 23 bp, Homo sapiens
cttgtatgtaaggaggtttgtat

SEQ ID NO: 4633864 - DNA, 22 bp, Homo sapiens
cttgtattaagttgttaataaa

SEQ ID NO: 4633865 - DNA, 15 bp, Homo sapiens
cttgtcagacataaa

SEQ ID NO: 4633866 - DNA, 18 bp, Homo sapiens
cttgtcagacataaagcc

SEQ ID NO: 4633867 - DNA, 23 bp, Homo sapiens
cttgtcagggtctccttccttcc

SEQ ID NO: 4633868 - DNA, 12 bp, Homo sapiens
cttgtccagctg

SEQ ID NO: 4633869 - DNA, 19 bp, Homo sapiens
cttgtcccagaggctgccc

SEQ ID NO: 4633870 - DNA, 14 bp, Homo sapiens
cttgtccccaaatc

SEQ ID NO: 4633871 - DNA, 18 bp, Homo sapiens
cttgtcctttgaggcccc

SEQ ID NO: 4633872 - DNA, 17 bp, Homo sapiens
cttgtctgcctcctgct

SEQ ID NO: 4633873 - DNA, 22 bp, Homo sapiens
cttgtctgcctcctgctttggg

SEQ ID NO: 4633874 - DNA, 18 bp, Homo sapiens
cttgtcttttcaaaatat

SEQ ID NO: 4633875 - DNA, 17 bp, Homo sapiens
cttgtgaaacgtctgga

SEQ ID NO: 4633876 - DNA, 11 bp, Homo sapiens
cttgtgccata

SEQ ID NO: 4633877 - DNA, 17 bp, Homo sapiens
cttgtggagatcacagc

SEQ ID NO: 4633878 - DNA, 19 bp, Homo sapiens
cttgtgtatttctctgtga

SEQ ID NO: 4633879 - DNA, 12 bp, Homo sapiens
cttgtgtctgta

SEQ ID NO: 4633880 - DNA, 14 bp, Homo sapiens
cttgtgtctgtaca

SEQ ID NO: 4633881 - DNA, 18 bp, Homo sapiens
cttgtgtctgtacacgtg

SEQ ID NO: 4633882 - DNA, 20 bp, Homo sapiens
cttgtgttaacttgcctcca

SEQ ID NO: 4633883 - DNA, 21 bp, Homo sapiens
cttgtgttcagctctttccaa

SEQ ID NO: 4633884 - DNA, 14 bp, Homo sapiens
cttgttattattgt

SEQ ID NO: 4633885 - DNA, 22 bp, Homo sapiens
cttgttattattgttaataata

SEQ ID NO: 4633886 - DNA, 23 bp, Homo sapiens
cttgttcagcaggctagacagaa

SEQ ID NO: 4633887 - DNA, 16 bp, Homo sapiens
cttgttcattttgagt

SEQ ID NO: 4633888 - DNA, 13 bp, Homo sapiens
cttgttctatttt

SEQ ID NO: 4633889 - DNA, 19 bp, Homo sapiens
cttgttgaagtgctgtttt

SEQ ID NO: 4633890 - DNA, 20 bp, Homo sapiens
ctttaaaaaaaaatcttgtg

SEQ ID NO: 4633891 - DNA, 22 bp, Homo sapiens
ctttaaaaaggtgcactacagt

SEQ ID NO: 4633892 - DNA, 15 bp, Homo sapiens
ctttaaaagaatgac

SEQ ID NO: 4633893 - DNA, 14 bp, Homo sapiens
ctttaaatatcatt

SEQ ID NO: 4633894 - DNA, 15 bp, Homo sapiens
ctttaaatatcattc

SEQ ID NO: 4633895 - DNA, 16 bp, Homo sapiens
ctttaaatatcattct

SEQ ID NO: 4633896 - DNA, 18 bp, Homo sapiens
ctttaaatcctaccaaag

SEQ ID NO: 4633897 - DNA, 21 bp, Homo sapiens
ctttaaatgcaacagttttta

SEQ ID NO: 4633898 - DNA, 15 bp, Homo sapiens
ctttaagccaaagaa

SEQ ID NO: 4633899 - DNA, 16 bp, Homo sapiens
ctttaagccaaagaaa

SEQ ID NO: 4633900 - DNA, 19 bp, Homo sapiens
ctttaagccaaagaaacaa

SEQ ID NO: 4633901 - DNA, 17 bp, Homo sapiens
ctttaataaattgctta

SEQ ID NO: 4633902 - DNA, 23 bp, Homo sapiens
ctttaatagtcaccttcatgatt

SEQ ID NO: 4633903 - DNA, 24 bp, Homo sapiens
ctttaattccttatcctagccttt

SEQ ID NO: 4633904 - DNA, 14 bp, Homo sapiens
ctttacaaaccttt

SEQ ID NO: 4633905 - DNA, 21 bp, Homo sapiens
ctttacatctaagaatttttt

SEQ ID NO: 4633906 - DNA, 22 bp, Homo sapiens
ctttacattttcagtaccaaag

SEQ ID NO: 4633907 - DNA, 16 bp, Homo sapiens
ctttactattaaaata

SEQ ID NO: 4633908 - DNA, 20 bp, Homo sapiens
ctttagaccctcgggcccca

SEQ ID NO: 4633909 - DNA, 22 bp, Homo sapiens
ctttagtagtaacaaaagggtt

SEQ ID NO: 4633910 - DNA, 19 bp, Homo sapiens
ctttataacttaaatattg

SEQ ID NO: 4633911 - DNA, 13 bp, Homo sapiens
ctttatctgcacc

SEQ ID NO: 4633912 - DNA, 16 bp, Homo sapiens
ctttatgcaaatacaa

SEQ ID NO: 4633913 - DNA, 20 bp, Homo sapiens
ctttatgtagtttttatatg

SEQ ID NO: 4633914 - DNA, 16 bp, Homo sapiens
ctttattgcagaatgt

SEQ ID NO: 4633915 - DNA, 14 bp, Homo sapiens
ctttatttatttct

SEQ ID NO: 4633916 - DNA, 15 bp, Homo sapiens
ctttatttatttcta

SEQ ID NO: 4633917 - DNA, 20 bp, Homo sapiens
ctttatttctcttctaccct

SEQ ID NO: 4633918 - DNA, 18 bp, Homo sapiens
ctttattttattattcag

SEQ ID NO: 4633919 - DNA, 16 bp, Homo sapiens
ctttcaataaagttgt

SEQ ID NO: 4633920 - DNA, 22 bp, Homo sapiens
ctttcaataaagttgttgcatt

SEQ ID NO: 4633921 - DNA, 23 bp, Homo sapiens
ctttcaataaagttgttgcattc

SEQ ID NO: 4633922 - DNA, 20 bp, Homo sapiens
ctttcaattccaccagggcc

SEQ ID NO: 4633923 - DNA, 22 bp, Homo sapiens
ctttcacctgggtgtctgggct

SEQ ID NO: 4633924 - DNA, 17 bp, Homo sapiens
ctttcagtgcagtttct

SEQ ID NO: 4633925 - DNA, 17 bp, Homo sapiens
ctttcagttattaaatg

SEQ ID NO: 4633926 - DNA, 18 bp, Homo sapiens
ctttcatgttgcaaagaa

SEQ ID NO: 4633927 - DNA, 21 bp, Homo sapiens
ctttcattaaaggcttctctc

SEQ ID NO: 4633928 - DNA, 23 bp, Homo sapiens
ctttcattaaaggcttctctctc

SEQ ID NO: 4633929 - DNA, 11 bp, Homo sapiens
ctttccaaatt

SEQ ID NO: 4633930 - DNA, 14 bp, Homo sapiens
ctttccaaattaaa

SEQ ID NO: 4633931 - DNA, 22 bp, Homo sapiens
ctttccaaattaaaacaaatat

SEQ ID NO: 4633932 - DNA, 14 bp, Homo sapiens
ctttccaagcttgg

SEQ ID NO: 4633933 - DNA, 12 bp, Homo sapiens
ctttccaaggaa

SEQ ID NO: 4633934 - DNA, 14 bp, Homo sapiens
ctttccaaggaagc

SEQ ID NO: 4633935 - DNA, 17 bp, Homo sapiens
ctttccaaggaagcaga

SEQ ID NO: 4633936 - DNA, 16 bp, Homo sapiens
ctttccaatgccacag

SEQ ID NO: 4633937 - DNA, 17 bp, Homo sapiens
ctttccaatgccacaga

SEQ ID NO: 4633938 - DNA, 18 bp, Homo sapiens
ctttccaatgccacagac

SEQ ID NO: 4633939 - DNA, 19 bp, Homo sapiens
ctttccatctatcactgca

SEQ ID NO: 4633940 - DNA, 16 bp, Homo sapiens
ctttcccaccattcct

SEQ ID NO: 4633941 - DNA, 22 bp, Homo sapiens
ctttcccaccattcctgccttt

SEQ ID NO: 4633942 - DNA, 22 bp, Homo sapiens
ctttccccaaggacccagccct

SEQ ID NO: 4633943 - DNA, 15 bp, Homo sapiens
ctttcccccaggaaa

SEQ ID NO: 4633944 - DNA, 17 bp, Homo sapiens
ctttcccgcccagcctc

SEQ ID NO: 4633945 - DNA, 17 bp, Homo sapiens
ctttccttttttaaaaa

SEQ ID NO: 4633946 - DNA, 22 bp, Homo sapiens
ctttcgaaagcaatgcttctat

SEQ ID NO: 4633947 - DNA, 14 bp, Homo sapiens
ctttcggagctcct

SEQ ID NO: 4633948 - DNA, 15 bp, Homo sapiens
ctttctcaactgtcc

SEQ ID NO: 4633949 - DNA, 14 bp, Homo sapiens
ctttctcctctttg

SEQ ID NO: 4633950 - DNA, 17 bp, Homo sapiens
ctttctcctctttgaga

SEQ ID NO: 4633951 - DNA, 12 bp, Homo sapiens
ctttctctgcct

SEQ ID NO: 4633952 - DNA, 13 bp, Homo sapiens
ctttctctgcctg

SEQ ID NO: 4633953 - DNA, 13 bp, Homo sapiens
ctttctgggctct

SEQ ID NO: 4633954 - DNA, 19 bp, Homo sapiens
ctttctgggctctggactc

SEQ ID NO: 4633955 - DNA, 14 bp, Homo sapiens
ctttctgttcccta

SEQ ID NO: 4633956 - DNA, 12 bp, Homo sapiens
ctttctgtttcc

SEQ ID NO: 4633957 - DNA, 14 bp, Homo sapiens
ctttctgtttcctg

SEQ ID NO: 4633958 - DNA, 16 bp, Homo sapiens
ctttctgtttcctggc

SEQ ID NO: 4633959 - DNA, 22 bp, Homo sapiens
ctttctgtttcctggcctcaga

SEQ ID NO: 4633960 - DNA, 23 bp, Homo sapiens
ctttctgtttcctggcctcagag

SEQ ID NO: 4633961 - DNA, 12 bp, Homo sapiens
ctttgaaagaag

SEQ ID NO: 4633962 - DNA, 15 bp, Homo sapiens
ctttgaaagaagcaa

SEQ ID NO: 4633963 - DNA, 23 bp, Homo sapiens
ctttgaactagttttactttgaa

SEQ ID NO: 4633964 - DNA, 12 bp, Homo sapiens
ctttgaattttc

SEQ ID NO: 4633965 - DNA, 21 bp, Homo sapiens
ctttgacaattgggagctgcc

SEQ ID NO: 4633966 - DNA, 22 bp, Homo sapiens
ctttgacaattgggagctgcca

SEQ ID NO: 4633967 - DNA, 22 bp, Homo sapiens
ctttgacttcttgcttcagtca

SEQ ID NO: 4633968 - DNA, 17 bp, Homo sapiens
ctttgaggccccaactc

SEQ ID NO: 4633969 - DNA, 17 bp, Homo sapiens
ctttgcccttcctcctg

SEQ ID NO: 4633970 - DNA, 22 bp, Homo sapiens
ctttgcggggcctgtctcagtg

SEQ ID NO: 4633971 - DNA, 24 bp, Homo sapiens
ctttgctccttcagttctgcttgc

SEQ ID NO: 4633972 - DNA, 18 bp, Homo sapiens
ctttgctggaagaaacta

SEQ ID NO: 4633973 - DNA, 21 bp, Homo sapiens
ctttgctggaagaaactaaaa

SEQ ID NO: 4633974 - DNA, 20 bp, Homo sapiens
ctttggaaaatgcattgtat

SEQ ID NO: 4633975 - DNA, 18 bp, Homo sapiens
ctttggattgctggggcc

SEQ ID NO: 4633976 - DNA, 13 bp, Homo sapiens
ctttgtagctact

SEQ ID NO: 4633977 - DNA, 15 bp, Homo sapiens
ctttgtagctacttt

SEQ ID NO: 4633978 - DNA, 15 bp, Homo sapiens
ctttgtatcttaaat

SEQ ID NO: 4633979 - DNA, 17 bp, Homo sapiens
ctttgtccaaaggaaag

SEQ ID NO: 4633980 - DNA, 12 bp, Homo sapiens
ctttgtcttgga

SEQ ID NO: 4633981 - DNA, 22 bp, Homo sapiens
ctttgtgagccaaagcttatgt

SEQ ID NO: 4633982 - DNA, 13 bp, Homo sapiens
ctttgtgcattct

SEQ ID NO: 4633983 - DNA, 14 bp, Homo sapiens
ctttgtgcattctg

SEQ ID NO: 4633984 - DNA, 16 bp, Homo sapiens
ctttgtgttcatttca

SEQ ID NO: 4633985 - DNA, 18 bp, Homo sapiens
ctttgttagaaagtgctt

SEQ ID NO: 4633986 - DNA, 15 bp, Homo sapiens
ctttgttatgacagt

SEQ ID NO: 4633987 - DNA, 19 bp, Homo sapiens
cttttaaagaagctttatc

SEQ ID NO: 4633988 - DNA, 13 bp, Homo sapiens
cttttaaagtatt

SEQ ID NO: 4633989 - DNA, 21 bp, Homo sapiens
cttttaaagtatttataaaaa

SEQ ID NO: 4633990 - DNA, 14 bp, Homo sapiens
cttttaaggtttca

SEQ ID NO: 4633991 - DNA, 21 bp, Homo sapiens
cttttaaggtttcaacaaatt

SEQ ID NO: 4633992 - DNA, 19 bp, Homo sapiens
cttttaatggatgtataat

SEQ ID NO: 4633993 - DNA, 15 bp, Homo sapiens
cttttagaaatgcat

SEQ ID NO: 4633994 - DNA, 17 bp, Homo sapiens
cttttagaaatgcatat

SEQ ID NO: 4633995 - DNA, 16 bp, Homo sapiens
cttttagtagagacag

SEQ ID NO: 4633996 - DNA, 15 bp, Homo sapiens
cttttataaggaaac

SEQ ID NO: 4633997 - DNA, 23 bp, Homo sapiens
cttttattattattattgctgaa

SEQ ID NO: 4633998 - DNA, 15 bp, Homo sapiens
cttttatttaacaaa

SEQ ID NO: 4633999 - DNA, 22 bp, Homo sapiens
cttttatttaacaaaaaatgta

SEQ ID NO: 4634000 - DNA, 19 bp, Homo sapiens
cttttatttggtgtgttcg

SEQ ID NO: 4634001 - DNA, 16 bp, Homo sapiens
cttttcccccaccctc

SEQ ID NO: 4634002 - DNA, 19 bp, Homo sapiens
cttttcctaacatgcacct

SEQ ID NO: 4634003 - DNA, 21 bp, Homo sapiens
cttttcctggacttaaagaaa

SEQ ID NO: 4634004 - DNA, 17 bp, Homo sapiens
cttttctgccactccat

SEQ ID NO: 4634005 - DNA, 18 bp, Homo sapiens
cttttctgtctctctctt

SEQ ID NO: 4634006 - DNA, 13 bp, Homo sapiens
cttttgccactcc

SEQ ID NO: 4634007 - DNA, 12 bp, Homo sapiens
cttttgctgtgc

SEQ ID NO: 4634008 - DNA, 23 bp, Homo sapiens
cttttggagaaccagggctcttc

SEQ ID NO: 4634009 - DNA, 19 bp, Homo sapiens
cttttggcagttctgataa

SEQ ID NO: 4634010 - DNA, 20 bp, Homo sapiens
cttttgttctactccttccc

SEQ ID NO: 4634011 - DNA, 14 bp, Homo sapiens
cttttgttctctga

SEQ ID NO: 4634012 - DNA, 13 bp, Homo sapiens
ctttttcatcctt

SEQ ID NO: 4634013 - DNA, 21 bp, Homo sapiens
ctttttcatttaactttataa

SEQ ID NO: 4634014 - DNA, 17 bp, Homo sapiens
ctttttcattttccaat

SEQ ID NO: 4634015 - DNA, 18 bp, Homo sapiens
ctttttcattttccaata

SEQ ID NO: 4634016 - DNA, 13 bp, Homo sapiens
ctttttgctgtgt

SEQ ID NO: 4634017 - DNA, 13 bp, Homo sapiens
ctttttggcctgt

SEQ ID NO: 4634018 - DNA, 13 bp, Homo sapiens
ctttttgtaaata

SEQ ID NO: 4634019 - DNA, 17 bp, Homo sapiens
cttttttaaatattttc

SEQ ID NO: 4634020 - DNA, 18 bp, Homo sapiens
cttttttgtttgtttctt

SEQ ID NO: 4634021 - DNA, 20 bp, Homo sapiens
ctttttttttttttttaatg

SEQ ID NO: 4634022 - DNA, 16 bp, Homo sapiens
gaaaaaaaaaatgttg

SEQ ID NO: 4634023 - DNA, 19 bp, Homo sapiens
gaaaaactctttattttcc

SEQ ID NO: 4634024 - DNA, 19 bp, Homo sapiens
gaaaaatagagcaaaatca

SEQ ID NO: 4634025 - DNA, 12 bp, Homo sapiens
gaaaactgtgtt

SEQ ID NO: 4634026 - DNA, 22 bp, Homo sapiens
gaaaagagggagaagaaagaaa

SEQ ID NO: 4634027 - DNA, 16 bp, Homo sapiens
gaaaaggcctggggtg

SEQ ID NO: 4634028 - DNA, 18 bp, Homo sapiens
gaaaagggcactcccaac

SEQ ID NO: 4634029 - DNA, 21 bp, Homo sapiens
gaaaagggtcttgggaaatat

SEQ ID NO: 4634030 - DNA, 13 bp, Homo sapiens
gaaaagtttccta

SEQ ID NO: 4634031 - DNA, 22 bp, Homo sapiens
gaaaagtttcctaggatgtcat

SEQ ID NO: 4634032 - DNA, 21 bp, Homo sapiens
gaaaatgaaagtgttaatttt

SEQ ID NO: 4634033 - DNA, 22 bp, Homo sapiens
gaaaatgaaagtgttaatttta

SEQ ID NO: 4634034 - DNA, 16 bp, Homo sapiens
gaaaatgaatccctct

SEQ ID NO: 4634035 - DNA, 14 bp, Homo sapiens
gaaaatgacttatt

SEQ ID NO: 4634036 - DNA, 17 bp, Homo sapiens
gaaaatgacttatttct

SEQ ID NO: 4634037 - DNA, 23 bp, Homo sapiens
gaaaatgcttattgatgaggttt

SEQ ID NO: 4634038 - DNA, 17 bp, Homo sapiens
gaaaattatttgtatga

SEQ ID NO: 4634039 - DNA, 21 bp, Homo sapiens
gaaaattctaacccaagacat

SEQ ID NO: 4634040 - DNA, 21 bp, Homo sapiens
gaaaattggcagtggcagaga

SEQ ID NO: 4634041 - DNA, 21 bp, Homo sapiens
gaaaatttacaaaatttattc

SEQ ID NO: 4634042 - DNA, 22 bp, Homo sapiens
gaaaatttacaaaatttattct

SEQ ID NO: 4634043 - DNA, 12 bp, Homo sapiens
gaaacaaagaag

SEQ ID NO: 4634044 - DNA, 14 bp, Homo sapiens
gaaacaagctgtgc

SEQ ID NO: 4634045 - DNA, 22 bp, Homo sapiens
gaaacaagctgtgcaggcatgg

SEQ ID NO: 4634046 - DNA, 22 bp, Homo sapiens
gaaacacagcttacaatcgcaa

SEQ ID NO: 4634047 - DNA, 18 bp, Homo sapiens
gaaacaccacttaatctt

SEQ ID NO: 4634048 - DNA, 21 bp, Homo sapiens
gaaacagagtggcctccctgc

SEQ ID NO: 4634049 - DNA, 16 bp, Homo sapiens
gaaacagcatattagc

SEQ ID NO: 4634050 - DNA, 17 bp, Homo sapiens
gaaacagctcagccagt

SEQ ID NO: 4634051 - DNA, 17 bp, Homo sapiens
gaaacagttgctgtgaa

SEQ ID NO: 4634052 - DNA, 12 bp, Homo sapiens
gaaacattgtaa

SEQ ID NO: 4634053 - DNA, 14 bp, Homo sapiens
gaaacatttatatt

SEQ ID NO: 4634054 - DNA, 18 bp, Homo sapiens
gaaacctggggtgaatac

SEQ ID NO: 4634055 - DNA, 18 bp, Homo sapiens
gaaacctgtcattgtatt

SEQ ID NO: 4634056 - DNA, 19 bp, Homo sapiens
gaaacgtgttgtatctaca

SEQ ID NO: 4634057 - DNA, 15 bp, Homo sapiens
gaaactaaaaatata

SEQ ID NO: 4634058 - DNA, 20 bp, Homo sapiens
gaaactaaaaatatagcaaa

SEQ ID NO: 4634059 - DNA, 18 bp, Homo sapiens
gaaactcatagacactga

SEQ ID NO: 4634060 - DNA, 19 bp, Homo sapiens
gaaacttacactgtttcat

SEQ ID NO: 4634061 - DNA, 11 bp, Homo sapiens
gaaacttctga

SEQ ID NO: 4634062 - DNA, 13 bp, Homo sapiens
gaaagaagcaaga

SEQ ID NO: 4634063 - DNA, 16 bp, Homo sapiens
gaaagaagcaagacac

SEQ ID NO: 4634064 - DNA, 20 bp, Homo sapiens
gaaagaatcagtaggaccag

SEQ ID NO: 4634065 - DNA, 18 bp, Homo sapiens
gaaagaccctgatgcagg

SEQ ID NO: 4634066 - DNA, 19 bp, Homo sapiens
gaaagagctgcctggatga

SEQ ID NO: 4634067 - DNA, 15 bp, Homo sapiens
gaaagcctaaaattg

SEQ ID NO: 4634068 - DNA, 14 bp, Homo sapiens
gaaaggaaaagagg

SEQ ID NO: 4634069 - DNA, 17 bp, Homo sapiens
gaaaggaagcaacagat

SEQ ID NO: 4634070 - DNA, 22 bp, Homo sapiens
gaaaggagcctaggccaggtgc

SEQ ID NO: 4634071 - DNA, 19 bp, Homo sapiens
gaaaggaggaccagtcagg

SEQ ID NO: 4634072 - DNA, 16 bp, Homo sapiens
gaaaggccttcagaca

SEQ ID NO: 4634073 - DNA, 19 bp, Homo sapiens
gaaaggccttcagacacat

SEQ ID NO: 4634074 - DNA, 15 bp, Homo sapiens
gaaagggacccacct

SEQ ID NO: 4634075 - DNA, 18 bp, Homo sapiens
gaaagggacccacctgct

SEQ ID NO: 4634076 - DNA, 17 bp, Homo sapiens
gaaagggagatgtcagg

SEQ ID NO: 4634077 - DNA, 19 bp, Homo sapiens
gaaagggagatgtcaggat

SEQ ID NO: 4634078 - DNA, 15 bp, Homo sapiens
gaaagggagggctct

SEQ ID NO: 4634079 - DNA, 16 bp, Homo sapiens
gaaagggagggctctg

SEQ ID NO: 4634080 - DNA, 17 bp, Homo sapiens
gaaagggagggctctga

SEQ ID NO: 4634081 - DNA, 12 bp, Homo sapiens
gaaagggcactt

SEQ ID NO: 4634082 - DNA, 16 bp, Homo sapiens
gaaagggcacttaatt

SEQ ID NO: 4634083 - DNA, 21 bp, Homo sapiens
gaaagggcacttaatttgtaa

SEQ ID NO: 4634084 - DNA, 14 bp, Homo sapiens
gaaaggggttgggg

SEQ ID NO: 4634085 - DNA, 16 bp, Homo sapiens
gaaaggtgtgaacagc

SEQ ID NO: 4634086 - DNA, 18 bp, Homo sapiens
gaaagtcagctcttgtca

SEQ ID NO: 4634087 - DNA, 13 bp, Homo sapiens
gaaagttcatgct

SEQ ID NO: 4634088 - DNA, 17 bp, Homo sapiens
gaaataaaaggaagcca

SEQ ID NO: 4634089 - DNA, 18 bp, Homo sapiens
gaaataaaaggaagccaa

SEQ ID NO: 4634090 - DNA, 18 bp, Homo sapiens
gaaataacaaaatggaca

SEQ ID NO: 4634091 - DNA, 19 bp, Homo sapiens
gaaataacaaaatggacat

SEQ ID NO: 4634092 - DNA, 18 bp, Homo sapiens
gaaataacagagagaatg

SEQ ID NO: 4634093 - DNA, 15 bp, Homo sapiens
gaaatagttgtctgt

SEQ ID NO: 4634094 - DNA, 17 bp, Homo sapiens
gaaatagttgtctgtgc

SEQ ID NO: 4634095 - DNA, 14 bp, Homo sapiens
gaaatatgaatgcc

SEQ ID NO: 4634096 - DNA, 16 bp, Homo sapiens
gaaatattcagaaatt

SEQ ID NO: 4634097 - DNA, 15 bp, Homo sapiens
gaaatctgtctttgc

SEQ ID NO: 4634098 - DNA, 15 bp, Homo sapiens
gaaatcttttacatt

SEQ ID NO: 4634099 - DNA, 14 bp, Homo sapiens
gaaatgaggtgcca

SEQ ID NO: 4634100 - DNA, 19 bp, Homo sapiens
gaaatgctgggctgacggt

SEQ ID NO: 4634101 - DNA, 14 bp, Homo sapiens
gaaatgtacacttt

SEQ ID NO: 4634102 - DNA, 17 bp, Homo sapiens
gaaatgtacacttttta

SEQ ID NO: 4634103 - DNA, 21 bp, Homo sapiens
gaaatgtacactttttacagc

SEQ ID NO: 4634104 - DNA, 23 bp, Homo sapiens
gaaatgtttaataaagctttata

SEQ ID NO: 4634105 - DNA, 12 bp, Homo sapiens
gaaattaacaca

SEQ ID NO: 4634106 - DNA, 23 bp, Homo sapiens
gaaattaagactttatgtagttt

SEQ ID NO: 4634107 - DNA, 16 bp, Homo sapiens
gaaattctttcagcta

SEQ ID NO: 4634108 - DNA, 13 bp, Homo sapiens
gaaattgacagat

SEQ ID NO: 4634109 - DNA, 16 bp, Homo sapiens
gaaattggaagagcac

SEQ ID NO: 4634110 - DNA, 17 bp, Homo sapiens
gaaatttttcagatgct

SEQ ID NO: 4634111 - DNA, 15 bp, Homo sapiens
gaaattttttagtat

SEQ ID NO: 4634112 - DNA, 19 bp, Homo sapiens
gaacaaaactgttcttttg

SEQ ID NO: 4634113 - DNA, 14 bp, Homo sapiens
gaacaaagcagcca

SEQ ID NO: 4634114 - DNA, 18 bp, Homo sapiens
gaacagaactggaggcag

SEQ ID NO: 4634115 - DNA, 19 bp, Homo sapiens
gaacagggttactgtatac

SEQ ID NO: 4634116 - DNA, 19 bp, Homo sapiens
gaacaggttcttaaaaagg

SEQ ID NO: 4634117 - DNA, 19 bp, Homo sapiens
gaacagtggttgcctgggg

SEQ ID NO: 4634118 - DNA, 20 bp, Homo sapiens
gaacagtggttgcctggggg

SEQ ID NO: 4634119 - DNA, 14 bp, Homo sapiens
gaacatacatgata

SEQ ID NO: 4634120 - DNA, 13 bp, Homo sapiens
gaacatactgttc

SEQ ID NO: 4634121 - DNA, 15 bp, Homo sapiens
gaacatactgttctc

SEQ ID NO: 4634122 - DNA, 14 bp, Homo sapiens
gaacatctcttgaa

SEQ ID NO: 4634123 - DNA, 18 bp, Homo sapiens
gaacatcttcatataaac

SEQ ID NO: 4634124 - DNA, 14 bp, Homo sapiens
gaacattcagctct

SEQ ID NO: 4634125 - DNA, 20 bp, Homo sapiens
gaacattcagctctggagaa

SEQ ID NO: 4634126 - DNA, 23 bp, Homo sapiens
gaaccaaatggttcttacttttc

SEQ ID NO: 4634127 - DNA, 16 bp, Homo sapiens
gaaccagtacctcagt

SEQ ID NO: 4634128 - DNA, 17 bp, Homo sapiens
gaacccaccaaccagaa

SEQ ID NO: 4634129 - DNA, 23 bp, Homo sapiens
gaaccccctccctgtcccagggc

SEQ ID NO: 4634130 - DNA, 14 bp, Homo sapiens
gaaccctgccctgc

SEQ ID NO: 4634131 - DNA, 16 bp, Homo sapiens
gaaccctgccctgctc

SEQ ID NO: 4634132 - DNA, 21 bp, Homo sapiens
gaaccctgccctgctctgccc

SEQ ID NO: 4634133 - DNA, 13 bp, Homo sapiens
gaaccgcccagtg

SEQ ID NO: 4634134 - DNA, 13 bp, Homo sapiens
gaacctcctctgt

SEQ ID NO: 4634135 - DNA, 16 bp, Homo sapiens
gaacctcctctgtgaa

SEQ ID NO: 4634136 - DNA, 14 bp, Homo sapiens
gaacctggccttca

SEQ ID NO: 4634137 - DNA, 13 bp, Homo sapiens
gaacctgggcact

SEQ ID NO: 4634138 - DNA, 13 bp, Homo sapiens
gaaccttgttatt

SEQ ID NO: 4634139 - DNA, 16 bp, Homo sapiens
gaacgtggctctgctg

SEQ ID NO: 4634140 - DNA, 19 bp, Homo sapiens
gaacgtggtctgattttga

SEQ ID NO: 4634141 - DNA, 19 bp, Homo sapiens
gaacgttttttcctcagtg

SEQ ID NO: 4634142 - DNA, 17 bp, Homo sapiens
gaactaggctgagcaat

SEQ ID NO: 4634143 - DNA, 14 bp, Homo sapiens
gaactcactctggg

SEQ ID NO: 4634144 - DNA, 20 bp, Homo sapiens
gaactctcccctccccatct

SEQ ID NO: 4634145 - DNA, 23 bp, Homo sapiens
gaactctcccctccccatctgtg

SEQ ID NO: 4634146 - DNA, 19 bp, Homo sapiens
gaactgaagggggcggcct

SEQ ID NO: 4634147 - DNA, 22 bp, Homo sapiens
gaactgattgctcccaggatct

SEQ ID NO: 4634148 - DNA, 13 bp, Homo sapiens
gaactgcttcatg

SEQ ID NO: 4634149 - DNA, 14 bp, Homo sapiens
gaactggccaagct

SEQ ID NO: 4634150 - DNA, 12 bp, Homo sapiens
gaactgtgtgtg

SEQ ID NO: 4634151 - DNA, 13 bp, Homo sapiens
gaacttatgtaca

SEQ ID NO: 4634152 - DNA, 21 bp, Homo sapiens
gaacttcaagatgagcctggg

SEQ ID NO: 4634153 - DNA, 22 bp, Homo sapiens
gaacttcaagatgagcctgggc

SEQ ID NO: 4634154 - DNA, 14 bp, Homo sapiens
gaacttctagctca

SEQ ID NO: 4634155 - DNA, 15 bp, Homo sapiens
gaacttttctgtaat

SEQ ID NO: 4634156 - DNA, 18 bp, Homo sapiens
gaagaaactttctggtgc

SEQ ID NO: 4634157 - DNA, 21 bp, Homo sapiens
gaagaaagggtgtttttctgt

SEQ ID NO: 4634158 - DNA, 17 bp, Homo sapiens
gaagaaagtcaaaaaat

SEQ ID NO: 4634159 - DNA, 16 bp, Homo sapiens
gaagaacaagaaatgg

SEQ ID NO: 4634160 - DNA, 22 bp, Homo sapiens
gaagaacgttttttcctcagtg

SEQ ID NO: 4634161 - DNA, 20 bp, Homo sapiens
gaagaattttatttttctgt

SEQ ID NO: 4634162 - DNA, 19 bp, Homo sapiens
gaagacattttctcttaga

SEQ ID NO: 4634163 - DNA, 19 bp, Homo sapiens
gaagacgcagagcaaatga

SEQ ID NO: 4634164 - DNA, 20 bp, Homo sapiens
gaagacgggaggggaggcat

SEQ ID NO: 4634165 - DNA, 13 bp, Homo sapiens
gaagactgagaac

SEQ ID NO: 4634166 - DNA, 17 bp, Homo sapiens
gaagactttgtgactgt

SEQ ID NO: 4634167 - DNA, 15 bp, Homo sapiens
gaagagacagcccag

SEQ ID NO: 4634168 - DNA, 22 bp, Homo sapiens
gaagagaggaaataacagagag

SEQ ID NO: 4634169 - DNA, 17 bp, Homo sapiens
gaagagatcccaggagg

SEQ ID NO: 4634170 - DNA, 19 bp, Homo sapiens
gaagagatcccaggaggtg

SEQ ID NO: 4634171 - DNA, 11 bp, Homo sapiens
gaagagccacc

SEQ ID NO: 4634172 - DNA, 16 bp, Homo sapiens
gaagagccacctgcaa

SEQ ID NO: 4634173 - DNA, 23 bp, Homo sapiens
gaagagccacctgcaagatggac

SEQ ID NO: 4634174 - DNA, 12 bp, Homo sapiens
gaagaggagatg

SEQ ID NO: 4634175 - DNA, 16 bp, Homo sapiens
gaagaggggcagcttt

SEQ ID NO: 4634176 - DNA, 22 bp, Homo sapiens
gaagagtcttggtttctctcta

SEQ ID NO: 4634177 - DNA, 16 bp, Homo sapiens
gaagatggcatcctgt

SEQ ID NO: 4634178 - DNA, 19 bp, Homo sapiens
gaagcaacagatagatgtt

SEQ ID NO: 4634179 - DNA, 22 bp, Homo sapiens
gaagcaacattttagctctatt

SEQ ID NO: 4634180 - DNA, 19 bp, Homo sapiens
gaagcaagacacgtggcct

SEQ ID NO: 4634181 - DNA, 19 bp, Homo sapiens
gaagcaaggagaaaatata

SEQ ID NO: 4634182 - DNA, 18 bp, Homo sapiens
gaagcaataaagaagagt

SEQ ID NO: 4634183 - DNA, 17 bp, Homo sapiens
gaagcacagctcctgcc

SEQ ID NO: 4634184 - DNA, 12 bp, Homo sapiens
gaagcaggttcc

SEQ ID NO: 4634185 - DNA, 13 bp, Homo sapiens
gaagccaaagagt

SEQ ID NO: 4634186 - DNA, 17 bp, Homo sapiens
gaagccacctcaccaag

SEQ ID NO: 4634187 - DNA, 10 bp, Homo sapiens
gaagccagcc

SEQ ID NO: 4634188 - DNA, 12 bp, Homo sapiens
gaagccagccac

SEQ ID NO: 4634189 - DNA, 17 bp, Homo sapiens
gaagccagccacagacc

SEQ ID NO: 4634190 - DNA, 22 bp, Homo sapiens
gaagccagccacagacccctgg

SEQ ID NO: 4634191 - DNA, 17 bp, Homo sapiens
gaagccaggtacaggag

SEQ ID NO: 4634192 - DNA, 18 bp, Homo sapiens
gaagccaggtacaggaga

SEQ ID NO: 4634193 - DNA, 19 bp, Homo sapiens
gaagccatttagagggtga

SEQ ID NO: 4634194 - DNA, 13 bp, Homo sapiens
gaagccgactctg

SEQ ID NO: 4634195 - DNA, 17 bp, Homo sapiens
gaagccgactctggccc

SEQ ID NO: 4634196 - DNA, 22 bp, Homo sapiens
gaagccgactctggccctggcc

SEQ ID NO: 4634197 - DNA, 20 bp, Homo sapiens
gaagccgtgctcgccccagc

SEQ ID NO: 4634198 - DNA, 15 bp, Homo sapiens
gaagccttcccccag

SEQ ID NO: 4634199 - DNA, 17 bp, Homo sapiens
gaagcgaacatcttcat

SEQ ID NO: 4634200 - DNA, 21 bp, Homo sapiens
gaagctaacagggaaggcagg

SEQ ID NO: 4634201 - DNA, 21 bp, Homo sapiens
gaagctgcgggggcaggccgg

SEQ ID NO: 4634202 - DNA, 17 bp, Homo sapiens
gaagctgctgaggcccc

SEQ ID NO: 4634203 - DNA, 20 bp, Homo sapiens
gaagctgttaatttttctta

SEQ ID NO: 4634204 - DNA, 16 bp, Homo sapiens
gaagctgttgtgtgag

SEQ ID NO: 4634205 - DNA, 16 bp, Homo sapiens
gaagcttggaggaggg

SEQ ID NO: 4634206 - DNA, 15 bp, Homo sapiens
gaaggaaaagcaaga

SEQ ID NO: 4634207 - DNA, 15 bp, Homo sapiens
gaaggaaggagggca

SEQ ID NO: 4634208 - DNA, 16 bp, Homo sapiens
gaaggaaggagggcac

SEQ ID NO: 4634209 - DNA, 19 bp, Homo sapiens
gaaggaaggcctgagcccc

SEQ ID NO: 4634210 - DNA, 23 bp, Homo sapiens
gaaggaaggggctatcctgggac

SEQ ID NO: 4634211 - DNA, 17 bp, Homo sapiens
gaaggaatttgggagga

SEQ ID NO: 4634212 - DNA, 19 bp, Homo sapiens
gaaggacaggaccctcagg

SEQ ID NO: 4634213 - DNA, 21 bp, Homo sapiens
gaaggacatgagatcagggcc

SEQ ID NO: 4634214 - DNA, 13 bp, Homo sapiens
gaaggagacagga

SEQ ID NO: 4634215 - DNA, 20 bp, Homo sapiens
gaaggaggaatgctggactg

SEQ ID NO: 4634216 - DNA, 14 bp, Homo sapiens
gaaggagtttaaaa

SEQ ID NO: 4634217 - DNA, 15 bp, Homo sapiens
gaaggcacagctaac

SEQ ID NO: 4634218 - DNA, 15 bp, Homo sapiens
gaaggcagacagcag

SEQ ID NO: 4634219 - DNA, 17 bp, Homo sapiens
gaaggcaggcagggctc

SEQ ID NO: 4634220 - DNA, 21 bp, Homo sapiens
gaaggcaggcagggctctcct

SEQ ID NO: 4634221 - DNA, 13 bp, Homo sapiens
gaaggcagtggca

SEQ ID NO: 4634222 - DNA, 19 bp, Homo sapiens
gaaggcagtggcaggggag

SEQ ID NO: 4634223 - DNA, 19 bp, Homo sapiens
gaaggccaaaatcaagagt

SEQ ID NO: 4634224 - DNA, 14 bp, Homo sapiens
gaaggcctccctct

SEQ ID NO: 4634225 - DNA, 18 bp, Homo sapiens
gaaggcttaagaactgct

SEQ ID NO: 4634226 - DNA, 24 bp, Homo sapiens
gaaggctttcagggcctccagccc

SEQ ID NO: 4634227 - DNA, 17 bp, Homo sapiens
gaagggagtctctcttc

SEQ ID NO: 4634228 - DNA, 14 bp, Homo sapiens
gaagggggccctgc

SEQ ID NO: 4634229 - DNA, 16 bp, Homo sapiens
gaagggggccctgcta

SEQ ID NO: 4634230 - DNA, 19 bp, Homo sapiens
gaagggtttttagagaatg

SEQ ID NO: 4634231 - DNA, 14 bp, Homo sapiens
gaaggtcaaggtca

SEQ ID NO: 4634232 - DNA, 20 bp, Homo sapiens
gaaggtttgtgtttttctgc

SEQ ID NO: 4634233 - DNA, 19 bp, Homo sapiens
gaagtagcttgctccctgt

SEQ ID NO: 4634234 - DNA, 17 bp, Homo sapiens
gaagtatggtgtgttca

SEQ ID NO: 4634235 - DNA, 15 bp, Homo sapiens
gaagtattgctgaaa

SEQ ID NO: 4634236 - DNA, 17 bp, Homo sapiens
gaagtcaaataaatgtt

SEQ ID NO: 4634237 - DNA, 24 bp, Homo sapiens
gaagtcgtccttactcctgtggga

SEQ ID NO: 4634238 - DNA, 14 bp, Homo sapiens
gaagtgaggatgag

SEQ ID NO: 4634239 - DNA, 21 bp, Homo sapiens
gaagtgcgtgaatgtatgtaa

SEQ ID NO: 4634240 - DNA, 21 bp, Homo sapiens
gaagtgctctaacttttctta

SEQ ID NO: 4634241 - DNA, 14 bp, Homo sapiens
gaagtgtgctgtga

SEQ ID NO: 4634242 - DNA, 17 bp, Homo sapiens
gaagttgtggaggaggt

SEQ ID NO: 4634243 - DNA, 23 bp, Homo sapiens
gaagtttaacaagtatttattcc

SEQ ID NO: 4634244 - DNA, 14 bp, Homo sapiens
gaagtttgtagcca

SEQ ID NO: 4634245 - DNA, 17 bp, Homo sapiens
gaagtttgtagccaggt

SEQ ID NO: 4634246 - DNA, 22 bp, Homo sapiens
gaataaacgcagaagaggggga

SEQ ID NO: 4634247 - DNA, 16 bp, Homo sapiens
gaataaatcatgactt

SEQ ID NO: 4634248 - DNA, 16 bp, Homo sapiens
gaataagcagaacata

SEQ ID NO: 4634249 - DNA, 13 bp, Homo sapiens
gaataatgaaaat

SEQ ID NO: 4634250 - DNA, 20 bp, Homo sapiens
gaatacattaacggtgctaa

SEQ ID NO: 4634251 - DNA, 13 bp, Homo sapiens
gaatacattttat

SEQ ID NO: 4634252 - DNA, 17 bp, Homo sapiens
gaatacattttattctg

SEQ ID NO: 4634253 - DNA, 14 bp, Homo sapiens
gaatactcttgaaa

SEQ ID NO: 4634254 - DNA, 15 bp, Homo sapiens
gaatagcctgtggcc

SEQ ID NO: 4634255 - DNA, 18 bp, Homo sapiens
gaatataaagcttaataa

SEQ ID NO: 4634256 - DNA, 13 bp, Homo sapiens
gaatatttgaata

SEQ ID NO: 4634257 - DNA, 21 bp, Homo sapiens
gaatcaaaacaaacgagcagg

SEQ ID NO: 4634258 - DNA, 19 bp, Homo sapiens
gaatcagtaggaccaggcc

SEQ ID NO: 4634259 - DNA, 20 bp, Homo sapiens
gaatcagtaggaccaggcca

SEQ ID NO: 4634260 - DNA, 20 bp, Homo sapiens
gaatcatttttgtaggaagc

SEQ ID NO: 4634261 - DNA, 18 bp, Homo sapiens
gaatccatgggtctggct

SEQ ID NO: 4634262 - DNA, 22 bp, Homo sapiens
gaatcctatatagaatgctgca

SEQ ID NO: 4634263 - DNA, 21 bp, Homo sapiens
gaatcgattcccaagctccct

SEQ ID NO: 4634264 - DNA, 21 bp, Homo sapiens
gaatctaggccaccccaacct

SEQ ID NO: 4634265 - DNA, 20 bp, Homo sapiens
gaatctataagtagtaaatc

SEQ ID NO: 4634266 - DNA, 18 bp, Homo sapiens
gaatctctgaatttgaga

SEQ ID NO: 4634267 - DNA, 23 bp, Homo sapiens
gaatctgcttttcctctgccttc

SEQ ID NO: 4634268 - DNA, 16 bp, Homo sapiens
gaatcttaatttatta

SEQ ID NO: 4634269 - DNA, 15 bp, Homo sapiens
gaatgaagttctgct

SEQ ID NO: 4634270 - DNA, 12 bp, Homo sapiens
gaatgagcccag

SEQ ID NO: 4634271 - DNA, 19 bp, Homo sapiens
gaatgagcccagagaacag

SEQ ID NO: 4634272 - DNA, 21 bp, Homo sapiens
gaatgatggtttccagcttca

SEQ ID NO: 4634273 - DNA, 18 bp, Homo sapiens
gaatgcagaggtctccaa

SEQ ID NO: 4634274 - DNA, 15 bp, Homo sapiens
gaatgcataatgttt

SEQ ID NO: 4634275 - DNA, 17 bp, Homo sapiens
gaatgcccccagctggc

SEQ ID NO: 4634276 - DNA, 18 bp, Homo sapiens
gaatgcctcctgtgggga

SEQ ID NO: 4634277 - DNA, 19 bp, Homo sapiens
gaatgcctcgctcccttca

SEQ ID NO: 4634278 - DNA, 20 bp, Homo sapiens
gaatgcctcgctcccttcaa

SEQ ID NO: 4634279 - DNA, 16 bp, Homo sapiens
gaatggaggagccagg

SEQ ID NO: 4634280 - DNA, 14 bp, Homo sapiens
gaatgtggtctcag

SEQ ID NO: 4634281 - DNA, 17 bp, Homo sapiens
gaatgtggtctcaggat

SEQ ID NO: 4634282 - DNA, 14 bp, Homo sapiens
gaattaaaaaagca

SEQ ID NO: 4634283 - DNA, 15 bp, Homo sapiens
gaattaagttatctt

SEQ ID NO: 4634284 - DNA, 16 bp, Homo sapiens
gaattagtaaagttag

SEQ ID NO: 4634285 - DNA, 16 bp, Homo sapiens
gaattataaatgtgtt

SEQ ID NO: 4634286 - DNA, 24 bp, Homo sapiens
gaattcagtgccttcaacaacgtg

SEQ ID NO: 4634287 - DNA, 15 bp, Homo sapiens
gaattcatactctgt

SEQ ID NO: 4634288 - DNA, 18 bp, Homo sapiens
gaattctaccctggaaaa

SEQ ID NO: 4634289 - DNA, 17 bp, Homo sapiens
gaattcttgataaatga

SEQ ID NO: 4634290 - DNA, 16 bp, Homo sapiens
gaattcttttggggaa

SEQ ID NO: 4634291 - DNA, 14 bp, Homo sapiens
gaattgaaatgagg

SEQ ID NO: 4634292 - DNA, 16 bp, Homo sapiens
gaattgatcagaatcc

SEQ ID NO: 4634293 - DNA, 12 bp, Homo sapiens
gaatttaatata

SEQ ID NO: 4634294 - DNA, 16 bp, Homo sapiens
gaatttactggacata

SEQ ID NO: 4634295 - DNA, 12 bp, Homo sapiens
gaatttgaagag

SEQ ID NO: 4634296 - DNA, 14 bp, Homo sapiens
gaatttgaagagat

SEQ ID NO: 4634297 - DNA, 23 bp, Homo sapiens
gaatttgatcgttccagttccca

SEQ ID NO: 4634298 - DNA, 20 bp, Homo sapiens
gaattttcaaggccttcagt

SEQ ID NO: 4634299 - DNA, 22 bp, Homo sapiens
gaattttcctgagacaaatttt

SEQ ID NO: 4634300 - DNA, 14 bp, Homo sapiens
gacaaaacttcttg

SEQ ID NO: 4634301 - DNA, 19 bp, Homo sapiens
gacaaaacttcttgtcaga

SEQ ID NO: 4634302 - DNA, 16 bp, Homo sapiens
gacaaaggagcctgtg

SEQ ID NO: 4634303 - DNA, 18 bp, Homo sapiens
gacaaataagtttttgct

SEQ ID NO: 4634304 - DNA, 13 bp, Homo sapiens
gacaacagcacac

SEQ ID NO: 4634305 - DNA, 20 bp, Homo sapiens
gacaaccagaaggcccttaa

SEQ ID NO: 4634306 - DNA, 15 bp, Homo sapiens
gacaagcagcccttg

SEQ ID NO: 4634307 - DNA, 14 bp, Homo sapiens
gacaagcaggccgc

SEQ ID NO: 4634308 - DNA, 19 bp, Homo sapiens
gacaagctggccaaagtca

SEQ ID NO: 4634309 - DNA, 22 bp, Homo sapiens
gacaagtctttctcctctttga

SEQ ID NO: 4634310 - DNA, 15 bp, Homo sapiens
gacaataacttctta

SEQ ID NO: 4634311 - DNA, 19 bp, Homo sapiens
gacaataattctggagata

SEQ ID NO: 4634312 - DNA, 18 bp, Homo sapiens
gacaatgttgtcctcctg

SEQ ID NO: 4634313 - DNA, 13 bp, Homo sapiens
gacaattctgttt

SEQ ID NO: 4634314 - DNA, 13 bp, Homo sapiens
gacacaacacaga

SEQ ID NO: 4634315 - DNA, 19 bp, Homo sapiens
gacacaattacgcaggtat

SEQ ID NO: 4634316 - DNA, 17 bp, Homo sapiens
gacacaggcctgtgtag

SEQ ID NO: 4634317 - DNA, 12 bp, Homo sapiens
gacacaggtcac

SEQ ID NO: 4634318 - DNA, 19 bp, Homo sapiens
gacacatacagagtgggcc

SEQ ID NO: 4634319 - DNA, 15 bp, Homo sapiens
gacacatgctatgtt

SEQ ID NO: 4634320 - DNA, 16 bp, Homo sapiens
gacacatgctatgttc

SEQ ID NO: 4634321 - DNA, 17 bp, Homo sapiens
gacacatgctatgttct

SEQ ID NO: 4634322 - DNA, 20 bp, Homo sapiens
gacacgagccacaagctgca

SEQ ID NO: 4634323 - DNA, 23 bp, Homo sapiens
gacacgtggcctcgtgaggggca

SEQ ID NO: 4634324 - DNA, 16 bp, Homo sapiens
gacactcgtcacccca

SEQ ID NO: 4634325 - DNA, 18 bp, Homo sapiens
gacactcgtcaccccagc

SEQ ID NO: 4634326 - DNA, 16 bp, Homo sapiens
gacactctgacaagct

SEQ ID NO: 4634327 - DNA, 17 bp, Homo sapiens
gacactctgacaagctg

SEQ ID NO: 4634328 - DNA, 21 bp, Homo sapiens
gacactctgacaagctggcca

SEQ ID NO: 4634329 - DNA, 22 bp, Homo sapiens
gacactctgacaagctggccaa

SEQ ID NO: 4634330 - DNA, 12 bp, Homo sapiens
gacactgtacaa

SEQ ID NO: 4634331 - DNA, 14 bp, Homo sapiens
gacacttttatgtt

SEQ ID NO: 4634332 - DNA, 13 bp, Homo sapiens
gacagacagccag

SEQ ID NO: 4634333 - DNA, 22 bp, Homo sapiens
gacagacgagacaacagcacac

SEQ ID NO: 4634334 - DNA, 14 bp, Homo sapiens
gacagaggcgaggg

SEQ ID NO: 4634335 - DNA, 15 bp, Homo sapiens
gacagaggttttgaa

SEQ ID NO: 4634336 - DNA, 16 bp, Homo sapiens
gacagatcaagctgtg

SEQ ID NO: 4634337 - DNA, 17 bp, Homo sapiens
gacagcaggcagcgcca

SEQ ID NO: 4634338 - DNA, 18 bp, Homo sapiens
gacagctgactgaatgca

SEQ ID NO: 4634339 - DNA, 15 bp, Homo sapiens
gacagctgtgcctcg

SEQ ID NO: 4634340 - DNA, 17 bp, Homo sapiens
gacagctgtgcctcgct

SEQ ID NO: 4634341 - DNA, 11 bp, Homo sapiens
gacaggaccct

SEQ ID NO: 4634342 - DNA, 22 bp, Homo sapiens
gacaggcactccaaacctgtct

SEQ ID NO: 4634343 - DNA, 15 bp, Homo sapiens
gacaggcagcctgga

SEQ ID NO: 4634344 - DNA, 14 bp, Homo sapiens
gacaggctggctcc

SEQ ID NO: 4634345 - DNA, 22 bp, Homo sapiens
gacagggccagtggggcctgtg

SEQ ID NO: 4634346 - DNA, 20 bp, Homo sapiens
gacagtcatcatcagggcct

SEQ ID NO: 4634347 - DNA, 23 bp, Homo sapiens
gacagtcatcatcagggcctggg

SEQ ID NO: 4634348 - DNA, 15 bp, Homo sapiens
gacagtcctttccca

SEQ ID NO: 4634349 - DNA, 23 bp, Homo sapiens
gacagtcctttcccaccattcct

SEQ ID NO: 4634350 - DNA, 21 bp, Homo sapiens
gacagtgccatccccaccttc

SEQ ID NO: 4634351 - DNA, 13 bp, Homo sapiens
gacagtggcagga

SEQ ID NO: 4634352 - DNA, 15 bp, Homo sapiens
gacagtggcaggaca

SEQ ID NO: 4634353 - DNA, 13 bp, Homo sapiens
gacagtgggaaat

SEQ ID NO: 4634354 - DNA, 15 bp, Homo sapiens
gacagtgggaaatat

SEQ ID NO: 4634355 - DNA, 22 bp, Homo sapiens
gacagtgtatggggctgcagtt

SEQ ID NO: 4634356 - DNA, 13 bp, Homo sapiens
gacagtttccaaa

SEQ ID NO: 4634357 - DNA, 19 bp, Homo sapiens
gacataagcaatcatttta

SEQ ID NO: 4634358 - DNA, 20 bp, Homo sapiens
gacataagcaatcattttat

SEQ ID NO: 4634359 - DNA, 20 bp, Homo sapiens
gacatagagagggagaagaa

SEQ ID NO: 4634360 - DNA, 13 bp, Homo sapiens
gacatcattgtca

SEQ ID NO: 4634361 - DNA, 17 bp, Homo sapiens
gacatccataaagaagc

SEQ ID NO: 4634362 - DNA, 18 bp, Homo sapiens
gacatccataaagaagca

SEQ ID NO: 4634363 - DNA, 20 bp, Homo sapiens
gacatccataaagaagcaat

SEQ ID NO: 4634364 - DNA, 23 bp, Homo sapiens
gacatccatgttccgagaagaac

SEQ ID NO: 4634365 - DNA, 17 bp, Homo sapiens
gacatgcggtagccagc

SEQ ID NO: 4634366 - DNA, 18 bp, Homo sapiens
gacatgcggtagccagca

SEQ ID NO: 4634367 - DNA, 19 bp, Homo sapiens
gacatgcggtagccagcac

SEQ ID NO: 4634368 - DNA, 22 bp, Homo sapiens
gacatgcggtagccagcacaca

SEQ ID NO: 4634369 - DNA, 22 bp, Homo sapiens
gacatgcttttctgccactcca

SEQ ID NO: 4634370 - DNA, 12 bp, Homo sapiens
gacatgtagctt

SEQ ID NO: 4634371 - DNA, 14 bp, Homo sapiens
gacattctaatgca

SEQ ID NO: 4634372 - DNA, 20 bp, Homo sapiens
gacattctaatgcatattta

SEQ ID NO: 4634373 - DNA, 21 bp, Homo sapiens
gacattgtctcctatatattt

SEQ ID NO: 4634374 - DNA, 14 bp, Homo sapiens
gacatttatatatt

SEQ ID NO: 4634375 - DNA, 16 bp, Homo sapiens
gacattttctcttaga

SEQ ID NO: 4634376 - DNA, 17 bp, Homo sapiens
gacattttctcttagag

SEQ ID NO: 4634377 - DNA, 17 bp, Homo sapiens
gaccagcaggctggcct

SEQ ID NO: 4634378 - DNA, 16 bp, Homo sapiens
gaccaggatggagcaa

SEQ ID NO: 4634379 - DNA, 12 bp, Homo sapiens
gaccaggccacc

SEQ ID NO: 4634380 - DNA, 15 bp, Homo sapiens
gaccagggatgctgg

SEQ ID NO: 4634381 - DNA, 16 bp, Homo sapiens
gaccagggatgctggg

SEQ ID NO: 4634382 - DNA, 17 bp, Homo sapiens
gaccagggatgctgggc

SEQ ID NO: 4634383 - DNA, 16 bp, Homo sapiens
gaccagggctgctctt

SEQ ID NO: 4634384 - DNA, 22 bp, Homo sapiens
gaccagtcaggatgaggccccg

SEQ ID NO: 4634385 - DNA, 12 bp, Homo sapiens
gacccacctgct

SEQ ID NO: 4634386 - DNA, 15 bp, Homo sapiens
gacccagccccttcc

SEQ ID NO: 4634387 - DNA, 16 bp, Homo sapiens
gacccagccccttccc

SEQ ID NO: 4634388 - DNA, 20 bp, Homo sapiens
gacccagccccttcccctgg

SEQ ID NO: 4634389 - DNA, 15 bp, Homo sapiens
gacccatctctccct

SEQ ID NO: 4634390 - DNA, 15 bp, Homo sapiens
gaccccagggcacag

SEQ ID NO: 4634391 - DNA, 18 bp, Homo sapiens
gaccccagggcacaggag

SEQ ID NO: 4634392 - DNA, 19 bp, Homo sapiens
gaccccagtcaagctccta

SEQ ID NO: 4634393 - DNA, 22 bp, Homo sapiens
gaccccagtcgtgatgtggagg

SEQ ID NO: 4634394 - DNA, 23 bp, Homo sapiens
gaccccagtcgtgatgtggagga

SEQ ID NO: 4634395 - DNA, 19 bp, Homo sapiens
gaccccatcacctactcac

SEQ ID NO: 4634396 - DNA, 21 bp, Homo sapiens
gacccccccccaatcggactg

SEQ ID NO: 4634397 - DNA, 23 bp, Homo sapiens
gacccccccccaatcggactgcc

SEQ ID NO: 4634398 - DNA, 20 bp, Homo sapiens
gaccctatgggtctaggaca

SEQ ID NO: 4634399 - DNA, 22 bp, Homo sapiens
gaccctcaggaattcagtgcct

SEQ ID NO: 4634400 - DNA, 15 bp, Homo sapiens
gaccctgcccttgtt

SEQ ID NO: 4634401 - DNA, 16 bp, Homo sapiens
gacccttattgctgtc

SEQ ID NO: 4634402 - DNA, 13 bp, Homo sapiens
gacccttttaagc

SEQ ID NO: 4634403 - DNA, 15 bp, Homo sapiens
gacccttttgtgtct

SEQ ID NO: 4634404 - DNA, 22 bp, Homo sapiens
gaccgctacaccactctggcag

SEQ ID NO: 4634405 - DNA, 23 bp, Homo sapiens
gaccgctacaccactctggcagc

SEQ ID NO: 4634406 - DNA, 14 bp, Homo sapiens
gaccggcagagctc

SEQ ID NO: 4634407 - DNA, 23 bp, Homo sapiens
gaccggcagagctctacaggcct

SEQ ID NO: 4634408 - DNA, 13 bp, Homo sapiens
gaccgggccaggc

SEQ ID NO: 4634409 - DNA, 15 bp, Homo sapiens
gaccggtgctgcagg

SEQ ID NO: 4634410 - DNA, 17 bp, Homo sapiens
gaccggtgctgcaggag

SEQ ID NO: 4634411 - DNA, 17 bp, Homo sapiens
gacctaacctaggaggg

SEQ ID NO: 4634412 - DNA, 21 bp, Homo sapiens
gacctaacctaggagggctct

SEQ ID NO: 4634413 - DNA, 14 bp, Homo sapiens
gacctaatatcatt

SEQ ID NO: 4634414 - DNA, 15 bp, Homo sapiens
gacctaatatcattt

SEQ ID NO: 4634415 - DNA, 22 bp, Homo sapiens
gacctaatatcattttattcac

SEQ ID NO: 4634416 - DNA, 23 bp, Homo sapiens
gacctaatatcattttattcaca

SEQ ID NO: 4634417 - DNA, 16 bp, Homo sapiens
gacctcagaagtaaag

SEQ ID NO: 4634418 - DNA, 18 bp, Homo sapiens
gacctcatgatctgccca

SEQ ID NO: 4634419 - DNA, 19 bp, Homo sapiens
gacctccagctttcctgta

SEQ ID NO: 4634420 - DNA, 18 bp, Homo sapiens
gacctccccagcccagga

SEQ ID NO: 4634421 - DNA, 15 bp, Homo sapiens
gacctcgtgatctac

SEQ ID NO: 4634422 - DNA, 14 bp, Homo sapiens
gacctgagcctgcc

SEQ ID NO: 4634423 - DNA, 17 bp, Homo sapiens
gacctgagcctgccgag

SEQ ID NO: 4634424 - DNA, 20 bp, Homo sapiens
gacctgcatggtcaagcctc

SEQ ID NO: 4634425 - DNA, 17 bp, Homo sapiens
gacctgctgagctctga

SEQ ID NO: 4634426 - DNA, 19 bp, Homo sapiens
gacctggaggggagaggtc

SEQ ID NO: 4634427 - DNA, 20 bp, Homo sapiens
gacctgggacaagcaggccg

SEQ ID NO: 4634428 - DNA, 15 bp, Homo sapiens
gacctggggcagata

SEQ ID NO: 4634429 - DNA, 19 bp, Homo sapiens
gacctgtcaccctgcagga

SEQ ID NO: 4634430 - DNA, 15 bp, Homo sapiens
gacctgtctcctggc

SEQ ID NO: 4634431 - DNA, 19 bp, Homo sapiens
gacctgtggccaagttctt

SEQ ID NO: 4634432 - DNA, 17 bp, Homo sapiens
gacctgttagcagacag

SEQ ID NO: 4634433 - DNA, 15 bp, Homo sapiens
gaccttaaaatgtgt

SEQ ID NO: 4634434 - DNA, 23 bp, Homo sapiens
gaccttccctccgccttctccca

SEQ ID NO: 4634435 - DNA, 14 bp, Homo sapiens
gacgaggggcaggg

SEQ ID NO: 4634436 - DNA, 21 bp, Homo sapiens
gacgaggggcagggaaggaca

SEQ ID NO: 4634437 - DNA, 12 bp, Homo sapiens
gacgcaccgcct

SEQ ID NO: 4634438 - DNA, 24 bp, Homo sapiens
gacgcaccgcctgaaggcacagct

SEQ ID NO: 4634439 - DNA, 20 bp, Homo sapiens
gacgcccgagagcctcgctt

SEQ ID NO: 4634440 - DNA, 17 bp, Homo sapiens
gacgtgattttgctgta

SEQ ID NO: 4634441 - DNA, 14 bp, Homo sapiens
gactaacactcaga

SEQ ID NO: 4634442 - DNA, 22 bp, Homo sapiens
gactacaaaataaaacttggtt

SEQ ID NO: 4634443 - DNA, 18 bp, Homo sapiens
gactacttgggagcaccg

SEQ ID NO: 4634444 - DNA, 16 bp, Homo sapiens
gactagcaggctactg

SEQ ID NO: 4634445 - DNA, 14 bp, Homo sapiens
gactcacctgcgca

SEQ ID NO: 4634446 - DNA, 23 bp, Homo sapiens
gactcagggaccggtgctgcagg

SEQ ID NO: 4634447 - DNA, 24 bp, Homo sapiens
gactcagggaccggtgctgcagga

SEQ ID NO: 4634448 - DNA, 12 bp, Homo sapiens
gactcagggcag

SEQ ID NO: 4634449 - DNA, 13 bp, Homo sapiens
gactcagggcagc

SEQ ID NO: 4634450 - DNA, 17 bp, Homo sapiens
gactcagggcagcgcca

SEQ ID NO: 4634451 - DNA, 12 bp, Homo sapiens
gactcagttttt

SEQ ID NO: 4634452 - DNA, 19 bp, Homo sapiens
gactcatccttgcccaggt

SEQ ID NO: 4634453 - DNA, 22 bp, Homo sapiens
gactccacggatgcgtgggcag

SEQ ID NO: 4634454 - DNA, 15 bp, Homo sapiens
gactcccaaccctgg

SEQ ID NO: 4634455 - DNA, 17 bp, Homo sapiens
gactccgaggtggttca

SEQ ID NO: 4634456 - DNA, 13 bp, Homo sapiens
gactcctgctggt

SEQ ID NO: 4634457 - DNA, 17 bp, Homo sapiens
gactctaggttatacaa

SEQ ID NO: 4634458 - DNA, 18 bp, Homo sapiens
gactctaggttatacaat

SEQ ID NO: 4634459 - DNA, 12 bp, Homo sapiens
gactctcacctg

SEQ ID NO: 4634460 - DNA, 13 bp, Homo sapiens
gactctccaggga

SEQ ID NO: 4634461 - DNA, 20 bp, Homo sapiens
gactctgaggactcctgagg

SEQ ID NO: 4634462 - DNA, 14 bp, Homo sapiens
gactctggccctgg

SEQ ID NO: 4634463 - DNA, 19 bp, Homo sapiens
gactcttatttatagaatt

SEQ ID NO: 4634464 - DNA, 13 bp, Homo sapiens
gactcttgctcct

SEQ ID NO: 4634465 - DNA, 20 bp, Homo sapiens
gactgaaacaaaatgttttt

SEQ ID NO: 4634466 - DNA, 16 bp, Homo sapiens
gactgaagcgaacatc

SEQ ID NO: 4634467 - DNA, 18 bp, Homo sapiens
gactgaagcgaacatctt

SEQ ID NO: 4634468 - DNA, 12 bp, Homo sapiens
gactgaatgcag

SEQ ID NO: 4634469 - DNA, 17 bp, Homo sapiens
gactgagggcagtgccc

SEQ ID NO: 4634470 - DNA, 18 bp, Homo sapiens
gactgccaagccagattc

SEQ ID NO: 4634471 - DNA, 20 bp, Homo sapiens
gactgccaagccagattctc

SEQ ID NO: 4634472 - DNA, 12 bp, Homo sapiens
gactgccctgcc

SEQ ID NO: 4634473 - DNA, 14 bp, Homo sapiens
gactgccctgccca

SEQ ID NO: 4634474 - DNA, 23 bp, Homo sapiens
gactgctattctagagcttttat

SEQ ID NO: 4634475 - DNA, 15 bp, Homo sapiens
gactggaggcccctg

SEQ ID NO: 4634476 - DNA, 23 bp, Homo sapiens
gactggaggcccctggagccaga

SEQ ID NO: 4634477 - DNA, 15 bp, Homo sapiens
gactgggccccacat

SEQ ID NO: 4634478 - DNA, 15 bp, Homo sapiens
gactggttttctgcc

SEQ ID NO: 4634479 - DNA, 16 bp, Homo sapiens
gactggttttctgcca

SEQ ID NO: 4634480 - DNA, 17 bp, Homo sapiens
gactgtacattatgaag

SEQ ID NO: 4634481 - DNA, 15 bp, Homo sapiens
gactgtcctagccag

SEQ ID NO: 4634482 - DNA, 20 bp, Homo sapiens
gactgtcgccacacgcctct

SEQ ID NO: 4634483 - DNA, 23 bp, Homo sapiens
gactgtggtgacttctgctgctg

SEQ ID NO: 4634484 - DNA, 20 bp, Homo sapiens
gactgttgtccctgcactct

SEQ ID NO: 4634485 - DNA, 19 bp, Homo sapiens
gactgtttcatagttttct

SEQ ID NO: 4634486 - DNA, 13 bp, Homo sapiens
gacttactgcctg

SEQ ID NO: 4634487 - DNA, 13 bp, Homo sapiens
gacttagaaactg

SEQ ID NO: 4634488 - DNA, 15 bp, Homo sapiens
gacttagattcatta

SEQ ID NO: 4634489 - DNA, 16 bp, Homo sapiens
gacttatttatataaa

SEQ ID NO: 4634490 - DNA, 12 bp, Homo sapiens
gacttatttctg

SEQ ID NO: 4634491 - DNA, 15 bp, Homo sapiens
gacttatttctgctc

SEQ ID NO: 4634492 - DNA, 20 bp, Homo sapiens
gacttatttctgctctggaa

SEQ ID NO: 4634493 - DNA, 22 bp, Homo sapiens
gacttcacgaagtgttgcatgg

SEQ ID NO: 4634494 - DNA, 14 bp, Homo sapiens
gacttcacttatta

SEQ ID NO: 4634495 - DNA, 19 bp, Homo sapiens
gacttcctgactctcacct

SEQ ID NO: 4634496 - DNA, 12 bp, Homo sapiens
gacttctgctgc

SEQ ID NO: 4634497 - DNA, 23 bp, Homo sapiens
gacttgggcacccccagcctggg

SEQ ID NO: 4634498 - DNA, 17 bp, Homo sapiens
gacttggttctgaagcc

SEQ ID NO: 4634499 - DNA, 22 bp, Homo sapiens
gacttgtctgcctcctgctttg

SEQ ID NO: 4634500 - DNA, 15 bp, Homo sapiens
gacttgtgcatccct

SEQ ID NO: 4634501 - DNA, 16 bp, Homo sapiens
gactttacaaaccttt

SEQ ID NO: 4634502 - DNA, 17 bp, Homo sapiens
gactttacaaacctttg

SEQ ID NO: 4634503 - DNA, 17 bp, Homo sapiens
gactttatgtagttttt

SEQ ID NO: 4634504 - DNA, 13 bp, Homo sapiens
gactttatttatt

SEQ ID NO: 4634505 - DNA, 14 bp, Homo sapiens
gactttatttattt

SEQ ID NO: 4634506 - DNA, 16 bp, Homo sapiens
gactttatttatttct

SEQ ID NO: 4634507 - DNA, 19 bp, Homo sapiens
gactttatttatttctagt

SEQ ID NO: 4634508 - DNA, 16 bp, Homo sapiens
gactttcacaccatta

SEQ ID NO: 4634509 - DNA, 17 bp, Homo sapiens
gactttcagtaaacata

SEQ ID NO: 4634510 - DNA, 14 bp, Homo sapiens
gactttctcctggc

SEQ ID NO: 4634511 - DNA, 13 bp, Homo sapiens
gacttttctttct

SEQ ID NO: 4634512 - DNA, 19 bp, Homo sapiens
gagaaacagctcagccagt

SEQ ID NO: 4634513 - DNA, 14 bp, Homo sapiens
gagaaacttcaaag

SEQ ID NO: 4634514 - DNA, 17 bp, Homo sapiens
gagaaagagagaagcca

SEQ ID NO: 4634515 - DNA, 18 bp, Homo sapiens
gagaaagagctgcctgga

SEQ ID NO: 4634516 - DNA, 19 bp, Homo sapiens
gagaacagtggttgcctgg

SEQ ID NO: 4634517 - DNA, 14 bp, Homo sapiens
gagaacctggcctt

SEQ ID NO: 4634518 - DNA, 22 bp, Homo sapiens
gagaagaaagaggtgaccccag

SEQ ID NO: 4634519 - DNA, 18 bp, Homo sapiens
gagaagaacaagaaatgg

SEQ ID NO: 4634520 - DNA, 12 bp, Homo sapiens
gagaagagagga

SEQ ID NO: 4634521 - DNA, 14 bp, Homo sapiens
gagaagcacttgag

SEQ ID NO: 4634522 - DNA, 13 bp, Homo sapiens
gagaaggctatgt

SEQ ID NO: 4634523 - DNA, 16 bp, Homo sapiens
gagaaggctggagaag

SEQ ID NO: 4634524 - DNA, 16 bp, Homo sapiens
gagaagttgtgaaaga

SEQ ID NO: 4634525 - DNA, 17 bp, Homo sapiens
gagaatgctggcaaagg

SEQ ID NO: 4634526 - DNA, 20 bp, Homo sapiens
gagacagagcctcgctctgt

SEQ ID NO: 4634527 - DNA, 20 bp, Homo sapiens
gagacagagtcttgctctgt

SEQ ID NO: 4634528 - DNA, 22 bp, Homo sapiens
gagacccagccccttcccctgg

SEQ ID NO: 4634529 - DNA, 18 bp, Homo sapiens
gagaccccgcacccggct

SEQ ID NO: 4634530 - DNA, 19 bp, Homo sapiens
gagaccccgcacccggctc

SEQ ID NO: 4634531 - DNA, 22 bp, Homo sapiens
gagaccctgcaaacagaacagg

SEQ ID NO: 4634532 - DNA, 21 bp, Homo sapiens
gagacgcacacagctgagcac

SEQ ID NO: 4634533 - DNA, 18 bp, Homo sapiens
gagactttacaaaccttt

SEQ ID NO: 4634534 - DNA, 15 bp, Homo sapiens
gagagaaagaagata

SEQ ID NO: 4634535 - DNA, 15 bp, Homo sapiens
gagagaaagagagaa

SEQ ID NO: 4634536 - DNA, 21 bp, Homo sapiens
gagagaaagagagaagccagc

SEQ ID NO: 4634537 - DNA, 11 bp, Homo sapiens
gagagaagcca

SEQ ID NO: 4634538 - DNA, 13 bp, Homo sapiens
gagagaagccagc

SEQ ID NO: 4634539 - DNA, 13 bp, Homo sapiens
gagagaagctctt

SEQ ID NO: 4634540 - DNA, 17 bp, Homo sapiens
gagagaccacacatttt

SEQ ID NO: 4634541 - DNA, 20 bp, Homo sapiens
gagagaccccgcacccggct

SEQ ID NO: 4634542 - DNA, 18 bp, Homo sapiens
gagagcccctcacacagc

SEQ ID NO: 4634543 - DNA, 14 bp, Homo sapiens
gagagccctgaggc

SEQ ID NO: 4634544 - DNA, 13 bp, Homo sapiens
gagagctaggagc

SEQ ID NO: 4634545 - DNA, 15 bp, Homo sapiens
gagaggcttccctac

SEQ ID NO: 4634546 - DNA, 18 bp, Homo sapiens
gagagggacaggcactcc

SEQ ID NO: 4634547 - DNA, 14 bp, Homo sapiens
gagagggagaagaa

SEQ ID NO: 4634548 - DNA, 17 bp, Homo sapiens
gagaggggtcacaccca

SEQ ID NO: 4634549 - DNA, 13 bp, Homo sapiens
gagagggtgacaa

SEQ ID NO: 4634550 - DNA, 14 bp, Homo sapiens
gagaggtcagcctt

SEQ ID NO: 4634551 - DNA, 16 bp, Homo sapiens
gagagtacctgtgtgt

SEQ ID NO: 4634552 - DNA, 16 bp, Homo sapiens
gagagttgtgatggag

SEQ ID NO: 4634553 - DNA, 23 bp, Homo sapiens
gagatagcattgtgaactgacag

SEQ ID NO: 4634554 - DNA, 14 bp, Homo sapiens
gagatattgatatt

SEQ ID NO: 4634555 - DNA, 19 bp, Homo sapiens
gagatcacagccccaccct

SEQ ID NO: 4634556 - DNA, 18 bp, Homo sapiens
gagatccagggcaaggcc

SEQ ID NO: 4634557 - DNA, 20 bp, Homo sapiens
gagatccctgcagaacccac

SEQ ID NO: 4634558 - DNA, 16 bp, Homo sapiens
gagatggagggcttgg

SEQ ID NO: 4634559 - DNA, 18 bp, Homo sapiens
gagatggagttcttgtgc

SEQ ID NO: 4634560 - DNA, 13 bp, Homo sapiens
gagcaaagcctgt

SEQ ID NO: 4634561 - DNA, 15 bp, Homo sapiens
gagcaagaggaggcc

SEQ ID NO: 4634562 - DNA, 13 bp, Homo sapiens
gagcaagctcttc

SEQ ID NO: 4634563 - DNA, 21 bp, Homo sapiens
gagcaagctcttcccttgctc

SEQ ID NO: 4634564 - DNA, 17 bp, Homo sapiens
gagcaaggccttctctc

SEQ ID NO: 4634565 - DNA, 22 bp, Homo sapiens
gagcaccgcctgtgaaatacca

SEQ ID NO: 4634566 - DNA, 11 bp, Homo sapiens
gagcacctgtc

SEQ ID NO: 4634567 - DNA, 15 bp, Homo sapiens
gagcacctgtctgga

SEQ ID NO: 4634568 - DNA, 16 bp, Homo sapiens
gagcactgccaggagg

SEQ ID NO: 4634569 - DNA, 17 bp, Homo sapiens
gagcactgccaggaggg

SEQ ID NO: 4634570 - DNA, 18 bp, Homo sapiens
gagcagaatgttgtactt

SEQ ID NO: 4634571 - DNA, 20 bp, Homo sapiens
gagcagacaggctacaaagc

SEQ ID NO: 4634572 - DNA, 17 bp, Homo sapiens
gagcagctccaccactg

SEQ ID NO: 4634573 - DNA, 20 bp, Homo sapiens
gagcagctccaccactgtgc

SEQ ID NO: 4634574 - DNA, 21 bp, Homo sapiens
gagcagctccaccactgtgca

SEQ ID NO: 4634575 - DNA, 13 bp, Homo sapiens
gagcagctgagca

SEQ ID NO: 4634576 - DNA, 16 bp, Homo sapiens
gagcagctgagcaggg

SEQ ID NO: 4634577 - DNA, 18 bp, Homo sapiens
gagcagctgagcagggcc

SEQ ID NO: 4634578 - DNA, 21 bp, Homo sapiens
gagcagggccggggaactggc

SEQ ID NO: 4634579 - DNA, 16 bp, Homo sapiens
gagcagggtcaagcct

SEQ ID NO: 4634580 - DNA, 17 bp, Homo sapiens
gagcagggtcaagcctc

SEQ ID NO: 4634581 - DNA, 23 bp, Homo sapiens
gagcatattttcttacttttatt

SEQ ID NO: 4634582 - DNA, 17 bp, Homo sapiens
gagcatcatgcctctga

SEQ ID NO: 4634583 - DNA, 19 bp, Homo sapiens
gagcatcatgcctctgagg

SEQ ID NO: 4634584 - DNA, 24 bp, Homo sapiens
gagcatcatgcctctgaggccagc

SEQ ID NO: 4634585 - DNA, 18 bp, Homo sapiens
gagcatttgcacctctgt

SEQ ID NO: 4634586 - DNA, 23 bp, Homo sapiens
gagccacaagctgcactgtgaac

SEQ ID NO: 4634587 - DNA, 12 bp, Homo sapiens
gagccactctgt

SEQ ID NO: 4634588 - DNA, 16 bp, Homo sapiens
gagccaggatgcccag

SEQ ID NO: 4634589 - DNA, 13 bp, Homo sapiens
gagccaggcccca

SEQ ID NO: 4634590 - DNA, 19 bp, Homo sapiens
gagcccagcggcccaagag

SEQ ID NO: 4634591 - DNA, 19 bp, Homo sapiens
gagcccagctgggtcaggc

SEQ ID NO: 4634592 - DNA, 21 bp, Homo sapiens
gagcccagctgggtcaggcag

SEQ ID NO: 4634593 - DNA, 16 bp, Homo sapiens
gagcccattaatcttg

SEQ ID NO: 4634594 - DNA, 14 bp, Homo sapiens
gagcccccagccct

SEQ ID NO: 4634595 - DNA, 22 bp, Homo sapiens
gagcccctcctccagcccctgt

SEQ ID NO: 4634596 - DNA, 21 bp, Homo sapiens
gagccccttctgctcagctct

SEQ ID NO: 4634597 - DNA, 22 bp, Homo sapiens
gagccccttctgctcagctctg

SEQ ID NO: 4634598 - DNA, 17 bp, Homo sapiens
gagccctgaggcctaga

SEQ ID NO: 4634599 - DNA, 19 bp, Homo sapiens
gagccgctggcagaaggga

SEQ ID NO: 4634600 - DNA, 16 bp, Homo sapiens
gagcctaggccaggtg

SEQ ID NO: 4634601 - DNA, 12 bp, Homo sapiens
gagcctccctgc

SEQ ID NO: 4634602 - DNA, 13 bp, Homo sapiens
gagcctccctgcc

SEQ ID NO: 4634603 - DNA, 19 bp, Homo sapiens
gagcctccctgcctcaggc

SEQ ID NO: 4634604 - DNA, 13 bp, Homo sapiens
gagcctgccgagc

SEQ ID NO: 4634605 - DNA, 11 bp, Homo sapiens
gagcctggggc

SEQ ID NO: 4634606 - DNA, 13 bp, Homo sapiens
gagcctggggctc

SEQ ID NO: 4634607 - DNA, 15 bp, Homo sapiens
gagcctggggctcta

SEQ ID NO: 4634608 - DNA, 23 bp, Homo sapiens
gagcctggggctctaacgcctga

SEQ ID NO: 4634609 - DNA, 16 bp, Homo sapiens
gagcctgtgaacccag

SEQ ID NO: 4634610 - DNA, 20 bp, Homo sapiens
gagcctgtgaacccaggaca

SEQ ID NO: 4634611 - DNA, 18 bp, Homo sapiens
gagcctgtgcgtcccagc

SEQ ID NO: 4634612 - DNA, 19 bp, Homo sapiens
gagcctgtgcgtcccagct

SEQ ID NO: 4634613 - DNA, 15 bp, Homo sapiens
gagccttcagtcagg

SEQ ID NO: 4634614 - DNA, 21 bp, Homo sapiens
gagcgccctgcagaccctgcc

SEQ ID NO: 4634615 - DNA, 18 bp, Homo sapiens
gagctaagggtgggtgct

SEQ ID NO: 4634616 - DNA, 22 bp, Homo sapiens
gagctaagggtgggtgctcaga

SEQ ID NO: 4634617 - DNA, 23 bp, Homo sapiens
gagctaagggtgggtgctcagaa

SEQ ID NO: 4634618 - DNA, 19 bp, Homo sapiens
gagctacctgtgtggacag

SEQ ID NO: 4634619 - DNA, 12 bp, Homo sapiens
gagctaggagca

SEQ ID NO: 4634620 - DNA, 17 bp, Homo sapiens
gagctaggagcaaagcc

SEQ ID NO: 4634621 - DNA, 18 bp, Homo sapiens
gagctaggagcaaagcct

SEQ ID NO: 4634622 - DNA, 19 bp, Homo sapiens
gagctaggagcaaagcctg

SEQ ID NO: 4634623 - DNA, 20 bp, Homo sapiens
gagctaggagcaaagcctgt

SEQ ID NO: 4634624 - DNA, 20 bp, Homo sapiens
gagctatttccttccagcct

SEQ ID NO: 4634625 - DNA, 19 bp, Homo sapiens
gagctcaacggtctggcag

SEQ ID NO: 4634626 - DNA, 20 bp, Homo sapiens
gagctcaacggtctggcagg

SEQ ID NO: 4634627 - DNA, 16 bp, Homo sapiens
gagctcacaaggcagc

SEQ ID NO: 4634628 - DNA, 17 bp, Homo sapiens
gagctcacaaggcagca

SEQ ID NO: 4634629 - DNA, 19 bp, Homo sapiens
gagctcctgatcagaggca

SEQ ID NO: 4634630 - DNA, 16 bp, Homo sapiens
gagctctacaggcctg

SEQ ID NO: 4634631 - DNA, 13 bp, Homo sapiens
gagctctgagagg

SEQ ID NO: 4634632 - DNA, 14 bp, Homo sapiens
gagctctgagaggc

SEQ ID NO: 4634633 - DNA, 11 bp, Homo sapiens
gagctgcctgg

SEQ ID NO: 4634634 - DNA, 12 bp, Homo sapiens
gagctgcctgga

SEQ ID NO: 4634635 - DNA, 13 bp, Homo sapiens
gagctggaagggg

SEQ ID NO: 4634636 - DNA, 18 bp, Homo sapiens
gagctggggactcaggga

SEQ ID NO: 4634637 - DNA, 11 bp, Homo sapiens
gagctgtgcca

SEQ ID NO: 4634638 - DNA, 12 bp, Homo sapiens
gagctgtgccag

SEQ ID NO: 4634639 - DNA, 14 bp, Homo sapiens
gagcttagggatga

SEQ ID NO: 4634640 - DNA, 22 bp, Homo sapiens
gagcttccaaggggcaaatttt

SEQ ID NO: 4634641 - DNA, 17 bp, Homo sapiens
gagcttcctggggacca

SEQ ID NO: 4634642 - DNA, 17 bp, Homo sapiens
gaggaagagccacctgc

SEQ ID NO: 4634643 - DNA, 21 bp, Homo sapiens
gaggaagagccacctgcaaga

SEQ ID NO: 4634644 - DNA, 13 bp, Homo sapiens
gaggaagagtctt

SEQ ID NO: 4634645 - DNA, 17 bp, Homo sapiens
gaggaatacattttatt

SEQ ID NO: 4634646 - DNA, 17 bp, Homo sapiens
gaggaatgctggactgg

SEQ ID NO: 4634647 - DNA, 14 bp, Homo sapiens
gaggaatgtgggct

SEQ ID NO: 4634648 - DNA, 17 bp, Homo sapiens
gaggaatgtgggctatg

SEQ ID NO: 4634649 - DNA, 17 bp, Homo sapiens
gaggacaaaacttcttg

SEQ ID NO: 4634650 - DNA, 18 bp, Homo sapiens
gaggacagaaagaccctg

SEQ ID NO: 4634651 - DNA, 16 bp, Homo sapiens
gaggacctgagcctgc

SEQ ID NO: 4634652 - DNA, 14 bp, Homo sapiens
gaggagagaagaat

SEQ ID NO: 4634653 - DNA, 21 bp, Homo sapiens
gaggagagaagaatgagccta

SEQ ID NO: 4634654 - DNA, 12 bp, Homo sapiens
gaggagagagac

SEQ ID NO: 4634655 - DNA, 23 bp, Homo sapiens
gaggagatgtgatcaggccccac

SEQ ID NO: 4634656 - DNA, 20 bp, Homo sapiens
gaggagcaacggccccagcg

SEQ ID NO: 4634657 - DNA, 13 bp, Homo sapiens
gaggagccaggcc

SEQ ID NO: 4634658 - DNA, 15 bp, Homo sapiens
gaggagccaggcccc

SEQ ID NO: 4634659 - DNA, 13 bp, Homo sapiens
gaggagcccagcg

SEQ ID NO: 4634660 - DNA, 14 bp, Homo sapiens
gaggaggaaaagaa

SEQ ID NO: 4634661 - DNA, 20 bp, Homo sapiens
gaggagggtttgggcagagc

SEQ ID NO: 4634662 - DNA, 21 bp, Homo sapiens
gaggagggtttgggcagagcg

SEQ ID NO: 4634663 - DNA, 21 bp, Homo sapiens
gaggagtcagatgaggccctg

SEQ ID NO: 4634664 - DNA, 20 bp, Homo sapiens
gaggagtctgaggtcctgag

SEQ ID NO: 4634665 - DNA, 16 bp, Homo sapiens
gaggatgaaggaaggg

SEQ ID NO: 4634666 - DNA, 22 bp, Homo sapiens
gaggatgtataaaatggtcatg

SEQ ID NO: 4634667 - DNA, 18 bp, Homo sapiens
gaggatgtccctgggcca

SEQ ID NO: 4634668 - DNA, 14 bp, Homo sapiens
gaggcagatgccct

SEQ ID NO: 4634669 - DNA, 18 bp, Homo sapiens
gaggcagggacaagtctt

SEQ ID NO: 4634670 - DNA, 18 bp, Homo sapiens
gaggcatttgagcagctg

SEQ ID NO: 4634671 - DNA, 17 bp, Homo sapiens
gaggccaaccagcccga

SEQ ID NO: 4634672 - DNA, 11 bp, Homo sapiens
gaggccagcct

SEQ ID NO: 4634673 - DNA, 19 bp, Homo sapiens
gaggccagcctggcctcct

SEQ ID NO: 4634674 - DNA, 20 bp, Homo sapiens
gaggccagcctggcctcctg

SEQ ID NO: 4634675 - DNA, 19 bp, Homo sapiens
gaggcccacggtttcagct

SEQ ID NO: 4634676 - DNA, 13 bp, Homo sapiens
gaggccccaactc

SEQ ID NO: 4634677 - DNA, 22 bp, Homo sapiens
gaggccccgccttttcccccac

SEQ ID NO: 4634678 - DNA, 17 bp, Homo sapiens
gaggcccctggagccag

SEQ ID NO: 4634679 - DNA, 19 bp, Homo sapiens
gaggccctcctgtgctggg

SEQ ID NO: 4634680 - DNA, 21 bp, Homo sapiens
gaggccctcctgtgctggggg

SEQ ID NO: 4634681 - DNA, 13 bp, Homo sapiens
gaggccctggagg

SEQ ID NO: 4634682 - DNA, 14 bp, Homo sapiens
gaggccctggaggt

SEQ ID NO: 4634683 - DNA, 19 bp, Homo sapiens
gaggccctggaggtctcca

SEQ ID NO: 4634684 - DNA, 14 bp, Homo sapiens
gaggccctggatca

SEQ ID NO: 4634685 - DNA, 23 bp, Homo sapiens
gaggccctggatcagcgtggcct

SEQ ID NO: 4634686 - DNA, 18 bp, Homo sapiens
gaggccgttgattcactt

SEQ ID NO: 4634687 - DNA, 21 bp, Homo sapiens
gaggcgccccaacccgtggag

SEQ ID NO: 4634688 - DNA, 22 bp, Homo sapiens
gaggcgccccaacccgtggagg

SEQ ID NO: 4634689 - DNA, 12 bp, Homo sapiens
gaggctcaggtc

SEQ ID NO: 4634690 - DNA, 15 bp, Homo sapiens
gaggctgaggctggc

SEQ ID NO: 4634691 - DNA, 19 bp, Homo sapiens
gaggctgaggctggcacag

SEQ ID NO: 4634692 - DNA, 23 bp, Homo sapiens
gaggctgccccacccctccccat

SEQ ID NO: 4634693 - DNA, 24 bp, Homo sapiens
gaggctgctcggggtgcacaggag

SEQ ID NO: 4634694 - DNA, 20 bp, Homo sapiens
gaggcttccctacacagggc

SEQ ID NO: 4634695 - DNA, 14 bp, Homo sapiens
gaggcttgaaggcc

SEQ ID NO: 4634696 - DNA, 19 bp, Homo sapiens
gaggctttctgggctctgg

SEQ ID NO: 4634697 - DNA, 10 bp, Homo sapiens
gagggaaaag

SEQ ID NO: 4634698 - DNA, 15 bp, Homo sapiens
gagggaaaagggaag

SEQ ID NO: 4634699 - DNA, 16 bp, Homo sapiens
gagggaaaagggaagt

SEQ ID NO: 4634700 - DNA, 16 bp, Homo sapiens
gagggaaatctgtaaa

SEQ ID NO: 4634701 - DNA, 22 bp, Homo sapiens
gagggaaattgtaaatcctgtg

SEQ ID NO: 4634702 - DNA, 16 bp, Homo sapiens
gagggaaggagacagg

SEQ ID NO: 4634703 - DNA, 14 bp, Homo sapiens
gagggaataaatca

SEQ ID NO: 4634704 - DNA, 19 bp, Homo sapiens
gagggacaaaggagcctgt

SEQ ID NO: 4634705 - DNA, 20 bp, Homo sapiens
gagggacaaaggagcctgtg

SEQ ID NO: 4634706 - DNA, 22 bp, Homo sapiens
gagggacaaccagaaggccctt

SEQ ID NO: 4634707 - DNA, 14 bp, Homo sapiens
gagggacaggctga

SEQ ID NO: 4634708 - DNA, 18 bp, Homo sapiens
gagggactgtcgctgctt

SEQ ID NO: 4634709 - DNA, 22 bp, Homo sapiens
gagggagtttaatacaggaaat

SEQ ID NO: 4634710 - DNA, 15 bp, Homo sapiens
gagggattgctgtga

SEQ ID NO: 4634711 - DNA, 17 bp, Homo sapiens
gagggcaacagggagca

SEQ ID NO: 4634712 - DNA, 21 bp, Homo sapiens
gagggcacattaactccctcc

SEQ ID NO: 4634713 - DNA, 22 bp, Homo sapiens
gagggcacattaactccctcca

SEQ ID NO: 4634714 - DNA, 14 bp, Homo sapiens
gagggcagcagcca

SEQ ID NO: 4634715 - DNA, 20 bp, Homo sapiens
gagggcagcagccagccctg

SEQ ID NO: 4634716 - DNA, 18 bp, Homo sapiens
gagggcagcgggagcctc

SEQ ID NO: 4634717 - DNA, 15 bp, Homo sapiens
gagggccacggggag

SEQ ID NO: 4634718 - DNA, 22 bp, Homo sapiens
gagggcccaaagcttgtaaata

SEQ ID NO: 4634719 - DNA, 11 bp, Homo sapiens
gagggctctga

SEQ ID NO: 4634720 - DNA, 12 bp, Homo sapiens
gagggctctgag

SEQ ID NO: 4634721 - DNA, 17 bp, Homo sapiens
gagggcttggcccagcg

SEQ ID NO: 4634722 - DNA, 13 bp, Homo sapiens
gaggggatccagc

SEQ ID NO: 4634723 - DNA, 15 bp, Homo sapiens
gaggggatccagcca

SEQ ID NO: 4634724 - DNA, 16 bp, Homo sapiens
gaggggcaagctaggc

SEQ ID NO: 4634725 - DNA, 20 bp, Homo sapiens
gaggggcagggaaggacagg

SEQ ID NO: 4634726 - DNA, 23 bp, Homo sapiens
gaggggcagtttgggaaggtgat

SEQ ID NO: 4634727 - DNA, 19 bp, Homo sapiens
gagggggtcgtggagagct

SEQ ID NO: 4634728 - DNA, 21 bp, Homo sapiens
gagggggtcgtggagagctag

SEQ ID NO: 4634729 - DNA, 16 bp, Homo sapiens
gaggggtctcggatga

SEQ ID NO: 4634730 - DNA, 19 bp, Homo sapiens
gagggtatactgaggggtc

SEQ ID NO: 4634731 - DNA, 15 bp, Homo sapiens
gagggtcagccaggg

SEQ ID NO: 4634732 - DNA, 16 bp, Homo sapiens
gagggtcagccagggc

SEQ ID NO: 4634733 - DNA, 18 bp, Homo sapiens
gagggtcagccagggcct

SEQ ID NO: 4634734 - DNA, 14 bp, Homo sapiens
gagggtttgggcag

SEQ ID NO: 4634735 - DNA, 17 bp, Homo sapiens
gaggtactagaatgctt

SEQ ID NO: 4634736 - DNA, 19 bp, Homo sapiens
gaggtcaaggctgcagtga

SEQ ID NO: 4634737 - DNA, 21 bp, Homo sapiens
gaggtcaccaggggaggagcc

SEQ ID NO: 4634738 - DNA, 11 bp, Homo sapiens
gaggtcagcct

SEQ ID NO: 4634739 - DNA, 22 bp, Homo sapiens
gaggtcagggagtgctggctca

SEQ ID NO: 4634740 - DNA, 18 bp, Homo sapiens
gaggtcctgagcactgcc

SEQ ID NO: 4634741 - DNA, 16 bp, Homo sapiens
gaggtctcgaccctgt

SEQ ID NO: 4634742 - DNA, 17 bp, Homo sapiens
gaggtctcgaccctgtc

SEQ ID NO: 4634743 - DNA, 18 bp, Homo sapiens
gaggtctcgaccctgtcc

SEQ ID NO: 4634744 - DNA, 15 bp, Homo sapiens
gaggtgaccccaggg

SEQ ID NO: 4634745 - DNA, 16 bp, Homo sapiens
gaggtgaccccagggc

SEQ ID NO: 4634746 - DNA, 18 bp, Homo sapiens
gaggtgaccccagggcac

SEQ ID NO: 4634747 - DNA, 21 bp, Homo sapiens
gaggtgaccccagggcacagg

SEQ ID NO: 4634748 - DNA, 17 bp, Homo sapiens
gaggtgcagtggagggg

SEQ ID NO: 4634749 - DNA, 14 bp, Homo sapiens
gaggtgcccactcc

SEQ ID NO: 4634750 - DNA, 17 bp, Homo sapiens
gaggtgcccactccgcc

SEQ ID NO: 4634751 - DNA, 23 bp, Homo sapiens
gaggtgcccactccgccagccac

SEQ ID NO: 4634752 - DNA, 15 bp, Homo sapiens
gaggtgcccaggaga

SEQ ID NO: 4634753 - DNA, 18 bp, Homo sapiens
gaggtgcctgaaagctgg

SEQ ID NO: 4634754 - DNA, 15 bp, Homo sapiens
gaggtgctgtcccca

SEQ ID NO: 4634755 - DNA, 13 bp, Homo sapiens
gaggtgtgccaga

SEQ ID NO: 4634756 - DNA, 16 bp, Homo sapiens
gaggtgtgccagaaag

SEQ ID NO: 4634757 - DNA, 15 bp, Homo sapiens
gaggttgcattctag

SEQ ID NO: 4634758 - DNA, 22 bp, Homo sapiens
gaggtttcaccatgatggccag

SEQ ID NO: 4634759 - DNA, 22 bp, Homo sapiens
gaggtttttaaatatatatttt

SEQ ID NO: 4634760 - DNA, 20 bp, Homo sapiens
gagtaaaaagacatttttta

SEQ ID NO: 4634761 - DNA, 16 bp, Homo sapiens
gagtaaactgaggccc

SEQ ID NO: 4634762 - DNA, 23 bp, Homo sapiens
gagtacaaatgccttaaaatgga

SEQ ID NO: 4634763 - DNA, 14 bp, Homo sapiens
gagtacctgtgtgt

SEQ ID NO: 4634764 - DNA, 12 bp, Homo sapiens
gagtagcctgga

SEQ ID NO: 4634765 - DNA, 15 bp, Homo sapiens
gagtagcggtccaag

SEQ ID NO: 4634766 - DNA, 17 bp, Homo sapiens
gagtatttctgttcctt

SEQ ID NO: 4634767 - DNA, 16 bp, Homo sapiens
gagtcagatgaggccc

SEQ ID NO: 4634768 - DNA, 17 bp, Homo sapiens
gagtcagatgaggccct

SEQ ID NO: 4634769 - DNA, 23 bp, Homo sapiens
gagtcagtgaagtctagaatcat

SEQ ID NO: 4634770 - DNA, 21 bp, Homo sapiens
gagtcatgttgaaggtgccca

SEQ ID NO: 4634771 - DNA, 12 bp, Homo sapiens
gagtcccagagc

SEQ ID NO: 4634772 - DNA, 20 bp, Homo sapiens
gagtcccttttcattctcct

SEQ ID NO: 4634773 - DNA, 21 bp, Homo sapiens
gagtcccttttcattctcctc

SEQ ID NO: 4634774 - DNA, 12 bp, Homo sapiens
gagtcctgcctt

SEQ ID NO: 4634775 - DNA, 16 bp, Homo sapiens
gagtctatgttcaaag

SEQ ID NO: 4634776 - DNA, 19 bp, Homo sapiens
gagtctatgttcaaagact

SEQ ID NO: 4634777 - DNA, 17 bp, Homo sapiens
gagtctcatttgggcta

SEQ ID NO: 4634778 - DNA, 11 bp, Homo sapiens
gagtctctctt

SEQ ID NO: 4634779 - DNA, 13 bp, Homo sapiens
gagtctgaggtcc

SEQ ID NO: 4634780 - DNA, 14 bp, Homo sapiens
gagtctgaggtcct

SEQ ID NO: 4634781 - DNA, 18 bp, Homo sapiens
gagtctgaggtcctgagc

SEQ ID NO: 4634782 - DNA, 21 bp, Homo sapiens
gagtcttgctcttgtcgccca

SEQ ID NO: 4634783 - DNA, 22 bp, Homo sapiens
gagtcttggtttctctctacag

SEQ ID NO: 4634784 - DNA, 19 bp, Homo sapiens
gagtgaccagcacactgga

SEQ ID NO: 4634785 - DNA, 21 bp, Homo sapiens
gagtgacctccttctgcaaag

SEQ ID NO: 4634786 - DNA, 15 bp, Homo sapiens
gagtgagaggccccc

SEQ ID NO: 4634787 - DNA, 22 bp, Homo sapiens
gagtgcaggggatggggtgggg

SEQ ID NO: 4634788 - DNA, 18 bp, Homo sapiens
gagtgctggctcacagta

SEQ ID NO: 4634789 - DNA, 19 bp, Homo sapiens
gagtggagagaagctcttc

SEQ ID NO: 4634790 - DNA, 16 bp, Homo sapiens
gagtggatgctgtgct

SEQ ID NO: 4634791 - DNA, 14 bp, Homo sapiens
gagtggcctccctg

SEQ ID NO: 4634792 - DNA, 19 bp, Homo sapiens
gagtgggccccgggctgga

SEQ ID NO: 4634793 - DNA, 22 bp, Homo sapiens
gagtgggccccgggctggagaa

SEQ ID NO: 4634794 - DNA, 15 bp, Homo sapiens
gagtggtgcagacag

SEQ ID NO: 4634795 - DNA, 19 bp, Homo sapiens
gagtgtagcctaaagggca

SEQ ID NO: 4634796 - DNA, 22 bp, Homo sapiens
gagtgtagcctaaagggcaggg

SEQ ID NO: 4634797 - DNA, 14 bp, Homo sapiens
gagtgtagctgtaa

SEQ ID NO: 4634798 - DNA, 19 bp, Homo sapiens
gagtgtcctgcccatgccc

SEQ ID NO: 4634799 - DNA, 17 bp, Homo sapiens
gagtgtgacagggccag

SEQ ID NO: 4634800 - DNA, 18 bp, Homo sapiens
gagtgtgagccacctaag

SEQ ID NO: 4634801 - DNA, 15 bp, Homo sapiens
gagtgtgcatggagg

SEQ ID NO: 4634802 - DNA, 18 bp, Homo sapiens
gagttaggggccttaggg

SEQ ID NO: 4634803 - DNA, 21 bp, Homo sapiens
gagttatttaactggtaagcg

SEQ ID NO: 4634804 - DNA, 14 bp, Homo sapiens
gagttcaaatactt

SEQ ID NO: 4634805 - DNA, 22 bp, Homo sapiens
gagttcaataaatgtctgttga

SEQ ID NO: 4634806 - DNA, 11 bp, Homo sapiens
gagttggaatt

SEQ ID NO: 4634807 - DNA, 17 bp, Homo sapiens
gagttgtgatggagggg

SEQ ID NO: 4634808 - DNA, 18 bp, Homo sapiens
gagttgtgatggagggga

SEQ ID NO: 4634809 - DNA, 17 bp, Homo sapiens
gagtttcagctggaaac

SEQ ID NO: 4634810 - DNA, 13 bp, Homo sapiens
gataaaatatttt

SEQ ID NO: 4634811 - DNA, 11 bp, Homo sapiens
gataaaggtga

SEQ ID NO: 4634812 - DNA, 12 bp, Homo sapiens
gataacaccttg

SEQ ID NO: 4634813 - DNA, 11 bp, Homo sapiens
gataactctgt

SEQ ID NO: 4634814 - DNA, 16 bp, Homo sapiens
gataactttacagaaa

SEQ ID NO: 4634815 - DNA, 17 bp, Homo sapiens
gataagcaccagtggga

SEQ ID NO: 4634816 - DNA, 19 bp, Homo sapiens
gataataggggattttaaa

SEQ ID NO: 4634817 - DNA, 14 bp, Homo sapiens
gataatatgtttag

SEQ ID NO: 4634818 - DNA, 20 bp, Homo sapiens
gataatatgtttagttttac

SEQ ID NO: 4634819 - DNA, 22 bp, Homo sapiens
gataatatttttgtatttctct

SEQ ID NO: 4634820 - DNA, 18 bp, Homo sapiens
gataatgaaatagttatt

SEQ ID NO: 4634821 - DNA, 23 bp, Homo sapiens
gataatgaaatagttattttaat

SEQ ID NO: 4634822 - DNA, 17 bp, Homo sapiens
gataatgcttttactaa

SEQ ID NO: 4634823 - DNA, 18 bp, Homo sapiens
gatacaggactggttcct

SEQ ID NO: 4634824 - DNA, 20 bp, Homo sapiens
gatacaggactggttccttc

SEQ ID NO: 4634825 - DNA, 12 bp, Homo sapiens
gatacagttttg

SEQ ID NO: 4634826 - DNA, 11 bp, Homo sapiens
gatacattttt

SEQ ID NO: 4634827 - DNA, 19 bp, Homo sapiens
gatactaatagagtactta

SEQ ID NO: 4634828 - DNA, 22 bp, Homo sapiens
gatactaatagagtacttaata

SEQ ID NO: 4634829 - DNA, 21 bp, Homo sapiens
gatactgacagaagttatttc

SEQ ID NO: 4634830 - DNA, 16 bp, Homo sapiens
gatactggcacagagg

SEQ ID NO: 4634831 - DNA, 23 bp, Homo sapiens
gatagaacacaaaacttgaaaga

SEQ ID NO: 4634832 - DNA, 13 bp, Homo sapiens
gatagataagtat

SEQ ID NO: 4634833 - DNA, 15 bp, Homo sapiens
gatagcattgtgaac

SEQ ID NO: 4634834 - DNA, 18 bp, Homo sapiens
gatagctactaaatatat

SEQ ID NO: 4634835 - DNA, 22 bp, Homo sapiens
gatagtagttaaataactgtgt

SEQ ID NO: 4634836 - DNA, 16 bp, Homo sapiens
gatagtctgggtcaga

SEQ ID NO: 4634837 - DNA, 18 bp, Homo sapiens
gatataaaagactgacca

SEQ ID NO: 4634838 - DNA, 22 bp, Homo sapiens
gatataacacaaagagatattt

SEQ ID NO: 4634839 - DNA, 13 bp, Homo sapiens
gatatcattttaa

SEQ ID NO: 4634840 - DNA, 14 bp, Homo sapiens
gatatgattggcaa

SEQ ID NO: 4634841 - DNA, 15 bp, Homo sapiens
gatatggcattgcac

SEQ ID NO: 4634842 - DNA, 21 bp, Homo sapiens
gatatggcttaggaatgactt

SEQ ID NO: 4634843 - DNA, 14 bp, Homo sapiens
gatattatagaaaa

SEQ ID NO: 4634844 - DNA, 16 bp, Homo sapiens
gatattatagaaaatt

SEQ ID NO: 4634845 - DNA, 20 bp, Homo sapiens
gatatttcaagctcatgtca

SEQ ID NO: 4634846 - DNA, 22 bp, Homo sapiens
gatattttttggtgtgccctgt

SEQ ID NO: 4634847 - DNA, 15 bp, Homo sapiens
gatcaaatatagaaa

SEQ ID NO: 4634848 - DNA, 16 bp, Homo sapiens
gatcaacgcctcactg

SEQ ID NO: 4634849 - DNA, 14 bp, Homo sapiens
gatcacagccccac

SEQ ID NO: 4634850 - DNA, 16 bp, Homo sapiens
gatcacagcctcaccc

SEQ ID NO: 4634851 - DNA, 21 bp, Homo sapiens
gatcacagcctcacccctgcc

SEQ ID NO: 4634852 - DNA, 15 bp, Homo sapiens
gatcagcatgcctgt

SEQ ID NO: 4634853 - DNA, 14 bp, Homo sapiens
gatcagcctgtgcc

SEQ ID NO: 4634854 - DNA, 17 bp, Homo sapiens
gatcaggatcagctttg

SEQ ID NO: 4634855 - DNA, 17 bp, Homo sapiens
gatcaggccccacccct

SEQ ID NO: 4634856 - DNA, 19 bp, Homo sapiens
gatcaggctagccctgccc

SEQ ID NO: 4634857 - DNA, 20 bp, Homo sapiens
gatcaggttatactttaggt

SEQ ID NO: 4634858 - DNA, 17 bp, Homo sapiens
gatcagtatttaactaa

SEQ ID NO: 4634859 - DNA, 23 bp, Homo sapiens
gatcagtcctttgatcagtataa

SEQ ID NO: 4634860 - DNA, 19 bp, Homo sapiens
gatcatatacgtgaaaatt

SEQ ID NO: 4634861 - DNA, 19 bp, Homo sapiens
gatcatgtactttttagta

SEQ ID NO: 4634862 - DNA, 20 bp, Homo sapiens
gatcatgtactttttagtaa

SEQ ID NO: 4634863 - DNA, 17 bp, Homo sapiens
gatcattgccatcacca

SEQ ID NO: 4634864 - DNA, 16 bp, Homo sapiens
gatccaatgttagaga

SEQ ID NO: 4634865 - DNA, 13 bp, Homo sapiens
gatccagccactt

SEQ ID NO: 4634866 - DNA, 20 bp, Homo sapiens
gatccatccatctctctctt

SEQ ID NO: 4634867 - DNA, 16 bp, Homo sapiens
gatcctctcacctcag

SEQ ID NO: 4634868 - DNA, 19 bp, Homo sapiens
gatcctctcacctcagcct

SEQ ID NO: 4634869 - DNA, 14 bp, Homo sapiens
gatcgacagacagc

SEQ ID NO: 4634870 - DNA, 16 bp, Homo sapiens
gatctcacaggctgag

SEQ ID NO: 4634871 - DNA, 13 bp, Homo sapiens
gatctcctgacct

SEQ ID NO: 4634872 - DNA, 20 bp, Homo sapiens
gatctcctgccagcccagct

SEQ ID NO: 4634873 - DNA, 22 bp, Homo sapiens
gatctcctgccagcccagctgg

SEQ ID NO: 4634874 - DNA, 18 bp, Homo sapiens
gatctctctagctttgtc

SEQ ID NO: 4634875 - DNA, 24 bp, Homo sapiens
gatctctgagaccacagaggctca

SEQ ID NO: 4634876 - DNA, 19 bp, Homo sapiens
gatctgccagacctgcatg

SEQ ID NO: 4634877 - DNA, 20 bp, Homo sapiens
gatctgccagacctgcatgg

SEQ ID NO: 4634878 - DNA, 15 bp, Homo sapiens
gatctggggaggcag

SEQ ID NO: 4634879 - DNA, 14 bp, Homo sapiens
gatcttgaatgtgg

SEQ ID NO: 4634880 - DNA, 19 bp, Homo sapiens
gatcttgagcaagttcctt

SEQ ID NO: 4634881 - DNA, 18 bp, Homo sapiens
gatcttttcgaagctgtt

SEQ ID NO: 4634882 - DNA, 18 bp, Homo sapiens
gatgaactgactgaagga

SEQ ID NO: 4634883 - DNA, 13 bp, Homo sapiens
gatgaaggaaggg

SEQ ID NO: 4634884 - DNA, 15 bp, Homo sapiens
gatgacaccctggcc

SEQ ID NO: 4634885 - DNA, 14 bp, Homo sapiens
gatgaccagggatg

SEQ ID NO: 4634886 - DNA, 18 bp, Homo sapiens
gatgagaaacagctcagc

SEQ ID NO: 4634887 - DNA, 17 bp, Homo sapiens
gatgagacccagcccct

SEQ ID NO: 4634888 - DNA, 19 bp, Homo sapiens
gatgagacccagccccttc

SEQ ID NO: 4634889 - DNA, 15 bp, Homo sapiens
gatgagcccaccctg

SEQ ID NO: 4634890 - DNA, 13 bp, Homo sapiens
gatgagcctgggc

SEQ ID NO: 4634891 - DNA, 12 bp, Homo sapiens
gatgaggccctg

SEQ ID NO: 4634892 - DNA, 14 bp, Homo sapiens
gatgagggcagcag

SEQ ID NO: 4634893 - DNA, 20 bp, Homo sapiens
gatgagggcagcagccagcc

SEQ ID NO: 4634894 - DNA, 20 bp, Homo sapiens
gatgaggtcaccaggggagg

SEQ ID NO: 4634895 - DNA, 22 bp, Homo sapiens
gatgatcgctgtattttgagtt

SEQ ID NO: 4634896 - DNA, 15 bp, Homo sapiens
gatgcacatccctgg

SEQ ID NO: 4634897 - DNA, 16 bp, Homo sapiens
gatgcacatccctgga

SEQ ID NO: 4634898 - DNA, 18 bp, Homo sapiens
gatgcagataaaatattt

SEQ ID NO: 4634899 - DNA, 14 bp, Homo sapiens
gatgcatgtctttt

SEQ ID NO: 4634900 - DNA, 16 bp, Homo sapiens
gatgcatgtcttttaa

SEQ ID NO: 4634901 - DNA, 22 bp, Homo sapiens
gatgcatgtcttttaaaatgca

SEQ ID NO: 4634902 - DNA, 13 bp, Homo sapiens
gatgccaccggcc

SEQ ID NO: 4634903 - DNA, 15 bp, Homo sapiens
gatgccaccggcctg

SEQ ID NO: 4634904 - DNA, 18 bp, Homo sapiens
gatgcccttgctgggcct

SEQ ID NO: 4634905 - DNA, 21 bp, Homo sapiens
gatgcccttgctgggcctggg

SEQ ID NO: 4634906 - DNA, 16 bp, Homo sapiens
gatgcctcctgtcaga

SEQ ID NO: 4634907 - DNA, 17 bp, Homo sapiens
gatgcggatcctgctgg

SEQ ID NO: 4634908 - DNA, 18 bp, Homo sapiens
gatgcggatcctgctggg

SEQ ID NO: 4634909 - DNA, 20 bp, Homo sapiens
gatgcgggccagtgctccag

SEQ ID NO: 4634910 - DNA, 20 bp, Homo sapiens
gatgctgacattcacctgcc

SEQ ID NO: 4634911 - DNA, 15 bp, Homo sapiens
gatgctgggctgggc

SEQ ID NO: 4634912 - DNA, 20 bp, Homo sapiens
gatgctgggctgggccctct

SEQ ID NO: 4634913 - DNA, 17 bp, Homo sapiens
gatggaacacggccaca

SEQ ID NO: 4634914 - DNA, 18 bp, Homo sapiens
gatggacacgagccacaa

SEQ ID NO: 4634915 - DNA, 23 bp, Homo sapiens
gatggacacgagccacaagctgc

SEQ ID NO: 4634916 - DNA, 21 bp, Homo sapiens
gatggagcaagctcttccctt

SEQ ID NO: 4634917 - DNA, 21 bp, Homo sapiens
gatggagtctcactcttgtca

SEQ ID NO: 4634918 - DNA, 17 bp, Homo sapiens
gatggcaacattggaca

SEQ ID NO: 4634919 - DNA, 13 bp, Homo sapiens
gatggcagactct

SEQ ID NO: 4634920 - DNA, 18 bp, Homo sapiens
gatggcagactctttaat

SEQ ID NO: 4634921 - DNA, 19 bp, Homo sapiens
gatggcagactctttaata

SEQ ID NO: 4634922 - DNA, 23 bp, Homo sapiens
gatggcagactctttaataaatt

SEQ ID NO: 4634923 - DNA, 15 bp, Homo sapiens
gatggcatcctgtga

SEQ ID NO: 4634924 - DNA, 18 bp, Homo sapiens
gatggccggagaggaccg

SEQ ID NO: 4634925 - DNA, 20 bp, Homo sapiens
gatgggagggaggctcaggt

SEQ ID NO: 4634926 - DNA, 18 bp, Homo sapiens
gatgggcaaagcttgtca

SEQ ID NO: 4634927 - DNA, 23 bp, Homo sapiens
gatgggcatatgtgtcagtgggg

SEQ ID NO: 4634928 - DNA, 18 bp, Homo sapiens
gatggtcggatctcacag

SEQ ID NO: 4634929 - DNA, 20 bp, Homo sapiens
gatgtacttctctgtgtgca

SEQ ID NO: 4634930 - DNA, 13 bp, Homo sapiens
gatgtagaaagtt

SEQ ID NO: 4634931 - DNA, 16 bp, Homo sapiens
gatgtaggagggactg

SEQ ID NO: 4634932 - DNA, 22 bp, Homo sapiens
gatgtcaggatgttgctccatc

SEQ ID NO: 4634933 - DNA, 18 bp, Homo sapiens
gatgtcatgtctgcttgt

SEQ ID NO: 4634934 - DNA, 20 bp, Homo sapiens
gatgtcatgtctgcttgtca

SEQ ID NO: 4634935 - DNA, 21 bp, Homo sapiens
gatgtccctgggccagggtct

SEQ ID NO: 4634936 - DNA, 14 bp, Homo sapiens
gatgtctgttgaaa

SEQ ID NO: 4634937 - DNA, 13 bp, Homo sapiens
gatgtgaagccaa

SEQ ID NO: 4634938 - DNA, 23 bp, Homo sapiens
gatgtgaagccaattcagacagg

SEQ ID NO: 4634939 - DNA, 17 bp, Homo sapiens
gatgtgatcaggcccca

SEQ ID NO: 4634940 - DNA, 14 bp, Homo sapiens
gatgtggaggaaga

SEQ ID NO: 4634941 - DNA, 18 bp, Homo sapiens
gatgtggaggaagagcca

SEQ ID NO: 4634942 - DNA, 17 bp, Homo sapiens
gatgttgctgttcacag

SEQ ID NO: 4634943 - DNA, 22 bp, Homo sapiens
gatgtttgttttcaaaatactt

SEQ ID NO: 4634944 - DNA, 12 bp, Homo sapiens
gattaaaccttt

SEQ ID NO: 4634945 - DNA, 15 bp, Homo sapiens
gattaaaccttttta

SEQ ID NO: 4634946 - DNA, 17 bp, Homo sapiens
gattaaatatttgaaga

SEQ ID NO: 4634947 - DNA, 17 bp, Homo sapiens
gattaatgttttcatta

SEQ ID NO: 4634948 - DNA, 21 bp, Homo sapiens
gattacaggtgtgtgggccac

SEQ ID NO: 4634949 - DNA, 21 bp, Homo sapiens
gattaggctcttttaggtaac

SEQ ID NO: 4634950 - DNA, 19 bp, Homo sapiens
gattataaaattaatcaca

SEQ ID NO: 4634951 - DNA, 22 bp, Homo sapiens
gattcaagactcaatgtggaaa

SEQ ID NO: 4634952 - DNA, 19 bp, Homo sapiens
gattcaggaaaaggcctgg

SEQ ID NO: 4634953 - DNA, 23 bp, Homo sapiens
gattcaggaaaaggcctggggtg

SEQ ID NO: 4634954 - DNA, 22 bp, Homo sapiens
gattcatggagtagcctggact

SEQ ID NO: 4634955 - DNA, 20 bp, Homo sapiens
gattcattctcataattcct

SEQ ID NO: 4634956 - DNA, 18 bp, Homo sapiens
gattcccaagctcccttc

SEQ ID NO: 4634957 - DNA, 18 bp, Homo sapiens
gattccctctcccaggcc

SEQ ID NO: 4634958 - DNA, 20 bp, Homo sapiens
gattcctctcatttccagct

SEQ ID NO: 4634959 - DNA, 20 bp, Homo sapiens
gattctaccgtaattgcttt

SEQ ID NO: 4634960 - DNA, 22 bp, Homo sapiens
gattctaccgtaattgctttgt

SEQ ID NO: 4634961 - DNA, 19 bp, Homo sapiens
gattgacattctacagttg

SEQ ID NO: 4634962 - DNA, 11 bp, Homo sapiens
gattgattttc

SEQ ID NO: 4634963 - DNA, 15 bp, Homo sapiens
gattggaatgcagag

SEQ ID NO: 4634964 - DNA, 15 bp, Homo sapiens
gattgtactgttcat

SEQ ID NO: 4634965 - DNA, 17 bp, Homo sapiens
gattgttttggtctcaa

SEQ ID NO: 4634966 - DNA, 23 bp, Homo sapiens
gatttaaaaacaaccaacagaaa

SEQ ID NO: 4634967 - DNA, 22 bp, Homo sapiens
gatttaaccttaattttacagc

SEQ ID NO: 4634968 - DNA, 19 bp, Homo sapiens
gatttagaagatagaaata

SEQ ID NO: 4634969 - DNA, 16 bp, Homo sapiens
gatttcatccttgaat

SEQ ID NO: 4634970 - DNA, 15 bp, Homo sapiens
gatttctaattgtaa

SEQ ID NO: 4634971 - DNA, 14 bp, Homo sapiens
gatttggccaggcc

SEQ ID NO: 4634972 - DNA, 15 bp, Homo sapiens
gatttggccaggcct

SEQ ID NO: 4634973 - DNA, 18 bp, Homo sapiens
gatttgtgtttctttata

SEQ ID NO: 4634974 - DNA, 21 bp, Homo sapiens
gattttcaaccagataacata

SEQ ID NO: 4634975 - DNA, 15 bp, Homo sapiens
gattttcctttgtag

SEQ ID NO: 4634976 - DNA, 12 bp, Homo sapiens
gattttgaggtt

SEQ ID NO: 4634977 - DNA, 16 bp, Homo sapiens
gattttgctgtagaag

SEQ ID NO: 4634978 - DNA, 17 bp, Homo sapiens
gatttttaaaaaatatt

SEQ ID NO: 4634979 - DNA, 13 bp, Homo sapiens
gatttttaaagtt

SEQ ID NO: 4634980 - DNA, 13 bp, Homo sapiens
gatttttttcctc

SEQ ID NO: 4634981 - DNA, 17 bp, Homo sapiens
gcaaaactcaggcagaa

SEQ ID NO: 4634982 - DNA, 13 bp, Homo sapiens
gcaaaaggcctct

SEQ ID NO: 4634983 - DNA, 19 bp, Homo sapiens
gcaaaatacacgtttatct

SEQ ID NO: 4634984 - DNA, 12 bp, Homo sapiens
gcaaaattaaat

SEQ ID NO: 4634985 - DNA, 14 bp, Homo sapiens
gcaaacactccacc

SEQ ID NO: 4634986 - DNA, 17 bp, Homo sapiens
gcaaaccattatacctt

SEQ ID NO: 4634987 - DNA, 19 bp, Homo sapiens
gcaaacgagactttctcct

SEQ ID NO: 4634988 - DNA, 14 bp, Homo sapiens
gcaaagctggttgt

SEQ ID NO: 4634989 - DNA, 20 bp, Homo sapiens
gcaaaggagaagcacagctc

SEQ ID NO: 4634990 - DNA, 12 bp, Homo sapiens
gcaaataaaagt

SEQ ID NO: 4634991 - DNA, 17 bp, Homo sapiens
gcaaatcctatgtgatt

SEQ ID NO: 4634992 - DNA, 20 bp, Homo sapiens
gcaaattaaaacatatttca

SEQ ID NO: 4634993 - DNA, 18 bp, Homo sapiens
gcaaatttctataaattt

SEQ ID NO: 4634994 - DNA, 22 bp, Homo sapiens
gcaaatttctataaatttaaga

SEQ ID NO: 4634995 - DNA, 21 bp, Homo sapiens
gcaacaacaattggtaaaact

SEQ ID NO: 4634996 - DNA, 22 bp, Homo sapiens
gcaacaacaattggtaaaactc

SEQ ID NO: 4634997 - DNA, 16 bp, Homo sapiens
gcaacagaaaccaaga

SEQ ID NO: 4634998 - DNA, 23 bp, Homo sapiens
gcaacagatagatgttgctcttt

SEQ ID NO: 4634999 - DNA, 15 bp, Homo sapiens
gcaacagggagcacc

SEQ ID NO: 4635000 - DNA, 20 bp, Homo sapiens
gcaacattggacagaaaatg

SEQ ID NO: 4635001 - DNA, 17 bp, Homo sapiens
gcaaccagggagctgca

SEQ ID NO: 4635002 - DNA, 23 bp, Homo sapiens
gcaaccagggagctgcaggggca

SEQ ID NO: 4635003 - DNA, 14 bp, Homo sapiens
gcaacctacccagc

SEQ ID NO: 4635004 - DNA, 16 bp, Homo sapiens
gcaacctcttggcctg

SEQ ID NO: 4635005 - DNA, 15 bp, Homo sapiens
gcaagaatttgatcg

SEQ ID NO: 4635006 - DNA, 23 bp, Homo sapiens
gcaagacacgtggcctcgtgagg

SEQ ID NO: 4635007 - DNA, 14 bp, Homo sapiens
gcaagaccctgcct

SEQ ID NO: 4635008 - DNA, 14 bp, Homo sapiens
gcaagccctgccca

SEQ ID NO: 4635009 - DNA, 15 bp, Homo sapiens
gcaagccctgcccac

SEQ ID NO: 4635010 - DNA, 20 bp, Homo sapiens
gcaagccctgcccacagaaa

SEQ ID NO: 4635011 - DNA, 17 bp, Homo sapiens
gcaagctaggccccaga

SEQ ID NO: 4635012 - DNA, 20 bp, Homo sapiens
gcaagctttgctccttcagt

SEQ ID NO: 4635013 - DNA, 16 bp, Homo sapiens
gcaaggagaaaatata

SEQ ID NO: 4635014 - DNA, 19 bp, Homo sapiens
gcaaggaggaggagtcaga

SEQ ID NO: 4635015 - DNA, 19 bp, Homo sapiens
gcaaggcccgagcagctga

SEQ ID NO: 4635016 - DNA, 20 bp, Homo sapiens
gcaaggcccgagcagctgag

SEQ ID NO: 4635017 - DNA, 19 bp, Homo sapiens
gcaatacattaaaataact

SEQ ID NO: 4635018 - DNA, 12 bp, Homo sapiens
gcaatctcagct

SEQ ID NO: 4635019 - DNA, 22 bp, Homo sapiens
gcaatctgaccctatgggtcta

SEQ ID NO: 4635020 - DNA, 23 bp, Homo sapiens
gcaatgacataaccaatttgtaa

SEQ ID NO: 4635021 - DNA, 20 bp, Homo sapiens
gcaatggccaggggccagga

SEQ ID NO: 4635022 - DNA, 21 bp, Homo sapiens
gcaatggccaggggccaggag

SEQ ID NO: 4635023 - DNA, 18 bp, Homo sapiens
gcaattccaagaaaatat

SEQ ID NO: 4635024 - DNA, 19 bp, Homo sapiens
gcaattccaagaaaatatc

SEQ ID NO: 4635025 - DNA, 14 bp, Homo sapiens
gcacaaagtggcat

SEQ ID NO: 4635026 - DNA, 19 bp, Homo sapiens
gcacaattcctgtgctcaa

SEQ ID NO: 4635027 - DNA, 23 bp, Homo sapiens
gcacacacggttttggcagctga

SEQ ID NO: 4635028 - DNA, 18 bp, Homo sapiens
gcacacagctgagcactt

SEQ ID NO: 4635029 - DNA, 15 bp, Homo sapiens
gcacacaggcagcca

SEQ ID NO: 4635030 - DNA, 11 bp, Homo sapiens
gcacactattt

SEQ ID NO: 4635031 - DNA, 23 bp, Homo sapiens
gcacactctcttctccattccct

SEQ ID NO: 4635032 - DNA, 20 bp, Homo sapiens
gcacactcttctcttgagca

SEQ ID NO: 4635033 - DNA, 16 bp, Homo sapiens
gcacagaacaggaggt

SEQ ID NO: 4635034 - DNA, 22 bp, Homo sapiens
gcacagcagcctggggctggcc

SEQ ID NO: 4635035 - DNA, 14 bp, Homo sapiens
gcacagctcctgcc

SEQ ID NO: 4635036 - DNA, 15 bp, Homo sapiens
gcacagctcctgcca

SEQ ID NO: 4635037 - DNA, 16 bp, Homo sapiens
gcacagctgtttgaaa

SEQ ID NO: 4635038 - DNA, 14 bp, Homo sapiens
gcacaggacatgcg

SEQ ID NO: 4635039 - DNA, 13 bp, Homo sapiens
gcacagtgggagc

SEQ ID NO: 4635040 - DNA, 20 bp, Homo sapiens
gcacagtgggagctgagctg

SEQ ID NO: 4635041 - DNA, 18 bp, Homo sapiens
gcacatcatgagccttca

SEQ ID NO: 4635042 - DNA, 13 bp, Homo sapiens
gcacatccctgga

SEQ ID NO: 4635043 - DNA, 23 bp, Homo sapiens
gcacattaactccctccaccagc

SEQ ID NO: 4635044 - DNA, 19 bp, Homo sapiens
gcaccaagggacaggagaa

SEQ ID NO: 4635045 - DNA, 22 bp, Homo sapiens
gcacccccacaagctgtccctg

SEQ ID NO: 4635046 - DNA, 16 bp, Homo sapiens
gcacccccagcctggg

SEQ ID NO: 4635047 - DNA, 19 bp, Homo sapiens
gcaccccctgcagcttgta

SEQ ID NO: 4635048 - DNA, 24 bp, Homo sapiens
gcaccccctgcagcttgtagccag

SEQ ID NO: 4635049 - DNA, 20 bp, Homo sapiens
gcaccctcatacacagaaac

SEQ ID NO: 4635050 - DNA, 15 bp, Homo sapiens
gcaccctccctagct

SEQ ID NO: 4635051 - DNA, 20 bp, Homo sapiens
gcaccgccacgtcccagcat

SEQ ID NO: 4635052 - DNA, 21 bp, Homo sapiens
gcaccgcctgaaggcacagct

SEQ ID NO: 4635053 - DNA, 15 bp, Homo sapiens
gcaccgttctgtgca

SEQ ID NO: 4635054 - DNA, 15 bp, Homo sapiens
gcacctccaggcctg

SEQ ID NO: 4635055 - DNA, 19 bp, Homo sapiens
gcacctctgttcatttcac

SEQ ID NO: 4635056 - DNA, 16 bp, Homo sapiens
gcacctgcctcaggac

SEQ ID NO: 4635057 - DNA, 19 bp, Homo sapiens
gcacctgggccctggggcc

SEQ ID NO: 4635058 - DNA, 23 bp, Homo sapiens
gcacctgggccctggggcctgta

SEQ ID NO: 4635059 - DNA, 11 bp, Homo sapiens
gcacctgtccc

SEQ ID NO: 4635060 - DNA, 11 bp, Homo sapiens
gcacctgtctg

SEQ ID NO: 4635061 - DNA, 14 bp, Homo sapiens
gcactactgggtgt

SEQ ID NO: 4635062 - DNA, 17 bp, Homo sapiens
gcactactgggtgtcat

SEQ ID NO: 4635063 - DNA, 15 bp, Homo sapiens
gcactccagcctggg

SEQ ID NO: 4635064 - DNA, 14 bp, Homo sapiens
gcactccccagagc

SEQ ID NO: 4635065 - DNA, 18 bp, Homo sapiens
gcactccccagagctgtg

SEQ ID NO: 4635066 - DNA, 22 bp, Homo sapiens
gcactccccagagctgtgccag

SEQ ID NO: 4635067 - DNA, 21 bp, Homo sapiens
gcactccgcgccgatgccacc

SEQ ID NO: 4635068 - DNA, 23 bp, Homo sapiens
gcactccgcgccgatgccaccgg

SEQ ID NO: 4635069 - DNA, 20 bp, Homo sapiens
gcactctttaagggagtgta

SEQ ID NO: 4635070 - DNA, 21 bp, Homo sapiens
gcactgaaggctttcagggcc

SEQ ID NO: 4635071 - DNA, 21 bp, Homo sapiens
gcactgcccatggacaggctg

SEQ ID NO: 4635072 - DNA, 14 bp, Homo sapiens
gcactgcctctcac

SEQ ID NO: 4635073 - DNA, 19 bp, Homo sapiens
gcactgcctctcacagctg

SEQ ID NO: 4635074 - DNA, 12 bp, Homo sapiens
gcactgggctgt

SEQ ID NO: 4635075 - DNA, 19 bp, Homo sapiens
gcactggtaggttgggaca

SEQ ID NO: 4635076 - DNA, 23 bp, Homo sapiens
gcactggtaggttgggacaccag

SEQ ID NO: 4635077 - DNA, 16 bp, Homo sapiens
gcacttaatttgtaaa

SEQ ID NO: 4635078 - DNA, 17 bp, Homo sapiens
gcacttaatttgtaaac

SEQ ID NO: 4635079 - DNA, 16 bp, Homo sapiens
gcacttagacctgcca

SEQ ID NO: 4635080 - DNA, 23 bp, Homo sapiens
gcacttatctcgaatttgaagag

SEQ ID NO: 4635081 - DNA, 16 bp, Homo sapiens
gcacttccacctccag

SEQ ID NO: 4635082 - DNA, 21 bp, Homo sapiens
gcacttccttttacctgccca

SEQ ID NO: 4635083 - DNA, 16 bp, Homo sapiens
gcacttgagctgtctg

SEQ ID NO: 4635084 - DNA, 20 bp, Homo sapiens
gcacttgattaagcttttgt

SEQ ID NO: 4635085 - DNA, 17 bp, Homo sapiens
gcactttcctttcaata

SEQ ID NO: 4635086 - DNA, 21 bp, Homo sapiens
gcactttcctttcaataaagt

SEQ ID NO: 4635087 - DNA, 23 bp, Homo sapiens
gcactttcctttcaataaagttg

SEQ ID NO: 4635088 - DNA, 22 bp, Homo sapiens
gcagaaatagttgtctgtgctt

SEQ ID NO: 4635089 - DNA, 19 bp, Homo sapiens
gcagaagacgggaggggag

SEQ ID NO: 4635090 - DNA, 14 bp, Homo sapiens
gcagaatgaagcca

SEQ ID NO: 4635091 - DNA, 13 bp, Homo sapiens
gcagacagacaat

SEQ ID NO: 4635092 - DNA, 15 bp, Homo sapiens
gcagacagcaggcag

SEQ ID NO: 4635093 - DNA, 19 bp, Homo sapiens
gcagacagcaggcagcgcc

SEQ ID NO: 4635094 - DNA, 17 bp, Homo sapiens
gcagactgtgaacttga

SEQ ID NO: 4635095 - DNA, 13 bp, Homo sapiens
gcagagcagacag

SEQ ID NO: 4635096 - DNA, 14 bp, Homo sapiens
gcagagggacaacc

SEQ ID NO: 4635097 - DNA, 20 bp, Homo sapiens
gcagagggacaaccagaagg

SEQ ID NO: 4635098 - DNA, 19 bp, Homo sapiens
gcagaggggcagatggaaa

SEQ ID NO: 4635099 - DNA, 14 bp, Homo sapiens
gcagaggtctccaa

SEQ ID NO: 4635100 - DNA, 19 bp, Homo sapiens
gcagaggtctccaaactga

SEQ ID NO: 4635101 - DNA, 19 bp, Homo sapiens
gcagagtcctgccttcttc

SEQ ID NO: 4635102 - DNA, 14 bp, Homo sapiens
gcagataaaatatt

SEQ ID NO: 4635103 - DNA, 13 bp, Homo sapiens
gcagatgcccttg

SEQ ID NO: 4635104 - DNA, 23 bp, Homo sapiens
gcagatgcccttgctgggcctgg

SEQ ID NO: 4635105 - DNA, 14 bp, Homo sapiens
gcagatgtaggagg

SEQ ID NO: 4635106 - DNA, 20 bp, Homo sapiens
gcagcaatattttgtatatt

SEQ ID NO: 4635107 - DNA, 19 bp, Homo sapiens
gcagcaccgttctgtgcac

SEQ ID NO: 4635108 - DNA, 19 bp, Homo sapiens
gcagcacttagacctgcca

SEQ ID NO: 4635109 - DNA, 20 bp, Homo sapiens
gcagcacttagacctgccag

SEQ ID NO: 4635110 - DNA, 18 bp, Homo sapiens
gcagcagagcctggaaga

SEQ ID NO: 4635111 - DNA, 12 bp, Homo sapiens
gcagcagcactt

SEQ ID NO: 4635112 - DNA, 13 bp, Homo sapiens
gcagcagccagcc

SEQ ID NO: 4635113 - DNA, 15 bp, Homo sapiens
gcagcagccagccct

SEQ ID NO: 4635114 - DNA, 18 bp, Homo sapiens
gcagcagccagccctgcc

SEQ ID NO: 4635115 - DNA, 20 bp, Homo sapiens
gcagcagccagccctgcctg

SEQ ID NO: 4635116 - DNA, 21 bp, Homo sapiens
gcagcagccagccctgcctgg

SEQ ID NO: 4635117 - DNA, 21 bp, Homo sapiens
gcagcaggaggctttctgggc

SEQ ID NO: 4635118 - DNA, 17 bp, Homo sapiens
gcagcagttgaggtggg

SEQ ID NO: 4635119 - DNA, 16 bp, Homo sapiens
gcagcatggagagagg

SEQ ID NO: 4635120 - DNA, 18 bp, Homo sapiens
gcagccacacttctcagg

SEQ ID NO: 4635121 - DNA, 20 bp, Homo sapiens
gcagccacacttctcaggac

SEQ ID NO: 4635122 - DNA, 14 bp, Homo sapiens
gcagccagccctgc

SEQ ID NO: 4635123 - DNA, 12 bp, Homo sapiens
gcagcccaaagg

SEQ ID NO: 4635124 - DNA, 14 bp, Homo sapiens
gcagcccaaggaca

SEQ ID NO: 4635125 - DNA, 15 bp, Homo sapiens
gcagcccctgttttc

SEQ ID NO: 4635126 - DNA, 21 bp, Homo sapiens
gcagcccctgttttctgctgt

SEQ ID NO: 4635127 - DNA, 21 bp, Homo sapiens
gcagcccttgctttcggagct

SEQ ID NO: 4635128 - DNA, 21 bp, Homo sapiens
gcagcctgctctagtgggaca

SEQ ID NO: 4635129 - DNA, 10 bp, Homo sapiens
gcagcctggg

SEQ ID NO: 4635130 - DNA, 13 bp, Homo sapiens
gcagcgccaggct

SEQ ID NO: 4635131 - DNA, 14 bp, Homo sapiens
gcagcgccaggctg

SEQ ID NO: 4635132 - DNA, 13 bp, Homo sapiens
gcagcgggcggag

SEQ ID NO: 4635133 - DNA, 22 bp, Homo sapiens
gcagcgggcggaggggatccag

SEQ ID NO: 4635134 - DNA, 20 bp, Homo sapiens
gcagctcctctgtctcgagc

SEQ ID NO: 4635135 - DNA, 18 bp, Homo sapiens
gcagctgaataacctgca

SEQ ID NO: 4635136 - DNA, 23 bp, Homo sapiens
gcagctgaataacctgcacaggc

SEQ ID NO: 4635137 - DNA, 11 bp, Homo sapiens
gcagctgccta

SEQ ID NO: 4635138 - DNA, 13 bp, Homo sapiens
gcagctgcctagg

SEQ ID NO: 4635139 - DNA, 18 bp, Homo sapiens
gcagcttgtagccagccg

SEQ ID NO: 4635140 - DNA, 22 bp, Homo sapiens
gcaggaaagcatgcattgaaaa

SEQ ID NO: 4635141 - DNA, 19 bp, Homo sapiens
gcaggaacttctagctcat

SEQ ID NO: 4635142 - DNA, 15 bp, Homo sapiens
gcaggaataaagact

SEQ ID NO: 4635143 - DNA, 13 bp, Homo sapiens
gcaggacaggaaa

SEQ ID NO: 4635144 - DNA, 14 bp, Homo sapiens
gcaggagccccgcc

SEQ ID NO: 4635145 - DNA, 18 bp, Homo sapiens
gcaggagccccgccacag

SEQ ID NO: 4635146 - DNA, 19 bp, Homo sapiens
gcaggagccccgccacagc

SEQ ID NO: 4635147 - DNA, 16 bp, Homo sapiens
gcaggagctactgaga

SEQ ID NO: 4635148 - DNA, 19 bp, Homo sapiens
gcaggaggctttctgggct

SEQ ID NO: 4635149 - DNA, 14 bp, Homo sapiens
gcaggagtagctga

SEQ ID NO: 4635150 - DNA, 16 bp, Homo sapiens
gcaggagtagctgagc

SEQ ID NO: 4635151 - DNA, 14 bp, Homo sapiens
gcaggcaccgccac

SEQ ID NO: 4635152 - DNA, 18 bp, Homo sapiens
gcaggcattgaggaagag

SEQ ID NO: 4635153 - DNA, 21 bp, Homo sapiens
gcaggccaaacatggccagac

SEQ ID NO: 4635154 - DNA, 20 bp, Homo sapiens
gcaggccgggcctgctgtca

SEQ ID NO: 4635155 - DNA, 18 bp, Homo sapiens
gcagggaccggcagagct

SEQ ID NO: 4635156 - DNA, 22 bp, Homo sapiens
gcagggccatctgactgccaag

SEQ ID NO: 4635157 - DNA, 14 bp, Homo sapiens
gcagggcccacgtg

SEQ ID NO: 4635158 - DNA, 13 bp, Homo sapiens
gcagggcctggca

SEQ ID NO: 4635159 - DNA, 19 bp, Homo sapiens
gcagggctggtcacctccc

SEQ ID NO: 4635160 - DNA, 13 bp, Homo sapiens
gcagggcttctcc

SEQ ID NO: 4635161 - DNA, 21 bp, Homo sapiens
gcaggggagggtcagccaggg

SEQ ID NO: 4635162 - DNA, 23 bp, Homo sapiens
gcaggggcgggcggagggagggg

SEQ ID NO: 4635163 - DNA, 18 bp, Homo sapiens
gcagggggccccgccagg

SEQ ID NO: 4635164 - DNA, 21 bp, Homo sapiens
gcagggggccccgccagggct

SEQ ID NO: 4635165 - DNA, 17 bp, Homo sapiens
gcaggggggctgtgcca

SEQ ID NO: 4635166 - DNA, 17 bp, Homo sapiens
gcaggtagacctgtctc

SEQ ID NO: 4635167 - DNA, 19 bp, Homo sapiens
gcaggtagacctgtctcct

SEQ ID NO: 4635168 - DNA, 17 bp, Homo sapiens
gcaggtatttagaagca

SEQ ID NO: 4635169 - DNA, 19 bp, Homo sapiens
gcaggtatttagaagcaga

SEQ ID NO: 4635170 - DNA, 20 bp, Homo sapiens
gcaggtatttcagaaggaga

SEQ ID NO: 4635171 - DNA, 14 bp, Homo sapiens
gcaggtgggcagac

SEQ ID NO: 4635172 - DNA, 15 bp, Homo sapiens
gcaggttcccaagct

SEQ ID NO: 4635173 - DNA, 18 bp, Homo sapiens
gcaggttcccaagctcag

SEQ ID NO: 4635174 - DNA, 15 bp, Homo sapiens
gcaggttccccaagg

SEQ ID NO: 4635175 - DNA, 23 bp, Homo sapiens
gcaggttccccaagggccctggc

SEQ ID NO: 4635176 - DNA, 22 bp, Homo sapiens
gcaggttcttcttcctgaagct

SEQ ID NO: 4635177 - DNA, 16 bp, Homo sapiens
gcagtcactgggagag

SEQ ID NO: 4635178 - DNA, 22 bp, Homo sapiens
gcagtctaaacagagtccggga

SEQ ID NO: 4635179 - DNA, 12 bp, Homo sapiens
gcagtctttccc

SEQ ID NO: 4635180 - DNA, 13 bp, Homo sapiens
gcagtctttcccc

SEQ ID NO: 4635181 - DNA, 16 bp, Homo sapiens
gcagtctttcccccag

SEQ ID NO: 4635182 - DNA, 18 bp, Homo sapiens
gcagtctttcccccagga

SEQ ID NO: 4635183 - DNA, 18 bp, Homo sapiens
gcagtgcccatgtgtaca

SEQ ID NO: 4635184 - DNA, 19 bp, Homo sapiens
gcagtgcccatgtgtacat

SEQ ID NO: 4635185 - DNA, 13 bp, Homo sapiens
gcagtgccctttg

SEQ ID NO: 4635186 - DNA, 14 bp, Homo sapiens
gcagtggagggggc

SEQ ID NO: 4635187 - DNA, 18 bp, Homo sapiens
gcagtggcaggggagcag

SEQ ID NO: 4635188 - DNA, 18 bp, Homo sapiens
gcagtggccatcatcctc

SEQ ID NO: 4635189 - DNA, 17 bp, Homo sapiens
gcagtggggtcaagctg

SEQ ID NO: 4635190 - DNA, 22 bp, Homo sapiens
gcagtggggtcaagctgagctg

SEQ ID NO: 4635191 - DNA, 15 bp, Homo sapiens
gcagttcgcagccac

SEQ ID NO: 4635192 - DNA, 16 bp, Homo sapiens
gcagttcgcagccacc

SEQ ID NO: 4635193 - DNA, 21 bp, Homo sapiens
gcagttctcctgcctcagcct

SEQ ID NO: 4635194 - DNA, 17 bp, Homo sapiens
gcagttgatgtgtcttt

SEQ ID NO: 4635195 - DNA, 14 bp, Homo sapiens
gcataccacttgaa

SEQ ID NO: 4635196 - DNA, 13 bp, Homo sapiens
gcatactgaaaat

SEQ ID NO: 4635197 - DNA, 20 bp, Homo sapiens
gcatagagtaggtactccat

SEQ ID NO: 4635198 - DNA, 14 bp, Homo sapiens
gcatatagagatga

SEQ ID NO: 4635199 - DNA, 19 bp, Homo sapiens
gcatatatgtctctttgga

SEQ ID NO: 4635200 - DNA, 18 bp, Homo sapiens
gcatatggtcctagacaa

SEQ ID NO: 4635201 - DNA, 18 bp, Homo sapiens
gcatattgttggcacaga

SEQ ID NO: 4635202 - DNA, 22 bp, Homo sapiens
gcatattttaatcattatttga

SEQ ID NO: 4635203 - DNA, 23 bp, Homo sapiens
gcatattttcttacttttattat

SEQ ID NO: 4635204 - DNA, 16 bp, Homo sapiens
gcatcagaaagggagg

SEQ ID NO: 4635205 - DNA, 21 bp, Homo sapiens
gcatcagaaagggagggctct

SEQ ID NO: 4635206 - DNA, 23 bp, Homo sapiens
gcatcagaaagggagggctctga

SEQ ID NO: 4635207 - DNA, 20 bp, Homo sapiens
gcatcatgcctctgaggcca

SEQ ID NO: 4635208 - DNA, 21 bp, Homo sapiens
gcatcattactgttccagatt

SEQ ID NO: 4635209 - DNA, 18 bp, Homo sapiens
gcatccagcagcagcact

SEQ ID NO: 4635210 - DNA, 19 bp, Homo sapiens
gcatccagcagcagcactt

SEQ ID NO: 4635211 - DNA, 19 bp, Homo sapiens
gcatccctggagcaggagc

SEQ ID NO: 4635212 - DNA, 15 bp, Homo sapiens
gcatcctcagttcct

SEQ ID NO: 4635213 - DNA, 21 bp, Homo sapiens
gcatcctcagttcctgcagca

SEQ ID NO: 4635214 - DNA, 17 bp, Homo sapiens
gcatcctgtgaagtcct

SEQ ID NO: 4635215 - DNA, 13 bp, Homo sapiens
gcatctgctttta

SEQ ID NO: 4635216 - DNA, 16 bp, Homo sapiens
gcatctgtctgctctg

SEQ ID NO: 4635217 - DNA, 15 bp, Homo sapiens
gcatgactgtcgcca

SEQ ID NO: 4635218 - DNA, 18 bp, Homo sapiens
gcatgagtctgtttccca

SEQ ID NO: 4635219 - DNA, 21 bp, Homo sapiens
gcatgagtctgtttcccaagc

SEQ ID NO: 4635220 - DNA, 22 bp, Homo sapiens
gcatgagtctgtttcccaagct

SEQ ID NO: 4635221 - DNA, 17 bp, Homo sapiens
gcatgatgggaggtgtg

SEQ ID NO: 4635222 - DNA, 22 bp, Homo sapiens
gcatgatgggaggtgtgccaga

SEQ ID NO: 4635223 - DNA, 16 bp, Homo sapiens
gcatggaggccctcct

SEQ ID NO: 4635224 - DNA, 20 bp, Homo sapiens
gcatggggattgcagagtga

SEQ ID NO: 4635225 - DNA, 15 bp, Homo sapiens
gcatgggtccagaag

SEQ ID NO: 4635226 - DNA, 21 bp, Homo sapiens
gcatggtcccacatccctggg

SEQ ID NO: 4635227 - DNA, 15 bp, Homo sapiens
gcatgtatgtcttgg

SEQ ID NO: 4635228 - DNA, 21 bp, Homo sapiens
gcatgtgactctgaagctgac

SEQ ID NO: 4635229 - DNA, 12 bp, Homo sapiens
gcatgtttaatg

SEQ ID NO: 4635230 - DNA, 17 bp, Homo sapiens
gcattcatttttatagc

SEQ ID NO: 4635231 - DNA, 22 bp, Homo sapiens
gcattcatttttatagcaacaa

SEQ ID NO: 4635232 - DNA, 19 bp, Homo sapiens
gcattctctcccatcctgg

SEQ ID NO: 4635233 - DNA, 21 bp, Homo sapiens
gcattctctcccatcctgggg

SEQ ID NO: 4635234 - DNA, 21 bp, Homo sapiens
gcattctggcataatttttac

SEQ ID NO: 4635235 - DNA, 14 bp, Homo sapiens
gcattgacataggt

SEQ ID NO: 4635236 - DNA, 21 bp, Homo sapiens
gcattgacataggtcataaag

SEQ ID NO: 4635237 - DNA, 15 bp, Homo sapiens
gcattgacctggagg

SEQ ID NO: 4635238 - DNA, 18 bp, Homo sapiens
gcattgattgcacttgat

SEQ ID NO: 4635239 - DNA, 19 bp, Homo sapiens
gcattgccataccattccc

SEQ ID NO: 4635240 - DNA, 15 bp, Homo sapiens
gcattgctttccact

SEQ ID NO: 4635241 - DNA, 12 bp, Homo sapiens
gcattgctttct

SEQ ID NO: 4635242 - DNA, 17 bp, Homo sapiens
gcattggcatctgcttt

SEQ ID NO: 4635243 - DNA, 17 bp, Homo sapiens
gcattgtgaactgacag

SEQ ID NO: 4635244 - DNA, 12 bp, Homo sapiens
gcatttgcacct

SEQ ID NO: 4635245 - DNA, 23 bp, Homo sapiens
gcatttgcacctctgttcatttc

SEQ ID NO: 4635246 - DNA, 23 bp, Homo sapiens
gcatttgctctttcatctctgct

SEQ ID NO: 4635247 - DNA, 21 bp, Homo sapiens
gcatttgtgctagaaattttc

SEQ ID NO: 4635248 - DNA, 15 bp, Homo sapiens
gcattttgaaacaaa

SEQ ID NO: 4635249 - DNA, 13 bp, Homo sapiens
gcatttttgcttc

SEQ ID NO: 4635250 - DNA, 15 bp, Homo sapiens
gcatttttgcttcct

SEQ ID NO: 4635251 - DNA, 15 bp, Homo sapiens
gcatttttgtaactt

SEQ ID NO: 4635252 - DNA, 20 bp, Homo sapiens
gcattttttatcaggcagga

SEQ ID NO: 4635253 - DNA, 11 bp, Homo sapiens
gccaaacaaaa

SEQ ID NO: 4635254 - DNA, 13 bp, Homo sapiens
gccaaacctctgt

SEQ ID NO: 4635255 - DNA, 19 bp, Homo sapiens
gccaaacctctgttcagtg

SEQ ID NO: 4635256 - DNA, 22 bp, Homo sapiens
gccaaacctctgttcagtgtaa

SEQ ID NO: 4635257 - DNA, 23 bp, Homo sapiens
gccaaagaaacaagctgtgcagg

SEQ ID NO: 4635258 - DNA, 15 bp, Homo sapiens
gccaaaggagacccg

SEQ ID NO: 4635259 - DNA, 20 bp, Homo sapiens
gccaaagtcacttccccaag

SEQ ID NO: 4635260 - DNA, 14 bp, Homo sapiens
gccaaattttatct

SEQ ID NO: 4635261 - DNA, 20 bp, Homo sapiens
gccaacacgcacctgcctca

SEQ ID NO: 4635262 - DNA, 13 bp, Homo sapiens
gccaaccagcccg

SEQ ID NO: 4635263 - DNA, 13 bp, Homo sapiens
gccaactcctcac

SEQ ID NO: 4635264 - DNA, 17 bp, Homo sapiens
gccaactgtttccctgc

SEQ ID NO: 4635265 - DNA, 18 bp, Homo sapiens
gccaactgtttccctgct

SEQ ID NO: 4635266 - DNA, 12 bp, Homo sapiens
gccaagccagat

SEQ ID NO: 4635267 - DNA, 14 bp, Homo sapiens
gccaagctgaggtg

SEQ ID NO: 4635268 - DNA, 15 bp, Homo sapiens
gccaagctgaggtgc

SEQ ID NO: 4635269 - DNA, 18 bp, Homo sapiens
gccaagctgaggtgccca

SEQ ID NO: 4635270 - DNA, 21 bp, Homo sapiens
gccaagctgaggtgcccagga

SEQ ID NO: 4635271 - DNA, 20 bp, Homo sapiens
gccaaggtaagaggattgct

SEQ ID NO: 4635272 - DNA, 22 bp, Homo sapiens
gccaaggtgccaccaccctgcc

SEQ ID NO: 4635273 - DNA, 19 bp, Homo sapiens
gccaagtccaggtcctggt

SEQ ID NO: 4635274 - DNA, 21 bp, Homo sapiens
gccaagtccaggtcctggtgg

SEQ ID NO: 4635275 - DNA, 23 bp, Homo sapiens
gccaagtgcgtgccgtgtgagtg

SEQ ID NO: 4635276 - DNA, 16 bp, Homo sapiens
gccaatacagacaaag

SEQ ID NO: 4635277 - DNA, 18 bp, Homo sapiens
gccaattcagacaggcaa

SEQ ID NO: 4635278 - DNA, 13 bp, Homo sapiens
gccaatttttgta

SEQ ID NO: 4635279 - DNA, 16 bp, Homo sapiens
gccacaagctgcactg

SEQ ID NO: 4635280 - DNA, 19 bp, Homo sapiens
gccacaagctgcactgtga

SEQ ID NO: 4635281 - DNA, 21 bp, Homo sapiens
gccacaagctgcactgtgaac

SEQ ID NO: 4635282 - DNA, 17 bp, Homo sapiens
gccacactcagcacaag

SEQ ID NO: 4635283 - DNA, 19 bp, Homo sapiens
gccacacttctcaggacac

SEQ ID NO: 4635284 - DNA, 18 bp, Homo sapiens
gccacacttgaacctaat

SEQ ID NO: 4635285 - DNA, 24 bp, Homo sapiens
gccacagacaactcacattgttca

SEQ ID NO: 4635286 - DNA, 18 bp, Homo sapiens
gccacagacccctgggag

SEQ ID NO: 4635287 - DNA, 19 bp, Homo sapiens
gccacagacccctgggagc

SEQ ID NO: 4635288 - DNA, 21 bp, Homo sapiens
gccacagccttccctctgcat

SEQ ID NO: 4635289 - DNA, 13 bp, Homo sapiens
gccaccaccctgc

SEQ ID NO: 4635290 - DNA, 19 bp, Homo sapiens
gccacccagtagcccagag

SEQ ID NO: 4635291 - DNA, 23 bp, Homo sapiens
gccaccctgaggagtctgaggtc

SEQ ID NO: 4635292 - DNA, 23 bp, Homo sapiens
gccaccggcctgtgggtctctga

SEQ ID NO: 4635293 - DNA, 14 bp, Homo sapiens
gccaccgtgcctgg

SEQ ID NO: 4635294 - DNA, 10 bp, Homo sapiens
gccacctgca

SEQ ID NO: 4635295 - DNA, 11 bp, Homo sapiens
gccacctgcaa

SEQ ID NO: 4635296 - DNA, 12 bp, Homo sapiens
gccacggcctgg

SEQ ID NO: 4635297 - DNA, 14 bp, Homo sapiens
gccacggcctggct

SEQ ID NO: 4635298 - DNA, 17 bp, Homo sapiens
gccacggcctggctggt

SEQ ID NO: 4635299 - DNA, 15 bp, Homo sapiens
gccacgtcccagcat

SEQ ID NO: 4635300 - DNA, 18 bp, Homo sapiens
gccacgtcccagcatccc

SEQ ID NO: 4635301 - DNA, 16 bp, Homo sapiens
gccactaacttctaaa

SEQ ID NO: 4635302 - DNA, 13 bp, Homo sapiens
gccactccttcct

SEQ ID NO: 4635303 - DNA, 17 bp, Homo sapiens
gccactccttcctgccc

SEQ ID NO: 4635304 - DNA, 15 bp, Homo sapiens
gccactgcactccag

SEQ ID NO: 4635305 - DNA, 18 bp, Homo sapiens
gccactgcactccagcct

SEQ ID NO: 4635306 - DNA, 18 bp, Homo sapiens
gccacttccttttaactg

SEQ ID NO: 4635307 - DNA, 12 bp, Homo sapiens
gccacttctggc

SEQ ID NO: 4635308 - DNA, 20 bp, Homo sapiens
gccacttctggcttcagccc

SEQ ID NO: 4635309 - DNA, 14 bp, Homo sapiens
gccactttggctga

SEQ ID NO: 4635310 - DNA, 20 bp, Homo sapiens
gccagaacgtggctctgctg

SEQ ID NO: 4635311 - DNA, 17 bp, Homo sapiens
gccagaattctaccctg

SEQ ID NO: 4635312 - DNA, 12 bp, Homo sapiens
gccagacctgca

SEQ ID NO: 4635313 - DNA, 21 bp, Homo sapiens
gccagacctgcagacgcccag

SEQ ID NO: 4635314 - DNA, 14 bp, Homo sapiens
gccagacctgcatg

SEQ ID NO: 4635315 - DNA, 12 bp, Homo sapiens
gccagactccct

SEQ ID NO: 4635316 - DNA, 14 bp, Homo sapiens
gccagactcccttg

SEQ ID NO: 4635317 - DNA, 17 bp, Homo sapiens
gccagactctaggttat

SEQ ID NO: 4635318 - DNA, 12 bp, Homo sapiens
gccagagccaaa

SEQ ID NO: 4635319 - DNA, 13 bp, Homo sapiens
gccagagcctggg

SEQ ID NO: 4635320 - DNA, 17 bp, Homo sapiens
gccagagcctggggctc

SEQ ID NO: 4635321 - DNA, 22 bp, Homo sapiens
gccagatgcacatccctggaag

SEQ ID NO: 4635322 - DNA, 21 bp, Homo sapiens
gccagattctcttgaataaag

SEQ ID NO: 4635323 - DNA, 14 bp, Homo sapiens
gccagatttgtctt

SEQ ID NO: 4635324 - DNA, 12 bp, Homo sapiens
gccagcaacgct

SEQ ID NO: 4635325 - DNA, 13 bp, Homo sapiens
gccagcaacgctt

SEQ ID NO: 4635326 - DNA, 19 bp, Homo sapiens
gccagcaagagttaggggc

SEQ ID NO: 4635327 - DNA, 16 bp, Homo sapiens
gccagcacacagggca

SEQ ID NO: 4635328 - DNA, 14 bp, Homo sapiens
gccagcacttgtcc

SEQ ID NO: 4635329 - DNA, 19 bp, Homo sapiens
gccagcagaactgaagtgt

SEQ ID NO: 4635330 - DNA, 12 bp, Homo sapiens
gccagcaggaat

SEQ ID NO: 4635331 - DNA, 15 bp, Homo sapiens
gccagcaggaataaa

SEQ ID NO: 4635332 - DNA, 16 bp, Homo sapiens
gccagccacagacccc

SEQ ID NO: 4635333 - DNA, 21 bp, Homo sapiens
gccagccacagacccctggga

SEQ ID NO: 4635334 - DNA, 16 bp, Homo sapiens
gccagccacaggacca

SEQ ID NO: 4635335 - DNA, 19 bp, Homo sapiens
gccagcccctggccccagg

SEQ ID NO: 4635336 - DNA, 13 bp, Homo sapiens
gccagccctgcct

SEQ ID NO: 4635337 - DNA, 23 bp, Homo sapiens
gccagccggggcgagtggcacgt

SEQ ID NO: 4635338 - DNA, 15 bp, Homo sapiens
gccagccgtggccag

SEQ ID NO: 4635339 - DNA, 20 bp, Homo sapiens
gccagcctgaggtgcccact

SEQ ID NO: 4635340 - DNA, 15 bp, Homo sapiens
gccagcctggcctcc

SEQ ID NO: 4635341 - DNA, 20 bp, Homo sapiens
gccagcctggcctcctgcct

SEQ ID NO: 4635342 - DNA, 14 bp, Homo sapiens
gccagctgctcccc

SEQ ID NO: 4635343 - DNA, 16 bp, Homo sapiens
gccagctgctccccag

SEQ ID NO: 4635344 - DNA, 16 bp, Homo sapiens
gccaggagcagccctg

SEQ ID NO: 4635345 - DNA, 15 bp, Homo sapiens
gccaggagcttcttc

SEQ ID NO: 4635346 - DNA, 22 bp, Homo sapiens
gccaggagcttcttcgttcctg

SEQ ID NO: 4635347 - DNA, 21 bp, Homo sapiens
gccaggagggacaaaggagcc

SEQ ID NO: 4635348 - DNA, 22 bp, Homo sapiens
gccaggagggacaaaggagcct

SEQ ID NO: 4635349 - DNA, 23 bp, Homo sapiens
gccaggagggacaaaggagcctg

SEQ ID NO: 4635350 - DNA, 14 bp, Homo sapiens
gccaggcagagaac

SEQ ID NO: 4635351 - DNA, 21 bp, Homo sapiens
gccaggccccaccccttccct

SEQ ID NO: 4635352 - DNA, 12 bp, Homo sapiens
gccaggccccat

SEQ ID NO: 4635353 - DNA, 13 bp, Homo sapiens
gccaggccccatg

SEQ ID NO: 4635354 - DNA, 14 bp, Homo sapiens
gccaggccccatgg

SEQ ID NO: 4635355 - DNA, 20 bp, Homo sapiens
gccaggccccatggagggta

SEQ ID NO: 4635356 - DNA, 13 bp, Homo sapiens
gccaggctggttt

SEQ ID NO: 4635357 - DNA, 18 bp, Homo sapiens
gccagggctgccctgaga

SEQ ID NO: 4635358 - DNA, 19 bp, Homo sapiens
gccagggctgccctgagaa

SEQ ID NO: 4635359 - DNA, 11 bp, Homo sapiens
gccagggctgg

SEQ ID NO: 4635360 - DNA, 12 bp, Homo sapiens
gccagggctggg

SEQ ID NO: 4635361 - DNA, 15 bp, Homo sapiens
gccagggctggggac

SEQ ID NO: 4635362 - DNA, 14 bp, Homo sapiens
gccaggggccagga

SEQ ID NO: 4635363 - DNA, 17 bp, Homo sapiens
gccagggtctctccctc

SEQ ID NO: 4635364 - DNA, 18 bp, Homo sapiens
gccagggtctctccctca

SEQ ID NO: 4635365 - DNA, 18 bp, Homo sapiens
gccagggtctgtgtgaat

SEQ ID NO: 4635366 - DNA, 16 bp, Homo sapiens
gccagggtgagcaggg

SEQ ID NO: 4635367 - DNA, 20 bp, Homo sapiens
gccagggtggtcttgatctc

SEQ ID NO: 4635368 - DNA, 22 bp, Homo sapiens
gccaggtactgcattctctccc

SEQ ID NO: 4635369 - DNA, 16 bp, Homo sapiens
gccaggtatggctctg

SEQ ID NO: 4635370 - DNA, 17 bp, Homo sapiens
gccaggtctcctgggaa

SEQ ID NO: 4635371 - DNA, 14 bp, Homo sapiens
gccagtctcattgt

SEQ ID NO: 4635372 - DNA, 18 bp, Homo sapiens
gccagtgctaaactactg

SEQ ID NO: 4635373 - DNA, 15 bp, Homo sapiens
gccagtgctccagcc

SEQ ID NO: 4635374 - DNA, 14 bp, Homo sapiens
gccagtgctgtctg

SEQ ID NO: 4635375 - DNA, 21 bp, Homo sapiens
gccagtggggatgaggtcacc

SEQ ID NO: 4635376 - DNA, 17 bp, Homo sapiens
gccagtggggcctgtgg

SEQ ID NO: 4635377 - DNA, 13 bp, Homo sapiens
gccagtgtttctg

SEQ ID NO: 4635378 - DNA, 22 bp, Homo sapiens
gccagtgtttctgaatgtttgt

SEQ ID NO: 4635379 - DNA, 16 bp, Homo sapiens
gccagttggtgttcct

SEQ ID NO: 4635380 - DNA, 13 bp, Homo sapiens
gccataattatga

SEQ ID NO: 4635381 - DNA, 19 bp, Homo sapiens
gccataattatgaaaactc

SEQ ID NO: 4635382 - DNA, 14 bp, Homo sapiens
gccataattttgca

SEQ ID NO: 4635383 - DNA, 15 bp, Homo sapiens
gccatacctcagata

SEQ ID NO: 4635384 - DNA, 22 bp, Homo sapiens
gccatccccaccttcacctcgg

SEQ ID NO: 4635385 - DNA, 22 bp, Homo sapiens
gccatctcaggagatggagggc

SEQ ID NO: 4635386 - DNA, 23 bp, Homo sapiens
gccatctgactgccaagccagat

SEQ ID NO: 4635387 - DNA, 22 bp, Homo sapiens
gccatgagtatgccactgcact

SEQ ID NO: 4635388 - DNA, 16 bp, Homo sapiens
gccatgatggcaacag

SEQ ID NO: 4635389 - DNA, 22 bp, Homo sapiens
gccatgctgggccactggggac

SEQ ID NO: 4635390 - DNA, 23 bp, Homo sapiens
gccatggatggaaaacgctctct

SEQ ID NO: 4635391 - DNA, 23 bp, Homo sapiens
gccatgtagccacccaactttgt

SEQ ID NO: 4635392 - DNA, 19 bp, Homo sapiens
gccatgtataaatgtgata

SEQ ID NO: 4635393 - DNA, 22 bp, Homo sapiens
gccatgttgtgcctccctggtg

SEQ ID NO: 4635394 - DNA, 18 bp, Homo sapiens
gccattctgcatgagctg

SEQ ID NO: 4635395 - DNA, 14 bp, Homo sapiens
gccatttcttatat

SEQ ID NO: 4635396 - DNA, 19 bp, Homo sapiens
gcccaaagcctgaggacag

SEQ ID NO: 4635397 - DNA, 19 bp, Homo sapiens
gcccaaagtggtatagaaa

SEQ ID NO: 4635398 - DNA, 19 bp, Homo sapiens
gcccaagagcccgtgccac

SEQ ID NO: 4635399 - DNA, 17 bp, Homo sapiens
gcccaccctcctgtacc

SEQ ID NO: 4635400 - DNA, 15 bp, Homo sapiens
gcccacctcagcctc

SEQ ID NO: 4635401 - DNA, 23 bp, Homo sapiens
gcccacggaggcctcgagcagag

SEQ ID NO: 4635402 - DNA, 21 bp, Homo sapiens
gcccacggtttcagctagaca

SEQ ID NO: 4635403 - DNA, 14 bp, Homo sapiens
gcccactccgccag

SEQ ID NO: 4635404 - DNA, 17 bp, Homo sapiens
gcccactccgccagcca

SEQ ID NO: 4635405 - DNA, 20 bp, Homo sapiens
gcccactccgccagccacag

SEQ ID NO: 4635406 - DNA, 23 bp, Homo sapiens
gcccactccgccagccacaggac

SEQ ID NO: 4635407 - DNA, 19 bp, Homo sapiens
gcccagaggagcccagcgg

SEQ ID NO: 4635408 - DNA, 12 bp, Homo sapiens
gcccagagtgag

SEQ ID NO: 4635409 - DNA, 19 bp, Homo sapiens
gcccagattatgagacaca

SEQ ID NO: 4635410 - DNA, 20 bp, Homo sapiens
gcccagattatgagacacag

SEQ ID NO: 4635411 - DNA, 13 bp, Homo sapiens
gcccagcctcact

SEQ ID NO: 4635412 - DNA, 19 bp, Homo sapiens
gcccagcggacagtggcag

SEQ ID NO: 4635413 - DNA, 15 bp, Homo sapiens
gcccaggatactggc

SEQ ID NO: 4635414 - DNA, 23 bp, Homo sapiens
gcccaggatactggcacagaggt

SEQ ID NO: 4635415 - DNA, 12 bp, Homo sapiens
gcccaggatctc

SEQ ID NO: 4635416 - DNA, 17 bp, Homo sapiens
gcccaggcaaggaacag

SEQ ID NO: 4635417 - DNA, 17 bp, Homo sapiens
gcccaggtatcctgggg

SEQ ID NO: 4635418 - DNA, 20 bp, Homo sapiens
gcccaggtatcctgggggaa

SEQ ID NO: 4635419 - DNA, 20 bp, Homo sapiens
gcccaggtgagggaaggaga

SEQ ID NO: 4635420 - DNA, 17 bp, Homo sapiens
gcccagtgcaggtattt

SEQ ID NO: 4635421 - DNA, 20 bp, Homo sapiens
gcccatccattaggccagca

SEQ ID NO: 4635422 - DNA, 19 bp, Homo sapiens
gcccatggacaggctggct

SEQ ID NO: 4635423 - DNA, 21 bp, Homo sapiens
gcccatggacaggctggctcc

SEQ ID NO: 4635424 - DNA, 15 bp, Homo sapiens
gcccatggaggcaga

SEQ ID NO: 4635425 - DNA, 16 bp, Homo sapiens
gcccattaatcttgat

SEQ ID NO: 4635426 - DNA, 14 bp, Homo sapiens
gcccattagagaag

SEQ ID NO: 4635427 - DNA, 15 bp, Homo sapiens
gccccaacccgtgga

SEQ ID NO: 4635428 - DNA, 21 bp, Homo sapiens
gccccaactctcccctgacct

SEQ ID NO: 4635429 - DNA, 17 bp, Homo sapiens
gccccacaaggcctggt

SEQ ID NO: 4635430 - DNA, 18 bp, Homo sapiens
gccccacaaggcctggtc

SEQ ID NO: 4635431 - DNA, 21 bp, Homo sapiens
gccccacaaggcctggtctgg

SEQ ID NO: 4635432 - DNA, 12 bp, Homo sapiens
gccccacccttg

SEQ ID NO: 4635433 - DNA, 18 bp, Homo sapiens
gccccagaggccctggag

SEQ ID NO: 4635434 - DNA, 21 bp, Homo sapiens
gccccaggacctggctgccat

SEQ ID NO: 4635435 - DNA, 20 bp, Homo sapiens
gccccatcctcatccctgac

SEQ ID NO: 4635436 - DNA, 22 bp, Homo sapiens
gcccccaccgtgggcagggagc

SEQ ID NO: 4635437 - DNA, 13 bp, Homo sapiens
gcccccagctggc

SEQ ID NO: 4635438 - DNA, 14 bp, Homo sapiens
gcccccagctggcc

SEQ ID NO: 4635439 - DNA, 16 bp, Homo sapiens
gcccccatcagccctg

SEQ ID NO: 4635440 - DNA, 18 bp, Homo sapiens
gcccccatcagccctgct

SEQ ID NO: 4635441 - DNA, 15 bp, Homo sapiens
gcccccgtcagggag

SEQ ID NO: 4635442 - DNA, 17 bp, Homo sapiens
gccccctccaggagaga

SEQ ID NO: 4635443 - DNA, 13 bp, Homo sapiens
gccccgccagggc

SEQ ID NO: 4635444 - DNA, 19 bp, Homo sapiens
gccccgccagggctgggga

SEQ ID NO: 4635445 - DNA, 20 bp, Homo sapiens
gccccgccagggctggggac

SEQ ID NO: 4635446 - DNA, 22 bp, Homo sapiens
gccccgccttttcccccaccct

SEQ ID NO: 4635447 - DNA, 15 bp, Homo sapiens
gccccgggctggaga

SEQ ID NO: 4635448 - DNA, 17 bp, Homo sapiens
gcccctaggctgctgct

SEQ ID NO: 4635449 - DNA, 13 bp, Homo sapiens
gcccctcagagca

SEQ ID NO: 4635450 - DNA, 18 bp, Homo sapiens
gcccctccaatcctcccc

SEQ ID NO: 4635451 - DNA, 12 bp, Homo sapiens
gcccctctctgg

SEQ ID NO: 4635452 - DNA, 13 bp, Homo sapiens
gcccctgcctgct

SEQ ID NO: 4635453 - DNA, 17 bp, Homo sapiens
gcccctgttttctgctg

SEQ ID NO: 4635454 - DNA, 14 bp, Homo sapiens
gccccttctgctca

SEQ ID NO: 4635455 - DNA, 15 bp, Homo sapiens
gccccttctgctcag

SEQ ID NO: 4635456 - DNA, 20 bp, Homo sapiens
gccccttctgctcagctctg

SEQ ID NO: 4635457 - DNA, 23 bp, Homo sapiens
gccccttctgctcagctctgggc

SEQ ID NO: 4635458 - DNA, 16 bp, Homo sapiens
gcccgacagtgccatc

SEQ ID NO: 4635459 - DNA, 23 bp, Homo sapiens
gcccgacagtgccatccccacct

SEQ ID NO: 4635460 - DNA, 16 bp, Homo sapiens
gcccgagcagctgagc

SEQ ID NO: 4635461 - DNA, 18 bp, Homo sapiens
gcccgagcagctgagcag

SEQ ID NO: 4635462 - DNA, 13 bp, Homo sapiens
gcccgagggcagc

SEQ ID NO: 4635463 - DNA, 14 bp, Homo sapiens
gcccgagggcagcc

SEQ ID NO: 4635464 - DNA, 15 bp, Homo sapiens
gcccgagggcagccc

SEQ ID NO: 4635465 - DNA, 19 bp, Homo sapiens
gcccgagggcagccccctc

SEQ ID NO: 4635466 - DNA, 19 bp, Homo sapiens
gcccggagctgcccctctc

SEQ ID NO: 4635467 - DNA, 14 bp, Homo sapiens
gcccggtgcagggc

SEQ ID NO: 4635468 - DNA, 20 bp, Homo sapiens
gcccggtgcagggcctggca

SEQ ID NO: 4635469 - DNA, 19 bp, Homo sapiens
gcccgtgacagactcctga

SEQ ID NO: 4635470 - DNA, 17 bp, Homo sapiens
gcccgtgccacccccag

SEQ ID NO: 4635471 - DNA, 15 bp, Homo sapiens
gccctcacatcttcc

SEQ ID NO: 4635472 - DNA, 22 bp, Homo sapiens
gccctcagctggtcctgaccag

SEQ ID NO: 4635473 - DNA, 19 bp, Homo sapiens
gccctcccagcccattgct

SEQ ID NO: 4635474 - DNA, 23 bp, Homo sapiens
gccctcccagcccattgctgcca

SEQ ID NO: 4635475 - DNA, 12 bp, Homo sapiens
gccctcctgtgc

SEQ ID NO: 4635476 - DNA, 17 bp, Homo sapiens
gccctccttcttttcct

SEQ ID NO: 4635477 - DNA, 17 bp, Homo sapiens
gccctctatttattagc

SEQ ID NO: 4635478 - DNA, 22 bp, Homo sapiens
gccctctatttattagccaact

SEQ ID NO: 4635479 - DNA, 20 bp, Homo sapiens
gccctctttccctgcgagac

SEQ ID NO: 4635480 - DNA, 13 bp, Homo sapiens
gccctgcagaccc

SEQ ID NO: 4635481 - DNA, 17 bp, Homo sapiens
gccctgcagaccctgcc

SEQ ID NO: 4635482 - DNA, 18 bp, Homo sapiens
gccctgcagaccctgccc

SEQ ID NO: 4635483 - DNA, 19 bp, Homo sapiens
gccctgcagaccctgccct

SEQ ID NO: 4635484 - DNA, 20 bp, Homo sapiens
gccctgcagaccctgccctt

SEQ ID NO: 4635485 - DNA, 13 bp, Homo sapiens
gccctgcatctgt

SEQ ID NO: 4635486 - DNA, 15 bp, Homo sapiens
gccctgcccacagaa

SEQ ID NO: 4635487 - DNA, 12 bp, Homo sapiens
gccctgcccagg

SEQ ID NO: 4635488 - DNA, 15 bp, Homo sapiens
gccctgcccttcagc

SEQ ID NO: 4635489 - DNA, 18 bp, Homo sapiens
gccctgcctggaggacct

SEQ ID NO: 4635490 - DNA, 22 bp, Homo sapiens
gccctgcctggaggacctgagc

SEQ ID NO: 4635491 - DNA, 17 bp, Homo sapiens
gccctgctacctgttct

SEQ ID NO: 4635492 - DNA, 13 bp, Homo sapiens
gccctgctctgcc

SEQ ID NO: 4635493 - DNA, 18 bp, Homo sapiens
gccctgctctgcccaggc

SEQ ID NO: 4635494 - DNA, 14 bp, Homo sapiens
gccctggaggtctc

SEQ ID NO: 4635495 - DNA, 19 bp, Homo sapiens
gccctggatcagcgtggcc

SEQ ID NO: 4635496 - DNA, 17 bp, Homo sapiens
gccctggcacccccaca

SEQ ID NO: 4635497 - DNA, 20 bp, Homo sapiens
gccctggcacccccacaagc

SEQ ID NO: 4635498 - DNA, 15 bp, Homo sapiens
gccctgggaaccact

SEQ ID NO: 4635499 - DNA, 22 bp, Homo sapiens
gccctgggaccgctacaccact

SEQ ID NO: 4635500 - DNA, 14 bp, Homo sapiens
gccctggggcctgt

SEQ ID NO: 4635501 - DNA, 18 bp, Homo sapiens
gccctggggcctgtactg

SEQ ID NO: 4635502 - DNA, 21 bp, Homo sapiens
gccctggggcctgtactgcct

SEQ ID NO: 4635503 - DNA, 13 bp, Homo sapiens
gccctgtctctgg

SEQ ID NO: 4635504 - DNA, 22 bp, Homo sapiens
gccctgtctctggctactccct

SEQ ID NO: 4635505 - DNA, 13 bp, Homo sapiens
gccctgtgctcca

SEQ ID NO: 4635506 - DNA, 17 bp, Homo sapiens
gccctgtgttctttccc

SEQ ID NO: 4635507 - DNA, 17 bp, Homo sapiens
gccctgttagctttcca

SEQ ID NO: 4635508 - DNA, 18 bp, Homo sapiens
gcccttaactatcaccag

SEQ ID NO: 4635509 - DNA, 15 bp, Homo sapiens
gcccttacctgtctc

SEQ ID NO: 4635510 - DNA, 14 bp, Homo sapiens
gcccttcctcctgc

SEQ ID NO: 4635511 - DNA, 16 bp, Homo sapiens
gcccttcctcctgcct

SEQ ID NO: 4635512 - DNA, 23 bp, Homo sapiens
gcccttcctctccaccctcccag

SEQ ID NO: 4635513 - DNA, 15 bp, Homo sapiens
gcccttcctggacag

SEQ ID NO: 4635514 - DNA, 16 bp, Homo sapiens
gcccttcctggacagc

SEQ ID NO: 4635515 - DNA, 17 bp, Homo sapiens
gcccttcctggacagct

SEQ ID NO: 4635516 - DNA, 21 bp, Homo sapiens
gcccttcctggacagctgtgc

SEQ ID NO: 4635517 - DNA, 16 bp, Homo sapiens
gcccttgaaccccctc

SEQ ID NO: 4635518 - DNA, 17 bp, Homo sapiens
gcccttgctgggcctgg

SEQ ID NO: 4635519 - DNA, 19 bp, Homo sapiens
gcccttgctgggcctgggg

SEQ ID NO: 4635520 - DNA, 22 bp, Homo sapiens
gcccttgctttcggagctcctg

SEQ ID NO: 4635521 - DNA, 17 bp, Homo sapiens
gcccttggcttgtgtta

SEQ ID NO: 4635522 - DNA, 20 bp, Homo sapiens
gccctttgagatctggggag

SEQ ID NO: 4635523 - DNA, 14 bp, Homo sapiens
gccgaagctaacag

SEQ ID NO: 4635524 - DNA, 22 bp, Homo sapiens
gccgaccttccctccgccttct

SEQ ID NO: 4635525 - DNA, 15 bp, Homo sapiens
gccgactctggccct

SEQ ID NO: 4635526 - DNA, 16 bp, Homo sapiens
gccgactctggccctg

SEQ ID NO: 4635527 - DNA, 15 bp, Homo sapiens
gccgagtccaagctg

SEQ ID NO: 4635528 - DNA, 15 bp, Homo sapiens
gccgatgccaccggc

SEQ ID NO: 4635529 - DNA, 16 bp, Homo sapiens
gccgatgccaccggcc

SEQ ID NO: 4635530 - DNA, 19 bp, Homo sapiens
gccgcaccattgaactgta

SEQ ID NO: 4635531 - DNA, 16 bp, Homo sapiens
gccgccacggcctggc

SEQ ID NO: 4635532 - DNA, 18 bp, Homo sapiens
gccgccacggcctggctg

SEQ ID NO: 4635533 - DNA, 14 bp, Homo sapiens
gccggccagcccct

SEQ ID NO: 4635534 - DNA, 16 bp, Homo sapiens
gccggggaactggcca

SEQ ID NO: 4635535 - DNA, 22 bp, Homo sapiens
gccggggaactggccaagctga

SEQ ID NO: 4635536 - DNA, 24 bp, Homo sapiens
gccggggctctgggtgctgccctg

SEQ ID NO: 4635537 - DNA, 22 bp, Homo sapiens
gccggtaactgtcctgtcctgc

SEQ ID NO: 4635538 - DNA, 15 bp, Homo sapiens
gccggtggtgcaggt

SEQ ID NO: 4635539 - DNA, 20 bp, Homo sapiens
gccgtcccaccagcttcact

SEQ ID NO: 4635540 - DNA, 17 bp, Homo sapiens
gccgtgctcgccccagc

SEQ ID NO: 4635541 - DNA, 21 bp, Homo sapiens
gccgtgctcgccccagcaggt

SEQ ID NO: 4635542 - DNA, 13 bp, Homo sapiens
gccgtggccagag

SEQ ID NO: 4635543 - DNA, 19 bp, Homo sapiens
gccgtgtgagtgtgacagg

SEQ ID NO: 4635544 - DNA, 23 bp, Homo sapiens
gccgtgtgagtgtgacagggcca

SEQ ID NO: 4635545 - DNA, 19 bp, Homo sapiens
gccgttgattcacttcacg

SEQ ID NO: 4635546 - DNA, 15 bp, Homo sapiens
gcctaaacctcagtt

SEQ ID NO: 4635547 - DNA, 18 bp, Homo sapiens
gcctaaagctaaaaatat

SEQ ID NO: 4635548 - DNA, 19 bp, Homo sapiens
gcctaaagctaaaaatatt

SEQ ID NO: 4635549 - DNA, 13 bp, Homo sapiens
gcctaaagggcag

SEQ ID NO: 4635550 - DNA, 15 bp, Homo sapiens
gcctaaagggcaggg

SEQ ID NO: 4635551 - DNA, 23 bp, Homo sapiens
gcctaagggatcctgcctgcccc

SEQ ID NO: 4635552 - DNA, 21 bp, Homo sapiens
gcctacaaaacctcaaaccag

SEQ ID NO: 4635553 - DNA, 20 bp, Homo sapiens
gcctaccgctggccctgccg

SEQ ID NO: 4635554 - DNA, 14 bp, Homo sapiens
gcctacctgtatgt

SEQ ID NO: 4635555 - DNA, 15 bp, Homo sapiens
gcctagagtgtagcc

SEQ ID NO: 4635556 - DNA, 16 bp, Homo sapiens
gcctaggccaggtgca

SEQ ID NO: 4635557 - DNA, 17 bp, Homo sapiens
gcctagtacaatcttgg

SEQ ID NO: 4635558 - DNA, 18 bp, Homo sapiens
gcctagtacaatcttggg

SEQ ID NO: 4635559 - DNA, 18 bp, Homo sapiens
gcctataatcttatacaa

SEQ ID NO: 4635560 - DNA, 20 bp, Homo sapiens
gcctatcaaaggaaatgaga

SEQ ID NO: 4635561 - DNA, 16 bp, Homo sapiens
gcctatgacttgggca

SEQ ID NO: 4635562 - DNA, 14 bp, Homo sapiens
gcctatgcacatat

SEQ ID NO: 4635563 - DNA, 17 bp, Homo sapiens
gcctatggagagccctg

SEQ ID NO: 4635564 - DNA, 18 bp, Homo sapiens
gcctatggagagccctgg

SEQ ID NO: 4635565 - DNA, 21 bp, Homo sapiens
gcctcaaaacgggtcagtatt

SEQ ID NO: 4635566 - DNA, 14 bp, Homo sapiens
gcctcacatctccc

SEQ ID NO: 4635567 - DNA, 18 bp, Homo sapiens
gcctcacccctcccctgg

SEQ ID NO: 4635568 - DNA, 21 bp, Homo sapiens
gcctcacccctcccctgggac

SEQ ID NO: 4635569 - DNA, 15 bp, Homo sapiens
gcctcacccctgccc

SEQ ID NO: 4635570 - DNA, 19 bp, Homo sapiens
gcctcactaatttttgtat

SEQ ID NO: 4635571 - DNA, 20 bp, Homo sapiens
gcctcactgaaacatggctg

SEQ ID NO: 4635572 - DNA, 17 bp, Homo sapiens
gcctcacttcctttgcc

SEQ ID NO: 4635573 - DNA, 19 bp, Homo sapiens
gcctcacttcctttgccct

SEQ ID NO: 4635574 - DNA, 14 bp, Homo sapiens
gcctcagagcttcc

SEQ ID NO: 4635575 - DNA, 16 bp, Homo sapiens
gcctcagcctcccgag

SEQ ID NO: 4635576 - DNA, 12 bp, Homo sapiens
gcctcaggctct

SEQ ID NO: 4635577 - DNA, 13 bp, Homo sapiens
gcctcaggctctg

SEQ ID NO: 4635578 - DNA, 21 bp, Homo sapiens
gcctcaggctctgcacagaca

SEQ ID NO: 4635579 - DNA, 16 bp, Homo sapiens
gcctcattgtgtctcc

SEQ ID NO: 4635580 - DNA, 14 bp, Homo sapiens
gcctccagccctct

SEQ ID NO: 4635581 - DNA, 20 bp, Homo sapiens
gcctccatctttttcttggg

SEQ ID NO: 4635582 - DNA, 18 bp, Homo sapiens
gcctcccaaaatgctggg

SEQ ID NO: 4635583 - DNA, 15 bp, Homo sapiens
gcctcccatccaggg

SEQ ID NO: 4635584 - DNA, 22 bp, Homo sapiens
gcctcccatccagggcccccat

SEQ ID NO: 4635585 - DNA, 20 bp, Homo sapiens
gcctccccttaaaggggaga

SEQ ID NO: 4635586 - DNA, 21 bp, Homo sapiens
gcctccccttaaaggggagac

SEQ ID NO: 4635587 - DNA, 16 bp, Homo sapiens
gcctccctgcctcagg

SEQ ID NO: 4635588 - DNA, 17 bp, Homo sapiens
gcctccctgcctcaggc

SEQ ID NO: 4635589 - DNA, 17 bp, Homo sapiens
gcctccctgctgtgcca

SEQ ID NO: 4635590 - DNA, 18 bp, Homo sapiens
gcctccgacgctgcctct

SEQ ID NO: 4635591 - DNA, 16 bp, Homo sapiens
gcctcctctctccctg

SEQ ID NO: 4635592 - DNA, 19 bp, Homo sapiens
gcctcctctctccctgcct

SEQ ID NO: 4635593 - DNA, 21 bp, Homo sapiens
gcctcctctctccctgcctca

SEQ ID NO: 4635594 - DNA, 23 bp, Homo sapiens
gcctcctctctccctgcctcaca

SEQ ID NO: 4635595 - DNA, 12 bp, Homo sapiens
gcctcctgcctc

SEQ ID NO: 4635596 - DNA, 12 bp, Homo sapiens
gcctcctgcttt

SEQ ID NO: 4635597 - DNA, 12 bp, Homo sapiens
gcctcctgtggg

SEQ ID NO: 4635598 - DNA, 15 bp, Homo sapiens
gcctcgccttgtgtt

SEQ ID NO: 4635599 - DNA, 17 bp, Homo sapiens
gcctcgccttgtgttac

SEQ ID NO: 4635600 - DNA, 19 bp, Homo sapiens
gcctcgctccccactctgc

SEQ ID NO: 4635601 - DNA, 20 bp, Homo sapiens
gcctcgctctgttacccagg

SEQ ID NO: 4635602 - DNA, 16 bp, Homo sapiens
gcctcgctttttcatc

SEQ ID NO: 4635603 - DNA, 18 bp, Homo sapiens
gcctctactgggaaggct

SEQ ID NO: 4635604 - DNA, 19 bp, Homo sapiens
gcctctgagaagctctgaa

SEQ ID NO: 4635605 - DNA, 15 bp, Homo sapiens
gcctctgaggccagc

SEQ ID NO: 4635606 - DNA, 17 bp, Homo sapiens
gcctctgaggccagcct

SEQ ID NO: 4635607 - DNA, 23 bp, Homo sapiens
gcctctgaggccagcctggcctc

SEQ ID NO: 4635608 - DNA, 12 bp, Homo sapiens
gcctctgtgtac

SEQ ID NO: 4635609 - DNA, 18 bp, Homo sapiens
gcctcttccccctgcttc

SEQ ID NO: 4635610 - DNA, 22 bp, Homo sapiens
gcctcttccccctgcttccacc

SEQ ID NO: 4635611 - DNA, 18 bp, Homo sapiens
gcctcttgtaaagactgg

SEQ ID NO: 4635612 - DNA, 19 bp, Homo sapiens
gcctctttgtctaaaacaa

SEQ ID NO: 4635613 - DNA, 21 bp, Homo sapiens
gcctgaaagctgggagcgtgg

SEQ ID NO: 4635614 - DNA, 14 bp, Homo sapiens
gcctgaactgagga

SEQ ID NO: 4635615 - DNA, 14 bp, Homo sapiens
gcctgaaggcacag

SEQ ID NO: 4635616 - DNA, 12 bp, Homo sapiens
gcctgagcccag

SEQ ID NO: 4635617 - DNA, 17 bp, Homo sapiens
gcctgagcccagggagg

SEQ ID NO: 4635618 - DNA, 20 bp, Homo sapiens
gcctgagcccagggaggccg

SEQ ID NO: 4635619 - DNA, 11 bp, Homo sapiens
gcctgagcccc

SEQ ID NO: 4635620 - DNA, 22 bp, Homo sapiens
gcctgaggtgcccactccgcca

SEQ ID NO: 4635621 - DNA, 24 bp, Homo sapiens
gcctgaggtgcccactccgccagc

SEQ ID NO: 4635622 - DNA, 18 bp, Homo sapiens
gcctgagtgacctccttc

SEQ ID NO: 4635623 - DNA, 19 bp, Homo sapiens
gcctgatgagatttttaaa

SEQ ID NO: 4635624 - DNA, 20 bp, Homo sapiens
gcctgcagcccctaagtgca

SEQ ID NO: 4635625 - DNA, 22 bp, Homo sapiens
gcctgcccctaccctggacttg

SEQ ID NO: 4635626 - DNA, 21 bp, Homo sapiens
gcctggagacaaggtgctaac

SEQ ID NO: 4635627 - DNA, 14 bp, Homo sapiens
gcctggaggacctg

SEQ ID NO: 4635628 - DNA, 15 bp, Homo sapiens
gcctggaggacctga

SEQ ID NO: 4635629 - DNA, 16 bp, Homo sapiens
gcctggaggacctgag

SEQ ID NO: 4635630 - DNA, 19 bp, Homo sapiens
gcctggaggacctgagcct

SEQ ID NO: 4635631 - DNA, 21 bp, Homo sapiens
gcctggaggacctgagcctgc

SEQ ID NO: 4635632 - DNA, 15 bp, Homo sapiens
gcctggcccccagct

SEQ ID NO: 4635633 - DNA, 12 bp, Homo sapiens
gcctggccctgc

SEQ ID NO: 4635634 - DNA, 14 bp, Homo sapiens
gcctggcctcctgc

SEQ ID NO: 4635635 - DNA, 16 bp, Homo sapiens
gcctggcctcctgcct

SEQ ID NO: 4635636 - DNA, 13 bp, Homo sapiens
gcctggcctggca

SEQ ID NO: 4635637 - DNA, 16 bp, Homo sapiens
gcctggcctggcacac

SEQ ID NO: 4635638 - DNA, 17 bp, Homo sapiens
gcctggctgattcagca

SEQ ID NO: 4635639 - DNA, 16 bp, Homo sapiens
gcctggctggctgagg

SEQ ID NO: 4635640 - DNA, 18 bp, Homo sapiens
gcctggctggctgagggc

SEQ ID NO: 4635641 - DNA, 21 bp, Homo sapiens
gcctggctggctgagggcagt

SEQ ID NO: 4635642 - DNA, 20 bp, Homo sapiens
gcctgggatgcccttccccc

SEQ ID NO: 4635643 - DNA, 18 bp, Homo sapiens
gcctgggcaatggccagg

SEQ ID NO: 4635644 - DNA, 21 bp, Homo sapiens
gcctgggcaatggccaggggc

SEQ ID NO: 4635645 - DNA, 23 bp, Homo sapiens
gcctgggcaatggccaggggcca

SEQ ID NO: 4635646 - DNA, 21 bp, Homo sapiens
gcctgggcctatggagagccc

SEQ ID NO: 4635647 - DNA, 16 bp, Homo sapiens
gcctggggcctgagag

SEQ ID NO: 4635648 - DNA, 20 bp, Homo sapiens
gcctggggctctaacgcctg

SEQ ID NO: 4635649 - DNA, 23 bp, Homo sapiens
gcctggggctctaacgcctgagc

SEQ ID NO: 4635650 - DNA, 16 bp, Homo sapiens
gcctgggggcctggct

SEQ ID NO: 4635651 - DNA, 17 bp, Homo sapiens
gcctgggggcctggctg

SEQ ID NO: 4635652 - DNA, 20 bp, Homo sapiens
gcctgggggcctggctggct

SEQ ID NO: 4635653 - DNA, 18 bp, Homo sapiens
gcctggggtgacccggca

SEQ ID NO: 4635654 - DNA, 18 bp, Homo sapiens
gcctgggtaggccccaca

SEQ ID NO: 4635655 - DNA, 14 bp, Homo sapiens
gcctggtctgggag

SEQ ID NO: 4635656 - DNA, 21 bp, Homo sapiens
gcctggttctaggctgctgca

SEQ ID NO: 4635657 - DNA, 20 bp, Homo sapiens
gcctgtaatcccagtacttt

SEQ ID NO: 4635658 - DNA, 16 bp, Homo sapiens
gcctgtactgcctgct

SEQ ID NO: 4635659 - DNA, 19 bp, Homo sapiens
gcctgtagaatagcctgtg

SEQ ID NO: 4635660 - DNA, 20 bp, Homo sapiens
gcctgtagaatagcctgtgg

SEQ ID NO: 4635661 - DNA, 17 bp, Homo sapiens
gcctgtgaacccaggac

SEQ ID NO: 4635662 - DNA, 16 bp, Homo sapiens
gcctgtgatgttttat

SEQ ID NO: 4635663 - DNA, 23 bp, Homo sapiens
gcctgtgcgtcccagctgaaggc

SEQ ID NO: 4635664 - DNA, 18 bp, Homo sapiens
gcctgtggaatgagtgtg

SEQ ID NO: 4635665 - DNA, 19 bp, Homo sapiens
gcctgtggaatgagtgtgc

SEQ ID NO: 4635666 - DNA, 22 bp, Homo sapiens
gcctgtgtagctgtgacctgct

SEQ ID NO: 4635667 - DNA, 16 bp, Homo sapiens
gcctgttcatggcaga

SEQ ID NO: 4635668 - DNA, 14 bp, Homo sapiens
gccttaaaatggaa

SEQ ID NO: 4635669 - DNA, 22 bp, Homo sapiens
gccttaaaatggaattgaaaaa

SEQ ID NO: 4635670 - DNA, 14 bp, Homo sapiens
gccttaacctggga

SEQ ID NO: 4635671 - DNA, 12 bp, Homo sapiens
gccttagtgggc

SEQ ID NO: 4635672 - DNA, 17 bp, Homo sapiens
gccttagtgggccaggg

SEQ ID NO: 4635673 - DNA, 19 bp, Homo sapiens
gccttagtgggccagggct

SEQ ID NO: 4635674 - DNA, 20 bp, Homo sapiens
gccttagtgggccagggctg

SEQ ID NO: 4635675 - DNA, 14 bp, Homo sapiens
gccttattttgagt

SEQ ID NO: 4635676 - DNA, 21 bp, Homo sapiens
gccttcaacaacgtgagagaa

SEQ ID NO: 4635677 - DNA, 22 bp, Homo sapiens
gccttcaacaacgtgagagaaa

SEQ ID NO: 4635678 - DNA, 20 bp, Homo sapiens
gccttcccaagttgtgcttg

SEQ ID NO: 4635679 - DNA, 13 bp, Homo sapiens
gccttcccccagc

SEQ ID NO: 4635680 - DNA, 18 bp, Homo sapiens
gccttcccccagcaaggc

SEQ ID NO: 4635681 - DNA, 15 bp, Homo sapiens
gccttccctctgcat

SEQ ID NO: 4635682 - DNA, 17 bp, Homo sapiens
gccttccctctgcattg

SEQ ID NO: 4635683 - DNA, 15 bp, Homo sapiens
gccttcggagggaaa

SEQ ID NO: 4635684 - DNA, 24 bp, Homo sapiens
gccttctaggaatggaggagccag

SEQ ID NO: 4635685 - DNA, 19 bp, Homo sapiens
gccttcttccttgaggggc

SEQ ID NO: 4635686 - DNA, 11 bp, Homo sapiens
gccttgaccta

SEQ ID NO: 4635687 - DNA, 17 bp, Homo sapiens
gccttggggaggacaaa

SEQ ID NO: 4635688 - DNA, 20 bp, Homo sapiens
gccttggggaggacaaaact

SEQ ID NO: 4635689 - DNA, 16 bp, Homo sapiens
gccttgttctgtcacc

SEQ ID NO: 4635690 - DNA, 22 bp, Homo sapiens
gcctttgggcacggccctcctt

SEQ ID NO: 4635691 - DNA, 18 bp, Homo sapiens
gccttttcccccaccctc

SEQ ID NO: 4635692 - DNA, 22 bp, Homo sapiens
gccttttgttaaacccttctgt

SEQ ID NO: 4635693 - DNA, 16 bp, Homo sapiens
gcctttttagggcaga

SEQ ID NO: 4635694 - DNA, 23 bp, Homo sapiens
gcctttttggcctgtgatgtttt

SEQ ID NO: 4635695 - DNA, 17 bp, Homo sapiens
gccttttttgccagact

SEQ ID NO: 4635696 - DNA, 22 bp, Homo sapiens
gcgagacgcacacagctgagca

SEQ ID NO: 4635697 - DNA, 14 bp, Homo sapiens
gcgattccctctcc

SEQ ID NO: 4635698 - DNA, 14 bp, Homo sapiens
gcgcaagtgcctgg

SEQ ID NO: 4635699 - DNA, 15 bp, Homo sapiens
gcgcaagtgcctggg

SEQ ID NO: 4635700 - DNA, 13 bp, Homo sapiens
gcgcagctgccta

SEQ ID NO: 4635701 - DNA, 21 bp, Homo sapiens
gcgccatctcggctcactgca

SEQ ID NO: 4635702 - DNA, 12 bp, Homo sapiens
gcgccctgcaga

SEQ ID NO: 4635703 - DNA, 12 bp, Homo sapiens
gcgcccttcctc

SEQ ID NO: 4635704 - DNA, 15 bp, Homo sapiens
gcgcctttttggcct

SEQ ID NO: 4635705 - DNA, 16 bp, Homo sapiens
gcggacagtggcagga

SEQ ID NO: 4635706 - DNA, 22 bp, Homo sapiens
gcggagagaggccttgtcccag

SEQ ID NO: 4635707 - DNA, 22 bp, Homo sapiens
gcggagggaggggaggggtgaa

SEQ ID NO: 4635708 - DNA, 14 bp, Homo sapiens
gcggatcctgctgg

SEQ ID NO: 4635709 - DNA, 13 bp, Homo sapiens
gcggatggccgga

SEQ ID NO: 4635710 - DNA, 20 bp, Homo sapiens
gcggcccgcgcagctgccta

SEQ ID NO: 4635711 - DNA, 23 bp, Homo sapiens
gcggcctatgacttgggcacccc

SEQ ID NO: 4635712 - DNA, 18 bp, Homo sapiens
gcggctctagccccagcg

SEQ ID NO: 4635713 - DNA, 14 bp, Homo sapiens
gcgggagcctccct

SEQ ID NO: 4635714 - DNA, 22 bp, Homo sapiens
gcgggcgcactgcctctcacag

SEQ ID NO: 4635715 - DNA, 23 bp, Homo sapiens
gcgggcgcactgcctctcacagc

SEQ ID NO: 4635716 - DNA, 17 bp, Homo sapiens
gcgggcggagggagggg

SEQ ID NO: 4635717 - DNA, 14 bp, Homo sapiens
gcgggggcaggccg

SEQ ID NO: 4635718 - DNA, 22 bp, Homo sapiens
gcgggggcaggccgggcctgct

SEQ ID NO: 4635719 - DNA, 21 bp, Homo sapiens
gcgggtgaacaaagcagccac

SEQ ID NO: 4635720 - DNA, 22 bp, Homo sapiens
gcgggtgaacaaagcagccacg

SEQ ID NO: 4635721 - DNA, 17 bp, Homo sapiens
gcgggtgtcacattcct

SEQ ID NO: 4635722 - DNA, 18 bp, Homo sapiens
gcggtccctgtccctcta

SEQ ID NO: 4635723 - DNA, 21 bp, Homo sapiens
gcggtccctgtccctctagtg

SEQ ID NO: 4635724 - DNA, 16 bp, Homo sapiens
gcgtctaccctgggat

SEQ ID NO: 4635725 - DNA, 20 bp, Homo sapiens
gcgtgccgtgtgagtgtgac

SEQ ID NO: 4635726 - DNA, 22 bp, Homo sapiens
gcgtgccgtgtgagtgtgacag

SEQ ID NO: 4635727 - DNA, 24 bp, Homo sapiens
gcgtgccgtgtgagtgtgacaggg

SEQ ID NO: 4635728 - DNA, 13 bp, Homo sapiens
gcgtggactctgc

SEQ ID NO: 4635729 - DNA, 18 bp, Homo sapiens
gcgtggactctgcacatg

SEQ ID NO: 4635730 - DNA, 16 bp, Homo sapiens
gcgttaagggcagagt

SEQ ID NO: 4635731 - DNA, 14 bp, Homo sapiens
gctaacaaagacaa

SEQ ID NO: 4635732 - DNA, 15 bp, Homo sapiens
gctaacagggaaggc

SEQ ID NO: 4635733 - DNA, 20 bp, Homo sapiens
gctaacagggaaggcaggca

SEQ ID NO: 4635734 - DNA, 22 bp, Homo sapiens
gctaacagggaaggcaggcagg

SEQ ID NO: 4635735 - DNA, 13 bp, Homo sapiens
gctaactgtaaat

SEQ ID NO: 4635736 - DNA, 14 bp, Homo sapiens
gctaactgtaaatc

SEQ ID NO: 4635737 - DNA, 19 bp, Homo sapiens
gctaagggtgggtgctcag

SEQ ID NO: 4635738 - DNA, 20 bp, Homo sapiens
gctaatcaaagccagggtct

SEQ ID NO: 4635739 - DNA, 21 bp, Homo sapiens
gctaattaggtctcatccttt

SEQ ID NO: 4635740 - DNA, 14 bp, Homo sapiens
gctaatttaacacc

SEQ ID NO: 4635741 - DNA, 18 bp, Homo sapiens
gctacaaggtaggctgca

SEQ ID NO: 4635742 - DNA, 19 bp, Homo sapiens
gctacaccactctggcagc

SEQ ID NO: 4635743 - DNA, 22 bp, Homo sapiens
gctacaccactctggcagccac

SEQ ID NO: 4635744 - DNA, 21 bp, Homo sapiens
gctacattaaactcaaatgta

SEQ ID NO: 4635745 - DNA, 20 bp, Homo sapiens
gctaccagaagaggggcagc

SEQ ID NO: 4635746 - DNA, 23 bp, Homo sapiens
gctacgtgtgaaatctgtctttg

SEQ ID NO: 4635747 - DNA, 14 bp, Homo sapiens
gctactccctggac

SEQ ID NO: 4635748 - DNA, 15 bp, Homo sapiens
gctactccctggacc

SEQ ID NO: 4635749 - DNA, 19 bp, Homo sapiens
gctactccctggaccacga

SEQ ID NO: 4635750 - DNA, 16 bp, Homo sapiens
gctactctgtgccaga

SEQ ID NO: 4635751 - DNA, 23 bp, Homo sapiens
gctactctgtgccagagcctggg

SEQ ID NO: 4635752 - DNA, 21 bp, Homo sapiens
gctagacaatgatttggccag

SEQ ID NO: 4635753 - DNA, 15 bp, Homo sapiens
gctagacgcaccgcc

SEQ ID NO: 4635754 - DNA, 12 bp, Homo sapiens
gctagactgtgt

SEQ ID NO: 4635755 - DNA, 19 bp, Homo sapiens
gctagacttagattcatta

SEQ ID NO: 4635756 - DNA, 13 bp, Homo sapiens
gctagagggccca

SEQ ID NO: 4635757 - DNA, 13 bp, Homo sapiens
gctagccctgccc

SEQ ID NO: 4635758 - DNA, 15 bp, Homo sapiens
gctagccctgccctc

SEQ ID NO: 4635759 - DNA, 15 bp, Homo sapiens
gctaggagcaaagcc

SEQ ID NO: 4635760 - DNA, 16 bp, Homo sapiens
gctaggagcaaagcct

SEQ ID NO: 4635761 - DNA, 19 bp, Homo sapiens
gctaggagcaaagcctgtt

SEQ ID NO: 4635762 - DNA, 15 bp, Homo sapiens
gctaggccccagagg

SEQ ID NO: 4635763 - DNA, 18 bp, Homo sapiens
gctaggccccagaggccc

SEQ ID NO: 4635764 - DNA, 15 bp, Homo sapiens
gctagggaggaccaa

SEQ ID NO: 4635765 - DNA, 14 bp, Homo sapiens
gctagtcgcccctc

SEQ ID NO: 4635766 - DNA, 17 bp, Homo sapiens
gctagtcgcccctcaga

SEQ ID NO: 4635767 - DNA, 20 bp, Homo sapiens
gctagtcgcccctcagagca

SEQ ID NO: 4635768 - DNA, 21 bp, Homo sapiens
gctagtcgcccctcagagcat

SEQ ID NO: 4635769 - DNA, 22 bp, Homo sapiens
gctagtcgcccctcagagcatg

SEQ ID NO: 4635770 - DNA, 16 bp, Homo sapiens
gctatagttgcagccc

SEQ ID NO: 4635771 - DNA, 18 bp, Homo sapiens
gctatagttgcagcccaa

SEQ ID NO: 4635772 - DNA, 20 bp, Homo sapiens
gctatcacctagcagcctca

SEQ ID NO: 4635773 - DNA, 12 bp, Homo sapiens
gctatcctggga

SEQ ID NO: 4635774 - DNA, 20 bp, Homo sapiens
gctatgcggaggaaagcaag

SEQ ID NO: 4635775 - DNA, 18 bp, Homo sapiens
gctatggatggcttctaa

SEQ ID NO: 4635776 - DNA, 14 bp, Homo sapiens
gctatggtgagatg

SEQ ID NO: 4635777 - DNA, 17 bp, Homo sapiens
gctatgtagtcataata

SEQ ID NO: 4635778 - DNA, 21 bp, Homo sapiens
gctatgttctgtcttcccaaa

SEQ ID NO: 4635779 - DNA, 23 bp, Homo sapiens
gctattactaaggagtaatctgt

SEQ ID NO: 4635780 - DNA, 13 bp, Homo sapiens
gctatttccttcc

SEQ ID NO: 4635781 - DNA, 15 bp, Homo sapiens
gctatttccttccag

SEQ ID NO: 4635782 - DNA, 19 bp, Homo sapiens
gctatttgaagaaaaaaat

SEQ ID NO: 4635783 - DNA, 14 bp, Homo sapiens
gctcaacggtctgg

SEQ ID NO: 4635784 - DNA, 17 bp, Homo sapiens
gctcaacggtctggcag

SEQ ID NO: 4635785 - DNA, 15 bp, Homo sapiens
gctcaagctttcccg

SEQ ID NO: 4635786 - DNA, 13 bp, Homo sapiens
gctcacaaggcag

SEQ ID NO: 4635787 - DNA, 14 bp, Homo sapiens
gctcacaaggcagc

SEQ ID NO: 4635788 - DNA, 15 bp, Homo sapiens
gctcacaaggcagca

SEQ ID NO: 4635789 - DNA, 15 bp, Homo sapiens
gctcaccgactcacc

SEQ ID NO: 4635790 - DNA, 19 bp, Homo sapiens
gctcaccgactcacctgcg

SEQ ID NO: 4635791 - DNA, 21 bp, Homo sapiens
gctcagcagggctggtcacct

SEQ ID NO: 4635792 - DNA, 12 bp, Homo sapiens
gctcagccagca

SEQ ID NO: 4635793 - DNA, 21 bp, Homo sapiens
gctcagtgcaacctctgcttc

SEQ ID NO: 4635794 - DNA, 22 bp, Homo sapiens
gctcatcccccctgctgcccag

SEQ ID NO: 4635795 - DNA, 23 bp, Homo sapiens
gctcatcccccctgctgcccagt

SEQ ID NO: 4635796 - DNA, 15 bp, Homo sapiens
gctcatgagctcctg

SEQ ID NO: 4635797 - DNA, 22 bp, Homo sapiens
gctcatgagctcctgatcagag

SEQ ID NO: 4635798 - DNA, 17 bp, Homo sapiens
gctcattcttcagttct

SEQ ID NO: 4635799 - DNA, 18 bp, Homo sapiens
gctcattcttcagttctc

SEQ ID NO: 4635800 - DNA, 13 bp, Homo sapiens
gctcatttttgca

SEQ ID NO: 4635801 - DNA, 12 bp, Homo sapiens
gctccaccactg

SEQ ID NO: 4635802 - DNA, 16 bp, Homo sapiens
gctccaccactgtgca

SEQ ID NO: 4635803 - DNA, 18 bp, Homo sapiens
gctccaccactgtgcact

SEQ ID NO: 4635804 - DNA, 16 bp, Homo sapiens
gctccaccctggccga

SEQ ID NO: 4635805 - DNA, 21 bp, Homo sapiens
gctccagatgcagggcagtca

SEQ ID NO: 4635806 - DNA, 16 bp, Homo sapiens
gctccaggcctgcagc

SEQ ID NO: 4635807 - DNA, 21 bp, Homo sapiens
gctccatatttgatttctaat

SEQ ID NO: 4635808 - DNA, 17 bp, Homo sapiens
gctccattcactcccag

SEQ ID NO: 4635809 - DNA, 21 bp, Homo sapiens
gctcccaactcccttctgctt

SEQ ID NO: 4635810 - DNA, 14 bp, Homo sapiens
gctcccaagcccct

SEQ ID NO: 4635811 - DNA, 15 bp, Homo sapiens
gctcccaagcccctg

SEQ ID NO: 4635812 - DNA, 19 bp, Homo sapiens
gctcccaagcccctgaccc

SEQ ID NO: 4635813 - DNA, 22 bp, Homo sapiens
gctcccagggccatgaactttg

SEQ ID NO: 4635814 - DNA, 16 bp, Homo sapiens
gctccccactctgctc

SEQ ID NO: 4635815 - DNA, 18 bp, Homo sapiens
gctccccactctgctctg

SEQ ID NO: 4635816 - DNA, 15 bp, Homo sapiens
gctcccccaggcaga

SEQ ID NO: 4635817 - DNA, 22 bp, Homo sapiens
gctcccctgccttaacctggga

SEQ ID NO: 4635818 - DNA, 23 bp, Homo sapiens
gctcccctgccttaacctgggac

SEQ ID NO: 4635819 - DNA, 15 bp, Homo sapiens
gctcccgtggcctgt

SEQ ID NO: 4635820 - DNA, 14 bp, Homo sapiens
gctccctctctcct

SEQ ID NO: 4635821 - DNA, 18 bp, Homo sapiens
gctccctctctcctggac

SEQ ID NO: 4635822 - DNA, 19 bp, Homo sapiens
gctccctctctcctggact

SEQ ID NO: 4635823 - DNA, 21 bp, Homo sapiens
gctccctctctcctggactgg

SEQ ID NO: 4635824 - DNA, 22 bp, Homo sapiens
gctccctctctcctggactggt

SEQ ID NO: 4635825 - DNA, 23 bp, Homo sapiens
gctcccttcaagacgaggggcag

SEQ ID NO: 4635826 - DNA, 20 bp, Homo sapiens
gctcctccagggtgtgtgct

SEQ ID NO: 4635827 - DNA, 13 bp, Homo sapiens
gctcctctgtctc

SEQ ID NO: 4635828 - DNA, 22 bp, Homo sapiens
gctcctctgtctcgagcgccct

SEQ ID NO: 4635829 - DNA, 12 bp, Homo sapiens
gctcctgccagg

SEQ ID NO: 4635830 - DNA, 15 bp, Homo sapiens
gctccttcagttctg

SEQ ID NO: 4635831 - DNA, 19 bp, Homo sapiens
gctcctttctgtcctggag

SEQ ID NO: 4635832 - DNA, 17 bp, Homo sapiens
gctcggacttactgcct

SEQ ID NO: 4635833 - DNA, 19 bp, Homo sapiens
gctcggacttactgcctga

SEQ ID NO: 4635834 - DNA, 17 bp, Homo sapiens
gctcgtgtatttattac

SEQ ID NO: 4635835 - DNA, 15 bp, Homo sapiens
gctctaacgcctgag

SEQ ID NO: 4635836 - DNA, 21 bp, Homo sapiens
gctctaacgcctgagcccagg

SEQ ID NO: 4635837 - DNA, 22 bp, Homo sapiens
gctctaacgcctgagcccaggg

SEQ ID NO: 4635838 - DNA, 15 bp, Homo sapiens
gctctaagcccagga

SEQ ID NO: 4635839 - DNA, 16 bp, Homo sapiens
gctctaagcccaggat

SEQ ID NO: 4635840 - DNA, 19 bp, Homo sapiens
gctctaaggtactgtgggg

SEQ ID NO: 4635841 - DNA, 22 bp, Homo sapiens
gctctacaggcctgcagcccct

SEQ ID NO: 4635842 - DNA, 15 bp, Homo sapiens
gctctagccccagcg

SEQ ID NO: 4635843 - DNA, 18 bp, Homo sapiens
gctctagccccagcgcca

SEQ ID NO: 4635844 - DNA, 20 bp, Homo sapiens
gctctagtgggacagcccag

SEQ ID NO: 4635845 - DNA, 14 bp, Homo sapiens
gctctatgtttgta

SEQ ID NO: 4635846 - DNA, 20 bp, Homo sapiens
gctctatgtttgtatttgga

SEQ ID NO: 4635847 - DNA, 20 bp, Homo sapiens
gctctcatggtacttcctct

SEQ ID NO: 4635848 - DNA, 14 bp, Homo sapiens
gctctcctggcttc

SEQ ID NO: 4635849 - DNA, 14 bp, Homo sapiens
gctctctctagaat

SEQ ID NO: 4635850 - DNA, 21 bp, Homo sapiens
gctctgaacttccaagctcca

SEQ ID NO: 4635851 - DNA, 17 bp, Homo sapiens
gctctgagaggccctgg

SEQ ID NO: 4635852 - DNA, 9 bp, Homo sapiens
gctctgagg

SEQ ID NO: 4635853 - DNA, 10 bp, Homo sapiens
gctctgaggc

SEQ ID NO: 4635854 - DNA, 11 bp, Homo sapiens
gctctgatgca

SEQ ID NO: 4635855 - DNA, 16 bp, Homo sapiens
gctctgatgcatcaga

SEQ ID NO: 4635856 - DNA, 22 bp, Homo sapiens
gctctgcacagacaagcagccc

SEQ ID NO: 4635857 - DNA, 15 bp, Homo sapiens
gctctgcacccctct

SEQ ID NO: 4635858 - DNA, 12 bp, Homo sapiens
gctctgcccagg

SEQ ID NO: 4635859 - DNA, 14 bp, Homo sapiens
gctctgcccaggca

SEQ ID NO: 4635860 - DNA, 22 bp, Homo sapiens
gctctgcccaggcaaggaacag

SEQ ID NO: 4635861 - DNA, 14 bp, Homo sapiens
gctctgccccaggc

SEQ ID NO: 4635862 - DNA, 21 bp, Homo sapiens
gctctgccgccgcccgctggg

SEQ ID NO: 4635863 - DNA, 13 bp, Homo sapiens
gctctggagaaca

SEQ ID NO: 4635864 - DNA, 20 bp, Homo sapiens
gctctgggccattctccaca

SEQ ID NO: 4635865 - DNA, 22 bp, Homo sapiens
gctctgtgagggtgctgactgg

SEQ ID NO: 4635866 - DNA, 18 bp, Homo sapiens
gctcttcaacatgacatc

SEQ ID NO: 4635867 - DNA, 12 bp, Homo sapiens
gctcttcccttg

SEQ ID NO: 4635868 - DNA, 22 bp, Homo sapiens
gctcttcccttgctcatgagct

SEQ ID NO: 4635869 - DNA, 15 bp, Homo sapiens
gctcttggggaaggg

SEQ ID NO: 4635870 - DNA, 16 bp, Homo sapiens
gctctttcacctgggt

SEQ ID NO: 4635871 - DNA, 20 bp, Homo sapiens
gctctttccaaattaaaaca

SEQ ID NO: 4635872 - DNA, 23 bp, Homo sapiens
gctctttccaaattaaaacaaat

SEQ ID NO: 4635873 - DNA, 20 bp, Homo sapiens
gctctttccacttgccctgt

SEQ ID NO: 4635874 - DNA, 16 bp, Homo sapiens
gctcttttaggtaact

SEQ ID NO: 4635875 - DNA, 22 bp, Homo sapiens
gctcttttttgtttgtttcttt

SEQ ID NO: 4635876 - DNA, 15 bp, Homo sapiens
gctgaaaagggcact

SEQ ID NO: 4635877 - DNA, 21 bp, Homo sapiens
gctgaaattgcttatttttgg

SEQ ID NO: 4635878 - DNA, 15 bp, Homo sapiens
gctgaaggcagtggc

SEQ ID NO: 4635879 - DNA, 15 bp, Homo sapiens
gctgaataacctgca

SEQ ID NO: 4635880 - DNA, 14 bp, Homo sapiens
gctgacagacacta

SEQ ID NO: 4635881 - DNA, 17 bp, Homo sapiens
gctgacatgaagctgtt

SEQ ID NO: 4635882 - DNA, 14 bp, Homo sapiens
gctgaccacagcac

SEQ ID NO: 4635883 - DNA, 17 bp, Homo sapiens
gctgaccacagcacagc

SEQ ID NO: 4635884 - DNA, 15 bp, Homo sapiens
gctgacccagcatct

SEQ ID NO: 4635885 - DNA, 19 bp, Homo sapiens
gctgacgaacttccatggc

SEQ ID NO: 4635886 - DNA, 20 bp, Homo sapiens
gctgacttcacttattagtc

SEQ ID NO: 4635887 - DNA, 24 bp, Homo sapiens
gctgacttcatctcccacctagca

SEQ ID NO: 4635888 - DNA, 14 bp, Homo sapiens
gctgagaacctggc

SEQ ID NO: 4635889 - DNA, 17 bp, Homo sapiens
gctgagaacctggcctt

SEQ ID NO: 4635890 - DNA, 14 bp, Homo sapiens
gctgagcagggccg

SEQ ID NO: 4635891 - DNA, 19 bp, Homo sapiens
gctgagctcacaaggcagc

SEQ ID NO: 4635892 - DNA, 20 bp, Homo sapiens
gctgagctcacaaggcagca

SEQ ID NO: 4635893 - DNA, 21 bp, Homo sapiens
gctgagctcacaaggcagcaa

SEQ ID NO: 4635894 - DNA, 15 bp, Homo sapiens
gctgagctctgagag

SEQ ID NO: 4635895 - DNA, 20 bp, Homo sapiens
gctgagctctgagaggccct

SEQ ID NO: 4635896 - DNA, 22 bp, Homo sapiens
gctgagctctgagaggccctgg

SEQ ID NO: 4635897 - DNA, 12 bp, Homo sapiens
gctgagctggct

SEQ ID NO: 4635898 - DNA, 16 bp, Homo sapiens
gctgaggcagggggat

SEQ ID NO: 4635899 - DNA, 18 bp, Homo sapiens
gctgaggctggcacagga

SEQ ID NO: 4635900 - DNA, 21 bp, Homo sapiens
gctgagggcagttcgcagcca

SEQ ID NO: 4635901 - DNA, 22 bp, Homo sapiens
gctgagggcagttcgcagccac

SEQ ID NO: 4635902 - DNA, 17 bp, Homo sapiens
gctgaggggtctcggat

SEQ ID NO: 4635903 - DNA, 18 bp, Homo sapiens
gctgaggtgcccaggaga

SEQ ID NO: 4635904 - DNA, 20 bp, Homo sapiens
gctgagtgagtgggagagta

SEQ ID NO: 4635905 - DNA, 13 bp, Homo sapiens
gctgatgtagtat

SEQ ID NO: 4635906 - DNA, 16 bp, Homo sapiens
gctgcaaaaattatat

SEQ ID NO: 4635907 - DNA, 19 bp, Homo sapiens
gctgcaaaaattatatatt

SEQ ID NO: 4635908 - DNA, 14 bp, Homo sapiens
gctgcaaaattaaa

SEQ ID NO: 4635909 - DNA, 18 bp, Homo sapiens
gctgcaaaggagaagcac

SEQ ID NO: 4635910 - DNA, 20 bp, Homo sapiens
gctgcaatacattaaaataa

SEQ ID NO: 4635911 - DNA, 19 bp, Homo sapiens
gctgcacaccaaggccctg

SEQ ID NO: 4635912 - DNA, 22 bp, Homo sapiens
gctgcacaccaaggccctgcat

SEQ ID NO: 4635913 - DNA, 14 bp, Homo sapiens
gctgcactgtgaac

SEQ ID NO: 4635914 - DNA, 21 bp, Homo sapiens
gctgcaggagtgtcctgccca

SEQ ID NO: 4635915 - DNA, 23 bp, Homo sapiens
gctgcaggagtgtcctgcccatg

SEQ ID NO: 4635916 - DNA, 17 bp, Homo sapiens
gctgcaggggcatggga

SEQ ID NO: 4635917 - DNA, 23 bp, Homo sapiens
gctgcagtccgtgtggatccaat

SEQ ID NO: 4635918 - DNA, 19 bp, Homo sapiens
gctgccccacaggtgtgtt

SEQ ID NO: 4635919 - DNA, 12 bp, Homo sapiens
gctgcccctctc

SEQ ID NO: 4635920 - DNA, 14 bp, Homo sapiens
gctgcccctctctg

SEQ ID NO: 4635921 - DNA, 15 bp, Homo sapiens
gctgcccctctctgg

SEQ ID NO: 4635922 - DNA, 19 bp, Homo sapiens
gctgcccctctctgggcct

SEQ ID NO: 4635923 - DNA, 13 bp, Homo sapiens
gctgccctgagaa

SEQ ID NO: 4635924 - DNA, 21 bp, Homo sapiens
gctgccctgagaagctgctcc

SEQ ID NO: 4635925 - DNA, 19 bp, Homo sapiens
gctgccgtctggccgggct

SEQ ID NO: 4635926 - DNA, 21 bp, Homo sapiens
gctgcctgggtaggccccaca

SEQ ID NO: 4635927 - DNA, 15 bp, Homo sapiens
gctgcggagcaagag

SEQ ID NO: 4635928 - DNA, 19 bp, Homo sapiens
gctgctcggggtgcacagg

SEQ ID NO: 4635929 - DNA, 18 bp, Homo sapiens
gctgctctaagcccagga

SEQ ID NO: 4635930 - DNA, 18 bp, Homo sapiens
gctgctctttccacttgc

SEQ ID NO: 4635931 - DNA, 15 bp, Homo sapiens
gctgctgagaacctg

SEQ ID NO: 4635932 - DNA, 16 bp, Homo sapiens
gctgctgagaacctgg

SEQ ID NO: 4635933 - DNA, 17 bp, Homo sapiens
gctgctgagaacctggc

SEQ ID NO: 4635934 - DNA, 22 bp, Homo sapiens
gctgctgagaacctggccttca

SEQ ID NO: 4635935 - DNA, 23 bp, Homo sapiens
gctgctggtcagtcgtggagcgc

SEQ ID NO: 4635936 - DNA, 17 bp, Homo sapiens
gctgcttcctgtgacag

SEQ ID NO: 4635937 - DNA, 23 bp, Homo sapiens
gctggaaaagggtcttgggaaat

SEQ ID NO: 4635938 - DNA, 16 bp, Homo sapiens
gctggagaaagagctg

SEQ ID NO: 4635939 - DNA, 18 bp, Homo sapiens
gctggagaaagagctgcc

SEQ ID NO: 4635940 - DNA, 19 bp, Homo sapiens
gctggagaaagagctgcct

SEQ ID NO: 4635941 - DNA, 20 bp, Homo sapiens
gctggagaaagagctgcctg

SEQ ID NO: 4635942 - DNA, 22 bp, Homo sapiens
gctggagaaagagctgcctgga

SEQ ID NO: 4635943 - DNA, 14 bp, Homo sapiens
gctggccaaagtca

SEQ ID NO: 4635944 - DNA, 16 bp, Homo sapiens
gctggccaaagtcact

SEQ ID NO: 4635945 - DNA, 21 bp, Homo sapiens
gctggccaatttttgtacttt

SEQ ID NO: 4635946 - DNA, 21 bp, Homo sapiens
gctggccccgcccctgccccc

SEQ ID NO: 4635947 - DNA, 19 bp, Homo sapiens
gctggcccgtgacagactc

SEQ ID NO: 4635948 - DNA, 17 bp, Homo sapiens
gctggctccagatgcag

SEQ ID NO: 4635949 - DNA, 21 bp, Homo sapiens
gctggctccagatgcagggca

SEQ ID NO: 4635950 - DNA, 16 bp, Homo sapiens
gctggctcccagggcc

SEQ ID NO: 4635951 - DNA, 16 bp, Homo sapiens
gctggctgagggcagt

SEQ ID NO: 4635952 - DNA, 20 bp, Homo sapiens
gctgggacgtggctcagcca

SEQ ID NO: 4635953 - DNA, 13 bp, Homo sapiens
gctgggccactgg

SEQ ID NO: 4635954 - DNA, 21 bp, Homo sapiens
gctgggccctctttccctgcg

SEQ ID NO: 4635955 - DNA, 15 bp, Homo sapiens
gctgggctctgcctg

SEQ ID NO: 4635956 - DNA, 12 bp, Homo sapiens
gctgggctgggc

SEQ ID NO: 4635957 - DNA, 18 bp, Homo sapiens
gctgggctgggccctctt

SEQ ID NO: 4635958 - DNA, 16 bp, Homo sapiens
gctggggactcaggga

SEQ ID NO: 4635959 - DNA, 18 bp, Homo sapiens
gctggggaggaggagaga

SEQ ID NO: 4635960 - DNA, 21 bp, Homo sapiens
gctggggccaggccccatgga

SEQ ID NO: 4635961 - DNA, 21 bp, Homo sapiens
gctggggccgccacggcctgg

SEQ ID NO: 4635962 - DNA, 21 bp, Homo sapiens
gctgggggaatgagcccagag

SEQ ID NO: 4635963 - DNA, 22 bp, Homo sapiens
gctgggggaatgagcccagaga

SEQ ID NO: 4635964 - DNA, 15 bp, Homo sapiens
gctgggtcaggcagg

SEQ ID NO: 4635965 - DNA, 13 bp, Homo sapiens
gctggtcctgacc

SEQ ID NO: 4635966 - DNA, 16 bp, Homo sapiens
gctggtcctgaccagg

SEQ ID NO: 4635967 - DNA, 13 bp, Homo sapiens
gctggtgggaagg

SEQ ID NO: 4635968 - DNA, 21 bp, Homo sapiens
gctggtgttcaccaaaaccaa

SEQ ID NO: 4635969 - DNA, 19 bp, Homo sapiens
gctgtaaatttggcttctg

SEQ ID NO: 4635970 - DNA, 18 bp, Homo sapiens
gctgtaactgagagaaag

SEQ ID NO: 4635971 - DNA, 18 bp, Homo sapiens
gctgtaagggcagtgccc

SEQ ID NO: 4635972 - DNA, 13 bp, Homo sapiens
gctgtatttgctg

SEQ ID NO: 4635973 - DNA, 14 bp, Homo sapiens
gctgtattttgagt

SEQ ID NO: 4635974 - DNA, 19 bp, Homo sapiens
gctgtcacctcgctgggct

SEQ ID NO: 4635975 - DNA, 15 bp, Homo sapiens
gctgtcacttcttca

SEQ ID NO: 4635976 - DNA, 18 bp, Homo sapiens
gctgtccccactgcccca

SEQ ID NO: 4635977 - DNA, 11 bp, Homo sapiens
gctgtccctgc

SEQ ID NO: 4635978 - DNA, 12 bp, Homo sapiens
gctgtccctgca

SEQ ID NO: 4635979 - DNA, 18 bp, Homo sapiens
gctgtccctgcagggcca

SEQ ID NO: 4635980 - DNA, 16 bp, Homo sapiens
gctgtcctggaggggc

SEQ ID NO: 4635981 - DNA, 23 bp, Homo sapiens
gctgtcctggaggggctggggac

SEQ ID NO: 4635982 - DNA, 16 bp, Homo sapiens
gctgtctgaagcccaa

SEQ ID NO: 4635983 - DNA, 13 bp, Homo sapiens
gctgtgacctgct

SEQ ID NO: 4635984 - DNA, 20 bp, Homo sapiens
gctgtgacctgctgagctct

SEQ ID NO: 4635985 - DNA, 18 bp, Homo sapiens
gctgtgagacagtgggaa

SEQ ID NO: 4635986 - DNA, 20 bp, Homo sapiens
gctgtgagacagtgggaaat

SEQ ID NO: 4635987 - DNA, 23 bp, Homo sapiens
gctgtgagacagtgggaaatatt

SEQ ID NO: 4635988 - DNA, 14 bp, Homo sapiens
gctgtgccagcagg

SEQ ID NO: 4635989 - DNA, 17 bp, Homo sapiens
gctgtgccatgctgggc

SEQ ID NO: 4635990 - DNA, 18 bp, Homo sapiens
gctgtgcctcgctcccca

SEQ ID NO: 4635991 - DNA, 20 bp, Homo sapiens
gctgtgtagttccctctgcc

SEQ ID NO: 4635992 - DNA, 19 bp, Homo sapiens
gctgtgtttgcagcctgct

SEQ ID NO: 4635993 - DNA, 23 bp, Homo sapiens
gctgttagggctgaatcttctgg

SEQ ID NO: 4635994 - DNA, 17 bp, Homo sapiens
gctgttcacagcttttc

SEQ ID NO: 4635995 - DNA, 14 bp, Homo sapiens
gctgtttcaaatgt

SEQ ID NO: 4635996 - DNA, 13 bp, Homo sapiens
gcttaaaaatact

SEQ ID NO: 4635997 - DNA, 16 bp, Homo sapiens
gcttacggccctggcc

SEQ ID NO: 4635998 - DNA, 17 bp, Homo sapiens
gcttagaggttctgcct

SEQ ID NO: 4635999 - DNA, 18 bp, Homo sapiens
gcttagaggttctgcctc

SEQ ID NO: 4636000 - DNA, 18 bp, Homo sapiens
gcttatgaaagaggcagc

SEQ ID NO: 4636001 - DNA, 19 bp, Homo sapiens
gcttatgagatctaatgtg

SEQ ID NO: 4636002 - DNA, 22 bp, Homo sapiens
gcttatgagatctaatgtgaaa

SEQ ID NO: 4636003 - DNA, 16 bp, Homo sapiens
gcttcagcccccacca

SEQ ID NO: 4636004 - DNA, 18 bp, Homo sapiens
gcttcagtaacaagtgtt

SEQ ID NO: 4636005 - DNA, 14 bp, Homo sapiens
gcttccacctcacc

SEQ ID NO: 4636006 - DNA, 20 bp, Homo sapiens
gcttccacctcaccccactt

SEQ ID NO: 4636007 - DNA, 18 bp, Homo sapiens
gcttcccatccccagcga

SEQ ID NO: 4636008 - DNA, 16 bp, Homo sapiens
gcttccctacacaggg

SEQ ID NO: 4636009 - DNA, 19 bp, Homo sapiens
gcttccctacacagggcct

SEQ ID NO: 4636010 - DNA, 21 bp, Homo sapiens
gcttccctacacagggcctgc

SEQ ID NO: 4636011 - DNA, 22 bp, Homo sapiens
gcttccgctttgaaagaagcaa

SEQ ID NO: 4636012 - DNA, 13 bp, Homo sapiens
gcttccgttcctc

SEQ ID NO: 4636013 - DNA, 21 bp, Homo sapiens
gcttcctagaaagttctgtgt

SEQ ID NO: 4636014 - DNA, 23 bp, Homo sapiens
gcttcctagtaagtcaggacagc

SEQ ID NO: 4636015 - DNA, 18 bp, Homo sapiens
gcttcctggggaccaaga

SEQ ID NO: 4636016 - DNA, 16 bp, Homo sapiens
gcttctgttgtcacct

SEQ ID NO: 4636017 - DNA, 21 bp, Homo sapiens
gcttcttattaatcatacaaa

SEQ ID NO: 4636018 - DNA, 19 bp, Homo sapiens
gcttcttcgttcctgcgca

SEQ ID NO: 4636019 - DNA, 15 bp, Homo sapiens
gcttcttctgaaaga

SEQ ID NO: 4636020 - DNA, 21 bp, Homo sapiens
gcttctttcccttagtgactc

SEQ ID NO: 4636021 - DNA, 20 bp, Homo sapiens
gcttgaactaggctgagcaa

SEQ ID NO: 4636022 - DNA, 21 bp, Homo sapiens
gcttgagagccctgaggccta

SEQ ID NO: 4636023 - DNA, 12 bp, Homo sapiens
gcttgagcccag

SEQ ID NO: 4636024 - DNA, 19 bp, Homo sapiens
gcttgcctgtttcttctct

SEQ ID NO: 4636025 - DNA, 21 bp, Homo sapiens
gcttgctcccaagcccctgac

SEQ ID NO: 4636026 - DNA, 23 bp, Homo sapiens
gcttgctgtatgacccctggcca

SEQ ID NO: 4636027 - DNA, 18 bp, Homo sapiens
gcttggagggggaagaga

SEQ ID NO: 4636028 - DNA, 15 bp, Homo sapiens
gcttggcccagcgcc

SEQ ID NO: 4636029 - DNA, 20 bp, Homo sapiens
gcttggcggctctagcccca

SEQ ID NO: 4636030 - DNA, 21 bp, Homo sapiens
gcttgggctgacccagcatct

SEQ ID NO: 4636031 - DNA, 14 bp, Homo sapiens
gcttggggggtgat

SEQ ID NO: 4636032 - DNA, 13 bp, Homo sapiens
gcttgtagccagc

SEQ ID NO: 4636033 - DNA, 14 bp, Homo sapiens
gcttgttggatttt

SEQ ID NO: 4636034 - DNA, 17 bp, Homo sapiens
gctttacattttcagta

SEQ ID NO: 4636035 - DNA, 21 bp, Homo sapiens
gctttcaattgacaaatgatg

SEQ ID NO: 4636036 - DNA, 19 bp, Homo sapiens
gctttcatgttgcaaagaa

SEQ ID NO: 4636037 - DNA, 18 bp, Homo sapiens
gctttcccgcccagcctc

SEQ ID NO: 4636038 - DNA, 13 bp, Homo sapiens
gctttcctgctgg

SEQ ID NO: 4636039 - DNA, 23 bp, Homo sapiens
gctttccttttttaaaaatgcaa

SEQ ID NO: 4636040 - DNA, 13 bp, Homo sapiens
gctttctgggctc

SEQ ID NO: 4636041 - DNA, 20 bp, Homo sapiens
gctttctgggctctggactc

SEQ ID NO: 4636042 - DNA, 22 bp, Homo sapiens
gctttgggaatgtttttagctg

SEQ ID NO: 4636043 - DNA, 18 bp, Homo sapiens
gctttggtaaaacagttt

SEQ ID NO: 4636044 - DNA, 22 bp, Homo sapiens
gctttggtaaaacagtttcatc

SEQ ID NO: 4636045 - DNA, 11 bp, Homo sapiens
gctttgtgcct

SEQ ID NO: 4636046 - DNA, 20 bp, Homo sapiens
gcttttatttggtgtgttcg

SEQ ID NO: 4636047 - DNA, 13 bp, Homo sapiens
gcttttcctctgc

SEQ ID NO: 4636048 - DNA, 21 bp, Homo sapiens
gctttttcatccttctttcct

SEQ ID NO: 4636049 - DNA, 14 bp, Homo sapiens
ggaaaaaatatttt

SEQ ID NO: 4636050 - DNA, 12 bp, Homo sapiens
ggaaaaccagac

SEQ ID NO: 4636051 - DNA, 14 bp, Homo sapiens
ggaaaacgctctct

SEQ ID NO: 4636052 - DNA, 14 bp, Homo sapiens
ggaaaagaaacctg

SEQ ID NO: 4636053 - DNA, 13 bp, Homo sapiens
ggaaaaggcctgg

SEQ ID NO: 4636054 - DNA, 17 bp, Homo sapiens
ggaaaaggcctggggtg

SEQ ID NO: 4636055 - DNA, 20 bp, Homo sapiens
ggaaaagggtcttgggaaat

SEQ ID NO: 4636056 - DNA, 17 bp, Homo sapiens
ggaaaatgacttgtaag

SEQ ID NO: 4636057 - DNA, 14 bp, Homo sapiens
ggaaaatgcattgt

SEQ ID NO: 4636058 - DNA, 17 bp, Homo sapiens
ggaaagaagggggccct

SEQ ID NO: 4636059 - DNA, 22 bp, Homo sapiens
ggaaagacatccataaagaagc

SEQ ID NO: 4636060 - DNA, 15 bp, Homo sapiens
ggaaagctaggcttc

SEQ ID NO: 4636061 - DNA, 12 bp, Homo sapiens
ggaaaggaggac

SEQ ID NO: 4636062 - DNA, 22 bp, Homo sapiens
ggaaaggggttggggtgacagt

SEQ ID NO: 4636063 - DNA, 17 bp, Homo sapiens
ggaaatctgtaaagcca

SEQ ID NO: 4636064 - DNA, 15 bp, Homo sapiens
ggaaatgtacttttg

SEQ ID NO: 4636065 - DNA, 21 bp, Homo sapiens
ggaaattgtaaatcctgtgtt

SEQ ID NO: 4636066 - DNA, 14 bp, Homo sapiens
ggaacaaacagggc

SEQ ID NO: 4636067 - DNA, 15 bp, Homo sapiens
ggaacaaattatttt

SEQ ID NO: 4636068 - DNA, 19 bp, Homo sapiens
ggaacaagatgctgatcca

SEQ ID NO: 4636069 - DNA, 21 bp, Homo sapiens
ggaacagaagtgaggatgaga

SEQ ID NO: 4636070 - DNA, 12 bp, Homo sapiens
ggaacagcccag

SEQ ID NO: 4636071 - DNA, 21 bp, Homo sapiens
ggaactcctaaacctttgccc

SEQ ID NO: 4636072 - DNA, 16 bp, Homo sapiens
ggaactctcctggcct

SEQ ID NO: 4636073 - DNA, 21 bp, Homo sapiens
ggaactgaagggggcggccta

SEQ ID NO: 4636074 - DNA, 21 bp, Homo sapiens
ggaactgattgctcccaggat

SEQ ID NO: 4636075 - DNA, 17 bp, Homo sapiens
ggaagaaactttctggt

SEQ ID NO: 4636076 - DNA, 15 bp, Homo sapiens
ggaagagatcccagg

SEQ ID NO: 4636077 - DNA, 15 bp, Homo sapiens
ggaagagccacctgc

SEQ ID NO: 4636078 - DNA, 14 bp, Homo sapiens
ggaagaggaaaatt

SEQ ID NO: 4636079 - DNA, 20 bp, Homo sapiens
ggaagaggagatgtgatcag

SEQ ID NO: 4636080 - DNA, 16 bp, Homo sapiens
ggaagagggaaatgta

SEQ ID NO: 4636081 - DNA, 12 bp, Homo sapiens
ggaagcattttt

SEQ ID NO: 4636082 - DNA, 12 bp, Homo sapiens
ggaagccaggta

SEQ ID NO: 4636083 - DNA, 15 bp, Homo sapiens
ggaagccaggtacag

SEQ ID NO: 4636084 - DNA, 21 bp, Homo sapiens
ggaagccaggtacaggagagg

SEQ ID NO: 4636085 - DNA, 15 bp, Homo sapiens
ggaagctgcctggtg

SEQ ID NO: 4636086 - DNA, 14 bp, Homo sapiens
ggaagcttggcttc

SEQ ID NO: 4636087 - DNA, 21 bp, Homo sapiens
ggaaggaaatcccatcagtga

SEQ ID NO: 4636088 - DNA, 17 bp, Homo sapiens
ggaaggaaggagggcac

SEQ ID NO: 4636089 - DNA, 19 bp, Homo sapiens
ggaaggacaggaccctcag

SEQ ID NO: 4636090 - DNA, 21 bp, Homo sapiens
ggaaggacaggaccctcagga

SEQ ID NO: 4636091 - DNA, 12 bp, Homo sapiens
ggaaggagcagt

SEQ ID NO: 4636092 - DNA, 18 bp, Homo sapiens
ggaaggataaagccactt

SEQ ID NO: 4636093 - DNA, 22 bp, Homo sapiens
ggaaggcagacagcaggcagcg

SEQ ID NO: 4636094 - DNA, 12 bp, Homo sapiens
ggaaggcaggca

SEQ ID NO: 4636095 - DNA, 14 bp, Homo sapiens
ggaaggcaggcagg

SEQ ID NO: 4636096 - DNA, 16 bp, Homo sapiens
ggaaggcaggcagggc

SEQ ID NO: 4636097 - DNA, 15 bp, Homo sapiens
ggaaggcctccctct

SEQ ID NO: 4636098 - DNA, 14 bp, Homo sapiens
ggaaggcctgagcc

SEQ ID NO: 4636099 - DNA, 16 bp, Homo sapiens
ggaaggcctgagcccc

SEQ ID NO: 4636100 - DNA, 23 bp, Homo sapiens
ggaaggctacttcggggctggga

SEQ ID NO: 4636101 - DNA, 12 bp, Homo sapiens
ggaaggggacag

SEQ ID NO: 4636102 - DNA, 12 bp, Homo sapiens
ggaaggggctag

SEQ ID NO: 4636103 - DNA, 15 bp, Homo sapiens
ggaaggggctaggga

SEQ ID NO: 4636104 - DNA, 14 bp, Homo sapiens
ggaagtagtccttg

SEQ ID NO: 4636105 - DNA, 23 bp, Homo sapiens
ggaagtcgtccttactcctgtgg

SEQ ID NO: 4636106 - DNA, 15 bp, Homo sapiens
ggaagtgtgacttct

SEQ ID NO: 4636107 - DNA, 14 bp, Homo sapiens
ggaatacattttat

SEQ ID NO: 4636108 - DNA, 13 bp, Homo sapiens
ggaatatttgaat

SEQ ID NO: 4636109 - DNA, 23 bp, Homo sapiens
ggaatcctgaaagggcacttaat

SEQ ID NO: 4636110 - DNA, 21 bp, Homo sapiens
ggaatgagcccagagaacagc

SEQ ID NO: 4636111 - DNA, 13 bp, Homo sapiens
ggaatgcagaggt

SEQ ID NO: 4636112 - DNA, 17 bp, Homo sapiens
ggaatggaggagccagg

SEQ ID NO: 4636113 - DNA, 19 bp, Homo sapiens
ggaattcagtgccttcaac

SEQ ID NO: 4636114 - DNA, 17 bp, Homo sapiens
ggaattttgagaaaaat

SEQ ID NO: 4636115 - DNA, 21 bp, Homo sapiens
ggacaaaacttcttgtcagac

SEQ ID NO: 4636116 - DNA, 13 bp, Homo sapiens
ggacaagcatggt

SEQ ID NO: 4636117 - DNA, 13 bp, Homo sapiens
ggacacaggcctg

SEQ ID NO: 4636118 - DNA, 23 bp, Homo sapiens
ggacacaggcctgtgtagctgtg

SEQ ID NO: 4636119 - DNA, 14 bp, Homo sapiens
ggacacagttcctg

SEQ ID NO: 4636120 - DNA, 21 bp, Homo sapiens
ggacacagttcctgggaacat

SEQ ID NO: 4636121 - DNA, 14 bp, Homo sapiens
ggacacgagccaca

SEQ ID NO: 4636122 - DNA, 16 bp, Homo sapiens
ggacacgagccacaag

SEQ ID NO: 4636123 - DNA, 22 bp, Homo sapiens
ggacacgagccacaagctgcac

SEQ ID NO: 4636124 - DNA, 15 bp, Homo sapiens
ggacagaaaatgcaa

SEQ ID NO: 4636125 - DNA, 15 bp, Homo sapiens
ggacagaaagaccct

SEQ ID NO: 4636126 - DNA, 19 bp, Homo sapiens
ggacagaaagaccctgatg

SEQ ID NO: 4636127 - DNA, 14 bp, Homo sapiens
ggacagcccagagc

SEQ ID NO: 4636128 - DNA, 17 bp, Homo sapiens
ggacagcccagagcctg

SEQ ID NO: 4636129 - DNA, 14 bp, Homo sapiens
ggacagcccagcgc

SEQ ID NO: 4636130 - DNA, 20 bp, Homo sapiens
ggacagctgactgaatgcag

SEQ ID NO: 4636131 - DNA, 15 bp, Homo sapiens
ggacagcttgtatgt

SEQ ID NO: 4636132 - DNA, 12 bp, Homo sapiens
ggacaggaccct

SEQ ID NO: 4636133 - DNA, 16 bp, Homo sapiens
ggacaggaccctcagg

SEQ ID NO: 4636134 - DNA, 13 bp, Homo sapiens
ggacaggctggct

SEQ ID NO: 4636135 - DNA, 15 bp, Homo sapiens
ggacaggctggctcc

SEQ ID NO: 4636136 - DNA, 14 bp, Homo sapiens
ggacagtggcagga

SEQ ID NO: 4636137 - DNA, 14 bp, Homo sapiens
ggacagttcagaga

SEQ ID NO: 4636138 - DNA, 15 bp, Homo sapiens
ggacagttcagagat

SEQ ID NO: 4636139 - DNA, 12 bp, Homo sapiens
ggacataaaatt

SEQ ID NO: 4636140 - DNA, 19 bp, Homo sapiens
ggacatgcggtagccagca

SEQ ID NO: 4636141 - DNA, 20 bp, Homo sapiens
ggacatgcttttctgccact

SEQ ID NO: 4636142 - DNA, 15 bp, Homo sapiens
ggacattctaatgca

SEQ ID NO: 4636143 - DNA, 15 bp, Homo sapiens
ggaccaacctgacct

SEQ ID NO: 4636144 - DNA, 16 bp, Homo sapiens
ggaccaagatttacca

SEQ ID NO: 4636145 - DNA, 19 bp, Homo sapiens
ggaccacctcctctgccag

SEQ ID NO: 4636146 - DNA, 22 bp, Homo sapiens
ggaccacctcctctgccagcag

SEQ ID NO: 4636147 - DNA, 18 bp, Homo sapiens
ggaccagtcaggatgagg

SEQ ID NO: 4636148 - DNA, 22 bp, Homo sapiens
ggacccatgagttggggtctgg

SEQ ID NO: 4636149 - DNA, 14 bp, Homo sapiens
ggaccccagctgct

SEQ ID NO: 4636150 - DNA, 13 bp, Homo sapiens
ggaccctgggccc

SEQ ID NO: 4636151 - DNA, 20 bp, Homo sapiens
ggaccgctacaccactctgg

SEQ ID NO: 4636152 - DNA, 20 bp, Homo sapiens
ggaccggtgctgcaggagtg

SEQ ID NO: 4636153 - DNA, 15 bp, Homo sapiens
ggacctcctcttccc

SEQ ID NO: 4636154 - DNA, 13 bp, Homo sapiens
ggacctgagcctg

SEQ ID NO: 4636155 - DNA, 19 bp, Homo sapiens
ggacgtggctcagccagca

SEQ ID NO: 4636156 - DNA, 18 bp, Homo sapiens
ggactaacactcagaagc

SEQ ID NO: 4636157 - DNA, 21 bp, Homo sapiens
ggactaacactcagaagcctg

SEQ ID NO: 4636158 - DNA, 22 bp, Homo sapiens
ggactaacactcagaagcctgg

SEQ ID NO: 4636159 - DNA, 11 bp, Homo sapiens
ggactcaggga

SEQ ID NO: 4636160 - DNA, 16 bp, Homo sapiens
ggactcatccttgccc

SEQ ID NO: 4636161 - DNA, 18 bp, Homo sapiens
ggactcccaaccctggct

SEQ ID NO: 4636162 - DNA, 21 bp, Homo sapiens
ggactctgcacatgtcttgta

SEQ ID NO: 4636163 - DNA, 17 bp, Homo sapiens
ggactgagggcagtgcc

SEQ ID NO: 4636164 - DNA, 11 bp, Homo sapiens
ggactgccaaa

SEQ ID NO: 4636165 - DNA, 20 bp, Homo sapiens
ggactgctattctagagctt

SEQ ID NO: 4636166 - DNA, 17 bp, Homo sapiens
ggactggaggcccctgg

SEQ ID NO: 4636167 - DNA, 21 bp, Homo sapiens
ggactggttatcttgttatta

SEQ ID NO: 4636168 - DNA, 15 bp, Homo sapiens
ggactgtcctagcca

SEQ ID NO: 4636169 - DNA, 17 bp, Homo sapiens
ggactgtcctagccagg

SEQ ID NO: 4636170 - DNA, 19 bp, Homo sapiens
ggactgtcctagccaggtc

SEQ ID NO: 4636171 - DNA, 22 bp, Homo sapiens
ggactgtcctagccaggtctcc

SEQ ID NO: 4636172 - DNA, 20 bp, Homo sapiens
ggactgtcgctgcttcgtgg

SEQ ID NO: 4636173 - DNA, 21 bp, Homo sapiens
ggacttcacgaagtgttgcat

SEQ ID NO: 4636174 - DNA, 12 bp, Homo sapiens
ggacttgtgtct

SEQ ID NO: 4636175 - DNA, 15 bp, Homo sapiens
ggactttcccaccca

SEQ ID NO: 4636176 - DNA, 21 bp, Homo sapiens
ggactttcccacccaggaaag

SEQ ID NO: 4636177 - DNA, 20 bp, Homo sapiens
ggagaaagaagtggagacag

SEQ ID NO: 4636178 - DNA, 12 bp, Homo sapiens
ggagaaagagct

SEQ ID NO: 4636179 - DNA, 17 bp, Homo sapiens
ggagaaagagctgcctg

SEQ ID NO: 4636180 - DNA, 22 bp, Homo sapiens
ggagaaagagctgcctggatga

SEQ ID NO: 4636181 - DNA, 18 bp, Homo sapiens
ggagaagaaagaaacttc

SEQ ID NO: 4636182 - DNA, 23 bp, Homo sapiens
ggagaagaaagaggtgaccccag

SEQ ID NO: 4636183 - DNA, 17 bp, Homo sapiens
ggagaagaacaagaaat

SEQ ID NO: 4636184 - DNA, 19 bp, Homo sapiens
ggagaagaacaagaaatgg

SEQ ID NO: 4636185 - DNA, 13 bp, Homo sapiens
ggagaagaagtca

SEQ ID NO: 4636186 - DNA, 21 bp, Homo sapiens
ggagaagcacagctcctgcca

SEQ ID NO: 4636187 - DNA, 22 bp, Homo sapiens
ggagaagggggctctgccccag

SEQ ID NO: 4636188 - DNA, 21 bp, Homo sapiens
ggagaccctgcaaacagaaca

SEQ ID NO: 4636189 - DNA, 22 bp, Homo sapiens
ggagaccctgcaaacagaacag

SEQ ID NO: 4636190 - DNA, 14 bp, Homo sapiens
ggagagctaggagc

SEQ ID NO: 4636191 - DNA, 14 bp, Homo sapiens
ggagaggcttccct

SEQ ID NO: 4636192 - DNA, 18 bp, Homo sapiens
ggagagttgtgatggagg

SEQ ID NO: 4636193 - DNA, 18 bp, Homo sapiens
ggagatcagcatgcctgt

SEQ ID NO: 4636194 - DNA, 16 bp, Homo sapiens
ggagatgaccagggat

SEQ ID NO: 4636195 - DNA, 17 bp, Homo sapiens
ggagatgaccagggatg

SEQ ID NO: 4636196 - DNA, 14 bp, Homo sapiens
ggagatgtctagag

SEQ ID NO: 4636197 - DNA, 19 bp, Homo sapiens
ggagatgtgatcaggcccc

SEQ ID NO: 4636198 - DNA, 21 bp, Homo sapiens
ggagatgtgatcaggccccac

SEQ ID NO: 4636199 - DNA, 23 bp, Homo sapiens
ggagcaaagcctgttcatggcag

SEQ ID NO: 4636200 - DNA, 15 bp, Homo sapiens
ggagcaagaggaggc

SEQ ID NO: 4636201 - DNA, 12 bp, Homo sapiens
ggagcagccctg

SEQ ID NO: 4636202 - DNA, 17 bp, Homo sapiens
ggagcaggttccccaag

SEQ ID NO: 4636203 - DNA, 13 bp, Homo sapiens
ggagccaggcccc

SEQ ID NO: 4636204 - DNA, 20 bp, Homo sapiens
ggagcccagcggcccaagag

SEQ ID NO: 4636205 - DNA, 21 bp, Homo sapiens
ggagccccttctgctcagctc

SEQ ID NO: 4636206 - DNA, 22 bp, Homo sapiens
ggagcccgaagtctgctgctgt

SEQ ID NO: 4636207 - DNA, 20 bp, Homo sapiens
ggagccgctggcagaaggga

SEQ ID NO: 4636208 - DNA, 16 bp, Homo sapiens
ggagcctaggccaggt

SEQ ID NO: 4636209 - DNA, 17 bp, Homo sapiens
ggagcctaggccaggtg

SEQ ID NO: 4636210 - DNA, 15 bp, Homo sapiens
ggagcctccctgcct

SEQ ID NO: 4636211 - DNA, 18 bp, Homo sapiens
ggagcctccctgcctcag

SEQ ID NO: 4636212 - DNA, 22 bp, Homo sapiens
ggagcctccctgcctcaggcct

SEQ ID NO: 4636213 - DNA, 22 bp, Homo sapiens
ggagcctccgacgctgcctctc

SEQ ID NO: 4636214 - DNA, 18 bp, Homo sapiens
ggagcctcgcaacccgtg

SEQ ID NO: 4636215 - DNA, 22 bp, Homo sapiens
ggagcctcgcaacccgtgccaa

SEQ ID NO: 4636216 - DNA, 20 bp, Homo sapiens
ggagcctgtgaacccaggac

SEQ ID NO: 4636217 - DNA, 19 bp, Homo sapiens
ggagcctgtgcgtcccagc

SEQ ID NO: 4636218 - DNA, 18 bp, Homo sapiens
ggagctcaacggtctggc

SEQ ID NO: 4636219 - DNA, 17 bp, Homo sapiens
ggagctcatctgcaaaa

SEQ ID NO: 4636220 - DNA, 13 bp, Homo sapiens
ggagctgccacag

SEQ ID NO: 4636221 - DNA, 15 bp, Homo sapiens
ggagctgcccctctc

SEQ ID NO: 4636222 - DNA, 15 bp, Homo sapiens
ggaggaagagccacc

SEQ ID NO: 4636223 - DNA, 18 bp, Homo sapiens
ggaggaagagccacctgc

SEQ ID NO: 4636224 - DNA, 23 bp, Homo sapiens
ggaggaagagccacctgcaagat

SEQ ID NO: 4636225 - DNA, 11 bp, Homo sapiens
ggaggaagccc

SEQ ID NO: 4636226 - DNA, 14 bp, Homo sapiens
ggaggacaaaactt

SEQ ID NO: 4636227 - DNA, 19 bp, Homo sapiens
ggaggacctgagcctgccg

SEQ ID NO: 4636228 - DNA, 14 bp, Homo sapiens
ggaggagagagacc

SEQ ID NO: 4636229 - DNA, 17 bp, Homo sapiens
ggaggagagagtcccag

SEQ ID NO: 4636230 - DNA, 20 bp, Homo sapiens
ggaggagcaacggccccagc

SEQ ID NO: 4636231 - DNA, 15 bp, Homo sapiens
ggaggagccaggccc

SEQ ID NO: 4636232 - DNA, 13 bp, Homo sapiens
ggaggagcctgtg

SEQ ID NO: 4636233 - DNA, 20 bp, Homo sapiens
ggaggagtcagatgaggccc

SEQ ID NO: 4636234 - DNA, 21 bp, Homo sapiens
ggaggagtcagatgaggccct

SEQ ID NO: 4636235 - DNA, 14 bp, Homo sapiens
ggaggccaaccagc

SEQ ID NO: 4636236 - DNA, 21 bp, Homo sapiens
ggaggccaaccagcccgacag

SEQ ID NO: 4636237 - DNA, 18 bp, Homo sapiens
ggaggcccctggagccag

SEQ ID NO: 4636238 - DNA, 16 bp, Homo sapiens
ggaggccctcctgtgc

SEQ ID NO: 4636239 - DNA, 16 bp, Homo sapiens
ggaggcctcgagcaga

SEQ ID NO: 4636240 - DNA, 20 bp, Homo sapiens
ggaggctaaagcccagagac

SEQ ID NO: 4636241 - DNA, 15 bp, Homo sapiens
ggaggctcaggtccc

SEQ ID NO: 4636242 - DNA, 12 bp, Homo sapiens
ggaggctgctcg

SEQ ID NO: 4636243 - DNA, 17 bp, Homo sapiens
ggaggctttctgggctc

SEQ ID NO: 4636244 - DNA, 20 bp, Homo sapiens
ggaggctttctgggctctgg

SEQ ID NO: 4636245 - DNA, 19 bp, Homo sapiens
ggagggaaaagggaagtag

SEQ ID NO: 4636246 - DNA, 17 bp, Homo sapiens
ggagggacaaaggagcc

SEQ ID NO: 4636247 - DNA, 19 bp, Homo sapiens
ggagggacaaaggagcctg

SEQ ID NO: 4636248 - DNA, 14 bp, Homo sapiens
ggagggctctgagg

SEQ ID NO: 4636249 - DNA, 22 bp, Homo sapiens
ggagggctgtcatctgtgcact

SEQ ID NO: 4636250 - DNA, 12 bp, Homo sapiens
ggaggggagagg

SEQ ID NO: 4636251 - DNA, 13 bp, Homo sapiens
ggaggggagaggg

SEQ ID NO: 4636252 - DNA, 13 bp, Homo sapiens
ggaggggaggcat

SEQ ID NO: 4636253 - DNA, 13 bp, Homo sapiens
ggagggggaagag

SEQ ID NO: 4636254 - DNA, 12 bp, Homo sapiens
ggagggggcaag

SEQ ID NO: 4636255 - DNA, 17 bp, Homo sapiens
ggagggggcctcattgt

SEQ ID NO: 4636256 - DNA, 13 bp, Homo sapiens
ggaggtctccagg

SEQ ID NO: 4636257 - DNA, 16 bp, Homo sapiens
ggaggtctccaggggc

SEQ ID NO: 4636258 - DNA, 22 bp, Homo sapiens
ggaggtctccaggggcctgcag

SEQ ID NO: 4636259 - DNA, 17 bp, Homo sapiens
ggaggtgcagtggaggg

SEQ ID NO: 4636260 - DNA, 15 bp, Homo sapiens
ggaggtgtgaatgca

SEQ ID NO: 4636261 - DNA, 16 bp, Homo sapiens
ggaggtgtgaatgcac

SEQ ID NO: 4636262 - DNA, 18 bp, Homo sapiens
ggagtaatctgtgtacaa

SEQ ID NO: 4636263 - DNA, 17 bp, Homo sapiens
ggagtagctgagctcac

SEQ ID NO: 4636264 - DNA, 20 bp, Homo sapiens
ggagtatgctggaggcagag

SEQ ID NO: 4636265 - DNA, 18 bp, Homo sapiens
ggagtcagatgaggccct

SEQ ID NO: 4636266 - DNA, 22 bp, Homo sapiens
ggagtcagatgaggccctgcac

SEQ ID NO: 4636267 - DNA, 17 bp, Homo sapiens
ggagtccctgcaggtga

SEQ ID NO: 4636268 - DNA, 20 bp, Homo sapiens
ggagtctgaggtcctgagca

SEQ ID NO: 4636269 - DNA, 23 bp, Homo sapiens
ggagtctgaggtcctgagcactg

SEQ ID NO: 4636270 - DNA, 14 bp, Homo sapiens
ggagtgagaggccc

SEQ ID NO: 4636271 - DNA, 16 bp, Homo sapiens
ggagtgagaggccccc

SEQ ID NO: 4636272 - DNA, 13 bp, Homo sapiens
ggagtggggagag

SEQ ID NO: 4636273 - DNA, 17 bp, Homo sapiens
ggagtgtcctgcccatg

SEQ ID NO: 4636274 - DNA, 22 bp, Homo sapiens
ggagttgccaactattctcagg

SEQ ID NO: 4636275 - DNA, 19 bp, Homo sapiens
ggagtttaatacaggaaat

SEQ ID NO: 4636276 - DNA, 23 bp, Homo sapiens
ggagtttttttatacaatgttct

SEQ ID NO: 4636277 - DNA, 21 bp, Homo sapiens
ggataagaaagcctaaaattg

SEQ ID NO: 4636278 - DNA, 12 bp, Homo sapiens
ggatattataga

SEQ ID NO: 4636279 - DNA, 16 bp, Homo sapiens
ggatattatagaaaat

SEQ ID NO: 4636280 - DNA, 17 bp, Homo sapiens
ggatattatagaaaatt

SEQ ID NO: 4636281 - DNA, 23 bp, Homo sapiens
ggatatttactgctctttattgc

SEQ ID NO: 4636282 - DNA, 23 bp, Homo sapiens
ggatattttttggtgtgccctgt

SEQ ID NO: 4636283 - DNA, 20 bp, Homo sapiens
ggatcacagcctcacccctg

SEQ ID NO: 4636284 - DNA, 21 bp, Homo sapiens
ggatcacagcctcacccctgc

SEQ ID NO: 4636285 - DNA, 15 bp, Homo sapiens
ggatcagcgtggcct

SEQ ID NO: 4636286 - DNA, 17 bp, Homo sapiens
ggatcagcgtggccttg

SEQ ID NO: 4636287 - DNA, 12 bp, Homo sapiens
ggatcagctttg

SEQ ID NO: 4636288 - DNA, 21 bp, Homo sapiens
ggatcgaagggtttttagaga

SEQ ID NO: 4636289 - DNA, 17 bp, Homo sapiens
ggatctcacaggctgag

SEQ ID NO: 4636290 - DNA, 19 bp, Homo sapiens
ggatctcctgccagcccag

SEQ ID NO: 4636291 - DNA, 22 bp, Homo sapiens
ggatctcctgccagcccagctg

SEQ ID NO: 4636292 - DNA, 17 bp, Homo sapiens
ggatctgctgggctctg

SEQ ID NO: 4636293 - DNA, 14 bp, Homo sapiens
ggatcttgaatgtg

SEQ ID NO: 4636294 - DNA, 16 bp, Homo sapiens
ggatgacaccctggcc

SEQ ID NO: 4636295 - DNA, 18 bp, Homo sapiens
ggatgacaccctggcctg

SEQ ID NO: 4636296 - DNA, 19 bp, Homo sapiens
ggatgagaaacagctcagc

SEQ ID NO: 4636297 - DNA, 23 bp, Homo sapiens
ggatgagaaacagctcagccagt

SEQ ID NO: 4636298 - DNA, 16 bp, Homo sapiens
ggatgagacccagccc

SEQ ID NO: 4636299 - DNA, 12 bp, Homo sapiens
ggatgaggcccc

SEQ ID NO: 4636300 - DNA, 13 bp, Homo sapiens
ggatgaggccccg

SEQ ID NO: 4636301 - DNA, 15 bp, Homo sapiens
ggatgaggccccgcc

SEQ ID NO: 4636302 - DNA, 19 bp, Homo sapiens
ggatgaggtcaccagggga

SEQ ID NO: 4636303 - DNA, 18 bp, Homo sapiens
ggatgaggtctcgaccct

SEQ ID NO: 4636304 - DNA, 16 bp, Homo sapiens
ggatgcccttccccct

SEQ ID NO: 4636305 - DNA, 18 bp, Homo sapiens
ggatgcggatcctgctgg

SEQ ID NO: 4636306 - DNA, 14 bp, Homo sapiens
ggatgcgtgggcag

SEQ ID NO: 4636307 - DNA, 15 bp, Homo sapiens
ggatgcgtgggcaga

SEQ ID NO: 4636308 - DNA, 18 bp, Homo sapiens
ggatgcgtgggcagagga

SEQ ID NO: 4636309 - DNA, 13 bp, Homo sapiens
ggatgctgggctg

SEQ ID NO: 4636310 - DNA, 14 bp, Homo sapiens
ggatgctgggctgg

SEQ ID NO: 4636311 - DNA, 15 bp, Homo sapiens
ggatgctgggctggg

SEQ ID NO: 4636312 - DNA, 18 bp, Homo sapiens
ggatgctgggctgggccc

SEQ ID NO: 4636313 - DNA, 13 bp, Homo sapiens
ggatgctgtgcta

SEQ ID NO: 4636314 - DNA, 18 bp, Homo sapiens
ggatggagaaagaagtgg

SEQ ID NO: 4636315 - DNA, 19 bp, Homo sapiens
ggatggagaaagaagtgga

SEQ ID NO: 4636316 - DNA, 19 bp, Homo sapiens
ggatgtcatgtctgcttgt

SEQ ID NO: 4636317 - DNA, 14 bp, Homo sapiens
ggatgtccctgggc

SEQ ID NO: 4636318 - DNA, 18 bp, Homo sapiens
ggatgtccctgggccagg

SEQ ID NO: 4636319 - DNA, 18 bp, Homo sapiens
ggatgtctgttgaaataa

SEQ ID NO: 4636320 - DNA, 20 bp, Homo sapiens
ggattcaggaaaaggcctgg

SEQ ID NO: 4636321 - DNA, 20 bp, Homo sapiens
ggattcatggagtagcctgg

SEQ ID NO: 4636322 - DNA, 21 bp, Homo sapiens
ggattccttctaagtgtactt

SEQ ID NO: 4636323 - DNA, 22 bp, Homo sapiens
ggattgctggggccaggcccca

SEQ ID NO: 4636324 - DNA, 16 bp, Homo sapiens
ggattggaatgcagag

SEQ ID NO: 4636325 - DNA, 20 bp, Homo sapiens
ggattttaatttcaggaaaa

SEQ ID NO: 4636326 - DNA, 16 bp, Homo sapiens
ggatttttgtcttgtg

SEQ ID NO: 4636327 - DNA, 10 bp, Homo sapiens
ggcaaaataa

SEQ ID NO: 4636328 - DNA, 20 bp, Homo sapiens
ggcaacagggagcacctgtc

SEQ ID NO: 4636329 - DNA, 19 bp, Homo sapiens
ggcaacatcttacttgtcc

SEQ ID NO: 4636330 - DNA, 13 bp, Homo sapiens
ggcaagccctgcc

SEQ ID NO: 4636331 - DNA, 19 bp, Homo sapiens
ggcaagctaggccccagag

SEQ ID NO: 4636332 - DNA, 22 bp, Homo sapiens
ggcaagctaggccccagaggcc

SEQ ID NO: 4636333 - DNA, 15 bp, Homo sapiens
ggcaaggaggaggag

SEQ ID NO: 4636334 - DNA, 13 bp, Homo sapiens
ggcaatggccagg

SEQ ID NO: 4636335 - DNA, 18 bp, Homo sapiens
ggcaattagtgtgacagt

SEQ ID NO: 4636336 - DNA, 22 bp, Homo sapiens
ggcaattcagtcctgggcaaag

SEQ ID NO: 4636337 - DNA, 14 bp, Homo sapiens
ggcacagaagagga

SEQ ID NO: 4636338 - DNA, 19 bp, Homo sapiens
ggcacagtgggagctgagc

SEQ ID NO: 4636339 - DNA, 22 bp, Homo sapiens
ggcacattaactccctccacca

SEQ ID NO: 4636340 - DNA, 20 bp, Homo sapiens
ggcacccccacaagctgtcc

SEQ ID NO: 4636341 - DNA, 16 bp, Homo sapiens
ggcacccccagcctgg

SEQ ID NO: 4636342 - DNA, 17 bp, Homo sapiens
ggcacccccagcctggg

SEQ ID NO: 4636343 - DNA, 21 bp, Homo sapiens
ggcactccgcgccgatgccac

SEQ ID NO: 4636344 - DNA, 14 bp, Homo sapiens
ggcactggcccagg

SEQ ID NO: 4636345 - DNA, 19 bp, Homo sapiens
ggcactgtgatacagtttt

SEQ ID NO: 4636346 - DNA, 13 bp, Homo sapiens
ggcactgtggcct

SEQ ID NO: 4636347 - DNA, 21 bp, Homo sapiens
ggcacttaatttgtaaacttc

SEQ ID NO: 4636348 - DNA, 23 bp, Homo sapiens
ggcacttccacctccagcctctg

SEQ ID NO: 4636349 - DNA, 16 bp, Homo sapiens
ggcagaaatagttgtc

SEQ ID NO: 4636350 - DNA, 22 bp, Homo sapiens
ggcagaaatagttgtctgtgct

SEQ ID NO: 4636351 - DNA, 17 bp, Homo sapiens
ggcagaagcttggagga

SEQ ID NO: 4636352 - DNA, 21 bp, Homo sapiens
ggcagactctttaataaattg

SEQ ID NO: 4636353 - DNA, 23 bp, Homo sapiens
ggcagactctttaataaattgct

SEQ ID NO: 4636354 - DNA, 21 bp, Homo sapiens
ggcagagctctacaggcctgc

SEQ ID NO: 4636355 - DNA, 21 bp, Homo sapiens
ggcagagggcaagggaggggt

SEQ ID NO: 4636356 - DNA, 19 bp, Homo sapiens
ggcagatgcccttgctggg

SEQ ID NO: 4636357 - DNA, 21 bp, Homo sapiens
ggcagatgcccttgctgggcc

SEQ ID NO: 4636358 - DNA, 16 bp, Homo sapiens
ggcagatgtaggaggg

SEQ ID NO: 4636359 - DNA, 17 bp, Homo sapiens
ggcagcaaggcccgagc

SEQ ID NO: 4636360 - DNA, 13 bp, Homo sapiens
ggcagcagccagc

SEQ ID NO: 4636361 - DNA, 15 bp, Homo sapiens
ggcagcagccagccc

SEQ ID NO: 4636362 - DNA, 16 bp, Homo sapiens
ggcagcagccagccct

SEQ ID NO: 4636363 - DNA, 18 bp, Homo sapiens
ggcagcatgcttgggctg

SEQ ID NO: 4636364 - DNA, 18 bp, Homo sapiens
ggcagcatggagagaggc

SEQ ID NO: 4636365 - DNA, 20 bp, Homo sapiens
ggcagccacacttctcagga

SEQ ID NO: 4636366 - DNA, 11 bp, Homo sapiens
ggcagccagac

SEQ ID NO: 4636367 - DNA, 14 bp, Homo sapiens
ggcagccagaccag

SEQ ID NO: 4636368 - DNA, 15 bp, Homo sapiens
ggcagccagatggcc

SEQ ID NO: 4636369 - DNA, 12 bp, Homo sapiens
ggcagccccctc

SEQ ID NO: 4636370 - DNA, 16 bp, Homo sapiens
ggcagcccctgttttc

SEQ ID NO: 4636371 - DNA, 21 bp, Homo sapiens
ggcagcccctgttttctgctg

SEQ ID NO: 4636372 - DNA, 21 bp, Homo sapiens
ggcagcctcccatccagggcc

SEQ ID NO: 4636373 - DNA, 22 bp, Homo sapiens
ggcagcctcccatccagggccc

SEQ ID NO: 4636374 - DNA, 22 bp, Homo sapiens
ggcagcgccaagtgcgtgccgt

SEQ ID NO: 4636375 - DNA, 21 bp, Homo sapiens
ggcagcgccaggctgaccaca

SEQ ID NO: 4636376 - DNA, 17 bp, Homo sapiens
ggcagcgcccttcctct

SEQ ID NO: 4636377 - DNA, 18 bp, Homo sapiens
ggcagctcctctgtctcg

SEQ ID NO: 4636378 - DNA, 23 bp, Homo sapiens
ggcaggagaagaacaagaaatgg

SEQ ID NO: 4636379 - DNA, 14 bp, Homo sapiens
ggcaggagctactg

SEQ ID NO: 4636380 - DNA, 14 bp, Homo sapiens
ggcaggagtagctg

SEQ ID NO: 4636381 - DNA, 22 bp, Homo sapiens
ggcaggcagggctctcctggct

SEQ ID NO: 4636382 - DNA, 23 bp, Homo sapiens
ggcaggcagggctctcctggctt

SEQ ID NO: 4636383 - DNA, 14 bp, Homo sapiens
ggcaggcattcctg

SEQ ID NO: 4636384 - DNA, 13 bp, Homo sapiens
ggcaggcattgag

SEQ ID NO: 4636385 - DNA, 17 bp, Homo sapiens
ggcagggaaggacagga

SEQ ID NO: 4636386 - DNA, 22 bp, Homo sapiens
ggcagggacaagtctttctcct

SEQ ID NO: 4636387 - DNA, 19 bp, Homo sapiens
ggcagggaccggcagagct

SEQ ID NO: 4636388 - DNA, 18 bp, Homo sapiens
ggcagggcagcaggaggc

SEQ ID NO: 4636389 - DNA, 17 bp, Homo sapiens
ggcagggcccacgtgta

SEQ ID NO: 4636390 - DNA, 19 bp, Homo sapiens
ggcagggctctcctggctt

SEQ ID NO: 4636391 - DNA, 20 bp, Homo sapiens
ggcaggggagggtcagccag

SEQ ID NO: 4636392 - DNA, 21 bp, Homo sapiens
ggcaggggcgggcggagggag

SEQ ID NO: 4636393 - DNA, 22 bp, Homo sapiens
ggcaggggcgggcggagggagg

SEQ ID NO: 4636394 - DNA, 23 bp, Homo sapiens
ggcagggggccccgccagggctg

SEQ ID NO: 4636395 - DNA, 14 bp, Homo sapiens
ggcaggtgggcaga

SEQ ID NO: 4636396 - DNA, 20 bp, Homo sapiens
ggcagtgcccatgtgtacat

SEQ ID NO: 4636397 - DNA, 21 bp, Homo sapiens
ggcagtgccctttgagatctg

SEQ ID NO: 4636398 - DNA, 14 bp, Homo sapiens
ggcagtggcagaga

SEQ ID NO: 4636399 - DNA, 17 bp, Homo sapiens
ggcagtggcaggggagc

SEQ ID NO: 4636400 - DNA, 15 bp, Homo sapiens
ggcagttgcttgtgt

SEQ ID NO: 4636401 - DNA, 21 bp, Homo sapiens
ggcatatggtcctagacaaac

SEQ ID NO: 4636402 - DNA, 22 bp, Homo sapiens
ggcatccacgtagggggcaggg

SEQ ID NO: 4636403 - DNA, 23 bp, Homo sapiens
ggcatccacgtagggggcagggg

SEQ ID NO: 4636404 - DNA, 13 bp, Homo sapiens
ggcatctgctttt

SEQ ID NO: 4636405 - DNA, 13 bp, Homo sapiens
ggcatgagtctgt

SEQ ID NO: 4636406 - DNA, 11 bp, Homo sapiens
ggcatgctaaa

SEQ ID NO: 4636407 - DNA, 17 bp, Homo sapiens
ggcatgctaaagccttc

SEQ ID NO: 4636408 - DNA, 12 bp, Homo sapiens
ggcattgctttc

SEQ ID NO: 4636409 - DNA, 13 bp, Homo sapiens
ggcattgctttcc

SEQ ID NO: 4636410 - DNA, 15 bp, Homo sapiens
ggcattggcatctgc

SEQ ID NO: 4636411 - DNA, 15 bp, Homo sapiens
ggcatttcctgggtg

SEQ ID NO: 4636412 - DNA, 23 bp, Homo sapiens
ggcatttttgcttcctagtaagt

SEQ ID NO: 4636413 - DNA, 17 bp, Homo sapiens
ggccaaacatggccaga

SEQ ID NO: 4636414 - DNA, 20 bp, Homo sapiens
ggccaaacccttgctttcct

SEQ ID NO: 4636415 - DNA, 21 bp, Homo sapiens
ggccaaacccttgctttcctg

SEQ ID NO: 4636416 - DNA, 20 bp, Homo sapiens
ggccaaccagcccgacagtg

SEQ ID NO: 4636417 - DNA, 18 bp, Homo sapiens
ggccaagaatacttgaag

SEQ ID NO: 4636418 - DNA, 15 bp, Homo sapiens
ggccaagatgtactt

SEQ ID NO: 4636419 - DNA, 15 bp, Homo sapiens
ggccaagctgaggtg

SEQ ID NO: 4636420 - DNA, 23 bp, Homo sapiens
ggccaagctgaggtgcccaggag

SEQ ID NO: 4636421 - DNA, 16 bp, Homo sapiens
ggccaaggtgccacca

SEQ ID NO: 4636422 - DNA, 19 bp, Homo sapiens
ggccaccgtgcctggctga

SEQ ID NO: 4636423 - DNA, 19 bp, Homo sapiens
ggccactccttcctgcccc

SEQ ID NO: 4636424 - DNA, 17 bp, Homo sapiens
ggccactttcagagccc

SEQ ID NO: 4636425 - DNA, 21 bp, Homo sapiens
ggccactttcagagcccccag

SEQ ID NO: 4636426 - DNA, 22 bp, Homo sapiens
ggccactttcagagcccccagc

SEQ ID NO: 4636427 - DNA, 21 bp, Homo sapiens
ggccagaagatgaacagactg

SEQ ID NO: 4636428 - DNA, 14 bp, Homo sapiens
ggccagactccctt

SEQ ID NO: 4636429 - DNA, 15 bp, Homo sapiens
ggccagactcccttg

SEQ ID NO: 4636430 - DNA, 14 bp, Homo sapiens
ggccagagcagctc

SEQ ID NO: 4636431 - DNA, 22 bp, Homo sapiens
ggccagagcagctccaccactg

SEQ ID NO: 4636432 - DNA, 23 bp, Homo sapiens
ggccagaggctcgaggggctcag

SEQ ID NO: 4636433 - DNA, 23 bp, Homo sapiens
ggccagatgcacatccctggaag

SEQ ID NO: 4636434 - DNA, 17 bp, Homo sapiens
ggccagcaacgcttgta

SEQ ID NO: 4636435 - DNA, 13 bp, Homo sapiens
ggccagcctggcc

SEQ ID NO: 4636436 - DNA, 14 bp, Homo sapiens
ggccagcctggcct

SEQ ID NO: 4636437 - DNA, 15 bp, Homo sapiens
ggccaggagtgggga

SEQ ID NO: 4636438 - DNA, 23 bp, Homo sapiens
ggccaggcctagtaaccaaggcc

SEQ ID NO: 4636439 - DNA, 17 bp, Homo sapiens
ggccagggctgccctga

SEQ ID NO: 4636440 - DNA, 14 bp, Homo sapiens
ggccaggggccagg

SEQ ID NO: 4636441 - DNA, 17 bp, Homo sapiens
ggccagggtctgtgtga

SEQ ID NO: 4636442 - DNA, 23 bp, Homo sapiens
ggccagggtctgtgtgaatgtgg

SEQ ID NO: 4636443 - DNA, 16 bp, Homo sapiens
ggccagtggggcctgt

SEQ ID NO: 4636444 - DNA, 14 bp, Homo sapiens
ggccatctcaggag

SEQ ID NO: 4636445 - DNA, 22 bp, Homo sapiens
ggccatctgactgccaagccag

SEQ ID NO: 4636446 - DNA, 17 bp, Homo sapiens
ggccatgaactttgtcc

SEQ ID NO: 4636447 - DNA, 23 bp, Homo sapiens
ggccatgaccactttccccgtgg

SEQ ID NO: 4636448 - DNA, 19 bp, Homo sapiens
ggcccaaagcttgtaaata

SEQ ID NO: 4636449 - DNA, 14 bp, Homo sapiens
ggcccaagtctcct

SEQ ID NO: 4636450 - DNA, 16 bp, Homo sapiens
ggccccacaaggcctg

SEQ ID NO: 4636451 - DNA, 15 bp, Homo sapiens
ggccccagaggccct

SEQ ID NO: 4636452 - DNA, 18 bp, Homo sapiens
ggccccagaggccctgga

SEQ ID NO: 4636453 - DNA, 16 bp, Homo sapiens
ggccccatgacctcca

SEQ ID NO: 4636454 - DNA, 18 bp, Homo sapiens
ggccccatgacctccagc

SEQ ID NO: 4636455 - DNA, 18 bp, Homo sapiens
ggcccccatcagccctgc

SEQ ID NO: 4636456 - DNA, 15 bp, Homo sapiens
ggccccgccagggct

SEQ ID NO: 4636457 - DNA, 17 bp, Homo sapiens
ggccccgccagggctgg

SEQ ID NO: 4636458 - DNA, 18 bp, Homo sapiens
ggccccgccagggctggg

SEQ ID NO: 4636459 - DNA, 20 bp, Homo sapiens
ggccccgccagggctgggga

SEQ ID NO: 4636460 - DNA, 17 bp, Homo sapiens
ggccccgggctggagaa

SEQ ID NO: 4636461 - DNA, 18 bp, Homo sapiens
ggccccgtgggtgggcct

SEQ ID NO: 4636462 - DNA, 13 bp, Homo sapiens
ggcccctggagcc

SEQ ID NO: 4636463 - DNA, 17 bp, Homo sapiens
ggcccgcgcagctgcct

SEQ ID NO: 4636464 - DNA, 14 bp, Homo sapiens
ggccctcctgtgct

SEQ ID NO: 4636465 - DNA, 14 bp, Homo sapiens
ggccctctttccct

SEQ ID NO: 4636466 - DNA, 15 bp, Homo sapiens
ggccctctttccctg

SEQ ID NO: 4636467 - DNA, 18 bp, Homo sapiens
ggccctgcatctgtctgc

SEQ ID NO: 4636468 - DNA, 19 bp, Homo sapiens
ggccctggaggtctccagg

SEQ ID NO: 4636469 - DNA, 16 bp, Homo sapiens
ggccctggggcctgta

SEQ ID NO: 4636470 - DNA, 20 bp, Homo sapiens
ggcccttacttgcttctcta

SEQ ID NO: 4636471 - DNA, 12 bp, Homo sapiens
ggcccttcctgg

SEQ ID NO: 4636472 - DNA, 16 bp, Homo sapiens
ggcccttcctggacag

SEQ ID NO: 4636473 - DNA, 19 bp, Homo sapiens
ggcccttcctggacagctg

SEQ ID NO: 4636474 - DNA, 20 bp, Homo sapiens
ggcccttcctggacagctgt

SEQ ID NO: 4636475 - DNA, 21 bp, Homo sapiens
ggcccttcctggacagctgtg

SEQ ID NO: 4636476 - DNA, 13 bp, Homo sapiens
ggccgagtccaag

SEQ ID NO: 4636477 - DNA, 20 bp, Homo sapiens
ggccggggaactggccaagc

SEQ ID NO: 4636478 - DNA, 22 bp, Homo sapiens
ggccggggctctgggtgctgcc

SEQ ID NO: 4636479 - DNA, 14 bp, Homo sapiens
ggcctaaacttcag

SEQ ID NO: 4636480 - DNA, 19 bp, Homo sapiens
ggcctagtaaccaaggccc

SEQ ID NO: 4636481 - DNA, 21 bp, Homo sapiens
ggcctagtaaccaaggccctg

SEQ ID NO: 4636482 - DNA, 18 bp, Homo sapiens
ggcctatctggaagccac

SEQ ID NO: 4636483 - DNA, 16 bp, Homo sapiens
ggcctatggagagccc

SEQ ID NO: 4636484 - DNA, 18 bp, Homo sapiens
ggcctatggagagccctg

SEQ ID NO: 4636485 - DNA, 19 bp, Homo sapiens
ggcctatggagagccctgg

SEQ ID NO: 4636486 - DNA, 21 bp, Homo sapiens
ggcctatggagagccctggga

SEQ ID NO: 4636487 - DNA, 14 bp, Homo sapiens
ggcctatgtggtct

SEQ ID NO: 4636488 - DNA, 18 bp, Homo sapiens
ggcctcacccctcccctg

SEQ ID NO: 4636489 - DNA, 21 bp, Homo sapiens
ggcctcacccctcccctggga

SEQ ID NO: 4636490 - DNA, 23 bp, Homo sapiens
ggcctcacccctcccctgggact

SEQ ID NO: 4636491 - DNA, 19 bp, Homo sapiens
ggcctcagagcttcctggg

SEQ ID NO: 4636492 - DNA, 17 bp, Homo sapiens
ggcctcagctgaatgcc

SEQ ID NO: 4636493 - DNA, 11 bp, Homo sapiens
ggcctcattgt

SEQ ID NO: 4636494 - DNA, 17 bp, Homo sapiens
ggcctccctgctgtgcc

SEQ ID NO: 4636495 - DNA, 20 bp, Homo sapiens
ggcctccctttgtgtgcata

SEQ ID NO: 4636496 - DNA, 12 bp, Homo sapiens
ggcctctccagt

SEQ ID NO: 4636497 - DNA, 11 bp, Homo sapiens
ggcctctgccc

SEQ ID NO: 4636498 - DNA, 13 bp, Homo sapiens
ggcctgagagaat

SEQ ID NO: 4636499 - DNA, 12 bp, Homo sapiens
ggcctgagcccc

SEQ ID NO: 4636500 - DNA, 22 bp, Homo sapiens
ggcctgagtgacctccttctgc

SEQ ID NO: 4636501 - DNA, 15 bp, Homo sapiens
ggcctgatcagacca

SEQ ID NO: 4636502 - DNA, 18 bp, Homo sapiens
ggcctgatcagaccacgg

SEQ ID NO: 4636503 - DNA, 20 bp, Homo sapiens
ggcctgatcagaccacggct

SEQ ID NO: 4636504 - DNA, 20 bp, Homo sapiens
ggcctgcagaaggaaagaag

SEQ ID NO: 4636505 - DNA, 20 bp, Homo sapiens
ggcctgcagcaggagtggtg

SEQ ID NO: 4636506 - DNA, 18 bp, Homo sapiens
ggcctgcagcccctaagt

SEQ ID NO: 4636507 - DNA, 15 bp, Homo sapiens
ggcctgccccctggg

SEQ ID NO: 4636508 - DNA, 22 bp, Homo sapiens
ggcctgccctgttagctttcca

SEQ ID NO: 4636509 - DNA, 13 bp, Homo sapiens
ggcctgctattgc

SEQ ID NO: 4636510 - DNA, 15 bp, Homo sapiens
ggcctggagccccat

SEQ ID NO: 4636511 - DNA, 14 bp, Homo sapiens
ggcctggccctgct

SEQ ID NO: 4636512 - DNA, 11 bp, Homo sapiens
ggcctggctgg

SEQ ID NO: 4636513 - DNA, 14 bp, Homo sapiens
ggcctggctggtgg

SEQ ID NO: 4636514 - DNA, 20 bp, Homo sapiens
ggcctggctggtgggaaggc

SEQ ID NO: 4636515 - DNA, 16 bp, Homo sapiens
ggcctggggcctgaga

SEQ ID NO: 4636516 - DNA, 17 bp, Homo sapiens
ggcctggggcctgagag

SEQ ID NO: 4636517 - DNA, 21 bp, Homo sapiens
ggcctgggggttttccaagcc

SEQ ID NO: 4636518 - DNA, 21 bp, Homo sapiens
ggcctggggtgacccggcacc

SEQ ID NO: 4636519 - DNA, 19 bp, Homo sapiens
ggcctgggtgatctgctgc

SEQ ID NO: 4636520 - DNA, 21 bp, Homo sapiens
ggcctgggtgatctgctgctg

SEQ ID NO: 4636521 - DNA, 14 bp, Homo sapiens
ggcctgtactgcct

SEQ ID NO: 4636522 - DNA, 17 bp, Homo sapiens
ggcctgtactgcctgct

SEQ ID NO: 4636523 - DNA, 14 bp, Homo sapiens
ggcctgtcctccaa

SEQ ID NO: 4636524 - DNA, 14 bp, Homo sapiens
ggcctgtctcagtg

SEQ ID NO: 4636525 - DNA, 16 bp, Homo sapiens
ggcctgtctcagtgat

SEQ ID NO: 4636526 - DNA, 16 bp, Homo sapiens
ggcctgtggaatgagt

SEQ ID NO: 4636527 - DNA, 18 bp, Homo sapiens
ggcctgtggaatgagtgt

SEQ ID NO: 4636528 - DNA, 21 bp, Homo sapiens
ggcctgtgggtctctgaaggg

SEQ ID NO: 4636529 - DNA, 19 bp, Homo sapiens
ggcctgtgtagctgtgacc

SEQ ID NO: 4636530 - DNA, 20 bp, Homo sapiens
ggcctgtgtagctgtgacct

SEQ ID NO: 4636531 - DNA, 19 bp, Homo sapiens
ggccttaaagagggacagg

SEQ ID NO: 4636532 - DNA, 20 bp, Homo sapiens
ggccttagggcactgggctg

SEQ ID NO: 4636533 - DNA, 16 bp, Homo sapiens
ggccttagtgggccag

SEQ ID NO: 4636534 - DNA, 23 bp, Homo sapiens
ggccttcagacacatgctatgtt

SEQ ID NO: 4636535 - DNA, 19 bp, Homo sapiens
ggccttcagtttatttcca

SEQ ID NO: 4636536 - DNA, 17 bp, Homo sapiens
ggccttctaggaatgga

SEQ ID NO: 4636537 - DNA, 21 bp, Homo sapiens
ggccttctaggaatggaggag

SEQ ID NO: 4636538 - DNA, 19 bp, Homo sapiens
ggcctttgcaagatgcttg

SEQ ID NO: 4636539 - DNA, 23 bp, Homo sapiens
ggccttttgttaaacccttctgt

SEQ ID NO: 4636540 - DNA, 14 bp, Homo sapiens
ggcgcactgcctct

SEQ ID NO: 4636541 - DNA, 12 bp, Homo sapiens
ggcggtacacta

SEQ ID NO: 4636542 - DNA, 17 bp, Homo sapiens
ggctaactatatttgct

SEQ ID NO: 4636543 - DNA, 16 bp, Homo sapiens
ggctactctgtgccag

SEQ ID NO: 4636544 - DNA, 23 bp, Homo sapiens
ggctactctgtgccagagcctgg

SEQ ID NO: 4636545 - DNA, 24 bp, Homo sapiens
ggctactctgtgccagagcctggg

SEQ ID NO: 4636546 - DNA, 18 bp, Homo sapiens
ggctacttcggggctggg

SEQ ID NO: 4636547 - DNA, 14 bp, Homo sapiens
ggctagagggccca

SEQ ID NO: 4636548 - DNA, 17 bp, Homo sapiens
ggctagagggcccaaag

SEQ ID NO: 4636549 - DNA, 18 bp, Homo sapiens
ggctatgtagtcataata

SEQ ID NO: 4636550 - DNA, 16 bp, Homo sapiens
ggctcaagctttcccg

SEQ ID NO: 4636551 - DNA, 17 bp, Homo sapiens
ggctcactggctttgaa

SEQ ID NO: 4636552 - DNA, 13 bp, Homo sapiens
ggctcagcagggc

SEQ ID NO: 4636553 - DNA, 19 bp, Homo sapiens
ggctccccctccagccaga

SEQ ID NO: 4636554 - DNA, 15 bp, Homo sapiens
ggctccctctctcct

SEQ ID NO: 4636555 - DNA, 19 bp, Homo sapiens
ggctccctctctcctggac

SEQ ID NO: 4636556 - DNA, 13 bp, Homo sapiens
ggctccctgcccc

SEQ ID NO: 4636557 - DNA, 19 bp, Homo sapiens
ggctctaacgcctgagccc

SEQ ID NO: 4636558 - DNA, 23 bp, Homo sapiens
ggctctaacgcctgagcccaggg

SEQ ID NO: 4636559 - DNA, 15 bp, Homo sapiens
ggctctaaggtactg

SEQ ID NO: 4636560 - DNA, 18 bp, Homo sapiens
ggctctaaggtactgtgg

SEQ ID NO: 4636561 - DNA, 12 bp, Homo sapiens
ggctctcctggc

SEQ ID NO: 4636562 - DNA, 13 bp, Homo sapiens
ggctctcctggct

SEQ ID NO: 4636563 - DNA, 22 bp, Homo sapiens
ggctctgagccaaccttgctct

SEQ ID NO: 4636564 - DNA, 12 bp, Homo sapiens
ggctctgaggcg

SEQ ID NO: 4636565 - DNA, 13 bp, Homo sapiens
ggctctgccccag

SEQ ID NO: 4636566 - DNA, 13 bp, Homo sapiens
ggctgaccacagc

SEQ ID NO: 4636567 - DNA, 22 bp, Homo sapiens
ggctgaccacagcacagccaac

SEQ ID NO: 4636568 - DNA, 23 bp, Homo sapiens
ggctgacccagcatctcccagca

SEQ ID NO: 4636569 - DNA, 17 bp, Homo sapiens
ggctgaggctggcacag

SEQ ID NO: 4636570 - DNA, 13 bp, Homo sapiens
ggctgagggcagt

SEQ ID NO: 4636571 - DNA, 19 bp, Homo sapiens
ggctgattcctctcatttc

SEQ ID NO: 4636572 - DNA, 17 bp, Homo sapiens
ggctgcaaaattaaatc

SEQ ID NO: 4636573 - DNA, 18 bp, Homo sapiens
ggctgccctgagaagctg

SEQ ID NO: 4636574 - DNA, 16 bp, Homo sapiens
ggctgccttctggcct

SEQ ID NO: 4636575 - DNA, 21 bp, Homo sapiens
ggctgctcggggtgcacagga

SEQ ID NO: 4636576 - DNA, 22 bp, Homo sapiens
ggctgctcggggtgcacaggag

SEQ ID NO: 4636577 - DNA, 13 bp, Homo sapiens
ggctgcttcctgt

SEQ ID NO: 4636578 - DNA, 14 bp, Homo sapiens
ggctggagaaagag

SEQ ID NO: 4636579 - DNA, 20 bp, Homo sapiens
ggctggagtgcagtggcgca

SEQ ID NO: 4636580 - DNA, 19 bp, Homo sapiens
ggctgggacgtggctcagc

SEQ ID NO: 4636581 - DNA, 22 bp, Homo sapiens
ggctgggccctctttccctgcg

SEQ ID NO: 4636582 - DNA, 11 bp, Homo sapiens
ggctggggagg

SEQ ID NO: 4636583 - DNA, 15 bp, Homo sapiens
ggctggtgggaaggc

SEQ ID NO: 4636584 - DNA, 22 bp, Homo sapiens
ggctggtttaaccattggaatg

SEQ ID NO: 4636585 - DNA, 20 bp, Homo sapiens
ggctggtttcaaactcctga

SEQ ID NO: 4636586 - DNA, 17 bp, Homo sapiens
ggctgtcatctgtgcac

SEQ ID NO: 4636587 - DNA, 11 bp, Homo sapiens
ggctgtgccaa

SEQ ID NO: 4636588 - DNA, 14 bp, Homo sapiens
ggctgtgggcaagc

SEQ ID NO: 4636589 - DNA, 16 bp, Homo sapiens
ggctgtgttatgaaaa

SEQ ID NO: 4636590 - DNA, 20 bp, Homo sapiens
ggctgtgtttgcagcctgct

SEQ ID NO: 4636591 - DNA, 14 bp, Homo sapiens
ggcttaagaactgc

SEQ ID NO: 4636592 - DNA, 17 bp, Homo sapiens
ggcttacggccctggcc

SEQ ID NO: 4636593 - DNA, 18 bp, Homo sapiens
ggcttatgagatctaatg

SEQ ID NO: 4636594 - DNA, 19 bp, Homo sapiens
ggcttatttctatgacaaa

SEQ ID NO: 4636595 - DNA, 15 bp, Homo sapiens
ggcttcactcctgct

SEQ ID NO: 4636596 - DNA, 17 bp, Homo sapiens
ggcttcactcctgctgt

SEQ ID NO: 4636597 - DNA, 17 bp, Homo sapiens
ggcttcagcccccacca

SEQ ID NO: 4636598 - DNA, 23 bp, Homo sapiens
ggcttccatcccaaccagtgcca

SEQ ID NO: 4636599 - DNA, 19 bp, Homo sapiens
ggcttcccaggctgggctc

SEQ ID NO: 4636600 - DNA, 11 bp, Homo sapiens
ggcttctctct

SEQ ID NO: 4636601 - DNA, 14 bp, Homo sapiens
ggcttgaaggccag

SEQ ID NO: 4636602 - DNA, 14 bp, Homo sapiens
ggctttatgcaaat

SEQ ID NO: 4636603 - DNA, 19 bp, Homo sapiens
ggctttctgggtgtgactg

SEQ ID NO: 4636604 - DNA, 12 bp, Homo sapiens
gggaaagggaga

SEQ ID NO: 4636605 - DNA, 15 bp, Homo sapiens
gggaaccactcccac

SEQ ID NO: 4636606 - DNA, 17 bp, Homo sapiens
gggaagacaaagcacac

SEQ ID NO: 4636607 - DNA, 22 bp, Homo sapiens
gggaagagatcccaggaggtgc

SEQ ID NO: 4636608 - DNA, 13 bp, Homo sapiens
gggaaggacagga

SEQ ID NO: 4636609 - DNA, 21 bp, Homo sapiens
gggaaggctacttcggggctg

SEQ ID NO: 4636610 - DNA, 14 bp, Homo sapiens
gggaagtaacagac

SEQ ID NO: 4636611 - DNA, 15 bp, Homo sapiens
gggaagtagtccttg

SEQ ID NO: 4636612 - DNA, 17 bp, Homo sapiens
gggaagtgaggaagcca

SEQ ID NO: 4636613 - DNA, 15 bp, Homo sapiens
gggaatgagcccaga

SEQ ID NO: 4636614 - DNA, 16 bp, Homo sapiens
gggaatgagcccagag

SEQ ID NO: 4636615 - DNA, 21 bp, Homo sapiens
gggaatgagcccagagaacag

SEQ ID NO: 4636616 - DNA, 12 bp, Homo sapiens
gggaattctctt

SEQ ID NO: 4636617 - DNA, 19 bp, Homo sapiens
gggacaagcaggccgccct

SEQ ID NO: 4636618 - DNA, 22 bp, Homo sapiens
gggacaagtctttctcctcttt

SEQ ID NO: 4636619 - DNA, 22 bp, Homo sapiens
gggacaagtggactcagggcag

SEQ ID NO: 4636620 - DNA, 21 bp, Homo sapiens
gggacattgttctttccggcc

SEQ ID NO: 4636621 - DNA, 13 bp, Homo sapiens
gggacccacctgc

SEQ ID NO: 4636622 - DNA, 23 bp, Homo sapiens
gggaccccagctgctctaagccc

SEQ ID NO: 4636623 - DNA, 19 bp, Homo sapiens
gggaccggtgctgcaggag

SEQ ID NO: 4636624 - DNA, 19 bp, Homo sapiens
gggacctataactgcccag

SEQ ID NO: 4636625 - DNA, 18 bp, Homo sapiens
gggacgtggctcagccag

SEQ ID NO: 4636626 - DNA, 20 bp, Homo sapiens
gggacgtggctcagccagca

SEQ ID NO: 4636627 - DNA, 16 bp, Homo sapiens
gggactcatccttgcc

SEQ ID NO: 4636628 - DNA, 17 bp, Homo sapiens
gggactcatccttgccc

SEQ ID NO: 4636629 - DNA, 17 bp, Homo sapiens
gggactgtcgctgcttc

SEQ ID NO: 4636630 - DNA, 14 bp, Homo sapiens
gggacttgtgtctg

SEQ ID NO: 4636631 - DNA, 13 bp, Homo sapiens
gggagaagaaaga

SEQ ID NO: 4636632 - DNA, 16 bp, Homo sapiens
gggagaggtcaccagc

SEQ ID NO: 4636633 - DNA, 18 bp, Homo sapiens
gggagagttgtgatggag

SEQ ID NO: 4636634 - DNA, 20 bp, Homo sapiens
gggagagttgtgatggaggg

SEQ ID NO: 4636635 - DNA, 21 bp, Homo sapiens
gggagcaggttccccaagggc

SEQ ID NO: 4636636 - DNA, 23 bp, Homo sapiens
gggagcaggttccccaagggccc

SEQ ID NO: 4636637 - DNA, 22 bp, Homo sapiens
gggagcttccgctttgaaagaa

SEQ ID NO: 4636638 - DNA, 23 bp, Homo sapiens
gggaggagcctgtgcgtcccagc

SEQ ID NO: 4636639 - DNA, 20 bp, Homo sapiens
gggagggaaaagggaagtag

SEQ ID NO: 4636640 - DNA, 11 bp, Homo sapiens
gggagggatta

SEQ ID NO: 4636641 - DNA, 15 bp, Homo sapiens
gggagggctctgagg

SEQ ID NO: 4636642 - DNA, 16 bp, Homo sapiens
gggaggggaggcattg

SEQ ID NO: 4636643 - DNA, 14 bp, Homo sapiens
gggagtctctcttc

SEQ ID NO: 4636644 - DNA, 16 bp, Homo sapiens
gggagtgctggctcac

SEQ ID NO: 4636645 - DNA, 20 bp, Homo sapiens
gggagtttaatacaggaaat

SEQ ID NO: 4636646 - DNA, 23 bp, Homo sapiens
gggatgaggtcaccaggggagga

SEQ ID NO: 4636647 - DNA, 16 bp, Homo sapiens
gggatgcggatcctgc

SEQ ID NO: 4636648 - DNA, 18 bp, Homo sapiens
gggatgcggatcctgctg

SEQ ID NO: 4636649 - DNA, 15 bp, Homo sapiens
gggatggagaaagaa

SEQ ID NO: 4636650 - DNA, 13 bp, Homo sapiens
gggcaaagcttgt

SEQ ID NO: 4636651 - DNA, 21 bp, Homo sapiens
gggcaagcctaagggatcctg

SEQ ID NO: 4636652 - DNA, 22 bp, Homo sapiens
gggcaagctaggccccagaggc

SEQ ID NO: 4636653 - DNA, 13 bp, Homo sapiens
gggcaagctttgc

SEQ ID NO: 4636654 - DNA, 14 bp, Homo sapiens
gggcacccccagcc

SEQ ID NO: 4636655 - DNA, 18 bp, Homo sapiens
gggcactccgcgccgatg

SEQ ID NO: 4636656 - DNA, 14 bp, Homo sapiens
gggcactggcccag

SEQ ID NO: 4636657 - DNA, 17 bp, Homo sapiens
gggcacttaatttgtaa

SEQ ID NO: 4636658 - DNA, 19 bp, Homo sapiens
gggcacttaatttgtaaac

SEQ ID NO: 4636659 - DNA, 17 bp, Homo sapiens
gggcagagtcctgcctt

SEQ ID NO: 4636660 - DNA, 16 bp, Homo sapiens
gggcagcactccccag

SEQ ID NO: 4636661 - DNA, 12 bp, Homo sapiens
gggcagcagcca

SEQ ID NO: 4636662 - DNA, 13 bp, Homo sapiens
gggcagcagccag

SEQ ID NO: 4636663 - DNA, 23 bp, Homo sapiens
gggcagcagccagccctgcctgg

SEQ ID NO: 4636664 - DNA, 19 bp, Homo sapiens
gggcagcagttgaggtggg

SEQ ID NO: 4636665 - DNA, 13 bp, Homo sapiens
gggcagccccctc

SEQ ID NO: 4636666 - DNA, 23 bp, Homo sapiens
gggcagcgcccttcctctccacc

SEQ ID NO: 4636667 - DNA, 12 bp, Homo sapiens
gggcagctcctc

SEQ ID NO: 4636668 - DNA, 21 bp, Homo sapiens
gggcagctcctctgtctcgag

SEQ ID NO: 4636669 - DNA, 15 bp, Homo sapiens
gggcaggagtagctg

SEQ ID NO: 4636670 - DNA, 20 bp, Homo sapiens
gggcaggagtagctgagctc

SEQ ID NO: 4636671 - DNA, 14 bp, Homo sapiens
gggcagggcccacg

SEQ ID NO: 4636672 - DNA, 16 bp, Homo sapiens
gggcagttcgcagcca

SEQ ID NO: 4636673 - DNA, 20 bp, Homo sapiens
gggcagttcgcagccaccct

SEQ ID NO: 4636674 - DNA, 22 bp, Homo sapiens
gggcagttcgcagccaccctga

SEQ ID NO: 4636675 - DNA, 16 bp, Homo sapiens
gggcagtttgggaagg

SEQ ID NO: 4636676 - DNA, 19 bp, Homo sapiens
gggcatccacgtagggggc

SEQ ID NO: 4636677 - DNA, 24 bp, Homo sapiens
gggcatgactgtcgccacacgcct

SEQ ID NO: 4636678 - DNA, 18 bp, Homo sapiens
gggccacgtggatgggca

SEQ ID NO: 4636679 - DNA, 12 bp, Homo sapiens
gggccactcctt

SEQ ID NO: 4636680 - DNA, 20 bp, Homo sapiens
gggccactccttcctgcccc

SEQ ID NO: 4636681 - DNA, 13 bp, Homo sapiens
gggccactgggga

SEQ ID NO: 4636682 - DNA, 18 bp, Homo sapiens
gggccaggccccatggag

SEQ ID NO: 4636683 - DNA, 13 bp, Homo sapiens
gggccagggctgc

SEQ ID NO: 4636684 - DNA, 21 bp, Homo sapiens
gggccagggctgccctgagaa

SEQ ID NO: 4636685 - DNA, 15 bp, Homo sapiens
gggccagtggggcct

SEQ ID NO: 4636686 - DNA, 17 bp, Homo sapiens
gggccagtggggcctgt

SEQ ID NO: 4636687 - DNA, 22 bp, Homo sapiens
gggccatctgactgccaagcca

SEQ ID NO: 4636688 - DNA, 17 bp, Homo sapiens
gggccatgttgtgcctc

SEQ ID NO: 4636689 - DNA, 18 bp, Homo sapiens
gggccccgccagggctgg

SEQ ID NO: 4636690 - DNA, 19 bp, Homo sapiens
gggccccgccagggctggg

SEQ ID NO: 4636691 - DNA, 20 bp, Homo sapiens
gggccccgccagggctgggg

SEQ ID NO: 4636692 - DNA, 17 bp, Homo sapiens
gggccccgggctggaga

SEQ ID NO: 4636693 - DNA, 17 bp, Homo sapiens
gggccctctttccctgc

SEQ ID NO: 4636694 - DNA, 14 bp, Homo sapiens
gggccctggggcct

SEQ ID NO: 4636695 - DNA, 20 bp, Homo sapiens
gggccctggggcctgtactg

SEQ ID NO: 4636696 - DNA, 19 bp, Homo sapiens
gggccgccacggcctggct

SEQ ID NO: 4636697 - DNA, 17 bp, Homo sapiens
gggccgggcagaggggc

SEQ ID NO: 4636698 - DNA, 20 bp, Homo sapiens
gggccggggaactggccaag

SEQ ID NO: 4636699 - DNA, 23 bp, Homo sapiens
gggccggggaactggccaagctg

SEQ ID NO: 4636700 - DNA, 19 bp, Homo sapiens
gggcctatggagagccctg

SEQ ID NO: 4636701 - DNA, 15 bp, Homo sapiens
gggcctgccccctgg

SEQ ID NO: 4636702 - DNA, 16 bp, Homo sapiens
gggcctgccccctggg

SEQ ID NO: 4636703 - DNA, 11 bp, Homo sapiens
gggcctgctgc

SEQ ID NO: 4636704 - DNA, 17 bp, Homo sapiens
gggcctgctgctgagaa

SEQ ID NO: 4636705 - DNA, 23 bp, Homo sapiens
gggcctgctgctgagaacctggc

SEQ ID NO: 4636706 - DNA, 18 bp, Homo sapiens
gggcctggcatagagtag

SEQ ID NO: 4636707 - DNA, 13 bp, Homo sapiens
gggcctggctggc

SEQ ID NO: 4636708 - DNA, 17 bp, Homo sapiens
gggcctggctggctgag

SEQ ID NO: 4636709 - DNA, 20 bp, Homo sapiens
gggcctggctggctgagggc

SEQ ID NO: 4636710 - DNA, 21 bp, Homo sapiens
gggcctggctggctgagggca

SEQ ID NO: 4636711 - DNA, 16 bp, Homo sapiens
gggcctggtccctggg

SEQ ID NO: 4636712 - DNA, 19 bp, Homo sapiens
gggcctggtccctgggagg

SEQ ID NO: 4636713 - DNA, 16 bp, Homo sapiens
gggcctgtctcagtga

SEQ ID NO: 4636714 - DNA, 18 bp, Homo sapiens
gggccttagtgggccagg

SEQ ID NO: 4636715 - DNA, 15 bp, Homo sapiens
gggcctttgcaagat

SEQ ID NO: 4636716 - DNA, 13 bp, Homo sapiens
gggcgggcggagg

SEQ ID NO: 4636717 - DNA, 17 bp, Homo sapiens
gggctagggaggaccaa

SEQ ID NO: 4636718 - DNA, 15 bp, Homo sapiens
gggctatcctgggac

SEQ ID NO: 4636719 - DNA, 15 bp, Homo sapiens
gggctcagcagggct

SEQ ID NO: 4636720 - DNA, 18 bp, Homo sapiens
gggctcagcagggctggt

SEQ ID NO: 4636721 - DNA, 15 bp, Homo sapiens
gggctctaacgcctg

SEQ ID NO: 4636722 - DNA, 16 bp, Homo sapiens
gggctctaacgcctga

SEQ ID NO: 4636723 - DNA, 18 bp, Homo sapiens
gggctctaacgcctgagc

SEQ ID NO: 4636724 - DNA, 20 bp, Homo sapiens
gggctctaacgcctgagccc

SEQ ID NO: 4636725 - DNA, 12 bp, Homo sapiens
gggctctgaggc

SEQ ID NO: 4636726 - DNA, 13 bp, Homo sapiens
gggctctgcccca

SEQ ID NO: 4636727 - DNA, 13 bp, Homo sapiens
gggctctggactc

SEQ ID NO: 4636728 - DNA, 14 bp, Homo sapiens
gggctctggactcc

SEQ ID NO: 4636729 - DNA, 15 bp, Homo sapiens
gggctctgggtgctg

SEQ ID NO: 4636730 - DNA, 22 bp, Homo sapiens
gggctcttctcaggggctctag

SEQ ID NO: 4636731 - DNA, 21 bp, Homo sapiens
gggctgacccagcatctccca

SEQ ID NO: 4636732 - DNA, 19 bp, Homo sapiens
gggctgctctttccacttg

SEQ ID NO: 4636733 - DNA, 22 bp, Homo sapiens
gggctggagaaagagctgcctg

SEQ ID NO: 4636734 - DNA, 23 bp, Homo sapiens
gggctggagaaagagctgcctgg

SEQ ID NO: 4636735 - DNA, 20 bp, Homo sapiens
gggctggggaggaggagaga

SEQ ID NO: 4636736 - DNA, 17 bp, Homo sapiens
gggctgtcatctgtgca

SEQ ID NO: 4636737 - DNA, 21 bp, Homo sapiens
gggcttctcctcctctgtctt

SEQ ID NO: 4636738 - DNA, 12 bp, Homo sapiens
gggcttggccca

SEQ ID NO: 4636739 - DNA, 15 bp, Homo sapiens
gggcttggtcctagg

SEQ ID NO: 4636740 - DNA, 15 bp, Homo sapiens
gggcttttgccactc

SEQ ID NO: 4636741 - DNA, 13 bp, Homo sapiens
ggggaactggcca

SEQ ID NO: 4636742 - DNA, 23 bp, Homo sapiens
ggggaagagggaaatgtacactt

SEQ ID NO: 4636743 - DNA, 12 bp, Homo sapiens
ggggaaggggac

SEQ ID NO: 4636744 - DNA, 20 bp, Homo sapiens
ggggaccctgggcccatctc

SEQ ID NO: 4636745 - DNA, 19 bp, Homo sapiens
ggggacgcccccagtgaga

SEQ ID NO: 4636746 - DNA, 21 bp, Homo sapiens
ggggatcacagcctcacccct

SEQ ID NO: 4636747 - DNA, 17 bp, Homo sapiens
ggggatccagccacttc

SEQ ID NO: 4636748 - DNA, 16 bp, Homo sapiens
ggggcagcactcccca

SEQ ID NO: 4636749 - DNA, 20 bp, Homo sapiens
ggggcagcagttgaggtggg

SEQ ID NO: 4636750 - DNA, 11 bp, Homo sapiens
ggggcaggagt

SEQ ID NO: 4636751 - DNA, 20 bp, Homo sapiens
ggggcaggagtagctgagct

SEQ ID NO: 4636752 - DNA, 18 bp, Homo sapiens
ggggcagggaaggacagg

SEQ ID NO: 4636753 - DNA, 19 bp, Homo sapiens
ggggcagggaaggacagga

SEQ ID NO: 4636754 - DNA, 16 bp, Homo sapiens
ggggcaggggcagggg

SEQ ID NO: 4636755 - DNA, 12 bp, Homo sapiens
ggggccaggagt

SEQ ID NO: 4636756 - DNA, 22 bp, Homo sapiens
ggggccaggccccatggagggt

SEQ ID NO: 4636757 - DNA, 13 bp, Homo sapiens
ggggccctgctac

SEQ ID NO: 4636758 - DNA, 12 bp, Homo sapiens
ggggcctgagag

SEQ ID NO: 4636759 - DNA, 12 bp, Homo sapiens
ggggcctgcaga

SEQ ID NO: 4636760 - DNA, 20 bp, Homo sapiens
ggggcctgcagaaggaaaga

SEQ ID NO: 4636761 - DNA, 18 bp, Homo sapiens
ggggcctgtactgcctgc

SEQ ID NO: 4636762 - DNA, 17 bp, Homo sapiens
ggggcctgtctcagtga

SEQ ID NO: 4636763 - DNA, 23 bp, Homo sapiens
ggggccttagggcactgggctgt

SEQ ID NO: 4636764 - DNA, 18 bp, Homo sapiens
ggggctctaacgcctgag

SEQ ID NO: 4636765 - DNA, 12 bp, Homo sapiens
ggggctgtgcca

SEQ ID NO: 4636766 - DNA, 14 bp, Homo sapiens
ggggctgtgccaac

SEQ ID NO: 4636767 - DNA, 16 bp, Homo sapiens
ggggcttttgccactc

SEQ ID NO: 4636768 - DNA, 16 bp, Homo sapiens
gggggaatgagcccag

SEQ ID NO: 4636769 - DNA, 19 bp, Homo sapiens
gggggcaggggcaggggcg

SEQ ID NO: 4636770 - DNA, 18 bp, Homo sapiens
gggggccccgccagggct

SEQ ID NO: 4636771 - DNA, 12 bp, Homo sapiens
gggggccctgct

SEQ ID NO: 4636772 - DNA, 18 bp, Homo sapiens
gggggcctcattgtgtct

SEQ ID NO: 4636773 - DNA, 13 bp, Homo sapiens
gggggcctggctg

SEQ ID NO: 4636774 - DNA, 14 bp, Homo sapiens
gggggcctggctgg

SEQ ID NO: 4636775 - DNA, 20 bp, Homo sapiens
gggggcctggctggctgagg

SEQ ID NO: 4636776 - DNA, 18 bp, Homo sapiens
gggggctgtgccaacctg

SEQ ID NO: 4636777 - DNA, 18 bp, Homo sapiens
gggggtgatgagggcagc

SEQ ID NO: 4636778 - DNA, 20 bp, Homo sapiens
gggggtgatgagggcagcag

SEQ ID NO: 4636779 - DNA, 21 bp, Homo sapiens
ggggtcacacccaccccctgc

SEQ ID NO: 4636780 - DNA, 17 bp, Homo sapiens
ggggtgatgagggcagc

SEQ ID NO: 4636781 - DNA, 14 bp, Homo sapiens
ggggtgcacaggag

SEQ ID NO: 4636782 - DNA, 15 bp, Homo sapiens
ggggtgcacaggagg

SEQ ID NO: 4636783 - DNA, 16 bp, Homo sapiens
ggggtgcacaggaggg

SEQ ID NO: 4636784 - DNA, 17 bp, Homo sapiens
ggggttggggtgacagt

SEQ ID NO: 4636785 - DNA, 22 bp, Homo sapiens
gggtaggccccacaaggcctgg

SEQ ID NO: 4636786 - DNA, 23 bp, Homo sapiens
gggtcaagctgagctggcttcgg

SEQ ID NO: 4636787 - DNA, 20 bp, Homo sapiens
gggtcatgtttgcaggggtg

SEQ ID NO: 4636788 - DNA, 21 bp, Homo sapiens
gggtcatgtttgcaggggtga

SEQ ID NO: 4636789 - DNA, 22 bp, Homo sapiens
gggtctcggatgacaccctggc

SEQ ID NO: 4636790 - DNA, 22 bp, Homo sapiens
gggtctctgaagggaccccccc

SEQ ID NO: 4636791 - DNA, 20 bp, Homo sapiens
gggtctgagtctatgttcaa

SEQ ID NO: 4636792 - DNA, 19 bp, Homo sapiens
gggtctggctagagggccc

SEQ ID NO: 4636793 - DNA, 20 bp, Homo sapiens
gggtctggctagagggccca

SEQ ID NO: 4636794 - DNA, 15 bp, Homo sapiens
gggtctgtgtgaatg

SEQ ID NO: 4636795 - DNA, 24 bp, Homo sapiens
gggtctgtgtgaatgtgggcactg

SEQ ID NO: 4636796 - DNA, 21 bp, Homo sapiens
gggtgacaagatagagagcta

SEQ ID NO: 4636797 - DNA, 20 bp, Homo sapiens
gggtgacccggcaccccctg

SEQ ID NO: 4636798 - DNA, 17 bp, Homo sapiens
gggtgatgagggcagca

SEQ ID NO: 4636799 - DNA, 23 bp, Homo sapiens
gggtgatgagggcagcagccagc

SEQ ID NO: 4636800 - DNA, 17 bp, Homo sapiens
gggtgcaagcactcggg

SEQ ID NO: 4636801 - DNA, 23 bp, Homo sapiens
gggtggctactctgtgccagagc

SEQ ID NO: 4636802 - DNA, 20 bp, Homo sapiens
gggtgggaaggggctaggga

SEQ ID NO: 4636803 - DNA, 24 bp, Homo sapiens
gggtgtcaaacattcgtgagctgg

SEQ ID NO: 4636804 - DNA, 18 bp, Homo sapiens
gggtgtcatttcattcca

SEQ ID NO: 4636805 - DNA, 17 bp, Homo sapiens
gggttcaagcttgtcca

SEQ ID NO: 4636806 - DNA, 20 bp, Homo sapiens
gggttcacgtaatcctcctg

SEQ ID NO: 4636807 - DNA, 19 bp, Homo sapiens
gggtttttagagaatgtgt

SEQ ID NO: 4636808 - DNA, 19 bp, Homo sapiens
ggtaaaactcactgtgatc

SEQ ID NO: 4636809 - DNA, 22 bp, Homo sapiens
ggtacactacgcactggacagc

SEQ ID NO: 4636810 - DNA, 16 bp, Homo sapiens
ggtacaggagaggcag

SEQ ID NO: 4636811 - DNA, 18 bp, Homo sapiens
ggtaccatgctttttctc

SEQ ID NO: 4636812 - DNA, 21 bp, Homo sapiens
ggtactccataaaaggtgtgt

SEQ ID NO: 4636813 - DNA, 17 bp, Homo sapiens
ggtactgtggggtggac

SEQ ID NO: 4636814 - DNA, 20 bp, Homo sapiens
ggtacttaagctcccctgcc

SEQ ID NO: 4636815 - DNA, 20 bp, Homo sapiens
ggtagaaagagatacagagg

SEQ ID NO: 4636816 - DNA, 19 bp, Homo sapiens
ggtagacctgtctcctggc

SEQ ID NO: 4636817 - DNA, 22 bp, Homo sapiens
ggtagacctgtctcctggcggt

SEQ ID NO: 4636818 - DNA, 17 bp, Homo sapiens
ggtagagccacaaaaga

SEQ ID NO: 4636819 - DNA, 13 bp, Homo sapiens
ggtagccagcaca

SEQ ID NO: 4636820 - DNA, 17 bp, Homo sapiens
ggtaggttgggacacca

SEQ ID NO: 4636821 - DNA, 16 bp, Homo sapiens
ggtattttttcctttt

SEQ ID NO: 4636822 - DNA, 18 bp, Homo sapiens
ggtcaagctgagctggct

SEQ ID NO: 4636823 - DNA, 19 bp, Homo sapiens
ggtcaagctgagctggctt

SEQ ID NO: 4636824 - DNA, 23 bp, Homo sapiens
ggtcacacccaccccctgcctgg

SEQ ID NO: 4636825 - DNA, 16 bp, Homo sapiens
ggtcaccaagcagtgg

SEQ ID NO: 4636826 - DNA, 14 bp, Homo sapiens
ggtcaccaggggag

SEQ ID NO: 4636827 - DNA, 22 bp, Homo sapiens
ggtcaccaggggaggagcctgt

SEQ ID NO: 4636828 - DNA, 17 bp, Homo sapiens
ggtcacctcccatcccg

SEQ ID NO: 4636829 - DNA, 23 bp, Homo sapiens
ggtcagggagtgctggctcacag

SEQ ID NO: 4636830 - DNA, 20 bp, Homo sapiens
ggtcagtagtttcatgtttt

SEQ ID NO: 4636831 - DNA, 12 bp, Homo sapiens
ggtcataaagca

SEQ ID NO: 4636832 - DNA, 18 bp, Homo sapiens
ggtcattcttttgccaca

SEQ ID NO: 4636833 - DNA, 21 bp, Homo sapiens
ggtcattcttttgccacatcc

SEQ ID NO: 4636834 - DNA, 20 bp, Homo sapiens
ggtccatagagatgagccca

SEQ ID NO: 4636835 - DNA, 21 bp, Homo sapiens
ggtccatagagatgagcccac

SEQ ID NO: 4636836 - DNA, 19 bp, Homo sapiens
ggtcccacatccctgggcc

SEQ ID NO: 4636837 - DNA, 23 bp, Homo sapiens
ggtccctgggaggaaatttgaat

SEQ ID NO: 4636838 - DNA, 14 bp, Homo sapiens
ggtcctagacaaac

SEQ ID NO: 4636839 - DNA, 23 bp, Homo sapiens
ggtcctgagcactgccaggaggg

SEQ ID NO: 4636840 - DNA, 17 bp, Homo sapiens
ggtcctggtggggcagc

SEQ ID NO: 4636841 - DNA, 19 bp, Homo sapiens
ggtcgtggagagctaggag

SEQ ID NO: 4636842 - DNA, 14 bp, Homo sapiens
ggtctagaagaaca

SEQ ID NO: 4636843 - DNA, 13 bp, Homo sapiens
ggtctagaccagg

SEQ ID NO: 4636844 - DNA, 17 bp, Homo sapiens
ggtctagaccagggctg

SEQ ID NO: 4636845 - DNA, 21 bp, Homo sapiens
ggtctcaggatatccttatca

SEQ ID NO: 4636846 - DNA, 15 bp, Homo sapiens
ggtctccaaactgat

SEQ ID NO: 4636847 - DNA, 21 bp, Homo sapiens
ggtctcccttctctacactct

SEQ ID NO: 4636848 - DNA, 17 bp, Homo sapiens
ggtctctccctcaggtg

SEQ ID NO: 4636849 - DNA, 19 bp, Homo sapiens
ggtctgagtctatgttcaa

SEQ ID NO: 4636850 - DNA, 19 bp, Homo sapiens
ggtctgagtgcaagttcat

SEQ ID NO: 4636851 - DNA, 22 bp, Homo sapiens
ggtctggcagcctcccatccag

SEQ ID NO: 4636852 - DNA, 16 bp, Homo sapiens
ggtctggcagggcagc

SEQ ID NO: 4636853 - DNA, 17 bp, Homo sapiens
ggtctggcagggcagca

SEQ ID NO: 4636854 - DNA, 15 bp, Homo sapiens
ggtctggttgggcag

SEQ ID NO: 4636855 - DNA, 13 bp, Homo sapiens
ggtcttaggtctt

SEQ ID NO: 4636856 - DNA, 13 bp, Homo sapiens
ggtcttcctgtgg

SEQ ID NO: 4636857 - DNA, 13 bp, Homo sapiens
ggtcttgatctcc

SEQ ID NO: 4636858 - DNA, 15 bp, Homo sapiens
ggtcttggctgcctg

SEQ ID NO: 4636859 - DNA, 18 bp, Homo sapiens
ggtgaaagaaagggaccc

SEQ ID NO: 4636860 - DNA, 19 bp, Homo sapiens
ggtgaaagaaagggaccca

SEQ ID NO: 4636861 - DNA, 18 bp, Homo sapiens
ggtgaacaaagcagccac

SEQ ID NO: 4636862 - DNA, 13 bp, Homo sapiens
ggtgaccccaggg

SEQ ID NO: 4636863 - DNA, 20 bp, Homo sapiens
ggtgaccccagggcacagga

SEQ ID NO: 4636864 - DNA, 23 bp, Homo sapiens
ggtgaccccagggcacaggagct

SEQ ID NO: 4636865 - DNA, 20 bp, Homo sapiens
ggtgacccggcaccccctgc

SEQ ID NO: 4636866 - DNA, 22 bp, Homo sapiens
ggtgacccggcaccccctgcag

SEQ ID NO: 4636867 - DNA, 16 bp, Homo sapiens
ggtgacttgtctgcct

SEQ ID NO: 4636868 - DNA, 21 bp, Homo sapiens
ggtgacttgtctgcctcctgc

SEQ ID NO: 4636869 - DNA, 20 bp, Homo sapiens
ggtgagagggccgggcagag

SEQ ID NO: 4636870 - DNA, 21 bp, Homo sapiens
ggtgagagggccgggcagagg

SEQ ID NO: 4636871 - DNA, 13 bp, Homo sapiens
ggtgagggaagga

SEQ ID NO: 4636872 - DNA, 14 bp, Homo sapiens
ggtgagggaaggag

SEQ ID NO: 4636873 - DNA, 12 bp, Homo sapiens
ggtgcaaccagg

SEQ ID NO: 4636874 - DNA, 12 bp, Homo sapiens
ggtgcacaggag

SEQ ID NO: 4636875 - DNA, 13 bp, Homo sapiens
ggtgcacaggagg

SEQ ID NO: 4636876 - DNA, 15 bp, Homo sapiens
ggtgcacaggagggg

SEQ ID NO: 4636877 - DNA, 12 bp, Homo sapiens
ggtgcagggcct

SEQ ID NO: 4636878 - DNA, 18 bp, Homo sapiens
ggtgcagggcctggcata

SEQ ID NO: 4636879 - DNA, 12 bp, Homo sapiens
ggtgcaggtaga

SEQ ID NO: 4636880 - DNA, 17 bp, Homo sapiens
ggtgcagtggagggggc

SEQ ID NO: 4636881 - DNA, 14 bp, Homo sapiens
ggtgcccacaggcc

SEQ ID NO: 4636882 - DNA, 13 bp, Homo sapiens
ggtgcccactccg

SEQ ID NO: 4636883 - DNA, 14 bp, Homo sapiens
ggtgcccaggagaa

SEQ ID NO: 4636884 - DNA, 18 bp, Homo sapiens
ggtgcctgaaagctggga

SEQ ID NO: 4636885 - DNA, 23 bp, Homo sapiens
ggtgctcagaataaggcaggcat

SEQ ID NO: 4636886 - DNA, 14 bp, Homo sapiens
ggtgctgcaggagt

SEQ ID NO: 4636887 - DNA, 15 bp, Homo sapiens
ggtgcttggaggggg

SEQ ID NO: 4636888 - DNA, 16 bp, Homo sapiens
ggtgcttggaggggga

SEQ ID NO: 4636889 - DNA, 20 bp, Homo sapiens
ggtgcttttattgtaaagtc

SEQ ID NO: 4636890 - DNA, 15 bp, Homo sapiens
ggtggaacaagcaca

SEQ ID NO: 4636891 - DNA, 15 bp, Homo sapiens
ggtggaaggcagaca

SEQ ID NO: 4636892 - DNA, 19 bp, Homo sapiens
ggtggagtgcagtggtgcg

SEQ ID NO: 4636893 - DNA, 12 bp, Homo sapiens
ggtggcctcagc

SEQ ID NO: 4636894 - DNA, 18 bp, Homo sapiens
ggtggcctggaggtgggc

SEQ ID NO: 4636895 - DNA, 16 bp, Homo sapiens
ggtggctactctgtgc

SEQ ID NO: 4636896 - DNA, 18 bp, Homo sapiens
ggtggctactctgtgcca

SEQ ID NO: 4636897 - DNA, 23 bp, Homo sapiens
ggtggctactctgtgccagagcc

SEQ ID NO: 4636898 - DNA, 14 bp, Homo sapiens
ggtgggcagtgagt

SEQ ID NO: 4636899 - DNA, 12 bp, Homo sapiens
ggtgggtgctca

SEQ ID NO: 4636900 - DNA, 18 bp, Homo sapiens
ggtgtactgtgtttgatt

SEQ ID NO: 4636901 - DNA, 14 bp, Homo sapiens
ggtgtagaaaaggt

SEQ ID NO: 4636902 - DNA, 12 bp, Homo sapiens
ggtgtagccagg

SEQ ID NO: 4636903 - DNA, 22 bp, Homo sapiens
ggtgtatatgtgccacattttc

SEQ ID NO: 4636904 - DNA, 23 bp, Homo sapiens
ggtgtgccagaaagtcccccctc

SEQ ID NO: 4636905 - DNA, 15 bp, Homo sapiens
ggtgtgtccacagag

SEQ ID NO: 4636906 - DNA, 15 bp, Homo sapiens
ggtgtttctatctct

SEQ ID NO: 4636907 - DNA, 16 bp, Homo sapiens
ggtgtttgcttgaatg

SEQ ID NO: 4636908 - DNA, 17 bp, Homo sapiens
ggttaaaaaacaaatgt

SEQ ID NO: 4636909 - DNA, 17 bp, Homo sapiens
ggttagcatcctgcccg

SEQ ID NO: 4636910 - DNA, 13 bp, Homo sapiens
ggttcaagcttgt

SEQ ID NO: 4636911 - DNA, 16 bp, Homo sapiens
ggttccttccttagtt

SEQ ID NO: 4636912 - DNA, 19 bp, Homo sapiens
ggttctaggctaccagaag

SEQ ID NO: 4636913 - DNA, 16 bp, Homo sapiens
ggttctaggctgctgc

SEQ ID NO: 4636914 - DNA, 18 bp, Homo sapiens
ggttcttacttttcctgg

SEQ ID NO: 4636915 - DNA, 23 bp, Homo sapiens
ggttgcagtctttcccccaggaa

SEQ ID NO: 4636916 - DNA, 14 bp, Homo sapiens
ggttgcctgggggc

SEQ ID NO: 4636917 - DNA, 15 bp, Homo sapiens
ggttgcttaattcct

SEQ ID NO: 4636918 - DNA, 21 bp, Homo sapiens
ggttgggcagccagaccagca

SEQ ID NO: 4636919 - DNA, 13 bp, Homo sapiens
ggttgtgtgtgtt

SEQ ID NO: 4636920 - DNA, 16 bp, Homo sapiens
ggtttcaacaaatttc

SEQ ID NO: 4636921 - DNA, 18 bp, Homo sapiens
ggtttcaacaaatttcat

SEQ ID NO: 4636922 - DNA, 22 bp, Homo sapiens
ggtttcaacaaatttcattgca

SEQ ID NO: 4636923 - DNA, 23 bp, Homo sapiens
ggtttcaacaaatttcattgcac

SEQ ID NO: 4636924 - DNA, 20 bp, Homo sapiens
ggtttcaccatgttggtcag

SEQ ID NO: 4636925 - DNA, 15 bp, Homo sapiens
ggtttctctctacag

SEQ ID NO: 4636926 - DNA, 20 bp, Homo sapiens
ggtttctctctacagtgcca

SEQ ID NO: 4636927 - DNA, 22 bp, Homo sapiens
ggtttctttcagattttttgaa

SEQ ID NO: 4636928 - DNA, 21 bp, Homo sapiens
ggtttgccggtggtgcaggta

SEQ ID NO: 4636929 - DNA, 14 bp, Homo sapiens
ggtttgggcagagc

SEQ ID NO: 4636930 - DNA, 13 bp, Homo sapiens
gtaaaaaatgtct

SEQ ID NO: 4636931 - DNA, 19 bp, Homo sapiens
gtaaaaacagcattgcttt

SEQ ID NO: 4636932 - DNA, 21 bp, Homo sapiens
gtaaaaacagcattgctttct

SEQ ID NO: 4636933 - DNA, 22 bp, Homo sapiens
gtaaaaggccaaacctctgttc

SEQ ID NO: 4636934 - DNA, 19 bp, Homo sapiens
gtaaacaaaccacagcagg

SEQ ID NO: 4636935 - DNA, 16 bp, Homo sapiens
gtaaactatttatctg

SEQ ID NO: 4636936 - DNA, 21 bp, Homo sapiens
gtaaactatttatctgtgttt

SEQ ID NO: 4636937 - DNA, 12 bp, Homo sapiens
gtaaacttctga

SEQ ID NO: 4636938 - DNA, 17 bp, Homo sapiens
gtaaacttggaatcaag

SEQ ID NO: 4636939 - DNA, 23 bp, Homo sapiens
gtaaatagtgtcatataaactca

SEQ ID NO: 4636940 - DNA, 21 bp, Homo sapiens
gtaaatatggggatagtctgg

SEQ ID NO: 4636941 - DNA, 14 bp, Homo sapiens
gtaaatatttactc

SEQ ID NO: 4636942 - DNA, 18 bp, Homo sapiens
gtaaatatttactctttg

SEQ ID NO: 4636943 - DNA, 16 bp, Homo sapiens
gtaaatcagaaagtaa

SEQ ID NO: 4636944 - DNA, 13 bp, Homo sapiens
gtaaatcctgtgt

SEQ ID NO: 4636945 - DNA, 15 bp, Homo sapiens
gtaaatcctgtgttt

SEQ ID NO: 4636946 - DNA, 16 bp, Homo sapiens
gtaaatttggcttctg

SEQ ID NO: 4636947 - DNA, 11 bp, Homo sapiens
gtaacagacac

SEQ ID NO: 4636948 - DNA, 15 bp, Homo sapiens
gtaaccaaggccctg

SEQ ID NO: 4636949 - DNA, 20 bp, Homo sapiens
gtaacctgggcttaagtttt

SEQ ID NO: 4636950 - DNA, 15 bp, Homo sapiens
gtaactgtcctgtcc

SEQ ID NO: 4636951 - DNA, 21 bp, Homo sapiens
gtaactgtcctgtcctgctca

SEQ ID NO: 4636952 - DNA, 16 bp, Homo sapiens
gtaagaccaccttccc

SEQ ID NO: 4636953 - DNA, 18 bp, Homo sapiens
gtaagcgatttgaaacac

SEQ ID NO: 4636954 - DNA, 14 bp, Homo sapiens
gtaagtgtaaaaaa

SEQ ID NO: 4636955 - DNA, 21 bp, Homo sapiens
gtaatatcaaagcattttata

SEQ ID NO: 4636956 - DNA, 14 bp, Homo sapiens
gtaatatgacagat

SEQ ID NO: 4636957 - DNA, 20 bp, Homo sapiens
gtaatctgtgtacaaagaaa

SEQ ID NO: 4636958 - DNA, 20 bp, Homo sapiens
gtaatgagtcagtgaagtct

SEQ ID NO: 4636959 - DNA, 16 bp, Homo sapiens
gtaatgattttggaac

SEQ ID NO: 4636960 - DNA, 17 bp, Homo sapiens
gtaatgcactgttttta

SEQ ID NO: 4636961 - DNA, 19 bp, Homo sapiens
gtaatggaggtcccagccc

SEQ ID NO: 4636962 - DNA, 22 bp, Homo sapiens
gtaatggaggtcccagccctgg

SEQ ID NO: 4636963 - DNA, 23 bp, Homo sapiens
gtaatgggtacaatgaagaagtt

SEQ ID NO: 4636964 - DNA, 17 bp, Homo sapiens
gtaatgtaaaatccatc

SEQ ID NO: 4636965 - DNA, 18 bp, Homo sapiens
gtaatgtgtggtggcctc

SEQ ID NO: 4636966 - DNA, 17 bp, Homo sapiens
gtaattatgaaaagaaa

SEQ ID NO: 4636967 - DNA, 17 bp, Homo sapiens
gtaatttaatgcctgcc

SEQ ID NO: 4636968 - DNA, 12 bp, Homo sapiens
gtaatttcaaaa

SEQ ID NO: 4636969 - DNA, 15 bp, Homo sapiens
gtaattttgtcacat

SEQ ID NO: 4636970 - DNA, 17 bp, Homo sapiens
gtacaaatgaagaaagt

SEQ ID NO: 4636971 - DNA, 21 bp, Homo sapiens
gtacacagagaaggctatgta

SEQ ID NO: 4636972 - DNA, 17 bp, Homo sapiens
gtacactttttacagca

SEQ ID NO: 4636973 - DNA, 15 bp, Homo sapiens
gtacagcatgtgcct

SEQ ID NO: 4636974 - DNA, 16 bp, Homo sapiens
gtacaggagaggcagc

SEQ ID NO: 4636975 - DNA, 18 bp, Homo sapiens
gtacaggatgctttggtt

SEQ ID NO: 4636976 - DNA, 13 bp, Homo sapiens
gtacagtcttgta

SEQ ID NO: 4636977 - DNA, 17 bp, Homo sapiens
gtacatatgtaaacata

SEQ ID NO: 4636978 - DNA, 17 bp, Homo sapiens
gtacatatttattttct

SEQ ID NO: 4636979 - DNA, 19 bp, Homo sapiens
gtacatatttattttcttt

SEQ ID NO: 4636980 - DNA, 14 bp, Homo sapiens
gtacatgaaagtag

SEQ ID NO: 4636981 - DNA, 19 bp, Homo sapiens
gtacatgtgtagcctgtgc

SEQ ID NO: 4636982 - DNA, 20 bp, Homo sapiens
gtacatgtgtagcctgtgca

SEQ ID NO: 4636983 - DNA, 13 bp, Homo sapiens
gtacatgtgtgca

SEQ ID NO: 4636984 - DNA, 17 bp, Homo sapiens
gtaccgtcgacaagaat

SEQ ID NO: 4636985 - DNA, 16 bp, Homo sapiens
gtacctcaagccccat

SEQ ID NO: 4636986 - DNA, 13 bp, Homo sapiens
gtacctcagtatt

SEQ ID NO: 4636987 - DNA, 23 bp, Homo sapiens
gtactacacatttttaaattgtt

SEQ ID NO: 4636988 - DNA, 18 bp, Homo sapiens
gtactaggatactgctgc

SEQ ID NO: 4636989 - DNA, 22 bp, Homo sapiens
gtactaggatactgctgcgtca

SEQ ID NO: 4636990 - DNA, 16 bp, Homo sapiens
gtactagttacacatc

SEQ ID NO: 4636991 - DNA, 17 bp, Homo sapiens
gtactagttacacatct

SEQ ID NO: 4636992 - DNA, 21 bp, Homo sapiens
gtactatttagatataacact

SEQ ID NO: 4636993 - DNA, 20 bp, Homo sapiens
gtactgcattctctcccatc

SEQ ID NO: 4636994 - DNA, 11 bp, Homo sapiens
gtactgcctgc

SEQ ID NO: 4636995 - DNA, 16 bp, Homo sapiens
gtactgcctgcttggg

SEQ ID NO: 4636996 - DNA, 14 bp, Homo sapiens
gtactgggacattg

SEQ ID NO: 4636997 - DNA, 18 bp, Homo sapiens
gtactgttcatacagttt

SEQ ID NO: 4636998 - DNA, 19 bp, Homo sapiens
gtactgttcatacagtttt

SEQ ID NO: 4636999 - DNA, 14 bp, Homo sapiens
gtacttaatatact

SEQ ID NO: 4637000 - DNA, 21 bp, Homo sapiens
gtacttcataagatattcttt

SEQ ID NO: 4637001 - DNA, 11 bp, Homo sapiens
gtacttcctct

SEQ ID NO: 4637002 - DNA, 15 bp, Homo sapiens
gtacttcctctgtga

SEQ ID NO: 4637003 - DNA, 16 bp, Homo sapiens
gtacttcctctgtgaa

SEQ ID NO: 4637004 - DNA, 19 bp, Homo sapiens
gtacttcctctgtgaactg

SEQ ID NO: 4637005 - DNA, 16 bp, Homo sapiens
gtacttctctgtgtgc

SEQ ID NO: 4637006 - DNA, 14 bp, Homo sapiens
gtacttgtcaaaga

SEQ ID NO: 4637007 - DNA, 15 bp, Homo sapiens
gtacttgtcaaagaa

SEQ ID NO: 4637008 - DNA, 16 bp, Homo sapiens
gtacttttcattctct

SEQ ID NO: 4637009 - DNA, 17 bp, Homo sapiens
gtacttttcattctctt

SEQ ID NO: 4637010 - DNA, 18 bp, Homo sapiens
gtacttttcattctcttt

SEQ ID NO: 4637011 - DNA, 20 bp, Homo sapiens
gtacttttttaaatattttc

SEQ ID NO: 4637012 - DNA, 21 bp, Homo sapiens
gtacttttttaaatattttct

SEQ ID NO: 4637013 - DNA, 22 bp, Homo sapiens
gtagaaagttgtaaaatagaaa

SEQ ID NO: 4637014 - DNA, 16 bp, Homo sapiens
gtagaactgtctgtga

SEQ ID NO: 4637015 - DNA, 15 bp, Homo sapiens
gtagacacaggtcac

SEQ ID NO: 4637016 - DNA, 19 bp, Homo sapiens
gtagacctgtctcctggcg

SEQ ID NO: 4637017 - DNA, 17 bp, Homo sapiens
gtagactgtttcacatt

SEQ ID NO: 4637018 - DNA, 15 bp, Homo sapiens
gtagagacagtgttt

SEQ ID NO: 4637019 - DNA, 16 bp, Homo sapiens
gtagatgcttgattgt

SEQ ID NO: 4637020 - DNA, 18 bp, Homo sapiens
gtagattttaaagacaaa

SEQ ID NO: 4637021 - DNA, 17 bp, Homo sapiens
gtagcaggttctaggct

SEQ ID NO: 4637022 - DNA, 14 bp, Homo sapiens
gtagcctaaagggc

SEQ ID NO: 4637023 - DNA, 17 bp, Homo sapiens
gtagcctggactgtttc

SEQ ID NO: 4637024 - DNA, 22 bp, Homo sapiens
gtagcctggactgtttcatagt

SEQ ID NO: 4637025 - DNA, 17 bp, Homo sapiens
gtagctacaagggaagc

SEQ ID NO: 4637026 - DNA, 22 bp, Homo sapiens
gtagctatagttgcagcccaag

SEQ ID NO: 4637027 - DNA, 12 bp, Homo sapiens
gtagctgagctc

SEQ ID NO: 4637028 - DNA, 13 bp, Homo sapiens
gtagctgagctca

SEQ ID NO: 4637029 - DNA, 14 bp, Homo sapiens
gtagctgtaagggc

SEQ ID NO: 4637030 - DNA, 15 bp, Homo sapiens
gtagctgtaagggca

SEQ ID NO: 4637031 - DNA, 16 bp, Homo sapiens
gtagctgtaagggcag

SEQ ID NO: 4637032 - DNA, 13 bp, Homo sapiens
gtagctgtgacct

SEQ ID NO: 4637033 - DNA, 14 bp, Homo sapiens
gtagctgtgacctg

SEQ ID NO: 4637034 - DNA, 15 bp, Homo sapiens
gtagctgtgacctgc

SEQ ID NO: 4637035 - DNA, 19 bp, Homo sapiens
gtagctgtgacctgctgag

SEQ ID NO: 4637036 - DNA, 18 bp, Homo sapiens
gtagcttcttctgaaaga

SEQ ID NO: 4637037 - DNA, 14 bp, Homo sapiens
gtagcttgctccct

SEQ ID NO: 4637038 - DNA, 12 bp, Homo sapiens
gtagctttcctg

SEQ ID NO: 4637039 - DNA, 13 bp, Homo sapiens
gtagctttcctgg

SEQ ID NO: 4637040 - DNA, 17 bp, Homo sapiens
gtaggaccaggccaccg

SEQ ID NO: 4637041 - DNA, 14 bp, Homo sapiens
gtaggccccacaag

SEQ ID NO: 4637042 - DNA, 16 bp, Homo sapiens
gtaggctgcaaaatta

SEQ ID NO: 4637043 - DNA, 20 bp, Homo sapiens
gtagggatgcggatcctgct

SEQ ID NO: 4637044 - DNA, 23 bp, Homo sapiens
gtagggatgcggatcctgctggg

SEQ ID NO: 4637045 - DNA, 12 bp, Homo sapiens
gtagtcataata

SEQ ID NO: 4637046 - DNA, 13 bp, Homo sapiens
gtagtcataataa

SEQ ID NO: 4637047 - DNA, 14 bp, Homo sapiens
gtagtcataataaa

SEQ ID NO: 4637048 - DNA, 16 bp, Homo sapiens
gtagtcatgctgtgca

SEQ ID NO: 4637049 - DNA, 20 bp, Homo sapiens
gtagtctcactgcttgaact

SEQ ID NO: 4637050 - DNA, 12 bp, Homo sapiens
gtagtgagcgag

SEQ ID NO: 4637051 - DNA, 15 bp, Homo sapiens
gtagtgccgcagtgg

SEQ ID NO: 4637052 - DNA, 20 bp, Homo sapiens
gtagtgccgcagtggggtca

SEQ ID NO: 4637053 - DNA, 13 bp, Homo sapiens
gtagttaaataac

SEQ ID NO: 4637054 - DNA, 16 bp, Homo sapiens
gtagttccctctgcct

SEQ ID NO: 4637055 - DNA, 21 bp, Homo sapiens
gtagttggaactttctgttcc

SEQ ID NO: 4637056 - DNA, 21 bp, Homo sapiens
gtataatacatccattctaca

SEQ ID NO: 4637057 - DNA, 14 bp, Homo sapiens
gtataatctttcta

SEQ ID NO: 4637058 - DNA, 23 bp, Homo sapiens
gtatacaccatatactgttcttc

SEQ ID NO: 4637059 - DNA, 15 bp, Homo sapiens
gtatagaaatgctgg

SEQ ID NO: 4637060 - DNA, 19 bp, Homo sapiens
gtataggagccccaggcag

SEQ ID NO: 4637061 - DNA, 16 bp, Homo sapiens
gtatagtatctgtata

SEQ ID NO: 4637062 - DNA, 21 bp, Homo sapiens
gtatagtctcccttttataat

SEQ ID NO: 4637063 - DNA, 19 bp, Homo sapiens
gtatataatttactttgta

SEQ ID NO: 4637064 - DNA, 12 bp, Homo sapiens
gtatatcatgta

SEQ ID NO: 4637065 - DNA, 24 bp, Homo sapiens
gtatatcatgtaaagaaatgtctt

SEQ ID NO: 4637066 - DNA, 19 bp, Homo sapiens
gtatattccttttaaagaa

SEQ ID NO: 4637067 - DNA, 13 bp, Homo sapiens
gtatccccagtgc

SEQ ID NO: 4637068 - DNA, 18 bp, Homo sapiens
gtatcctgggggaagagg

SEQ ID NO: 4637069 - DNA, 19 bp, Homo sapiens
gtatctacagtaatgaaat

SEQ ID NO: 4637070 - DNA, 14 bp, Homo sapiens
gtatctacattaaa

SEQ ID NO: 4637071 - DNA, 16 bp, Homo sapiens
gtatctacattaaaat

SEQ ID NO: 4637072 - DNA, 18 bp, Homo sapiens
gtatctacattaaaatga

SEQ ID NO: 4637073 - DNA, 21 bp, Homo sapiens
gtatctgtttacatccagagt

SEQ ID NO: 4637074 - DNA, 21 bp, Homo sapiens
gtatcttaaaggacataaaat

SEQ ID NO: 4637075 - DNA, 13 bp, Homo sapiens
gtatcttaaattt

SEQ ID NO: 4637076 - DNA, 22 bp, Homo sapiens
gtatgaataatgaaaataaaac

SEQ ID NO: 4637077 - DNA, 21 bp, Homo sapiens
gtatgacccctggccacagcc

SEQ ID NO: 4637078 - DNA, 12 bp, Homo sapiens
gtatgcatgtga

SEQ ID NO: 4637079 - DNA, 15 bp, Homo sapiens
gtatgccttctgtat

SEQ ID NO: 4637080 - DNA, 14 bp, Homo sapiens
gtatggctctgcac

SEQ ID NO: 4637081 - DNA, 20 bp, Homo sapiens
gtatggctctgcacccctct

SEQ ID NO: 4637082 - DNA, 21 bp, Homo sapiens
gtatggctctgcacccctctg

SEQ ID NO: 4637083 - DNA, 13 bp, Homo sapiens
gtatggtgtgttc

SEQ ID NO: 4637084 - DNA, 15 bp, Homo sapiens
gtatggtgtgttcac

SEQ ID NO: 4637085 - DNA, 22 bp, Homo sapiens
gtatgtcaataaacaacagctg

SEQ ID NO: 4637086 - DNA, 22 bp, Homo sapiens
gtattaagttgttaataaaagt

SEQ ID NO: 4637087 - DNA, 22 bp, Homo sapiens
gtattaatggacaaataagttt

SEQ ID NO: 4637088 - DNA, 14 bp, Homo sapiens
gtattacaaacaag

SEQ ID NO: 4637089 - DNA, 19 bp, Homo sapiens
gtattatcattgctcccct

SEQ ID NO: 4637090 - DNA, 17 bp, Homo sapiens
gtatttataaaaatata

SEQ ID NO: 4637091 - DNA, 14 bp, Homo sapiens
gtatttattcccat

SEQ ID NO: 4637092 - DNA, 21 bp, Homo sapiens
gtatttctctattttcataat

SEQ ID NO: 4637093 - DNA, 14 bp, Homo sapiens
gtatttctctgtga

SEQ ID NO: 4637094 - DNA, 18 bp, Homo sapiens
gtatttctgttccttttt

SEQ ID NO: 4637095 - DNA, 16 bp, Homo sapiens
gtatttcttggcatgc

SEQ ID NO: 4637096 - DNA, 12 bp, Homo sapiens
gtatttgctgtt

SEQ ID NO: 4637097 - DNA, 16 bp, Homo sapiens
gtatttgttcccaaga

SEQ ID NO: 4637098 - DNA, 17 bp, Homo sapiens
gtatttgtttgtagctt

SEQ ID NO: 4637099 - DNA, 16 bp, Homo sapiens
gtattttgagtttcag

SEQ ID NO: 4637100 - DNA, 19 bp, Homo sapiens
gtatttttaaaaaatatgt

SEQ ID NO: 4637101 - DNA, 14 bp, Homo sapiens
gtattttttccttt

SEQ ID NO: 4637102 - DNA, 17 bp, Homo sapiens
gtatttttttgtaattg

SEQ ID NO: 4637103 - DNA, 19 bp, Homo sapiens
gtcaaaaaattatttgcta

SEQ ID NO: 4637104 - DNA, 11 bp, Homo sapiens
gtcaaagaagg

SEQ ID NO: 4637105 - DNA, 20 bp, Homo sapiens
gtcaaataaatgtttccccc

SEQ ID NO: 4637106 - DNA, 21 bp, Homo sapiens
gtcaaataaatgtttccccca

SEQ ID NO: 4637107 - DNA, 13 bp, Homo sapiens
gtcaacctcctgg

SEQ ID NO: 4637108 - DNA, 15 bp, Homo sapiens
gtcaacctcctggac

SEQ ID NO: 4637109 - DNA, 18 bp, Homo sapiens
gtcaagaaacagccagca

SEQ ID NO: 4637110 - DNA, 23 bp, Homo sapiens
gtcaagcctcttattccaggaga

SEQ ID NO: 4637111 - DNA, 17 bp, Homo sapiens
gtcaagtaatggaggtc

SEQ ID NO: 4637112 - DNA, 15 bp, Homo sapiens
gtcaatgtactagga

SEQ ID NO: 4637113 - DNA, 17 bp, Homo sapiens
gtcacacccaccccctg

SEQ ID NO: 4637114 - DNA, 23 bp, Homo sapiens
gtcacatggcctatgcacatatg

SEQ ID NO: 4637115 - DNA, 22 bp, Homo sapiens
gtcacattatttattaaaaatg

SEQ ID NO: 4637116 - DNA, 19 bp, Homo sapiens
gtcaccaatgtacccaccg

SEQ ID NO: 4637117 - DNA, 21 bp, Homo sapiens
gtcaccagctgctgtgcccca

SEQ ID NO: 4637118 - DNA, 17 bp, Homo sapiens
gtcaccaggggaggagc

SEQ ID NO: 4637119 - DNA, 19 bp, Homo sapiens
gtcacctccttccccagct

SEQ ID NO: 4637120 - DNA, 16 bp, Homo sapiens
gtcacctcgctgggct

SEQ ID NO: 4637121 - DNA, 22 bp, Homo sapiens
gtcacctgccccgtagagaatg

SEQ ID NO: 4637122 - DNA, 20 bp, Homo sapiens
gtcactcattaatgaatcac

SEQ ID NO: 4637123 - DNA, 12 bp, Homo sapiens
gtcagacataaa

SEQ ID NO: 4637124 - DNA, 13 bp, Homo sapiens
gtcagacataaag

SEQ ID NO: 4637125 - DNA, 20 bp, Homo sapiens
gtcagacccatctctccctt

SEQ ID NO: 4637126 - DNA, 23 bp, Homo sapiens
gtcagactttgtgttcatttcat

SEQ ID NO: 4637127 - DNA, 21 bp, Homo sapiens
gtcagatgaggccctgcacct

SEQ ID NO: 4637128 - DNA, 18 bp, Homo sapiens
gtcagcccatggaggcag

SEQ ID NO: 4637129 - DNA, 23 bp, Homo sapiens
gtcagcccatggaggcagatgcc

SEQ ID NO: 4637130 - DNA, 20 bp, Homo sapiens
gtcagctcttgtcaaaaggt

SEQ ID NO: 4637131 - DNA, 13 bp, Homo sapiens
gtcaggcagggtg

SEQ ID NO: 4637132 - DNA, 16 bp, Homo sapiens
gtcaggctacaaggta

SEQ ID NO: 4637133 - DNA, 13 bp, Homo sapiens
gtcagggagaggt

SEQ ID NO: 4637134 - DNA, 21 bp, Homo sapiens
gtcagggagaggtcaccagct

SEQ ID NO: 4637135 - DNA, 22 bp, Homo sapiens
gtcagggagtgctggctcacag

SEQ ID NO: 4637136 - DNA, 17 bp, Homo sapiens
gtcagggtctccttcct

SEQ ID NO: 4637137 - DNA, 13 bp, Homo sapiens
gtcagtcacagcc

SEQ ID NO: 4637138 - DNA, 16 bp, Homo sapiens
gtcagtgtagacacag

SEQ ID NO: 4637139 - DNA, 17 bp, Homo sapiens
gtcagtgtagacacagg

SEQ ID NO: 4637140 - DNA, 16 bp, Homo sapiens
gtcataaatttgaata

SEQ ID NO: 4637141 - DNA, 11 bp, Homo sapiens
gtcataataaa

SEQ ID NO: 4637142 - DNA, 14 bp, Homo sapiens
gtcatcatcagggc

SEQ ID NO: 4637143 - DNA, 21 bp, Homo sapiens
gtcatcatcagggcctggggc

SEQ ID NO: 4637144 - DNA, 19 bp, Homo sapiens
gtcatgtctgcttgtcaaa

SEQ ID NO: 4637145 - DNA, 16 bp, Homo sapiens
gtcatgttgaaggtgc

SEQ ID NO: 4637146 - DNA, 15 bp, Homo sapiens
gtcatgttggccagg

SEQ ID NO: 4637147 - DNA, 16 bp, Homo sapiens
gtcatgttggccaggc

SEQ ID NO: 4637148 - DNA, 19 bp, Homo sapiens
gtcatgttggccaggctgg

SEQ ID NO: 4637149 - DNA, 15 bp, Homo sapiens
gtcatgtttgcaggg

SEQ ID NO: 4637150 - DNA, 16 bp, Homo sapiens
gtcatgtttgcagggg

SEQ ID NO: 4637151 - DNA, 14 bp, Homo sapiens
gtcattcagaaaaa

SEQ ID NO: 4637152 - DNA, 16 bp, Homo sapiens
gtcattcgttctgtgg

SEQ ID NO: 4637153 - DNA, 15 bp, Homo sapiens
gtcattctttattct

SEQ ID NO: 4637154 - DNA, 23 bp, Homo sapiens
gtcattcttttgccacatcccta

SEQ ID NO: 4637155 - DNA, 17 bp, Homo sapiens
gtcattttattttgtaa

SEQ ID NO: 4637156 - DNA, 12 bp, Homo sapiens
gtccaataagac

SEQ ID NO: 4637157 - DNA, 19 bp, Homo sapiens
gtccactgttctgttctca

SEQ ID NO: 4637158 - DNA, 17 bp, Homo sapiens
gtccaggtcctggtggg

SEQ ID NO: 4637159 - DNA, 15 bp, Homo sapiens
gtccaggttgatctt

SEQ ID NO: 4637160 - DNA, 19 bp, Homo sapiens
gtccatagagatgagccca

SEQ ID NO: 4637161 - DNA, 10 bp, Homo sapiens
gtccatcttg

SEQ ID NO: 4637162 - DNA, 19 bp, Homo sapiens
gtccatgctaacaaagaca

SEQ ID NO: 4637163 - DNA, 22 bp, Homo sapiens
gtcccaaggagggggcctcatt

SEQ ID NO: 4637164 - DNA, 20 bp, Homo sapiens
gtcccacatccctgggcctg

SEQ ID NO: 4637165 - DNA, 15 bp, Homo sapiens
gtcccagcatccctg

SEQ ID NO: 4637166 - DNA, 18 bp, Homo sapiens
gtcccagcatccctggag

SEQ ID NO: 4637167 - DNA, 16 bp, Homo sapiens
gtcccagccctggggg

SEQ ID NO: 4637168 - DNA, 16 bp, Homo sapiens
gtcccagctgaaggca

SEQ ID NO: 4637169 - DNA, 18 bp, Homo sapiens
gtcccagctgaaggcagt

SEQ ID NO: 4637170 - DNA, 19 bp, Homo sapiens
gtcccatttttctcttgcc

SEQ ID NO: 4637171 - DNA, 18 bp, Homo sapiens
gtccccaccctccactca

SEQ ID NO: 4637172 - DNA, 12 bp, Homo sapiens
gtccccagagaa

SEQ ID NO: 4637173 - DNA, 16 bp, Homo sapiens
gtccccagctgagtga

SEQ ID NO: 4637174 - DNA, 22 bp, Homo sapiens
gtccccagctgagtgagtggga

SEQ ID NO: 4637175 - DNA, 22 bp, Homo sapiens
gtccccatctaggtcctggctg

SEQ ID NO: 4637176 - DNA, 17 bp, Homo sapiens
gtccctatatcagggcc

SEQ ID NO: 4637177 - DNA, 18 bp, Homo sapiens
gtccctatatcagggcct

SEQ ID NO: 4637178 - DNA, 20 bp, Homo sapiens
gtccctatatcagggcctga

SEQ ID NO: 4637179 - DNA, 13 bp, Homo sapiens
gtccctctctctg

SEQ ID NO: 4637180 - DNA, 22 bp, Homo sapiens
gtccctgagatttaacccctcc

SEQ ID NO: 4637181 - DNA, 12 bp, Homo sapiens
gtccctgcaggg

SEQ ID NO: 4637182 - DNA, 13 bp, Homo sapiens
gtccctgcagggc

SEQ ID NO: 4637183 - DNA, 16 bp, Homo sapiens
gtccctgcagggccat

SEQ ID NO: 4637184 - DNA, 21 bp, Homo sapiens
gtccctgcagggccatctgac

SEQ ID NO: 4637185 - DNA, 14 bp, Homo sapiens
gtccctgggccagg

SEQ ID NO: 4637186 - DNA, 18 bp, Homo sapiens
gtccctgggccagggtct

SEQ ID NO: 4637187 - DNA, 20 bp, Homo sapiens
gtccctgtccctctagtgcc

SEQ ID NO: 4637188 - DNA, 20 bp, Homo sapiens
gtccgtgcgggaaattcagt

SEQ ID NO: 4637189 - DNA, 17 bp, Homo sapiens
gtcctaaagaagacatt

SEQ ID NO: 4637190 - DNA, 20 bp, Homo sapiens
gtcctaaagaagacattttc

SEQ ID NO: 4637191 - DNA, 21 bp, Homo sapiens
gtcctagccaggtctcctggg

SEQ ID NO: 4637192 - DNA, 23 bp, Homo sapiens
gtcctagccaggtctcctgggaa

SEQ ID NO: 4637193 - DNA, 20 bp, Homo sapiens
gtcctctgtcagtcacagcc

SEQ ID NO: 4637194 - DNA, 13 bp, Homo sapiens
gtcctcttctgca

SEQ ID NO: 4637195 - DNA, 15 bp, Homo sapiens
gtcctgaccaggatg

SEQ ID NO: 4637196 - DNA, 21 bp, Homo sapiens
gtcctgagcactgccaggagg

SEQ ID NO: 4637197 - DNA, 21 bp, Homo sapiens
gtcctgcagcaaacactccac

SEQ ID NO: 4637198 - DNA, 23 bp, Homo sapiens
gtcctgcagcaaacactccaccc

SEQ ID NO: 4637199 - DNA, 22 bp, Homo sapiens
gtcctgccttcttccttgaggg

SEQ ID NO: 4637200 - DNA, 18 bp, Homo sapiens
gtcctggcacagaagagg

SEQ ID NO: 4637201 - DNA, 21 bp, Homo sapiens
gtcctggcacagaagaggagt

SEQ ID NO: 4637202 - DNA, 18 bp, Homo sapiens
gtcctggtggggcagctc

SEQ ID NO: 4637203 - DNA, 20 bp, Homo sapiens
gtcctggtggggcagctcct

SEQ ID NO: 4637204 - DNA, 22 bp, Homo sapiens
gtcctggtggggcagctcctct

SEQ ID NO: 4637205 - DNA, 21 bp, Homo sapiens
gtcctgtagttgcgtggactc

SEQ ID NO: 4637206 - DNA, 18 bp, Homo sapiens
gtccttactcctgtggga

SEQ ID NO: 4637207 - DNA, 23 bp, Homo sapiens
gtccttactcctgtgggagcctc

SEQ ID NO: 4637208 - DNA, 17 bp, Homo sapiens
gtccttaggcctctgag

SEQ ID NO: 4637209 - DNA, 13 bp, Homo sapiens
gtccttcaaaggc

SEQ ID NO: 4637210 - DNA, 23 bp, Homo sapiens
gtccttggactgttttgaaaagt

SEQ ID NO: 4637211 - DNA, 15 bp, Homo sapiens
gtccttggctgccgt

SEQ ID NO: 4637212 - DNA, 22 bp, Homo sapiens
gtcctttcaattccaccagggc

SEQ ID NO: 4637213 - DNA, 20 bp, Homo sapiens
gtcctttcccaccattcctg

SEQ ID NO: 4637214 - DNA, 15 bp, Homo sapiens
gtcctttgaggcccc

SEQ ID NO: 4637215 - DNA, 14 bp, Homo sapiens
gtcgatgaactatt

SEQ ID NO: 4637216 - DNA, 21 bp, Homo sapiens
gtcgccacacgcctctgtgta

SEQ ID NO: 4637217 - DNA, 15 bp, Homo sapiens
gtcgcccctcagagc

SEQ ID NO: 4637218 - DNA, 14 bp, Homo sapiens
gtcggccccatctc

SEQ ID NO: 4637219 - DNA, 13 bp, Homo sapiens
gtcggtggctgtc

SEQ ID NO: 4637220 - DNA, 15 bp, Homo sapiens
gtcgtagaattcctt

SEQ ID NO: 4637221 - DNA, 19 bp, Homo sapiens
gtcgtggagagctaggagc

SEQ ID NO: 4637222 - DNA, 23 bp, Homo sapiens
gtctaacacaccactttctgctt

SEQ ID NO: 4637223 - DNA, 22 bp, Homo sapiens
gtctaccctgggattcaggaaa

SEQ ID NO: 4637224 - DNA, 14 bp, Homo sapiens
gtctagaccagggc

SEQ ID NO: 4637225 - DNA, 14 bp, Homo sapiens
gtctagtttcctgg

SEQ ID NO: 4637226 - DNA, 16 bp, Homo sapiens
gtctatgttcaaagac

SEQ ID NO: 4637227 - DNA, 17 bp, Homo sapiens
gtctcaaaataaagcaa

SEQ ID NO: 4637228 - DNA, 18 bp, Homo sapiens
gtctcaaaataaagcaat

SEQ ID NO: 4637229 - DNA, 14 bp, Homo sapiens
gtctcattctcaga

SEQ ID NO: 4637230 - DNA, 15 bp, Homo sapiens
gtctcattgtcacct

SEQ ID NO: 4637231 - DNA, 20 bp, Homo sapiens
gtctccaggggcctgcagaa

SEQ ID NO: 4637232 - DNA, 18 bp, Homo sapiens
gtctcctaggggcttggt

SEQ ID NO: 4637233 - DNA, 21 bp, Homo sapiens
gtctcctaggggcttggtcct

SEQ ID NO: 4637234 - DNA, 22 bp, Homo sapiens
gtctcctatatatttctattat

SEQ ID NO: 4637235 - DNA, 15 bp, Homo sapiens
gtctcctctccattt

SEQ ID NO: 4637236 - DNA, 20 bp, Homo sapiens
gtctcgagcgccctgcagac

SEQ ID NO: 4637237 - DNA, 21 bp, Homo sapiens
gtctcggatgacaccctggcc

SEQ ID NO: 4637238 - DNA, 19 bp, Homo sapiens
gtctcgtggtaggactgta

SEQ ID NO: 4637239 - DNA, 15 bp, Homo sapiens
gtctctccctcaggt

SEQ ID NO: 4637240 - DNA, 19 bp, Homo sapiens
gtctctggctactccctgg

SEQ ID NO: 4637241 - DNA, 20 bp, Homo sapiens
gtctctggctactccctgga

SEQ ID NO: 4637242 - DNA, 20 bp, Homo sapiens
gtctctgttgactggctgtg

SEQ ID NO: 4637243 - DNA, 14 bp, Homo sapiens
gtctgaagcccaaa

SEQ ID NO: 4637244 - DNA, 16 bp, Homo sapiens
gtctgaagcccaaagc

SEQ ID NO: 4637245 - DNA, 21 bp, Homo sapiens
gtctgaagcccaaagcctgag

SEQ ID NO: 4637246 - DNA, 20 bp, Homo sapiens
gtctgacagtagctcttaga

SEQ ID NO: 4637247 - DNA, 14 bp, Homo sapiens
gtctgaggtcctga

SEQ ID NO: 4637248 - DNA, 15 bp, Homo sapiens
gtctgaggtcctgag

SEQ ID NO: 4637249 - DNA, 17 bp, Homo sapiens
gtctgaggtcctgagca

SEQ ID NO: 4637250 - DNA, 21 bp, Homo sapiens
gtctgaggtcctgagcactgc

SEQ ID NO: 4637251 - DNA, 14 bp, Homo sapiens
gtctgcctcctgct

SEQ ID NO: 4637252 - DNA, 16 bp, Homo sapiens
gtctgcctcctgcttt

SEQ ID NO: 4637253 - DNA, 14 bp, Homo sapiens
gtctggactgctat

SEQ ID NO: 4637254 - DNA, 12 bp, Homo sapiens
gtctggcagcct

SEQ ID NO: 4637255 - DNA, 15 bp, Homo sapiens
gtctggcagggcagc

SEQ ID NO: 4637256 - DNA, 17 bp, Homo sapiens
gtctggcagggcagcag

SEQ ID NO: 4637257 - DNA, 22 bp, Homo sapiens
gtctggcagggcagcaggaggc

SEQ ID NO: 4637258 - DNA, 18 bp, Homo sapiens
gtctggctccctgcccct

SEQ ID NO: 4637259 - DNA, 21 bp, Homo sapiens
gtctgggagaaattgacagat

SEQ ID NO: 4637260 - DNA, 20 bp, Homo sapiens
gtctgggagtatacggaaac

SEQ ID NO: 4637261 - DNA, 16 bp, Homo sapiens
gtctgggtccatcctg

SEQ ID NO: 4637262 - DNA, 21 bp, Homo sapiens
gtctgtacacgtgtcctgtag

SEQ ID NO: 4637263 - DNA, 16 bp, Homo sapiens
gtctgtaggtgaaaga

SEQ ID NO: 4637264 - DNA, 16 bp, Homo sapiens
gtctgtatcactctgt

SEQ ID NO: 4637265 - DNA, 13 bp, Homo sapiens
gtctgtgtgaatg

SEQ ID NO: 4637266 - DNA, 19 bp, Homo sapiens
gtctgttaccttgttaata

SEQ ID NO: 4637267 - DNA, 16 bp, Homo sapiens
gtctgtttcccaagct

SEQ ID NO: 4637268 - DNA, 15 bp, Homo sapiens
gtcttactactttaa

SEQ ID NO: 4637269 - DNA, 20 bp, Homo sapiens
gtcttactactttaaatcct

SEQ ID NO: 4637270 - DNA, 14 bp, Homo sapiens
gtcttagactgcta

SEQ ID NO: 4637271 - DNA, 13 bp, Homo sapiens
gtcttagctttac

SEQ ID NO: 4637272 - DNA, 15 bp, Homo sapiens
gtcttagctttacat

SEQ ID NO: 4637273 - DNA, 20 bp, Homo sapiens
gtcttagctttacattttca

SEQ ID NO: 4637274 - DNA, 18 bp, Homo sapiens
gtcttaggtcttcctgtg

SEQ ID NO: 4637275 - DNA, 19 bp, Homo sapiens
gtcttatgtgaaaaattaa

SEQ ID NO: 4637276 - DNA, 19 bp, Homo sapiens
gtcttcctgtggctccctc

SEQ ID NO: 4637277 - DNA, 24 bp, Homo sapiens
gtcttcctgtggctccctctctcc

SEQ ID NO: 4637278 - DNA, 16 bp, Homo sapiens
gtcttgtggttgtgtg

SEQ ID NO: 4637279 - DNA, 18 bp, Homo sapiens
gtcttgtggttgtgtgtg

SEQ ID NO: 4637280 - DNA, 19 bp, Homo sapiens
gtcttgtgtatttctctgt

SEQ ID NO: 4637281 - DNA, 22 bp, Homo sapiens
gtcttgtgtatttctctgtgaa

SEQ ID NO: 4637282 - DNA, 11 bp, Homo sapiens
gtctttcagta

SEQ ID NO: 4637283 - DNA, 22 bp, Homo sapiens
gtctttcagtacttttttaaat

SEQ ID NO: 4637284 - DNA, 18 bp, Homo sapiens
gtctttcccccaggaaaa

SEQ ID NO: 4637285 - DNA, 22 bp, Homo sapiens
gtctttgcggggcctgtctcag

SEQ ID NO: 4637286 - DNA, 18 bp, Homo sapiens
gtgaaacagttgctgtga

SEQ ID NO: 4637287 - DNA, 17 bp, Homo sapiens
gtgaaagaaagggaccc

SEQ ID NO: 4637288 - DNA, 19 bp, Homo sapiens
gtgaaataacaaaatggac

SEQ ID NO: 4637289 - DNA, 16 bp, Homo sapiens
gtgaaatctgtctttg

SEQ ID NO: 4637290 - DNA, 17 bp, Homo sapiens
gtgaacaaagcagccac

SEQ ID NO: 4637291 - DNA, 17 bp, Homo sapiens
gtgaacagagagaccct

SEQ ID NO: 4637292 - DNA, 15 bp, Homo sapiens
gtgaacccaggacaa

SEQ ID NO: 4637293 - DNA, 12 bp, Homo sapiens
gtgaactctccc

SEQ ID NO: 4637294 - DNA, 16 bp, Homo sapiens
gtgaactgacaggcag

SEQ ID NO: 4637295 - DNA, 12 bp, Homo sapiens
gtgaactgtgtg

SEQ ID NO: 4637296 - DNA, 21 bp, Homo sapiens
gtgaactgtgtgtgaatctgc

SEQ ID NO: 4637297 - DNA, 19 bp, Homo sapiens
gtgaacttggctttcctgt

SEQ ID NO: 4637298 - DNA, 20 bp, Homo sapiens
gtgaagccaattcagacagg

SEQ ID NO: 4637299 - DNA, 20 bp, Homo sapiens
gtgaaggcctcgcaggaaga

SEQ ID NO: 4637300 - DNA, 18 bp, Homo sapiens
gtgaagggaagagacagc

SEQ ID NO: 4637301 - DNA, 17 bp, Homo sapiens
gtgaaggtcctgctatt

SEQ ID NO: 4637302 - DNA, 23 bp, Homo sapiens
gtgaagtacaataattcatattc

SEQ ID NO: 4637303 - DNA, 19 bp, Homo sapiens
gtgaagtttaattgactta

SEQ ID NO: 4637304 - DNA, 13 bp, Homo sapiens
gtgaataaagtgc

SEQ ID NO: 4637305 - DNA, 14 bp, Homo sapiens
gtgaataaagtgct

SEQ ID NO: 4637306 - DNA, 16 bp, Homo sapiens
gtgaatcacgtaaagc

SEQ ID NO: 4637307 - DNA, 18 bp, Homo sapiens
gtgaatccatgggtctgg

SEQ ID NO: 4637308 - DNA, 12 bp, Homo sapiens
gtgaattttcaa

SEQ ID NO: 4637309 - DNA, 19 bp, Homo sapiens
gtgacagactcctgaggac

SEQ ID NO: 4637310 - DNA, 19 bp, Homo sapiens
gtgacagggccagtggggc

SEQ ID NO: 4637311 - DNA, 20 bp, Homo sapiens
gtgacagggccagtggggcc

SEQ ID NO: 4637312 - DNA, 22 bp, Homo sapiens
gtgacagtcatcatcagggcct

SEQ ID NO: 4637313 - DNA, 13 bp, Homo sapiens
gtgacagtgaaat

SEQ ID NO: 4637314 - DNA, 14 bp, Homo sapiens
gtgacagtttccaa

SEQ ID NO: 4637315 - DNA, 14 bp, Homo sapiens
gtgacccacatgcc

SEQ ID NO: 4637316 - DNA, 14 bp, Homo sapiens
gtgaccccagggca

SEQ ID NO: 4637317 - DNA, 21 bp, Homo sapiens
gtgaccccagggcacaggagc

SEQ ID NO: 4637318 - DNA, 22 bp, Homo sapiens
gtgaccccagggcacaggagct

SEQ ID NO: 4637319 - DNA, 23 bp, Homo sapiens
gtgaccccagggcacaggagcta

SEQ ID NO: 4637320 - DNA, 16 bp, Homo sapiens
gtgacccccagctccg

SEQ ID NO: 4637321 - DNA, 23 bp, Homo sapiens
gtgacccggcaccccctgcagct

SEQ ID NO: 4637322 - DNA, 18 bp, Homo sapiens
gtgacctccttctgcaaa

SEQ ID NO: 4637323 - DNA, 14 bp, Homo sapiens
gtgacctgctgagc

SEQ ID NO: 4637324 - DNA, 20 bp, Homo sapiens
gtgacctgctgagctctgag

SEQ ID NO: 4637325 - DNA, 14 bp, Homo sapiens
gtgactcctgctgg

SEQ ID NO: 4637326 - DNA, 15 bp, Homo sapiens
gtgactcctgctggt

SEQ ID NO: 4637327 - DNA, 22 bp, Homo sapiens
gtgactcctgctggtacctgcc

SEQ ID NO: 4637328 - DNA, 14 bp, Homo sapiens
gtgactctgaagct

SEQ ID NO: 4637329 - DNA, 18 bp, Homo sapiens
gtgacttctgctgctggc

SEQ ID NO: 4637330 - DNA, 18 bp, Homo sapiens
gtgacttgtctgcctcct

SEQ ID NO: 4637331 - DNA, 19 bp, Homo sapiens
gtgacttgtctgcctcctg

SEQ ID NO: 4637332 - DNA, 21 bp, Homo sapiens
gtgacttgtctgcctcctgct

SEQ ID NO: 4637333 - DNA, 21 bp, Homo sapiens
gtgagaaatagctgaaaaggg

SEQ ID NO: 4637334 - DNA, 19 bp, Homo sapiens
gtgagaagatcattgccat

SEQ ID NO: 4637335 - DNA, 17 bp, Homo sapiens
gtgagagaaagagagaa

SEQ ID NO: 4637336 - DNA, 18 bp, Homo sapiens
gtgagagaaagagagaag

SEQ ID NO: 4637337 - DNA, 22 bp, Homo sapiens
gtgagagaaagagagaagccag

SEQ ID NO: 4637338 - DNA, 18 bp, Homo sapiens
gtgagagacctctgccta

SEQ ID NO: 4637339 - DNA, 15 bp, Homo sapiens
gtgagaggcccccac

SEQ ID NO: 4637340 - DNA, 16 bp, Homo sapiens
gtgagaggcccccacc

SEQ ID NO: 4637341 - DNA, 16 bp, Homo sapiens
gtgagatgcagctgga

SEQ ID NO: 4637342 - DNA, 23 bp, Homo sapiens
gtgagatttaagttcctgctgcc

SEQ ID NO: 4637343 - DNA, 19 bp, Homo sapiens
gtgagcagggtcaagcctc

SEQ ID NO: 4637344 - DNA, 23 bp, Homo sapiens
gtgagcatacctgtctcagctgt

SEQ ID NO: 4637345 - DNA, 18 bp, Homo sapiens
gtgagcccagctgggtca

SEQ ID NO: 4637346 - DNA, 20 bp, Homo sapiens
gtgagcccagctgggtcagg

SEQ ID NO: 4637347 - DNA, 12 bp, Homo sapiens
gtgagctgggga

SEQ ID NO: 4637348 - DNA, 23 bp, Homo sapiens
gtgaggacacccaggaatgaccc

SEQ ID NO: 4637349 - DNA, 17 bp, Homo sapiens
gtgaggatgagacccag

SEQ ID NO: 4637350 - DNA, 15 bp, Homo sapiens
gtgaggtgttgcagc

SEQ ID NO: 4637351 - DNA, 18 bp, Homo sapiens
gtgagtatttctgttcct

SEQ ID NO: 4637352 - DNA, 22 bp, Homo sapiens
gtgagtgggagagtacctgtgt

SEQ ID NO: 4637353 - DNA, 15 bp, Homo sapiens
gtgagtgtgacaggg

SEQ ID NO: 4637354 - DNA, 17 bp, Homo sapiens
gtgagtgtgacagggcc

SEQ ID NO: 4637355 - DNA, 19 bp, Homo sapiens
gtgagtgtgacagggccag

SEQ ID NO: 4637356 - DNA, 20 bp, Homo sapiens
gtgagtgtgacagggccagt

SEQ ID NO: 4637357 - DNA, 12 bp, Homo sapiens
gtgatacagttt

SEQ ID NO: 4637358 - DNA, 17 bp, Homo sapiens
gtgatcaatatttttat

SEQ ID NO: 4637359 - DNA, 15 bp, Homo sapiens
gtgatcaggccccac

SEQ ID NO: 4637360 - DNA, 21 bp, Homo sapiens
gtgatcaggccccacccctgt

SEQ ID NO: 4637361 - DNA, 21 bp, Homo sapiens
gtgatccgcccacctcagcct

SEQ ID NO: 4637362 - DNA, 16 bp, Homo sapiens
gtgatgagggcagcag

SEQ ID NO: 4637363 - DNA, 17 bp, Homo sapiens
gtgatgagggcagcagc

SEQ ID NO: 4637364 - DNA, 20 bp, Homo sapiens
gtgatgagggcagcagccag

SEQ ID NO: 4637365 - DNA, 21 bp, Homo sapiens
gtgatgagggcagcagccagc

SEQ ID NO: 4637366 - DNA, 22 bp, Homo sapiens
gtgatgagggcagcagccagcc

SEQ ID NO: 4637367 - DNA, 14 bp, Homo sapiens
gtgatggaggggag

SEQ ID NO: 4637368 - DNA, 21 bp, Homo sapiens
gtgatgtggaggaagagccac

SEQ ID NO: 4637369 - DNA, 18 bp, Homo sapiens
gtgattttaactctgtct

SEQ ID NO: 4637370 - DNA, 20 bp, Homo sapiens
gtgattttcctttgtagcta

SEQ ID NO: 4637371 - DNA, 16 bp, Homo sapiens
gtgattttgctgtaga

SEQ ID NO: 4637372 - DNA, 23 bp, Homo sapiens
gtgcaacctcttggcctgatcag

SEQ ID NO: 4637373 - DNA, 23 bp, Homo sapiens
gtgcaagttcatgtgtggaaatg

SEQ ID NO: 4637374 - DNA, 18 bp, Homo sapiens
gtgcaattccaagaaaat

SEQ ID NO: 4637375 - DNA, 19 bp, Homo sapiens
gtgcaattccaagaaaata

SEQ ID NO: 4637376 - DNA, 14 bp, Homo sapiens
gtgcacaaagtggc

SEQ ID NO: 4637377 - DNA, 21 bp, Homo sapiens
gtgcacaaagtggcataaaaa

SEQ ID NO: 4637378 - DNA, 21 bp, Homo sapiens
gtgcacaaatacaaagtggaa

SEQ ID NO: 4637379 - DNA, 14 bp, Homo sapiens
gtgcacaggagggg

SEQ ID NO: 4637380 - DNA, 22 bp, Homo sapiens
gtgcacatatccaggcaccagg

SEQ ID NO: 4637381 - DNA, 19 bp, Homo sapiens
gtgcactgcccatggacag

SEQ ID NO: 4637382 - DNA, 20 bp, Homo sapiens
gtgcactgcccatggacagg

SEQ ID NO: 4637383 - DNA, 14 bp, Homo sapiens
gtgcagagcagaca

SEQ ID NO: 4637384 - DNA, 15 bp, Homo sapiens
gtgcagggcctggca

SEQ ID NO: 4637385 - DNA, 19 bp, Homo sapiens
gtgcagggcctggcataga

SEQ ID NO: 4637386 - DNA, 21 bp, Homo sapiens
gtgcaggggatggggtggggg

SEQ ID NO: 4637387 - DNA, 12 bp, Homo sapiens
gtgcagtctggg

SEQ ID NO: 4637388 - DNA, 16 bp, Homo sapiens
gtgcagtggagggggc

SEQ ID NO: 4637389 - DNA, 16 bp, Homo sapiens
gtgcatgtatgtcttg

SEQ ID NO: 4637390 - DNA, 13 bp, Homo sapiens
gtgcattcctgaa

SEQ ID NO: 4637391 - DNA, 15 bp, Homo sapiens
gtgccaactcctcac

SEQ ID NO: 4637392 - DNA, 22 bp, Homo sapiens
gtgccaagtccaggtcctggtg

SEQ ID NO: 4637393 - DNA, 20 bp, Homo sapiens
gtgccacccagtagcccaga

SEQ ID NO: 4637394 - DNA, 12 bp, Homo sapiens
gtgccagagcct

SEQ ID NO: 4637395 - DNA, 15 bp, Homo sapiens
gtgccagagcctggg

SEQ ID NO: 4637396 - DNA, 19 bp, Homo sapiens
gtgccataccttctcccag

SEQ ID NO: 4637397 - DNA, 17 bp, Homo sapiens
gtgccatagtcacatgg

SEQ ID NO: 4637398 - DNA, 23 bp, Homo sapiens
gtgccatgctgggccactgggga

SEQ ID NO: 4637399 - DNA, 21 bp, Homo sapiens
gtgcccggtgcagggcctggc

SEQ ID NO: 4637400 - DNA, 22 bp, Homo sapiens
gtgcccggtgcagggcctggca

SEQ ID NO: 4637401 - DNA, 13 bp, Homo sapiens
gtgccctgtgtgt

SEQ ID NO: 4637402 - DNA, 18 bp, Homo sapiens
gtgccgtgtgagtgtgac

SEQ ID NO: 4637403 - DNA, 21 bp, Homo sapiens
gtgccgtgtgagtgtgacagg

SEQ ID NO: 4637404 - DNA, 20 bp, Homo sapiens
gtgcctcgctccccactctg

SEQ ID NO: 4637405 - DNA, 23 bp, Homo sapiens
gtgcctgaaagctgggagcgtgg

SEQ ID NO: 4637406 - DNA, 15 bp, Homo sapiens
gtgcctgattatttt

SEQ ID NO: 4637407 - DNA, 19 bp, Homo sapiens
gtgcctgcacatcatgagc

SEQ ID NO: 4637408 - DNA, 15 bp, Homo sapiens
gtgcctggcctggca

SEQ ID NO: 4637409 - DNA, 20 bp, Homo sapiens
gtgcctgtctgttacactgg

SEQ ID NO: 4637410 - DNA, 15 bp, Homo sapiens
gtgcgtaaggatgtg

SEQ ID NO: 4637411 - DNA, 20 bp, Homo sapiens
gtgctacgtgtgaaatctgt

SEQ ID NO: 4637412 - DNA, 23 bp, Homo sapiens
gtgctacgtgtgaaatctgtctt

SEQ ID NO: 4637413 - DNA, 19 bp, Homo sapiens
gtgctcagaataaggcagg

SEQ ID NO: 4637414 - DNA, 22 bp, Homo sapiens
gtgctccatatttgatttctaa

SEQ ID NO: 4637415 - DNA, 19 bp, Homo sapiens
gtgctgcggagcaagagga

SEQ ID NO: 4637416 - DNA, 20 bp, Homo sapiens
gtgctggctcacagtacagc

SEQ ID NO: 4637417 - DNA, 23 bp, Homo sapiens
gtgctgggggaatgagcccagag

SEQ ID NO: 4637418 - DNA, 17 bp, Homo sapiens
gtgctgtcttttgttct

SEQ ID NO: 4637419 - DNA, 14 bp, Homo sapiens
gtgcttgagccagg

SEQ ID NO: 4637420 - DNA, 17 bp, Homo sapiens
gtgcttggagggggaag

SEQ ID NO: 4637421 - DNA, 14 bp, Homo sapiens
gtgctttaaagata

SEQ ID NO: 4637422 - DNA, 12 bp, Homo sapiens
gtgcttttctgt

SEQ ID NO: 4637423 - DNA, 16 bp, Homo sapiens
gtggaacatctataga

SEQ ID NO: 4637424 - DNA, 20 bp, Homo sapiens
gtggaaggcagacagcaggc

SEQ ID NO: 4637425 - DNA, 18 bp, Homo sapiens
gtggaagttccaagtcca

SEQ ID NO: 4637426 - DNA, 18 bp, Homo sapiens
gtggaatgagtgtgcatg

SEQ ID NO: 4637427 - DNA, 15 bp, Homo sapiens
gtggactcagggcag

SEQ ID NO: 4637428 - DNA, 16 bp, Homo sapiens
gtggactcagggcagc

SEQ ID NO: 4637429 - DNA, 21 bp, Homo sapiens
gtggagatcacagccccaccc

SEQ ID NO: 4637430 - DNA, 15 bp, Homo sapiens
gtggaggaagagcca

SEQ ID NO: 4637431 - DNA, 17 bp, Homo sapiens
gtggaggaagagccacc

SEQ ID NO: 4637432 - DNA, 13 bp, Homo sapiens
gtggaggctgctc

SEQ ID NO: 4637433 - DNA, 22 bp, Homo sapiens
gtggagggaaggataaagccac

SEQ ID NO: 4637434 - DNA, 19 bp, Homo sapiens
gtggatccaatgttagaga

SEQ ID NO: 4637435 - DNA, 12 bp, Homo sapiens
gtggatgggcaa

SEQ ID NO: 4637436 - DNA, 20 bp, Homo sapiens
gtggcacttccacctccagc

SEQ ID NO: 4637437 - DNA, 22 bp, Homo sapiens
gtggcacttccacctccagcct

SEQ ID NO: 4637438 - DNA, 13 bp, Homo sapiens
gtggcagggaccg

SEQ ID NO: 4637439 - DNA, 20 bp, Homo sapiens
gtggcagggaccggcagagc

SEQ ID NO: 4637440 - DNA, 22 bp, Homo sapiens
gtggcagggggccccgccaggg

SEQ ID NO: 4637441 - DNA, 23 bp, Homo sapiens
gtggcagggggccccgccagggc

SEQ ID NO: 4637442 - DNA, 14 bp, Homo sapiens
gtggcccttcctgg

SEQ ID NO: 4637443 - DNA, 16 bp, Homo sapiens
gtggcccttcctggac

SEQ ID NO: 4637444 - DNA, 17 bp, Homo sapiens
gtggcccttcctggaca

SEQ ID NO: 4637445 - DNA, 19 bp, Homo sapiens
gtggcctccctgctgtgcc

SEQ ID NO: 4637446 - DNA, 22 bp, Homo sapiens
gtggcctccctgctgtgccatg

SEQ ID NO: 4637447 - DNA, 13 bp, Homo sapiens
gtggcctctttgt

SEQ ID NO: 4637448 - DNA, 15 bp, Homo sapiens
gtggctactctgtgc

SEQ ID NO: 4637449 - DNA, 16 bp, Homo sapiens
gtggctactctgtgcc

SEQ ID NO: 4637450 - DNA, 20 bp, Homo sapiens
gtggctactctgtgccagag

SEQ ID NO: 4637451 - DNA, 19 bp, Homo sapiens
gtggctccctctctcctgg

SEQ ID NO: 4637452 - DNA, 23 bp, Homo sapiens
gtggcttcactcctgctgtaaat

SEQ ID NO: 4637453 - DNA, 18 bp, Homo sapiens
gtgggacacaacacagat

SEQ ID NO: 4637454 - DNA, 21 bp, Homo sapiens
gtgggacagcccagagcctgg

SEQ ID NO: 4637455 - DNA, 22 bp, Homo sapiens
gtgggactgtggtgacttctgc

SEQ ID NO: 4637456 - DNA, 11 bp, Homo sapiens
gtgggagcctc

SEQ ID NO: 4637457 - DNA, 13 bp, Homo sapiens
gtgggagctgagc

SEQ ID NO: 4637458 - DNA, 16 bp, Homo sapiens
gtgggattacaggtgt

SEQ ID NO: 4637459 - DNA, 18 bp, Homo sapiens
gtgggccaccgtgcctgg

SEQ ID NO: 4637460 - DNA, 22 bp, Homo sapiens
gtgggccaccgtgcctggctga

SEQ ID NO: 4637461 - DNA, 19 bp, Homo sapiens
gtgggccagggctgccctg

SEQ ID NO: 4637462 - DNA, 17 bp, Homo sapiens
gtgggccccgggctgga

SEQ ID NO: 4637463 - DNA, 13 bp, Homo sapiens
gtgggcctggccc

SEQ ID NO: 4637464 - DNA, 23 bp, Homo sapiens
gtgggcgggcaggggagggtcag

SEQ ID NO: 4637465 - DNA, 17 bp, Homo sapiens
gtggggcagctcctctg

SEQ ID NO: 4637466 - DNA, 13 bp, Homo sapiens
gtggggcctgtgg

SEQ ID NO: 4637467 - DNA, 18 bp, Homo sapiens
gtgggggcttccaggtgg

SEQ ID NO: 4637468 - DNA, 20 bp, Homo sapiens
gtggggtcaagctgagctgg

SEQ ID NO: 4637469 - DNA, 23 bp, Homo sapiens
gtggggtcaagctgagctggctt

SEQ ID NO: 4637470 - DNA, 14 bp, Homo sapiens
gtgggtctctgaag

SEQ ID NO: 4637471 - DNA, 18 bp, Homo sapiens
gtgggtctctgtgtgtgt

SEQ ID NO: 4637472 - DNA, 13 bp, Homo sapiens
gtgggtgctcaga

SEQ ID NO: 4637473 - DNA, 14 bp, Homo sapiens
gtgggtgctcagaa

SEQ ID NO: 4637474 - DNA, 14 bp, Homo sapiens
gtgggtgtagccag

SEQ ID NO: 4637475 - DNA, 12 bp, Homo sapiens
gtggtctcagga

SEQ ID NO: 4637476 - DNA, 22 bp, Homo sapiens
gtggtctgattttgaggtttag

SEQ ID NO: 4637477 - DNA, 11 bp, Homo sapiens
gtggtgcattc

SEQ ID NO: 4637478 - DNA, 13 bp, Homo sapiens
gtggtggcatttt

SEQ ID NO: 4637479 - DNA, 17 bp, Homo sapiens
gtggttgcagtctttcc

SEQ ID NO: 4637480 - DNA, 13 bp, Homo sapiens
gtggttgcctggg

SEQ ID NO: 4637481 - DNA, 22 bp, Homo sapiens
gtgtaataagacttagattgtg

SEQ ID NO: 4637482 - DNA, 12 bp, Homo sapiens
gtgtacaaattg

SEQ ID NO: 4637483 - DNA, 21 bp, Homo sapiens
gtgtacatgtgtgcagagcag

SEQ ID NO: 4637484 - DNA, 21 bp, Homo sapiens
gtgtactcccagggcttacgg

SEQ ID NO: 4637485 - DNA, 23 bp, Homo sapiens
gtgtagccaggtatggctctgca

SEQ ID NO: 4637486 - DNA, 21 bp, Homo sapiens
gtgtagcctaaagggcagggc

SEQ ID NO: 4637487 - DNA, 18 bp, Homo sapiens
gtgtagctgtaagggcag

SEQ ID NO: 4637488 - DNA, 22 bp, Homo sapiens
gtgtagctgtaagggcagtgcc

SEQ ID NO: 4637489 - DNA, 18 bp, Homo sapiens
gtgtagctgtgacctgct

SEQ ID NO: 4637490 - DNA, 21 bp, Homo sapiens
gtgtagctgtgacctgctgag

SEQ ID NO: 4637491 - DNA, 23 bp, Homo sapiens
gtgtagctgtgacctgctgagct

SEQ ID NO: 4637492 - DNA, 15 bp, Homo sapiens
gtgtagttccctctg

SEQ ID NO: 4637493 - DNA, 15 bp, Homo sapiens
gtgtatttctctgtg

SEQ ID NO: 4637494 - DNA, 12 bp, Homo sapiens
gtgtcacctcct

SEQ ID NO: 4637495 - DNA, 15 bp, Homo sapiens
gtgtcacctccttcc

SEQ ID NO: 4637496 - DNA, 16 bp, Homo sapiens
gtgtcacctccttccc

SEQ ID NO: 4637497 - DNA, 21 bp, Homo sapiens
gtgtcacctccttccccagct

SEQ ID NO: 4637498 - DNA, 22 bp, Homo sapiens
gtgtcacctccttccccagctc

SEQ ID NO: 4637499 - DNA, 13 bp, Homo sapiens
gtgtcataaactt

SEQ ID NO: 4637500 - DNA, 18 bp, Homo sapiens
gtgtccctctctctggaa

SEQ ID NO: 4637501 - DNA, 16 bp, Homo sapiens
gtgtcctgcccatgcc

SEQ ID NO: 4637502 - DNA, 20 bp, Homo sapiens
gtgtctatgatgttgctgtt

SEQ ID NO: 4637503 - DNA, 13 bp, Homo sapiens
gtgtctgaatcat

SEQ ID NO: 4637504 - DNA, 19 bp, Homo sapiens
gtgtctgaatcatgtctgt

SEQ ID NO: 4637505 - DNA, 17 bp, Homo sapiens
gtgtctgagtggcttca

SEQ ID NO: 4637506 - DNA, 21 bp, Homo sapiens
gtgtctgggctcaagctttcc

SEQ ID NO: 4637507 - DNA, 12 bp, Homo sapiens
gtgtctgtacac

SEQ ID NO: 4637508 - DNA, 16 bp, Homo sapiens
gtgtctgtacacgtgt

SEQ ID NO: 4637509 - DNA, 21 bp, Homo sapiens
gtgtctgtacacgtgtcctgt

SEQ ID NO: 4637510 - DNA, 22 bp, Homo sapiens
gtgtctgtggttgcagtctttc

SEQ ID NO: 4637511 - DNA, 19 bp, Homo sapiens
gtgtctttaaatgctgctt

SEQ ID NO: 4637512 - DNA, 15 bp, Homo sapiens
gtgtgaaatctgtct

SEQ ID NO: 4637513 - DNA, 23 bp, Homo sapiens
gtgtgaatgtgggcactggccca

SEQ ID NO: 4637514 - DNA, 18 bp, Homo sapiens
gtgtgacagggccagtgg

SEQ ID NO: 4637515 - DNA, 15 bp, Homo sapiens
gtgtgagtgtgacag

SEQ ID NO: 4637516 - DNA, 18 bp, Homo sapiens
gtgtgagtgtgacagggc

SEQ ID NO: 4637517 - DNA, 20 bp, Homo sapiens
gtgtgcagagcagacaggct

SEQ ID NO: 4637518 - DNA, 13 bp, Homo sapiens
gtgtggtgcattc

SEQ ID NO: 4637519 - DNA, 12 bp, Homo sapiens
gtgtggtggcct

SEQ ID NO: 4637520 - DNA, 23 bp, Homo sapiens
gtgtggtggcctcagctgaatgc

SEQ ID NO: 4637521 - DNA, 17 bp, Homo sapiens
gtgtgtactctgtccag

SEQ ID NO: 4637522 - DNA, 17 bp, Homo sapiens
gtgtgtgacaattctgt

SEQ ID NO: 4637523 - DNA, 13 bp, Homo sapiens
gtgtgtgtgtggc

SEQ ID NO: 4637524 - DNA, 21 bp, Homo sapiens
gtgttaacttgcctccatctt

SEQ ID NO: 4637525 - DNA, 22 bp, Homo sapiens
gtgttaacttgcctccatcttt

SEQ ID NO: 4637526 - DNA, 19 bp, Homo sapiens
gtgttactgctttgcaaag

SEQ ID NO: 4637527 - DNA, 17 bp, Homo sapiens
gtgttatcttttgaatt

SEQ ID NO: 4637528 - DNA, 21 bp, Homo sapiens
gtgttcagctctttccaaatt

SEQ ID NO: 4637529 - DNA, 21 bp, Homo sapiens
gtgttcgttgcacagctgttt

SEQ ID NO: 4637530 - DNA, 16 bp, Homo sapiens
gtgttgaaatggcatt

SEQ ID NO: 4637531 - DNA, 19 bp, Homo sapiens
gtgttgccacagtagaact

SEQ ID NO: 4637532 - DNA, 14 bp, Homo sapiens
gtgttgggagggat

SEQ ID NO: 4637533 - DNA, 19 bp, Homo sapiens
gtgtttcattacttgaatg

SEQ ID NO: 4637534 - DNA, 18 bp, Homo sapiens
gtgtttctatctctttct

SEQ ID NO: 4637535 - DNA, 16 bp, Homo sapiens
gtgtttctttagtttt

SEQ ID NO: 4637536 - DNA, 19 bp, Homo sapiens
gttaacttgcctccatctt

SEQ ID NO: 4637537 - DNA, 22 bp, Homo sapiens
gttaagagatcccttaagaagt

SEQ ID NO: 4637538 - DNA, 17 bp, Homo sapiens
gttaaggttcaagacag

SEQ ID NO: 4637539 - DNA, 16 bp, Homo sapiens
gttaataataattatt

SEQ ID NO: 4637540 - DNA, 17 bp, Homo sapiens
gttaataataattatta

SEQ ID NO: 4637541 - DNA, 22 bp, Homo sapiens
gttaatgctctatgtttgtatt

SEQ ID NO: 4637542 - DNA, 14 bp, Homo sapiens
gttaatttttctta

SEQ ID NO: 4637543 - DNA, 17 bp, Homo sapiens
gttacacatttttcaga

SEQ ID NO: 4637544 - DNA, 21 bp, Homo sapiens
gttaccactcttttgctgtgc

SEQ ID NO: 4637545 - DNA, 16 bp, Homo sapiens
gttactccagtgccaa

SEQ ID NO: 4637546 - DNA, 19 bp, Homo sapiens
gttactgcctataatctta

SEQ ID NO: 4637547 - DNA, 12 bp, Homo sapiens
gttactgctttg

SEQ ID NO: 4637548 - DNA, 13 bp, Homo sapiens
gttacttctctga

SEQ ID NO: 4637549 - DNA, 16 bp, Homo sapiens
gttagaaaatgactta

SEQ ID NO: 4637550 - DNA, 18 bp, Homo sapiens
gttagaaaattcagctcc

SEQ ID NO: 4637551 - DNA, 20 bp, Homo sapiens
gttagagacttttttctagt

SEQ ID NO: 4637552 - DNA, 21 bp, Homo sapiens
gttagagcccattaatcttga

SEQ ID NO: 4637553 - DNA, 22 bp, Homo sapiens
gttagagcccattaatcttgat

SEQ ID NO: 4637554 - DNA, 14 bp, Homo sapiens
gttagatctaccct

SEQ ID NO: 4637555 - DNA, 11 bp, Homo sapiens
gttagctttcc

SEQ ID NO: 4637556 - DNA, 19 bp, Homo sapiens
gttagtaatggcagagcag

SEQ ID NO: 4637557 - DNA, 16 bp, Homo sapiens
gttagtataagctttt

SEQ ID NO: 4637558 - DNA, 12 bp, Homo sapiens
gttatacaataa

SEQ ID NO: 4637559 - DNA, 16 bp, Homo sapiens
gttatacaataaccca

SEQ ID NO: 4637560 - DNA, 20 bp, Homo sapiens
gttatacaataacccagtta

SEQ ID NO: 4637561 - DNA, 17 bp, Homo sapiens
gttataccccatatatt

SEQ ID NO: 4637562 - DNA, 21 bp, Homo sapiens
gttatgtaaaaggccaaacct

SEQ ID NO: 4637563 - DNA, 21 bp, Homo sapiens
gttattaaacgtatgcatgtg

SEQ ID NO: 4637564 - DNA, 15 bp, Homo sapiens
gttattaaactgaat

SEQ ID NO: 4637565 - DNA, 15 bp, Homo sapiens
gttattattgttaat

SEQ ID NO: 4637566 - DNA, 19 bp, Homo sapiens
gttatttattttttaagaa

SEQ ID NO: 4637567 - DNA, 21 bp, Homo sapiens
gttattttaatacctttaaat

SEQ ID NO: 4637568 - DNA, 16 bp, Homo sapiens
gttcaactttcagaag

SEQ ID NO: 4637569 - DNA, 14 bp, Homo sapiens
gttcaataagcatt

SEQ ID NO: 4637570 - DNA, 19 bp, Homo sapiens
gttcacagcttttcttgat

SEQ ID NO: 4637571 - DNA, 22 bp, Homo sapiens
gttcacctccaagcatttcatg

SEQ ID NO: 4637572 - DNA, 19 bp, Homo sapiens
gttcacgtaatcctcctga

SEQ ID NO: 4637573 - DNA, 20 bp, Homo sapiens
gttcacgtaatcctcctgag

SEQ ID NO: 4637574 - DNA, 16 bp, Homo sapiens
gttcagacaagacaga

SEQ ID NO: 4637575 - DNA, 18 bp, Homo sapiens
gttcagctctttccaaat

SEQ ID NO: 4637576 - DNA, 15 bp, Homo sapiens
gttcagctgccccac

SEQ ID NO: 4637577 - DNA, 14 bp, Homo sapiens
gttcatacagtttt

SEQ ID NO: 4637578 - DNA, 22 bp, Homo sapiens
gttcatggcagatgtaggaggg

SEQ ID NO: 4637579 - DNA, 23 bp, Homo sapiens
gttcatgtcagcttatatgtgac

SEQ ID NO: 4637580 - DNA, 11 bp, Homo sapiens
gttcatttcac

SEQ ID NO: 4637581 - DNA, 19 bp, Homo sapiens
gttcattttgagtattttt

SEQ ID NO: 4637582 - DNA, 19 bp, Homo sapiens
gttcccaagctcagaggcg

SEQ ID NO: 4637583 - DNA, 17 bp, Homo sapiens
gttcccacaagcctgcc

SEQ ID NO: 4637584 - DNA, 21 bp, Homo sapiens
gttcccacaagcctgcctcgc

SEQ ID NO: 4637585 - DNA, 14 bp, Homo sapiens
gttcccacttggag

SEQ ID NO: 4637586 - DNA, 20 bp, Homo sapiens
gttccccaagggccctggca

SEQ ID NO: 4637587 - DNA, 13 bp, Homo sapiens
gttccccacccag

SEQ ID NO: 4637588 - DNA, 21 bp, Homo sapiens
gttccctatggagaggcttcc

SEQ ID NO: 4637589 - DNA, 13 bp, Homo sapiens
gttccctctgcct

SEQ ID NO: 4637590 - DNA, 15 bp, Homo sapiens
gttccctctgcctgg

SEQ ID NO: 4637591 - DNA, 13 bp, Homo sapiens
gttcccttcctct

SEQ ID NO: 4637592 - DNA, 20 bp, Homo sapiens
gttcccttcctcttcctgcc

SEQ ID NO: 4637593 - DNA, 21 bp, Homo sapiens
gttcccttcctcttcctgccc

SEQ ID NO: 4637594 - DNA, 22 bp, Homo sapiens
gttccgcttctctcttttaaag

SEQ ID NO: 4637595 - DNA, 15 bp, Homo sapiens
gttcctccccctgct

SEQ ID NO: 4637596 - DNA, 18 bp, Homo sapiens
gttcctcgttctccctgg

SEQ ID NO: 4637597 - DNA, 17 bp, Homo sapiens
gttcctgcagcagagcc

SEQ ID NO: 4637598 - DNA, 14 bp, Homo sapiens
gttcctgctgcctg

SEQ ID NO: 4637599 - DNA, 16 bp, Homo sapiens
gttcctgctgcctggg

SEQ ID NO: 4637600 - DNA, 22 bp, Homo sapiens
gttcctggacagatcaggctag

SEQ ID NO: 4637601 - DNA, 17 bp, Homo sapiens
gttcgcagccaccctga

SEQ ID NO: 4637602 - DNA, 18 bp, Homo sapiens
gttctacccgttccaaaa

SEQ ID NO: 4637603 - DNA, 18 bp, Homo sapiens
gttctcaacatactgtaa

SEQ ID NO: 4637604 - DNA, 21 bp, Homo sapiens
gttctctactccctcttgtca

SEQ ID NO: 4637605 - DNA, 17 bp, Homo sapiens
gttctgaaatgttctta

SEQ ID NO: 4637606 - DNA, 11 bp, Homo sapiens
gttctgtgcac

SEQ ID NO: 4637607 - DNA, 22 bp, Homo sapiens
gttctgttataccccatatatt

SEQ ID NO: 4637608 - DNA, 16 bp, Homo sapiens
gttcttaagacgtgat

SEQ ID NO: 4637609 - DNA, 20 bp, Homo sapiens
gttcttagagtgtagctgta

SEQ ID NO: 4637610 - DNA, 18 bp, Homo sapiens
gttcttagctttgaaact

SEQ ID NO: 4637611 - DNA, 19 bp, Homo sapiens
gttcttatgcaaaatggaa

SEQ ID NO: 4637612 - DNA, 22 bp, Homo sapiens
gttcttgggcctcaggctctgc

SEQ ID NO: 4637613 - DNA, 23 bp, Homo sapiens
gttcttgggcctcaggctctgca

SEQ ID NO: 4637614 - DNA, 19 bp, Homo sapiens
gttgaaacttacactgttt

SEQ ID NO: 4637615 - DNA, 18 bp, Homo sapiens
gttgaaccctccccacca

SEQ ID NO: 4637616 - DNA, 17 bp, Homo sapiens
gttgaagtgctgtttta

SEQ ID NO: 4637617 - DNA, 16 bp, Homo sapiens
gttgagaagcgttttt

SEQ ID NO: 4637618 - DNA, 16 bp, Homo sapiens
gttgagattgtactgt

SEQ ID NO: 4637619 - DNA, 19 bp, Homo sapiens
gttgagattgtactgttca

SEQ ID NO: 4637620 - DNA, 19 bp, Homo sapiens
gttgcacagctgtttgaaa

SEQ ID NO: 4637621 - DNA, 20 bp, Homo sapiens
gttgcacagctgtttgaaat

SEQ ID NO: 4637622 - DNA, 15 bp, Homo sapiens
gttgcagcccaagga

SEQ ID NO: 4637623 - DNA, 22 bp, Homo sapiens
gttgcagtgtctagtttctcaa

SEQ ID NO: 4637624 - DNA, 20 bp, Homo sapiens
gttgcctttttcattttcca

SEQ ID NO: 4637625 - DNA, 14 bp, Homo sapiens
gttggatttttgtc

SEQ ID NO: 4637626 - DNA, 23 bp, Homo sapiens
gttggcaaacgagactttctcct

SEQ ID NO: 4637627 - DNA, 13 bp, Homo sapiens
gttggcacagaac

SEQ ID NO: 4637628 - DNA, 14 bp, Homo sapiens
gttgggcagccaga

SEQ ID NO: 4637629 - DNA, 13 bp, Homo sapiens
gttggggtgacag

SEQ ID NO: 4637630 - DNA, 22 bp, Homo sapiens
gttggtgaattttcaaggcctt

SEQ ID NO: 4637631 - DNA, 15 bp, Homo sapiens
gttggtgacttgtct

SEQ ID NO: 4637632 - DNA, 12 bp, Homo sapiens
gttggtgttcct

SEQ ID NO: 4637633 - DNA, 15 bp, Homo sapiens
gttgtatctacagta

SEQ ID NO: 4637634 - DNA, 11 bp, Homo sapiens
gttgtctgtgc

SEQ ID NO: 4637635 - DNA, 16 bp, Homo sapiens
gttgtcttatgtgaaa

SEQ ID NO: 4637636 - DNA, 23 bp, Homo sapiens
gttgtcttatgtgaaaaattaac

SEQ ID NO: 4637637 - DNA, 18 bp, Homo sapiens
gttgtgcctccctggtga

SEQ ID NO: 4637638 - DNA, 13 bp, Homo sapiens
gttgttgcattcc

SEQ ID NO: 4637639 - DNA, 12 bp, Homo sapiens
gtttaaactgat

SEQ ID NO: 4637640 - DNA, 22 bp, Homo sapiens
gtttaacaagtatttattccca

SEQ ID NO: 4637641 - DNA, 14 bp, Homo sapiens
gtttaataaagctt

SEQ ID NO: 4637642 - DNA, 19 bp, Homo sapiens
gtttaatcagttctgtgtg

SEQ ID NO: 4637643 - DNA, 21 bp, Homo sapiens
gtttacatttgatgcatgtct

SEQ ID NO: 4637644 - DNA, 19 bp, Homo sapiens
gtttagttataaaaggctt

SEQ ID NO: 4637645 - DNA, 20 bp, Homo sapiens
gtttcaaactcctgacctca

SEQ ID NO: 4637646 - DNA, 20 bp, Homo sapiens
gtttcaaagctttcctgttt

SEQ ID NO: 4637647 - DNA, 22 bp, Homo sapiens
gtttcaaagtgtctcattctca

SEQ ID NO: 4637648 - DNA, 16 bp, Homo sapiens
gtttcaaatggactgt

SEQ ID NO: 4637649 - DNA, 15 bp, Homo sapiens
gtttcaacaaatttc

SEQ ID NO: 4637650 - DNA, 17 bp, Homo sapiens
gtttcaacaaatttcat

SEQ ID NO: 4637651 - DNA, 21 bp, Homo sapiens
gtttcaacaaatttcattgca

SEQ ID NO: 4637652 - DNA, 23 bp, Homo sapiens
gtttcaacaaatttcattgcact

SEQ ID NO: 4637653 - DNA, 20 bp, Homo sapiens
gtttcagctggaaacttctg

SEQ ID NO: 4637654 - DNA, 17 bp, Homo sapiens
gtttcatctaaatgaaa

SEQ ID NO: 4637655 - DNA, 14 bp, Homo sapiens
gtttcatctcagct

SEQ ID NO: 4637656 - DNA, 23 bp, Homo sapiens
gtttcatgtagccagcagaactg

SEQ ID NO: 4637657 - DNA, 22 bp, Homo sapiens
gtttccccttttaaggtttcaa

SEQ ID NO: 4637658 - DNA, 13 bp, Homo sapiens
gtttccctctcct

SEQ ID NO: 4637659 - DNA, 15 bp, Homo sapiens
gtttcctggcctcag

SEQ ID NO: 4637660 - DNA, 16 bp, Homo sapiens
gtttcctggcctcaga

SEQ ID NO: 4637661 - DNA, 19 bp, Homo sapiens
gtttcctggcctcagagct

SEQ ID NO: 4637662 - DNA, 13 bp, Homo sapiens
gtttcgtcatgtt

SEQ ID NO: 4637663 - DNA, 21 bp, Homo sapiens
gtttcgtcatgttggccaggc

SEQ ID NO: 4637664 - DNA, 20 bp, Homo sapiens
gtttctcaaaacccttaaaa

SEQ ID NO: 4637665 - DNA, 16 bp, Homo sapiens
gtttctctctacagtg

SEQ ID NO: 4637666 - DNA, 19 bp, Homo sapiens
gtttctctctacagtgcca

SEQ ID NO: 4637667 - DNA, 13 bp, Homo sapiens
gtttctgaatgtt

SEQ ID NO: 4637668 - DNA, 21 bp, Homo sapiens
gtttctgaatgtttgtgtctg

SEQ ID NO: 4637669 - DNA, 22 bp, Homo sapiens
gtttctgaatgtttgtgtctgt

SEQ ID NO: 4637670 - DNA, 13 bp, Homo sapiens
gtttctgcctggg

SEQ ID NO: 4637671 - DNA, 16 bp, Homo sapiens
gtttctttagtttttg

SEQ ID NO: 4637672 - DNA, 14 bp, Homo sapiens
gtttctttgtgttg

SEQ ID NO: 4637673 - DNA, 15 bp, Homo sapiens
gtttgcaggggtgac

SEQ ID NO: 4637674 - DNA, 15 bp, Homo sapiens
gtttgcttgaatgct

SEQ ID NO: 4637675 - DNA, 12 bp, Homo sapiens
gtttgggcagag

SEQ ID NO: 4637676 - DNA, 15 bp, Homo sapiens
gtttggggcaggagt

SEQ ID NO: 4637677 - DNA, 23 bp, Homo sapiens
gtttggtcttaggtcttcctgtg

SEQ ID NO: 4637678 - DNA, 12 bp, Homo sapiens
gtttgtagcttt

SEQ ID NO: 4637679 - DNA, 18 bp, Homo sapiens
gtttgtagctttcctgga

SEQ ID NO: 4637680 - DNA, 21 bp, Homo sapiens
gtttgtagctttcctggaagt

SEQ ID NO: 4637681 - DNA, 17 bp, Homo sapiens
gtttgtagttgttttaa

SEQ ID NO: 4637682 - DNA, 14 bp, Homo sapiens
gtttgtcagaggaa

SEQ ID NO: 4637683 - DNA, 17 bp, Homo sapiens
gtttgtggcgtctccct

SEQ ID NO: 4637684 - DNA, 19 bp, Homo sapiens
gtttgtggcgtctccctcg

SEQ ID NO: 4637685 - DNA, 17 bp, Homo sapiens
gtttgtgggacacaaca

SEQ ID NO: 4637686 - DNA, 15 bp, Homo sapiens
gtttgtgtctgtggt

SEQ ID NO: 4637687 - DNA, 12 bp, Homo sapiens
gtttgtttcttt

SEQ ID NO: 4637688 - DNA, 16 bp, Homo sapiens
gttttaaaaaagcatt

SEQ ID NO: 4637689 - DNA, 23 bp, Homo sapiens
gttttaaaatgtgaggcaataag

SEQ ID NO: 4637690 - DNA, 19 bp, Homo sapiens
gttttaatttatactggca

SEQ ID NO: 4637691 - DNA, 21 bp, Homo sapiens
gttttaatttatactggcatg

SEQ ID NO: 4637692 - DNA, 22 bp, Homo sapiens
gttttaatttatactggcatgc

SEQ ID NO: 4637693 - DNA, 17 bp, Homo sapiens
gttttacactaggaaac

SEQ ID NO: 4637694 - DNA, 13 bp, Homo sapiens
gttttacatttta

SEQ ID NO: 4637695 - DNA, 22 bp, Homo sapiens
gttttagggagtggttcctgtg

SEQ ID NO: 4637696 - DNA, 19 bp, Homo sapiens
gttttataccctttttcat

SEQ ID NO: 4637697 - DNA, 23 bp, Homo sapiens
gttttataccctttttcatttaa

SEQ ID NO: 4637698 - DNA, 18 bp, Homo sapiens
gttttatccttacaatgt

SEQ ID NO: 4637699 - DNA, 16 bp, Homo sapiens
gttttcattatgttca

SEQ ID NO: 4637700 - DNA, 17 bp, Homo sapiens
gttttcattatgttcat

SEQ ID NO: 4637701 - DNA, 21 bp, Homo sapiens
gttttcattatgttcatgtaa

SEQ ID NO: 4637702 - DNA, 17 bp, Homo sapiens
gttttccaagccctcag

SEQ ID NO: 4637703 - DNA, 17 bp, Homo sapiens
gttttccattgtttgaa

SEQ ID NO: 4637704 - DNA, 18 bp, Homo sapiens
gttttctatttatgcctt

SEQ ID NO: 4637705 - DNA, 13 bp, Homo sapiens
gttttctgctgtt

SEQ ID NO: 4637706 - DNA, 18 bp, Homo sapiens
gttttggatcttgaatgt

SEQ ID NO: 4637707 - DNA, 19 bp, Homo sapiens
gttttggatcttgaatgtg

SEQ ID NO: 4637708 - DNA, 13 bp, Homo sapiens
gttttgtaaagtc

SEQ ID NO: 4637709 - DNA, 17 bp, Homo sapiens
gtttttacctctgtctt

SEQ ID NO: 4637710 - DNA, 12 bp, Homo sapiens
gtttttcagttt

SEQ ID NO: 4637711 - DNA, 17 bp, Homo sapiens
gtttttgtataggagcc

SEQ ID NO: 4637712 - DNA, 20 bp, Homo sapiens
gttttttcctcagtgcattt

SEQ ID NO: 4637713 - DNA, 22 bp, Homo sapiens
taaaaaaaaaaaagtctaccaa

SEQ ID NO: 4637714 - DNA, 16 bp, Homo sapiens
taaaaaaaaatcttgt

SEQ ID NO: 4637715 - DNA, 17 bp, Homo sapiens
taaaaacagcattgctt

SEQ ID NO: 4637716 - DNA, 19 bp, Homo sapiens
taaaaacagcattgctttc

SEQ ID NO: 4637717 - DNA, 22 bp, Homo sapiens
taaaaacagcattgctttctga

SEQ ID NO: 4637718 - DNA, 17 bp, Homo sapiens
taaaaacttaaatattg

SEQ ID NO: 4637719 - DNA, 15 bp, Homo sapiens
taaaaagaaatccag

SEQ ID NO: 4637720 - DNA, 20 bp, Homo sapiens
taaaaagacattttttaaaa

SEQ ID NO: 4637721 - DNA, 13 bp, Homo sapiens
taaaaaggaacaa

SEQ ID NO: 4637722 - DNA, 19 bp, Homo sapiens
taaaaaggtctgttaatgt

SEQ ID NO: 4637723 - DNA, 21 bp, Homo sapiens
taaaaaggtctgttaatgtca

SEQ ID NO: 4637724 - DNA, 15 bp, Homo sapiens
taaaaatataaattg

SEQ ID NO: 4637725 - DNA, 18 bp, Homo sapiens
taaaaatataaattgtac

SEQ ID NO: 4637726 - DNA, 19 bp, Homo sapiens
taaaaatataaattgtaca

SEQ ID NO: 4637727 - DNA, 20 bp, Homo sapiens
taaaaatataaattgtacat

SEQ ID NO: 4637728 - DNA, 16 bp, Homo sapiens
taaaaatatagcaaat

SEQ ID NO: 4637729 - DNA, 16 bp, Homo sapiens
taaaaatatgtaattt

SEQ ID NO: 4637730 - DNA, 15 bp, Homo sapiens
taaaaatctcttttc

SEQ ID NO: 4637731 - DNA, 16 bp, Homo sapiens
taaaaatgcaaatcct

SEQ ID NO: 4637732 - DNA, 19 bp, Homo sapiens
taaaaatgcaaatcctatg

SEQ ID NO: 4637733 - DNA, 20 bp, Homo sapiens
taaaaatgcaaatcctatgt

SEQ ID NO: 4637734 - DNA, 15 bp, Homo sapiens
taaaaatgttctcaa

SEQ ID NO: 4637735 - DNA, 11 bp, Homo sapiens
taaaacaaata

SEQ ID NO: 4637736 - DNA, 22 bp, Homo sapiens
taaaacaaccagttaaagccac

SEQ ID NO: 4637737 - DNA, 14 bp, Homo sapiens
taaaacatatttca

SEQ ID NO: 4637738 - DNA, 15 bp, Homo sapiens
taaaacatatttcat

SEQ ID NO: 4637739 - DNA, 16 bp, Homo sapiens
taaaacatatttcatt

SEQ ID NO: 4637740 - DNA, 21 bp, Homo sapiens
taaaacatatttcattttaac

SEQ ID NO: 4637741 - DNA, 15 bp, Homo sapiens
taaaaccttgttcta

SEQ ID NO: 4637742 - DNA, 21 bp, Homo sapiens
taaaaccttgttctatttttc

SEQ ID NO: 4637743 - DNA, 17 bp, Homo sapiens
taaaactcactgtgatc

SEQ ID NO: 4637744 - DNA, 16 bp, Homo sapiens
taaaactctacagatg

SEQ ID NO: 4637745 - DNA, 18 bp, Homo sapiens
taaaagaaatatattttt

SEQ ID NO: 4637746 - DNA, 21 bp, Homo sapiens
taaaagatcaggttatacttt

SEQ ID NO: 4637747 - DNA, 14 bp, Homo sapiens
taaaagccttccag

SEQ ID NO: 4637748 - DNA, 19 bp, Homo sapiens
taaaaggaagccaaagagt

SEQ ID NO: 4637749 - DNA, 15 bp, Homo sapiens
taaaaggccaaacct

SEQ ID NO: 4637750 - DNA, 18 bp, Homo sapiens
taaaagttttgaaggaaa

SEQ ID NO: 4637751 - DNA, 20 bp, Homo sapiens
taaaagttttgatatttatt

SEQ ID NO: 4637752 - DNA, 15 bp, Homo sapiens
taaaataaaatgaaa

SEQ ID NO: 4637753 - DNA, 17 bp, Homo sapiens
taaaataaaatgaaaat

SEQ ID NO: 4637754 - DNA, 14 bp, Homo sapiens
taaaatagaataat

SEQ ID NO: 4637755 - DNA, 16 bp, Homo sapiens
taaaatagaataattc

SEQ ID NO: 4637756 - DNA, 22 bp, Homo sapiens
taaaatagaataattcttttct

SEQ ID NO: 4637757 - DNA, 15 bp, Homo sapiens
taaaatatattgctg

SEQ ID NO: 4637758 - DNA, 22 bp, Homo sapiens
taaaatatattgctgcatttta

SEQ ID NO: 4637759 - DNA, 19 bp, Homo sapiens
taaaatatcataaagcatt

SEQ ID NO: 4637760 - DNA, 16 bp, Homo sapiens
taaaatattttggatg

SEQ ID NO: 4637761 - DNA, 17 bp, Homo sapiens
taaaatcaaaacaagtg

SEQ ID NO: 4637762 - DNA, 17 bp, Homo sapiens
taaaatccattttaggt

SEQ ID NO: 4637763 - DNA, 15 bp, Homo sapiens
taaaatgaaaattgt

SEQ ID NO: 4637764 - DNA, 15 bp, Homo sapiens
taaaatgaaatgcta

SEQ ID NO: 4637765 - DNA, 13 bp, Homo sapiens
taaaatgaacatc

SEQ ID NO: 4637766 - DNA, 17 bp, Homo sapiens
taaaatgatttgtagtg

SEQ ID NO: 4637767 - DNA, 17 bp, Homo sapiens
taaaatgtgaggcaata

SEQ ID NO: 4637768 - DNA, 18 bp, Homo sapiens
taaaatgtgaggcaataa

SEQ ID NO: 4637769 - DNA, 19 bp, Homo sapiens
taaaatgtgaggcaataag

SEQ ID NO: 4637770 - DNA, 13 bp, Homo sapiens
taaaatgttcagt

SEQ ID NO: 4637771 - DNA, 13 bp, Homo sapiens
taaaatttaaaaa

SEQ ID NO: 4637772 - DNA, 22 bp, Homo sapiens
taaaattttttaaaagttttga

SEQ ID NO: 4637773 - DNA, 19 bp, Homo sapiens
taaaattttttttcatgtt

SEQ ID NO: 4637774 - DNA, 20 bp, Homo sapiens
taaaattttttttcatgttt

SEQ ID NO: 4637775 - DNA, 23 bp, Homo sapiens
taaaattttttttcatgttttaa

SEQ ID NO: 4637776 - DNA, 12 bp, Homo sapiens
taaacaaacaag

SEQ ID NO: 4637777 - DNA, 22 bp, Homo sapiens
taaacaaacaagccccctgccc

SEQ ID NO: 4637778 - DNA, 18 bp, Homo sapiens
taaacaacagctgaagca

SEQ ID NO: 4637779 - DNA, 18 bp, Homo sapiens
taaacaatatcagacttt

SEQ ID NO: 4637780 - DNA, 21 bp, Homo sapiens
taaacacaacaataactttta

SEQ ID NO: 4637781 - DNA, 20 bp, Homo sapiens
taaacagaaaactcccaata

SEQ ID NO: 4637782 - DNA, 19 bp, Homo sapiens
taaacagagtccgggagaa

SEQ ID NO: 4637783 - DNA, 16 bp, Homo sapiens
taaacataatgaaaat

SEQ ID NO: 4637784 - DNA, 21 bp, Homo sapiens
taaaccacaaggctgttgcat

SEQ ID NO: 4637785 - DNA, 21 bp, Homo sapiens
taaaccagaacccagtgtttc

SEQ ID NO: 4637786 - DNA, 19 bp, Homo sapiens
taaacctagtaaaaccttg

SEQ ID NO: 4637787 - DNA, 15 bp, Homo sapiens
taaactgaatataaa

SEQ ID NO: 4637788 - DNA, 20 bp, Homo sapiens
taaacttctgaagactgaga

SEQ ID NO: 4637789 - DNA, 13 bp, Homo sapiens
taaactttatttg

SEQ ID NO: 4637790 - DNA, 15 bp, Homo sapiens
taaactttatttgta

SEQ ID NO: 4637791 - DNA, 17 bp, Homo sapiens
taaactttatttgtaaa

SEQ ID NO: 4637792 - DNA, 18 bp, Homo sapiens
taaagaaaatctctgtga

SEQ ID NO: 4637793 - DNA, 20 bp, Homo sapiens
taaagaaactgaggcccacg

SEQ ID NO: 4637794 - DNA, 17 bp, Homo sapiens
taaagaagacattttct

SEQ ID NO: 4637795 - DNA, 21 bp, Homo sapiens
taaagaagcaataaagaagag

SEQ ID NO: 4637796 - DNA, 16 bp, Homo sapiens
taaagaatatgacttt

SEQ ID NO: 4637797 - DNA, 22 bp, Homo sapiens
taaagactggttttctgccaat

SEQ ID NO: 4637798 - DNA, 14 bp, Homo sapiens
taaagagtgtggca

SEQ ID NO: 4637799 - DNA, 21 bp, Homo sapiens
taaagcaaactatgatttatt

SEQ ID NO: 4637800 - DNA, 12 bp, Homo sapiens
taaagcatatag

SEQ ID NO: 4637801 - DNA, 14 bp, Homo sapiens
taaagccatttctt

SEQ ID NO: 4637802 - DNA, 16 bp, Homo sapiens
taaaggctaactatga

SEQ ID NO: 4637803 - DNA, 17 bp, Homo sapiens
taaaggcttctctctca

SEQ ID NO: 4637804 - DNA, 21 bp, Homo sapiens
taaagggaatcatttttgtag

SEQ ID NO: 4637805 - DNA, 21 bp, Homo sapiens
taaagggcagggcccacgtgt

SEQ ID NO: 4637806 - DNA, 18 bp, Homo sapiens
taaaggtgtagaaaaggt

SEQ ID NO: 4637807 - DNA, 13 bp, Homo sapiens
taaagtatttata

SEQ ID NO: 4637808 - DNA, 20 bp, Homo sapiens
taaagtatttataaaaatat

SEQ ID NO: 4637809 - DNA, 18 bp, Homo sapiens
taaagtcaggtccaattt

SEQ ID NO: 4637810 - DNA, 17 bp, Homo sapiens
taaagtttaaataccag

SEQ ID NO: 4637811 - DNA, 19 bp, Homo sapiens
taaagtttaaataccagta

SEQ ID NO: 4637812 - DNA, 19 bp, Homo sapiens
taaataaaaatatgtaatt

SEQ ID NO: 4637813 - DNA, 16 bp, Homo sapiens
taaatagatgatttca

SEQ ID NO: 4637814 - DNA, 20 bp, Homo sapiens
taaatagatgatttcaatag

SEQ ID NO: 4637815 - DNA, 21 bp, Homo sapiens
taaatagtgtcatataaactc

SEQ ID NO: 4637816 - DNA, 17 bp, Homo sapiens
taaatatcattctttgt

SEQ ID NO: 4637817 - DNA, 22 bp, Homo sapiens
taaatatctgtacttcttcgat

SEQ ID NO: 4637818 - DNA, 20 bp, Homo sapiens
taaatatggggatagtctgg

SEQ ID NO: 4637819 - DNA, 22 bp, Homo sapiens
taaatatggggatagtctgggt

SEQ ID NO: 4637820 - DNA, 20 bp, Homo sapiens
taaatattagttaatggatt

SEQ ID NO: 4637821 - DNA, 17 bp, Homo sapiens
taaatattgctctatgt

SEQ ID NO: 4637822 - DNA, 18 bp, Homo sapiens
taaatattgtaatatgac

SEQ ID NO: 4637823 - DNA, 19 bp, Homo sapiens
taaatattgtaatatgaca

SEQ ID NO: 4637824 - DNA, 22 bp, Homo sapiens
taaatattgtaatatgacagat

SEQ ID NO: 4637825 - DNA, 20 bp, Homo sapiens
taaatatttactctttgcaa

SEQ ID NO: 4637826 - DNA, 21 bp, Homo sapiens
taaatatttactctttgcaaa

SEQ ID NO: 4637827 - DNA, 14 bp, Homo sapiens
taaatcacagaaaa

SEQ ID NO: 4637828 - DNA, 16 bp, Homo sapiens
taaatcacagaaaatt

SEQ ID NO: 4637829 - DNA, 18 bp, Homo sapiens
taaatcacagaaaattta

SEQ ID NO: 4637830 - DNA, 19 bp, Homo sapiens
taaatcacagaaaatttaa

SEQ ID NO: 4637831 - DNA, 19 bp, Homo sapiens
taaatcagaaagtaacaat

SEQ ID NO: 4637832 - DNA, 21 bp, Homo sapiens
taaatcagaaagtaacaatct

SEQ ID NO: 4637833 - DNA, 15 bp, Homo sapiens
taaatcctaccaaag

SEQ ID NO: 4637834 - DNA, 23 bp, Homo sapiens
taaatgtgagtatttctgttcct

SEQ ID NO: 4637835 - DNA, 19 bp, Homo sapiens
taaatgtttcccccactcc

SEQ ID NO: 4637836 - DNA, 15 bp, Homo sapiens
taaattaaacatttt

SEQ ID NO: 4637837 - DNA, 17 bp, Homo sapiens
taaattaaacatttttc

SEQ ID NO: 4637838 - DNA, 20 bp, Homo sapiens
taaattaaacatttttcaca

SEQ ID NO: 4637839 - DNA, 16 bp, Homo sapiens
taaattacaattttat

SEQ ID NO: 4637840 - DNA, 20 bp, Homo sapiens
taaattccacagattatcaa

SEQ ID NO: 4637841 - DNA, 13 bp, Homo sapiens
taaattgctctgt

SEQ ID NO: 4637842 - DNA, 23 bp, Homo sapiens
taaatttaagaaaacaagtatat

SEQ ID NO: 4637843 - DNA, 16 bp, Homo sapiens
taaatttgaataagca

SEQ ID NO: 4637844 - DNA, 17 bp, Homo sapiens
taaatttggcttctgtt

SEQ ID NO: 4637845 - DNA, 16 bp, Homo sapiens
taacaaaaaatgtaat

SEQ ID NO: 4637846 - DNA, 19 bp, Homo sapiens
taacaaaagattaatcttt

SEQ ID NO: 4637847 - DNA, 14 bp, Homo sapiens
taacaaaatgagat

SEQ ID NO: 4637848 - DNA, 13 bp, Homo sapiens
taacaaaatggac

SEQ ID NO: 4637849 - DNA, 20 bp, Homo sapiens
taacaaatttctttgtttaa

SEQ ID NO: 4637850 - DNA, 13 bp, Homo sapiens
taacacaaaggaa

SEQ ID NO: 4637851 - DNA, 14 bp, Homo sapiens
taacaccttggact

SEQ ID NO: 4637852 - DNA, 23 bp, Homo sapiens
taacagggaaggcaggcagggct

SEQ ID NO: 4637853 - DNA, 19 bp, Homo sapiens
taacaggtattttgtttct

SEQ ID NO: 4637854 - DNA, 23 bp, Homo sapiens
taacatacaagaaaatgtatcca

SEQ ID NO: 4637855 - DNA, 18 bp, Homo sapiens
taacatacacgttaactg

SEQ ID NO: 4637856 - DNA, 14 bp, Homo sapiens
taacatgatttcaa

SEQ ID NO: 4637857 - DNA, 18 bp, Homo sapiens
taacatgcatactttatt

SEQ ID NO: 4637858 - DNA, 18 bp, Homo sapiens
taacatttaaattccaca

SEQ ID NO: 4637859 - DNA, 19 bp, Homo sapiens
taacattttgagctatttc

SEQ ID NO: 4637860 - DNA, 14 bp, Homo sapiens
taaccaaggccctg

SEQ ID NO: 4637861 - DNA, 21 bp, Homo sapiens
taaccacggttatttaagcat

SEQ ID NO: 4637862 - DNA, 18 bp, Homo sapiens
taaccacttcgcacacac

SEQ ID NO: 4637863 - DNA, 15 bp, Homo sapiens
taaccattggaatgg

SEQ ID NO: 4637864 - DNA, 15 bp, Homo sapiens
taacccagttacttt

SEQ ID NO: 4637865 - DNA, 19 bp, Homo sapiens
taacctcaagtgatcctcc

SEQ ID NO: 4637866 - DNA, 20 bp, Homo sapiens
taacctgcacaggcttgctg

SEQ ID NO: 4637867 - DNA, 17 bp, Homo sapiens
taacctgttttgttaat

SEQ ID NO: 4637868 - DNA, 19 bp, Homo sapiens
taaccttactaattatact

SEQ ID NO: 4637869 - DNA, 12 bp, Homo sapiens
taacgcctgagc

SEQ ID NO: 4637870 - DNA, 18 bp, Homo sapiens
taacgcctgagcccaggg

SEQ ID NO: 4637871 - DNA, 19 bp, Homo sapiens
taacgcctgagcccaggga

SEQ ID NO: 4637872 - DNA, 20 bp, Homo sapiens
taacggtttaattctgtctt

SEQ ID NO: 4637873 - DNA, 18 bp, Homo sapiens
taactatatttgcttttt

SEQ ID NO: 4637874 - DNA, 18 bp, Homo sapiens
taactatcaccagtgcat

SEQ ID NO: 4637875 - DNA, 15 bp, Homo sapiens
taactattaaccttt

SEQ ID NO: 4637876 - DNA, 16 bp, Homo sapiens
taactattaacctttt

SEQ ID NO: 4637877 - DNA, 18 bp, Homo sapiens
taactattaacctttttt

SEQ ID NO: 4637878 - DNA, 19 bp, Homo sapiens
taactcaatcatgaatgaa

SEQ ID NO: 4637879 - DNA, 16 bp, Homo sapiens
taactcatagtttgtt

SEQ ID NO: 4637880 - DNA, 17 bp, Homo sapiens
taactccctccaccagc

SEQ ID NO: 4637881 - DNA, 16 bp, Homo sapiens
taactctgcccaccct

SEQ ID NO: 4637882 - DNA, 22 bp, Homo sapiens
taactctgtattacagctttca

SEQ ID NO: 4637883 - DNA, 15 bp, Homo sapiens
taactctgtcttcac

SEQ ID NO: 4637884 - DNA, 22 bp, Homo sapiens
taactgacttcactaggcattg

SEQ ID NO: 4637885 - DNA, 17 bp, Homo sapiens
taactgatgagtaaact

SEQ ID NO: 4637886 - DNA, 23 bp, Homo sapiens
taactgcccagcggacagtggca

SEQ ID NO: 4637887 - DNA, 20 bp, Homo sapiens
taactggcctaaatttcttc

SEQ ID NO: 4637888 - DNA, 14 bp, Homo sapiens
taactgtaaacttg

SEQ ID NO: 4637889 - DNA, 21 bp, Homo sapiens
taactgtaaacttggaatcaa

SEQ ID NO: 4637890 - DNA, 14 bp, Homo sapiens
taactgtaaatcat

SEQ ID NO: 4637891 - DNA, 14 bp, Homo sapiens
taactgtacatttc

SEQ ID NO: 4637892 - DNA, 12 bp, Homo sapiens
taactgtcctgt

SEQ ID NO: 4637893 - DNA, 14 bp, Homo sapiens
taactgtcctgtcc

SEQ ID NO: 4637894 - DNA, 17 bp, Homo sapiens
taactgtcctgtcctgc

SEQ ID NO: 4637895 - DNA, 14 bp, Homo sapiens
taacttaaatattg

SEQ ID NO: 4637896 - DNA, 16 bp, Homo sapiens
taacttgcctccatct

SEQ ID NO: 4637897 - DNA, 17 bp, Homo sapiens
taacttgcctccatctt

SEQ ID NO: 4637898 - DNA, 14 bp, Homo sapiens
taactttacagaaa

SEQ ID NO: 4637899 - DNA, 13 bp, Homo sapiens
taactttctctta

SEQ ID NO: 4637900 - DNA, 14 bp, Homo sapiens
taacttttatatta

SEQ ID NO: 4637901 - DNA, 15 bp, Homo sapiens
taagaaaacaagtat

SEQ ID NO: 4637902 - DNA, 17 bp, Homo sapiens
taagaaaagtaatgaag

SEQ ID NO: 4637903 - DNA, 12 bp, Homo sapiens
taagaaaatgta

SEQ ID NO: 4637904 - DNA, 13 bp, Homo sapiens
taagaaaatttac

SEQ ID NO: 4637905 - DNA, 19 bp, Homo sapiens
taagaaagcctaaaattga

SEQ ID NO: 4637906 - DNA, 18 bp, Homo sapiens
taagaaccattgatttaa

SEQ ID NO: 4637907 - DNA, 19 bp, Homo sapiens
taagaagccccttattttt

SEQ ID NO: 4637908 - DNA, 16 bp, Homo sapiens
taagaattactttgtg

SEQ ID NO: 4637909 - DNA, 15 bp, Homo sapiens
taagaattttgcttt

SEQ ID NO: 4637910 - DNA, 19 bp, Homo sapiens
taagaatttttttttaaat

SEQ ID NO: 4637911 - DNA, 20 bp, Homo sapiens
taagagacacatacagagtg

SEQ ID NO: 4637912 - DNA, 14 bp, Homo sapiens
taagatattcttta

SEQ ID NO: 4637913 - DNA, 13 bp, Homo sapiens
taagatttactta

SEQ ID NO: 4637914 - DNA, 19 bp, Homo sapiens
taagatttacttaattgct

SEQ ID NO: 4637915 - DNA, 22 bp, Homo sapiens
taagcaccagtgggactgtggt

SEQ ID NO: 4637916 - DNA, 19 bp, Homo sapiens
taagcagaacatactgttc

SEQ ID NO: 4637917 - DNA, 16 bp, Homo sapiens
taagcagcctttgtgg

SEQ ID NO: 4637918 - DNA, 21 bp, Homo sapiens
taagcaggagagaaatttctc

SEQ ID NO: 4637919 - DNA, 19 bp, Homo sapiens
taagcatactttgtaaata

SEQ ID NO: 4637920 - DNA, 15 bp, Homo sapiens
taagcatgtgatgtt

SEQ ID NO: 4637921 - DNA, 17 bp, Homo sapiens
taagcattttgaaacaa

SEQ ID NO: 4637922 - DNA, 11 bp, Homo sapiens
taagccaaaga

SEQ ID NO: 4637923 - DNA, 12 bp, Homo sapiens
taagccaaagaa

SEQ ID NO: 4637924 - DNA, 17 bp, Homo sapiens
taagccaaagaaacaag

SEQ ID NO: 4637925 - DNA, 22 bp, Homo sapiens
taagccaaagaaacaagctgtg

SEQ ID NO: 4637926 - DNA, 15 bp, Homo sapiens
taagcccaggatctc

SEQ ID NO: 4637927 - DNA, 15 bp, Homo sapiens
taagccctggccccc

SEQ ID NO: 4637928 - DNA, 16 bp, Homo sapiens
taagctcccctgcctt

SEQ ID NO: 4637929 - DNA, 21 bp, Homo sapiens
taagctcccctgccttaacct

SEQ ID NO: 4637930 - DNA, 12 bp, Homo sapiens
taagctctgccc

SEQ ID NO: 4637931 - DNA, 19 bp, Homo sapiens
taagctctgccccttcccc

SEQ ID NO: 4637932 - DNA, 15 bp, Homo sapiens
taagcttttatttct

SEQ ID NO: 4637933 - DNA, 20 bp, Homo sapiens
taagcttttcacaaacatta

SEQ ID NO: 4637934 - DNA, 15 bp, Homo sapiens
taaggaaacttctga

SEQ ID NO: 4637935 - DNA, 19 bp, Homo sapiens
taaggagtaatctgtgtac

SEQ ID NO: 4637936 - DNA, 21 bp, Homo sapiens
taaggatggaaaggtgacagt

SEQ ID NO: 4637937 - DNA, 23 bp, Homo sapiens
taaggcacagtgggagctgagct

SEQ ID NO: 4637938 - DNA, 11 bp, Homo sapiens
taagggcagag

SEQ ID NO: 4637939 - DNA, 14 bp, Homo sapiens
taagggcagtgccc

SEQ ID NO: 4637940 - DNA, 13 bp, Homo sapiens
taagggtgggtgc

SEQ ID NO: 4637941 - DNA, 19 bp, Homo sapiens
taaggtactgtggggtgga

SEQ ID NO: 4637942 - DNA, 18 bp, Homo sapiens
taaggtctttcagtactt

SEQ ID NO: 4637943 - DNA, 22 bp, Homo sapiens
taaggtttcaacaaatttcatt

SEQ ID NO: 4637944 - DNA, 16 bp, Homo sapiens
taagtaatatctttca

SEQ ID NO: 4637945 - DNA, 19 bp, Homo sapiens
taagtactacacattttta

SEQ ID NO: 4637946 - DNA, 15 bp, Homo sapiens
taagtagtaaatcag

SEQ ID NO: 4637947 - DNA, 17 bp, Homo sapiens
taagtatatcatgtaaa

SEQ ID NO: 4637948 - DNA, 22 bp, Homo sapiens
taagtatatcatgtaaagaaat

SEQ ID NO: 4637949 - DNA, 13 bp, Homo sapiens
taagtcaggacag

SEQ ID NO: 4637950 - DNA, 18 bp, Homo sapiens
taagtcgtgcactttctc

SEQ ID NO: 4637951 - DNA, 19 bp, Homo sapiens
taagtcgtgcactttctcg

SEQ ID NO: 4637952 - DNA, 22 bp, Homo sapiens
taagtctatactaatgcttaca

SEQ ID NO: 4637953 - DNA, 18 bp, Homo sapiens
taagtgcaaacacagcat

SEQ ID NO: 4637954 - DNA, 15 bp, Homo sapiens
taagtgtaaaaaatg

SEQ ID NO: 4637955 - DNA, 16 bp, Homo sapiens
taagtgtaaaaaatgt

SEQ ID NO: 4637956 - DNA, 15 bp, Homo sapiens
taagtgtatcttaat

SEQ ID NO: 4637957 - DNA, 21 bp, Homo sapiens
taagttacacatttttcagat

SEQ ID NO: 4637958 - DNA, 13 bp, Homo sapiens
taagttcctgctg

SEQ ID NO: 4637959 - DNA, 15 bp, Homo sapiens
taagttcctgctgcc

SEQ ID NO: 4637960 - DNA, 22 bp, Homo sapiens
taagttcctgctgcctgggtag

SEQ ID NO: 4637961 - DNA, 17 bp, Homo sapiens
taagttgctattttcat

SEQ ID NO: 4637962 - DNA, 20 bp, Homo sapiens
taagtttgcaacatttattg

SEQ ID NO: 4637963 - DNA, 19 bp, Homo sapiens
taataaacataatgaaaat

SEQ ID NO: 4637964 - DNA, 12 bp, Homo sapiens
taataaattgct

SEQ ID NO: 4637965 - DNA, 13 bp, Homo sapiens
taataaattgctt

SEQ ID NO: 4637966 - DNA, 19 bp, Homo sapiens
taataaattgcttactgat

SEQ ID NO: 4637967 - DNA, 20 bp, Homo sapiens
taataatatactgtactata

SEQ ID NO: 4637968 - DNA, 12 bp, Homo sapiens
taataattgtat

SEQ ID NO: 4637969 - DNA, 17 bp, Homo sapiens
taataattttatagaaa

SEQ ID NO: 4637970 - DNA, 14 bp, Homo sapiens
taatacatccattc

SEQ ID NO: 4637971 - DNA, 13 bp, Homo sapiens
taatacctctgtg

SEQ ID NO: 4637972 - DNA, 14 bp, Homo sapiens
taatacctctgtgt

SEQ ID NO: 4637973 - DNA, 15 bp, Homo sapiens
taatacctctgtgtg

SEQ ID NO: 4637974 - DNA, 18 bp, Homo sapiens
taatacctctgtgtgctc

SEQ ID NO: 4637975 - DNA, 13 bp, Homo sapiens
taatacctttaaa

SEQ ID NO: 4637976 - DNA, 16 bp, Homo sapiens
taatacctttaaatat

SEQ ID NO: 4637977 - DNA, 16 bp, Homo sapiens
taatagcatttttgta

SEQ ID NO: 4637978 - DNA, 14 bp, Homo sapiens
taatagggaatata

SEQ ID NO: 4637979 - DNA, 21 bp, Homo sapiens
taatatactcagggattcctt

SEQ ID NO: 4637980 - DNA, 21 bp, Homo sapiens
taatatcaaataaaatatcat

SEQ ID NO: 4637981 - DNA, 17 bp, Homo sapiens
taatatcattttattca

SEQ ID NO: 4637982 - DNA, 18 bp, Homo sapiens
taatatcattttattcac

SEQ ID NO: 4637983 - DNA, 13 bp, Homo sapiens
taatatctttcag

SEQ ID NO: 4637984 - DNA, 14 bp, Homo sapiens
taatatgacagata

SEQ ID NO: 4637985 - DNA, 15 bp, Homo sapiens
taatatggaaatctt

SEQ ID NO: 4637986 - DNA, 12 bp, Homo sapiens
taatatggattt

SEQ ID NO: 4637987 - DNA, 20 bp, Homo sapiens
taatatttagctgtaaactg

SEQ ID NO: 4637988 - DNA, 22 bp, Homo sapiens
taatatttagctgtaaactgaa

SEQ ID NO: 4637989 - DNA, 23 bp, Homo sapiens
taatatttagctgtaaactgaat

SEQ ID NO: 4637990 - DNA, 11 bp, Homo sapiens
taatcaagaga

SEQ ID NO: 4637991 - DNA, 16 bp, Homo sapiens
taatcaagagaaactt

SEQ ID NO: 4637992 - DNA, 22 bp, Homo sapiens
taatcaagagaaacttcaaagt

SEQ ID NO: 4637993 - DNA, 20 bp, Homo sapiens
taatcagaaaagtaattttg

SEQ ID NO: 4637994 - DNA, 23 bp, Homo sapiens
taatcagaaaagtaattttgtca

SEQ ID NO: 4637995 - DNA, 13 bp, Homo sapiens
taatcagtaaata

SEQ ID NO: 4637996 - DNA, 16 bp, Homo sapiens
taatcattatttgaga

SEQ ID NO: 4637997 - DNA, 13 bp, Homo sapiens
taatcatttgttt

SEQ ID NO: 4637998 - DNA, 19 bp, Homo sapiens
taatcatttgtttacattt

SEQ ID NO: 4637999 - DNA, 21 bp, Homo sapiens
taatcatttgtttacatttga

SEQ ID NO: 4638000 - DNA, 13 bp, Homo sapiens
taatcattttcat

SEQ ID NO: 4638001 - DNA, 14 bp, Homo sapiens
taatcattttcatt

SEQ ID NO: 4638002 - DNA, 17 bp, Homo sapiens
taatcattttcattcct

SEQ ID NO: 4638003 - DNA, 16 bp, Homo sapiens
taatcccagcactttg

SEQ ID NO: 4638004 - DNA, 14 bp, Homo sapiens
taatcctcctgagt

SEQ ID NO: 4638005 - DNA, 19 bp, Homo sapiens
taatctctctctctttttt

SEQ ID NO: 4638006 - DNA, 12 bp, Homo sapiens
taatctggatgt

SEQ ID NO: 4638007 - DNA, 17 bp, Homo sapiens
taatcttgctttcttta

SEQ ID NO: 4638008 - DNA, 14 bp, Homo sapiens
taatctttatttta

SEQ ID NO: 4638009 - DNA, 15 bp, Homo sapiens
taatctttattttat

SEQ ID NO: 4638010 - DNA, 18 bp, Homo sapiens
taatctttattttattat

SEQ ID NO: 4638011 - DNA, 17 bp, Homo sapiens
taatgaaaataaaacac

SEQ ID NO: 4638012 - DNA, 19 bp, Homo sapiens
taatgaaatagttatttta

SEQ ID NO: 4638013 - DNA, 14 bp, Homo sapiens
taatgacttagaaa

SEQ ID NO: 4638014 - DNA, 12 bp, Homo sapiens
taatgattttgg

SEQ ID NO: 4638015 - DNA, 13 bp, Homo sapiens
taatgcatattta

SEQ ID NO: 4638016 - DNA, 19 bp, Homo sapiens
taatgctctatgtttgtat

SEQ ID NO: 4638017 - DNA, 17 bp, Homo sapiens
taatgctgtttctaaga

SEQ ID NO: 4638018 - DNA, 15 bp, Homo sapiens
taatggaggtcccag

SEQ ID NO: 4638019 - DNA, 17 bp, Homo sapiens
taatggaggtcccagcc

SEQ ID NO: 4638020 - DNA, 15 bp, Homo sapiens
taatggcagagcagt

SEQ ID NO: 4638021 - DNA, 20 bp, Homo sapiens
taatggtatcctactgagca

SEQ ID NO: 4638022 - DNA, 13 bp, Homo sapiens
taatgtaaaatga

SEQ ID NO: 4638023 - DNA, 14 bp, Homo sapiens
taatgtaaaatgat

SEQ ID NO: 4638024 - DNA, 11 bp, Homo sapiens
taatgtatctt

SEQ ID NO: 4638025 - DNA, 12 bp, Homo sapiens
taatgtatctta

SEQ ID NO: 4638026 - DNA, 13 bp, Homo sapiens
taatgtatcttaa

SEQ ID NO: 4638027 - DNA, 15 bp, Homo sapiens
taatgtcatggcctt

SEQ ID NO: 4638028 - DNA, 13 bp, Homo sapiens
taatgtgaaaatc

SEQ ID NO: 4638029 - DNA, 16 bp, Homo sapiens
taatgtgaaaatcatc

SEQ ID NO: 4638030 - DNA, 18 bp, Homo sapiens
taatgtgaactctcccct

SEQ ID NO: 4638031 - DNA, 15 bp, Homo sapiens
taatgtgatcatatg

SEQ ID NO: 4638032 - DNA, 18 bp, Homo sapiens
taatgtgtggtggcctca

SEQ ID NO: 4638033 - DNA, 14 bp, Homo sapiens
taatgttaaccaag

SEQ ID NO: 4638034 - DNA, 13 bp, Homo sapiens
taatgttattcat

SEQ ID NO: 4638035 - DNA, 23 bp, Homo sapiens
taatgttcttatgcaaaatggaa

SEQ ID NO: 4638036 - DNA, 14 bp, Homo sapiens
taatgtttgaacaa

SEQ ID NO: 4638037 - DNA, 15 bp, Homo sapiens
taatgttttcattat

SEQ ID NO: 4638038 - DNA, 21 bp, Homo sapiens
taattaaacattgtgatcatt

SEQ ID NO: 4638039 - DNA, 15 bp, Homo sapiens
taattaatgtttgtg

SEQ ID NO: 4638040 - DNA, 15 bp, Homo sapiens
taattattattatta

SEQ ID NO: 4638041 - DNA, 15 bp, Homo sapiens
taattcagctttgtc

SEQ ID NO: 4638042 - DNA, 15 bp, Homo sapiens
taattcatattcttc

SEQ ID NO: 4638043 - DNA, 16 bp, Homo sapiens
taattcctacagcact

SEQ ID NO: 4638044 - DNA, 20 bp, Homo sapiens
taattccttatcctagcctt

SEQ ID NO: 4638045 - DNA, 23 bp, Homo sapiens
taattcttcagcgtaaaatggtg

SEQ ID NO: 4638046 - DNA, 21 bp, Homo sapiens
taattgcaaaaacatagaaat

SEQ ID NO: 4638047 - DNA, 19 bp, Homo sapiens
taattggtgctatttgaag

SEQ ID NO: 4638048 - DNA, 21 bp, Homo sapiens
taattggtgctatttgaagaa

SEQ ID NO: 4638049 - DNA, 22 bp, Homo sapiens
taattggtgctatttgaagaaa

SEQ ID NO: 4638050 - DNA, 18 bp, Homo sapiens
taattgtatctacattaa

SEQ ID NO: 4638051 - DNA, 19 bp, Homo sapiens
taattgtatctacattaaa

SEQ ID NO: 4638052 - DNA, 16 bp, Homo sapiens
taattgttttgcactt

SEQ ID NO: 4638053 - DNA, 19 bp, Homo sapiens
taatttaacaccctttaga

SEQ ID NO: 4638054 - DNA, 18 bp, Homo sapiens
taatttactttgtagact

SEQ ID NO: 4638055 - DNA, 13 bp, Homo sapiens
taatttatacttt

SEQ ID NO: 4638056 - DNA, 16 bp, Homo sapiens
taatttatagcaagat

SEQ ID NO: 4638057 - DNA, 12 bp, Homo sapiens
taatttcaaaat

SEQ ID NO: 4638058 - DNA, 14 bp, Homo sapiens
taatttcaaaatac

SEQ ID NO: 4638059 - DNA, 21 bp, Homo sapiens
taatttcaggaaaatgtattg

SEQ ID NO: 4638060 - DNA, 12 bp, Homo sapiens
taatttgatctt

SEQ ID NO: 4638061 - DNA, 15 bp, Homo sapiens
taatttggtcatttg

SEQ ID NO: 4638062 - DNA, 13 bp, Homo sapiens
taatttgtaaact

SEQ ID NO: 4638063 - DNA, 18 bp, Homo sapiens
taatttgtaaacttctga

SEQ ID NO: 4638064 - DNA, 19 bp, Homo sapiens
taatttgtaaacttctgaa

SEQ ID NO: 4638065 - DNA, 17 bp, Homo sapiens
taattttacagcccttg

SEQ ID NO: 4638066 - DNA, 21 bp, Homo sapiens
taattttacatgtttataaat

SEQ ID NO: 4638067 - DNA, 15 bp, Homo sapiens
taattttatagaaaa

SEQ ID NO: 4638068 - DNA, 21 bp, Homo sapiens
taattttctagattttctact

SEQ ID NO: 4638069 - DNA, 22 bp, Homo sapiens
taattttctctttgtatgtctg

SEQ ID NO: 4638070 - DNA, 13 bp, Homo sapiens
taattttgatttc

SEQ ID NO: 4638071 - DNA, 21 bp, Homo sapiens
taattttgcatactgaaaatc

SEQ ID NO: 4638072 - DNA, 21 bp, Homo sapiens
taatttttgtattatttttgt

SEQ ID NO: 4638073 - DNA, 19 bp, Homo sapiens
tacaaaacctcaaaccagt

SEQ ID NO: 4638074 - DNA, 16 bp, Homo sapiens
tacaaaatttattctc

SEQ ID NO: 4638075 - DNA, 23 bp, Homo sapiens
tacaaactcatcctcttttaatg

SEQ ID NO: 4638076 - DNA, 14 bp, Homo sapiens
tacaaactctcacc

SEQ ID NO: 4638077 - DNA, 21 bp, Homo sapiens
tacaaatgaagaaagtcaaaa

SEQ ID NO: 4638078 - DNA, 21 bp, Homo sapiens
tacaaatgccttaaaatggaa

SEQ ID NO: 4638079 - DNA, 22 bp, Homo sapiens
tacaaatgccttaaaatggaat

SEQ ID NO: 4638080 - DNA, 18 bp, Homo sapiens
tacaagaaaatgtatcca

SEQ ID NO: 4638081 - DNA, 22 bp, Homo sapiens
tacaagagtggagagaagctct

SEQ ID NO: 4638082 - DNA, 23 bp, Homo sapiens
tacaataagcgttaagggcagag

SEQ ID NO: 4638083 - DNA, 15 bp, Homo sapiens
tacaatcgcaaatca

SEQ ID NO: 4638084 - DNA, 18 bp, Homo sapiens
tacaatcgcaaatcaaaa

SEQ ID NO: 4638085 - DNA, 13 bp, Homo sapiens
tacaatcttggga

SEQ ID NO: 4638086 - DNA, 13 bp, Homo sapiens
tacaatgtagatg

SEQ ID NO: 4638087 - DNA, 11 bp, Homo sapiens
tacaatgtgaa

SEQ ID NO: 4638088 - DNA, 23 bp, Homo sapiens
tacaatgtgaataatggcactga

SEQ ID NO: 4638089 - DNA, 12 bp, Homo sapiens
tacaattttatc

SEQ ID NO: 4638090 - DNA, 15 bp, Homo sapiens
tacacaattgtttta

SEQ ID NO: 4638091 - DNA, 19 bp, Homo sapiens
tacacatttttaaattgtt

SEQ ID NO: 4638092 - DNA, 21 bp, Homo sapiens
tacacatttttcagatataaa

SEQ ID NO: 4638093 - DNA, 16 bp, Homo sapiens
tacaccactctggcag

SEQ ID NO: 4638094 - DNA, 20 bp, Homo sapiens
tacacctcctttaagattta

SEQ ID NO: 4638095 - DNA, 22 bp, Homo sapiens
tacactacattttttctaataa

SEQ ID NO: 4638096 - DNA, 20 bp, Homo sapiens
tacactacgcactggacagc

SEQ ID NO: 4638097 - DNA, 19 bp, Homo sapiens
tacactggaggagagaaga

SEQ ID NO: 4638098 - DNA, 22 bp, Homo sapiens
tacactggaggagagaagaatg

SEQ ID NO: 4638099 - DNA, 22 bp, Homo sapiens
tacactgtttcatctcagcttt

SEQ ID NO: 4638100 - DNA, 15 bp, Homo sapiens
tacactttttacagc

SEQ ID NO: 4638101 - DNA, 19 bp, Homo sapiens
tacagagcacctgtagctg

SEQ ID NO: 4638102 - DNA, 11 bp, Homo sapiens
tacagaggaaa

SEQ ID NO: 4638103 - DNA, 15 bp, Homo sapiens
tacagaggaaatctg

SEQ ID NO: 4638104 - DNA, 14 bp, Homo sapiens
tacagcagcaatat

SEQ ID NO: 4638105 - DNA, 18 bp, Homo sapiens
tacagcagcaatattttg

SEQ ID NO: 4638106 - DNA, 21 bp, Homo sapiens
tacagccaagtgccaaatgct

SEQ ID NO: 4638107 - DNA, 21 bp, Homo sapiens
tacaggactggttccttcctt

SEQ ID NO: 4638108 - DNA, 13 bp, Homo sapiens
tacaggcgcctgc

SEQ ID NO: 4638109 - DNA, 20 bp, Homo sapiens
tacagggcacaggccatgga

SEQ ID NO: 4638110 - DNA, 13 bp, Homo sapiens
tacaggggccaga

SEQ ID NO: 4638111 - DNA, 21 bp, Homo sapiens
tacagtaatgaaatgtttact

SEQ ID NO: 4638112 - DNA, 19 bp, Homo sapiens
tacagtcttcttacttgga

SEQ ID NO: 4638113 - DNA, 22 bp, Homo sapiens
tacagtgaacaaatgtcttaaa

SEQ ID NO: 4638114 - DNA, 15 bp, Homo sapiens
tacagtgtacagtct

SEQ ID NO: 4638115 - DNA, 19 bp, Homo sapiens
tacagttgaaataactgga

SEQ ID NO: 4638116 - DNA, 15 bp, Homo sapiens
tacagttttgagtaa

SEQ ID NO: 4638117 - DNA, 21 bp, Homo sapiens
tacataggtctgtatggctgt

SEQ ID NO: 4638118 - DNA, 22 bp, Homo sapiens
tacataggtctgtatggctgta

SEQ ID NO: 4638119 - DNA, 14 bp, Homo sapiens
tacatatattttta

SEQ ID NO: 4638120 - DNA, 19 bp, Homo sapiens
tacatatgctgatctttta

SEQ ID NO: 4638121 - DNA, 14 bp, Homo sapiens
tacatatgtaaaca

SEQ ID NO: 4638122 - DNA, 21 bp, Homo sapiens
tacatcagtatagtgttttat

SEQ ID NO: 4638123 - DNA, 19 bp, Homo sapiens
tacatccaaagcagacagc

SEQ ID NO: 4638124 - DNA, 15 bp, Homo sapiens
tacatccagagttct

SEQ ID NO: 4638125 - DNA, 16 bp, Homo sapiens
tacatgatacattttt

SEQ ID NO: 4638126 - DNA, 17 bp, Homo sapiens
tacatgatacattttta

SEQ ID NO: 4638127 - DNA, 17 bp, Homo sapiens
tacatgcaacagaagtg

SEQ ID NO: 4638128 - DNA, 13 bp, Homo sapiens
tacatgctacttt

SEQ ID NO: 4638129 - DNA, 14 bp, Homo sapiens
tacatgtaatttga

SEQ ID NO: 4638130 - DNA, 18 bp, Homo sapiens
tacatgtgtagcctgtgc

SEQ ID NO: 4638131 - DNA, 19 bp, Homo sapiens
tacatgtgtagcctgtgca

SEQ ID NO: 4638132 - DNA, 19 bp, Homo sapiens
tacatgtgtatattccttt

SEQ ID NO: 4638133 - DNA, 17 bp, Homo sapiens
tacatgtttataaatct

SEQ ID NO: 4638134 - DNA, 17 bp, Homo sapiens
tacattaaaataactaa

SEQ ID NO: 4638135 - DNA, 12 bp, Homo sapiens
tacattaaaatg

SEQ ID NO: 4638136 - DNA, 13 bp, Homo sapiens
tacattaaaatga

SEQ ID NO: 4638137 - DNA, 18 bp, Homo sapiens
tacattaacggtgctaaa

SEQ ID NO: 4638138 - DNA, 15 bp, Homo sapiens
tacattatgaagaat

SEQ ID NO: 4638139 - DNA, 19 bp, Homo sapiens
tacattctgcctagagtgt

SEQ ID NO: 4638140 - DNA, 13 bp, Homo sapiens
tacatttattcat

SEQ ID NO: 4638141 - DNA, 18 bp, Homo sapiens
tacatttcacaggctaat

SEQ ID NO: 4638142 - DNA, 14 bp, Homo sapiens
tacattttattctg

SEQ ID NO: 4638143 - DNA, 18 bp, Homo sapiens
tacattttcagtaccaaa

SEQ ID NO: 4638144 - DNA, 20 bp, Homo sapiens
tacattttcagtaccaaaga

SEQ ID NO: 4638145 - DNA, 13 bp, Homo sapiens
tacattttctaaa

SEQ ID NO: 4638146 - DNA, 15 bp, Homo sapiens
tacattttgtaaaat

SEQ ID NO: 4638147 - DNA, 14 bp, Homo sapiens
taccaagttgtgct

SEQ ID NO: 4638148 - DNA, 12 bp, Homo sapiens
taccagtacttg

SEQ ID NO: 4638149 - DNA, 17 bp, Homo sapiens
taccagtgacgctgctg

SEQ ID NO: 4638150 - DNA, 14 bp, Homo sapiens
taccatatgatctg

SEQ ID NO: 4638151 - DNA, 16 bp, Homo sapiens
taccatcttaatcttt

SEQ ID NO: 4638152 - DNA, 16 bp, Homo sapiens
taccattaacattttt

SEQ ID NO: 4638153 - DNA, 22 bp, Homo sapiens
tacccaccgggccactccttcc

SEQ ID NO: 4638154 - DNA, 18 bp, Homo sapiens
tacccagggtggagtgca

SEQ ID NO: 4638155 - DNA, 13 bp, Homo sapiens
tacccatcttgct

SEQ ID NO: 4638156 - DNA, 16 bp, Homo sapiens
tacccatcttgcttcc

SEQ ID NO: 4638157 - DNA, 17 bp, Homo sapiens
tacccatcttgcttcca

SEQ ID NO: 4638158 - DNA, 22 bp, Homo sapiens
tacccatcttgcttccaagacc

SEQ ID NO: 4638159 - DNA, 23 bp, Homo sapiens
tacccatcttgcttccaagacca

SEQ ID NO: 4638160 - DNA, 17 bp, Homo sapiens
tacccattgttcccttc

SEQ ID NO: 4638161 - DNA, 21 bp, Homo sapiens
taccctggaaaagtgttaggg

SEQ ID NO: 4638162 - DNA, 17 bp, Homo sapiens
taccctgtacatatgta

SEQ ID NO: 4638163 - DNA, 15 bp, Homo sapiens
tacccttttcctttt

SEQ ID NO: 4638164 - DNA, 14 bp, Homo sapiens
taccctttttcatt

SEQ ID NO: 4638165 - DNA, 15 bp, Homo sapiens
taccgcagtggctct

SEQ ID NO: 4638166 - DNA, 18 bp, Homo sapiens
taccggattctctcttta

SEQ ID NO: 4638167 - DNA, 22 bp, Homo sapiens
taccgtaattgctttgtgcctt

SEQ ID NO: 4638168 - DNA, 15 bp, Homo sapiens
tacctcaaactatct

SEQ ID NO: 4638169 - DNA, 18 bp, Homo sapiens
tacctcaagccccatttc

SEQ ID NO: 4638170 - DNA, 18 bp, Homo sapiens
tacctcagataatatgtt

SEQ ID NO: 4638171 - DNA, 17 bp, Homo sapiens
tacctcaggtgccaacc

SEQ ID NO: 4638172 - DNA, 18 bp, Homo sapiens
tacctcaggtgccaaccc

SEQ ID NO: 4638173 - DNA, 12 bp, Homo sapiens
tacctctgtgtg

SEQ ID NO: 4638174 - DNA, 18 bp, Homo sapiens
tacctgggtgattacata

SEQ ID NO: 4638175 - DNA, 17 bp, Homo sapiens
tacctgtccaagacagg

SEQ ID NO: 4638176 - DNA, 16 bp, Homo sapiens
tacctgtgtggacagg

SEQ ID NO: 4638177 - DNA, 12 bp, Homo sapiens
tacctgtgtgtt

SEQ ID NO: 4638178 - DNA, 13 bp, Homo sapiens
taccttctcccag

SEQ ID NO: 4638179 - DNA, 15 bp, Homo sapiens
taccttctcccaggc

SEQ ID NO: 4638180 - DNA, 11 bp, Homo sapiens
tacctttaaat

SEQ ID NO: 4638181 - DNA, 21 bp, Homo sapiens
tacgaataaacgcagaagagg

SEQ ID NO: 4638182 - DNA, 18 bp, Homo sapiens
tacgagaaaatctgcatg

SEQ ID NO: 4638183 - DNA, 20 bp, Homo sapiens
tacgattatacttgagattt

SEQ ID NO: 4638184 - DNA, 15 bp, Homo sapiens
tacgcactggacagc

SEQ ID NO: 4638185 - DNA, 22 bp, Homo sapiens
tacgcactggacagcatcagaa

SEQ ID NO: 4638186 - DNA, 13 bp, Homo sapiens
tacgctgaagatg

SEQ ID NO: 4638187 - DNA, 22 bp, Homo sapiens
tacgctgaagatggcatcctgt

SEQ ID NO: 4638188 - DNA, 13 bp, Homo sapiens
tacgtctgggaga

SEQ ID NO: 4638189 - DNA, 21 bp, Homo sapiens
tacgtctgggagaaattgaca

SEQ ID NO: 4638190 - DNA, 11 bp, Homo sapiens
tacgtgagaaa

SEQ ID NO: 4638191 - DNA, 12 bp, Homo sapiens
tacgtgtgaaat

SEQ ID NO: 4638192 - DNA, 18 bp, Homo sapiens
tacgtgtgaaatctgtct

SEQ ID NO: 4638193 - DNA, 22 bp, Homo sapiens
tactaaggagtaatctgtgtac

SEQ ID NO: 4638194 - DNA, 18 bp, Homo sapiens
tactaagggaacaatcca

SEQ ID NO: 4638195 - DNA, 17 bp, Homo sapiens
tactaatagagtactta

SEQ ID NO: 4638196 - DNA, 20 bp, Homo sapiens
tactaatagagtacttaata

SEQ ID NO: 4638197 - DNA, 15 bp, Homo sapiens
tactacacattttta

SEQ ID NO: 4638198 - DNA, 22 bp, Homo sapiens
tactacacatttttaaattgtt

SEQ ID NO: 4638199 - DNA, 16 bp, Homo sapiens
tactacccatagaaaa

SEQ ID NO: 4638200 - DNA, 16 bp, Homo sapiens
tactactttaaatcct

SEQ ID NO: 4638201 - DNA, 22 bp, Homo sapiens
tactactttaaatcctaccaaa

SEQ ID NO: 4638202 - DNA, 13 bp, Homo sapiens
tactagaatgctt

SEQ ID NO: 4638203 - DNA, 16 bp, Homo sapiens
tactcagtcaaacact

SEQ ID NO: 4638204 - DNA, 21 bp, Homo sapiens
tactcagtttatgttgtacaa

SEQ ID NO: 4638205 - DNA, 17 bp, Homo sapiens
tactcctgtgggagcct

SEQ ID NO: 4638206 - DNA, 21 bp, Homo sapiens
tactctgctttttttctactg

SEQ ID NO: 4638207 - DNA, 19 bp, Homo sapiens
tactctgtgccagagcctg

SEQ ID NO: 4638208 - DNA, 13 bp, Homo sapiens
tactctgttgcct

SEQ ID NO: 4638209 - DNA, 16 bp, Homo sapiens
tactcttgaaaggcca

SEQ ID NO: 4638210 - DNA, 14 bp, Homo sapiens
tactctttttgttt

SEQ ID NO: 4638211 - DNA, 14 bp, Homo sapiens
tactgaaaatccaa

SEQ ID NO: 4638212 - DNA, 16 bp, Homo sapiens
tactgaaggtctgaca

SEQ ID NO: 4638213 - DNA, 15 bp, Homo sapiens
tactgaataatatca

SEQ ID NO: 4638214 - DNA, 18 bp, Homo sapiens
tactgaataatatcaaat

SEQ ID NO: 4638215 - DNA, 17 bp, Homo sapiens
tactgacagaagttatt

SEQ ID NO: 4638216 - DNA, 18 bp, Homo sapiens
tactgatgagtcttgatc

SEQ ID NO: 4638217 - DNA, 14 bp, Homo sapiens
tactgattgtttca

SEQ ID NO: 4638218 - DNA, 16 bp, Homo sapiens
tactgcagcacctcca

SEQ ID NO: 4638219 - DNA, 18 bp, Homo sapiens
tactgcattctctcccat

SEQ ID NO: 4638220 - DNA, 19 bp, Homo sapiens
tactgcattctctcccatc

SEQ ID NO: 4638221 - DNA, 10 bp, Homo sapiens
tactgcctgc

SEQ ID NO: 4638222 - DNA, 14 bp, Homo sapiens
tactgcctgcttgg

SEQ ID NO: 4638223 - DNA, 18 bp, Homo sapiens
tactgctgcttgtcaaat

SEQ ID NO: 4638224 - DNA, 20 bp, Homo sapiens
tactgggccatgttgtgcct

SEQ ID NO: 4638225 - DNA, 12 bp, Homo sapiens
tactgggcctta

SEQ ID NO: 4638226 - DNA, 12 bp, Homo sapiens
tactgtatactg

SEQ ID NO: 4638227 - DNA, 18 bp, Homo sapiens
tactgtatactgaaggtc

SEQ ID NO: 4638228 - DNA, 16 bp, Homo sapiens
tactgttcatacagtt

SEQ ID NO: 4638229 - DNA, 20 bp, Homo sapiens
tactgttcatacagttttat

SEQ ID NO: 4638230 - DNA, 17 bp, Homo sapiens
tactgttcttcatttta

SEQ ID NO: 4638231 - DNA, 21 bp, Homo sapiens
tacttaagctcccctgcctta

SEQ ID NO: 4638232 - DNA, 17 bp, Homo sapiens
tacttcataagatattc

SEQ ID NO: 4638233 - DNA, 12 bp, Homo sapiens
tacttcctctgt

SEQ ID NO: 4638234 - DNA, 14 bp, Homo sapiens
tacttcctctgtga

SEQ ID NO: 4638235 - DNA, 18 bp, Homo sapiens
tacttcctctgtgaactg

SEQ ID NO: 4638236 - DNA, 18 bp, Homo sapiens
tacttgaagaaacagagt

SEQ ID NO: 4638237 - DNA, 19 bp, Homo sapiens
tacttgaaggtacacccca

SEQ ID NO: 4638238 - DNA, 14 bp, Homo sapiens
tacttgtcaaagaa

SEQ ID NO: 4638239 - DNA, 18 bp, Homo sapiens
tacttgtcaaagaaggtt

SEQ ID NO: 4638240 - DNA, 14 bp, Homo sapiens
tactttaaacttgt

SEQ ID NO: 4638241 - DNA, 18 bp, Homo sapiens
tactttacacaattctta

SEQ ID NO: 4638242 - DNA, 13 bp, Homo sapiens
tactttgtagact

SEQ ID NO: 4638243 - DNA, 19 bp, Homo sapiens
tactttgtagactgtttca

SEQ ID NO: 4638244 - DNA, 22 bp, Homo sapiens
tacttttctgtttagttttaca

SEQ ID NO: 4638245 - DNA, 19 bp, Homo sapiens
tactttttagtaatttctt

SEQ ID NO: 4638246 - DNA, 18 bp, Homo sapiens
tacttttttaaatatttt

SEQ ID NO: 4638247 - DNA, 12 bp, Homo sapiens
tagaaaaggaac

SEQ ID NO: 4638248 - DNA, 11 bp, Homo sapiens
tagaaaaggcg

SEQ ID NO: 4638249 - DNA, 21 bp, Homo sapiens
tagaaaatgacttatttctgc

SEQ ID NO: 4638250 - DNA, 19 bp, Homo sapiens
tagaaaattatttgtatga

SEQ ID NO: 4638251 - DNA, 17 bp, Homo sapiens
tagaaacttcatggttt

SEQ ID NO: 4638252 - DNA, 21 bp, Homo sapiens
tagaaagaaactaaacagaaa

SEQ ID NO: 4638253 - DNA, 21 bp, Homo sapiens
tagaaagtgcttagaggttct

SEQ ID NO: 4638254 - DNA, 22 bp, Homo sapiens
tagaaagttctgtgtaaacaga

SEQ ID NO: 4638255 - DNA, 13 bp, Homo sapiens
tagaaatgcatat

SEQ ID NO: 4638256 - DNA, 17 bp, Homo sapiens
tagaaatggaaattttg

SEQ ID NO: 4638257 - DNA, 19 bp, Homo sapiens
tagaaatttttcagatgct

SEQ ID NO: 4638258 - DNA, 23 bp, Homo sapiens
tagaacaggttcttaaaaaggaa

SEQ ID NO: 4638259 - DNA, 14 bp, Homo sapiens
tagaacctccctcc

SEQ ID NO: 4638260 - DNA, 18 bp, Homo sapiens
tagaagatggcacttata

SEQ ID NO: 4638261 - DNA, 23 bp, Homo sapiens
tagaagcaaattaaacggtaaca

SEQ ID NO: 4638262 - DNA, 20 bp, Homo sapiens
tagaagcaaggagaaaatat

SEQ ID NO: 4638263 - DNA, 17 bp, Homo sapiens
tagaaggcttaagaact

SEQ ID NO: 4638264 - DNA, 12 bp, Homo sapiens
tagaataattct

SEQ ID NO: 4638265 - DNA, 21 bp, Homo sapiens
tagaatagcctgtggcctttg

SEQ ID NO: 4638266 - DNA, 14 bp, Homo sapiens
tagaatgagatctg

SEQ ID NO: 4638267 - DNA, 21 bp, Homo sapiens
tagaatggataaaataatgct

SEQ ID NO: 4638268 - DNA, 21 bp, Homo sapiens
tagaattccttcgaaaggcct

SEQ ID NO: 4638269 - DNA, 17 bp, Homo sapiens
tagacagttagagactc

SEQ ID NO: 4638270 - DNA, 22 bp, Homo sapiens
tagaccagggctgctctttcca

SEQ ID NO: 4638271 - DNA, 21 bp, Homo sapiens
tagacctctggttaatttata

SEQ ID NO: 4638272 - DNA, 16 bp, Homo sapiens
tagacctgtctcctgg

SEQ ID NO: 4638273 - DNA, 13 bp, Homo sapiens
tagactgtgtctg

SEQ ID NO: 4638274 - DNA, 23 bp, Homo sapiens
tagactgtgtctgaatcatgtct

SEQ ID NO: 4638275 - DNA, 17 bp, Homo sapiens
tagagacttttttctag

SEQ ID NO: 4638276 - DNA, 15 bp, Homo sapiens
tagagatatttcaag

SEQ ID NO: 4638277 - DNA, 22 bp, Homo sapiens
tagagatatttcaagctcatgt

SEQ ID NO: 4638278 - DNA, 23 bp, Homo sapiens
tagagatgaagtttgtagttgtt

SEQ ID NO: 4638279 - DNA, 13 bp, Homo sapiens
tagagatgagccc

SEQ ID NO: 4638280 - DNA, 15 bp, Homo sapiens
tagagatgaggtttc

SEQ ID NO: 4638281 - DNA, 17 bp, Homo sapiens
tagagcaaaatcaacat

SEQ ID NO: 4638282 - DNA, 18 bp, Homo sapiens
tagagtacttaatatact

SEQ ID NO: 4638283 - DNA, 11 bp, Homo sapiens
tagagtgtagc

SEQ ID NO: 4638284 - DNA, 20 bp, Homo sapiens
tagagtgtagcctaaagggc

SEQ ID NO: 4638285 - DNA, 22 bp, Homo sapiens
tagagtgtagcctaaagggcag

SEQ ID NO: 4638286 - DNA, 15 bp, Homo sapiens
tagagtgtagctgta

SEQ ID NO: 4638287 - DNA, 13 bp, Homo sapiens
tagataatttgaa

SEQ ID NO: 4638288 - DNA, 18 bp, Homo sapiens
tagatacacttcttaaat

SEQ ID NO: 4638289 - DNA, 16 bp, Homo sapiens
tagatagaagaatttt

SEQ ID NO: 4638290 - DNA, 21 bp, Homo sapiens
tagatgggagggaggctcagg

SEQ ID NO: 4638291 - DNA, 17 bp, Homo sapiens
tagatgttgctctttca

SEQ ID NO: 4638292 - DNA, 15 bp, Homo sapiens
tagcaactaatgttt

SEQ ID NO: 4638293 - DNA, 11 bp, Homo sapiens
tagcagacagg

SEQ ID NO: 4638294 - DNA, 13 bp, Homo sapiens
tagcagacaggcc

SEQ ID NO: 4638295 - DNA, 23 bp, Homo sapiens
tagcagacctaaagcaagcctga

SEQ ID NO: 4638296 - DNA, 20 bp, Homo sapiens
tagcagcaccgttctgtgca

SEQ ID NO: 4638297 - DNA, 21 bp, Homo sapiens
tagcaggaacttctagctcat

SEQ ID NO: 4638298 - DNA, 17 bp, Homo sapiens
tagcagtgtgaagtaca

SEQ ID NO: 4638299 - DNA, 20 bp, Homo sapiens
tagcatggggattgcagagt

SEQ ID NO: 4638300 - DNA, 14 bp, Homo sapiens
tagcatttttgtaa

SEQ ID NO: 4638301 - DNA, 20 bp, Homo sapiens
tagccaactgtttccctgct

SEQ ID NO: 4638302 - DNA, 15 bp, Homo sapiens
tagccagatttgtct

SEQ ID NO: 4638303 - DNA, 23 bp, Homo sapiens
tagccagccggggcgagtggcac

SEQ ID NO: 4638304 - DNA, 14 bp, Homo sapiens
tagccagctgctcc

SEQ ID NO: 4638305 - DNA, 19 bp, Homo sapiens
tagccaggtctcctgggaa

SEQ ID NO: 4638306 - DNA, 21 bp, Homo sapiens
tagccaggtctcctgggaaag

SEQ ID NO: 4638307 - DNA, 18 bp, Homo sapiens
tagccatgatggcaacag

SEQ ID NO: 4638308 - DNA, 13 bp, Homo sapiens
tagcccagagtga

SEQ ID NO: 4638309 - DNA, 12 bp, Homo sapiens
tagccctgccct

SEQ ID NO: 4638310 - DNA, 17 bp, Homo sapiens
tagcctaaagggcaggg

SEQ ID NO: 4638311 - DNA, 15 bp, Homo sapiens
tagcctgcaaagctg

SEQ ID NO: 4638312 - DNA, 21 bp, Homo sapiens
tagcctttgggcacaattcct

SEQ ID NO: 4638313 - DNA, 17 bp, Homo sapiens
tagctaaattcagggag

SEQ ID NO: 4638314 - DNA, 15 bp, Homo sapiens
tagctaataatgtta

SEQ ID NO: 4638315 - DNA, 16 bp, Homo sapiens
tagctacttggcaggc

SEQ ID NO: 4638316 - DNA, 18 bp, Homo sapiens
tagctacttttgcaggat

SEQ ID NO: 4638317 - DNA, 15 bp, Homo sapiens
tagctctctaggcct

SEQ ID NO: 4638318 - DNA, 17 bp, Homo sapiens
tagctctctaggcctct

SEQ ID NO: 4638319 - DNA, 19 bp, Homo sapiens
tagctcttttttgtttgtt

SEQ ID NO: 4638320 - DNA, 22 bp, Homo sapiens
tagctgaaaagggcactcccaa

SEQ ID NO: 4638321 - DNA, 23 bp, Homo sapiens
tagctgaaaagggcactcccaac

SEQ ID NO: 4638322 - DNA, 21 bp, Homo sapiens
tagctgagctcacaaggcagc

SEQ ID NO: 4638323 - DNA, 22 bp, Homo sapiens
tagctggctctgtgagggtgct

SEQ ID NO: 4638324 - DNA, 17 bp, Homo sapiens
tagctgtaagggcagtg

SEQ ID NO: 4638325 - DNA, 20 bp, Homo sapiens
tagctgtaagggcagtgccc

SEQ ID NO: 4638326 - DNA, 15 bp, Homo sapiens
tagctgtgacctgct

SEQ ID NO: 4638327 - DNA, 19 bp, Homo sapiens
tagctgtgacctgctgagc

SEQ ID NO: 4638328 - DNA, 24 bp, Homo sapiens
tagctgtgacctgctgagctctga

SEQ ID NO: 4638329 - DNA, 14 bp, Homo sapiens
tagctgtttcaaat

SEQ ID NO: 4638330 - DNA, 20 bp, Homo sapiens
tagctttccaaggaagcaga

SEQ ID NO: 4638331 - DNA, 13 bp, Homo sapiens
tagctttcctgga

SEQ ID NO: 4638332 - DNA, 15 bp, Homo sapiens
tagctttcctggaag

SEQ ID NO: 4638333 - DNA, 18 bp, Homo sapiens
tagctttttattatttta

SEQ ID NO: 4638334 - DNA, 16 bp, Homo sapiens
taggaaaatgcttatt

SEQ ID NO: 4638335 - DNA, 14 bp, Homo sapiens
taggaacagcccag

SEQ ID NO: 4638336 - DNA, 18 bp, Homo sapiens
taggaatggaggagccag

SEQ ID NO: 4638337 - DNA, 19 bp, Homo sapiens
taggaattcttttggggaa

SEQ ID NO: 4638338 - DNA, 14 bp, Homo sapiens
taggaattggaggc

SEQ ID NO: 4638339 - DNA, 17 bp, Homo sapiens
taggagcaaagcctgtt

SEQ ID NO: 4638340 - DNA, 19 bp, Homo sapiens
taggatagctaactgtaaa

SEQ ID NO: 4638341 - DNA, 15 bp, Homo sapiens
taggatttttttcct

SEQ ID NO: 4638342 - DNA, 20 bp, Homo sapiens
taggcatttcctgctgaacg

SEQ ID NO: 4638343 - DNA, 22 bp, Homo sapiens
taggccaggtgcaaccagggag

SEQ ID NO: 4638344 - DNA, 22 bp, Homo sapiens
taggccccacaaggcctggtct

SEQ ID NO: 4638345 - DNA, 13 bp, Homo sapiens
taggccccagagg

SEQ ID NO: 4638346 - DNA, 19 bp, Homo sapiens
taggccccagaggccctgg

SEQ ID NO: 4638347 - DNA, 13 bp, Homo sapiens
taggctaatgtca

SEQ ID NO: 4638348 - DNA, 15 bp, Homo sapiens
taggctgcaaaatta

SEQ ID NO: 4638349 - DNA, 15 bp, Homo sapiens
taggctggaatgttc

SEQ ID NO: 4638350 - DNA, 21 bp, Homo sapiens
tagggactgccaggctgtttc

SEQ ID NO: 4638351 - DNA, 16 bp, Homo sapiens
tagggcactgggctgt

SEQ ID NO: 4638352 - DNA, 20 bp, Homo sapiens
tagggcagattttcatgcaa

SEQ ID NO: 4638353 - DNA, 17 bp, Homo sapiens
tagggcagattttggtt

SEQ ID NO: 4638354 - DNA, 23 bp, Homo sapiens
taggtagtcatgctgtgcatttt

SEQ ID NO: 4638355 - DNA, 17 bp, Homo sapiens
taggtcataaagcattg

SEQ ID NO: 4638356 - DNA, 15 bp, Homo sapiens
taggtcttcctgtgg

SEQ ID NO: 4638357 - DNA, 18 bp, Homo sapiens
taggtcttcctgtggctc

SEQ ID NO: 4638358 - DNA, 23 bp, Homo sapiens
taggtcttcctgtggctccctct

SEQ ID NO: 4638359 - DNA, 22 bp, Homo sapiens
taggtggtaaaacctgttctcc

SEQ ID NO: 4638360 - DNA, 18 bp, Homo sapiens
taggttatacaataaccc

SEQ ID NO: 4638361 - DNA, 12 bp, Homo sapiens
taggtttctctc

SEQ ID NO: 4638362 - DNA, 17 bp, Homo sapiens
taggtttctctccctcc

SEQ ID NO: 4638363 - DNA, 14 bp, Homo sapiens
tagtaaacatatgt

SEQ ID NO: 4638364 - DNA, 17 bp, Homo sapiens
tagtaaacatatgttcc

SEQ ID NO: 4638365 - DNA, 16 bp, Homo sapiens
tagtaaatcagaaagt

SEQ ID NO: 4638366 - DNA, 18 bp, Homo sapiens
tagtaaccaaggccctgt

SEQ ID NO: 4638367 - DNA, 20 bp, Homo sapiens
tagtaatttctttttttcct

SEQ ID NO: 4638368 - DNA, 16 bp, Homo sapiens
tagtagttaaataact

SEQ ID NO: 4638369 - DNA, 16 bp, Homo sapiens
tagtataagcttttca

SEQ ID NO: 4638370 - DNA, 16 bp, Homo sapiens
tagtatagtctccctt

SEQ ID NO: 4638371 - DNA, 11 bp, Homo sapiens
tagtatctgta

SEQ ID NO: 4638372 - DNA, 19 bp, Homo sapiens
tagtatgttcaactctcat

SEQ ID NO: 4638373 - DNA, 23 bp, Homo sapiens
tagtcacatggcctatgcacata

SEQ ID NO: 4638374 - DNA, 13 bp, Homo sapiens
tagtcataataaa

SEQ ID NO: 4638375 - DNA, 18 bp, Homo sapiens
tagtcgcccctcagagca

SEQ ID NO: 4638376 - DNA, 19 bp, Homo sapiens
tagtctcactgcttgaact

SEQ ID NO: 4638377 - DNA, 22 bp, Homo sapiens
tagtctgggtcagacccatctc

SEQ ID NO: 4638378 - DNA, 15 bp, Homo sapiens
tagtgagcgagtgga

SEQ ID NO: 4638379 - DNA, 21 bp, Homo sapiens
tagtgagcgagtggatgctgt

SEQ ID NO: 4638380 - DNA, 21 bp, Homo sapiens
tagtgcaattccaagaaaata

SEQ ID NO: 4638381 - DNA, 14 bp, Homo sapiens
tagtgggccagggc

SEQ ID NO: 4638382 - DNA, 15 bp, Homo sapiens
tagtgtaatatacca

SEQ ID NO: 4638383 - DNA, 19 bp, Homo sapiens
tagtgtgacagtttccaaa

SEQ ID NO: 4638384 - DNA, 16 bp, Homo sapiens
tagttaaggagcctaa

SEQ ID NO: 4638385 - DNA, 12 bp, Homo sapiens
tagttattttaa

SEQ ID NO: 4638386 - DNA, 17 bp, Homo sapiens
tagttattttaatacct

SEQ ID NO: 4638387 - DNA, 13 bp, Homo sapiens
tagttccctctgc

SEQ ID NO: 4638388 - DNA, 20 bp, Homo sapiens
tagttctataagtgaggaag

SEQ ID NO: 4638389 - DNA, 16 bp, Homo sapiens
tagttctttcctcccc

SEQ ID NO: 4638390 - DNA, 22 bp, Homo sapiens
tagttctttcctccccctgcaa

SEQ ID NO: 4638391 - DNA, 14 bp, Homo sapiens
tagttgcagcccaa

SEQ ID NO: 4638392 - DNA, 19 bp, Homo sapiens
tagttggaactttctgttc

SEQ ID NO: 4638393 - DNA, 18 bp, Homo sapiens
tagttggtctttccatct

SEQ ID NO: 4638394 - DNA, 13 bp, Homo sapiens
tagttggttccta

SEQ ID NO: 4638395 - DNA, 15 bp, Homo sapiens
tagttgtctgtgctt

SEQ ID NO: 4638396 - DNA, 16 bp, Homo sapiens
tagttgttttaagtac

SEQ ID NO: 4638397 - DNA, 15 bp, Homo sapiens
tagtttcctatggaa

SEQ ID NO: 4638398 - DNA, 15 bp, Homo sapiens
tagtttttatatgtt

SEQ ID NO: 4638399 - DNA, 19 bp, Homo sapiens
tagtttttggaaaaacctt

SEQ ID NO: 4638400 - DNA, 12 bp, Homo sapiens
tataaactcatt

SEQ ID NO: 4638401 - DNA, 22 bp, Homo sapiens
tataaagttggttcacttcaaa

SEQ ID NO: 4638402 - DNA, 17 bp, Homo sapiens
tataaatacgtattaca

SEQ ID NO: 4638403 - DNA, 17 bp, Homo sapiens
tataaatgatatcaaag

SEQ ID NO: 4638404 - DNA, 16 bp, Homo sapiens
tataaatggacctttt

SEQ ID NO: 4638405 - DNA, 19 bp, Homo sapiens
tataaatggaccttttata

SEQ ID NO: 4638406 - DNA, 14 bp, Homo sapiens
tataaattgtacat

SEQ ID NO: 4638407 - DNA, 17 bp, Homo sapiens
tataacgtgatacattt

SEQ ID NO: 4638408 - DNA, 13 bp, Homo sapiens
tataagaaaagta

SEQ ID NO: 4638409 - DNA, 19 bp, Homo sapiens
tataagaaaagtaatgaag

SEQ ID NO: 4638410 - DNA, 20 bp, Homo sapiens
tataagtagtaaatcagaaa

SEQ ID NO: 4638411 - DNA, 21 bp, Homo sapiens
tataagtagtaaatcagaaag

SEQ ID NO: 4638412 - DNA, 22 bp, Homo sapiens
tataagtgagatggtatgaaat

SEQ ID NO: 4638413 - DNA, 15 bp, Homo sapiens
tataatcttatacaa

SEQ ID NO: 4638414 - DNA, 16 bp, Homo sapiens
tataatcttatacaac

SEQ ID NO: 4638415 - DNA, 20 bp, Homo sapiens
tataatgttgataatatata

SEQ ID NO: 4638416 - DNA, 16 bp, Homo sapiens
tataattaatgtttgt

SEQ ID NO: 4638417 - DNA, 23 bp, Homo sapiens
tataattgaattggtttttccca

SEQ ID NO: 4638418 - DNA, 18 bp, Homo sapiens
tataatttactttgtaga

SEQ ID NO: 4638419 - DNA, 19 bp, Homo sapiens
tataatttatttccactaa

SEQ ID NO: 4638420 - DNA, 15 bp, Homo sapiens
tataattttttaaag

SEQ ID NO: 4638421 - DNA, 21 bp, Homo sapiens
tatacaccatatactgttctt

SEQ ID NO: 4638422 - DNA, 17 bp, Homo sapiens
tatacagacctaatatc

SEQ ID NO: 4638423 - DNA, 13 bp, Homo sapiens
tatacagaggaaa

SEQ ID NO: 4638424 - DNA, 13 bp, Homo sapiens
tatacatacatgt

SEQ ID NO: 4638425 - DNA, 14 bp, Homo sapiens
tatacatacatgta

SEQ ID NO: 4638426 - DNA, 15 bp, Homo sapiens
tatacatacatgtat

SEQ ID NO: 4638427 - DNA, 16 bp, Homo sapiens
tatacatagtctttgt

SEQ ID NO: 4638428 - DNA, 23 bp, Homo sapiens
tatacatcagtatagtgttttat

SEQ ID NO: 4638429 - DNA, 13 bp, Homo sapiens
tatacattttcta

SEQ ID NO: 4638430 - DNA, 15 bp, Homo sapiens
tatacattttctaaa

SEQ ID NO: 4638431 - DNA, 17 bp, Homo sapiens
tatacattttctaaata

SEQ ID NO: 4638432 - DNA, 14 bp, Homo sapiens
tataccagcagaaa

SEQ ID NO: 4638433 - DNA, 14 bp, Homo sapiens
tatagactgtacat

SEQ ID NO: 4638434 - DNA, 19 bp, Homo sapiens
tatagagataaatagaaat

SEQ ID NO: 4638435 - DNA, 14 bp, Homo sapiens
tatagcaactaatg

SEQ ID NO: 4638436 - DNA, 13 bp, Homo sapiens
tatagcaagatat

SEQ ID NO: 4638437 - DNA, 21 bp, Homo sapiens
tatagctgagactacaagtgt

SEQ ID NO: 4638438 - DNA, 11 bp, Homo sapiens
tataggaacag

SEQ ID NO: 4638439 - DNA, 12 bp, Homo sapiens
tataggaacagc

SEQ ID NO: 4638440 - DNA, 23 bp, Homo sapiens
tataggaacagcccagcacaggt

SEQ ID NO: 4638441 - DNA, 15 bp, Homo sapiens
tataggagccccagg

SEQ ID NO: 4638442 - DNA, 15 bp, Homo sapiens
tataggctagactta

SEQ ID NO: 4638443 - DNA, 13 bp, Homo sapiens
tataggttctttt

SEQ ID NO: 4638444 - DNA, 13 bp, Homo sapiens
tatagtatctgta

SEQ ID NO: 4638445 - DNA, 21 bp, Homo sapiens
tatagttgtcagtattattct

SEQ ID NO: 4638446 - DNA, 14 bp, Homo sapiens
tatataacaaataa

SEQ ID NO: 4638447 - DNA, 16 bp, Homo sapiens
tatatacagaggaaat

SEQ ID NO: 4638448 - DNA, 13 bp, Homo sapiens
tatatcatgcaaa

SEQ ID NO: 4638449 - DNA, 18 bp, Homo sapiens
tatatcatgtaaagaaat

SEQ ID NO: 4638450 - DNA, 15 bp, Homo sapiens
tatatctctatttga

SEQ ID NO: 4638451 - DNA, 19 bp, Homo sapiens
tatatctgggttaagtgtt

SEQ ID NO: 4638452 - DNA, 20 bp, Homo sapiens
tatatctgggttaagtgttt

SEQ ID NO: 4638453 - DNA, 15 bp, Homo sapiens
tatatctgtctttta

SEQ ID NO: 4638454 - DNA, 11 bp, Homo sapiens
tatatgtcttg

SEQ ID NO: 4638455 - DNA, 19 bp, Homo sapiens
tatatgtgtatacatacat

SEQ ID NO: 4638456 - DNA, 14 bp, Homo sapiens
tatatgttcactgt

SEQ ID NO: 4638457 - DNA, 17 bp, Homo sapiens
tatattagctgaaacaa

SEQ ID NO: 4638458 - DNA, 13 bp, Homo sapiens
tatattatgttta

SEQ ID NO: 4638459 - DNA, 15 bp, Homo sapiens
tatattttaccatac

SEQ ID NO: 4638460 - DNA, 13 bp, Homo sapiens
tatattttatctt

SEQ ID NO: 4638461 - DNA, 14 bp, Homo sapiens
tatattttatcttg

SEQ ID NO: 4638462 - DNA, 18 bp, Homo sapiens
tatattttgtactttgtg

SEQ ID NO: 4638463 - DNA, 20 bp, Homo sapiens
tatatttttagcctaaatgt

SEQ ID NO: 4638464 - DNA, 14 bp, Homo sapiens
tatcaaagagcact

SEQ ID NO: 4638465 - DNA, 18 bp, Homo sapiens
tatcaaataaaatatcat

SEQ ID NO: 4638466 - DNA, 15 bp, Homo sapiens
tatcaaatctaccac

SEQ ID NO: 4638467 - DNA, 18 bp, Homo sapiens
tatcacctagcagcctca

SEQ ID NO: 4638468 - DNA, 20 bp, Homo sapiens
tatcactaaataaacacgat

SEQ ID NO: 4638469 - DNA, 20 bp, Homo sapiens
tatcactgcattatcttgct

SEQ ID NO: 4638470 - DNA, 16 bp, Homo sapiens
tatcagaataggaaga

SEQ ID NO: 4638471 - DNA, 15 bp, Homo sapiens
tatcagactcagttt

SEQ ID NO: 4638472 - DNA, 21 bp, Homo sapiens
tatcagactcagttttttgta

SEQ ID NO: 4638473 - DNA, 16 bp, Homo sapiens
tatcatgtaaagaaat

SEQ ID NO: 4638474 - DNA, 22 bp, Homo sapiens
tatcatgtaaagaaatgtctta

SEQ ID NO: 4638475 - DNA, 19 bp, Homo sapiens
tatcattctttgtatctta

SEQ ID NO: 4638476 - DNA, 22 bp, Homo sapiens
tatcattctttgtatcttaaat

SEQ ID NO: 4638477 - DNA, 20 bp, Homo sapiens
tatcattgattttataattg

SEQ ID NO: 4638478 - DNA, 14 bp, Homo sapiens
tatcattttaaaaa

SEQ ID NO: 4638479 - DNA, 21 bp, Homo sapiens
tatcattttaaaaactttatt

SEQ ID NO: 4638480 - DNA, 12 bp, Homo sapiens
tatcattttatt

SEQ ID NO: 4638481 - DNA, 15 bp, Homo sapiens
tatccatttctcatg

SEQ ID NO: 4638482 - DNA, 12 bp, Homo sapiens
tatccctctcca

SEQ ID NO: 4638483 - DNA, 12 bp, Homo sapiens
tatcctgggacc

SEQ ID NO: 4638484 - DNA, 16 bp, Homo sapiens
tatcctgggggaagag

SEQ ID NO: 4638485 - DNA, 23 bp, Homo sapiens
tatcctgggggaagaggagatgt

SEQ ID NO: 4638486 - DNA, 15 bp, Homo sapiens
tatctaatacctctg

SEQ ID NO: 4638487 - DNA, 20 bp, Homo sapiens
tatctaatacctctgtgtgc

SEQ ID NO: 4638488 - DNA, 14 bp, Homo sapiens
tatctaatatgaag

SEQ ID NO: 4638489 - DNA, 14 bp, Homo sapiens
tatctacattaaaa

SEQ ID NO: 4638490 - DNA, 17 bp, Homo sapiens
tatctacattaaaatga

SEQ ID NO: 4638491 - DNA, 16 bp, Homo sapiens
tatctatatgtacttg

SEQ ID NO: 4638492 - DNA, 19 bp, Homo sapiens
tatctatatgtacttgtca

SEQ ID NO: 4638493 - DNA, 16 bp, Homo sapiens
tatctctatttgagaa

SEQ ID NO: 4638494 - DNA, 11 bp, Homo sapiens
tatctctttct

SEQ ID NO: 4638495 - DNA, 20 bp, Homo sapiens
tatctggaagttgagactta

SEQ ID NO: 4638496 - DNA, 16 bp, Homo sapiens
tatctgggttaagtgt

SEQ ID NO: 4638497 - DNA, 22 bp, Homo sapiens
tatctgtttcctgacattgtct

SEQ ID NO: 4638498 - DNA, 16 bp, Homo sapiens
tatcttaaatctgtga

SEQ ID NO: 4638499 - DNA, 20 bp, Homo sapiens
tatcttaatatatacatttt

SEQ ID NO: 4638500 - DNA, 17 bp, Homo sapiens
tatcttgttattattgt

SEQ ID NO: 4638501 - DNA, 23 bp, Homo sapiens
tatcttgttattattgttaataa

SEQ ID NO: 4638502 - DNA, 22 bp, Homo sapiens
tatctttaaaaaaaaatcttgt

SEQ ID NO: 4638503 - DNA, 21 bp, Homo sapiens
tatgaaaatatagacattctc

SEQ ID NO: 4638504 - DNA, 18 bp, Homo sapiens
tatgaagaatacccagga

SEQ ID NO: 4638505 - DNA, 21 bp, Homo sapiens
tatgaagaatacccaggaaga

SEQ ID NO: 4638506 - DNA, 13 bp, Homo sapiens
tatgaagtgcgtg

SEQ ID NO: 4638507 - DNA, 18 bp, Homo sapiens
tatgaatatcattgattt

SEQ ID NO: 4638508 - DNA, 20 bp, Homo sapiens
tatgaatgcccccagctggc

SEQ ID NO: 4638509 - DNA, 14 bp, Homo sapiens
tatgacaaattcaa

SEQ ID NO: 4638510 - DNA, 17 bp, Homo sapiens
tatgacagataacctaa

SEQ ID NO: 4638511 - DNA, 21 bp, Homo sapiens
tatgacagataacctaataat

SEQ ID NO: 4638512 - DNA, 21 bp, Homo sapiens
tatgacataagcaatcatttt

SEQ ID NO: 4638513 - DNA, 19 bp, Homo sapiens
tatgacatttcttaaaact

SEQ ID NO: 4638514 - DNA, 23 bp, Homo sapiens
tatgacatttcttaaaactttat

SEQ ID NO: 4638515 - DNA, 21 bp, Homo sapiens
tatgacccctggccacagcct

SEQ ID NO: 4638516 - DNA, 14 bp, Homo sapiens
tatgaccctgttta

SEQ ID NO: 4638517 - DNA, 21 bp, Homo sapiens
tatgacttgggcacccccagc

SEQ ID NO: 4638518 - DNA, 18 bp, Homo sapiens
tatgagagtttggaatta

SEQ ID NO: 4638519 - DNA, 18 bp, Homo sapiens
tatgatcagtgttactgc

SEQ ID NO: 4638520 - DNA, 14 bp, Homo sapiens
tatgatgttgctgt

SEQ ID NO: 4638521 - DNA, 17 bp, Homo sapiens
tatgatttaaaaacaac

SEQ ID NO: 4638522 - DNA, 13 bp, Homo sapiens
tatgcaaaatgga

SEQ ID NO: 4638523 - DNA, 13 bp, Homo sapiens
tatgcaaatacaa

SEQ ID NO: 4638524 - DNA, 19 bp, Homo sapiens
tatgcaagatatttttgaa

SEQ ID NO: 4638525 - DNA, 13 bp, Homo sapiens
tatgcacatatgg

SEQ ID NO: 4638526 - DNA, 14 bp, Homo sapiens
tatgcaccttgtgt

SEQ ID NO: 4638527 - DNA, 13 bp, Homo sapiens
tatgcacttttag

SEQ ID NO: 4638528 - DNA, 20 bp, Homo sapiens
tatgcacttttagaaatgca

SEQ ID NO: 4638529 - DNA, 14 bp, Homo sapiens
tatgcattatatca

SEQ ID NO: 4638530 - DNA, 18 bp, Homo sapiens
tatgccacacctggcctt

SEQ ID NO: 4638531 - DNA, 15 bp, Homo sapiens
tatgccacttccttt

SEQ ID NO: 4638532 - DNA, 19 bp, Homo sapiens
tatgccttcttattgcttt

SEQ ID NO: 4638533 - DNA, 18 bp, Homo sapiens
tatgccttggggaggaca

SEQ ID NO: 4638534 - DNA, 18 bp, Homo sapiens
tatgctctcactgtttgt

SEQ ID NO: 4638535 - DNA, 17 bp, Homo sapiens
tatgctcttgaaatatt

SEQ ID NO: 4638536 - DNA, 21 bp, Homo sapiens
tatgctcttgaaatattcaga

SEQ ID NO: 4638537 - DNA, 17 bp, Homo sapiens
tatgctgatcttttaaa

SEQ ID NO: 4638538 - DNA, 20 bp, Homo sapiens
tatgctgatcttttaaaatc

SEQ ID NO: 4638539 - DNA, 15 bp, Homo sapiens
tatggaaaactgtgt

SEQ ID NO: 4638540 - DNA, 15 bp, Homo sapiens
tatggaaatctttta

SEQ ID NO: 4638541 - DNA, 15 bp, Homo sapiens
tatggactctgcaca

SEQ ID NO: 4638542 - DNA, 15 bp, Homo sapiens
tatggagaggcttcc

SEQ ID NO: 4638543 - DNA, 17 bp, Homo sapiens
tatggcaggagctactg

SEQ ID NO: 4638544 - DNA, 17 bp, Homo sapiens
tatggcaggataagaaa

SEQ ID NO: 4638545 - DNA, 15 bp, Homo sapiens
tatggcttatttcta

SEQ ID NO: 4638546 - DNA, 14 bp, Homo sapiens
tatgggtctaggac

SEQ ID NO: 4638547 - DNA, 14 bp, Homo sapiens
tatggtgagatgca

SEQ ID NO: 4638548 - DNA, 20 bp, Homo sapiens
tatggtgagatgcagctgga

SEQ ID NO: 4638549 - DNA, 23 bp, Homo sapiens
tatgtaaaaggccaaacctctgt

SEQ ID NO: 4638550 - DNA, 22 bp, Homo sapiens
tatgtaaacaaaccacagcagg

SEQ ID NO: 4638551 - DNA, 16 bp, Homo sapiens
tatgtaatttcaaaat

SEQ ID NO: 4638552 - DNA, 17 bp, Homo sapiens
tatgtaatttcaaaata

SEQ ID NO: 4638553 - DNA, 21 bp, Homo sapiens
tatgtacagaaaacatgtata

SEQ ID NO: 4638554 - DNA, 15 bp, Homo sapiens
tatgtcactagaatg

SEQ ID NO: 4638555 - DNA, 19 bp, Homo sapiens
tatgtcgtagaattccttc

SEQ ID NO: 4638556 - DNA, 18 bp, Homo sapiens
tatgtcttactactttaa

SEQ ID NO: 4638557 - DNA, 14 bp, Homo sapiens
tatgtcttggacac

SEQ ID NO: 4638558 - DNA, 14 bp, Homo sapiens
tatgtgacattcct

SEQ ID NO: 4638559 - DNA, 19 bp, Homo sapiens
tatgtgattttaactctgt

SEQ ID NO: 4638560 - DNA, 13 bp, Homo sapiens
tatgtgtttactt

SEQ ID NO: 4638561 - DNA, 17 bp, Homo sapiens
tatgttctgtcttccca

SEQ ID NO: 4638562 - DNA, 17 bp, Homo sapiens
tatgtttgtatttggaa

SEQ ID NO: 4638563 - DNA, 15 bp, Homo sapiens
tattaaaatattttg

SEQ ID NO: 4638564 - DNA, 19 bp, Homo sapiens
tattaaacaagtcaattct

SEQ ID NO: 4638565 - DNA, 22 bp, Homo sapiens
tattaaacgtatgcatgtgaag

SEQ ID NO: 4638566 - DNA, 13 bp, Homo sapiens
tattaaactgaat

SEQ ID NO: 4638567 - DNA, 23 bp, Homo sapiens
tattaacaacaataacactgtct

SEQ ID NO: 4638568 - DNA, 14 bp, Homo sapiens
tattaagtaaaatc

SEQ ID NO: 4638569 - DNA, 17 bp, Homo sapiens
tattaagtgtgccaaat

SEQ ID NO: 4638570 - DNA, 24 bp, Homo sapiens
tattaatatttaggagtctatttt

SEQ ID NO: 4638571 - DNA, 19 bp, Homo sapiens
tattaatcaagagaaactt

SEQ ID NO: 4638572 - DNA, 20 bp, Homo sapiens
tattaatcatacaaactctc

SEQ ID NO: 4638573 - DNA, 17 bp, Homo sapiens
tattaatggacaaataa

SEQ ID NO: 4638574 - DNA, 21 bp, Homo sapiens
tattaattgttttgcactttt

SEQ ID NO: 4638575 - DNA, 12 bp, Homo sapiens
tattacaaatgc

SEQ ID NO: 4638576 - DNA, 15 bp, Homo sapiens
tattaccatcttaat

SEQ ID NO: 4638577 - DNA, 16 bp, Homo sapiens
tattaccatcttaatc

SEQ ID NO: 4638578 - DNA, 18 bp, Homo sapiens
tattaccatcttaatctt

SEQ ID NO: 4638579 - DNA, 16 bp, Homo sapiens
tattactgaataatat

SEQ ID NO: 4638580 - DNA, 21 bp, Homo sapiens
tattactgaataatatcaaat

SEQ ID NO: 4638581 - DNA, 22 bp, Homo sapiens
tattactgaataatatcaaata

SEQ ID NO: 4638582 - DNA, 23 bp, Homo sapiens
tattactgaataatatcaaataa

SEQ ID NO: 4638583 - DNA, 16 bp, Homo sapiens
tattactgatgtgtgc

SEQ ID NO: 4638584 - DNA, 18 bp, Homo sapiens
tattactgatgtgtgcaa

SEQ ID NO: 4638585 - DNA, 13 bp, Homo sapiens
tattactgtttct

SEQ ID NO: 4638586 - DNA, 17 bp, Homo sapiens
tattagataatattttt

SEQ ID NO: 4638587 - DNA, 19 bp, Homo sapiens
tattagcagggattctctc

SEQ ID NO: 4638588 - DNA, 18 bp, Homo sapiens
tattagcatggcatattt

SEQ ID NO: 4638589 - DNA, 23 bp, Homo sapiens
tattagcatggcatattttaatc

SEQ ID NO: 4638590 - DNA, 23 bp, Homo sapiens
tattagccaactgtttccctgct

SEQ ID NO: 4638591 - DNA, 12 bp, Homo sapiens
tattatagaaaa

SEQ ID NO: 4638592 - DNA, 19 bp, Homo sapiens
tattatagaaaattatttg

SEQ ID NO: 4638593 - DNA, 15 bp, Homo sapiens
tattatataaactgt

SEQ ID NO: 4638594 - DNA, 13 bp, Homo sapiens
tattatatacata

SEQ ID NO: 4638595 - DNA, 12 bp, Homo sapiens
tattatctttaa

SEQ ID NO: 4638596 - DNA, 16 bp, Homo sapiens
tattatggaaaactgt

SEQ ID NO: 4638597 - DNA, 20 bp, Homo sapiens
tattatggaaaactgtgttg

SEQ ID NO: 4638598 - DNA, 12 bp, Homo sapiens
tattattatctt

SEQ ID NO: 4638599 - DNA, 12 bp, Homo sapiens
tattattttcca

SEQ ID NO: 4638600 - DNA, 14 bp, Homo sapiens
tattattttccaaa

SEQ ID NO: 4638601 - DNA, 19 bp, Homo sapiens
tattcaactaatacatggt

SEQ ID NO: 4638602 - DNA, 20 bp, Homo sapiens
tattcaactaatacatggtt

SEQ ID NO: 4638603 - DNA, 19 bp, Homo sapiens
tattcaactcataagactt

SEQ ID NO: 4638604 - DNA, 20 bp, Homo sapiens
tattcacagttttttaaaaa

SEQ ID NO: 4638605 - DNA, 17 bp, Homo sapiens
tattcatggatggctca

SEQ ID NO: 4638606 - DNA, 15 bp, Homo sapiens
tattcattcattttg

SEQ ID NO: 4638607 - DNA, 13 bp, Homo sapiens
tattcccaagccg

SEQ ID NO: 4638608 - DNA, 17 bp, Homo sapiens
tattccttttaaagaag

SEQ ID NO: 4638609 - DNA, 21 bp, Homo sapiens
tattccttttaaagaagcttt

SEQ ID NO: 4638610 - DNA, 21 bp, Homo sapiens
tattctagcctgcattgagct

SEQ ID NO: 4638611 - DNA, 20 bp, Homo sapiens
tattctcaggtaatcatttt

SEQ ID NO: 4638612 - DNA, 19 bp, Homo sapiens
tattcttattggaaatgta

SEQ ID NO: 4638613 - DNA, 15 bp, Homo sapiens
tattcttcatatcct

SEQ ID NO: 4638614 - DNA, 15 bp, Homo sapiens
tattctttctgcctt

SEQ ID NO: 4638615 - DNA, 12 bp, Homo sapiens
tattgatcaaat

SEQ ID NO: 4638616 - DNA, 24 bp, Homo sapiens
tattgatgaggtttattctatctg

SEQ ID NO: 4638617 - DNA, 21 bp, Homo sapiens
tattgcaaggtgtgatggtct

SEQ ID NO: 4638618 - DNA, 18 bp, Homo sapiens
tattgcagaatgaagcca

SEQ ID NO: 4638619 - DNA, 20 bp, Homo sapiens
tattgcagacctgtcaccct

SEQ ID NO: 4638620 - DNA, 17 bp, Homo sapiens
tattgccttttaatttt

SEQ ID NO: 4638621 - DNA, 19 bp, Homo sapiens
tattgcttgttggattttt

SEQ ID NO: 4638622 - DNA, 14 bp, Homo sapiens
tattgggtttttat

SEQ ID NO: 4638623 - DNA, 17 bp, Homo sapiens
tattgggtttttattgt

SEQ ID NO: 4638624 - DNA, 17 bp, Homo sapiens
tattggttttaaaaaag

SEQ ID NO: 4638625 - DNA, 20 bp, Homo sapiens
tattggttttaaaaaagcat

SEQ ID NO: 4638626 - DNA, 14 bp, Homo sapiens
tattgtaatatgac

SEQ ID NO: 4638627 - DNA, 11 bp, Homo sapiens
tattgtacagt

SEQ ID NO: 4638628 - DNA, 15 bp, Homo sapiens
tattgtttctgcatt

SEQ ID NO: 4638629 - DNA, 15 bp, Homo sapiens
tattgtttttatttc

SEQ ID NO: 4638630 - DNA, 18 bp, Homo sapiens
tattgtttttatttctag

SEQ ID NO: 4638631 - DNA, 18 bp, Homo sapiens
tatttaaattacaatttt

SEQ ID NO: 4638632 - DNA, 14 bp, Homo sapiens
tatttaagcataat

SEQ ID NO: 4638633 - DNA, 14 bp, Homo sapiens
tatttactaactaa

SEQ ID NO: 4638634 - DNA, 19 bp, Homo sapiens
tatttactaactaaatacc

SEQ ID NO: 4638635 - DNA, 14 bp, Homo sapiens
tatttactacctta

SEQ ID NO: 4638636 - DNA, 13 bp, Homo sapiens
tatttactctttg

SEQ ID NO: 4638637 - DNA, 16 bp, Homo sapiens
tatttactctttgcaa

SEQ ID NO: 4638638 - DNA, 15 bp, Homo sapiens
tatttagaactttgt

SEQ ID NO: 4638639 - DNA, 17 bp, Homo sapiens
tatttagaactttgtat

SEQ ID NO: 4638640 - DNA, 16 bp, Homo sapiens
tatttagaagcagagg

SEQ ID NO: 4638641 - DNA, 18 bp, Homo sapiens
tatttagatataacacta

SEQ ID NO: 4638642 - DNA, 13 bp, Homo sapiens
tatttataagaga

SEQ ID NO: 4638643 - DNA, 15 bp, Homo sapiens
tatttataagagaag

SEQ ID NO: 4638644 - DNA, 17 bp, Homo sapiens
tatttatagaatttaat

SEQ ID NO: 4638645 - DNA, 14 bp, Homo sapiens
tatttattgattaa

SEQ ID NO: 4638646 - DNA, 10 bp, Homo sapiens
tatttattgt

SEQ ID NO: 4638647 - DNA, 18 bp, Homo sapiens
tatttcaagctcatgtca

SEQ ID NO: 4638648 - DNA, 22 bp, Homo sapiens
tatttcacacgctgttctaatg

SEQ ID NO: 4638649 - DNA, 23 bp, Homo sapiens
tatttcatgtggtgaatatgcaa

SEQ ID NO: 4638650 - DNA, 14 bp, Homo sapiens
tatttccactaaaa

SEQ ID NO: 4638651 - DNA, 16 bp, Homo sapiens
tatttccttccagcct

SEQ ID NO: 4638652 - DNA, 17 bp, Homo sapiens
tatttccttccagcctt

SEQ ID NO: 4638653 - DNA, 21 bp, Homo sapiens
tatttccttccagccttttta

SEQ ID NO: 4638654 - DNA, 19 bp, Homo sapiens
tatttctagttctttcctc

SEQ ID NO: 4638655 - DNA, 14 bp, Homo sapiens
tatttctattatta

SEQ ID NO: 4638656 - DNA, 20 bp, Homo sapiens
tatttcttcgtgaacataga

SEQ ID NO: 4638657 - DNA, 22 bp, Homo sapiens
tatttctttatatttatccact

SEQ ID NO: 4638658 - DNA, 22 bp, Homo sapiens
tatttgaaaacatataaagcac

SEQ ID NO: 4638659 - DNA, 15 bp, Homo sapiens
tatttgaacaagtgg

SEQ ID NO: 4638660 - DNA, 23 bp, Homo sapiens
tatttgatagatttttcttaaca

SEQ ID NO: 4638661 - DNA, 13 bp, Homo sapiens
tatttgatttcta

SEQ ID NO: 4638662 - DNA, 18 bp, Homo sapiens
tatttgatttctaattgt

SEQ ID NO: 4638663 - DNA, 19 bp, Homo sapiens
tatttgccttctgaaatgt

SEQ ID NO: 4638664 - DNA, 21 bp, Homo sapiens
tatttgctaatcaaagccagg

SEQ ID NO: 4638665 - DNA, 18 bp, Homo sapiens
tatttggaatatttgaat

SEQ ID NO: 4638666 - DNA, 18 bp, Homo sapiens
tatttggagtttttctga

SEQ ID NO: 4638667 - DNA, 17 bp, Homo sapiens
tatttgttcccaagagc

SEQ ID NO: 4638668 - DNA, 21 bp, Homo sapiens
tattttaaactactgattgaa

SEQ ID NO: 4638669 - DNA, 23 bp, Homo sapiens
tattttaagactgattttaatag

SEQ ID NO: 4638670 - DNA, 21 bp, Homo sapiens
tattttaatacctttaaatat

SEQ ID NO: 4638671 - DNA, 14 bp, Homo sapiens
tattttattattca

SEQ ID NO: 4638672 - DNA, 15 bp, Homo sapiens
tattttattattcag

SEQ ID NO: 4638673 - DNA, 17 bp, Homo sapiens
tattttattattcagaa

SEQ ID NO: 4638674 - DNA, 12 bp, Homo sapiens
tattttcaaaga

SEQ ID NO: 4638675 - DNA, 17 bp, Homo sapiens
tattttcagtgcatcat

SEQ ID NO: 4638676 - DNA, 16 bp, Homo sapiens
tattttcccctatcat

SEQ ID NO: 4638677 - DNA, 16 bp, Homo sapiens
tattttcctaatgtga

SEQ ID NO: 4638678 - DNA, 19 bp, Homo sapiens
tattttctattttaagact

SEQ ID NO: 4638679 - DNA, 16 bp, Homo sapiens
tattttctccacttca

SEQ ID NO: 4638680 - DNA, 18 bp, Homo sapiens
tattttgagtttcagctg

SEQ ID NO: 4638681 - DNA, 17 bp, Homo sapiens
tattttggcttcatttc

SEQ ID NO: 4638682 - DNA, 21 bp, Homo sapiens
tattttggcttcatttcaatc

SEQ ID NO: 4638683 - DNA, 22 bp, Homo sapiens
tatttttgaagtaaattaaaca

SEQ ID NO: 4638684 - DNA, 23 bp, Homo sapiens
tatttttgttggagccactctgt

SEQ ID NO: 4638685 - DNA, 11 bp, Homo sapiens
tattttttcct

SEQ ID NO: 4638686 - DNA, 14 bp, Homo sapiens
tattttttggtgtg

SEQ ID NO: 4638687 - DNA, 12 bp, Homo sapiens
tcaaaaagtatt

SEQ ID NO: 4638688 - DNA, 16 bp, Homo sapiens
tcaaaacccttaaaag

SEQ ID NO: 4638689 - DNA, 12 bp, Homo sapiens
tcaaaatacttc

SEQ ID NO: 4638690 - DNA, 21 bp, Homo sapiens
tcaaaatacttctttttcatt

SEQ ID NO: 4638691 - DNA, 16 bp, Homo sapiens
tcaaaatggtgtgcta

SEQ ID NO: 4638692 - DNA, 19 bp, Homo sapiens
tcaaaattgtttaaaaatt

SEQ ID NO: 4638693 - DNA, 20 bp, Homo sapiens
tcaaacattcgtgagctggg

SEQ ID NO: 4638694 - DNA, 15 bp, Homo sapiens
tcaaaccagtcactt

SEQ ID NO: 4638695 - DNA, 17 bp, Homo sapiens
tcaaactatctggccat

SEQ ID NO: 4638696 - DNA, 15 bp, Homo sapiens
tcaaactcctgacct

SEQ ID NO: 4638697 - DNA, 21 bp, Homo sapiens
tcaaagaggctgaggctggca

SEQ ID NO: 4638698 - DNA, 23 bp, Homo sapiens
tcaaagctttcctgtttccaggg

SEQ ID NO: 4638699 - DNA, 19 bp, Homo sapiens
tcaaaggaatataagaaaa

SEQ ID NO: 4638700 - DNA, 18 bp, Homo sapiens
tcaaagtatgcaatgctt

SEQ ID NO: 4638701 - DNA, 16 bp, Homo sapiens
tcaaagtgtctcattc

SEQ ID NO: 4638702 - DNA, 16 bp, Homo sapiens
tcaaataaaatatcat

SEQ ID NO: 4638703 - DNA, 17 bp, Homo sapiens
tcaaataaatgtttccc

SEQ ID NO: 4638704 - DNA, 18 bp, Homo sapiens
tcaaataaatgtttcccc

SEQ ID NO: 4638705 - DNA, 21 bp, Homo sapiens
tcaaataaatgtttcccccac

SEQ ID NO: 4638706 - DNA, 21 bp, Homo sapiens
tcaaatatgagtacaaatgcc

SEQ ID NO: 4638707 - DNA, 22 bp, Homo sapiens
tcaaatccacccatatgttaaa

SEQ ID NO: 4638708 - DNA, 15 bp, Homo sapiens
tcaaatctcttgctt

SEQ ID NO: 4638709 - DNA, 13 bp, Homo sapiens
tcaaatggactgt

SEQ ID NO: 4638710 - DNA, 20 bp, Homo sapiens
tcaaatggactgttacagac

SEQ ID NO: 4638711 - DNA, 15 bp, Homo sapiens
tcaacaaatttcatt

SEQ ID NO: 4638712 - DNA, 17 bp, Homo sapiens
tcaacaaatttcattgc

SEQ ID NO: 4638713 - DNA, 18 bp, Homo sapiens
tcaacaaatttcattgca

SEQ ID NO: 4638714 - DNA, 17 bp, Homo sapiens
tcaacaataaaattttt

SEQ ID NO: 4638715 - DNA, 15 bp, Homo sapiens
tcaacatactgtaat

SEQ ID NO: 4638716 - DNA, 19 bp, Homo sapiens
tcaacatgtagggcaagag

SEQ ID NO: 4638717 - DNA, 15 bp, Homo sapiens
tcaaccataaaagaa

SEQ ID NO: 4638718 - DNA, 17 bp, Homo sapiens
tcaaccataaaagaagt

SEQ ID NO: 4638719 - DNA, 23 bp, Homo sapiens
tcaaccggaaggaggccaaccag

SEQ ID NO: 4638720 - DNA, 19 bp, Homo sapiens
tcaacgcctcactgaaaca

SEQ ID NO: 4638721 - DNA, 16 bp, Homo sapiens
tcaacggtctggcagg

SEQ ID NO: 4638722 - DNA, 19 bp, Homo sapiens
tcaactaaaaaaaaaaaag

SEQ ID NO: 4638723 - DNA, 19 bp, Homo sapiens
tcaactcataagactttgg

SEQ ID NO: 4638724 - DNA, 14 bp, Homo sapiens
tcaagaatgaaaaa

SEQ ID NO: 4638725 - DNA, 16 bp, Homo sapiens
tcaagacgaggggcag

SEQ ID NO: 4638726 - DNA, 20 bp, Homo sapiens
tcaagacgaggggcagggaa

SEQ ID NO: 4638727 - DNA, 20 bp, Homo sapiens
tcaagagctagaaaaataaa

SEQ ID NO: 4638728 - DNA, 14 bp, Homo sapiens
tcaagatgagcctg

SEQ ID NO: 4638729 - DNA, 22 bp, Homo sapiens
tcaagccatgtataaatgtgat

SEQ ID NO: 4638730 - DNA, 17 bp, Homo sapiens
tcaagcgattctcctgc

SEQ ID NO: 4638731 - DNA, 22 bp, Homo sapiens
tcaagctcctagtatgccctgt

SEQ ID NO: 4638732 - DNA, 18 bp, Homo sapiens
tcaagctgagctggcttc

SEQ ID NO: 4638733 - DNA, 21 bp, Homo sapiens
tcaagctgtgagacagtggga

SEQ ID NO: 4638734 - DNA, 16 bp, Homo sapiens
tcaaggccttcagttt

SEQ ID NO: 4638735 - DNA, 17 bp, Homo sapiens
tcaagtgatcctcccac

SEQ ID NO: 4638736 - DNA, 22 bp, Homo sapiens
tcaagtgtcacctccttcccca

SEQ ID NO: 4638737 - DNA, 23 bp, Homo sapiens
tcaagtgtcacctccttccccag

SEQ ID NO: 4638738 - DNA, 18 bp, Homo sapiens
tcaataaacaacagctga

SEQ ID NO: 4638739 - DNA, 15 bp, Homo sapiens
tcaataaatgtctgt

SEQ ID NO: 4638740 - DNA, 16 bp, Homo sapiens
tcaataaatgtctgtt

SEQ ID NO: 4638741 - DNA, 19 bp, Homo sapiens
tcaatacagtgaaggtctt

SEQ ID NO: 4638742 - DNA, 23 bp, Homo sapiens
tcaatactgtatgccttctgtat

SEQ ID NO: 4638743 - DNA, 15 bp, Homo sapiens
tcaatatgaatctat

SEQ ID NO: 4638744 - DNA, 14 bp, Homo sapiens
tcaatcatcaaaaa

SEQ ID NO: 4638745 - DNA, 22 bp, Homo sapiens
tcaatgtactaggatactgctg

SEQ ID NO: 4638746 - DNA, 18 bp, Homo sapiens
tcaattagtggtcataaa

SEQ ID NO: 4638747 - DNA, 19 bp, Homo sapiens
tcaattagtggtcataaaa

SEQ ID NO: 4638748 - DNA, 19 bp, Homo sapiens
tcaatttttgtctcagaag

SEQ ID NO: 4638749 - DNA, 12 bp, Homo sapiens
tcacaactcctt

SEQ ID NO: 4638750 - DNA, 20 bp, Homo sapiens
tcacaactccttccatcctt

SEQ ID NO: 4638751 - DNA, 12 bp, Homo sapiens
tcacaaggcagc

SEQ ID NO: 4638752 - DNA, 16 bp, Homo sapiens
tcacaaggcagcaagg

SEQ ID NO: 4638753 - DNA, 21 bp, Homo sapiens
tcacacaggcatttcctgggt

SEQ ID NO: 4638754 - DNA, 12 bp, Homo sapiens
tcacacagtgaa

SEQ ID NO: 4638755 - DNA, 12 bp, Homo sapiens
tcacacccaccc

SEQ ID NO: 4638756 - DNA, 16 bp, Homo sapiens
tcacacccaccccctg

SEQ ID NO: 4638757 - DNA, 23 bp, Homo sapiens
tcacacccaccccctgcctggtt

SEQ ID NO: 4638758 - DNA, 14 bp, Homo sapiens
tcacacccctgccc

SEQ ID NO: 4638759 - DNA, 15 bp, Homo sapiens
tcacacccctgcccc

SEQ ID NO: 4638760 - DNA, 13 bp, Homo sapiens
tcacactcttcag

SEQ ID NO: 4638761 - DNA, 16 bp, Homo sapiens
tcacagccacccctga

SEQ ID NO: 4638762 - DNA, 19 bp, Homo sapiens
tcacagcctcacccctgcc

SEQ ID NO: 4638763 - DNA, 15 bp, Homo sapiens
tcacaggctgagaac

SEQ ID NO: 4638764 - DNA, 22 bp, Homo sapiens
tcacatataaatagatgatttc

SEQ ID NO: 4638765 - DNA, 21 bp, Homo sapiens
tcacatctcccttccacctca

SEQ ID NO: 4638766 - DNA, 15 bp, Homo sapiens
tcacatctgcacact

SEQ ID NO: 4638767 - DNA, 20 bp, Homo sapiens
tcacatgaccacatagcatg

SEQ ID NO: 4638768 - DNA, 17 bp, Homo sapiens
tcacattaacattttga

SEQ ID NO: 4638769 - DNA, 18 bp, Homo sapiens
tcacattatttattaaaa

SEQ ID NO: 4638770 - DNA, 22 bp, Homo sapiens
tcacattcctctgcccttcctg

SEQ ID NO: 4638771 - DNA, 13 bp, Homo sapiens
tcacatttctact

SEQ ID NO: 4638772 - DNA, 15 bp, Homo sapiens
tcaccaatgtaccca

SEQ ID NO: 4638773 - DNA, 12 bp, Homo sapiens
tcaccagctgct

SEQ ID NO: 4638774 - DNA, 16 bp, Homo sapiens
tcaccaggggaggagc

SEQ ID NO: 4638775 - DNA, 15 bp, Homo sapiens
tcaccatgatgtgaa

SEQ ID NO: 4638776 - DNA, 17 bp, Homo sapiens
tcaccattatgctggtg

SEQ ID NO: 4638777 - DNA, 15 bp, Homo sapiens
tcaccatttcctcct

SEQ ID NO: 4638778 - DNA, 11 bp, Homo sapiens
tcacccactcc

SEQ ID NO: 4638779 - DNA, 16 bp, Homo sapiens
tcacccactcccttga

SEQ ID NO: 4638780 - DNA, 15 bp, Homo sapiens
tcacccaggctggag

SEQ ID NO: 4638781 - DNA, 22 bp, Homo sapiens
tcaccccacttatccctctcca

SEQ ID NO: 4638782 - DNA, 14 bp, Homo sapiens
tcacccctcccctg

SEQ ID NO: 4638783 - DNA, 12 bp, Homo sapiens
tcacccctgccc

SEQ ID NO: 4638784 - DNA, 15 bp, Homo sapiens
tcacccctgcccctg

SEQ ID NO: 4638785 - DNA, 17 bp, Homo sapiens
tcacccctgcccctgtg

SEQ ID NO: 4638786 - DNA, 12 bp, Homo sapiens
tcaccctgcagg

SEQ ID NO: 4638787 - DNA, 17 bp, Homo sapiens
tcaccctgcaggacttg

SEQ ID NO: 4638788 - DNA, 20 bp, Homo sapiens
tcacctccaagcatttcatg

SEQ ID NO: 4638789 - DNA, 13 bp, Homo sapiens
tcacctcctgctg

SEQ ID NO: 4638790 - DNA, 17 bp, Homo sapiens
tcacctcctgctgggca

SEQ ID NO: 4638791 - DNA, 15 bp, Homo sapiens
tcacctccttcccca

SEQ ID NO: 4638792 - DNA, 20 bp, Homo sapiens
tcacctccttccccagctcc

SEQ ID NO: 4638793 - DNA, 22 bp, Homo sapiens
tcacctcggagggatggagaaa

SEQ ID NO: 4638794 - DNA, 19 bp, Homo sapiens
tcacctctgggaccccagc

SEQ ID NO: 4638795 - DNA, 23 bp, Homo sapiens
tcacctctgggaccccagctgct

SEQ ID NO: 4638796 - DNA, 15 bp, Homo sapiens
tcacctctgtgaccc

SEQ ID NO: 4638797 - DNA, 19 bp, Homo sapiens
tcacctgccccgtagagaa

SEQ ID NO: 4638798 - DNA, 19 bp, Homo sapiens
tcacctgcgcaagtgcctg

SEQ ID NO: 4638799 - DNA, 20 bp, Homo sapiens
tcacctgcgcaagtgcctgg

SEQ ID NO: 4638800 - DNA, 20 bp, Homo sapiens
tcacgtaaagctagaaatga

SEQ ID NO: 4638801 - DNA, 22 bp, Homo sapiens
tcacgtttcatgtaatcctcaa

SEQ ID NO: 4638802 - DNA, 13 bp, Homo sapiens
tcactaaacttta

SEQ ID NO: 4638803 - DNA, 21 bp, Homo sapiens
tcactaaataaacacgatttt

SEQ ID NO: 4638804 - DNA, 16 bp, Homo sapiens
tcactaatttttgtat

SEQ ID NO: 4638805 - DNA, 12 bp, Homo sapiens
tcactcataaag

SEQ ID NO: 4638806 - DNA, 13 bp, Homo sapiens
tcactccctaggc

SEQ ID NO: 4638807 - DNA, 16 bp, Homo sapiens
tcactccctaggccca

SEQ ID NO: 4638808 - DNA, 12 bp, Homo sapiens
tcactcctgctg

SEQ ID NO: 4638809 - DNA, 13 bp, Homo sapiens
tcactcctgctgt

SEQ ID NO: 4638810 - DNA, 19 bp, Homo sapiens
tcactctgtgtctgagtgg

SEQ ID NO: 4638811 - DNA, 13 bp, Homo sapiens
tcactcttctcag

SEQ ID NO: 4638812 - DNA, 18 bp, Homo sapiens
tcactcttctcagccact

SEQ ID NO: 4638813 - DNA, 18 bp, Homo sapiens
tcactgaaaacatctgga

SEQ ID NO: 4638814 - DNA, 18 bp, Homo sapiens
tcactgatgggaaaactg

SEQ ID NO: 4638815 - DNA, 19 bp, Homo sapiens
tcactgcaacctctgcctc

SEQ ID NO: 4638816 - DNA, 21 bp, Homo sapiens
tcactgcaacctctgcctcct

SEQ ID NO: 4638817 - DNA, 23 bp, Homo sapiens
tcactgcaacctctgcctcctgg

SEQ ID NO: 4638818 - DNA, 18 bp, Homo sapiens
tcactgcaagctccgcct

SEQ ID NO: 4638819 - DNA, 18 bp, Homo sapiens
tcactgcaatctctgcct

SEQ ID NO: 4638820 - DNA, 11 bp, Homo sapiens
tcactgcatta

SEQ ID NO: 4638821 - DNA, 22 bp, Homo sapiens
tcactgcattatcttgctcatt

SEQ ID NO: 4638822 - DNA, 12 bp, Homo sapiens
tcactgtgatca

SEQ ID NO: 4638823 - DNA, 18 bp, Homo sapiens
tcactgtgttactgcttt

SEQ ID NO: 4638824 - DNA, 16 bp, Homo sapiens
tcactgtttgttttta

SEQ ID NO: 4638825 - DNA, 23 bp, Homo sapiens
tcacttccccaagatctgccaga

SEQ ID NO: 4638826 - DNA, 12 bp, Homo sapiens
tcacttcctttg

SEQ ID NO: 4638827 - DNA, 20 bp, Homo sapiens
tcacttcctttgcccttcct

SEQ ID NO: 4638828 - DNA, 14 bp, Homo sapiens
tcacttgctgcttt

SEQ ID NO: 4638829 - DNA, 16 bp, Homo sapiens
tcacttgctgcttttt

SEQ ID NO: 4638830 - DNA, 19 bp, Homo sapiens
tcacttgctgctttttctg

SEQ ID NO: 4638831 - DNA, 18 bp, Homo sapiens
tcacttgcttcttatcct

SEQ ID NO: 4638832 - DNA, 14 bp, Homo sapiens
tcagaaagggaggg

SEQ ID NO: 4638833 - DNA, 18 bp, Homo sapiens
tcagaaagggagggctct

SEQ ID NO: 4638834 - DNA, 23 bp, Homo sapiens
tcagaaagggagggctctgaggc

SEQ ID NO: 4638835 - DNA, 13 bp, Homo sapiens
tcagaaagtaaca

SEQ ID NO: 4638836 - DNA, 18 bp, Homo sapiens
tcagaaagtaacaatcta

SEQ ID NO: 4638837 - DNA, 18 bp, Homo sapiens
tcagaacattcagctctg

SEQ ID NO: 4638838 - DNA, 21 bp, Homo sapiens
tcagaacattcagctctggag

SEQ ID NO: 4638839 - DNA, 12 bp, Homo sapiens
tcagaagcctgg

SEQ ID NO: 4638840 - DNA, 16 bp, Homo sapiens
tcagaagcctgggggc

SEQ ID NO: 4638841 - DNA, 19 bp, Homo sapiens
tcagaagcctgggggcctg

SEQ ID NO: 4638842 - DNA, 20 bp, Homo sapiens
tcagaagcctgggggcctgg

SEQ ID NO: 4638843 - DNA, 21 bp, Homo sapiens
tcagaagcctgggggcctggc

SEQ ID NO: 4638844 - DNA, 22 bp, Homo sapiens
tcagaaggagaaggctggagaa

SEQ ID NO: 4638845 - DNA, 23 bp, Homo sapiens
tcagaaggagaaggctggagaag

SEQ ID NO: 4638846 - DNA, 15 bp, Homo sapiens
tcagaataggaagat

SEQ ID NO: 4638847 - DNA, 23 bp, Homo sapiens
tcagacaagacagaggggagcag

SEQ ID NO: 4638848 - DNA, 14 bp, Homo sapiens
tcagacataaagcc

SEQ ID NO: 4638849 - DNA, 14 bp, Homo sapiens
tcagacccatctct

SEQ ID NO: 4638850 - DNA, 15 bp, Homo sapiens
tcagactcagttttt

SEQ ID NO: 4638851 - DNA, 21 bp, Homo sapiens
tcagactcagttttttgtaac

SEQ ID NO: 4638852 - DNA, 20 bp, Homo sapiens
tcagactgtcaggcaagccc

SEQ ID NO: 4638853 - DNA, 17 bp, Homo sapiens
tcagactttcacaccat

SEQ ID NO: 4638854 - DNA, 20 bp, Homo sapiens
tcagactttggaaaatgcat

SEQ ID NO: 4638855 - DNA, 22 bp, Homo sapiens
tcagactttgtgttcatttcat

SEQ ID NO: 4638856 - DNA, 11 bp, Homo sapiens
tcagagagggt

SEQ ID NO: 4638857 - DNA, 15 bp, Homo sapiens
tcagagcatgatggg

SEQ ID NO: 4638858 - DNA, 16 bp, Homo sapiens
tcagagcatgatggga

SEQ ID NO: 4638859 - DNA, 17 bp, Homo sapiens
tcagagcccccagccct

SEQ ID NO: 4638860 - DNA, 16 bp, Homo sapiens
tcagagcgcacaggga

SEQ ID NO: 4638861 - DNA, 14 bp, Homo sapiens
tcagaggaacaaac

SEQ ID NO: 4638862 - DNA, 19 bp, Homo sapiens
tcagaggcatttgagcagc

SEQ ID NO: 4638863 - DNA, 22 bp, Homo sapiens
tcagaggccttatgagggtcct

SEQ ID NO: 4638864 - DNA, 16 bp, Homo sapiens
tcagaggcgcactgtg

SEQ ID NO: 4638865 - DNA, 23 bp, Homo sapiens
tcagataattagatgattatata

SEQ ID NO: 4638866 - DNA, 17 bp, Homo sapiens
tcagatataaaagactg

SEQ ID NO: 4638867 - DNA, 20 bp, Homo sapiens
tcagatataaaagactgacc

SEQ ID NO: 4638868 - DNA, 18 bp, Homo sapiens
tcagatgcttctgggaga

SEQ ID NO: 4638869 - DNA, 22 bp, Homo sapiens
tcagatggaagcttactctctg

SEQ ID NO: 4638870 - DNA, 18 bp, Homo sapiens
tcagattgcatgtgactc

SEQ ID NO: 4638871 - DNA, 19 bp, Homo sapiens
tcagattgcatgtgactct

SEQ ID NO: 4638872 - DNA, 22 bp, Homo sapiens
tcagattgcatgtgactctgaa

SEQ ID NO: 4638873 - DNA, 13 bp, Homo sapiens
tcagcacaaggcc

SEQ ID NO: 4638874 - DNA, 19 bp, Homo sapiens
tcagcacaaggccatctgg

SEQ ID NO: 4638875 - DNA, 20 bp, Homo sapiens
tcagcacctacagtgtacag

SEQ ID NO: 4638876 - DNA, 21 bp, Homo sapiens
tcagcacctacagtgtacagt

SEQ ID NO: 4638877 - DNA, 17 bp, Homo sapiens
tcagcaggctagacaga

SEQ ID NO: 4638878 - DNA, 18 bp, Homo sapiens
tcagcaggctagacagaa

SEQ ID NO: 4638879 - DNA, 11 bp, Homo sapiens
tcagcagggct

SEQ ID NO: 4638880 - DNA, 23 bp, Homo sapiens
tcagcagggctggtcacctccca

SEQ ID NO: 4638881 - DNA, 18 bp, Homo sapiens
tcagcatcctcagttcct

SEQ ID NO: 4638882 - DNA, 23 bp, Homo sapiens
tcagcatctaaagcagcaggtct

SEQ ID NO: 4638883 - DNA, 12 bp, Homo sapiens
tcagccagcact

SEQ ID NO: 4638884 - DNA, 14 bp, Homo sapiens
tcagccagcacttg

SEQ ID NO: 4638885 - DNA, 18 bp, Homo sapiens
tcagcccatggaggcaga

SEQ ID NO: 4638886 - DNA, 22 bp, Homo sapiens
tcagcccatggaggcagatgcc

SEQ ID NO: 4638887 - DNA, 23 bp, Homo sapiens
tcagcccatggaggcagatgccc

SEQ ID NO: 4638888 - DNA, 14 bp, Homo sapiens
tcagcccccaccag

SEQ ID NO: 4638889 - DNA, 15 bp, Homo sapiens
tcagcccccaccagg

SEQ ID NO: 4638890 - DNA, 16 bp, Homo sapiens
tcagcccccaccaggg

SEQ ID NO: 4638891 - DNA, 19 bp, Homo sapiens
tcagcccccaccaggggaa

SEQ ID NO: 4638892 - DNA, 16 bp, Homo sapiens
tcagccccgacttcct

SEQ ID NO: 4638893 - DNA, 23 bp, Homo sapiens
tcagccctgcccttcagcatcct

SEQ ID NO: 4638894 - DNA, 20 bp, Homo sapiens
tcagcctcccgagtagctgg

SEQ ID NO: 4638895 - DNA, 16 bp, Homo sapiens
tcagcgtaaaatggtg

SEQ ID NO: 4638896 - DNA, 17 bp, Homo sapiens
tcagcgtggccttgttc

SEQ ID NO: 4638897 - DNA, 15 bp, Homo sapiens
tcagctctttccaaa

SEQ ID NO: 4638898 - DNA, 21 bp, Homo sapiens
tcagctgaatgcctcctgtgg

SEQ ID NO: 4638899 - DNA, 22 bp, Homo sapiens
tcagctgaatgcctcctgtggg

SEQ ID NO: 4638900 - DNA, 22 bp, Homo sapiens
tcagctggtcctgaccaggatg

SEQ ID NO: 4638901 - DNA, 17 bp, Homo sapiens
tcagctgtcctgcagca

SEQ ID NO: 4638902 - DNA, 18 bp, Homo sapiens
tcagctgttaaccatttg

SEQ ID NO: 4638903 - DNA, 13 bp, Homo sapiens
tcagcttgctggg

SEQ ID NO: 4638904 - DNA, 22 bp, Homo sapiens
tcagctttgaaggctggattct

SEQ ID NO: 4638905 - DNA, 23 bp, Homo sapiens
tcagctttgaaggctggattcta

SEQ ID NO: 4638906 - DNA, 21 bp, Homo sapiens
tcagctttggattgctggggc

SEQ ID NO: 4638907 - DNA, 19 bp, Homo sapiens
tcaggaaaaggcctggggt

SEQ ID NO: 4638908 - DNA, 22 bp, Homo sapiens
tcaggaaaatgtattgattcaa

SEQ ID NO: 4638909 - DNA, 13 bp, Homo sapiens
tcaggaattcagt

SEQ ID NO: 4638910 - DNA, 16 bp, Homo sapiens
tcaggaattcagtgcc

SEQ ID NO: 4638911 - DNA, 15 bp, Homo sapiens
tcaggacacaggcct

SEQ ID NO: 4638912 - DNA, 13 bp, Homo sapiens
tcaggacagcttg

SEQ ID NO: 4638913 - DNA, 20 bp, Homo sapiens
tcaggagaatagcttttact

SEQ ID NO: 4638914 - DNA, 23 bp, Homo sapiens
tcaggagactttacaaacctttg

SEQ ID NO: 4638915 - DNA, 23 bp, Homo sapiens
tcaggagatggagggcttggccc

SEQ ID NO: 4638916 - DNA, 20 bp, Homo sapiens
tcaggatccagtctggaaaa

SEQ ID NO: 4638917 - DNA, 13 bp, Homo sapiens
tcaggcaaggagg

SEQ ID NO: 4638918 - DNA, 14 bp, Homo sapiens
tcaggcaggaccag

SEQ ID NO: 4638919 - DNA, 14 bp, Homo sapiens
tcaggccccacccc

SEQ ID NO: 4638920 - DNA, 15 bp, Homo sapiens
tcaggccccacccct

SEQ ID NO: 4638921 - DNA, 20 bp, Homo sapiens
tcaggctagccctgccctcc

SEQ ID NO: 4638922 - DNA, 17 bp, Homo sapiens
tcaggctctgcacagac

SEQ ID NO: 4638923 - DNA, 22 bp, Homo sapiens
tcagggaccggtgctgcaggag

SEQ ID NO: 4638924 - DNA, 13 bp, Homo sapiens
tcagggagtgctg

SEQ ID NO: 4638925 - DNA, 13 bp, Homo sapiens
tcagggcctcagg

SEQ ID NO: 4638926 - DNA, 20 bp, Homo sapiens
tcaggggctctagggactgc

SEQ ID NO: 4638927 - DNA, 18 bp, Homo sapiens
tcaggtaatcattttaat

SEQ ID NO: 4638928 - DNA, 19 bp, Homo sapiens
tcaggtgatttgtatgctc

SEQ ID NO: 4638929 - DNA, 22 bp, Homo sapiens
tcaggtgtgataaaatgttgaa

SEQ ID NO: 4638930 - DNA, 14 bp, Homo sapiens
tcagtaagcagcct

SEQ ID NO: 4638931 - DNA, 12 bp, Homo sapiens
tcagtaccaaag

SEQ ID NO: 4638932 - DNA, 14 bp, Homo sapiens
tcagtactttttta

SEQ ID NO: 4638933 - DNA, 14 bp, Homo sapiens
tcagtatttaacta

SEQ ID NO: 4638934 - DNA, 13 bp, Homo sapiens
tcagtcacagcca

SEQ ID NO: 4638935 - DNA, 22 bp, Homo sapiens
tcagtcagggtttgtcagagga

SEQ ID NO: 4638936 - DNA, 13 bp, Homo sapiens
tcagtccctcttc

SEQ ID NO: 4638937 - DNA, 16 bp, Homo sapiens
tcagtcctgggcaaag

SEQ ID NO: 4638938 - DNA, 15 bp, Homo sapiens
tcagtgactcctgct

SEQ ID NO: 4638939 - DNA, 19 bp, Homo sapiens
tcagtgattcgcttttggt

SEQ ID NO: 4638940 - DNA, 19 bp, Homo sapiens
tcagtgcaaaatgtcttgt

SEQ ID NO: 4638941 - DNA, 14 bp, Homo sapiens
tcagtgcagtttct

SEQ ID NO: 4638942 - DNA, 20 bp, Homo sapiens
tcagtggaaaccctgagagt

SEQ ID NO: 4638943 - DNA, 18 bp, Homo sapiens
tcagtggggctctctgag

SEQ ID NO: 4638944 - DNA, 19 bp, Homo sapiens
tcagtggggctctctgagt

SEQ ID NO: 4638945 - DNA, 22 bp, Homo sapiens
tcagtgtaccgcgtctaccctg

SEQ ID NO: 4638946 - DNA, 20 bp, Homo sapiens
tcagttccaaacagacaaaa

SEQ ID NO: 4638947 - DNA, 15 bp, Homo sapiens
tcagttctctgggaa

SEQ ID NO: 4638948 - DNA, 13 bp, Homo sapiens
tcagttctgcttg

SEQ ID NO: 4638949 - DNA, 13 bp, Homo sapiens
tcagttctgtgtg

SEQ ID NO: 4638950 - DNA, 20 bp, Homo sapiens
tcagttgtccttaaatttgt

SEQ ID NO: 4638951 - DNA, 16 bp, Homo sapiens
tcagtttatgttgtac

SEQ ID NO: 4638952 - DNA, 15 bp, Homo sapiens
tcagtttctgcctgg

SEQ ID NO: 4638953 - DNA, 19 bp, Homo sapiens
tcataagactttgggatag

SEQ ID NO: 4638954 - DNA, 19 bp, Homo sapiens
tcataagatattctttaca

SEQ ID NO: 4638955 - DNA, 16 bp, Homo sapiens
tcataatcagtaaata

SEQ ID NO: 4638956 - DNA, 18 bp, Homo sapiens
tcataattcctacagcac

SEQ ID NO: 4638957 - DNA, 12 bp, Homo sapiens
tcatacagtttt

SEQ ID NO: 4638958 - DNA, 16 bp, Homo sapiens
tcatactctgttgcct

SEQ ID NO: 4638959 - DNA, 14 bp, Homo sapiens
tcatacttaacatt

SEQ ID NO: 4638960 - DNA, 15 bp, Homo sapiens
tcatagatagataag

SEQ ID NO: 4638961 - DNA, 18 bp, Homo sapiens
tcatagccctcagacatt

SEQ ID NO: 4638962 - DNA, 22 bp, Homo sapiens
tcatagccctcagacatttata

SEQ ID NO: 4638963 - DNA, 20 bp, Homo sapiens
tcatagtatcttcactgtgt

SEQ ID NO: 4638964 - DNA, 15 bp, Homo sapiens
tcatataaactcatt

SEQ ID NO: 4638965 - DNA, 16 bp, Homo sapiens
tcatataaactcattt

SEQ ID NO: 4638966 - DNA, 17 bp, Homo sapiens
tcatataaactcattta

SEQ ID NO: 4638967 - DNA, 18 bp, Homo sapiens
tcatatcactaaataaac

SEQ ID NO: 4638968 - DNA, 19 bp, Homo sapiens
tcatatgaattagccaaaa

SEQ ID NO: 4638969 - DNA, 14 bp, Homo sapiens
tcatcagggcctgg

SEQ ID NO: 4638970 - DNA, 14 bp, Homo sapiens
tcatcccccctgct

SEQ ID NO: 4638971 - DNA, 16 bp, Homo sapiens
tcatcccccctgctgc

SEQ ID NO: 4638972 - DNA, 16 bp, Homo sapiens
tcatccttctttcctt

SEQ ID NO: 4638973 - DNA, 17 bp, Homo sapiens
tcatccttctttccttg

SEQ ID NO: 4638974 - DNA, 19 bp, Homo sapiens
tcatccttctttccttgtt

SEQ ID NO: 4638975 - DNA, 15 bp, Homo sapiens
tcatctcagcttttg

SEQ ID NO: 4638976 - DNA, 17 bp, Homo sapiens
tcatctcagcttttgat

SEQ ID NO: 4638977 - DNA, 18 bp, Homo sapiens
tcatctcagcttttgatg

SEQ ID NO: 4638978 - DNA, 12 bp, Homo sapiens
tcatctgggaaa

SEQ ID NO: 4638979 - DNA, 15 bp, Homo sapiens
tcatctgtggagctg

SEQ ID NO: 4638980 - DNA, 19 bp, Homo sapiens
tcatctgtggagctgccac

SEQ ID NO: 4638981 - DNA, 22 bp, Homo sapiens
tcatctttcattaaaggcttct

SEQ ID NO: 4638982 - DNA, 21 bp, Homo sapiens
tcatgaattcatactctgttg

SEQ ID NO: 4638983 - DNA, 20 bp, Homo sapiens
tcatgagcgtcaaagaaaat

SEQ ID NO: 4638984 - DNA, 21 bp, Homo sapiens
tcatgagcgtcaaagaaaatg

SEQ ID NO: 4638985 - DNA, 12 bp, Homo sapiens
tcatgcccaaga

SEQ ID NO: 4638986 - DNA, 14 bp, Homo sapiens
tcatgcctctgagg

SEQ ID NO: 4638987 - DNA, 15 bp, Homo sapiens
tcatgctgtgcattt

SEQ ID NO: 4638988 - DNA, 19 bp, Homo sapiens
tcatgcttctactgtgaca

SEQ ID NO: 4638989 - DNA, 16 bp, Homo sapiens
tcatggctacctcaga

SEQ ID NO: 4638990 - DNA, 18 bp, Homo sapiens
tcatggtacttcctctgt

SEQ ID NO: 4638991 - DNA, 20 bp, Homo sapiens
tcatggtacttcctctgtga

SEQ ID NO: 4638992 - DNA, 17 bp, Homo sapiens
tcatggtccgcctgcct

SEQ ID NO: 4638993 - DNA, 22 bp, Homo sapiens
tcatgtaaagaaatgtcttaat

SEQ ID NO: 4638994 - DNA, 22 bp, Homo sapiens
tcatgtactttttagtaatttc

SEQ ID NO: 4638995 - DNA, 15 bp, Homo sapiens
tcatgtcattatgac

SEQ ID NO: 4638996 - DNA, 22 bp, Homo sapiens
tcatgtctgtatccccagtgcc

SEQ ID NO: 4638997 - DNA, 18 bp, Homo sapiens
tcatgtggtgaatatgca

SEQ ID NO: 4638998 - DNA, 20 bp, Homo sapiens
tcatgtggtgaatatgcaag

SEQ ID NO: 4638999 - DNA, 18 bp, Homo sapiens
tcatgttggccaggctgg

SEQ ID NO: 4639000 - DNA, 13 bp, Homo sapiens
tcatgttttaaca

SEQ ID NO: 4639001 - DNA, 14 bp, Homo sapiens
tcatgttttaacaa

SEQ ID NO: 4639002 - DNA, 18 bp, Homo sapiens
tcattaactcaaattcaa

SEQ ID NO: 4639003 - DNA, 15 bp, Homo sapiens
tcattaatgacactt

SEQ ID NO: 4639004 - DNA, 21 bp, Homo sapiens
tcattaatgacacttgtcccc

SEQ ID NO: 4639005 - DNA, 17 bp, Homo sapiens
tcattactcttaaggaa

SEQ ID NO: 4639006 - DNA, 23 bp, Homo sapiens
tcattactgtgaggagtctgggt

SEQ ID NO: 4639007 - DNA, 13 bp, Homo sapiens
tcattatgacatt

SEQ ID NO: 4639008 - DNA, 20 bp, Homo sapiens
tcattatgttcatgtaagaa

SEQ ID NO: 4639009 - DNA, 18 bp, Homo sapiens
tcattattcaagaatgaa

SEQ ID NO: 4639010 - DNA, 19 bp, Homo sapiens
tcattctttgtatcttaaa

SEQ ID NO: 4639011 - DNA, 19 bp, Homo sapiens
tcattgaactttaagaagc

SEQ ID NO: 4639012 - DNA, 17 bp, Homo sapiens
tcattgattttataatt

SEQ ID NO: 4639013 - DNA, 22 bp, Homo sapiens
tcattgcactttcctttcaata

SEQ ID NO: 4639014 - DNA, 16 bp, Homo sapiens
tcattgtattcagata

SEQ ID NO: 4639015 - DNA, 12 bp, Homo sapiens
tcattgtcacct

SEQ ID NO: 4639016 - DNA, 20 bp, Homo sapiens
tcatttacctcgcagtgtgt

SEQ ID NO: 4639017 - DNA, 17 bp, Homo sapiens
tcatttagataatttga

SEQ ID NO: 4639018 - DNA, 19 bp, Homo sapiens
tcatttagataatttgaaa

SEQ ID NO: 4639019 - DNA, 20 bp, Homo sapiens
tcatttagataatttgaaaa

SEQ ID NO: 4639020 - DNA, 23 bp, Homo sapiens
tcatttataaagggacactttta

SEQ ID NO: 4639021 - DNA, 20 bp, Homo sapiens
tcatttcaatcattgaagta

SEQ ID NO: 4639022 - DNA, 17 bp, Homo sapiens
tcatttccagcttctca

SEQ ID NO: 4639023 - DNA, 20 bp, Homo sapiens
tcatttccagcttctcagtt

SEQ ID NO: 4639024 - DNA, 13 bp, Homo sapiens
tcatttggaggaa

SEQ ID NO: 4639025 - DNA, 15 bp, Homo sapiens
tcatttgtttacatt

SEQ ID NO: 4639026 - DNA, 18 bp, Homo sapiens
tcatttgtttacatttga

SEQ ID NO: 4639027 - DNA, 16 bp, Homo sapiens
tcattttattcacata

SEQ ID NO: 4639028 - DNA, 16 bp, Homo sapiens
tcattttattttgtaa

SEQ ID NO: 4639029 - DNA, 17 bp, Homo sapiens
tcattttattttgtaat

SEQ ID NO: 4639030 - DNA, 20 bp, Homo sapiens
tcatttttaagaaaggaagc

SEQ ID NO: 4639031 - DNA, 22 bp, Homo sapiens
tcatttttaagaaaggaagcaa

SEQ ID NO: 4639032 - DNA, 19 bp, Homo sapiens
tccaaaagtggcctctttg

SEQ ID NO: 4639033 - DNA, 21 bp, Homo sapiens
tccaaacagacaaaacagata

SEQ ID NO: 4639034 - DNA, 18 bp, Homo sapiens
tccaaaccttcacacaca

SEQ ID NO: 4639035 - DNA, 22 bp, Homo sapiens
tccaaaccttcacacacagact

SEQ ID NO: 4639036 - DNA, 15 bp, Homo sapiens
tccaaataataaagt

SEQ ID NO: 4639037 - DNA, 16 bp, Homo sapiens
tccaaataataaagtc

SEQ ID NO: 4639038 - DNA, 19 bp, Homo sapiens
tccaaattaaaacaaatat

SEQ ID NO: 4639039 - DNA, 21 bp, Homo sapiens
tccaacaccaagcacagcagc

SEQ ID NO: 4639040 - DNA, 23 bp, Homo sapiens
tccaactctacacagctcagcag

SEQ ID NO: 4639041 - DNA, 17 bp, Homo sapiens
tccaactttcaggggct

SEQ ID NO: 4639042 - DNA, 19 bp, Homo sapiens
tccaagacagggctcattt

SEQ ID NO: 4639043 - DNA, 18 bp, Homo sapiens
tccaagaccatttgtagt

SEQ ID NO: 4639044 - DNA, 19 bp, Homo sapiens
tccaagaccatttgtagtg

SEQ ID NO: 4639045 - DNA, 23 bp, Homo sapiens
tccaagcatttcatgaaaaagct

SEQ ID NO: 4639046 - DNA, 14 bp, Homo sapiens
tccaagccctcagc

SEQ ID NO: 4639047 - DNA, 13 bp, Homo sapiens
tccaaggaagcag

SEQ ID NO: 4639048 - DNA, 17 bp, Homo sapiens
tccaagtccaataagac

SEQ ID NO: 4639049 - DNA, 13 bp, Homo sapiens
tccaatagaaaga

SEQ ID NO: 4639050 - DNA, 21 bp, Homo sapiens
tccaatcctccccgctctgcc

SEQ ID NO: 4639051 - DNA, 18 bp, Homo sapiens
tccacactgcagggagga

SEQ ID NO: 4639052 - DNA, 19 bp, Homo sapiens
tccacagcaaccccaggct

SEQ ID NO: 4639053 - DNA, 20 bp, Homo sapiens
tccacagcaaccccaggctg

SEQ ID NO: 4639054 - DNA, 19 bp, Homo sapiens
tccacagggagcaaacact

SEQ ID NO: 4639055 - DNA, 15 bp, Homo sapiens
tccaccactgtgcac

SEQ ID NO: 4639056 - DNA, 17 bp, Homo sapiens
tccaccagcctgctgac

SEQ ID NO: 4639057 - DNA, 17 bp, Homo sapiens
tccaccagggccagagc

SEQ ID NO: 4639058 - DNA, 18 bp, Homo sapiens
tccaccctccaccttcca

SEQ ID NO: 4639059 - DNA, 16 bp, Homo sapiens
tccaccctcccagacc

SEQ ID NO: 4639060 - DNA, 16 bp, Homo sapiens
tccacctcacaactcc

SEQ ID NO: 4639061 - DNA, 14 bp, Homo sapiens
tccacctcacccca

SEQ ID NO: 4639062 - DNA, 14 bp, Homo sapiens
tccacctccagcct

SEQ ID NO: 4639063 - DNA, 18 bp, Homo sapiens
tccacctccagcctctgg

SEQ ID NO: 4639064 - DNA, 20 bp, Homo sapiens
tccaccttccgttccccgct

SEQ ID NO: 4639065 - DNA, 20 bp, Homo sapiens
tccacgtcctccaagctcac

SEQ ID NO: 4639066 - DNA, 14 bp, Homo sapiens
tccactaaaaatat

SEQ ID NO: 4639067 - DNA, 13 bp, Homo sapiens
tccactactccgt

SEQ ID NO: 4639068 - DNA, 17 bp, Homo sapiens
tccactattttcaaaga

SEQ ID NO: 4639069 - DNA, 12 bp, Homo sapiens
tccactccttct

SEQ ID NO: 4639070 - DNA, 15 bp, Homo sapiens
tccactccttctctc

SEQ ID NO: 4639071 - DNA, 19 bp, Homo sapiens
tccacttcatttttaagaa

SEQ ID NO: 4639072 - DNA, 18 bp, Homo sapiens
tccacttgccctgtgttc

SEQ ID NO: 4639073 - DNA, 12 bp, Homo sapiens
tccacttttgtt

SEQ ID NO: 4639074 - DNA, 15 bp, Homo sapiens
tccagagacaacagg

SEQ ID NO: 4639075 - DNA, 15 bp, Homo sapiens
tccagatgcagggca

SEQ ID NO: 4639076 - DNA, 19 bp, Homo sapiens
tccagatgcagggcagtca

SEQ ID NO: 4639077 - DNA, 16 bp, Homo sapiens
tccagcagcagcactt

SEQ ID NO: 4639078 - DNA, 11 bp, Homo sapiens
tccagccactt

SEQ ID NO: 4639079 - DNA, 15 bp, Homo sapiens
tccagcccctgtccc

SEQ ID NO: 4639080 - DNA, 23 bp, Homo sapiens
tccagcccctgtcccaccccctt

SEQ ID NO: 4639081 - DNA, 12 bp, Homo sapiens
tccagcttctca

SEQ ID NO: 4639082 - DNA, 23 bp, Homo sapiens
tccaggagaagggggctctgccc

SEQ ID NO: 4639083 - DNA, 16 bp, Homo sapiens
tccaggattttaattt

SEQ ID NO: 4639084 - DNA, 16 bp, Homo sapiens
tccaggggcctgcaga

SEQ ID NO: 4639085 - DNA, 21 bp, Homo sapiens
tccaggggcctgcagaaggaa

SEQ ID NO: 4639086 - DNA, 20 bp, Homo sapiens
tccaggtgattctgtttcct

SEQ ID NO: 4639087 - DNA, 21 bp, Homo sapiens
tccaggtggcccttcccggca

SEQ ID NO: 4639088 - DNA, 22 bp, Homo sapiens
tccagtcattttattttgtaat

SEQ ID NO: 4639089 - DNA, 14 bp, Homo sapiens
tccagtctggaaaa

SEQ ID NO: 4639090 - DNA, 21 bp, Homo sapiens
tccagtctggaaaacagaaac

SEQ ID NO: 4639091 - DNA, 19 bp, Homo sapiens
tccagtgccaacaatccta

SEQ ID NO: 4639092 - DNA, 13 bp, Homo sapiens
tccagtgctccca

SEQ ID NO: 4639093 - DNA, 17 bp, Homo sapiens
tccagttaaccaagtca

SEQ ID NO: 4639094 - DNA, 21 bp, Homo sapiens
tccagttcatcgattttctat

SEQ ID NO: 4639095 - DNA, 17 bp, Homo sapiens
tccagtttgcacctgtc

SEQ ID NO: 4639096 - DNA, 13 bp, Homo sapiens
tccataaagaagc

SEQ ID NO: 4639097 - DNA, 20 bp, Homo sapiens
tccataaagaagcaataaag

SEQ ID NO: 4639098 - DNA, 17 bp, Homo sapiens
tccataaccccaccctt

SEQ ID NO: 4639099 - DNA, 15 bp, Homo sapiens
tccatactgtagaca

SEQ ID NO: 4639100 - DNA, 17 bp, Homo sapiens
tccatactgtagacact

SEQ ID NO: 4639101 - DNA, 20 bp, Homo sapiens
tccatactgtagacactctg

SEQ ID NO: 4639102 - DNA, 18 bp, Homo sapiens
tccatagagatgagccca

SEQ ID NO: 4639103 - DNA, 20 bp, Homo sapiens
tccatagagatgagcccacc

SEQ ID NO: 4639104 - DNA, 16 bp, Homo sapiens
tccatatttgatttct

SEQ ID NO: 4639105 - DNA, 18 bp, Homo sapiens
tccatcccaaccagtgcc

SEQ ID NO: 4639106 - DNA, 23 bp, Homo sapiens
tccatcccaaccagtgccaagga

SEQ ID NO: 4639107 - DNA, 12 bp, Homo sapiens
tccatctctctc

SEQ ID NO: 4639108 - DNA, 18 bp, Homo sapiens
tccatctctctcttgcct

SEQ ID NO: 4639109 - DNA, 13 bp, Homo sapiens
tccatgctcccaa

SEQ ID NO: 4639110 - DNA, 17 bp, Homo sapiens
tccatgggtctggctag

SEQ ID NO: 4639111 - DNA, 23 bp, Homo sapiens
tccatgtgattaatgttttcatt

SEQ ID NO: 4639112 - DNA, 20 bp, Homo sapiens
tccatgttagtaatggcaga

SEQ ID NO: 4639113 - DNA, 22 bp, Homo sapiens
tccatgttagtaatggcagagc

SEQ ID NO: 4639114 - DNA, 15 bp, Homo sapiens
tccattcccacccct

SEQ ID NO: 4639115 - DNA, 12 bp, Homo sapiens
tccattccctag

SEQ ID NO: 4639116 - DNA, 18 bp, Homo sapiens
tccattgcctagctcttt

SEQ ID NO: 4639117 - DNA, 23 bp, Homo sapiens
tccattgtaaaccacaaggctgt

SEQ ID NO: 4639118 - DNA, 23 bp, Homo sapiens
tccattgtttgaaacaaagaagg

SEQ ID NO: 4639119 - DNA, 18 bp, Homo sapiens
tccatttatgctggttaa

SEQ ID NO: 4639120 - DNA, 23 bp, Homo sapiens
tccattttaggtgataaaatttt

SEQ ID NO: 4639121 - DNA, 17 bp, Homo sapiens
tccattttcccccacta

SEQ ID NO: 4639122 - DNA, 14 bp, Homo sapiens
tcccaaacccagtc

SEQ ID NO: 4639123 - DNA, 23 bp, Homo sapiens
tcccaaacccagtctcctctcca

SEQ ID NO: 4639124 - DNA, 23 bp, Homo sapiens
tcccaaagtgctgggattacaga

SEQ ID NO: 4639125 - DNA, 22 bp, Homo sapiens
tcccaaatccgccagtgtttct

SEQ ID NO: 4639126 - DNA, 17 bp, Homo sapiens
tcccaaccagtgccaag

SEQ ID NO: 4639127 - DNA, 21 bp, Homo sapiens
tcccaaccccttaagccctgg

SEQ ID NO: 4639128 - DNA, 21 bp, Homo sapiens
tcccaactcccttctgcttgt

SEQ ID NO: 4639129 - DNA, 22 bp, Homo sapiens
tcccaagagcatcatgcctctg

SEQ ID NO: 4639130 - DNA, 21 bp, Homo sapiens
tcccaagctagactgtgtctg

SEQ ID NO: 4639131 - DNA, 16 bp, Homo sapiens
tcccaagctcagaggc

SEQ ID NO: 4639132 - DNA, 20 bp, Homo sapiens
tcccaaggagggggcctcat

SEQ ID NO: 4639133 - DNA, 23 bp, Homo sapiens
tcccaaggagggggcctcattgt

SEQ ID NO: 4639134 - DNA, 12 bp, Homo sapiens
tcccaatacaaa

SEQ ID NO: 4639135 - DNA, 14 bp, Homo sapiens
tcccaatacaaaga

SEQ ID NO: 4639136 - DNA, 18 bp, Homo sapiens
tcccaatacaaagatgac

SEQ ID NO: 4639137 - DNA, 17 bp, Homo sapiens
tcccaatggtgcttgga

SEQ ID NO: 4639138 - DNA, 17 bp, Homo sapiens
tcccacatccctgggcc

SEQ ID NO: 4639139 - DNA, 14 bp, Homo sapiens
tcccaccattcctg

SEQ ID NO: 4639140 - DNA, 15 bp, Homo sapiens
tcccaccattcctgc

SEQ ID NO: 4639141 - DNA, 16 bp, Homo sapiens
tcccacccacatgtga

SEQ ID NO: 4639142 - DNA, 23 bp, Homo sapiens
tcccaccgcccagcggcttgcct

SEQ ID NO: 4639143 - DNA, 15 bp, Homo sapiens
tcccactatctgggt

SEQ ID NO: 4639144 - DNA, 17 bp, Homo sapiens
tcccacttggaggcctt

SEQ ID NO: 4639145 - DNA, 23 bp, Homo sapiens
tcccagcaagacctcatctgtgg

SEQ ID NO: 4639146 - DNA, 15 bp, Homo sapiens
tcccagcatccctgg

SEQ ID NO: 4639147 - DNA, 17 bp, Homo sapiens
tcccagcatccctggag

SEQ ID NO: 4639148 - DNA, 19 bp, Homo sapiens
tcccagcatccctggagca

SEQ ID NO: 4639149 - DNA, 18 bp, Homo sapiens
tcccagcccattgctgcc

SEQ ID NO: 4639150 - DNA, 15 bp, Homo sapiens
tcccagccctggggg

SEQ ID NO: 4639151 - DNA, 14 bp, Homo sapiens
tcccagcgctgctg

SEQ ID NO: 4639152 - DNA, 19 bp, Homo sapiens
tcccagctgaaggcagtgg

SEQ ID NO: 4639153 - DNA, 23 bp, Homo sapiens
tcccaggaggtgcagtggagggg

SEQ ID NO: 4639154 - DNA, 13 bp, Homo sapiens
tcccaggatctcc

SEQ ID NO: 4639155 - DNA, 15 bp, Homo sapiens
tcccaggcctctgcc

SEQ ID NO: 4639156 - DNA, 17 bp, Homo sapiens
tcccaggcctctgcccc

SEQ ID NO: 4639157 - DNA, 20 bp, Homo sapiens
tcccaggctgggctctgcct

SEQ ID NO: 4639158 - DNA, 20 bp, Homo sapiens
tcccagggccctcccagccc

SEQ ID NO: 4639159 - DNA, 15 bp, Homo sapiens
tcccaggtgagaatt

SEQ ID NO: 4639160 - DNA, 13 bp, Homo sapiens
tcccatccagggc

SEQ ID NO: 4639161 - DNA, 21 bp, Homo sapiens
tcccatgagactgccctgccc

SEQ ID NO: 4639162 - DNA, 14 bp, Homo sapiens
tccccaaggaccca

SEQ ID NO: 4639163 - DNA, 15 bp, Homo sapiens
tccccaaggacccag

SEQ ID NO: 4639164 - DNA, 13 bp, Homo sapiens
tccccaagggccc

SEQ ID NO: 4639165 - DNA, 16 bp, Homo sapiens
tccccaagggccctgg

SEQ ID NO: 4639166 - DNA, 19 bp, Homo sapiens
tccccaccctccactcagc

SEQ ID NO: 4639167 - DNA, 20 bp, Homo sapiens
tccccaccttcacctcggag

SEQ ID NO: 4639168 - DNA, 16 bp, Homo sapiens
tccccactctgctctg

SEQ ID NO: 4639169 - DNA, 20 bp, Homo sapiens
tccccactctgctctgatgc

SEQ ID NO: 4639170 - DNA, 14 bp, Homo sapiens
tccccagagctgtg

SEQ ID NO: 4639171 - DNA, 23 bp, Homo sapiens
tccccaggggcatgactgtcgcc

SEQ ID NO: 4639172 - DNA, 14 bp, Homo sapiens
tccccagtgcccgg

SEQ ID NO: 4639173 - DNA, 22 bp, Homo sapiens
tccccatctaggtcctggctgg

SEQ ID NO: 4639174 - DNA, 16 bp, Homo sapiens
tccccatctcactctt

SEQ ID NO: 4639175 - DNA, 15 bp, Homo sapiens
tccccatctgtgttc

SEQ ID NO: 4639176 - DNA, 16 bp, Homo sapiens
tccccatgaaccctgc

SEQ ID NO: 4639177 - DNA, 17 bp, Homo sapiens
tccccatgaaccctgcc

SEQ ID NO: 4639178 - DNA, 13 bp, Homo sapiens
tcccccaccctcc

SEQ ID NO: 4639179 - DNA, 14 bp, Homo sapiens
tcccccctccattc

SEQ ID NO: 4639180 - DNA, 13 bp, Homo sapiens
tcccccctgctgc

SEQ ID NO: 4639181 - DNA, 14 bp, Homo sapiens
tcccccctgctgcc

SEQ ID NO: 4639182 - DNA, 15 bp, Homo sapiens
tcccccctgctgccc

SEQ ID NO: 4639183 - DNA, 18 bp, Homo sapiens
tcccccctgctgcccagt

SEQ ID NO: 4639184 - DNA, 19 bp, Homo sapiens
tccccctgcttccacctca

SEQ ID NO: 4639185 - DNA, 14 bp, Homo sapiens
tccccctttctctg

SEQ ID NO: 4639186 - DNA, 17 bp, Homo sapiens
tccccctttctctgcct

SEQ ID NO: 4639187 - DNA, 21 bp, Homo sapiens
tccccctttctctgcctggca

SEQ ID NO: 4639188 - DNA, 22 bp, Homo sapiens
tccccctttctctgcctggcaa

SEQ ID NO: 4639189 - DNA, 19 bp, Homo sapiens
tcccctacttctcagtccc

SEQ ID NO: 4639190 - DNA, 14 bp, Homo sapiens
tcccctccccatct

SEQ ID NO: 4639191 - DNA, 15 bp, Homo sapiens
tcccctccccatctg

SEQ ID NO: 4639192 - DNA, 20 bp, Homo sapiens
tcccctccccatctgtgttc

SEQ ID NO: 4639193 - DNA, 22 bp, Homo sapiens
tcccctccccatctgtgttcta

SEQ ID NO: 4639194 - DNA, 21 bp, Homo sapiens
tcccctgccttaacctgggac

SEQ ID NO: 4639195 - DNA, 12 bp, Homo sapiens
tcccctgggact

SEQ ID NO: 4639196 - DNA, 23 bp, Homo sapiens
tcccctgggactttcccacccag

SEQ ID NO: 4639197 - DNA, 18 bp, Homo sapiens
tccccttttaaggtttca

SEQ ID NO: 4639198 - DNA, 15 bp, Homo sapiens
tcccgagtagctggg

SEQ ID NO: 4639199 - DNA, 20 bp, Homo sapiens
tcccgcgtgcaaaggaaagg

SEQ ID NO: 4639200 - DNA, 21 bp, Homo sapiens
tcccgtaagaccaccttccct

SEQ ID NO: 4639201 - DNA, 20 bp, Homo sapiens
tcccgtcacccctgtttctg

SEQ ID NO: 4639202 - DNA, 18 bp, Homo sapiens
tccctaaccctacaaaga

SEQ ID NO: 4639203 - DNA, 16 bp, Homo sapiens
tccctacacagggcct

SEQ ID NO: 4639204 - DNA, 17 bp, Homo sapiens
tccctacacagggcctg

SEQ ID NO: 4639205 - DNA, 23 bp, Homo sapiens
tccctagcaggaacttctagctc

SEQ ID NO: 4639206 - DNA, 15 bp, Homo sapiens
tccctataggaacag

SEQ ID NO: 4639207 - DNA, 19 bp, Homo sapiens
tccctataggaacagccca

SEQ ID NO: 4639208 - DNA, 20 bp, Homo sapiens
tccctataggaacagcccag

SEQ ID NO: 4639209 - DNA, 20 bp, Homo sapiens
tccctatggagaggcttccc

SEQ ID NO: 4639210 - DNA, 18 bp, Homo sapiens
tccctcagcaacatccca

SEQ ID NO: 4639211 - DNA, 11 bp, Homo sapiens
tccctccacct

SEQ ID NO: 4639212 - DNA, 15 bp, Homo sapiens
tccctcctcactccc

SEQ ID NO: 4639213 - DNA, 14 bp, Homo sapiens
tccctctcccaggc

SEQ ID NO: 4639214 - DNA, 17 bp, Homo sapiens
tccctctcccaggcccc

SEQ ID NO: 4639215 - DNA, 21 bp, Homo sapiens
tccctctcccaggccccatga

SEQ ID NO: 4639216 - DNA, 12 bp, Homo sapiens
tccctctccttc

SEQ ID NO: 4639217 - DNA, 14 bp, Homo sapiens
tccctctccttcca

SEQ ID NO: 4639218 - DNA, 16 bp, Homo sapiens
tccctctctcctggac

SEQ ID NO: 4639219 - DNA, 13 bp, Homo sapiens
tccctctgcattg

SEQ ID NO: 4639220 - DNA, 14 bp, Homo sapiens
tccctctgcattga

SEQ ID NO: 4639221 - DNA, 21 bp, Homo sapiens
tccctctgcattgacctggag

SEQ ID NO: 4639222 - DNA, 15 bp, Homo sapiens
tccctctgcctggga

SEQ ID NO: 4639223 - DNA, 16 bp, Homo sapiens
tccctctgcctgggat

SEQ ID NO: 4639224 - DNA, 18 bp, Homo sapiens
tccctctgcctgggatgc

SEQ ID NO: 4639225 - DNA, 19 bp, Homo sapiens
tccctctgcctgggatgcc

SEQ ID NO: 4639226 - DNA, 14 bp, Homo sapiens
tccctgcagggcca

SEQ ID NO: 4639227 - DNA, 12 bp, Homo sapiens
tccctgcctcac

SEQ ID NO: 4639228 - DNA, 16 bp, Homo sapiens
tccctgcctcaggcct

SEQ ID NO: 4639229 - DNA, 17 bp, Homo sapiens
tccctgcgcaccaggct

SEQ ID NO: 4639230 - DNA, 12 bp, Homo sapiens
tccctgctgaat

SEQ ID NO: 4639231 - DNA, 12 bp, Homo sapiens
tccctgggcatt

SEQ ID NO: 4639232 - DNA, 17 bp, Homo sapiens
tccctgggccagggtct

SEQ ID NO: 4639233 - DNA, 14 bp, Homo sapiens
tccctgggcctgct

SEQ ID NO: 4639234 - DNA, 19 bp, Homo sapiens
tccctgggcctgctgctga

SEQ ID NO: 4639235 - DNA, 19 bp, Homo sapiens
tccctggtgagagggccgg

SEQ ID NO: 4639236 - DNA, 14 bp, Homo sapiens
tccctgtcccaggg

SEQ ID NO: 4639237 - DNA, 17 bp, Homo sapiens
tccctgtcccagggccc

SEQ ID NO: 4639238 - DNA, 21 bp, Homo sapiens
tccctgtccctctagtgcctt

SEQ ID NO: 4639239 - DNA, 17 bp, Homo sapiens
tcccttccacctcacaa

SEQ ID NO: 4639240 - DNA, 21 bp, Homo sapiens
tcccttccacctcacaactcc

SEQ ID NO: 4639241 - DNA, 22 bp, Homo sapiens
tcccttccacctcacaactcct

SEQ ID NO: 4639242 - DNA, 17 bp, Homo sapiens
tcccttcccagcgctgc

SEQ ID NO: 4639243 - DNA, 22 bp, Homo sapiens
tcccttcctcttcctgcccttg

SEQ ID NO: 4639244 - DNA, 16 bp, Homo sapiens
tcccttctgcttgtcc

SEQ ID NO: 4639245 - DNA, 20 bp, Homo sapiens
tcccttgaagttgtggagga

SEQ ID NO: 4639246 - DNA, 18 bp, Homo sapiens
tcccttgctcatgagctc

SEQ ID NO: 4639247 - DNA, 19 bp, Homo sapiens
tcccttttaatcctggctg

SEQ ID NO: 4639248 - DNA, 20 bp, Homo sapiens
tcccttttcattctcctcct

SEQ ID NO: 4639249 - DNA, 15 bp, Homo sapiens
tccgaacctcctctg

SEQ ID NO: 4639250 - DNA, 17 bp, Homo sapiens
tccgaacctcctctgtg

SEQ ID NO: 4639251 - DNA, 23 bp, Homo sapiens
tccgacgctgcctctcattggca

SEQ ID NO: 4639252 - DNA, 20 bp, Homo sapiens
tccgagacaccacaaggcag

SEQ ID NO: 4639253 - DNA, 21 bp, Homo sapiens
tccgcacagaaaatacgagaa

SEQ ID NO: 4639254 - DNA, 17 bp, Homo sapiens
tccgccagccacaggac

SEQ ID NO: 4639255 - DNA, 18 bp, Homo sapiens
tccgccagccacaggacc

SEQ ID NO: 4639256 - DNA, 15 bp, Homo sapiens
tccgccagtgtttct

SEQ ID NO: 4639257 - DNA, 16 bp, Homo sapiens
tccgcccacctcagcc

SEQ ID NO: 4639258 - DNA, 19 bp, Homo sapiens
tccgcccacctcagcctcc

SEQ ID NO: 4639259 - DNA, 16 bp, Homo sapiens
tccgccttctcccaca

SEQ ID NO: 4639260 - DNA, 19 bp, Homo sapiens
tccgcgccgatgccaccgg

SEQ ID NO: 4639261 - DNA, 19 bp, Homo sapiens
tccgctttgaaagaagcaa

SEQ ID NO: 4639262 - DNA, 21 bp, Homo sapiens
tccggccaaggtgccaccacc

SEQ ID NO: 4639263 - DNA, 18 bp, Homo sapiens
tccggtggaaggccttct

SEQ ID NO: 4639264 - DNA, 20 bp, Homo sapiens
tccgtagccagctgctcccc

SEQ ID NO: 4639265 - DNA, 14 bp, Homo sapiens
tccgtgaggcaggg

SEQ ID NO: 4639266 - DNA, 18 bp, Homo sapiens
tcctaaagaagacatttt

SEQ ID NO: 4639267 - DNA, 15 bp, Homo sapiens
tcctacagcactact

SEQ ID NO: 4639268 - DNA, 21 bp, Homo sapiens
tcctaccaatggattcatgga

SEQ ID NO: 4639269 - DNA, 19 bp, Homo sapiens
tcctagctacttggcaggc

SEQ ID NO: 4639270 - DNA, 17 bp, Homo sapiens
tcctaggggcttggtcc

SEQ ID NO: 4639271 - DNA, 20 bp, Homo sapiens
tcctagggtgggaaggggct

SEQ ID NO: 4639272 - DNA, 17 bp, Homo sapiens
tcctagtatgccctgta

SEQ ID NO: 4639273 - DNA, 20 bp, Homo sapiens
tcctatatatttctattatt

SEQ ID NO: 4639274 - DNA, 22 bp, Homo sapiens
tcctatgtgattttaactctgt

SEQ ID NO: 4639275 - DNA, 20 bp, Homo sapiens
tcctcactccctaggcccaa

SEQ ID NO: 4639276 - DNA, 21 bp, Homo sapiens
tcctcactcttcaaggaggcc

SEQ ID NO: 4639277 - DNA, 15 bp, Homo sapiens
tcctcagtccctctt

SEQ ID NO: 4639278 - DNA, 17 bp, Homo sapiens
tcctcagtgcaaaatgt

SEQ ID NO: 4639279 - DNA, 22 bp, Homo sapiens
tcctcagtgcaaaatgtcttgt

SEQ ID NO: 4639280 - DNA, 14 bp, Homo sapiens
tcctcatccctgac

SEQ ID NO: 4639281 - DNA, 22 bp, Homo sapiens
tcctccaacaccaagcacagca

SEQ ID NO: 4639282 - DNA, 12 bp, Homo sapiens
tcctccagcccc

SEQ ID NO: 4639283 - DNA, 15 bp, Homo sapiens
tcctccccctgcaac

SEQ ID NO: 4639284 - DNA, 18 bp, Homo sapiens
tcctcccgccaggagctt

SEQ ID NO: 4639285 - DNA, 14 bp, Homo sapiens
tcctccctcctcac

SEQ ID NO: 4639286 - DNA, 17 bp, Homo sapiens
tcctcctgcctttctca

SEQ ID NO: 4639287 - DNA, 18 bp, Homo sapiens
tcctcctgcctttctcaa

SEQ ID NO: 4639288 - DNA, 19 bp, Homo sapiens
tcctccttggtgcctggcc

SEQ ID NO: 4639289 - DNA, 22 bp, Homo sapiens
tcctcgcccctcttctctccct

SEQ ID NO: 4639290 - DNA, 21 bp, Homo sapiens
tcctcgttctccctgggaggc

SEQ ID NO: 4639291 - DNA, 18 bp, Homo sapiens
tcctctcaccttgtccct

SEQ ID NO: 4639292 - DNA, 21 bp, Homo sapiens
tcctctctccctgcctcacat

SEQ ID NO: 4639293 - DNA, 20 bp, Homo sapiens
tcctctgccagcaggaataa

SEQ ID NO: 4639294 - DNA, 19 bp, Homo sapiens
tcctctgtcagtcacagcc

SEQ ID NO: 4639295 - DNA, 22 bp, Homo sapiens
tcctctgtcagtcacagccacc

SEQ ID NO: 4639296 - DNA, 14 bp, Homo sapiens
tcctctgtgaactg

SEQ ID NO: 4639297 - DNA, 15 bp, Homo sapiens
tcctctgtgaactgt

SEQ ID NO: 4639298 - DNA, 21 bp, Homo sapiens
tcctctgttaatgtggactgg

SEQ ID NO: 4639299 - DNA, 21 bp, Homo sapiens
tcctcttctaaaatagcaata

SEQ ID NO: 4639300 - DNA, 16 bp, Homo sapiens
tcctcttcttgttgac

SEQ ID NO: 4639301 - DNA, 22 bp, Homo sapiens
tcctctttttttaaaaataaat

SEQ ID NO: 4639302 - DNA, 16 bp, Homo sapiens
tcctgaaagggcactt

SEQ ID NO: 4639303 - DNA, 14 bp, Homo sapiens
tcctgaagggaact

SEQ ID NO: 4639304 - DNA, 16 bp, Homo sapiens
tcctgagaccacagag

SEQ ID NO: 4639305 - DNA, 12 bp, Homo sapiens
tcctgagcactg

SEQ ID NO: 4639306 - DNA, 14 bp, Homo sapiens
tcctgagcactgcc

SEQ ID NO: 4639307 - DNA, 17 bp, Homo sapiens
tcctgagcactgccagg

SEQ ID NO: 4639308 - DNA, 21 bp, Homo sapiens
tcctgagcactgccaggaggg

SEQ ID NO: 4639309 - DNA, 22 bp, Homo sapiens
tcctgagcactgccaggaggga

SEQ ID NO: 4639310 - DNA, 14 bp, Homo sapiens
tcctgatcagaggc

SEQ ID NO: 4639311 - DNA, 16 bp, Homo sapiens
tcctgatcagaggcat

SEQ ID NO: 4639312 - DNA, 17 bp, Homo sapiens
tcctgccagcccagctg

SEQ ID NO: 4639313 - DNA, 18 bp, Homo sapiens
tcctgccagcccagctgg

SEQ ID NO: 4639314 - DNA, 20 bp, Homo sapiens
tcctgccagggtgagcaggg

SEQ ID NO: 4639315 - DNA, 23 bp, Homo sapiens
tcctgccctaactctgcccaccc

SEQ ID NO: 4639316 - DNA, 10 bp, Homo sapiens
tcctgccctt

SEQ ID NO: 4639317 - DNA, 13 bp, Homo sapiens
tcctgcctcagcc

SEQ ID NO: 4639318 - DNA, 18 bp, Homo sapiens
tcctgcctcagcctcccg

SEQ ID NO: 4639319 - DNA, 19 bp, Homo sapiens
tcctgccttcttccttgag

SEQ ID NO: 4639320 - DNA, 20 bp, Homo sapiens
tcctgcctttaagccaaaga

SEQ ID NO: 4639321 - DNA, 14 bp, Homo sapiens
tcctgctgcctggg

SEQ ID NO: 4639322 - DNA, 22 bp, Homo sapiens
tcctggaagtcaaataaatgtt

SEQ ID NO: 4639323 - DNA, 11 bp, Homo sapiens
tcctggacagc

SEQ ID NO: 4639324 - DNA, 15 bp, Homo sapiens
tcctggacagctgtg

SEQ ID NO: 4639325 - DNA, 14 bp, Homo sapiens
tcctggacattttt

SEQ ID NO: 4639326 - DNA, 12 bp, Homo sapiens
tcctggcacaga

SEQ ID NO: 4639327 - DNA, 22 bp, Homo sapiens
tcctggcacagaagaggagtca

SEQ ID NO: 4639328 - DNA, 13 bp, Homo sapiens
tcctggcccctgc

SEQ ID NO: 4639329 - DNA, 14 bp, Homo sapiens
tcctggcctcagag

SEQ ID NO: 4639330 - DNA, 18 bp, Homo sapiens
tcctggcctcagagcttc

SEQ ID NO: 4639331 - DNA, 21 bp, Homo sapiens
tcctggcctcagagcttcctg

SEQ ID NO: 4639332 - DNA, 22 bp, Homo sapiens
tcctggcctcagagcttcctgg

SEQ ID NO: 4639333 - DNA, 16 bp, Homo sapiens
tcctggctcagcctca

SEQ ID NO: 4639334 - DNA, 16 bp, Homo sapiens
tcctgggcaaaggtat

SEQ ID NO: 4639335 - DNA, 13 bp, Homo sapiens
tcctgggcctttg

SEQ ID NO: 4639336 - DNA, 18 bp, Homo sapiens
tcctgggcctttgcaaga

SEQ ID NO: 4639337 - DNA, 13 bp, Homo sapiens
tcctggggcagca

SEQ ID NO: 4639338 - DNA, 16 bp, Homo sapiens
tcctggggcagcactc

SEQ ID NO: 4639339 - DNA, 17 bp, Homo sapiens
tcctgggtggctactct

SEQ ID NO: 4639340 - DNA, 24 bp, Homo sapiens
tcctgggtggctactctgtgccag

SEQ ID NO: 4639341 - DNA, 14 bp, Homo sapiens
tcctggtcagctgc

SEQ ID NO: 4639342 - DNA, 13 bp, Homo sapiens
tcctggtgccacc

SEQ ID NO: 4639343 - DNA, 14 bp, Homo sapiens
tcctggtgccacct

SEQ ID NO: 4639344 - DNA, 15 bp, Homo sapiens
tcctggtgccacctc

SEQ ID NO: 4639345 - DNA, 19 bp, Homo sapiens
tcctggtggggcagctcct

SEQ ID NO: 4639346 - DNA, 19 bp, Homo sapiens
tcctgtatttgttcccaag

SEQ ID NO: 4639347 - DNA, 20 bp, Homo sapiens
tcctgtatttgttcccaaga

SEQ ID NO: 4639348 - DNA, 13 bp, Homo sapiens
tcctgtcctgctc

SEQ ID NO: 4639349 - DNA, 18 bp, Homo sapiens
tcctgtgctcaaaaatga

SEQ ID NO: 4639350 - DNA, 18 bp, Homo sapiens
tcctgtggctccctctct

SEQ ID NO: 4639351 - DNA, 19 bp, Homo sapiens
tcctgtggctccctctctc

SEQ ID NO: 4639352 - DNA, 18 bp, Homo sapiens
tcctgtgggagcctcgca

SEQ ID NO: 4639353 - DNA, 18 bp, Homo sapiens
tcctgtgtgtactctgtc

SEQ ID NO: 4639354 - DNA, 17 bp, Homo sapiens
tcctgtttccagggtct

SEQ ID NO: 4639355 - DNA, 11 bp, Homo sapiens
tccttaagtat

SEQ ID NO: 4639356 - DNA, 14 bp, Homo sapiens
tccttacactcccc

SEQ ID NO: 4639357 - DNA, 15 bp, Homo sapiens
tccttacagtcacta

SEQ ID NO: 4639358 - DNA, 22 bp, Homo sapiens
tccttaccgtgggcactgaagg

SEQ ID NO: 4639359 - DNA, 17 bp, Homo sapiens
tccttactcctgtggga

SEQ ID NO: 4639360 - DNA, 22 bp, Homo sapiens
tccttactcctgtgggagcctc

SEQ ID NO: 4639361 - DNA, 15 bp, Homo sapiens
tccttatcagagcta

SEQ ID NO: 4639362 - DNA, 19 bp, Homo sapiens
tccttattgggacttttct

SEQ ID NO: 4639363 - DNA, 19 bp, Homo sapiens
tccttcagttctgcttgct

SEQ ID NO: 4639364 - DNA, 20 bp, Homo sapiens
tccttcagttctgcttgctc

SEQ ID NO: 4639365 - DNA, 21 bp, Homo sapiens
tccttcagttctgcttgctcc

SEQ ID NO: 4639366 - DNA, 16 bp, Homo sapiens
tccttccagctagtga

SEQ ID NO: 4639367 - DNA, 22 bp, Homo sapiens
tccttccagctagtgacccaca

SEQ ID NO: 4639368 - DNA, 16 bp, Homo sapiens
tccttcccagaatgtt

SEQ ID NO: 4639369 - DNA, 17 bp, Homo sapiens
tccttccccagctcccc

SEQ ID NO: 4639370 - DNA, 24 bp, Homo sapiens
tccttccccagctcccccaggcag

SEQ ID NO: 4639371 - DNA, 22 bp, Homo sapiens
tccttccctaatagctttttaa

SEQ ID NO: 4639372 - DNA, 16 bp, Homo sapiens
tccttcgaaaggcctt

SEQ ID NO: 4639373 - DNA, 18 bp, Homo sapiens
tccttcgaaaggccttca

SEQ ID NO: 4639374 - DNA, 22 bp, Homo sapiens
tccttctgcaaagtggcaggga

SEQ ID NO: 4639375 - DNA, 23 bp, Homo sapiens
tccttctgcaaagtggcagggac

SEQ ID NO: 4639376 - DNA, 18 bp, Homo sapiens
tccttggctttatgcaaa

SEQ ID NO: 4639377 - DNA, 22 bp, Homo sapiens
tccttggctttatgcaaataca

SEQ ID NO: 4639378 - DNA, 23 bp, Homo sapiens
tccttggctttatgcaaatacaa

SEQ ID NO: 4639379 - DNA, 22 bp, Homo sapiens
tccttgggccataattatgaaa

SEQ ID NO: 4639380 - DNA, 23 bp, Homo sapiens
tccttgtcagggtctccttcctt

SEQ ID NO: 4639381 - DNA, 17 bp, Homo sapiens
tcctttacctttcagtg

SEQ ID NO: 4639382 - DNA, 18 bp, Homo sapiens
tcctttcaaggtaactgt

SEQ ID NO: 4639383 - DNA, 19 bp, Homo sapiens
tcctttcaataaagttgtt

SEQ ID NO: 4639384 - DNA, 20 bp, Homo sapiens
tcctttcaataaagttgttg

SEQ ID NO: 4639385 - DNA, 19 bp, Homo sapiens
tcctttcaattccaccagg

SEQ ID NO: 4639386 - DNA, 20 bp, Homo sapiens
tcctttcaattccaccaggg

SEQ ID NO: 4639387 - DNA, 21 bp, Homo sapiens
tcctttccaatagaaagaaac

SEQ ID NO: 4639388 - DNA, 21 bp, Homo sapiens
tcctttgcccttcctcctgcc

SEQ ID NO: 4639389 - DNA, 12 bp, Homo sapiens
tccttttaactg

SEQ ID NO: 4639390 - DNA, 15 bp, Homo sapiens
tcgaaaggccttcag

SEQ ID NO: 4639391 - DNA, 16 bp, Homo sapiens
tcgaaaggccttcaga

SEQ ID NO: 4639392 - DNA, 20 bp, Homo sapiens
tcgaagggtttttagagaat

SEQ ID NO: 4639393 - DNA, 17 bp, Homo sapiens
tcgaatcttaatttatt

SEQ ID NO: 4639394 - DNA, 16 bp, Homo sapiens
tcgaatttgaagagat

SEQ ID NO: 4639395 - DNA, 13 bp, Homo sapiens
tcgaccctgtccc

SEQ ID NO: 4639396 - DNA, 18 bp, Homo sapiens
tcgagcgccctgcagacc

SEQ ID NO: 4639397 - DNA, 23 bp, Homo sapiens
tcgcacacacccatgtaaccact

SEQ ID NO: 4639398 - DNA, 20 bp, Homo sapiens
tcgcagccaccctgaggagt

SEQ ID NO: 4639399 - DNA, 16 bp, Homo sapiens
tcgcatgtttaatgtg

SEQ ID NO: 4639400 - DNA, 17 bp, Homo sapiens
tcgccacacgcctctgt

SEQ ID NO: 4639401 - DNA, 19 bp, Homo sapiens
tcgcccaggctggagtgca

SEQ ID NO: 4639402 - DNA, 14 bp, Homo sapiens
tcgcccctcagagc

SEQ ID NO: 4639403 - DNA, 17 bp, Homo sapiens
tcgctaatcagtcattt

SEQ ID NO: 4639404 - DNA, 12 bp, Homo sapiens
tcgctcttgagg

SEQ ID NO: 4639405 - DNA, 17 bp, Homo sapiens
tcggacattctaatgca

SEQ ID NO: 4639406 - DNA, 12 bp, Homo sapiens
tcggactgccaa

SEQ ID NO: 4639407 - DNA, 14 bp, Homo sapiens
tcggactgccaaat

SEQ ID NO: 4639408 - DNA, 16 bp, Homo sapiens
tcggacttactgcctg

SEQ ID NO: 4639409 - DNA, 12 bp, Homo sapiens
tcggaggaagcc

SEQ ID NO: 4639410 - DNA, 21 bp, Homo sapiens
tcggatgacaccctggcctga

SEQ ID NO: 4639411 - DNA, 12 bp, Homo sapiens
tcgggcatgagt

SEQ ID NO: 4639412 - DNA, 23 bp, Homo sapiens
tcgggcatgagtctgtttcccaa

SEQ ID NO: 4639413 - DNA, 15 bp, Homo sapiens
tcggggtgcacagga

SEQ ID NO: 4639414 - DNA, 16 bp, Homo sapiens
tcggggtgcacaggag

SEQ ID NO: 4639415 - DNA, 19 bp, Homo sapiens
tcggggtgcacaggagggg

SEQ ID NO: 4639416 - DNA, 23 bp, Homo sapiens
tcgggtccatagagatgagccca

SEQ ID NO: 4639417 - DNA, 18 bp, Homo sapiens
tcgtcaccccagccctcg

SEQ ID NO: 4639418 - DNA, 20 bp, Homo sapiens
tcgtccctatatcagggcct

SEQ ID NO: 4639419 - DNA, 13 bp, Homo sapiens
tcgtgagctgggg

SEQ ID NO: 4639420 - DNA, 20 bp, Homo sapiens
tcgtgagctggggactcagg

SEQ ID NO: 4639421 - DNA, 10 bp, Homo sapiens
tcgtggagag

SEQ ID NO: 4639422 - DNA, 18 bp, Homo sapiens
tcgtggagagctaggagc

SEQ ID NO: 4639423 - DNA, 15 bp, Homo sapiens
tcgttgcacagctgt

SEQ ID NO: 4639424 - DNA, 15 bp, Homo sapiens
tctaaaacaataaaa

SEQ ID NO: 4639425 - DNA, 14 bp, Homo sapiens
tctaaacaaaaaat

SEQ ID NO: 4639426 - DNA, 23 bp, Homo sapiens
tctaaactaggattgacattcta

SEQ ID NO: 4639427 - DNA, 23 bp, Homo sapiens
tctaaagaagttcaaaccctgta

SEQ ID NO: 4639428 - DNA, 16 bp, Homo sapiens
tctaaataaaaatatg

SEQ ID NO: 4639429 - DNA, 22 bp, Homo sapiens
tctaaataaaaatatgtaattt

SEQ ID NO: 4639430 - DNA, 16 bp, Homo sapiens
tctaacgccagcacac

SEQ ID NO: 4639431 - DNA, 13 bp, Homo sapiens
tctaacttattta

SEQ ID NO: 4639432 - DNA, 13 bp, Homo sapiens
tctaagaaaatgt

SEQ ID NO: 4639433 - DNA, 13 bp, Homo sapiens
tctaagcccagga

SEQ ID NO: 4639434 - DNA, 18 bp, Homo sapiens
tctaagcccaggatctct

SEQ ID NO: 4639435 - DNA, 12 bp, Homo sapiens
tctaaggtactg

SEQ ID NO: 4639436 - DNA, 17 bp, Homo sapiens
tctaagtcgtgcacttt

SEQ ID NO: 4639437 - DNA, 12 bp, Homo sapiens
tctaatagtctt

SEQ ID NO: 4639438 - DNA, 13 bp, Homo sapiens
tctaatgcatatt

SEQ ID NO: 4639439 - DNA, 19 bp, Homo sapiens
tctaatgcatatttataag

SEQ ID NO: 4639440 - DNA, 22 bp, Homo sapiens
tctaatgcatatttataagaga

SEQ ID NO: 4639441 - DNA, 21 bp, Homo sapiens
tctaattgtaagtgaaattaa

SEQ ID NO: 4639442 - DNA, 19 bp, Homo sapiens
tctacaaataattttagtg

SEQ ID NO: 4639443 - DNA, 14 bp, Homo sapiens
tctacaactggagt

SEQ ID NO: 4639444 - DNA, 15 bp, Homo sapiens
tctacaggcctgcag

SEQ ID NO: 4639445 - DNA, 20 bp, Homo sapiens
tctacaggcctgcagcccct

SEQ ID NO: 4639446 - DNA, 12 bp, Homo sapiens
tctacagttgtg

SEQ ID NO: 4639447 - DNA, 14 bp, Homo sapiens
tctacattaaaatg

SEQ ID NO: 4639448 - DNA, 18 bp, Homo sapiens
tctacattaaaatgacaa

SEQ ID NO: 4639449 - DNA, 20 bp, Homo sapiens
tctacattaaaatgacaaac

SEQ ID NO: 4639450 - DNA, 16 bp, Homo sapiens
tctacccgttccaaaa

SEQ ID NO: 4639451 - DNA, 15 bp, Homo sapiens
tctaccctggaaaag

SEQ ID NO: 4639452 - DNA, 12 bp, Homo sapiens
tctaccctggga

SEQ ID NO: 4639453 - DNA, 13 bp, Homo sapiens
tctaccctgggat

SEQ ID NO: 4639454 - DNA, 15 bp, Homo sapiens
tctacccttttcctt

SEQ ID NO: 4639455 - DNA, 22 bp, Homo sapiens
tctacgccaatgttatgccagc

SEQ ID NO: 4639456 - DNA, 21 bp, Homo sapiens
tctactttattaattgttttg

SEQ ID NO: 4639457 - DNA, 23 bp, Homo sapiens
tctagacatcattgtcagccttg

SEQ ID NO: 4639458 - DNA, 12 bp, Homo sapiens
tctagagctttt

SEQ ID NO: 4639459 - DNA, 17 bp, Homo sapiens
tctagatacaggactgg

SEQ ID NO: 4639460 - DNA, 14 bp, Homo sapiens
tctagcacactctt

SEQ ID NO: 4639461 - DNA, 13 bp, Homo sapiens
tctagccccagcg

SEQ ID NO: 4639462 - DNA, 12 bp, Homo sapiens
tctagctcattt

SEQ ID NO: 4639463 - DNA, 14 bp, Homo sapiens
tctagctctctagg

SEQ ID NO: 4639464 - DNA, 15 bp, Homo sapiens
tctagctttgtcata

SEQ ID NO: 4639465 - DNA, 13 bp, Homo sapiens
tctaggacacagt

SEQ ID NO: 4639466 - DNA, 23 bp, Homo sapiens
tctaggacacagttcctgggaac

SEQ ID NO: 4639467 - DNA, 14 bp, Homo sapiens
tctaggatagctaa

SEQ ID NO: 4639468 - DNA, 13 bp, Homo sapiens
tctaggttataca

SEQ ID NO: 4639469 - DNA, 16 bp, Homo sapiens
tctaggttatacaata

SEQ ID NO: 4639470 - DNA, 19 bp, Homo sapiens
tctaggttatacaataacc

SEQ ID NO: 4639471 - DNA, 15 bp, Homo sapiens
tctagtcattgtcat

SEQ ID NO: 4639472 - DNA, 22 bp, Homo sapiens
tctagtgggttgacctttaaat

SEQ ID NO: 4639473 - DNA, 15 bp, Homo sapiens
tctagttctttcctc

SEQ ID NO: 4639474 - DNA, 16 bp, Homo sapiens
tctagttctttcctcc

SEQ ID NO: 4639475 - DNA, 21 bp, Homo sapiens
tctagttctttcctccccctg

SEQ ID NO: 4639476 - DNA, 22 bp, Homo sapiens
tctagtttttggaaaaaccttg

SEQ ID NO: 4639477 - DNA, 19 bp, Homo sapiens
tctataagtagtaaatcag

SEQ ID NO: 4639478 - DNA, 20 bp, Homo sapiens
tctataatcccagcactttg

SEQ ID NO: 4639479 - DNA, 13 bp, Homo sapiens
tctatacaaaaaa

SEQ ID NO: 4639480 - DNA, 23 bp, Homo sapiens
tctatagccaactgctaatgcaa

SEQ ID NO: 4639481 - DNA, 18 bp, Homo sapiens
tctataggtgtcttcaga

SEQ ID NO: 4639482 - DNA, 16 bp, Homo sapiens
tctatcactgcattat

SEQ ID NO: 4639483 - DNA, 13 bp, Homo sapiens
tctatcagactca

SEQ ID NO: 4639484 - DNA, 14 bp, Homo sapiens
tctatcatatgaag

SEQ ID NO: 4639485 - DNA, 18 bp, Homo sapiens
tctatctacataagtcct

SEQ ID NO: 4639486 - DNA, 15 bp, Homo sapiens
tctatgacaaattca

SEQ ID NO: 4639487 - DNA, 15 bp, Homo sapiens
tctatgatccttttt

SEQ ID NO: 4639488 - DNA, 13 bp, Homo sapiens
tctatgatgttgc

SEQ ID NO: 4639489 - DNA, 16 bp, Homo sapiens
tctatgatgttgctgt

SEQ ID NO: 4639490 - DNA, 19 bp, Homo sapiens
tctatggcttatttctatg

SEQ ID NO: 4639491 - DNA, 22 bp, Homo sapiens
tctatgttagtataagcttttc

SEQ ID NO: 4639492 - DNA, 15 bp, Homo sapiens
tctatgttcaaagac

SEQ ID NO: 4639493 - DNA, 14 bp, Homo sapiens
tctatgtttgtatt

SEQ ID NO: 4639494 - DNA, 17 bp, Homo sapiens
tctattatggaaaactg

SEQ ID NO: 4639495 - DNA, 12 bp, Homo sapiens
tctattttaaga

SEQ ID NO: 4639496 - DNA, 17 bp, Homo sapiens
tctcaaaataaagcaat

SEQ ID NO: 4639497 - DNA, 19 bp, Homo sapiens
tctcaaagtataatctttc

SEQ ID NO: 4639498 - DNA, 23 bp, Homo sapiens
tctcaaagtataatctttctata

SEQ ID NO: 4639499 - DNA, 14 bp, Homo sapiens
tctcaacatactgt

SEQ ID NO: 4639500 - DNA, 15 bp, Homo sapiens
tctcaacatactgta

SEQ ID NO: 4639501 - DNA, 23 bp, Homo sapiens
tctcacaaataagtaatatcttt

SEQ ID NO: 4639502 - DNA, 13 bp, Homo sapiens
tctcacaggctga

SEQ ID NO: 4639503 - DNA, 13 bp, Homo sapiens
tctcactcttgtc

SEQ ID NO: 4639504 - DNA, 14 bp, Homo sapiens
tctcactgcttgaa

SEQ ID NO: 4639505 - DNA, 18 bp, Homo sapiens
tctcactgcttgaactag

SEQ ID NO: 4639506 - DNA, 14 bp, Homo sapiens
tctcactggcatct

SEQ ID NO: 4639507 - DNA, 16 bp, Homo sapiens
tctcactggcatcttg

SEQ ID NO: 4639508 - DNA, 21 bp, Homo sapiens
tctcactgtgtccctctctct

SEQ ID NO: 4639509 - DNA, 20 bp, Homo sapiens
tctcactgtgttactgcttt

SEQ ID NO: 4639510 - DNA, 23 bp, Homo sapiens
tctcactgtgttactgctttgca

SEQ ID NO: 4639511 - DNA, 19 bp, Homo sapiens
tctcactgtttgtttttat

SEQ ID NO: 4639512 - DNA, 15 bp, Homo sapiens
tctcaggagatggag

SEQ ID NO: 4639513 - DNA, 18 bp, Homo sapiens
tctcagtgattcgctttt

SEQ ID NO: 4639514 - DNA, 20 bp, Homo sapiens
tctcagtttctgcctgggca

SEQ ID NO: 4639515 - DNA, 21 bp, Homo sapiens
tctcatgcccctggctgggac

SEQ ID NO: 4639516 - DNA, 14 bp, Homo sapiens
tctccacagcaacc

SEQ ID NO: 4639517 - DNA, 19 bp, Homo sapiens
tctccacagcaaccccagg

SEQ ID NO: 4639518 - DNA, 23 bp, Homo sapiens
tctccaccctcccagacctgcct

SEQ ID NO: 4639519 - DNA, 19 bp, Homo sapiens
tctccaggattttaatttc

SEQ ID NO: 4639520 - DNA, 19 bp, Homo sapiens
tctccaggggcctgcagaa

SEQ ID NO: 4639521 - DNA, 17 bp, Homo sapiens
tctccataaccccaccc

SEQ ID NO: 4639522 - DNA, 18 bp, Homo sapiens
tctccataaccccaccct

SEQ ID NO: 4639523 - DNA, 24 bp, Homo sapiens
tctccataggagggaaggagcagt

SEQ ID NO: 4639524 - DNA, 15 bp, Homo sapiens
tctccatggccacct

SEQ ID NO: 4639525 - DNA, 15 bp, Homo sapiens
tctccattccctagc

SEQ ID NO: 4639526 - DNA, 17 bp, Homo sapiens
tctccattttagcccag

SEQ ID NO: 4639527 - DNA, 21 bp, Homo sapiens
tctcccacatgaggccatctc

SEQ ID NO: 4639528 - DNA, 13 bp, Homo sapiens
tctcccaggcccc

SEQ ID NO: 4639529 - DNA, 12 bp, Homo sapiens
tctcccaggcct

SEQ ID NO: 4639530 - DNA, 13 bp, Homo sapiens
tctcccaggcctc

SEQ ID NO: 4639531 - DNA, 15 bp, Homo sapiens
tctcccatcctgggg

SEQ ID NO: 4639532 - DNA, 16 bp, Homo sapiens
tctcccctccccatct

SEQ ID NO: 4639533 - DNA, 21 bp, Homo sapiens
tctcccctccccatctgtgtt

SEQ ID NO: 4639534 - DNA, 22 bp, Homo sapiens
tctcccctccccatctgtgttc

SEQ ID NO: 4639535 - DNA, 17 bp, Homo sapiens
tctccccttcacgtttg

SEQ ID NO: 4639536 - DNA, 12 bp, Homo sapiens
tctccctgcctc

SEQ ID NO: 4639537 - DNA, 18 bp, Homo sapiens
tctcctaggggcttggtc

SEQ ID NO: 4639538 - DNA, 19 bp, Homo sapiens
tctcctaggggcttggtcc

SEQ ID NO: 4639539 - DNA, 19 bp, Homo sapiens
tctcctatatatttctatt

SEQ ID NO: 4639540 - DNA, 22 bp, Homo sapiens
tctcctatatatttctattatt

SEQ ID NO: 4639541 - DNA, 23 bp, Homo sapiens
tctcctatatatttctattatta

SEQ ID NO: 4639542 - DNA, 14 bp, Homo sapiens
tctcctccatcttc

SEQ ID NO: 4639543 - DNA, 15 bp, Homo sapiens
tctcctcctcctccc

SEQ ID NO: 4639544 - DNA, 12 bp, Homo sapiens
tctcctctccat

SEQ ID NO: 4639545 - DNA, 14 bp, Homo sapiens
tctcctctccattt

SEQ ID NO: 4639546 - DNA, 22 bp, Homo sapiens
tctcctctccattttagcccag

SEQ ID NO: 4639547 - DNA, 22 bp, Homo sapiens
tctcctcttcatggcatcttca

SEQ ID NO: 4639548 - DNA, 14 bp, Homo sapiens
tctcctgcctcagc

SEQ ID NO: 4639549 - DNA, 18 bp, Homo sapiens
tctcctgcctcagcctcc

SEQ ID NO: 4639550 - DNA, 22 bp, Homo sapiens
tctcctggactggttatcttgt

SEQ ID NO: 4639551 - DNA, 12 bp, Homo sapiens
tctcctggcttc

SEQ ID NO: 4639552 - DNA, 18 bp, Homo sapiens
tctcctggcttcccatcc

SEQ ID NO: 4639553 - DNA, 12 bp, Homo sapiens
tctcctgggaaa

SEQ ID NO: 4639554 - DNA, 13 bp, Homo sapiens
tctcctgggaaag

SEQ ID NO: 4639555 - DNA, 13 bp, Homo sapiens
tctccttccttcc

SEQ ID NO: 4639556 - DNA, 23 bp, Homo sapiens
tctcgaatttgaagagattgctg

SEQ ID NO: 4639557 - DNA, 17 bp, Homo sapiens
tctcgagcgccctgcag

SEQ ID NO: 4639558 - DNA, 21 bp, Homo sapiens
tctcgcctcattactgtgagg

SEQ ID NO: 4639559 - DNA, 18 bp, Homo sapiens
tctcggatgacaccctgg

SEQ ID NO: 4639560 - DNA, 22 bp, Homo sapiens
tctcggatgacaccctggcctg

SEQ ID NO: 4639561 - DNA, 13 bp, Homo sapiens
tctcggctcactg

SEQ ID NO: 4639562 - DNA, 15 bp, Homo sapiens
tctcggctcactgca

SEQ ID NO: 4639563 - DNA, 14 bp, Homo sapiens
tctcggctcagtgc

SEQ ID NO: 4639564 - DNA, 19 bp, Homo sapiens
tctcgtggtaggactgtag

SEQ ID NO: 4639565 - DNA, 13 bp, Homo sapiens
tctctactctgct

SEQ ID NO: 4639566 - DNA, 18 bp, Homo sapiens
tctctaggcctctccagt

SEQ ID NO: 4639567 - DNA, 15 bp, Homo sapiens
tctctattttcataa

SEQ ID NO: 4639568 - DNA, 13 bp, Homo sapiens
tctctcaaatctg

SEQ ID NO: 4639569 - DNA, 14 bp, Homo sapiens
tctctcaaattgtc

SEQ ID NO: 4639570 - DNA, 22 bp, Homo sapiens
tctctcactgtgttactgcttt

SEQ ID NO: 4639571 - DNA, 15 bp, Homo sapiens
tctctccctctgccc

SEQ ID NO: 4639572 - DNA, 15 bp, Homo sapiens
tctctccctgcctca

SEQ ID NO: 4639573 - DNA, 14 bp, Homo sapiens
tctctcctggactg

SEQ ID NO: 4639574 - DNA, 15 bp, Homo sapiens
tctctcctggactgg

SEQ ID NO: 4639575 - DNA, 17 bp, Homo sapiens
tctctctagctttgtca

SEQ ID NO: 4639576 - DNA, 11 bp, Homo sapiens
tctctctcacc

SEQ ID NO: 4639577 - DNA, 20 bp, Homo sapiens
tctctcttgcctgaggggaa

SEQ ID NO: 4639578 - DNA, 18 bp, Homo sapiens
tctctgaagggacccccc

SEQ ID NO: 4639579 - DNA, 21 bp, Homo sapiens
tctctgagttttagttggtct

SEQ ID NO: 4639580 - DNA, 12 bp, Homo sapiens
tctctgcctggc

SEQ ID NO: 4639581 - DNA, 14 bp, Homo sapiens
tctctggctactcc

SEQ ID NO: 4639582 - DNA, 19 bp, Homo sapiens
tctctggctactccctgga

SEQ ID NO: 4639583 - DNA, 21 bp, Homo sapiens
tctctggctactccctggacc

SEQ ID NO: 4639584 - DNA, 21 bp, Homo sapiens
tctctgtacttttcattctct

SEQ ID NO: 4639585 - DNA, 13 bp, Homo sapiens
tctctgtgaatcc

SEQ ID NO: 4639586 - DNA, 19 bp, Homo sapiens
tctctgtgaatccatgggt

SEQ ID NO: 4639587 - DNA, 23 bp, Homo sapiens
tctctgttctacccgttccaaaa

SEQ ID NO: 4639588 - DNA, 18 bp, Homo sapiens
tctctgttgactggctgt

SEQ ID NO: 4639589 - DNA, 21 bp, Homo sapiens
tctctgttttgtgccagtgct

SEQ ID NO: 4639590 - DNA, 19 bp, Homo sapiens
tctcttagagattttcatt

SEQ ID NO: 4639591 - DNA, 20 bp, Homo sapiens
tctcttagagattttcattt

SEQ ID NO: 4639592 - DNA, 18 bp, Homo sapiens
tctcttccaagtccttta

SEQ ID NO: 4639593 - DNA, 17 bp, Homo sapiens
tctcttctacccttttc

SEQ ID NO: 4639594 - DNA, 21 bp, Homo sapiens
tctcttgccatttgtagcttt

SEQ ID NO: 4639595 - DNA, 22 bp, Homo sapiens
tctctttccccaaggacccagc

SEQ ID NO: 4639596 - DNA, 19 bp, Homo sapiens
tctctttctgtttcctggc

SEQ ID NO: 4639597 - DNA, 12 bp, Homo sapiens
tctcttttccac

SEQ ID NO: 4639598 - DNA, 15 bp, Homo sapiens
tctgaaagctttata

SEQ ID NO: 4639599 - DNA, 18 bp, Homo sapiens
tctgaagactgagaactt

SEQ ID NO: 4639600 - DNA, 17 bp, Homo sapiens
tctgaagcccaaagcct

SEQ ID NO: 4639601 - DNA, 18 bp, Homo sapiens
tctgaagcccaaagcctg

SEQ ID NO: 4639602 - DNA, 23 bp, Homo sapiens
tctgaagcccaaagcctgaggac

SEQ ID NO: 4639603 - DNA, 20 bp, Homo sapiens
tctgaagctgacgaacttcc

SEQ ID NO: 4639604 - DNA, 15 bp, Homo sapiens
tctgaatcatgtctg

SEQ ID NO: 4639605 - DNA, 15 bp, Homo sapiens
tctgaatgtttgtgt

SEQ ID NO: 4639606 - DNA, 17 bp, Homo sapiens
tctgaatgtttgtgtct

SEQ ID NO: 4639607 - DNA, 20 bp, Homo sapiens
tctgaatgtttgtgtctgtg

SEQ ID NO: 4639608 - DNA, 21 bp, Homo sapiens
tctgaatgtttgtgtctgtgg

SEQ ID NO: 4639609 - DNA, 22 bp, Homo sapiens
tctgaatgtttgtgtctgtggt

SEQ ID NO: 4639610 - DNA, 15 bp, Homo sapiens
tctgacaagctggcc

SEQ ID NO: 4639611 - DNA, 16 bp, Homo sapiens
tctgacaagctggcca

SEQ ID NO: 4639612 - DNA, 23 bp, Homo sapiens
tctgacccttacagcctctgact

SEQ ID NO: 4639613 - DNA, 13 bp, Homo sapiens
tctgactgccaag

SEQ ID NO: 4639614 - DNA, 18 bp, Homo sapiens
tctgactgccaagccaga

SEQ ID NO: 4639615 - DNA, 19 bp, Homo sapiens
tctgactgccaagccagat

SEQ ID NO: 4639616 - DNA, 23 bp, Homo sapiens
tctgactgccaagccagattctc

SEQ ID NO: 4639617 - DNA, 13 bp, Homo sapiens
tctgagaggccct

SEQ ID NO: 4639618 - DNA, 16 bp, Homo sapiens
tctgagaggccctgga

SEQ ID NO: 4639619 - DNA, 14 bp, Homo sapiens
tctgaggccagcct

SEQ ID NO: 4639620 - DNA, 16 bp, Homo sapiens
tctgaggccagcctgg

SEQ ID NO: 4639621 - DNA, 18 bp, Homo sapiens
tctgaggccagcctggcc

SEQ ID NO: 4639622 - DNA, 20 bp, Homo sapiens
tctgaggccagcctggcctc

SEQ ID NO: 4639623 - DNA, 21 bp, Homo sapiens
tctgaggcgccccaacccgtg

SEQ ID NO: 4639624 - DNA, 14 bp, Homo sapiens
tctgaggtcctgag

SEQ ID NO: 4639625 - DNA, 19 bp, Homo sapiens
tctgaggtcctgagcactg

SEQ ID NO: 4639626 - DNA, 15 bp, Homo sapiens
tctgagtctatgttc

SEQ ID NO: 4639627 - DNA, 18 bp, Homo sapiens
tctgagtctatgttcaaa

SEQ ID NO: 4639628 - DNA, 22 bp, Homo sapiens
tctgataagcttcctagaaagt

SEQ ID NO: 4639629 - DNA, 22 bp, Homo sapiens
tctgatagctgtttcaaatgtg

SEQ ID NO: 4639630 - DNA, 14 bp, Homo sapiens
tctgcaaaatacac

SEQ ID NO: 4639631 - DNA, 23 bp, Homo sapiens
tctgcacatgaatcccacccaca

SEQ ID NO: 4639632 - DNA, 16 bp, Homo sapiens
tctgcacatgtcttgt

SEQ ID NO: 4639633 - DNA, 21 bp, Homo sapiens
tctgcacccctctgccctcat

SEQ ID NO: 4639634 - DNA, 15 bp, Homo sapiens
tctgcatgtttgatt

SEQ ID NO: 4639635 - DNA, 15 bp, Homo sapiens
tctgcattgacctgg

SEQ ID NO: 4639636 - DNA, 15 bp, Homo sapiens
tctgccagacctgca

SEQ ID NO: 4639637 - DNA, 17 bp, Homo sapiens
tctgccagacctgcatg

SEQ ID NO: 4639638 - DNA, 15 bp, Homo sapiens
tctgccagcaggaat

SEQ ID NO: 4639639 - DNA, 16 bp, Homo sapiens
tctgccagcaggaata

SEQ ID NO: 4639640 - DNA, 18 bp, Homo sapiens
tctgccagcaggaataaa

SEQ ID NO: 4639641 - DNA, 19 bp, Homo sapiens
tctgccagcaggaataaag

SEQ ID NO: 4639642 - DNA, 18 bp, Homo sapiens
tctgcccaccctcctgta

SEQ ID NO: 4639643 - DNA, 16 bp, Homo sapiens
tctgcccaggcaagga

SEQ ID NO: 4639644 - DNA, 21 bp, Homo sapiens
tctgcccaggcaaggaacaga

SEQ ID NO: 4639645 - DNA, 14 bp, Homo sapiens
tctgccccaagagc

SEQ ID NO: 4639646 - DNA, 18 bp, Homo sapiens
tctgccccaggccctact

SEQ ID NO: 4639647 - DNA, 21 bp, Homo sapiens
tctgcctagagtgtagcctaa

SEQ ID NO: 4639648 - DNA, 21 bp, Homo sapiens
tctgcctcctgggttcacgta

SEQ ID NO: 4639649 - DNA, 11 bp, Homo sapiens
tctgcctggca

SEQ ID NO: 4639650 - DNA, 12 bp, Homo sapiens
tctgcctggcaa

SEQ ID NO: 4639651 - DNA, 21 bp, Homo sapiens
tctgcctgggatgcccttccc

SEQ ID NO: 4639652 - DNA, 19 bp, Homo sapiens
tctgcctgggcaatggcca

SEQ ID NO: 4639653 - DNA, 20 bp, Homo sapiens
tctgcctttaattttcttgt

SEQ ID NO: 4639654 - DNA, 13 bp, Homo sapiens
tctgctctgatgc

SEQ ID NO: 4639655 - DNA, 13 bp, Homo sapiens
tctgctctgcata

SEQ ID NO: 4639656 - DNA, 19 bp, Homo sapiens
tctgctctttcctcggcct

SEQ ID NO: 4639657 - DNA, 22 bp, Homo sapiens
tctgcttcccaggttcaagcga

SEQ ID NO: 4639658 - DNA, 16 bp, Homo sapiens
tctgcttgctcccaag

SEQ ID NO: 4639659 - DNA, 22 bp, Homo sapiens
tctggaaacctgtcattgtatt

SEQ ID NO: 4639660 - DNA, 14 bp, Homo sapiens
tctggaaaggagga

SEQ ID NO: 4639661 - DNA, 17 bp, Homo sapiens
tctggaagcccctgggc

SEQ ID NO: 4639662 - DNA, 18 bp, Homo sapiens
tctggaagcccctgggcc

SEQ ID NO: 4639663 - DNA, 18 bp, Homo sapiens
tctggaataaagttgcag

SEQ ID NO: 4639664 - DNA, 19 bp, Homo sapiens
tctggaataaagttgcaga

SEQ ID NO: 4639665 - DNA, 13 bp, Homo sapiens
tctggagaaaaag

SEQ ID NO: 4639666 - DNA, 19 bp, Homo sapiens
tctggcaaggacagaggcg

SEQ ID NO: 4639667 - DNA, 14 bp, Homo sapiens
tctggcagggcagc

SEQ ID NO: 4639668 - DNA, 15 bp, Homo sapiens
tctggcagggcagca

SEQ ID NO: 4639669 - DNA, 17 bp, Homo sapiens
tctggcagggcagcagg

SEQ ID NO: 4639670 - DNA, 14 bp, Homo sapiens
tctggccctggccc

SEQ ID NO: 4639671 - DNA, 17 bp, Homo sapiens
tctggctagagggccca

SEQ ID NO: 4639672 - DNA, 18 bp, Homo sapiens
tctgggaagtcctagccc

SEQ ID NO: 4639673 - DNA, 15 bp, Homo sapiens
tctgggaccccagct

SEQ ID NO: 4639674 - DNA, 19 bp, Homo sapiens
tctgggctcaagctttccc

SEQ ID NO: 4639675 - DNA, 11 bp, Homo sapiens
tctgggctctg

SEQ ID NO: 4639676 - DNA, 13 bp, Homo sapiens
tctgggctctgga

SEQ ID NO: 4639677 - DNA, 14 bp, Homo sapiens
tctgggctctggac

SEQ ID NO: 4639678 - DNA, 15 bp, Homo sapiens
tctgggctctggact

SEQ ID NO: 4639679 - DNA, 23 bp, Homo sapiens
tctgggctgtaacgtggcactgg

SEQ ID NO: 4639680 - DNA, 21 bp, Homo sapiens
tctggggaggcaggcattcct

SEQ ID NO: 4639681 - DNA, 17 bp, Homo sapiens
tctggtcaacctcctgg

SEQ ID NO: 4639682 - DNA, 17 bp, Homo sapiens
tctgtaattgtgtgtga

SEQ ID NO: 4639683 - DNA, 23 bp, Homo sapiens
tctgtacaatgaacccccatgat

SEQ ID NO: 4639684 - DNA, 13 bp, Homo sapiens
tctgtacacgtgt

SEQ ID NO: 4639685 - DNA, 21 bp, Homo sapiens
tctgtaggtgaaagaacaagt

SEQ ID NO: 4639686 - DNA, 16 bp, Homo sapiens
tctgtatatatatata

SEQ ID NO: 4639687 - DNA, 18 bp, Homo sapiens
tctgtatccccagtgccc

SEQ ID NO: 4639688 - DNA, 17 bp, Homo sapiens
tctgtcagtcacagcca

SEQ ID NO: 4639689 - DNA, 14 bp, Homo sapiens
tctgtctgctctgc

SEQ ID NO: 4639690 - DNA, 14 bp, Homo sapiens
tctgtcttgttcat

SEQ ID NO: 4639691 - DNA, 23 bp, Homo sapiens
tctgtctttgcggggcctgtctc

SEQ ID NO: 4639692 - DNA, 18 bp, Homo sapiens
tctgtgaatccatgggtc

SEQ ID NO: 4639693 - DNA, 13 bp, Homo sapiens
tctgtgccagagc

SEQ ID NO: 4639694 - DNA, 22 bp, Homo sapiens
tctgtgccagagcctggggctc

SEQ ID NO: 4639695 - DNA, 21 bp, Homo sapiens
tctgtggaagtagctttgaac

SEQ ID NO: 4639696 - DNA, 17 bp, Homo sapiens
tctgtggagctgccaca

SEQ ID NO: 4639697 - DNA, 22 bp, Homo sapiens
tctgtggagctgccacagagaa

SEQ ID NO: 4639698 - DNA, 23 bp, Homo sapiens
tctgtggagctgccacagagaag

SEQ ID NO: 4639699 - DNA, 14 bp, Homo sapiens
tctgtgtacaaaga

SEQ ID NO: 4639700 - DNA, 16 bp, Homo sapiens
tctgtgtctgagtggc

SEQ ID NO: 4639701 - DNA, 16 bp, Homo sapiens
tctgtgtggtatattg

SEQ ID NO: 4639702 - DNA, 16 bp, Homo sapiens
tctgtgtggtgcattc

SEQ ID NO: 4639703 - DNA, 17 bp, Homo sapiens
tctgtgtggtgcattcc

SEQ ID NO: 4639704 - DNA, 20 bp, Homo sapiens
tctgtgtggtgcattcctga

SEQ ID NO: 4639705 - DNA, 13 bp, Homo sapiens
tctgttaatgtgg

SEQ ID NO: 4639706 - DNA, 17 bp, Homo sapiens
tctgttcccagtagtta

SEQ ID NO: 4639707 - DNA, 14 bp, Homo sapiens
tctgttccccaccc

SEQ ID NO: 4639708 - DNA, 15 bp, Homo sapiens
tctgttccccaccca

SEQ ID NO: 4639709 - DNA, 21 bp, Homo sapiens
tctgttgaaacttacactgtt

SEQ ID NO: 4639710 - DNA, 12 bp, Homo sapiens
tctgttgcctcc

SEQ ID NO: 4639711 - DNA, 15 bp, Homo sapiens
tctgttgcctcctct

SEQ ID NO: 4639712 - DNA, 12 bp, Homo sapiens
tctgttgttttt

SEQ ID NO: 4639713 - DNA, 13 bp, Homo sapiens
tctgtttcccaag

SEQ ID NO: 4639714 - DNA, 16 bp, Homo sapiens
tctgtttcccaagcta

SEQ ID NO: 4639715 - DNA, 13 bp, Homo sapiens
tctgtttcctggc

SEQ ID NO: 4639716 - DNA, 13 bp, Homo sapiens
tctgttttcaagt

SEQ ID NO: 4639717 - DNA, 17 bp, Homo sapiens
tctgttttcaagtgtaa

SEQ ID NO: 4639718 - DNA, 13 bp, Homo sapiens
tctgttttgtaaa

SEQ ID NO: 4639719 - DNA, 22 bp, Homo sapiens
tctgttttgtaaagtccccaga

SEQ ID NO: 4639720 - DNA, 14 bp, Homo sapiens
tctgttttgtgcca

SEQ ID NO: 4639721 - DNA, 19 bp, Homo sapiens
tctgtttttaatgctattt

SEQ ID NO: 4639722 - DNA, 13 bp, Homo sapiens
tcttaaaggacat

SEQ ID NO: 4639723 - DNA, 23 bp, Homo sapiens
tcttaaaggacataaaatttaaa

SEQ ID NO: 4639724 - DNA, 14 bp, Homo sapiens
tcttaaatctgtga

SEQ ID NO: 4639725 - DNA, 15 bp, Homo sapiens
tcttaatctttattt

SEQ ID NO: 4639726 - DNA, 16 bp, Homo sapiens
tcttacacataaagca

SEQ ID NO: 4639727 - DNA, 18 bp, Homo sapiens
tcttaccattaacatttt

SEQ ID NO: 4639728 - DNA, 15 bp, Homo sapiens
tcttactactttaaa

SEQ ID NO: 4639729 - DNA, 16 bp, Homo sapiens
tcttactactttaaat

SEQ ID NO: 4639730 - DNA, 12 bp, Homo sapiens
tcttacttttat

SEQ ID NO: 4639731 - DNA, 20 bp, Homo sapiens
tcttacttttattattttaa

SEQ ID NO: 4639732 - DNA, 16 bp, Homo sapiens
tcttagagtgtagctg

SEQ ID NO: 4639733 - DNA, 14 bp, Homo sapiens
tcttagctttacat

SEQ ID NO: 4639734 - DNA, 19 bp, Homo sapiens
tcttagctttacattttca

SEQ ID NO: 4639735 - DNA, 21 bp, Homo sapiens
tcttaggtagtcatgctgtgc

SEQ ID NO: 4639736 - DNA, 14 bp, Homo sapiens
tcttaggtcttcct

SEQ ID NO: 4639737 - DNA, 15 bp, Homo sapiens
tcttatgcaaaatgg

SEQ ID NO: 4639738 - DNA, 21 bp, Homo sapiens
tcttatgctctcactgtttgt

SEQ ID NO: 4639739 - DNA, 17 bp, Homo sapiens
tcttattaaagtattct

SEQ ID NO: 4639740 - DNA, 22 bp, Homo sapiens
tcttattaatcatacaaactct

SEQ ID NO: 4639741 - DNA, 17 bp, Homo sapiens
tcttattccaggagaag

SEQ ID NO: 4639742 - DNA, 18 bp, Homo sapiens
tcttcaatagctaagcat

SEQ ID NO: 4639743 - DNA, 18 bp, Homo sapiens
tcttcaatatgaatctat

SEQ ID NO: 4639744 - DNA, 15 bp, Homo sapiens
tcttcacctcttcca

SEQ ID NO: 4639745 - DNA, 21 bp, Homo sapiens
tcttcacctgattcaactaaa

SEQ ID NO: 4639746 - DNA, 18 bp, Homo sapiens
tcttcagcgtaaaatggt

SEQ ID NO: 4639747 - DNA, 19 bp, Homo sapiens
tcttcagcgtaaaatggtg

SEQ ID NO: 4639748 - DNA, 21 bp, Homo sapiens
tcttcagttctctactccctc

SEQ ID NO: 4639749 - DNA, 14 bp, Homo sapiens
tcttcatataaact

SEQ ID NO: 4639750 - DNA, 16 bp, Homo sapiens
tcttcatttggaggaa

SEQ ID NO: 4639751 - DNA, 18 bp, Homo sapiens
tcttcccttgctcatgag

SEQ ID NO: 4639752 - DNA, 12 bp, Homo sapiens
tcttcctgtggc

SEQ ID NO: 4639753 - DNA, 19 bp, Homo sapiens
tcttcctgtggctccctct

SEQ ID NO: 4639754 - DNA, 19 bp, Homo sapiens
tcttcgatgtgcccagggg

SEQ ID NO: 4639755 - DNA, 14 bp, Homo sapiens
tcttcgtgaacata

SEQ ID NO: 4639756 - DNA, 20 bp, Homo sapiens
tcttctaaaatagcaataac

SEQ ID NO: 4639757 - DNA, 18 bp, Homo sapiens
tcttctacccttttcctt

SEQ ID NO: 4639758 - DNA, 20 bp, Homo sapiens
tcttctattaatcaagagaa

SEQ ID NO: 4639759 - DNA, 15 bp, Homo sapiens
tcttctccattccct

SEQ ID NO: 4639760 - DNA, 14 bp, Homo sapiens
tcttctctcttgat

SEQ ID NO: 4639761 - DNA, 15 bp, Homo sapiens
tcttctggtttccct

SEQ ID NO: 4639762 - DNA, 14 bp, Homo sapiens
tcttcttctgaaga

SEQ ID NO: 4639763 - DNA, 21 bp, Homo sapiens
tcttgaataaagtattctagt

SEQ ID NO: 4639764 - DNA, 23 bp, Homo sapiens
tcttgaataaagtattctagtgt

SEQ ID NO: 4639765 - DNA, 18 bp, Homo sapiens
tcttgaatgtggtctcag

SEQ ID NO: 4639766 - DNA, 20 bp, Homo sapiens
tcttgagtataagaaatgca

SEQ ID NO: 4639767 - DNA, 21 bp, Homo sapiens
tcttgagtataagaaatgcat

SEQ ID NO: 4639768 - DNA, 16 bp, Homo sapiens
tcttgatcattccggt

SEQ ID NO: 4639769 - DNA, 22 bp, Homo sapiens
tcttgatctagatacaggactg

SEQ ID NO: 4639770 - DNA, 19 bp, Homo sapiens
tcttgcaaagcctttaaat

SEQ ID NO: 4639771 - DNA, 22 bp, Homo sapiens
tcttgcttccaagaccatttgt

SEQ ID NO: 4639772 - DNA, 16 bp, Homo sapiens
tcttgcttggaagcca

SEQ ID NO: 4639773 - DNA, 21 bp, Homo sapiens
tcttgctttctttcttaaaaa

SEQ ID NO: 4639774 - DNA, 12 bp, Homo sapiens
tcttggggaagg

SEQ ID NO: 4639775 - DNA, 14 bp, Homo sapiens
tcttggtttccaaa

SEQ ID NO: 4639776 - DNA, 13 bp, Homo sapiens
tcttgtaaagact

SEQ ID NO: 4639777 - DNA, 14 bp, Homo sapiens
tcttgtacatgtgt

SEQ ID NO: 4639778 - DNA, 18 bp, Homo sapiens
tcttgtattaagttgtta

SEQ ID NO: 4639779 - DNA, 22 bp, Homo sapiens
tcttgtattaagttgttaataa

SEQ ID NO: 4639780 - DNA, 16 bp, Homo sapiens
tcttgtcacccaggct

SEQ ID NO: 4639781 - DNA, 21 bp, Homo sapiens
tcttgtcacccaggctggagt

SEQ ID NO: 4639782 - DNA, 21 bp, Homo sapiens
tcttgtcagtgtagacacagg

SEQ ID NO: 4639783 - DNA, 23 bp, Homo sapiens
tcttgtcagtgtagacacaggtc

SEQ ID NO: 4639784 - DNA, 17 bp, Homo sapiens
tcttgtggttgtgtgtg

SEQ ID NO: 4639785 - DNA, 23 bp, Homo sapiens
tcttgtggttgtgtgtgttctgt

SEQ ID NO: 4639786 - DNA, 19 bp, Homo sapiens
tcttgtgtatttctctgtg

SEQ ID NO: 4639787 - DNA, 22 bp, Homo sapiens
tcttgtgtatttctctgtgaat

SEQ ID NO: 4639788 - DNA, 23 bp, Homo sapiens
tcttgtgttaacttgcctccatc

SEQ ID NO: 4639789 - DNA, 20 bp, Homo sapiens
tctttaaaaaaaaatcttgt

SEQ ID NO: 4639790 - DNA, 17 bp, Homo sapiens
tctttaaaagaatgact

SEQ ID NO: 4639791 - DNA, 12 bp, Homo sapiens
tctttaaaccac

SEQ ID NO: 4639792 - DNA, 18 bp, Homo sapiens
tctttaaagtcaggtcca

SEQ ID NO: 4639793 - DNA, 18 bp, Homo sapiens
tctttactattaaaatat

SEQ ID NO: 4639794 - DNA, 18 bp, Homo sapiens
tctttattttattattca

SEQ ID NO: 4639795 - DNA, 16 bp, Homo sapiens
tctttcagtacttttt

SEQ ID NO: 4639796 - DNA, 21 bp, Homo sapiens
tctttcattaaaaagaataga

SEQ ID NO: 4639797 - DNA, 12 bp, Homo sapiens
tctttccaaatt

SEQ ID NO: 4639798 - DNA, 21 bp, Homo sapiens
tctttccccaaggacccagcc

SEQ ID NO: 4639799 - DNA, 23 bp, Homo sapiens
tctttcccctcaggagtttctat

SEQ ID NO: 4639800 - DNA, 12 bp, Homo sapiens
tctttccctgcg

SEQ ID NO: 4639801 - DNA, 18 bp, Homo sapiens
tctttcccttagtgactc

SEQ ID NO: 4639802 - DNA, 15 bp, Homo sapiens
tctttccggccaagg

SEQ ID NO: 4639803 - DNA, 12 bp, Homo sapiens
tctttctgcctt

SEQ ID NO: 4639804 - DNA, 14 bp, Homo sapiens
tctttctgtttcct

SEQ ID NO: 4639805 - DNA, 17 bp, Homo sapiens
tctttctgtttcctggc

SEQ ID NO: 4639806 - DNA, 20 bp, Homo sapiens
tctttgagaccccagtgcct

SEQ ID NO: 4639807 - DNA, 18 bp, Homo sapiens
tctttgcaaaccctggtg

SEQ ID NO: 4639808 - DNA, 21 bp, Homo sapiens
tctttgccagtcattcagcag

SEQ ID NO: 4639809 - DNA, 23 bp, Homo sapiens
tctttgcggggcctgtctcagtg

SEQ ID NO: 4639810 - DNA, 22 bp, Homo sapiens
tctttggagttggaatttcatt

SEQ ID NO: 4639811 - DNA, 16 bp, Homo sapiens
tctttgtgaaggcctc

SEQ ID NO: 4639812 - DNA, 18 bp, Homo sapiens
tcttttaaaaattcaaat

SEQ ID NO: 4639813 - DNA, 21 bp, Homo sapiens
tcttttaaagtatttataaaa

SEQ ID NO: 4639814 - DNA, 14 bp, Homo sapiens
tcttttacattttt

SEQ ID NO: 4639815 - DNA, 14 bp, Homo sapiens
tcttttatctgttt

SEQ ID NO: 4639816 - DNA, 19 bp, Homo sapiens
tcttttcatctgggaaaga

SEQ ID NO: 4639817 - DNA, 18 bp, Homo sapiens
tcttttcctaacatgcac

SEQ ID NO: 4639818 - DNA, 21 bp, Homo sapiens
tcttttctcccttttaatcct

SEQ ID NO: 4639819 - DNA, 15 bp, Homo sapiens
tcttttcttgatttt

SEQ ID NO: 4639820 - DNA, 16 bp, Homo sapiens
tcttttgaattcttga

SEQ ID NO: 4639821 - DNA, 20 bp, Homo sapiens
tcttttgcattttgccgctg

SEQ ID NO: 4639822 - DNA, 13 bp, Homo sapiens
tcttttgctgtgc

SEQ ID NO: 4639823 - DNA, 15 bp, Homo sapiens
tcttttgttctctga

SEQ ID NO: 4639824 - DNA, 14 bp, Homo sapiens
tctttttatgcatt

SEQ ID NO: 4639825 - DNA, 14 bp, Homo sapiens
tctttttcttgggt

SEQ ID NO: 4639826 - DNA, 16 bp, Homo sapiens
tctttttgttgtaaaa

SEQ ID NO: 4639827 - DNA, 15 bp, Homo sapiens
tcttttttagcataa

SEQ ID NO: 4639828 - DNA, 16 bp, Homo sapiens
tcttttttagcataaa

SEQ ID NO: 4639829 - DNA, 22 bp, Homo sapiens
tctttttttaaaaataaatcta

SEQ ID NO: 4639830 - DNA, 22 bp, Homo sapiens
tgaaaaaaaaaatgttgagaag

SEQ ID NO: 4639831 - DNA, 11 bp, Homo sapiens
tgaaaaattaa

SEQ ID NO: 4639832 - DNA, 12 bp, Homo sapiens
tgaaaaattaac

SEQ ID NO: 4639833 - DNA, 12 bp, Homo sapiens
tgaaaagatgta

SEQ ID NO: 4639834 - DNA, 15 bp, Homo sapiens
tgaaaataaaacaca

SEQ ID NO: 4639835 - DNA, 16 bp, Homo sapiens
tgaaaataaaacacac

SEQ ID NO: 4639836 - DNA, 20 bp, Homo sapiens
tgaaaataaaacacacctcg

SEQ ID NO: 4639837 - DNA, 15 bp, Homo sapiens
tgaaaatagtgttcc

SEQ ID NO: 4639838 - DNA, 15 bp, Homo sapiens
tgaaaatatagacat

SEQ ID NO: 4639839 - DNA, 14 bp, Homo sapiens
tgaaaatatatatt

SEQ ID NO: 4639840 - DNA, 22 bp, Homo sapiens
tgaaaattctaacccaagacat

SEQ ID NO: 4639841 - DNA, 13 bp, Homo sapiens
tgaaaattgtatt

SEQ ID NO: 4639842 - DNA, 18 bp, Homo sapiens
tgaaacagttgctgtgaa

SEQ ID NO: 4639843 - DNA, 20 bp, Homo sapiens
tgaaaccaattaagcagctt

SEQ ID NO: 4639844 - DNA, 21 bp, Homo sapiens
tgaaacgcaattttacctagt

SEQ ID NO: 4639845 - DNA, 13 bp, Homo sapiens
tgaaactggtttt

SEQ ID NO: 4639846 - DNA, 18 bp, Homo sapiens
tgaaacttacactgtttc

SEQ ID NO: 4639847 - DNA, 15 bp, Homo sapiens
tgaaagaaagggacc

SEQ ID NO: 4639848 - DNA, 17 bp, Homo sapiens
tgaaagaaagggaccca

SEQ ID NO: 4639849 - DNA, 11 bp, Homo sapiens
tgaaagaagca

SEQ ID NO: 4639850 - DNA, 12 bp, Homo sapiens
tgaaagaagcaa

SEQ ID NO: 4639851 - DNA, 16 bp, Homo sapiens
tgaaagaagcaagaca

SEQ ID NO: 4639852 - DNA, 23 bp, Homo sapiens
tgaaagaagcaagacacgtggcc

SEQ ID NO: 4639853 - DNA, 17 bp, Homo sapiens
tgaaataaattctgact

SEQ ID NO: 4639854 - DNA, 20 bp, Homo sapiens
tgaaataactggaacaaatt

SEQ ID NO: 4639855 - DNA, 16 bp, Homo sapiens
tgaaatattcagaaat

SEQ ID NO: 4639856 - DNA, 21 bp, Homo sapiens
tgaaatccatactgtagacac

SEQ ID NO: 4639857 - DNA, 22 bp, Homo sapiens
tgaaatccatactgtagacact

SEQ ID NO: 4639858 - DNA, 20 bp, Homo sapiens
tgaaatgtttaataaagctt

SEQ ID NO: 4639859 - DNA, 13 bp, Homo sapiens
tgaaattaagcat

SEQ ID NO: 4639860 - DNA, 19 bp, Homo sapiens
tgaaattaagcattttgaa

SEQ ID NO: 4639861 - DNA, 21 bp, Homo sapiens
tgaaattttttagtatgttca

SEQ ID NO: 4639862 - DNA, 16 bp, Homo sapiens
tgaacaaagcagccac

SEQ ID NO: 4639863 - DNA, 20 bp, Homo sapiens
tgaacaaagctcaaagtatg

SEQ ID NO: 4639864 - DNA, 18 bp, Homo sapiens
tgaacagactgaccttga

SEQ ID NO: 4639865 - DNA, 15 bp, Homo sapiens
tgaacagcttgctgt

SEQ ID NO: 4639866 - DNA, 15 bp, Homo sapiens
tgaacagctttgtat

SEQ ID NO: 4639867 - DNA, 21 bp, Homo sapiens
tgaacagctttgtatgtttat

SEQ ID NO: 4639868 - DNA, 18 bp, Homo sapiens
tgaacatctcttgaaacc

SEQ ID NO: 4639869 - DNA, 13 bp, Homo sapiens
tgaacattccaga

SEQ ID NO: 4639870 - DNA, 22 bp, Homo sapiens
tgaaccatccacttacatatat

SEQ ID NO: 4639871 - DNA, 12 bp, Homo sapiens
tgaacccaggac

SEQ ID NO: 4639872 - DNA, 13 bp, Homo sapiens
tgaacccaggaca

SEQ ID NO: 4639873 - DNA, 14 bp, Homo sapiens
tgaacccccatgat

SEQ ID NO: 4639874 - DNA, 22 bp, Homo sapiens
tgaaccccctccctgtcccagg

SEQ ID NO: 4639875 - DNA, 12 bp, Homo sapiens
tgaacctgccct

SEQ ID NO: 4639876 - DNA, 14 bp, Homo sapiens
tgaacctgtgcaat

SEQ ID NO: 4639877 - DNA, 15 bp, Homo sapiens
tgaactctcccctcc

SEQ ID NO: 4639878 - DNA, 16 bp, Homo sapiens
tgaactctcccctccc

SEQ ID NO: 4639879 - DNA, 20 bp, Homo sapiens
tgaactctcccctccccatc

SEQ ID NO: 4639880 - DNA, 21 bp, Homo sapiens
tgaactctcccctccccatct

SEQ ID NO: 4639881 - DNA, 15 bp, Homo sapiens
tgaacttaaaatgaa

SEQ ID NO: 4639882 - DNA, 18 bp, Homo sapiens
tgaacttaaaatgaaagt

SEQ ID NO: 4639883 - DNA, 21 bp, Homo sapiens
tgaagaaaaaaatgtacattt

SEQ ID NO: 4639884 - DNA, 21 bp, Homo sapiens
tgaagaaacagagtggcctcc

SEQ ID NO: 4639885 - DNA, 13 bp, Homo sapiens
tgaagaaagtcaa

SEQ ID NO: 4639886 - DNA, 22 bp, Homo sapiens
tgaagaaagtcaaaaaattatt

SEQ ID NO: 4639887 - DNA, 17 bp, Homo sapiens
tgaagaactagcatata

SEQ ID NO: 4639888 - DNA, 23 bp, Homo sapiens
tgaagaaggaaggcctgagcccc

SEQ ID NO: 4639889 - DNA, 15 bp, Homo sapiens
tgaagagattgctga

SEQ ID NO: 4639890 - DNA, 15 bp, Homo sapiens
tgaagagtttcacaa

SEQ ID NO: 4639891 - DNA, 14 bp, Homo sapiens
tgaagataacgcct

SEQ ID NO: 4639892 - DNA, 17 bp, Homo sapiens
tgaagatggcatcctgt

SEQ ID NO: 4639893 - DNA, 18 bp, Homo sapiens
tgaagatggcatcctgtg

SEQ ID NO: 4639894 - DNA, 21 bp, Homo sapiens
tgaagatggcatcctgtgaag

SEQ ID NO: 4639895 - DNA, 20 bp, Homo sapiens
tgaagcaggttcccaagctc

SEQ ID NO: 4639896 - DNA, 17 bp, Homo sapiens
tgaagccatgtagccac

SEQ ID NO: 4639897 - DNA, 19 bp, Homo sapiens
tgaagccatgtagccaccc

SEQ ID NO: 4639898 - DNA, 21 bp, Homo sapiens
tgaagccatgtagccacccaa

SEQ ID NO: 4639899 - DNA, 20 bp, Homo sapiens
tgaagccatttagagggtga

SEQ ID NO: 4639900 - DNA, 15 bp, Homo sapiens
tgaagcccaaagcct

SEQ ID NO: 4639901 - DNA, 20 bp, Homo sapiens
tgaagcccaaagcctgagga

SEQ ID NO: 4639902 - DNA, 20 bp, Homo sapiens
tgaagccgactctggccctg

SEQ ID NO: 4639903 - DNA, 16 bp, Homo sapiens
tgaagctgttgtgtga

SEQ ID NO: 4639904 - DNA, 10 bp, Homo sapiens
tgaaggaatt

SEQ ID NO: 4639905 - DNA, 18 bp, Homo sapiens
tgaaggcacagctaacca

SEQ ID NO: 4639906 - DNA, 16 bp, Homo sapiens
tgaaggcctcgcagga

SEQ ID NO: 4639907 - DNA, 15 bp, Homo sapiens
tgaaggctggattct

SEQ ID NO: 4639908 - DNA, 20 bp, Homo sapiens
tgaaggcttctctgttctac

SEQ ID NO: 4639909 - DNA, 15 bp, Homo sapiens
tgaagtacacctgtg

SEQ ID NO: 4639910 - DNA, 21 bp, Homo sapiens
tgaagtatattcttattggaa

SEQ ID NO: 4639911 - DNA, 17 bp, Homo sapiens
tgaagtgctgttttatt

SEQ ID NO: 4639912 - DNA, 22 bp, Homo sapiens
tgaagtgctgttttattactgt

SEQ ID NO: 4639913 - DNA, 21 bp, Homo sapiens
tgaagtggttgcattctacta

SEQ ID NO: 4639914 - DNA, 16 bp, Homo sapiens
tgaagttgtggaggag

SEQ ID NO: 4639915 - DNA, 20 bp, Homo sapiens
tgaagtttgtagttgtttta

SEQ ID NO: 4639916 - DNA, 22 bp, Homo sapiens
tgaataagcagaacatactgtt

SEQ ID NO: 4639917 - DNA, 20 bp, Homo sapiens
tgaatacttattttcagtgc

SEQ ID NO: 4639918 - DNA, 13 bp, Homo sapiens
tgaatatatttta

SEQ ID NO: 4639919 - DNA, 14 bp, Homo sapiens
tgaatatcattgat

SEQ ID NO: 4639920 - DNA, 18 bp, Homo sapiens
tgaatatcattgatttta

SEQ ID NO: 4639921 - DNA, 16 bp, Homo sapiens
tgaatcatgtctgtat

SEQ ID NO: 4639922 - DNA, 23 bp, Homo sapiens
tgaatcatgtctgtatccccagt

SEQ ID NO: 4639923 - DNA, 13 bp, Homo sapiens
tgaatctgctttt

SEQ ID NO: 4639924 - DNA, 23 bp, Homo sapiens
tgaatctgcttttcctctgcctt

SEQ ID NO: 4639925 - DNA, 19 bp, Homo sapiens
tgaatgatttgtgtttctt

SEQ ID NO: 4639926 - DNA, 17 bp, Homo sapiens
tgaatgatttttcattg

SEQ ID NO: 4639927 - DNA, 18 bp, Homo sapiens
tgaatgcataatgtttaa

SEQ ID NO: 4639928 - DNA, 18 bp, Homo sapiens
tgaatgcccccagctggc

SEQ ID NO: 4639929 - DNA, 19 bp, Homo sapiens
tgaatgcccccagctggcc

SEQ ID NO: 4639930 - DNA, 13 bp, Homo sapiens
tgaatgcctcctg

SEQ ID NO: 4639931 - DNA, 19 bp, Homo sapiens
tgaatgcctcgctcccttc

SEQ ID NO: 4639932 - DNA, 17 bp, Homo sapiens
tgaatgggtccattttg

SEQ ID NO: 4639933 - DNA, 22 bp, Homo sapiens
tgaatgtatgtaatgtgtggtg

SEQ ID NO: 4639934 - DNA, 15 bp, Homo sapiens
tgaatgtgggcactg

SEQ ID NO: 4639935 - DNA, 20 bp, Homo sapiens
tgaatgtttgtgtctgtggt

SEQ ID NO: 4639936 - DNA, 19 bp, Homo sapiens
tgaattgtttttattgttt

SEQ ID NO: 4639937 - DNA, 13 bp, Homo sapiens
tgaattttctgtg

SEQ ID NO: 4639938 - DNA, 14 bp, Homo sapiens
tgaattttctgtgt

SEQ ID NO: 4639939 - DNA, 18 bp, Homo sapiens
tgacaaaaaatgttttaa

SEQ ID NO: 4639940 - DNA, 13 bp, Homo sapiens
tgacaaacatgat

SEQ ID NO: 4639941 - DNA, 20 bp, Homo sapiens
tgacaaacatgatactgctg

SEQ ID NO: 4639942 - DNA, 16 bp, Homo sapiens
tgacaccctggcctga

SEQ ID NO: 4639943 - DNA, 16 bp, Homo sapiens
tgacacggccatgacc

SEQ ID NO: 4639944 - DNA, 18 bp, Homo sapiens
tgacactaaccagagtca

SEQ ID NO: 4639945 - DNA, 16 bp, Homo sapiens
tgacactgcagcagaa

SEQ ID NO: 4639946 - DNA, 17 bp, Homo sapiens
tgacacttatctcactg

SEQ ID NO: 4639947 - DNA, 21 bp, Homo sapiens
tgacacttatctcactgtttt

SEQ ID NO: 4639948 - DNA, 15 bp, Homo sapiens
tgacagactcctgag

SEQ ID NO: 4639949 - DNA, 17 bp, Homo sapiens
tgacagataacctaata

SEQ ID NO: 4639950 - DNA, 19 bp, Homo sapiens
tgacagatcaagctgtgag

SEQ ID NO: 4639951 - DNA, 21 bp, Homo sapiens
tgacagatcaagctgtgagac

SEQ ID NO: 4639952 - DNA, 18 bp, Homo sapiens
tgacagatggtgaagtaa

SEQ ID NO: 4639953 - DNA, 17 bp, Homo sapiens
tgacagggccagtgggg

SEQ ID NO: 4639954 - DNA, 15 bp, Homo sapiens
tgacagtagctctta

SEQ ID NO: 4639955 - DNA, 17 bp, Homo sapiens
tgacagtagctcttaga

SEQ ID NO: 4639956 - DNA, 11 bp, Homo sapiens
tgacagtcatc

SEQ ID NO: 4639957 - DNA, 19 bp, Homo sapiens
tgacagtcatcatcagggc

SEQ ID NO: 4639958 - DNA, 21 bp, Homo sapiens
tgacagtcatcatcagggcct

SEQ ID NO: 4639959 - DNA, 14 bp, Homo sapiens
tgacagtgtatggg

SEQ ID NO: 4639960 - DNA, 15 bp, Homo sapiens
tgacagtttccaaat

SEQ ID NO: 4639961 - DNA, 18 bp, Homo sapiens
tgacataggtcataaagc

SEQ ID NO: 4639962 - DNA, 21 bp, Homo sapiens
tgacataggtcataaagcatt

SEQ ID NO: 4639963 - DNA, 15 bp, Homo sapiens
tgacatgaagctgtt

SEQ ID NO: 4639964 - DNA, 12 bp, Homo sapiens
tgacattcacct

SEQ ID NO: 4639965 - DNA, 15 bp, Homo sapiens
tgacattcacctgcc

SEQ ID NO: 4639966 - DNA, 21 bp, Homo sapiens
tgacatttcttaaaactttat

SEQ ID NO: 4639967 - DNA, 16 bp, Homo sapiens
tgaccaattgagtaag

SEQ ID NO: 4639968 - DNA, 19 bp, Homo sapiens
tgaccaggatggagcaagc

SEQ ID NO: 4639969 - DNA, 22 bp, Homo sapiens
tgaccaggatggagcaagctct

SEQ ID NO: 4639970 - DNA, 16 bp, Homo sapiens
tgaccagggatgctgg

SEQ ID NO: 4639971 - DNA, 17 bp, Homo sapiens
tgaccagggatgctggg

SEQ ID NO: 4639972 - DNA, 16 bp, Homo sapiens
tgaccagtctgaccct

SEQ ID NO: 4639973 - DNA, 17 bp, Homo sapiens
tgaccattcaattagtg

SEQ ID NO: 4639974 - DNA, 19 bp, Homo sapiens
tgaccattgagtccctgct

SEQ ID NO: 4639975 - DNA, 15 bp, Homo sapiens
tgacccacatgccat

SEQ ID NO: 4639976 - DNA, 12 bp, Homo sapiens
tgacccagcatc

SEQ ID NO: 4639977 - DNA, 20 bp, Homo sapiens
tgacccagcatctcccagca

SEQ ID NO: 4639978 - DNA, 11 bp, Homo sapiens
tgaccccaggg

SEQ ID NO: 4639979 - DNA, 12 bp, Homo sapiens
tgaccccagggc

SEQ ID NO: 4639980 - DNA, 19 bp, Homo sapiens
tgaccccagggcacaggag

SEQ ID NO: 4639981 - DNA, 20 bp, Homo sapiens
tgaccccagtggaaaacaaa

SEQ ID NO: 4639982 - DNA, 12 bp, Homo sapiens
tgacccctggcc

SEQ ID NO: 4639983 - DNA, 13 bp, Homo sapiens
tgacccctggcca

SEQ ID NO: 4639984 - DNA, 22 bp, Homo sapiens
tgacccggcaccccctgcagct

SEQ ID NO: 4639985 - DNA, 20 bp, Homo sapiens
tgacccttacagcctctgac

SEQ ID NO: 4639986 - DNA, 16 bp, Homo sapiens
tgacctaacctaggag

SEQ ID NO: 4639987 - DNA, 18 bp, Homo sapiens
tgacctaatgaggtagct

SEQ ID NO: 4639988 - DNA, 16 bp, Homo sapiens
tgacctccttctgcaa

SEQ ID NO: 4639989 - DNA, 21 bp, Homo sapiens
tgacctctcataaatttactt

SEQ ID NO: 4639990 - DNA, 11 bp, Homo sapiens
tgacctgctga

SEQ ID NO: 4639991 - DNA, 22 bp, Homo sapiens
tgacctgctgagctctgagagg

SEQ ID NO: 4639992 - DNA, 21 bp, Homo sapiens
tgacctggaggggagaggtca

SEQ ID NO: 4639993 - DNA, 12 bp, Homo sapiens
tgaccttagccc

SEQ ID NO: 4639994 - DNA, 14 bp, Homo sapiens
tgaccttagcccca

SEQ ID NO: 4639995 - DNA, 23 bp, Homo sapiens
tgaccttagccccattgctccat

SEQ ID NO: 4639996 - DNA, 22 bp, Homo sapiens
tgaccttgatgagctgtgcaca

SEQ ID NO: 4639997 - DNA, 21 bp, Homo sapiens
tgacgcccgagagcctcgctt

SEQ ID NO: 4639998 - DNA, 22 bp, Homo sapiens
tgacgcccgagagcctcgcttt

SEQ ID NO: 4639999 - DNA, 18 bp, Homo sapiens
tgactatataatttattt

SEQ ID NO: 4640000 - DNA, 22 bp, Homo sapiens
tgactattacttttctgtttag

SEQ ID NO: 4640001 - DNA, 14 bp, Homo sapiens
tgactcctgctggt

SEQ ID NO: 4640002 - DNA, 22 bp, Homo sapiens
tgactcctgctggtacctgccc

SEQ ID NO: 4640003 - DNA, 23 bp, Homo sapiens
tgactcctgctggtacctgccct

SEQ ID NO: 4640004 - DNA, 19 bp, Homo sapiens
tgactcttatttatagaat

SEQ ID NO: 4640005 - DNA, 19 bp, Homo sapiens
tgactgaagcgaacatctt

SEQ ID NO: 4640006 - DNA, 15 bp, Homo sapiens
tgactgccaagccag

SEQ ID NO: 4640007 - DNA, 17 bp, Homo sapiens
tgactggcttcagcaag

SEQ ID NO: 4640008 - DNA, 12 bp, Homo sapiens
tgactgtatggc

SEQ ID NO: 4640009 - DNA, 18 bp, Homo sapiens
tgactgtcgccacacgcc

SEQ ID NO: 4640010 - DNA, 20 bp, Homo sapiens
tgactgtcgccacacgcctc

SEQ ID NO: 4640011 - DNA, 21 bp, Homo sapiens
tgactgtgtaactttctctta

SEQ ID NO: 4640012 - DNA, 23 bp, Homo sapiens
tgactgttgcctttgctcttata

SEQ ID NO: 4640013 - DNA, 17 bp, Homo sapiens
tgacttatttatataaa

SEQ ID NO: 4640014 - DNA, 21 bp, Homo sapiens
tgacttatttatataaatttt

SEQ ID NO: 4640015 - DNA, 18 bp, Homo sapiens
tgacttatttctgctctg

SEQ ID NO: 4640016 - DNA, 20 bp, Homo sapiens
tgacttatttctgctctgga

SEQ ID NO: 4640017 - DNA, 21 bp, Homo sapiens
tgacttatttctgctctggaa

SEQ ID NO: 4640018 - DNA, 17 bp, Homo sapiens
tgacttctgctgctggc

SEQ ID NO: 4640019 - DNA, 21 bp, Homo sapiens
tgacttgggcacccccagcct

SEQ ID NO: 4640020 - DNA, 18 bp, Homo sapiens
tgacttggggagatggag

SEQ ID NO: 4640021 - DNA, 14 bp, Homo sapiens
tgactttttataaa

SEQ ID NO: 4640022 - DNA, 15 bp, Homo sapiens
tgagaaacagctcag

SEQ ID NO: 4640023 - DNA, 20 bp, Homo sapiens
tgagaaacagctcagccagt

SEQ ID NO: 4640024 - DNA, 15 bp, Homo sapiens
tgagaacctggcctt

SEQ ID NO: 4640025 - DNA, 21 bp, Homo sapiens
tgagaacttttttgaggcctt

SEQ ID NO: 4640026 - DNA, 13 bp, Homo sapiens
tgagaagctgctc

SEQ ID NO: 4640027 - DNA, 22 bp, Homo sapiens
tgagaagctgctccaggcctgc

SEQ ID NO: 4640028 - DNA, 20 bp, Homo sapiens
tgagaatctaggccacccca

SEQ ID NO: 4640029 - DNA, 17 bp, Homo sapiens
tgagaatgacagccttt

SEQ ID NO: 4640030 - DNA, 23 bp, Homo sapiens
tgagacaaattttaacttcttgt

SEQ ID NO: 4640031 - DNA, 15 bp, Homo sapiens
tgagacagtgggaaa

SEQ ID NO: 4640032 - DNA, 13 bp, Homo sapiens
tgagaccacagag

SEQ ID NO: 4640033 - DNA, 13 bp, Homo sapiens
tgagacccagccc

SEQ ID NO: 4640034 - DNA, 14 bp, Homo sapiens
tgagacccagcccc

SEQ ID NO: 4640035 - DNA, 15 bp, Homo sapiens
tgagacccagcccct

SEQ ID NO: 4640036 - DNA, 21 bp, Homo sapiens
tgagacccagccccttcccct

SEQ ID NO: 4640037 - DNA, 13 bp, Homo sapiens
tgagactgccctg

SEQ ID NO: 4640038 - DNA, 22 bp, Homo sapiens
tgagagaaagagagaagccagc

SEQ ID NO: 4640039 - DNA, 16 bp, Homo sapiens
tgagagaattggctca

SEQ ID NO: 4640040 - DNA, 18 bp, Homo sapiens
tgagagaccacacatttt

SEQ ID NO: 4640041 - DNA, 20 bp, Homo sapiens
tgagagccctgaggcctaga

SEQ ID NO: 4640042 - DNA, 19 bp, Homo sapiens
tgagaggcccccacccttg

SEQ ID NO: 4640043 - DNA, 12 bp, Homo sapiens
tgagaggccctg

SEQ ID NO: 4640044 - DNA, 13 bp, Homo sapiens
tgagaggccctgg

SEQ ID NO: 4640045 - DNA, 14 bp, Homo sapiens
tgagagggccgggc

SEQ ID NO: 4640046 - DNA, 18 bp, Homo sapiens
tgagagtgacggctggca

SEQ ID NO: 4640047 - DNA, 20 bp, Homo sapiens
tgagataagtaggctggttt

SEQ ID NO: 4640048 - DNA, 16 bp, Homo sapiens
tgagatagcattgtga

SEQ ID NO: 4640049 - DNA, 19 bp, Homo sapiens
tgagatagcattgtgaact

SEQ ID NO: 4640050 - DNA, 19 bp, Homo sapiens
tgagatcagggcctgcccc

SEQ ID NO: 4640051 - DNA, 15 bp, Homo sapiens
tgagatgcagctgga

SEQ ID NO: 4640052 - DNA, 16 bp, Homo sapiens
tgagatgcagctggaa

SEQ ID NO: 4640053 - DNA, 22 bp, Homo sapiens
tgagatggagtctcactcttgt

SEQ ID NO: 4640054 - DNA, 17 bp, Homo sapiens
tgagatgggtgtacaaa

SEQ ID NO: 4640055 - DNA, 23 bp, Homo sapiens
tgagatttaacccctccactgct

SEQ ID NO: 4640056 - DNA, 23 bp, Homo sapiens
tgagatttaagttcctgctgcct

SEQ ID NO: 4640057 - DNA, 12 bp, Homo sapiens
tgagattttcct

SEQ ID NO: 4640058 - DNA, 22 bp, Homo sapiens
tgagatttttaaaaaatatttt

SEQ ID NO: 4640059 - DNA, 15 bp, Homo sapiens
tgagcactgccagga

SEQ ID NO: 4640060 - DNA, 22 bp, Homo sapiens
tgagcactgccaggagggacaa

SEQ ID NO: 4640061 - DNA, 23 bp, Homo sapiens
tgagcagaatgttgtacttgaaa

SEQ ID NO: 4640062 - DNA, 12 bp, Homo sapiens
tgagcagggccg

SEQ ID NO: 4640063 - DNA, 22 bp, Homo sapiens
tgagcatacctgtctcagctgt

SEQ ID NO: 4640064 - DNA, 15 bp, Homo sapiens
tgagcatattttctt

SEQ ID NO: 4640065 - DNA, 22 bp, Homo sapiens
tgagcatattttcttactttta

SEQ ID NO: 4640066 - DNA, 23 bp, Homo sapiens
tgagcatattttcttacttttat

SEQ ID NO: 4640067 - DNA, 17 bp, Homo sapiens
tgagcccagagaacagc

SEQ ID NO: 4640068 - DNA, 13 bp, Homo sapiens
tgagcccagggag

SEQ ID NO: 4640069 - DNA, 16 bp, Homo sapiens
tgagcctacgctgaag

SEQ ID NO: 4640070 - DNA, 13 bp, Homo sapiens
tgagcctgccgag

SEQ ID NO: 4640071 - DNA, 15 bp, Homo sapiens
tgagcgagtggatgc

SEQ ID NO: 4640072 - DNA, 16 bp, Homo sapiens
tgagcgagtggatgct

SEQ ID NO: 4640073 - DNA, 19 bp, Homo sapiens
tgagcgtcaaagaaaatgc

SEQ ID NO: 4640074 - DNA, 16 bp, Homo sapiens
tgagctatttccttcc

SEQ ID NO: 4640075 - DNA, 17 bp, Homo sapiens
tgagctcacaaccacca

SEQ ID NO: 4640076 - DNA, 22 bp, Homo sapiens
tgagctcacaaggcagcaaggc

SEQ ID NO: 4640077 - DNA, 23 bp, Homo sapiens
tgagctcacaaggcagcaaggcc

SEQ ID NO: 4640078 - DNA, 20 bp, Homo sapiens
tgagctcctgatcagaggca

SEQ ID NO: 4640079 - DNA, 12 bp, Homo sapiens
tgagctctgaga

SEQ ID NO: 4640080 - DNA, 17 bp, Homo sapiens
tgagctctgagaggccc

SEQ ID NO: 4640081 - DNA, 23 bp, Homo sapiens
tgagctctgagaggccctggatc

SEQ ID NO: 4640082 - DNA, 17 bp, Homo sapiens
tgagctggaaggggcca

SEQ ID NO: 4640083 - DNA, 18 bp, Homo sapiens
tgagctgtctgaagccca

SEQ ID NO: 4640084 - DNA, 22 bp, Homo sapiens
tgagctgtctgaagcccaaagc

SEQ ID NO: 4640085 - DNA, 20 bp, Homo sapiens
tgagctgtgcacaaagtggc

SEQ ID NO: 4640086 - DNA, 14 bp, Homo sapiens
tgaggaagagtctt

SEQ ID NO: 4640087 - DNA, 23 bp, Homo sapiens
tgaggacagaaagaccctgatgc

SEQ ID NO: 4640088 - DNA, 17 bp, Homo sapiens
tgaggacagctgtcctc

SEQ ID NO: 4640089 - DNA, 18 bp, Homo sapiens
tgaggacctttatatctg

SEQ ID NO: 4640090 - DNA, 22 bp, Homo sapiens
tgaggagatgaccagggatgct

SEQ ID NO: 4640091 - DNA, 12 bp, Homo sapiens
tgaggagctcaa

SEQ ID NO: 4640092 - DNA, 23 bp, Homo sapiens
tgaggagctcaacggtctggcag

SEQ ID NO: 4640093 - DNA, 20 bp, Homo sapiens
tgaggaggatgtccctgggc

SEQ ID NO: 4640094 - DNA, 13 bp, Homo sapiens
tgaggagtctgag

SEQ ID NO: 4640095 - DNA, 21 bp, Homo sapiens
tgaggagtctgaggtcctgag

SEQ ID NO: 4640096 - DNA, 16 bp, Homo sapiens
tgaggatgagacccag

SEQ ID NO: 4640097 - DNA, 19 bp, Homo sapiens
tgaggcatctttacatcta

SEQ ID NO: 4640098 - DNA, 12 bp, Homo sapiens
tgaggccacact

SEQ ID NO: 4640099 - DNA, 19 bp, Homo sapiens
tgaggccacactcagcaca

SEQ ID NO: 4640100 - DNA, 23 bp, Homo sapiens
tgaggccacactcagcacaaggc

SEQ ID NO: 4640101 - DNA, 13 bp, Homo sapiens
tgaggccagcctg

SEQ ID NO: 4640102 - DNA, 14 bp, Homo sapiens
tgaggccagcctgg

SEQ ID NO: 4640103 - DNA, 15 bp, Homo sapiens
tgaggccagcctggc

SEQ ID NO: 4640104 - DNA, 20 bp, Homo sapiens
tgaggccagcctggcctcct

SEQ ID NO: 4640105 - DNA, 19 bp, Homo sapiens
tgaggccatctcaggagat

SEQ ID NO: 4640106 - DNA, 22 bp, Homo sapiens
tgaggccatctcaggagatgga

SEQ ID NO: 4640107 - DNA, 16 bp, Homo sapiens
tgaggcctagactctg

SEQ ID NO: 4640108 - DNA, 23 bp, Homo sapiens
tgaggcgccccaacccgtggagg

SEQ ID NO: 4640109 - DNA, 16 bp, Homo sapiens
tgagggcagcagccag

SEQ ID NO: 4640110 - DNA, 20 bp, Homo sapiens
tgagggcagcagccagccct

SEQ ID NO: 4640111 - DNA, 21 bp, Homo sapiens
tgagggcagcagccagccctg

SEQ ID NO: 4640112 - DNA, 23 bp, Homo sapiens
tgagggcagcagccagccctgcc

SEQ ID NO: 4640113 - DNA, 16 bp, Homo sapiens
tgagggcagtgccctt

SEQ ID NO: 4640114 - DNA, 19 bp, Homo sapiens
tgagggcagttcgcagcca

SEQ ID NO: 4640115 - DNA, 20 bp, Homo sapiens
tgagggcagttcgcagccac

SEQ ID NO: 4640116 - DNA, 16 bp, Homo sapiens
tgaggtcagggagtgc

SEQ ID NO: 4640117 - DNA, 14 bp, Homo sapiens
tgaggtcctgagca

SEQ ID NO: 4640118 - DNA, 15 bp, Homo sapiens
tgaggtcctgagcac

SEQ ID NO: 4640119 - DNA, 22 bp, Homo sapiens
tgaggtcctgagcactgccagg

SEQ ID NO: 4640120 - DNA, 18 bp, Homo sapiens
tgaggtctcgaccctgtc

SEQ ID NO: 4640121 - DNA, 17 bp, Homo sapiens
tgaggtgcccactccgc

SEQ ID NO: 4640122 - DNA, 16 bp, Homo sapiens
tgaggtgcccaggaga

SEQ ID NO: 4640123 - DNA, 18 bp, Homo sapiens
tgaggtgcccaggagaag

SEQ ID NO: 4640124 - DNA, 14 bp, Homo sapiens
tgaggtgttgcagc

SEQ ID NO: 4640125 - DNA, 17 bp, Homo sapiens
tgaggtgttgcagccca

SEQ ID NO: 4640126 - DNA, 17 bp, Homo sapiens
tgagtatttctgttcct

SEQ ID NO: 4640127 - DNA, 12 bp, Homo sapiens
tgagtccctgct

SEQ ID NO: 4640128 - DNA, 14 bp, Homo sapiens
tgagtcctggccca

SEQ ID NO: 4640129 - DNA, 15 bp, Homo sapiens
tgagtctatgttcaa

SEQ ID NO: 4640130 - DNA, 17 bp, Homo sapiens
tgagtctatgttcaaag

SEQ ID NO: 4640131 - DNA, 20 bp, Homo sapiens
tgagtctatgttcaaagact

SEQ ID NO: 4640132 - DNA, 13 bp, Homo sapiens
tgagtctgtttcc

SEQ ID NO: 4640133 - DNA, 18 bp, Homo sapiens
tgagtctgtttcccaagc

SEQ ID NO: 4640134 - DNA, 19 bp, Homo sapiens
tgagtctgtttcccaagct

SEQ ID NO: 4640135 - DNA, 18 bp, Homo sapiens
tgagtctgttttgtaaag

SEQ ID NO: 4640136 - DNA, 20 bp, Homo sapiens
tgagtgaagtattgctgaaa

SEQ ID NO: 4640137 - DNA, 18 bp, Homo sapiens
tgagtgacctccttctgc

SEQ ID NO: 4640138 - DNA, 16 bp, Homo sapiens
tgagtgagtgggagag

SEQ ID NO: 4640139 - DNA, 19 bp, Homo sapiens
tgagtggcttcactcctgc

SEQ ID NO: 4640140 - DNA, 23 bp, Homo sapiens
tgagtggcttcactcctgctgta

SEQ ID NO: 4640141 - DNA, 19 bp, Homo sapiens
tgagtgggagagtacctgt

SEQ ID NO: 4640142 - DNA, 13 bp, Homo sapiens
tgagtgtgacagg

SEQ ID NO: 4640143 - DNA, 15 bp, Homo sapiens
tgagtgtgacagggc

SEQ ID NO: 4640144 - DNA, 16 bp, Homo sapiens
tgagtgtgacagggcc

SEQ ID NO: 4640145 - DNA, 16 bp, Homo sapiens
tgagtgtgcatggagg

SEQ ID NO: 4640146 - DNA, 20 bp, Homo sapiens
tgagttatatgttcactgtc

SEQ ID NO: 4640147 - DNA, 23 bp, Homo sapiens
tgagttatcagggaacttagtaa

SEQ ID NO: 4640148 - DNA, 16 bp, Homo sapiens
tgagtttcagctggaa

SEQ ID NO: 4640149 - DNA, 19 bp, Homo sapiens
tgagtttgtagaactttat

SEQ ID NO: 4640150 - DNA, 18 bp, Homo sapiens
tgataatagcatttttgt

SEQ ID NO: 4640151 - DNA, 14 bp, Homo sapiens
tgataatatatatt

SEQ ID NO: 4640152 - DNA, 13 bp, Homo sapiens
tgatacagttttg

SEQ ID NO: 4640153 - DNA, 22 bp, Homo sapiens
tgatacatccaaagcagacagc

SEQ ID NO: 4640154 - DNA, 14 bp, Homo sapiens
tgataggaaggaaa

SEQ ID NO: 4640155 - DNA, 18 bp, Homo sapiens
tgatagttgattttcaaa

SEQ ID NO: 4640156 - DNA, 14 bp, Homo sapiens
tgatataacacaaa

SEQ ID NO: 4640157 - DNA, 16 bp, Homo sapiens
tgatattgaaggaatt

SEQ ID NO: 4640158 - DNA, 12 bp, Homo sapiens
tgatcaggcccc

SEQ ID NO: 4640159 - DNA, 16 bp, Homo sapiens
tgatcaggccccaccc

SEQ ID NO: 4640160 - DNA, 16 bp, Homo sapiens
tgatccatccatctct

SEQ ID NO: 4640161 - DNA, 12 bp, Homo sapiens
tgatcctcagtg

SEQ ID NO: 4640162 - DNA, 20 bp, Homo sapiens
tgatctagatacaggactgg

SEQ ID NO: 4640163 - DNA, 14 bp, Homo sapiens
tgatctgctgctga

SEQ ID NO: 4640164 - DNA, 20 bp, Homo sapiens
tgatcttgaactcctgacct

SEQ ID NO: 4640165 - DNA, 13 bp, Homo sapiens
tgatcttttaaaa

SEQ ID NO: 4640166 - DNA, 20 bp, Homo sapiens
tgatgacaaaaaatgtttta

SEQ ID NO: 4640167 - DNA, 24 bp, Homo sapiens
tgatgagctgtgcacaaagtggca

SEQ ID NO: 4640168 - DNA, 16 bp, Homo sapiens
tgatgagggcagcagc

SEQ ID NO: 4640169 - DNA, 14 bp, Homo sapiens
tgatgagtcttgat

SEQ ID NO: 4640170 - DNA, 17 bp, Homo sapiens
tgatgagtcttgatcta

SEQ ID NO: 4640171 - DNA, 18 bp, Homo sapiens
tgatgcagataaaatatt

SEQ ID NO: 4640172 - DNA, 23 bp, Homo sapiens
tgatgcgggccagtgctccagcc

SEQ ID NO: 4640173 - DNA, 17 bp, Homo sapiens
tgatggaattaaatgtg

SEQ ID NO: 4640174 - DNA, 14 bp, Homo sapiens
tgatggcagaggag

SEQ ID NO: 4640175 - DNA, 13 bp, Homo sapiens
tgatgggaaaact

SEQ ID NO: 4640176 - DNA, 12 bp, Homo sapiens
tgatgggaggtg

SEQ ID NO: 4640177 - DNA, 13 bp, Homo sapiens
tgatgggaggtgt

SEQ ID NO: 4640178 - DNA, 18 bp, Homo sapiens
tgatgtgaagagtttcac

SEQ ID NO: 4640179 - DNA, 19 bp, Homo sapiens
tgatgtgaagagtttcaca

SEQ ID NO: 4640180 - DNA, 22 bp, Homo sapiens
tgatgtgaagccaattcagaca

SEQ ID NO: 4640181 - DNA, 22 bp, Homo sapiens
tgatgtggaggaagagccacct

SEQ ID NO: 4640182 - DNA, 23 bp, Homo sapiens
tgatgtggaggaagagccacctg

SEQ ID NO: 4640183 - DNA, 13 bp, Homo sapiens
tgatgttgctgtt

SEQ ID NO: 4640184 - DNA, 18 bp, Homo sapiens
tgattaaatatttgaaga

SEQ ID NO: 4640185 - DNA, 18 bp, Homo sapiens
tgattaatgttttcatta

SEQ ID NO: 4640186 - DNA, 21 bp, Homo sapiens
tgattaatgttttcattatgt

SEQ ID NO: 4640187 - DNA, 21 bp, Homo sapiens
tgattacttgtaattatgaaa

SEQ ID NO: 4640188 - DNA, 18 bp, Homo sapiens
tgattatagcaactaatg

SEQ ID NO: 4640189 - DNA, 12 bp, Homo sapiens
tgattatcttga

SEQ ID NO: 4640190 - DNA, 15 bp, Homo sapiens
tgattattcaacaca

SEQ ID NO: 4640191 - DNA, 12 bp, Homo sapiens
tgattcaacagg

SEQ ID NO: 4640192 - DNA, 14 bp, Homo sapiens
tgattcaactaaaa

SEQ ID NO: 4640193 - DNA, 20 bp, Homo sapiens
tgattcacttcacgctttca

SEQ ID NO: 4640194 - DNA, 13 bp, Homo sapiens
tgattcctctcat

SEQ ID NO: 4640195 - DNA, 22 bp, Homo sapiens
tgattcctctcatttccagctt

SEQ ID NO: 4640196 - DNA, 13 bp, Homo sapiens
tgattctgtttcc

SEQ ID NO: 4640197 - DNA, 15 bp, Homo sapiens
tgattgctcccagga

SEQ ID NO: 4640198 - DNA, 16 bp, Homo sapiens
tgattgctcccaggat

SEQ ID NO: 4640199 - DNA, 19 bp, Homo sapiens
tgattgtttctcaaatctt

SEQ ID NO: 4640200 - DNA, 14 bp, Homo sapiens
tgatttaatatgga

SEQ ID NO: 4640201 - DNA, 13 bp, Homo sapiens
tgatttggccagg

SEQ ID NO: 4640202 - DNA, 20 bp, Homo sapiens
tgatttgtgaaacagttgct

SEQ ID NO: 4640203 - DNA, 15 bp, Homo sapiens
tgatttgtggaaatg

SEQ ID NO: 4640204 - DNA, 14 bp, Homo sapiens
tgattttaactctg

SEQ ID NO: 4640205 - DNA, 17 bp, Homo sapiens
tgattttaactctgtct

SEQ ID NO: 4640206 - DNA, 16 bp, Homo sapiens
tgattttcagacaggg

SEQ ID NO: 4640207 - DNA, 22 bp, Homo sapiens
tgattttcctttgtagctactt

SEQ ID NO: 4640208 - DNA, 23 bp, Homo sapiens
tgattttcctttgtagctacttt

SEQ ID NO: 4640209 - DNA, 23 bp, Homo sapiens
tgatttttaaagtttaaatacca

SEQ ID NO: 4640210 - DNA, 14 bp, Homo sapiens
tgcaaaatgtcttg

SEQ ID NO: 4640211 - DNA, 13 bp, Homo sapiens
tgcaaaattaaat

SEQ ID NO: 4640212 - DNA, 13 bp, Homo sapiens
tgcaaacacagca

SEQ ID NO: 4640213 - DNA, 14 bp, Homo sapiens
tgcaaaccacttct

SEQ ID NO: 4640214 - DNA, 22 bp, Homo sapiens
tgcaaaccacttctccatgctg

SEQ ID NO: 4640215 - DNA, 18 bp, Homo sapiens
tgcaaagccagtgctgtc

SEQ ID NO: 4640216 - DNA, 17 bp, Homo sapiens
tgcaaatacaatcagcc

SEQ ID NO: 4640217 - DNA, 17 bp, Homo sapiens
tgcaaatcctatgtgat

SEQ ID NO: 4640218 - DNA, 18 bp, Homo sapiens
tgcaaatcctatgtgatt

SEQ ID NO: 4640219 - DNA, 21 bp, Homo sapiens
tgcaaatcctatgtgatttta

SEQ ID NO: 4640220 - DNA, 15 bp, Homo sapiens
tgcaaattaaaacat

SEQ ID NO: 4640221 - DNA, 16 bp, Homo sapiens
tgcaaatttctataaa

SEQ ID NO: 4640222 - DNA, 18 bp, Homo sapiens
tgcaaatttctataaatt

SEQ ID NO: 4640223 - DNA, 13 bp, Homo sapiens
tgcaacatttatt

SEQ ID NO: 4640224 - DNA, 12 bp, Homo sapiens
tgcaacctctgc

SEQ ID NO: 4640225 - DNA, 22 bp, Homo sapiens
tgcaacctctgcctcctgggtt

SEQ ID NO: 4640226 - DNA, 18 bp, Homo sapiens
tgcaacttccgctgaggg

SEQ ID NO: 4640227 - DNA, 23 bp, Homo sapiens
tgcaagcactcggggtccctgga

SEQ ID NO: 4640228 - DNA, 17 bp, Homo sapiens
tgcaatgacataaccaa

SEQ ID NO: 4640229 - DNA, 16 bp, Homo sapiens
tgcaatgtgctactga

SEQ ID NO: 4640230 - DNA, 19 bp, Homo sapiens
tgcacaaaacccagacctg

SEQ ID NO: 4640231 - DNA, 20 bp, Homo sapiens
tgcacaaagtggcataaaaa

SEQ ID NO: 4640232 - DNA, 17 bp, Homo sapiens
tgcacaccaaggccctg

SEQ ID NO: 4640233 - DNA, 19 bp, Homo sapiens
tgcacaccaaggccctgca

SEQ ID NO: 4640234 - DNA, 17 bp, Homo sapiens
tgcacagacaagcagcc

SEQ ID NO: 4640235 - DNA, 12 bp, Homo sapiens
tgcacagcgtgg

SEQ ID NO: 4640236 - DNA, 18 bp, Homo sapiens
tgcacagctgtttgaaat

SEQ ID NO: 4640237 - DNA, 20 bp, Homo sapiens
tgcacagctgtttgaaatgt

SEQ ID NO: 4640238 - DNA, 13 bp, Homo sapiens
tgcacaggagggg

SEQ ID NO: 4640239 - DNA, 12 bp, Homo sapiens
tgcacaggcttg

SEQ ID NO: 4640240 - DNA, 16 bp, Homo sapiens
tgcacaggcttgctgt

SEQ ID NO: 4640241 - DNA, 14 bp, Homo sapiens
tgcacatatggact

SEQ ID NO: 4640242 - DNA, 16 bp, Homo sapiens
tgcacctgtccccacc

SEQ ID NO: 4640243 - DNA, 17 bp, Homo sapiens
tgcacctgtccccaccc

SEQ ID NO: 4640244 - DNA, 21 bp, Homo sapiens
tgcacctgtccccaccctcca

SEQ ID NO: 4640245 - DNA, 12 bp, Homo sapiens
tgcaccttcagc

SEQ ID NO: 4640246 - DNA, 12 bp, Homo sapiens
tgcaccttgctc

SEQ ID NO: 4640247 - DNA, 15 bp, Homo sapiens
tgcactcatcatatt

SEQ ID NO: 4640248 - DNA, 13 bp, Homo sapiens
tgcactgatgttg

SEQ ID NO: 4640249 - DNA, 12 bp, Homo sapiens
tgcactgttttt

SEQ ID NO: 4640250 - DNA, 13 bp, Homo sapiens
tgcactgttttta

SEQ ID NO: 4640251 - DNA, 23 bp, Homo sapiens
tgcactttcctttcaataaagtt

SEQ ID NO: 4640252 - DNA, 17 bp, Homo sapiens
tgcagaccatcgcacac

SEQ ID NO: 4640253 - DNA, 18 bp, Homo sapiens
tgcagagaagattttata

SEQ ID NO: 4640254 - DNA, 14 bp, Homo sapiens
tgcagagcagacag

SEQ ID NO: 4640255 - DNA, 14 bp, Homo sapiens
tgcagaggtctcca

SEQ ID NO: 4640256 - DNA, 23 bp, Homo sapiens
tgcagagtaaattgctctgttcc

SEQ ID NO: 4640257 - DNA, 14 bp, Homo sapiens
tgcagcacctccag

SEQ ID NO: 4640258 - DNA, 18 bp, Homo sapiens
tgcagcacctccaggcct

SEQ ID NO: 4640259 - DNA, 19 bp, Homo sapiens
tgcagcacctccaggcctg

SEQ ID NO: 4640260 - DNA, 20 bp, Homo sapiens
tgcagcacctccaggcctgt

SEQ ID NO: 4640261 - DNA, 20 bp, Homo sapiens
tgcagcagaaaggctctgaa

SEQ ID NO: 4640262 - DNA, 14 bp, Homo sapiens
tgcagcaggagtgg

SEQ ID NO: 4640263 - DNA, 23 bp, Homo sapiens
tgcagcaggagtggtgcagacag

SEQ ID NO: 4640264 - DNA, 19 bp, Homo sapiens
tgcagcatatcgtttaatt

SEQ ID NO: 4640265 - DNA, 14 bp, Homo sapiens
tgcagcattgaagt

SEQ ID NO: 4640266 - DNA, 22 bp, Homo sapiens
tgcagcccaaaggctgcagcat

SEQ ID NO: 4640267 - DNA, 14 bp, Homo sapiens
tgcagcccaaggac

SEQ ID NO: 4640268 - DNA, 12 bp, Homo sapiens
tgcagcctgctc

SEQ ID NO: 4640269 - DNA, 22 bp, Homo sapiens
tgcagcctgctctagtgggaca

SEQ ID NO: 4640270 - DNA, 20 bp, Homo sapiens
tgcagcttcaacttttctct

SEQ ID NO: 4640271 - DNA, 18 bp, Homo sapiens
tgcagcttgtagccagcc

SEQ ID NO: 4640272 - DNA, 19 bp, Homo sapiens
tgcaggcaggaacaaacag

SEQ ID NO: 4640273 - DNA, 15 bp, Homo sapiens
tgcagggaggagtgg

SEQ ID NO: 4640274 - DNA, 16 bp, Homo sapiens
tgcagggcctggcata

SEQ ID NO: 4640275 - DNA, 17 bp, Homo sapiens
tgcagggcctggcatag

SEQ ID NO: 4640276 - DNA, 15 bp, Homo sapiens
tgcagggcttctcct

SEQ ID NO: 4640277 - DNA, 22 bp, Homo sapiens
tgcaggggtgacggccctcatc

SEQ ID NO: 4640278 - DNA, 19 bp, Homo sapiens
tgcaggtaagtctggtttt

SEQ ID NO: 4640279 - DNA, 15 bp, Homo sapiens
tgcaggtagacctgt

SEQ ID NO: 4640280 - DNA, 18 bp, Homo sapiens
tgcaggtagacctgtctc

SEQ ID NO: 4640281 - DNA, 16 bp, Homo sapiens
tgcaggtcagcccatg

SEQ ID NO: 4640282 - DNA, 18 bp, Homo sapiens
tgcaggtcagcccatgga

SEQ ID NO: 4640283 - DNA, 21 bp, Homo sapiens
tgcaggtcagcccatggaggc

SEQ ID NO: 4640284 - DNA, 15 bp, Homo sapiens
tgcagtctttccccc

SEQ ID NO: 4640285 - DNA, 17 bp, Homo sapiens
tgcagtctttcccccag

SEQ ID NO: 4640286 - DNA, 21 bp, Homo sapiens
tgcagtctttcccccaggaaa

SEQ ID NO: 4640287 - DNA, 18 bp, Homo sapiens
tgcagtggagggggcaag

SEQ ID NO: 4640288 - DNA, 20 bp, Homo sapiens
tgcagtggagggggcaagct

SEQ ID NO: 4640289 - DNA, 22 bp, Homo sapiens
tgcagtggcgccatctcggctc

SEQ ID NO: 4640290 - DNA, 15 bp, Homo sapiens
tgcagtttcttttca

SEQ ID NO: 4640291 - DNA, 13 bp, Homo sapiens
tgcatactgaaaa

SEQ ID NO: 4640292 - DNA, 15 bp, Homo sapiens
tgcatatttataaga

SEQ ID NO: 4640293 - DNA, 13 bp, Homo sapiens
tgcatatttgcca

SEQ ID NO: 4640294 - DNA, 16 bp, Homo sapiens
tgcatcacatctgcac

SEQ ID NO: 4640295 - DNA, 17 bp, Homo sapiens
tgcatcagaaagggagg

SEQ ID NO: 4640296 - DNA, 18 bp, Homo sapiens
tgcatcagaaagggaggg

SEQ ID NO: 4640297 - DNA, 22 bp, Homo sapiens
tgcatcagaaagggagggctct

SEQ ID NO: 4640298 - DNA, 17 bp, Homo sapiens
tgcatctgtctgctctg

SEQ ID NO: 4640299 - DNA, 15 bp, Homo sapiens
tgcatgctctgcagc

SEQ ID NO: 4640300 - DNA, 18 bp, Homo sapiens
tgcatggaggccctcctg

SEQ ID NO: 4640301 - DNA, 17 bp, Homo sapiens
tgcatggtcaagcctct

SEQ ID NO: 4640302 - DNA, 16 bp, Homo sapiens
tgcatgtatgtcttgg

SEQ ID NO: 4640303 - DNA, 15 bp, Homo sapiens
tgcatgtctgttctt

SEQ ID NO: 4640304 - DNA, 16 bp, Homo sapiens
tgcatgtctgttcttc

SEQ ID NO: 4640305 - DNA, 14 bp, Homo sapiens
tgcatgtgactctg

SEQ ID NO: 4640306 - DNA, 22 bp, Homo sapiens
tgcattatcttgctcattcttc

SEQ ID NO: 4640307 - DNA, 15 bp, Homo sapiens
tgcattatgtacaca

SEQ ID NO: 4640308 - DNA, 18 bp, Homo sapiens
tgcattcatttttatagc

SEQ ID NO: 4640309 - DNA, 20 bp, Homo sapiens
tgcattcatttttatagcaa

SEQ ID NO: 4640310 - DNA, 17 bp, Homo sapiens
tgcattcttccgcaccc

SEQ ID NO: 4640311 - DNA, 20 bp, Homo sapiens
tgcattcttttggcagttct

SEQ ID NO: 4640312 - DNA, 12 bp, Homo sapiens
tgcatttgattt

SEQ ID NO: 4640313 - DNA, 17 bp, Homo sapiens
tgccaaaattcatttct

SEQ ID NO: 4640314 - DNA, 23 bp, Homo sapiens
tgccaacctgttcttagagtgta

SEQ ID NO: 4640315 - DNA, 17 bp, Homo sapiens
tgccaagccagattctc

SEQ ID NO: 4640316 - DNA, 19 bp, Homo sapiens
tgccaaggtggagggaagg

SEQ ID NO: 4640317 - DNA, 20 bp, Homo sapiens
tgccaaggtggagggaagga

SEQ ID NO: 4640318 - DNA, 13 bp, Homo sapiens
tgccaagtccagg

SEQ ID NO: 4640319 - DNA, 15 bp, Homo sapiens
tgccaagtccaggtc

SEQ ID NO: 4640320 - DNA, 23 bp, Homo sapiens
tgccacagagaagtttgtagcca

SEQ ID NO: 4640321 - DNA, 18 bp, Homo sapiens
tgccaccacgctggccaa

SEQ ID NO: 4640322 - DNA, 15 bp, Homo sapiens
tgccactaacttcta

SEQ ID NO: 4640323 - DNA, 20 bp, Homo sapiens
tgccactgcactccagcctg

SEQ ID NO: 4640324 - DNA, 20 bp, Homo sapiens
tgccagaaagtcccccctcg

SEQ ID NO: 4640325 - DNA, 21 bp, Homo sapiens
tgccagaaagtcccccctcgc

SEQ ID NO: 4640326 - DNA, 14 bp, Homo sapiens
tgccagacctgcat

SEQ ID NO: 4640327 - DNA, 22 bp, Homo sapiens
tgccagactctaggttatacaa

SEQ ID NO: 4640328 - DNA, 14 bp, Homo sapiens
tgccagagcctggg

SEQ ID NO: 4640329 - DNA, 16 bp, Homo sapiens
tgccagagcctggggc

SEQ ID NO: 4640330 - DNA, 20 bp, Homo sapiens
tgccagagcctggggctcta

SEQ ID NO: 4640331 - DNA, 15 bp, Homo sapiens
tgccagcaggaataa

SEQ ID NO: 4640332 - DNA, 19 bp, Homo sapiens
tgccagcaggggggctgtg

SEQ ID NO: 4640333 - DNA, 22 bp, Homo sapiens
tgccagcaggggggctgtgcca

SEQ ID NO: 4640334 - DNA, 12 bp, Homo sapiens
tgccagcccagc

SEQ ID NO: 4640335 - DNA, 14 bp, Homo sapiens
tgccagcccagctg

SEQ ID NO: 4640336 - DNA, 18 bp, Homo sapiens
tgccagcctgaggtgccc

SEQ ID NO: 4640337 - DNA, 18 bp, Homo sapiens
tgccagctccatgttctc

SEQ ID NO: 4640338 - DNA, 22 bp, Homo sapiens
tgccaggagggacaaaggagcc

SEQ ID NO: 4640339 - DNA, 24 bp, Homo sapiens
tgccaggagggacaaaggagcctg

SEQ ID NO: 4640340 - DNA, 12 bp, Homo sapiens
tgccaggctgtt

SEQ ID NO: 4640341 - DNA, 17 bp, Homo sapiens
tgccagggtgagcaggg

SEQ ID NO: 4640342 - DNA, 15 bp, Homo sapiens
tgccagtctcattgt

SEQ ID NO: 4640343 - DNA, 15 bp, Homo sapiens
tgccataccttctcc

SEQ ID NO: 4640344 - DNA, 19 bp, Homo sapiens
tgccataccttctcccagg

SEQ ID NO: 4640345 - DNA, 16 bp, Homo sapiens
tgccatagtcacatgg

SEQ ID NO: 4640346 - DNA, 21 bp, Homo sapiens
tgccatcaactactattcaaa

SEQ ID NO: 4640347 - DNA, 21 bp, Homo sapiens
tgccatctcacctcctgctgg

SEQ ID NO: 4640348 - DNA, 13 bp, Homo sapiens
tgccatgctgggc

SEQ ID NO: 4640349 - DNA, 22 bp, Homo sapiens
tgccatgctgggccactgggga

SEQ ID NO: 4640350 - DNA, 21 bp, Homo sapiens
tgccatgttggccaggctggt

SEQ ID NO: 4640351 - DNA, 21 bp, Homo sapiens
tgccattctgcatgagctgat

SEQ ID NO: 4640352 - DNA, 15 bp, Homo sapiens
tgccatttgtactga

SEQ ID NO: 4640353 - DNA, 23 bp, Homo sapiens
tgccatttgtactgaccccatca

SEQ ID NO: 4640354 - DNA, 12 bp, Homo sapiens
tgcccacaggcc

SEQ ID NO: 4640355 - DNA, 17 bp, Homo sapiens
tgcccactccgccagcc

SEQ ID NO: 4640356 - DNA, 18 bp, Homo sapiens
tgcccactccgccagcca

SEQ ID NO: 4640357 - DNA, 20 bp, Homo sapiens
tgcccactccgccagccaca

SEQ ID NO: 4640358 - DNA, 21 bp, Homo sapiens
tgcccactccgccagccacag

SEQ ID NO: 4640359 - DNA, 22 bp, Homo sapiens
tgcccactccgccagccacagg

SEQ ID NO: 4640360 - DNA, 14 bp, Homo sapiens
tgcccaggcaagga

SEQ ID NO: 4640361 - DNA, 14 bp, Homo sapiens
tgcccagggaataa

SEQ ID NO: 4640362 - DNA, 17 bp, Homo sapiens
tgcccaggtatcctggg

SEQ ID NO: 4640363 - DNA, 18 bp, Homo sapiens
tgcccaggtatcctgggg

SEQ ID NO: 4640364 - DNA, 23 bp, Homo sapiens
tgcccaggtatcctgggggaaga

SEQ ID NO: 4640365 - DNA, 14 bp, Homo sapiens
tgcccatgtgtaca

SEQ ID NO: 4640366 - DNA, 19 bp, Homo sapiens
tgcccatgtgtacattctg

SEQ ID NO: 4640367 - DNA, 16 bp, Homo sapiens
tgcccattagagaagt

SEQ ID NO: 4640368 - DNA, 20 bp, Homo sapiens
tgccccaactccttccagct

SEQ ID NO: 4640369 - DNA, 19 bp, Homo sapiens
tgccccacgttgtccctga

SEQ ID NO: 4640370 - DNA, 15 bp, Homo sapiens
tgccccaggccctac

SEQ ID NO: 4640371 - DNA, 22 bp, Homo sapiens
tgccccagtcggccccatctct

SEQ ID NO: 4640372 - DNA, 20 bp, Homo sapiens
tgccccccctaagagacaca

SEQ ID NO: 4640373 - DNA, 13 bp, Homo sapiens
tgcccctctctgg

SEQ ID NO: 4640374 - DNA, 13 bp, Homo sapiens
tgcccctggctgg

SEQ ID NO: 4640375 - DNA, 14 bp, Homo sapiens
tgcccgagggcagc

SEQ ID NO: 4640376 - DNA, 18 bp, Homo sapiens
tgcccggtgcagggcctg

SEQ ID NO: 4640377 - DNA, 14 bp, Homo sapiens
tgccctaactctgc

SEQ ID NO: 4640378 - DNA, 21 bp, Homo sapiens
tgccctaactctgcccaccct

SEQ ID NO: 4640379 - DNA, 15 bp, Homo sapiens
tgccctatgctgtgc

SEQ ID NO: 4640380 - DNA, 19 bp, Homo sapiens
tgccctcattactgggcct

SEQ ID NO: 4640381 - DNA, 15 bp, Homo sapiens
tgccctcctctccct

SEQ ID NO: 4640382 - DNA, 21 bp, Homo sapiens
tgccctcctctccctcccact

SEQ ID NO: 4640383 - DNA, 20 bp, Homo sapiens
tgccctgagaagctgctcca

SEQ ID NO: 4640384 - DNA, 21 bp, Homo sapiens
tgccctgctctgcccaggcaa

SEQ ID NO: 4640385 - DNA, 18 bp, Homo sapiens
tgccctgttagctttcca

SEQ ID NO: 4640386 - DNA, 21 bp, Homo sapiens
tgcccttacctgtctctctct

SEQ ID NO: 4640387 - DNA, 23 bp, Homo sapiens
tgcccttccccctttctctgcct

SEQ ID NO: 4640388 - DNA, 11 bp, Homo sapiens
tgcccttcctc

SEQ ID NO: 4640389 - DNA, 13 bp, Homo sapiens
tgcccttcctcct

SEQ ID NO: 4640390 - DNA, 12 bp, Homo sapiens
tgcccttgctgg

SEQ ID NO: 4640391 - DNA, 13 bp, Homo sapiens
tgcccttgctggg

SEQ ID NO: 4640392 - DNA, 23 bp, Homo sapiens
tgcccttgtttggggcaggagta

SEQ ID NO: 4640393 - DNA, 24 bp, Homo sapiens
tgcccttgtttggggcaggagtag

SEQ ID NO: 4640394 - DNA, 15 bp, Homo sapiens
tgccgagcaaccgtg

SEQ ID NO: 4640395 - DNA, 17 bp, Homo sapiens
tgccgagcaaccgtggc

SEQ ID NO: 4640396 - DNA, 21 bp, Homo sapiens
tgccgtgtgagtgtgacaggg

SEQ ID NO: 4640397 - DNA, 22 bp, Homo sapiens
tgcctcactaatttttgtatta

SEQ ID NO: 4640398 - DNA, 16 bp, Homo sapiens
tgcctcaggcctctgt

SEQ ID NO: 4640399 - DNA, 15 bp, Homo sapiens
tgcctccataatttg

SEQ ID NO: 4640400 - DNA, 16 bp, Homo sapiens
tgcctccataatttgg

SEQ ID NO: 4640401 - DNA, 13 bp, Homo sapiens
tgcctccatcttt

SEQ ID NO: 4640402 - DNA, 14 bp, Homo sapiens
tgcctccatctttt

SEQ ID NO: 4640403 - DNA, 13 bp, Homo sapiens
tgcctccctggtg

SEQ ID NO: 4640404 - DNA, 19 bp, Homo sapiens
tgcctcctctctccctgcc

SEQ ID NO: 4640405 - DNA, 21 bp, Homo sapiens
tgcctcctctctccctgcctc

SEQ ID NO: 4640406 - DNA, 15 bp, Homo sapiens
tgcctcgccttgtgt

SEQ ID NO: 4640407 - DNA, 16 bp, Homo sapiens
tgcctcgccttgtgtt

SEQ ID NO: 4640408 - DNA, 16 bp, Homo sapiens
tgcctcgctcccttca

SEQ ID NO: 4640409 - DNA, 16 bp, Homo sapiens
tgcctctactgggaag

SEQ ID NO: 4640410 - DNA, 16 bp, Homo sapiens
tgcctctatttttgtt

SEQ ID NO: 4640411 - DNA, 21 bp, Homo sapiens
tgcctctcacagctgagttgt

SEQ ID NO: 4640412 - DNA, 13 bp, Homo sapiens
tgcctctgaggcc

SEQ ID NO: 4640413 - DNA, 15 bp, Homo sapiens
tgcctctgaggccag

SEQ ID NO: 4640414 - DNA, 17 bp, Homo sapiens
tgcctctgaggccagcc

SEQ ID NO: 4640415 - DNA, 18 bp, Homo sapiens
tgcctctgaggccagcct

SEQ ID NO: 4640416 - DNA, 18 bp, Homo sapiens
tgcctgaggggaaagaga

SEQ ID NO: 4640417 - DNA, 20 bp, Homo sapiens
tgcctgcccattagagaagt

SEQ ID NO: 4640418 - DNA, 16 bp, Homo sapiens
tgcctgctcgctccct

SEQ ID NO: 4640419 - DNA, 21 bp, Homo sapiens
tgcctgctcgctccctgcaga

SEQ ID NO: 4640420 - DNA, 20 bp, Homo sapiens
tgcctggagacaaggtgcta

SEQ ID NO: 4640421 - DNA, 23 bp, Homo sapiens
tgcctggagacaaggtgctaaca

SEQ ID NO: 4640422 - DNA, 18 bp, Homo sapiens
tgcctggaggacctgagc

SEQ ID NO: 4640423 - DNA, 22 bp, Homo sapiens
tgcctggaggacctgagcctgc

SEQ ID NO: 4640424 - DNA, 14 bp, Homo sapiens
tgcctgggatgccc

SEQ ID NO: 4640425 - DNA, 22 bp, Homo sapiens
tgcctgggcaatggccaggggc

SEQ ID NO: 4640426 - DNA, 17 bp, Homo sapiens
tgcctgggtaggcccca

SEQ ID NO: 4640427 - DNA, 16 bp, Homo sapiens
tgcctggtattttcaa

SEQ ID NO: 4640428 - DNA, 19 bp, Homo sapiens
tgcctggtattttcaacca

SEQ ID NO: 4640429 - DNA, 16 bp, Homo sapiens
tgcctggttctaggct

SEQ ID NO: 4640430 - DNA, 17 bp, Homo sapiens
tgcctggttctaggctg

SEQ ID NO: 4640431 - DNA, 19 bp, Homo sapiens
tgcctggttctaggctgct

SEQ ID NO: 4640432 - DNA, 21 bp, Homo sapiens
tgcctgtactactctagggag

SEQ ID NO: 4640433 - DNA, 18 bp, Homo sapiens
tgcctgtcaagttgtaca

SEQ ID NO: 4640434 - DNA, 16 bp, Homo sapiens
tgcctgtttcttctct

SEQ ID NO: 4640435 - DNA, 17 bp, Homo sapiens
tgccttaaacacacatt

SEQ ID NO: 4640436 - DNA, 21 bp, Homo sapiens
tgccttattgctgttgcttat

SEQ ID NO: 4640437 - DNA, 21 bp, Homo sapiens
tgccttcaacaacgtgagaga

SEQ ID NO: 4640438 - DNA, 23 bp, Homo sapiens
tgccttcaacaacgtgagagaaa

SEQ ID NO: 4640439 - DNA, 15 bp, Homo sapiens
tgccttctgaaatgt

SEQ ID NO: 4640440 - DNA, 20 bp, Homo sapiens
tgccttctgaaatgtgaccc

SEQ ID NO: 4640441 - DNA, 15 bp, Homo sapiens
tgccttgatgattta

SEQ ID NO: 4640442 - DNA, 23 bp, Homo sapiens
tgccttggggaggacaaaacttc

SEQ ID NO: 4640443 - DNA, 14 bp, Homo sapiens
tgcctttaagccaa

SEQ ID NO: 4640444 - DNA, 22 bp, Homo sapiens
tgcctttaagccaaagaaacaa

SEQ ID NO: 4640445 - DNA, 17 bp, Homo sapiens
tgcctttggcagagttc

SEQ ID NO: 4640446 - DNA, 17 bp, Homo sapiens
tgcctttgggcacggcc

SEQ ID NO: 4640447 - DNA, 16 bp, Homo sapiens
tgccttttaattttta

SEQ ID NO: 4640448 - DNA, 23 bp, Homo sapiens
tgcgagacgcacacagctgagca

SEQ ID NO: 4640449 - DNA, 15 bp, Homo sapiens
tgcgcaagtgcctgg

SEQ ID NO: 4640450 - DNA, 17 bp, Homo sapiens
tgcgcaagtgcctggga

SEQ ID NO: 4640451 - DNA, 17 bp, Homo sapiens
tgcggggcctgtctcag

SEQ ID NO: 4640452 - DNA, 20 bp, Homo sapiens
tgcggggcctgtctcagtga

SEQ ID NO: 4640453 - DNA, 14 bp, Homo sapiens
tgcgggggcaggcc

SEQ ID NO: 4640454 - DNA, 18 bp, Homo sapiens
tgcgggtgaacaaagcag

SEQ ID NO: 4640455 - DNA, 21 bp, Homo sapiens
tgcgggtgaacaaagcagcca

SEQ ID NO: 4640456 - DNA, 13 bp, Homo sapiens
tgcgtacacagag

SEQ ID NO: 4640457 - DNA, 20 bp, Homo sapiens
tgcgtcattacagggcacag

SEQ ID NO: 4640458 - DNA, 12 bp, Homo sapiens
tgcgtgaatgta

SEQ ID NO: 4640459 - DNA, 12 bp, Homo sapiens
tgcgtgggcaga

SEQ ID NO: 4640460 - DNA, 14 bp, Homo sapiens
tgcgtgggcagagg

SEQ ID NO: 4640461 - DNA, 15 bp, Homo sapiens
tgcgtgggcagagga

SEQ ID NO: 4640462 - DNA, 20 bp, Homo sapiens
tgcgtgtgacagtgtatggg

SEQ ID NO: 4640463 - DNA, 21 bp, Homo sapiens
tgctaaactactgattacttg

SEQ ID NO: 4640464 - DNA, 15 bp, Homo sapiens
tgctaaatgtgagta

SEQ ID NO: 4640465 - DNA, 21 bp, Homo sapiens
tgctaaatgtgagtatttctg

SEQ ID NO: 4640466 - DNA, 13 bp, Homo sapiens
tgctaacaaagac

SEQ ID NO: 4640467 - DNA, 22 bp, Homo sapiens
tgctaacaaagacaaaagtctg

SEQ ID NO: 4640468 - DNA, 19 bp, Homo sapiens
tgctaagaatgcattattg

SEQ ID NO: 4640469 - DNA, 16 bp, Homo sapiens
tgctaatcaaagccag

SEQ ID NO: 4640470 - DNA, 21 bp, Homo sapiens
tgctacaggggccagaagatg

SEQ ID NO: 4640471 - DNA, 15 bp, Homo sapiens
tgctacgtgtgaaat

SEQ ID NO: 4640472 - DNA, 16 bp, Homo sapiens
tgctacgtgtgaaatc

SEQ ID NO: 4640473 - DNA, 17 bp, Homo sapiens
tgctacgtgtgaaatct

SEQ ID NO: 4640474 - DNA, 21 bp, Homo sapiens
tgctacgtgtgaaatctgtct

SEQ ID NO: 4640475 - DNA, 15 bp, Homo sapiens
tgctagaaattttca

SEQ ID NO: 4640476 - DNA, 19 bp, Homo sapiens
tgctagtcgcccctcagag

SEQ ID NO: 4640477 - DNA, 19 bp, Homo sapiens
tgctatcaacaataaaatt

SEQ ID NO: 4640478 - DNA, 15 bp, Homo sapiens
tgctatccatttctc

SEQ ID NO: 4640479 - DNA, 16 bp, Homo sapiens
tgctatggatggcttc

SEQ ID NO: 4640480 - DNA, 14 bp, Homo sapiens
tgctatgttctgtc

SEQ ID NO: 4640481 - DNA, 19 bp, Homo sapiens
tgctattctagagctttta

SEQ ID NO: 4640482 - DNA, 11 bp, Homo sapiens
tgctatttgaa

SEQ ID NO: 4640483 - DNA, 16 bp, Homo sapiens
tgctatttgaagaaaa

SEQ ID NO: 4640484 - DNA, 17 bp, Homo sapiens
tgctcacaacttagtgt

SEQ ID NO: 4640485 - DNA, 20 bp, Homo sapiens
tgctcaccgactcacctgcg

SEQ ID NO: 4640486 - DNA, 14 bp, Homo sapiens
tgctcactttatta

SEQ ID NO: 4640487 - DNA, 16 bp, Homo sapiens
tgctcatctgttgtag

SEQ ID NO: 4640488 - DNA, 21 bp, Homo sapiens
tgctcatgagctcctgatcag

SEQ ID NO: 4640489 - DNA, 13 bp, Homo sapiens
tgctccaggcctg

SEQ ID NO: 4640490 - DNA, 18 bp, Homo sapiens
tgctccaggcctgcagca

SEQ ID NO: 4640491 - DNA, 15 bp, Homo sapiens
tgctccatatttgat

SEQ ID NO: 4640492 - DNA, 12 bp, Homo sapiens
tgctcccaactc

SEQ ID NO: 4640493 - DNA, 22 bp, Homo sapiens
tgctcccaactcccttctgctt

SEQ ID NO: 4640494 - DNA, 12 bp, Homo sapiens
tgctcccaggat

SEQ ID NO: 4640495 - DNA, 16 bp, Homo sapiens
tgctcctgcttctcct

SEQ ID NO: 4640496 - DNA, 17 bp, Homo sapiens
tgctccttcagttctgc

SEQ ID NO: 4640497 - DNA, 19 bp, Homo sapiens
tgctctaagcccaggatct

SEQ ID NO: 4640498 - DNA, 21 bp, Homo sapiens
tgctctaagcccaggatctct

SEQ ID NO: 4640499 - DNA, 17 bp, Homo sapiens
tgctctgatgcatcaga

SEQ ID NO: 4640500 - DNA, 18 bp, Homo sapiens
tgctctgatgcatcagaa

SEQ ID NO: 4640501 - DNA, 20 bp, Homo sapiens
tgctctgcagcattgaagta

SEQ ID NO: 4640502 - DNA, 22 bp, Homo sapiens
tgctctggaataaagttgcaga

SEQ ID NO: 4640503 - DNA, 23 bp, Homo sapiens
tgctctggaataaagttgcagat

SEQ ID NO: 4640504 - DNA, 14 bp, Homo sapiens
tgctctgttcccag

SEQ ID NO: 4640505 - DNA, 13 bp, Homo sapiens
tgctcttggggaa

SEQ ID NO: 4640506 - DNA, 18 bp, Homo sapiens
tgctcttggggaagggga

SEQ ID NO: 4640507 - DNA, 16 bp, Homo sapiens
tgctctttattgcaga

SEQ ID NO: 4640508 - DNA, 18 bp, Homo sapiens
tgctctttcatctctgct

SEQ ID NO: 4640509 - DNA, 23 bp, Homo sapiens
tgctctttccacttgccctgtgt

SEQ ID NO: 4640510 - DNA, 13 bp, Homo sapiens
tgctgacagacac

SEQ ID NO: 4640511 - DNA, 20 bp, Homo sapiens
tgctgacgcccgagagcctc

SEQ ID NO: 4640512 - DNA, 18 bp, Homo sapiens
tgctgactggcttcagca

SEQ ID NO: 4640513 - DNA, 18 bp, Homo sapiens
tgctgagaacctggcctt

SEQ ID NO: 4640514 - DNA, 21 bp, Homo sapiens
tgctgagaacctggccttcag

SEQ ID NO: 4640515 - DNA, 22 bp, Homo sapiens
tgctgagctctgagaggccctg

SEQ ID NO: 4640516 - DNA, 15 bp, Homo sapiens
tgctgagctgtttat

SEQ ID NO: 4640517 - DNA, 17 bp, Homo sapiens
tgctgatggagccttcc

SEQ ID NO: 4640518 - DNA, 17 bp, Homo sapiens
tgctgcaaaggagaagc

SEQ ID NO: 4640519 - DNA, 22 bp, Homo sapiens
tgctgcaaaggagaagcacagc

SEQ ID NO: 4640520 - DNA, 14 bp, Homo sapiens
tgctgcaatgggaa

SEQ ID NO: 4640521 - DNA, 17 bp, Homo sapiens
tgctgcacaccaaggcc

SEQ ID NO: 4640522 - DNA, 23 bp, Homo sapiens
tgctgccaaggtggagggaagga

SEQ ID NO: 4640523 - DNA, 20 bp, Homo sapiens
tgctgcctgggtaggcccca

SEQ ID NO: 4640524 - DNA, 20 bp, Homo sapiens
tgctgcggagcaagaggagg

SEQ ID NO: 4640525 - DNA, 23 bp, Homo sapiens
tgctgcgtcattacagggcacag

SEQ ID NO: 4640526 - DNA, 20 bp, Homo sapiens
tgctgctgagaacctggcct

SEQ ID NO: 4640527 - DNA, 18 bp, Homo sapiens
tgctggaagaaactaaaa

SEQ ID NO: 4640528 - DNA, 21 bp, Homo sapiens
tgctggactggaggcccctgg

SEQ ID NO: 4640529 - DNA, 18 bp, Homo sapiens
tgctggccccgcccctgc

SEQ ID NO: 4640530 - DNA, 16 bp, Homo sapiens
tgctggctcccagggc

SEQ ID NO: 4640531 - DNA, 20 bp, Homo sapiens
tgctgggccactggggactt

SEQ ID NO: 4640532 - DNA, 13 bp, Homo sapiens
tgctgggctgggc

SEQ ID NO: 4640533 - DNA, 15 bp, Homo sapiens
tgctgggctgggccc

SEQ ID NO: 4640534 - DNA, 14 bp, Homo sapiens
tgctggggccaggc

SEQ ID NO: 4640535 - DNA, 15 bp, Homo sapiens
tgctggggccaggcc

SEQ ID NO: 4640536 - DNA, 17 bp, Homo sapiens
tgctggggccaggcccc

SEQ ID NO: 4640537 - DNA, 22 bp, Homo sapiens
tgctggggccgccacggcctgg

SEQ ID NO: 4640538 - DNA, 23 bp, Homo sapiens
tgctgggggaatgagcccagaga

SEQ ID NO: 4640539 - DNA, 13 bp, Homo sapiens
tgctggtacctgc

SEQ ID NO: 4640540 - DNA, 15 bp, Homo sapiens
tgctggtttttcagt

SEQ ID NO: 4640541 - DNA, 18 bp, Homo sapiens
tgctggtttttcagtttt

SEQ ID NO: 4640542 - DNA, 20 bp, Homo sapiens
tgctgtatgacccctggcca

SEQ ID NO: 4640543 - DNA, 10 bp, Homo sapiens
tgctgtcacc

SEQ ID NO: 4640544 - DNA, 18 bp, Homo sapiens
tgctgtcacttcttcacc

SEQ ID NO: 4640545 - DNA, 17 bp, Homo sapiens
tgctgtctaacctgtga

SEQ ID NO: 4640546 - DNA, 20 bp, Homo sapiens
tgctgtcttttgttctctga

SEQ ID NO: 4640547 - DNA, 23 bp, Homo sapiens
tgctgtgccatgctgggccactg

SEQ ID NO: 4640548 - DNA, 20 bp, Homo sapiens
tgctgtgctacgtgtgaaat

SEQ ID NO: 4640549 - DNA, 23 bp, Homo sapiens
tgctgtgtagttccctctgcctg

SEQ ID NO: 4640550 - DNA, 14 bp, Homo sapiens
tgctgttcacagct

SEQ ID NO: 4640551 - DNA, 16 bp, Homo sapiens
tgctgttcacagcttt

SEQ ID NO: 4640552 - DNA, 19 bp, Homo sapiens
tgctgttcacagcttttct

SEQ ID NO: 4640553 - DNA, 22 bp, Homo sapiens
tgctgttcacagcttttcttga

SEQ ID NO: 4640554 - DNA, 12 bp, Homo sapiens
tgctgtttctaa

SEQ ID NO: 4640555 - DNA, 13 bp, Homo sapiens
tgctgtttctaag

SEQ ID NO: 4640556 - DNA, 23 bp, Homo sapiens
tgctgtttctaagaaaatgtagt

SEQ ID NO: 4640557 - DNA, 15 bp, Homo sapiens
tgcttaaaaatactt

SEQ ID NO: 4640558 - DNA, 20 bp, Homo sapiens
tgcttagaggttctgcctct

SEQ ID NO: 4640559 - DNA, 20 bp, Homo sapiens
tgcttagataactcttgttt

SEQ ID NO: 4640560 - DNA, 15 bp, Homo sapiens
tgcttcatgtgaaca

SEQ ID NO: 4640561 - DNA, 19 bp, Homo sapiens
tgcttcattattcaagaat

SEQ ID NO: 4640562 - DNA, 20 bp, Homo sapiens
tgcttccaagaccatttgta

SEQ ID NO: 4640563 - DNA, 19 bp, Homo sapiens
tgcttccacctcaccccac

SEQ ID NO: 4640564 - DNA, 15 bp, Homo sapiens
tgcttcctagtaagt

SEQ ID NO: 4640565 - DNA, 20 bp, Homo sapiens
tgcttccttggttcatgctt

SEQ ID NO: 4640566 - DNA, 22 bp, Homo sapiens
tgcttccttggttcatgcttct

SEQ ID NO: 4640567 - DNA, 18 bp, Homo sapiens
tgcttctactgtgacact

SEQ ID NO: 4640568 - DNA, 17 bp, Homo sapiens
tgcttgcataagagctt

SEQ ID NO: 4640569 - DNA, 20 bp, Homo sapiens
tgcttgctcccaagcccctg

SEQ ID NO: 4640570 - DNA, 14 bp, Homo sapiens
tgcttggaagccag

SEQ ID NO: 4640571 - DNA, 16 bp, Homo sapiens
tgcttggaagccaggt

SEQ ID NO: 4640572 - DNA, 12 bp, Homo sapiens
tgcttgggctga

SEQ ID NO: 4640573 - DNA, 21 bp, Homo sapiens
tgcttgggctgacccagcatc

SEQ ID NO: 4640574 - DNA, 20 bp, Homo sapiens
tgcttggggggtgatgaggg

SEQ ID NO: 4640575 - DNA, 14 bp, Homo sapiens
tgcttgttggattt

SEQ ID NO: 4640576 - DNA, 16 bp, Homo sapiens
tgctttaaagataaaa

SEQ ID NO: 4640577 - DNA, 15 bp, Homo sapiens
tgctttatgccttct

SEQ ID NO: 4640578 - DNA, 16 bp, Homo sapiens
tgctttcctgggcctt

SEQ ID NO: 4640579 - DNA, 18 bp, Homo sapiens
tgctttctccattgtaaa

SEQ ID NO: 4640580 - DNA, 20 bp, Homo sapiens
tgctttctttagaattttta

SEQ ID NO: 4640581 - DNA, 15 bp, Homo sapiens
tgcttttcctctgcc

SEQ ID NO: 4640582 - DNA, 17 bp, Homo sapiens
tgctttttctcaaaatg

SEQ ID NO: 4640583 - DNA, 17 bp, Homo sapiens
tgctttttctgcgcttc

SEQ ID NO: 4640584 - DNA, 21 bp, Homo sapiens
tggaaaagggtcttgggaaat

SEQ ID NO: 4640585 - DNA, 17 bp, Homo sapiens
tggaaacctctacatat

SEQ ID NO: 4640586 - DNA, 17 bp, Homo sapiens
tggaaacctgtcattgt

SEQ ID NO: 4640587 - DNA, 17 bp, Homo sapiens
tggaaacttctgtaagg

SEQ ID NO: 4640588 - DNA, 13 bp, Homo sapiens
tggaaatcaatac

SEQ ID NO: 4640589 - DNA, 16 bp, Homo sapiens
tggaaattggaagagc

SEQ ID NO: 4640590 - DNA, 18 bp, Homo sapiens
tggaaatttagagttcta

SEQ ID NO: 4640591 - DNA, 15 bp, Homo sapiens
tggaacacggccaca

SEQ ID NO: 4640592 - DNA, 20 bp, Homo sapiens
tggaactgaagggggcggcc

SEQ ID NO: 4640593 - DNA, 15 bp, Homo sapiens
tggaactgtgtttca

SEQ ID NO: 4640594 - DNA, 18 bp, Homo sapiens
tggaactgtgtttcaaat

SEQ ID NO: 4640595 - DNA, 21 bp, Homo sapiens
tggaagaaactaaaaatatag

SEQ ID NO: 4640596 - DNA, 22 bp, Homo sapiens
tggaagccaggtacaggagagg

SEQ ID NO: 4640597 - DNA, 16 bp, Homo sapiens
tggaagccttccccca

SEQ ID NO: 4640598 - DNA, 22 bp, Homo sapiens
tggaagccttcccccagcaagg

SEQ ID NO: 4640599 - DNA, 23 bp, Homo sapiens
tggaaggggccacgtggatgggc

SEQ ID NO: 4640600 - DNA, 18 bp, Homo sapiens
tggaagtcaaataaatgt

SEQ ID NO: 4640601 - DNA, 18 bp, Homo sapiens
tggaataaagttgcagat

SEQ ID NO: 4640602 - DNA, 14 bp, Homo sapiens
tggaatatttgaat

SEQ ID NO: 4640603 - DNA, 20 bp, Homo sapiens
tggaatcaaggtaagctcag

SEQ ID NO: 4640604 - DNA, 18 bp, Homo sapiens
tggaatgagtgtgcatgg

SEQ ID NO: 4640605 - DNA, 23 bp, Homo sapiens
tggacacgagccacaagctgcac

SEQ ID NO: 4640606 - DNA, 14 bp, Homo sapiens
tggacactgtacaa

SEQ ID NO: 4640607 - DNA, 21 bp, Homo sapiens
tggacctgggacaagcaggcc

SEQ ID NO: 4640608 - DNA, 21 bp, Homo sapiens
tggactagccagaattctacc

SEQ ID NO: 4640609 - DNA, 18 bp, Homo sapiens
tggactcagggcagcgcc

SEQ ID NO: 4640610 - DNA, 15 bp, Homo sapiens
tggactctgcacatg

SEQ ID NO: 4640611 - DNA, 16 bp, Homo sapiens
tggactctgcacatga

SEQ ID NO: 4640612 - DNA, 22 bp, Homo sapiens
tggactgctattctagagcttt

SEQ ID NO: 4640613 - DNA, 17 bp, Homo sapiens
tggactggaggcccctg

SEQ ID NO: 4640614 - DNA, 18 bp, Homo sapiens
tggactggttatcttgtt

SEQ ID NO: 4640615 - DNA, 14 bp, Homo sapiens
tggacttgcctctg

SEQ ID NO: 4640616 - DNA, 14 bp, Homo sapiens
tggagaaagaagtg

SEQ ID NO: 4640617 - DNA, 18 bp, Homo sapiens
tggagaaagagctgcctg

SEQ ID NO: 4640618 - DNA, 22 bp, Homo sapiens
tggagaaccagggctcttctca

SEQ ID NO: 4640619 - DNA, 23 bp, Homo sapiens
tggagaaccagggctcttctcag

SEQ ID NO: 4640620 - DNA, 17 bp, Homo sapiens
tggagaagttgtgaaag

SEQ ID NO: 4640621 - DNA, 15 bp, Homo sapiens
tggagagaagctctt

SEQ ID NO: 4640622 - DNA, 17 bp, Homo sapiens
tggagagaatgtgtgtg

SEQ ID NO: 4640623 - DNA, 15 bp, Homo sapiens
tggagaggcgagagg

SEQ ID NO: 4640624 - DNA, 21 bp, Homo sapiens
tggagatcacagccccaccct

SEQ ID NO: 4640625 - DNA, 22 bp, Homo sapiens
tggagatcacagccccaccctt

SEQ ID NO: 4640626 - DNA, 14 bp, Homo sapiens
tggagcaagctctt

SEQ ID NO: 4640627 - DNA, 15 bp, Homo sapiens
tggagcaagctcttc

SEQ ID NO: 4640628 - DNA, 23 bp, Homo sapiens
tggagcaagctcttcccttgctc

SEQ ID NO: 4640629 - DNA, 15 bp, Homo sapiens
tggagccactctgtt

SEQ ID NO: 4640630 - DNA, 14 bp, Homo sapiens
tggagctgccacag

SEQ ID NO: 4640631 - DNA, 16 bp, Homo sapiens
tggagctgccacagag

SEQ ID NO: 4640632 - DNA, 17 bp, Homo sapiens
tggaggaatacatttta

SEQ ID NO: 4640633 - DNA, 14 bp, Homo sapiens
tggaggacctgagc

SEQ ID NO: 4640634 - DNA, 19 bp, Homo sapiens
tggaggacctgagcctgcc

SEQ ID NO: 4640635 - DNA, 11 bp, Homo sapiens
tggaggagaga

SEQ ID NO: 4640636 - DNA, 15 bp, Homo sapiens
tggaggagccaggcc

SEQ ID NO: 4640637 - DNA, 21 bp, Homo sapiens
tggaggagggtttgggcagag

SEQ ID NO: 4640638 - DNA, 23 bp, Homo sapiens
tggaggatttcctacccccgtcc

SEQ ID NO: 4640639 - DNA, 16 bp, Homo sapiens
tggaggcagatgccct

SEQ ID NO: 4640640 - DNA, 13 bp, Homo sapiens
tggaggcccctgg

SEQ ID NO: 4640641 - DNA, 17 bp, Homo sapiens
tggaggcccctggagcc

SEQ ID NO: 4640642 - DNA, 20 bp, Homo sapiens
tggaggcccctggagccaga

SEQ ID NO: 4640643 - DNA, 21 bp, Homo sapiens
tggaggccctcctgtgctggg

SEQ ID NO: 4640644 - DNA, 11 bp, Homo sapiens
tggaggctgca

SEQ ID NO: 4640645 - DNA, 15 bp, Homo sapiens
tggaggctgcagtga

SEQ ID NO: 4640646 - DNA, 18 bp, Homo sapiens
tggaggctgcagtgagcc

SEQ ID NO: 4640647 - DNA, 16 bp, Homo sapiens
tggaggggagaggggt

SEQ ID NO: 4640648 - DNA, 12 bp, Homo sapiens
tggagggggaag

SEQ ID NO: 4640649 - DNA, 16 bp, Homo sapiens
tggaggtcccagccct

SEQ ID NO: 4640650 - DNA, 17 bp, Homo sapiens
tggaggtctccaggggc

SEQ ID NO: 4640651 - DNA, 18 bp, Homo sapiens
tggaggtctccaggggcc

SEQ ID NO: 4640652 - DNA, 13 bp, Homo sapiens
tggagtagcctgg

SEQ ID NO: 4640653 - DNA, 12 bp, Homo sapiens
tggagtcattca

SEQ ID NO: 4640654 - DNA, 15 bp, Homo sapiens
tggagtctcactctt

SEQ ID NO: 4640655 - DNA, 19 bp, Homo sapiens
tggataaaataatgctgca

SEQ ID NO: 4640656 - DNA, 15 bp, Homo sapiens
tggataagtggctgt

SEQ ID NO: 4640657 - DNA, 21 bp, Homo sapiens
tggataagtggctgtttcatc

SEQ ID NO: 4640658 - DNA, 13 bp, Homo sapiens
tggataagtttct

SEQ ID NO: 4640659 - DNA, 19 bp, Homo sapiens
tggataagtttctattctg

SEQ ID NO: 4640660 - DNA, 16 bp, Homo sapiens
tggatcagtcctttga

SEQ ID NO: 4640661 - DNA, 19 bp, Homo sapiens
tggatcagtcctttgatca

SEQ ID NO: 4640662 - DNA, 14 bp, Homo sapiens
tggatccaatgtta

SEQ ID NO: 4640663 - DNA, 23 bp, Homo sapiens
tggatccaatgttagagactttt

SEQ ID NO: 4640664 - DNA, 14 bp, Homo sapiens
tggatggcagactc

SEQ ID NO: 4640665 - DNA, 15 bp, Homo sapiens
tggatggcagactct

SEQ ID NO: 4640666 - DNA, 18 bp, Homo sapiens
tggatggctcaagtctgc

SEQ ID NO: 4640667 - DNA, 13 bp, Homo sapiens
tggatggcttcta

SEQ ID NO: 4640668 - DNA, 14 bp, Homo sapiens
tggattaaaccttt

SEQ ID NO: 4640669 - DNA, 18 bp, Homo sapiens
tggattaaacctttttat

SEQ ID NO: 4640670 - DNA, 13 bp, Homo sapiens
tggattaaattta

SEQ ID NO: 4640671 - DNA, 17 bp, Homo sapiens
tggattcattctcataa

SEQ ID NO: 4640672 - DNA, 18 bp, Homo sapiens
tggattcccttaaacaaa

SEQ ID NO: 4640673 - DNA, 17 bp, Homo sapiens
tggatttttgtcttgtg

SEQ ID NO: 4640674 - DNA, 17 bp, Homo sapiens
tggattttttattatta

SEQ ID NO: 4640675 - DNA, 14 bp, Homo sapiens
tggcaaaactcagg

SEQ ID NO: 4640676 - DNA, 15 bp, Homo sapiens
tggcaaaactcaggc

SEQ ID NO: 4640677 - DNA, 16 bp, Homo sapiens
tggcaaacgagacttt

SEQ ID NO: 4640678 - DNA, 20 bp, Homo sapiens
tggcaaacgagactttctcc

SEQ ID NO: 4640679 - DNA, 15 bp, Homo sapiens
tggcaacagaaacca

SEQ ID NO: 4640680 - DNA, 15 bp, Homo sapiens
tggcaatattcctta

SEQ ID NO: 4640681 - DNA, 14 bp, Homo sapiens
tggcacagaacagg

SEQ ID NO: 4640682 - DNA, 20 bp, Homo sapiens
tggcactgaccggtgctttt

SEQ ID NO: 4640683 - DNA, 22 bp, Homo sapiens
tggcactggtaggttgggacac

SEQ ID NO: 4640684 - DNA, 20 bp, Homo sapiens
tggcacttccacctccagcc

SEQ ID NO: 4640685 - DNA, 22 bp, Homo sapiens
tggcacttccacctccagcctc

SEQ ID NO: 4640686 - DNA, 11 bp, Homo sapiens
tggcagactct

SEQ ID NO: 4640687 - DNA, 12 bp, Homo sapiens
tggcagactctt

SEQ ID NO: 4640688 - DNA, 22 bp, Homo sapiens
tggcagactctttaataaattg

SEQ ID NO: 4640689 - DNA, 14 bp, Homo sapiens
tggcagattcaaat

SEQ ID NO: 4640690 - DNA, 21 bp, Homo sapiens
tggcagccacacttctcagga

SEQ ID NO: 4640691 - DNA, 20 bp, Homo sapiens
tggcagcctcccatccaggg

SEQ ID NO: 4640692 - DNA, 21 bp, Homo sapiens
tggcagcctcccatccagggc

SEQ ID NO: 4640693 - DNA, 14 bp, Homo sapiens
tggcagggaccggc

SEQ ID NO: 4640694 - DNA, 21 bp, Homo sapiens
tggcagggaccggcagagctc

SEQ ID NO: 4640695 - DNA, 14 bp, Homo sapiens
tggcaggggagcag

SEQ ID NO: 4640696 - DNA, 15 bp, Homo sapiens
tggcaggggagcagg

SEQ ID NO: 4640697 - DNA, 14 bp, Homo sapiens
tggcagtggcagag

SEQ ID NO: 4640698 - DNA, 18 bp, Homo sapiens
tggcagtggcagagaatc

SEQ ID NO: 4640699 - DNA, 14 bp, Homo sapiens
tggcatgttgattt

SEQ ID NO: 4640700 - DNA, 17 bp, Homo sapiens
tggcatttctctttaaa

SEQ ID NO: 4640701 - DNA, 23 bp, Homo sapiens
tggcatttctctttaaactatgt

SEQ ID NO: 4640702 - DNA, 14 bp, Homo sapiens
tggcatttttgctt

SEQ ID NO: 4640703 - DNA, 13 bp, Homo sapiens
tggccaagctgag

SEQ ID NO: 4640704 - DNA, 14 bp, Homo sapiens
tggccaagctgagg

SEQ ID NO: 4640705 - DNA, 16 bp, Homo sapiens
tggccaagttcttagt

SEQ ID NO: 4640706 - DNA, 12 bp, Homo sapiens
tggccacagcct

SEQ ID NO: 4640707 - DNA, 19 bp, Homo sapiens
tggccacagccttccctct

SEQ ID NO: 4640708 - DNA, 13 bp, Homo sapiens
tggccaggcctag

SEQ ID NO: 4640709 - DNA, 15 bp, Homo sapiens
tggccaggctggttt

SEQ ID NO: 4640710 - DNA, 16 bp, Homo sapiens
tggccaggggccagga

SEQ ID NO: 4640711 - DNA, 23 bp, Homo sapiens
tggccaggggccaggagtgggga

SEQ ID NO: 4640712 - DNA, 13 bp, Homo sapiens
tggccatcatcct

SEQ ID NO: 4640713 - DNA, 12 bp, Homo sapiens
tggccccaggac

SEQ ID NO: 4640714 - DNA, 20 bp, Homo sapiens
tggccccaggacctggctgc

SEQ ID NO: 4640715 - DNA, 20 bp, Homo sapiens
tggcccctaggctgctgctg

SEQ ID NO: 4640716 - DNA, 20 bp, Homo sapiens
tggcccctccaatcctcccc

SEQ ID NO: 4640717 - DNA, 20 bp, Homo sapiens
tggccctgctttctacgcca

SEQ ID NO: 4640718 - DNA, 21 bp, Homo sapiens
tggcccttacttgcttctcta

SEQ ID NO: 4640719 - DNA, 15 bp, Homo sapiens
tggcccttcccggca

SEQ ID NO: 4640720 - DNA, 21 bp, Homo sapiens
tggcccttcctggacagctgt

SEQ ID NO: 4640721 - DNA, 13 bp, Homo sapiens
tggcctaaatttc

SEQ ID NO: 4640722 - DNA, 13 bp, Homo sapiens
tggcctcagagct

SEQ ID NO: 4640723 - DNA, 17 bp, Homo sapiens
tggcctcagagcttcct

SEQ ID NO: 4640724 - DNA, 22 bp, Homo sapiens
tggcctcagctgaatgcctcct

SEQ ID NO: 4640725 - DNA, 20 bp, Homo sapiens
tggcctcccaaatgagccat

SEQ ID NO: 4640726 - DNA, 16 bp, Homo sapiens
tggcctgaactgagga

SEQ ID NO: 4640727 - DNA, 17 bp, Homo sapiens
tggcctgaactgaggag

SEQ ID NO: 4640728 - DNA, 12 bp, Homo sapiens
tggcctggcaca

SEQ ID NO: 4640729 - DNA, 15 bp, Homo sapiens
tggcctgtgatgttt

SEQ ID NO: 4640730 - DNA, 16 bp, Homo sapiens
tggccttaaagaggga

SEQ ID NO: 4640731 - DNA, 21 bp, Homo sapiens
tggccttctaggaatggagga

SEQ ID NO: 4640732 - DNA, 18 bp, Homo sapiens
tggccttgggccctctgg

SEQ ID NO: 4640733 - DNA, 19 bp, Homo sapiens
tggccttgttctgtcacca

SEQ ID NO: 4640734 - DNA, 13 bp, Homo sapiens
tggccttttgata

SEQ ID NO: 4640735 - DNA, 15 bp, Homo sapiens
tggcgcaatctcagc

SEQ ID NO: 4640736 - DNA, 23 bp, Homo sapiens
tggctactccctggaccacgagg

SEQ ID NO: 4640737 - DNA, 14 bp, Homo sapiens
tggctactctgtgc

SEQ ID NO: 4640738 - DNA, 16 bp, Homo sapiens
tggctactctgtgcca

SEQ ID NO: 4640739 - DNA, 19 bp, Homo sapiens
tggctactctgtgccagag

SEQ ID NO: 4640740 - DNA, 20 bp, Homo sapiens
tggctactctgtgccagagc

SEQ ID NO: 4640741 - DNA, 20 bp, Homo sapiens
tggctccagatgcagggcag

SEQ ID NO: 4640742 - DNA, 21 bp, Homo sapiens
tggctccagatgcagggcagt

SEQ ID NO: 4640743 - DNA, 23 bp, Homo sapiens
tggctccagatgcagggcagtca

SEQ ID NO: 4640744 - DNA, 15 bp, Homo sapiens
tggctcccagggcca

SEQ ID NO: 4640745 - DNA, 21 bp, Homo sapiens
tggctccctctctcctggact

SEQ ID NO: 4640746 - DNA, 23 bp, Homo sapiens
tggctccctctctcctggactgg

SEQ ID NO: 4640747 - DNA, 11 bp, Homo sapiens
tggctctgctg

SEQ ID NO: 4640748 - DNA, 15 bp, Homo sapiens
tggctgaactacaag

SEQ ID NO: 4640749 - DNA, 14 bp, Homo sapiens
tggctgagggcagt

SEQ ID NO: 4640750 - DNA, 16 bp, Homo sapiens
tggctgattcagcatt

SEQ ID NO: 4640751 - DNA, 15 bp, Homo sapiens
tggctgcttcctgtg

SEQ ID NO: 4640752 - DNA, 12 bp, Homo sapiens
tggctggctgag

SEQ ID NO: 4640753 - DNA, 14 bp, Homo sapiens
tggctggctgaggg

SEQ ID NO: 4640754 - DNA, 15 bp, Homo sapiens
tggctggctgagggc

SEQ ID NO: 4640755 - DNA, 17 bp, Homo sapiens
tggctggtgggaaggcc

SEQ ID NO: 4640756 - DNA, 15 bp, Homo sapiens
tggctgtatttgctg

SEQ ID NO: 4640757 - DNA, 14 bp, Homo sapiens
tggcttcactcctg

SEQ ID NO: 4640758 - DNA, 18 bp, Homo sapiens
tggcttcactcctgctgt

SEQ ID NO: 4640759 - DNA, 19 bp, Homo sapiens
tggcttcactcctgctgta

SEQ ID NO: 4640760 - DNA, 14 bp, Homo sapiens
tggcttcccatccc

SEQ ID NO: 4640761 - DNA, 15 bp, Homo sapiens
tggcttcccatcccc

SEQ ID NO: 4640762 - DNA, 18 bp, Homo sapiens
tggcttcccatccccagc

SEQ ID NO: 4640763 - DNA, 19 bp, Homo sapiens
tggcttctgttgtcacctt

SEQ ID NO: 4640764 - DNA, 22 bp, Homo sapiens
tggcttggggtcaagaaacagc

SEQ ID NO: 4640765 - DNA, 23 bp, Homo sapiens
tggcttggggtcaagaaacagcc

SEQ ID NO: 4640766 - DNA, 16 bp, Homo sapiens
tgggaaggccggcagc

SEQ ID NO: 4640767 - DNA, 23 bp, Homo sapiens
tgggaaggctacttcggggctgg

SEQ ID NO: 4640768 - DNA, 18 bp, Homo sapiens
tgggacaagcaggccgcc

SEQ ID NO: 4640769 - DNA, 13 bp, Homo sapiens
tgggacaccaggg

SEQ ID NO: 4640770 - DNA, 18 bp, Homo sapiens
tgggacagcccagagcct

SEQ ID NO: 4640771 - DNA, 17 bp, Homo sapiens
tgggaccaacctgacct

SEQ ID NO: 4640772 - DNA, 15 bp, Homo sapiens
tgggaccgctacacc

SEQ ID NO: 4640773 - DNA, 21 bp, Homo sapiens
tgggaccgctacaccactctg

SEQ ID NO: 4640774 - DNA, 20 bp, Homo sapiens
tgggacgtggctcagccagc

SEQ ID NO: 4640775 - DNA, 21 bp, Homo sapiens
tgggacgtggctcagccagca

SEQ ID NO: 4640776 - DNA, 16 bp, Homo sapiens
tgggactgtggtgact

SEQ ID NO: 4640777 - DNA, 13 bp, Homo sapiens
tgggacttttctt

SEQ ID NO: 4640778 - DNA, 18 bp, Homo sapiens
tgggagaaattgacagat

SEQ ID NO: 4640779 - DNA, 19 bp, Homo sapiens
tgggagaaattgacagatc

SEQ ID NO: 4640780 - DNA, 22 bp, Homo sapiens
tgggagctgaggccacactcag

SEQ ID NO: 4640781 - DNA, 15 bp, Homo sapiens
tgggaggaaatttga

SEQ ID NO: 4640782 - DNA, 15 bp, Homo sapiens
tgggaggaggaaaag

SEQ ID NO: 4640783 - DNA, 13 bp, Homo sapiens
tgggaggaggcct

SEQ ID NO: 4640784 - DNA, 16 bp, Homo sapiens
tgggagggaggctcag

SEQ ID NO: 4640785 - DNA, 22 bp, Homo sapiens
tgggagggaggctcaggtccct

SEQ ID NO: 4640786 - DNA, 15 bp, Homo sapiens
tgggaggtaaggaaa

SEQ ID NO: 4640787 - DNA, 17 bp, Homo sapiens
tgggagtatacggaaac

SEQ ID NO: 4640788 - DNA, 13 bp, Homo sapiens
tgggataggaaaa

SEQ ID NO: 4640789 - DNA, 21 bp, Homo sapiens
tgggatatcattttaaaaact

SEQ ID NO: 4640790 - DNA, 16 bp, Homo sapiens
tgggatgcccttcccc

SEQ ID NO: 4640791 - DNA, 17 bp, Homo sapiens
tgggatgcccttccccc

SEQ ID NO: 4640792 - DNA, 21 bp, Homo sapiens
tgggatggtcggatctcacag

SEQ ID NO: 4640793 - DNA, 21 bp, Homo sapiens
tgggattacaggcgcctgcca

SEQ ID NO: 4640794 - DNA, 13 bp, Homo sapiens
tgggcaaagcttg

SEQ ID NO: 4640795 - DNA, 23 bp, Homo sapiens
tgggcaaagcttgtcaaagatgc

SEQ ID NO: 4640796 - DNA, 18 bp, Homo sapiens
tgggcaatggccaggggc

SEQ ID NO: 4640797 - DNA, 16 bp, Homo sapiens
tgggcacaattcctgt

SEQ ID NO: 4640798 - DNA, 21 bp, Homo sapiens
tgggcacaattcctgtgctca

SEQ ID NO: 4640799 - DNA, 23 bp, Homo sapiens
tgggcacccccagcctgggccta

SEQ ID NO: 4640800 - DNA, 21 bp, Homo sapiens
tgggcactccgcgccgatgcc

SEQ ID NO: 4640801 - DNA, 23 bp, Homo sapiens
tgggcactccgcgccgatgccac

SEQ ID NO: 4640802 - DNA, 12 bp, Homo sapiens
tgggcagaggaa

SEQ ID NO: 4640803 - DNA, 16 bp, Homo sapiens
tgggcagagtcctgcc

SEQ ID NO: 4640804 - DNA, 12 bp, Homo sapiens
tgggcagccaga

SEQ ID NO: 4640805 - DNA, 19 bp, Homo sapiens
tgggcagcgcccttcctct

SEQ ID NO: 4640806 - DNA, 20 bp, Homo sapiens
tgggcagcgcccttcctctc

SEQ ID NO: 4640807 - DNA, 21 bp, Homo sapiens
tgggcagcgcccttcctctcc

SEQ ID NO: 4640808 - DNA, 14 bp, Homo sapiens
tgggcattgctttc

SEQ ID NO: 4640809 - DNA, 15 bp, Homo sapiens
tgggcattgctttcc

SEQ ID NO: 4640810 - DNA, 20 bp, Homo sapiens
tgggcattgctttccactga

SEQ ID NO: 4640811 - DNA, 19 bp, Homo sapiens
tgggccaccgtgcctggct

SEQ ID NO: 4640812 - DNA, 14 bp, Homo sapiens
tgggccactgggga

SEQ ID NO: 4640813 - DNA, 22 bp, Homo sapiens
tgggccactggggactttattt

SEQ ID NO: 4640814 - DNA, 13 bp, Homo sapiens
tgggccagggtct

SEQ ID NO: 4640815 - DNA, 19 bp, Homo sapiens
tgggccagggtctgtgtga

SEQ ID NO: 4640816 - DNA, 18 bp, Homo sapiens
tgggccataattatgaaa

SEQ ID NO: 4640817 - DNA, 18 bp, Homo sapiens
tgggccatgttgtgcctc

SEQ ID NO: 4640818 - DNA, 23 bp, Homo sapiens
tgggcccatctctccctgcgcac

SEQ ID NO: 4640819 - DNA, 23 bp, Homo sapiens
tgggccccgggctggagaaagag

SEQ ID NO: 4640820 - DNA, 19 bp, Homo sapiens
tgggccctggggcctgtac

SEQ ID NO: 4640821 - DNA, 18 bp, Homo sapiens
tgggcctatggagagccc

SEQ ID NO: 4640822 - DNA, 19 bp, Homo sapiens
tgggcctatggagagccct

SEQ ID NO: 4640823 - DNA, 13 bp, Homo sapiens
tgggcctgctgct

SEQ ID NO: 4640824 - DNA, 13 bp, Homo sapiens
tgggcctggccct

SEQ ID NO: 4640825 - DNA, 23 bp, Homo sapiens
tgggccttagtgggccagggctg

SEQ ID NO: 4640826 - DNA, 17 bp, Homo sapiens
tgggcgggcaggggagg

SEQ ID NO: 4640827 - DNA, 22 bp, Homo sapiens
tgggcgggcaggggagggtcag

SEQ ID NO: 4640828 - DNA, 14 bp, Homo sapiens
tgggctcaagcttt

SEQ ID NO: 4640829 - DNA, 16 bp, Homo sapiens
tgggctcagcagggct

SEQ ID NO: 4640830 - DNA, 23 bp, Homo sapiens
tgggctcagcagggctggtcacc

SEQ ID NO: 4640831 - DNA, 15 bp, Homo sapiens
tgggctcctccaggg

SEQ ID NO: 4640832 - DNA, 17 bp, Homo sapiens
tgggctctaaggtactg

SEQ ID NO: 4640833 - DNA, 13 bp, Homo sapiens
tgggctctgcctg

SEQ ID NO: 4640834 - DNA, 19 bp, Homo sapiens
tgggctctggactccacgg

SEQ ID NO: 4640835 - DNA, 20 bp, Homo sapiens
tgggctgacccagcatctcc

SEQ ID NO: 4640836 - DNA, 18 bp, Homo sapiens
tgggctgacggtgcagtc

SEQ ID NO: 4640837 - DNA, 14 bp, Homo sapiens
tgggctgggccctc

SEQ ID NO: 4640838 - DNA, 18 bp, Homo sapiens
tgggctggggaggaggag

SEQ ID NO: 4640839 - DNA, 19 bp, Homo sapiens
tgggctggggaggaggaga

SEQ ID NO: 4640840 - DNA, 22 bp, Homo sapiens
tgggcttccccaggtggcctgg

SEQ ID NO: 4640841 - DNA, 11 bp, Homo sapiens
tggggaaaggg

SEQ ID NO: 4640842 - DNA, 20 bp, Homo sapiens
tggggaaaggggttggggtg

SEQ ID NO: 4640843 - DNA, 16 bp, Homo sapiens
tggggacttgtgtctg

SEQ ID NO: 4640844 - DNA, 18 bp, Homo sapiens
tggggaggacaaaacttc

SEQ ID NO: 4640845 - DNA, 15 bp, Homo sapiens
tggggaggaggagag

SEQ ID NO: 4640846 - DNA, 13 bp, Homo sapiens
tggggcagcactc

SEQ ID NO: 4640847 - DNA, 15 bp, Homo sapiens
tggggcagctcctct

SEQ ID NO: 4640848 - DNA, 16 bp, Homo sapiens
tggggcagctcctctg

SEQ ID NO: 4640849 - DNA, 14 bp, Homo sapiens
tggggcaggagtag

SEQ ID NO: 4640850 - DNA, 18 bp, Homo sapiens
tggggcaggagtagctga

SEQ ID NO: 4640851 - DNA, 20 bp, Homo sapiens
tggggcaggagtagctgagc

SEQ ID NO: 4640852 - DNA, 19 bp, Homo sapiens
tggggccactttcagagcc

SEQ ID NO: 4640853 - DNA, 12 bp, Homo sapiens
tggggccaggcc

SEQ ID NO: 4640854 - DNA, 11 bp, Homo sapiens
tggggcctgag

SEQ ID NO: 4640855 - DNA, 18 bp, Homo sapiens
tggggcctgagagaattg

SEQ ID NO: 4640856 - DNA, 21 bp, Homo sapiens
tggggcctgtggaatgagtgt

SEQ ID NO: 4640857 - DNA, 17 bp, Homo sapiens
tggggctctaacgcctg

SEQ ID NO: 4640858 - DNA, 21 bp, Homo sapiens
tggggctctaacgcctgagcc

SEQ ID NO: 4640859 - DNA, 14 bp, Homo sapiens
tggggctggcctcc

SEQ ID NO: 4640860 - DNA, 16 bp, Homo sapiens
tggggctggttctgta

SEQ ID NO: 4640861 - DNA, 13 bp, Homo sapiens
tgggggaagagga

SEQ ID NO: 4640862 - DNA, 15 bp, Homo sapiens
tgggggcctggctgg

SEQ ID NO: 4640863 - DNA, 17 bp, Homo sapiens
tgggggcctggctggct

SEQ ID NO: 4640864 - DNA, 23 bp, Homo sapiens
tgggggggctcccgtggcctgta

SEQ ID NO: 4640865 - DNA, 20 bp, Homo sapiens
tggggggtgatgagggcagc

SEQ ID NO: 4640866 - DNA, 18 bp, Homo sapiens
tggggtagaaacattgta

SEQ ID NO: 4640867 - DNA, 22 bp, Homo sapiens
tggggtcaagaaacagccagca

SEQ ID NO: 4640868 - DNA, 22 bp, Homo sapiens
tggggtcaagctgagctggctt

SEQ ID NO: 4640869 - DNA, 17 bp, Homo sapiens
tggggtctggcagcctc

SEQ ID NO: 4640870 - DNA, 15 bp, Homo sapiens
tggggtgaatactta

SEQ ID NO: 4640871 - DNA, 15 bp, Homo sapiens
tggggtgacagtcat

SEQ ID NO: 4640872 - DNA, 13 bp, Homo sapiens
tggggtggacctg

SEQ ID NO: 4640873 - DNA, 17 bp, Homo sapiens
tggggtggacctgggac

SEQ ID NO: 4640874 - DNA, 16 bp, Homo sapiens
tgggtaccatgctttt

SEQ ID NO: 4640875 - DNA, 15 bp, Homo sapiens
tgggtccatcctggt

SEQ ID NO: 4640876 - DNA, 22 bp, Homo sapiens
tgggtcgtagagccttgacaat

SEQ ID NO: 4640877 - DNA, 19 bp, Homo sapiens
tgggtggctactctgtgcc

SEQ ID NO: 4640878 - DNA, 18 bp, Homo sapiens
tgggtgggcctggccctg

SEQ ID NO: 4640879 - DNA, 19 bp, Homo sapiens
tgggtgggcctggccctgc

SEQ ID NO: 4640880 - DNA, 16 bp, Homo sapiens
tgggtggggtattttt

SEQ ID NO: 4640881 - DNA, 20 bp, Homo sapiens
tgggtgtcatttcattccat

SEQ ID NO: 4640882 - DNA, 20 bp, Homo sapiens
tggtaaaacagtttcatcta

SEQ ID NO: 4640883 - DNA, 16 bp, Homo sapiens
tggtaagcgatttgaa

SEQ ID NO: 4640884 - DNA, 18 bp, Homo sapiens
tggtaagcgatttgaaac

SEQ ID NO: 4640885 - DNA, 20 bp, Homo sapiens
tggtaagcgatttgaaacac

SEQ ID NO: 4640886 - DNA, 13 bp, Homo sapiens
tggtaattttgat

SEQ ID NO: 4640887 - DNA, 16 bp, Homo sapiens
tggtaattttgatttc

SEQ ID NO: 4640888 - DNA, 15 bp, Homo sapiens
tggtacatggtgttt

SEQ ID NO: 4640889 - DNA, 22 bp, Homo sapiens
tggtacttaagctcccctgcct

SEQ ID NO: 4640890 - DNA, 13 bp, Homo sapiens
tggtacttcctct

SEQ ID NO: 4640891 - DNA, 14 bp, Homo sapiens
tggtacttcctctg

SEQ ID NO: 4640892 - DNA, 18 bp, Homo sapiens
tggtaggttgggacacca

SEQ ID NO: 4640893 - DNA, 21 bp, Homo sapiens
tggtaggttgggacaccaggg

SEQ ID NO: 4640894 - DNA, 13 bp, Homo sapiens
tggtatagaaatg

SEQ ID NO: 4640895 - DNA, 14 bp, Homo sapiens
tggtatagaaatgc

SEQ ID NO: 4640896 - DNA, 14 bp, Homo sapiens
tggtatcctactga

SEQ ID NO: 4640897 - DNA, 23 bp, Homo sapiens
tggtatgaaataaattctgactt

SEQ ID NO: 4640898 - DNA, 20 bp, Homo sapiens
tggtattcaactaatacatg

SEQ ID NO: 4640899 - DNA, 20 bp, Homo sapiens
tggtatttgtttgtagcttt

SEQ ID NO: 4640900 - DNA, 22 bp, Homo sapiens
tggtatttgtttgtagctttcc

SEQ ID NO: 4640901 - DNA, 14 bp, Homo sapiens
tggtattttatttt

SEQ ID NO: 4640902 - DNA, 15 bp, Homo sapiens
tggtattttcaacca

SEQ ID NO: 4640903 - DNA, 14 bp, Homo sapiens
tggtcaacctcctg

SEQ ID NO: 4640904 - DNA, 13 bp, Homo sapiens
tggtcataaaata

SEQ ID NO: 4640905 - DNA, 15 bp, Homo sapiens
tggtcataaaataga

SEQ ID NO: 4640906 - DNA, 22 bp, Homo sapiens
tggtcatgaattcatactctgt

SEQ ID NO: 4640907 - DNA, 22 bp, Homo sapiens
tggtcatttggcagcccctgtt

SEQ ID NO: 4640908 - DNA, 19 bp, Homo sapiens
tggtcccacatccctgggc

SEQ ID NO: 4640909 - DNA, 21 bp, Homo sapiens
tggtcccacatccctgggcct

SEQ ID NO: 4640910 - DNA, 13 bp, Homo sapiens
tggtcccttaagg

SEQ ID NO: 4640911 - DNA, 16 bp, Homo sapiens
tggtcggatctcacag

SEQ ID NO: 4640912 - DNA, 22 bp, Homo sapiens
tggtcggatctcacaggctgag

SEQ ID NO: 4640913 - DNA, 14 bp, Homo sapiens
tggtctagaccagg

SEQ ID NO: 4640914 - DNA, 16 bp, Homo sapiens
tggtctagaccagggc

SEQ ID NO: 4640915 - DNA, 22 bp, Homo sapiens
tggtctcaaaatggtgtgctat

SEQ ID NO: 4640916 - DNA, 17 bp, Homo sapiens
tggtctggttgggcagc

SEQ ID NO: 4640917 - DNA, 15 bp, Homo sapiens
tggtcttagctttac

SEQ ID NO: 4640918 - DNA, 18 bp, Homo sapiens
tggtcttaggtcttcctg

SEQ ID NO: 4640919 - DNA, 19 bp, Homo sapiens
tggtcttaggtcttcctgt

SEQ ID NO: 4640920 - DNA, 21 bp, Homo sapiens
tggtcttaggtcttcctgtgg

SEQ ID NO: 4640921 - DNA, 19 bp, Homo sapiens
tggtcttgtggttgtgtgt

SEQ ID NO: 4640922 - DNA, 20 bp, Homo sapiens
tggtgaattttcaaggcctt

SEQ ID NO: 4640923 - DNA, 16 bp, Homo sapiens
tggtgacttctgctgc

SEQ ID NO: 4640924 - DNA, 19 bp, Homo sapiens
tggtgacttgtctgcctcc

SEQ ID NO: 4640925 - DNA, 22 bp, Homo sapiens
tggtgacttgtctgcctcctgc

SEQ ID NO: 4640926 - DNA, 13 bp, Homo sapiens
tggtgcagacaga

SEQ ID NO: 4640927 - DNA, 21 bp, Homo sapiens
tggtgcaggtagacctgtctc

SEQ ID NO: 4640928 - DNA, 13 bp, Homo sapiens
tggtgcctggcct

SEQ ID NO: 4640929 - DNA, 24 bp, Homo sapiens
tggtgcctggcctggcacacatca

SEQ ID NO: 4640930 - DNA, 23 bp, Homo sapiens
tggtgccttaccaagttgtgctt

SEQ ID NO: 4640931 - DNA, 13 bp, Homo sapiens
tggtgctatttga

SEQ ID NO: 4640932 - DNA, 18 bp, Homo sapiens
tggtgctatttgaagaaa

SEQ ID NO: 4640933 - DNA, 10 bp, Homo sapiens
tggtggcctc

SEQ ID NO: 4640934 - DNA, 13 bp, Homo sapiens
tggtggcctcagc

SEQ ID NO: 4640935 - DNA, 14 bp, Homo sapiens
tggtggctgtggaa

SEQ ID NO: 4640936 - DNA, 16 bp, Homo sapiens
tggtggtattttattt

SEQ ID NO: 4640937 - DNA, 11 bp, Homo sapiens
tggtgtgaagg

SEQ ID NO: 4640938 - DNA, 23 bp, Homo sapiens
tggttaccactcttttgctgtgc

SEQ ID NO: 4640939 - DNA, 20 bp, Homo sapiens
tggttcacttcaaagctaaa

SEQ ID NO: 4640940 - DNA, 15 bp, Homo sapiens
tggttctaggctgct

SEQ ID NO: 4640941 - DNA, 17 bp, Homo sapiens
tggttgcagtctttccc

SEQ ID NO: 4640942 - DNA, 13 bp, Homo sapiens
tggttgcctgggg

SEQ ID NO: 4640943 - DNA, 12 bp, Homo sapiens
tggttggttttt

SEQ ID NO: 4640944 - DNA, 15 bp, Homo sapiens
tggttggtttttaca

SEQ ID NO: 4640945 - DNA, 17 bp, Homo sapiens
tggtttcaaactcctga

SEQ ID NO: 4640946 - DNA, 19 bp, Homo sapiens
tggtttgcctgaggctgta

SEQ ID NO: 4640947 - DNA, 17 bp, Homo sapiens
tggttttattacaaatg

SEQ ID NO: 4640948 - DNA, 22 bp, Homo sapiens
tgtaaaaaatgtctcatgtcaa

SEQ ID NO: 4640949 - DNA, 20 bp, Homo sapiens
tgtaaaaacagcattgcttt

SEQ ID NO: 4640950 - DNA, 18 bp, Homo sapiens
tgtaaacagcctcttttt

SEQ ID NO: 4640951 - DNA, 23 bp, Homo sapiens
tgtaaaccacaaggctgttgcat

SEQ ID NO: 4640952 - DNA, 15 bp, Homo sapiens
tgtaaaccattgtaa

SEQ ID NO: 4640953 - DNA, 16 bp, Homo sapiens
tgtaaaccattgtaac

SEQ ID NO: 4640954 - DNA, 21 bp, Homo sapiens
tgtaaaccattgtaactatta

SEQ ID NO: 4640955 - DNA, 13 bp, Homo sapiens
tgtaaacttctga

SEQ ID NO: 4640956 - DNA, 17 bp, Homo sapiens
tgtaaacttggaatcaa

SEQ ID NO: 4640957 - DNA, 18 bp, Homo sapiens
tgtaaacttggaatcaag

SEQ ID NO: 4640958 - DNA, 12 bp, Homo sapiens
tgtaaagactgg

SEQ ID NO: 4640959 - DNA, 20 bp, Homo sapiens
tgtaaatatgtgacattcct

SEQ ID NO: 4640960 - DNA, 15 bp, Homo sapiens
tgtaaatcctgtgtt

SEQ ID NO: 4640961 - DNA, 17 bp, Homo sapiens
tgtaaatcctgtgtttc

SEQ ID NO: 4640962 - DNA, 17 bp, Homo sapiens
tgtaactaatagatttt

SEQ ID NO: 4640963 - DNA, 16 bp, Homo sapiens
tgtaactgagagaaag

SEQ ID NO: 4640964 - DNA, 22 bp, Homo sapiens
tgtaagcatactttgtaaatag

SEQ ID NO: 4640965 - DNA, 12 bp, Homo sapiens
tgtaaggggaag

SEQ ID NO: 4640966 - DNA, 15 bp, Homo sapiens
tgtaagtgaaattaa

SEQ ID NO: 4640967 - DNA, 19 bp, Homo sapiens
tgtaataactttcttacca

SEQ ID NO: 4640968 - DNA, 19 bp, Homo sapiens
tgtaatataccagcttgta

SEQ ID NO: 4640969 - DNA, 16 bp, Homo sapiens
tgtaatatgacagata

SEQ ID NO: 4640970 - DNA, 22 bp, Homo sapiens
tgtaatatggaaatcttttaca

SEQ ID NO: 4640971 - DNA, 17 bp, Homo sapiens
tgtaatattgagggata

SEQ ID NO: 4640972 - DNA, 18 bp, Homo sapiens
tgtaatatttagctgtaa

SEQ ID NO: 4640973 - DNA, 17 bp, Homo sapiens
tgtaatatttcttcaaa

SEQ ID NO: 4640974 - DNA, 20 bp, Homo sapiens
tgtaatcaggcaaggaggag

SEQ ID NO: 4640975 - DNA, 14 bp, Homo sapiens
tgtaatcatttgtt

SEQ ID NO: 4640976 - DNA, 21 bp, Homo sapiens
tgtaatcctagctacttggca

SEQ ID NO: 4640977 - DNA, 12 bp, Homo sapiens
tgtaatgcactg

SEQ ID NO: 4640978 - DNA, 18 bp, Homo sapiens
tgtaatgcactgttttta

SEQ ID NO: 4640979 - DNA, 18 bp, Homo sapiens
tgtaatgtgtggtggcct

SEQ ID NO: 4640980 - DNA, 20 bp, Homo sapiens
tgtaatgtgtggtggcctca

SEQ ID NO: 4640981 - DNA, 19 bp, Homo sapiens
tgtaatttaatgcctgccc

SEQ ID NO: 4640982 - DNA, 21 bp, Homo sapiens
tgtacaaatacatgtgtatat

SEQ ID NO: 4640983 - DNA, 20 bp, Homo sapiens
tgtacaaattgtcgttttta

SEQ ID NO: 4640984 - DNA, 16 bp, Homo sapiens
tgtacacgtgtcctgt

SEQ ID NO: 4640985 - DNA, 15 bp, Homo sapiens
tgtacagaagagcaa

SEQ ID NO: 4640986 - DNA, 19 bp, Homo sapiens
tgtacaggatgctttggtt

SEQ ID NO: 4640987 - DNA, 12 bp, Homo sapiens
tgtacagtcttg

SEQ ID NO: 4640988 - DNA, 11 bp, Homo sapiens
tgtacatgtgt

SEQ ID NO: 4640989 - DNA, 14 bp, Homo sapiens
tgtacattatgaag

SEQ ID NO: 4640990 - DNA, 15 bp, Homo sapiens
tgtacattatgaaga

SEQ ID NO: 4640991 - DNA, 17 bp, Homo sapiens
tgtacattatgaagaat

SEQ ID NO: 4640992 - DNA, 20 bp, Homo sapiens
tgtacattttgtaaaatatt

SEQ ID NO: 4640993 - DNA, 18 bp, Homo sapiens
tgtaccatatgatctgtt

SEQ ID NO: 4640994 - DNA, 12 bp, Homo sapiens
tgtacccaccgg

SEQ ID NO: 4640995 - DNA, 18 bp, Homo sapiens
tgtactaggatactgctg

SEQ ID NO: 4640996 - DNA, 15 bp, Homo sapiens
tgtactattgcagac

SEQ ID NO: 4640997 - DNA, 14 bp, Homo sapiens
tgtactgcctgctt

SEQ ID NO: 4640998 - DNA, 23 bp, Homo sapiens
tgtacttcataagatattcttta

SEQ ID NO: 4640999 - DNA, 12 bp, Homo sapiens
tgtacttctctg

SEQ ID NO: 4641000 - DNA, 17 bp, Homo sapiens
tgtacttctctgtgtgc

SEQ ID NO: 4641001 - DNA, 18 bp, Homo sapiens
tgtacttctctgtgtgca

SEQ ID NO: 4641002 - DNA, 21 bp, Homo sapiens
tgtacttttagtagagacagt

SEQ ID NO: 4641003 - DNA, 21 bp, Homo sapiens
tgtactttttagtaatttctt

SEQ ID NO: 4641004 - DNA, 21 bp, Homo sapiens
tgtagaaaagggaactgaaca

SEQ ID NO: 4641005 - DNA, 18 bp, Homo sapiens
tgtagaatagcctgtggc

SEQ ID NO: 4641006 - DNA, 15 bp, Homo sapiens
tgtagacaggaaagc

SEQ ID NO: 4641007 - DNA, 21 bp, Homo sapiens
tgtagacatgcccaaaactta

SEQ ID NO: 4641008 - DNA, 22 bp, Homo sapiens
tgtagactcttgctcctgcttc

SEQ ID NO: 4641009 - DNA, 16 bp, Homo sapiens
tgtagagtttttggaa

SEQ ID NO: 4641010 - DNA, 17 bp, Homo sapiens
tgtagccaggtatggct

SEQ ID NO: 4641011 - DNA, 21 bp, Homo sapiens
tgtagccaggtatggctctgc

SEQ ID NO: 4641012 - DNA, 22 bp, Homo sapiens
tgtagccaggtatggctctgca

SEQ ID NO: 4641013 - DNA, 17 bp, Homo sapiens
tgtagctgtaagggcag

SEQ ID NO: 4641014 - DNA, 20 bp, Homo sapiens
tgtagctgtaagggcagtgc

SEQ ID NO: 4641015 - DNA, 14 bp, Homo sapiens
tgtagctgtgacct

SEQ ID NO: 4641016 - DNA, 15 bp, Homo sapiens
tgtagctgtgacctg

SEQ ID NO: 4641017 - DNA, 17 bp, Homo sapiens
tgtagctgtgacctgct

SEQ ID NO: 4641018 - DNA, 19 bp, Homo sapiens
tgtagctgtgacctgctga

SEQ ID NO: 4641019 - DNA, 21 bp, Homo sapiens
tgtagctgtgacctgctgagc

SEQ ID NO: 4641020 - DNA, 22 bp, Homo sapiens
tgtagctgtgacctgctgagct

SEQ ID NO: 4641021 - DNA, 23 bp, Homo sapiens
tgtagctgtgacctgctgagctc

SEQ ID NO: 4641022 - DNA, 21 bp, Homo sapiens
tgtagcttcttctgaaagaat

SEQ ID NO: 4641023 - DNA, 18 bp, Homo sapiens
tgtagctttcctggaagt

SEQ ID NO: 4641024 - DNA, 14 bp, Homo sapiens
tgtaggagggactg

SEQ ID NO: 4641025 - DNA, 19 bp, Homo sapiens
tgtaggagggactgtcgct

SEQ ID NO: 4641026 - DNA, 18 bp, Homo sapiens
tgtaggatttttttcctc

SEQ ID NO: 4641027 - DNA, 23 bp, Homo sapiens
tgtaggccaccattataatttat

SEQ ID NO: 4641028 - DNA, 18 bp, Homo sapiens
tgtagtcaaaaaaggaaa

SEQ ID NO: 4641029 - DNA, 15 bp, Homo sapiens
tgtagtcataataaa

SEQ ID NO: 4641030 - DNA, 21 bp, Homo sapiens
tgtagtgagatagcattgtga

SEQ ID NO: 4641031 - DNA, 21 bp, Homo sapiens
tgtagtgagcgagtggatgct

SEQ ID NO: 4641032 - DNA, 15 bp, Homo sapiens
tgtagttccctctgc

SEQ ID NO: 4641033 - DNA, 16 bp, Homo sapiens
tgtagttccctctgcc

SEQ ID NO: 4641034 - DNA, 17 bp, Homo sapiens
tgtagttccctctgcct

SEQ ID NO: 4641035 - DNA, 20 bp, Homo sapiens
tgtagttccctctgcctggg

SEQ ID NO: 4641036 - DNA, 21 bp, Homo sapiens
tgtagttccctctgcctggga

SEQ ID NO: 4641037 - DNA, 20 bp, Homo sapiens
tgtagttgcgtggactctgc

SEQ ID NO: 4641038 - DNA, 17 bp, Homo sapiens
tgtataattaatgctta

SEQ ID NO: 4641039 - DNA, 13 bp, Homo sapiens
tgtatacatacat

SEQ ID NO: 4641040 - DNA, 15 bp, Homo sapiens
tgtatacatacatgt

SEQ ID NO: 4641041 - DNA, 14 bp, Homo sapiens
tgtatagttcacgt

SEQ ID NO: 4641042 - DNA, 17 bp, Homo sapiens
tgtatataagttgctgt

SEQ ID NO: 4641043 - DNA, 14 bp, Homo sapiens
tgtatattcctttt

SEQ ID NO: 4641044 - DNA, 21 bp, Homo sapiens
tgtatctacagtaatgaaatg

SEQ ID NO: 4641045 - DNA, 12 bp, Homo sapiens
tgtatctgttta

SEQ ID NO: 4641046 - DNA, 12 bp, Homo sapiens
tgtatcttaaat

SEQ ID NO: 4641047 - DNA, 19 bp, Homo sapiens
tgtatcttaaatctgtgaa

SEQ ID NO: 4641048 - DNA, 15 bp, Homo sapiens
tgtatcttaaatttg

SEQ ID NO: 4641049 - DNA, 23 bp, Homo sapiens
tgtatctttaaaaaaaaatcttg

SEQ ID NO: 4641050 - DNA, 20 bp, Homo sapiens
tgtatgacccctggccacag

SEQ ID NO: 4641051 - DNA, 16 bp, Homo sapiens
tgtatgatctctctag

SEQ ID NO: 4641052 - DNA, 18 bp, Homo sapiens
tgtatgggagcttaactt

SEQ ID NO: 4641053 - DNA, 14 bp, Homo sapiens
tgtatgtattatta

SEQ ID NO: 4641054 - DNA, 14 bp, Homo sapiens
tgtatgtcttggac

SEQ ID NO: 4641055 - DNA, 19 bp, Homo sapiens
tgtatgtcttggacactgt

SEQ ID NO: 4641056 - DNA, 21 bp, Homo sapiens
tgtattaagttgttaataaaa

SEQ ID NO: 4641057 - DNA, 18 bp, Homo sapiens
tgtattgattcaacaggg

SEQ ID NO: 4641058 - DNA, 14 bp, Homo sapiens
tgtatttctctgtg

SEQ ID NO: 4641059 - DNA, 15 bp, Homo sapiens
tgtatttctctgtga

SEQ ID NO: 4641060 - DNA, 17 bp, Homo sapiens
tgtatttctctgtgaat

SEQ ID NO: 4641061 - DNA, 15 bp, Homo sapiens
tgtatttgctgttga

SEQ ID NO: 4641062 - DNA, 16 bp, Homo sapiens
tgtcaagctggtgcta

SEQ ID NO: 4641063 - DNA, 17 bp, Homo sapiens
tgtcacattatttatta

SEQ ID NO: 4641064 - DNA, 11 bp, Homo sapiens
tgtcacattcc

SEQ ID NO: 4641065 - DNA, 23 bp, Homo sapiens
tgtcaccaatgtacccaccgggc

SEQ ID NO: 4641066 - DNA, 14 bp, Homo sapiens
tgtcacctccttcc

SEQ ID NO: 4641067 - DNA, 16 bp, Homo sapiens
tgtcacctccttcccc

SEQ ID NO: 4641068 - DNA, 17 bp, Homo sapiens
tgtcacctcgctgggct

SEQ ID NO: 4641069 - DNA, 15 bp, Homo sapiens
tgtcactagaatgga

SEQ ID NO: 4641070 - DNA, 14 bp, Homo sapiens
tgtcacttcttcac

SEQ ID NO: 4641071 - DNA, 19 bp, Homo sapiens
tgtcacttgactcttgaat

SEQ ID NO: 4641072 - DNA, 15 bp, Homo sapiens
tgtcagacataaagc

SEQ ID NO: 4641073 - DNA, 16 bp, Homo sapiens
tgtcagacataaagcc

SEQ ID NO: 4641074 - DNA, 17 bp, Homo sapiens
tgtcagacataaagcca

SEQ ID NO: 4641075 - DNA, 18 bp, Homo sapiens
tgtcagggtctccttcct

SEQ ID NO: 4641076 - DNA, 20 bp, Homo sapiens
tgtcagggtctccttccttc

SEQ ID NO: 4641077 - DNA, 14 bp, Homo sapiens
tgtcagtcacagcc

SEQ ID NO: 4641078 - DNA, 15 bp, Homo sapiens
tgtcagtcacagcca

SEQ ID NO: 4641079 - DNA, 16 bp, Homo sapiens
tgtcagtcacagccac

SEQ ID NO: 4641080 - DNA, 18 bp, Homo sapiens
tgtcagtggggctctctg

SEQ ID NO: 4641081 - DNA, 17 bp, Homo sapiens
tgtcagtgtagacacag

SEQ ID NO: 4641082 - DNA, 19 bp, Homo sapiens
tgtcagtgtagacacaggt

SEQ ID NO: 4641083 - DNA, 20 bp, Homo sapiens
tgtcagtgtagacacaggtc

SEQ ID NO: 4641084 - DNA, 16 bp, Homo sapiens
tgtcagttttgtacat

SEQ ID NO: 4641085 - DNA, 13 bp, Homo sapiens
tgtcatatcagca

SEQ ID NO: 4641086 - DNA, 17 bp, Homo sapiens
tgtcatatcagcacata

SEQ ID NO: 4641087 - DNA, 16 bp, Homo sapiens
tgtcatgtctgcttgt

SEQ ID NO: 4641088 - DNA, 14 bp, Homo sapiens
tgtccacctgtggg

SEQ ID NO: 4641089 - DNA, 14 bp, Homo sapiens
tgtccactgttctg

SEQ ID NO: 4641090 - DNA, 18 bp, Homo sapiens
tgtccactgttctgttct

SEQ ID NO: 4641091 - DNA, 10 bp, Homo sapiens
tgtccatctt

SEQ ID NO: 4641092 - DNA, 20 bp, Homo sapiens
tgtccatcttgtttcatttg

SEQ ID NO: 4641093 - DNA, 23 bp, Homo sapiens
tgtccatcttgtttcatttgctt

SEQ ID NO: 4641094 - DNA, 15 bp, Homo sapiens
tgtcccaaatccgcc

SEQ ID NO: 4641095 - DNA, 20 bp, Homo sapiens
tgtcccacccccttccccca

SEQ ID NO: 4641096 - DNA, 15 bp, Homo sapiens
tgtcccactatctgg

SEQ ID NO: 4641097 - DNA, 19 bp, Homo sapiens
tgtccccaaatccgaacct

SEQ ID NO: 4641098 - DNA, 20 bp, Homo sapiens
tgtccccatctaggtcctgg

SEQ ID NO: 4641099 - DNA, 15 bp, Homo sapiens
tgtccctcagcaaca

SEQ ID NO: 4641100 - DNA, 15 bp, Homo sapiens
tgtccctgcagggcc

SEQ ID NO: 4641101 - DNA, 16 bp, Homo sapiens
tgtccctgcagggcca

SEQ ID NO: 4641102 - DNA, 14 bp, Homo sapiens
tgtccctgggccag

SEQ ID NO: 4641103 - DNA, 22 bp, Homo sapiens
tgtcctaaagaagacattttct

SEQ ID NO: 4641104 - DNA, 22 bp, Homo sapiens
tgtcctagccaggtctcctggg

SEQ ID NO: 4641105 - DNA, 23 bp, Homo sapiens
tgtcctcttctgcatcttgggga

SEQ ID NO: 4641106 - DNA, 11 bp, Homo sapiens
tgtcctgtcct

SEQ ID NO: 4641107 - DNA, 13 bp, Homo sapiens
tgtcctgtcctgc

SEQ ID NO: 4641108 - DNA, 15 bp, Homo sapiens
tgtcctgtcctgctc

SEQ ID NO: 4641109 - DNA, 22 bp, Homo sapiens
tgtcgaaacctacaagatttcc

SEQ ID NO: 4641110 - DNA, 15 bp, Homo sapiens
tgtcgccacacgcct

SEQ ID NO: 4641111 - DNA, 21 bp, Homo sapiens
tgtcgccacacgcctctgtgt

SEQ ID NO: 4641112 - DNA, 20 bp, Homo sapiens
tgtcggtcatagtttcctga

SEQ ID NO: 4641113 - DNA, 23 bp, Homo sapiens
tgtcgtagaattccttcgaaagg

SEQ ID NO: 4641114 - DNA, 13 bp, Homo sapiens
tgtctaaaacaat

SEQ ID NO: 4641115 - DNA, 12 bp, Homo sapiens
tgtctcagtgat

SEQ ID NO: 4641116 - DNA, 13 bp, Homo sapiens
tgtctcagtgatt

SEQ ID NO: 4641117 - DNA, 13 bp, Homo sapiens
tgtctcatatatt

SEQ ID NO: 4641118 - DNA, 20 bp, Homo sapiens
tgtctcatatatttggagtt

SEQ ID NO: 4641119 - DNA, 13 bp, Homo sapiens
tgtctcattctca

SEQ ID NO: 4641120 - DNA, 14 bp, Homo sapiens
tgtctcattctcag

SEQ ID NO: 4641121 - DNA, 21 bp, Homo sapiens
tgtctcattctcagagtaaaa

SEQ ID NO: 4641122 - DNA, 20 bp, Homo sapiens
tgtctcccgtgcatgctctg

SEQ ID NO: 4641123 - DNA, 17 bp, Homo sapiens
tgtctcgagcgccctgc

SEQ ID NO: 4641124 - DNA, 19 bp, Homo sapiens
tgtctcgagcgccctgcag

SEQ ID NO: 4641125 - DNA, 20 bp, Homo sapiens
tgtctcgagcgccctgcaga

SEQ ID NO: 4641126 - DNA, 18 bp, Homo sapiens
tgtctcgtggtaggactg

SEQ ID NO: 4641127 - DNA, 19 bp, Homo sapiens
tgtctctggctactccctg

SEQ ID NO: 4641128 - DNA, 21 bp, Homo sapiens
tgtctctggctactccctgga

SEQ ID NO: 4641129 - DNA, 22 bp, Homo sapiens
tgtctgaagcccaaagcctgag

SEQ ID NO: 4641130 - DNA, 16 bp, Homo sapiens
tgtctgagtggcttca

SEQ ID NO: 4641131 - DNA, 15 bp, Homo sapiens
tgtctgcctcctgct

SEQ ID NO: 4641132 - DNA, 15 bp, Homo sapiens
tgtctgctctgcata

SEQ ID NO: 4641133 - DNA, 15 bp, Homo sapiens
tgtctgcttgtcaaa

SEQ ID NO: 4641134 - DNA, 19 bp, Homo sapiens
tgtctgggctcaagctttc

SEQ ID NO: 4641135 - DNA, 15 bp, Homo sapiens
tgtctggtgcctgga

SEQ ID NO: 4641136 - DNA, 13 bp, Homo sapiens
tgtctgtacacgt

SEQ ID NO: 4641137 - DNA, 15 bp, Homo sapiens
tgtctgtatccccag

SEQ ID NO: 4641138 - DNA, 12 bp, Homo sapiens
tgtctgttgaaa

SEQ ID NO: 4641139 - DNA, 18 bp, Homo sapiens
tgtctgttgaaataaaac

SEQ ID NO: 4641140 - DNA, 24 bp, Homo sapiens
tgtcttcacctgattcaactaaaa

SEQ ID NO: 4641141 - DNA, 20 bp, Homo sapiens
tgtcttgcaaagcctttaaa

SEQ ID NO: 4641142 - DNA, 13 bp, Homo sapiens
tgtcttggacact

SEQ ID NO: 4641143 - DNA, 15 bp, Homo sapiens
tgtcttggacactgt

SEQ ID NO: 4641144 - DNA, 16 bp, Homo sapiens
tgtcttgtacatgtgt

SEQ ID NO: 4641145 - DNA, 18 bp, Homo sapiens
tgtcttgtgtatttctct

SEQ ID NO: 4641146 - DNA, 21 bp, Homo sapiens
tgtcttgtgtatttctctgtg

SEQ ID NO: 4641147 - DNA, 18 bp, Homo sapiens
tgtcttgtgtttctttag

SEQ ID NO: 4641148 - DNA, 16 bp, Homo sapiens
tgtcttgtgtttttgt

SEQ ID NO: 4641149 - DNA, 16 bp, Homo sapiens
tgtcttttaaaatgca

SEQ ID NO: 4641150 - DNA, 15 bp, Homo sapiens
tgtctttttgttgta

SEQ ID NO: 4641151 - DNA, 17 bp, Homo sapiens
tgtgaaaaattaacttt

SEQ ID NO: 4641152 - DNA, 15 bp, Homo sapiens
tgtgaacagagagac

SEQ ID NO: 4641153 - DNA, 23 bp, Homo sapiens
tgtgaacagagagacccttgtgg

SEQ ID NO: 4641154 - DNA, 20 bp, Homo sapiens
tgtgaactctcccctcccca

SEQ ID NO: 4641155 - DNA, 15 bp, Homo sapiens
tgtgaactgacaggc

SEQ ID NO: 4641156 - DNA, 12 bp, Homo sapiens
tgtgaagcattc

SEQ ID NO: 4641157 - DNA, 10 bp, Homo sapiens
tgtgaagcca

SEQ ID NO: 4641158 - DNA, 20 bp, Homo sapiens
tgtgaagccaattcagacag

SEQ ID NO: 4641159 - DNA, 12 bp, Homo sapiens
tgtgaatgtggg

SEQ ID NO: 4641160 - DNA, 14 bp, Homo sapiens
tgtgacaataataa

SEQ ID NO: 4641161 - DNA, 15 bp, Homo sapiens
tgtgacaattctgtt

SEQ ID NO: 4641162 - DNA, 12 bp, Homo sapiens
tgtgacagggcc

SEQ ID NO: 4641163 - DNA, 13 bp, Homo sapiens
tgtgacagggcca

SEQ ID NO: 4641164 - DNA, 15 bp, Homo sapiens
tgtgacagggccagt

SEQ ID NO: 4641165 - DNA, 22 bp, Homo sapiens
tgtgacagggccagtggggcct

SEQ ID NO: 4641166 - DNA, 17 bp, Homo sapiens
tgtgacagtttccaaat

SEQ ID NO: 4641167 - DNA, 18 bp, Homo sapiens
tgtgacagtttccaaatt

SEQ ID NO: 4641168 - DNA, 21 bp, Homo sapiens
tgtgacagtttccaaattgcc

SEQ ID NO: 4641169 - DNA, 16 bp, Homo sapiens
tgtgacccccagctcc

SEQ ID NO: 4641170 - DNA, 13 bp, Homo sapiens
tgtgacctgctga

SEQ ID NO: 4641171 - DNA, 17 bp, Homo sapiens
tgtgacctgctgagctc

SEQ ID NO: 4641172 - DNA, 18 bp, Homo sapiens
tgtgacctgctgagctct

SEQ ID NO: 4641173 - DNA, 17 bp, Homo sapiens
tgtgaccttaggcccgg

SEQ ID NO: 4641174 - DNA, 15 bp, Homo sapiens
tgtgagcccagctgg

SEQ ID NO: 4641175 - DNA, 14 bp, Homo sapiens
tgtgaggcaataag

SEQ ID NO: 4641176 - DNA, 18 bp, Homo sapiens
tgtgagtgtgacagggcc

SEQ ID NO: 4641177 - DNA, 16 bp, Homo sapiens
tgtgataaaatgttga

SEQ ID NO: 4641178 - DNA, 16 bp, Homo sapiens
tgtgataatagcattt

SEQ ID NO: 4641179 - DNA, 17 bp, Homo sapiens
tgtgataatagcatttt

SEQ ID NO: 4641180 - DNA, 15 bp, Homo sapiens
tgtgatgtgaagcca

SEQ ID NO: 4641181 - DNA, 23 bp, Homo sapiens
tgtgatgtttaggggcaaacatc

SEQ ID NO: 4641182 - DNA, 19 bp, Homo sapiens
tgtgattaatgttttcatt

SEQ ID NO: 4641183 - DNA, 16 bp, Homo sapiens
tgtgattttaactctg

SEQ ID NO: 4641184 - DNA, 20 bp, Homo sapiens
tgtgattttaactctgtctt

SEQ ID NO: 4641185 - DNA, 13 bp, Homo sapiens
tgtgcactgccca

SEQ ID NO: 4641186 - DNA, 21 bp, Homo sapiens
tgtgcactgcccatggacagg

SEQ ID NO: 4641187 - DNA, 24 bp, Homo sapiens
tgtgcactgtataccaagttctta

SEQ ID NO: 4641188 - DNA, 19 bp, Homo sapiens
tgtgcagagcagacaggct

SEQ ID NO: 4641189 - DNA, 23 bp, Homo sapiens
tgtgcatgtatgtcttggacact

SEQ ID NO: 4641190 - DNA, 19 bp, Homo sapiens
tgtgcattttgtggaattt

SEQ ID NO: 4641191 - DNA, 14 bp, Homo sapiens
tgtgccacattttc

SEQ ID NO: 4641192 - DNA, 23 bp, Homo sapiens
tgtgccagaaagtcccccctcgc

SEQ ID NO: 4641193 - DNA, 12 bp, Homo sapiens
tgtgccagagcc

SEQ ID NO: 4641194 - DNA, 20 bp, Homo sapiens
tgtgccagagcctggggctc

SEQ ID NO: 4641195 - DNA, 20 bp, Homo sapiens
tgtgccagtgctaaactact

SEQ ID NO: 4641196 - DNA, 18 bp, Homo sapiens
tgtgccatagtcacatgg

SEQ ID NO: 4641197 - DNA, 17 bp, Homo sapiens
tgtgcccatggcttctg

SEQ ID NO: 4641198 - DNA, 20 bp, Homo sapiens
tgtgcctcgctccccactct

SEQ ID NO: 4641199 - DNA, 15 bp, Homo sapiens
tgtgcctgattattt

SEQ ID NO: 4641200 - DNA, 15 bp, Homo sapiens
tgtgcgtcccagctg

SEQ ID NO: 4641201 - DNA, 15 bp, Homo sapiens
tgtgctacaggggcc

SEQ ID NO: 4641202 - DNA, 17 bp, Homo sapiens
tgtgctacgtgtgaaat

SEQ ID NO: 4641203 - DNA, 19 bp, Homo sapiens
tgtgctacgtgtgaaatct

SEQ ID NO: 4641204 - DNA, 17 bp, Homo sapiens
tgtgctactgattgttt

SEQ ID NO: 4641205 - DNA, 17 bp, Homo sapiens
tgtgctagaaattttca

SEQ ID NO: 4641206 - DNA, 22 bp, Homo sapiens
tgtgctccatatttgatttcta

SEQ ID NO: 4641207 - DNA, 11 bp, Homo sapiens
tgtgctggggg

SEQ ID NO: 4641208 - DNA, 14 bp, Homo sapiens
tgtgcttccttggt

SEQ ID NO: 4641209 - DNA, 13 bp, Homo sapiens
tgtggaaatggga

SEQ ID NO: 4641210 - DNA, 13 bp, Homo sapiens
tgtggaatgagtg

SEQ ID NO: 4641211 - DNA, 18 bp, Homo sapiens
tgtggactggaacatggt

SEQ ID NO: 4641212 - DNA, 22 bp, Homo sapiens
tgtggagatcacagccccaccc

SEQ ID NO: 4641213 - DNA, 22 bp, Homo sapiens
tgtggaggaagagccacctgca

SEQ ID NO: 4641214 - DNA, 19 bp, Homo sapiens
tgtggcaattagtgtgaca

SEQ ID NO: 4641215 - DNA, 13 bp, Homo sapiens
tgtggcagggggc

SEQ ID NO: 4641216 - DNA, 20 bp, Homo sapiens
tgtggcagggggccccgcca

SEQ ID NO: 4641217 - DNA, 16 bp, Homo sapiens
tgtggcccagttctga

SEQ ID NO: 4641218 - DNA, 21 bp, Homo sapiens
tgtggctccctctctcctgga

SEQ ID NO: 4641219 - DNA, 12 bp, Homo sapiens
tgtgggagcctc

SEQ ID NO: 4641220 - DNA, 16 bp, Homo sapiens
tgtgggcactggccca

SEQ ID NO: 4641221 - DNA, 23 bp, Homo sapiens
tgtgggcactggcccaggttcat

SEQ ID NO: 4641222 - DNA, 20 bp, Homo sapiens
tgtggggtggacctgggaca

SEQ ID NO: 4641223 - DNA, 16 bp, Homo sapiens
tgtgggtatttcttgg

SEQ ID NO: 4641224 - DNA, 16 bp, Homo sapiens
tgtggtacatggtgtt

SEQ ID NO: 4641225 - DNA, 15 bp, Homo sapiens
tgtggtctcaggata

SEQ ID NO: 4641226 - DNA, 15 bp, Homo sapiens
tgtggtgaatatgca

SEQ ID NO: 4641227 - DNA, 15 bp, Homo sapiens
tgtggtggcctcagc

SEQ ID NO: 4641228 - DNA, 20 bp, Homo sapiens
tgtgtacaaatacatgtgta

SEQ ID NO: 4641229 - DNA, 18 bp, Homo sapiens
tgtgtacagtgaacaaat

SEQ ID NO: 4641230 - DNA, 21 bp, Homo sapiens
tgtgtacatgtgtgcagagca

SEQ ID NO: 4641231 - DNA, 22 bp, Homo sapiens
tgtgtacatgtgtgcagagcag

SEQ ID NO: 4641232 - DNA, 16 bp, Homo sapiens
tgtgtagctgtgacct

SEQ ID NO: 4641233 - DNA, 19 bp, Homo sapiens
tgtgtagttccctctgcct

SEQ ID NO: 4641234 - DNA, 21 bp, Homo sapiens
tgtgtagttccctctgcctgg

SEQ ID NO: 4641235 - DNA, 13 bp, Homo sapiens
tgtgtatgagaga

SEQ ID NO: 4641236 - DNA, 20 bp, Homo sapiens
tgtgtctaggcaggacctgt

SEQ ID NO: 4641237 - DNA, 18 bp, Homo sapiens
tgtgtctgaatcatgtct

SEQ ID NO: 4641238 - DNA, 21 bp, Homo sapiens
tgtgtctgaatcatgtctgta

SEQ ID NO: 4641239 - DNA, 15 bp, Homo sapiens
tgtgtctgtggttgc

SEQ ID NO: 4641240 - DNA, 20 bp, Homo sapiens
tgtgtgcagagcagacaggc

SEQ ID NO: 4641241 - DNA, 15 bp, Homo sapiens
tgtgtggcagggggc

SEQ ID NO: 4641242 - DNA, 19 bp, Homo sapiens
tgtgtggcagggggccccg

SEQ ID NO: 4641243 - DNA, 14 bp, Homo sapiens
tgtgtggtgcattc

SEQ ID NO: 4641244 - DNA, 14 bp, Homo sapiens
tgtgtggtggcctc

SEQ ID NO: 4641245 - DNA, 16 bp, Homo sapiens
tgtgtggtggcctcag

SEQ ID NO: 4641246 - DNA, 20 bp, Homo sapiens
tgtgtgtacaaatacatgtg

SEQ ID NO: 4641247 - DNA, 10 bp, Homo sapiens
tgtgtgttct

SEQ ID NO: 4641248 - DNA, 19 bp, Homo sapiens
tgtgtgtttcaaggtcaga

SEQ ID NO: 4641249 - DNA, 18 bp, Homo sapiens
tgtgtgtttgtgtgtttc

SEQ ID NO: 4641250 - DNA, 18 bp, Homo sapiens
tgtgttaacttgcctcca

SEQ ID NO: 4641251 - DNA, 20 bp, Homo sapiens
tgtgttactgctttgcaaag

SEQ ID NO: 4641252 - DNA, 22 bp, Homo sapiens
tgtgttatcggacattctaatg

SEQ ID NO: 4641253 - DNA, 12 bp, Homo sapiens
tgtgttcatttc

SEQ ID NO: 4641254 - DNA, 13 bp, Homo sapiens
tgtgttctttccc

SEQ ID NO: 4641255 - DNA, 23 bp, Homo sapiens
tgtgttgatgactcactcataaa

SEQ ID NO: 4641256 - DNA, 22 bp, Homo sapiens
tgtgttgccacagtagaactgt

SEQ ID NO: 4641257 - DNA, 17 bp, Homo sapiens
tgtgtttcattacttga

SEQ ID NO: 4641258 - DNA, 15 bp, Homo sapiens
tgttaactacatatt

SEQ ID NO: 4641259 - DNA, 19 bp, Homo sapiens
tgttaactacatattgtct

SEQ ID NO: 4641260 - DNA, 22 bp, Homo sapiens
tgttaagaatgaagttctgcta

SEQ ID NO: 4641261 - DNA, 13 bp, Homo sapiens
tgttaataaaagt

SEQ ID NO: 4641262 - DNA, 16 bp, Homo sapiens
tgttaatgctctatgt

SEQ ID NO: 4641263 - DNA, 21 bp, Homo sapiens
tgttaattttaccttgtttga

SEQ ID NO: 4641264 - DNA, 15 bp, Homo sapiens
tgttacagactgaaa

SEQ ID NO: 4641265 - DNA, 13 bp, Homo sapiens
tgttacagaggac

SEQ ID NO: 4641266 - DNA, 18 bp, Homo sapiens
tgttactgctttgcaaag

SEQ ID NO: 4641267 - DNA, 22 bp, Homo sapiens
tgttagaaaatgacttatttct

SEQ ID NO: 4641268 - DNA, 23 bp, Homo sapiens
tgttagaaaatgacttatttctg

SEQ ID NO: 4641269 - DNA, 17 bp, Homo sapiens
tgttagactagtttctt

SEQ ID NO: 4641270 - DNA, 21 bp, Homo sapiens
tgttagagacttttttctagt

SEQ ID NO: 4641271 - DNA, 20 bp, Homo sapiens
tgttagcttccttaagtata

SEQ ID NO: 4641272 - DNA, 14 bp, Homo sapiens
tgttagggattcct

SEQ ID NO: 4641273 - DNA, 23 bp, Homo sapiens
tgttagtaaataaaattaacaaa

SEQ ID NO: 4641274 - DNA, 19 bp, Homo sapiens
tgttagtataagcttttca

SEQ ID NO: 4641275 - DNA, 21 bp, Homo sapiens
tgttattaaacgtatgcatgt

SEQ ID NO: 4641276 - DNA, 17 bp, Homo sapiens
tgttatttctcagactt

SEQ ID NO: 4641277 - DNA, 15 bp, Homo sapiens
tgttcaaagactgtg

SEQ ID NO: 4641278 - DNA, 15 bp, Homo sapiens
tgttcacagcttttc

SEQ ID NO: 4641279 - DNA, 19 bp, Homo sapiens
tgttcacagcttttcttga

SEQ ID NO: 4641280 - DNA, 17 bp, Homo sapiens
tgttcaccaaaaccaaa

SEQ ID NO: 4641281 - DNA, 13 bp, Homo sapiens
tgttcagtaataa

SEQ ID NO: 4641282 - DNA, 14 bp, Homo sapiens
tgttcatggcagat

SEQ ID NO: 4641283 - DNA, 11 bp, Homo sapiens
tgttcatttag

SEQ ID NO: 4641284 - DNA, 22 bp, Homo sapiens
tgttcatttagataatttgaaa

SEQ ID NO: 4641285 - DNA, 12 bp, Homo sapiens
tgttcattttga

SEQ ID NO: 4641286 - DNA, 15 bp, Homo sapiens
tgttcattttgagta

SEQ ID NO: 4641287 - DNA, 23 bp, Homo sapiens
tgttccagattcctatgatggat

SEQ ID NO: 4641288 - DNA, 22 bp, Homo sapiens
tgttcccaagagcatcatgcct

SEQ ID NO: 4641289 - DNA, 22 bp, Homo sapiens
tgttcccttcctcttcctgccc

SEQ ID NO: 4641290 - DNA, 21 bp, Homo sapiens
tgttctaatccaagggccagt

SEQ ID NO: 4641291 - DNA, 19 bp, Homo sapiens
tgttctacccgttccaaaa

SEQ ID NO: 4641292 - DNA, 16 bp, Homo sapiens
tgttctcaacatactg

SEQ ID NO: 4641293 - DNA, 24 bp, Homo sapiens
tgttctcaacatactgtaatcaaa

SEQ ID NO: 4641294 - DNA, 17 bp, Homo sapiens
tgttctcatagaggaaa

SEQ ID NO: 4641295 - DNA, 13 bp, Homo sapiens
tgttctgtcacca

SEQ ID NO: 4641296 - DNA, 15 bp, Homo sapiens
tgttctgtcttccca

SEQ ID NO: 4641297 - DNA, 17 bp, Homo sapiens
tgttctgtcttcccaaa

SEQ ID NO: 4641298 - DNA, 18 bp, Homo sapiens
tgttctgtcttcccaaac

SEQ ID NO: 4641299 - DNA, 16 bp, Homo sapiens
tgttctgtttgaaact

SEQ ID NO: 4641300 - DNA, 16 bp, Homo sapiens
tgttcttaagacgtga

SEQ ID NO: 4641301 - DNA, 20 bp, Homo sapiens
tgttcttatgcaaaatggaa

SEQ ID NO: 4641302 - DNA, 20 bp, Homo sapiens
tgttcttgaagcagtagcct

SEQ ID NO: 4641303 - DNA, 21 bp, Homo sapiens
tgttctttccccaggggcatg

SEQ ID NO: 4641304 - DNA, 22 bp, Homo sapiens
tgttgatcatgtactttttagt

SEQ ID NO: 4641305 - DNA, 20 bp, Homo sapiens
tgttgcctcctctctccctg

SEQ ID NO: 4641306 - DNA, 21 bp, Homo sapiens
tgttgcctcctctctccctgc

SEQ ID NO: 4641307 - DNA, 17 bp, Homo sapiens
tgttgcctttgctctta

SEQ ID NO: 4641308 - DNA, 12 bp, Homo sapiens
tgttgctctttc

SEQ ID NO: 4641309 - DNA, 16 bp, Homo sapiens
tgttgctgttcacagc

SEQ ID NO: 4641310 - DNA, 14 bp, Homo sapiens
tgttggccaggctg

SEQ ID NO: 4641311 - DNA, 14 bp, Homo sapiens
tgttggttcaaact

SEQ ID NO: 4641312 - DNA, 22 bp, Homo sapiens
tgttgtaaaacaaaatttgact

SEQ ID NO: 4641313 - DNA, 23 bp, Homo sapiens
tgttgtaaaacaaaatttgacta

SEQ ID NO: 4641314 - DNA, 17 bp, Homo sapiens
tgttgtacttgaaaatg

SEQ ID NO: 4641315 - DNA, 16 bp, Homo sapiens
tgttgtcctcctgttc

SEQ ID NO: 4641316 - DNA, 19 bp, Homo sapiens
tgttgtgcactagtgcaat

SEQ ID NO: 4641317 - DNA, 14 bp, Homo sapiens
tgttgttgttttgt

SEQ ID NO: 4641318 - DNA, 18 bp, Homo sapiens
tgtttaaaagaaatatat

SEQ ID NO: 4641319 - DNA, 21 bp, Homo sapiens
tgtttaatgtgaactctcccc

SEQ ID NO: 4641320 - DNA, 16 bp, Homo sapiens
tgtttacaacatcacc

SEQ ID NO: 4641321 - DNA, 22 bp, Homo sapiens
tgtttacatttgatgcatgtct

SEQ ID NO: 4641322 - DNA, 19 bp, Homo sapiens
tgtttatagctcatttgta

SEQ ID NO: 4641323 - DNA, 15 bp, Homo sapiens
tgtttatatgtcttg

SEQ ID NO: 4641324 - DNA, 18 bp, Homo sapiens
tgtttatatgtcttgcaa

SEQ ID NO: 4641325 - DNA, 14 bp, Homo sapiens
tgtttcatctcagc

SEQ ID NO: 4641326 - DNA, 18 bp, Homo sapiens
tgtttcattacttgaatg

SEQ ID NO: 4641327 - DNA, 15 bp, Homo sapiens
tgtttcccccactcc

SEQ ID NO: 4641328 - DNA, 21 bp, Homo sapiens
tgtttcctgacattgtctcct

SEQ ID NO: 4641329 - DNA, 14 bp, Homo sapiens
tgtttcctggcctc

SEQ ID NO: 4641330 - DNA, 19 bp, Homo sapiens
tgtttcctggcctcagagc

SEQ ID NO: 4641331 - DNA, 21 bp, Homo sapiens
tgtttcctggcctcagagctt

SEQ ID NO: 4641332 - DNA, 14 bp, Homo sapiens
tgtttctaagaaaa

SEQ ID NO: 4641333 - DNA, 22 bp, Homo sapiens
tgtttctgaatgtttgtgtctg

SEQ ID NO: 4641334 - DNA, 14 bp, Homo sapiens
tgtttctttgtgtt

SEQ ID NO: 4641335 - DNA, 18 bp, Homo sapiens
tgtttgaaacaaagaagg

SEQ ID NO: 4641336 - DNA, 15 bp, Homo sapiens
tgtttgaaatgttta

SEQ ID NO: 4641337 - DNA, 22 bp, Homo sapiens
tgtttgaaatgtttaataaagc

SEQ ID NO: 4641338 - DNA, 21 bp, Homo sapiens
tgtttgacgggaaacaaaact

SEQ ID NO: 4641339 - DNA, 19 bp, Homo sapiens
tgtttgagttatcagggaa

SEQ ID NO: 4641340 - DNA, 21 bp, Homo sapiens
tgtttgatttgtctcatatat

SEQ ID NO: 4641341 - DNA, 20 bp, Homo sapiens
tgtttgcttgaatgctggta

SEQ ID NO: 4641342 - DNA, 20 bp, Homo sapiens
tgtttgtacacaacaatcct

SEQ ID NO: 4641343 - DNA, 22 bp, Homo sapiens
tgtttgtgggtatttcttggca

SEQ ID NO: 4641344 - DNA, 13 bp, Homo sapiens
tgtttgtttcttt

SEQ ID NO: 4641345 - DNA, 15 bp, Homo sapiens
tgttttaaaatgtga

SEQ ID NO: 4641346 - DNA, 22 bp, Homo sapiens
tgttttaaaatgtgaggcaata

SEQ ID NO: 4641347 - DNA, 21 bp, Homo sapiens
tgttttacctgttctgaaatg

SEQ ID NO: 4641348 - DNA, 14 bp, Homo sapiens
tgttttcaagatgg

SEQ ID NO: 4641349 - DNA, 18 bp, Homo sapiens
tgttttcattatgttcat

SEQ ID NO: 4641350 - DNA, 14 bp, Homo sapiens
tgttttctgctgtt

SEQ ID NO: 4641351 - DNA, 15 bp, Homo sapiens
tgttttctttgagga

SEQ ID NO: 4641352 - DNA, 19 bp, Homo sapiens
tgttttggtctcaaaatgg

SEQ ID NO: 4641353 - DNA, 12 bp, Homo sapiens
tgttttgtaaag

SEQ ID NO: 4641354 - DNA, 19 bp, Homo sapiens
tgttttgtaaagtccccag

SEQ ID NO: 4641355 - DNA, 12 bp, Homo sapiens
tgttttgttaat

SEQ ID NO: 4641356 - DNA, 13 bp, Homo sapiens
tgtttttaatgac

SEQ ID NO: 4641357 - DNA, 19 bp, Homo sapiens
tgtttttaatgctatttga

SEQ ID NO: 4641358 - DNA, 17 bp, Homo sapiens
tgtttttattgttttct

SEQ ID NO: 4641359 - DNA, 13 bp, Homo sapiens
tgtttttgaaata

SEQ ID NO: 4641360 - DNA, 17 bp, Homo sapiens
tgttttttatgaagtgc

SEQ ID NO: 4641361 - DNA, 12 bp, Homo sapiens
tgttttttgata

SEQ ID NO: 4641362 - DNA, 11 bp, Homo sapiens
tgttttttgtt

SEQ ID NO: 4641363 - DNA, 9 bp, Homo sapiens
tgttttttt

SEQ ID NO: 4641364 - DNA, 14 bp, Homo sapiens
tgtttttttgagat

SEQ ID NO: 4641365 - DNA, 21 bp, Homo sapiens
tgtttttttgagatggagtct

SEQ ID NO: 4641366 - DNA, 18 bp, Homo sapiens
tgtttttttttttgagat

SEQ ID NO: 4641367 - DNA, 20 bp, Homo sapiens
ttaaaaaaaaatcttgtgtt

SEQ ID NO: 4641368 - DNA, 21 bp, Homo sapiens
ttaaaaaaaaatcttgtgtta

SEQ ID NO: 4641369 - DNA, 20 bp, Homo sapiens
ttaaaaaactgacaggcact

SEQ ID NO: 4641370 - DNA, 16 bp, Homo sapiens
ttaaaaaatattttct

SEQ ID NO: 4641371 - DNA, 16 bp, Homo sapiens
ttaaaaatgttctcaa

SEQ ID NO: 4641372 - DNA, 20 bp, Homo sapiens
ttaaaaattcttgaaagaat

SEQ ID NO: 4641373 - DNA, 12 bp, Homo sapiens
ttaaaagaaata

SEQ ID NO: 4641374 - DNA, 12 bp, Homo sapiens
ttaaaagaatga

SEQ ID NO: 4641375 - DNA, 15 bp, Homo sapiens
ttaaaagaatgacta

SEQ ID NO: 4641376 - DNA, 17 bp, Homo sapiens
ttaaaagcacaatcact

SEQ ID NO: 4641377 - DNA, 19 bp, Homo sapiens
ttaaaagccttccagtttt

SEQ ID NO: 4641378 - DNA, 21 bp, Homo sapiens
ttaaaagccttccagttttgt

SEQ ID NO: 4641379 - DNA, 14 bp, Homo sapiens
ttaaaataaaatga

SEQ ID NO: 4641380 - DNA, 17 bp, Homo sapiens
ttaaaataaaatgaaaa

SEQ ID NO: 4641381 - DNA, 15 bp, Homo sapiens
ttaaaatacatttta

SEQ ID NO: 4641382 - DNA, 21 bp, Homo sapiens
ttaaacaagtcaattctgtgt

SEQ ID NO: 4641383 - DNA, 20 bp, Homo sapiens
ttaaacagcagcacttttta

SEQ ID NO: 4641384 - DNA, 12 bp, Homo sapiens
ttaaaccagaac

SEQ ID NO: 4641385 - DNA, 16 bp, Homo sapiens
ttaaacgtatgcatgt

SEQ ID NO: 4641386 - DNA, 20 bp, Homo sapiens
ttaaacgtatgcatgtgaag

SEQ ID NO: 4641387 - DNA, 21 bp, Homo sapiens
ttaaactatgttcctaacaaa

SEQ ID NO: 4641388 - DNA, 13 bp, Homo sapiens
ttaaagaagcttt

SEQ ID NO: 4641389 - DNA, 14 bp, Homo sapiens
ttaaagaagcttta

SEQ ID NO: 4641390 - DNA, 15 bp, Homo sapiens
ttaaagaagctttat

SEQ ID NO: 4641391 - DNA, 22 bp, Homo sapiens
ttaaagcaaactatgatttatt

SEQ ID NO: 4641392 - DNA, 16 bp, Homo sapiens
ttaaagcaagcaacac

SEQ ID NO: 4641393 - DNA, 17 bp, Homo sapiens
ttaaaggcttctctctc

SEQ ID NO: 4641394 - DNA, 19 bp, Homo sapiens
ttaaaggcttctctctcac

SEQ ID NO: 4641395 - DNA, 20 bp, Homo sapiens
ttaaaggcttctctctcacc

SEQ ID NO: 4641396 - DNA, 21 bp, Homo sapiens
ttaaagggaatcatttttgta

SEQ ID NO: 4641397 - DNA, 23 bp, Homo sapiens
ttaaaggggagacctcagaagta

SEQ ID NO: 4641398 - DNA, 23 bp, Homo sapiens
ttaaagtatttataaaaatataa

SEQ ID NO: 4641399 - DNA, 14 bp, Homo sapiens
ttaaagtttaaata

SEQ ID NO: 4641400 - DNA, 16 bp, Homo sapiens
ttaaatatatattttg

SEQ ID NO: 4641401 - DNA, 17 bp, Homo sapiens
ttaaatatcattctttg

SEQ ID NO: 4641402 - DNA, 18 bp, Homo sapiens
ttaaatatcattctttgt

SEQ ID NO: 4641403 - DNA, 20 bp, Homo sapiens
ttaaatattagttaatggat

SEQ ID NO: 4641404 - DNA, 22 bp, Homo sapiens
ttaaatattgtaatatgacaga

SEQ ID NO: 4641405 - DNA, 15 bp, Homo sapiens
ttaaatatttgaaga

SEQ ID NO: 4641406 - DNA, 13 bp, Homo sapiens
ttaaatattttct

SEQ ID NO: 4641407 - DNA, 17 bp, Homo sapiens
ttaaatcctaccaaagt

SEQ ID NO: 4641408 - DNA, 20 bp, Homo sapiens
ttaaatctaaacaaaaaata

SEQ ID NO: 4641409 - DNA, 12 bp, Homo sapiens
ttaaatctagac

SEQ ID NO: 4641410 - DNA, 17 bp, Homo sapiens
ttaaatgcaacagtttt

SEQ ID NO: 4641411 - DNA, 12 bp, Homo sapiens
ttaaattacaat

SEQ ID NO: 4641412 - DNA, 16 bp, Homo sapiens
ttaaattacaatttta

SEQ ID NO: 4641413 - DNA, 19 bp, Homo sapiens
ttaaattgttcctctttgt

SEQ ID NO: 4641414 - DNA, 19 bp, Homo sapiens
ttaaattttgtaggatttt

SEQ ID NO: 4641415 - DNA, 16 bp, Homo sapiens
ttaacaaaaaatgtaa

SEQ ID NO: 4641416 - DNA, 21 bp, Homo sapiens
ttaacaaaaaatgtaattaac

SEQ ID NO: 4641417 - DNA, 21 bp, Homo sapiens
ttaacaagtatttattcccat

SEQ ID NO: 4641418 - DNA, 13 bp, Homo sapiens
ttaaccctctctt

SEQ ID NO: 4641419 - DNA, 12 bp, Homo sapiens
ttaacctgggac

SEQ ID NO: 4641420 - DNA, 13 bp, Homo sapiens
ttaacctgggacc

SEQ ID NO: 4641421 - DNA, 17 bp, Homo sapiens
ttaactatcaccagtgc

SEQ ID NO: 4641422 - DNA, 15 bp, Homo sapiens
ttaactccctccacc

SEQ ID NO: 4641423 - DNA, 22 bp, Homo sapiens
ttaactccctccaccagcctgc

SEQ ID NO: 4641424 - DNA, 19 bp, Homo sapiens
ttaagaaaatttacaaaat

SEQ ID NO: 4641425 - DNA, 15 bp, Homo sapiens
ttaagaaaggaagca

SEQ ID NO: 4641426 - DNA, 16 bp, Homo sapiens
ttaagaaaggaagcaa

SEQ ID NO: 4641427 - DNA, 18 bp, Homo sapiens
ttaagaatgaagttctgc

SEQ ID NO: 4641428 - DNA, 14 bp, Homo sapiens
ttaagactgatttt

SEQ ID NO: 4641429 - DNA, 22 bp, Homo sapiens
ttaagagatcccttaagaagtt

SEQ ID NO: 4641430 - DNA, 14 bp, Homo sapiens
ttaagatagaacac

SEQ ID NO: 4641431 - DNA, 16 bp, Homo sapiens
ttaagctcccctgcct

SEQ ID NO: 4641432 - DNA, 17 bp, Homo sapiens
ttaagctcccctgcctt

SEQ ID NO: 4641433 - DNA, 20 bp, Homo sapiens
ttaaggacccttttaagcat

SEQ ID NO: 4641434 - DNA, 23 bp, Homo sapiens
ttaaggacccttttaagcatgtg

SEQ ID NO: 4641435 - DNA, 14 bp, Homo sapiens
ttaaggagcctaat

SEQ ID NO: 4641436 - DNA, 13 bp, Homo sapiens
ttaagggcagagt

SEQ ID NO: 4641437 - DNA, 15 bp, Homo sapiens
ttaaggtttcaacaa

SEQ ID NO: 4641438 - DNA, 23 bp, Homo sapiens
ttaaggtttcaacaaatttcatt

SEQ ID NO: 4641439 - DNA, 14 bp, Homo sapiens
ttaagtatatcatg

SEQ ID NO: 4641440 - DNA, 17 bp, Homo sapiens
ttaagtatatcatgtaa

SEQ ID NO: 4641441 - DNA, 20 bp, Homo sapiens
ttaagtggggttgataacac

SEQ ID NO: 4641442 - DNA, 22 bp, Homo sapiens
ttaagttacacatttttcagat

SEQ ID NO: 4641443 - DNA, 14 bp, Homo sapiens
ttaagttcctgctg

SEQ ID NO: 4641444 - DNA, 17 bp, Homo sapiens
ttaagttcctgctgcct

SEQ ID NO: 4641445 - DNA, 18 bp, Homo sapiens
ttaagttcctgctgcctg

SEQ ID NO: 4641446 - DNA, 13 bp, Homo sapiens
ttaataaagcttt

SEQ ID NO: 4641447 - DNA, 16 bp, Homo sapiens
ttaataaagctttata

SEQ ID NO: 4641448 - DNA, 14 bp, Homo sapiens
ttaatacctttaaa

SEQ ID NO: 4641449 - DNA, 19 bp, Homo sapiens
ttaatacctttaaatatca

SEQ ID NO: 4641450 - DNA, 13 bp, Homo sapiens
ttaatacttttcc

SEQ ID NO: 4641451 - DNA, 23 bp, Homo sapiens
ttaatagtcaccttcatgattat

SEQ ID NO: 4641452 - DNA, 16 bp, Homo sapiens
ttaatatatacatttt

SEQ ID NO: 4641453 - DNA, 17 bp, Homo sapiens
ttaatatggatttgtta

SEQ ID NO: 4641454 - DNA, 17 bp, Homo sapiens
ttaatcaagagaaactt

SEQ ID NO: 4641455 - DNA, 19 bp, Homo sapiens
ttaatcaagagaaacttca

SEQ ID NO: 4641456 - DNA, 15 bp, Homo sapiens
ttaatcattttcatt

SEQ ID NO: 4641457 - DNA, 17 bp, Homo sapiens
ttaatcttctctcttga

SEQ ID NO: 4641458 - DNA, 21 bp, Homo sapiens
ttaatcttctctcttgattga

SEQ ID NO: 4641459 - DNA, 11 bp, Homo sapiens
ttaatcttgat

SEQ ID NO: 4641460 - DNA, 14 bp, Homo sapiens
ttaatcttgatcat

SEQ ID NO: 4641461 - DNA, 15 bp, Homo sapiens
ttaatcttgctttct

SEQ ID NO: 4641462 - DNA, 14 bp, Homo sapiens
ttaatgacacttgt

SEQ ID NO: 4641463 - DNA, 19 bp, Homo sapiens
ttaatgacacttgtcccca

SEQ ID NO: 4641464 - DNA, 14 bp, Homo sapiens
ttaatgcctgccca

SEQ ID NO: 4641465 - DNA, 22 bp, Homo sapiens
ttaatgcctgcccattagagaa

SEQ ID NO: 4641466 - DNA, 14 bp, Homo sapiens
ttaatgctatttga

SEQ ID NO: 4641467 - DNA, 15 bp, Homo sapiens
ttaatgctgtttcta

SEQ ID NO: 4641468 - DNA, 22 bp, Homo sapiens
ttaatggtatcctactgagcat

SEQ ID NO: 4641469 - DNA, 13 bp, Homo sapiens
ttaatgtatctta

SEQ ID NO: 4641470 - DNA, 14 bp, Homo sapiens
ttaatgtatcttaa

SEQ ID NO: 4641471 - DNA, 18 bp, Homo sapiens
ttaatgtatcttaaagga

SEQ ID NO: 4641472 - DNA, 22 bp, Homo sapiens
ttaattcttcagcgtaaaatgg

SEQ ID NO: 4641473 - DNA, 19 bp, Homo sapiens
ttaattgttttgcactttt

SEQ ID NO: 4641474 - DNA, 14 bp, Homo sapiens
ttaatttcaggaaa

SEQ ID NO: 4641475 - DNA, 14 bp, Homo sapiens
ttaatttgtaaact

SEQ ID NO: 4641476 - DNA, 18 bp, Homo sapiens
ttaatttgtaaacttctg

SEQ ID NO: 4641477 - DNA, 13 bp, Homo sapiens
ttaattttaagaa

SEQ ID NO: 4641478 - DNA, 11 bp, Homo sapiens
ttaattttacc

SEQ ID NO: 4641479 - DNA, 19 bp, Homo sapiens
ttaattttctctttgtatg

SEQ ID NO: 4641480 - DNA, 18 bp, Homo sapiens
ttaatttttcttagtgtt

SEQ ID NO: 4641481 - DNA, 21 bp, Homo sapiens
ttacaaacaagtggatgtttt

SEQ ID NO: 4641482 - DNA, 17 bp, Homo sapiens
ttacaactttctaagag

SEQ ID NO: 4641483 - DNA, 15 bp, Homo sapiens
ttacaatgtgaataa

SEQ ID NO: 4641484 - DNA, 16 bp, Homo sapiens
ttacaatgtgaataat

SEQ ID NO: 4641485 - DNA, 13 bp, Homo sapiens
ttacaattttatc

SEQ ID NO: 4641486 - DNA, 22 bp, Homo sapiens
ttacactggaggagagaagaat

SEQ ID NO: 4641487 - DNA, 12 bp, Homo sapiens
ttacagcccttg

SEQ ID NO: 4641488 - DNA, 19 bp, Homo sapiens
ttacaggtgtgcaccacca

SEQ ID NO: 4641489 - DNA, 16 bp, Homo sapiens
ttacatgtttataaat

SEQ ID NO: 4641490 - DNA, 14 bp, Homo sapiens
ttacattcagaaat

SEQ ID NO: 4641491 - DNA, 18 bp, Homo sapiens
ttacattcagaaatgtgg

SEQ ID NO: 4641492 - DNA, 20 bp, Homo sapiens
ttacatttgatgcatgtctt

SEQ ID NO: 4641493 - DNA, 13 bp, Homo sapiens
ttaccaagaagcc

SEQ ID NO: 4641494 - DNA, 16 bp, Homo sapiens
ttaccatcttaatctt

SEQ ID NO: 4641495 - DNA, 20 bp, Homo sapiens
ttacccatcttgcttccaag

SEQ ID NO: 4641496 - DNA, 22 bp, Homo sapiens
ttaccgtcacactcttcagtga

SEQ ID NO: 4641497 - DNA, 15 bp, Homo sapiens
ttacctatctgtgga

SEQ ID NO: 4641498 - DNA, 16 bp, Homo sapiens
ttacctatctgtggaa

SEQ ID NO: 4641499 - DNA, 15 bp, Homo sapiens
ttacctgtctctctc

SEQ ID NO: 4641500 - DNA, 16 bp, Homo sapiens
ttacgacccaggacaa

SEQ ID NO: 4641501 - DNA, 13 bp, Homo sapiens
ttacgatatttcg

SEQ ID NO: 4641502 - DNA, 21 bp, Homo sapiens
ttacgcaggtatttagaagca

SEQ ID NO: 4641503 - DNA, 22 bp, Homo sapiens
ttacgcaggtatttagaagcag

SEQ ID NO: 4641504 - DNA, 15 bp, Homo sapiens
ttacggaggaacaga

SEQ ID NO: 4641505 - DNA, 16 bp, Homo sapiens
ttacggaggaacagat

SEQ ID NO: 4641506 - DNA, 18 bp, Homo sapiens
ttacggccctggccttgg

SEQ ID NO: 4641507 - DNA, 23 bp, Homo sapiens
ttactaagttttcaaatttgtaa

SEQ ID NO: 4641508 - DNA, 15 bp, Homo sapiens
ttactactttaaatc

SEQ ID NO: 4641509 - DNA, 19 bp, Homo sapiens
ttactcctgtgggagcctc

SEQ ID NO: 4641510 - DNA, 22 bp, Homo sapiens
ttactgatgtgtgcaacctttt

SEQ ID NO: 4641511 - DNA, 13 bp, Homo sapiens
ttacttgaatgta

SEQ ID NO: 4641512 - DNA, 15 bp, Homo sapiens
ttacttgcttctcta

SEQ ID NO: 4641513 - DNA, 11 bp, Homo sapiens
ttactttgtgt

SEQ ID NO: 4641514 - DNA, 21 bp, Homo sapiens
ttagaaaatgacttatttctg

SEQ ID NO: 4641515 - DNA, 22 bp, Homo sapiens
ttagaaaatgacttatttctgc

SEQ ID NO: 4641516 - DNA, 18 bp, Homo sapiens
ttagaaaattcagctcct

SEQ ID NO: 4641517 - DNA, 19 bp, Homo sapiens
ttagaaggcttaagaactg

SEQ ID NO: 4641518 - DNA, 17 bp, Homo sapiens
ttagaattaaaaaagca

SEQ ID NO: 4641519 - DNA, 18 bp, Homo sapiens
ttagagaatgtgtttcaa

SEQ ID NO: 4641520 - DNA, 21 bp, Homo sapiens
ttagagcttccgagaatagct

SEQ ID NO: 4641521 - DNA, 17 bp, Homo sapiens
ttagagggtgaaggaga

SEQ ID NO: 4641522 - DNA, 17 bp, Homo sapiens
ttagaggtaaaagtaca

SEQ ID NO: 4641523 - DNA, 16 bp, Homo sapiens
ttagataatttgaaaa

SEQ ID NO: 4641524 - DNA, 14 bp, Homo sapiens
ttagatacacttct

SEQ ID NO: 4641525 - DNA, 13 bp, Homo sapiens
ttagatagaagaa

SEQ ID NO: 4641526 - DNA, 17 bp, Homo sapiens
ttagatataacactatg

SEQ ID NO: 4641527 - DNA, 19 bp, Homo sapiens
ttagcagagacaaagagtt

SEQ ID NO: 4641528 - DNA, 22 bp, Homo sapiens
ttagcagggattctctcatcta

SEQ ID NO: 4641529 - DNA, 23 bp, Homo sapiens
ttagccaactgtttccctgctga

SEQ ID NO: 4641530 - DNA, 13 bp, Homo sapiens
ttagccacatgta

SEQ ID NO: 4641531 - DNA, 17 bp, Homo sapiens
ttagccagatttgtctt

SEQ ID NO: 4641532 - DNA, 14 bp, Homo sapiens
ttagcctttgaatg

SEQ ID NO: 4641533 - DNA, 18 bp, Homo sapiens
ttagctaaattcagggag

SEQ ID NO: 4641534 - DNA, 14 bp, Homo sapiens
ttagctgtaaactg

SEQ ID NO: 4641535 - DNA, 12 bp, Homo sapiens
ttagctttacat

SEQ ID NO: 4641536 - DNA, 20 bp, Homo sapiens
ttagctttccaaggaagcag

SEQ ID NO: 4641537 - DNA, 16 bp, Homo sapiens
ttaggaattggaggct

SEQ ID NO: 4641538 - DNA, 19 bp, Homo sapiens
ttaggcactgttcaatact

SEQ ID NO: 4641539 - DNA, 19 bp, Homo sapiens
ttaggcatttcctgctgaa

SEQ ID NO: 4641540 - DNA, 15 bp, Homo sapiens
ttagggcactgggct

SEQ ID NO: 4641541 - DNA, 17 bp, Homo sapiens
ttaggggttctatttat

SEQ ID NO: 4641542 - DNA, 13 bp, Homo sapiens
ttaggtactattc

SEQ ID NO: 4641543 - DNA, 14 bp, Homo sapiens
ttaggtagtcatgc

SEQ ID NO: 4641544 - DNA, 13 bp, Homo sapiens
ttaggtcttcctg

SEQ ID NO: 4641545 - DNA, 15 bp, Homo sapiens
ttaggtcttcctgtg

SEQ ID NO: 4641546 - DNA, 18 bp, Homo sapiens
ttagtaaagtcaaggaga

SEQ ID NO: 4641547 - DNA, 15 bp, Homo sapiens
ttagtataagctttt

SEQ ID NO: 4641548 - DNA, 17 bp, Homo sapiens
ttagtcgggcatgagtc

SEQ ID NO: 4641549 - DNA, 20 bp, Homo sapiens
ttagtcgggcatgagtctgt

SEQ ID NO: 4641550 - DNA, 22 bp, Homo sapiens
ttagtcttagggatttattttc

SEQ ID NO: 4641551 - DNA, 16 bp, Homo sapiens
ttagtgggccagggct

SEQ ID NO: 4641552 - DNA, 12 bp, Homo sapiens
ttagtgggggac

SEQ ID NO: 4641553 - DNA, 19 bp, Homo sapiens
ttagtggtcataaaataga

SEQ ID NO: 4641554 - DNA, 15 bp, Homo sapiens
ttagtgtatctttaa

SEQ ID NO: 4641555 - DNA, 21 bp, Homo sapiens
ttagtgtgacagtttccaaat

SEQ ID NO: 4641556 - DNA, 19 bp, Homo sapiens
ttagtgttaaaaatctagt

SEQ ID NO: 4641557 - DNA, 14 bp, Homo sapiens
ttagttaagtttta

SEQ ID NO: 4641558 - DNA, 13 bp, Homo sapiens
ttagttaatggat

SEQ ID NO: 4641559 - DNA, 17 bp, Homo sapiens
ttagttcaatacagtga

SEQ ID NO: 4641560 - DNA, 20 bp, Homo sapiens
ttagttttacactaggaaac

SEQ ID NO: 4641561 - DNA, 21 bp, Homo sapiens
ttagtttttgtgaagtttaat

SEQ ID NO: 4641562 - DNA, 14 bp, Homo sapiens
ttataaaaatataa

SEQ ID NO: 4641563 - DNA, 21 bp, Homo sapiens
ttataaagatcatttataata

SEQ ID NO: 4641564 - DNA, 22 bp, Homo sapiens
ttataattagtcgggcatgagt

SEQ ID NO: 4641565 - DNA, 22 bp, Homo sapiens
ttataattggtgctatttgaag

SEQ ID NO: 4641566 - DNA, 14 bp, Homo sapiens
ttataattttctaa

SEQ ID NO: 4641567 - DNA, 13 bp, Homo sapiens
ttatacaataacc

SEQ ID NO: 4641568 - DNA, 17 bp, Homo sapiens
ttatacaataacccagt

SEQ ID NO: 4641569 - DNA, 21 bp, Homo sapiens
ttatacaataacccagttact

SEQ ID NO: 4641570 - DNA, 22 bp, Homo sapiens
ttatacaataacccagttactt

SEQ ID NO: 4641571 - DNA, 16 bp, Homo sapiens
ttatacagacctaata

SEQ ID NO: 4641572 - DNA, 19 bp, Homo sapiens
ttatacctcaaactatctg

SEQ ID NO: 4641573 - DNA, 14 bp, Homo sapiens
ttatactggcatgc

SEQ ID NO: 4641574 - DNA, 18 bp, Homo sapiens
ttatactttgtaaagaca

SEQ ID NO: 4641575 - DNA, 11 bp, Homo sapiens
ttatagaaaat

SEQ ID NO: 4641576 - DNA, 21 bp, Homo sapiens
ttatagagaatgatgataaca

SEQ ID NO: 4641577 - DNA, 20 bp, Homo sapiens
ttatagcaacaacaattggt

SEQ ID NO: 4641578 - DNA, 22 bp, Homo sapiens
ttatagcaagatattgatcaaa

SEQ ID NO: 4641579 - DNA, 14 bp, Homo sapiens
ttatatacagagga

SEQ ID NO: 4641580 - DNA, 21 bp, Homo sapiens
ttatatacagaggaaatctgt

SEQ ID NO: 4641581 - DNA, 15 bp, Homo sapiens
ttatatattgttgtt

SEQ ID NO: 4641582 - DNA, 14 bp, Homo sapiens
ttatatcatgcaaa

SEQ ID NO: 4641583 - DNA, 15 bp, Homo sapiens
ttatatgatttttga

SEQ ID NO: 4641584 - DNA, 17 bp, Homo sapiens
ttatatgccaagctaat

SEQ ID NO: 4641585 - DNA, 20 bp, Homo sapiens
ttatatgccaagctaattta

SEQ ID NO: 4641586 - DNA, 16 bp, Homo sapiens
ttatattcacagtttt

SEQ ID NO: 4641587 - DNA, 13 bp, Homo sapiens
ttatatttatcca

SEQ ID NO: 4641588 - DNA, 14 bp, Homo sapiens
ttatcaaaaagtat

SEQ ID NO: 4641589 - DNA, 17 bp, Homo sapiens
ttatcggacattctaat

SEQ ID NO: 4641590 - DNA, 21 bp, Homo sapiens
ttatcggacattctaatgcat

SEQ ID NO: 4641591 - DNA, 19 bp, Homo sapiens
ttatctaatacctctgtgt

SEQ ID NO: 4641592 - DNA, 19 bp, Homo sapiens
ttatctattagataatcaa

SEQ ID NO: 4641593 - DNA, 18 bp, Homo sapiens
ttatctcgaatttgaaga

SEQ ID NO: 4641594 - DNA, 20 bp, Homo sapiens
ttatctcgaatttgaagaga

SEQ ID NO: 4641595 - DNA, 19 bp, Homo sapiens
ttatctggaaataatatca

SEQ ID NO: 4641596 - DNA, 19 bp, Homo sapiens
ttatctgtttaaagcatat

SEQ ID NO: 4641597 - DNA, 22 bp, Homo sapiens
ttatctgtttcctgacattgtc

SEQ ID NO: 4641598 - DNA, 12 bp, Homo sapiens
ttatcttacatt

SEQ ID NO: 4641599 - DNA, 18 bp, Homo sapiens
ttatcttgttattattgt

SEQ ID NO: 4641600 - DNA, 20 bp, Homo sapiens
ttatgaagtgcgtgaatgta

SEQ ID NO: 4641601 - DNA, 18 bp, Homo sapiens
ttatgaattataaatgtg

SEQ ID NO: 4641602 - DNA, 18 bp, Homo sapiens
ttatgacatttcttaaaa

SEQ ID NO: 4641603 - DNA, 20 bp, Homo sapiens
ttatgacatttcttaaaact

SEQ ID NO: 4641604 - DNA, 19 bp, Homo sapiens
ttatgagatctaatgtgaa

SEQ ID NO: 4641605 - DNA, 22 bp, Homo sapiens
ttatgagatctaatgtgaaaat

SEQ ID NO: 4641606 - DNA, 14 bp, Homo sapiens
ttatgagcttccaa

SEQ ID NO: 4641607 - DNA, 22 bp, Homo sapiens
ttatgcacttttagaaatgcat

SEQ ID NO: 4641608 - DNA, 22 bp, Homo sapiens
ttatgccacttccttttaactg

SEQ ID NO: 4641609 - DNA, 20 bp, Homo sapiens
ttatgggggtgtttctatct

SEQ ID NO: 4641610 - DNA, 13 bp, Homo sapiens
ttatgtgaaaaat

SEQ ID NO: 4641611 - DNA, 14 bp, Homo sapiens
ttatgttcatgtaa

SEQ ID NO: 4641612 - DNA, 19 bp, Homo sapiens
ttatgtttaaaagaaatat

SEQ ID NO: 4641613 - DNA, 20 bp, Homo sapiens
ttattaaaaatgttctcaaa

SEQ ID NO: 4641614 - DNA, 11 bp, Homo sapiens
ttattaaaaga

SEQ ID NO: 4641615 - DNA, 14 bp, Homo sapiens
ttattaaaagaatg

SEQ ID NO: 4641616 - DNA, 22 bp, Homo sapiens
ttattaattgttttgcactttt

SEQ ID NO: 4641617 - DNA, 19 bp, Homo sapiens
ttattactgtttctaaact

SEQ ID NO: 4641618 - DNA, 13 bp, Homo sapiens
ttattatctttaa

SEQ ID NO: 4641619 - DNA, 13 bp, Homo sapiens
ttattattattat

SEQ ID NO: 4641620 - DNA, 17 bp, Homo sapiens
ttattcaagaatgaaaa

SEQ ID NO: 4641621 - DNA, 19 bp, Homo sapiens
ttattcaagaatgaaaaat

SEQ ID NO: 4641622 - DNA, 15 bp, Homo sapiens
ttattctatctgttt

SEQ ID NO: 4641623 - DNA, 15 bp, Homo sapiens
ttattctttactatt

SEQ ID NO: 4641624 - DNA, 24 bp, Homo sapiens
ttattgaaaaaaaaaatgttgaga

SEQ ID NO: 4641625 - DNA, 13 bp, Homo sapiens
ttattgcttttat

SEQ ID NO: 4641626 - DNA, 20 bp, Homo sapiens
ttattgtaaagtcctatagt

SEQ ID NO: 4641627 - DNA, 12 bp, Homo sapiens
ttatttaagcat

SEQ ID NO: 4641628 - DNA, 19 bp, Homo sapiens
ttatttaagcataatctga

SEQ ID NO: 4641629 - DNA, 17 bp, Homo sapiens
ttatttactaattttct

SEQ ID NO: 4641630 - DNA, 19 bp, Homo sapiens
ttatttctagttctttcct

SEQ ID NO: 4641631 - DNA, 19 bp, Homo sapiens
ttatttctgctctggaata

SEQ ID NO: 4641632 - DNA, 18 bp, Homo sapiens
ttatttgccagagccaaa

SEQ ID NO: 4641633 - DNA, 21 bp, Homo sapiens
ttatttgtaaaccattgtaac

SEQ ID NO: 4641634 - DNA, 14 bp, Homo sapiens
ttattttaatacct

SEQ ID NO: 4641635 - DNA, 15 bp, Homo sapiens
ttattttaggcactg

SEQ ID NO: 4641636 - DNA, 23 bp, Homo sapiens
ttattttaggcactgttcaatac

SEQ ID NO: 4641637 - DNA, 17 bp, Homo sapiens
ttattttattattcaga

SEQ ID NO: 4641638 - DNA, 13 bp, Homo sapiens
ttattttccaaaa

SEQ ID NO: 4641639 - DNA, 15 bp, Homo sapiens
ttcaaaactgtttgt

SEQ ID NO: 4641640 - DNA, 15 bp, Homo sapiens
ttcaaaataaaaagt

SEQ ID NO: 4641641 - DNA, 15 bp, Homo sapiens
ttcaaaccctgtatc

SEQ ID NO: 4641642 - DNA, 15 bp, Homo sapiens
ttcaaactcctgacc

SEQ ID NO: 4641643 - DNA, 17 bp, Homo sapiens
ttcaaactcctgacctc

SEQ ID NO: 4641644 - DNA, 11 bp, Homo sapiens
ttcaaatgtgc

SEQ ID NO: 4641645 - DNA, 17 bp, Homo sapiens
ttcaacaaatttcattg

SEQ ID NO: 4641646 - DNA, 18 bp, Homo sapiens
ttcaacaaatttcattgc

SEQ ID NO: 4641647 - DNA, 15 bp, Homo sapiens
ttcaacctaaatact

SEQ ID NO: 4641648 - DNA, 18 bp, Homo sapiens
ttcaagaatgaaaaatat

SEQ ID NO: 4641649 - DNA, 16 bp, Homo sapiens
ttcaagacgaggggca

SEQ ID NO: 4641650 - DNA, 20 bp, Homo sapiens
ttcaagagctagaaaaataa

SEQ ID NO: 4641651 - DNA, 23 bp, Homo sapiens
ttcaagagctagaaaaataaaat

SEQ ID NO: 4641652 - DNA, 16 bp, Homo sapiens
ttcaagctcatgtcat

SEQ ID NO: 4641653 - DNA, 17 bp, Homo sapiens
ttcaaggaggcccactg

SEQ ID NO: 4641654 - DNA, 23 bp, Homo sapiens
ttcaaggaggcccactgtgtcta

SEQ ID NO: 4641655 - DNA, 10 bp, Homo sapiens
ttcaaggcct

SEQ ID NO: 4641656 - DNA, 12 bp, Homo sapiens
ttcaaggccttc

SEQ ID NO: 4641657 - DNA, 17 bp, Homo sapiens
ttcaaggccttcagttt

SEQ ID NO: 4641658 - DNA, 15 bp, Homo sapiens
ttcaagtgtaaatga

SEQ ID NO: 4641659 - DNA, 15 bp, Homo sapiens
ttcaataaagttgtt

SEQ ID NO: 4641660 - DNA, 19 bp, Homo sapiens
ttcaataaagttgttgcat

SEQ ID NO: 4641661 - DNA, 18 bp, Homo sapiens
ttcaataaatgtctgttg

SEQ ID NO: 4641662 - DNA, 19 bp, Homo sapiens
ttcaataaatgtctgttga

SEQ ID NO: 4641663 - DNA, 17 bp, Homo sapiens
ttcaatcattgaagtat

SEQ ID NO: 4641664 - DNA, 20 bp, Homo sapiens
ttcaatgacttctaatttat

SEQ ID NO: 4641665 - DNA, 18 bp, Homo sapiens
ttcaattccaccagggcc

SEQ ID NO: 4641666 - DNA, 19 bp, Homo sapiens
ttcacaaacattagtatag

SEQ ID NO: 4641667 - DNA, 18 bp, Homo sapiens
ttcacagcttttcttgat

SEQ ID NO: 4641668 - DNA, 19 bp, Homo sapiens
ttcacagcttttcttgata

SEQ ID NO: 4641669 - DNA, 17 bp, Homo sapiens
ttcacaggtagcctatt

SEQ ID NO: 4641670 - DNA, 14 bp, Homo sapiens
ttcaccaaaaccaa

SEQ ID NO: 4641671 - DNA, 23 bp, Homo sapiens
ttcacctcggagggatggagaaa

SEQ ID NO: 4641672 - DNA, 22 bp, Homo sapiens
ttcacctctgggaccccagctg

SEQ ID NO: 4641673 - DNA, 23 bp, Homo sapiens
ttcacctctgggaccccagctgc

SEQ ID NO: 4641674 - DNA, 13 bp, Homo sapiens
ttcacctcttcca

SEQ ID NO: 4641675 - DNA, 14 bp, Homo sapiens
ttcactcctgctgt

SEQ ID NO: 4641676 - DNA, 15 bp, Homo sapiens
ttcactctccagggt

SEQ ID NO: 4641677 - DNA, 19 bp, Homo sapiens
ttcagaaatctggagctgg

SEQ ID NO: 4641678 - DNA, 23 bp, Homo sapiens
ttcagaattatacagacctaata

SEQ ID NO: 4641679 - DNA, 16 bp, Homo sapiens
ttcagacaagacagag

SEQ ID NO: 4641680 - DNA, 21 bp, Homo sapiens
ttcagacacatgctatgttct

SEQ ID NO: 4641681 - DNA, 20 bp, Homo sapiens
ttcagagcccccagccctgg

SEQ ID NO: 4641682 - DNA, 15 bp, Homo sapiens
ttcagatgcttctgg

SEQ ID NO: 4641683 - DNA, 22 bp, Homo sapiens
ttcagcacctacagtgtacagt

SEQ ID NO: 4641684 - DNA, 23 bp, Homo sapiens
ttcagcacctacagtgtacagtc

SEQ ID NO: 4641685 - DNA, 18 bp, Homo sapiens
ttcagcaggctagacaga

SEQ ID NO: 4641686 - DNA, 22 bp, Homo sapiens
ttcagcatctaaagcagcaggt

SEQ ID NO: 4641687 - DNA, 16 bp, Homo sapiens
ttcagcattttttatc

SEQ ID NO: 4641688 - DNA, 15 bp, Homo sapiens
ttcagcctgccttct

SEQ ID NO: 4641689 - DNA, 16 bp, Homo sapiens
ttcagcgatgtatgca

SEQ ID NO: 4641690 - DNA, 11 bp, Homo sapiens
ttcagctcctt

SEQ ID NO: 4641691 - DNA, 11 bp, Homo sapiens
ttcagctctgg

SEQ ID NO: 4641692 - DNA, 15 bp, Homo sapiens
ttcagctctggagaa

SEQ ID NO: 4641693 - DNA, 18 bp, Homo sapiens
ttcagctctttccaaatt

SEQ ID NO: 4641694 - DNA, 20 bp, Homo sapiens
ttcagctctttccaaattaa

SEQ ID NO: 4641695 - DNA, 19 bp, Homo sapiens
ttcaggaaaaggcctgggg

SEQ ID NO: 4641696 - DNA, 19 bp, Homo sapiens
ttcagtaaacataaagcca

SEQ ID NO: 4641697 - DNA, 14 bp, Homo sapiens
ttcagtactttttt

SEQ ID NO: 4641698 - DNA, 19 bp, Homo sapiens
ttcagtacttttttaaata

SEQ ID NO: 4641699 - DNA, 21 bp, Homo sapiens
ttcagtattttctccacttca

SEQ ID NO: 4641700 - DNA, 19 bp, Homo sapiens
ttcagtcctgggcaaaggt

SEQ ID NO: 4641701 - DNA, 17 bp, Homo sapiens
ttcagtgactcctgctg

SEQ ID NO: 4641702 - DNA, 18 bp, Homo sapiens
ttcagtgactcctgctgg

SEQ ID NO: 4641703 - DNA, 19 bp, Homo sapiens
ttcagtgactcctgctggt

SEQ ID NO: 4641704 - DNA, 13 bp, Homo sapiens
ttcagtgcaatca

SEQ ID NO: 4641705 - DNA, 16 bp, Homo sapiens
ttcataagatattctt

SEQ ID NO: 4641706 - DNA, 22 bp, Homo sapiens
ttcataagatattctttacaaa

SEQ ID NO: 4641707 - DNA, 18 bp, Homo sapiens
ttcataatcagtaaatag

SEQ ID NO: 4641708 - DNA, 17 bp, Homo sapiens
ttcatactctgttgcct

SEQ ID NO: 4641709 - DNA, 22 bp, Homo sapiens
ttcatactctgttgcctcctct

SEQ ID NO: 4641710 - DNA, 15 bp, Homo sapiens
ttcatcagtaagcag

SEQ ID NO: 4641711 - DNA, 14 bp, Homo sapiens
ttcatctcagcttt

SEQ ID NO: 4641712 - DNA, 22 bp, Homo sapiens
ttcatgaaaaagctgcttctta

SEQ ID NO: 4641713 - DNA, 21 bp, Homo sapiens
ttcatgcttctactgtgacac

SEQ ID NO: 4641714 - DNA, 22 bp, Homo sapiens
ttcatgcttctactgtgacact

SEQ ID NO: 4641715 - DNA, 18 bp, Homo sapiens
ttcatggagtagcctgga

SEQ ID NO: 4641716 - DNA, 22 bp, Homo sapiens
ttcatggtttgcatttaaacat

SEQ ID NO: 4641717 - DNA, 22 bp, Homo sapiens
ttcatgtcctaaagaagacatt

SEQ ID NO: 4641718 - DNA, 19 bp, Homo sapiens
ttcatgtgtggaaatggga

SEQ ID NO: 4641719 - DNA, 15 bp, Homo sapiens
ttcatgttttaacaa

SEQ ID NO: 4641720 - DNA, 23 bp, Homo sapiens
ttcattaaaggcttctctctcac

SEQ ID NO: 4641721 - DNA, 16 bp, Homo sapiens
ttcattacttgaatgt

SEQ ID NO: 4641722 - DNA, 17 bp, Homo sapiens
ttcattacttgaatgta

SEQ ID NO: 4641723 - DNA, 17 bp, Homo sapiens
ttcattatgttcatgta

SEQ ID NO: 4641724 - DNA, 15 bp, Homo sapiens
ttcattccattgcct

SEQ ID NO: 4641725 - DNA, 16 bp, Homo sapiens
ttcattcctaaagaaa

SEQ ID NO: 4641726 - DNA, 17 bp, Homo sapiens
ttcattctcctcctcct

SEQ ID NO: 4641727 - DNA, 20 bp, Homo sapiens
ttcattctcctcctcctccc

SEQ ID NO: 4641728 - DNA, 13 bp, Homo sapiens
ttcattgcacttt

SEQ ID NO: 4641729 - DNA, 14 bp, Homo sapiens
ttcattgcactttc

SEQ ID NO: 4641730 - DNA, 17 bp, Homo sapiens
ttcattggtgtactgtg

SEQ ID NO: 4641731 - DNA, 21 bp, Homo sapiens
ttcatttcaatcattgaagta

SEQ ID NO: 4641732 - DNA, 18 bp, Homo sapiens
ttcatttcagggtcttgg

SEQ ID NO: 4641733 - DNA, 15 bp, Homo sapiens
ttcatttcatttcag

SEQ ID NO: 4641734 - DNA, 15 bp, Homo sapiens
ttcatttctaattaa

SEQ ID NO: 4641735 - DNA, 21 bp, Homo sapiens
ttcattttaacatgatttcaa

SEQ ID NO: 4641736 - DNA, 20 bp, Homo sapiens
ttcattttagtgtatcttta

SEQ ID NO: 4641737 - DNA, 16 bp, Homo sapiens
ttccaaaagtggcctc

SEQ ID NO: 4641738 - DNA, 17 bp, Homo sapiens
ttccaaaagtggcctct

SEQ ID NO: 4641739 - DNA, 23 bp, Homo sapiens
ttccaaacagacaaaacagataa

SEQ ID NO: 4641740 - DNA, 16 bp, Homo sapiens
ttccaaagaatatttt

SEQ ID NO: 4641741 - DNA, 19 bp, Homo sapiens
ttccaaataataaagtcta

SEQ ID NO: 4641742 - DNA, 17 bp, Homo sapiens
ttccaagaccatttgta

SEQ ID NO: 4641743 - DNA, 18 bp, Homo sapiens
ttccaaggggcaaatttt

SEQ ID NO: 4641744 - DNA, 15 bp, Homo sapiens
ttccaatagaaagaa

SEQ ID NO: 4641745 - DNA, 22 bp, Homo sapiens
ttccaatagttagatctaccct

SEQ ID NO: 4641746 - DNA, 17 bp, Homo sapiens
ttccaatgccacagaca

SEQ ID NO: 4641747 - DNA, 21 bp, Homo sapiens
ttccacagatttttttgtaag

SEQ ID NO: 4641748 - DNA, 13 bp, Homo sapiens
ttccaccagggcc

SEQ ID NO: 4641749 - DNA, 20 bp, Homo sapiens
ttccaccagggccagagcag

SEQ ID NO: 4641750 - DNA, 13 bp, Homo sapiens
ttccacctcaccc

SEQ ID NO: 4641751 - DNA, 17 bp, Homo sapiens
ttccacctccagcctct

SEQ ID NO: 4641752 - DNA, 20 bp, Homo sapiens
ttccacctccagcctctggt

SEQ ID NO: 4641753 - DNA, 18 bp, Homo sapiens
ttccactaaaaatattgt

SEQ ID NO: 4641754 - DNA, 18 bp, Homo sapiens
ttccactattttcaaaga

SEQ ID NO: 4641755 - DNA, 16 bp, Homo sapiens
ttccacttgccctgtg

SEQ ID NO: 4641756 - DNA, 15 bp, Homo sapiens
ttccagaacactctt

SEQ ID NO: 4641757 - DNA, 14 bp, Homo sapiens
ttccagattcctat

SEQ ID NO: 4641758 - DNA, 15 bp, Homo sapiens
ttccagcaagcaaag

SEQ ID NO: 4641759 - DNA, 11 bp, Homo sapiens
ttccagttccc

SEQ ID NO: 4641760 - DNA, 22 bp, Homo sapiens
ttccagttttgtggattaaacc

SEQ ID NO: 4641761 - DNA, 23 bp, Homo sapiens
ttccatcccaaccagtgccaagg

SEQ ID NO: 4641762 - DNA, 13 bp, Homo sapiens
ttccatctagttt

SEQ ID NO: 4641763 - DNA, 16 bp, Homo sapiens
ttccatctatcactgc

SEQ ID NO: 4641764 - DNA, 16 bp, Homo sapiens
ttccatggccctcatt

SEQ ID NO: 4641765 - DNA, 16 bp, Homo sapiens
ttccatggtgtatatg

SEQ ID NO: 4641766 - DNA, 17 bp, Homo sapiens
ttccattgtttgaaaca

SEQ ID NO: 4641767 - DNA, 19 bp, Homo sapiens
ttccatttatgctggttaa

SEQ ID NO: 4641768 - DNA, 17 bp, Homo sapiens
ttcccaagctagactgt

SEQ ID NO: 4641769 - DNA, 13 bp, Homo sapiens
ttcccacaagcct

SEQ ID NO: 4641770 - DNA, 17 bp, Homo sapiens
ttcccacaagcctgcct

SEQ ID NO: 4641771 - DNA, 17 bp, Homo sapiens
ttcccacccaggaaagg

SEQ ID NO: 4641772 - DNA, 23 bp, Homo sapiens
ttcccagaatgttactgactcct

SEQ ID NO: 4641773 - DNA, 15 bp, Homo sapiens
ttcccatccccagcg

SEQ ID NO: 4641774 - DNA, 16 bp, Homo sapiens
ttcccatggagttgcc

SEQ ID NO: 4641775 - DNA, 13 bp, Homo sapiens
ttccccaaggacc

SEQ ID NO: 4641776 - DNA, 19 bp, Homo sapiens
ttccccagctcccccaggc

SEQ ID NO: 4641777 - DNA, 20 bp, Homo sapiens
ttccccagctcccccaggca

SEQ ID NO: 4641778 - DNA, 17 bp, Homo sapiens
ttccccatctcactctt

SEQ ID NO: 4641779 - DNA, 18 bp, Homo sapiens
ttcccccactactgcagc

SEQ ID NO: 4641780 - DNA, 22 bp, Homo sapiens
ttccccctgcttccacctcacc

SEQ ID NO: 4641781 - DNA, 22 bp, Homo sapiens
ttccccctttctctgcctggca

SEQ ID NO: 4641782 - DNA, 20 bp, Homo sapiens
ttccccttttaaggtttcaa

SEQ ID NO: 4641783 - DNA, 23 bp, Homo sapiens
ttcccgtggaacgtttttcctgt

SEQ ID NO: 4641784 - DNA, 18 bp, Homo sapiens
ttccctaatagcttttta

SEQ ID NO: 4641785 - DNA, 14 bp, Homo sapiens
ttccctacacaggg

SEQ ID NO: 4641786 - DNA, 15 bp, Homo sapiens
ttccctacacagggc

SEQ ID NO: 4641787 - DNA, 17 bp, Homo sapiens
ttccctataggaacagc

SEQ ID NO: 4641788 - DNA, 20 bp, Homo sapiens
ttccctatggagaggcttcc

SEQ ID NO: 4641789 - DNA, 21 bp, Homo sapiens
ttccctctgcattgacctgga

SEQ ID NO: 4641790 - DNA, 13 bp, Homo sapiens
ttccctctgcctg

SEQ ID NO: 4641791 - DNA, 11 bp, Homo sapiens
ttccctgctga

SEQ ID NO: 4641792 - DNA, 12 bp, Homo sapiens
ttccctgctgaa

SEQ ID NO: 4641793 - DNA, 13 bp, Homo sapiens
ttccctgctgaat

SEQ ID NO: 4641794 - DNA, 14 bp, Homo sapiens
ttcccttagtgact

SEQ ID NO: 4641795 - DNA, 15 bp, Homo sapiens
ttcccttcctcagca

SEQ ID NO: 4641796 - DNA, 20 bp, Homo sapiens
ttcccttgctcatgagctcc

SEQ ID NO: 4641797 - DNA, 20 bp, Homo sapiens
ttccgagacaccacaaggca

SEQ ID NO: 4641798 - DNA, 12 bp, Homo sapiens
ttccgctgaggg

SEQ ID NO: 4641799 - DNA, 22 bp, Homo sapiens
ttccgctttgaaagaagcaaga

SEQ ID NO: 4641800 - DNA, 16 bp, Homo sapiens
ttccgttcctccccct

SEQ ID NO: 4641801 - DNA, 13 bp, Homo sapiens
ttcctaaagaaaa

SEQ ID NO: 4641802 - DNA, 20 bp, Homo sapiens
ttcctaacatgcaccttgct

SEQ ID NO: 4641803 - DNA, 17 bp, Homo sapiens
ttcctacagcactactg

SEQ ID NO: 4641804 - DNA, 21 bp, Homo sapiens
ttcctacagcactactgggtg

SEQ ID NO: 4641805 - DNA, 19 bp, Homo sapiens
ttcctactgacaacattat

SEQ ID NO: 4641806 - DNA, 13 bp, Homo sapiens
ttcctatgatgga

SEQ ID NO: 4641807 - DNA, 18 bp, Homo sapiens
ttcctatgatggatggca

SEQ ID NO: 4641808 - DNA, 15 bp, Homo sapiens
ttcctcagcaggcca

SEQ ID NO: 4641809 - DNA, 14 bp, Homo sapiens
ttcctccattttta

SEQ ID NO: 4641810 - DNA, 14 bp, Homo sapiens
ttcctccccctgca

SEQ ID NO: 4641811 - DNA, 15 bp, Homo sapiens
ttcctccccctgcaa

SEQ ID NO: 4641812 - DNA, 20 bp, Homo sapiens
ttcctctgcccttcctgcag

SEQ ID NO: 4641813 - DNA, 15 bp, Homo sapiens
ttcctcttcctgccc

SEQ ID NO: 4641814 - DNA, 15 bp, Homo sapiens
ttcctcttcttgttg

SEQ ID NO: 4641815 - DNA, 12 bp, Homo sapiens
ttcctctttgtt

SEQ ID NO: 4641816 - DNA, 14 bp, Homo sapiens
ttcctgaagcattt

SEQ ID NO: 4641817 - DNA, 13 bp, Homo sapiens
ttcctgaagggaa

SEQ ID NO: 4641818 - DNA, 14 bp, Homo sapiens
ttcctgaattggaa

SEQ ID NO: 4641819 - DNA, 21 bp, Homo sapiens
ttcctgcagcagagcctggaa

SEQ ID NO: 4641820 - DNA, 21 bp, Homo sapiens
ttcctgcaggcaggaacaaac

SEQ ID NO: 4641821 - DNA, 18 bp, Homo sapiens
ttcctgctgaacgtttcc

SEQ ID NO: 4641822 - DNA, 22 bp, Homo sapiens
ttcctgctgaacgtttccccga

SEQ ID NO: 4641823 - DNA, 12 bp, Homo sapiens
ttcctgctgcct

SEQ ID NO: 4641824 - DNA, 23 bp, Homo sapiens
ttcctgctgcctgggtaggcccc

SEQ ID NO: 4641825 - DNA, 21 bp, Homo sapiens
ttcctggaagtcaaataaatg

SEQ ID NO: 4641826 - DNA, 23 bp, Homo sapiens
ttcctggaagtcaaataaatgtt

SEQ ID NO: 4641827 - DNA, 19 bp, Homo sapiens
ttcctggacagctgtgcct

SEQ ID NO: 4641828 - DNA, 21 bp, Homo sapiens
ttcctggacagctgtgcctcg

SEQ ID NO: 4641829 - DNA, 16 bp, Homo sapiens
ttcctggcctcagagc

SEQ ID NO: 4641830 - DNA, 24 bp, Homo sapiens
ttcctggcctcagagcttcctggg

SEQ ID NO: 4641831 - DNA, 18 bp, Homo sapiens
ttcctggggaccaagatt

SEQ ID NO: 4641832 - DNA, 22 bp, Homo sapiens
ttcctgtatttgttcccaagag

SEQ ID NO: 4641833 - DNA, 19 bp, Homo sapiens
ttcctgtggctccctctct

SEQ ID NO: 4641834 - DNA, 21 bp, Homo sapiens
ttcctgtggctccctctctcc

SEQ ID NO: 4641835 - DNA, 22 bp, Homo sapiens
ttcctgtggttttattacaaat

SEQ ID NO: 4641836 - DNA, 17 bp, Homo sapiens
ttcctgtgtgtactctg

SEQ ID NO: 4641837 - DNA, 13 bp, Homo sapiens
ttccttagtttca

SEQ ID NO: 4641838 - DNA, 15 bp, Homo sapiens
ttccttatcctagcc

SEQ ID NO: 4641839 - DNA, 15 bp, Homo sapiens
ttccttccactaact

SEQ ID NO: 4641840 - DNA, 21 bp, Homo sapiens
ttccttccatgctcccaactc

SEQ ID NO: 4641841 - DNA, 19 bp, Homo sapiens
ttccttcgaaaggccttca

SEQ ID NO: 4641842 - DNA, 20 bp, Homo sapiens
ttccttcgaaaggccttcag

SEQ ID NO: 4641843 - DNA, 13 bp, Homo sapiens
ttcctttgccctt

SEQ ID NO: 4641844 - DNA, 17 bp, Homo sapiens
ttcctttgcccttcctc

SEQ ID NO: 4641845 - DNA, 13 bp, Homo sapiens
ttcgaaaggcctt

SEQ ID NO: 4641846 - DNA, 23 bp, Homo sapiens
ttcgaagctgttaatttttctta

SEQ ID NO: 4641847 - DNA, 23 bp, Homo sapiens
ttcgaatcttaatttattatttt

SEQ ID NO: 4641848 - DNA, 11 bp, Homo sapiens
ttcgcagccac

SEQ ID NO: 4641849 - DNA, 24 bp, Homo sapiens
ttcgcagccaccctgaggagtctg

SEQ ID NO: 4641850 - DNA, 14 bp, Homo sapiens
ttcgcatgtttaat

SEQ ID NO: 4641851 - DNA, 17 bp, Homo sapiens
ttcgcatgtttaatgtg

SEQ ID NO: 4641852 - DNA, 12 bp, Homo sapiens
ttcgtgaacata

SEQ ID NO: 4641853 - DNA, 23 bp, Homo sapiens
ttcgttaagaatttggggcagga

SEQ ID NO: 4641854 - DNA, 20 bp, Homo sapiens
ttcgttgcacagctgtttga

SEQ ID NO: 4641855 - DNA, 15 bp, Homo sapiens
ttcgtttggtcttag

SEQ ID NO: 4641856 - DNA, 12 bp, Homo sapiens
ttcgttttggag

SEQ ID NO: 4641857 - DNA, 14 bp, Homo sapiens
ttctaaaatagcaa

SEQ ID NO: 4641858 - DNA, 16 bp, Homo sapiens
ttctaaaatagcaata

SEQ ID NO: 4641859 - DNA, 22 bp, Homo sapiens
ttctaaccacggttatttaagc

SEQ ID NO: 4641860 - DNA, 22 bp, Homo sapiens
ttctaagaaaatgtagttagct

SEQ ID NO: 4641861 - DNA, 15 bp, Homo sapiens
ttctaagtgtacttc

SEQ ID NO: 4641862 - DNA, 12 bp, Homo sapiens
ttctaatgcata

SEQ ID NO: 4641863 - DNA, 13 bp, Homo sapiens
ttctaatgcatat

SEQ ID NO: 4641864 - DNA, 14 bp, Homo sapiens
ttctaatttatatt

SEQ ID NO: 4641865 - DNA, 16 bp, Homo sapiens
ttctacccgttccaaa

SEQ ID NO: 4641866 - DNA, 13 bp, Homo sapiens
ttctacccttttc

SEQ ID NO: 4641867 - DNA, 16 bp, Homo sapiens
ttctactctagatggc

SEQ ID NO: 4641868 - DNA, 18 bp, Homo sapiens
ttctatcagactcagttt

SEQ ID NO: 4641869 - DNA, 14 bp, Homo sapiens
ttctatgacaaatt

SEQ ID NO: 4641870 - DNA, 22 bp, Homo sapiens
ttctattaatcaagagaaactt

SEQ ID NO: 4641871 - DNA, 22 bp, Homo sapiens
ttctattcattcattttgaaat

SEQ ID NO: 4641872 - DNA, 16 bp, Homo sapiens
ttctatttttcaatca

SEQ ID NO: 4641873 - DNA, 17 bp, Homo sapiens
ttctatttttcaatcat

SEQ ID NO: 4641874 - DNA, 18 bp, Homo sapiens
ttctatttttcaatcatc

SEQ ID NO: 4641875 - DNA, 16 bp, Homo sapiens
ttctcaacatactgta

SEQ ID NO: 4641876 - DNA, 22 bp, Homo sapiens
ttctcaacatactgtaatcaaa

SEQ ID NO: 4641877 - DNA, 22 bp, Homo sapiens
ttctcagactttggaaaatgca

SEQ ID NO: 4641878 - DNA, 16 bp, Homo sapiens
ttctcaggacacaggc

SEQ ID NO: 4641879 - DNA, 16 bp, Homo sapiens
ttctcagtttctgcct

SEQ ID NO: 4641880 - DNA, 17 bp, Homo sapiens
ttctcataattcctaca

SEQ ID NO: 4641881 - DNA, 20 bp, Homo sapiens
ttctcataattcctacagca

SEQ ID NO: 4641882 - DNA, 23 bp, Homo sapiens
ttctcataattcctacagcacta

SEQ ID NO: 4641883 - DNA, 22 bp, Homo sapiens
ttctccatgctgcaaaggagaa

SEQ ID NO: 4641884 - DNA, 17 bp, Homo sapiens
ttctccattccctagca

SEQ ID NO: 4641885 - DNA, 23 bp, Homo sapiens
ttctcccacatgaggccatctca

SEQ ID NO: 4641886 - DNA, 12 bp, Homo sapiens
ttctcccaggcc

SEQ ID NO: 4641887 - DNA, 22 bp, Homo sapiens
ttctcccttaggaatatacata

SEQ ID NO: 4641888 - DNA, 21 bp, Homo sapiens
ttctcctggcccctgcctgct

SEQ ID NO: 4641889 - DNA, 21 bp, Homo sapiens
ttctcggggtgggacagacga

SEQ ID NO: 4641890 - DNA, 19 bp, Homo sapiens
ttctcggtccactcttgtt

SEQ ID NO: 4641891 - DNA, 18 bp, Homo sapiens
ttctctactccctcttgt

SEQ ID NO: 4641892 - DNA, 18 bp, Homo sapiens
ttctctagctctctaggc

SEQ ID NO: 4641893 - DNA, 22 bp, Homo sapiens
ttctctagctctctaggcctct

SEQ ID NO: 4641894 - DNA, 22 bp, Homo sapiens
ttctctcatctaactgatgagt

SEQ ID NO: 4641895 - DNA, 22 bp, Homo sapiens
ttctctcttgattgatttttaa

SEQ ID NO: 4641896 - DNA, 17 bp, Homo sapiens
ttctctcttttaaagta

SEQ ID NO: 4641897 - DNA, 21 bp, Homo sapiens
ttctctgtacttttcattctc

SEQ ID NO: 4641898 - DNA, 11 bp, Homo sapiens
ttctctgtgaa

SEQ ID NO: 4641899 - DNA, 12 bp, Homo sapiens
ttctctgtgaat

SEQ ID NO: 4641900 - DNA, 22 bp, Homo sapiens
ttctctgtgaatccatgggtct

SEQ ID NO: 4641901 - DNA, 23 bp, Homo sapiens
ttctctgttctacccgttccaaa

SEQ ID NO: 4641902 - DNA, 21 bp, Homo sapiens
ttctcttagagattttcattt

SEQ ID NO: 4641903 - DNA, 15 bp, Homo sapiens
ttctcttgaataaag

SEQ ID NO: 4641904 - DNA, 17 bp, Homo sapiens
ttctgaatgtttgtgtc

SEQ ID NO: 4641905 - DNA, 20 bp, Homo sapiens
ttctgaatgtttgtgtctgt

SEQ ID NO: 4641906 - DNA, 21 bp, Homo sapiens
ttctgaatgtttgtgtctgtg

SEQ ID NO: 4641907 - DNA, 22 bp, Homo sapiens
ttctgaatgtttgtgtctgtgg

SEQ ID NO: 4641908 - DNA, 23 bp, Homo sapiens
ttctgaatgtttgtgtctgtggt

SEQ ID NO: 4641909 - DNA, 15 bp, Homo sapiens
ttctgacttatgaat

SEQ ID NO: 4641910 - DNA, 22 bp, Homo sapiens
ttctgcaaagtgtatgtgacca

SEQ ID NO: 4641911 - DNA, 15 bp, Homo sapiens
ttctgcatgagctga

SEQ ID NO: 4641912 - DNA, 18 bp, Homo sapiens
ttctgcatgagctgatca

SEQ ID NO: 4641913 - DNA, 21 bp, Homo sapiens
ttctgcattcatttttatagc

SEQ ID NO: 4641914 - DNA, 15 bp, Homo sapiens
ttctgcctagagtgt

SEQ ID NO: 4641915 - DNA, 14 bp, Homo sapiens
ttctgcgcttcagt

SEQ ID NO: 4641916 - DNA, 15 bp, Homo sapiens
ttctgctcagctctg

SEQ ID NO: 4641917 - DNA, 17 bp, Homo sapiens
ttctgctctggaataaa

SEQ ID NO: 4641918 - DNA, 14 bp, Homo sapiens
ttctgctgctggcc

SEQ ID NO: 4641919 - DNA, 19 bp, Homo sapiens
ttctgcttttgaaatctgt

SEQ ID NO: 4641920 - DNA, 16 bp, Homo sapiens
ttctggctctcccatt

SEQ ID NO: 4641921 - DNA, 10 bp, Homo sapiens
ttctgggctc

SEQ ID NO: 4641922 - DNA, 14 bp, Homo sapiens
ttctgggctctgga

SEQ ID NO: 4641923 - DNA, 19 bp, Homo sapiens
ttctgggctctggactcca

SEQ ID NO: 4641924 - DNA, 15 bp, Homo sapiens
ttctggtttcccttt

SEQ ID NO: 4641925 - DNA, 22 bp, Homo sapiens
ttctgtaaggggcagcagttga

SEQ ID NO: 4641926 - DNA, 23 bp, Homo sapiens
ttctgtccccatctaggtcctgg

SEQ ID NO: 4641927 - DNA, 22 bp, Homo sapiens
ttctgtggaagtagctttgaac

SEQ ID NO: 4641928 - DNA, 21 bp, Homo sapiens
ttctgtgtaaacagaagcctg

SEQ ID NO: 4641929 - DNA, 22 bp, Homo sapiens
ttctgtgtggtgcattcctgaa

SEQ ID NO: 4641930 - DNA, 12 bp, Homo sapiens
ttcttaaaactt

SEQ ID NO: 4641931 - DNA, 19 bp, Homo sapiens
ttcttaaaactttattaaa

SEQ ID NO: 4641932 - DNA, 20 bp, Homo sapiens
ttcttaaaactttattaaaa

SEQ ID NO: 4641933 - DNA, 14 bp, Homo sapiens
ttcttaaggttttg

SEQ ID NO: 4641934 - DNA, 22 bp, Homo sapiens
ttcttaccctgtacatatgtaa

SEQ ID NO: 4641935 - DNA, 14 bp, Homo sapiens
ttcttacttttatt

SEQ ID NO: 4641936 - DNA, 22 bp, Homo sapiens
ttcttagagtgtagctgtaagg

SEQ ID NO: 4641937 - DNA, 17 bp, Homo sapiens
ttcttagctttgaaact

SEQ ID NO: 4641938 - DNA, 24 bp, Homo sapiens
ttcttagtccagttgtgttgacac

SEQ ID NO: 4641939 - DNA, 14 bp, Homo sapiens
ttcttatccttaca

SEQ ID NO: 4641940 - DNA, 17 bp, Homo sapiens
ttcttatgcaaaatgga

SEQ ID NO: 4641941 - DNA, 20 bp, Homo sapiens
ttcttcagcgtaaaatggtg

SEQ ID NO: 4641942 - DNA, 17 bp, Homo sapiens
ttcttcatttggaggaa

SEQ ID NO: 4641943 - DNA, 17 bp, Homo sapiens
ttcttgcttcagtcatc

SEQ ID NO: 4641944 - DNA, 23 bp, Homo sapiens
ttcttgggcctcaggctctgcac

SEQ ID NO: 4641945 - DNA, 17 bp, Homo sapiens
ttcttgtcagacataaa

SEQ ID NO: 4641946 - DNA, 20 bp, Homo sapiens
ttcttgtcagacataaagcc

SEQ ID NO: 4641947 - DNA, 22 bp, Homo sapiens
ttcttgtgccatagtcacatgg

SEQ ID NO: 4641948 - DNA, 17 bp, Homo sapiens
ttctttaaaagaatgac

SEQ ID NO: 4641949 - DNA, 19 bp, Homo sapiens
ttctttcccttagtgactc

SEQ ID NO: 4641950 - DNA, 16 bp, Homo sapiens
ttctttccggccaagg

SEQ ID NO: 4641951 - DNA, 14 bp, Homo sapiens
ttctttccttgttc

SEQ ID NO: 4641952 - DNA, 22 bp, Homo sapiens
ttctttctctttctgtttcctg

SEQ ID NO: 4641953 - DNA, 15 bp, Homo sapiens
ttctttgaatttact

SEQ ID NO: 4641954 - DNA, 16 bp, Homo sapiens
ttctttgtactaatac

SEQ ID NO: 4641955 - DNA, 16 bp, Homo sapiens
ttctttgtatcttaaa

SEQ ID NO: 4641956 - DNA, 17 bp, Homo sapiens
ttctttgtatcttaaat

SEQ ID NO: 4641957 - DNA, 21 bp, Homo sapiens
ttctttgtatcttaaatctgt

SEQ ID NO: 4641958 - DNA, 11 bp, Homo sapiens
ttctttgtgtt

SEQ ID NO: 4641959 - DNA, 14 bp, Homo sapiens
ttcttttacagact

SEQ ID NO: 4641960 - DNA, 18 bp, Homo sapiens
ttctttttttccttttta

SEQ ID NO: 4641961 - DNA, 21 bp, Homo sapiens
ttcttttttttttttttgaga

SEQ ID NO: 4641962 - DNA, 14 bp, Homo sapiens
ttgaaaaactcttt

SEQ ID NO: 4641963 - DNA, 16 bp, Homo sapiens
ttgaaaagtttcctag

SEQ ID NO: 4641964 - DNA, 14 bp, Homo sapiens
ttgaaacctgttaa

SEQ ID NO: 4641965 - DNA, 17 bp, Homo sapiens
ttgaaacttacactgtt

SEQ ID NO: 4641966 - DNA, 20 bp, Homo sapiens
ttgaaacttacactgtttca

SEQ ID NO: 4641967 - DNA, 13 bp, Homo sapiens
ttgaaagaagttt

SEQ ID NO: 4641968 - DNA, 14 bp, Homo sapiens
ttgaaataaaacat

SEQ ID NO: 4641969 - DNA, 21 bp, Homo sapiens
ttgaaataactggaacaaatt

SEQ ID NO: 4641970 - DNA, 16 bp, Homo sapiens
ttgaaccatccactta

SEQ ID NO: 4641971 - DNA, 17 bp, Homo sapiens
ttgaaccccctccctgt

SEQ ID NO: 4641972 - DNA, 20 bp, Homo sapiens
ttgaaccccctccctgtccc

SEQ ID NO: 4641973 - DNA, 19 bp, Homo sapiens
ttgaagaaagtcagctctt

SEQ ID NO: 4641974 - DNA, 17 bp, Homo sapiens
ttgaagccgactctggc

SEQ ID NO: 4641975 - DNA, 23 bp, Homo sapiens
ttgaaggagtttaaaaggaggct

SEQ ID NO: 4641976 - DNA, 22 bp, Homo sapiens
ttgaagtatattcttattggaa

SEQ ID NO: 4641977 - DNA, 19 bp, Homo sapiens
ttgaagtatggtgtgttca

SEQ ID NO: 4641978 - DNA, 22 bp, Homo sapiens
ttgaataagcagaacatactgt

SEQ ID NO: 4641979 - DNA, 17 bp, Homo sapiens
ttgacacatatgaacac

SEQ ID NO: 4641980 - DNA, 17 bp, Homo sapiens
ttgacagatcaagctgt

SEQ ID NO: 4641981 - DNA, 21 bp, Homo sapiens
ttgacataggtcataaagcat

SEQ ID NO: 4641982 - DNA, 23 bp, Homo sapiens
ttgacataggtcataaagcattg

SEQ ID NO: 4641983 - DNA, 16 bp, Homo sapiens
ttgacatgtagcttct

SEQ ID NO: 4641984 - DNA, 18 bp, Homo sapiens
ttgacccttttttgaacc

SEQ ID NO: 4641985 - DNA, 12 bp, Homo sapiens
ttgacctggagg

SEQ ID NO: 4641986 - DNA, 23 bp, Homo sapiens
ttgacctggaggggagaggtcag

SEQ ID NO: 4641987 - DNA, 14 bp, Homo sapiens
ttgactaattttac

SEQ ID NO: 4641988 - DNA, 16 bp, Homo sapiens
ttgactcctttccaat

SEQ ID NO: 4641989 - DNA, 20 bp, Homo sapiens
ttgactgaagcgaacatctt

SEQ ID NO: 4641990 - DNA, 21 bp, Homo sapiens
ttgactgaagcgaacatcttc

SEQ ID NO: 4641991 - DNA, 16 bp, Homo sapiens
ttgacttcttgcttca

SEQ ID NO: 4641992 - DNA, 23 bp, Homo sapiens
ttgagaaaaatagagcaaaatca

SEQ ID NO: 4641993 - DNA, 16 bp, Homo sapiens
ttgagactgtcctgtg

SEQ ID NO: 4641994 - DNA, 14 bp, Homo sapiens
ttgagatggagtct

SEQ ID NO: 4641995 - DNA, 14 bp, Homo sapiens
ttgagggaccaata

SEQ ID NO: 4641996 - DNA, 18 bp, Homo sapiens
ttgagggccttgcacata

SEQ ID NO: 4641997 - DNA, 16 bp, Homo sapiens
ttgagtaaaaagacat

SEQ ID NO: 4641998 - DNA, 19 bp, Homo sapiens
ttgatagtcctgacctcat

SEQ ID NO: 4641999 - DNA, 17 bp, Homo sapiens
ttgatcaaatatagaaa

SEQ ID NO: 4642000 - DNA, 18 bp, Homo sapiens
ttgatccagtcattttat

SEQ ID NO: 4642001 - DNA, 18 bp, Homo sapiens
ttgatgcagataaaatat

SEQ ID NO: 4642002 - DNA, 16 bp, Homo sapiens
ttgatgtgtgtctagg

SEQ ID NO: 4642003 - DNA, 17 bp, Homo sapiens
ttgattaagcttttgtc

SEQ ID NO: 4642004 - DNA, 17 bp, Homo sapiens
ttgattgatttttaaag

SEQ ID NO: 4642005 - DNA, 16 bp, Homo sapiens
ttgatttcctgtgtgt

SEQ ID NO: 4642006 - DNA, 18 bp, Homo sapiens
ttgatttttaaagtttaa

SEQ ID NO: 4642007 - DNA, 18 bp, Homo sapiens
ttgatttttttaaacata

SEQ ID NO: 4642008 - DNA, 12 bp, Homo sapiens
ttgcaaagaact

SEQ ID NO: 4642009 - DNA, 19 bp, Homo sapiens
ttgcaaggtgtgatggtct

SEQ ID NO: 4642010 - DNA, 18 bp, Homo sapiens
ttgcacagctgtttgaaa

SEQ ID NO: 4642011 - DNA, 17 bp, Homo sapiens
ttgcactcatcatattt

SEQ ID NO: 4642012 - DNA, 14 bp, Homo sapiens
ttgcactgcttata

SEQ ID NO: 4642013 - DNA, 10 bp, Homo sapiens
ttgcactttc

SEQ ID NO: 4642014 - DNA, 22 bp, Homo sapiens
ttgcactttcctttcaataaag

SEQ ID NO: 4642015 - DNA, 17 bp, Homo sapiens
ttgcagaatgaagccat

SEQ ID NO: 4642016 - DNA, 14 bp, Homo sapiens
ttgcagtctttccc

SEQ ID NO: 4642017 - DNA, 15 bp, Homo sapiens
ttgcagttgatgtgt

SEQ ID NO: 4642018 - DNA, 22 bp, Homo sapiens
ttgcagttgatgtgtctttttt

SEQ ID NO: 4642019 - DNA, 13 bp, Homo sapiens
ttgcataagagct

SEQ ID NO: 4642020 - DNA, 17 bp, Homo sapiens
ttgcatgggctaatgaa

SEQ ID NO: 4642021 - DNA, 22 bp, Homo sapiens
ttgcatgggctaatgaagatca

SEQ ID NO: 4642022 - DNA, 19 bp, Homo sapiens
ttgcatttaaacatgttta

SEQ ID NO: 4642023 - DNA, 16 bp, Homo sapiens
ttgcatttagcttctt

SEQ ID NO: 4642024 - DNA, 15 bp, Homo sapiens
ttgcatttgctcttt

SEQ ID NO: 4642025 - DNA, 19 bp, Homo sapiens
ttgccaaaattcatttcta

SEQ ID NO: 4642026 - DNA, 17 bp, Homo sapiens
ttgccacagtagaactg

SEQ ID NO: 4642027 - DNA, 18 bp, Homo sapiens
ttgccacagtagaactgt

SEQ ID NO: 4642028 - DNA, 14 bp, Homo sapiens
ttgccacatcccta

SEQ ID NO: 4642029 - DNA, 19 bp, Homo sapiens
ttgccacccccagttccta

SEQ ID NO: 4642030 - DNA, 12 bp, Homo sapiens
ttgccagactct

SEQ ID NO: 4642031 - DNA, 17 bp, Homo sapiens
ttgccataccattccca

SEQ ID NO: 4642032 - DNA, 18 bp, Homo sapiens
ttgccatcaccatttggt

SEQ ID NO: 4642033 - DNA, 19 bp, Homo sapiens
ttgccatccgcacagaaaa

SEQ ID NO: 4642034 - DNA, 23 bp, Homo sapiens
ttgcccctggggcttccatccca

SEQ ID NO: 4642035 - DNA, 17 bp, Homo sapiens
ttgcccttacctgtctc

SEQ ID NO: 4642036 - DNA, 13 bp, Homo sapiens
ttgcccttcctcc

SEQ ID NO: 4642037 - DNA, 18 bp, Homo sapiens
ttgcccttcctcctgcct

SEQ ID NO: 4642038 - DNA, 20 bp, Homo sapiens
ttgcctatgcccagggaata

SEQ ID NO: 4642039 - DNA, 14 bp, Homo sapiens
ttgcctccatcttt

SEQ ID NO: 4642040 - DNA, 19 bp, Homo sapiens
ttgcctcctctctccctgc

SEQ ID NO: 4642041 - DNA, 13 bp, Homo sapiens
ttgcctgtcaagt

SEQ ID NO: 4642042 - DNA, 19 bp, Homo sapiens
ttgccttttaatttttaat

SEQ ID NO: 4642043 - DNA, 21 bp, Homo sapiens
ttgcggggcctgtctcagtga

SEQ ID NO: 4642044 - DNA, 15 bp, Homo sapiens
ttgcgtacacagaga

SEQ ID NO: 4642045 - DNA, 22 bp, Homo sapiens
ttgctaatcaaagccagggtct

SEQ ID NO: 4642046 - DNA, 18 bp, Homo sapiens
ttgctcaccgactcacct

SEQ ID NO: 4642047 - DNA, 20 bp, Homo sapiens
ttgctcaccgactcacctgc

SEQ ID NO: 4642048 - DNA, 23 bp, Homo sapiens
ttgctcaccgactcacctgcgca

SEQ ID NO: 4642049 - DNA, 19 bp, Homo sapiens
ttgctcccaagcccctgac

SEQ ID NO: 4642050 - DNA, 14 bp, Homo sapiens
ttgctcccaggatc

SEQ ID NO: 4642051 - DNA, 17 bp, Homo sapiens
ttgctcccctgatagaa

SEQ ID NO: 4642052 - DNA, 22 bp, Homo sapiens
ttgctctcgaccggccctgcat

SEQ ID NO: 4642053 - DNA, 13 bp, Homo sapiens
ttgctctgttccc

SEQ ID NO: 4642054 - DNA, 11 bp, Homo sapiens
ttgctctttca

SEQ ID NO: 4642055 - DNA, 18 bp, Homo sapiens
ttgctggggccaggcccc

SEQ ID NO: 4642056 - DNA, 23 bp, Homo sapiens
ttgctgtaccagcccagatgttt

SEQ ID NO: 4642057 - DNA, 20 bp, Homo sapiens
ttgctgtcacttcttcacct

SEQ ID NO: 4642058 - DNA, 17 bp, Homo sapiens
ttgctgtgtagttccct

SEQ ID NO: 4642059 - DNA, 20 bp, Homo sapiens
ttgctgtgtagttccctctg

SEQ ID NO: 4642060 - DNA, 21 bp, Homo sapiens
ttgctgtgtagttccctctgc

SEQ ID NO: 4642061 - DNA, 22 bp, Homo sapiens
ttgctgtgtagttccctctgcc

SEQ ID NO: 4642062 - DNA, 17 bp, Homo sapiens
ttgctgttcacagcttt

SEQ ID NO: 4642063 - DNA, 18 bp, Homo sapiens
ttgctgttcacagctttt

SEQ ID NO: 4642064 - DNA, 15 bp, Homo sapiens
ttgcttccaagacca

SEQ ID NO: 4642065 - DNA, 13 bp, Homo sapiens
ttgcttgagccca

SEQ ID NO: 4642066 - DNA, 19 bp, Homo sapiens
ttgcttgagcccagaactt

SEQ ID NO: 4642067 - DNA, 17 bp, Homo sapiens
ttgctttcctgggcctt

SEQ ID NO: 4642068 - DNA, 13 bp, Homo sapiens
ttgctttctgaaa

SEQ ID NO: 4642069 - DNA, 14 bp, Homo sapiens
ttgctttctgaaat

SEQ ID NO: 4642070 - DNA, 18 bp, Homo sapiens
ttgctttctttagaattt

SEQ ID NO: 4642071 - DNA, 16 bp, Homo sapiens
ttggaactgtgtttca

SEQ ID NO: 4642072 - DNA, 21 bp, Homo sapiens
ttggacagctgactgaatgca

SEQ ID NO: 4642073 - DNA, 22 bp, Homo sapiens
ttggacagctgactgaatgcag

SEQ ID NO: 4642074 - DNA, 15 bp, Homo sapiens
ttggactagccagaa

SEQ ID NO: 4642075 - DNA, 18 bp, Homo sapiens
ttggactgttagtgttaa

SEQ ID NO: 4642076 - DNA, 13 bp, Homo sapiens
ttggaggagagag

SEQ ID NO: 4642077 - DNA, 22 bp, Homo sapiens
ttggagtttaggaattggaggc

SEQ ID NO: 4642078 - DNA, 23 bp, Homo sapiens
ttggagtttaggaattggaggct

SEQ ID NO: 4642079 - DNA, 15 bp, Homo sapiens
ttggagtttttctga

SEQ ID NO: 4642080 - DNA, 21 bp, Homo sapiens
ttggataagtttctattctgt

SEQ ID NO: 4642081 - DNA, 17 bp, Homo sapiens
ttggatcttgaatgtgg

SEQ ID NO: 4642082 - DNA, 16 bp, Homo sapiens
ttggcaatattcctta

SEQ ID NO: 4642083 - DNA, 11 bp, Homo sapiens
ttggcccagcg

SEQ ID NO: 4642084 - DNA, 15 bp, Homo sapiens
ttggctgcttcctgt

SEQ ID NO: 4642085 - DNA, 17 bp, Homo sapiens
ttggcttcatttcaatc

SEQ ID NO: 4642086 - DNA, 14 bp, Homo sapiens
ttggcttgtgttat

SEQ ID NO: 4642087 - DNA, 16 bp, Homo sapiens
ttggctttatgcaaat

SEQ ID NO: 4642088 - DNA, 20 bp, Homo sapiens
ttggctttatgcaaatacaa

SEQ ID NO: 4642089 - DNA, 19 bp, Homo sapiens
ttgggaacagggttactgt

SEQ ID NO: 4642090 - DNA, 14 bp, Homo sapiens
ttgggacaccaggg

SEQ ID NO: 4642091 - DNA, 16 bp, Homo sapiens
ttgggaggaggaaaag

SEQ ID NO: 4642092 - DNA, 19 bp, Homo sapiens
ttgggagggaaaagggaag

SEQ ID NO: 4642093 - DNA, 17 bp, Homo sapiens
ttgggcacccccagcct

SEQ ID NO: 4642094 - DNA, 18 bp, Homo sapiens
ttgggcacccccagcctg

SEQ ID NO: 4642095 - DNA, 11 bp, Homo sapiens
ttgggcagagc

SEQ ID NO: 4642096 - DNA, 19 bp, Homo sapiens
ttgggcagcgcccttcctc

SEQ ID NO: 4642097 - DNA, 21 bp, Homo sapiens
ttgggccataattatgaaaac

SEQ ID NO: 4642098 - DNA, 12 bp, Homo sapiens
ttgggcctcagg

SEQ ID NO: 4642099 - DNA, 19 bp, Homo sapiens
ttgggcctcaggctctgca

SEQ ID NO: 4642100 - DNA, 23 bp, Homo sapiens
ttgggcctcaggctctgcacaga

SEQ ID NO: 4642101 - DNA, 14 bp, Homo sapiens
ttgggctgacccag

SEQ ID NO: 4642102 - DNA, 15 bp, Homo sapiens
ttgggctgacccagc

SEQ ID NO: 4642103 - DNA, 18 bp, Homo sapiens
ttggggagtacctgtcca

SEQ ID NO: 4642104 - DNA, 20 bp, Homo sapiens
ttggggcaggagtagctgag

SEQ ID NO: 4642105 - DNA, 15 bp, Homo sapiens
ttggggggtgggaga

SEQ ID NO: 4642106 - DNA, 23 bp, Homo sapiens
ttggggtcaagaaacagccagca

SEQ ID NO: 4642107 - DNA, 17 bp, Homo sapiens
ttggggtctggcagcct

SEQ ID NO: 4642108 - DNA, 20 bp, Homo sapiens
ttggtaaaactcactgtgat

SEQ ID NO: 4642109 - DNA, 20 bp, Homo sapiens
ttggtatttgtttgtagctt

SEQ ID NO: 4642110 - DNA, 17 bp, Homo sapiens
ttggtcttagctttaca

SEQ ID NO: 4642111 - DNA, 18 bp, Homo sapiens
ttggtcttagctttacat

SEQ ID NO: 4642112 - DNA, 20 bp, Homo sapiens
ttggtcttagctttacattt

SEQ ID NO: 4642113 - DNA, 19 bp, Homo sapiens
ttggtcttaggtcttcctg

SEQ ID NO: 4642114 - DNA, 20 bp, Homo sapiens
ttggtgacttgtctgcctcc

SEQ ID NO: 4642115 - DNA, 12 bp, Homo sapiens
ttggtgcctggc

SEQ ID NO: 4642116 - DNA, 20 bp, Homo sapiens
ttggtgcctggcctggcaca

SEQ ID NO: 4642117 - DNA, 20 bp, Homo sapiens
ttggtggcctaatttacaag

SEQ ID NO: 4642118 - DNA, 17 bp, Homo sapiens
ttggtgtgccctgtgtg

SEQ ID NO: 4642119 - DNA, 19 bp, Homo sapiens
ttggtgtgttcctgtggga

SEQ ID NO: 4642120 - DNA, 12 bp, Homo sapiens
ttggtgtgttcg

SEQ ID NO: 4642121 - DNA, 13 bp, Homo sapiens
ttggttggttttt

SEQ ID NO: 4642122 - DNA, 21 bp, Homo sapiens
ttggtttgtggcgtctccctc

SEQ ID NO: 4642123 - DNA, 15 bp, Homo sapiens
ttggttttaaaagca

SEQ ID NO: 4642124 - DNA, 18 bp, Homo sapiens
ttgtaaaacaaaatttga

SEQ ID NO: 4642125 - DNA, 18 bp, Homo sapiens
ttgtaaaatagaaaaagt

SEQ ID NO: 4642126 - DNA, 16 bp, Homo sapiens
ttgtaaaccattgtaa

SEQ ID NO: 4642127 - DNA, 18 bp, Homo sapiens
ttgtaaaccattgtaact

SEQ ID NO: 4642128 - DNA, 21 bp, Homo sapiens
ttgtaaagactggttttctgc

SEQ ID NO: 4642129 - DNA, 15 bp, Homo sapiens
ttgtaaatcctgtgt

SEQ ID NO: 4642130 - DNA, 20 bp, Homo sapiens
ttgtaagtgtaaaaaatgtc

SEQ ID NO: 4642131 - DNA, 14 bp, Homo sapiens
ttgtaataaaatgt

SEQ ID NO: 4642132 - DNA, 17 bp, Homo sapiens
ttgtaatatgacagata

SEQ ID NO: 4642133 - DNA, 16 bp, Homo sapiens
ttgtaatattgaggga

SEQ ID NO: 4642134 - DNA, 12 bp, Homo sapiens
ttgtaatgcact

SEQ ID NO: 4642135 - DNA, 23 bp, Homo sapiens
ttgtaatgcactgtttttaatct

SEQ ID NO: 4642136 - DNA, 13 bp, Homo sapiens
ttgtacaagtatt

SEQ ID NO: 4642137 - DNA, 13 bp, Homo sapiens
ttgtacatagcaa

SEQ ID NO: 4642138 - DNA, 22 bp, Homo sapiens
ttgtactgttcatacagtttta

SEQ ID NO: 4642139 - DNA, 19 bp, Homo sapiens
ttgtacttttagtagagac

SEQ ID NO: 4642140 - DNA, 20 bp, Homo sapiens
ttgtagaaaaatccctccac

SEQ ID NO: 4642141 - DNA, 19 bp, Homo sapiens
ttgtagaactcactctggg

SEQ ID NO: 4642142 - DNA, 16 bp, Homo sapiens
ttgtagactcttgctc

SEQ ID NO: 4642143 - DNA, 18 bp, Homo sapiens
ttgtagccaggtactgca

SEQ ID NO: 4642144 - DNA, 21 bp, Homo sapiens
ttgtagctaaaaataaaacat

SEQ ID NO: 4642145 - DNA, 15 bp, Homo sapiens
ttgtagctttcctgg

SEQ ID NO: 4642146 - DNA, 19 bp, Homo sapiens
ttgtagctttcctggaagt

SEQ ID NO: 4642147 - DNA, 15 bp, Homo sapiens
ttgtaggaagcattt

SEQ ID NO: 4642148 - DNA, 16 bp, Homo sapiens
ttgtaggaagcatttt

SEQ ID NO: 4642149 - DNA, 20 bp, Homo sapiens
ttgtaggaagcattttttat

SEQ ID NO: 4642150 - DNA, 20 bp, Homo sapiens
ttgtatacaccatatactgt

SEQ ID NO: 4642151 - DNA, 18 bp, Homo sapiens
ttgtataggctaaatgtt

SEQ ID NO: 4642152 - DNA, 19 bp, Homo sapiens
ttgtatattatgtttattt

SEQ ID NO: 4642153 - DNA, 16 bp, Homo sapiens
ttgtatctacattaaa

SEQ ID NO: 4642154 - DNA, 17 bp, Homo sapiens
ttgtcaccttcacctcc

SEQ ID NO: 4642155 - DNA, 23 bp, Homo sapiens
ttgtcagctttggattgctgggg

SEQ ID NO: 4642156 - DNA, 16 bp, Homo sapiens
ttgtcagggtctcctt

SEQ ID NO: 4642157 - DNA, 22 bp, Homo sapiens
ttgtcagtgtagacacaggtca

SEQ ID NO: 4642158 - DNA, 19 bp, Homo sapiens
ttgtccacaaatcttcagt

SEQ ID NO: 4642159 - DNA, 17 bp, Homo sapiens
ttgtccaggttgatctt

SEQ ID NO: 4642160 - DNA, 21 bp, Homo sapiens
ttgtcccaaatccgccagtgt

SEQ ID NO: 4642161 - DNA, 20 bp, Homo sapiens
ttgtcctttgaggccccaac

SEQ ID NO: 4642162 - DNA, 22 bp, Homo sapiens
ttgtcctttgaggccccaactc

SEQ ID NO: 4642163 - DNA, 18 bp, Homo sapiens
ttgtctagtcattgtcat

SEQ ID NO: 4642164 - DNA, 19 bp, Homo sapiens
ttgtctagtcattgtcata

SEQ ID NO: 4642165 - DNA, 12 bp, Homo sapiens
ttgtctgcctcc

SEQ ID NO: 4642166 - DNA, 19 bp, Homo sapiens
ttgtctgcctcctgctttg

SEQ ID NO: 4642167 - DNA, 21 bp, Homo sapiens
ttgtctgtaggtgaaagaaca

SEQ ID NO: 4642168 - DNA, 23 bp, Homo sapiens
ttgtctgtgcttccttggttcat

SEQ ID NO: 4642169 - DNA, 15 bp, Homo sapiens
ttgtcttattgaaaa

SEQ ID NO: 4642170 - DNA, 20 bp, Homo sapiens
ttgtcttggaaccaccagtc

SEQ ID NO: 4642171 - DNA, 17 bp, Homo sapiens
ttgtgataatagcattt

SEQ ID NO: 4642172 - DNA, 14 bp, Homo sapiens
ttgtgatttcttta

SEQ ID NO: 4642173 - DNA, 17 bp, Homo sapiens
ttgtggattaaaccttt

SEQ ID NO: 4642174 - DNA, 15 bp, Homo sapiens
ttgtggcgtctccct

SEQ ID NO: 4642175 - DNA, 16 bp, Homo sapiens
ttgtgtatatattata

SEQ ID NO: 4642176 - DNA, 21 bp, Homo sapiens
ttgtgtctcccgtgcatgctc

SEQ ID NO: 4642177 - DNA, 13 bp, Homo sapiens
ttgtgtctgtaca

SEQ ID NO: 4642178 - DNA, 14 bp, Homo sapiens
ttgtgtctgtacac

SEQ ID NO: 4642179 - DNA, 13 bp, Homo sapiens
ttgtgtctgtggt

SEQ ID NO: 4642180 - DNA, 17 bp, Homo sapiens
ttgtgtggtattcaact

SEQ ID NO: 4642181 - DNA, 16 bp, Homo sapiens
ttgtgtgtgttctgtc

SEQ ID NO: 4642182 - DNA, 12 bp, Homo sapiens
ttgtgtgtttca

SEQ ID NO: 4642183 - DNA, 22 bp, Homo sapiens
ttgtgttatcggacattctaat

SEQ ID NO: 4642184 - DNA, 16 bp, Homo sapiens
ttgtgttcatttcatt

SEQ ID NO: 4642185 - DNA, 16 bp, Homo sapiens
ttgtgtttaactgtga

SEQ ID NO: 4642186 - DNA, 22 bp, Homo sapiens
ttgtgtttaactgtgaacaaat

SEQ ID NO: 4642187 - DNA, 19 bp, Homo sapiens
ttgtgtttctttagttttt

SEQ ID NO: 4642188 - DNA, 22 bp, Homo sapiens
ttgtgtttttctatagaaaaag

SEQ ID NO: 4642189 - DNA, 14 bp, Homo sapiens
ttgttaataaaagt

SEQ ID NO: 4642190 - DNA, 19 bp, Homo sapiens
ttgttaataaaagtacatg

SEQ ID NO: 4642191 - DNA, 21 bp, Homo sapiens
ttgttaataaaagtacatgtt

SEQ ID NO: 4642192 - DNA, 22 bp, Homo sapiens
ttgttaatgctctatgtttgta

SEQ ID NO: 4642193 - DNA, 20 bp, Homo sapiens
ttgttagcttccttaagtat

SEQ ID NO: 4642194 - DNA, 17 bp, Homo sapiens
ttgttcattttgagtat

SEQ ID NO: 4642195 - DNA, 19 bp, Homo sapiens
ttgttcccttcctcttcct

SEQ ID NO: 4642196 - DNA, 16 bp, Homo sapiens
ttgttctatttttcaa

SEQ ID NO: 4642197 - DNA, 17 bp, Homo sapiens
ttgttctatttttcaat

SEQ ID NO: 4642198 - DNA, 16 bp, Homo sapiens
ttgttctgcctggaga

SEQ ID NO: 4642199 - DNA, 14 bp, Homo sapiens
ttgttctgtcacca

SEQ ID NO: 4642200 - DNA, 21 bp, Homo sapiens
ttgttgacccttttttgaacc

SEQ ID NO: 4642201 - DNA, 20 bp, Homo sapiens
ttgttggtgaattttcaagg

SEQ ID NO: 4642202 - DNA, 15 bp, Homo sapiens
ttgtttcaactttct

SEQ ID NO: 4642203 - DNA, 23 bp, Homo sapiens
ttgtttctcctctgaagcatttg

SEQ ID NO: 4642204 - DNA, 14 bp, Homo sapiens
ttgtttgtagcttt

SEQ ID NO: 4642205 - DNA, 14 bp, Homo sapiens
ttgtttgtttcttt

SEQ ID NO: 4642206 - DNA, 13 bp, Homo sapiens
ttgtttttgtaat

SEQ ID NO: 4642207 - DNA, 13 bp, Homo sapiens
ttgttttttgttc

SEQ ID NO: 4642208 - DNA, 18 bp, Homo sapiens
tttaaaaaaaaatcttgt

SEQ ID NO: 4642209 - DNA, 20 bp, Homo sapiens
tttaaaaaagcattatcctt

SEQ ID NO: 4642210 - DNA, 16 bp, Homo sapiens
tttaaaaaatattttc

SEQ ID NO: 4642211 - DNA, 17 bp, Homo sapiens
tttaaaaaatattttct

SEQ ID NO: 4642212 - DNA, 20 bp, Homo sapiens
tttaaaaaatgaaatccttt

SEQ ID NO: 4642213 - DNA, 11 bp, Homo sapiens
tttaaaaactt

SEQ ID NO: 4642214 - DNA, 19 bp, Homo sapiens
tttaaaataaaatgaaaat

SEQ ID NO: 4642215 - DNA, 20 bp, Homo sapiens
tttaaaatgtgaggcaataa

SEQ ID NO: 4642216 - DNA, 16 bp, Homo sapiens
tttaaacataagctaa

SEQ ID NO: 4642217 - DNA, 14 bp, Homo sapiens
tttaaagaagcttt

SEQ ID NO: 4642218 - DNA, 20 bp, Homo sapiens
tttaaagtatttataaaaat

SEQ ID NO: 4642219 - DNA, 14 bp, Homo sapiens
tttaaagtttaaat

SEQ ID NO: 4642220 - DNA, 16 bp, Homo sapiens
tttaaagtttaaatac

SEQ ID NO: 4642221 - DNA, 24 bp, Homo sapiens
tttaaatatcattctttgtatctt

SEQ ID NO: 4642222 - DNA, 15 bp, Homo sapiens
tttaaatattttcta

SEQ ID NO: 4642223 - DNA, 17 bp, Homo sapiens
tttaaatattttctatt

SEQ ID NO: 4642224 - DNA, 16 bp, Homo sapiens
tttaaatcctaccaaa

SEQ ID NO: 4642225 - DNA, 16 bp, Homo sapiens
tttaacaaaaaatgta

SEQ ID NO: 4642226 - DNA, 15 bp, Homo sapiens
tttaacaaaaaccaa

SEQ ID NO: 4642227 - DNA, 18 bp, Homo sapiens
tttaacatacaagaaaat

SEQ ID NO: 4642228 - DNA, 18 bp, Homo sapiens
tttaacctgttttgttaa

SEQ ID NO: 4642229 - DNA, 12 bp, Homo sapiens
tttaactctgtc

SEQ ID NO: 4642230 - DNA, 16 bp, Homo sapiens
tttaagaaaaaaagct

SEQ ID NO: 4642231 - DNA, 23 bp, Homo sapiens
tttaagactctcgcatcttccca

SEQ ID NO: 4642232 - DNA, 12 bp, Homo sapiens
tttaagcctttt

SEQ ID NO: 4642233 - DNA, 20 bp, Homo sapiens
tttaagtactacacattttt

SEQ ID NO: 4642234 - DNA, 20 bp, Homo sapiens
tttaagtgaatacattaacg

SEQ ID NO: 4642235 - DNA, 20 bp, Homo sapiens
tttaagtggggttgataaca

SEQ ID NO: 4642236 - DNA, 11 bp, Homo sapiens
tttaagtttgt

SEQ ID NO: 4642237 - DNA, 14 bp, Homo sapiens
tttaataaagcttt

SEQ ID NO: 4642238 - DNA, 15 bp, Homo sapiens
tttaatgctatttga

SEQ ID NO: 4642239 - DNA, 20 bp, Homo sapiens
tttaatggccggctggaaat

SEQ ID NO: 4642240 - DNA, 12 bp, Homo sapiens
tttaatgtgaac

SEQ ID NO: 4642241 - DNA, 16 bp, Homo sapiens
tttaatgtttttctgg

SEQ ID NO: 4642242 - DNA, 19 bp, Homo sapiens
tttaattaagcagaaacag

SEQ ID NO: 4642243 - DNA, 12 bp, Homo sapiens
tttaatttcagg

SEQ ID NO: 4642244 - DNA, 13 bp, Homo sapiens
tttaatttcagga

SEQ ID NO: 4642245 - DNA, 15 bp, Homo sapiens
tttaattttaatgct

SEQ ID NO: 4642246 - DNA, 16 bp, Homo sapiens
tttaattttcttgttt

SEQ ID NO: 4642247 - DNA, 16 bp, Homo sapiens
tttacaaacctttgtt

SEQ ID NO: 4642248 - DNA, 14 bp, Homo sapiens
tttacacaattctt

SEQ ID NO: 4642249 - DNA, 15 bp, Homo sapiens
tttacagcagcaata

SEQ ID NO: 4642250 - DNA, 16 bp, Homo sapiens
tttacagcagcaatat

SEQ ID NO: 4642251 - DNA, 21 bp, Homo sapiens
tttacattttcagtaccaaag

SEQ ID NO: 4642252 - DNA, 20 bp, Homo sapiens
tttaccaaagagatattgat

SEQ ID NO: 4642253 - DNA, 20 bp, Homo sapiens
tttaccaattcacccactcc

SEQ ID NO: 4642254 - DNA, 13 bp, Homo sapiens
tttagaaatgcat

SEQ ID NO: 4642255 - DNA, 14 bp, Homo sapiens
tttagaaatgcata

SEQ ID NO: 4642256 - DNA, 18 bp, Homo sapiens
tttagaagcagagggaca

SEQ ID NO: 4642257 - DNA, 17 bp, Homo sapiens
tttagagggtgaaggag

SEQ ID NO: 4642258 - DNA, 19 bp, Homo sapiens
tttagccataattttgcat

SEQ ID NO: 4642259 - DNA, 19 bp, Homo sapiens
tttaggggcaaacatcaca

SEQ ID NO: 4642260 - DNA, 21 bp, Homo sapiens
tttaggtgaattaattaaaca

SEQ ID NO: 4642261 - DNA, 17 bp, Homo sapiens
tttagtagctcaaaaat

SEQ ID NO: 4642262 - DNA, 18 bp, Homo sapiens
tttagttataaaaggctt

SEQ ID NO: 4642263 - DNA, 23 bp, Homo sapiens
tttataaaaagatgatcgctgta

SEQ ID NO: 4642264 - DNA, 19 bp, Homo sapiens
tttataaagatcatttata

SEQ ID NO: 4642265 - DNA, 22 bp, Homo sapiens
tttataaccttgttctctgctt

SEQ ID NO: 4642266 - DNA, 22 bp, Homo sapiens
tttataattggtgctatttgaa

SEQ ID NO: 4642267 - DNA, 17 bp, Homo sapiens
tttataattttctaagt

SEQ ID NO: 4642268 - DNA, 21 bp, Homo sapiens
tttatagcaagatattgatca

SEQ ID NO: 4642269 - DNA, 22 bp, Homo sapiens
tttatagcaagatattgatcaa

SEQ ID NO: 4642270 - DNA, 23 bp, Homo sapiens
tttatagcaagatattgatcaaa

SEQ ID NO: 4642271 - DNA, 17 bp, Homo sapiens
tttatatcatgcaaaat

SEQ ID NO: 4642272 - DNA, 12 bp, Homo sapiens
tttatatctaat

SEQ ID NO: 4642273 - DNA, 12 bp, Homo sapiens
tttatatgtctt

SEQ ID NO: 4642274 - DNA, 13 bp, Homo sapiens
tttatatgtcttg

SEQ ID NO: 4642275 - DNA, 22 bp, Homo sapiens
tttatattatccataggtttct

SEQ ID NO: 4642276 - DNA, 14 bp, Homo sapiens
tttatatttatcca

SEQ ID NO: 4642277 - DNA, 16 bp, Homo sapiens
tttatatttattgtta

SEQ ID NO: 4642278 - DNA, 23 bp, Homo sapiens
tttatccttacaatgtgaataat

SEQ ID NO: 4642279 - DNA, 17 bp, Homo sapiens
tttatctgcacctagaa

SEQ ID NO: 4642280 - DNA, 14 bp, Homo sapiens
tttatctgtttcct

SEQ ID NO: 4642281 - DNA, 12 bp, Homo sapiens
tttatgaagaaa

SEQ ID NO: 4642282 - DNA, 22 bp, Homo sapiens
tttatgaagaaagatactaata

SEQ ID NO: 4642283 - DNA, 15 bp, Homo sapiens
tttatgcaaatacaa

SEQ ID NO: 4642284 - DNA, 16 bp, Homo sapiens
tttatgcaaatacaat

SEQ ID NO: 4642285 - DNA, 13 bp, Homo sapiens
tttattacaaatg

SEQ ID NO: 4642286 - DNA, 19 bp, Homo sapiens
tttattataaactgtatgc

SEQ ID NO: 4642287 - DNA, 17 bp, Homo sapiens
tttattatgcattatat

SEQ ID NO: 4642288 - DNA, 15 bp, Homo sapiens
tttattcctcttatt

SEQ ID NO: 4642289 - DNA, 21 bp, Homo sapiens
tttattctcaggtaatcattt

SEQ ID NO: 4642290 - DNA, 17 bp, Homo sapiens
tttattctttactatta

SEQ ID NO: 4642291 - DNA, 14 bp, Homo sapiens
tttattgcagaatg

SEQ ID NO: 4642292 - DNA, 22 bp, Homo sapiens
tttattgttttctatttatgcc

SEQ ID NO: 4642293 - DNA, 11 bp, Homo sapiens
tttatttacta

SEQ ID NO: 4642294 - DNA, 12 bp, Homo sapiens
tttatttccact

SEQ ID NO: 4642295 - DNA, 20 bp, Homo sapiens
tttatttctagcaaacagat

SEQ ID NO: 4642296 - DNA, 12 bp, Homo sapiens
tttatttctctt

SEQ ID NO: 4642297 - DNA, 20 bp, Homo sapiens
tttatttcttcgtgaacata

SEQ ID NO: 4642298 - DNA, 16 bp, Homo sapiens
tttattttaggcactg

SEQ ID NO: 4642299 - DNA, 14 bp, Homo sapiens
tttattttttagtg

SEQ ID NO: 4642300 - DNA, 23 bp, Homo sapiens
tttcaaaagaaatttaagttcta

SEQ ID NO: 4642301 - DNA, 15 bp, Homo sapiens
tttcaaaatacattt

SEQ ID NO: 4642302 - DNA, 19 bp, Homo sapiens
tttcaaaatacatttgtaa

SEQ ID NO: 4642303 - DNA, 19 bp, Homo sapiens
tttcaacaaatttcattgc

SEQ ID NO: 4642304 - DNA, 20 bp, Homo sapiens
tttcaaccagataacatacc

SEQ ID NO: 4642305 - DNA, 18 bp, Homo sapiens
tttcaactttcttatctg

SEQ ID NO: 4642306 - DNA, 14 bp, Homo sapiens
tttcaaggccttca

SEQ ID NO: 4642307 - DNA, 16 bp, Homo sapiens
tttcaaggccttcagt

SEQ ID NO: 4642308 - DNA, 14 bp, Homo sapiens
tttcaataaagttg

SEQ ID NO: 4642309 - DNA, 19 bp, Homo sapiens
tttcaataaagttgttgca

SEQ ID NO: 4642310 - DNA, 21 bp, Homo sapiens
tttcaataacaaaacgaaact

SEQ ID NO: 4642311 - DNA, 14 bp, Homo sapiens
tttcaatcattgaa

SEQ ID NO: 4642312 - DNA, 15 bp, Homo sapiens
tttcaatcattgaag

SEQ ID NO: 4642313 - DNA, 18 bp, Homo sapiens
tttcaatcattgaagtat

SEQ ID NO: 4642314 - DNA, 14 bp, Homo sapiens
tttcaattgacaaa

SEQ ID NO: 4642315 - DNA, 15 bp, Homo sapiens
tttcaattgacaaat

SEQ ID NO: 4642316 - DNA, 20 bp, Homo sapiens
tttcacatataaatagatga

SEQ ID NO: 4642317 - DNA, 14 bp, Homo sapiens
tttcacttatacct

SEQ ID NO: 4642318 - DNA, 19 bp, Homo sapiens
tttcagagcccccagccct

SEQ ID NO: 4642319 - DNA, 14 bp, Homo sapiens
tttcagatataaaa

SEQ ID NO: 4642320 - DNA, 16 bp, Homo sapiens
tttcagatgcttctgg

SEQ ID NO: 4642321 - DNA, 23 bp, Homo sapiens
tttcagcacctacagtgtacagt

SEQ ID NO: 4642322 - DNA, 22 bp, Homo sapiens
tttcaggggctgactctccagg

SEQ ID NO: 4642323 - DNA, 20 bp, Homo sapiens
tttcagggtcttggctgcct

SEQ ID NO: 4642324 - DNA, 15 bp, Homo sapiens
tttcagtaccaaaga

SEQ ID NO: 4642325 - DNA, 19 bp, Homo sapiens
tttcagtacttttttaaat

SEQ ID NO: 4642326 - DNA, 19 bp, Homo sapiens
tttcatactaccctttgct

SEQ ID NO: 4642327 - DNA, 16 bp, Homo sapiens
tttcatagttttctaa

SEQ ID NO: 4642328 - DNA, 18 bp, Homo sapiens
tttcatagttttctaaat

SEQ ID NO: 4642329 - DNA, 21 bp, Homo sapiens
tttcatcagtaagcagccttt

SEQ ID NO: 4642330 - DNA, 13 bp, Homo sapiens
tttcatccttctt

SEQ ID NO: 4642331 - DNA, 16 bp, Homo sapiens
tttcatccttctttcc

SEQ ID NO: 4642332 - DNA, 18 bp, Homo sapiens
tttcatccttctttcctt

SEQ ID NO: 4642333 - DNA, 22 bp, Homo sapiens
tttcatccttctttccttgttc

SEQ ID NO: 4642334 - DNA, 18 bp, Homo sapiens
tttcatctgggaaagaca

SEQ ID NO: 4642335 - DNA, 12 bp, Homo sapiens
tttcatgaaaaa

SEQ ID NO: 4642336 - DNA, 15 bp, Homo sapiens
tttcatgaaaaagct

SEQ ID NO: 4642337 - DNA, 20 bp, Homo sapiens
tttcatgaaaaagctgcttc

SEQ ID NO: 4642338 - DNA, 20 bp, Homo sapiens
tttcatgaacgttattatat

SEQ ID NO: 4642339 - DNA, 19 bp, Homo sapiens
tttcatgttttaacaaaaa

SEQ ID NO: 4642340 - DNA, 23 bp, Homo sapiens
tttcattaaaggcttctctctca

SEQ ID NO: 4642341 - DNA, 17 bp, Homo sapiens
tttcattacttgaatgt

SEQ ID NO: 4642342 - DNA, 18 bp, Homo sapiens
tttcattacttgaatgta

SEQ ID NO: 4642343 - DNA, 20 bp, Homo sapiens
tttcattatgttcatgtaag

SEQ ID NO: 4642344 - DNA, 11 bp, Homo sapiens
tttcattccat

SEQ ID NO: 4642345 - DNA, 13 bp, Homo sapiens
tttcattgcactt

SEQ ID NO: 4642346 - DNA, 14 bp, Homo sapiens
tttcattgcacttt

SEQ ID NO: 4642347 - DNA, 19 bp, Homo sapiens
tttcattgtacaagtatta

SEQ ID NO: 4642348 - DNA, 23 bp, Homo sapiens
tttcattttagtgtatctttaaa

SEQ ID NO: 4642349 - DNA, 14 bp, Homo sapiens
tttcattttccaat

SEQ ID NO: 4642350 - DNA, 18 bp, Homo sapiens
tttccaaaagtggcctct

SEQ ID NO: 4642351 - DNA, 18 bp, Homo sapiens
tttccaagccctcagctg

SEQ ID NO: 4642352 - DNA, 14 bp, Homo sapiens
tttccacacgcatt

SEQ ID NO: 4642353 - DNA, 21 bp, Homo sapiens
tttccacagatttttttgtaa

SEQ ID NO: 4642354 - DNA, 16 bp, Homo sapiens
tttccactccattgtc

SEQ ID NO: 4642355 - DNA, 14 bp, Homo sapiens
tttccattgtttga

SEQ ID NO: 4642356 - DNA, 22 bp, Homo sapiens
tttcccaagctagactgtgtct

SEQ ID NO: 4642357 - DNA, 13 bp, Homo sapiens
tttcccccactcc

SEQ ID NO: 4642358 - DNA, 15 bp, Homo sapiens
tttcccccaggaaaa

SEQ ID NO: 4642359 - DNA, 18 bp, Homo sapiens
tttcccctatcatttatt

SEQ ID NO: 4642360 - DNA, 23 bp, Homo sapiens
tttcccgcccagcctcacttcct

SEQ ID NO: 4642361 - DNA, 13 bp, Homo sapiens
tttccctctcctt

SEQ ID NO: 4642362 - DNA, 12 bp, Homo sapiens
tttccctgctga

SEQ ID NO: 4642363 - DNA, 14 bp, Homo sapiens
tttcccttatcaaa

SEQ ID NO: 4642364 - DNA, 18 bp, Homo sapiens
tttcctggcctcagagct

SEQ ID NO: 4642365 - DNA, 12 bp, Homo sapiens
tttcctgggcct

SEQ ID NO: 4642366 - DNA, 18 bp, Homo sapiens
tttcctgggcctttgcaa

SEQ ID NO: 4642367 - DNA, 22 bp, Homo sapiens
tttcctgggtggctactctgtg

SEQ ID NO: 4642368 - DNA, 19 bp, Homo sapiens
tttcctgtagccttctgta

SEQ ID NO: 4642369 - DNA, 12 bp, Homo sapiens
tttccttccatg

SEQ ID NO: 4642370 - DNA, 13 bp, Homo sapiens
tttccttccatgc

SEQ ID NO: 4642371 - DNA, 21 bp, Homo sapiens
tttcctttttaaggtctttca

SEQ ID NO: 4642372 - DNA, 14 bp, Homo sapiens
tttcgtcatgttgg

SEQ ID NO: 4642373 - DNA, 15 bp, Homo sapiens
tttctaagaaaatgt

SEQ ID NO: 4642374 - DNA, 22 bp, Homo sapiens
tttctaattgtaagtgaaatta

SEQ ID NO: 4642375 - DNA, 20 bp, Homo sapiens
tttctacaaataattttagt

SEQ ID NO: 4642376 - DNA, 14 bp, Homo sapiens
tttctatgacaaat

SEQ ID NO: 4642377 - DNA, 22 bp, Homo sapiens
tttctcaaaacccttaaaagaa

SEQ ID NO: 4642378 - DNA, 20 bp, Homo sapiens
tttctcagaagtccctgttt

SEQ ID NO: 4642379 - DNA, 13 bp, Homo sapiens
tttctctccctcc

SEQ ID NO: 4642380 - DNA, 12 bp, Homo sapiens
tttctctgcctg

SEQ ID NO: 4642381 - DNA, 16 bp, Homo sapiens
tttctctgcctggcaa

SEQ ID NO: 4642382 - DNA, 18 bp, Homo sapiens
tttctctgtacttttcat

SEQ ID NO: 4642383 - DNA, 21 bp, Homo sapiens
tttctcttctacccttttcct

SEQ ID NO: 4642384 - DNA, 14 bp, Homo sapiens
tttctctttaaact

SEQ ID NO: 4642385 - DNA, 20 bp, Homo sapiens
tttctgagatgctcacttta

SEQ ID NO: 4642386 - DNA, 22 bp, Homo sapiens
tttctgctctggaataaagttg

SEQ ID NO: 4642387 - DNA, 16 bp, Homo sapiens
tttctgctgtttacaa

SEQ ID NO: 4642388 - DNA, 18 bp, Homo sapiens
tttctgctgtttacaaca

SEQ ID NO: 4642389 - DNA, 13 bp, Homo sapiens
tttctgggctctg

SEQ ID NO: 4642390 - DNA, 16 bp, Homo sapiens
tttctgggctctggac

SEQ ID NO: 4642391 - DNA, 16 bp, Homo sapiens
tttctgttatttttaa

SEQ ID NO: 4642392 - DNA, 21 bp, Homo sapiens
tttctgttatttttaagcttt

SEQ ID NO: 4642393 - DNA, 12 bp, Homo sapiens
tttcttaaggtt

SEQ ID NO: 4642394 - DNA, 15 bp, Homo sapiens
tttcttcgtgaacat

SEQ ID NO: 4642395 - DNA, 13 bp, Homo sapiens
tttcttctattaa

SEQ ID NO: 4642396 - DNA, 15 bp, Homo sapiens
tttctttcagatttt

SEQ ID NO: 4642397 - DNA, 23 bp, Homo sapiens
tttgaaataattatgcagacaca

SEQ ID NO: 4642398 - DNA, 16 bp, Homo sapiens
tttgaaccaacatctt

SEQ ID NO: 4642399 - DNA, 13 bp, Homo sapiens
tttgaaggaaacc

SEQ ID NO: 4642400 - DNA, 19 bp, Homo sapiens
tttgaagtaaattaaacat

SEQ ID NO: 4642401 - DNA, 19 bp, Homo sapiens
tttgaatatattttatctt

SEQ ID NO: 4642402 - DNA, 14 bp, Homo sapiens
tttgaatttactgg

SEQ ID NO: 4642403 - DNA, 21 bp, Homo sapiens
tttgactaattttacatgttt

SEQ ID NO: 4642404 - DNA, 14 bp, Homo sapiens
tttgacttcttgct

SEQ ID NO: 4642405 - DNA, 16 bp, Homo sapiens
tttgagtttcagctgg

SEQ ID NO: 4642406 - DNA, 18 bp, Homo sapiens
tttgataggaaggaaact

SEQ ID NO: 4642407 - DNA, 16 bp, Homo sapiens
tttgatgcatgtcttt

SEQ ID NO: 4642408 - DNA, 13 bp, Homo sapiens
tttgatttacata

SEQ ID NO: 4642409 - DNA, 16 bp, Homo sapiens
tttgatttctaattgt

SEQ ID NO: 4642410 - DNA, 21 bp, Homo sapiens
tttgcactaggaagaatcagt

SEQ ID NO: 4642411 - DNA, 19 bp, Homo sapiens
tttgcagttgatgtgtctt

SEQ ID NO: 4642412 - DNA, 20 bp, Homo sapiens
tttgcatactgaaaatccaa

SEQ ID NO: 4642413 - DNA, 15 bp, Homo sapiens
tttgcatccagcagc

SEQ ID NO: 4642414 - DNA, 17 bp, Homo sapiens
tttgccccgggatatta

SEQ ID NO: 4642415 - DNA, 12 bp, Homo sapiens
tttgcccttcct

SEQ ID NO: 4642416 - DNA, 16 bp, Homo sapiens
tttgcctgaggctgta

SEQ ID NO: 4642417 - DNA, 22 bp, Homo sapiens
tttgcggggcctgtctcagtga

SEQ ID NO: 4642418 - DNA, 16 bp, Homo sapiens
tttgctatctgggctg

SEQ ID NO: 4642419 - DNA, 14 bp, Homo sapiens
tttgctcttataaa

SEQ ID NO: 4642420 - DNA, 18 bp, Homo sapiens
tttgctgtgtagttccct

SEQ ID NO: 4642421 - DNA, 22 bp, Homo sapiens
tttgctgtgtagttccctctgc

SEQ ID NO: 4642422 - DNA, 23 bp, Homo sapiens
tttgctgtgtagttccctctgcc

SEQ ID NO: 4642423 - DNA, 14 bp, Homo sapiens
tttgctttttgcta

SEQ ID NO: 4642424 - DNA, 16 bp, Homo sapiens
tttggaatatttgaat

SEQ ID NO: 4642425 - DNA, 19 bp, Homo sapiens
tttggaggaatcaccccat

SEQ ID NO: 4642426 - DNA, 14 bp, Homo sapiens
tttggatggtttgt

SEQ ID NO: 4642427 - DNA, 22 bp, Homo sapiens
tttggctttatgtgcaaaatct

SEQ ID NO: 4642428 - DNA, 20 bp, Homo sapiens
tttgggaggaggaaaagaaa

SEQ ID NO: 4642429 - DNA, 11 bp, Homo sapiens
tttgggcagag

SEQ ID NO: 4642430 - DNA, 22 bp, Homo sapiens
tttgggttggttccaagtcttt

SEQ ID NO: 4642431 - DNA, 18 bp, Homo sapiens
tttggtgtgccctgtgtg

SEQ ID NO: 4642432 - DNA, 16 bp, Homo sapiens
tttggttttaaaagca

SEQ ID NO: 4642433 - DNA, 21 bp, Homo sapiens
tttgtaaaaacagcattgctt

SEQ ID NO: 4642434 - DNA, 20 bp, Homo sapiens
tttgtaaaatattatgtttg

SEQ ID NO: 4642435 - DNA, 13 bp, Homo sapiens
tttgtaaacttct

SEQ ID NO: 4642436 - DNA, 14 bp, Homo sapiens
tttgtaaacttctg

SEQ ID NO: 4642437 - DNA, 17 bp, Homo sapiens
tttgtaatgcactgttt

SEQ ID NO: 4642438 - DNA, 19 bp, Homo sapiens
tttgtaatgcactgttttt

SEQ ID NO: 4642439 - DNA, 13 bp, Homo sapiens
tttgtaattgctt

SEQ ID NO: 4642440 - DNA, 13 bp, Homo sapiens
tttgtacttttag

SEQ ID NO: 4642441 - DNA, 13 bp, Homo sapiens
tttgtagctactt

SEQ ID NO: 4642442 - DNA, 23 bp, Homo sapiens
tttgtagtggaaacatttatatt

SEQ ID NO: 4642443 - DNA, 16 bp, Homo sapiens
tttgtatcttaaatct

SEQ ID NO: 4642444 - DNA, 15 bp, Homo sapiens
tttgtcaattgctaa

SEQ ID NO: 4642445 - DNA, 12 bp, Homo sapiens
tttgtcatttta

SEQ ID NO: 4642446 - DNA, 12 bp, Homo sapiens
tttgtccatctt

SEQ ID NO: 4642447 - DNA, 18 bp, Homo sapiens
tttgtccatcttgtttca

SEQ ID NO: 4642448 - DNA, 15 bp, Homo sapiens
tttgtgactgtcact

SEQ ID NO: 4642449 - DNA, 21 bp, Homo sapiens
tttgtgctagaaattttcaag

SEQ ID NO: 4642450 - DNA, 15 bp, Homo sapiens
tttgtgtctatgatg

SEQ ID NO: 4642451 - DNA, 14 bp, Homo sapiens
tttgttaacttttg

SEQ ID NO: 4642452 - DNA, 10 bp, Homo sapiens
tttgttctac

SEQ ID NO: 4642453 - DNA, 15 bp, Homo sapiens
tttgttctactcctt

SEQ ID NO: 4642454 - DNA, 21 bp, Homo sapiens
tttgttctctgaattttcaga

SEQ ID NO: 4642455 - DNA, 22 bp, Homo sapiens
tttgttgtggccaatgtcgaaa

SEQ ID NO: 4642456 - DNA, 13 bp, Homo sapiens
tttgtttcatatt

SEQ ID NO: 4642457 - DNA, 13 bp, Homo sapiens
tttgttttcttaa

SEQ ID NO: 4642458 - DNA, 19 bp, Homo sapiens
tttgtttttgtataggagc

SEQ ID NO: 4642459 - DNA, 14 bp, Homo sapiens
ttttaaaaatgcaa

SEQ ID NO: 4642460 - DNA, 22 bp, Homo sapiens
ttttaaaagcacaatcactaaa

SEQ ID NO: 4642461 - DNA, 23 bp, Homo sapiens
ttttaaaagttttgaaggaaacc

SEQ ID NO: 4642462 - DNA, 16 bp, Homo sapiens
ttttaaaatgcaatgt

SEQ ID NO: 4642463 - DNA, 20 bp, Homo sapiens
ttttaaagtatttataaaaa

SEQ ID NO: 4642464 - DNA, 14 bp, Homo sapiens
ttttaagcttttat

SEQ ID NO: 4642465 - DNA, 17 bp, Homo sapiens
ttttaaggtctttcagt

SEQ ID NO: 4642466 - DNA, 17 bp, Homo sapiens
ttttaaggtttcaacaa

SEQ ID NO: 4642467 - DNA, 19 bp, Homo sapiens
ttttaaggtttcaacaaat

SEQ ID NO: 4642468 - DNA, 21 bp, Homo sapiens
ttttaagttacacatttttca

SEQ ID NO: 4642469 - DNA, 14 bp, Homo sapiens
ttttaatgataaaa

SEQ ID NO: 4642470 - DNA, 13 bp, Homo sapiens
ttttaatgtatct

SEQ ID NO: 4642471 - DNA, 11 bp, Homo sapiens
ttttaatttca

SEQ ID NO: 4642472 - DNA, 13 bp, Homo sapiens
ttttaatttcagg

SEQ ID NO: 4642473 - DNA, 21 bp, Homo sapiens
ttttaatttcaggaaaatgta

SEQ ID NO: 4642474 - DNA, 18 bp, Homo sapiens
ttttacatgtttataaat

SEQ ID NO: 4642475 - DNA, 19 bp, Homo sapiens
ttttactaagttttcaaat

SEQ ID NO: 4642476 - DNA, 20 bp, Homo sapiens
ttttagagaatgtgtttcaa

SEQ ID NO: 4642477 - DNA, 15 bp, Homo sapiens
ttttaggacatctta

SEQ ID NO: 4642478 - DNA, 13 bp, Homo sapiens
ttttataatgtta

SEQ ID NO: 4642479 - DNA, 12 bp, Homo sapiens
ttttataattgg

SEQ ID NO: 4642480 - DNA, 15 bp, Homo sapiens
ttttataattttcta

SEQ ID NO: 4642481 - DNA, 9 bp, Homo sapiens
ttttatatt

SEQ ID NO: 4642482 - DNA, 20 bp, Homo sapiens
ttttatcaattatattatgt

SEQ ID NO: 4642483 - DNA, 19 bp, Homo sapiens
ttttatcattaaaaattac

SEQ ID NO: 4642484 - DNA, 20 bp, Homo sapiens
ttttatccttacaatgtgaa

SEQ ID NO: 4642485 - DNA, 22 bp, Homo sapiens
ttttatcttggtagtacatttt

SEQ ID NO: 4642486 - DNA, 18 bp, Homo sapiens
ttttatgagcttccaagg

SEQ ID NO: 4642487 - DNA, 15 bp, Homo sapiens
ttttatgctcttgaa

SEQ ID NO: 4642488 - DNA, 21 bp, Homo sapiens
ttttatgtattctttctgcct

SEQ ID NO: 4642489 - DNA, 17 bp, Homo sapiens
ttttattacaaatgcaa

SEQ ID NO: 4642490 - DNA, 22 bp, Homo sapiens
ttttattattcagaattataca

SEQ ID NO: 4642491 - DNA, 19 bp, Homo sapiens
ttttattgttgttgtttga

SEQ ID NO: 4642492 - DNA, 17 bp, Homo sapiens
ttttcaaatgagtttaa

SEQ ID NO: 4642493 - DNA, 17 bp, Homo sapiens
ttttcaaggccttcagt

SEQ ID NO: 4642494 - DNA, 22 bp, Homo sapiens
ttttcacatataaatagatgat

SEQ ID NO: 4642495 - DNA, 22 bp, Homo sapiens
ttttcagatataaaagactgac

SEQ ID NO: 4642496 - DNA, 15 bp, Homo sapiens
ttttcagtaccaaag

SEQ ID NO: 4642497 - DNA, 23 bp, Homo sapiens
ttttcagtaccaaagaaacacca

SEQ ID NO: 4642498 - DNA, 12 bp, Homo sapiens
ttttcagttttc

SEQ ID NO: 4642499 - DNA, 14 bp, Homo sapiens
ttttcatctgggaa

SEQ ID NO: 4642500 - DNA, 16 bp, Homo sapiens
ttttcatctgggaaag

SEQ ID NO: 4642501 - DNA, 15 bp, Homo sapiens
ttttcattttccaat

SEQ ID NO: 4642502 - DNA, 17 bp, Homo sapiens
ttttcattttccaatac

SEQ ID NO: 4642503 - DNA, 20 bp, Homo sapiens
ttttccaaaagtggcctctt

SEQ ID NO: 4642504 - DNA, 23 bp, Homo sapiens
ttttcccagactactattttctt

SEQ ID NO: 4642505 - DNA, 20 bp, Homo sapiens
ttttcctggacttaaagaaa

SEQ ID NO: 4642506 - DNA, 15 bp, Homo sapiens
ttttccttccatgct

SEQ ID NO: 4642507 - DNA, 22 bp, Homo sapiens
ttttctaaataaaaatatgtaa

SEQ ID NO: 4642508 - DNA, 20 bp, Homo sapiens
ttttctaagtcgtgcacttt

SEQ ID NO: 4642509 - DNA, 14 bp, Homo sapiens
ttttctccacttca

SEQ ID NO: 4642510 - DNA, 18 bp, Homo sapiens
ttttctctgtacttttca

SEQ ID NO: 4642511 - DNA, 12 bp, Homo sapiens
ttttctcttaga

SEQ ID NO: 4642512 - DNA, 22 bp, Homo sapiens
ttttctgagatgctcactttat

SEQ ID NO: 4642513 - DNA, 11 bp, Homo sapiens
ttttctgctgt

SEQ ID NO: 4642514 - DNA, 14 bp, Homo sapiens
ttttcttactttta

SEQ ID NO: 4642515 - DNA, 22 bp, Homo sapiens
ttttgaaacaaagtactcttta

SEQ ID NO: 4642516 - DNA, 12 bp, Homo sapiens
ttttgaagtgat

SEQ ID NO: 4642517 - DNA, 23 bp, Homo sapiens
ttttgagatggagtctcactctt

SEQ ID NO: 4642518 - DNA, 21 bp, Homo sapiens
ttttgagtttcagctggaaac

SEQ ID NO: 4642519 - DNA, 17 bp, Homo sapiens
ttttgatgcagataaaa

SEQ ID NO: 4642520 - DNA, 23 bp, Homo sapiens
ttttgatggtactgatgagtctt

SEQ ID NO: 4642521 - DNA, 15 bp, Homo sapiens
ttttgcatactgaaa

SEQ ID NO: 4642522 - DNA, 17 bp, Homo sapiens
ttttgccgctgagatat

SEQ ID NO: 4642523 - DNA, 15 bp, Homo sapiens
ttttggaaaaacctt

SEQ ID NO: 4642524 - DNA, 19 bp, Homo sapiens
ttttggcctgtgatgtttt

SEQ ID NO: 4642525 - DNA, 19 bp, Homo sapiens
ttttggtgtgccctgtgtg

SEQ ID NO: 4642526 - DNA, 14 bp, Homo sapiens
ttttgtaaggggaa

SEQ ID NO: 4642527 - DNA, 21 bp, Homo sapiens
ttttgtaatgcactgttttta

SEQ ID NO: 4642528 - DNA, 14 bp, Homo sapiens
ttttgtaattgctt

SEQ ID NO: 4642529 - DNA, 15 bp, Homo sapiens
ttttgtacttttagt

SEQ ID NO: 4642530 - DNA, 16 bp, Homo sapiens
ttttgtaggaagcatt

SEQ ID NO: 4642531 - DNA, 18 bp, Homo sapiens
ttttgtggattaaacctt

SEQ ID NO: 4642532 - DNA, 19 bp, Homo sapiens
ttttgtttcatattgatgt

SEQ ID NO: 4642533 - DNA, 15 bp, Homo sapiens
ttttgttttgttgga

SEQ ID NO: 4642534 - DNA, 19 bp, Homo sapiens
ttttgtttttgtaatgcac

SEQ ID NO: 4642535 - DNA, 18 bp, Homo sapiens
tttttaaaaaatattttc

SEQ ID NO: 4642536 - DNA, 19 bp, Homo sapiens
tttttaaaaaatattttct

SEQ ID NO: 4642537 - DNA, 21 bp, Homo sapiens
tttttaaaaataaatctaaat

SEQ ID NO: 4642538 - DNA, 21 bp, Homo sapiens
tttttaaaaatgtgtcaaaat

SEQ ID NO: 4642539 - DNA, 19 bp, Homo sapiens
tttttaaaatatattgctg

SEQ ID NO: 4642540 - DNA, 14 bp, Homo sapiens
tttttaaagtttaa

SEQ ID NO: 4642541 - DNA, 13 bp, Homo sapiens
tttttaacctgtt

SEQ ID NO: 4642542 - DNA, 13 bp, Homo sapiens
tttttaagaaaaa

SEQ ID NO: 4642543 - DNA, 18 bp, Homo sapiens
tttttaagttacacattt

SEQ ID NO: 4642544 - DNA, 15 bp, Homo sapiens
tttttaatgaccaat

SEQ ID NO: 4642545 - DNA, 22 bp, Homo sapiens
tttttagccataattttgcata

SEQ ID NO: 4642546 - DNA, 15 bp, Homo sapiens
tttttaggacatctt

SEQ ID NO: 4642547 - DNA, 18 bp, Homo sapiens
tttttataatgttattca

SEQ ID NO: 4642548 - DNA, 13 bp, Homo sapiens
tttttatgctctt

SEQ ID NO: 4642549 - DNA, 15 bp, Homo sapiens
tttttattatgcatt

SEQ ID NO: 4642550 - DNA, 13 bp, Homo sapiens
tttttatttaaat

SEQ ID NO: 4642551 - DNA, 18 bp, Homo sapiens
tttttattttaggcactg

SEQ ID NO: 4642552 - DNA, 12 bp, Homo sapiens
tttttcagtttt

SEQ ID NO: 4642553 - DNA, 19 bp, Homo sapiens
tttttcatccttctttcct

SEQ ID NO: 4642554 - DNA, 10 bp, Homo sapiens
tttttcatgt

SEQ ID NO: 4642555 - DNA, 11 bp, Homo sapiens
tttttcatgtt

SEQ ID NO: 4642556 - DNA, 18 bp, Homo sapiens
tttttcatgttttaacaa

SEQ ID NO: 4642557 - DNA, 14 bp, Homo sapiens
tttttctagtacac

SEQ ID NO: 4642558 - DNA, 14 bp, Homo sapiens
tttttctgcttttg

SEQ ID NO: 4642559 - DNA, 14 bp, Homo sapiens
tttttcttaacaag

SEQ ID NO: 4642560 - DNA, 19 bp, Homo sapiens
tttttcttgtattcatgaa

SEQ ID NO: 4642561 - DNA, 19 bp, Homo sapiens
tttttgcaactaggtattt

SEQ ID NO: 4642562 - DNA, 15 bp, Homo sapiens
tttttggtttccaaa

SEQ ID NO: 4642563 - DNA, 22 bp, Homo sapiens
tttttgtccatcttgtttcatt

SEQ ID NO: 4642564 - DNA, 23 bp, Homo sapiens
ttttttaaaccagggatgtctgt

SEQ ID NO: 4642565 - DNA, 16 bp, Homo sapiens
ttttttccacttttgt

SEQ ID NO: 4642566 - DNA, 19 bp, Homo sapiens
ttttttctaataaagccat

SEQ ID NO: 4642567 - DNA, 12 bp, Homo sapiens
ttttttggttaa

SEQ ID NO: 4642568 - DNA, 17 bp, Homo sapiens
ttttttgtcttattgaa

SEQ ID NO: 4642569 - DNA, 18 bp, Homo sapiens
gccccagagaaactgcca

SEQ ID NO: 4642570 - DNA, 16 bp, Homo sapiens
gccccagaggccctgg

SEQ ID NO: 4642571 - DNA, 20 bp, Homo sapiens
gccccagaggccctggaggt

SEQ ID NO: 4642572 - DNA, 16 bp, Homo sapiens
gccccaggccctacta

SEQ ID NO: 4642573 - DNA, 17 bp, Homo sapiens
gccccaggccctactac

SEQ ID NO: 4642574 - DNA, 17 bp, Homo sapiens
gccccagtcggccccat

SEQ ID NO: 4642575 - DNA, 17 bp, Homo sapiens
gccccatcctcatccct

SEQ ID NO: 4642576 - DNA, 15 bp, Homo sapiens
gccccatgacctcca

SEQ ID NO: 4642577 - DNA, 12 bp, Homo sapiens
gcccccaccagg

SEQ ID NO: 4642578 - DNA, 18 bp, Homo sapiens
gcccccaccgtgggcagg

SEQ ID NO: 4642579 - DNA, 15 bp, Homo sapiens
gcccccagccccctc

SEQ ID NO: 4642580 - DNA, 18 bp, Homo sapiens
gcccccagccccctcctg

SEQ ID NO: 4642581 - DNA, 18 bp, Homo sapiens
gcccccagccctgggaac

SEQ ID NO: 4642582 - DNA, 15 bp, Homo sapiens
gcccccagctggccc

SEQ ID NO: 4642583 - DNA, 18 bp, Homo sapiens
gcccccatctcatgcccc

SEQ ID NO: 4642584 - DNA, 13 bp, Homo sapiens
gccccccctaaga

SEQ ID NO: 4642585 - DNA, 21 bp, Homo sapiens
gcccccgtcagggagaggtca

SEQ ID NO: 4642586 - DNA, 15 bp, Homo sapiens
gccccgccagggctg

SEQ ID NO: 4642587 - DNA, 17 bp, Homo sapiens
gccccgccagggctggg

SEQ ID NO: 4642588 - DNA, 16 bp, Homo sapiens
gccccgcccctgcccc

SEQ ID NO: 4642589 - DNA, 19 bp, Homo sapiens
gccccgccttttcccccac

SEQ ID NO: 4642590 - DNA, 22 bp, Homo sapiens
gccccgggatattatagaaaat

SEQ ID NO: 4642591 - DNA, 22 bp, Homo sapiens
gccccgggctggagaaagagct

SEQ ID NO: 4642592 - DNA, 23 bp, Homo sapiens
gccccgtgggtgggcctggccct

SEQ ID NO: 4642593 - DNA, 23 bp, Homo sapiens
gcccctaagtgcaaacacagcat

SEQ ID NO: 4642594 - DNA, 12 bp, Homo sapiens
gcccctcacttc

SEQ ID NO: 4642595 - DNA, 14 bp, Homo sapiens
gcccctctctgggc

SEQ ID NO: 4642596 - DNA, 16 bp, Homo sapiens
gcccctgcctgctgga

SEQ ID NO: 4642597 - DNA, 14 bp, Homo sapiens
gcccctggagccag

SEQ ID NO: 4642598 - DNA, 15 bp, Homo sapiens
gcccctggagccaga

SEQ ID NO: 4642599 - DNA, 14 bp, Homo sapiens
gcccctggccccag

SEQ ID NO: 4642600 - DNA, 12 bp, Homo sapiens
gcccctggctgg

SEQ ID NO: 4642601 - DNA, 14 bp, Homo sapiens
gcccctggctggga

SEQ ID NO: 4642602 - DNA, 16 bp, Homo sapiens
gcccctggctgggacg

SEQ ID NO: 4642603 - DNA, 14 bp, Homo sapiens
gcccctgtgggact

SEQ ID NO: 4642604 - DNA, 22 bp, Homo sapiens
gccccttccccatgaaccctgc

SEQ ID NO: 4642605 - DNA, 23 bp, Homo sapiens
gccccttccccatgaaccctgcc

SEQ ID NO: 4642606 - DNA, 12 bp, Homo sapiens
gccccttcccct

SEQ ID NO: 4642607 - DNA, 18 bp, Homo sapiens
gccccttcccctgggaac

SEQ ID NO: 4642608 - DNA, 17 bp, Homo sapiens
gccccttctgctcagct

SEQ ID NO: 4642609 - DNA, 18 bp, Homo sapiens
gccccttctgctcagctc

SEQ ID NO: 4642610 - DNA, 14 bp, Homo sapiens
gcccctttgcctgt

SEQ ID NO: 4642611 - DNA, 19 bp, Homo sapiens
gcccgaagtctgctgctgt

SEQ ID NO: 4642612 - DNA, 17 bp, Homo sapiens
gcccgacagtgccatcc

SEQ ID NO: 4642613 - DNA, 21 bp, Homo sapiens
gcccgaccgggccaggcctgg

SEQ ID NO: 4642614 - DNA, 14 bp, Homo sapiens
gcccgagcagctga

SEQ ID NO: 4642615 - DNA, 19 bp, Homo sapiens
gcccgagcagctgagcagg

SEQ ID NO: 4642616 - DNA, 23 bp, Homo sapiens
gcccgagcagctgagcagggccg

SEQ ID NO: 4642617 - DNA, 15 bp, Homo sapiens
gcccgcagacctctg

SEQ ID NO: 4642618 - DNA, 18 bp, Homo sapiens
gcccgcagacctctggat

SEQ ID NO: 4642619 - DNA, 14 bp, Homo sapiens
gcccgcgcagctgc

SEQ ID NO: 4642620 - DNA, 13 bp, Homo sapiens
gcccgctggggac

SEQ ID NO: 4642621 - DNA, 17 bp, Homo sapiens
gcccggtgcagggcctg

SEQ ID NO: 4642622 - DNA, 19 bp, Homo sapiens
gcccgtgccacccccagcc

SEQ ID NO: 4642623 - DNA, 15 bp, Homo sapiens
gccctaatgtctgta

SEQ ID NO: 4642624 - DNA, 13 bp, Homo sapiens
gccctcagactgt

SEQ ID NO: 4642625 - DNA, 15 bp, Homo sapiens
gccctcagctggtcc

SEQ ID NO: 4642626 - DNA, 18 bp, Homo sapiens
gccctcattactgggcct

SEQ ID NO: 4642627 - DNA, 19 bp, Homo sapiens
gccctcattactgggcctt

SEQ ID NO: 4642628 - DNA, 11 bp, Homo sapiens
gccctcccagc

SEQ ID NO: 4642629 - DNA, 15 bp, Homo sapiens
gccctcccagcccat

SEQ ID NO: 4642630 - DNA, 16 bp, Homo sapiens
gccctctatttattag

SEQ ID NO: 4642631 - DNA, 17 bp, Homo sapiens
gccctctttccctgcga

SEQ ID NO: 4642632 - DNA, 20 bp, Homo sapiens
gccctgagaagctgctccag

SEQ ID NO: 4642633 - DNA, 15 bp, Homo sapiens
gccctgcaccttccc

SEQ ID NO: 4642634 - DNA, 15 bp, Homo sapiens
gccctgcagaccctg

SEQ ID NO: 4642635 - DNA, 16 bp, Homo sapiens
gccctgcagaccctgc

SEQ ID NO: 4642636 - DNA, 21 bp, Homo sapiens
gccctgcatctgtctgctctg

SEQ ID NO: 4642637 - DNA, 22 bp, Homo sapiens
gccctgcatctgtctgctctgc

SEQ ID NO: 4642638 - DNA, 14 bp, Homo sapiens
gccctgcccacaga

SEQ ID NO: 4642639 - DNA, 13 bp, Homo sapiens
gccctgcccaggt

SEQ ID NO: 4642640 - DNA, 20 bp, Homo sapiens
gccctgcccaggtatcctgg

SEQ ID NO: 4642641 - DNA, 20 bp, Homo sapiens
gccctgcccttcagcatcct

SEQ ID NO: 4642642 - DNA, 20 bp, Homo sapiens
gccctgcctggaggacctga

SEQ ID NO: 4642643 - DNA, 10 bp, Homo sapiens
gccctgctac

SEQ ID NO: 4642644 - DNA, 14 bp, Homo sapiens
gccctgctctgccc

SEQ ID NO: 4642645 - DNA, 19 bp, Homo sapiens
gccctgctctgcccaggca

SEQ ID NO: 4642646 - DNA, 19 bp, Homo sapiens
gccctggaggtctccaggg

SEQ ID NO: 4642647 - DNA, 17 bp, Homo sapiens
gccctggatcagcgtgg

SEQ ID NO: 4642648 - DNA, 23 bp, Homo sapiens
gccctggatcagcgtggccttgt

SEQ ID NO: 4642649 - DNA, 19 bp, Homo sapiens
gccctggcccccatcagcc

SEQ ID NO: 4642650 - DNA, 23 bp, Homo sapiens
gccctggcccccatcagccctgc

SEQ ID NO: 4642651 - DNA, 17 bp, Homo sapiens
gccctgggaaccactcc

SEQ ID NO: 4642652 - DNA, 18 bp, Homo sapiens
gccctgggaaccactccc

SEQ ID NO: 4642653 - DNA, 21 bp, Homo sapiens
gccctgggaaccactcccacc

SEQ ID NO: 4642654 - DNA, 20 bp, Homo sapiens
gccctgggaccgctacacca

SEQ ID NO: 4642655 - DNA, 23 bp, Homo sapiens
gccctgggggtttaagctctgcc

SEQ ID NO: 4642656 - DNA, 11 bp, Homo sapiens
gccctgtgtgt

SEQ ID NO: 4642657 - DNA, 20 bp, Homo sapiens
gccctgttcagctactccca

SEQ ID NO: 4642658 - DNA, 20 bp, Homo sapiens
gcccttacctgtctctctct

SEQ ID NO: 4642659 - DNA, 22 bp, Homo sapiens
gcccttacctgtctctctcttc

SEQ ID NO: 4642660 - DNA, 13 bp, Homo sapiens
gcccttccccctt

SEQ ID NO: 4642661 - DNA, 22 bp, Homo sapiens
gcccttccccctttctctgcct

SEQ ID NO: 4642662 - DNA, 23 bp, Homo sapiens
gcccttccccctttctctgcctg

SEQ ID NO: 4642663 - DNA, 14 bp, Homo sapiens
gcccttcctctcca

SEQ ID NO: 4642664 - DNA, 13 bp, Homo sapiens
gcccttcctggac

SEQ ID NO: 4642665 - DNA, 19 bp, Homo sapiens
gcccttcctggacagctgt

SEQ ID NO: 4642666 - DNA, 20 bp, Homo sapiens
gcccttcctggacagctgtg

SEQ ID NO: 4642667 - DNA, 22 bp, Homo sapiens
gcccttcctggacagctgtgcc

SEQ ID NO: 4642668 - DNA, 23 bp, Homo sapiens
gcccttcctggacagctgtgcct

SEQ ID NO: 4642669 - DNA, 22 bp, Homo sapiens
gcccttgaaccccctccctgtc

SEQ ID NO: 4642670 - DNA, 23 bp, Homo sapiens
gcccttgctttcggagctcctgt

SEQ ID NO: 4642671 - DNA, 18 bp, Homo sapiens
gcccttgtttggggcagg

SEQ ID NO: 4642672 - DNA, 21 bp, Homo sapiens
gcccttgtttggggcaggagt

SEQ ID NO: 4642673 - DNA, 21 bp, Homo sapiens
gccctttgagatctggggagg

SEQ ID NO: 4642674 - DNA, 23 bp, Homo sapiens
gccctttgagatctggggaggca

SEQ ID NO: 4642675 - DNA, 19 bp, Homo sapiens
gccgaagctaacagggaag

SEQ ID NO: 4642676 - DNA, 14 bp, Homo sapiens
gccgagtccaagct

SEQ ID NO: 4642677 - DNA, 13 bp, Homo sapiens
gccgatgccaccg

SEQ ID NO: 4642678 - DNA, 15 bp, Homo sapiens
gccgcccgctgggga

SEQ ID NO: 4642679 - DNA, 14 bp, Homo sapiens
gccgccgcccgctg

SEQ ID NO: 4642680 - DNA, 15 bp, Homo sapiens
gccgccgcccgctgg

SEQ ID NO: 4642681 - DNA, 22 bp, Homo sapiens
gccggcagcgggcggaggggat

SEQ ID NO: 4642682 - DNA, 13 bp, Homo sapiens
gccggctggaaat

SEQ ID NO: 4642683 - DNA, 22 bp, Homo sapiens
gccggctggaaatgctgggctg

SEQ ID NO: 4642684 - DNA, 13 bp, Homo sapiens
gccgggcagaggg

SEQ ID NO: 4642685 - DNA, 23 bp, Homo sapiens
gccggggctctgggtgctgccct

SEQ ID NO: 4642686 - DNA, 14 bp, Homo sapiens
gccgtgtgagtgtg

SEQ ID NO: 4642687 - DNA, 22 bp, Homo sapiens
gccgtgtgagtgtgacagggcc

SEQ ID NO: 4642688 - DNA, 22 bp, Homo sapiens
gccgtttgaatatattttatct

SEQ ID NO: 4642689 - DNA, 22 bp, Homo sapiens
gcctaatccctgggcattgctt

SEQ ID NO: 4642690 - DNA, 23 bp, Homo sapiens
gcctaatccctgggcattgcttt

SEQ ID NO: 4642691 - DNA, 21 bp, Homo sapiens
gcctaccgctggccctgccgt

SEQ ID NO: 4642692 - DNA, 13 bp, Homo sapiens
gcctagagctcta

SEQ ID NO: 4642693 - DNA, 16 bp, Homo sapiens
gcctagtaaccaaggc

SEQ ID NO: 4642694 - DNA, 19 bp, Homo sapiens
gcctagtaaccaaggccct

SEQ ID NO: 4642695 - DNA, 20 bp, Homo sapiens
gcctagtaaccaaggccctg

SEQ ID NO: 4642696 - DNA, 16 bp, Homo sapiens
gcctagtacaatcttg

SEQ ID NO: 4642697 - DNA, 17 bp, Homo sapiens
gcctatgacttgggcac

SEQ ID NO: 4642698 - DNA, 20 bp, Homo sapiens
gcctatgcacatatggactc

SEQ ID NO: 4642699 - DNA, 16 bp, Homo sapiens
gcctatggagagccct

SEQ ID NO: 4642700 - DNA, 19 bp, Homo sapiens
gcctatggagagccctggg

SEQ ID NO: 4642701 - DNA, 18 bp, Homo sapiens
gcctatgtggtctaaggt

SEQ ID NO: 4642702 - DNA, 20 bp, Homo sapiens
gcctcaaaacgggtcagtat

SEQ ID NO: 4642703 - DNA, 12 bp, Homo sapiens
gcctcaaaatgt

SEQ ID NO: 4642704 - DNA, 15 bp, Homo sapiens
gcctcacatctccct

SEQ ID NO: 4642705 - DNA, 17 bp, Homo sapiens
gcctcacatctcccttc

SEQ ID NO: 4642706 - DNA, 19 bp, Homo sapiens
gcctcacccctcccctggg

SEQ ID NO: 4642707 - DNA, 13 bp, Homo sapiens
gcctcacccctgc

SEQ ID NO: 4642708 - DNA, 16 bp, Homo sapiens
gcctcacccctgcccc

SEQ ID NO: 4642709 - DNA, 17 bp, Homo sapiens
gcctcacccctgcccct

SEQ ID NO: 4642710 - DNA, 20 bp, Homo sapiens
gcctcacttcctttgccctt

SEQ ID NO: 4642711 - DNA, 12 bp, Homo sapiens
gcctcagagctt

SEQ ID NO: 4642712 - DNA, 20 bp, Homo sapiens
gcctcagagcttcctgggga

SEQ ID NO: 4642713 - DNA, 12 bp, Homo sapiens
gcctccatcttt

SEQ ID NO: 4642714 - DNA, 18 bp, Homo sapiens
gcctccatctttttcttg

SEQ ID NO: 4642715 - DNA, 14 bp, Homo sapiens
gcctccctgcctca

SEQ ID NO: 4642716 - DNA, 15 bp, Homo sapiens
gcctccctggtgaga

SEQ ID NO: 4642717 - DNA, 20 bp, Homo sapiens
gcctccgaaggggctctgag

SEQ ID NO: 4642718 - DNA, 21 bp, Homo sapiens
gcctccgacgctgcctctcat

SEQ ID NO: 4642719 - DNA, 14 bp, Homo sapiens
gcctcctctctccc

SEQ ID NO: 4642720 - DNA, 17 bp, Homo sapiens
gcctcctctctccctgc

SEQ ID NO: 4642721 - DNA, 13 bp, Homo sapiens
gcctcctgcctct

SEQ ID NO: 4642722 - DNA, 13 bp, Homo sapiens
gcctcctgtgggg

SEQ ID NO: 4642723 - DNA, 14 bp, Homo sapiens
gcctcctgtgggga

SEQ ID NO: 4642724 - DNA, 22 bp, Homo sapiens
gcctcgacagggcctggagccc

SEQ ID NO: 4642725 - DNA, 20 bp, Homo sapiens
gcctcgcaacccgtgccaag

SEQ ID NO: 4642726 - DNA, 14 bp, Homo sapiens
gcctcgcaggaaga

SEQ ID NO: 4642727 - DNA, 20 bp, Homo sapiens
gcctcgctccccactctgct

SEQ ID NO: 4642728 - DNA, 24 bp, Homo sapiens
gcctcgctccccactctgctctga

SEQ ID NO: 4642729 - DNA, 13 bp, Homo sapiens
gcctcgctccctt

SEQ ID NO: 4642730 - DNA, 19 bp, Homo sapiens
gcctcgctctgttacccag

SEQ ID NO: 4642731 - DNA, 23 bp, Homo sapiens
gcctcgctctgttacccagggtg

SEQ ID NO: 4642732 - DNA, 19 bp, Homo sapiens
gcctcgctttttcatcctt

SEQ ID NO: 4642733 - DNA, 23 bp, Homo sapiens
gcctcgctttttcatccttcttt

SEQ ID NO: 4642734 - DNA, 19 bp, Homo sapiens
gcctcgtgaggggcaagct

SEQ ID NO: 4642735 - DNA, 13 bp, Homo sapiens
gcctctgaggcca

SEQ ID NO: 4642736 - DNA, 18 bp, Homo sapiens
gcctctgaggccagcctg

SEQ ID NO: 4642737 - DNA, 21 bp, Homo sapiens
gcctctgaggccagcctggcc

SEQ ID NO: 4642738 - DNA, 15 bp, Homo sapiens
gcctcttatgggggt

SEQ ID NO: 4642739 - DNA, 21 bp, Homo sapiens
gcctcttattccaggagaagg

SEQ ID NO: 4642740 - DNA, 16 bp, Homo sapiens
gcctcttgtaaagact

SEQ ID NO: 4642741 - DNA, 16 bp, Homo sapiens
gcctgaaagctgggag

SEQ ID NO: 4642742 - DNA, 22 bp, Homo sapiens
gcctgaacactcagttgcaggg

SEQ ID NO: 4642743 - DNA, 20 bp, Homo sapiens
gcctgagagaattggctcaa

SEQ ID NO: 4642744 - DNA, 13 bp, Homo sapiens
gcctgagcccagg

SEQ ID NO: 4642745 - DNA, 14 bp, Homo sapiens
gcctgagcccaggg

SEQ ID NO: 4642746 - DNA, 18 bp, Homo sapiens
gcctgagcccagggaggc

SEQ ID NO: 4642747 - DNA, 19 bp, Homo sapiens
gcctgagcccagggaggcc

SEQ ID NO: 4642748 - DNA, 12 bp, Homo sapiens
gcctgagcccct

SEQ ID NO: 4642749 - DNA, 21 bp, Homo sapiens
gcctgaggacagaaagaccct

SEQ ID NO: 4642750 - DNA, 19 bp, Homo sapiens
gcctgaggggaaagagaga

SEQ ID NO: 4642751 - DNA, 22 bp, Homo sapiens
gcctgagtgacctccttctgca

SEQ ID NO: 4642752 - DNA, 20 bp, Homo sapiens
gcctgatgagatttttaaaa

SEQ ID NO: 4642753 - DNA, 17 bp, Homo sapiens
gcctgcacatcatgagc

SEQ ID NO: 4642754 - DNA, 11 bp, Homo sapiens
gcctgcagaag

SEQ ID NO: 4642755 - DNA, 21 bp, Homo sapiens
gcctgcattgagcttgcatgc

SEQ ID NO: 4642756 - DNA, 13 bp, Homo sapiens
gcctgccccctgg

SEQ ID NO: 4642757 - DNA, 15 bp, Homo sapiens
gcctgccccctgggg

SEQ ID NO: 4642758 - DNA, 16 bp, Homo sapiens
gcctgccgagcaaccg

SEQ ID NO: 4642759 - DNA, 19 bp, Homo sapiens
gcctgccgagcaaccgtgg

SEQ ID NO: 4642760 - DNA, 14 bp, Homo sapiens
gcctgcctggaaga

SEQ ID NO: 4642761 - DNA, 21 bp, Homo sapiens
gcctgcgtccgtttcgcgctg

SEQ ID NO: 4642762 - DNA, 13 bp, Homo sapiens
gcctgctgctgag

SEQ ID NO: 4642763 - DNA, 17 bp, Homo sapiens
gcctgctgctgagaacc

SEQ ID NO: 4642764 - DNA, 18 bp, Homo sapiens
gcctgctgctgagaacct

SEQ ID NO: 4642765 - DNA, 23 bp, Homo sapiens
gcctgctgctgagaacctggcct

SEQ ID NO: 4642766 - DNA, 14 bp, Homo sapiens
gcctgctgtcacct

SEQ ID NO: 4642767 - DNA, 22 bp, Homo sapiens
gcctgctgtcacctcgctgggc

SEQ ID NO: 4642768 - DNA, 20 bp, Homo sapiens
gcctggagacaaggtgctaa

SEQ ID NO: 4642769 - DNA, 12 bp, Homo sapiens
gcctggagcccc

SEQ ID NO: 4642770 - DNA, 18 bp, Homo sapiens
gcctggagccccatcggc

SEQ ID NO: 4642771 - DNA, 20 bp, Homo sapiens
gcctggaggacctgagcctg

SEQ ID NO: 4642772 - DNA, 21 bp, Homo sapiens
gcctggatgagaaacagctca

SEQ ID NO: 4642773 - DNA, 23 bp, Homo sapiens
gcctggatgagaaacagctcagc

SEQ ID NO: 4642774 - DNA, 20 bp, Homo sapiens
gcctggatgcggatggccgg

SEQ ID NO: 4642775 - DNA, 22 bp, Homo sapiens
gcctggcaacatcttacttgtc

SEQ ID NO: 4642776 - DNA, 14 bp, Homo sapiens
gcctggcacacatc

SEQ ID NO: 4642777 - DNA, 13 bp, Homo sapiens
gcctggccctgct

SEQ ID NO: 4642778 - DNA, 14 bp, Homo sapiens
gcctggccctgctt

SEQ ID NO: 4642779 - DNA, 15 bp, Homo sapiens
gcctggcctcctgcc

SEQ ID NO: 4642780 - DNA, 22 bp, Homo sapiens
gcctggcctcctgcctctactg

SEQ ID NO: 4642781 - DNA, 21 bp, Homo sapiens
tgggataggaaaaatgagtaa

SEQ ID NO: 4642782 - DNA, 15 bp, Homo sapiens
tgggatcatccagag

SEQ ID NO: 4642783 - DNA, 18 bp, Homo sapiens
tgggattacaggcgcctg

SEQ ID NO: 4642784 - DNA, 23 bp, Homo sapiens
tgggattgacagaagcttctgcc

SEQ ID NO: 4642785 - DNA, 14 bp, Homo sapiens
tgggcaaagcttgt

SEQ ID NO: 4642786 - DNA, 16 bp, Homo sapiens
tgggcaaagggaagta

SEQ ID NO: 4642787 - DNA, 15 bp, Homo sapiens
tgggcacccccagcc

SEQ ID NO: 4642788 - DNA, 21 bp, Homo sapiens
tgggcacccccagcctgggcc

SEQ ID NO: 4642789 - DNA, 16 bp, Homo sapiens
tgggcacggccctcct

SEQ ID NO: 4642790 - DNA, 22 bp, Homo sapiens
tgggcactccgcgccgatgcca

SEQ ID NO: 4642791 - DNA, 21 bp, Homo sapiens
tgggcagaggaatgtgggcta

SEQ ID NO: 4642792 - DNA, 19 bp, Homo sapiens
tgggcagagtcctgccttc

SEQ ID NO: 4642793 - DNA, 13 bp, Homo sapiens
tgggcagccagac

SEQ ID NO: 4642794 - DNA, 13 bp, Homo sapiens
tgggcagcgccct

SEQ ID NO: 4642795 - DNA, 17 bp, Homo sapiens
tgggcagcgcccttcct

SEQ ID NO: 4642796 - DNA, 12 bp, Homo sapiens
tgggcattgctt

SEQ ID NO: 4642797 - DNA, 13 bp, Homo sapiens
tgggcattgcttt

SEQ ID NO: 4642798 - DNA, 12 bp, Homo sapiens
tgggccagggct

SEQ ID NO: 4642799 - DNA, 22 bp, Homo sapiens
tgggccagggctgccctgagaa

SEQ ID NO: 4642800 - DNA, 19 bp, Homo sapiens
tgggccattctccacagca

SEQ ID NO: 4642801 - DNA, 17 bp, Homo sapiens
tgggccccgggctggag

SEQ ID NO: 4642802 - DNA, 19 bp, Homo sapiens
tgggccccgggctggagaa

SEQ ID NO: 4642803 - DNA, 21 bp, Homo sapiens
tgggcctatggagagccctgg

SEQ ID NO: 4642804 - DNA, 17 bp, Homo sapiens
tgggcctcaggctctgc

SEQ ID NO: 4642805 - DNA, 15 bp, Homo sapiens
tgggcctgctgctga

SEQ ID NO: 4642806 - DNA, 16 bp, Homo sapiens
tgggcctgctgctgag

SEQ ID NO: 4642807 - DNA, 15 bp, Homo sapiens
tgggcctggatgcag

SEQ ID NO: 4642808 - DNA, 16 bp, Homo sapiens
tgggccttagtgggcc

SEQ ID NO: 4642809 - DNA, 18 bp, Homo sapiens
tgggctcaagctttcccg

SEQ ID NO: 4642810 - DNA, 14 bp, Homo sapiens
tgggctcagcaggg

SEQ ID NO: 4642811 - DNA, 12 bp, Homo sapiens
tgggctctggac

SEQ ID NO: 4642812 - DNA, 15 bp, Homo sapiens
tgggctctggactcc

SEQ ID NO: 4642813 - DNA, 16 bp, Homo sapiens
tgggctgacccagcat

SEQ ID NO: 4642814 - DNA, 15 bp, Homo sapiens
tgggctggggaggag

SEQ ID NO: 4642815 - DNA, 17 bp, Homo sapiens
tgggctggggaggagga

SEQ ID NO: 4642816 - DNA, 16 bp, Homo sapiens
tggggacagagggtgt

SEQ ID NO: 4642817 - DNA, 20 bp, Homo sapiens
tggggacatctctttgaatt

SEQ ID NO: 4642818 - DNA, 21 bp, Homo sapiens
tggggactttatttatttcta

SEQ ID NO: 4642819 - DNA, 13 bp, Homo sapiens
tggggaggcaggc

SEQ ID NO: 4642820 - DNA, 14 bp, Homo sapiens
tggacagaaaatgc

SEQ ID NO: 4642821 - DNA, 15 bp, Homo sapiens
tggacagaaaatgca

SEQ ID NO: 4642822 - DNA, 18 bp, Homo sapiens
tggacagcatcagaaatc

SEQ ID NO: 4642823 - DNA, 13 bp, Homo sapiens
tggacagctgtgc

SEQ ID NO: 4642824 - DNA, 14 bp, Homo sapiens
tggacaggctggct

SEQ ID NO: 4642825 - DNA, 17 bp, Homo sapiens
tggacattttttcagtc

SEQ ID NO: 4642826 - DNA, 13 bp, Homo sapiens
tggactagccaga

SEQ ID NO: 4642827 - DNA, 18 bp, Homo sapiens
tggactagccagaattct

SEQ ID NO: 4642828 - DNA, 14 bp, Homo sapiens
tggactcagggcag

SEQ ID NO: 4642829 - DNA, 13 bp, Homo sapiens
tggactctgcaca

SEQ ID NO: 4642830 - DNA, 14 bp, Homo sapiens
tggactctgcacat

SEQ ID NO: 4642831 - DNA, 17 bp, Homo sapiens
tggactctgcacatgaa

SEQ ID NO: 4642832 - DNA, 19 bp, Homo sapiens
tggactgtttcatagtttt

SEQ ID NO: 4642833 - DNA, 15 bp, Homo sapiens
tggacttaaagaaaa

SEQ ID NO: 4642834 - DNA, 17 bp, Homo sapiens
tggagaaagaagtggag

SEQ ID NO: 4642835 - DNA, 19 bp, Homo sapiens
tggagaaagagctgcctgg

SEQ ID NO: 4642836 - DNA, 23 bp, Homo sapiens
tggagaaagagctgcctggatga

SEQ ID NO: 4642837 - DNA, 15 bp, Homo sapiens
tggagaacagtggtt

SEQ ID NO: 4642838 - DNA, 16 bp, Homo sapiens
tggagacaaggtgcta

SEQ ID NO: 4642839 - DNA, 17 bp, Homo sapiens
tggagacaaggtgctaa

SEQ ID NO: 4642840 - DNA, 18 bp, Homo sapiens
tggagacaaggtgctaac

SEQ ID NO: 4642841 - DNA, 22 bp, Homo sapiens
tggagacagtcctttcccacca

SEQ ID NO: 4642842 - DNA, 15 bp, Homo sapiens
tggagagccctggga

SEQ ID NO: 4642843 - DNA, 14 bp, Homo sapiens
tggagagctaggag

SEQ ID NO: 4642844 - DNA, 15 bp, Homo sapiens
tggagagctaggagc

SEQ ID NO: 4642845 - DNA, 22 bp, Homo sapiens
tggagagctaggagcaaagcct

SEQ ID NO: 4642846 - DNA, 16 bp, Homo sapiens
tggagaggcttcccta

SEQ ID NO: 4642847 - DNA, 16 bp, Homo sapiens
tggagatactggtgga

SEQ ID NO: 4642848 - DNA, 15 bp, Homo sapiens
tggagatcacagccc

SEQ ID NO: 4642849 - DNA, 20 bp, Homo sapiens
tggagatcacagccccaccc

SEQ ID NO: 4642850 - DNA, 20 bp, Homo sapiens
tggagcaagctcttcccttg

SEQ ID NO: 4642851 - DNA, 17 bp, Homo sapiens
tggagccccatcggcca

SEQ ID NO: 4642852 - DNA, 16 bp, Homo sapiens
tggaggaagagccacc

SEQ ID NO: 4642853 - DNA, 17 bp, Homo sapiens
tggaggaagagccacct

SEQ ID NO: 4642854 - DNA, 20 bp, Homo sapiens
tggaggaagagccacctgca

SEQ ID NO: 4642855 - DNA, 22 bp, Homo sapiens
tggaggaagagccacctgcaag

SEQ ID NO: 4642856 - DNA, 18 bp, Homo sapiens
tggaggaatacattttat

SEQ ID NO: 4642857 - DNA, 21 bp, Homo sapiens
tggaggaatacattttattct

SEQ ID NO: 4642858 - DNA, 17 bp, Homo sapiens
tggaggacctgagcctg

SEQ ID NO: 4642859 - DNA, 14 bp, Homo sapiens
tggaggagagagac

SEQ ID NO: 4642860 - DNA, 16 bp, Homo sapiens
tggaggagccaggccc

SEQ ID NO: 4642861 - DNA, 17 bp, Homo sapiens
tggaggagccaggcccc

SEQ ID NO: 4642862 - DNA, 20 bp, Homo sapiens
tggaggagggtttgggcaga

SEQ ID NO: 4642863 - DNA, 11 bp, Homo sapiens
tggaggcagag

SEQ ID NO: 4642864 - DNA, 12 bp, Homo sapiens
tggaggctgctc

SEQ ID NO: 4642865 - DNA, 22 bp, Homo sapiens
tggagggaaggataaagccact

SEQ ID NO: 4642866 - DNA, 19 bp, Homo sapiens
tggagggcaagccctgccc

SEQ ID NO: 4642867 - DNA, 15 bp, Homo sapiens
tggagggcttggccc

SEQ ID NO: 4642868 - DNA, 22 bp, Homo sapiens
tggaggggagaggtcagccttg

SEQ ID NO: 4642869 - DNA, 15 bp, Homo sapiens
tggaggtcccagccc

SEQ ID NO: 4642870 - DNA, 22 bp, Homo sapiens
tggaggtctccaggggcctgca

SEQ ID NO: 4642871 - DNA, 13 bp, Homo sapiens
tggaggtgggcaa

SEQ ID NO: 4642872 - DNA, 21 bp, Homo sapiens
tggagtagcctggactgtttc

SEQ ID NO: 4642873 - DNA, 14 bp, Homo sapiens
tggagtatgattta

SEQ ID NO: 4642874 - DNA, 16 bp, Homo sapiens
tggagtctcactcttg

SEQ ID NO: 4642875 - DNA, 21 bp, Homo sapiens
tggagtgagaggcccccaccc

SEQ ID NO: 4642876 - DNA, 14 bp, Homo sapiens
tggagttcttgtgc

SEQ ID NO: 4642877 - DNA, 15 bp, Homo sapiens
tggagttcttgtgcc

SEQ ID NO: 4642878 - DNA, 15 bp, Homo sapiens
tggagtttttctgaa

SEQ ID NO: 4642879 - DNA, 17 bp, Homo sapiens
tggataaaataatgctg

SEQ ID NO: 4642880 - DNA, 19 bp, Homo sapiens
tggataagtggctgtttca

SEQ ID NO: 4642881 - DNA, 21 bp, Homo sapiens
tggatagcattgttttctttt

SEQ ID NO: 4642882 - DNA, 24 bp, Homo sapiens
tggatattttttggtgtgccctgt

SEQ ID NO: 4642883 - DNA, 18 bp, Homo sapiens
tggatccaatgttagaga

SEQ ID NO: 4642884 - DNA, 17 bp, Homo sapiens
tggatctctggttgtct

SEQ ID NO: 4642885 - DNA, 15 bp, Homo sapiens
tggatcttgaatgtg

SEQ ID NO: 4642886 - DNA, 22 bp, Homo sapiens
aatatgtttagttttacatttt

SEQ ID NO: 4642887 - DNA, 22 bp, Homo sapiens
aatattactcagtttatgttgt

SEQ ID NO: 4642888 - DNA, 14 bp, Homo sapiens
aatattagttaatg

SEQ ID NO: 4642889 - DNA, 12 bp, Homo sapiens
aatattgtaata

SEQ ID NO: 4642890 - DNA, 14 bp, Homo sapiens
aatattgtacagtt

SEQ ID NO: 4642891 - DNA, 12 bp, Homo sapiens
aatatttcttca

SEQ ID NO: 4642892 - DNA, 16 bp, Homo sapiens
aatattttctatttta

SEQ ID NO: 4642893 - DNA, 20 bp, Homo sapiens
aatatttttgtatttctcta

SEQ ID NO: 4642894 - DNA, 14 bp, Homo sapiens
aatcaaaacaagtg

SEQ ID NO: 4642895 - DNA, 13 bp, Homo sapiens
aatcaagagaaac

SEQ ID NO: 4642896 - DNA, 10 bp, Homo sapiens
aatcaagagt

SEQ ID NO: 4642897 - DNA, 14 bp, Homo sapiens
aatcaagtattttg

SEQ ID NO: 4642898 - DNA, 14 bp, Homo sapiens
aatcacactgcggt

SEQ ID NO: 4642899 - DNA, 20 bp, Homo sapiens
aatcacattaacattttgag

SEQ ID NO: 4642900 - DNA, 21 bp, Homo sapiens
aatcacgtaaagctagaaatg

SEQ ID NO: 4642901 - DNA, 16 bp, Homo sapiens
aatcactaaactttat

SEQ ID NO: 4642902 - DNA, 18 bp, Homo sapiens
aatcactaaactttattt

SEQ ID NO: 4642903 - DNA, 13 bp, Homo sapiens
aatcagaaagtaa

SEQ ID NO: 4642904 - DNA, 17 bp, Homo sapiens
aatcagaaagtaacaat

SEQ ID NO: 4642905 - DNA, 12 bp, Homo sapiens
aatcaggcaagg

SEQ ID NO: 4642906 - DNA, 22 bp, Homo sapiens
aatcaggcaaggaggaggagtc

SEQ ID NO: 4642907 - DNA, 18 bp, Homo sapiens
aatcagtaggaccaggcc

SEQ ID NO: 4642908 - DNA, 16 bp, Homo sapiens
aatcagttctgtgtgg

SEQ ID NO: 4642909 - DNA, 19 bp, Homo sapiens
aatcagttctgtgtggtgc

SEQ ID NO: 4642910 - DNA, 23 bp, Homo sapiens
aatcagttctgtgtggtgcattc

SEQ ID NO: 4642911 - DNA, 14 bp, Homo sapiens
aatcagtttttcat

SEQ ID NO: 4642912 - DNA, 20 bp, Homo sapiens
aatcatacaaactctcacca

SEQ ID NO: 4642913 - DNA, 22 bp, Homo sapiens
aatcatgttgatcatgtacttt

SEQ ID NO: 4642914 - DNA, 23 bp, Homo sapiens
aatcatgttgatcatgtactttt

SEQ ID NO: 4642915 - DNA, 20 bp, Homo sapiens
aatcattaatttcaaaattt

SEQ ID NO: 4642916 - DNA, 12 bp, Homo sapiens
aatcattatttg

SEQ ID NO: 4642917 - DNA, 14 bp, Homo sapiens
aatcattgaagtat

SEQ ID NO: 4642918 - DNA, 20 bp, Homo sapiens
aatcattgaagtatattctt

SEQ ID NO: 4642919 - DNA, 22 bp, Homo sapiens
aatcattgaagtatattcttat

SEQ ID NO: 4642920 - DNA, 12 bp, Homo sapiens
aatcattgttgc

SEQ ID NO: 4642921 - DNA, 13 bp, Homo sapiens
aatcatttattca

SEQ ID NO: 4642922 - DNA, 22 bp, Homo sapiens
aatcatttgtttacatttgatg

SEQ ID NO: 4642923 - DNA, 14 bp, Homo sapiens
aatcatttttgtag

SEQ ID NO: 4642924 - DNA, 15 bp, Homo sapiens
aatccatactgtaga

SEQ ID NO: 4642925 - DNA, 17 bp, Homo sapiens
aatccatactgtagaca

SEQ ID NO: 4642926 - DNA, 22 bp, Homo sapiens
aatccatactgtagacactctg

SEQ ID NO: 4642927 - DNA, 12 bp, Homo sapiens
aatccattttag

SEQ ID NO: 4642928 - DNA, 15 bp, Homo sapiens
aatcccagcactttg

SEQ ID NO: 4642929 - DNA, 19 bp, Homo sapiens
aatccctgggcattgcttt

SEQ ID NO: 4642930 - DNA, 21 bp, Homo sapiens
aatccctgggcattgctttcc

SEQ ID NO: 4642931 - DNA, 23 bp, Homo sapiens
aatcccttttatctattagataa

SEQ ID NO: 4642932 - DNA, 12 bp, Homo sapiens
aatccgaacctc

SEQ ID NO: 4642933 - DNA, 13 bp, Homo sapiens
aatccgaacctcc

SEQ ID NO: 4642934 - DNA, 15 bp, Homo sapiens
aatccgccagtgttt

SEQ ID NO: 4642935 - DNA, 18 bp, Homo sapiens
aatccgccagtgtttctg

SEQ ID NO: 4642936 - DNA, 17 bp, Homo sapiens
aatcctatatagaatgc

SEQ ID NO: 4642937 - DNA, 20 bp, Homo sapiens
aatcctccccgctctgccgc

SEQ ID NO: 4642938 - DNA, 11 bp, Homo sapiens
aatcctcctga

SEQ ID NO: 4642939 - DNA, 22 bp, Homo sapiens
aatcctcctgagtagctgggat

SEQ ID NO: 4642940 - DNA, 19 bp, Homo sapiens
aatcctcttctaaaatagc

SEQ ID NO: 4642941 - DNA, 13 bp, Homo sapiens
aatcctgtgtttc

SEQ ID NO: 4642942 - DNA, 18 bp, Homo sapiens
aatccttttcctgttcat

SEQ ID NO: 4642943 - DNA, 13 bp, Homo sapiens
aaggaaagaaggg

SEQ ID NO: 4642944 - DNA, 14 bp, Homo sapiens
aaggaagcaacaga

SEQ ID NO: 4642945 - DNA, 23 bp, Homo sapiens
aaggaaggggctatcctgggacc

SEQ ID NO: 4642946 - DNA, 16 bp, Homo sapiens
aaggacagttcagaga

SEQ ID NO: 4642947 - DNA, 17 bp, Homo sapiens
aaggacatgagatcagg

SEQ ID NO: 4642948 - DNA, 14 bp, Homo sapiens
aaggacccagccct

SEQ ID NO: 4642949 - DNA, 17 bp, Homo sapiens
aaggacccttttaagca

SEQ ID NO: 4642950 - DNA, 20 bp, Homo sapiens
aaggacccttttaagcatgt

SEQ ID NO: 4642951 - DNA, 23 bp, Homo sapiens
aaggacctcctcttcccccttcc

SEQ ID NO: 4642952 - DNA, 19 bp, Homo sapiens
aaggactgagggcagtgcc

SEQ ID NO: 4642953 - DNA, 15 bp, Homo sapiens
aaggagacaggatga

SEQ ID NO: 4642954 - DNA, 22 bp, Homo sapiens
aaggagacaggatgaggtctcg

SEQ ID NO: 4642955 - DNA, 20 bp, Homo sapiens
aaggagcaaaaatctgagaa

SEQ ID NO: 4642956 - DNA, 16 bp, Homo sapiens
aaggagcctaggccag

SEQ ID NO: 4642957 - DNA, 22 bp, Homo sapiens
aaggagcctgtgaacccaggac

SEQ ID NO: 4642958 - DNA, 16 bp, Homo sapiens
aaggaggaaggagcct

SEQ ID NO: 4642959 - DNA, 22 bp, Homo sapiens
aaggaggaccagtcaggatgag

SEQ ID NO: 4642960 - DNA, 20 bp, Homo sapiens
aaggaggccaaccagcccga

SEQ ID NO: 4642961 - DNA, 17 bp, Homo sapiens
aaggaggcccactgtgt

SEQ ID NO: 4642962 - DNA, 12 bp, Homo sapiens
aaggagtgccat

SEQ ID NO: 4642963 - DNA, 19 bp, Homo sapiens
aaggataaagccacttctg

SEQ ID NO: 4642964 - DNA, 15 bp, Homo sapiens
aaggatcaattgtaa

SEQ ID NO: 4642965 - DNA, 15 bp, Homo sapiens
aaggcaaaaccgtgc

SEQ ID NO: 4642966 - DNA, 14 bp, Homo sapiens
aaggcacagtggga

SEQ ID NO: 4642967 - DNA, 16 bp, Homo sapiens
aaggcacagtgggagc

SEQ ID NO: 4642968 - DNA, 22 bp, Homo sapiens
aaggcacagtgggagctgagct

SEQ ID NO: 4642969 - DNA, 14 bp, Homo sapiens
aaggcagacagcag

SEQ ID NO: 4642970 - DNA, 14 bp, Homo sapiens
aaggcagcaaggcc

SEQ ID NO: 4642971 - DNA, 17 bp, Homo sapiens
aaggcagcctgaacact

SEQ ID NO: 4642972 - DNA, 18 bp, Homo sapiens
aaggcaggcagggctctc

SEQ ID NO: 4642973 - DNA, 21 bp, Homo sapiens
aaggcaggcagggctctcctg

SEQ ID NO: 4642974 - DNA, 21 bp, Homo sapiens
aaggcagtggcaggggagcag

SEQ ID NO: 4642975 - DNA, 21 bp, Homo sapiens
aaggcattggcatctgctttt

SEQ ID NO: 4642976 - DNA, 22 bp, Homo sapiens
aaggccatctgggctcctccag

SEQ ID NO: 4642977 - DNA, 20 bp, Homo sapiens
aaggcctcttgtaaagactg

SEQ ID NO: 4642978 - DNA, 15 bp, Homo sapiens
aaggcctggggtgac

SEQ ID NO: 4642979 - DNA, 22 bp, Homo sapiens
aaggcctggggtgacccggcac

SEQ ID NO: 4642980 - DNA, 14 bp, Homo sapiens
aaggcctggtctgg

SEQ ID NO: 4642981 - DNA, 22 bp, Homo sapiens
aaggctcagcttggatttgtgt

SEQ ID NO: 4642982 - DNA, 16 bp, Homo sapiens
aaggctttcagggcct

SEQ ID NO: 4642983 - DNA, 17 bp, Homo sapiens
aaggctttcagggcctc

SEQ ID NO: 4642984 - DNA, 20 bp, Homo sapiens
aagggaagaaggaggaatgc

SEQ ID NO: 4642985 - DNA, 17 bp, Homo sapiens
aagggacccacctgcta

SEQ ID NO: 4642986 - DNA, 13 bp, Homo sapiens
aagggagaaaaaa

SEQ ID NO: 4642987 - DNA, 15 bp, Homo sapiens
aagggagatgtcagg

SEQ ID NO: 4642988 - DNA, 13 bp, Homo sapiens
aagggagggctct

SEQ ID NO: 4642989 - DNA, 16 bp, Homo sapiens
aagggagggctctgag

SEQ ID NO: 4642990 - DNA, 17 bp, Homo sapiens
aagggagggctctgagg

SEQ ID NO: 4642991 - DNA, 21 bp, Homo sapiens
aagggagggctctgaggcgcc

SEQ ID NO: 4642992 - DNA, 17 bp, Homo sapiens
tggtgctatttgaagaa

SEQ ID NO: 4642993 - DNA, 16 bp, Homo sapiens
tggtgcttggaggggg

SEQ ID NO: 4642994 - DNA, 12 bp, Homo sapiens
tggtggcatttt

SEQ ID NO: 4642995 - DNA, 17 bp, Homo sapiens
tggtggcatttttgctt

SEQ ID NO: 4642996 - DNA, 21 bp, Homo sapiens
tggtggcatttttgcttccta

SEQ ID NO: 4642997 - DNA, 15 bp, Homo sapiens
tggtggctcccgcct

SEQ ID NO: 4642998 - DNA, 19 bp, Homo sapiens
tggtgggattacaggtgtg

SEQ ID NO: 4642999 - DNA, 14 bp, Homo sapiens
tggtggtattttat

SEQ ID NO: 4643000 - DNA, 22 bp, Homo sapiens
tggtgtgagaagatcattgcca

SEQ ID NO: 4643001 - DNA, 17 bp, Homo sapiens
tggtgtgccctgtgtgt

SEQ ID NO: 4643002 - DNA, 20 bp, Homo sapiens
tggtgttttggggatgagag

SEQ ID NO: 4643003 - DNA, 17 bp, Homo sapiens
tggtgtttttcccccgc

SEQ ID NO: 4643004 - DNA, 18 bp, Homo sapiens
tggttaaccctctcttga

SEQ ID NO: 4643005 - DNA, 13 bp, Homo sapiens
tggttatcttgtt

SEQ ID NO: 4643006 - DNA, 23 bp, Homo sapiens
tggttgcagtctttcccccagga

SEQ ID NO: 4643007 - DNA, 22 bp, Homo sapiens
tggtttaaccattggaatggac

SEQ ID NO: 4643008 - DNA, 21 bp, Homo sapiens
tggtttagttataaaaggctt

SEQ ID NO: 4643009 - DNA, 15 bp, Homo sapiens
tggtttccaaagaat

SEQ ID NO: 4643010 - DNA, 18 bp, Homo sapiens
tggttttctgccaatgac

SEQ ID NO: 4643011 - DNA, 16 bp, Homo sapiens
tggtttttcagttttc

SEQ ID NO: 4643012 - DNA, 23 bp, Homo sapiens
tgtaaaaacagcattgctttctg

SEQ ID NO: 4643013 - DNA, 24 bp, Homo sapiens
tgtaaaaacagcattgctttctga

SEQ ID NO: 4643014 - DNA, 22 bp, Homo sapiens
tgtaaaaggccaaacctctgtt

SEQ ID NO: 4643015 - DNA, 20 bp, Homo sapiens
tgtaaacagaagcctgtttc

SEQ ID NO: 4643016 - DNA, 22 bp, Homo sapiens
tgtaaaccacaaggctgttgca

SEQ ID NO: 4643017 - DNA, 22 bp, Homo sapiens
tgtaaacttctgaagactgaga

SEQ ID NO: 4643018 - DNA, 21 bp, Homo sapiens
tgtaaatcatgttgatcatgt

SEQ ID NO: 4643019 - DNA, 18 bp, Homo sapiens
tgtaaatttggcttctgt

SEQ ID NO: 4643020 - DNA, 16 bp, Homo sapiens
tgtaacgtggcactgg

SEQ ID NO: 4643021 - DNA, 23 bp, Homo sapiens
tgtaacttgccatccgcacagaa

SEQ ID NO: 4643022 - DNA, 19 bp, Homo sapiens
tgtaagaagccccttattt

SEQ ID NO: 4643023 - DNA, 13 bp, Homo sapiens
tgtaagggcagtg

SEQ ID NO: 4643024 - DNA, 14 bp, Homo sapiens
tgtaagggcagtgc

SEQ ID NO: 4643025 - DNA, 15 bp, Homo sapiens
tgtaagggcagtgcc

SEQ ID NO: 4643026 - DNA, 15 bp, Homo sapiens
tgtaagtgtaaaaaa

SEQ ID NO: 4643027 - DNA, 20 bp, Homo sapiens
tgtaagtttacctatgtaac

SEQ ID NO: 4643028 - DNA, 18 bp, Homo sapiens
tgtaataactttcttacc

SEQ ID NO: 4643029 - DNA, 21 bp, Homo sapiens
tgtaataagacttagattgtg

SEQ ID NO: 4643030 - DNA, 20 bp, Homo sapiens
tgtaatagggaaaattctaa

SEQ ID NO: 4643031 - DNA, 17 bp, Homo sapiens
tgtaatatgacagataa

SEQ ID NO: 4643032 - DNA, 19 bp, Homo sapiens
tgtaatcaggcaaggagga

SEQ ID NO: 4643033 - DNA, 13 bp, Homo sapiens
tgtaatcccagta

SEQ ID NO: 4643034 - DNA, 21 bp, Homo sapiens
tgtaatcccagtactttggaa

SEQ ID NO: 4643035 - DNA, 23 bp, Homo sapiens
tgtaatgattttggaactgtgtt

SEQ ID NO: 4643036 - DNA, 16 bp, Homo sapiens
tgtaatgcactgtttt

SEQ ID NO: 4643037 - DNA, 21 bp, Homo sapiens
tgtaatgtgtggtggcctcag

SEQ ID NO: 4643038 - DNA, 14 bp, Homo sapiens
tgtaattaactgta

SEQ ID NO: 4643039 - DNA, 16 bp, Homo sapiens
tgtaattgctttttta

SEQ ID NO: 4643040 - DNA, 12 bp, Homo sapiens
tgtaatttcaaa

SEQ ID NO: 4643041 - DNA, 13 bp, Homo sapiens
tgtaatttcaaaa

SEQ ID NO: 4643042 - DNA, 18 bp, Homo sapiens
tgtaatttcaaaatacat

SEQ ID NO: 4643043 - DNA, 21 bp, Homo sapiens
tgtacactttttacagcagca

SEQ ID NO: 4643044 - DNA, 15 bp, Homo sapiens
tgtacagaaaacatg

SEQ ID NO: 4643045 - DNA, 18 bp, Homo sapiens
tgtacagaggtcagcaca

SEQ ID NO: 4643046 - DNA, 16 bp, Homo sapiens
tgtacaggaactgcat

SEQ ID NO: 4643047 - DNA, 14 bp, Homo sapiens
tgtacagtcttgta

SEQ ID NO: 4643048 - DNA, 15 bp, Homo sapiens
tgtacagtcttgtat

SEQ ID NO: 4643049 - DNA, 17 bp, Homo sapiens
tgtacagtcttgtatta

SEQ ID NO: 4643050 - DNA, 15 bp, Homo sapiens
tgtacatgtgtagcc

SEQ ID NO: 4643051 - DNA, 19 bp, Homo sapiens
tgtacatgtgtgcagagca

SEQ ID NO: 4643052 - DNA, 14 bp, Homo sapiens
tgtacatttattca

SEQ ID NO: 4643053 - DNA, 17 bp, Homo sapiens
tgtacatttattcatag

SEQ ID NO: 4643054 - DNA, 14 bp, Homo sapiens
tgtacattttgtaa

SEQ ID NO: 4643055 - DNA, 21 bp, Homo sapiens
tgtacccaccgggccactcct

SEQ ID NO: 4643056 - DNA, 19 bp, Homo sapiens
tgtaccgcgtctaccctgg

SEQ ID NO: 4643057 - DNA, 21 bp, Homo sapiens
tgtaccgcgtctaccctggga

SEQ ID NO: 4643058 - DNA, 23 bp, Homo sapiens
tgtaccgtcgacaagaatgtccc

SEQ ID NO: 4643059 - DNA, 15 bp, Homo sapiens
tgtactactctaggg

SEQ ID NO: 4643060 - DNA, 23 bp, Homo sapiens
tgtactactctagggagtatgct

SEQ ID NO: 4643061 - DNA, 22 bp, Homo sapiens
tgtactcttctgactgccccct

SEQ ID NO: 4643062 - DNA, 24 bp, Homo sapiens
tgtactgtgtttgatttgtctcat

SEQ ID NO: 4643063 - DNA, 23 bp, Homo sapiens
tgtactgttcatacagttttata

SEQ ID NO: 4643064 - DNA, 20 bp, Homo sapiens
tgtacttcataagatattct

SEQ ID NO: 4643065 - DNA, 12 bp, Homo sapiens
tgtacttttcat

SEQ ID NO: 4643066 - DNA, 13 bp, Homo sapiens
tgtacttttcatt

SEQ ID NO: 4643067 - DNA, 22 bp, Homo sapiens
tgtacttttcattctcttttaa

SEQ ID NO: 4643068 - DNA, 15 bp, Homo sapiens
tgtactttttagtaa

SEQ ID NO: 4643069 - DNA, 20 bp, Homo sapiens
tgtactttttagtaatttct

SEQ ID NO: 4643070 - DNA, 17 bp, Homo sapiens
tgtagaaaaatccctcc

SEQ ID NO: 4643071 - DNA, 19 bp, Homo sapiens
tgtagaaaagggaactgaa

SEQ ID NO: 4643072 - DNA, 12 bp, Homo sapiens
tgtagaaaaggt

SEQ ID NO: 4643073 - DNA, 17 bp, Homo sapiens
tgtagaactcactctgg

SEQ ID NO: 4643074 - DNA, 19 bp, Homo sapiens
tgtagaactcactctgggc

SEQ ID NO: 4643075 - DNA, 14 bp, Homo sapiens
tgtagacactctga

SEQ ID NO: 4643076 - DNA, 19 bp, Homo sapiens
tgtagacactctgacaagc

SEQ ID NO: 4643077 - DNA, 22 bp, Homo sapiens
tgtagatttagtgtaataagac

SEQ ID NO: 4643078 - DNA, 17 bp, Homo sapiens
tgtagcaggttctaggc

SEQ ID NO: 4643079 - DNA, 19 bp, Homo sapiens
tgtagccacccaactttgt

SEQ ID NO: 4643080 - DNA, 19 bp, Homo sapiens
tgtagccagccaggtgcat

SEQ ID NO: 4643081 - DNA, 12 bp, Homo sapiens
tgtagccagccg

SEQ ID NO: 4643082 - DNA, 20 bp, Homo sapiens
tgtagccaggtactgcattc

SEQ ID NO: 4643083 - DNA, 15 bp, Homo sapiens
tgtagcctaaagggc

SEQ ID NO: 4643084 - DNA, 18 bp, Homo sapiens
tgtagcctaaagggcagg

SEQ ID NO: 4643085 - DNA, 19 bp, Homo sapiens
tgtagcctaaagggcaggg

SEQ ID NO: 4643086 - DNA, 22 bp, Homo sapiens
tgtagcctaaagggcagggccc

SEQ ID NO: 4643087 - DNA, 16 bp, Homo sapiens
tgtagcctgtgcatgt

SEQ ID NO: 4643088 - DNA, 15 bp, Homo sapiens
tgtagctgtaagggc

SEQ ID NO: 4643089 - DNA, 22 bp, Homo sapiens
tgtagctgtaagggcagtgccc

SEQ ID NO: 4643090 - DNA, 11 bp, Homo sapiens
tgtagctgtga

SEQ ID NO: 4643091 - DNA, 18 bp, Homo sapiens
tgtagctgtgacctgctg

SEQ ID NO: 4643092 - DNA, 20 bp, Homo sapiens
tgtagctgtgacctgctgag

SEQ ID NO: 4643093 - DNA, 13 bp, Homo sapiens
tgtagcttctctt

SEQ ID NO: 4643094 - DNA, 16 bp, Homo sapiens
tgtagctttcctggaa

SEQ ID NO: 4643095 - DNA, 15 bp, Homo sapiens
tgtaggaagcatttt

SEQ ID NO: 4643096 - DNA, 21 bp, Homo sapiens
tgtaggaattcttttggggaa

SEQ ID NO: 4643097 - DNA, 17 bp, Homo sapiens
tgtagggagaagcttta

SEQ ID NO: 4643098 - DNA, 13 bp, Homo sapiens
tgtagtgagcgag

SEQ ID NO: 4643099 - DNA, 17 bp, Homo sapiens
tgtagttaaggagccta

SEQ ID NO: 4643100 - DNA, 21 bp, Homo sapiens
tgtagttgcgtggactctgca

SEQ ID NO: 4643101 - DNA, 19 bp, Homo sapiens
tgtataaatggacctttta

SEQ ID NO: 4643102 - DNA, 23 bp, Homo sapiens
acagacgttaggcatttcctgct

SEQ ID NO: 4643103 - DNA, 23 bp, Homo sapiens
acagactgtagcttctcttgctc

SEQ ID NO: 4643104 - DNA, 14 bp, Homo sapiens
acagacttgaagga

SEQ ID NO: 4643105 - DNA, 13 bp, Homo sapiens
acagagaaggcta

SEQ ID NO: 4643106 - DNA, 20 bp, Homo sapiens
acagagaagtttgtagccag

SEQ ID NO: 4643107 - DNA, 21 bp, Homo sapiens
acagagaagtttgtagccagg

SEQ ID NO: 4643108 - DNA, 17 bp, Homo sapiens
acagagcctcgctctgt

SEQ ID NO: 4643109 - DNA, 13 bp, Homo sapiens
acagaggggagca

SEQ ID NO: 4643110 - DNA, 24 bp, Homo sapiens
acagaggtagtctcactgcttgaa

SEQ ID NO: 4643111 - DNA, 16 bp, Homo sapiens
acagagtccgggagaa

SEQ ID NO: 4643112 - DNA, 19 bp, Homo sapiens
acagagtggcctccctgct

SEQ ID NO: 4643113 - DNA, 21 bp, Homo sapiens
acagataaagaaactgaggcc

SEQ ID NO: 4643114 - DNA, 23 bp, Homo sapiens
acagataaagaaactgaggccca

SEQ ID NO: 4643115 - DNA, 14 bp, Homo sapiens
acagataacctaat

SEQ ID NO: 4643116 - DNA, 20 bp, Homo sapiens
acagataatgcttttactaa

SEQ ID NO: 4643117 - DNA, 14 bp, Homo sapiens
acagatcaagctgt

SEQ ID NO: 4643118 - DNA, 18 bp, Homo sapiens
acagatcaggctagccct

SEQ ID NO: 4643119 - DNA, 16 bp, Homo sapiens
acagatgcaatgtgct

SEQ ID NO: 4643120 - DNA, 17 bp, Homo sapiens
acagatgcaatgtgcta

SEQ ID NO: 4643121 - DNA, 20 bp, Homo sapiens
acagatggcatacctgtgcc

SEQ ID NO: 4643122 - DNA, 19 bp, Homo sapiens
acagatgtttgttttcaaa

SEQ ID NO: 4643123 - DNA, 15 bp, Homo sapiens
acagatttttttgta

SEQ ID NO: 4643124 - DNA, 12 bp, Homo sapiens
acagcacacagg

SEQ ID NO: 4643125 - DNA, 13 bp, Homo sapiens
acagcacacaggc

SEQ ID NO: 4643126 - DNA, 14 bp, Homo sapiens
acagcacacaggca

SEQ ID NO: 4643127 - DNA, 24 bp, Homo sapiens
acagccaacacgcacctgcctcag

SEQ ID NO: 4643128 - DNA, 20 bp, Homo sapiens
acagccaagattttcctctt

SEQ ID NO: 4643129 - DNA, 23 bp, Homo sapiens
acagccaaggggatatttactgc

SEQ ID NO: 4643130 - DNA, 10 bp, Homo sapiens
acagcccaga

SEQ ID NO: 4643131 - DNA, 13 bp, Homo sapiens
acagcccagagcc

SEQ ID NO: 4643132 - DNA, 15 bp, Homo sapiens
acagcccagagcctg

SEQ ID NO: 4643133 - DNA, 13 bp, Homo sapiens
acagccccaccct

SEQ ID NO: 4643134 - DNA, 14 bp, Homo sapiens
acagccccaccctt

SEQ ID NO: 4643135 - DNA, 15 bp, Homo sapiens
acagcctcacccctg

SEQ ID NO: 4643136 - DNA, 20 bp, Homo sapiens
acagcctcacccctgcccct

SEQ ID NO: 4643137 - DNA, 14 bp, Homo sapiens
acagcctgtgtctt

SEQ ID NO: 4643138 - DNA, 23 bp, Homo sapiens
acagcctgtgtctttaaatgctg

SEQ ID NO: 4643139 - DNA, 20 bp, Homo sapiens
acagccttccctctgcattg

SEQ ID NO: 4643140 - DNA, 13 bp, Homo sapiens
acagctcagccag

SEQ ID NO: 4643141 - DNA, 21 bp, Homo sapiens
acagctcagccagtggggatg

SEQ ID NO: 4643142 - DNA, 14 bp, Homo sapiens
acagctcctgccag

SEQ ID NO: 4643143 - DNA, 15 bp, Homo sapiens
acagctgtgcctcgc

SEQ ID NO: 4643144 - DNA, 16 bp, Homo sapiens
acagctgtgcctcgct

SEQ ID NO: 4643145 - DNA, 18 bp, Homo sapiens
acagctttgtatgtttat

SEQ ID NO: 4643146 - DNA, 13 bp, Homo sapiens
acaggaccctcag

SEQ ID NO: 4643147 - DNA, 23 bp, Homo sapiens
aacgtggtttgcctgaggctgta

SEQ ID NO: 4643148 - DNA, 17 bp, Homo sapiens
aacgtttttcctgttct

SEQ ID NO: 4643149 - DNA, 21 bp, Homo sapiens
aactaaacagaaaactcccaa

SEQ ID NO: 4643150 - DNA, 18 bp, Homo sapiens
aactaaataccattcact

SEQ ID NO: 4643151 - DNA, 18 bp, Homo sapiens
aactaatgtttgaacaaa

SEQ ID NO: 4643152 - DNA, 14 bp, Homo sapiens
aactactgattgaa

SEQ ID NO: 4643153 - DNA, 17 bp, Homo sapiens
aactacttgcatttgat

SEQ ID NO: 4643154 - DNA, 15 bp, Homo sapiens
aactaggctgagcaa

SEQ ID NO: 4643155 - DNA, 15 bp, Homo sapiens
aactatcaccagtgc

SEQ ID NO: 4643156 - DNA, 21 bp, Homo sapiens
aactatgttcctaacaaaatg

SEQ ID NO: 4643157 - DNA, 14 bp, Homo sapiens
aactattaaccttt

SEQ ID NO: 4643158 - DNA, 17 bp, Homo sapiens
aactcacacccctgccc

SEQ ID NO: 4643159 - DNA, 22 bp, Homo sapiens
aactcactcagtttatgctgtg

SEQ ID NO: 4643160 - DNA, 16 bp, Homo sapiens
aactcactctgggctg

SEQ ID NO: 4643161 - DNA, 17 bp, Homo sapiens
aactcactctgggctgt

SEQ ID NO: 4643162 - DNA, 24 bp, Homo sapiens
aactcatcctcttttaatggcatt

SEQ ID NO: 4643163 - DNA, 15 bp, Homo sapiens
aactcatgatcaaga

SEQ ID NO: 4643164 - DNA, 13 bp, Homo sapiens
aactccagagtca

SEQ ID NO: 4643165 - DNA, 17 bp, Homo sapiens
aactccctccaccagcc

SEQ ID NO: 4643166 - DNA, 18 bp, Homo sapiens
aactccctccaccagcct

SEQ ID NO: 4643167 - DNA, 22 bp, Homo sapiens
aactccctccaccagcctgctg

SEQ ID NO: 4643168 - DNA, 15 bp, Homo sapiens
aactcccttctgctt

SEQ ID NO: 4643169 - DNA, 17 bp, Homo sapiens
aactcccttctgcttgt

SEQ ID NO: 4643170 - DNA, 14 bp, Homo sapiens
aactcctgacctca

SEQ ID NO: 4643171 - DNA, 18 bp, Homo sapiens
aactccttccatccttga

SEQ ID NO: 4643172 - DNA, 20 bp, Homo sapiens
aactccttccatccttgact

SEQ ID NO: 4643173 - DNA, 16 bp, Homo sapiens
aactctgcccaccctc

SEQ ID NO: 4643174 - DNA, 22 bp, Homo sapiens
aactgaaggagatcaatggttt

SEQ ID NO: 4643175 - DNA, 21 bp, Homo sapiens
aactgacaggcagcctggaca

SEQ ID NO: 4643176 - DNA, 14 bp, Homo sapiens
aactgagagaaaga

SEQ ID NO: 4643177 - DNA, 15 bp, Homo sapiens
aactgagagaaagat

SEQ ID NO: 4643178 - DNA, 21 bp, Homo sapiens
aactgattgctcccaggatct

SEQ ID NO: 4643179 - DNA, 22 bp, Homo sapiens
aactgcagagtaaattgctctg

SEQ ID NO: 4643180 - DNA, 16 bp, Homo sapiens
aactggaggcagtcca

SEQ ID NO: 4643181 - DNA, 16 bp, Homo sapiens
aactggccttttgata

SEQ ID NO: 4643182 - DNA, 22 bp, Homo sapiens
aactgtaaacttggaatcaagg

SEQ ID NO: 4643183 - DNA, 13 bp, Homo sapiens
aactgtacatttc

SEQ ID NO: 4643184 - DNA, 23 bp, Homo sapiens
aactgtacatttcacaggctaat

SEQ ID NO: 4643185 - DNA, 14 bp, Homo sapiens
aactgtcctgtcct

SEQ ID NO: 4643186 - DNA, 16 bp, Homo sapiens
aactgtcctgtcctgc

SEQ ID NO: 4643187 - DNA, 13 bp, Homo sapiens
aactgtgtggcag

SEQ ID NO: 4643188 - DNA, 12 bp, Homo sapiens
aactgtgtgtga

SEQ ID NO: 4643189 - DNA, 14 bp, Homo sapiens
aactgtgtgtgaat

SEQ ID NO: 4643190 - DNA, 18 bp, Homo sapiens
aactgtttccctgctgaa

SEQ ID NO: 4643191 - DNA, 19 bp, Homo sapiens
aactgtttccctgctgaat

SEQ ID NO: 4643192 - DNA, 19 bp, Homo sapiens
aacttaaatattgctctat

SEQ ID NO: 4643193 - DNA, 15 bp, Homo sapiens
aacttaaatattgta

SEQ ID NO: 4643194 - DNA, 22 bp, Homo sapiens
aacttaaatattgtaatatgac

SEQ ID NO: 4643195 - DNA, 23 bp, Homo sapiens
aacttacactgtttcatctcagc

SEQ ID NO: 4643196 - DNA, 16 bp, Homo sapiens
aacttattacctcagg

SEQ ID NO: 4643197 - DNA, 19 bp, Homo sapiens
aacttcaagatgagcctgg

SEQ ID NO: 4643198 - DNA, 13 bp, Homo sapiens
aacttcttgtcag

SEQ ID NO: 4643199 - DNA, 17 bp, Homo sapiens
aacttcttgtcagacat

SEQ ID NO: 4643200 - DNA, 18 bp, Homo sapiens
aacttcttgtcagacata

SEQ ID NO: 4643201 - DNA, 22 bp, Homo sapiens
aacttcttgtcagacataaagc

SEQ ID NO: 4643202 - DNA, 23 bp, Homo sapiens
aacttcttgtcagacataaagcc

SEQ ID NO: 4643203 - DNA, 23 bp, Homo sapiens
aacttgacatgtagcttcttctg

SEQ ID NO: 4643204 - DNA, 12 bp, Homo sapiens
aacttgcctcca

SEQ ID NO: 4643205 - DNA, 14 bp, Homo sapiens
aacttgcctccatc

SEQ ID NO: 4643206 - DNA, 19 bp, Homo sapiens
aacttggaatcaaggtaag

SEQ ID NO: 4643207 - DNA, 12 bp, Homo sapiens
aacttggctttc

SEQ ID NO: 4643208 - DNA, 21 bp, Homo sapiens
aactttaattctctttcaaag

SEQ ID NO: 4643209 - DNA, 13 bp, Homo sapiens
aactttgtatttt

SEQ ID NO: 4643210 - DNA, 14 bp, Homo sapiens
aacttttttttaag

SEQ ID NO: 4643211 - DNA, 15 bp, Homo sapiens
aagaaaacaagtata

SEQ ID NO: 4643212 - DNA, 18 bp, Homo sapiens
aagaaaagacttgtaata

SEQ ID NO: 4643213 - DNA, 16 bp, Homo sapiens
aagaaaagtaatgaag

SEQ ID NO: 4643214 - DNA, 12 bp, Homo sapiens
aagaaaatagat

SEQ ID NO: 4643215 - DNA, 23 bp, Homo sapiens
aagaaaatgcctagagatatttc

SEQ ID NO: 4643216 - DNA, 13 bp, Homo sapiens
aagaaacaagctg

SEQ ID NO: 4643217 - DNA, 20 bp, Homo sapiens
aagaaacaagctgtgcaggc

SEQ ID NO: 4643218 - DNA, 20 bp, Homo sapiens
aagaaacaccacttaatctt

SEQ ID NO: 4643219 - DNA, 23 bp, Homo sapiens
aagaaagaggtgaccccagggca

SEQ ID NO: 4643220 - DNA, 13 bp, Homo sapiens
aagaaagatacta

SEQ ID NO: 4643221 - DNA, 14 bp, Homo sapiens
aagaaaggaagcaa

SEQ ID NO: 4643222 - DNA, 19 bp, Homo sapiens
aagaaataatccctgtaat

SEQ ID NO: 4643223 - DNA, 20 bp, Homo sapiens
aagaaatgcatatgtcacta

SEQ ID NO: 4643224 - DNA, 23 bp, Homo sapiens
aagaaattcgcatgtttaatgtg

SEQ ID NO: 4643225 - DNA, 18 bp, Homo sapiens
aagaacatacatgataca

SEQ ID NO: 4643226 - DNA, 14 bp, Homo sapiens
aagaactctctgga

SEQ ID NO: 4643227 - DNA, 22 bp, Homo sapiens
aagaagccccttatttttagcc

SEQ ID NO: 4643228 - DNA, 17 bp, Homo sapiens
aagaaggaaagaaccga

SEQ ID NO: 4643229 - DNA, 19 bp, Homo sapiens
aagaaggaaggcctgagcc

SEQ ID NO: 4643230 - DNA, 21 bp, Homo sapiens
aagaaggaaggcctgagcccc

SEQ ID NO: 4643231 - DNA, 18 bp, Homo sapiens
aagaaggaccctttttgg

SEQ ID NO: 4643232 - DNA, 18 bp, Homo sapiens
aagaagggggccctgcta

SEQ ID NO: 4643233 - DNA, 21 bp, Homo sapiens
aagaaggttaccaagaagcct

SEQ ID NO: 4643234 - DNA, 14 bp, Homo sapiens
aagaagttttatgc

SEQ ID NO: 4643235 - DNA, 23 bp, Homo sapiens
aagaatacccaggaagactttgt

SEQ ID NO: 4643236 - DNA, 14 bp, Homo sapiens
aagaatcagtagga

SEQ ID NO: 4643237 - DNA, 20 bp, Homo sapiens
aagaatcagtaggaccaggc

SEQ ID NO: 4643238 - DNA, 13 bp, Homo sapiens
aagaatgaaaaat

SEQ ID NO: 4643239 - DNA, 14 bp, Homo sapiens
aagaatgaaaaata

SEQ ID NO: 4643240 - DNA, 18 bp, Homo sapiens
aagaatgagtgaagtatt

SEQ ID NO: 4643241 - DNA, 23 bp, Homo sapiens
aagaattatttgccttctgaaat

SEQ ID NO: 4643242 - DNA, 22 bp, Homo sapiens
aagaattttcctgagacaaatt

SEQ ID NO: 4643243 - DNA, 22 bp, Homo sapiens
aagacacgtggcctcgtgaggg

SEQ ID NO: 4643244 - DNA, 17 bp, Homo sapiens
aagacactcaaatatga

SEQ ID NO: 4643245 - DNA, 20 bp, Homo sapiens
aagacagggctcatttttgc

SEQ ID NO: 4643246 - DNA, 17 bp, Homo sapiens
aagacatccataaagaa

SEQ ID NO: 4643247 - DNA, 21 bp, Homo sapiens
aagacatccataaagaagcaa

SEQ ID NO: 4643248 - DNA, 21 bp, Homo sapiens
aagacattttttaaaagcctt

SEQ ID NO: 4643249 - DNA, 16 bp, Homo sapiens
aagaccatttgtagtg

SEQ ID NO: 4643250 - DNA, 19 bp, Homo sapiens
aagacgaggggcagggaag

SEQ ID NO: 4643251 - DNA, 23 bp, Homo sapiens
aagacgaggggcagggaaggaca

SEQ ID NO: 4643252 - DNA, 15 bp, Homo sapiens
aagacgggaggggag

SEQ ID NO: 4643253 - DNA, 18 bp, Homo sapiens
aagacgggaggggaggca

SEQ ID NO: 4643254 - DNA, 17 bp, Homo sapiens
aagactgggccccacat

SEQ ID NO: 4643255 - DNA, 23 bp, Homo sapiens
aagactgggccccacatggctta

SEQ ID NO: 4643256 - DNA, 13 bp, Homo sapiens
acacagtgaaacg

SEQ ID NO: 4643257 - DNA, 21 bp, Homo sapiens
acacatatatataacaaataa

SEQ ID NO: 4643258 - DNA, 12 bp, Homo sapiens
acacatatgaac

SEQ ID NO: 4643259 - DNA, 19 bp, Homo sapiens
acacatatgaacacagaca

SEQ ID NO: 4643260 - DNA, 20 bp, Homo sapiens
acacatctgtaatcctagct

SEQ ID NO: 4643261 - DNA, 21 bp, Homo sapiens
acacatgacgccagataaaat

SEQ ID NO: 4643262 - DNA, 22 bp, Homo sapiens
acacatgacgccagataaaatg

SEQ ID NO: 4643263 - DNA, 20 bp, Homo sapiens
acacattgcagcttcaactt

SEQ ID NO: 4643264 - DNA, 12 bp, Homo sapiens
acacattttatg

SEQ ID NO: 4643265 - DNA, 14 bp, Homo sapiens
acacattttatgag

SEQ ID NO: 4643266 - DNA, 20 bp, Homo sapiens
acaccaagcacagcagcctg

SEQ ID NO: 4643267 - DNA, 16 bp, Homo sapiens
acaccactctggcagc

SEQ ID NO: 4643268 - DNA, 20 bp, Homo sapiens
acaccactctggcagccaca

SEQ ID NO: 4643269 - DNA, 20 bp, Homo sapiens
acaccacttaatcttctctc

SEQ ID NO: 4643270 - DNA, 23 bp, Homo sapiens
acaccacttaatcttctctcttg

SEQ ID NO: 4643271 - DNA, 14 bp, Homo sapiens
acacccaccccctg

SEQ ID NO: 4643272 - DNA, 20 bp, Homo sapiens
acacccaccccctgcctggt

SEQ ID NO: 4643273 - DNA, 13 bp, Homo sapiens
acacccctgcccc

SEQ ID NO: 4643274 - DNA, 12 bp, Homo sapiens
acaccctggcct

SEQ ID NO: 4643275 - DNA, 19 bp, Homo sapiens
acacctgcccgctccccac

SEQ ID NO: 4643276 - DNA, 12 bp, Homo sapiens
acacgagccaca

SEQ ID NO: 4643277 - DNA, 18 bp, Homo sapiens
acacgagccacaagctgc

SEQ ID NO: 4643278 - DNA, 23 bp, Homo sapiens
acacgatgttgtcaaggatggtt

SEQ ID NO: 4643279 - DNA, 17 bp, Homo sapiens
acacgattttattgctg

SEQ ID NO: 4643280 - DNA, 13 bp, Homo sapiens
acacgcacctgcc

SEQ ID NO: 4643281 - DNA, 16 bp, Homo sapiens
acacgcacctgcctca

SEQ ID NO: 4643282 - DNA, 19 bp, Homo sapiens
acacggatctgctgggctc

SEQ ID NO: 4643283 - DNA, 12 bp, Homo sapiens
acacggccacat

SEQ ID NO: 4643284 - DNA, 12 bp, Homo sapiens
acacgtgtcctg

SEQ ID NO: 4643285 - DNA, 23 bp, Homo sapiens
acactaagtttgcaacatttatt

SEQ ID NO: 4643286 - DNA, 14 bp, Homo sapiens
acactcagaagcct

SEQ ID NO: 4643287 - DNA, 15 bp, Homo sapiens
acactcagaagcctg

SEQ ID NO: 4643288 - DNA, 20 bp, Homo sapiens
acactcagaagcctgggggc

SEQ ID NO: 4643289 - DNA, 16 bp, Homo sapiens
acactcagcacaaggc

SEQ ID NO: 4643290 - DNA, 19 bp, Homo sapiens
acactcatgcacacagata

SEQ ID NO: 4643291 - DNA, 16 bp, Homo sapiens
acactccaagatatgg

SEQ ID NO: 4643292 - DNA, 17 bp, Homo sapiens
acactcccccagcccca

SEQ ID NO: 4643293 - DNA, 16 bp, Homo sapiens
acactctgacaagctg

SEQ ID NO: 4643294 - DNA, 13 bp, Homo sapiens
acactcttagcta

SEQ ID NO: 4643295 - DNA, 22 bp, Homo sapiens
acactcttagctatgttgacat

SEQ ID NO: 4643296 - DNA, 21 bp, Homo sapiens
acactcttcagtgactcctgc

SEQ ID NO: 4643297 - DNA, 22 bp, Homo sapiens
acactcttcagtgactcctgct

SEQ ID NO: 4643298 - DNA, 15 bp, Homo sapiens
acactgcagggagga

SEQ ID NO: 4643299 - DNA, 16 bp, Homo sapiens
acactgcagggaggag

SEQ ID NO: 4643300 - DNA, 20 bp, Homo sapiens
acactggaggagagaagaat

SEQ ID NO: 4643301 - DNA, 15 bp, Homo sapiens
acactgtttcatctc

SEQ ID NO: 4643302 - DNA, 19 bp, Homo sapiens
acactgtttcatctcagct

SEQ ID NO: 4643303 - DNA, 20 bp, Homo sapiens
acactgtttcatctcagctt

SEQ ID NO: 4643304 - DNA, 14 bp, Homo sapiens
acacttctcaggac

SEQ ID NO: 4643305 - DNA, 24 bp, Homo sapiens
acacttctcaggacacaggcctgt

SEQ ID NO: 4643306 - DNA, 23 bp, Homo sapiens
acacttgatggagtgtgagccac

SEQ ID NO: 4643307 - DNA, 21 bp, Homo sapiens
acactttgccatttgcttgta

SEQ ID NO: 4643308 - DNA, 22 bp, Homo sapiens
acactttgccatttgcttgtac

SEQ ID NO: 4643309 - DNA, 17 bp, Homo sapiens
acactttttacagcagc

SEQ ID NO: 4643310 - DNA, 21 bp, Homo sapiens
acactttttacagcagcaata

SEQ ID NO: 4643311 - DNA, 22 bp, Homo sapiens
acagaaaacatgtataaatata

SEQ ID NO: 4643312 - DNA, 13 bp, Homo sapiens
acagaacagggtc

SEQ ID NO: 4643313 - DNA, 16 bp, Homo sapiens
acagaaccttgttatt

SEQ ID NO: 4643314 - DNA, 22 bp, Homo sapiens
acagaaccttgttatttctcag

SEQ ID NO: 4643315 - DNA, 15 bp, Homo sapiens
acagaactggaggca

SEQ ID NO: 4643316 - DNA, 12 bp, Homo sapiens
acagaagaggag

SEQ ID NO: 4643317 - DNA, 17 bp, Homo sapiens
acagaagtgaggatgag

SEQ ID NO: 4643318 - DNA, 15 bp, Homo sapiens
acagacctaatatca

SEQ ID NO: 4643319 - DNA, 14 bp, Homo sapiens
aaagggacccacct

SEQ ID NO: 4643320 - DNA, 20 bp, Homo sapiens
aaagggagatgtcaggatgt

SEQ ID NO: 4643321 - DNA, 18 bp, Homo sapiens
aaagggagggctctgagg

SEQ ID NO: 4643322 - DNA, 19 bp, Homo sapiens
aaagggagggctctgaggc

SEQ ID NO: 4643323 - DNA, 22 bp, Homo sapiens
aaagggagggctctgaggcgcc

SEQ ID NO: 4643324 - DNA, 20 bp, Homo sapiens
aaagggcactcccaaccctg

SEQ ID NO: 4643325 - DNA, 19 bp, Homo sapiens
aaagggcacttaatttgta

SEQ ID NO: 4643326 - DNA, 20 bp, Homo sapiens
aaagggcacttaatttgtaa

SEQ ID NO: 4643327 - DNA, 20 bp, Homo sapiens
aaaggggttggggtgacagt

SEQ ID NO: 4643328 - DNA, 16 bp, Homo sapiens
aaagggtgtttttctg

SEQ ID NO: 4643329 - DNA, 13 bp, Homo sapiens
aaaggtgtgaaca

SEQ ID NO: 4643330 - DNA, 15 bp, Homo sapiens
aaagtaacaatctat

SEQ ID NO: 4643331 - DNA, 21 bp, Homo sapiens
aaagtaatgacttagaaactg

SEQ ID NO: 4643332 - DNA, 16 bp, Homo sapiens
aaagtaattttgtcac

SEQ ID NO: 4643333 - DNA, 17 bp, Homo sapiens
aaagtaattttgtcaca

SEQ ID NO: 4643334 - DNA, 17 bp, Homo sapiens
aaagtacatatttattt

SEQ ID NO: 4643335 - DNA, 13 bp, Homo sapiens
aaagtactcttta

SEQ ID NO: 4643336 - DNA, 11 bp, Homo sapiens
aaagtagaggt

SEQ ID NO: 4643337 - DNA, 13 bp, Homo sapiens
aaagtattctgat

SEQ ID NO: 4643338 - DNA, 16 bp, Homo sapiens
aaagtcaaaaaattat

SEQ ID NO: 4643339 - DNA, 23 bp, Homo sapiens
aaagtcacagccgtttgaatata

SEQ ID NO: 4643340 - DNA, 16 bp, Homo sapiens
aaagtcaggtccaatt

SEQ ID NO: 4643341 - DNA, 14 bp, Homo sapiens
aaagtgctgcggag

SEQ ID NO: 4643342 - DNA, 20 bp, Homo sapiens
aaagttactttgtcagaggc

SEQ ID NO: 4643343 - DNA, 12 bp, Homo sapiens
aaagttgcagat

SEQ ID NO: 4643344 - DNA, 19 bp, Homo sapiens
aaagttggttcacttcaaa

SEQ ID NO: 4643345 - DNA, 16 bp, Homo sapiens
aaagttgttgcattcc

SEQ ID NO: 4643346 - DNA, 12 bp, Homo sapiens
aaagtttaaata

SEQ ID NO: 4643347 - DNA, 17 bp, Homo sapiens
aaagttttgaaggaaac

SEQ ID NO: 4643348 - DNA, 11 bp, Homo sapiens
aaagtttttta

SEQ ID NO: 4643349 - DNA, 18 bp, Homo sapiens
aaataaaaggaagccaaa

SEQ ID NO: 4643350 - DNA, 23 bp, Homo sapiens
aaataaaatgaaaattgtattat

SEQ ID NO: 4643351 - DNA, 13 bp, Homo sapiens
aaataaacacgat

SEQ ID NO: 4643352 - DNA, 21 bp, Homo sapiens
aaataacaagtcgatgaacta

SEQ ID NO: 4643353 - DNA, 22 bp, Homo sapiens
aaataactgtgtggcagttaat

SEQ ID NO: 4643354 - DNA, 15 bp, Homo sapiens
aaataagtaatatct

SEQ ID NO: 4643355 - DNA, 18 bp, Homo sapiens
aaatacgtattacaaaca

SEQ ID NO: 4643356 - DNA, 16 bp, Homo sapiens
aaatagaataattctt

SEQ ID NO: 4643357 - DNA, 21 bp, Homo sapiens
aaatagagcaaaatcaacatg

SEQ ID NO: 4643358 - DNA, 13 bp, Homo sapiens
aaatagattaggt

SEQ ID NO: 4643359 - DNA, 18 bp, Homo sapiens
aaatagcaataactgaaa

SEQ ID NO: 4643360 - DNA, 23 bp, Homo sapiens
aaatagtgtcatataaactcatt

SEQ ID NO: 4643361 - DNA, 15 bp, Homo sapiens
aaatagttattttaa

SEQ ID NO: 4643362 - DNA, 21 bp, Homo sapiens
aaatagttattttaatacctt

SEQ ID NO: 4643363 - DNA, 23 bp, Homo sapiens
aaatagttggttcctaagaatgt

SEQ ID NO: 4643364 - DNA, 16 bp, Homo sapiens
aaatagttgtctgtgc

SEQ ID NO: 4643365 - DNA, 17 bp, Homo sapiens
aaatagttgtctgtgct

SEQ ID NO: 4643366 - DNA, 17 bp, Homo sapiens
aaatataaattgtacat

SEQ ID NO: 4643367 - DNA, 20 bp, Homo sapiens
aaatataaattgtacatttt

SEQ ID NO: 4643368 - DNA, 20 bp, Homo sapiens
aaatataaggactttttgat

SEQ ID NO: 4643369 - DNA, 22 bp, Homo sapiens
aaatatagaaagttgatattca

SEQ ID NO: 4643370 - DNA, 23 bp, Homo sapiens
aaatatattacggaggaacagat

SEQ ID NO: 4643371 - DNA, 15 bp, Homo sapiens
aaatatcataaagca

SEQ ID NO: 4643372 - DNA, 11 bp, Homo sapiens
aaatatcattc

SEQ ID NO: 4643373 - DNA, 19 bp, Homo sapiens
aaatatggggatagtctgg

SEQ ID NO: 4643374 - DNA, 17 bp, Homo sapiens
aaatatgtaatttcaaa

SEQ ID NO: 4643375 - DNA, 15 bp, Homo sapiens
aaatatgtcgtagaa

SEQ ID NO: 4643376 - DNA, 14 bp, Homo sapiens
aaatattcagaaat

SEQ ID NO: 4643377 - DNA, 12 bp, Homo sapiens
aaatattgtaat

SEQ ID NO: 4643378 - DNA, 13 bp, Homo sapiens
aaatattgtaata

SEQ ID NO: 4643379 - DNA, 22 bp, Homo sapiens
aaatattgtaatatgacagata

SEQ ID NO: 4643380 - DNA, 20 bp, Homo sapiens
aaatatttactctttgcaaa

SEQ ID NO: 4643381 - DNA, 16 bp, Homo sapiens
aaatatttagcaaata

SEQ ID NO: 4643382 - DNA, 22 bp, Homo sapiens
aaatatttgttacttttagttc

SEQ ID NO: 4643383 - DNA, 14 bp, Homo sapiens
aaatatttttagta

SEQ ID NO: 4643384 - DNA, 16 bp, Homo sapiens
aaatcaagtattttgt

SEQ ID NO: 4643385 - DNA, 17 bp, Homo sapiens
aaatcagaaagtaacaa

SEQ ID NO: 4643386 - DNA, 18 bp, Homo sapiens
aaatcagaaagtaacaat

SEQ ID NO: 4643387 - DNA, 17 bp, Homo sapiens
aaatcagtttttcatac

SEQ ID NO: 4643388 - DNA, 19 bp, Homo sapiens
aaatcatattagtattaat

SEQ ID NO: 4643389 - DNA, 19 bp, Homo sapiens
aaatccacccatatgttaa

SEQ ID NO: 4643390 - DNA, 19 bp, Homo sapiens
aaatccgaacctcctctgt

SEQ ID NO: 4643391 - DNA, 18 bp, Homo sapiens
aaatccgccagtgtttct

SEQ ID NO: 4643392 - DNA, 15 bp, Homo sapiens
aaatcctaccaaagt

SEQ ID NO: 4643393 - DNA, 14 bp, Homo sapiens
aaatcctatgtgat

SEQ ID NO: 4643394 - DNA, 16 bp, Homo sapiens
aaatcctatgtgattt

SEQ ID NO: 4643395 - DNA, 12 bp, Homo sapiens
aaatcctgtgtt

SEQ ID NO: 4643396 - DNA, 15 bp, Homo sapiens
aaatcgatattagaa

SEQ ID NO: 4643397 - DNA, 12 bp, Homo sapiens
aaatctaaacaa

SEQ ID NO: 4643398 - DNA, 19 bp, Homo sapiens
aaatctaaatgattatctt

SEQ ID NO: 4643399 - DNA, 14 bp, Homo sapiens
aaatctacagtaca

SEQ ID NO: 4643400 - DNA, 20 bp, Homo sapiens
aaatctagacattcttttaa

SEQ ID NO: 4643401 - DNA, 23 bp, Homo sapiens
aaatctagacattcttttaatgc

SEQ ID NO: 4643402 - DNA, 20 bp, Homo sapiens
aaatctccccagtagagaaa

SEQ ID NO: 4643403 - DNA, 12 bp, Homo sapiens
aaatctctaata

SEQ ID NO: 4643404 - DNA, 17 bp, Homo sapiens
aaatctgtaaagccagt

SEQ ID NO: 4643405 - DNA, 22 bp, Homo sapiens
aaatctgtaacaggtattttgt

SEQ ID NO: 4643406 - DNA, 13 bp, Homo sapiens
aaatgaaaattgt

SEQ ID NO: 4643407 - DNA, 14 bp, Homo sapiens
aaatgaagaaagtc

SEQ ID NO: 4643408 - DNA, 13 bp, Homo sapiens
aaatgagccatga

SEQ ID NO: 4643409 - DNA, 21 bp, Homo sapiens
aaatgatagttgattttcaaa

SEQ ID NO: 4643410 - DNA, 13 bp, Homo sapiens
aaatgattatctt

SEQ ID NO: 4643411 - DNA, 21 bp, Homo sapiens
aaatgatttgtagtggaaaca

SEQ ID NO: 4643412 - DNA, 23 bp, Homo sapiens
aaatgatttttacaagttttaaa

SEQ ID NO: 4643413 - DNA, 14 bp, Homo sapiens
aaatgcaaatccta

SEQ ID NO: 4643414 - DNA, 18 bp, Homo sapiens
aaatgccttaaaatggaa

SEQ ID NO: 4643415 - DNA, 22 bp, Homo sapiens
aaatgctggtatttgatttcct

SEQ ID NO: 4643416 - DNA, 22 bp, Homo sapiens
aaatgctggtttttcagttttc

SEQ ID NO: 4643417 - DNA, 23 bp, Homo sapiens
aaatggactggagctcatctgca

SEQ ID NO: 4643418 - DNA, 23 bp, Homo sapiens
aaatggttatccaattgctcttt

SEQ ID NO: 4643419 - DNA, 14 bp, Homo sapiens
aaatgtacactttt

SEQ ID NO: 4643420 - DNA, 22 bp, Homo sapiens
aaatgtacactttttacagcag

SEQ ID NO: 4643421 - DNA, 16 bp, Homo sapiens
aaatgtacatttattc

SEQ ID NO: 4643422 - DNA, 21 bp, Homo sapiens
aaatgtatccaaggaaacatt

SEQ ID NO: 4643423 - DNA, 16 bp, Homo sapiens
aaatgtattgattcaa

SEQ ID NO: 4643424 - DNA, 18 bp, Homo sapiens
aaatgtcttaatttttga

SEQ ID NO: 4643425 - DNA, 17 bp, Homo sapiens
aaatgtgaggcaataag

SEQ ID NO: 4643426 - DNA, 14 bp, Homo sapiens
aaatgtgcattttg

SEQ ID NO: 4643427 - DNA, 15 bp, Homo sapiens
aaatgtggcaaaaaa

SEQ ID NO: 4643428 - DNA, 18 bp, Homo sapiens
aaatgtggccaagcctat

SEQ ID NO: 4643429 - DNA, 19 bp, Homo sapiens
aaatgtggccaagcctatc

SEQ ID NO: 4643430 - DNA, 18 bp, Homo sapiens
aaatgttaactacatatt

SEQ ID NO: 4643431 - DNA, 12 bp, Homo sapiens
aaatgttgagaa

SEQ ID NO: 4643432 - DNA, 17 bp, Homo sapiens
aaatgtttaataaagct

SEQ ID NO: 4643433 - DNA, 23 bp, Homo sapiens
aaatgtttcattatgcactttta

SEQ ID NO: 4643434 - DNA, 13 bp, Homo sapiens
aaatgtttccccc

SEQ ID NO: 4643435 - DNA, 18 bp, Homo sapiens
aaatgtttcccccactcc

SEQ ID NO: 4643436 - DNA, 14 bp, Homo sapiens
aaatgttttttgat

SEQ ID NO: 4643437 - DNA, 19 bp, Homo sapiens
aaattaaaacaaatataca

SEQ ID NO: 4643438 - DNA, 14 bp, Homo sapiens
aaattaaacatttt

SEQ ID NO: 4643439 - DNA, 22 bp, Homo sapiens
aaattaaatctagacattcttt

SEQ ID NO: 4643440 - DNA, 13 bp, Homo sapiens
aaattaagacttt

SEQ ID NO: 4643441 - DNA, 15 bp, Homo sapiens
aaattacaattttat

SEQ ID NO: 4643442 - DNA, 16 bp, Homo sapiens
aaattacaattttatc

SEQ ID NO: 4643443 - DNA, 20 bp, Homo sapiens
aaattacctttaattttaat

SEQ ID NO: 4643444 - DNA, 21 bp, Homo sapiens
aaattcaagagctagaaaaat

SEQ ID NO: 4643445 - DNA, 22 bp, Homo sapiens
aaattcaagagctagaaaaata

SEQ ID NO: 4643446 - DNA, 13 bp, Homo sapiens
aaattcagctcct

SEQ ID NO: 4643447 - DNA, 14 bp, Homo sapiens
aaattcgcatgttt

SEQ ID NO: 4643448 - DNA, 15 bp, Homo sapiens
aaattcgcatgttta

SEQ ID NO: 4643449 - DNA, 15 bp, Homo sapiens
aaattgtacattttg

SEQ ID NO: 4643450 - DNA, 18 bp, Homo sapiens
aaattgtacattttgtaa

SEQ ID NO: 4643451 - DNA, 13 bp, Homo sapiens
aaattgtcagcaa

SEQ ID NO: 4643452 - DNA, 23 bp, Homo sapiens
aaattgtgcagtactttgtgcat

SEQ ID NO: 4643453 - DNA, 18 bp, Homo sapiens
aaatttaaaaacttaaat

SEQ ID NO: 4643454 - DNA, 13 bp, Homo sapiens
aaatttaagaaaa

SEQ ID NO: 4643455 - DNA, 16 bp, Homo sapiens
aaatttaagaaaacaa

SEQ ID NO: 4643456 - DNA, 18 bp, Homo sapiens
aaatttaagaaaacaagt

SEQ ID NO: 4643457 - DNA, 23 bp, Homo sapiens
aaatttaagtatcttttttcaaa

SEQ ID NO: 4643458 - DNA, 22 bp, Homo sapiens
aaatttaatgtttttctggaag

SEQ ID NO: 4643459 - DNA, 14 bp, Homo sapiens
aaatttactttaca

SEQ ID NO: 4643460 - DNA, 12 bp, Homo sapiens
aaatttcattgc

SEQ ID NO: 4643461 - DNA, 14 bp, Homo sapiens
aaatttcattgcac

SEQ ID NO: 4643462 - DNA, 18 bp, Homo sapiens
aaatttcattgcactttc

SEQ ID NO: 4643463 - DNA, 21 bp, Homo sapiens
aaatttctataaatttaagaa

SEQ ID NO: 4643464 - DNA, 23 bp, Homo sapiens
aaatttctcatcacagggattta

SEQ ID NO: 4643465 - DNA, 10 bp, Homo sapiens
aaatttgaat

SEQ ID NO: 4643466 - DNA, 16 bp, Homo sapiens
aaatttgactaatttt

SEQ ID NO: 4643467 - DNA, 20 bp, Homo sapiens
aaatttgactaattttacat

SEQ ID NO: 4643468 - DNA, 17 bp, Homo sapiens
aaatttttcagatgctt

SEQ ID NO: 4643469 - DNA, 18 bp, Homo sapiens
aaatttttcagatgcttc

SEQ ID NO: 4643470 - DNA, 21 bp, Homo sapiens
aacaaaaatgatcctcagtgc

SEQ ID NO: 4643471 - DNA, 12 bp, Homo sapiens
aacaaaactgtt

SEQ ID NO: 4643472 - DNA, 15 bp, Homo sapiens
aacaaaagtgtttaa

SEQ ID NO: 4643473 - DNA, 11 bp, Homo sapiens
aacaaaatttg

SEQ ID NO: 4643474 - DNA, 19 bp, Homo sapiens
aacaaaatttgtttgaaat

SEQ ID NO: 4643475 - DNA, 18 bp, Homo sapiens
aacaaacaagccccctgc

SEQ ID NO: 4643476 - DNA, 14 bp, Homo sapiens
aacaaagcagccac

SEQ ID NO: 4643477 - DNA, 15 bp, Homo sapiens
aacaaagcagccacg

SEQ ID NO: 4643478 - DNA, 13 bp, Homo sapiens
aacaaagccaaac

SEQ ID NO: 4643479 - DNA, 17 bp, Homo sapiens
aacaaataatatattaa

SEQ ID NO: 4643480 - DNA, 13 bp, Homo sapiens
aacaaatttcatt

SEQ ID NO: 4643481 - DNA, 16 bp, Homo sapiens
aacaaatttcattgca

SEQ ID NO: 4643482 - DNA, 17 bp, Homo sapiens
aacaaatttcattgcac

SEQ ID NO: 4643483 - DNA, 20 bp, Homo sapiens
aacaaatttcattgcacttt

SEQ ID NO: 4643484 - DNA, 21 bp, Homo sapiens
aacaaatttcattgcactttc

SEQ ID NO: 4643485 - DNA, 23 bp, Homo sapiens
aacaacgtgagagaaagagagaa

SEQ ID NO: 4643486 - DNA, 12 bp, Homo sapiens
aacaagtattta

SEQ ID NO: 4643487 - DNA, 16 bp, Homo sapiens
aacaagtatttattcc

SEQ ID NO: 4643488 - DNA, 18 bp, Homo sapiens
aacaagtcaattctgtgt

SEQ ID NO: 4643489 - DNA, 23 bp, Homo sapiens
aacaagttagaaaattcagctcc

SEQ ID NO: 4643490 - DNA, 23 bp, Homo sapiens
aacaataaaattttttttcatgt

SEQ ID NO: 4643491 - DNA, 16 bp, Homo sapiens
aacaattggtaaaact

SEQ ID NO: 4643492 - DNA, 17 bp, Homo sapiens
aacacaaagagatattt

SEQ ID NO: 4643493 - DNA, 14 bp, Homo sapiens
aacacaaaggaagt

SEQ ID NO: 4643494 - DNA, 16 bp, Homo sapiens
aacacacagatctgca

SEQ ID NO: 4643495 - DNA, 10 bp, Homo sapiens
aacacacctc

SEQ ID NO: 4643496 - DNA, 18 bp, Homo sapiens
aacacagcaattcctcag

SEQ ID NO: 4643497 - DNA, 17 bp, Homo sapiens
aacaccaagcacagcag

SEQ ID NO: 4643498 - DNA, 16 bp, Homo sapiens
aacaccacttaatctt

SEQ ID NO: 4643499 - DNA, 19 bp, Homo sapiens
aacacgcacctgcctcagg

SEQ ID NO: 4643500 - DNA, 13 bp, Homo sapiens
aacacggccacat

SEQ ID NO: 4643501 - DNA, 21 bp, Homo sapiens
aacacggccacatcaaagagg

SEQ ID NO: 4643502 - DNA, 19 bp, Homo sapiens
aacactcagaagcctgggg

SEQ ID NO: 4643503 - DNA, 19 bp, Homo sapiens
aacactgataatcacactg

SEQ ID NO: 4643504 - DNA, 22 bp, Homo sapiens
aacagaaaactcccaatacaaa

SEQ ID NO: 4643505 - DNA, 11 bp, Homo sapiens
aacagaacagg

SEQ ID NO: 4643506 - DNA, 21 bp, Homo sapiens
aacagaagtgacttctggaga

SEQ ID NO: 4643507 - DNA, 14 bp, Homo sapiens
aacagaagtgagga

SEQ ID NO: 4643508 - DNA, 17 bp, Homo sapiens
aacagaagtgaggatga

SEQ ID NO: 4643509 - DNA, 18 bp, Homo sapiens
aacagaccccctctagaa

SEQ ID NO: 4643510 - DNA, 19 bp, Homo sapiens
aacagaccccctctagaaa

SEQ ID NO: 4643511 - DNA, 14 bp, Homo sapiens
aacagagagaatga

SEQ ID NO: 4643512 - DNA, 16 bp, Homo sapiens
aacagagagaatgaga

SEQ ID NO: 4643513 - DNA, 23 bp, Homo sapiens
aacagagtccgggagaatgctgg

SEQ ID NO: 4643514 - DNA, 15 bp, Homo sapiens
aacagagtggcctcc

SEQ ID NO: 4643515 - DNA, 23 bp, Homo sapiens
aacagatagatgttgctctttca

SEQ ID NO: 4643516 - DNA, 15 bp, Homo sapiens
aacagatgctaggaa

SEQ ID NO: 4643517 - DNA, 17 bp, Homo sapiens
aacagcaagtgtttgtg

SEQ ID NO: 4643518 - DNA, 12 bp, Homo sapiens
aacagccagcaa

SEQ ID NO: 4643519 - DNA, 20 bp, Homo sapiens
aacagggaaggcaggcaggg

SEQ ID NO: 4643520 - DNA, 14 bp, Homo sapiens
aacagggctgcctt

SEQ ID NO: 4643521 - DNA, 21 bp, Homo sapiens
aacaggtattttgtttctttt

SEQ ID NO: 4643522 - DNA, 22 bp, Homo sapiens
aacaggtattttgtttctttta

SEQ ID NO: 4643523 - DNA, 17 bp, Homo sapiens
aacagtggttgcctggg

SEQ ID NO: 4643524 - DNA, 18 bp, Homo sapiens
aacagtggttgcctgggg

SEQ ID NO: 4643525 - DNA, 13 bp, Homo sapiens
aacagttccattt

SEQ ID NO: 4643526 - DNA, 23 bp, Homo sapiens
aacagtttcttgcttggaagcca

SEQ ID NO: 4643527 - DNA, 21 bp, Homo sapiens
aacataactcacacccctgcc

SEQ ID NO: 4643528 - DNA, 15 bp, Homo sapiens
aacatacaagaaaat

SEQ ID NO: 4643529 - DNA, 18 bp, Homo sapiens
aacatacaagaaaatgta

SEQ ID NO: 4643530 - DNA, 11 bp, Homo sapiens
aacatactgta

SEQ ID NO: 4643531 - DNA, 15 bp, Homo sapiens
aacatataaagcact

SEQ ID NO: 4643532 - DNA, 22 bp, Homo sapiens
aacatatacattttgttgcagg

SEQ ID NO: 4643533 - DNA, 16 bp, Homo sapiens
aacatatttcatttta

SEQ ID NO: 4643534 - DNA, 16 bp, Homo sapiens
aacatcaccagtgcca

SEQ ID NO: 4643535 - DNA, 15 bp, Homo sapiens
aacatctcttgaaac

SEQ ID NO: 4643536 - DNA, 13 bp, Homo sapiens
aacatcttcatat

SEQ ID NO: 4643537 - DNA, 16 bp, Homo sapiens
aacatggccagactcc

SEQ ID NO: 4643538 - DNA, 12 bp, Homo sapiens
aacattagtata

SEQ ID NO: 4643539 - DNA, 18 bp, Homo sapiens
aacattcgtgagctgggg

SEQ ID NO: 4643540 - DNA, 19 bp, Homo sapiens
aacattcgtgagctgggga

SEQ ID NO: 4643541 - DNA, 21 bp, Homo sapiens
aacattgatccagtcatttta

SEQ ID NO: 4643542 - DNA, 17 bp, Homo sapiens
atagcaacaacaattgg

SEQ ID NO: 4643543 - DNA, 19 bp, Homo sapiens
atagcaacaacaattggta

SEQ ID NO: 4643544 - DNA, 20 bp, Homo sapiens
atagccactattaacatttc

SEQ ID NO: 4643545 - DNA, 14 bp, Homo sapiens
atagctaactgtaa

SEQ ID NO: 4643546 - DNA, 17 bp, Homo sapiens
atagctaactgtaaatc

SEQ ID NO: 4643547 - DNA, 18 bp, Homo sapiens
ataggagccccaggcagg

SEQ ID NO: 4643548 - DNA, 16 bp, Homo sapiens
atagggaaaattctaa

SEQ ID NO: 4643549 - DNA, 18 bp, Homo sapiens
atagggagaatatttact

SEQ ID NO: 4643550 - DNA, 15 bp, Homo sapiens
ataggtcataaagca

SEQ ID NO: 4643551 - DNA, 17 bp, Homo sapiens
ataggtcataaagcatt

SEQ ID NO: 4643552 - DNA, 15 bp, Homo sapiens
atagtatctgtatat

SEQ ID NO: 4643553 - DNA, 15 bp, Homo sapiens
atagtgagaacccat

SEQ ID NO: 4643554 - DNA, 17 bp, Homo sapiens
atagtgagatttaagtt

SEQ ID NO: 4643555 - DNA, 19 bp, Homo sapiens
atagtgtcatataaactca

SEQ ID NO: 4643556 - DNA, 21 bp, Homo sapiens
atagttcaggagactttacaa

SEQ ID NO: 4643557 - DNA, 14 bp, Homo sapiens
atagttgcagccca

SEQ ID NO: 4643558 - DNA, 16 bp, Homo sapiens
atagttggtcatctag

SEQ ID NO: 4643559 - DNA, 13 bp, Homo sapiens
atagttgtctgtg

SEQ ID NO: 4643560 - DNA, 15 bp, Homo sapiens
atagttgtctgtgct

SEQ ID NO: 4643561 - DNA, 12 bp, Homo sapiens
atagtttcctga

SEQ ID NO: 4643562 - DNA, 12 bp, Homo sapiens
atagtttgttat

SEQ ID NO: 4643563 - DNA, 16 bp, Homo sapiens
atataaaagactgacc

SEQ ID NO: 4643564 - DNA, 13 bp, Homo sapiens
atataaagcttaa

SEQ ID NO: 4643565 - DNA, 23 bp, Homo sapiens
atataaatagatgatttcaatag

SEQ ID NO: 4643566 - DNA, 12 bp, Homo sapiens
atataaattgta

SEQ ID NO: 4643567 - DNA, 15 bp, Homo sapiens
atataaattgtacat

SEQ ID NO: 4643568 - DNA, 11 bp, Homo sapiens
atataagaaaa

SEQ ID NO: 4643569 - DNA, 23 bp, Homo sapiens
atataagaaaagtaatgaagaat

SEQ ID NO: 4643570 - DNA, 14 bp, Homo sapiens
atatacattttcta

SEQ ID NO: 4643571 - DNA, 16 bp, Homo sapiens
atatacattttctaaa

SEQ ID NO: 4643572 - DNA, 22 bp, Homo sapiens
atatacattttgttgcaggaaa

SEQ ID NO: 4643573 - DNA, 15 bp, Homo sapiens
atatagactgtacat

SEQ ID NO: 4643574 - DNA, 16 bp, Homo sapiens
atatatctctatttga

SEQ ID NO: 4643575 - DNA, 14 bp, Homo sapiens
atatattatataca

SEQ ID NO: 4643576 - DNA, 21 bp, Homo sapiens
atatattctgaagcaacattt

SEQ ID NO: 4643577 - DNA, 18 bp, Homo sapiens
atatattgttgttacttt

SEQ ID NO: 4643578 - DNA, 22 bp, Homo sapiens
atatattttgtactttgtggag

SEQ ID NO: 4643579 - DNA, 22 bp, Homo sapiens
atatatttttaaaaaatgaaat

SEQ ID NO: 4643580 - DNA, 21 bp, Homo sapiens
atatattttttgttattatta

SEQ ID NO: 4643581 - DNA, 17 bp, Homo sapiens
atatcaaataaaatatc

SEQ ID NO: 4643582 - DNA, 21 bp, Homo sapiens
atatcagggcctgagtgacct

SEQ ID NO: 4643583 - DNA, 16 bp, Homo sapiens
atatcataaagcattt

SEQ ID NO: 4643584 - DNA, 16 bp, Homo sapiens
atatcattctttgtat

SEQ ID NO: 4643585 - DNA, 13 bp, Homo sapiens
atatcattttaaa

SEQ ID NO: 4643586 - DNA, 15 bp, Homo sapiens
atatcattttattca

SEQ ID NO: 4643587 - DNA, 17 bp, Homo sapiens
atatccttatcagagct

SEQ ID NO: 4643588 - DNA, 18 bp, Homo sapiens
atatccttatcagagcta

SEQ ID NO: 4643589 - DNA, 15 bp, Homo sapiens
atatctaatatgaag

SEQ ID NO: 4643590 - DNA, 16 bp, Homo sapiens
atatctctatttgaga

SEQ ID NO: 4643591 - DNA, 23 bp, Homo sapiens
atatcttggcctaaacctcagtt

SEQ ID NO: 4643592 - DNA, 14 bp, Homo sapiens
atatgaactgcagg

SEQ ID NO: 4643593 - DNA, 18 bp, Homo sapiens
atatgacagataacctaa

SEQ ID NO: 4643594 - DNA, 21 bp, Homo sapiens
atatgacagataacctaataa

SEQ ID NO: 4643595 - DNA, 15 bp, Homo sapiens
atatgactttttata

SEQ ID NO: 4643596 - DNA, 14 bp, Homo sapiens
atatgatctgtttt

SEQ ID NO: 4643597 - DNA, 22 bp, Homo sapiens
atatgattgtttctcaaatctt

SEQ ID NO: 4643598 - DNA, 17 bp, Homo sapiens
atatgcaccttgtgtct

SEQ ID NO: 4643599 - DNA, 18 bp, Homo sapiens
atatgccactaacttcta

SEQ ID NO: 4643600 - DNA, 15 bp, Homo sapiens
atatggactctgcac

SEQ ID NO: 4643601 - DNA, 20 bp, Homo sapiens
atatgtaaacataagtgtac

SEQ ID NO: 4643602 - DNA, 20 bp, Homo sapiens
atatgtaatttcaaaataca

SEQ ID NO: 4643603 - DNA, 19 bp, Homo sapiens
atatgtacttgtcaaagaa

SEQ ID NO: 4643604 - DNA, 20 bp, Homo sapiens
atatgtacttgtcaaagaag

SEQ ID NO: 4643605 - DNA, 16 bp, Homo sapiens
atatgtcgtagaattc

SEQ ID NO: 4643606 - DNA, 11 bp, Homo sapiens
atatgtcttgc

SEQ ID NO: 4643607 - DNA, 17 bp, Homo sapiens
atatgtgccacattttc

SEQ ID NO: 4643608 - DNA, 14 bp, Homo sapiens
atatgttcactgtc

SEQ ID NO: 4643609 - DNA, 18 bp, Homo sapiens
atatgttcaggaaatgaa

SEQ ID NO: 4643610 - DNA, 16 bp, Homo sapiens
atatgttgtaatattt

SEQ ID NO: 4643611 - DNA, 15 bp, Homo sapiens
atattaattttctac

SEQ ID NO: 4643612 - DNA, 16 bp, Homo sapiens
atattaccatcttaat

SEQ ID NO: 4643613 - DNA, 18 bp, Homo sapiens
atattacggaggaacaga

SEQ ID NO: 4643614 - DNA, 21 bp, Homo sapiens
atattactctagtttattcta

SEQ ID NO: 4643615 - DNA, 18 bp, Homo sapiens
atattcatggatggctca

SEQ ID NO: 4643616 - DNA, 12 bp, Homo sapiens
atattcctttta

SEQ ID NO: 4643617 - DNA, 13 bp, Homo sapiens
atattcttattgg

SEQ ID NO: 4643618 - DNA, 15 bp, Homo sapiens
atattcttattggaa

SEQ ID NO: 4643619 - DNA, 17 bp, Homo sapiens
atattcttattggaaat

SEQ ID NO: 4643620 - DNA, 22 bp, Homo sapiens
atattcttattggaaatgtact

SEQ ID NO: 4643621 - DNA, 18 bp, Homo sapiens
atattgatattgaaggaa

SEQ ID NO: 4643622 - DNA, 22 bp, Homo sapiens
atattgatcaaatatagaaagt

SEQ ID NO: 4643623 - DNA, 22 bp, Homo sapiens
atattgcaaggtgtgatggtct

SEQ ID NO: 4643624 - DNA, 18 bp, Homo sapiens
atattgctctatgttagt

SEQ ID NO: 4643625 - DNA, 17 bp, Homo sapiens
atattgtaatatgacag

SEQ ID NO: 4643626 - DNA, 14 bp, Homo sapiens
atattgtacagttt

SEQ ID NO: 4643627 - DNA, 14 bp, Homo sapiens
atattgtttctgca

SEQ ID NO: 4643628 - DNA, 18 bp, Homo sapiens
atatttactaactaaata

SEQ ID NO: 4643629 - DNA, 15 bp, Homo sapiens
atatttactgctctt

SEQ ID NO: 4643630 - DNA, 14 bp, Homo sapiens
atatttagctccaa

SEQ ID NO: 4643631 - DNA, 19 bp, Homo sapiens
atatttaggaaaatgctta

SEQ ID NO: 4643632 - DNA, 20 bp, Homo sapiens
atatttaggaaaatgcttat

SEQ ID NO: 4643633 - DNA, 16 bp, Homo sapiens
atatttataagagaag

SEQ ID NO: 4643634 - DNA, 14 bp, Homo sapiens
atatttatccacta

SEQ ID NO: 4643635 - DNA, 18 bp, Homo sapiens
atatttatttctagcaaa

SEQ ID NO: 4643636 - DNA, 22 bp, Homo sapiens
atatttattttcttttgaattg

SEQ ID NO: 4643637 - DNA, 20 bp, Homo sapiens
atatttggagtttttctgaa

SEQ ID NO: 4643638 - DNA, 18 bp, Homo sapiens
atattttctctgtacttt

SEQ ID NO: 4643639 - DNA, 17 bp, Homo sapiens
atatttttaaaaaatga

SEQ ID NO: 4643640 - DNA, 20 bp, Homo sapiens
atatttttataataaacata

SEQ ID NO: 4643641 - DNA, 16 bp, Homo sapiens
atatttttgtatttct

SEQ ID NO: 4643642 - DNA, 19 bp, Homo sapiens
atatttttgtatttctcta

SEQ ID NO: 4643643 - DNA, 16 bp, Homo sapiens
atcaaagccagggtct

SEQ ID NO: 4643644 - DNA, 17 bp, Homo sapiens
atcaacaataaaatttt

SEQ ID NO: 4643645 - DNA, 22 bp, Homo sapiens
atcaacaataaaatttttttaa

SEQ ID NO: 4643646 - DNA, 15 bp, Homo sapiens
atcaactactattca

SEQ ID NO: 4643647 - DNA, 17 bp, Homo sapiens
atcaactactattcaaa

SEQ ID NO: 4643648 - DNA, 14 bp, Homo sapiens
atcaagatatatgt

SEQ ID NO: 4643649 - DNA, 12 bp, Homo sapiens
atcaagctgtga

SEQ ID NO: 4643650 - DNA, 13 bp, Homo sapiens
atcaattgtaata

SEQ ID NO: 4643651 - DNA, 12 bp, Homo sapiens
atcacaaaatgt

SEQ ID NO: 4643652 - DNA, 16 bp, Homo sapiens
atcacagaaaatttaa

SEQ ID NO: 4643653 - DNA, 15 bp, Homo sapiens
atcacagccccaccc

SEQ ID NO: 4643654 - DNA, 22 bp, Homo sapiens
ataaacatttgtagcatcctct

SEQ ID NO: 4643655 - DNA, 20 bp, Homo sapiens
ataaactatttttttcttaa

SEQ ID NO: 4643656 - DNA, 19 bp, Homo sapiens
ataaagaaactgaggccca

SEQ ID NO: 4643657 - DNA, 23 bp, Homo sapiens
ataaagaagcaataaagaagagt

SEQ ID NO: 4643658 - DNA, 16 bp, Homo sapiens
ataaagatattgttca

SEQ ID NO: 4643659 - DNA, 17 bp, Homo sapiens
ataaagatcatttataa

SEQ ID NO: 4643660 - DNA, 13 bp, Homo sapiens
ataaagcttaata

SEQ ID NO: 4643661 - DNA, 13 bp, Homo sapiens
ataaagctttata

SEQ ID NO: 4643662 - DNA, 20 bp, Homo sapiens
ataaaggataactctgtatt

SEQ ID NO: 4643663 - DNA, 15 bp, Homo sapiens
ataaagtacaaatga

SEQ ID NO: 4643664 - DNA, 20 bp, Homo sapiens
ataaagtacaaatgaagaaa

SEQ ID NO: 4643665 - DNA, 20 bp, Homo sapiens
ataaagttctgcaaaataca

SEQ ID NO: 4643666 - DNA, 15 bp, Homo sapiens
ataaagttgttgcat

SEQ ID NO: 4643667 - DNA, 12 bp, Homo sapiens
ataaataacttt

SEQ ID NO: 4643668 - DNA, 21 bp, Homo sapiens
ataaatacgtattacaaacaa

SEQ ID NO: 4643669 - DNA, 12 bp, Homo sapiens
ataaatctaaat

SEQ ID NO: 4643670 - DNA, 15 bp, Homo sapiens
ataaatgtgtttata

SEQ ID NO: 4643671 - DNA, 18 bp, Homo sapiens
ataaattgtacattttgt

SEQ ID NO: 4643672 - DNA, 23 bp, Homo sapiens
ataaattgtacattttgtaaaat

SEQ ID NO: 4643673 - DNA, 18 bp, Homo sapiens
ataaatttaagaaaacaa

SEQ ID NO: 4643674 - DNA, 19 bp, Homo sapiens
ataaattttttttgtttca

SEQ ID NO: 4643675 - DNA, 14 bp, Homo sapiens
ataacaaaatggac

SEQ ID NO: 4643676 - DNA, 14 bp, Homo sapiens
ataaccaatttgta

SEQ ID NO: 4643677 - DNA, 19 bp, Homo sapiens
ataacctaataattgtatc

SEQ ID NO: 4643678 - DNA, 21 bp, Homo sapiens
ataacctaataattgtatcta

SEQ ID NO: 4643679 - DNA, 18 bp, Homo sapiens
ataacctgcacaggcttg

SEQ ID NO: 4643680 - DNA, 19 bp, Homo sapiens
ataactcacacccctgccc

SEQ ID NO: 4643681 - DNA, 17 bp, Homo sapiens
ataactgaaaatgaaag

SEQ ID NO: 4643682 - DNA, 15 bp, Homo sapiens
ataactgcagtgttc

SEQ ID NO: 4643683 - DNA, 13 bp, Homo sapiens
ataacttaaatat

SEQ ID NO: 4643684 - DNA, 23 bp, Homo sapiens
ataacttaaatattgctctatgt

SEQ ID NO: 4643685 - DNA, 13 bp, Homo sapiens
ataacttcttaaa

SEQ ID NO: 4643686 - DNA, 14 bp, Homo sapiens
ataagaaaagtaat

SEQ ID NO: 4643687 - DNA, 18 bp, Homo sapiens
ataagaaagcctaaaatt

SEQ ID NO: 4643688 - DNA, 22 bp, Homo sapiens
ataagagcatgaaatttttaaa

SEQ ID NO: 4643689 - DNA, 15 bp, Homo sapiens
ataagatattcttta

SEQ ID NO: 4643690 - DNA, 13 bp, Homo sapiens
ataagcagaacat

SEQ ID NO: 4643691 - DNA, 19 bp, Homo sapiens
ataagcagaacatactgtt

SEQ ID NO: 4643692 - DNA, 20 bp, Homo sapiens
ataagcgttaagggcagagt

SEQ ID NO: 4643693 - DNA, 20 bp, Homo sapiens
ataagcttttcacaaacatt

SEQ ID NO: 4643694 - DNA, 13 bp, Homo sapiens
ataagtagtaaat

SEQ ID NO: 4643695 - DNA, 18 bp, Homo sapiens
ataagtgaagggaaagat

SEQ ID NO: 4643696 - DNA, 17 bp, Homo sapiens
ataagtggctgtttcat

SEQ ID NO: 4643697 - DNA, 21 bp, Homo sapiens
ataagtttctattctgtcagt

SEQ ID NO: 4643698 - DNA, 13 bp, Homo sapiens
ataataaacataa

SEQ ID NO: 4643699 - DNA, 14 bp, Homo sapiens
ataataatgggaga

SEQ ID NO: 4643700 - DNA, 18 bp, Homo sapiens
ataataggggattttaaa

SEQ ID NO: 4643701 - DNA, 21 bp, Homo sapiens
ataatatgtttagttttacat

SEQ ID NO: 4643702 - DNA, 15 bp, Homo sapiens
ataatatttttgtat

SEQ ID NO: 4643703 - DNA, 17 bp, Homo sapiens
ataatcagaaaagtaat

SEQ ID NO: 4643704 - DNA, 21 bp, Homo sapiens
ataatcagcaagaatttgatc

SEQ ID NO: 4643705 - DNA, 13 bp, Homo sapiens
ataatcagtaaat

SEQ ID NO: 4643706 - DNA, 15 bp, Homo sapiens
ataatcagtaaatag

SEQ ID NO: 4643707 - DNA, 17 bp, Homo sapiens
ataatctgtacaatgaa

SEQ ID NO: 4643708 - DNA, 12 bp, Homo sapiens
ataatctttcta

SEQ ID NO: 4643709 - DNA, 14 bp, Homo sapiens
ataatctttctata

SEQ ID NO: 4643710 - DNA, 12 bp, Homo sapiens
ataatgaaaata

SEQ ID NO: 4643711 - DNA, 21 bp, Homo sapiens
ataatgaaatagttattttaa

SEQ ID NO: 4643712 - DNA, 15 bp, Homo sapiens
ataatgcttttacta

SEQ ID NO: 4643713 - DNA, 19 bp, Homo sapiens
ataatgtaaacaatatcag

SEQ ID NO: 4643714 - DNA, 13 bp, Homo sapiens
ataattcctacag

SEQ ID NO: 4643715 - DNA, 18 bp, Homo sapiens
ataattcctacagcacta

SEQ ID NO: 4643716 - DNA, 19 bp, Homo sapiens
ataattggtgctatttgaa

SEQ ID NO: 4643717 - DNA, 15 bp, Homo sapiens
ataattgtatctaca

SEQ ID NO: 4643718 - DNA, 21 bp, Homo sapiens
ataattttagtgtcatttcca

SEQ ID NO: 4643719 - DNA, 20 bp, Homo sapiens
atacaacagcaaaccctgat

SEQ ID NO: 4643720 - DNA, 20 bp, Homo sapiens
atacaataacccagttactt

SEQ ID NO: 4643721 - DNA, 16 bp, Homo sapiens
atacaatcagcccagt

SEQ ID NO: 4643722 - DNA, 19 bp, Homo sapiens
atacacgttaactgcagag

SEQ ID NO: 4643723 - DNA, 19 bp, Homo sapiens
atacactaaccaaatctct

SEQ ID NO: 4643724 - DNA, 18 bp, Homo sapiens
atacacttcttaaataca

SEQ ID NO: 4643725 - DNA, 20 bp, Homo sapiens
atacacttgtgattataaaa

SEQ ID NO: 4643726 - DNA, 13 bp, Homo sapiens
atacagacctaat

SEQ ID NO: 4643727 - DNA, 20 bp, Homo sapiens
atacaggactggttccttcc

SEQ ID NO: 4643728 - DNA, 16 bp, Homo sapiens
atacatacatgtatct

SEQ ID NO: 4643729 - DNA, 16 bp, Homo sapiens
atacatggtttaaagt

SEQ ID NO: 4643730 - DNA, 17 bp, Homo sapiens
atacattaaaataacta

SEQ ID NO: 4643731 - DNA, 14 bp, Homo sapiens
atacattttattct

SEQ ID NO: 4643732 - DNA, 18 bp, Homo sapiens
atacattttctaaataaa

SEQ ID NO: 4643733 - DNA, 19 bp, Homo sapiens
ataccagcttgtatgcaat

SEQ ID NO: 4643734 - DNA, 16 bp, Homo sapiens
atacccaccagggaga

SEQ ID NO: 4643735 - DNA, 14 bp, Homo sapiens
ataccctgcccttg

SEQ ID NO: 4643736 - DNA, 16 bp, Homo sapiens
atacctcaaactatct

SEQ ID NO: 4643737 - DNA, 14 bp, Homo sapiens
atacctctgtgtgc

SEQ ID NO: 4643738 - DNA, 17 bp, Homo sapiens
atacctctgtgtgctcc

SEQ ID NO: 4643739 - DNA, 17 bp, Homo sapiens
atacctttaaatatcat

SEQ ID NO: 4643740 - DNA, 19 bp, Homo sapiens
atacctttaaatatcattc

SEQ ID NO: 4643741 - DNA, 16 bp, Homo sapiens
atacgtattacaaaca

SEQ ID NO: 4643742 - DNA, 21 bp, Homo sapiens
atactcagggattccttctaa

SEQ ID NO: 4643743 - DNA, 15 bp, Homo sapiens
atactctgttgcctc

SEQ ID NO: 4643744 - DNA, 17 bp, Homo sapiens
atactctgttgcctcct

SEQ ID NO: 4643745 - DNA, 18 bp, Homo sapiens
atactctgttgcctcctc

SEQ ID NO: 4643746 - DNA, 13 bp, Homo sapiens
atactcttgaaag

SEQ ID NO: 4643747 - DNA, 17 bp, Homo sapiens
atactgaaggtctgaca

SEQ ID NO: 4643748 - DNA, 15 bp, Homo sapiens
atactggaggaacac

SEQ ID NO: 4643749 - DNA, 13 bp, Homo sapiens
atactggcacaga

SEQ ID NO: 4643750 - DNA, 14 bp, Homo sapiens
atactgtagacact

SEQ ID NO: 4643751 - DNA, 15 bp, Homo sapiens
atactgtagacactc

SEQ ID NO: 4643752 - DNA, 15 bp, Homo sapiens
atactgttgtgcgca

SEQ ID NO: 4643753 - DNA, 19 bp, Homo sapiens
atactgttttaaaatgtga

SEQ ID NO: 4643754 - DNA, 22 bp, Homo sapiens
atacttaacatttcattgtaca

SEQ ID NO: 4643755 - DNA, 20 bp, Homo sapiens
atacttggctgcttcctgtg

SEQ ID NO: 4643756 - DNA, 13 bp, Homo sapiens
atacttgtgaaac

SEQ ID NO: 4643757 - DNA, 13 bp, Homo sapiens
atagaaaattatt

SEQ ID NO: 4643758 - DNA, 19 bp, Homo sapiens
atagaaaattatttgtatg

SEQ ID NO: 4643759 - DNA, 13 bp, Homo sapiens
atagaaagaaact

SEQ ID NO: 4643760 - DNA, 14 bp, Homo sapiens
atagaaagaaacta

SEQ ID NO: 4643761 - DNA, 22 bp, Homo sapiens
atagaaatgctggtttttcagt

SEQ ID NO: 4643762 - DNA, 23 bp, Homo sapiens
atagaaatggaaattttgctatc

SEQ ID NO: 4643763 - DNA, 13 bp, Homo sapiens
atagaatgctgca

SEQ ID NO: 4643764 - DNA, 19 bp, Homo sapiens
atagagtacttaatatact

SEQ ID NO: 4643765 - DNA, 21 bp, Homo sapiens
atagagtacttaatatactca

SEQ ID NO: 4643766 - DNA, 19 bp, Homo sapiens
agtggcttcactcctgctg

SEQ ID NO: 4643767 - DNA, 15 bp, Homo sapiens
agtgggacagcccag

SEQ ID NO: 4643768 - DNA, 15 bp, Homo sapiens
agtgggagctgagct

SEQ ID NO: 4643769 - DNA, 14 bp, Homo sapiens
agtgggccagggct

SEQ ID NO: 4643770 - DNA, 19 bp, Homo sapiens
agtgggccccgggctggag

SEQ ID NO: 4643771 - DNA, 23 bp, Homo sapiens
agtggggagagttgtgatggagg

SEQ ID NO: 4643772 - DNA, 12 bp, Homo sapiens
agtggggttgat

SEQ ID NO: 4643773 - DNA, 16 bp, Homo sapiens
agtggtatagaaatgc

SEQ ID NO: 4643774 - DNA, 15 bp, Homo sapiens
agtggtcataaaata

SEQ ID NO: 4643775 - DNA, 21 bp, Homo sapiens
agtggtcataaaatagaataa

SEQ ID NO: 4643776 - DNA, 14 bp, Homo sapiens
agtggtgcagacag

SEQ ID NO: 4643777 - DNA, 21 bp, Homo sapiens
agtggtgcgatctcggctcag

SEQ ID NO: 4643778 - DNA, 14 bp, Homo sapiens
agtggttcctgtgg

SEQ ID NO: 4643779 - DNA, 21 bp, Homo sapiens
agtgtaaatagttactccagt

SEQ ID NO: 4643780 - DNA, 19 bp, Homo sapiens
agtgtagctgtaagggcag

SEQ ID NO: 4643781 - DNA, 20 bp, Homo sapiens
agtgtagtggcatgatctcg

SEQ ID NO: 4643782 - DNA, 13 bp, Homo sapiens
agtgtcacctcct

SEQ ID NO: 4643783 - DNA, 16 bp, Homo sapiens
agtgtcacctccttcc

SEQ ID NO: 4643784 - DNA, 19 bp, Homo sapiens
agtgtcacctccttcccca

SEQ ID NO: 4643785 - DNA, 23 bp, Homo sapiens
agtgtcacctccttccccagctc

SEQ ID NO: 4643786 - DNA, 23 bp, Homo sapiens
agtgtcagttcaactttcagaag

SEQ ID NO: 4643787 - DNA, 13 bp, Homo sapiens
agtgtcatttcca

SEQ ID NO: 4643788 - DNA, 11 bp, Homo sapiens
agtgtgacagg

SEQ ID NO: 4643789 - DNA, 22 bp, Homo sapiens
agtgttactgcctataatctta

SEQ ID NO: 4643790 - DNA, 16 bp, Homo sapiens
agtgttgcatggatgt

SEQ ID NO: 4643791 - DNA, 23 bp, Homo sapiens
agtgttggcaaacgagactttct

SEQ ID NO: 4643792 - DNA, 15 bp, Homo sapiens
agtgtttccacactt

SEQ ID NO: 4643793 - DNA, 13 bp, Homo sapiens
agtgtttcgtcat

SEQ ID NO: 4643794 - DNA, 16 bp, Homo sapiens
agtgtttcgtcatgtt

SEQ ID NO: 4643795 - DNA, 16 bp, Homo sapiens
agtgtttctgaatgtt

SEQ ID NO: 4643796 - DNA, 23 bp, Homo sapiens
agtgtttctgaatgtttgtgtct

SEQ ID NO: 4643797 - DNA, 17 bp, Homo sapiens
agtgttttctttgagga

SEQ ID NO: 4643798 - DNA, 17 bp, Homo sapiens
agtgtttttacctctgt

SEQ ID NO: 4643799 - DNA, 17 bp, Homo sapiens
agttaatgatggcagag

SEQ ID NO: 4643800 - DNA, 13 bp, Homo sapiens
agttacacatttt

SEQ ID NO: 4643801 - DNA, 16 bp, Homo sapiens
agttacacatttttca

SEQ ID NO: 4643802 - DNA, 16 bp, Homo sapiens
agttacttatgattta

SEQ ID NO: 4643803 - DNA, 20 bp, Homo sapiens
agttagaaaattcagctcct

SEQ ID NO: 4643804 - DNA, 21 bp, Homo sapiens
agttagagcccattaatcttg

SEQ ID NO: 4643805 - DNA, 16 bp, Homo sapiens
agttataaaaggcttt

SEQ ID NO: 4643806 - DNA, 16 bp, Homo sapiens
agttatattcacagtt

SEQ ID NO: 4643807 - DNA, 15 bp, Homo sapiens
agttatcaaaaagta

SEQ ID NO: 4643808 - DNA, 14 bp, Homo sapiens
agttatgtgatttt

SEQ ID NO: 4643809 - DNA, 20 bp, Homo sapiens
agttattacatgtaatttga

SEQ ID NO: 4643810 - DNA, 21 bp, Homo sapiens
agttcaataaatgtctgttga

SEQ ID NO: 4643811 - DNA, 17 bp, Homo sapiens
agttcatcgattttcta

SEQ ID NO: 4643812 - DNA, 16 bp, Homo sapiens
agttccctctgcctgg

SEQ ID NO: 4643813 - DNA, 17 bp, Homo sapiens
agttcctatgacacagt

SEQ ID NO: 4643814 - DNA, 15 bp, Homo sapiens
agttcctgctgcctg

SEQ ID NO: 4643815 - DNA, 17 bp, Homo sapiens
agttcctgctgcctggg

SEQ ID NO: 4643816 - DNA, 19 bp, Homo sapiens
agttcctgctgcctgggta

SEQ ID NO: 4643817 - DNA, 13 bp, Homo sapiens
agttcgcagccac

SEQ ID NO: 4643818 - DNA, 18 bp, Homo sapiens
agttctataagtgaggaa

SEQ ID NO: 4643819 - DNA, 11 bp, Homo sapiens
agttctgaaag

SEQ ID NO: 4643820 - DNA, 18 bp, Homo sapiens
agttctgaagaaaaatta

SEQ ID NO: 4643821 - DNA, 20 bp, Homo sapiens
agttctgtgtggtgcattcc

SEQ ID NO: 4643822 - DNA, 19 bp, Homo sapiens
agttcttagctttgaaact

SEQ ID NO: 4643823 - DNA, 19 bp, Homo sapiens
agttctttcctccccctgc

SEQ ID NO: 4643824 - DNA, 22 bp, Homo sapiens
agttctttcctccccctgcaac

SEQ ID NO: 4643825 - DNA, 19 bp, Homo sapiens
agttgaggtggggtagtgc

SEQ ID NO: 4643826 - DNA, 15 bp, Homo sapiens
agttgcagcccaagg

SEQ ID NO: 4643827 - DNA, 18 bp, Homo sapiens
agttgcatttagcttctt

SEQ ID NO: 4643828 - DNA, 11 bp, Homo sapiens
agttgctcacc

SEQ ID NO: 4643829 - DNA, 17 bp, Homo sapiens
agttggggtctggcagc

SEQ ID NO: 4643830 - DNA, 21 bp, Homo sapiens
agttggggtctggcagcctcc

SEQ ID NO: 4643831 - DNA, 22 bp, Homo sapiens
agttgtcttatgtgaaaaatta

SEQ ID NO: 4643832 - DNA, 23 bp, Homo sapiens
agttgtcttatgtgaaaaattaa

SEQ ID NO: 4643833 - DNA, 22 bp, Homo sapiens
agttgtgatggaggggagaggg

SEQ ID NO: 4643834 - DNA, 16 bp, Homo sapiens
agttgtgcttttctgt

SEQ ID NO: 4643835 - DNA, 23 bp, Homo sapiens
agttgttaataaaagtacatgtt

SEQ ID NO: 4643836 - DNA, 13 bp, Homo sapiens
agttgttgcattc

SEQ ID NO: 4643837 - DNA, 15 bp, Homo sapiens
agttgttgcattccc

SEQ ID NO: 4643838 - DNA, 15 bp, Homo sapiens
agtttaatacaggaa

SEQ ID NO: 4643839 - DNA, 15 bp, Homo sapiens
agtttaattgactta

SEQ ID NO: 4643840 - DNA, 18 bp, Homo sapiens
agtttaggaattggaggc

SEQ ID NO: 4643841 - DNA, 13 bp, Homo sapiens
agtttattctaat

SEQ ID NO: 4643842 - DNA, 13 bp, Homo sapiens
agtttatttccac

SEQ ID NO: 4643843 - DNA, 15 bp, Homo sapiens
agtttcaaagtgtct

SEQ ID NO: 4643844 - DNA, 19 bp, Homo sapiens
agtttcaaagtgtctcatt

SEQ ID NO: 4643845 - DNA, 22 bp, Homo sapiens
agtttcaagtatccttgttgac

SEQ ID NO: 4643846 - DNA, 20 bp, Homo sapiens
agtttcacaaatccttcaaa

SEQ ID NO: 4643847 - DNA, 22 bp, Homo sapiens
agtttcagttgtccttaaattt

SEQ ID NO: 4643848 - DNA, 16 bp, Homo sapiens
agtttcctgaagcatt

SEQ ID NO: 4643849 - DNA, 23 bp, Homo sapiens
agtttccttttctgtctctctct

SEQ ID NO: 4643850 - DNA, 21 bp, Homo sapiens
agtttctattctgtcagtgtt

SEQ ID NO: 4643851 - DNA, 14 bp, Homo sapiens
agtttctgcctggg

SEQ ID NO: 4643852 - DNA, 21 bp, Homo sapiens
agtttgctgtccttcttagaa

SEQ ID NO: 4643853 - DNA, 12 bp, Homo sapiens
agtttgtagcca

SEQ ID NO: 4643854 - DNA, 13 bp, Homo sapiens
agttttctaaatg

SEQ ID NO: 4643855 - DNA, 22 bp, Homo sapiens
agttttgtggattaaacctttt

SEQ ID NO: 4643856 - DNA, 23 bp, Homo sapiens
agtttttaaaatatattgctgca

SEQ ID NO: 4643857 - DNA, 19 bp, Homo sapiens
agtttttattaaacccctt

SEQ ID NO: 4643858 - DNA, 20 bp, Homo sapiens
agtttttattgcttgttgga

SEQ ID NO: 4643859 - DNA, 18 bp, Homo sapiens
agtttttatttagcatgg

SEQ ID NO: 4643860 - DNA, 23 bp, Homo sapiens
agttttttaattaagcagaaaca

SEQ ID NO: 4643861 - DNA, 17 bp, Homo sapiens
ataaaaagtaatgactt

SEQ ID NO: 4643862 - DNA, 13 bp, Homo sapiens
ataaaaatataaa

SEQ ID NO: 4643863 - DNA, 17 bp, Homo sapiens
ataaaaatataaattgt

SEQ ID NO: 4643864 - DNA, 18 bp, Homo sapiens
ataaaactctagcagttg

SEQ ID NO: 4643865 - DNA, 19 bp, Homo sapiens
ataaaaggaagccaaagag

SEQ ID NO: 4643866 - DNA, 21 bp, Homo sapiens
ataaaatattttgttaacttt

SEQ ID NO: 4643867 - DNA, 22 bp, Homo sapiens
ataaaatattttgttaactttt

SEQ ID NO: 4643868 - DNA, 16 bp, Homo sapiens
ataaaatcttggcgag

SEQ ID NO: 4643869 - DNA, 16 bp, Homo sapiens
ataaaatgaaaattgt

SEQ ID NO: 4643870 - DNA, 18 bp, Homo sapiens
ataaaatgaaaattgtat

SEQ ID NO: 4643871 - DNA, 16 bp, Homo sapiens
ataaaatgaaatgcta

SEQ ID NO: 4643872 - DNA, 17 bp, Homo sapiens
ataaaatgccagtctca

SEQ ID NO: 4643873 - DNA, 17 bp, Homo sapiens
ataaaatttaaaaactt

SEQ ID NO: 4643874 - DNA, 16 bp, Homo sapiens
ataaacaacagctgaa

SEQ ID NO: 4643875 - DNA, 19 bp, Homo sapiens
ataaacagataatgctttt

SEQ ID NO: 4643876 - DNA, 12 bp, Homo sapiens
ataaacatatgt

SEQ ID NO: 4643877 - DNA, 20 bp, Homo sapiens
agtattatataaactgtgcc

SEQ ID NO: 4643878 - DNA, 15 bp, Homo sapiens
agtattatcattgct

SEQ ID NO: 4643879 - DNA, 18 bp, Homo sapiens
agtattattctactatac

SEQ ID NO: 4643880 - DNA, 15 bp, Homo sapiens
agtatttattcccat

SEQ ID NO: 4643881 - DNA, 13 bp, Homo sapiens
agtcaaaaaatta

SEQ ID NO: 4643882 - DNA, 16 bp, Homo sapiens
agtcaacaggtcactt

SEQ ID NO: 4643883 - DNA, 18 bp, Homo sapiens
agtcaacaggtcacttga

SEQ ID NO: 4643884 - DNA, 14 bp, Homo sapiens
agtcaagctcctag

SEQ ID NO: 4643885 - DNA, 20 bp, Homo sapiens
agtcacccagggacactcca

SEQ ID NO: 4643886 - DNA, 22 bp, Homo sapiens
agtcactaatatagtagatttt

SEQ ID NO: 4643887 - DNA, 20 bp, Homo sapiens
agtcagaaaattggcagtgg

SEQ ID NO: 4643888 - DNA, 22 bp, Homo sapiens
agtcagaaaattggcagtggca

SEQ ID NO: 4643889 - DNA, 14 bp, Homo sapiens
agtcagatgaggcc

SEQ ID NO: 4643890 - DNA, 18 bp, Homo sapiens
agtcagatgaggccctgc

SEQ ID NO: 4643891 - DNA, 14 bp, Homo sapiens
agtcaggtccaatt

SEQ ID NO: 4643892 - DNA, 12 bp, Homo sapiens
agtcataataaa

SEQ ID NO: 4643893 - DNA, 13 bp, Homo sapiens
agtcataataaat

SEQ ID NO: 4643894 - DNA, 13 bp, Homo sapiens
agtcatcatcagg

SEQ ID NO: 4643895 - DNA, 15 bp, Homo sapiens
agtcatcatcagggc

SEQ ID NO: 4643896 - DNA, 18 bp, Homo sapiens
agtcatcatcagggcctg

SEQ ID NO: 4643897 - DNA, 17 bp, Homo sapiens
agtcatgctgtgcattt

SEQ ID NO: 4643898 - DNA, 13 bp, Homo sapiens
agtcattaaactt

SEQ ID NO: 4643899 - DNA, 18 bp, Homo sapiens
agtcattatccttgctat

SEQ ID NO: 4643900 - DNA, 20 bp, Homo sapiens
agtcattatccttgctatga

SEQ ID NO: 4643901 - DNA, 13 bp, Homo sapiens
agtcattcagcag

SEQ ID NO: 4643902 - DNA, 22 bp, Homo sapiens
agtcattcagcagcaaattttc

SEQ ID NO: 4643903 - DNA, 13 bp, Homo sapiens
agtcattgtcata

SEQ ID NO: 4643904 - DNA, 19 bp, Homo sapiens
agtcattttattttgtaat

SEQ ID NO: 4643905 - DNA, 11 bp, Homo sapiens
agtccaagctg

SEQ ID NO: 4643906 - DNA, 13 bp, Homo sapiens
agtccaataagac

SEQ ID NO: 4643907 - DNA, 19 bp, Homo sapiens
agtccaggtcctggtgggg

SEQ ID NO: 4643908 - DNA, 23 bp, Homo sapiens
agtccagttgtgttgacacatat

SEQ ID NO: 4643909 - DNA, 18 bp, Homo sapiens
agtcccatttttctcttg

SEQ ID NO: 4643910 - DNA, 13 bp, Homo sapiens
agtccccagagaa

SEQ ID NO: 4643911 - DNA, 14 bp, Homo sapiens
agtcccttttcatt

SEQ ID NO: 4643912 - DNA, 22 bp, Homo sapiens
agtcccttttcattctcctcct

SEQ ID NO: 4643913 - DNA, 16 bp, Homo sapiens
agtccgggagaatgct

SEQ ID NO: 4643914 - DNA, 15 bp, Homo sapiens
agtccgtcctggcac

SEQ ID NO: 4643915 - DNA, 19 bp, Homo sapiens
agtccgtgtggatccaatg

SEQ ID NO: 4643916 - DNA, 14 bp, Homo sapiens
agtcctagcccctc

SEQ ID NO: 4643917 - DNA, 20 bp, Homo sapiens
agtcctgccccccaccccac

SEQ ID NO: 4643918 - DNA, 21 bp, Homo sapiens
agtcctgccttcttccttgag

SEQ ID NO: 4643919 - DNA, 13 bp, Homo sapiens
agtcctggcccaa

SEQ ID NO: 4643920 - DNA, 12 bp, Homo sapiens
agtcgcccctca

SEQ ID NO: 4643921 - DNA, 14 bp, Homo sapiens
agtcgcccctcaga

SEQ ID NO: 4643922 - DNA, 16 bp, Homo sapiens
agtcgcccctcagagc

SEQ ID NO: 4643923 - DNA, 13 bp, Homo sapiens
agtcgtgatgtgg

SEQ ID NO: 4643924 - DNA, 14 bp, Homo sapiens
agtcgtgatgtgga

SEQ ID NO: 4643925 - DNA, 14 bp, Homo sapiens
agtctaccaaagga

SEQ ID NO: 4643926 - DNA, 19 bp, Homo sapiens
agtctagtccgtcctggca

SEQ ID NO: 4643927 - DNA, 18 bp, Homo sapiens
agtctcctaggggcttgg

SEQ ID NO: 4643928 - DNA, 19 bp, Homo sapiens
agtctcctaggggcttggt

SEQ ID NO: 4643929 - DNA, 11 bp, Homo sapiens
agtctcctctc

SEQ ID NO: 4643930 - DNA, 11 bp, Homo sapiens
agtctctcttc

SEQ ID NO: 4643931 - DNA, 14 bp, Homo sapiens
agtctgaggtcctg

SEQ ID NO: 4643932 - DNA, 22 bp, Homo sapiens
agtctgaggtcctgagcactgc

SEQ ID NO: 4643933 - DNA, 17 bp, Homo sapiens
agtctgggtccatcctg

SEQ ID NO: 4643934 - DNA, 16 bp, Homo sapiens
agtctgttttgtaaag

SEQ ID NO: 4643935 - DNA, 17 bp, Homo sapiens
agtcttggtttctctct

SEQ ID NO: 4643936 - DNA, 16 bp, Homo sapiens
agtcttgtattaagtt

SEQ ID NO: 4643937 - DNA, 22 bp, Homo sapiens
agtcttgtattaagttgttaat

SEQ ID NO: 4643938 - DNA, 19 bp, Homo sapiens
agtctttcccccaggaaaa

SEQ ID NO: 4643939 - DNA, 20 bp, Homo sapiens
agtctttctcctctttgaga

SEQ ID NO: 4643940 - DNA, 14 bp, Homo sapiens
agtgaaataacaaa

SEQ ID NO: 4643941 - DNA, 19 bp, Homo sapiens
agtgaaataacaaaatgga

SEQ ID NO: 4643942 - DNA, 21 bp, Homo sapiens
agtgaagtattgctgaaaagt

SEQ ID NO: 4643943 - DNA, 22 bp, Homo sapiens
agtgaatacattaacggtgcta

SEQ ID NO: 4643944 - DNA, 13 bp, Homo sapiens
agtgaccagcaca

SEQ ID NO: 4643945 - DNA, 18 bp, Homo sapiens
agtgaccagcacactgga

SEQ ID NO: 4643946 - DNA, 17 bp, Homo sapiens
agtgacccacatgccat

SEQ ID NO: 4643947 - DNA, 20 bp, Homo sapiens
agtgacctccttctgcaaag

SEQ ID NO: 4643948 - DNA, 17 bp, Homo sapiens
agtgacttctggagaaa

SEQ ID NO: 4643949 - DNA, 13 bp, Homo sapiens
agtgagaggcccc

SEQ ID NO: 4643950 - DNA, 19 bp, Homo sapiens
agtgagatagcattgtgaa

SEQ ID NO: 4643951 - DNA, 19 bp, Homo sapiens
agtgagcgagtggatgctg

SEQ ID NO: 4643952 - DNA, 22 bp, Homo sapiens
agtgagcgagtggatgctgtgc

SEQ ID NO: 4643953 - DNA, 22 bp, Homo sapiens
agtgaggatgagacccagcccc

SEQ ID NO: 4643954 - DNA, 19 bp, Homo sapiens
agtgagggagggctgtcat

SEQ ID NO: 4643955 - DNA, 19 bp, Homo sapiens
agtgaggtgttgcagccca

SEQ ID NO: 4643956 - DNA, 23 bp, Homo sapiens
agtgagtgggagagtacctgtgt

SEQ ID NO: 4643957 - DNA, 12 bp, Homo sapiens
agtgcaaaatgt

SEQ ID NO: 4643958 - DNA, 22 bp, Homo sapiens
agtgcaaaatgtcttgtgtatt

SEQ ID NO: 4643959 - DNA, 13 bp, Homo sapiens
agtgcaaaccact

SEQ ID NO: 4643960 - DNA, 16 bp, Homo sapiens
agtgcaacctctgctt

SEQ ID NO: 4643961 - DNA, 16 bp, Homo sapiens
agtgcaagttcatgtg

SEQ ID NO: 4643962 - DNA, 21 bp, Homo sapiens
agtgcaagttcatgtgtggaa

SEQ ID NO: 4643963 - DNA, 19 bp, Homo sapiens
agtgcaattccaagaaaat

SEQ ID NO: 4643964 - DNA, 14 bp, Homo sapiens
agtgcatcattact

SEQ ID NO: 4643965 - DNA, 17 bp, Homo sapiens
agtgcattatgtacaca

SEQ ID NO: 4643966 - DNA, 21 bp, Homo sapiens
agtgccaacaatcctagtgct

SEQ ID NO: 4643967 - DNA, 17 bp, Homo sapiens
agtgccataccttctcc

SEQ ID NO: 4643968 - DNA, 22 bp, Homo sapiens
agtgccataccttctcccaggc

SEQ ID NO: 4643969 - DNA, 21 bp, Homo sapiens
agtgcccggtgcagggcctgg

SEQ ID NO: 4643970 - DNA, 22 bp, Homo sapiens
agtgcccggtgcagggcctggc

SEQ ID NO: 4643971 - DNA, 13 bp, Homo sapiens
agtgcgtgaatgt

SEQ ID NO: 4643972 - DNA, 16 bp, Homo sapiens
agtgcgtgccgtgtga

SEQ ID NO: 4643973 - DNA, 23 bp, Homo sapiens
agtgctaaactactgattacttg

SEQ ID NO: 4643974 - DNA, 14 bp, Homo sapiens
agtgctatgcggag

SEQ ID NO: 4643975 - DNA, 15 bp, Homo sapiens
agtgctcagtgaagt

SEQ ID NO: 4643976 - DNA, 14 bp, Homo sapiens
agtgctcatctgtt

SEQ ID NO: 4643977 - DNA, 14 bp, Homo sapiens
agtgctcctgaaag

SEQ ID NO: 4643978 - DNA, 15 bp, Homo sapiens
agtgctggctcacag

SEQ ID NO: 4643979 - DNA, 16 bp, Homo sapiens
agtgctggctcacagt

SEQ ID NO: 4643980 - DNA, 21 bp, Homo sapiens
agtgctgttttattactgttt

SEQ ID NO: 4643981 - DNA, 21 bp, Homo sapiens
agtgcttagaggttctgcctc

SEQ ID NO: 4643982 - DNA, 22 bp, Homo sapiens
agtgcttagaggttctgcctct

SEQ ID NO: 4643983 - DNA, 16 bp, Homo sapiens
agtggactcagggcag

SEQ ID NO: 4643984 - DNA, 16 bp, Homo sapiens
agtggatgtttttaat

SEQ ID NO: 4643985 - DNA, 14 bp, Homo sapiens
agtggcaggggagc

SEQ ID NO: 4643986 - DNA, 18 bp, Homo sapiens
agtggcctccctgctgtg

SEQ ID NO: 4643987 - DNA, 15 bp, Homo sapiens
agtggcctctttgtc

SEQ ID NO: 4643988 - DNA, 15 bp, Homo sapiens
agtggctgtttcatc

SEQ ID NO: 4643989 - DNA, 20 bp, Homo sapiens
aggcatggtcccttaaggca

SEQ ID NO: 4643990 - DNA, 22 bp, Homo sapiens
aggcattgacataggtcataaa

SEQ ID NO: 4643991 - DNA, 20 bp, Homo sapiens
aggcattggcatctgctttt

SEQ ID NO: 4643992 - DNA, 15 bp, Homo sapiens
agacatccataaaga

SEQ ID NO: 4643993 - DNA, 18 bp, Homo sapiens
agacatccataaagaagc

SEQ ID NO: 4643994 - DNA, 15 bp, Homo sapiens
agacattctcacata

SEQ ID NO: 4643995 - DNA, 19 bp, Homo sapiens
agacattctcacataagcc

SEQ ID NO: 4643996 - DNA, 16 bp, Homo sapiens
agacattcttttaatg

SEQ ID NO: 4643997 - DNA, 13 bp, Homo sapiens
agacatttatata

SEQ ID NO: 4643998 - DNA, 15 bp, Homo sapiens
agacattttctctta

SEQ ID NO: 4643999 - DNA, 17 bp, Homo sapiens
agacattttctcttaga

SEQ ID NO: 4644000 - DNA, 15 bp, Homo sapiens
agacattttttaaaa

SEQ ID NO: 4644001 - DNA, 19 bp, Homo sapiens
agacattttttaaaagcct

SEQ ID NO: 4644002 - DNA, 15 bp, Homo sapiens
agaccacacatttta

SEQ ID NO: 4644003 - DNA, 16 bp, Homo sapiens
agaccacagaggctca

SEQ ID NO: 4644004 - DNA, 14 bp, Homo sapiens
agaccaccttccct

SEQ ID NO: 4644005 - DNA, 15 bp, Homo sapiens
agaccagccctgcag

SEQ ID NO: 4644006 - DNA, 14 bp, Homo sapiens
agaccagggctgct

SEQ ID NO: 4644007 - DNA, 23 bp, Homo sapiens
agaccagggctgctctttccact

SEQ ID NO: 4644008 - DNA, 12 bp, Homo sapiens
agacccagcccc

SEQ ID NO: 4644009 - DNA, 23 bp, Homo sapiens
agacccagccccttcccctggga

SEQ ID NO: 4644010 - DNA, 17 bp, Homo sapiens
agacccatctctccctt

SEQ ID NO: 4644011 - DNA, 19 bp, Homo sapiens
agaccccagtcaagctcct

SEQ ID NO: 4644012 - DNA, 12 bp, Homo sapiens
agaccctcgggc

SEQ ID NO: 4644013 - DNA, 13 bp, Homo sapiens
agaccctcgggcc

SEQ ID NO: 4644014 - DNA, 18 bp, Homo sapiens
agacctaaagcaagcctg

SEQ ID NO: 4644015 - DNA, 16 bp, Homo sapiens
agacctaatatcattt

SEQ ID NO: 4644016 - DNA, 15 bp, Homo sapiens
agcaaccccaggctg

SEQ ID NO: 4644017 - DNA, 16 bp, Homo sapiens
agcaaccccaggctga

SEQ ID NO: 4644018 - DNA, 19 bp, Homo sapiens
agcaaccgcctcaaaatgt

SEQ ID NO: 4644019 - DNA, 21 bp, Homo sapiens
agcaaccgcctcaaaatgtgt

SEQ ID NO: 4644020 - DNA, 15 bp, Homo sapiens
agcaaccgtggccct

SEQ ID NO: 4644021 - DNA, 16 bp, Homo sapiens
agcaaccgtggccctt

SEQ ID NO: 4644022 - DNA, 15 bp, Homo sapiens
agcaacctacccagc

SEQ ID NO: 4644023 - DNA, 14 bp, Homo sapiens
agcaacgcttgtag

SEQ ID NO: 4644024 - DNA, 23 bp, Homo sapiens
agcaacgcttgtagaactcactc

SEQ ID NO: 4644025 - DNA, 16 bp, Homo sapiens
agcaagaaacagtttc

SEQ ID NO: 4644026 - DNA, 22 bp, Homo sapiens
agcaagacctcatctgtggagc

SEQ ID NO: 4644027 - DNA, 13 bp, Homo sapiens
agcaagctcttcc

SEQ ID NO: 4644028 - DNA, 17 bp, Homo sapiens
agcaaggagaaaatata

SEQ ID NO: 4644029 - DNA, 13 bp, Homo sapiens
agcaaggcagaag

SEQ ID NO: 4644030 - DNA, 22 bp, Homo sapiens
agcaaggcccgagcagctgagc

SEQ ID NO: 4644031 - DNA, 17 bp, Homo sapiens
agcaataactgaaaatg

SEQ ID NO: 4644032 - DNA, 12 bp, Homo sapiens
agcaatattttg

SEQ ID NO: 4644033 - DNA, 13 bp, Homo sapiens
agcaatattttgt

SEQ ID NO: 4644034 - DNA, 15 bp, Homo sapiens
agcaatgcctgccca

SEQ ID NO: 4644035 - DNA, 17 bp, Homo sapiens
agcaatttaactagaca

SEQ ID NO: 4644036 - DNA, 22 bp, Homo sapiens
agcacaatcactaaactttatt

SEQ ID NO: 4644037 - DNA, 10 bp, Homo sapiens
agcacagcag

SEQ ID NO: 4644038 - DNA, 13 bp, Homo sapiens
agcacagcagcct

SEQ ID NO: 4644039 - DNA, 16 bp, Homo sapiens
agcacagctcctgcca

SEQ ID NO: 4644040 - DNA, 18 bp, Homo sapiens
agcacagctcctgccagg

SEQ ID NO: 4644041 - DNA, 15 bp, Homo sapiens
agcaccgttctgtgc

SEQ ID NO: 4644042 - DNA, 16 bp, Homo sapiens
agcaccgttctgtgca

SEQ ID NO: 4644043 - DNA, 14 bp, Homo sapiens
agcacctacagtgt

SEQ ID NO: 4644044 - DNA, 21 bp, Homo sapiens
agcacctacagtgtacagtct

SEQ ID NO: 4644045 - DNA, 16 bp, Homo sapiens
agcacctccaggcctg

SEQ ID NO: 4644046 - DNA, 17 bp, Homo sapiens
agcacctccaggcctgt

SEQ ID NO: 4644047 - DNA, 12 bp, Homo sapiens
agcacctgtctg

SEQ ID NO: 4644048 - DNA, 14 bp, Homo sapiens
agcactactgggtg

SEQ ID NO: 4644049 - DNA, 16 bp, Homo sapiens
agcacttagacctgcc

SEQ ID NO: 4644050 - DNA, 19 bp, Homo sapiens
agcacttagacctgccagc

SEQ ID NO: 4644051 - DNA, 22 bp, Homo sapiens
agcacttgagctgtctgaagcc

SEQ ID NO: 4644052 - DNA, 11 bp, Homo sapiens
agcagaaacag

SEQ ID NO: 4644053 - DNA, 17 bp, Homo sapiens
agcagaaaggctctgaa

SEQ ID NO: 4644054 - DNA, 19 bp, Homo sapiens
agcagaatgttgtacttga

SEQ ID NO: 4644055 - DNA, 12 bp, Homo sapiens
agcagacaggcc

SEQ ID NO: 4644056 - DNA, 16 bp, Homo sapiens
agcagagatcgacaga

SEQ ID NO: 4644057 - DNA, 20 bp, Homo sapiens
agcagagggacaaccagaag

SEQ ID NO: 4644058 - DNA, 17 bp, Homo sapiens
agcagcaatattttgta

SEQ ID NO: 4644059 - DNA, 20 bp, Homo sapiens
agcagcacttagacctgcca

SEQ ID NO: 4644060 - DNA, 15 bp, Homo sapiens
agcagcaggtctaga

SEQ ID NO: 4644061 - DNA, 16 bp, Homo sapiens
agcagcaggtctagaa

SEQ ID NO: 4644062 - DNA, 12 bp, Homo sapiens
agcagccagccc

SEQ ID NO: 4644063 - DNA, 14 bp, Homo sapiens
agcagccagccctg

SEQ ID NO: 4644064 - DNA, 16 bp, Homo sapiens
agcagccagccctgcc

SEQ ID NO: 4644065 - DNA, 12 bp, Homo sapiens
agcagcccttgc

SEQ ID NO: 4644066 - DNA, 19 bp, Homo sapiens
agcagctgaataacctgca

SEQ ID NO: 4644067 - DNA, 21 bp, Homo sapiens
agcagctgaataacctgcaca

SEQ ID NO: 4644068 - DNA, 11 bp, Homo sapiens
agcagctgagc

SEQ ID NO: 4644069 - DNA, 18 bp, Homo sapiens
agcaggaataaagacttg

SEQ ID NO: 4644070 - DNA, 20 bp, Homo sapiens
agcaggactgtgcctccata

SEQ ID NO: 4644071 - DNA, 23 bp, Homo sapiens
agcaggaggctttctgggctctg

SEQ ID NO: 4644072 - DNA, 13 bp, Homo sapiens
agcaggaggtgcc

SEQ ID NO: 4644073 - DNA, 18 bp, Homo sapiens
agcaggagtggtgcagac

SEQ ID NO: 4644074 - DNA, 21 bp, Homo sapiens
agcaggatcgaagggttttta

SEQ ID NO: 4644075 - DNA, 15 bp, Homo sapiens
agcaggcaccgccac

SEQ ID NO: 4644076 - DNA, 23 bp, Homo sapiens
agcaggcaccgccacgtcccagc

SEQ ID NO: 4644077 - DNA, 14 bp, Homo sapiens
agcaggcagcgcca

SEQ ID NO: 4644078 - DNA, 17 bp, Homo sapiens
agcaggctactgggacc

SEQ ID NO: 4644079 - DNA, 23 bp, Homo sapiens
agcagggccggggaactggccaa

SEQ ID NO: 4644080 - DNA, 15 bp, Homo sapiens
agcaggggggctgtg

SEQ ID NO: 4644081 - DNA, 20 bp, Homo sapiens
agcaggggggctgtgccaac

SEQ ID NO: 4644082 - DNA, 19 bp, Homo sapiens
agcagggtcttttcatctg

SEQ ID NO: 4644083 - DNA, 20 bp, Homo sapiens
agcagggtcttttcatctgg

SEQ ID NO: 4644084 - DNA, 13 bp, Homo sapiens
agcaggtgctgac

SEQ ID NO: 4644085 - DNA, 16 bp, Homo sapiens
agcaggttcccaagct

SEQ ID NO: 4644086 - DNA, 15 bp, Homo sapiens
agcaggttccccaag

SEQ ID NO: 4644087 - DNA, 16 bp, Homo sapiens
agcaggttccccaagg

SEQ ID NO: 4644088 - DNA, 20 bp, Homo sapiens
agcaggttccccaagggccc

SEQ ID NO: 4644089 - DNA, 14 bp, Homo sapiens
agcaggttctaggc

SEQ ID NO: 4644090 - DNA, 17 bp, Homo sapiens
agcagtcactgggagag

SEQ ID NO: 4644091 - DNA, 15 bp, Homo sapiens
agcagtccccagctg

SEQ ID NO: 4644092 - DNA, 17 bp, Homo sapiens
agcagtctaaacagagt

SEQ ID NO: 4644093 - DNA, 22 bp, Homo sapiens
agcagtggcctttttctgagat

SEQ ID NO: 4644094 - DNA, 15 bp, Homo sapiens
agcatacttctagga

SEQ ID NO: 4644095 - DNA, 14 bp, Homo sapiens
agcatactttgtaa

SEQ ID NO: 4644096 - DNA, 17 bp, Homo sapiens
agcatactttgtaaata

SEQ ID NO: 4644097 - DNA, 14 bp, Homo sapiens
agcatatagagatg

SEQ ID NO: 4644098 - DNA, 15 bp, Homo sapiens
agcatattttcttac

SEQ ID NO: 4644099 - DNA, 12 bp, Homo sapiens
agcatccctgga

SEQ ID NO: 4644100 - DNA, 19 bp, Homo sapiens
agcatccctggagcaggag

SEQ ID NO: 4644101 - DNA, 16 bp, Homo sapiens
agcatcctcagttcct

SEQ ID NO: 4644102 - DNA, 15 bp, Homo sapiens
agcatgcttgggctg

SEQ ID NO: 4644103 - DNA, 23 bp, Homo sapiens
agcatgcttgggctgacccagca

SEQ ID NO: 4644104 - DNA, 11 bp, Homo sapiens
agcatggcata

SEQ ID NO: 4644105 - DNA, 20 bp, Homo sapiens
agcatggcatattttaatca

SEQ ID NO: 4644106 - DNA, 16 bp, Homo sapiens
agcatgggtccagaag

SEQ ID NO: 4644107 - DNA, 23 bp, Homo sapiens
agcatggtcccacatccctgggc

SEQ ID NO: 4644108 - DNA, 18 bp, Homo sapiens
agcatgtgccttaatgct

SEQ ID NO: 4644109 - DNA, 14 bp, Homo sapiens
agcatgttcctcct

SEQ ID NO: 4644110 - DNA, 13 bp, Homo sapiens
agcattgctttct

SEQ ID NO: 4644111 - DNA, 17 bp, Homo sapiens
agcattgtgaactgaca

SEQ ID NO: 4644112 - DNA, 21 bp, Homo sapiens
agcattgtgaactgacaggca

SEQ ID NO: 4644113 - DNA, 11 bp, Homo sapiens
agcatttcatg

SEQ ID NO: 4644114 - DNA, 13 bp, Homo sapiens
agccaaacaaaac

SEQ ID NO: 4644115 - DNA, 14 bp, Homo sapiens
agccaaacaaaact

SEQ ID NO: 4644116 - DNA, 18 bp, Homo sapiens
agccaaagaaacaagctg

SEQ ID NO: 4644117 - DNA, 22 bp, Homo sapiens
agccaaagaaacaagctgtgca

SEQ ID NO: 4644118 - DNA, 18 bp, Homo sapiens
agccaacacgcacctgcc

SEQ ID NO: 4644119 - DNA, 15 bp, Homo sapiens
agccaaccttgctct

SEQ ID NO: 4644120 - DNA, 20 bp, Homo sapiens
agccaactgtttccctgctg

SEQ ID NO: 4644121 - DNA, 22 bp, Homo sapiens
agccaactgtttccctgctgaa

SEQ ID NO: 4644122 - DNA, 17 bp, Homo sapiens
agccaaggggatattta

SEQ ID NO: 4644123 - DNA, 12 bp, Homo sapiens
agccacaagctg

SEQ ID NO: 4644124 - DNA, 17 bp, Homo sapiens
agccacaagctgcactg

SEQ ID NO: 4644125 - DNA, 19 bp, Homo sapiens
agccacaagctgcactgtg

SEQ ID NO: 4644126 - DNA, 18 bp, Homo sapiens
agccacacttctcaggac

SEQ ID NO: 4644127 - DNA, 19 bp, Homo sapiens
agccacacttctcaggaca

SEQ ID NO: 4644128 - DNA, 15 bp, Homo sapiens
agccacagacccctg

SEQ ID NO: 4644129 - DNA, 17 bp, Homo sapiens
agccacaggccctggct

SEQ ID NO: 4644130 - DNA, 21 bp, Homo sapiens
agccaccaaagtcacatccac

SEQ ID NO: 4644131 - DNA, 14 bp, Homo sapiens
agccacctgcaaga

SEQ ID NO: 4644132 - DNA, 13 bp, Homo sapiens
agccactgaagta

SEQ ID NO: 4644133 - DNA, 16 bp, Homo sapiens
agccacttccccctct

SEQ ID NO: 4644134 - DNA, 22 bp, Homo sapiens
agccacttccccctcttcttct

SEQ ID NO: 4644135 - DNA, 13 bp, Homo sapiens
agccacttctggc

SEQ ID NO: 4644136 - DNA, 14 bp, Homo sapiens
agccagagacagag

SEQ ID NO: 4644137 - DNA, 14 bp, Homo sapiens
agccagattctctt

SEQ ID NO: 4644138 - DNA, 17 bp, Homo sapiens
agccagattctcttgaa

SEQ ID NO: 4644139 - DNA, 18 bp, Homo sapiens
agccagatttgtcttttt

SEQ ID NO: 4644140 - DNA, 22 bp, Homo sapiens
agccagcaagagggaacaaaac

SEQ ID NO: 4644141 - DNA, 13 bp, Homo sapiens
agccagcacacag

SEQ ID NO: 4644142 - DNA, 15 bp, Homo sapiens
agccagcacacaggg

SEQ ID NO: 4644143 - DNA, 10 bp, Homo sapiens
agccagccac

SEQ ID NO: 4644144 - DNA, 20 bp, Homo sapiens
agccagccacagacccctgg

SEQ ID NO: 4644145 - DNA, 22 bp, Homo sapiens
agccagccacagacccctggga

SEQ ID NO: 4644146 - DNA, 23 bp, Homo sapiens
agccagccacagacccctgggag

SEQ ID NO: 4644147 - DNA, 13 bp, Homo sapiens
agccagccctgcc

SEQ ID NO: 4644148 - DNA, 19 bp, Homo sapiens
agccagccctgcctggagg

SEQ ID NO: 4644149 - DNA, 16 bp, Homo sapiens
agccagccggggcgag

SEQ ID NO: 4644150 - DNA, 17 bp, Homo sapiens
agccagccgtggccaga

SEQ ID NO: 4644151 - DNA, 16 bp, Homo sapiens
agccagctgctcccca

SEQ ID NO: 4644152 - DNA, 17 bp, Homo sapiens
agccaggagcagccctg

SEQ ID NO: 4644153 - DNA, 18 bp, Homo sapiens
agccaggagcagccctgg

SEQ ID NO: 4644154 - DNA, 14 bp, Homo sapiens
agccaggaggcctg

SEQ ID NO: 4644155 - DNA, 18 bp, Homo sapiens
agccaggatgcccagatg

SEQ ID NO: 4644156 - DNA, 13 bp, Homo sapiens
agccaggccccac

SEQ ID NO: 4644157 - DNA, 17 bp, Homo sapiens
agccaggtacaggagag

SEQ ID NO: 4644158 - DNA, 18 bp, Homo sapiens
agccaggtacaggagagg

SEQ ID NO: 4644159 - DNA, 12 bp, Homo sapiens
agccataatttt

SEQ ID NO: 4644160 - DNA, 17 bp, Homo sapiens
agccataattttgcata

SEQ ID NO: 4644161 - DNA, 21 bp, Homo sapiens
agccatgagatgatacatcca

SEQ ID NO: 4644162 - DNA, 14 bp, Homo sapiens
agccatgatggcaa

SEQ ID NO: 4644163 - DNA, 15 bp, Homo sapiens
agccatgatggcaac

SEQ ID NO: 4644164 - DNA, 18 bp, Homo sapiens
agccattgttggctttcc

SEQ ID NO: 4644165 - DNA, 16 bp, Homo sapiens
agcccaaggacagttc

SEQ ID NO: 4644166 - DNA, 11 bp, Homo sapiens
agcccagagaa

SEQ ID NO: 4644167 - DNA, 15 bp, Homo sapiens
agcccagagaacagc

SEQ ID NO: 4644168 - DNA, 17 bp, Homo sapiens
agcccagagcctggctg

SEQ ID NO: 4644169 - DNA, 16 bp, Homo sapiens
agcccagcggcccaag

SEQ ID NO: 4644170 - DNA, 18 bp, Homo sapiens
agcccagcggcccaagag

SEQ ID NO: 4644171 - DNA, 20 bp, Homo sapiens
agcccagctgggtcaggcag

SEQ ID NO: 4644172 - DNA, 21 bp, Homo sapiens
agcccaggatactggcacaga

SEQ ID NO: 4644173 - DNA, 12 bp, Homo sapiens
agcccaggatct

SEQ ID NO: 4644174 - DNA, 21 bp, Homo sapiens
agcccatccattaggccagca

SEQ ID NO: 4644175 - DNA, 23 bp, Homo sapiens
agcccatccattaggccagcaac

SEQ ID NO: 4644176 - DNA, 15 bp, Homo sapiens
agcccattgctgcca

SEQ ID NO: 4644177 - DNA, 17 bp, Homo sapiens
agcccattgctgccaag

SEQ ID NO: 4644178 - DNA, 13 bp, Homo sapiens
agcccccaccagg

SEQ ID NO: 4644179 - DNA, 13 bp, Homo sapiens
agcccccagccct

SEQ ID NO: 4644180 - DNA, 16 bp, Homo sapiens
agcccccagccctggg

SEQ ID NO: 4644181 - DNA, 17 bp, Homo sapiens
agcccccagccctggga

SEQ ID NO: 4644182 - DNA, 20 bp, Homo sapiens
agccccctcctggtgccacc

SEQ ID NO: 4644183 - DNA, 21 bp, Homo sapiens
agcccctcctccagcccctgt

SEQ ID NO: 4644184 - DNA, 23 bp, Homo sapiens
agcccctcctccagcccctgtcc

SEQ ID NO: 4644185 - DNA, 13 bp, Homo sapiens
agcccctgtccca

SEQ ID NO: 4644186 - DNA, 15 bp, Homo sapiens
agccccttctgctca

SEQ ID NO: 4644187 - DNA, 16 bp, Homo sapiens
agccccttctgctcag

SEQ ID NO: 4644188 - DNA, 13 bp, Homo sapiens
agcccgacagtgc

SEQ ID NO: 4644189 - DNA, 17 bp, Homo sapiens
agcccgacagtgccatc

SEQ ID NO: 4644190 - DNA, 21 bp, Homo sapiens
agcccgacagtgccatcccca

SEQ ID NO: 4644191 - DNA, 23 bp, Homo sapiens
agccctcagctggtcctgaccag

SEQ ID NO: 4644192 - DNA, 16 bp, Homo sapiens
agccctctcactgtgt

SEQ ID NO: 4644193 - DNA, 13 bp, Homo sapiens
agccctgcccaca

SEQ ID NO: 4644194 - DNA, 15 bp, Homo sapiens
agccctgcccacaga

SEQ ID NO: 4644195 - DNA, 20 bp, Homo sapiens
agccctgcctggaggacctg

SEQ ID NO: 4644196 - DNA, 12 bp, Homo sapiens
agccctggcccc

SEQ ID NO: 4644197 - DNA, 23 bp, Homo sapiens
agccctggcccccatcagccctg

SEQ ID NO: 4644198 - DNA, 15 bp, Homo sapiens
agccctggccccctg

SEQ ID NO: 4644199 - DNA, 16 bp, Homo sapiens
agccctggccccctga

SEQ ID NO: 4644200 - DNA, 14 bp, Homo sapiens
agccctggcccctc

SEQ ID NO: 4644201 - DNA, 16 bp, Homo sapiens
agccctggcccctcca

SEQ ID NO: 4644202 - DNA, 15 bp, Homo sapiens
agccctgggaaccac

SEQ ID NO: 4644203 - DNA, 16 bp, Homo sapiens
agcccttggcttgtgt

SEQ ID NO: 4644204 - DNA, 15 bp, Homo sapiens
agccgaccttccctc

SEQ ID NO: 4644205 - DNA, 15 bp, Homo sapiens
agccgactctggccc

SEQ ID NO: 4644206 - DNA, 16 bp, Homo sapiens
agccgactctggccct

SEQ ID NO: 4644207 - DNA, 17 bp, Homo sapiens
agccgactctggccctg

SEQ ID NO: 4644208 - DNA, 16 bp, Homo sapiens
agccggtaactgtcct

SEQ ID NO: 4644209 - DNA, 21 bp, Homo sapiens
agccggtaactgtcctgtcct

SEQ ID NO: 4644210 - DNA, 18 bp, Homo sapiens
agccggtgggctagaaag

SEQ ID NO: 4644211 - DNA, 23 bp, Homo sapiens
agccgtttgaatatattttatct

SEQ ID NO: 4644212 - DNA, 14 bp, Homo sapiens
agcctaaagggcag

SEQ ID NO: 4644213 - DNA, 18 bp, Homo sapiens
agcctaaagggcagggcc

SEQ ID NO: 4644214 - DNA, 21 bp, Homo sapiens
agcctaagggatcctgcctgc

SEQ ID NO: 4644215 - DNA, 15 bp, Homo sapiens
agcctaatccctggg

SEQ ID NO: 4644216 - DNA, 21 bp, Homo sapiens
agcctaccgctggccctgccg

SEQ ID NO: 4644217 - DNA, 12 bp, Homo sapiens
agcctcacccct

SEQ ID NO: 4644218 - DNA, 15 bp, Homo sapiens
agcctcacccctgcc

SEQ ID NO: 4644219 - DNA, 16 bp, Homo sapiens
agcctcacccctgccc

SEQ ID NO: 4644220 - DNA, 20 bp, Homo sapiens
agcctcacccctgcccctgt

SEQ ID NO: 4644221 - DNA, 24 bp, Homo sapiens
agcctcacccctgcccctgtggga

SEQ ID NO: 4644222 - DNA, 21 bp, Homo sapiens
agctgaatgcctcctgtgggg

SEQ ID NO: 4644223 - DNA, 22 bp, Homo sapiens
agctgaatgcctcctgtgggga

SEQ ID NO: 4644224 - DNA, 19 bp, Homo sapiens
agctgacgaacttccatgg

SEQ ID NO: 4644225 - DNA, 13 bp, Homo sapiens
agctgagcagggc

SEQ ID NO: 4644226 - DNA, 15 bp, Homo sapiens
agctgagcagggccg

SEQ ID NO: 4644227 - DNA, 18 bp, Homo sapiens
agctgagctcacaaggca

SEQ ID NO: 4644228 - DNA, 22 bp, Homo sapiens
agctgagctcacaaggcagcaa

SEQ ID NO: 4644229 - DNA, 15 bp, Homo sapiens
agctgagctggaagg

SEQ ID NO: 4644230 - DNA, 18 bp, Homo sapiens
agctgagctggaaggggc

SEQ ID NO: 4644231 - DNA, 13 bp, Homo sapiens
agctgaggccaca

SEQ ID NO: 4644232 - DNA, 23 bp, Homo sapiens
aggaccacctcctctgccagcag

SEQ ID NO: 4644233 - DNA, 14 bp, Homo sapiens
aggaccagtcagga

SEQ ID NO: 4644234 - DNA, 22 bp, Homo sapiens
aggaccagtcaggatgaggccc

SEQ ID NO: 4644235 - DNA, 23 bp, Homo sapiens
aggaccagtcaggatgaggcccc

SEQ ID NO: 4644236 - DNA, 20 bp, Homo sapiens
aggaccccttaatcttgctt

SEQ ID NO: 4644237 - DNA, 17 bp, Homo sapiens
aggaccctcaggaattc

SEQ ID NO: 4644238 - DNA, 21 bp, Homo sapiens
aggaccctcaggaattcagtg

SEQ ID NO: 4644239 - DNA, 22 bp, Homo sapiens
aggacctcctcttcccccttcc

SEQ ID NO: 4644240 - DNA, 14 bp, Homo sapiens
aggacctgagcctg

SEQ ID NO: 4644241 - DNA, 17 bp, Homo sapiens
aggacctgagcctgccg

SEQ ID NO: 4644242 - DNA, 21 bp, Homo sapiens
aggacctgtggccaagttctt

SEQ ID NO: 4644243 - DNA, 22 bp, Homo sapiens
aggacgtggatgaccctcccct

SEQ ID NO: 4644244 - DNA, 11 bp, Homo sapiens
aggactgaggg

SEQ ID NO: 4644245 - DNA, 12 bp, Homo sapiens
aggactgagggc

SEQ ID NO: 4644246 - DNA, 13 bp, Homo sapiens
aggactgagggca

SEQ ID NO: 4644247 - DNA, 14 bp, Homo sapiens
aggactgagggcag

SEQ ID NO: 4644248 - DNA, 15 bp, Homo sapiens
aggactgagggcagt

SEQ ID NO: 4644249 - DNA, 15 bp, Homo sapiens
aggactggttccttc

SEQ ID NO: 4644250 - DNA, 16 bp, Homo sapiens
aggactggttccttcc

SEQ ID NO: 4644251 - DNA, 22 bp, Homo sapiens
aggactggttccttccttagtt

SEQ ID NO: 4644252 - DNA, 17 bp, Homo sapiens
aggagaagcacagctcc

SEQ ID NO: 4644253 - DNA, 17 bp, Homo sapiens
aggagacaggatgaggt

SEQ ID NO: 4644254 - DNA, 16 bp, Homo sapiens
aggagacccgccccag

SEQ ID NO: 4644255 - DNA, 13 bp, Homo sapiens
aggagagaagaat

SEQ ID NO: 4644256 - DNA, 14 bp, Homo sapiens
aggagagagccagg

SEQ ID NO: 4644257 - DNA, 15 bp, Homo sapiens
aggagagagccagga

SEQ ID NO: 4644258 - DNA, 16 bp, Homo sapiens
aggagagagtcccaga

SEQ ID NO: 4644259 - DNA, 18 bp, Homo sapiens
aggagagagtcccagagc

SEQ ID NO: 4644260 - DNA, 22 bp, Homo sapiens
aggagatgaccagggatgctgg

SEQ ID NO: 4644261 - DNA, 15 bp, Homo sapiens
aggagatggagggct

SEQ ID NO: 4644262 - DNA, 18 bp, Homo sapiens
aggagatgtgatcaggcc

SEQ ID NO: 4644263 - DNA, 14 bp, Homo sapiens
aggagccaggcccc

SEQ ID NO: 4644264 - DNA, 19 bp, Homo sapiens
aggagccaggccccacccc

SEQ ID NO: 4644265 - DNA, 21 bp, Homo sapiens
aggagcccagcggcccaagag

SEQ ID NO: 4644266 - DNA, 14 bp, Homo sapiens
aggagccccaggca

SEQ ID NO: 4644267 - DNA, 16 bp, Homo sapiens
aggagccccaggcagg

SEQ ID NO: 4644268 - DNA, 17 bp, Homo sapiens
aggagcctgtgaaccca

SEQ ID NO: 4644269 - DNA, 12 bp, Homo sapiens
aggagcctgtgc

SEQ ID NO: 4644270 - DNA, 20 bp, Homo sapiens
aggagcctgtgcgtcccagc

SEQ ID NO: 4644271 - DNA, 18 bp, Homo sapiens
aggagctacctgtgtgga

SEQ ID NO: 4644272 - DNA, 13 bp, Homo sapiens
aggaggaccagtc

SEQ ID NO: 4644273 - DNA, 13 bp, Homo sapiens
aggaggagagagt

SEQ ID NO: 4644274 - DNA, 17 bp, Homo sapiens
aggaggagtcagatgag

SEQ ID NO: 4644275 - DNA, 18 bp, Homo sapiens
aggaggccaaccagcccg

SEQ ID NO: 4644276 - DNA, 19 bp, Homo sapiens
aggaggccaaccagcccga

SEQ ID NO: 4644277 - DNA, 19 bp, Homo sapiens
aggaggctttctgggctct

SEQ ID NO: 4644278 - DNA, 20 bp, Homo sapiens
aggaggctttctgggctctg

SEQ ID NO: 4644279 - DNA, 22 bp, Homo sapiens
aggaggctttctgggctctgga

SEQ ID NO: 4644280 - DNA, 19 bp, Homo sapiens
aggagggacaaaggagcct

SEQ ID NO: 4644281 - DNA, 22 bp, Homo sapiens
aggagggacaaaggagcctgtg

SEQ ID NO: 4644282 - DNA, 21 bp, Homo sapiens
aggagggggtcgtggagagct

SEQ ID NO: 4644283 - DNA, 17 bp, Homo sapiens
aggagggtttgggcaga

SEQ ID NO: 4644284 - DNA, 18 bp, Homo sapiens
aggagggtttgggcagag

SEQ ID NO: 4644285 - DNA, 23 bp, Homo sapiens
aggaggtccttaggcctctgaga

SEQ ID NO: 4644286 - DNA, 15 bp, Homo sapiens
aggagtagctgagct

SEQ ID NO: 4644287 - DNA, 16 bp, Homo sapiens
aggagtagctgagctc

SEQ ID NO: 4644288 - DNA, 23 bp, Homo sapiens
aggagtcaagtaatggaggtccc

SEQ ID NO: 4644289 - DNA, 18 bp, Homo sapiens
aggagtcagatgaggccc

SEQ ID NO: 4644290 - DNA, 20 bp, Homo sapiens
aggagtcagatgaggccctg

SEQ ID NO: 4644291 - DNA, 20 bp, Homo sapiens
aggagtctgaggtcctgagc

SEQ ID NO: 4644292 - DNA, 21 bp, Homo sapiens
aggagtctgaggtcctgagca

SEQ ID NO: 4644293 - DNA, 22 bp, Homo sapiens
aggagtctgaggtcctgagcac

SEQ ID NO: 4644294 - DNA, 20 bp, Homo sapiens
aggagtctgggtccatcctg

SEQ ID NO: 4644295 - DNA, 18 bp, Homo sapiens
aggagtggtgcagacaga

SEQ ID NO: 4644296 - DNA, 15 bp, Homo sapiens
aggagtgtcctgccc

SEQ ID NO: 4644297 - DNA, 18 bp, Homo sapiens
aggatactggcacagagg

SEQ ID NO: 4644298 - DNA, 16 bp, Homo sapiens
aggatcagattgcatg

SEQ ID NO: 4644299 - DNA, 22 bp, Homo sapiens
aggatcgaagggtttttagaga

SEQ ID NO: 4644300 - DNA, 19 bp, Homo sapiens
aggatctcctgccagccca

SEQ ID NO: 4644301 - DNA, 20 bp, Homo sapiens
aggatctcctgccagcccag

SEQ ID NO: 4644302 - DNA, 23 bp, Homo sapiens
aggatctcctgccagcccagctg

SEQ ID NO: 4644303 - DNA, 14 bp, Homo sapiens
aggatgagacccag

SEQ ID NO: 4644304 - DNA, 17 bp, Homo sapiens
aggatgagacccagccc

SEQ ID NO: 4644305 - DNA, 14 bp, Homo sapiens
aggatgctttggtt

SEQ ID NO: 4644306 - DNA, 14 bp, Homo sapiens
aggatggaacacgg

SEQ ID NO: 4644307 - DNA, 15 bp, Homo sapiens
aggatgtcatgtctg

SEQ ID NO: 4644308 - DNA, 20 bp, Homo sapiens
aggatgtccctgggccaggg

SEQ ID NO: 4644309 - DNA, 21 bp, Homo sapiens
aggatgtccctgggccagggt

SEQ ID NO: 4644310 - DNA, 23 bp, Homo sapiens
aggatgtccctgggccagggtct

SEQ ID NO: 4644311 - DNA, 20 bp, Homo sapiens
aggattgacattctacagtt

SEQ ID NO: 4644312 - DNA, 22 bp, Homo sapiens
aggattgacattctacagttgt

SEQ ID NO: 4644313 - DNA, 14 bp, Homo sapiens
aggattgcttgagc

SEQ ID NO: 4644314 - DNA, 14 bp, Homo sapiens
aggattttaatttc

SEQ ID NO: 4644315 - DNA, 20 bp, Homo sapiens
aggattttaatttcaggaaa

SEQ ID NO: 4644316 - DNA, 12 bp, Homo sapiens
aggatttttaga

SEQ ID NO: 4644317 - DNA, 12 bp, Homo sapiens
aggcaaggagga

SEQ ID NO: 4644318 - DNA, 20 bp, Homo sapiens
aggcaaggaggaggagtcag

SEQ ID NO: 4644319 - DNA, 14 bp, Homo sapiens
aggcacagtgggag

SEQ ID NO: 4644320 - DNA, 18 bp, Homo sapiens
aggcacagtgggagctga

SEQ ID NO: 4644321 - DNA, 22 bp, Homo sapiens
aggcactataatttctgtaaca

SEQ ID NO: 4644322 - DNA, 21 bp, Homo sapiens
aggcacttaaagccttttcct

SEQ ID NO: 4644323 - DNA, 22 bp, Homo sapiens
aggcagagaacagaactggagg

SEQ ID NO: 4644324 - DNA, 20 bp, Homo sapiens
aggcagcatgcttgggctga

SEQ ID NO: 4644325 - DNA, 22 bp, Homo sapiens
aggcagcctggacatagagagg

SEQ ID NO: 4644326 - DNA, 13 bp, Homo sapiens
aggcaggcagggc

SEQ ID NO: 4644327 - DNA, 14 bp, Homo sapiens
aggcaggctttctg

SEQ ID NO: 4644328 - DNA, 14 bp, Homo sapiens
aggcagggctctcc

SEQ ID NO: 4644329 - DNA, 18 bp, Homo sapiens
aggcagggctctcctggc

SEQ ID NO: 4644330 - DNA, 19 bp, Homo sapiens
aggcagggctctcctggct

SEQ ID NO: 4644331 - DNA, 21 bp, Homo sapiens
aggcagggctctcctggcttc

SEQ ID NO: 4644332 - DNA, 14 bp, Homo sapiens
aggcagggtgcagt

SEQ ID NO: 4644333 - DNA, 15 bp, Homo sapiens
aggcaggtgggcaga

SEQ ID NO: 4644334 - DNA, 19 bp, Homo sapiens
aggcatccgtgaggcaggg

SEQ ID NO: 4644335 - DNA, 14 bp, Homo sapiens
aggcatctgagggg

SEQ ID NO: 4644336 - DNA, 15 bp, Homo sapiens
accagttaaagccac

SEQ ID NO: 4644337 - DNA, 19 bp, Homo sapiens
accatatgatctgttttgt

SEQ ID NO: 4644338 - DNA, 18 bp, Homo sapiens
accatgatggccaggctg

SEQ ID NO: 4644339 - DNA, 17 bp, Homo sapiens
accatgcctcactaatt

SEQ ID NO: 4644340 - DNA, 19 bp, Homo sapiens
accatgcctcactaatttt

SEQ ID NO: 4644341 - DNA, 20 bp, Homo sapiens
accatgcctcactaattttt

SEQ ID NO: 4644342 - DNA, 22 bp, Homo sapiens
accatgtggataactttacaga

SEQ ID NO: 4644343 - DNA, 15 bp, Homo sapiens
accattaacattttt

SEQ ID NO: 4644344 - DNA, 15 bp, Homo sapiens
accattataatttat

SEQ ID NO: 4644345 - DNA, 16 bp, Homo sapiens
accattatgctggtgt

SEQ ID NO: 4644346 - DNA, 13 bp, Homo sapiens
accattcctgcct

SEQ ID NO: 4644347 - DNA, 21 bp, Homo sapiens
accattcctgcctttaagcca

SEQ ID NO: 4644348 - DNA, 17 bp, Homo sapiens
accattgagtccctgct

SEQ ID NO: 4644349 - DNA, 18 bp, Homo sapiens
accattgatttaatgtaa

SEQ ID NO: 4644350 - DNA, 16 bp, Homo sapiens
accattgtaactatta

SEQ ID NO: 4644351 - DNA, 22 bp, Homo sapiens
accattgtaactattaaccttt

SEQ ID NO: 4644352 - DNA, 13 bp, Homo sapiens
accatttgtagtg

SEQ ID NO: 4644353 - DNA, 21 bp, Homo sapiens
acccaatacagtctagtttcc

SEQ ID NO: 4644354 - DNA, 15 bp, Homo sapiens
acccacatgtgacac

SEQ ID NO: 4644355 - DNA, 16 bp, Homo sapiens
acccacatgtgacaca

SEQ ID NO: 4644356 - DNA, 21 bp, Homo sapiens
acccacccaaaagtcacccag

SEQ ID NO: 4644357 - DNA, 12 bp, Homo sapiens
acccaccccctg

SEQ ID NO: 4644358 - DNA, 14 bp, Homo sapiens
acccaccccctgcc

SEQ ID NO: 4644359 - DNA, 16 bp, Homo sapiens
acccaccccctgcctg

SEQ ID NO: 4644360 - DNA, 16 bp, Homo sapiens
acccaccgggccactc

SEQ ID NO: 4644361 - DNA, 19 bp, Homo sapiens
acccaccgggccactcctt

SEQ ID NO: 4644362 - DNA, 24 bp, Homo sapiens
acccagaaatagccactattaaca

SEQ ID NO: 4644363 - DNA, 12 bp, Homo sapiens
acccagcccctt

SEQ ID NO: 4644364 - DNA, 14 bp, Homo sapiens
acccagccccttcc

SEQ ID NO: 4644365 - DNA, 21 bp, Homo sapiens
acccagccccttcccctggga

SEQ ID NO: 4644366 - DNA, 14 bp, Homo sapiens
acccaggaaaggag

SEQ ID NO: 4644367 - DNA, 13 bp, Homo sapiens
acccagtctcctc

SEQ ID NO: 4644368 - DNA, 13 bp, Homo sapiens
acccagttacttt

SEQ ID NO: 4644369 - DNA, 16 bp, Homo sapiens
acccagttcttcattt

SEQ ID NO: 4644370 - DNA, 13 bp, Homo sapiens
acccatctctccc

SEQ ID NO: 4644371 - DNA, 21 bp, Homo sapiens
acccatgagttggggtctggc

SEQ ID NO: 4644372 - DNA, 16 bp, Homo sapiens
acccatgtaaccactg

SEQ ID NO: 4644373 - DNA, 19 bp, Homo sapiens
acccattgttcccttcctc

SEQ ID NO: 4644374 - DNA, 13 bp, Homo sapiens
accccaaggactg

SEQ ID NO: 4644375 - DNA, 12 bp, Homo sapiens
accccagctgct

SEQ ID NO: 4644376 - DNA, 17 bp, Homo sapiens
accccagctgctctaag

SEQ ID NO: 4644377 - DNA, 15 bp, Homo sapiens
aaagaagtggagaca

SEQ ID NO: 4644378 - DNA, 15 bp, Homo sapiens
aaagaatatgacttt

SEQ ID NO: 4644379 - DNA, 20 bp, Homo sapiens
aaagaatcagtaggaccagg

SEQ ID NO: 4644380 - DNA, 13 bp, Homo sapiens
aaagaatgactat

SEQ ID NO: 4644381 - DNA, 18 bp, Homo sapiens
aaagacatccataaagaa

SEQ ID NO: 4644382 - DNA, 15 bp, Homo sapiens
aaagactggttttct

SEQ ID NO: 4644383 - DNA, 20 bp, Homo sapiens
aaagagagaagccagccaca

SEQ ID NO: 4644384 - DNA, 16 bp, Homo sapiens
aaagagagaccccagt

SEQ ID NO: 4644385 - DNA, 15 bp, Homo sapiens
aaagagctgcctgga

SEQ ID NO: 4644386 - DNA, 16 bp, Homo sapiens
aaagagctgcctggat

SEQ ID NO: 4644387 - DNA, 18 bp, Homo sapiens
aaagagggagaagaaaga

SEQ ID NO: 4644388 - DNA, 20 bp, Homo sapiens
aaagaggtgaccccagggca

SEQ ID NO: 4644389 - DNA, 23 bp, Homo sapiens
aaagatcatttataatactgttt

SEQ ID NO: 4644390 - DNA, 17 bp, Homo sapiens
aaagatgatcgctgtat

SEQ ID NO: 4644391 - DNA, 21 bp, Homo sapiens
aaagatgatcgctgtattttg

SEQ ID NO: 4644392 - DNA, 22 bp, Homo sapiens
aaagatgatcgctgtattttga

SEQ ID NO: 4644393 - DNA, 22 bp, Homo sapiens
aaagattactttttctttatgt

SEQ ID NO: 4644394 - DNA, 15 bp, Homo sapiens
aaagcaagaaacagt

SEQ ID NO: 4644395 - DNA, 13 bp, Homo sapiens
aaagcaagtgttg

SEQ ID NO: 4644396 - DNA, 14 bp, Homo sapiens
aaagcactatacag

SEQ ID NO: 4644397 - DNA, 19 bp, Homo sapiens
aaagcagggcagcagggaa

SEQ ID NO: 4644398 - DNA, 19 bp, Homo sapiens
aaagcatattgtaccccct

SEQ ID NO: 4644399 - DNA, 13 bp, Homo sapiens
aaagccaaggtaa

SEQ ID NO: 4644400 - DNA, 14 bp, Homo sapiens
aaagccacttctgg

SEQ ID NO: 4644401 - DNA, 17 bp, Homo sapiens
aaagccacttctggctt

SEQ ID NO: 4644402 - DNA, 13 bp, Homo sapiens
aaagccagggtct

SEQ ID NO: 4644403 - DNA, 22 bp, Homo sapiens
aaagccagggtctctccctcag

SEQ ID NO: 4644404 - DNA, 15 bp, Homo sapiens
aaagcccaaagtggt

SEQ ID NO: 4644405 - DNA, 20 bp, Homo sapiens
aaagccttttgctttatgct

SEQ ID NO: 4644406 - DNA, 13 bp, Homo sapiens
aaagctagaaatg

SEQ ID NO: 4644407 - DNA, 13 bp, Homo sapiens
aaagcttaataaa

SEQ ID NO: 4644408 - DNA, 11 bp, Homo sapiens
aaagctttata

SEQ ID NO: 4644409 - DNA, 21 bp, Homo sapiens
aaaggaaccgcccagtgcagg

SEQ ID NO: 4644410 - DNA, 14 bp, Homo sapiens
aaaggacataaaat

SEQ ID NO: 4644411 - DNA, 20 bp, Homo sapiens
aaaggagcctaggccaggtg

SEQ ID NO: 4644412 - DNA, 10 bp, Homo sapiens
aaaggcctgg

SEQ ID NO: 4644413 - DNA, 11 bp, Homo sapiens
aaaggcctggg

SEQ ID NO: 4644414 - DNA, 12 bp, Homo sapiens
aaaggcctgggg

SEQ ID NO: 4644415 - DNA, 12 bp, Homo sapiens
aaagggacccac

SEQ ID NO: 4644416 - DNA, 20 bp, Homo sapiens
gttctaggctaccagaagag

SEQ ID NO: 4644417 - DNA, 17 bp, Homo sapiens
gttctaggctgctgcac

SEQ ID NO: 4644418 - DNA, 16 bp, Homo sapiens
gttctatttttcaatc

SEQ ID NO: 4644419 - DNA, 16 bp, Homo sapiens
gttctcaacatactgt

SEQ ID NO: 4644420 - DNA, 13 bp, Homo sapiens
gttctgaaatgtt

SEQ ID NO: 4644421 - DNA, 20 bp, Homo sapiens
gttctgaagccatgtagcca

SEQ ID NO: 4644422 - DNA, 16 bp, Homo sapiens
gttctgctacattata

SEQ ID NO: 4644423 - DNA, 12 bp, Homo sapiens
gttctgtcacca

SEQ ID NO: 4644424 - DNA, 18 bp, Homo sapiens
gttctgtgtaaacagaag

SEQ ID NO: 4644425 - DNA, 18 bp, Homo sapiens
gttctgtgtggtgcattc

SEQ ID NO: 4644426 - DNA, 16 bp, Homo sapiens
gttctgttatacccca

SEQ ID NO: 4644427 - DNA, 19 bp, Homo sapiens
gttcttagttgctgtatgt

SEQ ID NO: 4644428 - DNA, 21 bp, Homo sapiens
gttcttatttgccagagccaa

SEQ ID NO: 4644429 - DNA, 18 bp, Homo sapiens
gttcttcatttggaggaa

SEQ ID NO: 4644430 - DNA, 19 bp, Homo sapiens
gttcttcatttggaggaat

SEQ ID NO: 4644431 - DNA, 17 bp, Homo sapiens
gttcttcttcctgaagc

SEQ ID NO: 4644432 - DNA, 20 bp, Homo sapiens
gttcttcttcctgaagctga

SEQ ID NO: 4644433 - DNA, 15 bp, Homo sapiens
gttcttgaagcagta

SEQ ID NO: 4644434 - DNA, 13 bp, Homo sapiens
gttctttccccag

SEQ ID NO: 4644435 - DNA, 17 bp, Homo sapiens
gttctttccccaggggc

SEQ ID NO: 4644436 - DNA, 15 bp, Homo sapiens
gttctttccggccaa

SEQ ID NO: 4644437 - DNA, 14 bp, Homo sapiens
gttgaagtgctgtt

SEQ ID NO: 4644438 - DNA, 17 bp, Homo sapiens
gttgagccccagtcctg

SEQ ID NO: 4644439 - DNA, 16 bp, Homo sapiens
gttgaggtttttaaat

SEQ ID NO: 4644440 - DNA, 22 bp, Homo sapiens
gttgatcatgtactttttagta

SEQ ID NO: 4644441 - DNA, 17 bp, Homo sapiens
gttgatgtgtctttttt

SEQ ID NO: 4644442 - DNA, 13 bp, Homo sapiens
gtgacagtcatca

SEQ ID NO: 4644443 - DNA, 21 bp, Homo sapiens
gtgacagtcatcatcagggcc

SEQ ID NO: 4644444 - DNA, 23 bp, Homo sapiens
gtgacagtcatcatcagggcctg

SEQ ID NO: 4644445 - DNA, 13 bp, Homo sapiens
gtgaccccagggc

SEQ ID NO: 4644446 - DNA, 15 bp, Homo sapiens
gtgaccccagggcac

SEQ ID NO: 4644447 - DNA, 15 bp, Homo sapiens
gtgacccccagctcc

SEQ ID NO: 4644448 - DNA, 17 bp, Homo sapiens
gtgacccggcaccccct

SEQ ID NO: 4644449 - DNA, 22 bp, Homo sapiens
gtgacccggcaccccctgcagc

SEQ ID NO: 4644450 - DNA, 22 bp, Homo sapiens
gtgacctctctaggtgtgtcca

SEQ ID NO: 4644451 - DNA, 13 bp, Homo sapiens
gtgacctgctgag

SEQ ID NO: 4644452 - DNA, 18 bp, Homo sapiens
gtgacctgctgagctctg

SEQ ID NO: 4644453 - DNA, 16 bp, Homo sapiens
gtgacggccctcatct

SEQ ID NO: 4644454 - DNA, 12 bp, Homo sapiens
gtgactcctgct

SEQ ID NO: 4644455 - DNA, 16 bp, Homo sapiens
gtgactcctgctggta

SEQ ID NO: 4644456 - DNA, 19 bp, Homo sapiens
gtgactgaaacaaaatgtt

SEQ ID NO: 4644457 - DNA, 18 bp, Homo sapiens
gtgactgtgtaactttct

SEQ ID NO: 4644458 - DNA, 14 bp, Homo sapiens
gtgacttctgctgc

SEQ ID NO: 4644459 - DNA, 16 bp, Homo sapiens
gtgacttctgctgctg

SEQ ID NO: 4644460 - DNA, 16 bp, Homo sapiens
gtgacttgtctgcctc

SEQ ID NO: 4644461 - DNA, 12 bp, Homo sapiens
gtgagagaaaga

SEQ ID NO: 4644462 - DNA, 12 bp, Homo sapiens
gtgagaggcccc

SEQ ID NO: 4644463 - DNA, 13 bp, Homo sapiens
gtgagaggccccc

SEQ ID NO: 4644464 - DNA, 15 bp, Homo sapiens
gtgagatgcagctgg

SEQ ID NO: 4644465 - DNA, 16 bp, Homo sapiens
gtgagatggtatgaaa

SEQ ID NO: 4644466 - DNA, 22 bp, Homo sapiens
gtgagcgagtggatgctgtgct

SEQ ID NO: 4644467 - DNA, 19 bp, Homo sapiens
gtgagctggggactcaggg

SEQ ID NO: 4644468 - DNA, 23 bp, Homo sapiens
gtgagctggggactcagggaccg

SEQ ID NO: 4644469 - DNA, 20 bp, Homo sapiens
gtgaggccatacttgtgaaa

SEQ ID NO: 4644470 - DNA, 13 bp, Homo sapiens
gtgagggaaggag

SEQ ID NO: 4644471 - DNA, 14 bp, Homo sapiens
gtgagggaaggaga

SEQ ID NO: 4644472 - DNA, 11 bp, Homo sapiens
gtgaggggaag

SEQ ID NO: 4644473 - DNA, 17 bp, Homo sapiens
gtgagggggggctccct

SEQ ID NO: 4644474 - DNA, 14 bp, Homo sapiens
gtgagtgggagagt

SEQ ID NO: 4644475 - DNA, 14 bp, Homo sapiens
gtgagtgtgacagg

SEQ ID NO: 4644476 - DNA, 18 bp, Homo sapiens
gtgagtgtgacagggcca

SEQ ID NO: 4644477 - DNA, 16 bp, Homo sapiens
gtgataaaatgttgaa

SEQ ID NO: 4644478 - DNA, 17 bp, Homo sapiens
gtgataaaatgttgaac

SEQ ID NO: 4644479 - DNA, 14 bp, Homo sapiens
gtgatacagttttg

SEQ ID NO: 4644480 - DNA, 19 bp, Homo sapiens
gtgatccgcccacctcagc

SEQ ID NO: 4644481 - DNA, 23 bp, Homo sapiens
gtgatccgcccacctcagcctcc

SEQ ID NO: 4644482 - DNA, 16 bp, Homo sapiens
gtgatctcccctcaca

SEQ ID NO: 4644483 - DNA, 14 bp, Homo sapiens
gtgatctgctgctg

SEQ ID NO: 4644484 - DNA, 15 bp, Homo sapiens
gtgatctgctgctga

SEQ ID NO: 4644485 - DNA, 14 bp, Homo sapiens
gtgatgagggcagc

SEQ ID NO: 4644486 - DNA, 17 bp, Homo sapiens
gtgatggaggggagagg

SEQ ID NO: 4644487 - DNA, 16 bp, Homo sapiens
gtgattttaactctgt

SEQ ID NO: 4644488 - DNA, 17 bp, Homo sapiens
gtgattttaactctgtc

SEQ ID NO: 4644489 - DNA, 12 bp, Homo sapiens
gtgattttcctt

SEQ ID NO: 4644490 - DNA, 14 bp, Homo sapiens
gtgcaaacacagca

SEQ ID NO: 4644491 - DNA, 21 bp, Homo sapiens
gtgcaaaccacttctccatgc

SEQ ID NO: 4644492 - DNA, 13 bp, Homo sapiens
gtgcaacctctgc

SEQ ID NO: 4644493 - DNA, 17 bp, Homo sapiens
gtgcaacctctgcttcc

SEQ ID NO: 4644494 - DNA, 21 bp, Homo sapiens
gtgcaatcagagtgtacaaat

SEQ ID NO: 4644495 - DNA, 13 bp, Homo sapiens
gtgcacaggaggg

SEQ ID NO: 4644496 - DNA, 18 bp, Homo sapiens
gtgcaccaccacacccgg

SEQ ID NO: 4644497 - DNA, 12 bp, Homo sapiens
gtgcactacagt

SEQ ID NO: 4644498 - DNA, 21 bp, Homo sapiens
gtgcactgcccatggacaggc

SEQ ID NO: 4644499 - DNA, 15 bp, Homo sapiens
gtgcacttagccatg

SEQ ID NO: 4644500 - DNA, 12 bp, Homo sapiens
gtgcagagcaga

SEQ ID NO: 4644501 - DNA, 18 bp, Homo sapiens
gtgcagagcagacaggct

SEQ ID NO: 4644502 - DNA, 15 bp, Homo sapiens
gtgcaggtagacctg

SEQ ID NO: 4644503 - DNA, 21 bp, Homo sapiens
gtgcaggtatttcagaaggag

SEQ ID NO: 4644504 - DNA, 22 bp, Homo sapiens
gtgcagtatcatgccctgtgca

SEQ ID NO: 4644505 - DNA, 13 bp, Homo sapiens
gtgcatcacatct

SEQ ID NO: 4644506 - DNA, 14 bp, Homo sapiens
gtgcatcacatctg

SEQ ID NO: 4644507 - DNA, 13 bp, Homo sapiens
gtgcatgctctgc

SEQ ID NO: 4644508 - DNA, 20 bp, Homo sapiens
gtgccaacaatcctagtgct

SEQ ID NO: 4644509 - DNA, 13 bp, Homo sapiens
gtgccaacctgtt

SEQ ID NO: 4644510 - DNA, 20 bp, Homo sapiens
gtgccaaggacctcctcttc

SEQ ID NO: 4644511 - DNA, 19 bp, Homo sapiens
gtgccaagtccaggtcctg

SEQ ID NO: 4644512 - DNA, 20 bp, Homo sapiens
gtgccaagtccaggtcctgg

SEQ ID NO: 4644513 - DNA, 21 bp, Homo sapiens
gtgccacacttcgctcttgag

SEQ ID NO: 4644514 - DNA, 13 bp, Homo sapiens
gtgccacattttc

SEQ ID NO: 4644515 - DNA, 13 bp, Homo sapiens
gtgccagagcctg

SEQ ID NO: 4644516 - DNA, 15 bp, Homo sapiens
ggccgccacggcctg

SEQ ID NO: 4644517 - DNA, 14 bp, Homo sapiens
ggccgccctcggac

SEQ ID NO: 4644518 - DNA, 16 bp, Homo sapiens
ggccgggcagaggggc

SEQ ID NO: 4644519 - DNA, 19 bp, Homo sapiens
ggcctagtacaatcttggg

SEQ ID NO: 4644520 - DNA, 21 bp, Homo sapiens
ggcctatgcacatatggactc

SEQ ID NO: 4644521 - DNA, 15 bp, Homo sapiens
ggcctatggagagcc

SEQ ID NO: 4644522 - DNA, 19 bp, Homo sapiens
ggcctcacccctcccctgg

SEQ ID NO: 4644523 - DNA, 22 bp, Homo sapiens
ggcctcacccctcccctgggac

SEQ ID NO: 4644524 - DNA, 15 bp, Homo sapiens
ggcctcagagcttcc

SEQ ID NO: 4644525 - DNA, 18 bp, Homo sapiens
ggcctcagagcttcctgg

SEQ ID NO: 4644526 - DNA, 22 bp, Homo sapiens
ggcctcagagcttcctggggac

SEQ ID NO: 4644527 - DNA, 15 bp, Homo sapiens
ggcctcaggctctgc

SEQ ID NO: 4644528 - DNA, 22 bp, Homo sapiens
ggcctccctgctgtgccatgct

SEQ ID NO: 4644529 - DNA, 13 bp, Homo sapiens
ggcctcctgcctc

SEQ ID NO: 4644530 - DNA, 15 bp, Homo sapiens
ggcctcctgcctcta

SEQ ID NO: 4644531 - DNA, 14 bp, Homo sapiens
ggcctgcagaagga

SEQ ID NO: 4644532 - DNA, 19 bp, Homo sapiens
ggcctgcagcaggagtggt

SEQ ID NO: 4644533 - DNA, 14 bp, Homo sapiens
ggcctgcagcccct

SEQ ID NO: 4644534 - DNA, 15 bp, Homo sapiens
ggcctgctgctgaga

SEQ ID NO: 4644535 - DNA, 16 bp, Homo sapiens
ggcctgctgctgagaa

SEQ ID NO: 4644536 - DNA, 22 bp, Homo sapiens
ggcctgctgctgagaacctggc

SEQ ID NO: 4644537 - DNA, 17 bp, Homo sapiens
ggcctggcccccagctt

SEQ ID NO: 4644538 - DNA, 15 bp, Homo sapiens
ggcctggctggctga

SEQ ID NO: 4644539 - DNA, 15 bp, Homo sapiens
ggcctggggcctgag

SEQ ID NO: 4644540 - DNA, 15 bp, Homo sapiens
ggcctggggtgaccc

SEQ ID NO: 4644541 - DNA, 18 bp, Homo sapiens
ggcctggggtgacccggc

SEQ ID NO: 4644542 - DNA, 19 bp, Homo sapiens
ggcctggggtgacccggca

SEQ ID NO: 4644543 - DNA, 11 bp, Homo sapiens
ggcctggtctg

SEQ ID NO: 4644544 - DNA, 14 bp, Homo sapiens
ggcctggtctggga

SEQ ID NO: 4644545 - DNA, 15 bp, Homo sapiens
ggcctgtactgcctg

SEQ ID NO: 4644546 - DNA, 16 bp, Homo sapiens
ggcctgtactgcctgc

SEQ ID NO: 4644547 - DNA, 11 bp, Homo sapiens
ggcctgtctca

SEQ ID NO: 4644548 - DNA, 22 bp, Homo sapiens
ggcctgtggaatgagtgtgcat

SEQ ID NO: 4644549 - DNA, 17 bp, Homo sapiens
ggcctgtgtagctgtga

SEQ ID NO: 4644550 - DNA, 21 bp, Homo sapiens
ggcctgttgctatagagccta

SEQ ID NO: 4644551 - DNA, 21 bp, Homo sapiens
ggccttagtgggccagggctg

SEQ ID NO: 4644552 - DNA, 22 bp, Homo sapiens
ggccttctaggaatggaggagc

SEQ ID NO: 4644553 - DNA, 12 bp, Homo sapiens
ggccttgtccca

SEQ ID NO: 4644554 - DNA, 13 bp, Homo sapiens
ggccttgttctgt

SEQ ID NO: 4644555 - DNA, 16 bp, Homo sapiens
ggccttgttctgtcac

SEQ ID NO: 4644556 - DNA, 16 bp, Homo sapiens
ggcctttttctgagat

SEQ ID NO: 4644557 - DNA, 15 bp, Homo sapiens
ggcgagaggtgagct

SEQ ID NO: 4644558 - DNA, 22 bp, Homo sapiens
gtcccagctgaaggcagtggca

SEQ ID NO: 4644559 - DNA, 21 bp, Homo sapiens
gtcccagggccctcccagccc

SEQ ID NO: 4644560 - DNA, 22 bp, Homo sapiens
gtccccaaatccgaacctcctc

SEQ ID NO: 4644561 - DNA, 16 bp, Homo sapiens
gtccccaccctccact

SEQ ID NO: 4644562 - DNA, 13 bp, Homo sapiens
gtccccatctagg

SEQ ID NO: 4644563 - DNA, 21 bp, Homo sapiens
gtcccctagggactgtcctag

SEQ ID NO: 4644564 - DNA, 19 bp, Homo sapiens
gtccctatatcagggcctg

SEQ ID NO: 4644565 - DNA, 14 bp, Homo sapiens
gtccctctctctgg

SEQ ID NO: 4644566 - DNA, 16 bp, Homo sapiens
gtccctcttctggttt

SEQ ID NO: 4644567 - DNA, 22 bp, Homo sapiens
gtccctcttctggtttcccttt

SEQ ID NO: 4644568 - DNA, 14 bp, Homo sapiens
gtccctgcagggcc

SEQ ID NO: 4644569 - DNA, 15 bp, Homo sapiens
gtccctgcagggcca

SEQ ID NO: 4644570 - DNA, 21 bp, Homo sapiens
gtccctggagggcaagccctg

SEQ ID NO: 4644571 - DNA, 22 bp, Homo sapiens
gtccctggagggcaagccctgc

SEQ ID NO: 4644572 - DNA, 22 bp, Homo sapiens
gtccctggggctagggggagcc

SEQ ID NO: 4644573 - DNA, 16 bp, Homo sapiens
gtcccttccaggagga

SEQ ID NO: 4644574 - DNA, 21 bp, Homo sapiens
gtccggtggaaggccttcttt

SEQ ID NO: 4644575 - DNA, 13 bp, Homo sapiens
gtccgtcctggca

SEQ ID NO: 4644576 - DNA, 15 bp, Homo sapiens
gtccgtcctggcaca

SEQ ID NO: 4644577 - DNA, 19 bp, Homo sapiens
gtcctaaagaagacatttt

SEQ ID NO: 4644578 - DNA, 23 bp, Homo sapiens
gtcctaaagaagacattttctct

SEQ ID NO: 4644579 - DNA, 14 bp, Homo sapiens
gtcctccctagctc

SEQ ID NO: 4644580 - DNA, 22 bp, Homo sapiens
gtcctcctgttcatctgtgcac

SEQ ID NO: 4644581 - DNA, 18 bp, Homo sapiens
gtcctctgtcagtcacag

SEQ ID NO: 4644582 - DNA, 14 bp, Homo sapiens
gtcctgagcactgc

SEQ ID NO: 4644583 - DNA, 16 bp, Homo sapiens
gtcctgagcactgcca

SEQ ID NO: 4644584 - DNA, 22 bp, Homo sapiens
gtcctgagcactgccaggaggg

SEQ ID NO: 4644585 - DNA, 23 bp, Homo sapiens
gtcctgagcactgccaggaggga

SEQ ID NO: 4644586 - DNA, 20 bp, Homo sapiens
gtcctgcagcaaacactcca

SEQ ID NO: 4644587 - DNA, 14 bp, Homo sapiens
gtcctgcccatgcc

SEQ ID NO: 4644588 - DNA, 21 bp, Homo sapiens
gtcctgctcattatgccactt

SEQ ID NO: 4644589 - DNA, 20 bp, Homo sapiens
gtcctggaggggctggggac

SEQ ID NO: 4644590 - DNA, 16 bp, Homo sapiens
gtcctggctggccgca

SEQ ID NO: 4644591 - DNA, 16 bp, Homo sapiens
gtcctggtggggcagc

SEQ ID NO: 4644592 - DNA, 17 bp, Homo sapiens
gtcctggtggggcagct

SEQ ID NO: 4644593 - DNA, 18 bp, Homo sapiens
gtcctgtttctgtcaagc

SEQ ID NO: 4644594 - DNA, 20 bp, Homo sapiens
gtcctttcaattccaccagg

SEQ ID NO: 4644595 - DNA, 15 bp, Homo sapiens
gtcctttcagtctga

SEQ ID NO: 4644596 - DNA, 14 bp, Homo sapiens
gtcctttcccacca

SEQ ID NO: 4644597 - DNA, 14 bp, Homo sapiens
gtcgacaagaatgt

SEQ ID NO: 4644598 - DNA, 17 bp, Homo sapiens
gtcgccacacgcctctg

SEQ ID NO: 4644599 - DNA, 20 bp, Homo sapiens
gtcgccacacgcctctgtgt

SEQ ID NO: 4644600 - DNA, 14 bp, Homo sapiens
gtcgcccctcagag

SEQ ID NO: 4644601 - DNA, 17 bp, Homo sapiens
gtcgcccctcagagcat

SEQ ID NO: 4644602 - DNA, 14 bp, Homo sapiens
gtcggaggtgctgt

SEQ ID NO: 4644603 - DNA, 17 bp, Homo sapiens
gtcggaggtgctgtccc

SEQ ID NO: 4644604 - DNA, 19 bp, Homo sapiens
gtcggaggtgctgtcccca

SEQ ID NO: 4644605 - DNA, 13 bp, Homo sapiens
gtcggatctcaca

SEQ ID NO: 4644606 - DNA, 17 bp, Homo sapiens
gtcgtccttactcctgt

SEQ ID NO: 4644607 - DNA, 17 bp, Homo sapiens
gtcgtgatgtggaggaa

SEQ ID NO: 4644608 - DNA, 18 bp, Homo sapiens
gtcgtggagagctaggag

SEQ ID NO: 4644609 - DNA, 20 bp, Homo sapiens
gtcgtggagagctaggagca

SEQ ID NO: 4644610 - DNA, 21 bp, Homo sapiens
gtcgtggagagctaggagcaa

SEQ ID NO: 4644611 - DNA, 13 bp, Homo sapiens
gtctaccctggga

SEQ ID NO: 4644612 - DNA, 14 bp, Homo sapiens
gtctagaagaacaa

SEQ ID NO: 4644613 - DNA, 16 bp, Homo sapiens
gtctagaccagggctg

SEQ ID NO: 4644614 - DNA, 17 bp, Homo sapiens
gtctagaccagggctgc

SEQ ID NO: 4644615 - DNA, 14 bp, Homo sapiens
gtctaggacacagt

SEQ ID NO: 4644616 - DNA, 18 bp, Homo sapiens
gtctagtccgtcctggca

SEQ ID NO: 4644617 - DNA, 21 bp, Homo sapiens
gtctataatcccagcactttg

SEQ ID NO: 4644618 - DNA, 13 bp, Homo sapiens
gtctataggtttg

SEQ ID NO: 4644619 - DNA, 15 bp, Homo sapiens
gtctatgttcaaaga

SEQ ID NO: 4644620 - DNA, 17 bp, Homo sapiens
gtctatgttcaaagact

SEQ ID NO: 4644621 - DNA, 22 bp, Homo sapiens
gtctcaaaatggtgtgctataa

SEQ ID NO: 4644622 - DNA, 22 bp, Homo sapiens
gtctcactcttgtcacccaggc

SEQ ID NO: 4644623 - DNA, 23 bp, Homo sapiens
gtctcactcttgtcacccaggct

SEQ ID NO: 4644624 - DNA, 14 bp, Homo sapiens
gtctcactgcttga

SEQ ID NO: 4644625 - DNA, 14 bp, Homo sapiens
gtctccaggggcct

SEQ ID NO: 4644626 - DNA, 19 bp, Homo sapiens
gtctccaggggcctgcaga

SEQ ID NO: 4644627 - DNA, 18 bp, Homo sapiens
gtctcccgtgcatgctct

SEQ ID NO: 4644628 - DNA, 20 bp, Homo sapiens
gtctcccgtgcatgctctgc

SEQ ID NO: 4644629 - DNA, 13 bp, Homo sapiens
gtctcctctccat

SEQ ID NO: 4644630 - DNA, 19 bp, Homo sapiens
gtctcgagcgccctgcaga

SEQ ID NO: 4644631 - DNA, 21 bp, Homo sapiens
gtctcgagcgccctgcagacc

SEQ ID NO: 4644632 - DNA, 22 bp, Homo sapiens
gtctcggatgacaccctggcct

SEQ ID NO: 4644633 - DNA, 21 bp, Homo sapiens
gtctctaatgtgactgttgag

SEQ ID NO: 4644634 - DNA, 22 bp, Homo sapiens
gtctctaatgtgactgttgagg

SEQ ID NO: 4644635 - DNA, 12 bp, Homo sapiens
gtctctgaaggg

SEQ ID NO: 4644636 - DNA, 18 bp, Homo sapiens
gtctgaatcatgtctgta

SEQ ID NO: 4644637 - DNA, 14 bp, Homo sapiens
gtctgacagtagct

SEQ ID NO: 4644638 - DNA, 23 bp, Homo sapiens
gtctgaccccagtggaaaacaaa

SEQ ID NO: 4644639 - DNA, 16 bp, Homo sapiens
gtctgaggtcctgagc

SEQ ID NO: 4644640 - DNA, 18 bp, Homo sapiens
gtctgaggtcctgagcac

SEQ ID NO: 4644641 - DNA, 19 bp, Homo sapiens
gtctgaggtcctgagcact

SEQ ID NO: 4644642 - DNA, 15 bp, Homo sapiens
gtctgagtctatgtt

SEQ ID NO: 4644643 - DNA, 17 bp, Homo sapiens
gtctgagtctatgttca

SEQ ID NO: 4644644 - DNA, 11 bp, Homo sapiens
gtctgcctcct

SEQ ID NO: 4644645 - DNA, 16 bp, Homo sapiens
gtctggactgctattc

SEQ ID NO: 4644646 - DNA, 19 bp, Homo sapiens
gtctggcagggcagcagga

SEQ ID NO: 4644647 - DNA, 19 bp, Homo sapiens
gtctggctagagggcccaa

SEQ ID NO: 4644648 - DNA, 20 bp, Homo sapiens
gtctggctagagggcccaaa

SEQ ID NO: 4644649 - DNA, 17 bp, Homo sapiens
gtctggctccctgcccc

SEQ ID NO: 4644650 - DNA, 16 bp, Homo sapiens
gtctgggacagggagg

SEQ ID NO: 4644651 - DNA, 16 bp, Homo sapiens
gtctgggtcagaccca

SEQ ID NO: 4644652 - DNA, 23 bp, Homo sapiens
gtctggttttgtcccttccagga

SEQ ID NO: 4644653 - DNA, 14 bp, Homo sapiens
gtctgtacacgtgt

SEQ ID NO: 4644654 - DNA, 15 bp, Homo sapiens
gtctgtatccccagt

SEQ ID NO: 4644655 - DNA, 16 bp, Homo sapiens
gtctgtatccccagtg

SEQ ID NO: 4644656 - DNA, 19 bp, Homo sapiens
gtctgtatccccagtgccc

SEQ ID NO: 4644657 - DNA, 19 bp, Homo sapiens
gtctgtcctgatttctaca

SEQ ID NO: 4644658 - DNA, 23 bp, Homo sapiens
gtctgtggttgcagtctttcccc

SEQ ID NO: 4644659 - DNA, 15 bp, Homo sapiens
gtctgtgtgaatgtg

SEQ ID NO: 4644660 - DNA, 16 bp, Homo sapiens
gtctgtgtgaatgtgg

SEQ ID NO: 4644661 - DNA, 14 bp, Homo sapiens
gtctgttacactgg

SEQ ID NO: 4644662 - DNA, 23 bp, Homo sapiens
gtctgttttgtaaagtccccaga

SEQ ID NO: 4644663 - DNA, 18 bp, Homo sapiens
gtcttaaagggaatcatt

SEQ ID NO: 4644664 - DNA, 17 bp, Homo sapiens
gtcttactactttaaat

SEQ ID NO: 4644665 - DNA, 14 bp, Homo sapiens
gtcttagctttaca

SEQ ID NO: 4644666 - DNA, 16 bp, Homo sapiens
gtcttagctttacatt

SEQ ID NO: 4644667 - DNA, 17 bp, Homo sapiens
gtcttagctttacattt

SEQ ID NO: 4644668 - DNA, 21 bp, Homo sapiens
gtcttaggtcttcctgtggct

SEQ ID NO: 4644669 - DNA, 14 bp, Homo sapiens
gggagctgagctgg

SEQ ID NO: 4644670 - DNA, 22 bp, Homo sapiens
gggaggagcaacggccccagcg

SEQ ID NO: 4644671 - DNA, 15 bp, Homo sapiens
gggaggagcctgtgc

SEQ ID NO: 4644672 - DNA, 23 bp, Homo sapiens
gggaggcccccccagaagcaaga

SEQ ID NO: 4644673 - DNA, 13 bp, Homo sapiens
gggaggctcaggt

SEQ ID NO: 4644674 - DNA, 15 bp, Homo sapiens
gggaggctcaggtcc

SEQ ID NO: 4644675 - DNA, 16 bp, Homo sapiens
gggagggctctgaggc

SEQ ID NO: 4644676 - DNA, 13 bp, Homo sapiens
gggaggggaggca

SEQ ID NO: 4644677 - DNA, 14 bp, Homo sapiens
gggaggggaggcat

SEQ ID NO: 4644678 - DNA, 17 bp, Homo sapiens
gggagggtcagccaggg

SEQ ID NO: 4644679 - DNA, 21 bp, Homo sapiens
gggagtatgctggaggcagag

SEQ ID NO: 4644680 - DNA, 15 bp, Homo sapiens
gggagtgctggctca

SEQ ID NO: 4644681 - DNA, 19 bp, Homo sapiens
gggagtgctggctcacagt

SEQ ID NO: 4644682 - DNA, 18 bp, Homo sapiens
gggagtggttcctgtgga

SEQ ID NO: 4644683 - DNA, 16 bp, Homo sapiens
gggatagtctgggtca

SEQ ID NO: 4644684 - DNA, 23 bp, Homo sapiens
gggatagtctgggtcagacccat

SEQ ID NO: 4644685 - DNA, 23 bp, Homo sapiens
gggatcacagcctcacccctgcc

SEQ ID NO: 4644686 - DNA, 15 bp, Homo sapiens
gggatccagccactt

SEQ ID NO: 4644687 - DNA, 22 bp, Homo sapiens
gggatgaggtcaccaggggagg

SEQ ID NO: 4644688 - DNA, 14 bp, Homo sapiens
gggatgctgggctg

SEQ ID NO: 4644689 - DNA, 17 bp, Homo sapiens
gggatgctgggctgggc

SEQ ID NO: 4644690 - DNA, 18 bp, Homo sapiens
gggatggggatgggaggg

SEQ ID NO: 4644691 - DNA, 19 bp, Homo sapiens
gggattacaggcgcctgcc

SEQ ID NO: 4644692 - DNA, 16 bp, Homo sapiens
gggattacaggggtga

SEQ ID NO: 4644693 - DNA, 21 bp, Homo sapiens
gggattcaggaaaaggcctgg

SEQ ID NO: 4644694 - DNA, 14 bp, Homo sapiens
gggcaagaggatga

SEQ ID NO: 4644695 - DNA, 19 bp, Homo sapiens
gggcaagccctgcccacag

SEQ ID NO: 4644696 - DNA, 16 bp, Homo sapiens
gggcaagctaggcccc

SEQ ID NO: 4644697 - DNA, 22 bp, Homo sapiens
gggcaagctttgctccttcagt

SEQ ID NO: 4644698 - DNA, 15 bp, Homo sapiens
gggcaatggccaggg

SEQ ID NO: 4644699 - DNA, 21 bp, Homo sapiens
gggcaatggccaggggccagg

SEQ ID NO: 4644700 - DNA, 12 bp, Homo sapiens
gggcacaggagc

SEQ ID NO: 4644701 - DNA, 13 bp, Homo sapiens
gggcacaggagct

SEQ ID NO: 4644702 - DNA, 14 bp, Homo sapiens
gggcacaggagcta

SEQ ID NO: 4644703 - DNA, 15 bp, Homo sapiens
gggcacaggagctac

SEQ ID NO: 4644704 - DNA, 21 bp, Homo sapiens
gggcacaggagctacctgtgt

SEQ ID NO: 4644705 - DNA, 20 bp, Homo sapiens
gggcacattaactccctcca

SEQ ID NO: 4644706 - DNA, 16 bp, Homo sapiens
gggcacccccagcctg

SEQ ID NO: 4644707 - DNA, 18 bp, Homo sapiens
gggcacccccagcctggg

SEQ ID NO: 4644708 - DNA, 21 bp, Homo sapiens
gggcacccccagcctgggcct

SEQ ID NO: 4644709 - DNA, 17 bp, Homo sapiens
gggcactcccaaccctg

SEQ ID NO: 4644710 - DNA, 14 bp, Homo sapiens
gggcagactgtgaa

SEQ ID NO: 4644711 - DNA, 15 bp, Homo sapiens
gggcagagtcctgcc

SEQ ID NO: 4644712 - DNA, 11 bp, Homo sapiens
gggcagcactc

SEQ ID NO: 4644713 - DNA, 21 bp, Homo sapiens
gggcagcactccccagagctg

SEQ ID NO: 4644714 - DNA, 20 bp, Homo sapiens
gggcagcagccagccctgcc

SEQ ID NO: 4644715 - DNA, 22 bp, Homo sapiens
gggcagcagccagccctgcctg

SEQ ID NO: 4644716 - DNA, 15 bp, Homo sapiens
gggcagccccctccc

SEQ ID NO: 4644717 - DNA, 13 bp, Homo sapiens
gggcagcgccagg

SEQ ID NO: 4644718 - DNA, 16 bp, Homo sapiens
gggcagcgcccttcct

SEQ ID NO: 4644719 - DNA, 20 bp, Homo sapiens
gggcagcgcccttcctctcc

SEQ ID NO: 4644720 - DNA, 22 bp, Homo sapiens
gggcagctcctctgtctcgagc

SEQ ID NO: 4644721 - DNA, 14 bp, Homo sapiens
gggcagggaaggac

SEQ ID NO: 4644722 - DNA, 23 bp, Homo sapiens
gggcaggggagggtcagccaggg

SEQ ID NO: 4644723 - DNA, 22 bp, Homo sapiens
gggcaggggcgggcggagggag

SEQ ID NO: 4644724 - DNA, 15 bp, Homo sapiens
gggcagtgccctttg

SEQ ID NO: 4644725 - DNA, 19 bp, Homo sapiens
gggcagttcgcagccaccc

SEQ ID NO: 4644726 - DNA, 15 bp, Homo sapiens
gggcatgagtctgtt

SEQ ID NO: 4644727 - DNA, 17 bp, Homo sapiens
gggcattttacccttgc

SEQ ID NO: 4644728 - DNA, 19 bp, Homo sapiens
gggccacatagatgctgat

SEQ ID NO: 4644729 - DNA, 16 bp, Homo sapiens
gggccactccttcctg

SEQ ID NO: 4644730 - DNA, 19 bp, Homo sapiens
gggccactccttcctgccc

SEQ ID NO: 4644731 - DNA, 15 bp, Homo sapiens
ggagtgtcctgccca

SEQ ID NO: 4644732 - DNA, 15 bp, Homo sapiens
ggagttttgctctct

SEQ ID NO: 4644733 - DNA, 13 bp, Homo sapiens
ggataaagccact

SEQ ID NO: 4644734 - DNA, 17 bp, Homo sapiens
ggataaagccacttctg

SEQ ID NO: 4644735 - DNA, 12 bp, Homo sapiens
ggataagaaagc

SEQ ID NO: 4644736 - DNA, 23 bp, Homo sapiens
ggataagtttctattctgtcagt

SEQ ID NO: 4644737 - DNA, 15 bp, Homo sapiens
ggatactggcacaga

SEQ ID NO: 4644738 - DNA, 17 bp, Homo sapiens
ggatactggcacagagg

SEQ ID NO: 4644739 - DNA, 18 bp, Homo sapiens
ggatactggcacagaggt

SEQ ID NO: 4644740 - DNA, 18 bp, Homo sapiens
ggatagctaactgtaaat

SEQ ID NO: 4644741 - DNA, 23 bp, Homo sapiens
ggatagtagttaaataactgtgt

SEQ ID NO: 4644742 - DNA, 21 bp, Homo sapiens
ggatagtctgggtcagaccca

SEQ ID NO: 4644743 - DNA, 21 bp, Homo sapiens
ggatatcattttaaaaacttt

SEQ ID NO: 4644744 - DNA, 22 bp, Homo sapiens
ggatatccttatcagagctaag

SEQ ID NO: 4644745 - DNA, 9 bp, Homo sapiens
ggatattat

SEQ ID NO: 4644746 - DNA, 19 bp, Homo sapiens
ggatattatagaaaattat

SEQ ID NO: 4644747 - DNA, 22 bp, Homo sapiens
ggatcacagcctcacccctgcc

SEQ ID NO: 4644748 - DNA, 13 bp, Homo sapiens
ggatcagcgtggc

SEQ ID NO: 4644749 - DNA, 13 bp, Homo sapiens
ggatccagccact

SEQ ID NO: 4644750 - DNA, 23 bp, Homo sapiens
ggatcccaccccattttctgtgg

SEQ ID NO: 4644751 - DNA, 11 bp, Homo sapiens
ggatctcacag

SEQ ID NO: 4644752 - DNA, 24 bp, Homo sapiens
ggatctctttccccaaggacccag

SEQ ID NO: 4644753 - DNA, 19 bp, Homo sapiens
ggatgacaccctggcctga

SEQ ID NO: 4644754 - DNA, 13 bp, Homo sapiens
ggatgagaaacag

SEQ ID NO: 4644755 - DNA, 15 bp, Homo sapiens
ggatgagacccagcc

SEQ ID NO: 4644756 - DNA, 22 bp, Homo sapiens
ggatgagatacttatgcaagat

SEQ ID NO: 4644757 - DNA, 19 bp, Homo sapiens
ggatgaggtctcgaccctg

SEQ ID NO: 4644758 - DNA, 23 bp, Homo sapiens
ggatgaggtctcgaccctgtccc

SEQ ID NO: 4644759 - DNA, 15 bp, Homo sapiens
ggatgcccttccccc

SEQ ID NO: 4644760 - DNA, 20 bp, Homo sapiens
ggatggagaaagaagtggag

SEQ ID NO: 4644761 - DNA, 21 bp, Homo sapiens
ggatggagcaagctcttccct

SEQ ID NO: 4644762 - DNA, 14 bp, Homo sapiens
ggatggcagactct

SEQ ID NO: 4644763 - DNA, 19 bp, Homo sapiens
ggatgtccctgggccaggg

SEQ ID NO: 4644764 - DNA, 22 bp, Homo sapiens
ggatgtccctgggccagggtct

SEQ ID NO: 4644765 - DNA, 19 bp, Homo sapiens
ggagaaagagctgcctgga

SEQ ID NO: 4644766 - DNA, 16 bp, Homo sapiens
ggagaaatacccatgt

SEQ ID NO: 4644767 - DNA, 18 bp, Homo sapiens
ggagaacagtggttgcct

SEQ ID NO: 4644768 - DNA, 11 bp, Homo sapiens
ggagaaccagg

SEQ ID NO: 4644769 - DNA, 19 bp, Homo sapiens
ggagaagaaagaaacttca

SEQ ID NO: 4644770 - DNA, 14 bp, Homo sapiens
ggagaaggacatga

SEQ ID NO: 4644771 - DNA, 20 bp, Homo sapiens
ggagaagggggctctgcccc

SEQ ID NO: 4644772 - DNA, 12 bp, Homo sapiens
ggagagaagaat

SEQ ID NO: 4644773 - DNA, 15 bp, Homo sapiens
ggagagagaccccgc

SEQ ID NO: 4644774 - DNA, 12 bp, Homo sapiens
ggagagagccag

SEQ ID NO: 4644775 - DNA, 15 bp, Homo sapiens
ggagagagccaggat

SEQ ID NO: 4644776 - DNA, 12 bp, Homo sapiens
ggagagccctgg

SEQ ID NO: 4644777 - DNA, 21 bp, Homo sapiens
ggagagctaggagcaaagcct

SEQ ID NO: 4644778 - DNA, 21 bp, Homo sapiens
ggagaggcttccctacacagg

SEQ ID NO: 4644779 - DNA, 17 bp, Homo sapiens
ggagaggggtcacaccc

SEQ ID NO: 4644780 - DNA, 19 bp, Homo sapiens
ggagaggggtcacacccac

SEQ ID NO: 4644781 - DNA, 21 bp, Homo sapiens
ggagaggggtcacacccaccc

SEQ ID NO: 4644782 - DNA, 14 bp, Homo sapiens
ggagaggtcaccag

SEQ ID NO: 4644783 - DNA, 14 bp, Homo sapiens
ggagatgaccaggg

SEQ ID NO: 4644784 - DNA, 23 bp, Homo sapiens
ggagatgagttttaggaccagca

SEQ ID NO: 4644785 - DNA, 15 bp, Homo sapiens
ggagatggagggctt

SEQ ID NO: 4644786 - DNA, 16 bp, Homo sapiens
ggagatggagggcttg

SEQ ID NO: 4644787 - DNA, 17 bp, Homo sapiens
ggagatgtgatcaggcc

SEQ ID NO: 4644788 - DNA, 20 bp, Homo sapiens
ggagatgtgatcaggcccca

SEQ ID NO: 4644789 - DNA, 15 bp, Homo sapiens
ggagcaaaccattat

SEQ ID NO: 4644790 - DNA, 16 bp, Homo sapiens
ggagcaaacctagccc

SEQ ID NO: 4644791 - DNA, 13 bp, Homo sapiens
ggagcaaagcctg

SEQ ID NO: 4644792 - DNA, 22 bp, Homo sapiens
ggagcaaagcctgttcatggca

SEQ ID NO: 4644793 - DNA, 24 bp, Homo sapiens
ggagcaaagcctgttcatggcaga

SEQ ID NO: 4644794 - DNA, 13 bp, Homo sapiens
ggagcaagctctt

SEQ ID NO: 4644795 - DNA, 23 bp, Homo sapiens
ggaaagctcttcctaatcgctaa

SEQ ID NO: 4644796 - DNA, 21 bp, Homo sapiens
ggaaaggagcctaggccaggt

SEQ ID NO: 4644797 - DNA, 21 bp, Homo sapiens
ggaaaggggttggggtgacag

SEQ ID NO: 4644798 - DNA, 14 bp, Homo sapiens
ggaaataacagaga

SEQ ID NO: 4644799 - DNA, 18 bp, Homo sapiens
ggaaatctgtaacaggta

SEQ ID NO: 4644800 - DNA, 19 bp, Homo sapiens
ggaaatgaaaggtgaatta

SEQ ID NO: 4644801 - DNA, 17 bp, Homo sapiens
ggaaatgtacacttttt

SEQ ID NO: 4644802 - DNA, 17 bp, Homo sapiens
ggaaattggaagagcac

SEQ ID NO: 4644803 - DNA, 13 bp, Homo sapiens
ggaacagcccagc

SEQ ID NO: 4644804 - DNA, 14 bp, Homo sapiens
ggaaccactcccac

SEQ ID NO: 4644805 - DNA, 21 bp, Homo sapiens
ggaaccccggggtgcccacag

SEQ ID NO: 4644806 - DNA, 16 bp, Homo sapiens
ggaactggccaagctg

SEQ ID NO: 4644807 - DNA, 19 bp, Homo sapiens
ggaactggccaagctgagg

SEQ ID NO: 4644808 - DNA, 17 bp, Homo sapiens
ggaacttctagctcatt

SEQ ID NO: 4644809 - DNA, 14 bp, Homo sapiens
ggaagaaggaggaa

SEQ ID NO: 4644810 - DNA, 18 bp, Homo sapiens
ggaagacccaacacatgg

SEQ ID NO: 4644811 - DNA, 17 bp, Homo sapiens
ggaagactttgtgactg

SEQ ID NO: 4644812 - DNA, 16 bp, Homo sapiens
ggaagagccacctgca

SEQ ID NO: 4644813 - DNA, 21 bp, Homo sapiens
ggaagagggaaatgtacactt

SEQ ID NO: 4644814 - DNA, 21 bp, Homo sapiens
ggaagatatgccactaacttc

SEQ ID NO: 4644815 - DNA, 20 bp, Homo sapiens
ggaagcagaagacgggaggg

SEQ ID NO: 4644816 - DNA, 14 bp, Homo sapiens
ggaagcatttttta

SEQ ID NO: 4644817 - DNA, 10 bp, Homo sapiens
ggaagccagg

SEQ ID NO: 4644818 - DNA, 14 bp, Homo sapiens
ggaagcccctgggc

SEQ ID NO: 4644819 - DNA, 23 bp, Homo sapiens
ggaagctgctgaggcccccaagt

SEQ ID NO: 4644820 - DNA, 21 bp, Homo sapiens
ggaaggagaaggagtgccata

SEQ ID NO: 4644821 - DNA, 13 bp, Homo sapiens
gcatccagcagca

SEQ ID NO: 4644822 - DNA, 15 bp, Homo sapiens
gcatccagttaacca

SEQ ID NO: 4644823 - DNA, 20 bp, Homo sapiens
gcatcctgcagggcttctcc

SEQ ID NO: 4644824 - DNA, 15 bp, Homo sapiens
gcatctgagggggag

SEQ ID NO: 4644825 - DNA, 13 bp, Homo sapiens
gcatctgatagaa

SEQ ID NO: 4644826 - DNA, 17 bp, Homo sapiens
gcatctgtctgctctgc

SEQ ID NO: 4644827 - DNA, 18 bp, Homo sapiens
gcatctgtctgctctgca

SEQ ID NO: 4644828 - DNA, 21 bp, Homo sapiens
gcatgaataacatttaaattc

SEQ ID NO: 4644829 - DNA, 20 bp, Homo sapiens
gcatgagctgatcagcctgt

SEQ ID NO: 4644830 - DNA, 14 bp, Homo sapiens
gcatgagtctgttt

SEQ ID NO: 4644831 - DNA, 20 bp, Homo sapiens
gcatgatgggaggtgtgcca

SEQ ID NO: 4644832 - DNA, 21 bp, Homo sapiens
gcatgatgggaggtgtgccag

SEQ ID NO: 4644833 - DNA, 14 bp, Homo sapiens
gcatgatgtttccc

SEQ ID NO: 4644834 - DNA, 16 bp, Homo sapiens
gcatgcctgtcctttc

SEQ ID NO: 4644835 - DNA, 20 bp, Homo sapiens
gcatggagtatagtgcaaat

SEQ ID NO: 4644836 - DNA, 16 bp, Homo sapiens
gcatggcatattttaa

SEQ ID NO: 4644837 - DNA, 22 bp, Homo sapiens
gcatggcggcacacatctgtaa

SEQ ID NO: 4644838 - DNA, 15 bp, Homo sapiens
gcatgtctgttcttc

SEQ ID NO: 4644839 - DNA, 14 bp, Homo sapiens
gcatgtcttttaaa

SEQ ID NO: 4644840 - DNA, 12 bp, Homo sapiens
gcatgtgaagaa

SEQ ID NO: 4644841 - DNA, 15 bp, Homo sapiens
gcatgtgactctgaa

SEQ ID NO: 4644842 - DNA, 18 bp, Homo sapiens
gcatgtttaatgtgaact

SEQ ID NO: 4644843 - DNA, 19 bp, Homo sapiens
gcattacttgctttcaatt

SEQ ID NO: 4644844 - DNA, 16 bp, Homo sapiens
gcattatcttgctcat

SEQ ID NO: 4644845 - DNA, 14 bp, Homo sapiens
gcattattctcttt

SEQ ID NO: 4644846 - DNA, 22 bp, Homo sapiens
gcattattctcttttatctgtt

SEQ ID NO: 4644847 - DNA, 15 bp, Homo sapiens
gcattcatttttata

SEQ ID NO: 4644848 - DNA, 20 bp, Homo sapiens
gcattccacactgcagggag

SEQ ID NO: 4644849 - DNA, 20 bp, Homo sapiens
gcattctctcccatcctggg

SEQ ID NO: 4644850 - DNA, 17 bp, Homo sapiens
gcattgacctggagggg

SEQ ID NO: 4644851 - DNA, 21 bp, Homo sapiens
gcattgactttcagtaaacat

SEQ ID NO: 4644852 - DNA, 15 bp, Homo sapiens
gcattgagcatattt

SEQ ID NO: 4644853 - DNA, 16 bp, Homo sapiens
gcattgagcttgcatg

SEQ ID NO: 4644854 - DNA, 12 bp, Homo sapiens
gcattgctttcc

SEQ ID NO: 4644855 - DNA, 20 bp, Homo sapiens
gcattggcatctgcttttaa

SEQ ID NO: 4644856 - DNA, 15 bp, Homo sapiens
gcattgtatcgatgt

SEQ ID NO: 4644857 - DNA, 19 bp, Homo sapiens
gcattgtatcgatgttatg

SEQ ID NO: 4644858 - DNA, 15 bp, Homo sapiens
gcattgtgatgttta

SEQ ID NO: 4644859 - DNA, 16 bp, Homo sapiens
gcatttaaacatgttt

SEQ ID NO: 4644860 - DNA, 14 bp, Homo sapiens
gcatttagcttctt

SEQ ID NO: 4644861 - DNA, 12 bp, Homo sapiens
gcatttcctggg

SEQ ID NO: 4644862 - DNA, 14 bp, Homo sapiens
gcatttctctttaa

SEQ ID NO: 4644863 - DNA, 15 bp, Homo sapiens
gcatttgcacctctg

SEQ ID NO: 4644864 - DNA, 16 bp, Homo sapiens
gcattttattgcttga

SEQ ID NO: 4644865 - DNA, 13 bp, Homo sapiens
gcattttgaaaca

SEQ ID NO: 4644866 - DNA, 17 bp, Homo sapiens
gcatttttgcttcctag

SEQ ID NO: 4644867 - DNA, 15 bp, Homo sapiens
gccaaaatcaagagt

SEQ ID NO: 4644868 - DNA, 18 bp, Homo sapiens
gccaaaccaggaccctgt

SEQ ID NO: 4644869 - DNA, 21 bp, Homo sapiens
gccaaaccaggaccctgtcca

SEQ ID NO: 4644870 - DNA, 15 bp, Homo sapiens
gccaaacctctgttc

SEQ ID NO: 4644871 - DNA, 17 bp, Homo sapiens
gccaaagaaacaagctg

SEQ ID NO: 4644872 - DNA, 21 bp, Homo sapiens
gccaaagaaacaagctgtgca

SEQ ID NO: 4644873 - DNA, 22 bp, Homo sapiens
gccaaatgctctctcaaattgt

SEQ ID NO: 4644874 - DNA, 17 bp, Homo sapiens
gccaacacgcacctgcc

SEQ ID NO: 4644875 - DNA, 22 bp, Homo sapiens
gccaaccagcccgacagtgcca

SEQ ID NO: 4644876 - DNA, 16 bp, Homo sapiens
gccaactattctcagg

SEQ ID NO: 4644877 - DNA, 20 bp, Homo sapiens
gccaactgtttccctgctga

SEQ ID NO: 4644878 - DNA, 14 bp, Homo sapiens
gccaagaatacttg

SEQ ID NO: 4644879 - DNA, 18 bp, Homo sapiens
gccaagatgtacttctct

SEQ ID NO: 4644880 - DNA, 12 bp, Homo sapiens
gccaagcctatc

SEQ ID NO: 4644881 - DNA, 22 bp, Homo sapiens
gccaagctgaggtgcccaggag

SEQ ID NO: 4644882 - DNA, 17 bp, Homo sapiens
gccaaggtggagggaag

SEQ ID NO: 4644883 - DNA, 19 bp, Homo sapiens
gccaagtaaacagggtacc

SEQ ID NO: 4644884 - DNA, 18 bp, Homo sapiens
gccaagtccaggtcctgg

SEQ ID NO: 4644885 - DNA, 17 bp, Homo sapiens
gccaagtgccaaatgct

SEQ ID NO: 4644886 - DNA, 18 bp, Homo sapiens
gccaagtgccaaatgctc

SEQ ID NO: 4644887 - DNA, 19 bp, Homo sapiens
gccaagtgcgtgccgtgtg

SEQ ID NO: 4644888 - DNA, 18 bp, Homo sapiens
gccaatgtcgaaacctac

SEQ ID NO: 4644889 - DNA, 21 bp, Homo sapiens
gccaatgttatgccagctcca

SEQ ID NO: 4644890 - DNA, 22 bp, Homo sapiens
gccaatgttatgccagctccat

SEQ ID NO: 4644891 - DNA, 23 bp, Homo sapiens
gccaatgttatgccagctccatg

SEQ ID NO: 4644892 - DNA, 20 bp, Homo sapiens
gccacacctggccttaaaga

SEQ ID NO: 4644893 - DNA, 19 bp, Homo sapiens
gccacactcagcacaaggc

SEQ ID NO: 4644894 - DNA, 20 bp, Homo sapiens
gccacacttcgctcttgagg

SEQ ID NO: 4644895 - DNA, 17 bp, Homo sapiens
gccacacttctcaggac

SEQ ID NO: 4644896 - DNA, 13 bp, Homo sapiens
gccacagacccct

SEQ ID NO: 4644897 - DNA, 13 bp, Homo sapiens
gccacagccttcc

SEQ ID NO: 4644898 - DNA, 20 bp, Homo sapiens
gccacagccttccctctgca

SEQ ID NO: 4644899 - DNA, 15 bp, Homo sapiens
gccacatcaaagagg

SEQ ID NO: 4644900 - DNA, 14 bp, Homo sapiens
gccaccaccctgcc

SEQ ID NO: 4644901 - DNA, 16 bp, Homo sapiens
gccaccacgctggcca

SEQ ID NO: 4644902 - DNA, 17 bp, Homo sapiens
gccaccccaacctctgt

SEQ ID NO: 4644903 - DNA, 18 bp, Homo sapiens
gccacccccagccctggc

SEQ ID NO: 4644904 - DNA, 20 bp, Homo sapiens
gccacccccagccctggccc

SEQ ID NO: 4644905 - DNA, 17 bp, Homo sapiens
gccaccgcgcctggccg

SEQ ID NO: 4644906 - DNA, 21 bp, Homo sapiens
gccaccggcctgtgggtctct

SEQ ID NO: 4644907 - DNA, 18 bp, Homo sapiens
gccaccgtgcctggctga

SEQ ID NO: 4644908 - DNA, 12 bp, Homo sapiens
gccacctgcaag

SEQ ID NO: 4644909 - DNA, 17 bp, Homo sapiens
gccacctgcaagatgga

SEQ ID NO: 4644910 - DNA, 13 bp, Homo sapiens
gccacggcctggc

SEQ ID NO: 4644911 - DNA, 15 bp, Homo sapiens
gccacggcctggctg

SEQ ID NO: 4644912 - DNA, 21 bp, Homo sapiens
gccacgtcccagcatccctgg

SEQ ID NO: 4644913 - DNA, 22 bp, Homo sapiens
gccacgtcccagcatccctgga

SEQ ID NO: 4644914 - DNA, 18 bp, Homo sapiens
gccactccttcctgcccc

SEQ ID NO: 4644915 - DNA, 13 bp, Homo sapiens
gccactctgttcc

SEQ ID NO: 4644916 - DNA, 23 bp, Homo sapiens
gccactctgttcctggctcagcc

SEQ ID NO: 4644917 - DNA, 23 bp, Homo sapiens
gccactggggactttatttattt

SEQ ID NO: 4644918 - DNA, 15 bp, Homo sapiens
gccacttctggcttc

SEQ ID NO: 4644919 - DNA, 23 bp, Homo sapiens
gccactttcagagcccccagccc

SEQ ID NO: 4644920 - DNA, 16 bp, Homo sapiens
gccagaattctaccct

SEQ ID NO: 4644921 - DNA, 18 bp, Homo sapiens
gccagaccagcaggctgg

SEQ ID NO: 4644922 - DNA, 18 bp, Homo sapiens
gccagacctgcatggtca

SEQ ID NO: 4644923 - DNA, 20 bp, Homo sapiens
gccagactctaggttataca

SEQ ID NO: 4644924 - DNA, 18 bp, Homo sapiens
gccagagcctggggctct

SEQ ID NO: 4644925 - DNA, 22 bp, Homo sapiens
gccagagctacccgcagagttc

SEQ ID NO: 4644926 - DNA, 21 bp, Homo sapiens
gccagaggctcgaggggctca

SEQ ID NO: 4644927 - DNA, 15 bp, Homo sapiens
gccagataaaatgtt

SEQ ID NO: 4644928 - DNA, 16 bp, Homo sapiens
gccagataaaatgttc

SEQ ID NO: 4644929 - DNA, 17 bp, Homo sapiens
gccagataaaatgttca

SEQ ID NO: 4644930 - DNA, 21 bp, Homo sapiens
gccagatgcacatccctggaa

SEQ ID NO: 4644931 - DNA, 22 bp, Homo sapiens
gcctgggggttttccaagccct

SEQ ID NO: 4644932 - DNA, 20 bp, Homo sapiens
gcctgggtaggccccacaag

SEQ ID NO: 4644933 - DNA, 19 bp, Homo sapiens
gcctgggtgatctgctgct

SEQ ID NO: 4644934 - DNA, 14 bp, Homo sapiens
gcctggtattttca

SEQ ID NO: 4644935 - DNA, 15 bp, Homo sapiens
gcctggtattttcaa

SEQ ID NO: 4644936 - DNA, 15 bp, Homo sapiens
gcctggtccctggga

SEQ ID NO: 4644937 - DNA, 10 bp, Homo sapiens
gcctggtctg

SEQ ID NO: 4644938 - DNA, 15 bp, Homo sapiens
gcctgtaatcccagt

SEQ ID NO: 4644939 - DNA, 19 bp, Homo sapiens
gcctgtaatcccagtactt

SEQ ID NO: 4644940 - DNA, 13 bp, Homo sapiens
gcctgtactgcct

SEQ ID NO: 4644941 - DNA, 15 bp, Homo sapiens
gcctgtactgcctgc

SEQ ID NO: 4644942 - DNA, 22 bp, Homo sapiens
gcctgtcctccaacaccaagca

SEQ ID NO: 4644943 - DNA, 18 bp, Homo sapiens
gcctgtgcgtcccagctg

SEQ ID NO: 4644944 - DNA, 22 bp, Homo sapiens
gctactctgtgccagagcctgg

SEQ ID NO: 4644945 - DNA, 18 bp, Homo sapiens
gctacttcggggctggga

SEQ ID NO: 4644946 - DNA, 17 bp, Homo sapiens
gctacttggcaggctga

SEQ ID NO: 4644947 - DNA, 19 bp, Homo sapiens
gctagacagaaacatgtct

SEQ ID NO: 4644948 - DNA, 15 bp, Homo sapiens
gctagactgtgtctg

SEQ ID NO: 4644949 - DNA, 18 bp, Homo sapiens
gctaggagcaaagcctgt

SEQ ID NO: 4644950 - DNA, 17 bp, Homo sapiens
gctaggccccagaggcc

SEQ ID NO: 4644951 - DNA, 19 bp, Homo sapiens
gctaggccccagaggccct

SEQ ID NO: 4644952 - DNA, 16 bp, Homo sapiens
gctagtcgcccctcag

SEQ ID NO: 4644953 - DNA, 13 bp, Homo sapiens
gctatagttgcag

SEQ ID NO: 4644954 - DNA, 19 bp, Homo sapiens
gctatagttgcagcccaag

SEQ ID NO: 4644955 - DNA, 17 bp, Homo sapiens
gctatctggtcaacctc

SEQ ID NO: 4644956 - DNA, 23 bp, Homo sapiens
gctatgtaaacaaaccacagcag

SEQ ID NO: 4644957 - DNA, 18 bp, Homo sapiens
gctatgtagtcataataa

SEQ ID NO: 4644958 - DNA, 20 bp, Homo sapiens
gctatgtagtcataataaat

SEQ ID NO: 4644959 - DNA, 18 bp, Homo sapiens
gctatgttctgtcttccc

SEQ ID NO: 4644960 - DNA, 14 bp, Homo sapiens
gctattgcagaatg

SEQ ID NO: 4644961 - DNA, 14 bp, Homo sapiens
gctatttccttcca

SEQ ID NO: 4644962 - DNA, 18 bp, Homo sapiens
gctatttccttccagcct

SEQ ID NO: 4644963 - DNA, 23 bp, Homo sapiens
gctatttccttccagccttttta

SEQ ID NO: 4644964 - DNA, 11 bp, Homo sapiens
gctatttgaag

SEQ ID NO: 4644965 - DNA, 23 bp, Homo sapiens
gctatttgaagaaaaaaatgtac

SEQ ID NO: 4644966 - DNA, 19 bp, Homo sapiens
gctcacaaggcagcaaggc

SEQ ID NO: 4644967 - DNA, 20 bp, Homo sapiens
gctcacaaggcagcaaggcc

SEQ ID NO: 4644968 - DNA, 21 bp, Homo sapiens
gctcagaggcgcactgtgacc

SEQ ID NO: 4644969 - DNA, 12 bp, Homo sapiens
gctcagcagggc

SEQ ID NO: 4644970 - DNA, 14 bp, Homo sapiens
gctcagccagcact

SEQ ID NO: 4644971 - DNA, 11 bp, Homo sapiens
gctcagccagt

SEQ ID NO: 4644972 - DNA, 17 bp, Homo sapiens
gctcagctctgggccat

SEQ ID NO: 4644973 - DNA, 22 bp, Homo sapiens
gctcaggatatggcttaggaat

SEQ ID NO: 4644974 - DNA, 19 bp, Homo sapiens
gctcagtgcaacctctgct

SEQ ID NO: 4644975 - DNA, 20 bp, Homo sapiens
gctcagtgcaacctctgctt

SEQ ID NO: 4644976 - DNA, 14 bp, Homo sapiens
gctcatgagctcct

SEQ ID NO: 4644977 - DNA, 18 bp, Homo sapiens
gctcatttttgcacttat

SEQ ID NO: 4644978 - DNA, 19 bp, Homo sapiens
gctccaggcctgcagcagg

SEQ ID NO: 4644979 - DNA, 22 bp, Homo sapiens
gctccaggcctgcagcaggagt

SEQ ID NO: 4644980 - DNA, 20 bp, Homo sapiens
gctccatatttgatttctaa

SEQ ID NO: 4644981 - DNA, 19 bp, Homo sapiens
gctccatcctttgtcttgg

SEQ ID NO: 4644982 - DNA, 16 bp, Homo sapiens
gctccattcactccca

SEQ ID NO: 4644983 - DNA, 19 bp, Homo sapiens
gctcccaatggtgcttgga

SEQ ID NO: 4644984 - DNA, 14 bp, Homo sapiens
gctccccactctgc

SEQ ID NO: 4644985 - DNA, 22 bp, Homo sapiens
gctccccactctgctctgatgc

SEQ ID NO: 4644986 - DNA, 13 bp, Homo sapiens
gctcccctgcctt

SEQ ID NO: 4644987 - DNA, 14 bp, Homo sapiens
gctcccctgcctta

SEQ ID NO: 4644988 - DNA, 15 bp, Homo sapiens
gctccctctctcctg

SEQ ID NO: 4644989 - DNA, 12 bp, Homo sapiens
gctccctgcccc

SEQ ID NO: 4644990 - DNA, 12 bp, Homo sapiens
gctccctggggg

SEQ ID NO: 4644991 - DNA, 21 bp, Homo sapiens
gctccctgtgtccacctgtgg

SEQ ID NO: 4644992 - DNA, 17 bp, Homo sapiens
gctcctctgtctcgagc

SEQ ID NO: 4644993 - DNA, 23 bp, Homo sapiens
gctcctctgtctcgagcgccctg

SEQ ID NO: 4644994 - DNA, 22 bp, Homo sapiens
gctcctgaaagaaacgctagaa

SEQ ID NO: 4644995 - DNA, 19 bp, Homo sapiens
gctccttcagttctgcttg

SEQ ID NO: 4644996 - DNA, 21 bp, Homo sapiens
gctcctttctgtcctggagct

SEQ ID NO: 4644997 - DNA, 18 bp, Homo sapiens
gctcggacttactgcctg

SEQ ID NO: 4644998 - DNA, 15 bp, Homo sapiens
gctcggaggaagccc

SEQ ID NO: 4644999 - DNA, 20 bp, Homo sapiens
gctcggggtgcacaggaggg

SEQ ID NO: 4645000 - DNA, 16 bp, Homo sapiens
gctctaacgcctgagc

SEQ ID NO: 4645001 - DNA, 23 bp, Homo sapiens
gctctaacgcctgagcccaggga

SEQ ID NO: 4645002 - DNA, 13 bp, Homo sapiens
gctctaagcccag

SEQ ID NO: 4645003 - DNA, 17 bp, Homo sapiens
gctctaaggtactgtgg

SEQ ID NO: 4645004 - DNA, 20 bp, Homo sapiens
gctctaaggtactgtggggt

SEQ ID NO: 4645005 - DNA, 13 bp, Homo sapiens
gctctacaggcct

SEQ ID NO: 4645006 - DNA, 14 bp, Homo sapiens
gctctacaggcctg

SEQ ID NO: 4645007 - DNA, 17 bp, Homo sapiens
gctctacaggcctgcag

SEQ ID NO: 4645008 - DNA, 20 bp, Homo sapiens
gctctacaggcctgcagccc

SEQ ID NO: 4645009 - DNA, 22 bp, Homo sapiens
gctctagggactgccaggctgt

SEQ ID NO: 4645010 - DNA, 15 bp, Homo sapiens
gctctagtgggacag

SEQ ID NO: 4645011 - DNA, 21 bp, Homo sapiens
gctctagtgggacagcccaga

SEQ ID NO: 4645012 - DNA, 19 bp, Homo sapiens
gctctatcgcccaggctgg

SEQ ID NO: 4645013 - DNA, 16 bp, Homo sapiens
gctctatgtttgtatt

SEQ ID NO: 4645014 - DNA, 12 bp, Homo sapiens
gctctcctggct

SEQ ID NO: 4645015 - DNA, 13 bp, Homo sapiens
gctctcctggctt

SEQ ID NO: 4645016 - DNA, 22 bp, Homo sapiens
gctctcgaccggccctgcattc

SEQ ID NO: 4645017 - DNA, 18 bp, Homo sapiens
gctctgaaatcaactctc

SEQ ID NO: 4645018 - DNA, 16 bp, Homo sapiens
gctctgaacttccaag

SEQ ID NO: 4645019 - DNA, 21 bp, Homo sapiens
gctctgaaggtccaaagagtt

SEQ ID NO: 4645020 - DNA, 18 bp, Homo sapiens
gctctgagaggccctgga

SEQ ID NO: 4645021 - DNA, 20 bp, Homo sapiens
gctctgagaggccctggatc

SEQ ID NO: 4645022 - DNA, 23 bp, Homo sapiens
gctctgaggcgccccaacccgtg

SEQ ID NO: 4645023 - DNA, 17 bp, Homo sapiens
gctctgcacagacaagc

SEQ ID NO: 4645024 - DNA, 20 bp, Homo sapiens
gctctgcagcattgaagtat

SEQ ID NO: 4645025 - DNA, 21 bp, Homo sapiens
gctctgcatatatgtctcttt

SEQ ID NO: 4645026 - DNA, 14 bp, Homo sapiens
gctctggactccac

SEQ ID NO: 4645027 - DNA, 11 bp, Homo sapiens
gctctggagaa

SEQ ID NO: 4645028 - DNA, 15 bp, Homo sapiens
gctctggagaacagt

SEQ ID NO: 4645029 - DNA, 17 bp, Homo sapiens
gctctgttacccagggt

SEQ ID NO: 4645030 - DNA, 23 bp, Homo sapiens
gctcttagactcgcctatcttag

SEQ ID NO: 4645031 - DNA, 19 bp, Homo sapiens
gctcttgaaatattcagaa

SEQ ID NO: 4645032 - DNA, 15 bp, Homo sapiens
gctcttgaggagctc

SEQ ID NO: 4645033 - DNA, 19 bp, Homo sapiens
gctctttattgcagaatgt

SEQ ID NO: 4645034 - DNA, 22 bp, Homo sapiens
gctctttccacttgccctgtgt

SEQ ID NO: 4645035 - DNA, 23 bp, Homo sapiens
gctctttccacttgccctgtgtt

SEQ ID NO: 4645036 - DNA, 21 bp, Homo sapiens
gctcttttttgtttgtttctt

SEQ ID NO: 4645037 - DNA, 17 bp, Homo sapiens
gctgaaaagggcactcc

SEQ ID NO: 4645038 - DNA, 14 bp, Homo sapiens
gctgaagagaggga

SEQ ID NO: 4645039 - DNA, 16 bp, Homo sapiens
gctgaagagagggaca

SEQ ID NO: 4645040 - DNA, 18 bp, Homo sapiens
gctgaagatggcatcctg

SEQ ID NO: 4645041 - DNA, 18 bp, Homo sapiens
gctgaaggcagtggcagg

SEQ ID NO: 4645042 - DNA, 17 bp, Homo sapiens
gctgaataacctgcaca

SEQ ID NO: 4645043 - DNA, 23 bp, Homo sapiens
gctgaataacctgcacaggcttg

SEQ ID NO: 4645044 - DNA, 19 bp, Homo sapiens
gctgaatgcctcctgtggg

SEQ ID NO: 4645045 - DNA, 13 bp, Homo sapiens
gctgacagacact

SEQ ID NO: 4645046 - DNA, 21 bp, Homo sapiens
gctgacatgaagctgttgtgt

SEQ ID NO: 4645047 - DNA, 17 bp, Homo sapiens
gctgacattcacctgcc

SEQ ID NO: 4645048 - DNA, 12 bp, Homo sapiens
gctgaccagaca

SEQ ID NO: 4645049 - DNA, 15 bp, Homo sapiens
gctgacgaacttcca

SEQ ID NO: 4645050 - DNA, 17 bp, Homo sapiens
gctgacgaacttccatg

SEQ ID NO: 4645051 - DNA, 17 bp, Homo sapiens
gctgacggtgcagtctg

SEQ ID NO: 4645052 - DNA, 14 bp, Homo sapiens
gctgactgaatgca

SEQ ID NO: 4645053 - DNA, 20 bp, Homo sapiens
gctgttcacagcttttcttg

SEQ ID NO: 4645054 - DNA, 22 bp, Homo sapiens
gctgttcacagcttttcttgat

SEQ ID NO: 4645055 - DNA, 21 bp, Homo sapiens
gctgttcctgttcagtaataa

SEQ ID NO: 4645056 - DNA, 12 bp, Homo sapiens
gctgtttctaag

SEQ ID NO: 4645057 - DNA, 19 bp, Homo sapiens
gctgttttattactgtttc

SEQ ID NO: 4645058 - DNA, 15 bp, Homo sapiens
gcttaatcattttca

SEQ ID NO: 4645059 - DNA, 16 bp, Homo sapiens
gcttaatcattttcat

SEQ ID NO: 4645060 - DNA, 21 bp, Homo sapiens
gcttaatcattttcattccta

SEQ ID NO: 4645061 - DNA, 15 bp, Homo sapiens
gcttacggccctggc

SEQ ID NO: 4645062 - DNA, 19 bp, Homo sapiens
gcttacggccctggccttg

SEQ ID NO: 4645063 - DNA, 19 bp, Homo sapiens
gcttagaggttctgcctct

SEQ ID NO: 4645064 - DNA, 18 bp, Homo sapiens
gcttatcaactaatgatt

SEQ ID NO: 4645065 - DNA, 22 bp, Homo sapiens
gcttatgacagaggttttgaaa

SEQ ID NO: 4645066 - DNA, 18 bp, Homo sapiens
gcttatgagatctaatgt

SEQ ID NO: 4645067 - DNA, 21 bp, Homo sapiens
gcttatgagatctaatgtgaa

SEQ ID NO: 4645068 - DNA, 21 bp, Homo sapiens
gcttatgtagctttttattat

SEQ ID NO: 4645069 - DNA, 14 bp, Homo sapiens
gcttattcttaact

SEQ ID NO: 4645070 - DNA, 16 bp, Homo sapiens
gcttcactcctgctgt

SEQ ID NO: 4645071 - DNA, 17 bp, Homo sapiens
gcttcactcctgctgta

SEQ ID NO: 4645072 - DNA, 18 bp, Homo sapiens
gcttcactcctgctgtaa

SEQ ID NO: 4645073 - DNA, 18 bp, Homo sapiens
gcttcagcccccaccagg

SEQ ID NO: 4645074 - DNA, 17 bp, Homo sapiens
gcttcagtaacaagtgt

SEQ ID NO: 4645075 - DNA, 19 bp, Homo sapiens
gagcagctccaccactgtg

SEQ ID NO: 4645076 - DNA, 22 bp, Homo sapiens
gagcagctccaccactgtgcac

SEQ ID NO: 4645077 - DNA, 23 bp, Homo sapiens
gagcagctgaataacctgcacag

SEQ ID NO: 4645078 - DNA, 14 bp, Homo sapiens
gagcagctgagcag

SEQ ID NO: 4645079 - DNA, 19 bp, Homo sapiens
gagcagctgagcagggccg

SEQ ID NO: 4645080 - DNA, 16 bp, Homo sapiens
gagcaggaggtgcctg

SEQ ID NO: 4645081 - DNA, 16 bp, Homo sapiens
gagcagggccggggaa

SEQ ID NO: 4645082 - DNA, 21 bp, Homo sapiens
gagcaggttccccaagggccc

SEQ ID NO: 4645083 - DNA, 22 bp, Homo sapiens
gagcaggttccccaagggccct

SEQ ID NO: 4645084 - DNA, 17 bp, Homo sapiens
gagcagtaatgcagcat

SEQ ID NO: 4645085 - DNA, 18 bp, Homo sapiens
gagcagtcactgggagag

SEQ ID NO: 4645086 - DNA, 14 bp, Homo sapiens
gagcatcatgcctc

SEQ ID NO: 4645087 - DNA, 17 bp, Homo sapiens
gagcatgaaatttttaa

SEQ ID NO: 4645088 - DNA, 16 bp, Homo sapiens
gacatccataaagaag

SEQ ID NO: 4645089 - DNA, 16 bp, Homo sapiens
gacatctctttgaatt

SEQ ID NO: 4645090 - DNA, 23 bp, Homo sapiens
gacatgagatcagggcctgcccc

SEQ ID NO: 4645091 - DNA, 23 bp, Homo sapiens
gacatgcggtagccagcacacag

SEQ ID NO: 4645092 - DNA, 21 bp, Homo sapiens
gacatgtagcttcttctgaaa

SEQ ID NO: 4645093 - DNA, 16 bp, Homo sapiens
gacattcacctgcccc

SEQ ID NO: 4645094 - DNA, 21 bp, Homo sapiens
gacattcacctgccccaactc

SEQ ID NO: 4645095 - DNA, 13 bp, Homo sapiens
gacattctaatgc

SEQ ID NO: 4645096 - DNA, 13 bp, Homo sapiens
gacattctcacat

SEQ ID NO: 4645097 - DNA, 16 bp, Homo sapiens
gacattcttttaatgc

SEQ ID NO: 4645098 - DNA, 11 bp, Homo sapiens
gacatttccca

SEQ ID NO: 4645099 - DNA, 17 bp, Homo sapiens
gaccaatattgtacagt

SEQ ID NO: 4645100 - DNA, 14 bp, Homo sapiens
gaccacagcacagc

SEQ ID NO: 4645101 - DNA, 16 bp, Homo sapiens
gaccacagcacagcca

SEQ ID NO: 4645102 - DNA, 21 bp, Homo sapiens
gaccacccctctcgcctcatt

SEQ ID NO: 4645103 - DNA, 22 bp, Homo sapiens
gaccacccctctcgcctcatta

SEQ ID NO: 4645104 - DNA, 21 bp, Homo sapiens
gaccacctcctctgccagcag

SEQ ID NO: 4645105 - DNA, 13 bp, Homo sapiens
gaccaccttccct

SEQ ID NO: 4645106 - DNA, 13 bp, Homo sapiens
gaccaggatggag

SEQ ID NO: 4645107 - DNA, 20 bp, Homo sapiens
gaccaggatggagcaagctc

SEQ ID NO: 4645108 - DNA, 24 bp, Homo sapiens
gaccaggatggagcaagctcttcc

SEQ ID NO: 4645109 - DNA, 22 bp, Homo sapiens
gaccagggatgctgggctgggc

SEQ ID NO: 4645110 - DNA, 15 bp, Homo sapiens
gaccagggctgctct

SEQ ID NO: 4645111 - DNA, 18 bp, Homo sapiens
gaccattgagtccctgct

SEQ ID NO: 4645112 - DNA, 15 bp, Homo sapiens
gaccatttgtagtga

SEQ ID NO: 4645113 - DNA, 13 bp, Homo sapiens
gacccacctgcta

SEQ ID NO: 4645114 - DNA, 15 bp, Homo sapiens
gacccagcatctccc

SEQ ID NO: 4645115 - DNA, 19 bp, Homo sapiens
gacccagccccttcccctg

SEQ ID NO: 4645116 - DNA, 21 bp, Homo sapiens
gacccagccccttcccctggg

SEQ ID NO: 4645117 - DNA, 12 bp, Homo sapiens
gacccagccctc

SEQ ID NO: 4645118 - DNA, 13 bp, Homo sapiens
gacccatctctcc

SEQ ID NO: 4645119 - DNA, 11 bp, Homo sapiens
gaccccagctg

SEQ ID NO: 4645120 - DNA, 15 bp, Homo sapiens
gaccccagctgctct

SEQ ID NO: 4645121 - DNA, 16 bp, Homo sapiens
gaccccagggcacagg

SEQ ID NO: 4645122 - DNA, 17 bp, Homo sapiens
gaccccagggcacagga

SEQ ID NO: 4645123 - DNA, 21 bp, Homo sapiens
gaccccagggcacaggagcta

SEQ ID NO: 4645124 - DNA, 20 bp, Homo sapiens
gaccccagtcgtgatgtgga

SEQ ID NO: 4645125 - DNA, 15 bp, Homo sapiens
gaccccagtgcctgc

SEQ ID NO: 4645126 - DNA, 20 bp, Homo sapiens
gaccccgcacccggctcgtg

SEQ ID NO: 4645127 - DNA, 18 bp, Homo sapiens
gacccctggccacagcct

SEQ ID NO: 4645128 - DNA, 21 bp, Homo sapiens
gacccctggccacagccttcc

SEQ ID NO: 4645129 - DNA, 14 bp, Homo sapiens
gacccctgggagct

SEQ ID NO: 4645130 - DNA, 20 bp, Homo sapiens
gaccccttaatcttgctttc

SEQ ID NO: 4645131 - DNA, 18 bp, Homo sapiens
gaccctatgggtctagga

SEQ ID NO: 4645132 - DNA, 16 bp, Homo sapiens
gaccctcgggccccat

SEQ ID NO: 4645133 - DNA, 20 bp, Homo sapiens
gaccctgcaaacagaacagg

SEQ ID NO: 4645134 - DNA, 22 bp, Homo sapiens
gaccctgcaaacagaacagggt

SEQ ID NO: 4645135 - DNA, 11 bp, Homo sapiens
gaccctgcctc

SEQ ID NO: 4645136 - DNA, 19 bp, Homo sapiens
gaccctgtcccctagggac

SEQ ID NO: 4645137 - DNA, 20 bp, Homo sapiens
gacccttacagcctctgact

SEQ ID NO: 4645138 - DNA, 17 bp, Homo sapiens
gacccttttgtgtctat

SEQ ID NO: 4645139 - DNA, 12 bp, Homo sapiens
gaccgggccagg

SEQ ID NO: 4645140 - DNA, 16 bp, Homo sapiens
gaccggttcccacaag

SEQ ID NO: 4645141 - DNA, 17 bp, Homo sapiens
gacctaaagcaagcctg

SEQ ID NO: 4645142 - DNA, 16 bp, Homo sapiens
gacctaacctaggagg

SEQ ID NO: 4645143 - DNA, 13 bp, Homo sapiens
gacctaatatcat

SEQ ID NO: 4645144 - DNA, 19 bp, Homo sapiens
gacctaatatcattttatt

SEQ ID NO: 4645145 - DNA, 15 bp, Homo sapiens
gacctcatctgtgga

SEQ ID NO: 4645146 - DNA, 19 bp, Homo sapiens
gacctcatctgtggagctg

SEQ ID NO: 4645147 - DNA, 20 bp, Homo sapiens
gacctcatctgtggagctgc

SEQ ID NO: 4645148 - DNA, 16 bp, Homo sapiens
gacctccagctttcct

SEQ ID NO: 4645149 - DNA, 14 bp, Homo sapiens
gacctccccagccc

SEQ ID NO: 4645150 - DNA, 15 bp, Homo sapiens
gacctccccagccca

SEQ ID NO: 4645151 - DNA, 16 bp, Homo sapiens
gacctccccagcccag

SEQ ID NO: 4645152 - DNA, 17 bp, Homo sapiens
gacctccccagcccagg

SEQ ID NO: 4645153 - DNA, 12 bp, Homo sapiens
gacctgagcctg

SEQ ID NO: 4645154 - DNA, 16 bp, Homo sapiens
gacctgagcctgccga

SEQ ID NO: 4645155 - DNA, 17 bp, Homo sapiens
gacctgcagacgcccag

SEQ ID NO: 4645156 - DNA, 13 bp, Homo sapiens
gacctgctgagct

SEQ ID NO: 4645157 - DNA, 19 bp, Homo sapiens
gacctgctgagctctgaga

SEQ ID NO: 4645158 - DNA, 15 bp, Homo sapiens
gacctgtgagcccag

SEQ ID NO: 4645159 - DNA, 23 bp, Homo sapiens
gacctgtgagcccagctgggtca

SEQ ID NO: 4645160 - DNA, 18 bp, Homo sapiens
gacctgttagcagacagg

SEQ ID NO: 4645161 - DNA, 13 bp, Homo sapiens
gaccttgatgagc

SEQ ID NO: 4645162 - DNA, 14 bp, Homo sapiens
gaccttgatgagct

SEQ ID NO: 4645163 - DNA, 15 bp, Homo sapiens
gaccttgatgagctg

SEQ ID NO: 4645164 - DNA, 19 bp, Homo sapiens
gacgagacaacagcacaca

SEQ ID NO: 4645165 - DNA, 12 bp, Homo sapiens
gacgaggggcag

SEQ ID NO: 4645166 - DNA, 19 bp, Homo sapiens
gacgcacacagctgagcac

SEQ ID NO: 4645167 - DNA, 17 bp, Homo sapiens
gacgccacggagggctg

SEQ ID NO: 4645168 - DNA, 14 bp, Homo sapiens
gacggctggcatgg

SEQ ID NO: 4645169 - DNA, 13 bp, Homo sapiens
gacgggaggggag

SEQ ID NO: 4645170 - DNA, 17 bp, Homo sapiens
gacgggaggggaggcat

SEQ ID NO: 4645171 - DNA, 16 bp, Homo sapiens
gacgtgattttgctgt

SEQ ID NO: 4645172 - DNA, 12 bp, Homo sapiens
gacgtggctcag

SEQ ID NO: 4645173 - DNA, 15 bp, Homo sapiens
gacgtggctcagcca

SEQ ID NO: 4645174 - DNA, 21 bp, Homo sapiens
gacgtggtctagaccagggct

SEQ ID NO: 4645175 - DNA, 23 bp, Homo sapiens
gactaacactcagaagcctgggg

SEQ ID NO: 4645176 - DNA, 18 bp, Homo sapiens
gactaattttacatgttt

SEQ ID NO: 4645177 - DNA, 14 bp, Homo sapiens
gactactattttct

SEQ ID NO: 4645178 - DNA, 20 bp, Homo sapiens
gactacttgggagcaccgcc

SEQ ID NO: 4645179 - DNA, 12 bp, Homo sapiens
gactagccagaa

SEQ ID NO: 4645180 - DNA, 23 bp, Homo sapiens
gactaggttagcatcctgcccga

SEQ ID NO: 4645181 - DNA, 18 bp, Homo sapiens
gactcagggaccggtgct

SEQ ID NO: 4645182 - DNA, 19 bp, Homo sapiens
gactcagttttttgtaact

SEQ ID NO: 4645183 - DNA, 13 bp, Homo sapiens
gactcatccttgc

SEQ ID NO: 4645184 - DNA, 19 bp, Homo sapiens
gactcctcagtccctcttc

SEQ ID NO: 4645185 - DNA, 19 bp, Homo sapiens
gactcctgaggacagctgt

SEQ ID NO: 4645186 - DNA, 21 bp, Homo sapiens
gactcctgaggacagctgtcc

SEQ ID NO: 4645187 - DNA, 12 bp, Homo sapiens
gactcctgctgg

SEQ ID NO: 4645188 - DNA, 19 bp, Homo sapiens
gactcctgctggtacctgc

SEQ ID NO: 4645189 - DNA, 14 bp, Homo sapiens
gactctaggttata

SEQ ID NO: 4645190 - DNA, 22 bp, Homo sapiens
gactctaggttatacaataacc

SEQ ID NO: 4645191 - DNA, 12 bp, Homo sapiens
gactctgcacat

SEQ ID NO: 4645192 - DNA, 14 bp, Homo sapiens
gactctgcacatga

SEQ ID NO: 4645193 - DNA, 20 bp, Homo sapiens
gactctgcacatgtcttgta

SEQ ID NO: 4645194 - DNA, 16 bp, Homo sapiens
gactctggccctggcc

SEQ ID NO: 4645195 - DNA, 18 bp, Homo sapiens
gactctggccctggccct

SEQ ID NO: 4645196 - DNA, 21 bp, Homo sapiens
gactctttaataaattgctta

SEQ ID NO: 4645197 - DNA, 23 bp, Homo sapiens
gactgaaaggtgtgaacagcttt

SEQ ID NO: 4645198 - DNA, 21 bp, Homo sapiens
gactgaccaatattgtacagt

SEQ ID NO: 4645199 - DNA, 13 bp, Homo sapiens
gactgagggcagt

SEQ ID NO: 4645200 - DNA, 14 bp, Homo sapiens
gagtttccttttct

SEQ ID NO: 4645201 - DNA, 21 bp, Homo sapiens
gataaagaaactgaggcccac

SEQ ID NO: 4645202 - DNA, 16 bp, Homo sapiens
gataaataactttttt

SEQ ID NO: 4645203 - DNA, 18 bp, Homo sapiens
gataacctaataattgta

SEQ ID NO: 4645204 - DNA, 12 bp, Homo sapiens
gataataatggg

SEQ ID NO: 4645205 - DNA, 22 bp, Homo sapiens
gataatttaaaatccattttag

SEQ ID NO: 4645206 - DNA, 12 bp, Homo sapiens
gataatttgaaa

SEQ ID NO: 4645207 - DNA, 17 bp, Homo sapiens
gatacatccaaagcaga

SEQ ID NO: 4645208 - DNA, 23 bp, Homo sapiens
gatacatccaaagcagacagctc

SEQ ID NO: 4645209 - DNA, 19 bp, Homo sapiens
gcacaatcactaaacttta

SEQ ID NO: 4645210 - DNA, 18 bp, Homo sapiens
gcacacacggttttggca

SEQ ID NO: 4645211 - DNA, 22 bp, Homo sapiens
gcacacagctgagcacttagca

SEQ ID NO: 4645212 - DNA, 23 bp, Homo sapiens
gcacacagctgagcacttagcag

SEQ ID NO: 4645213 - DNA, 18 bp, Homo sapiens
gcacacaggcagccagcc

SEQ ID NO: 4645214 - DNA, 13 bp, Homo sapiens
gcacacagggcag

SEQ ID NO: 4645215 - DNA, 13 bp, Homo sapiens
gcacacattattt

SEQ ID NO: 4645216 - DNA, 15 bp, Homo sapiens
gcacaccaaggccct

SEQ ID NO: 4645217 - DNA, 18 bp, Homo sapiens
gcacaccaaggccctgca

SEQ ID NO: 4645218 - DNA, 22 bp, Homo sapiens
gcacaccaaggccctgcatctg

SEQ ID NO: 4645219 - DNA, 11 bp, Homo sapiens
gcacagaacag

SEQ ID NO: 4645220 - DNA, 12 bp, Homo sapiens
gcacagaacagg

SEQ ID NO: 4645221 - DNA, 13 bp, Homo sapiens
gcacagaagagga

SEQ ID NO: 4645222 - DNA, 13 bp, Homo sapiens
gcacagctaacca

SEQ ID NO: 4645223 - DNA, 17 bp, Homo sapiens
gcacagctcctgccagg

SEQ ID NO: 4645224 - DNA, 13 bp, Homo sapiens
gcacagctgtttg

SEQ ID NO: 4645225 - DNA, 15 bp, Homo sapiens
gcacaggagctacct

SEQ ID NO: 4645226 - DNA, 22 bp, Homo sapiens
gcacaggagggggtcgtggaga

SEQ ID NO: 4645227 - DNA, 23 bp, Homo sapiens
gcacaggagggggtcgtggagag

SEQ ID NO: 4645228 - DNA, 18 bp, Homo sapiens
gcacagtgggagctgagc

SEQ ID NO: 4645229 - DNA, 21 bp, Homo sapiens
gcacagtgggagctgagctgg

SEQ ID NO: 4645230 - DNA, 19 bp, Homo sapiens
gcacatccaggcaatggcc

SEQ ID NO: 4645231 - DNA, 16 bp, Homo sapiens
gcacatgaaaaatttt

SEQ ID NO: 4645232 - DNA, 20 bp, Homo sapiens
gcaccaagggacaggagaag

SEQ ID NO: 4645233 - DNA, 21 bp, Homo sapiens
gcacccccacaagctgtccct

SEQ ID NO: 4645234 - DNA, 23 bp, Homo sapiens
gcacccccacaagctgtccctgc

SEQ ID NO: 4645235 - DNA, 12 bp, Homo sapiens
gcacccccagcc

SEQ ID NO: 4645236 - DNA, 23 bp, Homo sapiens
gcacccccagcctgggcctatgg

SEQ ID NO: 4645237 - DNA, 13 bp, Homo sapiens
gcaccccctgcag

SEQ ID NO: 4645238 - DNA, 15 bp, Homo sapiens
gcaccccctgcagct

SEQ ID NO: 4645239 - DNA, 13 bp, Homo sapiens
gcacccggctcgt

SEQ ID NO: 4645240 - DNA, 16 bp, Homo sapiens
gcaccctccctagctc

SEQ ID NO: 4645241 - DNA, 20 bp, Homo sapiens
gcaccgaggttgcattctag

SEQ ID NO: 4645242 - DNA, 14 bp, Homo sapiens
gcaccgttctgtgc

SEQ ID NO: 4645243 - DNA, 18 bp, Homo sapiens
gcacctacagtgtacagt

SEQ ID NO: 4645244 - DNA, 19 bp, Homo sapiens
gcacctacagtgtacagtc

SEQ ID NO: 4645245 - DNA, 16 bp, Homo sapiens
gcacctccaggcctgt

SEQ ID NO: 4645246 - DNA, 20 bp, Homo sapiens
gcacctccaggcctgttgct

SEQ ID NO: 4645247 - DNA, 15 bp, Homo sapiens
gcacctctgttcatt

SEQ ID NO: 4645248 - DNA, 17 bp, Homo sapiens
gcacctctgttcatttc

SEQ ID NO: 4645249 - DNA, 22 bp, Homo sapiens
gcacctgggccctggggcctgt

SEQ ID NO: 4645250 - DNA, 22 bp, Homo sapiens
gcacctgtctggattgttttta

SEQ ID NO: 4645251 - DNA, 20 bp, Homo sapiens
gcaccttcactctccagggt

SEQ ID NO: 4645252 - DNA, 20 bp, Homo sapiens
gcaccttgtgtctgtacacg

SEQ ID NO: 4645253 - DNA, 20 bp, Homo sapiens
gcactccagggaagatttta

SEQ ID NO: 4645254 - DNA, 13 bp, Homo sapiens
gcactcccaaccc

SEQ ID NO: 4645255 - DNA, 15 bp, Homo sapiens
gcactcccaaccctg

SEQ ID NO: 4645256 - DNA, 18 bp, Homo sapiens
gcactccgcgccgatgcc

SEQ ID NO: 4645257 - DNA, 22 bp, Homo sapiens
gcactccgcgccgatgccaccg

SEQ ID NO: 4645258 - DNA, 20 bp, Homo sapiens
gcactgatgttgtgttttta

SEQ ID NO: 4645259 - DNA, 13 bp, Homo sapiens
gcactgccaggag

SEQ ID NO: 4645260 - DNA, 15 bp, Homo sapiens
gcactgccaggaggg

SEQ ID NO: 4645261 - DNA, 17 bp, Homo sapiens
gcactgccaggagggac

SEQ ID NO: 4645262 - DNA, 18 bp, Homo sapiens
gcactgccaggagggaca

SEQ ID NO: 4645263 - DNA, 23 bp, Homo sapiens
gcactgccaggagggacaaagga

SEQ ID NO: 4645264 - DNA, 16 bp, Homo sapiens
gcactgcctctcacag

SEQ ID NO: 4645265 - DNA, 21 bp, Homo sapiens
gcactgcgcgctatcccctca

SEQ ID NO: 4645266 - DNA, 22 bp, Homo sapiens
gcactggtaggttgggacacca

SEQ ID NO: 4645267 - DNA, 15 bp, Homo sapiens
gcactgttcaatact

SEQ ID NO: 4645268 - DNA, 21 bp, Homo sapiens
gcacttaatttgtaaacttct

SEQ ID NO: 4645269 - DNA, 23 bp, Homo sapiens
gcacttaatttgtaaacttctga

SEQ ID NO: 4645270 - DNA, 18 bp, Homo sapiens
gcacttagacctgccagc

SEQ ID NO: 4645271 - DNA, 13 bp, Homo sapiens
gcacttagccatg

SEQ ID NO: 4645272 - DNA, 18 bp, Homo sapiens
gcacttagccatgatggc

SEQ ID NO: 4645273 - DNA, 23 bp, Homo sapiens
gcacttccacctccagcctctgg

SEQ ID NO: 4645274 - DNA, 16 bp, Homo sapiens
gcacttgtccagctga

SEQ ID NO: 4645275 - DNA, 15 bp, Homo sapiens
gcactttccaatgcc

SEQ ID NO: 4645276 - DNA, 16 bp, Homo sapiens
gcactttccaatgcca

SEQ ID NO: 4645277 - DNA, 18 bp, Homo sapiens
gcactttcctttcaataa

SEQ ID NO: 4645278 - DNA, 20 bp, Homo sapiens
gcactttcctttcaataaag

SEQ ID NO: 4645279 - DNA, 13 bp, Homo sapiens
gcactttctcggt

SEQ ID NO: 4645280 - DNA, 21 bp, Homo sapiens
gcactttctcggtccactctt

SEQ ID NO: 4645281 - DNA, 14 bp, Homo sapiens
gcacttttagaaat

SEQ ID NO: 4645282 - DNA, 17 bp, Homo sapiens
gcagaaatagttgtctg

SEQ ID NO: 4645283 - DNA, 19 bp, Homo sapiens
gcagaacccaccaaccaga

SEQ ID NO: 4645284 - DNA, 18 bp, Homo sapiens
gcagaagacgggagggga

SEQ ID NO: 4645285 - DNA, 23 bp, Homo sapiens
gcagaagacgggaggggaggcat

SEQ ID NO: 4645286 - DNA, 21 bp, Homo sapiens
gcagaaggaaagaagggggcc

SEQ ID NO: 4645287 - DNA, 22 bp, Homo sapiens
gcagaaggaaagaagggggccc

SEQ ID NO: 4645288 - DNA, 23 bp, Homo sapiens
gcagaaggaaagaagggggccct

SEQ ID NO: 4645289 - DNA, 19 bp, Homo sapiens
gcagaatgttgtacttgaa

SEQ ID NO: 4645290 - DNA, 20 bp, Homo sapiens
gcagacagaagtctcctcaa

SEQ ID NO: 4645291 - DNA, 20 bp, Homo sapiens
gcagacagcaggcagcgcca

SEQ ID NO: 4645292 - DNA, 14 bp, Homo sapiens
gcagaccctgccct

SEQ ID NO: 4645293 - DNA, 15 bp, Homo sapiens
gcagaccctgccctt

SEQ ID NO: 4645294 - DNA, 21 bp, Homo sapiens
gcagacctgtcaccctgcagg

SEQ ID NO: 4645295 - DNA, 13 bp, Homo sapiens
gcagacgcccaga

SEQ ID NO: 4645296 - DNA, 22 bp, Homo sapiens
gcagactgtgaacttgactggg

SEQ ID NO: 4645297 - DNA, 20 bp, Homo sapiens
gcagagatcgacagacagcc

SEQ ID NO: 4645298 - DNA, 14 bp, Homo sapiens
gcagagcagacagg

SEQ ID NO: 4645299 - DNA, 16 bp, Homo sapiens
gcagagcagacaggct

SEQ ID NO: 4645300 - DNA, 19 bp, Homo sapiens
gcagagctctacaggcctg

SEQ ID NO: 4645301 - DNA, 20 bp, Homo sapiens
gcagagctctacaggcctgc

SEQ ID NO: 4645302 - DNA, 18 bp, Homo sapiens
gcagaggaatgtgggcta

SEQ ID NO: 4645303 - DNA, 18 bp, Homo sapiens
gcagagtaaattgctctg

SEQ ID NO: 4645304 - DNA, 16 bp, Homo sapiens
gcagatgcccttgctg

SEQ ID NO: 4645305 - DNA, 17 bp, Homo sapiens
gcagatgcccttgctgg

SEQ ID NO: 4645306 - DNA, 20 bp, Homo sapiens
gcagatgcccttgctgggcc

SEQ ID NO: 4645307 - DNA, 17 bp, Homo sapiens
gcagatggaaaggagcc

SEQ ID NO: 4645308 - DNA, 13 bp, Homo sapiens
gcagatgtaggag

SEQ ID NO: 4645309 - DNA, 16 bp, Homo sapiens
gcagcaaacactccac

SEQ ID NO: 4645310 - DNA, 22 bp, Homo sapiens
gcagcaaacactccaccctcca

SEQ ID NO: 4645311 - DNA, 14 bp, Homo sapiens
gcagcaaattttca

SEQ ID NO: 4645312 - DNA, 13 bp, Homo sapiens
gcagcactcccca

SEQ ID NO: 4645313 - DNA, 16 bp, Homo sapiens
gcagcactccccagag

SEQ ID NO: 4645314 - DNA, 21 bp, Homo sapiens
gcagcactccccagagctgtg

SEQ ID NO: 4645315 - DNA, 16 bp, Homo sapiens
gcagcacttagacctg

SEQ ID NO: 4645316 - DNA, 17 bp, Homo sapiens
gcagcacttagacctgc

SEQ ID NO: 4645317 - DNA, 22 bp, Homo sapiens
gcagcagcacttagacctgcca

SEQ ID NO: 4645318 - DNA, 11 bp, Homo sapiens
gcagcagccag

SEQ ID NO: 4645319 - DNA, 19 bp, Homo sapiens
gcagcagccagccctgcct

SEQ ID NO: 4645320 - DNA, 23 bp, Homo sapiens
gcagcaggaggctttctgggctc

SEQ ID NO: 4645321 - DNA, 18 bp, Homo sapiens
gcagcatgcttgggctga

SEQ ID NO: 4645322 - DNA, 20 bp, Homo sapiens
gcagcatgcttgggctgacc

SEQ ID NO: 4645323 - DNA, 14 bp, Homo sapiens
gcagcattgaagta

SEQ ID NO: 4645324 - DNA, 21 bp, Homo sapiens
gcagccacacttctcaggaca

SEQ ID NO: 4645325 - DNA, 22 bp, Homo sapiens
gcagccacacttctcaggacac

SEQ ID NO: 4645326 - DNA, 16 bp, Homo sapiens
gcagccaccctgagga

SEQ ID NO: 4645327 - DNA, 19 bp, Homo sapiens
gcagccagaccagcaggct

SEQ ID NO: 4645328 - DNA, 15 bp, Homo sapiens
gcagccagccctgcc

SEQ ID NO: 4645329 - DNA, 19 bp, Homo sapiens
gcagccagccctgcctgga

SEQ ID NO: 4645330 - DNA, 22 bp, Homo sapiens
gcagccagccctgcctggagga

SEQ ID NO: 4645331 - DNA, 14 bp, Homo sapiens
gcagccagccgtgg

SEQ ID NO: 4645332 - DNA, 18 bp, Homo sapiens
gcagccagccgtggccag

SEQ ID NO: 4645333 - DNA, 17 bp, Homo sapiens
gcagccctggcccccat

SEQ ID NO: 4645334 - DNA, 23 bp, Homo sapiens
gcagcccttgctttcggagctcc

SEQ ID NO: 4645335 - DNA, 16 bp, Homo sapiens
gcagcgcccttcctct

SEQ ID NO: 4645336 - DNA, 22 bp, Homo sapiens
gcagcgggagcctccctgcctc

SEQ ID NO: 4645337 - DNA, 16 bp, Homo sapiens
gcagctcctctgtctc

SEQ ID NO: 4645338 - DNA, 16 bp, Homo sapiens
gcagctgagcagggcc

SEQ ID NO: 4645339 - DNA, 17 bp, Homo sapiens
gcagctgagcagggccg

SEQ ID NO: 4645340 - DNA, 19 bp, Homo sapiens
gcagctgagcagggccggg

SEQ ID NO: 4645341 - DNA, 20 bp, Homo sapiens
gcagctgagcagggccgggg

SEQ ID NO: 4645342 - DNA, 15 bp, Homo sapiens
gcagcttgtagccag

SEQ ID NO: 4645343 - DNA, 21 bp, Homo sapiens
gcagcttgtagccagccgggg

SEQ ID NO: 4645344 - DNA, 22 bp, Homo sapiens
gcagcttgtagccagccggggc

SEQ ID NO: 4645345 - DNA, 23 bp, Homo sapiens
gcagcttgtagccagccggggcg

SEQ ID NO: 4645346 - DNA, 12 bp, Homo sapiens
gcaggaataaag

SEQ ID NO: 4645347 - DNA, 14 bp, Homo sapiens
gcaggaataaagac

SEQ ID NO: 4645348 - DNA, 16 bp, Homo sapiens
gcaggactgtgcctcc

SEQ ID NO: 4645349 - DNA, 22 bp, Homo sapiens
gcaggagaagaacaagaaatgg

SEQ ID NO: 4645350 - DNA, 15 bp, Homo sapiens
gcaggagctactgag

SEQ ID NO: 4645351 - DNA, 21 bp, Homo sapiens
gcaggagctactgagaacata

SEQ ID NO: 4645352 - DNA, 23 bp, Homo sapiens
gcaggaggctttctgggctctgg

SEQ ID NO: 4645353 - DNA, 13 bp, Homo sapiens
gcaggaggtgcct

SEQ ID NO: 4645354 - DNA, 15 bp, Homo sapiens
gcaggaggtgcctga

SEQ ID NO: 4645355 - DNA, 17 bp, Homo sapiens
gcaggagtagctgagct

SEQ ID NO: 4645356 - DNA, 21 bp, Homo sapiens
gcaggagtagctgagctcaca

SEQ ID NO: 4645357 - DNA, 19 bp, Homo sapiens
gcaggagtggtgcagacag

SEQ ID NO: 4645358 - DNA, 20 bp, Homo sapiens
gcaggatcgaagggttttta

SEQ ID NO: 4645359 - DNA, 22 bp, Homo sapiens
gcaggcaccgccacgtcccagc

SEQ ID NO: 4645360 - DNA, 23 bp, Homo sapiens
gcaggcaccgccacgtcccagca

SEQ ID NO: 4645361 - DNA, 18 bp, Homo sapiens
gcaggcaggaacaaacag

SEQ ID NO: 4645362 - DNA, 22 bp, Homo sapiens
gcaggcaggaacaaacagggct

SEQ ID NO: 4645363 - DNA, 19 bp, Homo sapiens
gcaggcagggctctcctgg

SEQ ID NO: 4645364 - DNA, 15 bp, Homo sapiens
gcaggcattgaggaa

SEQ ID NO: 4645365 - DNA, 18 bp, Homo sapiens
gcaggccgccctcggact

SEQ ID NO: 4645366 - DNA, 19 bp, Homo sapiens
gcaggccgggcctgctgtc

SEQ ID NO: 4645367 - DNA, 17 bp, Homo sapiens
gcaggctggcctatgtg

SEQ ID NO: 4645368 - DNA, 21 bp, Homo sapiens
gcagggaaggacaggaccctc

SEQ ID NO: 4645369 - DNA, 23 bp, Homo sapiens
gcagggaaggacaggaccctcag

SEQ ID NO: 4645370 - DNA, 16 bp, Homo sapiens
gcagggaccggcagag

SEQ ID NO: 4645371 - DNA, 19 bp, Homo sapiens
gcagggagcggccggccag

SEQ ID NO: 4645372 - DNA, 13 bp, Homo sapiens
gcagggcagtcat

SEQ ID NO: 4645373 - DNA, 18 bp, Homo sapiens
gcagggccatctgactgc

SEQ ID NO: 4645374 - DNA, 13 bp, Homo sapiens
gcagggccgggga

SEQ ID NO: 4645375 - DNA, 14 bp, Homo sapiens
gcagggccggggaa

SEQ ID NO: 4645376 - DNA, 23 bp, Homo sapiens
gcagggccggggaactggccaag

SEQ ID NO: 4645377 - DNA, 16 bp, Homo sapiens
gcagggcctggcatag

SEQ ID NO: 4645378 - DNA, 15 bp, Homo sapiens
gcagggctctcctgg

SEQ ID NO: 4645379 - DNA, 16 bp, Homo sapiens
gcagggctctcctggc

SEQ ID NO: 4645380 - DNA, 18 bp, Homo sapiens
gcagggctctcctggctt

SEQ ID NO: 4645381 - DNA, 14 bp, Homo sapiens
gcagggcttctcct

SEQ ID NO: 4645382 - DNA, 21 bp, Homo sapiens
gcaggggcgggcggagggagg

SEQ ID NO: 4645383 - DNA, 22 bp, Homo sapiens
gcagggggccccgccagggctg

SEQ ID NO: 4645384 - DNA, 18 bp, Homo sapiens
gcaggggggctgtgccaa

SEQ ID NO: 4645385 - DNA, 23 bp, Homo sapiens
gcagggtcttttcatctgggaaa

SEQ ID NO: 4645386 - DNA, 20 bp, Homo sapiens
gcaggtatttagaagcagag

SEQ ID NO: 4645387 - DNA, 12 bp, Homo sapiens
gcaggtcagccc

SEQ ID NO: 4645388 - DNA, 13 bp, Homo sapiens
gcaggtcagccca

SEQ ID NO: 4645389 - DNA, 15 bp, Homo sapiens
gcaggtcagcccatg

SEQ ID NO: 4645390 - DNA, 12 bp, Homo sapiens
gcaggtgggcag

SEQ ID NO: 4645391 - DNA, 21 bp, Homo sapiens
gcaggtgggcagacagtgacc

SEQ ID NO: 4645392 - DNA, 19 bp, Homo sapiens
gcaggttcccaagctcaga

SEQ ID NO: 4645393 - DNA, 14 bp, Homo sapiens
gcaggttccccaag

SEQ ID NO: 4645394 - DNA, 21 bp, Homo sapiens
gcaggttccccaagggccctg

SEQ ID NO: 4645395 - DNA, 20 bp, Homo sapiens
gcaggttcttcttcctgaag

SEQ ID NO: 4645396 - DNA, 21 bp, Homo sapiens
gcagtccgtgtggatccaatg

SEQ ID NO: 4645397 - DNA, 14 bp, Homo sapiens
gcagtctttccccc

SEQ ID NO: 4645398 - DNA, 18 bp, Homo sapiens
gcagtggagggggcaagc

SEQ ID NO: 4645399 - DNA, 23 bp, Homo sapiens
gcagtggagggggcaagctttgc

SEQ ID NO: 4645400 - DNA, 16 bp, Homo sapiens
gcagtggcaggggagc

SEQ ID NO: 4645401 - DNA, 19 bp, Homo sapiens
gcagttcgcagccaccctg

SEQ ID NO: 4645402 - DNA, 14 bp, Homo sapiens
gcagttgaggtggg

SEQ ID NO: 4645403 - DNA, 18 bp, Homo sapiens
gcagttgttgaggggagg

SEQ ID NO: 4645404 - DNA, 17 bp, Homo sapiens
gcagtttcttttcacat

SEQ ID NO: 4645405 - DNA, 14 bp, Homo sapiens
gcataataaatgct

SEQ ID NO: 4645406 - DNA, 16 bp, Homo sapiens
gcataatctgaaaaca

SEQ ID NO: 4645407 - DNA, 15 bp, Homo sapiens
gcatactttgtaaat

SEQ ID NO: 4645408 - DNA, 15 bp, Homo sapiens
gcatatagactgtac

SEQ ID NO: 4645409 - DNA, 18 bp, Homo sapiens
gcatatgaccctgtttac

SEQ ID NO: 4645410 - DNA, 17 bp, Homo sapiens
gcatattgtaccccctc

SEQ ID NO: 4645411 - DNA, 14 bp, Homo sapiens
gcatcacatctgca

SEQ ID NO: 4645412 - DNA, 19 bp, Homo sapiens
gcatcagaaagggagggct

SEQ ID NO: 4645413 - DNA, 12 bp, Homo sapiens
gcatcatgcctc

SEQ ID NO: 4645414 - DNA, 17 bp, Homo sapiens
gcatcatgcctctgagg

SEQ ID NO: 4645415 - DNA, 18 bp, Homo sapiens
gcatcatgcctctgaggc

SEQ ID NO: 4645416 - DNA, 21 bp, Homo sapiens
gcatccacgtagggggcaggg

SEQ ID NO: 4645417 - DNA, 22 bp, Homo sapiens
gcatccacgtagggggcagggg

SEQ ID NO: 4645418 - DNA, 14 bp, Homo sapiens
ctggtacctgccct

SEQ ID NO: 4645419 - DNA, 21 bp, Homo sapiens
ctggtacctgccctctattta

SEQ ID NO: 4645420 - DNA, 17 bp, Homo sapiens
ctggtcaacctcctgga

SEQ ID NO: 4645421 - DNA, 12 bp, Homo sapiens
ctggtcacctcc

SEQ ID NO: 4645422 - DNA, 15 bp, Homo sapiens
ctggtcacctcccat

SEQ ID NO: 4645423 - DNA, 17 bp, Homo sapiens
ctggtcacctcccatcc

SEQ ID NO: 4645424 - DNA, 20 bp, Homo sapiens
ctggtcagtcgtggagcgcc

SEQ ID NO: 4645425 - DNA, 23 bp, Homo sapiens
ctggtccgtgcgggaaattcagt

SEQ ID NO: 4645426 - DNA, 18 bp, Homo sapiens
ctggtcctgaccaggatg

SEQ ID NO: 4645427 - DNA, 13 bp, Homo sapiens
ctggtctgggagt

SEQ ID NO: 4645428 - DNA, 14 bp, Homo sapiens
ctggtggggcagct

SEQ ID NO: 4645429 - DNA, 19 bp, Homo sapiens
ctggttaaaaaacaaatgt

SEQ ID NO: 4645430 - DNA, 16 bp, Homo sapiens
ctggttatcttgttat

SEQ ID NO: 4645431 - DNA, 18 bp, Homo sapiens
ctggttcaaagtaaagca

SEQ ID NO: 4645432 - DNA, 15 bp, Homo sapiens
ctggttccttcctta

SEQ ID NO: 4645433 - DNA, 13 bp, Homo sapiens
ctggtttcccttt

SEQ ID NO: 4645434 - DNA, 14 bp, Homo sapiens
ctgtaactgagaga

SEQ ID NO: 4645435 - DNA, 12 bp, Homo sapiens
ctgtaagggcag

SEQ ID NO: 4645436 - DNA, 17 bp, Homo sapiens
ctgtaagggcagtgccc

SEQ ID NO: 4645437 - DNA, 22 bp, Homo sapiens
ctgtaaggggcagcagttgagg

SEQ ID NO: 4645438 - DNA, 17 bp, Homo sapiens
ctgtaatcaaaaggagg

SEQ ID NO: 4645439 - DNA, 14 bp, Homo sapiens
ctgtaatcaggcaa

SEQ ID NO: 4645440 - DNA, 23 bp, Homo sapiens
ctgtaatcaggcaaggaggagga

SEQ ID NO: 4645441 - DNA, 18 bp, Homo sapiens
ctgtaatcatttgtttac

SEQ ID NO: 4645442 - DNA, 16 bp, Homo sapiens
ctgtacacgtgtcctg

SEQ ID NO: 4645443 - DNA, 17 bp, Homo sapiens
ctgtacacgtgtcctgt

SEQ ID NO: 4645444 - DNA, 18 bp, Homo sapiens
ctgtacacgtgtcctgta

SEQ ID NO: 4645445 - DNA, 16 bp, Homo sapiens
ctgtacatatgtaaac

SEQ ID NO: 4645446 - DNA, 18 bp, Homo sapiens
ctgtaccgtcgacaagaa

SEQ ID NO: 4645447 - DNA, 13 bp, Homo sapiens
ctgtactgcctgc

SEQ ID NO: 4645448 - DNA, 15 bp, Homo sapiens
ctgtactgcctgctt

SEQ ID NO: 4645449 - DNA, 19 bp, Homo sapiens
ctgtactgcctgcttgggg

SEQ ID NO: 4645450 - DNA, 17 bp, Homo sapiens
ctgtactgtaatttctt

SEQ ID NO: 4645451 - DNA, 18 bp, Homo sapiens
ctgtacttttcattctct

SEQ ID NO: 4645452 - DNA, 12 bp, Homo sapiens
ctgtagacactc

SEQ ID NO: 4645453 - DNA, 16 bp, Homo sapiens
ctgtagacactctgac

SEQ ID NO: 4645454 - DNA, 17 bp, Homo sapiens
ctgtagacactctgaca

SEQ ID NO: 4645455 - DNA, 13 bp, Homo sapiens
ctgtagccttctg

SEQ ID NO: 4645456 - DNA, 16 bp, Homo sapiens
ctgtagctacaaggga

SEQ ID NO: 4645457 - DNA, 19 bp, Homo sapiens
ctgtagctacaagggaagc

SEQ ID NO: 4645458 - DNA, 18 bp, Homo sapiens
ctgtagggagaagcttta

SEQ ID NO: 4645459 - DNA, 20 bp, Homo sapiens
ctgtaggtgaaagaacaagt

SEQ ID NO: 4645460 - DNA, 18 bp, Homo sapiens
ctgtagtaaactatttat

SEQ ID NO: 4645461 - DNA, 19 bp, Homo sapiens
ctgtagtaaactatttatc

SEQ ID NO: 4645462 - DNA, 17 bp, Homo sapiens
ctgtatataagttgctg

SEQ ID NO: 4645463 - DNA, 14 bp, Homo sapiens
ctgtatcactctgt

SEQ ID NO: 4645464 - DNA, 21 bp, Homo sapiens
ctgtatccaattttaatgata

SEQ ID NO: 4645465 - DNA, 13 bp, Homo sapiens
ctgtatccccagt

SEQ ID NO: 4645466 - DNA, 18 bp, Homo sapiens
ctgtatccccagtgcccg

SEQ ID NO: 4645467 - DNA, 17 bp, Homo sapiens
ctgtatctgtagtgaga

SEQ ID NO: 4645468 - DNA, 23 bp, Homo sapiens
ctgtatctgtagtgagatagcat

SEQ ID NO: 4645469 - DNA, 20 bp, Homo sapiens
ctgtatgtctcgtggtagga

SEQ ID NO: 4645470 - DNA, 16 bp, Homo sapiens
ctgtatttgttcccaa

SEQ ID NO: 4645471 - DNA, 18 bp, Homo sapiens
ctgtatttgttcccaaga

SEQ ID NO: 4645472 - DNA, 19 bp, Homo sapiens
ctgtatttgttcccaagag

SEQ ID NO: 4645473 - DNA, 23 bp, Homo sapiens
gactgcaaagccagtgctgtctg

SEQ ID NO: 4645474 - DNA, 16 bp, Homo sapiens
gactgccaggctgttt

SEQ ID NO: 4645475 - DNA, 13 bp, Homo sapiens
gactgccctgccc

SEQ ID NO: 4645476 - DNA, 21 bp, Homo sapiens
gactgctattctagagctttt

SEQ ID NO: 4645477 - DNA, 22 bp, Homo sapiens
gactgctattctagagctttta

SEQ ID NO: 4645478 - DNA, 21 bp, Homo sapiens
gactggcccctaggctgctgc

SEQ ID NO: 4645479 - DNA, 15 bp, Homo sapiens
gactggttatcttgt

SEQ ID NO: 4645480 - DNA, 15 bp, Homo sapiens
gactggttccttcct

SEQ ID NO: 4645481 - DNA, 14 bp, Homo sapiens
gactggttttctgc

SEQ ID NO: 4645482 - DNA, 19 bp, Homo sapiens
gactgtacattatgaagaa

SEQ ID NO: 4645483 - DNA, 20 bp, Homo sapiens
gactgtacattatgaagaat

SEQ ID NO: 4645484 - DNA, 22 bp, Homo sapiens
gactgtgaggccatacttgtga

SEQ ID NO: 4645485 - DNA, 20 bp, Homo sapiens
gactgtggtgacttctgctg

SEQ ID NO: 4645486 - DNA, 21 bp, Homo sapiens
gactgtggtgacttctgctgc

SEQ ID NO: 4645487 - DNA, 22 bp, Homo sapiens
gactgtgtctgaatcatgtctg

SEQ ID NO: 4645488 - DNA, 18 bp, Homo sapiens
gactgttacagactgaaa

SEQ ID NO: 4645489 - DNA, 16 bp, Homo sapiens
gactgttgtccctgca

SEQ ID NO: 4645490 - DNA, 20 bp, Homo sapiens
gactgtttcatagttttcta

SEQ ID NO: 4645491 - DNA, 13 bp, Homo sapiens
gacttatttctgc

SEQ ID NO: 4645492 - DNA, 20 bp, Homo sapiens
gacttgccacccccagttcc

SEQ ID NO: 4645493 - DNA, 16 bp, Homo sapiens
gacttgtctgcctcct

SEQ ID NO: 4645494 - DNA, 19 bp, Homo sapiens
gacttgtctgcctcctgct

SEQ ID NO: 4645495 - DNA, 21 bp, Homo sapiens
gacttgtctgcctcctgcttt

SEQ ID NO: 4645496 - DNA, 22 bp, Homo sapiens
gactttacaaacctttgtttca

SEQ ID NO: 4645497 - DNA, 15 bp, Homo sapiens
gactttatttatttc

SEQ ID NO: 4645498 - DNA, 17 bp, Homo sapiens
gactttatttatttcta

SEQ ID NO: 4645499 - DNA, 21 bp, Homo sapiens
gactttatttatttctagttc

SEQ ID NO: 4645500 - DNA, 15 bp, Homo sapiens
gactttcccacccag

SEQ ID NO: 4645501 - DNA, 16 bp, Homo sapiens
gactttcccacccagg

SEQ ID NO: 4645502 - DNA, 17 bp, Homo sapiens
gactttcccacccagga

SEQ ID NO: 4645503 - DNA, 20 bp, Homo sapiens
gactttgtgttcatttcatt

SEQ ID NO: 4645504 - DNA, 14 bp, Homo sapiens
gacttttacagatt

SEQ ID NO: 4645505 - DNA, 18 bp, Homo sapiens
gacttttttctagtacac

SEQ ID NO: 4645506 - DNA, 19 bp, Homo sapiens
gactttttttttttataat

SEQ ID NO: 4645507 - DNA, 15 bp, Homo sapiens
gagaaaatttatatc

SEQ ID NO: 4645508 - DNA, 16 bp, Homo sapiens
gagaaacagcctgtgt

SEQ ID NO: 4645509 - DNA, 15 bp, Homo sapiens
gagaaacagctcagc

SEQ ID NO: 4645510 - DNA, 18 bp, Homo sapiens
gagaaagagagaagccag

SEQ ID NO: 4645511 - DNA, 15 bp, Homo sapiens
gagaaagagctgcct

SEQ ID NO: 4645512 - DNA, 19 bp, Homo sapiens
gagaaagcgcagatgctag

SEQ ID NO: 4645513 - DNA, 14 bp, Homo sapiens
gagaaattgacaga

SEQ ID NO: 4645514 - DNA, 13 bp, Homo sapiens
gagaacagtggtt

SEQ ID NO: 4645515 - DNA, 12 bp, Homo sapiens
gagaacctggcc

SEQ ID NO: 4645516 - DNA, 13 bp, Homo sapiens
gagaacctggcct

SEQ ID NO: 4645517 - DNA, 15 bp, Homo sapiens
gagaagcgtttttaa

SEQ ID NO: 4645518 - DNA, 19 bp, Homo sapiens
gagaagctgctccaggcct

SEQ ID NO: 4645519 - DNA, 15 bp, Homo sapiens
gagaaggagtgccat

SEQ ID NO: 4645520 - DNA, 17 bp, Homo sapiens
gagaaggctggagaagg

SEQ ID NO: 4645521 - DNA, 20 bp, Homo sapiens
gagaagggggctctgcccca

SEQ ID NO: 4645522 - DNA, 20 bp, Homo sapiens
gagaaggtggtggcattttt

SEQ ID NO: 4645523 - DNA, 21 bp, Homo sapiens
gagaagtttaacaagtattta

SEQ ID NO: 4645524 - DNA, 20 bp, Homo sapiens
gagaagtttgtagccaggta

SEQ ID NO: 4645525 - DNA, 23 bp, Homo sapiens
gagaagtttgtagccaggtactg

SEQ ID NO: 4645526 - DNA, 23 bp, Homo sapiens
gagaataccttggtctcacctat

SEQ ID NO: 4645527 - DNA, 16 bp, Homo sapiens
gagaatagcttttact

SEQ ID NO: 4645528 - DNA, 16 bp, Homo sapiens
gagaatgtgtttcaaa

SEQ ID NO: 4645529 - DNA, 20 bp, Homo sapiens
gagacaacagcacacaggca

SEQ ID NO: 4645530 - DNA, 15 bp, Homo sapiens
gagacaaggtgctaa

SEQ ID NO: 4645531 - DNA, 21 bp, Homo sapiens
gagacacatacagagtgggcc

SEQ ID NO: 4645532 - DNA, 13 bp, Homo sapiens
gagacagcccagg

SEQ ID NO: 4645533 - DNA, 13 bp, Homo sapiens
gagacagtgtttc

SEQ ID NO: 4645534 - DNA, 17 bp, Homo sapiens
gagaccccagtgcctgc

SEQ ID NO: 4645535 - DNA, 13 bp, Homo sapiens
gagaccccgcacc

SEQ ID NO: 4645536 - DNA, 13 bp, Homo sapiens
gagactgccctgc

SEQ ID NO: 4645537 - DNA, 18 bp, Homo sapiens
gagactgccctgcccagg

SEQ ID NO: 4645538 - DNA, 17 bp, Homo sapiens
gagactttctcctggcc

SEQ ID NO: 4645539 - DNA, 14 bp, Homo sapiens
gagacttttttcta

SEQ ID NO: 4645540 - DNA, 14 bp, Homo sapiens
gagagaagctcttc

SEQ ID NO: 4645541 - DNA, 17 bp, Homo sapiens
gagagaattggctcaat

SEQ ID NO: 4645542 - DNA, 14 bp, Homo sapiens
gagagagtgtgtgt

SEQ ID NO: 4645543 - DNA, 13 bp, Homo sapiens
gagagccctggga

SEQ ID NO: 4645544 - DNA, 14 bp, Homo sapiens
gagagccctgggac

SEQ ID NO: 4645545 - DNA, 14 bp, Homo sapiens
gagagctaggagca

SEQ ID NO: 4645546 - DNA, 18 bp, Homo sapiens
gagaggcagcatgcttgg

SEQ ID NO: 4645547 - DNA, 11 bp, Homo sapiens
gagaggccccc

SEQ ID NO: 4645548 - DNA, 13 bp, Homo sapiens
gagaggccctgga

SEQ ID NO: 4645549 - DNA, 20 bp, Homo sapiens
gagaggcttccctacacagg

SEQ ID NO: 4645550 - DNA, 22 bp, Homo sapiens
gagaggcttccctacacagggc

SEQ ID NO: 4645551 - DNA, 15 bp, Homo sapiens
gagagggagaagaag

SEQ ID NO: 4645552 - DNA, 23 bp, Homo sapiens
gagagggccgggcagaggggcag

SEQ ID NO: 4645553 - DNA, 17 bp, Homo sapiens
gagagttgtgatggagg

SEQ ID NO: 4645554 - DNA, 20 bp, Homo sapiens
gagagttgttcccccagggg

SEQ ID NO: 4645555 - DNA, 15 bp, Homo sapiens
gagatagcattgtga

SEQ ID NO: 4645556 - DNA, 20 bp, Homo sapiens
gagatatttaggaaaatgct

SEQ ID NO: 4645557 - DNA, 23 bp, Homo sapiens
gagatcacagccccacccttgtc

SEQ ID NO: 4645558 - DNA, 17 bp, Homo sapiens
gagatcagcatgcctgt

SEQ ID NO: 4645559 - DNA, 17 bp, Homo sapiens
gagatcaggatcagctt

SEQ ID NO: 4645560 - DNA, 13 bp, Homo sapiens
gagatcagggcct

SEQ ID NO: 4645561 - DNA, 17 bp, Homo sapiens
gagatcagggcctgccc

SEQ ID NO: 4645562 - DNA, 17 bp, Homo sapiens
gagatcccttaagaagt

SEQ ID NO: 4645563 - DNA, 14 bp, Homo sapiens
gagatcgacagaca

SEQ ID NO: 4645564 - DNA, 16 bp, Homo sapiens
gagatcgacagacagc

SEQ ID NO: 4645565 - DNA, 14 bp, Homo sapiens
gagatgaccaggga

SEQ ID NO: 4645566 - DNA, 16 bp, Homo sapiens
gagatgaccagggatg

SEQ ID NO: 4645567 - DNA, 21 bp, Homo sapiens
gagatgaccagggatgctggg

SEQ ID NO: 4645568 - DNA, 20 bp, Homo sapiens
gagatgactattacttttct

SEQ ID NO: 4645569 - DNA, 16 bp, Homo sapiens
gagatgagttttagga

SEQ ID NO: 4645570 - DNA, 22 bp, Homo sapiens
gagatgatacatccaaagcaga

SEQ ID NO: 4645571 - DNA, 15 bp, Homo sapiens
gagatggagggcttg

SEQ ID NO: 4645572 - DNA, 22 bp, Homo sapiens
gagattgtactgttcatacagt

SEQ ID NO: 4645573 - DNA, 22 bp, Homo sapiens
gagatttaacccctccactgct

SEQ ID NO: 4645574 - DNA, 18 bp, Homo sapiens
gagcaaaaatctgagaaa

SEQ ID NO: 4645575 - DNA, 13 bp, Homo sapiens
gagcaaaatcaac

SEQ ID NO: 4645576 - DNA, 15 bp, Homo sapiens
gagcaaactctgctg

SEQ ID NO: 4645577 - DNA, 15 bp, Homo sapiens
gagcaaccgtggccc

SEQ ID NO: 4645578 - DNA, 16 bp, Homo sapiens
gagcaaccgtggccct

SEQ ID NO: 4645579 - DNA, 16 bp, Homo sapiens
gagcaaggccttctct

SEQ ID NO: 4645580 - DNA, 18 bp, Homo sapiens
gagcactgccaggaggga

SEQ ID NO: 4645581 - DNA, 21 bp, Homo sapiens
gagcagaatgttgtacttgaa

SEQ ID NO: 4645582 - DNA, 13 bp, Homo sapiens
gagcagacaggct

SEQ ID NO: 4645583 - DNA, 13 bp, Homo sapiens
gagcagccctggc

SEQ ID NO: 4645584 - DNA, 20 bp, Homo sapiens
gaatatatctctatttgaga

SEQ ID NO: 4645585 - DNA, 11 bp, Homo sapiens
gaatatttgaa

SEQ ID NO: 4645586 - DNA, 18 bp, Homo sapiens
gaatcaaggtaagctcag

SEQ ID NO: 4645587 - DNA, 20 bp, Homo sapiens
gaatcagtaatcacttttca

SEQ ID NO: 4645588 - DNA, 16 bp, Homo sapiens
gaatcagtaggaccag

SEQ ID NO: 4645589 - DNA, 20 bp, Homo sapiens
gaatcatacttaacatttca

SEQ ID NO: 4645590 - DNA, 22 bp, Homo sapiens
gaatcattaatttcaaaattta

SEQ ID NO: 4645591 - DNA, 23 bp, Homo sapiens
gaatcattaatttcaaaatttaa

SEQ ID NO: 4645592 - DNA, 20 bp, Homo sapiens
gaatccaaactcaacaagtg

SEQ ID NO: 4645593 - DNA, 19 bp, Homo sapiens
gaatccatgggtctggcta

SEQ ID NO: 4645594 - DNA, 20 bp, Homo sapiens
gaatccatgggtctggctag

SEQ ID NO: 4645595 - DNA, 19 bp, Homo sapiens
gaatccccaacatgcactg

SEQ ID NO: 4645596 - DNA, 23 bp, Homo sapiens
gaatcgtccctatatcagggcct

SEQ ID NO: 4645597 - DNA, 19 bp, Homo sapiens
gaatctataagtagtaaat

SEQ ID NO: 4645598 - DNA, 21 bp, Homo sapiens
gaatctataagtagtaaatca

SEQ ID NO: 4645599 - DNA, 18 bp, Homo sapiens
gaatctgcttttcctctg

SEQ ID NO: 4645600 - DNA, 20 bp, Homo sapiens
gaatgacccttttgtgtcta

SEQ ID NO: 4645601 - DNA, 20 bp, Homo sapiens
gaatgagagcgacacagacg

SEQ ID NO: 4645602 - DNA, 14 bp, Homo sapiens
gaatgagcccagag

SEQ ID NO: 4645603 - DNA, 20 bp, Homo sapiens
gaatgagcctacgctgaaga

SEQ ID NO: 4645604 - DNA, 19 bp, Homo sapiens
gaatgcagaggtctccaaa

SEQ ID NO: 4645605 - DNA, 16 bp, Homo sapiens
gaatgcctcctgtggg

SEQ ID NO: 4645606 - DNA, 16 bp, Homo sapiens
gaatgcctcgctccct

SEQ ID NO: 4645607 - DNA, 21 bp, Homo sapiens
gaatgcctcgctcccttcaag

SEQ ID NO: 4645608 - DNA, 19 bp, Homo sapiens
gaatggaggagccaggccc

SEQ ID NO: 4645609 - DNA, 11 bp, Homo sapiens
gaatgggaatt

SEQ ID NO: 4645610 - DNA, 11 bp, Homo sapiens
gaatgggactg

SEQ ID NO: 4645611 - DNA, 14 bp, Homo sapiens
gaatgtatgtaatg

SEQ ID NO: 4645612 - DNA, 17 bp, Homo sapiens
gaatgtatgtaatgtgt

SEQ ID NO: 4645613 - DNA, 20 bp, Homo sapiens
gaatgtgggctatgtagtca

SEQ ID NO: 4645614 - DNA, 13 bp, Homo sapiens
gaatgtggtctca

SEQ ID NO: 4645615 - DNA, 16 bp, Homo sapiens
gaatgtggtctcagga

SEQ ID NO: 4645616 - DNA, 23 bp, Homo sapiens
gaatgtgtgtgtgtggcaggggg

SEQ ID NO: 4645617 - DNA, 17 bp, Homo sapiens
gaatgtttgtgtctgtg

SEQ ID NO: 4645618 - DNA, 20 bp, Homo sapiens
gaattataaatgtgtttata

SEQ ID NO: 4645619 - DNA, 22 bp, Homo sapiens
gaattatacagacctaatatca

SEQ ID NO: 4645620 - DNA, 20 bp, Homo sapiens
gaattatttgccttctgaaa

SEQ ID NO: 4645621 - DNA, 14 bp, Homo sapiens
gaattcagtgcctt

SEQ ID NO: 4645622 - DNA, 17 bp, Homo sapiens
gaattcatactctgttg

SEQ ID NO: 4645623 - DNA, 13 bp, Homo sapiens
gaattccttcgaa

SEQ ID NO: 4645624 - DNA, 17 bp, Homo sapiens
gaattctaccctggaaa

SEQ ID NO: 4645625 - DNA, 15 bp, Homo sapiens
gaattgaaatgaggt

SEQ ID NO: 4645626 - DNA, 21 bp, Homo sapiens
gaattgcagcatatcgtttaa

SEQ ID NO: 4645627 - DNA, 19 bp, Homo sapiens
gaattggaggctgcagtga

SEQ ID NO: 4645628 - DNA, 13 bp, Homo sapiens
gaatttatacctc

SEQ ID NO: 4645629 - DNA, 18 bp, Homo sapiens
gaatttgcatccagcagc

SEQ ID NO: 4645630 - DNA, 22 bp, Homo sapiens
gaatttggggcaggaaatactt

SEQ ID NO: 4645631 - DNA, 15 bp, Homo sapiens
gaattttcaaggcct

SEQ ID NO: 4645632 - DNA, 17 bp, Homo sapiens
gaattttcaaggccttc

SEQ ID NO: 4645633 - DNA, 13 bp, Homo sapiens
gaattttctgtgt

SEQ ID NO: 4645634 - DNA, 17 bp, Homo sapiens
gacaaaagtctgtcttt

SEQ ID NO: 4645635 - DNA, 13 bp, Homo sapiens
gacaaaggagcct

SEQ ID NO: 4645636 - DNA, 14 bp, Homo sapiens
gacaaaggagcctg

SEQ ID NO: 4645637 - DNA, 17 bp, Homo sapiens
gacaaaggagcctgtga

SEQ ID NO: 4645638 - DNA, 17 bp, Homo sapiens
gacaaattcggatgtat

SEQ ID NO: 4645639 - DNA, 15 bp, Homo sapiens
gacaacagcacacag

SEQ ID NO: 4645640 - DNA, 16 bp, Homo sapiens
gacaacagcacacagg

SEQ ID NO: 4645641 - DNA, 18 bp, Homo sapiens
gacaaccagaaggccctt

SEQ ID NO: 4645642 - DNA, 14 bp, Homo sapiens
gacaagcagccctt

SEQ ID NO: 4645643 - DNA, 13 bp, Homo sapiens
gacaaggtgctaa

SEQ ID NO: 4645644 - DNA, 19 bp, Homo sapiens
gacaatgatttggccaggc

SEQ ID NO: 4645645 - DNA, 16 bp, Homo sapiens
gacacaggatgaagca

SEQ ID NO: 4645646 - DNA, 15 bp, Homo sapiens
gacacaggcctgtgt

SEQ ID NO: 4645647 - DNA, 16 bp, Homo sapiens
gacacaggcctgtgta

SEQ ID NO: 4645648 - DNA, 15 bp, Homo sapiens
gacacatacagagtg

SEQ ID NO: 4645649 - DNA, 22 bp, Homo sapiens
gacacatatgcaccttgtgtct

SEQ ID NO: 4645650 - DNA, 14 bp, Homo sapiens
gacacatgctatgt

SEQ ID NO: 4645651 - DNA, 21 bp, Homo sapiens
gacacattgactcctttccaa

SEQ ID NO: 4645652 - DNA, 12 bp, Homo sapiens
gacaccctggcc

SEQ ID NO: 4645653 - DNA, 14 bp, Homo sapiens
gacaccctggcctg

SEQ ID NO: 4645654 - DNA, 23 bp, Homo sapiens
gacaccctggcctgaactgagga

SEQ ID NO: 4645655 - DNA, 13 bp, Homo sapiens
gacacgagccaca

SEQ ID NO: 4645656 - DNA, 14 bp, Homo sapiens
gacacgagccacaa

SEQ ID NO: 4645657 - DNA, 13 bp, Homo sapiens
gacacgtggcctc

SEQ ID NO: 4645658 - DNA, 14 bp, Homo sapiens
gacacttgtcccca

SEQ ID NO: 4645659 - DNA, 22 bp, Homo sapiens
gacagaaaactaaaaaggaaga

SEQ ID NO: 4645660 - DNA, 22 bp, Homo sapiens
gacagaaacatgtcttgactgt

SEQ ID NO: 4645661 - DNA, 23 bp, Homo sapiens
gacagaaagaccctgatgcaggt

SEQ ID NO: 4645662 - DNA, 23 bp, Homo sapiens
gacagactcctgaggacagctgt

SEQ ID NO: 4645663 - DNA, 13 bp, Homo sapiens
gacagaggggagc

SEQ ID NO: 4645664 - DNA, 19 bp, Homo sapiens
gacagatcaggctagccct

SEQ ID NO: 4645665 - DNA, 15 bp, Homo sapiens
gacagcatcagaaat

SEQ ID NO: 4645666 - DNA, 11 bp, Homo sapiens
gacagccaggt

SEQ ID NO: 4645667 - DNA, 15 bp, Homo sapiens
gacagcccagagcct

SEQ ID NO: 4645668 - DNA, 17 bp, Homo sapiens
gacagcccagagcctgg

SEQ ID NO: 4645669 - DNA, 21 bp, Homo sapiens
gacagcccaggatactggcac

SEQ ID NO: 4645670 - DNA, 12 bp, Homo sapiens
gacagctccacc

SEQ ID NO: 4645671 - DNA, 20 bp, Homo sapiens
gacagctgactgaatgcaga

SEQ ID NO: 4645672 - DNA, 14 bp, Homo sapiens
gacagcttgtatgt

SEQ ID NO: 4645673 - DNA, 17 bp, Homo sapiens
gacaggaccctcaggaa

SEQ ID NO: 4645674 - DNA, 23 bp, Homo sapiens
gacaggactaacactcagaagcc

SEQ ID NO: 4645675 - DNA, 24 bp, Homo sapiens
gacaggactaacactcagaagcct

SEQ ID NO: 4645676 - DNA, 14 bp, Homo sapiens
gacaggagaagaga

SEQ ID NO: 4645677 - DNA, 14 bp, Homo sapiens
gacaggatgaggtc

SEQ ID NO: 4645678 - DNA, 16 bp, Homo sapiens
gacaggatgaggtctc

SEQ ID NO: 4645679 - DNA, 16 bp, Homo sapiens
gacaggcaaataaaag

SEQ ID NO: 4645680 - DNA, 13 bp, Homo sapiens
gacaggcactcca

SEQ ID NO: 4645681 - DNA, 22 bp, Homo sapiens
gacaggctacaaagcagagatc

SEQ ID NO: 4645682 - DNA, 13 bp, Homo sapiens
gacaggctgaaga

SEQ ID NO: 4645683 - DNA, 19 bp, Homo sapiens
gacaggctgaagagaggga

SEQ ID NO: 4645684 - DNA, 12 bp, Homo sapiens
gacaggctggct

SEQ ID NO: 4645685 - DNA, 12 bp, Homo sapiens
gacagggccagt

SEQ ID NO: 4645686 - DNA, 18 bp, Homo sapiens
gacagtcatcatcagggc

SEQ ID NO: 4645687 - DNA, 19 bp, Homo sapiens
gacagtcatcatcagggcc

SEQ ID NO: 4645688 - DNA, 21 bp, Homo sapiens
gacagtcatcatcagggcctg

SEQ ID NO: 4645689 - DNA, 22 bp, Homo sapiens
gacagtgacctctctaggtgtg

SEQ ID NO: 4645690 - DNA, 15 bp, Homo sapiens
gacagtgccatcccc

SEQ ID NO: 4645691 - DNA, 18 bp, Homo sapiens
gacagtggcaggacagga

SEQ ID NO: 4645692 - DNA, 11 bp, Homo sapiens
gacataaagcc

SEQ ID NO: 4645693 - DNA, 22 bp, Homo sapiens
gacatagagagggagaagaagt

SEQ ID NO: 4645694 - DNA, 18 bp, Homo sapiens
gacataggtcataaagca

SEQ ID NO: 4645695 - DNA, 17 bp, Homo sapiens
cttcccaaacccagtct

SEQ ID NO: 4645696 - DNA, 21 bp, Homo sapiens
cttcccaaacccagtctcctc

SEQ ID NO: 4645697 - DNA, 16 bp, Homo sapiens
cttcccagcgctgctg

SEQ ID NO: 4645698 - DNA, 15 bp, Homo sapiens
cttcccatccccagc

SEQ ID NO: 4645699 - DNA, 18 bp, Homo sapiens
cttccccaagatctgcca

SEQ ID NO: 4645700 - DNA, 19 bp, Homo sapiens
cttccccaagatctgccag

SEQ ID NO: 4645701 - DNA, 21 bp, Homo sapiens
cttccccagctcccccaggca

SEQ ID NO: 4645702 - DNA, 16 bp, Homo sapiens
cttcccccagcccatc

SEQ ID NO: 4645703 - DNA, 18 bp, Homo sapiens
cttccccctttctctgcc

SEQ ID NO: 4645704 - DNA, 19 bp, Homo sapiens
cttccccctttctctgcct

SEQ ID NO: 4645705 - DNA, 13 bp, Homo sapiens
cttcccctgggaa

SEQ ID NO: 4645706 - DNA, 22 bp, Homo sapiens
cttccctaatagctttttaaaa

SEQ ID NO: 4645707 - DNA, 19 bp, Homo sapiens
cttccctacacagggcctg

SEQ ID NO: 4645708 - DNA, 17 bp, Homo sapiens
cttccctccgccttctc

SEQ ID NO: 4645709 - DNA, 17 bp, Homo sapiens
cttcccttcctcagcag

SEQ ID NO: 4645710 - DNA, 23 bp, Homo sapiens
cttccgctttgaaagaagcaaga

SEQ ID NO: 4645711 - DNA, 15 bp, Homo sapiens
cttccgttccccgct

SEQ ID NO: 4645712 - DNA, 22 bp, Homo sapiens
cttccgttccccgctaggtcaa

SEQ ID NO: 4645713 - DNA, 17 bp, Homo sapiens
cttcctctgtgaactgt

SEQ ID NO: 4645714 - DNA, 12 bp, Homo sapiens
cttcctgccctt

SEQ ID NO: 4645715 - DNA, 17 bp, Homo sapiens
cttcctggacagctgtg

SEQ ID NO: 4645716 - DNA, 23 bp, Homo sapiens
cttcctggacagctgtgcctcgc

SEQ ID NO: 4645717 - DNA, 24 bp, Homo sapiens
cttcctggacagctgtgcctcgct

SEQ ID NO: 4645718 - DNA, 20 bp, Homo sapiens
cttcctgtggctccctctct

SEQ ID NO: 4645719 - DNA, 23 bp, Homo sapiens
cttccttagtttcaaagtgtctc

SEQ ID NO: 4645720 - DNA, 17 bp, Homo sapiens
cttccttgcttaaggta

SEQ ID NO: 4645721 - DNA, 21 bp, Homo sapiens
cttcctttgcccttcctcctg

SEQ ID NO: 4645722 - DNA, 14 bp, Homo sapiens
cttccttttaactg

SEQ ID NO: 4645723 - DNA, 15 bp, Homo sapiens
cttccttttgaggga

SEQ ID NO: 4645724 - DNA, 16 bp, Homo sapiens
cttcgaaaggccttca

SEQ ID NO: 4645725 - DNA, 23 bp, Homo sapiens
cttcgcacacacccatgtaacca

SEQ ID NO: 4645726 - DNA, 12 bp, Homo sapiens
cttcgctcttga

SEQ ID NO: 4645727 - DNA, 13 bp, Homo sapiens
cttcgttcctgcg

SEQ ID NO: 4645728 - DNA, 19 bp, Homo sapiens
cttctacccttttcctttt

SEQ ID NO: 4645729 - DNA, 19 bp, Homo sapiens
cttctagaaaacatttttg

SEQ ID NO: 4645730 - DNA, 13 bp, Homo sapiens
cttctaggaatgg

SEQ ID NO: 4645731 - DNA, 14 bp, Homo sapiens
cttctatcagactc

SEQ ID NO: 4645732 - DNA, 13 bp, Homo sapiens
cttctattctagc

SEQ ID NO: 4645733 - DNA, 20 bp, Homo sapiens
cttctattctagcctgcatt

SEQ ID NO: 4645734 - DNA, 14 bp, Homo sapiens
cttctattggtctc

SEQ ID NO: 4645735 - DNA, 12 bp, Homo sapiens
cttctcagccac

SEQ ID NO: 4645736 - DNA, 14 bp, Homo sapiens
cttctcagtttctg

SEQ ID NO: 4645737 - DNA, 19 bp, Homo sapiens
cttctcagtttctgcctgg

SEQ ID NO: 4645738 - DNA, 16 bp, Homo sapiens
cttctcccacatgagg

SEQ ID NO: 4645739 - DNA, 12 bp, Homo sapiens
cttctcccaggc

SEQ ID NO: 4645740 - DNA, 16 bp, Homo sapiens
gaagcagaagacggga

SEQ ID NO: 4645741 - DNA, 21 bp, Homo sapiens
gaagcagaagacgggagggga

SEQ ID NO: 4645742 - DNA, 18 bp, Homo sapiens
gaagccaattcagacagg

SEQ ID NO: 4645743 - DNA, 20 bp, Homo sapiens
gaagccaattcagacaggca

SEQ ID NO: 4645744 - DNA, 16 bp, Homo sapiens
gaagccagccacagac

SEQ ID NO: 4645745 - DNA, 18 bp, Homo sapiens
gaagccagccacagaccc

SEQ ID NO: 4645746 - DNA, 21 bp, Homo sapiens
gaagccagccacagacccctg

SEQ ID NO: 4645747 - DNA, 22 bp, Homo sapiens
gaagccaggtacaggagaggca

SEQ ID NO: 4645748 - DNA, 18 bp, Homo sapiens
gaagcccctgggcccagt

SEQ ID NO: 4645749 - DNA, 19 bp, Homo sapiens
gaagccgactctggccctg

SEQ ID NO: 4645750 - DNA, 16 bp, Homo sapiens
gaagcctgggggcctg

SEQ ID NO: 4645751 - DNA, 17 bp, Homo sapiens
gaagcctgggggcctgg

SEQ ID NO: 4645752 - DNA, 22 bp, Homo sapiens
gaagcctgggggcctggctggc

SEQ ID NO: 4645753 - DNA, 20 bp, Homo sapiens
gaagccttcccccagcaagg

SEQ ID NO: 4645754 - DNA, 15 bp, Homo sapiens
gaagcctttcctgta

SEQ ID NO: 4645755 - DNA, 14 bp, Homo sapiens
gaagctaacaggga

SEQ ID NO: 4645756 - DNA, 16 bp, Homo sapiens
gaagctaacagggaag

SEQ ID NO: 4645757 - DNA, 18 bp, Homo sapiens
gaagctaacagggaaggc

SEQ ID NO: 4645758 - DNA, 19 bp, Homo sapiens
gaagctaacagggaaggca

SEQ ID NO: 4645759 - DNA, 20 bp, Homo sapiens
gaagctaacagggaaggcag

SEQ ID NO: 4645760 - DNA, 13 bp, Homo sapiens
gaagctccatgga

SEQ ID NO: 4645761 - DNA, 19 bp, Homo sapiens
gaagctgcgggggcaggcc

SEQ ID NO: 4645762 - DNA, 13 bp, Homo sapiens
gaagctgctccag

SEQ ID NO: 4645763 - DNA, 14 bp, Homo sapiens
gaagctgctccagg

SEQ ID NO: 4645764 - DNA, 18 bp, Homo sapiens
gaagctgctccaggcctg

SEQ ID NO: 4645765 - DNA, 16 bp, Homo sapiens
gaagctgctgaggccc

SEQ ID NO: 4645766 - DNA, 15 bp, Homo sapiens
gaagcttactctctg

SEQ ID NO: 4645767 - DNA, 18 bp, Homo sapiens
gaagcttactctctgctt

SEQ ID NO: 4645768 - DNA, 19 bp, Homo sapiens
gaagcttactctctgcttc

SEQ ID NO: 4645769 - DNA, 14 bp, Homo sapiens
gaagcttggaggag

SEQ ID NO: 4645770 - DNA, 15 bp, Homo sapiens
gaaggaaactggaat

SEQ ID NO: 4645771 - DNA, 20 bp, Homo sapiens
gaaggaaatcccatcagtga

SEQ ID NO: 4645772 - DNA, 21 bp, Homo sapiens
gaaggaaggcctgagcccctt

SEQ ID NO: 4645773 - DNA, 18 bp, Homo sapiens
gaaggacatgagatcagg

SEQ ID NO: 4645774 - DNA, 22 bp, Homo sapiens
gaaggacatgagatcagggcct

SEQ ID NO: 4645775 - DNA, 22 bp, Homo sapiens
gaaggattcagtcataaagagg

SEQ ID NO: 4645776 - DNA, 16 bp, Homo sapiens
gaaggcagacagcagg

SEQ ID NO: 4645777 - DNA, 19 bp, Homo sapiens
gaaggcagacagcaggcag

SEQ ID NO: 4645778 - DNA, 21 bp, Homo sapiens
gaaggcagacagcaggcagcg

SEQ ID NO: 4645779 - DNA, 14 bp, Homo sapiens
gaaggcaggcaggg

SEQ ID NO: 4645780 - DNA, 16 bp, Homo sapiens
gaaggcaggcagggct

SEQ ID NO: 4645781 - DNA, 14 bp, Homo sapiens
gaaggcctcgcagg

SEQ ID NO: 4645782 - DNA, 14 bp, Homo sapiens
gaaggcctgagccc

SEQ ID NO: 4645783 - DNA, 15 bp, Homo sapiens
gaaggctggagaagg

SEQ ID NO: 4645784 - DNA, 17 bp, Homo sapiens
gaaggcttaagaactgc

SEQ ID NO: 4645785 - DNA, 23 bp, Homo sapiens
gaaggctttcagggcctccagcc

SEQ ID NO: 4645786 - DNA, 20 bp, Homo sapiens
gaaggggctatcctgggacc

SEQ ID NO: 4645787 - DNA, 20 bp, Homo sapiens
gaagggggccctgctacctg

SEQ ID NO: 4645788 - DNA, 18 bp, Homo sapiens
gaagggtttttagagaat

SEQ ID NO: 4645789 - DNA, 19 bp, Homo sapiens
gaaggtctttgttatgaca

SEQ ID NO: 4645790 - DNA, 22 bp, Homo sapiens
gaaggtggtggcatttttgctt

SEQ ID NO: 4645791 - DNA, 18 bp, Homo sapiens
gaagtagcttgctccctg

SEQ ID NO: 4645792 - DNA, 14 bp, Homo sapiens
gaagtagtccttgg

SEQ ID NO: 4645793 - DNA, 13 bp, Homo sapiens
gaagtattgctga

SEQ ID NO: 4645794 - DNA, 14 bp, Homo sapiens
gaagtatttatcag

SEQ ID NO: 4645795 - DNA, 13 bp, Homo sapiens
gaagtcagagagg

SEQ ID NO: 4645796 - DNA, 15 bp, Homo sapiens
gaagtcctagcccct

SEQ ID NO: 4645797 - DNA, 23 bp, Homo sapiens
gaagtcgtccttactcctgtggg

SEQ ID NO: 4645798 - DNA, 15 bp, Homo sapiens
gaagtctagaatcat

SEQ ID NO: 4645799 - DNA, 16 bp, Homo sapiens
gaagtgcgtgaatgta

SEQ ID NO: 4645800 - DNA, 16 bp, Homo sapiens
gaagtgtgacttctta

SEQ ID NO: 4645801 - DNA, 21 bp, Homo sapiens
gaagtgttgcatggatgtttt

SEQ ID NO: 4645802 - DNA, 22 bp, Homo sapiens
gaagtgttgcatggatgtttta

SEQ ID NO: 4645803 - DNA, 18 bp, Homo sapiens
gaagttgtggaggaggtg

SEQ ID NO: 4645804 - DNA, 19 bp, Homo sapiens
gaagtttaacaagtattta

SEQ ID NO: 4645805 - DNA, 18 bp, Homo sapiens
gaagtttaattgacttat

SEQ ID NO: 4645806 - DNA, 15 bp, Homo sapiens
gaataaacacacaga

SEQ ID NO: 4645807 - DNA, 14 bp, Homo sapiens
gaataaagttgcag

SEQ ID NO: 4645808 - DNA, 16 bp, Homo sapiens
gaataacatttaaatt

SEQ ID NO: 4645809 - DNA, 22 bp, Homo sapiens
gaataagcagaacatactgttc

SEQ ID NO: 4645810 - DNA, 23 bp, Homo sapiens
gaataagcagaacatactgttct

SEQ ID NO: 4645811 - DNA, 21 bp, Homo sapiens
gaatacattaacggtgctaaa

SEQ ID NO: 4645812 - DNA, 12 bp, Homo sapiens
gaatacatttta

SEQ ID NO: 4645813 - DNA, 20 bp, Homo sapiens
gaatacccaggaagactttg

SEQ ID NO: 4645814 - DNA, 12 bp, Homo sapiens
gaatacttattt

SEQ ID NO: 4645815 - DNA, 16 bp, Homo sapiens
gaatagaagcaaatta

SEQ ID NO: 4645816 - DNA, 22 bp, Homo sapiens
gaatagtgctgcaataaacata

SEQ ID NO: 4645817 - DNA, 21 bp, Homo sapiens
gaatagttggtcatctagcaa

SEQ ID NO: 4645818 - DNA, 11 bp, Homo sapiens
gaatataagaa

SEQ ID NO: 4645819 - DNA, 12 bp, Homo sapiens
gaatataagaaa

SEQ ID NO: 4645820 - DNA, 13 bp, Homo sapiens
gaatataagaaaa

SEQ ID NO: 4645821 - DNA, 18 bp, Homo sapiens
cttaatcttgctttcttt

SEQ ID NO: 4645822 - DNA, 19 bp, Homo sapiens
cttaatggtatcctactga

SEQ ID NO: 4645823 - DNA, 23 bp, Homo sapiens
cttaatggtatcctactgagcat

SEQ ID NO: 4645824 - DNA, 13 bp, Homo sapiens
cttaatgttctta

SEQ ID NO: 4645825 - DNA, 14 bp, Homo sapiens
cttaatgttcttat

SEQ ID NO: 4645826 - DNA, 20 bp, Homo sapiens
cttaatttgtaaacttctga

SEQ ID NO: 4645827 - DNA, 16 bp, Homo sapiens
cttaattttacagccc

SEQ ID NO: 4645828 - DNA, 21 bp, Homo sapiens
cttacaatcgcaaatcaaaac

SEQ ID NO: 4645829 - DNA, 14 bp, Homo sapiens
cttacaatgtgaat

SEQ ID NO: 4645830 - DNA, 23 bp, Homo sapiens
cttacaatgtgaataatggcact

SEQ ID NO: 4645831 - DNA, 19 bp, Homo sapiens
cttaccagtgacgctgctg

SEQ ID NO: 4645832 - DNA, 16 bp, Homo sapiens
cttacccatcttgctt

SEQ ID NO: 4645833 - DNA, 18 bp, Homo sapiens
cttacggccatctctttg

SEQ ID NO: 4645834 - DNA, 18 bp, Homo sapiens
cttactaatgtaaaatga

SEQ ID NO: 4645835 - DNA, 15 bp, Homo sapiens
cttactactttaaat

SEQ ID NO: 4645836 - DNA, 18 bp, Homo sapiens
cttactactttaaatcct

SEQ ID NO: 4645837 - DNA, 13 bp, Homo sapiens
cttactctctgct

SEQ ID NO: 4645838 - DNA, 14 bp, Homo sapiens
cttactgatattat

SEQ ID NO: 4645839 - DNA, 13 bp, Homo sapiens
cttactgcctgac

SEQ ID NO: 4645840 - DNA, 16 bp, Homo sapiens
cttactgcctgacctt

SEQ ID NO: 4645841 - DNA, 22 bp, Homo sapiens
cttactgcctgaccttggaatc

SEQ ID NO: 4645842 - DNA, 14 bp, Homo sapiens
cttacttagtgtta

SEQ ID NO: 4645843 - DNA, 14 bp, Homo sapiens
cttacttggaactg

SEQ ID NO: 4645844 - DNA, 22 bp, Homo sapiens
cttacttgtcctttgaggcccc

SEQ ID NO: 4645845 - DNA, 17 bp, Homo sapiens
cttacttttattatttt

SEQ ID NO: 4645846 - DNA, 21 bp, Homo sapiens
cttacttttcctggacttaaa

SEQ ID NO: 4645847 - DNA, 18 bp, Homo sapiens
cttagaggttctgcctct

SEQ ID NO: 4645848 - DNA, 12 bp, Homo sapiens
cttagagtgtag

SEQ ID NO: 4645849 - DNA, 14 bp, Homo sapiens
cttagagtgtagct

SEQ ID NO: 4645850 - DNA, 15 bp, Homo sapiens
cttagagtgtagctg

SEQ ID NO: 4645851 - DNA, 18 bp, Homo sapiens
cttagagtgtagctgtaa

SEQ ID NO: 4645852 - DNA, 14 bp, Homo sapiens
cttagcatggtacc

SEQ ID NO: 4645853 - DNA, 13 bp, Homo sapiens
cttagctttgaaa

SEQ ID NO: 4645854 - DNA, 21 bp, Homo sapiens
cttaggcccggagctgcccct

SEQ ID NO: 4645855 - DNA, 18 bp, Homo sapiens
cttagggcactgggctgt

SEQ ID NO: 4645856 - DNA, 20 bp, Homo sapiens
cttaggtagtcatgctgtgc

SEQ ID NO: 4645857 - DNA, 11 bp, Homo sapiens
cttaggtcttc

SEQ ID NO: 4645858 - DNA, 20 bp, Homo sapiens
cttaggtcttcctgtggctc

SEQ ID NO: 4645859 - DNA, 17 bp, Homo sapiens
cttagtgggccagggct

SEQ ID NO: 4645860 - DNA, 23 bp, Homo sapiens
cttagtgggccagggctgccctg

SEQ ID NO: 4645861 - DNA, 17 bp, Homo sapiens
cttagtttcaaagtgtc

SEQ ID NO: 4645862 - DNA, 20 bp, Homo sapiens
cttagtttcaaagtgtctca

SEQ ID NO: 4645863 - DNA, 14 bp, Homo sapiens
cttataaaatcaat

SEQ ID NO: 4645864 - DNA, 13 bp, Homo sapiens
cttatcagagcta

SEQ ID NO: 4645865 - DNA, 14 bp, Homo sapiens
cttatctcactgtt

SEQ ID NO: 4645866 - DNA, 22 bp, Homo sapiens
cttatgacagaggttttgaaat

SEQ ID NO: 4645867 - DNA, 20 bp, Homo sapiens
cttatgagatctaatgtgaa

SEQ ID NO: 4645868 - DNA, 20 bp, Homo sapiens
cttatgagggtcctctactt

SEQ ID NO: 4645869 - DNA, 17 bp, Homo sapiens
cttatgggggtgtttct

SEQ ID NO: 4645870 - DNA, 17 bp, Homo sapiens
cttatgtgaaaaattaa

SEQ ID NO: 4645871 - DNA, 18 bp, Homo sapiens
cttatgtgaaaaattaac

SEQ ID NO: 4645872 - DNA, 19 bp, Homo sapiens
cttatgtgaaaaattaact

SEQ ID NO: 4645873 - DNA, 15 bp, Homo sapiens
cttattaaagtattc

SEQ ID NO: 4645874 - DNA, 18 bp, Homo sapiens
cttattacctcaggtgcc

SEQ ID NO: 4645875 - DNA, 11 bp, Homo sapiens
cttattgaaaa

SEQ ID NO: 4645876 - DNA, 14 bp, Homo sapiens
cttattggaaatgt

SEQ ID NO: 4645877 - DNA, 22 bp, Homo sapiens
cttattgggatatcattttaaa

SEQ ID NO: 4645878 - DNA, 16 bp, Homo sapiens
cttatttctatgacaa

SEQ ID NO: 4645879 - DNA, 18 bp, Homo sapiens
cttatttctatgacaaat

SEQ ID NO: 4645880 - DNA, 18 bp, Homo sapiens
cttatttctgctctggaa

SEQ ID NO: 4645881 - DNA, 19 bp, Homo sapiens
cttatttctgctctggaat

SEQ ID NO: 4645882 - DNA, 18 bp, Homo sapiens
cttatttgccagagccaa

SEQ ID NO: 4645883 - DNA, 16 bp, Homo sapiens
cttatttttagccata

SEQ ID NO: 4645884 - DNA, 18 bp, Homo sapiens
cttatttttagccataat

SEQ ID NO: 4645885 - DNA, 21 bp, Homo sapiens
cttatttttagccataatttt

SEQ ID NO: 4645886 - DNA, 18 bp, Homo sapiens
cttcaacttttctcttta

SEQ ID NO: 4645887 - DNA, 16 bp, Homo sapiens
cttcaaggaggcccac

SEQ ID NO: 4645888 - DNA, 17 bp, Homo sapiens
cttcaaggtggcagctg

SEQ ID NO: 4645889 - DNA, 20 bp, Homo sapiens
cttcaaggtggcagctgtta

SEQ ID NO: 4645890 - DNA, 18 bp, Homo sapiens
cttcaatatgaatctata

SEQ ID NO: 4645891 - DNA, 15 bp, Homo sapiens
cttcacctcactgaa

SEQ ID NO: 4645892 - DNA, 19 bp, Homo sapiens
cttcacctctgggacccca

SEQ ID NO: 4645893 - DNA, 19 bp, Homo sapiens
cttcacctcttccactcct

SEQ ID NO: 4645894 - DNA, 20 bp, Homo sapiens
cttcacctgattcaactaaa

SEQ ID NO: 4645895 - DNA, 19 bp, Homo sapiens
cttcactaggcattgtgat

SEQ ID NO: 4645896 - DNA, 15 bp, Homo sapiens
cttcactcctgctgt

SEQ ID NO: 4645897 - DNA, 13 bp, Homo sapiens
cttcactctctcc

SEQ ID NO: 4645898 - DNA, 16 bp, Homo sapiens
cttcagcccccaccag

SEQ ID NO: 4645899 - DNA, 23 bp, Homo sapiens
cttcaggaacacccccatgacat

SEQ ID NO: 4645900 - DNA, 17 bp, Homo sapiens
cttcagtattttctcca

SEQ ID NO: 4645901 - DNA, 14 bp, Homo sapiens
cttcagtcagggtt

SEQ ID NO: 4645902 - DNA, 20 bp, Homo sapiens
cttcagtgactcctgctggt

SEQ ID NO: 4645903 - DNA, 23 bp, Homo sapiens
cttcagtgactcctgctggtacc

SEQ ID NO: 4645904 - DNA, 14 bp, Homo sapiens
cttcagttctgctt

SEQ ID NO: 4645905 - DNA, 20 bp, Homo sapiens
cttcagttctgcttgctccc

SEQ ID NO: 4645906 - DNA, 21 bp, Homo sapiens
cttcatgtcctaaagaagaca

SEQ ID NO: 4645907 - DNA, 21 bp, Homo sapiens
cttcattattcaagaatgaaa

SEQ ID NO: 4645908 - DNA, 12 bp, Homo sapiens
cttcatttcaat

SEQ ID NO: 4645909 - DNA, 18 bp, Homo sapiens
cttcatttcaatcattga

SEQ ID NO: 4645910 - DNA, 16 bp, Homo sapiens
cttcatttggaggaat

SEQ ID NO: 4645911 - DNA, 21 bp, Homo sapiens
cttcattttattaatattttt

SEQ ID NO: 4645912 - DNA, 22 bp, Homo sapiens
cttcattttattaatatttttc

SEQ ID NO: 4645913 - DNA, 15 bp, Homo sapiens
cttccaaataataaa

SEQ ID NO: 4645914 - DNA, 16 bp, Homo sapiens
cttccaagctccaaat

SEQ ID NO: 4645915 - DNA, 21 bp, Homo sapiens
cttccaagtcctttatctgca

SEQ ID NO: 4645916 - DNA, 16 bp, Homo sapiens
cttccacctcacaact

SEQ ID NO: 4645917 - DNA, 19 bp, Homo sapiens
cttccacctcacaactcct

SEQ ID NO: 4645918 - DNA, 22 bp, Homo sapiens
cttccacctcacaactccttcc

SEQ ID NO: 4645919 - DNA, 16 bp, Homo sapiens
cttccacctcacccca

SEQ ID NO: 4645920 - DNA, 20 bp, Homo sapiens
cttccacctcaccccactta

SEQ ID NO: 4645921 - DNA, 15 bp, Homo sapiens
cttccacctccagcc

SEQ ID NO: 4645922 - DNA, 19 bp, Homo sapiens
cttccacctccagcctctg

SEQ ID NO: 4645923 - DNA, 18 bp, Homo sapiens
cttccactccttctctca

SEQ ID NO: 4645924 - DNA, 16 bp, Homo sapiens
cttccagcctttttag

SEQ ID NO: 4645925 - DNA, 18 bp, Homo sapiens
cttccagctagtgaccca

SEQ ID NO: 4645926 - DNA, 14 bp, Homo sapiens
cttccatagcctaa

SEQ ID NO: 4645927 - DNA, 17 bp, Homo sapiens
cttccatcccaaccagt

SEQ ID NO: 4645928 - DNA, 21 bp, Homo sapiens
cttccatcccaaccagtgcca

SEQ ID NO: 4645929 - DNA, 20 bp, Homo sapiens
cttccatgccgtcctgcagt

SEQ ID NO: 4645930 - DNA, 18 bp, Homo sapiens
cttccatgctcccaactc

SEQ ID NO: 4645931 - DNA, 19 bp, Homo sapiens
cttccatgctcccaactcc

SEQ ID NO: 4645932 - DNA, 20 bp, Homo sapiens
ctgtgcaccacttgacagac

SEQ ID NO: 4645933 - DNA, 22 bp, Homo sapiens
ctgtgcacttagccatgatggc

SEQ ID NO: 4645934 - DNA, 15 bp, Homo sapiens
ctgtgcatgtatgtc

SEQ ID NO: 4645935 - DNA, 17 bp, Homo sapiens
ctgtgcatgtatgtctt

SEQ ID NO: 4645936 - DNA, 16 bp, Homo sapiens
ctgtgccagagcctgg

SEQ ID NO: 4645937 - DNA, 18 bp, Homo sapiens
ctgtgccagagcctgggg

SEQ ID NO: 4645938 - DNA, 20 bp, Homo sapiens
ctgtgccagagcctggggct

SEQ ID NO: 4645939 - DNA, 13 bp, Homo sapiens
ctgtgccagcagg

SEQ ID NO: 4645940 - DNA, 14 bp, Homo sapiens
ctgtgccatgctgg

SEQ ID NO: 4645941 - DNA, 20 bp, Homo sapiens
ctgtgccatgctgggccact

SEQ ID NO: 4645942 - DNA, 22 bp, Homo sapiens
ctgtgcctcgctccccactctg

SEQ ID NO: 4645943 - DNA, 24 bp, Homo sapiens
ctgtgcctcgctccccactctgct

SEQ ID NO: 4645944 - DNA, 15 bp, Homo sapiens
ctgtgctacgtgtga

SEQ ID NO: 4645945 - DNA, 16 bp, Homo sapiens
ctgtgctacgtgtgaa

SEQ ID NO: 4645946 - DNA, 20 bp, Homo sapiens
ctgtgcttccttggttcatg

SEQ ID NO: 4645947 - DNA, 12 bp, Homo sapiens
ctgtggaaagct

SEQ ID NO: 4645948 - DNA, 14 bp, Homo sapiens
ctgtggaaagctag

SEQ ID NO: 4645949 - DNA, 19 bp, Homo sapiens
ctgtggaatgagtgtgcat

SEQ ID NO: 4645950 - DNA, 14 bp, Homo sapiens
ctgtggagctgcca

SEQ ID NO: 4645951 - DNA, 17 bp, Homo sapiens
ctgtggagctgccacag

SEQ ID NO: 4645952 - DNA, 16 bp, Homo sapiens
ctgtggccaagttctt

SEQ ID NO: 4645953 - DNA, 15 bp, Homo sapiens
ctgtggccttggtct

SEQ ID NO: 4645954 - DNA, 14 bp, Homo sapiens
ctgtggctccctct

SEQ ID NO: 4645955 - DNA, 18 bp, Homo sapiens
ctgtgggactcatccttg

SEQ ID NO: 4645956 - DNA, 15 bp, Homo sapiens
ctgtgggagcctcgc

SEQ ID NO: 4645957 - DNA, 16 bp, Homo sapiens
ctgtgggagcctcgca

SEQ ID NO: 4645958 - DNA, 21 bp, Homo sapiens
ctgtgggagcctcgcaacccg

SEQ ID NO: 4645959 - DNA, 15 bp, Homo sapiens
ctgtggggtggacct

SEQ ID NO: 4645960 - DNA, 13 bp, Homo sapiens
ctgtgggtctctg

SEQ ID NO: 4645961 - DNA, 14 bp, Homo sapiens
ctgtgggtctctga

SEQ ID NO: 4645962 - DNA, 17 bp, Homo sapiens
ctgtgggtctctgaagg

SEQ ID NO: 4645963 - DNA, 23 bp, Homo sapiens
ctgtggttgcagtctttccccca

SEQ ID NO: 4645964 - DNA, 18 bp, Homo sapiens
ctgtgtaactttctctta

SEQ ID NO: 4645965 - DNA, 15 bp, Homo sapiens
ctgtgtacaaagaaa

SEQ ID NO: 4645966 - DNA, 20 bp, Homo sapiens
ctgtgtagctgtgacctgct

SEQ ID NO: 4645967 - DNA, 20 bp, Homo sapiens
ctgtgtagttccctctgcct

SEQ ID NO: 4645968 - DNA, 22 bp, Homo sapiens
ctgtgtctgaatcatgtctgta

SEQ ID NO: 4645969 - DNA, 15 bp, Homo sapiens
ctgtgtctgagtggc

SEQ ID NO: 4645970 - DNA, 13 bp, Homo sapiens
ctgtgtgaatgtg

SEQ ID NO: 4645971 - DNA, 18 bp, Homo sapiens
ctgtgtgctcctccttgg

SEQ ID NO: 4645972 - DNA, 18 bp, Homo sapiens
ctgtgtggtgcattcctg

SEQ ID NO: 4645973 - DNA, 15 bp, Homo sapiens
ctgtgtgtctgtcct

SEQ ID NO: 4645974 - DNA, 15 bp, Homo sapiens
ctgtgtgtgttgccc

SEQ ID NO: 4645975 - DNA, 18 bp, Homo sapiens
ctgtgttctaacttattt

SEQ ID NO: 4645976 - DNA, 21 bp, Homo sapiens
ctgtgttctttccccaggggc

SEQ ID NO: 4645977 - DNA, 13 bp, Homo sapiens
ctgtgttgccaca

SEQ ID NO: 4645978 - DNA, 22 bp, Homo sapiens
ctgtgtttcattacttgaatgt

SEQ ID NO: 4645979 - DNA, 20 bp, Homo sapiens
ctgtgtttgcagcctgctct

SEQ ID NO: 4645980 - DNA, 22 bp, Homo sapiens
ctgttaaggacccttttaagca

SEQ ID NO: 4645981 - DNA, 16 bp, Homo sapiens
ctgttacactggagga

SEQ ID NO: 4645982 - DNA, 22 bp, Homo sapiens
ctgttacccagggtggagtgca

SEQ ID NO: 4645983 - DNA, 13 bp, Homo sapiens
ctgttagcagaca

SEQ ID NO: 4645984 - DNA, 13 bp, Homo sapiens
ctgttagctttcc

SEQ ID NO: 4645985 - DNA, 19 bp, Homo sapiens
ctgttagctttccaaggaa

SEQ ID NO: 4645986 - DNA, 23 bp, Homo sapiens
ctgttagctttccaaggaagcag

SEQ ID NO: 4645987 - DNA, 14 bp, Homo sapiens
ctgttatttttaag

SEQ ID NO: 4645988 - DNA, 20 bp, Homo sapiens
ctgttcacagcttttcttga

SEQ ID NO: 4645989 - DNA, 14 bp, Homo sapiens
ctgttcatggcaga

SEQ ID NO: 4645990 - DNA, 23 bp, Homo sapiens
ctgttcatggcagatgtaggagg

SEQ ID NO: 4645991 - DNA, 14 bp, Homo sapiens
ctgttccccaccca

SEQ ID NO: 4645992 - DNA, 15 bp, Homo sapiens
ctgttccccacccag

SEQ ID NO: 4645993 - DNA, 16 bp, Homo sapiens
ctgttcctgttcagta

SEQ ID NO: 4645994 - DNA, 19 bp, Homo sapiens
ctgttctacccgttccaaa

SEQ ID NO: 4645995 - DNA, 20 bp, Homo sapiens
ctgttctacccgttccaaaa

SEQ ID NO: 4645996 - DNA, 19 bp, Homo sapiens
ctgttctcaacatactgta

SEQ ID NO: 4645997 - DNA, 16 bp, Homo sapiens
ctgttcttagagtgta

SEQ ID NO: 4645998 - DNA, 20 bp, Homo sapiens
ctgttcttgggcctcaggct

SEQ ID NO: 4645999 - DNA, 17 bp, Homo sapiens
ctgttgaatttcccaca

SEQ ID NO: 4646000 - DNA, 22 bp, Homo sapiens
ctgttgactggctgtgtgacct

SEQ ID NO: 4646001 - DNA, 13 bp, Homo sapiens
ctgttgcctcctc

SEQ ID NO: 4646002 - DNA, 14 bp, Homo sapiens
ctgttgcctcctct

SEQ ID NO: 4646003 - DNA, 15 bp, Homo sapiens
ctgttgcctcctctc

SEQ ID NO: 4646004 - DNA, 18 bp, Homo sapiens
ctgttgctatagagccta

SEQ ID NO: 4646005 - DNA, 15 bp, Homo sapiens
ctgttggttcaaact

SEQ ID NO: 4646006 - DNA, 18 bp, Homo sapiens
ctgttgtcaccttcacct

SEQ ID NO: 4646007 - DNA, 13 bp, Homo sapiens
ctgtttcaaatgt

SEQ ID NO: 4646008 - DNA, 17 bp, Homo sapiens
ctgtttcatagttttct

SEQ ID NO: 4646009 - DNA, 14 bp, Homo sapiens
ctgtttcccaagct

SEQ ID NO: 4646010 - DNA, 13 bp, Homo sapiens
ctgtttccctgct

SEQ ID NO: 4646011 - DNA, 14 bp, Homo sapiens
ctgtttccctgctg

SEQ ID NO: 4646012 - DNA, 16 bp, Homo sapiens
ctgtttccctgctgaa

SEQ ID NO: 4646013 - DNA, 18 bp, Homo sapiens
ctgtttcctggcctcaga

SEQ ID NO: 4646014 - DNA, 21 bp, Homo sapiens
ctgtttcctggcctcagagct

SEQ ID NO: 4646015 - DNA, 15 bp, Homo sapiens
ctgtttctaagaaaa

SEQ ID NO: 4646016 - DNA, 16 bp, Homo sapiens
ctgtttcttctctaca

SEQ ID NO: 4646017 - DNA, 20 bp, Homo sapiens
ctgtttgttatctcttgtta

SEQ ID NO: 4646018 - DNA, 14 bp, Homo sapiens
ctgttttattactg

SEQ ID NO: 4646019 - DNA, 18 bp, Homo sapiens
ctgttttattactgtttc

SEQ ID NO: 4646020 - DNA, 17 bp, Homo sapiens
ctgttttgtaaagtccc

SEQ ID NO: 4646021 - DNA, 12 bp, Homo sapiens
ctgtttttggac

SEQ ID NO: 4646022 - DNA, 17 bp, Homo sapiens
cttaaaaatacttctat

SEQ ID NO: 4646023 - DNA, 20 bp, Homo sapiens
cttaaaactttattaaaaga

SEQ ID NO: 4646024 - DNA, 15 bp, Homo sapiens
cttaaaatctctaat

SEQ ID NO: 4646025 - DNA, 18 bp, Homo sapiens
cttaaaatggaattgaaa

SEQ ID NO: 4646026 - DNA, 15 bp, Homo sapiens
cttaaaatgtgtaca

SEQ ID NO: 4646027 - DNA, 12 bp, Homo sapiens
cttaaaggacat

SEQ ID NO: 4646028 - DNA, 16 bp, Homo sapiens
cttaaaggacataaaa

SEQ ID NO: 4646029 - DNA, 21 bp, Homo sapiens
cttaaatattgtaatatgaca

SEQ ID NO: 4646030 - DNA, 23 bp, Homo sapiens
cttaaatattgtaatatgacaga

SEQ ID NO: 4646031 - DNA, 15 bp, Homo sapiens
cttaacctgggacca

SEQ ID NO: 4646032 - DNA, 23 bp, Homo sapiens
cttaactattaaggccttttcca

SEQ ID NO: 4646033 - DNA, 12 bp, Homo sapiens
cttaactttata

SEQ ID NO: 4646034 - DNA, 13 bp, Homo sapiens
cttaagaaaattt

SEQ ID NO: 4646035 - DNA, 19 bp, Homo sapiens
cttaagctcccctgcctta

SEQ ID NO: 4646036 - DNA, 22 bp, Homo sapiens
cttaagctcccctgccttaacc

SEQ ID NO: 4646037 - DNA, 18 bp, Homo sapiens
cttaaggaagtttgattt

SEQ ID NO: 4646038 - DNA, 20 bp, Homo sapiens
cttaaggaagtttgattttt

SEQ ID NO: 4646039 - DNA, 21 bp, Homo sapiens
cttaaggcacagtgggagctg

SEQ ID NO: 4646040 - DNA, 19 bp, Homo sapiens
cttaatatatacatttttt

SEQ ID NO: 4646041 - DNA, 20 bp, Homo sapiens
cttaatcttctctcttgatt

SEQ ID NO: 4646042 - DNA, 17 bp, Homo sapiens
cttaatcttgctttctt

SEQ ID NO: 4646043 - DNA, 22 bp, Homo sapiens
ctggccggagcaaactctgctg

SEQ ID NO: 4646044 - DNA, 16 bp, Homo sapiens
ctggcctcagagcttc

SEQ ID NO: 4646045 - DNA, 19 bp, Homo sapiens
ctggcctcagagcttcctg

SEQ ID NO: 4646046 - DNA, 14 bp, Homo sapiens
ctggcctcccaaat

SEQ ID NO: 4646047 - DNA, 16 bp, Homo sapiens
ctggcctcccaaatga

SEQ ID NO: 4646048 - DNA, 13 bp, Homo sapiens
ctggcctggcaca

SEQ ID NO: 4646049 - DNA, 18 bp, Homo sapiens
ctggcctggcacacatca

SEQ ID NO: 4646050 - DNA, 17 bp, Homo sapiens
ctggcctggcccccagc

SEQ ID NO: 4646051 - DNA, 19 bp, Homo sapiens
ctggccttaaagagggaca

SEQ ID NO: 4646052 - DNA, 21 bp, Homo sapiens
ctggccttaaagagggacagg

SEQ ID NO: 4646053 - DNA, 22 bp, Homo sapiens
ctggccttaaagagggacaggc

SEQ ID NO: 4646054 - DNA, 15 bp, Homo sapiens
ctggccttctaggaa

SEQ ID NO: 4646055 - DNA, 22 bp, Homo sapiens
ctggccttctaggaatggagga

SEQ ID NO: 4646056 - DNA, 14 bp, Homo sapiens
ctggctactccctg

SEQ ID NO: 4646057 - DNA, 16 bp, Homo sapiens
ctggctactccctgga

SEQ ID NO: 4646058 - DNA, 17 bp, Homo sapiens
ctggctactccctggac

SEQ ID NO: 4646059 - DNA, 18 bp, Homo sapiens
ctggctactccctggacc

SEQ ID NO: 4646060 - DNA, 19 bp, Homo sapiens
ctggctactccctggacca

SEQ ID NO: 4646061 - DNA, 21 bp, Homo sapiens
ctggctactccctggaccacg

SEQ ID NO: 4646062 - DNA, 17 bp, Homo sapiens
ctggctagagggcccaa

SEQ ID NO: 4646063 - DNA, 15 bp, Homo sapiens
ctggctcacagtaca

SEQ ID NO: 4646064 - DNA, 22 bp, Homo sapiens
ctggctcacagtacagcatgtg

SEQ ID NO: 4646065 - DNA, 14 bp, Homo sapiens
ctggctccagatgc

SEQ ID NO: 4646066 - DNA, 20 bp, Homo sapiens
ctggctccagatgcagggca

SEQ ID NO: 4646067 - DNA, 11 bp, Homo sapiens
ctggctggctg

SEQ ID NO: 4646068 - DNA, 13 bp, Homo sapiens
ctggctgtcgaga

SEQ ID NO: 4646069 - DNA, 18 bp, Homo sapiens
ctggcttcccatccccag

SEQ ID NO: 4646070 - DNA, 20 bp, Homo sapiens
ctggcttcccatccccagcg

SEQ ID NO: 4646071 - DNA, 21 bp, Homo sapiens
ctggcttcccatccccagcga

SEQ ID NO: 4646072 - DNA, 14 bp, Homo sapiens
ctgggaaagggaga

SEQ ID NO: 4646073 - DNA, 23 bp, Homo sapiens
ctgggaacatcacattcctctgc

SEQ ID NO: 4646074 - DNA, 16 bp, Homo sapiens
ctgggaactctcctgg

SEQ ID NO: 4646075 - DNA, 16 bp, Homo sapiens
ctgggaaggctacttc

SEQ ID NO: 4646076 - DNA, 23 bp, Homo sapiens
ctgggaaggctacttcggggctg

SEQ ID NO: 4646077 - DNA, 20 bp, Homo sapiens
ctgggaagtcctagcccctc

SEQ ID NO: 4646078 - DNA, 17 bp, Homo sapiens
ctgggaccaacctgacc

SEQ ID NO: 4646079 - DNA, 17 bp, Homo sapiens
ctgggaccccagctgct

SEQ ID NO: 4646080 - DNA, 18 bp, Homo sapiens
ctgggaccccagctgctc

SEQ ID NO: 4646081 - DNA, 19 bp, Homo sapiens
ctgggaccccagctgctct

SEQ ID NO: 4646082 - DNA, 23 bp, Homo sapiens
ctgggaccgctacaccactctgg

SEQ ID NO: 4646083 - DNA, 21 bp, Homo sapiens
ctgggacctccccagcccagg

SEQ ID NO: 4646084 - DNA, 15 bp, Homo sapiens
ctgggacgtggctca

SEQ ID NO: 4646085 - DNA, 16 bp, Homo sapiens
ctgggacgtggctcag

SEQ ID NO: 4646086 - DNA, 17 bp, Homo sapiens
ctgggacgtggctcagc

SEQ ID NO: 4646087 - DNA, 18 bp, Homo sapiens
ctgggacgtggctcagcc

SEQ ID NO: 4646088 - DNA, 23 bp, Homo sapiens
ctgggacgtggctcagccagcac

SEQ ID NO: 4646089 - DNA, 17 bp, Homo sapiens
ctgggactttcccaccc

SEQ ID NO: 4646090 - DNA, 19 bp, Homo sapiens
ctgggactttcccacccag

SEQ ID NO: 4646091 - DNA, 12 bp, Homo sapiens
ctgggagaggtt

SEQ ID NO: 4646092 - DNA, 17 bp, Homo sapiens
ctgggatgcccttcccc

SEQ ID NO: 4646093 - DNA, 19 bp, Homo sapiens
ctgggatgcccttccccct

SEQ ID NO: 4646094 - DNA, 23 bp, Homo sapiens
ctgggattacaggcgcctgccac

SEQ ID NO: 4646095 - DNA, 16 bp, Homo sapiens
ctgggcaatggccagg

SEQ ID NO: 4646096 - DNA, 13 bp, Homo sapiens
ctgggccagggtc

SEQ ID NO: 4646097 - DNA, 17 bp, Homo sapiens
ctgggccagggtctgtg

SEQ ID NO: 4646098 - DNA, 19 bp, Homo sapiens
ctgggccagggtctgtgtg

SEQ ID NO: 4646099 - DNA, 20 bp, Homo sapiens
ctgggccagggtctgtgtga

SEQ ID NO: 4646100 - DNA, 19 bp, Homo sapiens
ctgggccccacatggctta

SEQ ID NO: 4646101 - DNA, 23 bp, Homo sapiens
ctgggccctctttccctgcgaga

SEQ ID NO: 4646102 - DNA, 14 bp, Homo sapiens
ctgggccctggggc

SEQ ID NO: 4646103 - DNA, 22 bp, Homo sapiens
ctgggccctggggcctgtactg

SEQ ID NO: 4646104 - DNA, 16 bp, Homo sapiens
ctgattttgaggttta

SEQ ID NO: 4646105 - DNA, 16 bp, Homo sapiens
ctgcaaaaattatata

SEQ ID NO: 4646106 - DNA, 19 bp, Homo sapiens
ctgcaaaaggcctcttgta

SEQ ID NO: 4646107 - DNA, 15 bp, Homo sapiens
ctgcaaaattaaatc

SEQ ID NO: 4646108 - DNA, 15 bp, Homo sapiens
ctgcaaacagaacag

SEQ ID NO: 4646109 - DNA, 15 bp, Homo sapiens
ctgcaaaggagaagc

SEQ ID NO: 4646110 - DNA, 21 bp, Homo sapiens
ctgcaaaggagaagcacagct

SEQ ID NO: 4646111 - DNA, 16 bp, Homo sapiens
ctgcaaagtggcaggg

SEQ ID NO: 4646112 - DNA, 20 bp, Homo sapiens
ctgcaaagtggcagggaccg

SEQ ID NO: 4646113 - DNA, 16 bp, Homo sapiens
ctgcaacctctgcctc

SEQ ID NO: 4646114 - DNA, 17 bp, Homo sapiens
ctgcaacttccgctgag

SEQ ID NO: 4646115 - DNA, 19 bp, Homo sapiens
ctgcaacttccgctgaggg

SEQ ID NO: 4646116 - DNA, 22 bp, Homo sapiens
ctgcaagatggacacgagccac

SEQ ID NO: 4646117 - DNA, 23 bp, Homo sapiens
ctgcaagatggacacgagccaca

SEQ ID NO: 4646118 - DNA, 18 bp, Homo sapiens
ctgcacaccctccagaga

SEQ ID NO: 4646119 - DNA, 16 bp, Homo sapiens
ctgcacagacaagcag

SEQ ID NO: 4646120 - DNA, 21 bp, Homo sapiens
ctgcacagacaagcagccctt

SEQ ID NO: 4646121 - DNA, 22 bp, Homo sapiens
ctgcacagagcaagtcctcact

SEQ ID NO: 4646122 - DNA, 16 bp, Homo sapiens
ctgcacaggcttgctg

SEQ ID NO: 4646123 - DNA, 17 bp, Homo sapiens
ctgcacaggcttgctgt

SEQ ID NO: 4646124 - DNA, 21 bp, Homo sapiens
ctgcacaggcttgctgtatga

SEQ ID NO: 4646125 - DNA, 12 bp, Homo sapiens
ctgcacagggtc

SEQ ID NO: 4646126 - DNA, 13 bp, Homo sapiens
ctgcacagggtcc

SEQ ID NO: 4646127 - DNA, 20 bp, Homo sapiens
ctgcacatcatgagccttca

SEQ ID NO: 4646128 - DNA, 22 bp, Homo sapiens
ctgcacatgaatcccacccaca

SEQ ID NO: 4646129 - DNA, 21 bp, Homo sapiens
ctgcacatgtcttgtacatgt

SEQ ID NO: 4646130 - DNA, 20 bp, Homo sapiens
ctgcaccttccccaaaggaa

SEQ ID NO: 4646131 - DNA, 13 bp, Homo sapiens
ctgcactccagcc

SEQ ID NO: 4646132 - DNA, 16 bp, Homo sapiens
ctgcactccagcctgg

SEQ ID NO: 4646133 - DNA, 11 bp, Homo sapiens
ctgcactgtga

SEQ ID NO: 4646134 - DNA, 20 bp, Homo sapiens
ctgcactgtgaacctgggca

SEQ ID NO: 4646135 - DNA, 19 bp, Homo sapiens
ctgcacttatacccatgaa

SEQ ID NO: 4646136 - DNA, 21 bp, Homo sapiens
ctgcactttccaatgccacag

SEQ ID NO: 4646137 - DNA, 13 bp, Homo sapiens
ctgcagaaggaaa

SEQ ID NO: 4646138 - DNA, 14 bp, Homo sapiens
ctgcagaaggaaag

SEQ ID NO: 4646139 - DNA, 15 bp, Homo sapiens
ctgcagaaggaaaga

SEQ ID NO: 4646140 - DNA, 20 bp, Homo sapiens
ctgcagaaggaaagaagggg

SEQ ID NO: 4646141 - DNA, 13 bp, Homo sapiens
ctgcagaccctgc

SEQ ID NO: 4646142 - DNA, 17 bp, Homo sapiens
ctgcagaccctgccctt

SEQ ID NO: 4646143 - DNA, 21 bp, Homo sapiens
ctgcagagtaaattgctctgt

SEQ ID NO: 4646144 - DNA, 19 bp, Homo sapiens
ctgcagcacctccaggcct

SEQ ID NO: 4646145 - DNA, 15 bp, Homo sapiens
ctgcagcagagcctg

SEQ ID NO: 4646146 - DNA, 15 bp, Homo sapiens
ctgcagcattgaagt

SEQ ID NO: 4646147 - DNA, 17 bp, Homo sapiens
ctgcagcccctaagtgc

SEQ ID NO: 4646148 - DNA, 19 bp, Homo sapiens
ctgcagcccctaagtgcaa

SEQ ID NO: 4646149 - DNA, 22 bp, Homo sapiens
ctgcagcccctaagtgcaaaca

SEQ ID NO: 4646150 - DNA, 23 bp, Homo sapiens
ctgcagcccctaagtgcaaacac

SEQ ID NO: 4646151 - DNA, 21 bp, Homo sapiens
ctgcagcttgtagccagccgg

SEQ ID NO: 4646152 - DNA, 22 bp, Homo sapiens
ctgcagcttgtagccagccggg

SEQ ID NO: 4646153 - DNA, 17 bp, Homo sapiens
ctgcaggagtgtcctgc

SEQ ID NO: 4646154 - DNA, 14 bp, Homo sapiens
ctgcaggcaggaac

SEQ ID NO: 4646155 - DNA, 22 bp, Homo sapiens
ctgcagggccatctgactgcca

SEQ ID NO: 4646156 - DNA, 14 bp, Homo sapiens
ctgcagggcttctc

SEQ ID NO: 4646157 - DNA, 16 bp, Homo sapiens
ctgcaggggcatggga

SEQ ID NO: 4646158 - DNA, 21 bp, Homo sapiens
ctgcatcttggggacatctct

SEQ ID NO: 4646159 - DNA, 13 bp, Homo sapiens
ctgcatgagctga

SEQ ID NO: 4646160 - DNA, 15 bp, Homo sapiens
ctgcattatcttgct

SEQ ID NO: 4646161 - DNA, 21 bp, Homo sapiens
ctgcattatcttgctcattct

SEQ ID NO: 4646162 - DNA, 18 bp, Homo sapiens
ctgcattattctctttta

SEQ ID NO: 4646163 - DNA, 15 bp, Homo sapiens
ctgcattgacctgga

SEQ ID NO: 4646164 - DNA, 17 bp, Homo sapiens
ctgcattgacctggagg

SEQ ID NO: 4646165 - DNA, 17 bp, Homo sapiens
ctgcattgagcttgcat

SEQ ID NO: 4646166 - DNA, 23 bp, Homo sapiens
ctgccaagccagattctcttgaa

SEQ ID NO: 4646167 - DNA, 13 bp, Homo sapiens
ctgccagacctgc

SEQ ID NO: 4646168 - DNA, 14 bp, Homo sapiens
ctgccagacctgca

SEQ ID NO: 4646169 - DNA, 19 bp, Homo sapiens
ctgccagacctgcatggtc

SEQ ID NO: 4646170 - DNA, 14 bp, Homo sapiens
ctgccagccactgt

SEQ ID NO: 4646171 - DNA, 20 bp, Homo sapiens
ctgccagcctgaggtgccca

SEQ ID NO: 4646172 - DNA, 13 bp, Homo sapiens
ctgccaggaggga

SEQ ID NO: 4646173 - DNA, 22 bp, Homo sapiens
ctcagcagggctggtcacctcc

SEQ ID NO: 4646174 - DNA, 15 bp, Homo sapiens
ctcagccagtgggga

SEQ ID NO: 4646175 - DNA, 23 bp, Homo sapiens
ctcagctctgggccattctccac

SEQ ID NO: 4646176 - DNA, 17 bp, Homo sapiens
ctcaggacacaggcctg

SEQ ID NO: 4646177 - DNA, 18 bp, Homo sapiens
ctcaggacacaggcctgt

SEQ ID NO: 4646178 - DNA, 18 bp, Homo sapiens
ctcaggagatggagggct

SEQ ID NO: 4646179 - DNA, 22 bp, Homo sapiens
ctcaggatatccttatcagagc

SEQ ID NO: 4646180 - DNA, 13 bp, Homo sapiens
ctcaggcctctgt

SEQ ID NO: 4646181 - DNA, 12 bp, Homo sapiens
ctcaggctctgc

SEQ ID NO: 4646182 - DNA, 21 bp, Homo sapiens
ctcagggaccggtgctgcagg

SEQ ID NO: 4646183 - DNA, 23 bp, Homo sapiens
ctcagggaccggtgctgcaggag

SEQ ID NO: 4646184 - DNA, 20 bp, Homo sapiens
ctcagggcagcgccaggctg

SEQ ID NO: 4646185 - DNA, 22 bp, Homo sapiens
ctcaggtgttttttatgaagtg

SEQ ID NO: 4646186 - DNA, 13 bp, Homo sapiens
ctcagtccctctt

SEQ ID NO: 4646187 - DNA, 15 bp, Homo sapiens
ctcagtccctcttct

SEQ ID NO: 4646188 - DNA, 16 bp, Homo sapiens
ctcagtgattcgcttt

SEQ ID NO: 4646189 - DNA, 20 bp, Homo sapiens
ctcagtgattcgcttttggt

SEQ ID NO: 4646190 - DNA, 18 bp, Homo sapiens
ctcagtgcaaaatgtctt

SEQ ID NO: 4646191 - DNA, 20 bp, Homo sapiens
ctcagtgcaaaatgtcttgt

SEQ ID NO: 4646192 - DNA, 16 bp, Homo sapiens
ctcagtgcaacctctg

SEQ ID NO: 4646193 - DNA, 22 bp, Homo sapiens
ctcagtgcaacctctgcttccc

SEQ ID NO: 4646194 - DNA, 21 bp, Homo sapiens
ctcagttcctgcagcagagcc

SEQ ID NO: 4646195 - DNA, 17 bp, Homo sapiens
ctcagtttctgcctggg

SEQ ID NO: 4646196 - DNA, 13 bp, Homo sapiens
ctcatcatttttt

SEQ ID NO: 4646197 - DNA, 16 bp, Homo sapiens
ctcatcccccctgctg

SEQ ID NO: 4646198 - DNA, 18 bp, Homo sapiens
ctcatcccccctgctgcc

SEQ ID NO: 4646199 - DNA, 13 bp, Homo sapiens
ctcatctgcaaaa

SEQ ID NO: 4646200 - DNA, 22 bp, Homo sapiens
ctcatctgtggagctgccacag

SEQ ID NO: 4646201 - DNA, 15 bp, Homo sapiens
ctcatgagctcctga

SEQ ID NO: 4646202 - DNA, 20 bp, Homo sapiens
ctcatgatcaagatatatgt

SEQ ID NO: 4646203 - DNA, 22 bp, Homo sapiens
ctcatgatcaagatatatgtgt

SEQ ID NO: 4646204 - DNA, 13 bp, Homo sapiens
ctcatgttttcca

SEQ ID NO: 4646205 - DNA, 18 bp, Homo sapiens
ctcattatgccacttcct

SEQ ID NO: 4646206 - DNA, 22 bp, Homo sapiens
ctcattgtcacctctgtgaccc

SEQ ID NO: 4646207 - DNA, 13 bp, Homo sapiens
ctcattgtgtctc

SEQ ID NO: 4646208 - DNA, 14 bp, Homo sapiens
ctccaaaccttcac

SEQ ID NO: 4646209 - DNA, 23 bp, Homo sapiens
ctccaacaccaagcacagcagcc

SEQ ID NO: 4646210 - DNA, 19 bp, Homo sapiens
ctccaagcatttcatgaaa

SEQ ID NO: 4646211 - DNA, 12 bp, Homo sapiens
ctccaatcctcc

SEQ ID NO: 4646212 - DNA, 20 bp, Homo sapiens
ctccacaccattcaggtctt

SEQ ID NO: 4646213 - DNA, 16 bp, Homo sapiens
ctccacagcaacccca

SEQ ID NO: 4646214 - DNA, 22 bp, Homo sapiens
ctccaccactgtgcacttagcc

SEQ ID NO: 4646215 - DNA, 12 bp, Homo sapiens
ctccaccttcca

SEQ ID NO: 4646216 - DNA, 22 bp, Homo sapiens
ctccacggatgcgtgggcagag

SEQ ID NO: 4646217 - DNA, 23 bp, Homo sapiens
ctccacggatgcgtgggcagagg

SEQ ID NO: 4646218 - DNA, 14 bp, Homo sapiens
ctccactcagctgt

SEQ ID NO: 4646219 - DNA, 21 bp, Homo sapiens
ctccacttcatttttaagaaa

SEQ ID NO: 4646220 - DNA, 23 bp, Homo sapiens
ctccagactaacatgtcagtttt

SEQ ID NO: 4646221 - DNA, 17 bp, Homo sapiens
ctccagatgcagggcag

SEQ ID NO: 4646222 - DNA, 18 bp, Homo sapiens
ctccagatgcagggcagt

SEQ ID NO: 4646223 - DNA, 13 bp, Homo sapiens
ctccagccagaga

SEQ ID NO: 4646224 - DNA, 13 bp, Homo sapiens
ctccagcccctgt

SEQ ID NO: 4646225 - DNA, 11 bp, Homo sapiens
ctccagctcct

SEQ ID NO: 4646226 - DNA, 15 bp, Homo sapiens
ctccagctttcctgt

SEQ ID NO: 4646227 - DNA, 16 bp, Homo sapiens
ctccaggagagagcca

SEQ ID NO: 4646228 - DNA, 21 bp, Homo sapiens
ctccaggattttaatttcagg

SEQ ID NO: 4646229 - DNA, 16 bp, Homo sapiens
ctccaggggcctgcag

SEQ ID NO: 4646230 - DNA, 16 bp, Homo sapiens
ctccagggtgtgtgct

SEQ ID NO: 4646231 - DNA, 21 bp, Homo sapiens
ctccagtttgcacctgtcccc

SEQ ID NO: 4646232 - DNA, 19 bp, Homo sapiens
ctccataaagtacaaatga

SEQ ID NO: 4646233 - DNA, 15 bp, Homo sapiens
ctccataaccccacc

SEQ ID NO: 4646234 - DNA, 23 bp, Homo sapiens
ctccatcctttgtcttggaacca

SEQ ID NO: 4646235 - DNA, 13 bp, Homo sapiens
ctccatgctgcaa

SEQ ID NO: 4646236 - DNA, 23 bp, Homo sapiens
ctccatggacgtgtctgcacagg

SEQ ID NO: 4646237 - DNA, 23 bp, Homo sapiens
ctccatgttagtaatggcagagc

SEQ ID NO: 4646238 - DNA, 16 bp, Homo sapiens
ctccattccctagcag

SEQ ID NO: 4646239 - DNA, 15 bp, Homo sapiens
ctccattttagccca

SEQ ID NO: 4646240 - DNA, 12 bp, Homo sapiens
ctcccaaccctg

SEQ ID NO: 4646241 - DNA, 16 bp, Homo sapiens
ctcccaaccctggctt

SEQ ID NO: 4646242 - DNA, 19 bp, Homo sapiens
ctcccaagcccctgacccg

SEQ ID NO: 4646243 - DNA, 19 bp, Homo sapiens
ctcccagcccattgctgcc

SEQ ID NO: 4646244 - DNA, 13 bp, Homo sapiens
ctcccaggatctc

SEQ ID NO: 4646245 - DNA, 17 bp, Homo sapiens
ctcccaggcctctgccc

SEQ ID NO: 4646246 - DNA, 16 bp, Homo sapiens
ctcccatcctggggca

SEQ ID NO: 4646247 - DNA, 14 bp, Homo sapiens
ctccccactctgct

SEQ ID NO: 4646248 - DNA, 13 bp, Homo sapiens
ctcccccagcccc

SEQ ID NO: 4646249 - DNA, 13 bp, Homo sapiens
ctccccctgcaac

SEQ ID NO: 4646250 - DNA, 23 bp, Homo sapiens
ctccccctgcaacttccgctgag

SEQ ID NO: 4646251 - DNA, 15 bp, Homo sapiens
ctcccctccccatct

SEQ ID NO: 4646252 - DNA, 21 bp, Homo sapiens
ctcccctgatagaagattgtt

SEQ ID NO: 4646253 - DNA, 23 bp, Homo sapiens
ctcccctgccttaacctgggacc

SEQ ID NO: 4646254 - DNA, 18 bp, Homo sapiens
ctccccttcacgtttgca

SEQ ID NO: 4646255 - DNA, 20 bp, Homo sapiens
ctcccgcctgtaatcccagt

SEQ ID NO: 4646256 - DNA, 12 bp, Homo sapiens
cgcgcagctgcc

SEQ ID NO: 4646257 - DNA, 14 bp, Homo sapiens
cgcgtctaccctgg

SEQ ID NO: 4646258 - DNA, 16 bp, Homo sapiens
cgcgtctaccctggga

SEQ ID NO: 4646259 - DNA, 17 bp, Homo sapiens
cgcgtctaccctgggat

SEQ ID NO: 4646260 - DNA, 20 bp, Homo sapiens
cgctacaccactctggcagc

SEQ ID NO: 4646261 - DNA, 23 bp, Homo sapiens
cgctacaccactctggcagccac

SEQ ID NO: 4646262 - DNA, 18 bp, Homo sapiens
cgctacagtttttattta

SEQ ID NO: 4646263 - DNA, 15 bp, Homo sapiens
cgctccccactctgc

SEQ ID NO: 4646264 - DNA, 15 bp, Homo sapiens
cgctggccctgccgt

SEQ ID NO: 4646265 - DNA, 21 bp, Homo sapiens
cgctggggaccggttcccaca

SEQ ID NO: 4646266 - DNA, 18 bp, Homo sapiens
cgctgtattttgagtttc

SEQ ID NO: 4646267 - DNA, 20 bp, Homo sapiens
cgctgttggagcaaaccatt

SEQ ID NO: 4646268 - DNA, 20 bp, Homo sapiens
cgcttctgggaaacagtccc

SEQ ID NO: 4646269 - DNA, 17 bp, Homo sapiens
cgctttgaaagaagcaa

SEQ ID NO: 4646270 - DNA, 15 bp, Homo sapiens
cgctttttcatcctt

SEQ ID NO: 4646271 - DNA, 18 bp, Homo sapiens
cgctttttcatccttctt

SEQ ID NO: 4646272 - DNA, 12 bp, Homo sapiens
cggaaggaggcc

SEQ ID NO: 4646273 - DNA, 22 bp, Homo sapiens
cggaaggaggccaaccagcccg

SEQ ID NO: 4646274 - DNA, 18 bp, Homo sapiens
cggacactcgtcacccca

SEQ ID NO: 4646275 - DNA, 20 bp, Homo sapiens
cggacatgcttttctgccac

SEQ ID NO: 4646276 - DNA, 12 bp, Homo sapiens
cggactgccaaa

SEQ ID NO: 4646277 - DNA, 15 bp, Homo sapiens
cggacttactgcctg

SEQ ID NO: 4646278 - DNA, 17 bp, Homo sapiens
cggacttactgcctgac

SEQ ID NO: 4646279 - DNA, 20 bp, Homo sapiens
cggagctgcccctctctggg

SEQ ID NO: 4646280 - DNA, 23 bp, Homo sapiens
cggagctgcccctctctgggcct

SEQ ID NO: 4646281 - DNA, 16 bp, Homo sapiens
cggaggcctcgagcag

SEQ ID NO: 4646282 - DNA, 18 bp, Homo sapiens
cggaggcctcgagcagag

SEQ ID NO: 4646283 - DNA, 21 bp, Homo sapiens
cggagggaggggaggggtgaa

SEQ ID NO: 4646284 - DNA, 13 bp, Homo sapiens
cggagggatggag

SEQ ID NO: 4646285 - DNA, 19 bp, Homo sapiens
cggagggctggggatgcgc

SEQ ID NO: 4646286 - DNA, 16 bp, Homo sapiens
cggaggtgctgtcccc

SEQ ID NO: 4646287 - DNA, 18 bp, Homo sapiens
cggatgacaccctggcct

SEQ ID NO: 4646288 - DNA, 19 bp, Homo sapiens
cggatgacaccctggcctg

SEQ ID NO: 4646289 - DNA, 17 bp, Homo sapiens
cggatgcgtgggcagag

SEQ ID NO: 4646290 - DNA, 18 bp, Homo sapiens
cggatgcgtgggcagagg

SEQ ID NO: 4646291 - DNA, 13 bp, Homo sapiens
cggcacacatctg

SEQ ID NO: 4646292 - DNA, 16 bp, Homo sapiens
cggcaccccctgcagc

SEQ ID NO: 4646293 - DNA, 19 bp, Homo sapiens
cggcaccccctgcagcttg

SEQ ID NO: 4646294 - DNA, 20 bp, Homo sapiens
cggcaccccctgcagcttgt

SEQ ID NO: 4646295 - DNA, 15 bp, Homo sapiens
cggcactgtggcctt

SEQ ID NO: 4646296 - DNA, 14 bp, Homo sapiens
cggcagagctctac

SEQ ID NO: 4646297 - DNA, 22 bp, Homo sapiens
cggccatgaccactttccccgt

SEQ ID NO: 4646298 - DNA, 15 bp, Homo sapiens
cggcccagccccggg

SEQ ID NO: 4646299 - DNA, 11 bp, Homo sapiens
cggccccagcg

SEQ ID NO: 4646300 - DNA, 16 bp, Homo sapiens
cggccccagcgcgcaa

SEQ ID NO: 4646301 - DNA, 17 bp, Homo sapiens
cggcctatgacttgggc

SEQ ID NO: 4646302 - DNA, 21 bp, Homo sapiens
cggcctgtgggtctctgaagg

SEQ ID NO: 4646303 - DNA, 22 bp, Homo sapiens
cggctccccctccagccagaga

SEQ ID NO: 4646304 - DNA, 14 bp, Homo sapiens
cggctcgtgtattt

SEQ ID NO: 4646305 - DNA, 20 bp, Homo sapiens
cggctcgtgtatttattacc

SEQ ID NO: 4646306 - DNA, 21 bp, Homo sapiens
cggctcgtgtatttattaccg

SEQ ID NO: 4646307 - DNA, 17 bp, Homo sapiens
cggctctagccccagcg

SEQ ID NO: 4646308 - DNA, 17 bp, Homo sapiens
cgggagccgctggcaga

SEQ ID NO: 4646309 - DNA, 22 bp, Homo sapiens
cgggagcctccctgcctcaggc

SEQ ID NO: 4646310 - DNA, 12 bp, Homo sapiens
cgggaggggagg

SEQ ID NO: 4646311 - DNA, 20 bp, Homo sapiens
cgggcatccacgtagggggc

SEQ ID NO: 4646312 - DNA, 18 bp, Homo sapiens
cgggccactccttcctgc

SEQ ID NO: 4646313 - DNA, 19 bp, Homo sapiens
cgggccccatcctcatccc

SEQ ID NO: 4646314 - DNA, 22 bp, Homo sapiens
cgggccccatcctcatccctga

SEQ ID NO: 4646315 - DNA, 22 bp, Homo sapiens
cgggcgcactgcctctcacagc

SEQ ID NO: 4646316 - DNA, 14 bp, Homo sapiens
cgggcggagggagg

SEQ ID NO: 4646317 - DNA, 21 bp, Homo sapiens
cgggcggaggggatccagcca

SEQ ID NO: 4646318 - DNA, 13 bp, Homo sapiens
cgggctggagaaa

SEQ ID NO: 4646319 - DNA, 14 bp, Homo sapiens
cgggctggagaaag

SEQ ID NO: 4646320 - DNA, 14 bp, Homo sapiens
cggggcctgtctca

SEQ ID NO: 4646321 - DNA, 13 bp, Homo sapiens
cggggctgggaag

SEQ ID NO: 4646322 - DNA, 18 bp, Homo sapiens
cggggtgcacaggagggg

SEQ ID NO: 4646323 - DNA, 21 bp, Homo sapiens
cgggtccatagagatgagccc

SEQ ID NO: 4646324 - DNA, 22 bp, Homo sapiens
cgggtccatagagatgagccca

SEQ ID NO: 4646325 - DNA, 20 bp, Homo sapiens
cgggtgaacaaagcagccac

SEQ ID NO: 4646326 - DNA, 21 bp, Homo sapiens
cgggtgaacaaagcagccacg

SEQ ID NO: 4646327 - DNA, 14 bp, Homo sapiens
cggtaactgtcctg

SEQ ID NO: 4646328 - DNA, 18 bp, Homo sapiens
cggtaactgtcctgtcct

SEQ ID NO: 4646329 - DNA, 21 bp, Homo sapiens
cggtacactacgcactggaca

SEQ ID NO: 4646330 - DNA, 23 bp, Homo sapiens
cggtacactacgcactggacagc

SEQ ID NO: 4646331 - DNA, 22 bp, Homo sapiens
cggtagccagcacacagggcag

SEQ ID NO: 4646332 - DNA, 12 bp, Homo sapiens
cggtcactgatg

SEQ ID NO: 4646333 - DNA, 14 bp, Homo sapiens
cggtccctgtccct

SEQ ID NO: 4646334 - DNA, 11 bp, Homo sapiens
cggtctggcag

SEQ ID NO: 4646335 - DNA, 12 bp, Homo sapiens
cggtctggcagg

SEQ ID NO: 4646336 - DNA, 17 bp, Homo sapiens
cggtctggcagggcagc

SEQ ID NO: 4646337 - DNA, 17 bp, Homo sapiens
cggtgcagggcctggca

SEQ ID NO: 4646338 - DNA, 18 bp, Homo sapiens
cggtgcagggcctggcat

SEQ ID NO: 4646339 - DNA, 15 bp, Homo sapiens
cggtgctgcaggagt

SEQ ID NO: 4646340 - DNA, 19 bp, Homo sapiens
cggttcctcgttctccctg

SEQ ID NO: 4646341 - DNA, 16 bp, Homo sapiens
cgtaaagctagaaatg

SEQ ID NO: 4646342 - DNA, 17 bp, Homo sapiens
cgtaagaccaccttccc

SEQ ID NO: 4646343 - DNA, 18 bp, Homo sapiens
cgtaagaccaccttccct

SEQ ID NO: 4646344 - DNA, 15 bp, Homo sapiens
cgtaaggatgtgtga

SEQ ID NO: 4646345 - DNA, 19 bp, Homo sapiens
cgtaattgctttgtgcctt

SEQ ID NO: 4646346 - DNA, 16 bp, Homo sapiens
cgtagaattccttcga

SEQ ID NO: 4646347 - DNA, 16 bp, Homo sapiens
cgtagccagctgctcc

SEQ ID NO: 4646348 - DNA, 20 bp, Homo sapiens
cgtagcggttggtgacttgt

SEQ ID NO: 4646349 - DNA, 15 bp, Homo sapiens
cgtataggcatgtaa

SEQ ID NO: 4646350 - DNA, 18 bp, Homo sapiens
cgtcaaagaaaatgccta

SEQ ID NO: 4646351 - DNA, 21 bp, Homo sapiens
cgtcagggagaggtcaccagc

SEQ ID NO: 4646352 - DNA, 18 bp, Homo sapiens
cgtcatgttggccaggct

SEQ ID NO: 4646353 - DNA, 19 bp, Homo sapiens
cgtcatgttggccaggctg

SEQ ID NO: 4646354 - DNA, 20 bp, Homo sapiens
cgtcatgttggccaggctgg

SEQ ID NO: 4646355 - DNA, 19 bp, Homo sapiens
cgtcattacagggcacagg

SEQ ID NO: 4646356 - DNA, 17 bp, Homo sapiens
cgtcccagcatccctgg

SEQ ID NO: 4646357 - DNA, 18 bp, Homo sapiens
cgtcccagcatccctgga

SEQ ID NO: 4646358 - DNA, 20 bp, Homo sapiens
cgtccttactcctgtgggag

SEQ ID NO: 4646359 - DNA, 21 bp, Homo sapiens
cgtccttggctgccgtctggc

SEQ ID NO: 4646360 - DNA, 11 bp, Homo sapiens
cgtctccctcg

SEQ ID NO: 4646361 - DNA, 13 bp, Homo sapiens
cgtctggctccct

SEQ ID NO: 4646362 - DNA, 21 bp, Homo sapiens
cgtctgggagaaattgacaga

SEQ ID NO: 4646363 - DNA, 22 bp, Homo sapiens
cgtctgggagaaattgacagat

SEQ ID NO: 4646364 - DNA, 17 bp, Homo sapiens
cgtgacagactcctgag

SEQ ID NO: 4646365 - DNA, 18 bp, Homo sapiens
cgtgacagactcctgagg

SEQ ID NO: 4646366 - DNA, 14 bp, Homo sapiens
cgtgagagaaagag

SEQ ID NO: 4646367 - DNA, 16 bp, Homo sapiens
ctatatatttctatta

SEQ ID NO: 4646368 - DNA, 21 bp, Homo sapiens
ctatatcagggcctgagtgac

SEQ ID NO: 4646369 - DNA, 23 bp, Homo sapiens
ctatcaccagtgcatcacatctg

SEQ ID NO: 4646370 - DNA, 15 bp, Homo sapiens
ctatcagactcagtt

SEQ ID NO: 4646371 - DNA, 18 bp, Homo sapiens
ctatcatatgaagataac

SEQ ID NO: 4646372 - DNA, 12 bp, Homo sapiens
ctatcatttatt

SEQ ID NO: 4646373 - DNA, 20 bp, Homo sapiens
ctatcctgggacctccccag

SEQ ID NO: 4646374 - DNA, 19 bp, Homo sapiens
ctatcgtaacctggtgcct

SEQ ID NO: 4646375 - DNA, 12 bp, Homo sapiens
ctatctctttct

SEQ ID NO: 4646376 - DNA, 24 bp, Homo sapiens
ctatctggccatatttactacctt

SEQ ID NO: 4646377 - DNA, 22 bp, Homo sapiens
ctatctggtcaacctcctggac

SEQ ID NO: 4646378 - DNA, 22 bp, Homo sapiens
ctatcttaggtagtcatgctgt

SEQ ID NO: 4646379 - DNA, 15 bp, Homo sapiens
ctatgacaaattcaa

SEQ ID NO: 4646380 - DNA, 17 bp, Homo sapiens
ctatgacaaattcaaga

SEQ ID NO: 4646381 - DNA, 12 bp, Homo sapiens
ctatgacacagt

SEQ ID NO: 4646382 - DNA, 17 bp, Homo sapiens
ctatgacagaaaagtaa

SEQ ID NO: 4646383 - DNA, 16 bp, Homo sapiens
ctatgactctctgcta

SEQ ID NO: 4646384 - DNA, 12 bp, Homo sapiens
ctatgaggaaag

SEQ ID NO: 4646385 - DNA, 22 bp, Homo sapiens
ctatgatgttgctgttcacagc

SEQ ID NO: 4646386 - DNA, 24 bp, Homo sapiens
ctatgatgttgctgttcacagctt

SEQ ID NO: 4646387 - DNA, 12 bp, Homo sapiens
ctatgcacatat

SEQ ID NO: 4646388 - DNA, 22 bp, Homo sapiens
ctatgcacatatggactctgca

SEQ ID NO: 4646389 - DNA, 14 bp, Homo sapiens
ctatggagagccct

SEQ ID NO: 4646390 - DNA, 15 bp, Homo sapiens
ctatggagagccctg

SEQ ID NO: 4646391 - DNA, 16 bp, Homo sapiens
ctatggagagccctgg

SEQ ID NO: 4646392 - DNA, 17 bp, Homo sapiens
ctatggagagccctggg

SEQ ID NO: 4646393 - DNA, 19 bp, Homo sapiens
ctatggagaggcttcccta

SEQ ID NO: 4646394 - DNA, 16 bp, Homo sapiens
ctatggatggcttcta

SEQ ID NO: 4646395 - DNA, 20 bp, Homo sapiens
ctatggcaggataagaaagc

SEQ ID NO: 4646396 - DNA, 19 bp, Homo sapiens
ctatgggtctaggacacag

SEQ ID NO: 4646397 - DNA, 22 bp, Homo sapiens
ctatgtaaacaaaccacagcag

SEQ ID NO: 4646398 - DNA, 18 bp, Homo sapiens
ctatgtaacaaacctgca

SEQ ID NO: 4646399 - DNA, 15 bp, Homo sapiens
ctatgtagtcataat

SEQ ID NO: 4646400 - DNA, 17 bp, Homo sapiens
ctatgtagtcataataa

SEQ ID NO: 4646401 - DNA, 17 bp, Homo sapiens
ctatgtattttcctaat

SEQ ID NO: 4646402 - DNA, 18 bp, Homo sapiens
ctatgtattttcctaatg

SEQ ID NO: 4646403 - DNA, 13 bp, Homo sapiens
ctatgttcaaaga

SEQ ID NO: 4646404 - DNA, 17 bp, Homo sapiens
ctatgtttgtatttgga

SEQ ID NO: 4646405 - DNA, 19 bp, Homo sapiens
ctattaaaatacattttaa

SEQ ID NO: 4646406 - DNA, 16 bp, Homo sapiens
ctattaaccttttttg

SEQ ID NO: 4646407 - DNA, 20 bp, Homo sapiens
ctattaatcaagagaaactt

SEQ ID NO: 4646408 - DNA, 13 bp, Homo sapiens
ctattacttttct

SEQ ID NO: 4646409 - DNA, 20 bp, Homo sapiens
ctattacttttctgtttagt

SEQ ID NO: 4646410 - DNA, 18 bp, Homo sapiens
ctattagatacacttctt

SEQ ID NO: 4646411 - DNA, 17 bp, Homo sapiens
ctattatggaaaactgt

SEQ ID NO: 4646412 - DNA, 22 bp, Homo sapiens
ctattctgtcagtgttaaagat

SEQ ID NO: 4646413 - DNA, 18 bp, Homo sapiens
ctattgatactctttcta

SEQ ID NO: 4646414 - DNA, 16 bp, Homo sapiens
ctatttatctgtgttt

SEQ ID NO: 4646415 - DNA, 19 bp, Homo sapiens
ctatttatctgtgtttttg

SEQ ID NO: 4646416 - DNA, 23 bp, Homo sapiens
ctatttgaagaaaaaaatgtaca

SEQ ID NO: 4646417 - DNA, 19 bp, Homo sapiens
ctatttttaatgtttgtac

SEQ ID NO: 4646418 - DNA, 23 bp, Homo sapiens
ctatttttttcttaaagcaaact

SEQ ID NO: 4646419 - DNA, 19 bp, Homo sapiens
ctcaaaacccttaaaagaa

SEQ ID NO: 4646420 - DNA, 12 bp, Homo sapiens
ctcaaaatgtgt

SEQ ID NO: 4646421 - DNA, 14 bp, Homo sapiens
ctcaaaatgtgtaa

SEQ ID NO: 4646422 - DNA, 19 bp, Homo sapiens
ctcaaattcaatgcttcta

SEQ ID NO: 4646423 - DNA, 18 bp, Homo sapiens
ctcaactgtcccaaggag

SEQ ID NO: 4646424 - DNA, 21 bp, Homo sapiens
ctcaagaaataaaaggaagcc

SEQ ID NO: 4646425 - DNA, 22 bp, Homo sapiens
ctcaagaaataaaaggaagcca

SEQ ID NO: 4646426 - DNA, 21 bp, Homo sapiens
ctcaagctttcccgcccagcc

SEQ ID NO: 4646427 - DNA, 17 bp, Homo sapiens
ctcaagtgatcctccca

SEQ ID NO: 4646428 - DNA, 13 bp, Homo sapiens
ctcaagtgtcacc

SEQ ID NO: 4646429 - DNA, 17 bp, Homo sapiens
ctcaagtgtcacctcct

SEQ ID NO: 4646430 - DNA, 20 bp, Homo sapiens
ctcaagtgtcacctccttcc

SEQ ID NO: 4646431 - DNA, 23 bp, Homo sapiens
ctcaagtgtcacctccttcccca

SEQ ID NO: 4646432 - DNA, 23 bp, Homo sapiens
ctcaattttatgtattctttctg

SEQ ID NO: 4646433 - DNA, 20 bp, Homo sapiens
ctcaatttttgtctcagaag

SEQ ID NO: 4646434 - DNA, 17 bp, Homo sapiens
ctcacaaaatcacttta

SEQ ID NO: 4646435 - DNA, 14 bp, Homo sapiens
ctcacaactccttc

SEQ ID NO: 4646436 - DNA, 19 bp, Homo sapiens
ctcacaactccttccatcc

SEQ ID NO: 4646437 - DNA, 17 bp, Homo sapiens
ctcacaaggcagcaagg

SEQ ID NO: 4646438 - DNA, 20 bp, Homo sapiens
ctcacaaggcagcaaggccc

SEQ ID NO: 4646439 - DNA, 22 bp, Homo sapiens
ctcacaagggctctcaaagtat

SEQ ID NO: 4646440 - DNA, 19 bp, Homo sapiens
ctcacactaagagggcaga

SEQ ID NO: 4646441 - DNA, 13 bp, Homo sapiens
ctcacagctgagt

SEQ ID NO: 4646442 - DNA, 19 bp, Homo sapiens
ctcaccatgatgtgaagag

SEQ ID NO: 4646443 - DNA, 15 bp, Homo sapiens
ctcacccctgcccct

SEQ ID NO: 4646444 - DNA, 17 bp, Homo sapiens
ctcacccctgcccctgt

SEQ ID NO: 4646445 - DNA, 17 bp, Homo sapiens
ctcaccgactcacctgc

SEQ ID NO: 4646446 - DNA, 18 bp, Homo sapiens
ctcaccgactcacctgcg

SEQ ID NO: 4646447 - DNA, 20 bp, Homo sapiens
ctcaccgactcacctgcgca

SEQ ID NO: 4646448 - DNA, 13 bp, Homo sapiens
ctcacctcctgct

SEQ ID NO: 4646449 - DNA, 20 bp, Homo sapiens
ctcacctgcgcaagtgcctg

SEQ ID NO: 4646450 - DNA, 16 bp, Homo sapiens
ctcacctgtactattg

SEQ ID NO: 4646451 - DNA, 13 bp, Homo sapiens
ctcactaattttt

SEQ ID NO: 4646452 - DNA, 23 bp, Homo sapiens
ctcactaatttttgtattatttt

SEQ ID NO: 4646453 - DNA, 17 bp, Homo sapiens
cgtgagagaaagagaga

SEQ ID NO: 4646454 - DNA, 20 bp, Homo sapiens
cgtgagagaaagagagaagc

SEQ ID NO: 4646455 - DNA, 22 bp, Homo sapiens
cgtgagagaaagagagaagcca

SEQ ID NO: 4646456 - DNA, 23 bp, Homo sapiens
cgtgagagaaagagagaagccag

SEQ ID NO: 4646457 - DNA, 15 bp, Homo sapiens
cgtgagctggggact

SEQ ID NO: 4646458 - DNA, 22 bp, Homo sapiens
cgtgagctggggactcagggac

SEQ ID NO: 4646459 - DNA, 12 bp, Homo sapiens
cgtgaggggcaa

SEQ ID NO: 4646460 - DNA, 19 bp, Homo sapiens
cgtgaggggcaagctaggc

SEQ ID NO: 4646461 - DNA, 18 bp, Homo sapiens
cgtgatgtggaggaagag

SEQ ID NO: 4646462 - DNA, 15 bp, Homo sapiens
cgtgccaagtccagg

SEQ ID NO: 4646463 - DNA, 23 bp, Homo sapiens
cgtgccaagtccaggtcctggtg

SEQ ID NO: 4646464 - DNA, 13 bp, Homo sapiens
cgtggactctgca

SEQ ID NO: 4646465 - DNA, 16 bp, Homo sapiens
cgtggactctgcacat

SEQ ID NO: 4646466 - DNA, 15 bp, Homo sapiens
cgtggagagctagga

SEQ ID NO: 4646467 - DNA, 22 bp, Homo sapiens
cgtggcccttcctggacagctg

SEQ ID NO: 4646468 - DNA, 20 bp, Homo sapiens
cgtggccttgttctgtcacc

SEQ ID NO: 4646469 - DNA, 18 bp, Homo sapiens
cgtggctcagccagcact

SEQ ID NO: 4646470 - DNA, 14 bp, Homo sapiens
cgtgggcagaggaa

SEQ ID NO: 4646471 - DNA, 19 bp, Homo sapiens
cgtgggtgggcctggccct

SEQ ID NO: 4646472 - DNA, 13 bp, Homo sapiens
cgtgggtggtctt

SEQ ID NO: 4646473 - DNA, 19 bp, Homo sapiens
cgtggtctagaccagggct

SEQ ID NO: 4646474 - DNA, 22 bp, Homo sapiens
cgtggtctagaccagggctgct

SEQ ID NO: 4646475 - DNA, 17 bp, Homo sapiens
cgtgtatagtatctgta

SEQ ID NO: 4646476 - DNA, 21 bp, Homo sapiens
cgtgtcccttcccagcgctgc

SEQ ID NO: 4646477 - DNA, 19 bp, Homo sapiens
cgtgtgaaatctgtctttg

SEQ ID NO: 4646478 - DNA, 20 bp, Homo sapiens
cgtgtgagtgtgacagggcc

SEQ ID NO: 4646479 - DNA, 21 bp, Homo sapiens
cgtgtgagtgtgacagggcca

SEQ ID NO: 4646480 - DNA, 15 bp, Homo sapiens
cgtgttgtatctaca

SEQ ID NO: 4646481 - DNA, 14 bp, Homo sapiens
cgttaggcatttcc

SEQ ID NO: 4646482 - DNA, 17 bp, Homo sapiens
cgttgcacagctgtttg

SEQ ID NO: 4646483 - DNA, 14 bp, Homo sapiens
cgtttaattttaag

SEQ ID NO: 4646484 - DNA, 19 bp, Homo sapiens
cgtttcatgtagccagcag

SEQ ID NO: 4646485 - DNA, 18 bp, Homo sapiens
cgtttgcagttgatgtgt

SEQ ID NO: 4646486 - DNA, 16 bp, Homo sapiens
cgttttttcctcagtg

SEQ ID NO: 4646487 - DNA, 16 bp, Homo sapiens
ctaaaaaaaaaaaagt

SEQ ID NO: 4646488 - DNA, 18 bp, Homo sapiens
ctaaaaaaaaaaaagtat

SEQ ID NO: 4646489 - DNA, 15 bp, Homo sapiens
ctaaaaatatagcaa

SEQ ID NO: 4646490 - DNA, 22 bp, Homo sapiens
ctaaaattaaaaagaaaatatt

SEQ ID NO: 4646491 - DNA, 20 bp, Homo sapiens
ctaaacacaacaataacttt

SEQ ID NO: 4646492 - DNA, 13 bp, Homo sapiens
ctaaacctcagtt

SEQ ID NO: 4646493 - DNA, 17 bp, Homo sapiens
ctaaacctcagttatta

SEQ ID NO: 4646494 - DNA, 15 bp, Homo sapiens
ctaaactttatttgt

SEQ ID NO: 4646495 - DNA, 23 bp, Homo sapiens
ctaaagaaaaatatcttggccta

SEQ ID NO: 4646496 - DNA, 22 bp, Homo sapiens
ctaaagaagacattttctctta

SEQ ID NO: 4646497 - DNA, 13 bp, Homo sapiens
ctaaagggcaggg

SEQ ID NO: 4646498 - DNA, 19 bp, Homo sapiens
ctaaaggggactagacagt

SEQ ID NO: 4646499 - DNA, 15 bp, Homo sapiens
ctaaataaaaatatg

SEQ ID NO: 4646500 - DNA, 16 bp, Homo sapiens
ctaaataaaaatatgt

SEQ ID NO: 4646501 - DNA, 17 bp, Homo sapiens
ctaaatatatattatgc

SEQ ID NO: 4646502 - DNA, 19 bp, Homo sapiens
ctaaatgaaagtggtaatc

SEQ ID NO: 4646503 - DNA, 15 bp, Homo sapiens
ctaaattcagggaga

SEQ ID NO: 4646504 - DNA, 14 bp, Homo sapiens
ctaaattccacact

SEQ ID NO: 4646505 - DNA, 13 bp, Homo sapiens
ctaacaaaatgag

SEQ ID NO: 4646506 - DNA, 15 bp, Homo sapiens
ctaacaaaatgagat

SEQ ID NO: 4646507 - DNA, 17 bp, Homo sapiens
ctaacactcagaagcct

SEQ ID NO: 4646508 - DNA, 19 bp, Homo sapiens
ctaacactcagaagcctgg

SEQ ID NO: 4646509 - DNA, 22 bp, Homo sapiens
ctaacactcagaagcctggggg

SEQ ID NO: 4646510 - DNA, 14 bp, Homo sapiens
ctaacaggaaaaga

SEQ ID NO: 4646511 - DNA, 15 bp, Homo sapiens
ctaacaggaaaagag

SEQ ID NO: 4646512 - DNA, 18 bp, Homo sapiens
ctaacagggaaggcaggc

SEQ ID NO: 4646513 - DNA, 21 bp, Homo sapiens
ctaacagggaaggcaggcagg

SEQ ID NO: 4646514 - DNA, 12 bp, Homo sapiens
ctaacatgcacc

SEQ ID NO: 4646515 - DNA, 21 bp, Homo sapiens
ctaaccacggttatttaagca

SEQ ID NO: 4646516 - DNA, 23 bp, Homo sapiens
ctaacccaagacatgacattctt

SEQ ID NO: 4646517 - DNA, 19 bp, Homo sapiens
ctaacccaggtatccaaaa

SEQ ID NO: 4646518 - DNA, 20 bp, Homo sapiens
ctaacgcctgagcccaggga

SEQ ID NO: 4646519 - DNA, 21 bp, Homo sapiens
ctaacgcctgagcccagggag

SEQ ID NO: 4646520 - DNA, 18 bp, Homo sapiens
ctaactctgcccaccctc

SEQ ID NO: 4646521 - DNA, 15 bp, Homo sapiens
ctaactgtaaatcat

SEQ ID NO: 4646522 - DNA, 15 bp, Homo sapiens
ctaactgtacatttc

SEQ ID NO: 4646523 - DNA, 12 bp, Homo sapiens
ctaacttattta

SEQ ID NO: 4646524 - DNA, 19 bp, Homo sapiens
ctaacttttcttaaggttt

SEQ ID NO: 4646525 - DNA, 13 bp, Homo sapiens
ctaacttttgtgt

SEQ ID NO: 4646526 - DNA, 18 bp, Homo sapiens
ctaagaatgcattattga

SEQ ID NO: 4646527 - DNA, 14 bp, Homo sapiens
ctaagaatgtgatg

SEQ ID NO: 4646528 - DNA, 17 bp, Homo sapiens
ctaaggacatttcccag

SEQ ID NO: 4646529 - DNA, 22 bp, Homo sapiens
ctaagggaacaatccatgtgat

SEQ ID NO: 4646530 - DNA, 18 bp, Homo sapiens
ctaagggtgggtgctcag

SEQ ID NO: 4646531 - DNA, 21 bp, Homo sapiens
ctaagggtgggtgctcagaat

SEQ ID NO: 4646532 - DNA, 13 bp, Homo sapiens
ctaaggtactgtg

SEQ ID NO: 4646533 - DNA, 21 bp, Homo sapiens
ctaagtatattatatggcagg

SEQ ID NO: 4646534 - DNA, 22 bp, Homo sapiens
ctaagtatattatatggcagga

SEQ ID NO: 4646535 - DNA, 23 bp, Homo sapiens
ctaagtatattatatggcaggag

SEQ ID NO: 4646536 - DNA, 14 bp, Homo sapiens
ctaagtgcaaacac

SEQ ID NO: 4646537 - DNA, 18 bp, Homo sapiens
ctaagtgcaaacacagca

SEQ ID NO: 4646538 - DNA, 16 bp, Homo sapiens
ctaataattgtatcta

SEQ ID NO: 4646539 - DNA, 17 bp, Homo sapiens
ctaatacctctgtgtgc

SEQ ID NO: 4646540 - DNA, 15 bp, Homo sapiens
ctaatagagtactta

SEQ ID NO: 4646541 - DNA, 13 bp, Homo sapiens
ctaatagcttttt

SEQ ID NO: 4646542 - DNA, 16 bp, Homo sapiens
ctaatatcattttatt

SEQ ID NO: 4646543 - DNA, 16 bp, Homo sapiens
ctaatcaaagccaggg

SEQ ID NO: 4646544 - DNA, 21 bp, Homo sapiens
ctaatccctgggcattgcttt

SEQ ID NO: 4646545 - DNA, 21 bp, Homo sapiens
ctaatgagggaaatctgtaaa

SEQ ID NO: 4646546 - DNA, 19 bp, Homo sapiens
ctaatgcaaatacccacca

SEQ ID NO: 4646547 - DNA, 14 bp, Homo sapiens
ctaatgcaaattaa

SEQ ID NO: 4646548 - DNA, 11 bp, Homo sapiens
ctaatgcatat

SEQ ID NO: 4646549 - DNA, 12 bp, Homo sapiens
ctaatgcatatt

SEQ ID NO: 4646550 - DNA, 18 bp, Homo sapiens
ctaatgtctgtatcactc

SEQ ID NO: 4646551 - DNA, 15 bp, Homo sapiens
ctaatgtttgaacaa

SEQ ID NO: 4646552 - DNA, 18 bp, Homo sapiens
ctaattatactactttgt

SEQ ID NO: 4646553 - DNA, 12 bp, Homo sapiens
ctaatttacaag

SEQ ID NO: 4646554 - DNA, 22 bp, Homo sapiens
ctaatttatagcaagatattga

SEQ ID NO: 4646555 - DNA, 15 bp, Homo sapiens
ctaatttatattatc

SEQ ID NO: 4646556 - DNA, 20 bp, Homo sapiens
ctaatttatattatccatag

SEQ ID NO: 4646557 - DNA, 19 bp, Homo sapiens
ctaattttacatgtttata

SEQ ID NO: 4646558 - DNA, 20 bp, Homo sapiens
ctaatttttgtatttttagt

SEQ ID NO: 4646559 - DNA, 22 bp, Homo sapiens
ctacaaaataaaacttggttct

SEQ ID NO: 4646560 - DNA, 13 bp, Homo sapiens
ctacaagggaagc

SEQ ID NO: 4646561 - DNA, 15 bp, Homo sapiens
ctacacagggcctgc

SEQ ID NO: 4646562 - DNA, 19 bp, Homo sapiens
ctacacatttttaaattgt

SEQ ID NO: 4646563 - DNA, 14 bp, Homo sapiens
ctacaccactctgg

SEQ ID NO: 4646564 - DNA, 16 bp, Homo sapiens
ccttgctttcctgggc

SEQ ID NO: 4646565 - DNA, 17 bp, Homo sapiens
ccttgctttcctgggcc

SEQ ID NO: 4646566 - DNA, 20 bp, Homo sapiens
ccttgctttcggagctcctg

SEQ ID NO: 4646567 - DNA, 20 bp, Homo sapiens
ccttggaggagagagacccc

SEQ ID NO: 4646568 - DNA, 22 bp, Homo sapiens
ccttggctttatgcaaatacaa

SEQ ID NO: 4646569 - DNA, 22 bp, Homo sapiens
ccttgggcagagtcctgccttc

SEQ ID NO: 4646570 - DNA, 16 bp, Homo sapiens
ccttgggccataatta

SEQ ID NO: 4646571 - DNA, 20 bp, Homo sapiens
ccttggggaggacaaaactt

SEQ ID NO: 4646572 - DNA, 19 bp, Homo sapiens
ccttggttcatgcttctac

SEQ ID NO: 4646573 - DNA, 23 bp, Homo sapiens
ccttgtagaaaaatccctccacc

SEQ ID NO: 4646574 - DNA, 21 bp, Homo sapiens
ccttgtcagggtctccttcct

SEQ ID NO: 4646575 - DNA, 21 bp, Homo sapiens
ccttgttatttctcagacttt

SEQ ID NO: 4646576 - DNA, 22 bp, Homo sapiens
cctttaaatatcattctttgta

SEQ ID NO: 4646577 - DNA, 18 bp, Homo sapiens
cctttaattttcttgttt

SEQ ID NO: 4646578 - DNA, 15 bp, Homo sapiens
cctttatctgcacct

SEQ ID NO: 4646579 - DNA, 16 bp, Homo sapiens
cctttatttctcttct

SEQ ID NO: 4646580 - DNA, 13 bp, Homo sapiens
cctttcaataaag

SEQ ID NO: 4646581 - DNA, 17 bp, Homo sapiens
cctttcaataaagttgt

SEQ ID NO: 4646582 - DNA, 21 bp, Homo sapiens
cctttcaataaagttgttgca

SEQ ID NO: 4646583 - DNA, 17 bp, Homo sapiens
cctttcaattccaccag

SEQ ID NO: 4646584 - DNA, 23 bp, Homo sapiens
cctttcaattccaccagggccag

SEQ ID NO: 4646585 - DNA, 15 bp, Homo sapiens
cctttccaatagaaa

SEQ ID NO: 4646586 - DNA, 19 bp, Homo sapiens
cctttcccaccattcctgc

SEQ ID NO: 4646587 - DNA, 15 bp, Homo sapiens
cctttctcaactgtc

SEQ ID NO: 4646588 - DNA, 16 bp, Homo sapiens
cctttctctgcctggc

SEQ ID NO: 4646589 - DNA, 18 bp, Homo sapiens
cctttgagatctggggag

SEQ ID NO: 4646590 - DNA, 17 bp, Homo sapiens
cctttgcaagatgcttg

SEQ ID NO: 4646591 - DNA, 17 bp, Homo sapiens
cctttgctggaagaaac

SEQ ID NO: 4646592 - DNA, 15 bp, Homo sapiens
cctttggcagagttc

SEQ ID NO: 4646593 - DNA, 15 bp, Homo sapiens
cctttgtagctactt

SEQ ID NO: 4646594 - DNA, 18 bp, Homo sapiens
ccttttaagcatgtgatg

SEQ ID NO: 4646595 - DNA, 17 bp, Homo sapiens
ccttttaaggtttcaac

SEQ ID NO: 4646596 - DNA, 18 bp, Homo sapiens
ccttttataaggaaactt

SEQ ID NO: 4646597 - DNA, 20 bp, Homo sapiens
ccttttataattaatgtttg

SEQ ID NO: 4646598 - DNA, 16 bp, Homo sapiens
ccttttccacacgcat

SEQ ID NO: 4646599 - DNA, 18 bp, Homo sapiens
ccttttctgtctctctct

SEQ ID NO: 4646600 - DNA, 15 bp, Homo sapiens
ccttttgtgtctatg

SEQ ID NO: 4646601 - DNA, 11 bp, Homo sapiens
cctttttgtaa

SEQ ID NO: 4646602 - DNA, 18 bp, Homo sapiens
cctttttgtaaatatgtg

SEQ ID NO: 4646603 - DNA, 18 bp, Homo sapiens
ccttttttgtcattttat

SEQ ID NO: 4646604 - DNA, 11 bp, Homo sapiens
cgaaaggcctt

SEQ ID NO: 4646605 - DNA, 14 bp, Homo sapiens
cgaaaggccttcag

SEQ ID NO: 4646606 - DNA, 14 bp, Homo sapiens
cgaacatcttcata

SEQ ID NO: 4646607 - DNA, 16 bp, Homo sapiens
cgaacatcttcatata

SEQ ID NO: 4646608 - DNA, 19 bp, Homo sapiens
cgaacatcttcatataaac

SEQ ID NO: 4646609 - DNA, 20 bp, Homo sapiens
cgaacatcttcatataaact

SEQ ID NO: 4646610 - DNA, 16 bp, Homo sapiens
cgaacctcctctgtga

SEQ ID NO: 4646611 - DNA, 16 bp, Homo sapiens
cgaacctcggggtggg

SEQ ID NO: 4646612 - DNA, 17 bp, Homo sapiens
cgaacctcggggtgggg

SEQ ID NO: 4646613 - DNA, 13 bp, Homo sapiens
cgacaagaatgtc

SEQ ID NO: 4646614 - DNA, 16 bp, Homo sapiens
cgacagggcctggagc

SEQ ID NO: 4646615 - DNA, 16 bp, Homo sapiens
cgacagtgccatcccc

SEQ ID NO: 4646616 - DNA, 19 bp, Homo sapiens
cgacatacatgctactttt

SEQ ID NO: 4646617 - DNA, 12 bp, Homo sapiens
cgaccctgtccc

SEQ ID NO: 4646618 - DNA, 15 bp, Homo sapiens
cgacttcctgactct

SEQ ID NO: 4646619 - DNA, 21 bp, Homo sapiens
cgagacgcacacagctgagca

SEQ ID NO: 4646620 - DNA, 14 bp, Homo sapiens
cgagactttctcct

SEQ ID NO: 4646621 - DNA, 14 bp, Homo sapiens
cgagagcctcgctt

SEQ ID NO: 4646622 - DNA, 22 bp, Homo sapiens
cgagaggtgagctactttgtga

SEQ ID NO: 4646623 - DNA, 16 bp, Homo sapiens
cgagcaaccgtggccc

SEQ ID NO: 4646624 - DNA, 23 bp, Homo sapiens
cgagcaaccgtggcccttcctgg

SEQ ID NO: 4646625 - DNA, 13 bp, Homo sapiens
cgagcagctgagc

SEQ ID NO: 4646626 - DNA, 15 bp, Homo sapiens
cgagcagctgagcag

SEQ ID NO: 4646627 - DNA, 14 bp, Homo sapiens
cgagccacaagctg

SEQ ID NO: 4646628 - DNA, 17 bp, Homo sapiens
cgagccacaagctgcac

SEQ ID NO: 4646629 - DNA, 16 bp, Homo sapiens
cgagcgccctgcagac

SEQ ID NO: 4646630 - DNA, 19 bp, Homo sapiens
cgagcgccctgcagaccct

SEQ ID NO: 4646631 - DNA, 21 bp, Homo sapiens
cgagcgccctgcagaccctgc

SEQ ID NO: 4646632 - DNA, 17 bp, Homo sapiens
cgaggaggtaatgaatt

SEQ ID NO: 4646633 - DNA, 19 bp, Homo sapiens
cgagggcagccccctccct

SEQ ID NO: 4646634 - DNA, 13 bp, Homo sapiens
cgaggggcctaga

SEQ ID NO: 4646635 - DNA, 13 bp, Homo sapiens
cgagtccaagctg

SEQ ID NO: 4646636 - DNA, 16 bp, Homo sapiens
cgagtggatgctgtgc

SEQ ID NO: 4646637 - DNA, 13 bp, Homo sapiens
cgatgccaccggc

SEQ ID NO: 4646638 - DNA, 14 bp, Homo sapiens
cgattatacttgag

SEQ ID NO: 4646639 - DNA, 23 bp, Homo sapiens
cgattccctctcccaggccccat

SEQ ID NO: 4646640 - DNA, 13 bp, Homo sapiens
cgcaagtgcctgg

SEQ ID NO: 4646641 - DNA, 14 bp, Homo sapiens
cgcaagtgcctggg

SEQ ID NO: 4646642 - DNA, 16 bp, Homo sapiens
cgcacacagctgagca

SEQ ID NO: 4646643 - DNA, 17 bp, Homo sapiens
cgcacacagctgagcac

SEQ ID NO: 4646644 - DNA, 18 bp, Homo sapiens
cgcaccctccctagctct

SEQ ID NO: 4646645 - DNA, 14 bp, Homo sapiens
cgcactggacagca

SEQ ID NO: 4646646 - DNA, 17 bp, Homo sapiens
cgcactgtgacccccag

SEQ ID NO: 4646647 - DNA, 12 bp, Homo sapiens
cgcagccaccct

SEQ ID NO: 4646648 - DNA, 22 bp, Homo sapiens
cgcagccaccctgaggagtctg

SEQ ID NO: 4646649 - DNA, 19 bp, Homo sapiens
cgcaggtatttagaagcag

SEQ ID NO: 4646650 - DNA, 20 bp, Homo sapiens
cgcaggtatttagaagcaga

SEQ ID NO: 4646651 - DNA, 16 bp, Homo sapiens
cgccaagtgcgtgccg

SEQ ID NO: 4646652 - DNA, 19 bp, Homo sapiens
cgccaatgttatgccagct

SEQ ID NO: 4646653 - DNA, 17 bp, Homo sapiens
cgccacgtcccagcatc

SEQ ID NO: 4646654 - DNA, 12 bp, Homo sapiens
cgccagccacag

SEQ ID NO: 4646655 - DNA, 13 bp, Homo sapiens
cgccagccacagg

SEQ ID NO: 4646656 - DNA, 14 bp, Homo sapiens
cgccagccacagga

SEQ ID NO: 4646657 - DNA, 15 bp, Homo sapiens
cgccagctaattttt

SEQ ID NO: 4646658 - DNA, 16 bp, Homo sapiens
cgccaggctgaccaca

SEQ ID NO: 4646659 - DNA, 12 bp, Homo sapiens
cgccagggctgg

SEQ ID NO: 4646660 - DNA, 15 bp, Homo sapiens
cgccatctcggctca

SEQ ID NO: 4646661 - DNA, 23 bp, Homo sapiens
cgccatctcggctcactgcaacc

SEQ ID NO: 4646662 - DNA, 19 bp, Homo sapiens
cgcccagaggagcccagcg

SEQ ID NO: 4646663 - DNA, 13 bp, Homo sapiens
cgcccctcagagc

SEQ ID NO: 4646664 - DNA, 16 bp, Homo sapiens
cgcccctcagagcatg

SEQ ID NO: 4646665 - DNA, 16 bp, Homo sapiens
cctgggcctgctgctg

SEQ ID NO: 4646666 - DNA, 18 bp, Homo sapiens
cctgggcctgctgctgag

SEQ ID NO: 4646667 - DNA, 14 bp, Homo sapiens
cctgggctggggag

SEQ ID NO: 4646668 - DNA, 13 bp, Homo sapiens
cctggggcctgag

SEQ ID NO: 4646669 - DNA, 17 bp, Homo sapiens
cctggggcctgagagaa

SEQ ID NO: 4646670 - DNA, 20 bp, Homo sapiens
cctggggctctaacgcctga

SEQ ID NO: 4646671 - DNA, 15 bp, Homo sapiens
cctggggctggcctc

SEQ ID NO: 4646672 - DNA, 19 bp, Homo sapiens
cctggggctggcctcccaa

SEQ ID NO: 4646673 - DNA, 15 bp, Homo sapiens
cctgggggaagagga

SEQ ID NO: 4646674 - DNA, 13 bp, Homo sapiens
cctgggggcctgg

SEQ ID NO: 4646675 - DNA, 17 bp, Homo sapiens
cctgggggcctggctgg

SEQ ID NO: 4646676 - DNA, 23 bp, Homo sapiens
cctgggggcctggctggctgagg

SEQ ID NO: 4646677 - DNA, 18 bp, Homo sapiens
cctgggggttttccaagc

SEQ ID NO: 4646678 - DNA, 20 bp, Homo sapiens
cctgggggttttccaagccc

SEQ ID NO: 4646679 - DNA, 21 bp, Homo sapiens
cctgggtggctactctgtgcc

SEQ ID NO: 4646680 - DNA, 14 bp, Homo sapiens
cctggtggggcagc

SEQ ID NO: 4646681 - DNA, 23 bp, Homo sapiens
cctggtggggcagctcctctgtc

SEQ ID NO: 4646682 - DNA, 20 bp, Homo sapiens
cctggttctaggctgctgca

SEQ ID NO: 4646683 - DNA, 22 bp, Homo sapiens
cctggttctaggctgctgcaca

SEQ ID NO: 4646684 - DNA, 23 bp, Homo sapiens
cctgtaatcaggcaaggaggagg

SEQ ID NO: 4646685 - DNA, 14 bp, Homo sapiens
cctgtactgcctgc

SEQ ID NO: 4646686 - DNA, 16 bp, Homo sapiens
cctgtactgcctgctt

SEQ ID NO: 4646687 - DNA, 19 bp, Homo sapiens
cctgtagttgcgtggactc

SEQ ID NO: 4646688 - DNA, 20 bp, Homo sapiens
cctgtattactgaataatat

SEQ ID NO: 4646689 - DNA, 16 bp, Homo sapiens
cctgtatttgttccca

SEQ ID NO: 4646690 - DNA, 22 bp, Homo sapiens
cctgtccaagacagggctcatt

SEQ ID NO: 4646691 - DNA, 16 bp, Homo sapiens
cctgtcccagggccct

SEQ ID NO: 4646692 - DNA, 20 bp, Homo sapiens
cctgtctctggctactccct

SEQ ID NO: 4646693 - DNA, 20 bp, Homo sapiens
cctgtcttggggccactttc

SEQ ID NO: 4646694 - DNA, 17 bp, Homo sapiens
cctgtgaacccaggaca

SEQ ID NO: 4646695 - DNA, 18 bp, Homo sapiens
cctgtgatgttttatcct

SEQ ID NO: 4646696 - DNA, 17 bp, Homo sapiens
cctgtgcatgtatgtct

SEQ ID NO: 4646697 - DNA, 20 bp, Homo sapiens
cctgtgcccatggcttctgg

SEQ ID NO: 4646698 - DNA, 17 bp, Homo sapiens
cctgtgcctgattattt

SEQ ID NO: 4646699 - DNA, 21 bp, Homo sapiens
cctgtgctagaagctccatgg

SEQ ID NO: 4646700 - DNA, 21 bp, Homo sapiens
cctgtggaatgagtgtgcatg

SEQ ID NO: 4646701 - DNA, 14 bp, Homo sapiens
cctgtggctccctc

SEQ ID NO: 4646702 - DNA, 16 bp, Homo sapiens
cctgtggctccctctc

SEQ ID NO: 4646703 - DNA, 20 bp, Homo sapiens
cctgtggctccctctctcct

SEQ ID NO: 4646704 - DNA, 22 bp, Homo sapiens
cctgtggctccctctctcctgg

SEQ ID NO: 4646705 - DNA, 17 bp, Homo sapiens
cctgtgggactcatcct

SEQ ID NO: 4646706 - DNA, 16 bp, Homo sapiens
cctgtgggagcctcgc

SEQ ID NO: 4646707 - DNA, 12 bp, Homo sapiens
cctgtgggcttc

SEQ ID NO: 4646708 - DNA, 19 bp, Homo sapiens
cctgtgggtctctgaaggg

SEQ ID NO: 4646709 - DNA, 23 bp, Homo sapiens
cctgtgggtgtagccaggtatgg

SEQ ID NO: 4646710 - DNA, 17 bp, Homo sapiens
cctgtgtagctgtgacc

SEQ ID NO: 4646711 - DNA, 19 bp, Homo sapiens
cctgtgtagctgtgacctg

SEQ ID NO: 4646712 - DNA, 21 bp, Homo sapiens
cctgtgtagctgtgacctgct

SEQ ID NO: 4646713 - DNA, 22 bp, Homo sapiens
cctgttagctttccaaggaagc

SEQ ID NO: 4646714 - DNA, 13 bp, Homo sapiens
cctgttctgaaat

SEQ ID NO: 4646715 - DNA, 20 bp, Homo sapiens
cctgttctgaaatgttctta

SEQ ID NO: 4646716 - DNA, 20 bp, Homo sapiens
cctgttcttagagtgtagct

SEQ ID NO: 4646717 - DNA, 14 bp, Homo sapiens
cctgtttctggcac

SEQ ID NO: 4646718 - DNA, 14 bp, Homo sapiens
ccttaaaatgtgta

SEQ ID NO: 4646719 - DNA, 14 bp, Homo sapiens
ccttaaaggggaga

SEQ ID NO: 4646720 - DNA, 13 bp, Homo sapiens
ccttaatcttgct

SEQ ID NO: 4646721 - DNA, 16 bp, Homo sapiens
ccttaatcttgctttc

SEQ ID NO: 4646722 - DNA, 17 bp, Homo sapiens
ccttaccctccttggga

SEQ ID NO: 4646723 - DNA, 13 bp, Homo sapiens
ccttacctgtctc

SEQ ID NO: 4646724 - DNA, 20 bp, Homo sapiens
ccttacctgtctctctcttc

SEQ ID NO: 4646725 - DNA, 13 bp, Homo sapiens
ccttacgtgagaa

SEQ ID NO: 4646726 - DNA, 14 bp, Homo sapiens
ccttactaattata

SEQ ID NO: 4646727 - DNA, 19 bp, Homo sapiens
ccttactcctgtgggagcc

SEQ ID NO: 4646728 - DNA, 20 bp, Homo sapiens
ccttactcctgtgggagcct

SEQ ID NO: 4646729 - DNA, 14 bp, Homo sapiens
ccttaggcctctga

SEQ ID NO: 4646730 - DNA, 19 bp, Homo sapiens
ccttagtttcaaagtgtct

SEQ ID NO: 4646731 - DNA, 16 bp, Homo sapiens
ccttatcctagccttt

SEQ ID NO: 4646732 - DNA, 22 bp, Homo sapiens
ccttatttgctaatcaaagcca

SEQ ID NO: 4646733 - DNA, 14 bp, Homo sapiens
ccttattttgagta

SEQ ID NO: 4646734 - DNA, 20 bp, Homo sapiens
ccttattttgagtaaatatt

SEQ ID NO: 4646735 - DNA, 17 bp, Homo sapiens
ccttcacctcggaggga

SEQ ID NO: 4646736 - DNA, 17 bp, Homo sapiens
ccttcactctccagggt

SEQ ID NO: 4646737 - DNA, 18 bp, Homo sapiens
ccttcactctccagggta

SEQ ID NO: 4646738 - DNA, 16 bp, Homo sapiens
ccttcagttctgcttg

SEQ ID NO: 4646739 - DNA, 17 bp, Homo sapiens
ccttccaaataataaag

SEQ ID NO: 4646740 - DNA, 14 bp, Homo sapiens
ccttccaacaaaag

SEQ ID NO: 4646741 - DNA, 14 bp, Homo sapiens
ccttccccagctcc

SEQ ID NO: 4646742 - DNA, 22 bp, Homo sapiens
ccttccccagctcccccaggca

SEQ ID NO: 4646743 - DNA, 22 bp, Homo sapiens
ccttccccatgaaccctgccct

SEQ ID NO: 4646744 - DNA, 14 bp, Homo sapiens
ccttcccctgggaa

SEQ ID NO: 4646745 - DNA, 23 bp, Homo sapiens
ccttcccctgggaactctcctgg

SEQ ID NO: 4646746 - DNA, 17 bp, Homo sapiens
ccttccctaatagcttt

SEQ ID NO: 4646747 - DNA, 12 bp, Homo sapiens
ccttccctctgc

SEQ ID NO: 4646748 - DNA, 15 bp, Homo sapiens
ccttcccttcctcag

SEQ ID NO: 4646749 - DNA, 17 bp, Homo sapiens
ccttcccttcctcagca

SEQ ID NO: 4646750 - DNA, 16 bp, Homo sapiens
ccttccgttccccgct

SEQ ID NO: 4646751 - DNA, 18 bp, Homo sapiens
ccttcctcagcaggccaa

SEQ ID NO: 4646752 - DNA, 15 bp, Homo sapiens
ccttcctcctgcctt

SEQ ID NO: 4646753 - DNA, 22 bp, Homo sapiens
ccttcctctccaccctcccaga

SEQ ID NO: 4646754 - DNA, 17 bp, Homo sapiens
ccttcctcttcctgccc

SEQ ID NO: 4646755 - DNA, 19 bp, Homo sapiens
ccttcctggacagctgtgc

SEQ ID NO: 4646756 - DNA, 18 bp, Homo sapiens
ccttcgaaaggccttcag

SEQ ID NO: 4646757 - DNA, 19 bp, Homo sapiens
ccttcgaaaggccttcaga

SEQ ID NO: 4646758 - DNA, 12 bp, Homo sapiens
ccttctaggaat

SEQ ID NO: 4646759 - DNA, 15 bp, Homo sapiens
ccttctattctagcc

SEQ ID NO: 4646760 - DNA, 22 bp, Homo sapiens
ccttctcacacacaactgtcca

SEQ ID NO: 4646761 - DNA, 20 bp, Homo sapiens
ccttctctacactcttgtaa

SEQ ID NO: 4646762 - DNA, 17 bp, Homo sapiens
ccttctgcaaagtggca

SEQ ID NO: 4646763 - DNA, 11 bp, Homo sapiens
ccttcttcctt

SEQ ID NO: 4646764 - DNA, 15 bp, Homo sapiens
ccttgaagttgtgga

SEQ ID NO: 4646765 - DNA, 22 bp, Homo sapiens
ccttgacaatgttgtcctcctg

SEQ ID NO: 4646766 - DNA, 21 bp, Homo sapiens
ccttgactgaagcgaacatct

SEQ ID NO: 4646767 - DNA, 22 bp, Homo sapiens
ccttgaggggcagtttgggaag

SEQ ID NO: 4646768 - DNA, 18 bp, Homo sapiens
ccatgtgctacaggggcc

SEQ ID NO: 4646769 - DNA, 16 bp, Homo sapiens
ccatgtgtacattctg

SEQ ID NO: 4646770 - DNA, 14 bp, Homo sapiens
ccatgttacttctc

SEQ ID NO: 4646771 - DNA, 15 bp, Homo sapiens
ccatgttacttctct

SEQ ID NO: 4646772 - DNA, 15 bp, Homo sapiens
ccattaatcttgatc

SEQ ID NO: 4646773 - DNA, 20 bp, Homo sapiens
ccattaatcttgatcattcc

SEQ ID NO: 4646774 - DNA, 13 bp, Homo sapiens
ccattaggccagc

SEQ ID NO: 4646775 - DNA, 16 bp, Homo sapiens
ccattaggccagcaac

SEQ ID NO: 4646776 - DNA, 21 bp, Homo sapiens
ccattcactactcatgcgtga

SEQ ID NO: 4646777 - DNA, 13 bp, Homo sapiens
ccattcactccca

SEQ ID NO: 4646778 - DNA, 13 bp, Homo sapiens
ccattcctgcctt

SEQ ID NO: 4646779 - DNA, 18 bp, Homo sapiens
ccattctgcatgagctga

SEQ ID NO: 4646780 - DNA, 22 bp, Homo sapiens
ccaggccccatgacctccagct

SEQ ID NO: 4646781 - DNA, 18 bp, Homo sapiens
ccaggccccatggagggt

SEQ ID NO: 4646782 - DNA, 23 bp, Homo sapiens
ccaggcctagtaaccaaggccct

SEQ ID NO: 4646783 - DNA, 16 bp, Homo sapiens
ccaggcctgcagcagg

SEQ ID NO: 4646784 - DNA, 18 bp, Homo sapiens
ccaggcctgcagcaggag

SEQ ID NO: 4646785 - DNA, 23 bp, Homo sapiens
ccaggcctgggtgatctgctgct

SEQ ID NO: 4646786 - DNA, 20 bp, Homo sapiens
ccaggctgaagcaggttccc

SEQ ID NO: 4646787 - DNA, 18 bp, Homo sapiens
ccaggctgaccacagcac

SEQ ID NO: 4646788 - DNA, 21 bp, Homo sapiens
ccaggctgaccacagcacagc

SEQ ID NO: 4646789 - DNA, 20 bp, Homo sapiens
ccaggctgggctctgcctgt

SEQ ID NO: 4646790 - DNA, 14 bp, Homo sapiens
ccagggacactcca

SEQ ID NO: 4646791 - DNA, 13 bp, Homo sapiens
ccagggagctgca

SEQ ID NO: 4646792 - DNA, 14 bp, Homo sapiens
ccagggatgctggg

SEQ ID NO: 4646793 - DNA, 15 bp, Homo sapiens
ccagggatgctgggc

SEQ ID NO: 4646794 - DNA, 18 bp, Homo sapiens
ccagggatgctgggctgg

SEQ ID NO: 4646795 - DNA, 21 bp, Homo sapiens
ccagggatgctgggctgggcc

SEQ ID NO: 4646796 - DNA, 20 bp, Homo sapiens
ccagggatgtctgttgaaat

SEQ ID NO: 4646797 - DNA, 14 bp, Homo sapiens
ccagggccagagca

SEQ ID NO: 4646798 - DNA, 15 bp, Homo sapiens
ccagggccagagcag

SEQ ID NO: 4646799 - DNA, 16 bp, Homo sapiens
ccagggccagagcagc

SEQ ID NO: 4646800 - DNA, 17 bp, Homo sapiens
ccagggccagagcagct

SEQ ID NO: 4646801 - DNA, 18 bp, Homo sapiens
ccagggccagagcagctc

SEQ ID NO: 4646802 - DNA, 13 bp, Homo sapiens
ccagggccctccc

SEQ ID NO: 4646803 - DNA, 17 bp, Homo sapiens
ccagggccctcccagcc

SEQ ID NO: 4646804 - DNA, 18 bp, Homo sapiens
ccagggctgccctgagaa

SEQ ID NO: 4646805 - DNA, 15 bp, Homo sapiens
ccaggggcatgactg

SEQ ID NO: 4646806 - DNA, 12 bp, Homo sapiens
ccaggggcctgc

SEQ ID NO: 4646807 - DNA, 20 bp, Homo sapiens
ccaggtacaggagaggcagc

SEQ ID NO: 4646808 - DNA, 22 bp, Homo sapiens
ccaggtatccaaaaatgtgtaa

SEQ ID NO: 4646809 - DNA, 15 bp, Homo sapiens
ccaggtatcctgggg

SEQ ID NO: 4646810 - DNA, 19 bp, Homo sapiens
ccaggtatcctgggggaag

SEQ ID NO: 4646811 - DNA, 20 bp, Homo sapiens
ccaggtcaccaagcagtggc

SEQ ID NO: 4646812 - DNA, 12 bp, Homo sapiens
ccaggtcctggt

SEQ ID NO: 4646813 - DNA, 21 bp, Homo sapiens
ccaggtcctggtggggcagct

SEQ ID NO: 4646814 - DNA, 16 bp, Homo sapiens
ccaggtctcctgggaa

SEQ ID NO: 4646815 - DNA, 17 bp, Homo sapiens
ccaggtctcctgggaaa

SEQ ID NO: 4646816 - DNA, 14 bp, Homo sapiens
ccaggtgagaattc

SEQ ID NO: 4646817 - DNA, 20 bp, Homo sapiens
ccaggtggaaggcagacagc

SEQ ID NO: 4646818 - DNA, 20 bp, Homo sapiens
ccaggttcaagcgattctcc

SEQ ID NO: 4646819 - DNA, 13 bp, Homo sapiens
ccagtagcccaga

SEQ ID NO: 4646820 - DNA, 22 bp, Homo sapiens
ccagtagtgggatcatccagag

SEQ ID NO: 4646821 - DNA, 15 bp, Homo sapiens
ccagtcaagctccta

SEQ ID NO: 4646822 - DNA, 15 bp, Homo sapiens
ccagtcaggatgagg

SEQ ID NO: 4646823 - DNA, 18 bp, Homo sapiens
ccagtcggccccatctct

SEQ ID NO: 4646824 - DNA, 22 bp, Homo sapiens
ccagtctagtccgtcctggcac

SEQ ID NO: 4646825 - DNA, 15 bp, Homo sapiens
ccagtctcctctcca

SEQ ID NO: 4646826 - DNA, 12 bp, Homo sapiens
ccagtctgaccc

SEQ ID NO: 4646827 - DNA, 13 bp, Homo sapiens
ccagtgacgctgc

SEQ ID NO: 4646828 - DNA, 15 bp, Homo sapiens
ccagtgccacgtcat

SEQ ID NO: 4646829 - DNA, 13 bp, Homo sapiens
ccagtgggactgt

SEQ ID NO: 4646830 - DNA, 13 bp, Homo sapiens
ccagtggggcctg

SEQ ID NO: 4646831 - DNA, 16 bp, Homo sapiens
ccagtggggcctgtgg

SEQ ID NO: 4646832 - DNA, 17 bp, Homo sapiens
ccagtgtttctgaatgt

SEQ ID NO: 4646833 - DNA, 21 bp, Homo sapiens
ccagtgtttctgaatgtttgt

SEQ ID NO: 4646834 - DNA, 13 bp, Homo sapiens
ccagttaaagcca

SEQ ID NO: 4646835 - DNA, 14 bp, Homo sapiens
ccagttaaagccac

SEQ ID NO: 4646836 - DNA, 13 bp, Homo sapiens
ccagttcctatga

SEQ ID NO: 4646837 - DNA, 19 bp, Homo sapiens
ccagttcctatgacacagt

SEQ ID NO: 4646838 - DNA, 20 bp, Homo sapiens
ccagttcttcatttggagga

SEQ ID NO: 4646839 - DNA, 23 bp, Homo sapiens
ccagttcttcatttggaggaatc

SEQ ID NO: 4646840 - DNA, 17 bp, Homo sapiens
ccagttgtgttgacaca

SEQ ID NO: 4646841 - DNA, 17 bp, Homo sapiens
ccagtttgcacctgtcc

SEQ ID NO: 4646842 - DNA, 14 bp, Homo sapiens
ccagtttttattaa

SEQ ID NO: 4646843 - DNA, 20 bp, Homo sapiens
ccataattttgcatactgaa

SEQ ID NO: 4646844 - DNA, 12 bp, Homo sapiens
ccataccattcc

SEQ ID NO: 4646845 - DNA, 14 bp, Homo sapiens
ccataccttctccc

SEQ ID NO: 4646846 - DNA, 17 bp, Homo sapiens
ccataccttctcccagg

SEQ ID NO: 4646847 - DNA, 15 bp, Homo sapiens
ccatactgtagacac

SEQ ID NO: 4646848 - DNA, 20 bp, Homo sapiens
ccatagggtcggaggtgctg

SEQ ID NO: 4646849 - DNA, 21 bp, Homo sapiens
ccatagggtcggaggtgctgt

SEQ ID NO: 4646850 - DNA, 16 bp, Homo sapiens
ccataggtttctctcc

SEQ ID NO: 4646851 - DNA, 23 bp, Homo sapiens
ccatatattaccccttcatgtcc

SEQ ID NO: 4646852 - DNA, 21 bp, Homo sapiens
ccatatgccttggggaggaca

SEQ ID NO: 4646853 - DNA, 22 bp, Homo sapiens
ccatattgtcacctcagcactg

SEQ ID NO: 4646854 - DNA, 18 bp, Homo sapiens
ccatatttgatttctaat

SEQ ID NO: 4646855 - DNA, 22 bp, Homo sapiens
ccatcaaaggaatataagaaaa

SEQ ID NO: 4646856 - DNA, 12 bp, Homo sapiens
ccatcagccctg

SEQ ID NO: 4646857 - DNA, 13 bp, Homo sapiens
ccatcagccctgc

SEQ ID NO: 4646858 - DNA, 14 bp, Homo sapiens
ccatcagccctgct

SEQ ID NO: 4646859 - DNA, 16 bp, Homo sapiens
ccatcccaaccagtgc

SEQ ID NO: 4646860 - DNA, 20 bp, Homo sapiens
ccatcccaaccagtgccaag

SEQ ID NO: 4646861 - DNA, 20 bp, Homo sapiens
ccatcccactgctcccccaa

SEQ ID NO: 4646862 - DNA, 12 bp, Homo sapiens
ccatcctggggc

SEQ ID NO: 4646863 - DNA, 15 bp, Homo sapiens
ccatcctggggcagc

SEQ ID NO: 4646864 - DNA, 20 bp, Homo sapiens
ccatccttgactgaagcgaa

SEQ ID NO: 4646865 - DNA, 18 bp, Homo sapiens
ccatcctttgtcttggaa

SEQ ID NO: 4646866 - DNA, 16 bp, Homo sapiens
ccatctatcactgcat

SEQ ID NO: 4646867 - DNA, 17 bp, Homo sapiens
ccatctcacctcctgct

SEQ ID NO: 4646868 - DNA, 21 bp, Homo sapiens
ccatctcatgcccctggctgg

SEQ ID NO: 4646869 - DNA, 13 bp, Homo sapiens
ccatctgtgttct

SEQ ID NO: 4646870 - DNA, 15 bp, Homo sapiens
ccatcttgcttccaa

SEQ ID NO: 4646871 - DNA, 22 bp, Homo sapiens
ccatcttgtttcatttgcttgc

SEQ ID NO: 4646872 - DNA, 17 bp, Homo sapiens
ccatctttttcttgggt

SEQ ID NO: 4646873 - DNA, 14 bp, Homo sapiens
ccatgaaccctgcc

SEQ ID NO: 4646874 - DNA, 14 bp, Homo sapiens
ccatgaactttgtc

SEQ ID NO: 4646875 - DNA, 15 bp, Homo sapiens
ccatgaactttgtcc

SEQ ID NO: 4646876 - DNA, 14 bp, Homo sapiens
ccatgacctccagc

SEQ ID NO: 4646877 - DNA, 20 bp, Homo sapiens
ccatgacctccagctttcct

SEQ ID NO: 4646878 - DNA, 20 bp, Homo sapiens
ccatgagactgccctgccca

SEQ ID NO: 4646879 - DNA, 21 bp, Homo sapiens
ccatgagactgccctgcccag

SEQ ID NO: 4646880 - DNA, 17 bp, Homo sapiens
ccatgagtatgccactg

SEQ ID NO: 4646881 - DNA, 15 bp, Homo sapiens
ccatgctcccaactc

SEQ ID NO: 4646882 - DNA, 19 bp, Homo sapiens
ccatgctgcaaaggagaag

SEQ ID NO: 4646883 - DNA, 20 bp, Homo sapiens
ccatgctgggccactgggga

SEQ ID NO: 4646884 - DNA, 18 bp, Homo sapiens
ccatggaggcagatgccc

SEQ ID NO: 4646885 - DNA, 15 bp, Homo sapiens
ccatggccctcatta

SEQ ID NO: 4646886 - DNA, 23 bp, Homo sapiens
ccatgggtctggctagagggccc

SEQ ID NO: 4646887 - DNA, 16 bp, Homo sapiens
ccatgtaaccactgca

SEQ ID NO: 4646888 - DNA, 19 bp, Homo sapiens
ccatgtaaccactgcactt

SEQ ID NO: 4646889 - DNA, 11 bp, Homo sapiens
ccatgtagcca

SEQ ID NO: 4646890 - DNA, 21 bp, Homo sapiens
ccatgtgattaatgttttcat

SEQ ID NO: 4646891 - DNA, 13 bp, Homo sapiens
catgtgacacata

SEQ ID NO: 4646892 - DNA, 15 bp, Homo sapiens
catgtgacacatatg

SEQ ID NO: 4646893 - DNA, 12 bp, Homo sapiens
catgtgactctg

SEQ ID NO: 4646894 - DNA, 20 bp, Homo sapiens
catgtgctacaggggccaga

SEQ ID NO: 4646895 - DNA, 15 bp, Homo sapiens
catgtggccccaccc

SEQ ID NO: 4646896 - DNA, 19 bp, Homo sapiens
catgtgtatattcctttta

SEQ ID NO: 4646897 - DNA, 15 bp, Homo sapiens
catgtgtgcagagca

SEQ ID NO: 4646898 - DNA, 13 bp, Homo sapiens
catgttcctcctt

SEQ ID NO: 4646899 - DNA, 13 bp, Homo sapiens
catgttctcccaa

SEQ ID NO: 4646900 - DNA, 17 bp, Homo sapiens
catgttgatcatgtact

SEQ ID NO: 4646901 - DNA, 16 bp, Homo sapiens
catgttggccaggctg

SEQ ID NO: 4646902 - DNA, 18 bp, Homo sapiens
catgttgtgcctccctgg

SEQ ID NO: 4646903 - DNA, 20 bp, Homo sapiens
catgttgtgcctccctggtg

SEQ ID NO: 4646904 - DNA, 12 bp, Homo sapiens
catgtttataaa

SEQ ID NO: 4646905 - DNA, 20 bp, Homo sapiens
catgttttaacaaaaaccaa

SEQ ID NO: 4646906 - DNA, 17 bp, Homo sapiens
catgttttccattgttt

SEQ ID NO: 4646907 - DNA, 21 bp, Homo sapiens
catgttttccattgtttgaaa

SEQ ID NO: 4646908 - DNA, 13 bp, Homo sapiens
cattaaaaattac

SEQ ID NO: 4646909 - DNA, 13 bp, Homo sapiens
cattaaaatgaca

SEQ ID NO: 4646910 - DNA, 14 bp, Homo sapiens
cattaaaatgacaa

SEQ ID NO: 4646911 - DNA, 17 bp, Homo sapiens
cattaaaggcttctctc

SEQ ID NO: 4646912 - DNA, 16 bp, Homo sapiens
cattaacggtgctaaa

SEQ ID NO: 4646913 - DNA, 17 bp, Homo sapiens
cattaacggtgctaaaa

SEQ ID NO: 4646914 - DNA, 15 bp, Homo sapiens
cattaactccctcca

SEQ ID NO: 4646915 - DNA, 12 bp, Homo sapiens
cattaatttaat

SEQ ID NO: 4646916 - DNA, 15 bp, Homo sapiens
cattaatttaattac

SEQ ID NO: 4646917 - DNA, 16 bp, Homo sapiens
cattaattttttttca

SEQ ID NO: 4646918 - DNA, 18 bp, Homo sapiens
cattactaaggcaggtgg

SEQ ID NO: 4646919 - DNA, 16 bp, Homo sapiens
cattactcttaaggaa

SEQ ID NO: 4646920 - DNA, 15 bp, Homo sapiens
cattactgttccaga

SEQ ID NO: 4646921 - DNA, 13 bp, Homo sapiens
ccagagctgtgcc

SEQ ID NO: 4646922 - DNA, 14 bp, Homo sapiens
ccagagctgtgcca

SEQ ID NO: 4646923 - DNA, 15 bp, Homo sapiens
ccagagctgtgccag

SEQ ID NO: 4646924 - DNA, 18 bp, Homo sapiens
ccagagctgtgccagcag

SEQ ID NO: 4646925 - DNA, 15 bp, Homo sapiens
ccagaggactcccaa

SEQ ID NO: 4646926 - DNA, 17 bp, Homo sapiens
ccagaggccctggaggt

SEQ ID NO: 4646927 - DNA, 23 bp, Homo sapiens
ccagaggccctggaggtctccag

SEQ ID NO: 4646928 - DNA, 15 bp, Homo sapiens
ccagaggctgcccca

SEQ ID NO: 4646929 - DNA, 18 bp, Homo sapiens
ccagatgcacatccctgg

SEQ ID NO: 4646930 - DNA, 12 bp, Homo sapiens
ccagatttgtct

SEQ ID NO: 4646931 - DNA, 15 bp, Homo sapiens
ccagatttgtctttt

SEQ ID NO: 4646932 - DNA, 18 bp, Homo sapiens
ccagcaagagggaacaaa

SEQ ID NO: 4646933 - DNA, 20 bp, Homo sapiens
ccagcaagagggaacaaaac

SEQ ID NO: 4646934 - DNA, 22 bp, Homo sapiens
ccagcaccggccccatttaccc

SEQ ID NO: 4646935 - DNA, 11 bp, Homo sapiens
ccagcactttg

SEQ ID NO: 4646936 - DNA, 13 bp, Homo sapiens
ccagcagaactga

SEQ ID NO: 4646937 - DNA, 14 bp, Homo sapiens
ccagcagaactgaa

SEQ ID NO: 4646938 - DNA, 17 bp, Homo sapiens
ccagcaggaataaagac

SEQ ID NO: 4646939 - DNA, 13 bp, Homo sapiens
ccagcatccctgg

SEQ ID NO: 4646940 - DNA, 11 bp, Homo sapiens
ccagcatctcc

SEQ ID NO: 4646941 - DNA, 19 bp, Homo sapiens
ccagccacacttgaaccta

SEQ ID NO: 4646942 - DNA, 10 bp, Homo sapiens
ccagccacag

SEQ ID NO: 4646943 - DNA, 18 bp, Homo sapiens
ccagccacagacccctgg

SEQ ID NO: 4646944 - DNA, 11 bp, Homo sapiens
ccagccacagg

SEQ ID NO: 4646945 - DNA, 16 bp, Homo sapiens
ccagccacttccccct

SEQ ID NO: 4646946 - DNA, 22 bp, Homo sapiens
ccagccagaacgtggctctgct

SEQ ID NO: 4646947 - DNA, 23 bp, Homo sapiens
ccagccagaacgtggctctgctg

SEQ ID NO: 4646948 - DNA, 15 bp, Homo sapiens
ccagccatgcctgag

SEQ ID NO: 4646949 - DNA, 14 bp, Homo sapiens
ccagcccagatgtt

SEQ ID NO: 4646950 - DNA, 12 bp, Homo sapiens
ccagcccaggaa

SEQ ID NO: 4646951 - DNA, 14 bp, Homo sapiens
ccagcccattgctg

SEQ ID NO: 4646952 - DNA, 15 bp, Homo sapiens
ccagccccctcctgg

SEQ ID NO: 4646953 - DNA, 13 bp, Homo sapiens
ccagcccctgtcc

SEQ ID NO: 4646954 - DNA, 12 bp, Homo sapiens
ccagccccttcc

SEQ ID NO: 4646955 - DNA, 15 bp, Homo sapiens
ccagccccttcccct

SEQ ID NO: 4646956 - DNA, 17 bp, Homo sapiens
ccagcccgacagtgcca

SEQ ID NO: 4646957 - DNA, 21 bp, Homo sapiens
ccagcccgacagtgccatccc

SEQ ID NO: 4646958 - DNA, 22 bp, Homo sapiens
ccagcccgacagtgccatcccc

SEQ ID NO: 4646959 - DNA, 13 bp, Homo sapiens
ccagccctgcctg

SEQ ID NO: 4646960 - DNA, 14 bp, Homo sapiens
ccagccctgcctgg

SEQ ID NO: 4646961 - DNA, 17 bp, Homo sapiens
ccagccctgcctggagg

SEQ ID NO: 4646962 - DNA, 22 bp, Homo sapiens
ccagccctgcctggaggacctg

SEQ ID NO: 4646963 - DNA, 15 bp, Homo sapiens
ccagccctggcccct

SEQ ID NO: 4646964 - DNA, 12 bp, Homo sapiens
ccagccctgggg

SEQ ID NO: 4646965 - DNA, 15 bp, Homo sapiens
ccagcctcacttcct

SEQ ID NO: 4646966 - DNA, 18 bp, Homo sapiens
ccagcctgaggtgcccac

SEQ ID NO: 4646967 - DNA, 13 bp, Homo sapiens
ccagcctgctgac

SEQ ID NO: 4646968 - DNA, 20 bp, Homo sapiens
ccagcctgctgacagacact

SEQ ID NO: 4646969 - DNA, 22 bp, Homo sapiens
ccagcctggcctcctgcctcta

SEQ ID NO: 4646970 - DNA, 11 bp, Homo sapiens
ccagcctgggc

SEQ ID NO: 4646971 - DNA, 14 bp, Homo sapiens
ccagcctgggccta

SEQ ID NO: 4646972 - DNA, 19 bp, Homo sapiens
ccagcgattccctctccca

SEQ ID NO: 4646973 - DNA, 24 bp, Homo sapiens
ccagcgccaagtaaacagggtacc

SEQ ID NO: 4646974 - DNA, 17 bp, Homo sapiens
ccagcggacagtggcag

SEQ ID NO: 4646975 - DNA, 14 bp, Homo sapiens
ccagcggcccaaga

SEQ ID NO: 4646976 - DNA, 18 bp, Homo sapiens
ccagctagtgacccacat

SEQ ID NO: 4646977 - DNA, 21 bp, Homo sapiens
ccagctagtgacccacatgcc

SEQ ID NO: 4646978 - DNA, 17 bp, Homo sapiens
ccagctcccccaggcag

SEQ ID NO: 4646979 - DNA, 19 bp, Homo sapiens
ccagctgaaggcagtggca

SEQ ID NO: 4646980 - DNA, 17 bp, Homo sapiens
ccagctgagcgccagga

SEQ ID NO: 4646981 - DNA, 20 bp, Homo sapiens
ccagctgagcgccaggatgg

SEQ ID NO: 4646982 - DNA, 13 bp, Homo sapiens
ccagctgagtgag

SEQ ID NO: 4646983 - DNA, 22 bp, Homo sapiens
ccagctgctctaagcccaggat

SEQ ID NO: 4646984 - DNA, 20 bp, Homo sapiens
ccagctgctgtgccccacca

SEQ ID NO: 4646985 - DNA, 19 bp, Homo sapiens
ccagctggcctggccccca

SEQ ID NO: 4646986 - DNA, 12 bp, Homo sapiens
ccagcttcactc

SEQ ID NO: 4646987 - DNA, 20 bp, Homo sapiens
ccagcttctcagtttctgcc

SEQ ID NO: 4646988 - DNA, 21 bp, Homo sapiens
ccaggaaaaaaaaaaaaagaa

SEQ ID NO: 4646989 - DNA, 12 bp, Homo sapiens
ccaggaaaggag

SEQ ID NO: 4646990 - DNA, 23 bp, Homo sapiens
ccaggaaggccaaaatcaagagt

SEQ ID NO: 4646991 - DNA, 15 bp, Homo sapiens
ccaggagaagaaaga

SEQ ID NO: 4646992 - DNA, 16 bp, Homo sapiens
ccaggagaagggggct

SEQ ID NO: 4646993 - DNA, 22 bp, Homo sapiens
ccaggagaagggggctctgccc

SEQ ID NO: 4646994 - DNA, 21 bp, Homo sapiens
ccaggagcttcttcgttcctg

SEQ ID NO: 4646995 - DNA, 17 bp, Homo sapiens
ccaggagggacaaagga

SEQ ID NO: 4646996 - DNA, 15 bp, Homo sapiens
ccaggaggtgcagtg

SEQ ID NO: 4646997 - DNA, 18 bp, Homo sapiens
ccaggaggtgcagtggag

SEQ ID NO: 4646998 - DNA, 17 bp, Homo sapiens
ccaggagtggggagagt

SEQ ID NO: 4646999 - DNA, 21 bp, Homo sapiens
ccaggagtggggagagttgtg

SEQ ID NO: 4647000 - DNA, 21 bp, Homo sapiens
ccaggatactggcacagaggt

SEQ ID NO: 4647001 - DNA, 18 bp, Homo sapiens
ccaggatcagattgcatg

SEQ ID NO: 4647002 - DNA, 19 bp, Homo sapiens
ccaggatcagattgcatgt

SEQ ID NO: 4647003 - DNA, 21 bp, Homo sapiens
ccaggatcagattgcatgtga

SEQ ID NO: 4647004 - DNA, 21 bp, Homo sapiens
ccaggatctcctgccagccca

SEQ ID NO: 4647005 - DNA, 16 bp, Homo sapiens
ccaggatggagcaagc

SEQ ID NO: 4647006 - DNA, 22 bp, Homo sapiens
ccaggatggagcaagctcttcc

SEQ ID NO: 4647007 - DNA, 16 bp, Homo sapiens
ccaggcaaggaacaga

SEQ ID NO: 4647008 - DNA, 23 bp, Homo sapiens
ccaggcaatggcctaaacttcag

SEQ ID NO: 4647009 - DNA, 23 bp, Homo sapiens
ccaggcagaaatagttgtctgtg

SEQ ID NO: 4647010 - DNA, 10 bp, Homo sapiens
ccaggcccca

SEQ ID NO: 4647011 - DNA, 17 bp, Homo sapiens
ccaggccccatgacctc

SEQ ID NO: 4647012 - DNA, 18 bp, Homo sapiens
ccaggccccatgacctcc

SEQ ID NO: 4647013 - DNA, 20 bp, Homo sapiens
ccaggccccatgacctccag

SEQ ID NO: 4647014 - DNA, 17 bp, Homo sapiens
catgagactgccctgcc

SEQ ID NO: 4647015 - DNA, 18 bp, Homo sapiens
catgagactgccctgccc

SEQ ID NO: 4647016 - DNA, 16 bp, Homo sapiens
catgagatcagggcct

SEQ ID NO: 4647017 - DNA, 22 bp, Homo sapiens
catgagccttcagtcagggttt

SEQ ID NO: 4647018 - DNA, 22 bp, Homo sapiens
catgagctcctgatcagaggca

SEQ ID NO: 4647019 - DNA, 14 bp, Homo sapiens
catgaggccatctc

SEQ ID NO: 4647020 - DNA, 17 bp, Homo sapiens
catgaggccatctcagg

SEQ ID NO: 4647021 - DNA, 19 bp, Homo sapiens
catgaggccatctcaggag

SEQ ID NO: 4647022 - DNA, 20 bp, Homo sapiens
catgaggccatctcaggaga

SEQ ID NO: 4647023 - DNA, 21 bp, Homo sapiens
catgaggccatctcaggagat

SEQ ID NO: 4647024 - DNA, 15 bp, Homo sapiens
catgagtctgtttcc

SEQ ID NO: 4647025 - DNA, 20 bp, Homo sapiens
catgagtctgtttcccaagc

SEQ ID NO: 4647026 - DNA, 21 bp, Homo sapiens
catgagtctgtttcccaagct

SEQ ID NO: 4647027 - DNA, 14 bp, Homo sapiens
catgatactgctgc

SEQ ID NO: 4647028 - DNA, 17 bp, Homo sapiens
catgatactgctgcttg

SEQ ID NO: 4647029 - DNA, 18 bp, Homo sapiens
catgatactgctgcttgt

SEQ ID NO: 4647030 - DNA, 14 bp, Homo sapiens
catgatcaagatat

SEQ ID NO: 4647031 - DNA, 15 bp, Homo sapiens
catgatgcgggccag

SEQ ID NO: 4647032 - DNA, 13 bp, Homo sapiens
catgatggccagg

SEQ ID NO: 4647033 - DNA, 21 bp, Homo sapiens
catgatgggaggtgtgccaga

SEQ ID NO: 4647034 - DNA, 15 bp, Homo sapiens
catgatgtgaagagt

SEQ ID NO: 4647035 - DNA, 17 bp, Homo sapiens
catgcaaaatatgttta

SEQ ID NO: 4647036 - DNA, 13 bp, Homo sapiens
catgcacacagat

SEQ ID NO: 4647037 - DNA, 12 bp, Homo sapiens
catgcacactca

SEQ ID NO: 4647038 - DNA, 14 bp, Homo sapiens
catgcaccttgctc

SEQ ID NO: 4647039 - DNA, 16 bp, Homo sapiens
catgcaccttgctccc

SEQ ID NO: 4647040 - DNA, 17 bp, Homo sapiens
catgcaccttgctccca

SEQ ID NO: 4647041 - DNA, 14 bp, Homo sapiens
catgcactgatgtt

SEQ ID NO: 4647042 - DNA, 22 bp, Homo sapiens
catgccccagtcggccccatct

SEQ ID NO: 4647043 - DNA, 21 bp, Homo sapiens
catgcccccaccctcccctca

SEQ ID NO: 4647044 - DNA, 14 bp, Homo sapiens
catgcccctggctg

SEQ ID NO: 4647045 - DNA, 16 bp, Homo sapiens
catgcctctgaggcca

SEQ ID NO: 4647046 - DNA, 17 bp, Homo sapiens
catgcctctgaggccag

SEQ ID NO: 4647047 - DNA, 21 bp, Homo sapiens
catgcctctgaggccagcctg

SEQ ID NO: 4647048 - DNA, 17 bp, Homo sapiens
catgcctggtattttca

SEQ ID NO: 4647049 - DNA, 13 bp, Homo sapiens
catgcggtagcca

SEQ ID NO: 4647050 - DNA, 15 bp, Homo sapiens
catgcggtagccagc

SEQ ID NO: 4647051 - DNA, 22 bp, Homo sapiens
catgctctgcagcattgaagta

SEQ ID NO: 4647052 - DNA, 19 bp, Homo sapiens
catgctgaaggctgaaaga

SEQ ID NO: 4647053 - DNA, 19 bp, Homo sapiens
catgctggctcccagggcc

SEQ ID NO: 4647054 - DNA, 14 bp, Homo sapiens
catgctgggccact

SEQ ID NO: 4647055 - DNA, 21 bp, Homo sapiens
catgctgggccactggggact

SEQ ID NO: 4647056 - DNA, 18 bp, Homo sapiens
catgcttctactgtgaca

SEQ ID NO: 4647057 - DNA, 19 bp, Homo sapiens
catggaacttttctgtaat

SEQ ID NO: 4647058 - DNA, 18 bp, Homo sapiens
catggaggccctcctgtg

SEQ ID NO: 4647059 - DNA, 15 bp, Homo sapiens
catggagtagcctgg

SEQ ID NO: 4647060 - DNA, 21 bp, Homo sapiens
catggcagatgtaggagggac

SEQ ID NO: 4647061 - DNA, 23 bp, Homo sapiens
catggcagatgtaggagggactg

SEQ ID NO: 4647062 - DNA, 17 bp, Homo sapiens
catggcatattttaatc

SEQ ID NO: 4647063 - DNA, 15 bp, Homo sapiens
catggccctcattaa

SEQ ID NO: 4647064 - DNA, 13 bp, Homo sapiens
catggctacctca

SEQ ID NO: 4647065 - DNA, 17 bp, Homo sapiens
catggcttctggtcatg

SEQ ID NO: 4647066 - DNA, 16 bp, Homo sapiens
catgggaaggtgggcg

SEQ ID NO: 4647067 - DNA, 22 bp, Homo sapiens
catgggacctataactgcccag

SEQ ID NO: 4647068 - DNA, 19 bp, Homo sapiens
catgggtccagaagacgtg

SEQ ID NO: 4647069 - DNA, 14 bp, Homo sapiens
catgggtctggcta

SEQ ID NO: 4647070 - DNA, 24 bp, Homo sapiens
catggtacttcctctgtgaactgt

SEQ ID NO: 4647071 - DNA, 21 bp, Homo sapiens
catggtcccacatccctgggc

SEQ ID NO: 4647072 - DNA, 22 bp, Homo sapiens
catggtcccacatccctgggcc

SEQ ID NO: 4647073 - DNA, 16 bp, Homo sapiens
catggtggctcccgcc

SEQ ID NO: 4647074 - DNA, 18 bp, Homo sapiens
catggtggctcccgcctg

SEQ ID NO: 4647075 - DNA, 15 bp, Homo sapiens
catggtttaaagtca

SEQ ID NO: 4647076 - DNA, 18 bp, Homo sapiens
catgtaaagaaatgtctt

SEQ ID NO: 4647077 - DNA, 18 bp, Homo sapiens
catgtaaccactgcactt

SEQ ID NO: 4647078 - DNA, 15 bp, Homo sapiens
catgtagccagcaga

SEQ ID NO: 4647079 - DNA, 19 bp, Homo sapiens
catgtagccagcagaactg

SEQ ID NO: 4647080 - DNA, 17 bp, Homo sapiens
catgtagggcaagagga

SEQ ID NO: 4647081 - DNA, 14 bp, Homo sapiens
catgtataaatgtg

SEQ ID NO: 4647082 - DNA, 17 bp, Homo sapiens
catgtataaatgtgata

SEQ ID NO: 4647083 - DNA, 18 bp, Homo sapiens
catgtatgtcttggacac

SEQ ID NO: 4647084 - DNA, 23 bp, Homo sapiens
catgtcctaaagaagacattttc

SEQ ID NO: 4647085 - DNA, 22 bp, Homo sapiens
catgtctataatcccagcactt

SEQ ID NO: 4647086 - DNA, 18 bp, Homo sapiens
catgtctgtatccccagt

SEQ ID NO: 4647087 - DNA, 20 bp, Homo sapiens
catgtctgtatccccagtgc

SEQ ID NO: 4647088 - DNA, 15 bp, Homo sapiens
catgtcttgtacatg

SEQ ID NO: 4647089 - DNA, 17 bp, Homo sapiens
catgtcttgtacatgtg

SEQ ID NO: 4647090 - DNA, 15 bp, Homo sapiens
catgtcttttaaaat

SEQ ID NO: 4647091 - DNA, 12 bp, Homo sapiens
catgtgacacat

SEQ ID NO: 4647092 - DNA, 12 bp, Homo sapiens
cagggaggagtg

SEQ ID NO: 4647093 - DNA, 23 bp, Homo sapiens
cagggaggccgaagctaacaggg

SEQ ID NO: 4647094 - DNA, 14 bp, Homo sapiens
cagggagtgctggc

SEQ ID NO: 4647095 - DNA, 19 bp, Homo sapiens
cagggatgctgggctgggc

SEQ ID NO: 4647096 - DNA, 14 bp, Homo sapiens
cagggatgtctgtt

SEQ ID NO: 4647097 - DNA, 19 bp, Homo sapiens
cagggcacaggagctacct

SEQ ID NO: 4647098 - DNA, 21 bp, Homo sapiens
cagggcacaggagctacctgt

SEQ ID NO: 4647099 - DNA, 18 bp, Homo sapiens
cagggcacaggccatgga

SEQ ID NO: 4647100 - DNA, 19 bp, Homo sapiens
cagggcagcagggaacaaa

SEQ ID NO: 4647101 - DNA, 22 bp, Homo sapiens
cagggcagcagggaacaaaact

SEQ ID NO: 4647102 - DNA, 14 bp, Homo sapiens
cagggcagcgccag

SEQ ID NO: 4647103 - DNA, 22 bp, Homo sapiens
cagggcagcgccaggctgacca

SEQ ID NO: 4647104 - DNA, 13 bp, Homo sapiens
cagggccagagca

SEQ ID NO: 4647105 - DNA, 14 bp, Homo sapiens
cagggccagagcag

SEQ ID NO: 4647106 - DNA, 19 bp, Homo sapiens
cagggccagagcagctcca

SEQ ID NO: 4647107 - DNA, 23 bp, Homo sapiens
cagggccctcccagcccattgct

SEQ ID NO: 4647108 - DNA, 20 bp, Homo sapiens
cagggccggggaactggcca

SEQ ID NO: 4647109 - DNA, 23 bp, Homo sapiens
cagggccggggaactggccaagc

SEQ ID NO: 4647110 - DNA, 15 bp, Homo sapiens
cagggcctcaggcac

SEQ ID NO: 4647111 - DNA, 12 bp, Homo sapiens
cagggcctgagt

SEQ ID NO: 4647112 - DNA, 14 bp, Homo sapiens
cagggcctgagtga

SEQ ID NO: 4647113 - DNA, 23 bp, Homo sapiens
cagggcctgagtgacctccttct

SEQ ID NO: 4647114 - DNA, 13 bp, Homo sapiens
cagggcctgcccc

SEQ ID NO: 4647115 - DNA, 14 bp, Homo sapiens
cagggcctgccccc

SEQ ID NO: 4647116 - DNA, 16 bp, Homo sapiens
cagggcctgccccctg

SEQ ID NO: 4647117 - DNA, 18 bp, Homo sapiens
cagggcctgccccctggg

SEQ ID NO: 4647118 - DNA, 21 bp, Homo sapiens
cagggcctgccccctggggat

SEQ ID NO: 4647119 - DNA, 13 bp, Homo sapiens
cagggcctgcgag

SEQ ID NO: 4647120 - DNA, 13 bp, Homo sapiens
cagggcctgctat

SEQ ID NO: 4647121 - DNA, 13 bp, Homo sapiens
cagggcctggagc

SEQ ID NO: 4647122 - DNA, 15 bp, Homo sapiens
cagggcctggagccc

SEQ ID NO: 4647123 - DNA, 18 bp, Homo sapiens
cagggcctggagccccat

SEQ ID NO: 4647124 - DNA, 12 bp, Homo sapiens
cagggcctggca

SEQ ID NO: 4647125 - DNA, 13 bp, Homo sapiens
cagggcctggcat

SEQ ID NO: 4647126 - DNA, 14 bp, Homo sapiens
cagggcctggcata

SEQ ID NO: 4647127 - DNA, 18 bp, Homo sapiens
cagggcctggggcctgag

SEQ ID NO: 4647128 - DNA, 16 bp, Homo sapiens
cagggctctcctggct

SEQ ID NO: 4647129 - DNA, 17 bp, Homo sapiens
cagggctctcctggctt

SEQ ID NO: 4647130 - DNA, 15 bp, Homo sapiens
cagggctgctctttc

SEQ ID NO: 4647131 - DNA, 16 bp, Homo sapiens
cagggctgctctttcc

SEQ ID NO: 4647132 - DNA, 11 bp, Homo sapiens
cagggctgggg

SEQ ID NO: 4647133 - DNA, 17 bp, Homo sapiens
cagggctggggacagag

SEQ ID NO: 4647134 - DNA, 16 bp, Homo sapiens
cagggcttacggccct

SEQ ID NO: 4647135 - DNA, 15 bp, Homo sapiens
caggggacactttgt

SEQ ID NO: 4647136 - DNA, 18 bp, Homo sapiens
caggggagcgtgttcctg

SEQ ID NO: 4647137 - DNA, 18 bp, Homo sapiens
caggggagggtcagccag

SEQ ID NO: 4647138 - DNA, 20 bp, Homo sapiens
caggggagggtcagccaggg

SEQ ID NO: 4647139 - DNA, 13 bp, Homo sapiens
caggggcaggggc

SEQ ID NO: 4647140 - DNA, 20 bp, Homo sapiens
caggggccaggagtggggag

SEQ ID NO: 4647141 - DNA, 22 bp, Homo sapiens
caggggcctgcagaaggaaaga

SEQ ID NO: 4647142 - DNA, 12 bp, Homo sapiens
cagggggccccg

SEQ ID NO: 4647143 - DNA, 19 bp, Homo sapiens
cagggggccccgccagggc

SEQ ID NO: 4647144 - DNA, 20 bp, Homo sapiens
cagggggccccgccagggct

SEQ ID NO: 4647145 - DNA, 14 bp, Homo sapiens
caggggggctgtgc

SEQ ID NO: 4647146 - DNA, 14 bp, Homo sapiens
cagggtcaagcctc

SEQ ID NO: 4647147 - DNA, 18 bp, Homo sapiens
cagggtcatgtttgcagg

SEQ ID NO: 4647148 - DNA, 15 bp, Homo sapiens
cagggtctctccctc

SEQ ID NO: 4647149 - DNA, 16 bp, Homo sapiens
cagggtctctccctca

SEQ ID NO: 4647150 - DNA, 18 bp, Homo sapiens
cagggtctctccctcagg

SEQ ID NO: 4647151 - DNA, 16 bp, Homo sapiens
cagggtctgagtgcaa

SEQ ID NO: 4647152 - DNA, 19 bp, Homo sapiens
cagggtctgtgtgaatgtg

SEQ ID NO: 4647153 - DNA, 14 bp, Homo sapiens
cagggtcttggctg

SEQ ID NO: 4647154 - DNA, 15 bp, Homo sapiens
cagggtcttttcatc

SEQ ID NO: 4647155 - DNA, 21 bp, Homo sapiens
cagggtcttttcatctgggaa

SEQ ID NO: 4647156 - DNA, 20 bp, Homo sapiens
cagggtggagtgcagtggtg

SEQ ID NO: 4647157 - DNA, 13 bp, Homo sapiens
cagggttactgta

SEQ ID NO: 4647158 - DNA, 23 bp, Homo sapiens
cagggtttgtcagaggaacaaac

SEQ ID NO: 4647159 - DNA, 14 bp, Homo sapiens
caggtaaaacaggg

SEQ ID NO: 4647160 - DNA, 15 bp, Homo sapiens
caggtacaggagagg

SEQ ID NO: 4647161 - DNA, 17 bp, Homo sapiens
caatattaccatcttaa

SEQ ID NO: 4647162 - DNA, 22 bp, Homo sapiens
caatattaccatcttaatcttt

SEQ ID NO: 4647163 - DNA, 13 bp, Homo sapiens
caatattccttag

SEQ ID NO: 4647164 - DNA, 16 bp, Homo sapiens
caatatttttatatca

SEQ ID NO: 4647165 - DNA, 22 bp, Homo sapiens
caatatttttatatcatgcaaa

SEQ ID NO: 4647166 - DNA, 15 bp, Homo sapiens
caatcactaaacttt

SEQ ID NO: 4647167 - DNA, 20 bp, Homo sapiens
caatcactaaactttatttg

SEQ ID NO: 4647168 - DNA, 21 bp, Homo sapiens
caatcagagtgtacaaattgt

SEQ ID NO: 4647169 - DNA, 12 bp, Homo sapiens
caatcattgaag

SEQ ID NO: 4647170 - DNA, 15 bp, Homo sapiens
caatcctagtgcttt

SEQ ID NO: 4647171 - DNA, 21 bp, Homo sapiens
caatcctccccgctctgccgc

SEQ ID NO: 4647172 - DNA, 17 bp, Homo sapiens
caatcggactgccaaat

SEQ ID NO: 4647173 - DNA, 13 bp, Homo sapiens
caatctattattt

SEQ ID NO: 4647174 - DNA, 14 bp, Homo sapiens
caatctattatttc

SEQ ID NO: 4647175 - DNA, 23 bp, Homo sapiens
caatgacataaccaatttgtaat

SEQ ID NO: 4647176 - DNA, 13 bp, Homo sapiens
caatgacttctaa

SEQ ID NO: 4647177 - DNA, 19 bp, Homo sapiens
caatgacttctaatttata

SEQ ID NO: 4647178 - DNA, 18 bp, Homo sapiens
caatgatttggccaggcc

SEQ ID NO: 4647179 - DNA, 13 bp, Homo sapiens
caatgccacagac

SEQ ID NO: 4647180 - DNA, 13 bp, Homo sapiens
caatgctgtactt

SEQ ID NO: 4647181 - DNA, 17 bp, Homo sapiens
caatggattcatggagt

SEQ ID NO: 4647182 - DNA, 14 bp, Homo sapiens
caatggccaggggc

SEQ ID NO: 4647183 - DNA, 15 bp, Homo sapiens
caatggccaggggcc

SEQ ID NO: 4647184 - DNA, 16 bp, Homo sapiens
caatggccaggggcca

SEQ ID NO: 4647185 - DNA, 18 bp, Homo sapiens
caatggccaggggccagg

SEQ ID NO: 4647186 - DNA, 21 bp, Homo sapiens
caatgggagctgaggccacac

SEQ ID NO: 4647187 - DNA, 17 bp, Homo sapiens
caatggtgcttggaggg

SEQ ID NO: 4647188 - DNA, 17 bp, Homo sapiens
caatgtaagcatacttt

SEQ ID NO: 4647189 - DNA, 19 bp, Homo sapiens
caatgtacccaccgggcca

SEQ ID NO: 4647190 - DNA, 20 bp, Homo sapiens
caatgtgaataatggcactg

SEQ ID NO: 4647191 - DNA, 16 bp, Homo sapiens
caatgtgctactgatt

SEQ ID NO: 4647192 - DNA, 23 bp, Homo sapiens
caatgtgttttttcggacatgct

SEQ ID NO: 4647193 - DNA, 19 bp, Homo sapiens
caatgttatgccagctcca

SEQ ID NO: 4647194 - DNA, 14 bp, Homo sapiens
caattaagcagctt

SEQ ID NO: 4647195 - DNA, 20 bp, Homo sapiens
caattaatattaattttcta

SEQ ID NO: 4647196 - DNA, 19 bp, Homo sapiens
caattagtggtcataaaat

SEQ ID NO: 4647197 - DNA, 14 bp, Homo sapiens
caattcacccactc

SEQ ID NO: 4647198 - DNA, 15 bp, Homo sapiens
caattcacccactcc

SEQ ID NO: 4647199 - DNA, 14 bp, Homo sapiens
caattcagacaggc

SEQ ID NO: 4647200 - DNA, 23 bp, Homo sapiens
caattcagacaggcaaataaaag

SEQ ID NO: 4647201 - DNA, 14 bp, Homo sapiens
caattccaagaaaa

SEQ ID NO: 4647202 - DNA, 15 bp, Homo sapiens
caattccaagaaaat

SEQ ID NO: 4647203 - DNA, 17 bp, Homo sapiens
caattccaagaaaatat

SEQ ID NO: 4647204 - DNA, 18 bp, Homo sapiens
caattccaagaaaatatc

SEQ ID NO: 4647205 - DNA, 21 bp, Homo sapiens
caattccaagaaaatatcact

SEQ ID NO: 4647206 - DNA, 22 bp, Homo sapiens
caattccaccagggccagagca

SEQ ID NO: 4647207 - DNA, 23 bp, Homo sapiens
caattccaccagggccagagcag

SEQ ID NO: 4647208 - DNA, 20 bp, Homo sapiens
caattccgtagccagctgct

SEQ ID NO: 4647209 - DNA, 20 bp, Homo sapiens
caattcctgtgctcaaaaat

SEQ ID NO: 4647210 - DNA, 20 bp, Homo sapiens
caatttatccattcaatcat

SEQ ID NO: 4647211 - DNA, 17 bp, Homo sapiens
caatttggtcttagctt

SEQ ID NO: 4647212 - DNA, 19 bp, Homo sapiens
caatttggtcttagcttta

SEQ ID NO: 4647213 - DNA, 19 bp, Homo sapiens
caatttttgtctcagaagt

SEQ ID NO: 4647214 - DNA, 12 bp, Homo sapiens
atttttcaatca

SEQ ID NO: 4647215 - DNA, 16 bp, Homo sapiens
atttttcagatataaa

SEQ ID NO: 4647216 - DNA, 15 bp, Homo sapiens
atttttctgactttt

SEQ ID NO: 4647217 - DNA, 10 bp, Homo sapiens
atttttctgt

SEQ ID NO: 4647218 - DNA, 12 bp, Homo sapiens
atttttgcactt

SEQ ID NO: 4647219 - DNA, 11 bp, Homo sapiens
atttttgtaac

SEQ ID NO: 4647220 - DNA, 15 bp, Homo sapiens
atttttgtactttta

SEQ ID NO: 4647221 - DNA, 14 bp, Homo sapiens
atttttgtatttct

SEQ ID NO: 4647222 - DNA, 17 bp, Homo sapiens
attttttaaaagccttc

SEQ ID NO: 4647223 - DNA, 18 bp, Homo sapiens
attttttaggacatctta

SEQ ID NO: 4647224 - DNA, 19 bp, Homo sapiens
attttttataattttctaa

SEQ ID NO: 4647225 - DNA, 11 bp, Homo sapiens
attttttcctt

SEQ ID NO: 4647226 - DNA, 19 bp, Homo sapiens
attttttctaataaagcca

SEQ ID NO: 4647227 - DNA, 15 bp, Homo sapiens
atttttttaaacata

SEQ ID NO: 4647228 - DNA, 13 bp, Homo sapiens
atttttttgtaag

SEQ ID NO: 4647229 - DNA, 15 bp, Homo sapiens
atttttttgtaaggg

SEQ ID NO: 4647230 - DNA, 14 bp, Homo sapiens
atttttttgtaatt

SEQ ID NO: 4647231 - DNA, 16 bp, Homo sapiens
attttttttatattta

SEQ ID NO: 4647232 - DNA, 16 bp, Homo sapiens
attttttttcatgttt

SEQ ID NO: 4647233 - DNA, 20 bp, Homo sapiens
atttttttttccacttttgt

SEQ ID NO: 4647234 - DNA, 14 bp, Homo sapiens
caaaaagtattatc

SEQ ID NO: 4647235 - DNA, 13 bp, Homo sapiens
caaaaatgatttt

SEQ ID NO: 4647236 - DNA, 14 bp, Homo sapiens
caaaaattatatat

SEQ ID NO: 4647237 - DNA, 13 bp, Homo sapiens
caaaacccagacc

SEQ ID NO: 4647238 - DNA, 15 bp, Homo sapiens
caaaacccagacctg

SEQ ID NO: 4647239 - DNA, 20 bp, Homo sapiens
caaaacctgtattactgaat

SEQ ID NO: 4647240 - DNA, 23 bp, Homo sapiens
caaaacctgtattactgaataat

SEQ ID NO: 4647241 - DNA, 14 bp, Homo sapiens
caaaacgggtcagt

SEQ ID NO: 4647242 - DNA, 15 bp, Homo sapiens
caaaactcaggcaga

SEQ ID NO: 4647243 - DNA, 23 bp, Homo sapiens
caaaaggcctcttgtaaagactg

SEQ ID NO: 4647244 - DNA, 17 bp, Homo sapiens
caaaagtggcctctttg

SEQ ID NO: 4647245 - DNA, 20 bp, Homo sapiens
caaaataaagcaatgtgttt

SEQ ID NO: 4647246 - DNA, 20 bp, Homo sapiens
caaaataaaggataactctg

SEQ ID NO: 4647247 - DNA, 16 bp, Homo sapiens
caaaatacacgtttat

SEQ ID NO: 4647248 - DNA, 20 bp, Homo sapiens
caaaatcactttaagatctt

SEQ ID NO: 4647249 - DNA, 14 bp, Homo sapiens
caaaatggaacgct

SEQ ID NO: 4647250 - DNA, 14 bp, Homo sapiens
caaaatgtcttgtg

SEQ ID NO: 4647251 - DNA, 17 bp, Homo sapiens
caaaatgtcttgtgtat

SEQ ID NO: 4647252 - DNA, 15 bp, Homo sapiens
caaacaaaagttctg

SEQ ID NO: 4647253 - DNA, 22 bp, Homo sapiens
caaacaagtggatgtttttaat

SEQ ID NO: 4647254 - DNA, 17 bp, Homo sapiens
caaacagaacagggtca

SEQ ID NO: 4647255 - DNA, 19 bp, Homo sapiens
caaacagacaaaacagata

SEQ ID NO: 4647256 - DNA, 13 bp, Homo sapiens
caaacaggaacta

SEQ ID NO: 4647257 - DNA, 19 bp, Homo sapiens
caaacattcgtgagctggg

SEQ ID NO: 4647258 - DNA, 21 bp, Homo sapiens
caaacattcgtgagctgggga

SEQ ID NO: 4647259 - DNA, 16 bp, Homo sapiens
caaacccagtctcctc

SEQ ID NO: 4647260 - DNA, 22 bp, Homo sapiens
caaaccctggtggtattttatt

SEQ ID NO: 4647261 - DNA, 22 bp, Homo sapiens
caaacccttgctttcctgggcc

SEQ ID NO: 4647262 - DNA, 12 bp, Homo sapiens
caaacctctgtt

SEQ ID NO: 4647263 - DNA, 13 bp, Homo sapiens
caaacctctgttc

SEQ ID NO: 4647264 - DNA, 14 bp, Homo sapiens
caaacctctgttca

SEQ ID NO: 4647265 - DNA, 19 bp, Homo sapiens
caaacctctgttcagtgta

SEQ ID NO: 4647266 - DNA, 20 bp, Homo sapiens
caaacctctgttcagtgtaa

SEQ ID NO: 4647267 - DNA, 21 bp, Homo sapiens
caaactatgatttattttggt

SEQ ID NO: 4647268 - DNA, 15 bp, Homo sapiens
caaactcctgacctc

SEQ ID NO: 4647269 - DNA, 23 bp, Homo sapiens
caaactgattaaatatttgaaga

SEQ ID NO: 4647270 - DNA, 15 bp, Homo sapiens
caaagaaaatgccta

SEQ ID NO: 4647271 - DNA, 18 bp, Homo sapiens
caaagaaacaagctgtgc

SEQ ID NO: 4647272 - DNA, 21 bp, Homo sapiens
caaagaaacaccacttaatct

SEQ ID NO: 4647273 - DNA, 12 bp, Homo sapiens
caaagaatattt

SEQ ID NO: 4647274 - DNA, 19 bp, Homo sapiens
caaagacaaaagtctgtct

SEQ ID NO: 4647275 - DNA, 22 bp, Homo sapiens
caaagagatatttaggaaaatg

SEQ ID NO: 4647276 - DNA, 20 bp, Homo sapiens
caaagagcacttgagctgtc

SEQ ID NO: 4647277 - DNA, 20 bp, Homo sapiens
caaagaggctgaggctggca

SEQ ID NO: 4647278 - DNA, 20 bp, Homo sapiens
cacaggagctacctgtgtgg

SEQ ID NO: 4647279 - DNA, 15 bp, Homo sapiens
cacaggcagccagcc

SEQ ID NO: 4647280 - DNA, 20 bp, Homo sapiens
cacaggcagccagccgtggc

SEQ ID NO: 4647281 - DNA, 16 bp, Homo sapiens
cacaggcatttcctgg

SEQ ID NO: 4647282 - DNA, 18 bp, Homo sapiens
cacaggcatttcctgggt

SEQ ID NO: 4647283 - DNA, 14 bp, Homo sapiens
cacaggccctggct

SEQ ID NO: 4647284 - DNA, 18 bp, Homo sapiens
cacaggcctgtgtagctg

SEQ ID NO: 4647285 - DNA, 24 bp, Homo sapiens
cacaggcctgtgtagctgtgacct

SEQ ID NO: 4647286 - DNA, 14 bp, Homo sapiens
cacaggctggcagt

SEQ ID NO: 4647287 - DNA, 13 bp, Homo sapiens
cacaggcttgctg

SEQ ID NO: 4647288 - DNA, 17 bp, Homo sapiens
cacagtacagcatgtgc

SEQ ID NO: 4647289 - DNA, 18 bp, Homo sapiens
cacagtacagcatgtgcc

SEQ ID NO: 4647290 - DNA, 20 bp, Homo sapiens
cacagtacagcatgtgcctt

SEQ ID NO: 4647291 - DNA, 18 bp, Homo sapiens
cacagtgcattatgtaca

SEQ ID NO: 4647292 - DNA, 17 bp, Homo sapiens
cacagtgggagctgagc

SEQ ID NO: 4647293 - DNA, 22 bp, Homo sapiens
cacagtgtgaataaagtgctgc

SEQ ID NO: 4647294 - DNA, 15 bp, Homo sapiens
cacatatccaggcac

SEQ ID NO: 4647295 - DNA, 18 bp, Homo sapiens
cacatatccaggcaccag

SEQ ID NO: 4647296 - DNA, 18 bp, Homo sapiens
cacatatgcaccttgtgt

SEQ ID NO: 4647297 - DNA, 20 bp, Homo sapiens
cacatatgcaccttgtgtct

SEQ ID NO: 4647298 - DNA, 21 bp, Homo sapiens
cacatccctatagaccactgg

SEQ ID NO: 4647299 - DNA, 20 bp, Homo sapiens
cacatccctgggcctgctgc

SEQ ID NO: 4647300 - DNA, 22 bp, Homo sapiens
cacatccctgggcctgctgctg

SEQ ID NO: 4647301 - DNA, 13 bp, Homo sapiens
cacatctcccttc

SEQ ID NO: 4647302 - DNA, 14 bp, Homo sapiens
cacatctctggaaa

SEQ ID NO: 4647303 - DNA, 21 bp, Homo sapiens
cacatgaggccatctcaggag

SEQ ID NO: 4647304 - DNA, 22 bp, Homo sapiens
cacatgaggccatctcaggaga

SEQ ID NO: 4647305 - DNA, 15 bp, Homo sapiens
cacatggcctatgca

SEQ ID NO: 4647306 - DNA, 22 bp, Homo sapiens
cacatgtacactacattttttc

SEQ ID NO: 4647307 - DNA, 15 bp, Homo sapiens
cacatgtcttgtaca

SEQ ID NO: 4647308 - DNA, 13 bp, Homo sapiens
cacatgtgacaca

SEQ ID NO: 4647309 - DNA, 12 bp, Homo sapiens
cacatgtgtggt

SEQ ID NO: 4647310 - DNA, 20 bp, Homo sapiens
cacattaacattttgagcta

SEQ ID NO: 4647311 - DNA, 16 bp, Homo sapiens
cacattaactccctcc

SEQ ID NO: 4647312 - DNA, 13 bp, Homo sapiens
cacattcttggct

SEQ ID NO: 4647313 - DNA, 18 bp, Homo sapiens
cacattgggcagcgccct

SEQ ID NO: 4647314 - DNA, 22 bp, Homo sapiens
cacattgggcagcgcccttcct

SEQ ID NO: 4647315 - DNA, 17 bp, Homo sapiens
cacattgttcaactccc

SEQ ID NO: 4647316 - DNA, 14 bp, Homo sapiens
cacatttttcagat

SEQ ID NO: 4647317 - DNA, 18 bp, Homo sapiens
cacatttttcagatataa

SEQ ID NO: 4647318 - DNA, 14 bp, Homo sapiens
caccaaaaccaaac

SEQ ID NO: 4647319 - DNA, 23 bp, Homo sapiens
caccaaaaccaaacttgttcatt

SEQ ID NO: 4647320 - DNA, 13 bp, Homo sapiens
caccaagcacagc

SEQ ID NO: 4647321 - DNA, 14 bp, Homo sapiens
caccaagcacagca

SEQ ID NO: 4647322 - DNA, 19 bp, Homo sapiens
caccaagcacagcagcctg

SEQ ID NO: 4647323 - DNA, 23 bp, Homo sapiens
caccaagcccgaccgggccaggc

SEQ ID NO: 4647324 - DNA, 16 bp, Homo sapiens
caccaagggacaggag

SEQ ID NO: 4647325 - DNA, 20 bp, Homo sapiens
caccaagggacaggagaaga

SEQ ID NO: 4647326 - DNA, 19 bp, Homo sapiens
caccaagggcgcaagagta

SEQ ID NO: 4647327 - DNA, 23 bp, Homo sapiens
caccaagggcgcaagagtagcgg

SEQ ID NO: 4647328 - DNA, 23 bp, Homo sapiens
caccaagttggaacatccttgga

SEQ ID NO: 4647329 - DNA, 17 bp, Homo sapiens
caccaatgtacccaccg

SEQ ID NO: 4647330 - DNA, 12 bp, Homo sapiens
caccaccctgcc

SEQ ID NO: 4647331 - DNA, 11 bp, Homo sapiens
caccacgtctg

SEQ ID NO: 4647332 - DNA, 18 bp, Homo sapiens
caccactcaaaggccaga

SEQ ID NO: 4647333 - DNA, 22 bp, Homo sapiens
caccactcaaaggccagacctg

SEQ ID NO: 4647334 - DNA, 14 bp, Homo sapiens
caccactctggcag

SEQ ID NO: 4647335 - DNA, 18 bp, Homo sapiens
caccactctggcagccac

SEQ ID NO: 4647336 - DNA, 21 bp, Homo sapiens
caccagcctgctgacagacac

SEQ ID NO: 4647337 - DNA, 15 bp, Homo sapiens
caccagctgctgtgc

SEQ ID NO: 4647338 - DNA, 16 bp, Homo sapiens
caccagctgctgtgcc

SEQ ID NO: 4647339 - DNA, 19 bp, Homo sapiens
caccaggctggagtgcagt

SEQ ID NO: 4647340 - DNA, 19 bp, Homo sapiens
caccagggagatgtctaga

SEQ ID NO: 4647341 - DNA, 20 bp, Homo sapiens
caccagggccagagcagctc

SEQ ID NO: 4647342 - DNA, 14 bp, Homo sapiens
caccaggggaagga

SEQ ID NO: 4647343 - DNA, 14 bp, Homo sapiens
caccaggggaggag

SEQ ID NO: 4647344 - DNA, 15 bp, Homo sapiens
caccaggggaggagc

SEQ ID NO: 4647345 - DNA, 17 bp, Homo sapiens
caccaggggaggagcct

SEQ ID NO: 4647346 - DNA, 18 bp, Homo sapiens
caccagtgcatcacatct

SEQ ID NO: 4647347 - DNA, 15 bp, Homo sapiens
caccatgatggccag

SEQ ID NO: 4647348 - DNA, 15 bp, Homo sapiens
caccattcctgcctt

SEQ ID NO: 4647349 - DNA, 23 bp, Homo sapiens
caccattcctgcctttaagccaa

SEQ ID NO: 4647350 - DNA, 12 bp, Homo sapiens
cacccacatgtg

SEQ ID NO: 4647351 - DNA, 22 bp, Homo sapiens
cacccaccccctgcctggttct

SEQ ID NO: 4647352 - DNA, 12 bp, Homo sapiens
cacccactccct

SEQ ID NO: 4647353 - DNA, 17 bp, Homo sapiens
cacccaggaaaggagga

SEQ ID NO: 4647354 - DNA, 22 bp, Homo sapiens
cacccagggacactccaactct

SEQ ID NO: 4647355 - DNA, 19 bp, Homo sapiens
caccccacttatccctctc

SEQ ID NO: 4647356 - DNA, 24 bp, Homo sapiens
caccccacttatccctctccataa

SEQ ID NO: 4647357 - DNA, 14 bp, Homo sapiens
caccccagccctcg

SEQ ID NO: 4647358 - DNA, 12 bp, Homo sapiens
caccccatttca

SEQ ID NO: 4647359 - DNA, 21 bp, Homo sapiens
cacccccacaagctgtccctg

SEQ ID NO: 4647360 - DNA, 11 bp, Homo sapiens
cacccccacca

SEQ ID NO: 4647361 - DNA, 15 bp, Homo sapiens
cacccccagccctgg

SEQ ID NO: 4647362 - DNA, 12 bp, Homo sapiens
cacccccagcct

SEQ ID NO: 4647363 - DNA, 12 bp, Homo sapiens
cacccccagttc

SEQ ID NO: 4647364 - DNA, 13 bp, Homo sapiens
caccccctgcagc

SEQ ID NO: 4647365 - DNA, 14 bp, Homo sapiens
caccccctgcagct

SEQ ID NO: 4647366 - DNA, 12 bp, Homo sapiens
cacccctcccct

SEQ ID NO: 4647367 - DNA, 16 bp, Homo sapiens
cacccctcccctggga

SEQ ID NO: 4647368 - DNA, 13 bp, Homo sapiens
cacccctgcccct

SEQ ID NO: 4647369 - DNA, 14 bp, Homo sapiens
cacccctgcccctg

SEQ ID NO: 4647370 - DNA, 16 bp, Homo sapiens
cacccctgcccctgtg

SEQ ID NO: 4647371 - DNA, 21 bp, Homo sapiens
cacccctgcccctgtgggact

SEQ ID NO: 4647372 - DNA, 23 bp, Homo sapiens
caccccttccctataggaacagc

SEQ ID NO: 4647373 - DNA, 19 bp, Homo sapiens
caccccttggaggagagag

SEQ ID NO: 4647374 - DNA, 22 bp, Homo sapiens
caccccttggaggagagagacc

SEQ ID NO: 4647375 - DNA, 22 bp, Homo sapiens
caccctcccagacctgcctctt

SEQ ID NO: 4647376 - DNA, 23 bp, Homo sapiens
caccctcccatgagactgccctg

SEQ ID NO: 4647377 - DNA, 14 bp, Homo sapiens
caccctccctagct

SEQ ID NO: 4647378 - DNA, 15 bp, Homo sapiens
caccctgaggagtct

SEQ ID NO: 4647379 - DNA, 20 bp, Homo sapiens
caccctgaggtcagggagtg

SEQ ID NO: 4647380 - DNA, 15 bp, Homo sapiens
caccctgcaggactt

SEQ ID NO: 4647381 - DNA, 21 bp, Homo sapiens
caccctgccccccctaagaga

SEQ ID NO: 4647382 - DNA, 13 bp, Homo sapiens
caccctgctgaga

SEQ ID NO: 4647383 - DNA, 21 bp, Homo sapiens
caccctggcctgaactgagga

SEQ ID NO: 4647384 - DNA, 21 bp, Homo sapiens
caccggcctgtgggtctctga

SEQ ID NO: 4647385 - DNA, 22 bp, Homo sapiens
caccggcctgtgggtctctgaa

SEQ ID NO: 4647386 - DNA, 15 bp, Homo sapiens
caccgtgggcaggga

SEQ ID NO: 4647387 - DNA, 15 bp, Homo sapiens
caccgttctgtgcac

SEQ ID NO: 4647388 - DNA, 20 bp, Homo sapiens
cagagcaagtcctcactctt

SEQ ID NO: 4647389 - DNA, 21 bp, Homo sapiens
cagagcagctccaccactgtg

SEQ ID NO: 4647390 - DNA, 18 bp, Homo sapiens
cagagcagtctaaacaga

SEQ ID NO: 4647391 - DNA, 17 bp, Homo sapiens
cagagcccctcctccag

SEQ ID NO: 4647392 - DNA, 18 bp, Homo sapiens
cagagcccctcctccagc

SEQ ID NO: 4647393 - DNA, 16 bp, Homo sapiens
cagagcctcgctctgt

SEQ ID NO: 4647394 - DNA, 12 bp, Homo sapiens
cagagcctgggg

SEQ ID NO: 4647395 - DNA, 15 bp, Homo sapiens
cagagcgcacaggga

SEQ ID NO: 4647396 - DNA, 20 bp, Homo sapiens
cagagctcatcccccctgct

SEQ ID NO: 4647397 - DNA, 24 bp, Homo sapiens
cagagctcatcccccctgctgccc

SEQ ID NO: 4647398 - DNA, 12 bp, Homo sapiens
cagagctgtgcc

SEQ ID NO: 4647399 - DNA, 13 bp, Homo sapiens
cagagcttcctgg

SEQ ID NO: 4647400 - DNA, 19 bp, Homo sapiens
cagagcttcctggggacca

SEQ ID NO: 4647401 - DNA, 22 bp, Homo sapiens
cagagcttcctggggaccaaga

SEQ ID NO: 4647402 - DNA, 14 bp, Homo sapiens
cagaggaaatctgt

SEQ ID NO: 4647403 - DNA, 11 bp, Homo sapiens
cagaggagccc

SEQ ID NO: 4647404 - DNA, 13 bp, Homo sapiens
cagaggcatttga

SEQ ID NO: 4647405 - DNA, 18 bp, Homo sapiens
cagaggcatttgagcagc

SEQ ID NO: 4647406 - DNA, 12 bp, Homo sapiens
cagaggccctgg

SEQ ID NO: 4647407 - DNA, 18 bp, Homo sapiens
cagaggcgaggggacagc

SEQ ID NO: 4647408 - DNA, 20 bp, Homo sapiens
cagagggagtttaatacagg

SEQ ID NO: 4647409 - DNA, 17 bp, Homo sapiens
cagaggggcagatggaa

SEQ ID NO: 4647410 - DNA, 22 bp, Homo sapiens
cagaggtagtctcactgcttga

SEQ ID NO: 4647411 - DNA, 18 bp, Homo sapiens
cagaggtctccaaactga

SEQ ID NO: 4647412 - DNA, 22 bp, Homo sapiens
cagagtatgtttttaagtgtat

SEQ ID NO: 4647413 - DNA, 13 bp, Homo sapiens
cagagtcctgcct

SEQ ID NO: 4647414 - DNA, 16 bp, Homo sapiens
cagagtggcctccctg

SEQ ID NO: 4647415 - DNA, 18 bp, Homo sapiens
cagagtgggccccgggct

SEQ ID NO: 4647416 - DNA, 21 bp, Homo sapiens
cagagtgggccccgggctgga

SEQ ID NO: 4647417 - DNA, 23 bp, Homo sapiens
cagagtgggccccgggctggaga

SEQ ID NO: 4647418 - DNA, 16 bp, Homo sapiens
cagataaaatgttcag

SEQ ID NO: 4647419 - DNA, 22 bp, Homo sapiens
cagataaagaaactgaggccca

SEQ ID NO: 4647420 - DNA, 15 bp, Homo sapiens
cagataacctaataa

SEQ ID NO: 4647421 - DNA, 21 bp, Homo sapiens
cagataacctaataattgtat

SEQ ID NO: 4647422 - DNA, 22 bp, Homo sapiens
cagatataaaagactgaccaat

SEQ ID NO: 4647423 - DNA, 15 bp, Homo sapiens
cagatcaagctgtga

SEQ ID NO: 4647424 - DNA, 13 bp, Homo sapiens
cagatgaggccct

SEQ ID NO: 4647425 - DNA, 18 bp, Homo sapiens
cagatgaggccctgcacc

SEQ ID NO: 4647426 - DNA, 13 bp, Homo sapiens
cagatgcagggca

SEQ ID NO: 4647427 - DNA, 15 bp, Homo sapiens
cagatgcccttgctg

SEQ ID NO: 4647428 - DNA, 18 bp, Homo sapiens
cagatgcccttgctgggc

SEQ ID NO: 4647429 - DNA, 21 bp, Homo sapiens
cagatgcccttgctgggcctg

SEQ ID NO: 4647430 - DNA, 19 bp, Homo sapiens
cagatggcatacctgtgcc

SEQ ID NO: 4647431 - DNA, 22 bp, Homo sapiens
cagatgttttacgtctgggaga

SEQ ID NO: 4647432 - DNA, 15 bp, Homo sapiens
cagattatcacatta

SEQ ID NO: 4647433 - DNA, 19 bp, Homo sapiens
cagattatgagacacagga

SEQ ID NO: 4647434 - DNA, 21 bp, Homo sapiens
cagattatgagacacaggatg

SEQ ID NO: 4647435 - DNA, 13 bp, Homo sapiens
cagattgcatgtg

SEQ ID NO: 4647436 - DNA, 16 bp, Homo sapiens
cagattgcatgtgact

SEQ ID NO: 4647437 - DNA, 14 bp, Homo sapiens
cagattgttatcta

SEQ ID NO: 4647438 - DNA, 15 bp, Homo sapiens
cagcaaacactccac

SEQ ID NO: 4647439 - DNA, 14 bp, Homo sapiens
cagcaaattttcag

SEQ ID NO: 4647440 - DNA, 13 bp, Homo sapiens
cagcaaccccagg

SEQ ID NO: 4647441 - DNA, 16 bp, Homo sapiens
cagcaaccccaggctg

SEQ ID NO: 4647442 - DNA, 18 bp, Homo sapiens
cagcaacgcttgtagaac

SEQ ID NO: 4647443 - DNA, 12 bp, Homo sapiens
cagcaaggcaga

SEQ ID NO: 4647444 - DNA, 16 bp, Homo sapiens
cagcacaaggccatct

SEQ ID NO: 4647445 - DNA, 18 bp, Homo sapiens
cagcacacaggcagccag

SEQ ID NO: 4647446 - DNA, 19 bp, Homo sapiens
cagcacacaggcagccagc

SEQ ID NO: 4647447 - DNA, 13 bp, Homo sapiens
cagcacacagggc

SEQ ID NO: 4647448 - DNA, 15 bp, Homo sapiens
cagcacactggactc

SEQ ID NO: 4647449 - DNA, 13 bp, Homo sapiens
cagcacagccaac

SEQ ID NO: 4647450 - DNA, 16 bp, Homo sapiens
cagcaccgttctgtgc

SEQ ID NO: 4647451 - DNA, 21 bp, Homo sapiens
cagcacttagacctgccagcc

SEQ ID NO: 4647452 - DNA, 19 bp, Homo sapiens
cagcacttgtccagctgag

SEQ ID NO: 4647453 - DNA, 24 bp, Homo sapiens
cagcagaactgaagtgtgctgtga

SEQ ID NO: 4647454 - DNA, 13 bp, Homo sapiens
cagcagcagcact

SEQ ID NO: 4647455 - DNA, 10 bp, Homo sapiens
cagcagccag

SEQ ID NO: 4647456 - DNA, 11 bp, Homo sapiens
cagcagccagc

SEQ ID NO: 4647457 - DNA, 13 bp, Homo sapiens
cagcagccagccc

SEQ ID NO: 4647458 - DNA, 23 bp, Homo sapiens
cagcagccagccctgcctggagg

SEQ ID NO: 4647459 - DNA, 21 bp, Homo sapiens
cagcaggagtggtgcagacag

SEQ ID NO: 4647460 - DNA, 22 bp, Homo sapiens
cagcaggatcgaagggttttta

SEQ ID NO: 4647461 - DNA, 16 bp, Homo sapiens
cagcaggcagcgccaa

SEQ ID NO: 4647462 - DNA, 11 bp, Homo sapiens
cagcaggccaa

SEQ ID NO: 4647463 - DNA, 19 bp, Homo sapiens
cagcagggaacaaaactcc

SEQ ID NO: 4647464 - DNA, 21 bp, Homo sapiens
cagcagggctggtcacctccc

SEQ ID NO: 4647465 - DNA, 23 bp, Homo sapiens
cagcagggctggtcacctcccat

SEQ ID NO: 4647466 - DNA, 17 bp, Homo sapiens
cagcaggggggctgtgc

SEQ ID NO: 4647467 - DNA, 18 bp, Homo sapiens
cagcagggtcttttcatc

SEQ ID NO: 4647468 - DNA, 21 bp, Homo sapiens
cagcagggtcttttcatctgg

SEQ ID NO: 4647469 - DNA, 20 bp, Homo sapiens
cagcaggtctagaagaacaa

SEQ ID NO: 4647470 - DNA, 14 bp, Homo sapiens
cagcatacttcaaa

SEQ ID NO: 4647471 - DNA, 14 bp, Homo sapiens
cagcatccctggag

SEQ ID NO: 4647472 - DNA, 16 bp, Homo sapiens
cagcatccctggagca

SEQ ID NO: 4647473 - DNA, 17 bp, Homo sapiens
cagcatgcttgggctga

SEQ ID NO: 4647474 - DNA, 19 bp, Homo sapiens
cagcatgggtccagaagac

SEQ ID NO: 4647475 - DNA, 18 bp, Homo sapiens
cagcattactaaggcagg

SEQ ID NO: 4647476 - DNA, 13 bp, Homo sapiens
cagcattgctttc

SEQ ID NO: 4647477 - DNA, 22 bp, Homo sapiens
cagccaacacgcacctgcctca

SEQ ID NO: 4647478 - DNA, 23 bp, Homo sapiens
cagccaagattttcctcttgtga

SEQ ID NO: 4647479 - DNA, 14 bp, Homo sapiens
cagccacacttctc

SEQ ID NO: 4647480 - DNA, 17 bp, Homo sapiens
cagccacacttctcagg

SEQ ID NO: 4647481 - DNA, 15 bp, Homo sapiens
cagccacagacccct

SEQ ID NO: 4647482 - DNA, 22 bp, Homo sapiens
cagccacagacccctgggagct

SEQ ID NO: 4647483 - DNA, 14 bp, Homo sapiens
cagccaccctgagg

SEQ ID NO: 4647484 - DNA, 22 bp, Homo sapiens
cagccaccctgaggagtctgag

SEQ ID NO: 4647485 - DNA, 20 bp, Homo sapiens
cagccagaacgtggctctgc

SEQ ID NO: 4647486 - DNA, 15 bp, Homo sapiens
cagccagccctgcct

SEQ ID NO: 4647487 - DNA, 18 bp, Homo sapiens
cagccagccctgcctgga

SEQ ID NO: 4647488 - DNA, 18 bp, Homo sapiens
cagccagccgtggccaga

SEQ ID NO: 4647489 - DNA, 21 bp, Homo sapiens
cagccagggcctgcgagggca

SEQ ID NO: 4647490 - DNA, 22 bp, Homo sapiens
cagccagggcctgcgagggcag

SEQ ID NO: 4647491 - DNA, 23 bp, Homo sapiens
cagccagggcctgcgagggcagc

SEQ ID NO: 4647492 - DNA, 13 bp, Homo sapiens
cagcccaaggaca

SEQ ID NO: 4647493 - DNA, 11 bp, Homo sapiens
cagcccagctg

SEQ ID NO: 4647494 - DNA, 21 bp, Homo sapiens
cagcccaggaaaaactggaag

SEQ ID NO: 4647495 - DNA, 22 bp, Homo sapiens
cagcccatggaggcagatgccc

SEQ ID NO: 4647496 - DNA, 14 bp, Homo sapiens
cagcccattgctgc

SEQ ID NO: 4647497 - DNA, 15 bp, Homo sapiens
cagcccattgctgcc

SEQ ID NO: 4647498 - DNA, 23 bp, Homo sapiens
caggaaaagagggagaagaaaga

SEQ ID NO: 4647499 - DNA, 13 bp, Homo sapiens
caggaaaaggcct

SEQ ID NO: 4647500 - DNA, 14 bp, Homo sapiens
caggaaaaggcctg

SEQ ID NO: 4647501 - DNA, 18 bp, Homo sapiens
caggaaaaggcctggggt

SEQ ID NO: 4647502 - DNA, 21 bp, Homo sapiens
caggaaaaggcctggggtgac

SEQ ID NO: 4647503 - DNA, 17 bp, Homo sapiens
caggaaaatgtattgat

SEQ ID NO: 4647504 - DNA, 14 bp, Homo sapiens
caggaaagccaggc

SEQ ID NO: 4647505 - DNA, 13 bp, Homo sapiens
caggaaaggagga

SEQ ID NO: 4647506 - DNA, 14 bp, Homo sapiens
caggaaaggaggac

SEQ ID NO: 4647507 - DNA, 15 bp, Homo sapiens
caggaacttctagct

SEQ ID NO: 4647508 - DNA, 18 bp, Homo sapiens
caggaacttctagctcat

SEQ ID NO: 4647509 - DNA, 19 bp, Homo sapiens
caggaagacccaacacatg

SEQ ID NO: 4647510 - DNA, 19 bp, Homo sapiens
caggaagactttgtgactg

SEQ ID NO: 4647511 - DNA, 22 bp, Homo sapiens
caggaaggccaaaatcaagagt

SEQ ID NO: 4647512 - DNA, 12 bp, Homo sapiens
caggaataaaga

SEQ ID NO: 4647513 - DNA, 23 bp, Homo sapiens
caggaataaagacttgtgcatcc

SEQ ID NO: 4647514 - DNA, 15 bp, Homo sapiens
caggaattcagtgcc

SEQ ID NO: 4647515 - DNA, 17 bp, Homo sapiens
caggaattcagtgcctt

SEQ ID NO: 4647516 - DNA, 19 bp, Homo sapiens
caggaattcagtgccttca

SEQ ID NO: 4647517 - DNA, 12 bp, Homo sapiens
caggacacaggc

SEQ ID NO: 4647518 - DNA, 13 bp, Homo sapiens
caggacacaggcc

SEQ ID NO: 4647519 - DNA, 15 bp, Homo sapiens
caggacacaggcctg

SEQ ID NO: 4647520 - DNA, 22 bp, Homo sapiens
caggacacaggcctgtgtagct

SEQ ID NO: 4647521 - DNA, 21 bp, Homo sapiens
caggaccacctcctctgccag

SEQ ID NO: 4647522 - DNA, 24 bp, Homo sapiens
caggaccacctcctctgccagcag

SEQ ID NO: 4647523 - DNA, 14 bp, Homo sapiens
caggaccctcagga

SEQ ID NO: 4647524 - DNA, 15 bp, Homo sapiens
caggaccctcaggaa

SEQ ID NO: 4647525 - DNA, 17 bp, Homo sapiens
caggactaacactcaga

SEQ ID NO: 4647526 - DNA, 19 bp, Homo sapiens
caggactaacactcagaag

SEQ ID NO: 4647527 - DNA, 20 bp, Homo sapiens
caggactaacactcagaagc

SEQ ID NO: 4647528 - DNA, 15 bp, Homo sapiens
caggactgtgcctcc

SEQ ID NO: 4647529 - DNA, 20 bp, Homo sapiens
caggagaagaaagaggtgac

SEQ ID NO: 4647530 - DNA, 12 bp, Homo sapiens
caggagaagggg

SEQ ID NO: 4647531 - DNA, 21 bp, Homo sapiens
caggagaagggggctctgccc

SEQ ID NO: 4647532 - DNA, 16 bp, Homo sapiens
caggagagagccagga

SEQ ID NO: 4647533 - DNA, 14 bp, Homo sapiens
caggagatggaggg

SEQ ID NO: 4647534 - DNA, 16 bp, Homo sapiens
caggagatggagggct

SEQ ID NO: 4647535 - DNA, 21 bp, Homo sapiens
caggagatggagggcttggcc

SEQ ID NO: 4647536 - DNA, 18 bp, Homo sapiens
caggagcagccctggccc

SEQ ID NO: 4647537 - DNA, 17 bp, Homo sapiens
caggagctacctgtgtg

SEQ ID NO: 4647538 - DNA, 23 bp, Homo sapiens
caggagctacctgtgtggacagg

SEQ ID NO: 4647539 - DNA, 21 bp, Homo sapiens
caggaggctttctgggctctg

SEQ ID NO: 4647540 - DNA, 23 bp, Homo sapiens
caggaggctttctgggctctgga

SEQ ID NO: 4647541 - DNA, 18 bp, Homo sapiens
caggagggacaaaggagc

SEQ ID NO: 4647542 - DNA, 22 bp, Homo sapiens
caggagggacaaaggagcctgt

SEQ ID NO: 4647543 - DNA, 16 bp, Homo sapiens
caggagggggtcgtgg

SEQ ID NO: 4647544 - DNA, 19 bp, Homo sapiens
caggaggtgcagtggaggg

SEQ ID NO: 4647545 - DNA, 16 bp, Homo sapiens
caggagtagctgagct

SEQ ID NO: 4647546 - DNA, 14 bp, Homo sapiens
caggagtggggaga

SEQ ID NO: 4647547 - DNA, 17 bp, Homo sapiens
caggagtgggttgattt

SEQ ID NO: 4647548 - DNA, 17 bp, Homo sapiens
caggagtggtgcagaca

SEQ ID NO: 4647549 - DNA, 16 bp, Homo sapiens
caggagtgtcctgccc

SEQ ID NO: 4647550 - DNA, 15 bp, Homo sapiens
caggataataatttt

SEQ ID NO: 4647551 - DNA, 18 bp, Homo sapiens
caggatactggcacagag

SEQ ID NO: 4647552 - DNA, 20 bp, Homo sapiens
caggatcagattgcatgtga

SEQ ID NO: 4647553 - DNA, 14 bp, Homo sapiens
caggatcagctttg

SEQ ID NO: 4647554 - DNA, 15 bp, Homo sapiens
caggatcgaagggtt

SEQ ID NO: 4647555 - DNA, 21 bp, Homo sapiens
caggatctcctgccagcccag

SEQ ID NO: 4647556 - DNA, 12 bp, Homo sapiens
caggatctcttt

SEQ ID NO: 4647557 - DNA, 14 bp, Homo sapiens
caggatgaagcatt

SEQ ID NO: 4647558 - DNA, 20 bp, Homo sapiens
caggatgaggtctcgaccct

SEQ ID NO: 4647559 - DNA, 16 bp, Homo sapiens
caggatggagcaagct

SEQ ID NO: 4647560 - DNA, 21 bp, Homo sapiens
caggatggagcaagctcttcc

SEQ ID NO: 4647561 - DNA, 22 bp, Homo sapiens
caggcaacgcacaaaacagaaa

SEQ ID NO: 4647562 - DNA, 15 bp, Homo sapiens
caggcaaggaacaga

SEQ ID NO: 4647563 - DNA, 15 bp, Homo sapiens
caaattttatctgga

SEQ ID NO: 4647564 - DNA, 19 bp, Homo sapiens
caaatttttattttttagt

SEQ ID NO: 4647565 - DNA, 23 bp, Homo sapiens
caaatttttattttttagtgcat

SEQ ID NO: 4647566 - DNA, 15 bp, Homo sapiens
caacaaatttcattg

SEQ ID NO: 4647567 - DNA, 18 bp, Homo sapiens
caacaaatttcattgcac

SEQ ID NO: 4647568 - DNA, 21 bp, Homo sapiens
caacaaatttcattgcacttt

SEQ ID NO: 4647569 - DNA, 16 bp, Homo sapiens
caacaacaattggtaa

SEQ ID NO: 4647570 - DNA, 16 bp, Homo sapiens
caacaagtgctcctga

SEQ ID NO: 4647571 - DNA, 17 bp, Homo sapiens
caacaatcctagtgctt

SEQ ID NO: 4647572 - DNA, 18 bp, Homo sapiens
caacaatcctagtgcttt

SEQ ID NO: 4647573 - DNA, 14 bp, Homo sapiens
caacacagaggaat

SEQ ID NO: 4647574 - DNA, 15 bp, Homo sapiens
caacacgcacctgcc

SEQ ID NO: 4647575 - DNA, 19 bp, Homo sapiens
caacacgcacctgcctcag

SEQ ID NO: 4647576 - DNA, 15 bp, Homo sapiens
caacagagggagttt

SEQ ID NO: 4647577 - DNA, 14 bp, Homo sapiens
caacagcaaaccct

SEQ ID NO: 4647578 - DNA, 15 bp, Homo sapiens
caacagcaagtgttt

SEQ ID NO: 4647579 - DNA, 20 bp, Homo sapiens
caacagcacacaggcagcca

SEQ ID NO: 4647580 - DNA, 15 bp, Homo sapiens
caacagtttttaaaa

SEQ ID NO: 4647581 - DNA, 15 bp, Homo sapiens
caacatactgtaatc

SEQ ID NO: 4647582 - DNA, 15 bp, Homo sapiens
caacatcagaaagaa

SEQ ID NO: 4647583 - DNA, 17 bp, Homo sapiens
caacatcttacttgtcc

SEQ ID NO: 4647584 - DNA, 16 bp, Homo sapiens
caacatcttttttatt

SEQ ID NO: 4647585 - DNA, 19 bp, Homo sapiens
caacatgtagggcaagagg

SEQ ID NO: 4647586 - DNA, 14 bp, Homo sapiens
caacattggacaga

SEQ ID NO: 4647587 - DNA, 21 bp, Homo sapiens
caacattggacagaaaatgca

SEQ ID NO: 4647588 - DNA, 22 bp, Homo sapiens
caacattttagctctattgata

SEQ ID NO: 4647589 - DNA, 20 bp, Homo sapiens
caaccagcccgacagtgcca

SEQ ID NO: 4647590 - DNA, 16 bp, Homo sapiens
caaccagtgccaagga

SEQ ID NO: 4647591 - DNA, 14 bp, Homo sapiens
caaccataaaagaa

SEQ ID NO: 4647592 - DNA, 17 bp, Homo sapiens
caacccgtgccaagtcc

SEQ ID NO: 4647593 - DNA, 18 bp, Homo sapiens
caacccgtggaggctgct

SEQ ID NO: 4647594 - DNA, 18 bp, Homo sapiens
caaccctgggctggggag

SEQ ID NO: 4647595 - DNA, 18 bp, Homo sapiens
caaccgtggcccttcctg

SEQ ID NO: 4647596 - DNA, 21 bp, Homo sapiens
caaccgtggcccttcctggac

SEQ ID NO: 4647597 - DNA, 22 bp, Homo sapiens
caaccgtggcccttcctggaca

SEQ ID NO: 4647598 - DNA, 18 bp, Homo sapiens
caaccgttggaaacataa

SEQ ID NO: 4647599 - DNA, 14 bp, Homo sapiens
caacctaaatactg

SEQ ID NO: 4647600 - DNA, 21 bp, Homo sapiens
caacctattaaaatacatttt

SEQ ID NO: 4647601 - DNA, 13 bp, Homo sapiens
caacctctgcctc

SEQ ID NO: 4647602 - DNA, 14 bp, Homo sapiens
caacctctgcctcc

SEQ ID NO: 4647603 - DNA, 17 bp, Homo sapiens
caacctctgcctcctgg

SEQ ID NO: 4647604 - DNA, 17 bp, Homo sapiens
caacctctgttccccac

SEQ ID NO: 4647605 - DNA, 21 bp, Homo sapiens
caacctctgttccccacccag

SEQ ID NO: 4647606 - DNA, 23 bp, Homo sapiens
caacctctgttccccacccagtt

SEQ ID NO: 4647607 - DNA, 21 bp, Homo sapiens
caacctgttcttagagtgtag

SEQ ID NO: 4647608 - DNA, 24 bp, Homo sapiens
caacctgttcttagagtgtagctg

SEQ ID NO: 4647609 - DNA, 13 bp, Homo sapiens
caacgaaaagcac

SEQ ID NO: 4647610 - DNA, 22 bp, Homo sapiens
caacgaaaagcacatccaggca

SEQ ID NO: 4647611 - DNA, 15 bp, Homo sapiens
caacgtgagagaaag

SEQ ID NO: 4647612 - DNA, 20 bp, Homo sapiens
caacgtgagagaaagagaga

SEQ ID NO: 4647613 - DNA, 22 bp, Homo sapiens
caacgtgagagaaagagagaag

SEQ ID NO: 4647614 - DNA, 23 bp, Homo sapiens
caacgtgagagaaagagagaagc

SEQ ID NO: 4647615 - DNA, 15 bp, Homo sapiens
caactacctgagcta

SEQ ID NO: 4647616 - DNA, 14 bp, Homo sapiens
caactcccttctgc

SEQ ID NO: 4647617 - DNA, 17 bp, Homo sapiens
caactccttccagctag

SEQ ID NO: 4647618 - DNA, 18 bp, Homo sapiens
caactctcccctgacctg

SEQ ID NO: 4647619 - DNA, 20 bp, Homo sapiens
caactgtcccaaggaggggg

SEQ ID NO: 4647620 - DNA, 15 bp, Homo sapiens
caactgtttccctgc

SEQ ID NO: 4647621 - DNA, 19 bp, Homo sapiens
caagaaacagccagcaaga

SEQ ID NO: 4647622 - DNA, 16 bp, Homo sapiens
caagaaacagtttctt

SEQ ID NO: 4647623 - DNA, 19 bp, Homo sapiens
caagaaataaaaggaagcc

SEQ ID NO: 4647624 - DNA, 21 bp, Homo sapiens
caagaaataaaaggaagccaa

SEQ ID NO: 4647625 - DNA, 10 bp, Homo sapiens
caagaaatgg

SEQ ID NO: 4647626 - DNA, 14 bp, Homo sapiens
caagaatgaaaaat

SEQ ID NO: 4647627 - DNA, 21 bp, Homo sapiens
caagacacgtggcctcgtgag

SEQ ID NO: 4647628 - DNA, 15 bp, Homo sapiens
caagacagaggggag

SEQ ID NO: 4647629 - DNA, 15 bp, Homo sapiens
caagaccatttgtag

SEQ ID NO: 4647630 - DNA, 13 bp, Homo sapiens
caagacgaggggc

SEQ ID NO: 4647631 - DNA, 13 bp, Homo sapiens
caagactgggccc

SEQ ID NO: 4647632 - DNA, 13 bp, Homo sapiens
caagagaaacttc

SEQ ID NO: 4647633 - DNA, 16 bp, Homo sapiens
caagagacacaattac

SEQ ID NO: 4647634 - DNA, 16 bp, Homo sapiens
caagagacactccccc

SEQ ID NO: 4647635 - DNA, 23 bp, Homo sapiens
caagagcatcatgcctctgaggc

SEQ ID NO: 4647636 - DNA, 19 bp, Homo sapiens
caagagcccgtgccacccc

SEQ ID NO: 4647637 - DNA, 17 bp, Homo sapiens
caagagggaacaaaact

SEQ ID NO: 4647638 - DNA, 20 bp, Homo sapiens
caagagggaacaaaactgtt

SEQ ID NO: 4647639 - DNA, 20 bp, Homo sapiens
caagagtctaatagtctttg

SEQ ID NO: 4647640 - DNA, 22 bp, Homo sapiens
caagagtgagatgtagaaagtt

SEQ ID NO: 4647641 - DNA, 14 bp, Homo sapiens
caagatgagcctgg

SEQ ID NO: 4647642 - DNA, 15 bp, Homo sapiens
caagatgagcctggg

SEQ ID NO: 4647643 - DNA, 13 bp, Homo sapiens
caagatgcttggt

SEQ ID NO: 4647644 - DNA, 20 bp, Homo sapiens
caagatggacacgagccaca

SEQ ID NO: 4647645 - DNA, 21 bp, Homo sapiens
caagatggacttacctggcag

SEQ ID NO: 4647646 - DNA, 18 bp, Homo sapiens
caagattttcctcttgtg

SEQ ID NO: 4647647 - DNA, 13 bp, Homo sapiens
caagcacagcagc

SEQ ID NO: 4647648 - DNA, 15 bp, Homo sapiens
caagcagcccttgct

SEQ ID NO: 4647649 - DNA, 22 bp, Homo sapiens
caagcatggtcccacatccctg

SEQ ID NO: 4647650 - DNA, 23 bp, Homo sapiens
caagcatggtcccacatccctgg

SEQ ID NO: 4647651 - DNA, 19 bp, Homo sapiens
caagcatttcatgaaaaag

SEQ ID NO: 4647652 - DNA, 13 bp, Homo sapiens
caagccccctgcc

SEQ ID NO: 4647653 - DNA, 12 bp, Homo sapiens
caagccctcagc

SEQ ID NO: 4647654 - DNA, 13 bp, Homo sapiens
caagccctcagct

SEQ ID NO: 4647655 - DNA, 11 bp, Homo sapiens
caagccctgcc

SEQ ID NO: 4647656 - DNA, 16 bp, Homo sapiens
caagccgaccttccct

SEQ ID NO: 4647657 - DNA, 18 bp, Homo sapiens
caagcctaagggatcctg

SEQ ID NO: 4647658 - DNA, 18 bp, Homo sapiens
caagcctcttattccagg

SEQ ID NO: 4647659 - DNA, 13 bp, Homo sapiens
caagcctgcctcg

SEQ ID NO: 4647660 - DNA, 17 bp, Homo sapiens
caagcgattctcctgcc

SEQ ID NO: 4647661 - DNA, 20 bp, Homo sapiens
caagctagactgtgtctgaa

SEQ ID NO: 4647662 - DNA, 18 bp, Homo sapiens
caagctcctagtatgccc

SEQ ID NO: 4647663 - DNA, 24 bp, Homo sapiens
caagctcttcccttgctcatgagc

SEQ ID NO: 4647664 - DNA, 13 bp, Homo sapiens
caagctgagctgg

SEQ ID NO: 4647665 - DNA, 18 bp, Homo sapiens
caagctgaggtgcccagg

SEQ ID NO: 4647666 - DNA, 16 bp, Homo sapiens
caagctggccaaagtc

SEQ ID NO: 4647667 - DNA, 17 bp, Homo sapiens
caagctggccaaagtca

SEQ ID NO: 4647668 - DNA, 18 bp, Homo sapiens
caagctgtccctgcaggg

SEQ ID NO: 4647669 - DNA, 23 bp, Homo sapiens
caagctgtgagacagtgggaaat

SEQ ID NO: 4647670 - DNA, 12 bp, Homo sapiens
caagctgtgcag

SEQ ID NO: 4647671 - DNA, 23 bp, Homo sapiens
caagcttgtccaggttgatcttg

SEQ ID NO: 4647672 - DNA, 22 bp, Homo sapiens
caaggaaagagagaccccagtc

SEQ ID NO: 4647673 - DNA, 21 bp, Homo sapiens
caaggaagcagaagacgggag

SEQ ID NO: 4647674 - DNA, 21 bp, Homo sapiens
atttcagaaggagaaggctgg

SEQ ID NO: 4647675 - DNA, 21 bp, Homo sapiens
atttcaggaaaatgtattgat

SEQ ID NO: 4647676 - DNA, 17 bp, Homo sapiens
atttcatccttgaatcc

SEQ ID NO: 4647677 - DNA, 19 bp, Homo sapiens
atttcatgaaaaagctgct

SEQ ID NO: 4647678 - DNA, 16 bp, Homo sapiens
atttcattccattgcc

SEQ ID NO: 4647679 - DNA, 18 bp, Homo sapiens
atttcattccattgccta

SEQ ID NO: 4647680 - DNA, 20 bp, Homo sapiens
atttcattgcactttccttt

SEQ ID NO: 4647681 - DNA, 21 bp, Homo sapiens
atttccactaaaaatattgtt

SEQ ID NO: 4647682 - DNA, 20 bp, Homo sapiens
atttccactattttcaaaga

SEQ ID NO: 4647683 - DNA, 21 bp, Homo sapiens
atttccactattttcaaagaa

SEQ ID NO: 4647684 - DNA, 11 bp, Homo sapiens
atttcctcctt

SEQ ID NO: 4647685 - DNA, 13 bp, Homo sapiens
atttcctgctgaa

SEQ ID NO: 4647686 - DNA, 19 bp, Homo sapiens
atttcctgtgtgtgttgcc

SEQ ID NO: 4647687 - DNA, 13 bp, Homo sapiens
atttccttaaaat

SEQ ID NO: 4647688 - DNA, 13 bp, Homo sapiens
atttctaattgta

SEQ ID NO: 4647689 - DNA, 16 bp, Homo sapiens
atttctaattgtaagt

SEQ ID NO: 4647690 - DNA, 21 bp, Homo sapiens
atttctacaactggagttttt

SEQ ID NO: 4647691 - DNA, 14 bp, Homo sapiens
atttctcatgtttt

SEQ ID NO: 4647692 - DNA, 13 bp, Homo sapiens
atttctctgtgaa

SEQ ID NO: 4647693 - DNA, 14 bp, Homo sapiens
atttctctgtgaat

SEQ ID NO: 4647694 - DNA, 16 bp, Homo sapiens
atttctctgtgaatcc

SEQ ID NO: 4647695 - DNA, 22 bp, Homo sapiens
atttctcttctacccttttcct

SEQ ID NO: 4647696 - DNA, 14 bp, Homo sapiens
atttctgttatttt

SEQ ID NO: 4647697 - DNA, 20 bp, Homo sapiens
atttctgttatttttaagct

SEQ ID NO: 4647698 - DNA, 13 bp, Homo sapiens
atttctgttcctt

SEQ ID NO: 4647699 - DNA, 14 bp, Homo sapiens
atttctgttccttt

SEQ ID NO: 4647700 - DNA, 20 bp, Homo sapiens
atttctgttcctttttgtaa

SEQ ID NO: 4647701 - DNA, 20 bp, Homo sapiens
atttcttaaaactttattaa

SEQ ID NO: 4647702 - DNA, 22 bp, Homo sapiens
atttcttggcatgcatctttaa

SEQ ID NO: 4647703 - DNA, 19 bp, Homo sapiens
atttctttatatttatcca

SEQ ID NO: 4647704 - DNA, 21 bp, Homo sapiens
atttctttgtttaacaaaaga

SEQ ID NO: 4647705 - DNA, 16 bp, Homo sapiens
atttctttttttcctt

SEQ ID NO: 4647706 - DNA, 15 bp, Homo sapiens
atttgaataagcaga

SEQ ID NO: 4647707 - DNA, 15 bp, Homo sapiens
atttgactaatttta

SEQ ID NO: 4647708 - DNA, 23 bp, Homo sapiens
atttgatcgttccagttcccact

SEQ ID NO: 4647709 - DNA, 23 bp, Homo sapiens
atttgcacctctgttcatttcac

SEQ ID NO: 4647710 - DNA, 14 bp, Homo sapiens
atttgcatccagca

SEQ ID NO: 4647711 - DNA, 20 bp, Homo sapiens
atttgccagagccaaatttt

SEQ ID NO: 4647712 - DNA, 18 bp, Homo sapiens
atttgccttctgaaatgt

SEQ ID NO: 4647713 - DNA, 18 bp, Homo sapiens
atttgctaatcaaagcca

SEQ ID NO: 4647714 - DNA, 14 bp, Homo sapiens
atttggaatatttg

SEQ ID NO: 4647715 - DNA, 19 bp, Homo sapiens
atttggcagcccctgtttt

SEQ ID NO: 4647716 - DNA, 16 bp, Homo sapiens
atttggccaggcctag

SEQ ID NO: 4647717 - DNA, 20 bp, Homo sapiens
atttggtcttagctttacat

SEQ ID NO: 4647718 - DNA, 15 bp, Homo sapiens
atttggttatggtta

SEQ ID NO: 4647719 - DNA, 17 bp, Homo sapiens
atttgtaaacttctgaa

SEQ ID NO: 4647720 - DNA, 21 bp, Homo sapiens
atttgtaaacttctgaagact

SEQ ID NO: 4647721 - DNA, 15 bp, Homo sapiens
atttgtaatatggaa

SEQ ID NO: 4647722 - DNA, 22 bp, Homo sapiens
atttgtagtggaaacatttata

SEQ ID NO: 4647723 - DNA, 20 bp, Homo sapiens
atttgtgctagaaattttca

SEQ ID NO: 4647724 - DNA, 14 bp, Homo sapiens
atttgttacagcca

SEQ ID NO: 4647725 - DNA, 17 bp, Homo sapiens
atttgttcccaagagca

SEQ ID NO: 4647726 - DNA, 20 bp, Homo sapiens
atttgtttgtagctttcctg

SEQ ID NO: 4647727 - DNA, 15 bp, Homo sapiens
attttaaaaacttta

SEQ ID NO: 4647728 - DNA, 14 bp, Homo sapiens
attttaactctgtc

SEQ ID NO: 4647729 - DNA, 22 bp, Homo sapiens
attttaagtggggttgataaca

SEQ ID NO: 4647730 - DNA, 14 bp, Homo sapiens
attttaatcattat

SEQ ID NO: 4647731 - DNA, 18 bp, Homo sapiens
attttaatgctgtttcta

SEQ ID NO: 4647732 - DNA, 19 bp, Homo sapiens
attttaatgctgtttctaa

SEQ ID NO: 4647733 - DNA, 14 bp, Homo sapiens
attttaatttcagg

SEQ ID NO: 4647734 - DNA, 23 bp, Homo sapiens
attttagctctattgatactctt

SEQ ID NO: 4647735 - DNA, 21 bp, Homo sapiens
attttataattggtgctattt

SEQ ID NO: 4647736 - DNA, 12 bp, Homo sapiens
attttatcatta

SEQ ID NO: 4647737 - DNA, 13 bp, Homo sapiens
attttatcattaa

SEQ ID NO: 4647738 - DNA, 20 bp, Homo sapiens
attttatcattaaaaattac

SEQ ID NO: 4647739 - DNA, 19 bp, Homo sapiens
attttatgaatatcattga

SEQ ID NO: 4647740 - DNA, 19 bp, Homo sapiens
tttttacaagttttaaata

SEQ ID NO: 4647741 - DNA, 21 bp, Homo sapiens
tttttacatagttgagattgt

SEQ ID NO: 4647742 - DNA, 19 bp, Homo sapiens
tttttactaagttttcaaa

SEQ ID NO: 4647743 - DNA, 21 bp, Homo sapiens
tttttatatcatgcaaaatat

SEQ ID NO: 4647744 - DNA, 12 bp, Homo sapiens
tttttcatcctt

SEQ ID NO: 4647745 - DNA, 24 bp, Homo sapiens
tttttcatccttctttccttgttc

SEQ ID NO: 4647746 - DNA, 20 bp, Homo sapiens
tttttcatgttttaacaaaa

SEQ ID NO: 4647747 - DNA, 20 bp, Homo sapiens
tttttcccacgtctaactgg

SEQ ID NO: 4647748 - DNA, 17 bp, Homo sapiens
tttttctgcttttgaaa

SEQ ID NO: 4647749 - DNA, 21 bp, Homo sapiens
tttttgaaccatccacttaca

SEQ ID NO: 4647750 - DNA, 14 bp, Homo sapiens
tttttgatggaatt

SEQ ID NO: 4647751 - DNA, 17 bp, Homo sapiens
tttttgccagactctag

SEQ ID NO: 4647752 - DNA, 23 bp, Homo sapiens
tttttgctgctacttctgtggaa

SEQ ID NO: 4647753 - DNA, 16 bp, Homo sapiens
tttttgtaatgcactg

SEQ ID NO: 4647754 - DNA, 11 bp, Homo sapiens
tttttgtactt

SEQ ID NO: 4647755 - DNA, 18 bp, Homo sapiens
tttttgtcattttatgaa

SEQ ID NO: 4647756 - DNA, 22 bp, Homo sapiens
tttttgtgttttgttctttaaa

SEQ ID NO: 4647757 - DNA, 15 bp, Homo sapiens
tttttgtttgtttct

SEQ ID NO: 4647758 - DNA, 16 bp, Homo sapiens
ttttttaatgtatctt

SEQ ID NO: 4647759 - DNA, 22 bp, Homo sapiens
ttttttccacttttgttctact

SEQ ID NO: 4647760 - DNA, 10 bp, Homo sapiens
ttttttgaga

SEQ ID NO: 4647761 - DNA, 22 bp, Homo sapiens
ttttttggtgtgccctgtgtgt

SEQ ID NO: 4647762 - DNA, 16 bp, Homo sapiens
tttgtagctttcctgg

SEQ ID NO: 4647763 - DNA, 18 bp, Homo sapiens
tttgtagctttcctggaa

SEQ ID NO: 4647764 - DNA, 12 bp, Homo sapiens
tttgtagtgagc

SEQ ID NO: 4647765 - DNA, 21 bp, Homo sapiens
tttgtatttggaatatttgaa

SEQ ID NO: 4647766 - DNA, 18 bp, Homo sapiens
tttgtcattttatgaata

SEQ ID NO: 4647767 - DNA, 14 bp, Homo sapiens
tttgtctaaaacaa

SEQ ID NO: 4647768 - DNA, 22 bp, Homo sapiens
tttgtctcagaagtgaaaatct

SEQ ID NO: 4647769 - DNA, 13 bp, Homo sapiens
tttgtctttttgt

SEQ ID NO: 4647770 - DNA, 14 bp, Homo sapiens
tttgtgctagaaat

SEQ ID NO: 4647771 - DNA, 14 bp, Homo sapiens
tttgtgtgtttcaa

SEQ ID NO: 4647772 - DNA, 23 bp, Homo sapiens
tttgtgttgtcttttttatgtta

SEQ ID NO: 4647773 - DNA, 16 bp, Homo sapiens
tttgtgtttttctata

SEQ ID NO: 4647774 - DNA, 12 bp, Homo sapiens
tttgttatgaca

SEQ ID NO: 4647775 - DNA, 16 bp, Homo sapiens
tttgtttcaactttct

SEQ ID NO: 4647776 - DNA, 14 bp, Homo sapiens
tttgttttgttgga

SEQ ID NO: 4647777 - DNA, 14 bp, Homo sapiens
tttgtttttttgag

SEQ ID NO: 4647778 - DNA, 20 bp, Homo sapiens
ttttaaaatgtgaggcaata

SEQ ID NO: 4647779 - DNA, 19 bp, Homo sapiens
ttttaaacataagctaaat

SEQ ID NO: 4647780 - DNA, 23 bp, Homo sapiens
ttttaaaccagggatgtctgttg

SEQ ID NO: 4647781 - DNA, 16 bp, Homo sapiens
ttttaaagaagcttta

SEQ ID NO: 4647782 - DNA, 13 bp, Homo sapiens
ttttaaagtattt

SEQ ID NO: 4647783 - DNA, 18 bp, Homo sapiens
ttttaaagtttaaatacc

SEQ ID NO: 4647784 - DNA, 19 bp, Homo sapiens
ttttaaagtttaaatacca

SEQ ID NO: 4647785 - DNA, 15 bp, Homo sapiens
ttttaaatattttct

SEQ ID NO: 4647786 - DNA, 12 bp, Homo sapiens
ttttaaattgtt

SEQ ID NO: 4647787 - DNA, 15 bp, Homo sapiens
ttttaagaaggcatt

SEQ ID NO: 4647788 - DNA, 23 bp, Homo sapiens
ttttaaggtctttcagtactttt

SEQ ID NO: 4647789 - DNA, 14 bp, Homo sapiens
ttttaaggtttcaa

SEQ ID NO: 4647790 - DNA, 17 bp, Homo sapiens
ttttaagtgtatcttaa

SEQ ID NO: 4647791 - DNA, 16 bp, Homo sapiens
ttttaatacctttaaa

SEQ ID NO: 4647792 - DNA, 18 bp, Homo sapiens
ttttaatcattatttgag

SEQ ID NO: 4647793 - DNA, 15 bp, Homo sapiens
ttttaatgatgacaa

SEQ ID NO: 4647794 - DNA, 17 bp, Homo sapiens
ttttaatgatgacaaaa

SEQ ID NO: 4647795 - DNA, 20 bp, Homo sapiens
ttttaatgctatttgaacaa

SEQ ID NO: 4647796 - DNA, 21 bp, Homo sapiens
ttttaatgctgtttctaagaa

SEQ ID NO: 4647797 - DNA, 14 bp, Homo sapiens
ttttaatgtatctt

SEQ ID NO: 4647798 - DNA, 16 bp, Homo sapiens
ttttaatgtatcttaa

SEQ ID NO: 4647799 - DNA, 16 bp, Homo sapiens
ttttaattaagcagaa

SEQ ID NO: 4647800 - DNA, 23 bp, Homo sapiens
ttttacactgataaaagttttga

SEQ ID NO: 4647801 - DNA, 13 bp, Homo sapiens
ttttaccttgttt

SEQ ID NO: 4647802 - DNA, 20 bp, Homo sapiens
ttttactaagttttcaaatt

SEQ ID NO: 4647803 - DNA, 14 bp, Homo sapiens
ttttagaaatgcat

SEQ ID NO: 4647804 - DNA, 22 bp, Homo sapiens
ttttagctggtggcaataaata

SEQ ID NO: 4647805 - DNA, 21 bp, Homo sapiens
ttttagggagtggttcctgtg

SEQ ID NO: 4647806 - DNA, 15 bp, Homo sapiens
ttttagggcagattt

SEQ ID NO: 4647807 - DNA, 22 bp, Homo sapiens
ttttataaaatggctgtaatca

SEQ ID NO: 4647808 - DNA, 18 bp, Homo sapiens
ttttataaatgatatcaa

SEQ ID NO: 4647809 - DNA, 19 bp, Homo sapiens
ttttataaatgatatcaaa

SEQ ID NO: 4647810 - DNA, 17 bp, Homo sapiens
ttttataaccttgttct

SEQ ID NO: 4647811 - DNA, 23 bp, Homo sapiens
ttttataattggtgctatttgaa

SEQ ID NO: 4647812 - DNA, 17 bp, Homo sapiens
ttttataattttctaag

SEQ ID NO: 4647813 - DNA, 22 bp, Homo sapiens
ttttatatacagaggaaatctg

SEQ ID NO: 4647814 - DNA, 14 bp, Homo sapiens
ttttatattaaagt

SEQ ID NO: 4647815 - DNA, 14 bp, Homo sapiens
ttttatcaggcagg

SEQ ID NO: 4647816 - DNA, 21 bp, Homo sapiens
ttttatgaagtgcgtgaatgt

SEQ ID NO: 4647817 - DNA, 16 bp, Homo sapiens
ttttatgagcttccaa

SEQ ID NO: 4647818 - DNA, 18 bp, Homo sapiens
ttttatgcgtgtgacagt

SEQ ID NO: 4647819 - DNA, 22 bp, Homo sapiens
ttttattcctcttattgggata

SEQ ID NO: 4647820 - DNA, 23 bp, Homo sapiens
ttttcaaccagataacatacctt

SEQ ID NO: 4647821 - DNA, 12 bp, Homo sapiens
ttttcaaggcct

SEQ ID NO: 4647822 - DNA, 21 bp, Homo sapiens
ttttcaaggccttcagtttat

SEQ ID NO: 4647823 - DNA, 14 bp, Homo sapiens
ttttcaataacaaa

SEQ ID NO: 4647824 - DNA, 16 bp, Homo sapiens
ttttcaataagatgta

SEQ ID NO: 4647825 - DNA, 15 bp, Homo sapiens
ttttcagatataaaa

SEQ ID NO: 4647826 - DNA, 17 bp, Homo sapiens
ttttcagatataaaaga

SEQ ID NO: 4647827 - DNA, 16 bp, Homo sapiens
ttttcagtaccaaaga

SEQ ID NO: 4647828 - DNA, 23 bp, Homo sapiens
ttttcagtcatataaaagctatg

SEQ ID NO: 4647829 - DNA, 18 bp, Homo sapiens
ttttcatcacagttgcct

SEQ ID NO: 4647830 - DNA, 15 bp, Homo sapiens
ttttcatctgggaaa

SEQ ID NO: 4647831 - DNA, 12 bp, Homo sapiens
ttttcattatgt

SEQ ID NO: 4647832 - DNA, 14 bp, Homo sapiens
ttttcattctcctc

SEQ ID NO: 4647833 - DNA, 17 bp, Homo sapiens
ttttcattctcctcctc

SEQ ID NO: 4647834 - DNA, 13 bp, Homo sapiens
ttttcattttcca

SEQ ID NO: 4647835 - DNA, 14 bp, Homo sapiens
ttttcattttccaa

SEQ ID NO: 4647836 - DNA, 18 bp, Homo sapiens
ttttccaagccctcagct

SEQ ID NO: 4647837 - DNA, 18 bp, Homo sapiens
ttttccactccattgtcg

SEQ ID NO: 4647838 - DNA, 14 bp, Homo sapiens
ttttccacttttgt

SEQ ID NO: 4647839 - DNA, 17 bp, Homo sapiens
ttttccattgtttgaaa

SEQ ID NO: 4647840 - DNA, 21 bp, Homo sapiens
ttttcccacgtctaactggaa

SEQ ID NO: 4647841 - DNA, 18 bp, Homo sapiens
ttttcccccaccctccca

SEQ ID NO: 4647842 - DNA, 21 bp, Homo sapiens
ttttcctaatgtgatcatatg

SEQ ID NO: 4647843 - DNA, 11 bp, Homo sapiens
ttttccttcca

SEQ ID NO: 4647844 - DNA, 13 bp, Homo sapiens
ttttccttccatg

SEQ ID NO: 4647845 - DNA, 16 bp, Homo sapiens
ttttcctttgtagcta

SEQ ID NO: 4647846 - DNA, 22 bp, Homo sapiens
ttttctaagtcgtgcactttct

SEQ ID NO: 4647847 - DNA, 13 bp, Homo sapiens
ttttctacaaata

SEQ ID NO: 4647848 - DNA, 14 bp, Homo sapiens
ttttctagtacact

SEQ ID NO: 4647849 - DNA, 19 bp, Homo sapiens
ttttctattatggaaaact

SEQ ID NO: 4647850 - DNA, 14 bp, Homo sapiens
ttttctctgtactt

SEQ ID NO: 4647851 - DNA, 16 bp, Homo sapiens
ttttctgcgcttcagt

SEQ ID NO: 4647852 - DNA, 15 bp, Homo sapiens
ttttgaaacaaagta

SEQ ID NO: 4647853 - DNA, 22 bp, Homo sapiens
ttttgaaatattaaaccctgga

SEQ ID NO: 4647854 - DNA, 15 bp, Homo sapiens
ttttgagacagtctt

SEQ ID NO: 4647855 - DNA, 21 bp, Homo sapiens
ttttgagtaaaaagacatttt

SEQ ID NO: 4647856 - DNA, 17 bp, Homo sapiens
ttttgcatactgaaaat

SEQ ID NO: 4647857 - DNA, 14 bp, Homo sapiens
ttttgctgtagaag

SEQ ID NO: 4647858 - DNA, 14 bp, Homo sapiens
ttttgcttcctagt

SEQ ID NO: 4647859 - DNA, 19 bp, Homo sapiens
ttttggactagccagaatt

SEQ ID NO: 4647860 - DNA, 11 bp, Homo sapiens
ttttggcctgt

SEQ ID NO: 4647861 - DNA, 18 bp, Homo sapiens
ttttggcctgtgatgttt

SEQ ID NO: 4647862 - DNA, 18 bp, Homo sapiens
ttttggggaagtgaggaa

SEQ ID NO: 4647863 - DNA, 17 bp, Homo sapiens
ttttggtgcacaaatac

SEQ ID NO: 4647864 - DNA, 20 bp, Homo sapiens
ttttggttttaaaagcacaa

SEQ ID NO: 4647865 - DNA, 13 bp, Homo sapiens
gttttgttttttt

SEQ ID NO: 4647866 - DNA, 22 bp, Homo sapiens
gtttttaacctgttttgttaat

SEQ ID NO: 4647867 - DNA, 23 bp, Homo sapiens
gtttttagagaatgtgtttcaaa

SEQ ID NO: 4647868 - DNA, 17 bp, Homo sapiens
gtttttctgcttttgaa

SEQ ID NO: 4647869 - DNA, 15 bp, Homo sapiens
gtttttctggaagta

SEQ ID NO: 4647870 - DNA, 21 bp, Homo sapiens
gtttttggatctggcattgaa

SEQ ID NO: 4647871 - DNA, 15 bp, Homo sapiens
gttttttcctcagtg

SEQ ID NO: 4647872 - DNA, 10 bp, Homo sapiens
gtttttttga

SEQ ID NO: 4647873 - DNA, 18 bp, Homo sapiens
taaaaaagcatacttcta

SEQ ID NO: 4647874 - DNA, 13 bp, Homo sapiens
taaaaaatatttt

SEQ ID NO: 4647875 - DNA, 18 bp, Homo sapiens
taaaaaatattttctctg

SEQ ID NO: 4647876 - DNA, 20 bp, Homo sapiens
taaaaataaaacatcataaa

SEQ ID NO: 4647877 - DNA, 18 bp, Homo sapiens
taaaaataaagggaagaa

SEQ ID NO: 4647878 - DNA, 19 bp, Homo sapiens
taaaaatattgtttctgca

SEQ ID NO: 4647879 - DNA, 22 bp, Homo sapiens
taaaaatctagcacactcttct

SEQ ID NO: 4647880 - DNA, 20 bp, Homo sapiens
taaaaatgtaggctttcatg

SEQ ID NO: 4647881 - DNA, 11 bp, Homo sapiens
taaaaatgttc

SEQ ID NO: 4647882 - DNA, 20 bp, Homo sapiens
taaaaattacctttaatttt

SEQ ID NO: 4647883 - DNA, 14 bp, Homo sapiens
taaaacaaaatttg

SEQ ID NO: 4647884 - DNA, 14 bp, Homo sapiens
taaaaccttgttct

SEQ ID NO: 4647885 - DNA, 16 bp, Homo sapiens
taaaaccttgttctat

SEQ ID NO: 4647886 - DNA, 17 bp, Homo sapiens
taaaaccttgttctatt

SEQ ID NO: 4647887 - DNA, 16 bp, Homo sapiens
tttcagtggaaaccct

SEQ ID NO: 4647888 - DNA, 19 bp, Homo sapiens
tttcagtgggtctctgtgt

SEQ ID NO: 4647889 - DNA, 15 bp, Homo sapiens
gtgctcccgagagat

SEQ ID NO: 4647890 - DNA, 14 bp, Homo sapiens
gtgctcctgaaaga

SEQ ID NO: 4647891 - DNA, 14 bp, Homo sapiens
gtgctcgccctgcg

SEQ ID NO: 4647892 - DNA, 11 bp, Homo sapiens
gtgctgcagga

SEQ ID NO: 4647893 - DNA, 13 bp, Homo sapiens
gtgctgcaggagt

SEQ ID NO: 4647894 - DNA, 22 bp, Homo sapiens
gtgctggctcacagtacagcat

SEQ ID NO: 4647895 - DNA, 20 bp, Homo sapiens
gtgctgtccccactgcccca

SEQ ID NO: 4647896 - DNA, 19 bp, Homo sapiens
gtgctgttttattactgtt

SEQ ID NO: 4647897 - DNA, 21 bp, Homo sapiens
gtgcttagaggttctgcctct

SEQ ID NO: 4647898 - DNA, 13 bp, Homo sapiens
gtgcttccttggt

SEQ ID NO: 4647899 - DNA, 23 bp, Homo sapiens
gtgcttttctgttttcaagtgta

SEQ ID NO: 4647900 - DNA, 22 bp, Homo sapiens
gtggaacgtttttcctgttctt

SEQ ID NO: 4647901 - DNA, 14 bp, Homo sapiens
gtggaaggcctccc

SEQ ID NO: 4647902 - DNA, 17 bp, Homo sapiens
gtggaaggcctccctct

SEQ ID NO: 4647903 - DNA, 20 bp, Homo sapiens
gtggaattttgagaaaaata

SEQ ID NO: 4647904 - DNA, 12 bp, Homo sapiens
gtggacaggact

SEQ ID NO: 4647905 - DNA, 21 bp, Homo sapiens
gtggactcagggcagcgccag

SEQ ID NO: 4647906 - DNA, 21 bp, Homo sapiens
gtggactctgaggactcctga

SEQ ID NO: 4647907 - DNA, 22 bp, Homo sapiens
gtggactctgaggactcctgag

SEQ ID NO: 4647908 - DNA, 17 bp, Homo sapiens
gtggactctgcacatgt

SEQ ID NO: 4647909 - DNA, 14 bp, Homo sapiens
gtggagacagtcct

SEQ ID NO: 4647910 - DNA, 21 bp, Homo sapiens
gtggagatcagaaagtgacat

SEQ ID NO: 4647911 - DNA, 20 bp, Homo sapiens
gtggaggaagagccacctgc

SEQ ID NO: 4647912 - DNA, 14 bp, Homo sapiens
gtggaggctgctcg

SEQ ID NO: 4647913 - DNA, 23 bp, Homo sapiens
gtggagggaaggataaagccact

SEQ ID NO: 4647914 - DNA, 23 bp, Homo sapiens
gtggagggggcaagctttgctcc

SEQ ID NO: 4647915 - DNA, 14 bp, Homo sapiens
gtggagtgcagtgg

SEQ ID NO: 4647916 - DNA, 17 bp, Homo sapiens
gtggagtgcagtggtgc

SEQ ID NO: 4647917 - DNA, 13 bp, Homo sapiens
gtggatgctgtgc

SEQ ID NO: 4647918 - DNA, 14 bp, Homo sapiens
gtggatgctgtgct

SEQ ID NO: 4647919 - DNA, 15 bp, Homo sapiens
gtggattaaaccttt

SEQ ID NO: 4647920 - DNA, 21 bp, Homo sapiens
gtggcactggtaggttgggac

SEQ ID NO: 4647921 - DNA, 22 bp, Homo sapiens
gtggcactggtaggttgggaca

SEQ ID NO: 4647922 - DNA, 11 bp, Homo sapiens
gtggcagctgt

SEQ ID NO: 4647923 - DNA, 18 bp, Homo sapiens
gtggcagggggccccgcc

SEQ ID NO: 4647924 - DNA, 13 bp, Homo sapiens
gtggccaagccta

SEQ ID NO: 4647925 - DNA, 15 bp, Homo sapiens
gtggccatcatcctc

SEQ ID NO: 4647926 - DNA, 16 bp, Homo sapiens
gtggccatcatcctcc

SEQ ID NO: 4647927 - DNA, 20 bp, Homo sapiens
gtggccatcatcctcccgcc

SEQ ID NO: 4647928 - DNA, 13 bp, Homo sapiens
gtggcccttcctg

SEQ ID NO: 4647929 - DNA, 18 bp, Homo sapiens
gtggcctcagctgaatgc

SEQ ID NO: 4647930 - DNA, 16 bp, Homo sapiens
gtggcctctttgtcta

SEQ ID NO: 4647931 - DNA, 16 bp, Homo sapiens
gtggcgtctccctcgc

SEQ ID NO: 4647932 - DNA, 16 bp, Homo sapiens
gtggctccctctctcc

SEQ ID NO: 4647933 - DNA, 15 bp, Homo sapiens
gtggctctgctggcc

SEQ ID NO: 4647934 - DNA, 19 bp, Homo sapiens
gtggctggtggtcatgaat

SEQ ID NO: 4647935 - DNA, 17 bp, Homo sapiens
gtggcttcactcctgct

SEQ ID NO: 4647936 - DNA, 23 bp, Homo sapiens
gtgggaaagattactttttcttt

SEQ ID NO: 4647937 - DNA, 13 bp, Homo sapiens
gtgggaaggggct

SEQ ID NO: 4647938 - DNA, 13 bp, Homo sapiens
gtgggacagccca

SEQ ID NO: 4647939 - DNA, 18 bp, Homo sapiens
gtgggacagcccagagcc

SEQ ID NO: 4647940 - DNA, 19 bp, Homo sapiens
gtgggactcatccttgccc

SEQ ID NO: 4647941 - DNA, 14 bp, Homo sapiens
gtgggaggaggcct

SEQ ID NO: 4647942 - DNA, 16 bp, Homo sapiens
gtgggcactggcccag

SEQ ID NO: 4647943 - DNA, 11 bp, Homo sapiens
gtgggcagagg

SEQ ID NO: 4647944 - DNA, 13 bp, Homo sapiens
gtgggcagaggaa

SEQ ID NO: 4647945 - DNA, 21 bp, Homo sapiens
gtgggcagaggaatgtgggct

SEQ ID NO: 4647946 - DNA, 21 bp, Homo sapiens
gtgggccaccgtgcctggctg

SEQ ID NO: 4647947 - DNA, 14 bp, Homo sapiens
gtgggccagggctg

SEQ ID NO: 4647948 - DNA, 15 bp, Homo sapiens
gtgggccatggcaat

SEQ ID NO: 4647949 - DNA, 19 bp, Homo sapiens
gtggggcctgtggaatgag

SEQ ID NO: 4647950 - DNA, 17 bp, Homo sapiens
gtgggtctctgtgtgtg

SEQ ID NO: 4647951 - DNA, 20 bp, Homo sapiens
gtgggtgcgtaaggatgtgt

SEQ ID NO: 4647952 - DNA, 15 bp, Homo sapiens
gtgggtgctcagaat

SEQ ID NO: 4647953 - DNA, 22 bp, Homo sapiens
gtggtcataaaatagaataatt

SEQ ID NO: 4647954 - DNA, 23 bp, Homo sapiens
gtggtcatgaattcatactctgt

SEQ ID NO: 4647955 - DNA, 19 bp, Homo sapiens
gtggtctagaccagggctg

SEQ ID NO: 4647956 - DNA, 11 bp, Homo sapiens
gtggtctcagg

SEQ ID NO: 4647957 - DNA, 22 bp, Homo sapiens
gtggtgacttctgctgctggcc

SEQ ID NO: 4647958 - DNA, 14 bp, Homo sapiens
gtggtgcagacaga

SEQ ID NO: 4647959 - DNA, 16 bp, Homo sapiens
gtggtgcattcctgaa

SEQ ID NO: 4647960 - DNA, 13 bp, Homo sapiens
gtggttcctgtgg

SEQ ID NO: 4647961 - DNA, 12 bp, Homo sapiens
gtgtaataagac

SEQ ID NO: 4647962 - DNA, 13 bp, Homo sapiens
gtgtacagtcttg

SEQ ID NO: 4647963 - DNA, 16 bp, Homo sapiens
gtgtacagtcttgtat

SEQ ID NO: 4647964 - DNA, 22 bp, Homo sapiens
gtgtaccgcgtctaccctggga

SEQ ID NO: 4647965 - DNA, 16 bp, Homo sapiens
gtgtagacacaggtca

SEQ ID NO: 4647966 - DNA, 18 bp, Homo sapiens
tttgtcacattatttatt

SEQ ID NO: 4647967 - DNA, 21 bp, Homo sapiens
tttgtcacattatttattaaa

SEQ ID NO: 4647968 - DNA, 18 bp, Homo sapiens
tttgtcagaggaacaaac

SEQ ID NO: 4647969 - DNA, 16 bp, Homo sapiens
tttgtcattttatgaa

SEQ ID NO: 4647970 - DNA, 13 bp, Homo sapiens
tttgtccatcttg

SEQ ID NO: 4647971 - DNA, 22 bp, Homo sapiens
tttgtccgattaatttgaaatc

SEQ ID NO: 4647972 - DNA, 16 bp, Homo sapiens
tttgtctaaaacaata

SEQ ID NO: 4647973 - DNA, 19 bp, Homo sapiens
tttgtctaaaacaataaaa

SEQ ID NO: 4647974 - DNA, 14 bp, Homo sapiens
tttgtcttattgaa

SEQ ID NO: 4647975 - DNA, 16 bp, Homo sapiens
tttgtcttattgaaaa

SEQ ID NO: 4647976 - DNA, 21 bp, Homo sapiens
tttgtgaaacagttgctgtga

SEQ ID NO: 4647977 - DNA, 13 bp, Homo sapiens
tttgtgcattctg

SEQ ID NO: 4647978 - DNA, 15 bp, Homo sapiens
tttgtgtgaaataat

SEQ ID NO: 4647979 - DNA, 22 bp, Homo sapiens
tttgttaggattttcacattct

SEQ ID NO: 4647980 - DNA, 17 bp, Homo sapiens
tttgttctactccttcc

SEQ ID NO: 4647981 - DNA, 21 bp, Homo sapiens
tttgttgtggccaatgtcgaa

SEQ ID NO: 4647982 - DNA, 13 bp, Homo sapiens
tttgtttgtagct

SEQ ID NO: 4647983 - DNA, 18 bp, Homo sapiens
tttgtttttatttaaatt

SEQ ID NO: 4647984 - DNA, 15 bp, Homo sapiens
tttgtttttttgaga

SEQ ID NO: 4647985 - DNA, 18 bp, Homo sapiens
ttttaaaaaatattttct

SEQ ID NO: 4647986 - DNA, 22 bp, Homo sapiens
ttttaaaatgtgaggcaataag

SEQ ID NO: 4647987 - DNA, 15 bp, Homo sapiens
ttttaaagaagcttt

SEQ ID NO: 4647988 - DNA, 17 bp, Homo sapiens
ttttaaagaagctttat

SEQ ID NO: 4647989 - DNA, 17 bp, Homo sapiens
ttttaaatattttctat

SEQ ID NO: 4647990 - DNA, 14 bp, Homo sapiens
ttttaacctgtttt

SEQ ID NO: 4647991 - DNA, 14 bp, Homo sapiens
ttttaactctgtct

SEQ ID NO: 4647992 - DNA, 18 bp, Homo sapiens
ttttaagaaaggaagcaa

SEQ ID NO: 4647993 - DNA, 18 bp, Homo sapiens
ttttaaggtctttcagta

SEQ ID NO: 4647994 - DNA, 21 bp, Homo sapiens
ttttaaggtctttcagtactt

SEQ ID NO: 4647995 - DNA, 18 bp, Homo sapiens
ttttaaggtttcaacaaa

SEQ ID NO: 4647996 - DNA, 16 bp, Homo sapiens
ttttacatagttgaga

SEQ ID NO: 4647997 - DNA, 21 bp, Homo sapiens
ttttagagaatgtgtttcaaa

SEQ ID NO: 4647998 - DNA, 19 bp, Homo sapiens
ttttagccataattttgca

SEQ ID NO: 4647999 - DNA, 21 bp, Homo sapiens
ttttagccataattttgcata

SEQ ID NO: 4648000 - DNA, 20 bp, Homo sapiens
ttttagcccagtgttttctt

SEQ ID NO: 4648001 - DNA, 14 bp, Homo sapiens
ttttaggacatctt

SEQ ID NO: 4648002 - DNA, 16 bp, Homo sapiens
ttttaggacatcttaa

SEQ ID NO: 4648003 - DNA, 17 bp, Homo sapiens
ttttaggcataagatga

SEQ ID NO: 4648004 - DNA, 14 bp, Homo sapiens
ttttataagaattt

SEQ ID NO: 4648005 - DNA, 21 bp, Homo sapiens
ttttataatgttattcatttg

SEQ ID NO: 4648006 - DNA, 11 bp, Homo sapiens
ttttatattta

SEQ ID NO: 4648007 - DNA, 20 bp, Homo sapiens
ttttatatttattgttagaa

SEQ ID NO: 4648008 - DNA, 15 bp, Homo sapiens
ttttatccttacaat

SEQ ID NO: 4648009 - DNA, 23 bp, Homo sapiens
ttttatgttaaaaagaaatccag

SEQ ID NO: 4648010 - DNA, 18 bp, Homo sapiens
ttttattattcagaatta

SEQ ID NO: 4648011 - DNA, 15 bp, Homo sapiens
ttttattgttttcta

SEQ ID NO: 4648012 - DNA, 18 bp, Homo sapiens
ttttatttggtgtgttcg

SEQ ID NO: 4648013 - DNA, 13 bp, Homo sapiens
ttttattttgtaa

SEQ ID NO: 4648014 - DNA, 15 bp, Homo sapiens
ttttattttgtaata

SEQ ID NO: 4648015 - DNA, 15 bp, Homo sapiens
ttttcaaggccttca

SEQ ID NO: 4648016 - DNA, 14 bp, Homo sapiens
ttttcacaaacatt

SEQ ID NO: 4648017 - DNA, 14 bp, Homo sapiens
ttttcagttttcag

SEQ ID NO: 4648018 - DNA, 11 bp, Homo sapiens
ttttcatcctt

SEQ ID NO: 4648019 - DNA, 16 bp, Homo sapiens
ttttcatgttttaaca

SEQ ID NO: 4648020 - DNA, 19 bp, Homo sapiens
ttttcatgttttaacaaaa

SEQ ID NO: 4648021 - DNA, 17 bp, Homo sapiens
ttttcattcctaaagaa

SEQ ID NO: 4648022 - DNA, 23 bp, Homo sapiens
ttttccaaaagtggcctctttgt

SEQ ID NO: 4648023 - DNA, 15 bp, Homo sapiens
ttttccacttttgtt

SEQ ID NO: 4648024 - DNA, 20 bp, Homo sapiens
ttttccacttttgttctact

SEQ ID NO: 4648025 - DNA, 16 bp, Homo sapiens
ttttcctcttgtgatt

SEQ ID NO: 4648026 - DNA, 18 bp, Homo sapiens
ttttcctggacttaaaga

SEQ ID NO: 4648027 - DNA, 19 bp, Homo sapiens
ttttcctggacttaaagaa

SEQ ID NO: 4648028 - DNA, 23 bp, Homo sapiens
ttttccttccatgctcccaactc

SEQ ID NO: 4648029 - DNA, 17 bp, Homo sapiens
ttttctaaataaaaata

SEQ ID NO: 4648030 - DNA, 15 bp, Homo sapiens
ttttctactgtttta

SEQ ID NO: 4648031 - DNA, 17 bp, Homo sapiens
ttttctatttatgcctt

SEQ ID NO: 4648032 - DNA, 14 bp, Homo sapiens
ttttctgactttta

SEQ ID NO: 4648033 - DNA, 9 bp, Homo sapiens
ttttcttaa

SEQ ID NO: 4648034 - DNA, 17 bp, Homo sapiens
ttttgagacagaatctc

SEQ ID NO: 4648035 - DNA, 21 bp, Homo sapiens
ttttgagatggagtctcactc

SEQ ID NO: 4648036 - DNA, 12 bp, Homo sapiens
ttttgcactttt

SEQ ID NO: 4648037 - DNA, 16 bp, Homo sapiens
ttttgccagactctag

SEQ ID NO: 4648038 - DNA, 17 bp, Homo sapiens
ttttgctaaatgtgagt

SEQ ID NO: 4648039 - DNA, 15 bp, Homo sapiens
ttttggactagccag

SEQ ID NO: 4648040 - DNA, 17 bp, Homo sapiens
ttttggactagccagaa

SEQ ID NO: 4648041 - DNA, 17 bp, Homo sapiens
ttttggatcttgaatgt

SEQ ID NO: 4648042 - DNA, 13 bp, Homo sapiens
ttttggcagctga

SEQ ID NO: 4648043 - DNA, 17 bp, Homo sapiens
ttttggcttcatttcaa

SEQ ID NO: 4648044 - DNA, 15 bp, Homo sapiens
ttttggtgtgccctg

SEQ ID NO: 4648045 - DNA, 19 bp, Homo sapiens
ttttgtaatgcactgtttt

SEQ ID NO: 4648046 - DNA, 16 bp, Homo sapiens
ttttgtcacattattt

SEQ ID NO: 4648047 - DNA, 14 bp, Homo sapiens
ttttgtccatcttg

SEQ ID NO: 4648048 - DNA, 16 bp, Homo sapiens
ttttgtcttattgaaa

SEQ ID NO: 4648049 - DNA, 14 bp, Homo sapiens
ttttgttaatgctc

SEQ ID NO: 4648050 - DNA, 12 bp, Homo sapiens
ttttgtttcata

SEQ ID NO: 4648051 - DNA, 24 bp, Homo sapiens
tttccaaaagtggcctctttgtct

SEQ ID NO: 4648052 - DNA, 13 bp, Homo sapiens
tttccaaaggcat

SEQ ID NO: 4648053 - DNA, 13 bp, Homo sapiens
tttccaaattaaa

SEQ ID NO: 4648054 - DNA, 12 bp, Homo sapiens
tttccaaggaag

SEQ ID NO: 4648055 - DNA, 13 bp, Homo sapiens
tttccaatagaaa

SEQ ID NO: 4648056 - DNA, 18 bp, Homo sapiens
tttccacacgcattaata

SEQ ID NO: 4648057 - DNA, 22 bp, Homo sapiens
tttccacagatttttttgtaag

SEQ ID NO: 4648058 - DNA, 19 bp, Homo sapiens
tttccactattttcaaaga

SEQ ID NO: 4648059 - DNA, 23 bp, Homo sapiens
tttccatgcaccctcatacacag

SEQ ID NO: 4648060 - DNA, 21 bp, Homo sapiens
tttcccaagctagactgtgtc

SEQ ID NO: 4648061 - DNA, 21 bp, Homo sapiens
tttcccaccattcctgccttt

SEQ ID NO: 4648062 - DNA, 12 bp, Homo sapiens
tttcccccaccc

SEQ ID NO: 4648063 - DNA, 15 bp, Homo sapiens
tttcccccaccctcc

SEQ ID NO: 4648064 - DNA, 12 bp, Homo sapiens
tttcccccactc

SEQ ID NO: 4648065 - DNA, 16 bp, Homo sapiens
tttccctctccttcca

SEQ ID NO: 4648066 - DNA, 11 bp, Homo sapiens
tttccctgctg

SEQ ID NO: 4648067 - DNA, 21 bp, Homo sapiens
tttccggccaaggtgccacca

SEQ ID NO: 4648068 - DNA, 15 bp, Homo sapiens
tttcctccccctgca

SEQ ID NO: 4648069 - DNA, 12 bp, Homo sapiens
tttcctcttgtg

SEQ ID NO: 4648070 - DNA, 17 bp, Homo sapiens
tttcctggcctcagagc

SEQ ID NO: 4648071 - DNA, 22 bp, Homo sapiens
tttcctggcctcagagcttcct

SEQ ID NO: 4648072 - DNA, 15 bp, Homo sapiens
tttcctgtttccagg

SEQ ID NO: 4648073 - DNA, 17 bp, Homo sapiens
tttcctgtttccagggt

SEQ ID NO: 4648074 - DNA, 20 bp, Homo sapiens
tttccttccatgctcccaac

SEQ ID NO: 4648075 - DNA, 16 bp, Homo sapiens
tttcctttcaataaag

SEQ ID NO: 4648076 - DNA, 16 bp, Homo sapiens
tttccttttttaaaaa

SEQ ID NO: 4648077 - DNA, 21 bp, Homo sapiens
tttccttttttaaaaatgcaa

SEQ ID NO: 4648078 - DNA, 20 bp, Homo sapiens
tttctaaataaaaatatgta

SEQ ID NO: 4648079 - DNA, 19 bp, Homo sapiens
tttctaagtcgtgcacttt

SEQ ID NO: 4648080 - DNA, 18 bp, Homo sapiens
tttctactctagatggca

SEQ ID NO: 4648081 - DNA, 23 bp, Homo sapiens
tttctagacatcattgtcagcct

SEQ ID NO: 4648082 - DNA, 13 bp, Homo sapiens
tttctataaattt

SEQ ID NO: 4648083 - DNA, 19 bp, Homo sapiens
tttctataaatttaagaaa

SEQ ID NO: 4648084 - DNA, 23 bp, Homo sapiens
tttctataaatttaagaaaacaa

SEQ ID NO: 4648085 - DNA, 15 bp, Homo sapiens
tttctatgacaaatt

SEQ ID NO: 4648086 - DNA, 23 bp, Homo sapiens
tttctccacttcatttttaagaa

SEQ ID NO: 4648087 - DNA, 17 bp, Homo sapiens
tttctccttaccgtctt

SEQ ID NO: 4648088 - DNA, 20 bp, Homo sapiens
tttctcggtccactcttgtt

SEQ ID NO: 4648089 - DNA, 20 bp, Homo sapiens
tttctctccagcctgacttg

SEQ ID NO: 4648090 - DNA, 16 bp, Homo sapiens
tttctctctacagtgc

SEQ ID NO: 4648091 - DNA, 18 bp, Homo sapiens
tttctctctacagtgcca

SEQ ID NO: 4648092 - DNA, 11 bp, Homo sapiens
tttctctgcct

SEQ ID NO: 4648093 - DNA, 16 bp, Homo sapiens
tttctctgtacttttc

SEQ ID NO: 4648094 - DNA, 15 bp, Homo sapiens
tttctcttagagatt

SEQ ID NO: 4648095 - DNA, 23 bp, Homo sapiens
tttctcttctacccttttccttt

SEQ ID NO: 4648096 - DNA, 19 bp, Homo sapiens
tttctgaatgtttgtgtct

SEQ ID NO: 4648097 - DNA, 21 bp, Homo sapiens
tttctgaatgtttgtgtctgt

SEQ ID NO: 4648098 - DNA, 17 bp, Homo sapiens
tttctgctgtttacaac

SEQ ID NO: 4648099 - DNA, 10 bp, Homo sapiens
tttctggtgc

SEQ ID NO: 4648100 - DNA, 15 bp, Homo sapiens
tttctggtgctgtct

SEQ ID NO: 4648101 - DNA, 21 bp, Homo sapiens
tttcttagtgttgtggacact

SEQ ID NO: 4648102 - DNA, 21 bp, Homo sapiens
tttctttagtttttgtgaagt

SEQ ID NO: 4648103 - DNA, 17 bp, Homo sapiens
tttcttttacagactag

SEQ ID NO: 4648104 - DNA, 17 bp, Homo sapiens
tttgaaaaagttccata

SEQ ID NO: 4648105 - DNA, 22 bp, Homo sapiens
tttgaaaagtttcctaggatgt

SEQ ID NO: 4648106 - DNA, 20 bp, Homo sapiens
tttgaaacaaagtactcttt

SEQ ID NO: 4648107 - DNA, 13 bp, Homo sapiens
tttgaaagaagca

SEQ ID NO: 4648108 - DNA, 15 bp, Homo sapiens
tttgaaatataattt

SEQ ID NO: 4648109 - DNA, 14 bp, Homo sapiens
tttgaaatgtttaa

SEQ ID NO: 4648110 - DNA, 13 bp, Homo sapiens
tttgaaggctgga

SEQ ID NO: 4648111 - DNA, 21 bp, Homo sapiens
tttgaataatgacagatggtg

SEQ ID NO: 4648112 - DNA, 13 bp, Homo sapiens
tttgagaaaaata

SEQ ID NO: 4648113 - DNA, 17 bp, Homo sapiens
tttgagatctggggagg

SEQ ID NO: 4648114 - DNA, 23 bp, Homo sapiens
tttgagcagctgaataacctgca

SEQ ID NO: 4648115 - DNA, 19 bp, Homo sapiens
tttgagtaaaaagacattt

SEQ ID NO: 4648116 - DNA, 14 bp, Homo sapiens
tttgagtaaatatt

SEQ ID NO: 4648117 - DNA, 16 bp, Homo sapiens
tttgatagaggtaact

SEQ ID NO: 4648118 - DNA, 22 bp, Homo sapiens
tttgatgcagataaaatatttt

SEQ ID NO: 4648119 - DNA, 17 bp, Homo sapiens
tttgatgcatgtctttt

SEQ ID NO: 4648120 - DNA, 14 bp, Homo sapiens
tttgattctgaagt

SEQ ID NO: 4648121 - DNA, 18 bp, Homo sapiens
tttgatttctaattgtaa

SEQ ID NO: 4648122 - DNA, 18 bp, Homo sapiens
tttgatttgtctcatata

SEQ ID NO: 4648123 - DNA, 20 bp, Homo sapiens
tttgcaactaggtatttcta

SEQ ID NO: 4648124 - DNA, 13 bp, Homo sapiens
tttgcacctctgt

SEQ ID NO: 4648125 - DNA, 13 bp, Homo sapiens
tttgcagttgatg

SEQ ID NO: 4648126 - DNA, 19 bp, Homo sapiens
tttgcataataaatgcttc

SEQ ID NO: 4648127 - DNA, 13 bp, Homo sapiens
tttgcatccagca

SEQ ID NO: 4648128 - DNA, 23 bp, Homo sapiens
tttgccaaaattcatttctaatt

SEQ ID NO: 4648129 - DNA, 23 bp, Homo sapiens
tttgccccgggatattatagaaa

SEQ ID NO: 4648130 - DNA, 14 bp, Homo sapiens
tttgcccttcctcc

SEQ ID NO: 4648131 - DNA, 15 bp, Homo sapiens
tttgcccttcctcct

SEQ ID NO: 4648132 - DNA, 15 bp, Homo sapiens
tttgcgtacacagag

SEQ ID NO: 4648133 - DNA, 13 bp, Homo sapiens
tttgctccttcag

SEQ ID NO: 4648134 - DNA, 21 bp, Homo sapiens
tttgctccttcagttctgctt

SEQ ID NO: 4648135 - DNA, 13 bp, Homo sapiens
tttgctgtagaag

SEQ ID NO: 4648136 - DNA, 15 bp, Homo sapiens
gcgtacacagagaag

SEQ ID NO: 4648137 - DNA, 22 bp, Homo sapiens
gcgtcattacagggcacaggcc

SEQ ID NO: 4648138 - DNA, 14 bp, Homo sapiens
gcgtcccagctgaa

SEQ ID NO: 4648139 - DNA, 14 bp, Homo sapiens
gcgtctaccctggg

SEQ ID NO: 4648140 - DNA, 14 bp, Homo sapiens
gcgtggactctgca

SEQ ID NO: 4648141 - DNA, 11 bp, Homo sapiens
gcgtgggcaga

SEQ ID NO: 4648142 - DNA, 14 bp, Homo sapiens
gcgtgggcagagga

SEQ ID NO: 4648143 - DNA, 15 bp, Homo sapiens
gcgtgggcagaggaa

SEQ ID NO: 4648144 - DNA, 16 bp, Homo sapiens
gctaaaaatattactc

SEQ ID NO: 4648145 - DNA, 15 bp, Homo sapiens
gctaaaaatgaaaat

SEQ ID NO: 4648146 - DNA, 23 bp, Homo sapiens
gctaaactactgattacttgtaa

SEQ ID NO: 4648147 - DNA, 20 bp, Homo sapiens
gctaagggtgggtgctcaga

SEQ ID NO: 4648148 - DNA, 21 bp, Homo sapiens
gctaagggtgggtgctcagaa

SEQ ID NO: 4648149 - DNA, 17 bp, Homo sapiens
gctaataatgttaacca

SEQ ID NO: 4648150 - DNA, 18 bp, Homo sapiens
gctaatcaaagccagggt

SEQ ID NO: 4648151 - DNA, 21 bp, Homo sapiens
gctaatcaaagccagggtctc

SEQ ID NO: 4648152 - DNA, 20 bp, Homo sapiens
gctaatgcaaattaaaacat

SEQ ID NO: 4648153 - DNA, 14 bp, Homo sapiens
gctacaaaaattga

SEQ ID NO: 4648154 - DNA, 12 bp, Homo sapiens
gctacaaagcag

SEQ ID NO: 4648155 - DNA, 15 bp, Homo sapiens
gctacaaagcagaga

SEQ ID NO: 4648156 - DNA, 17 bp, Homo sapiens
gctacaccactctggca

SEQ ID NO: 4648157 - DNA, 22 bp, Homo sapiens
gctacccgcagagttctcagaa

SEQ ID NO: 4648158 - DNA, 14 bp, Homo sapiens
gctacgtgtgaaat

SEQ ID NO: 4648159 - DNA, 15 bp, Homo sapiens
gctacgtgtgaaatc

SEQ ID NO: 4648160 - DNA, 16 bp, Homo sapiens
gctacgtgtgaaatct

SEQ ID NO: 4648161 - DNA, 18 bp, Homo sapiens
gctactagaattctgtat

SEQ ID NO: 4648162 - DNA, 12 bp, Homo sapiens
gctactccccac

SEQ ID NO: 4648163 - DNA, 12 bp, Homo sapiens
gctactccctgg

SEQ ID NO: 4648164 - DNA, 17 bp, Homo sapiens
gctactccctggaccac

SEQ ID NO: 4648165 - DNA, 13 bp, Homo sapiens
gctactctgtgcc

SEQ ID NO: 4648166 - DNA, 15 bp, Homo sapiens
gctactctgtgccag

SEQ ID NO: 4648167 - DNA, 15 bp, Homo sapiens
gctacttggcaggct

SEQ ID NO: 4648168 - DNA, 16 bp, Homo sapiens
gctacttggcaggctg

SEQ ID NO: 4648169 - DNA, 13 bp, Homo sapiens
gctagaaaaataa

SEQ ID NO: 4648170 - DNA, 11 bp, Homo sapiens
gctagaaatga

SEQ ID NO: 4648171 - DNA, 20 bp, Homo sapiens
gctagacaatgatttggcca

SEQ ID NO: 4648172 - DNA, 23 bp, Homo sapiens
gctagacaatgatttggccaggc

SEQ ID NO: 4648173 - DNA, 13 bp, Homo sapiens
gctagactgtgtc

SEQ ID NO: 4648174 - DNA, 14 bp, Homo sapiens
gctagactgtgtct

SEQ ID NO: 4648175 - DNA, 14 bp, Homo sapiens
gctagagggcccaa

SEQ ID NO: 4648176 - DNA, 16 bp, Homo sapiens
gctagagggcccaaag

SEQ ID NO: 4648177 - DNA, 16 bp, Homo sapiens
gctagcacatgcccta

SEQ ID NO: 4648178 - DNA, 19 bp, Homo sapiens
gctagccctgccctccacc

SEQ ID NO: 4648179 - DNA, 17 bp, Homo sapiens
gctaggagcaaagcctg

SEQ ID NO: 4648180 - DNA, 21 bp, Homo sapiens
gctaggccccagaggccctgg

SEQ ID NO: 4648181 - DNA, 22 bp, Homo sapiens
gctaggccccagaggccctgga

SEQ ID NO: 4648182 - DNA, 14 bp, Homo sapiens
gctagggaggacca

SEQ ID NO: 4648183 - DNA, 19 bp, Homo sapiens
gctagtcgcccctcagagc

SEQ ID NO: 4648184 - DNA, 14 bp, Homo sapiens
gctatcacctagca

SEQ ID NO: 4648185 - DNA, 17 bp, Homo sapiens
gctatccatttctcatg

SEQ ID NO: 4648186 - DNA, 20 bp, Homo sapiens
gctatcctgggacctcccca

SEQ ID NO: 4648187 - DNA, 22 bp, Homo sapiens
gctatggtgagatgcagctgga

SEQ ID NO: 4648188 - DNA, 19 bp, Homo sapiens
gctatgtagtcataataaa

SEQ ID NO: 4648189 - DNA, 20 bp, Homo sapiens
gctatttccttccagccttt

SEQ ID NO: 4648190 - DNA, 22 bp, Homo sapiens
gctatttccttccagccttttt

SEQ ID NO: 4648191 - DNA, 18 bp, Homo sapiens
gctcaacggtctggcagg

SEQ ID NO: 4648192 - DNA, 20 bp, Homo sapiens
gctcaacggtctggcagggc

SEQ ID NO: 4648193 - DNA, 12 bp, Homo sapiens
gctcaagctttc

SEQ ID NO: 4648194 - DNA, 14 bp, Homo sapiens
gctcaataaagatt

SEQ ID NO: 4648195 - DNA, 21 bp, Homo sapiens
gctcacaaggcagcaaggccc

SEQ ID NO: 4648196 - DNA, 20 bp, Homo sapiens
gctcacagtacagcatgtgc

SEQ ID NO: 4648197 - DNA, 21 bp, Homo sapiens
gctcaccgactcacctgcgca

SEQ ID NO: 4648198 - DNA, 21 bp, Homo sapiens
gctcactgcaacctctgcctc

SEQ ID NO: 4648199 - DNA, 23 bp, Homo sapiens
gctcactgcaacctctgcctcct

SEQ ID NO: 4648200 - DNA, 14 bp, Homo sapiens
gctcactgcaatct

SEQ ID NO: 4648201 - DNA, 18 bp, Homo sapiens
gctcactgcaatctctgc

SEQ ID NO: 4648202 - DNA, 23 bp, Homo sapiens
gctcactgcaatctctgcctccc

SEQ ID NO: 4648203 - DNA, 20 bp, Homo sapiens
gctcactttattatccctat

SEQ ID NO: 4648204 - DNA, 15 bp, Homo sapiens
gctcagaataaggca

SEQ ID NO: 4648205 - DNA, 19 bp, Homo sapiens
gctcagaggcgcactgtga

SEQ ID NO: 4648206 - DNA, 15 bp, Homo sapiens
gctcagcagggctgg

SEQ ID NO: 4648207 - DNA, 13 bp, Homo sapiens
gctcagccagcac

SEQ ID NO: 4648208 - DNA, 15 bp, Homo sapiens
gctcagccagcactt

SEQ ID NO: 4648209 - DNA, 16 bp, Homo sapiens
gctcagctctgggcca

SEQ ID NO: 4648210 - DNA, 21 bp, Homo sapiens
gctcagggcctcaggcacccg

SEQ ID NO: 4648211 - DNA, 15 bp, Homo sapiens
gctcaggtccctggg

SEQ ID NO: 4648212 - DNA, 19 bp, Homo sapiens
gctcaggtccctggggcta

SEQ ID NO: 4648213 - DNA, 15 bp, Homo sapiens
gctcagtgaagtaca

SEQ ID NO: 4648214 - DNA, 17 bp, Homo sapiens
gctcagtgcaacctctg

SEQ ID NO: 4648215 - DNA, 20 bp, Homo sapiens
gctcatcccccctgctgccc

SEQ ID NO: 4648216 - DNA, 15 bp, Homo sapiens
gctccaaaccttcac

SEQ ID NO: 4648217 - DNA, 14 bp, Homo sapiens
gctccaccactgtg

SEQ ID NO: 4648218 - DNA, 18 bp, Homo sapiens
gctccagatgcagggcag

SEQ ID NO: 4648219 - DNA, 22 bp, Homo sapiens
gctccagatgcagggcagtcat

SEQ ID NO: 4648220 - DNA, 15 bp, Homo sapiens
gctccaggcctgcag

SEQ ID NO: 4648221 - DNA, 14 bp, Homo sapiens
gctccataaagtac

SEQ ID NO: 4648222 - DNA, 12 bp, Homo sapiens
gctccattcact

SEQ ID NO: 4648223 - DNA, 16 bp, Homo sapiens
gctcccaagcccctga

SEQ ID NO: 4648224 - DNA, 18 bp, Homo sapiens
gctcccaagcccctgacc

SEQ ID NO: 4648225 - DNA, 18 bp, Homo sapiens
gctcccaatggtgcttgg

SEQ ID NO: 4648226 - DNA, 13 bp, Homo sapiens
gctcccacagaac

SEQ ID NO: 4648227 - DNA, 19 bp, Homo sapiens
gctcccacagaacacagca

SEQ ID NO: 4648228 - DNA, 13 bp, Homo sapiens
gctcccaggatct

SEQ ID NO: 4648229 - DNA, 15 bp, Homo sapiens
gctcccaggatctcc

SEQ ID NO: 4648230 - DNA, 20 bp, Homo sapiens
gctccccactctgctctgat

SEQ ID NO: 4648231 - DNA, 12 bp, Homo sapiens
gctcccccaggc

SEQ ID NO: 4648232 - DNA, 14 bp, Homo sapiens
gctcccccaggcag

SEQ ID NO: 4648233 - DNA, 22 bp, Homo sapiens
gctcccccaggcagaaatagtt

SEQ ID NO: 4648234 - DNA, 21 bp, Homo sapiens
gctcccgcctgtaatcccagt

SEQ ID NO: 4648235 - DNA, 23 bp, Homo sapiens
gctcccgcctgtaatcccagtac

SEQ ID NO: 4648236 - DNA, 14 bp, Homo sapiens
gctcccgtggcctg

SEQ ID NO: 4648237 - DNA, 13 bp, Homo sapiens
gctccctctctcc

SEQ ID NO: 4648238 - DNA, 16 bp, Homo sapiens
gctccctctctcctgg

SEQ ID NO: 4648239 - DNA, 17 bp, Homo sapiens
gctccctctctcctgga

SEQ ID NO: 4648240 - DNA, 22 bp, Homo sapiens
gctccctgtgtccacctgtggg

SEQ ID NO: 4648241 - DNA, 16 bp, Homo sapiens
gctcctgatcagaggc

SEQ ID NO: 4648242 - DNA, 17 bp, Homo sapiens
gctcctgatcagaggca

SEQ ID NO: 4648243 - DNA, 18 bp, Homo sapiens
gctcctgatcagaggcat

SEQ ID NO: 4648244 - DNA, 13 bp, Homo sapiens
gctcctgcttctc

SEQ ID NO: 4648245 - DNA, 16 bp, Homo sapiens
gctcctgcttctcctg

SEQ ID NO: 4648246 - DNA, 20 bp, Homo sapiens
gctcctgcttctcctgatcc

SEQ ID NO: 4648247 - DNA, 14 bp, Homo sapiens
gctccttcagttct

SEQ ID NO: 4648248 - DNA, 22 bp, Homo sapiens
gctccttcagttctgcttgctc

SEQ ID NO: 4648249 - DNA, 13 bp, Homo sapiens
gctcgctccctgc

SEQ ID NO: 4648250 - DNA, 16 bp, Homo sapiens
gctcggggtgcacagg

SEQ ID NO: 4648251 - DNA, 13 bp, Homo sapiens
gctctaacgcctg

SEQ ID NO: 4648252 - DNA, 14 bp, Homo sapiens
gctctaacgcctga

SEQ ID NO: 4648253 - DNA, 17 bp, Homo sapiens
gctctaacgcctgagcc

SEQ ID NO: 4648254 - DNA, 18 bp, Homo sapiens
gctctaacgcctgagccc

SEQ ID NO: 4648255 - DNA, 23 bp, Homo sapiens
gctctagggactgccaggctgtt

SEQ ID NO: 4648256 - DNA, 14 bp, Homo sapiens
gctctagtgggaca

SEQ ID NO: 4648257 - DNA, 20 bp, Homo sapiens
gctctatgttagtataagct

SEQ ID NO: 4648258 - DNA, 13 bp, Homo sapiens
gctctcaatttta

SEQ ID NO: 4648259 - DNA, 23 bp, Homo sapiens
gctctcctggcttcccatcccca

SEQ ID NO: 4648260 - DNA, 18 bp, Homo sapiens
gctctctaggcctctcca

SEQ ID NO: 4648261 - DNA, 18 bp, Homo sapiens
gctctctgagtcctggcc

SEQ ID NO: 4648262 - DNA, 21 bp, Homo sapiens
gctctgaaatcaactctcttc

SEQ ID NO: 4648263 - DNA, 15 bp, Homo sapiens
gctctgagaggccct

SEQ ID NO: 4648264 - DNA, 16 bp, Homo sapiens
gctctgagaggccctg

SEQ ID NO: 4648265 - DNA, 23 bp, Homo sapiens
gctctgagaggccctggatcagc

SEQ ID NO: 4648266 - DNA, 20 bp, Homo sapiens
gctctgaggcgccccaaccc

SEQ ID NO: 4648267 - DNA, 19 bp, Homo sapiens
gctctgatgcatcagaaag

SEQ ID NO: 4648268 - DNA, 13 bp, Homo sapiens
gctctgcacagac

SEQ ID NO: 4648269 - DNA, 18 bp, Homo sapiens
gctctgcagcattgaagt

SEQ ID NO: 4648270 - DNA, 10 bp, Homo sapiens
gctctgccca

SEQ ID NO: 4648271 - DNA, 13 bp, Homo sapiens
gctctgcccaggc

SEQ ID NO: 4648272 - DNA, 18 bp, Homo sapiens
gctctgcccaggcaagga

SEQ ID NO: 4648273 - DNA, 16 bp, Homo sapiens
gctctgccccaggccc

SEQ ID NO: 4648274 - DNA, 22 bp, Homo sapiens
gctctgccccaggccctactac

SEQ ID NO: 4648275 - DNA, 17 bp, Homo sapiens
gctctgccccttcccca

SEQ ID NO: 4648276 - DNA, 20 bp, Homo sapiens
gctctgccgccgcccgctgg

SEQ ID NO: 4648277 - DNA, 23 bp, Homo sapiens
gctctggaactgattgctcccag

SEQ ID NO: 4648278 - DNA, 24 bp, Homo sapiens
gctctggaactgattgctcccagg

SEQ ID NO: 4648279 - DNA, 12 bp, Homo sapiens
gctctggactcc

SEQ ID NO: 4648280 - DNA, 13 bp, Homo sapiens
gctctggactcca

SEQ ID NO: 4648281 - DNA, 17 bp, Homo sapiens
gctctgggtgctgccct

SEQ ID NO: 4648282 - DNA, 16 bp, Homo sapiens
gctcttcccttgctca

SEQ ID NO: 4648283 - DNA, 21 bp, Homo sapiens
gctcttcccttgctcatgagc

SEQ ID NO: 4648284 - DNA, 21 bp, Homo sapiens
gctcttgaaatattcagaaat

SEQ ID NO: 4648285 - DNA, 22 bp, Homo sapiens
gctcttgaaatattcagaaatt

SEQ ID NO: 4648286 - DNA, 12 bp, Homo sapiens
gctcttggggaa

SEQ ID NO: 4648287 - DNA, 13 bp, Homo sapiens
gctctttccaaat

SEQ ID NO: 4648288 - DNA, 16 bp, Homo sapiens
gctctttccaaattaa

SEQ ID NO: 4648289 - DNA, 17 bp, Homo sapiens
gctctttccaaattaaa

SEQ ID NO: 4648290 - DNA, 22 bp, Homo sapiens
gctgaaaagggcactcccaacc

SEQ ID NO: 4648291 - DNA, 10 bp, Homo sapiens
gctgaaagca

SEQ ID NO: 4648292 - DNA, 17 bp, Homo sapiens
gctgaagagagggacag

SEQ ID NO: 4648293 - DNA, 12 bp, Homo sapiens
gctgaaggcagt

SEQ ID NO: 4648294 - DNA, 13 bp, Homo sapiens
gctgaatgcctcc

SEQ ID NO: 4648295 - DNA, 14 bp, Homo sapiens
gctgaatgcctcct

SEQ ID NO: 4648296 - DNA, 15 bp, Homo sapiens
gctgaatgcctcgct

SEQ ID NO: 4648297 - DNA, 19 bp, Homo sapiens
gctgaccacagcacagcca

SEQ ID NO: 4648298 - DNA, 18 bp, Homo sapiens
gctgactctccagggagc

SEQ ID NO: 4648299 - DNA, 16 bp, Homo sapiens
gctgagaacctggcct

SEQ ID NO: 4648300 - DNA, 23 bp, Homo sapiens
gctgagacgccacggagggctgg

SEQ ID NO: 4648301 - DNA, 20 bp, Homo sapiens
gctgagcacttagcaggcac

SEQ ID NO: 4648302 - DNA, 16 bp, Homo sapiens
gctgagcagggccggg

SEQ ID NO: 4648303 - DNA, 22 bp, Homo sapiens
gctgagctcacaaggcagcaag

SEQ ID NO: 4648304 - DNA, 17 bp, Homo sapiens
gctgagctctgagaggc

SEQ ID NO: 4648305 - DNA, 19 bp, Homo sapiens
gctgagctctgagaggccc

SEQ ID NO: 4648306 - DNA, 23 bp, Homo sapiens
gctgagctctgagaggccctgga

SEQ ID NO: 4648307 - DNA, 14 bp, Homo sapiens
gctgagctggcttc

SEQ ID NO: 4648308 - DNA, 21 bp, Homo sapiens
gctgaggccacactcagcaca

SEQ ID NO: 4648309 - DNA, 16 bp, Homo sapiens
gctgaggctggcacag

SEQ ID NO: 4648310 - DNA, 12 bp, Homo sapiens
gctgagggcagt

SEQ ID NO: 4648311 - DNA, 13 bp, Homo sapiens
gctgaggtgagaa

SEQ ID NO: 4648312 - DNA, 15 bp, Homo sapiens
gctgaggtgagaaga

SEQ ID NO: 4648313 - DNA, 15 bp, Homo sapiens
gctgagtgagtggga

SEQ ID NO: 4648314 - DNA, 21 bp, Homo sapiens
gctgagttgttgagtctgttt

SEQ ID NO: 4648315 - DNA, 19 bp, Homo sapiens
gctgattcctctcatttcc

SEQ ID NO: 4648316 - DNA, 16 bp, Homo sapiens
gctgcaaaattaaatc

SEQ ID NO: 4648317 - DNA, 15 bp, Homo sapiens
gctgcaaaggagaag

SEQ ID NO: 4648318 - DNA, 16 bp, Homo sapiens
gctgcacaccaaggcc

SEQ ID NO: 4648319 - DNA, 18 bp, Homo sapiens
gctgcacaccaaggccct

SEQ ID NO: 4648320 - DNA, 21 bp, Homo sapiens
gctgcacaccaaggccctgca

SEQ ID NO: 4648321 - DNA, 11 bp, Homo sapiens
gctgcactgtg

SEQ ID NO: 4648322 - DNA, 15 bp, Homo sapiens
gctgcagtgagccat

SEQ ID NO: 4648323 - DNA, 19 bp, Homo sapiens
gctgcagttggtctccctg

SEQ ID NO: 4648324 - DNA, 13 bp, Homo sapiens
gctgcattttata

SEQ ID NO: 4648325 - DNA, 19 bp, Homo sapiens
gctgccagcctgaggtgcc

SEQ ID NO: 4648326 - DNA, 22 bp, Homo sapiens
gctgccatctcacctcctgctg

SEQ ID NO: 4648327 - DNA, 21 bp, Homo sapiens
gctgcccatcatgtggcccca

SEQ ID NO: 4648328 - DNA, 23 bp, Homo sapiens
gctgcccctctctgggcctcaga

SEQ ID NO: 4648329 - DNA, 12 bp, Homo sapiens
gctgccctgaga

SEQ ID NO: 4648330 - DNA, 16 bp, Homo sapiens
gctgcctggatgagaa

SEQ ID NO: 4648331 - DNA, 16 bp, Homo sapiens
gctgcggagcaagagg

SEQ ID NO: 4648332 - DNA, 13 bp, Homo sapiens
gctgcgggggcag

SEQ ID NO: 4648333 - DNA, 17 bp, Homo sapiens
gctgcgtcattacaggg

SEQ ID NO: 4648334 - DNA, 17 bp, Homo sapiens
gctgctctaagcccagg

SEQ ID NO: 4648335 - DNA, 21 bp, Homo sapiens
gctgctctaagcccaggatct

SEQ ID NO: 4648336 - DNA, 23 bp, Homo sapiens
gctgctctaagcccaggatctct

SEQ ID NO: 4648337 - DNA, 20 bp, Homo sapiens
gctgctgagaacctggcctt

SEQ ID NO: 4648338 - DNA, 21 bp, Homo sapiens
gctgctgagaacctggccttc

SEQ ID NO: 4648339 - DNA, 13 bp, Homo sapiens
gctgctgcacacc

SEQ ID NO: 4648340 - DNA, 14 bp, Homo sapiens
gctgctgcacacca

SEQ ID NO: 4648341 - DNA, 12 bp, Homo sapiens
gctgctggcccc

SEQ ID NO: 4648342 - DNA, 22 bp, Homo sapiens
gctgctggccccgcccctgccc

SEQ ID NO: 4648343 - DNA, 19 bp, Homo sapiens
gctgctgtgcagcatggaa

SEQ ID NO: 4648344 - DNA, 21 bp, Homo sapiens
gctgctgtgccccaccacgtc

SEQ ID NO: 4648345 - DNA, 14 bp, Homo sapiens
gctgcttcctgtga

SEQ ID NO: 4648346 - DNA, 14 bp, Homo sapiens
gctggaaggggcca

SEQ ID NO: 4648347 - DNA, 12 bp, Homo sapiens
gctggagaaaga

SEQ ID NO: 4648348 - DNA, 17 bp, Homo sapiens
gctggagaaagagctgc

SEQ ID NO: 4648349 - DNA, 15 bp, Homo sapiens
gctggagtgcagtgg

SEQ ID NO: 4648350 - DNA, 14 bp, Homo sapiens
gctggattctatct

SEQ ID NO: 4648351 - DNA, 17 bp, Homo sapiens
gctggcccgtgacagac

SEQ ID NO: 4648352 - DNA, 22 bp, Homo sapiens
gctggcccgtgacagactcctg

SEQ ID NO: 4648353 - DNA, 22 bp, Homo sapiens
gctggccggagcaaactctgct

SEQ ID NO: 4648354 - DNA, 21 bp, Homo sapiens
gctggcctcccaaatgagcca

SEQ ID NO: 4648355 - DNA, 16 bp, Homo sapiens
gctggctcacagtaca

SEQ ID NO: 4648356 - DNA, 18 bp, Homo sapiens
gctggctcacagtacagc

SEQ ID NO: 4648357 - DNA, 17 bp, Homo sapiens
gctggctcccagggcca

SEQ ID NO: 4648358 - DNA, 19 bp, Homo sapiens
gctggctctgtgagggtgc

SEQ ID NO: 4648359 - DNA, 17 bp, Homo sapiens
gctgggccactggggac

SEQ ID NO: 4648360 - DNA, 19 bp, Homo sapiens
gctgggccctctttccctg

SEQ ID NO: 4648361 - DNA, 13 bp, Homo sapiens
gctgggcctgggg

SEQ ID NO: 4648362 - DNA, 13 bp, Homo sapiens
gctggggacagag

SEQ ID NO: 4648363 - DNA, 16 bp, Homo sapiens
gctggggacagagggt

SEQ ID NO: 4648364 - DNA, 14 bp, Homo sapiens
gctggggactcagg

SEQ ID NO: 4648365 - DNA, 15 bp, Homo sapiens
gctggggactcaggg

SEQ ID NO: 4648366 - DNA, 17 bp, Homo sapiens
gctggggactcagggac

SEQ ID NO: 4648367 - DNA, 16 bp, Homo sapiens
gctggggaggaggaga

SEQ ID NO: 4648368 - DNA, 19 bp, Homo sapiens
gctggggaggaggagagag

SEQ ID NO: 4648369 - DNA, 16 bp, Homo sapiens
gctggggatgcgcctg

SEQ ID NO: 4648370 - DNA, 15 bp, Homo sapiens
gctggggccaggccc

SEQ ID NO: 4648371 - DNA, 16 bp, Homo sapiens
gctggggccaggcccc

SEQ ID NO: 4648372 - DNA, 18 bp, Homo sapiens
gctggggccgccacggcc

SEQ ID NO: 4648373 - DNA, 20 bp, Homo sapiens
gctgggggaatgagcccaga

SEQ ID NO: 4648374 - DNA, 13 bp, Homo sapiens
gctgggtcaggca

SEQ ID NO: 4648375 - DNA, 14 bp, Homo sapiens
gctgggtcaggcag

SEQ ID NO: 4648376 - DNA, 14 bp, Homo sapiens
gctggtacctgccc

SEQ ID NO: 4648377 - DNA, 17 bp, Homo sapiens
gctggtcacctcccatc

SEQ ID NO: 4648378 - DNA, 17 bp, Homo sapiens
gctggtcctgaccagga

SEQ ID NO: 4648379 - DNA, 19 bp, Homo sapiens
gctggtcctgaccaggatg

SEQ ID NO: 4648380 - DNA, 12 bp, Homo sapiens
gctggtgggaag

SEQ ID NO: 4648381 - DNA, 21 bp, Homo sapiens
gctggtgggaaggccggcagc

SEQ ID NO: 4648382 - DNA, 12 bp, Homo sapiens
gctggttctgta

SEQ ID NO: 4648383 - DNA, 14 bp, Homo sapiens
gctggttgtcttta

SEQ ID NO: 4648384 - DNA, 18 bp, Homo sapiens
gctggtttcaaactcctg

SEQ ID NO: 4648385 - DNA, 15 bp, Homo sapiens
gctggtttttcagtt

SEQ ID NO: 4648386 - DNA, 22 bp, Homo sapiens
gctgtaaatttggcttctgttg

SEQ ID NO: 4648387 - DNA, 16 bp, Homo sapiens
gctgtaacgtggcact

SEQ ID NO: 4648388 - DNA, 13 bp, Homo sapiens
gctgtaagggcag

SEQ ID NO: 4648389 - DNA, 16 bp, Homo sapiens
gctgtaagggcagtgc

SEQ ID NO: 4648390 - DNA, 19 bp, Homo sapiens
gctgtaagggcagtgccca

SEQ ID NO: 4648391 - DNA, 15 bp, Homo sapiens
gctgtaatcatttgt

SEQ ID NO: 4648392 - DNA, 20 bp, Homo sapiens
gctgtagctacaagggaagc

SEQ ID NO: 4648393 - DNA, 18 bp, Homo sapiens
gctgtatgacccctggcc

SEQ ID NO: 4648394 - DNA, 22 bp, Homo sapiens
gctgtattttgagtttcagctg

SEQ ID NO: 4648395 - DNA, 22 bp, Homo sapiens
gctgtcacctcgctgggctcta

SEQ ID NO: 4648396 - DNA, 14 bp, Homo sapiens
gctgtcatctgtgc

SEQ ID NO: 4648397 - DNA, 15 bp, Homo sapiens
gctgtccccactgcc

SEQ ID NO: 4648398 - DNA, 14 bp, Homo sapiens
gctgtccctgcagg

SEQ ID NO: 4648399 - DNA, 15 bp, Homo sapiens
gctgtccctgcaggg

SEQ ID NO: 4648400 - DNA, 15 bp, Homo sapiens
gctgtcctggagggg

SEQ ID NO: 4648401 - DNA, 21 bp, Homo sapiens
gctgtctgaagcccaaagcct

SEQ ID NO: 4648402 - DNA, 18 bp, Homo sapiens
gctgtgacctgctgagct

SEQ ID NO: 4648403 - DNA, 19 bp, Homo sapiens
gctgtgacctgctgagctc

SEQ ID NO: 4648404 - DNA, 22 bp, Homo sapiens
gctgtgacctgctgagctctga

SEQ ID NO: 4648405 - DNA, 15 bp, Homo sapiens
gctgtgagacagtgg

SEQ ID NO: 4648406 - DNA, 18 bp, Homo sapiens
gctgtgcacaaagtggca

SEQ ID NO: 4648407 - DNA, 19 bp, Homo sapiens
gctgtgcacaaagtggcat

SEQ ID NO: 4648408 - DNA, 15 bp, Homo sapiens
gctgtgccatgctgg

SEQ ID NO: 4648409 - DNA, 23 bp, Homo sapiens
gctgtgcctcgctccccactctg

SEQ ID NO: 4648410 - DNA, 17 bp, Homo sapiens
gctgtgctacgtgtgaa

SEQ ID NO: 4648411 - DNA, 18 bp, Homo sapiens
gctgtgctacgtgtgaaa

SEQ ID NO: 4648412 - DNA, 19 bp, Homo sapiens
gctgtgctacgtgtgaaat

SEQ ID NO: 4648413 - DNA, 23 bp, Homo sapiens
gctgtgctacgtgtgaaatctgt

SEQ ID NO: 4648414 - DNA, 18 bp, Homo sapiens
gctgtgctccatatttga

SEQ ID NO: 4648415 - DNA, 18 bp, Homo sapiens
gctgtgggcaagcctaag

SEQ ID NO: 4648416 - DNA, 19 bp, Homo sapiens
gctgtgtagttccctctgc

SEQ ID NO: 4648417 - DNA, 22 bp, Homo sapiens
gctgtgtagttccctctgcctg

SEQ ID NO: 4648418 - DNA, 18 bp, Homo sapiens
gctgtgtttgcagcctgc

SEQ ID NO: 4648419 - DNA, 13 bp, Homo sapiens
gctgtttgaaatg

SEQ ID NO: 4648420 - DNA, 16 bp, Homo sapiens
gcttacaactttctaa

SEQ ID NO: 4648421 - DNA, 17 bp, Homo sapiens
gcttacggccctggcct

SEQ ID NO: 4648422 - DNA, 16 bp, Homo sapiens
gcttactctctgcttc

SEQ ID NO: 4648423 - DNA, 15 bp, Homo sapiens
gcttagaggttctgc

SEQ ID NO: 4648424 - DNA, 19 bp, Homo sapiens
gcttatttctatgacaaat

SEQ ID NO: 4648425 - DNA, 22 bp, Homo sapiens
gcttcacctctgggaccccagc

SEQ ID NO: 4648426 - DNA, 13 bp, Homo sapiens
gcttcatttcaat

SEQ ID NO: 4648427 - DNA, 22 bp, Homo sapiens
gcttccaaggggcaaattttta

SEQ ID NO: 4648428 - DNA, 16 bp, Homo sapiens
gcttccacctcacccc

SEQ ID NO: 4648429 - DNA, 17 bp, Homo sapiens
gcttccacctcacccca

SEQ ID NO: 4648430 - DNA, 18 bp, Homo sapiens
gcttccctacacagggcc

SEQ ID NO: 4648431 - DNA, 20 bp, Homo sapiens
gcttccctacacagggcctg

SEQ ID NO: 4648432 - DNA, 14 bp, Homo sapiens
gcttccgagacacc

SEQ ID NO: 4648433 - DNA, 14 bp, Homo sapiens
gcttcctcttcttg

SEQ ID NO: 4648434 - DNA, 15 bp, Homo sapiens
gcttccttggttcat

SEQ ID NO: 4648435 - DNA, 23 bp, Homo sapiens
gcttcctttcctgtgtgtactct

SEQ ID NO: 4648436 - DNA, 23 bp, Homo sapiens
gcttctatcagactcagtttttt

SEQ ID NO: 4648437 - DNA, 19 bp, Homo sapiens
gcttctcagtttctgcctg

SEQ ID NO: 4648438 - DNA, 16 bp, Homo sapiens
gcttctcgacccacgc

SEQ ID NO: 4648439 - DNA, 21 bp, Homo sapiens
gcttctctagctctctaggcc

SEQ ID NO: 4648440 - DNA, 22 bp, Homo sapiens
gcttctctagctctctaggcct

SEQ ID NO: 4648441 - DNA, 12 bp, Homo sapiens
gcttctctctca

SEQ ID NO: 4648442 - DNA, 13 bp, Homo sapiens
gcttctctctcac

SEQ ID NO: 4648443 - DNA, 15 bp, Homo sapiens
gcttgagccaggagg

SEQ ID NO: 4648444 - DNA, 11 bp, Homo sapiens
gcttgcctgtt

SEQ ID NO: 4648445 - DNA, 14 bp, Homo sapiens
gcttgctcccaagc

SEQ ID NO: 4648446 - DNA, 15 bp, Homo sapiens
gcttggaagccaggt

SEQ ID NO: 4648447 - DNA, 12 bp, Homo sapiens
gcttggaggagg

SEQ ID NO: 4648448 - DNA, 12 bp, Homo sapiens
gcttggcccagc

SEQ ID NO: 4648449 - DNA, 16 bp, Homo sapiens
gcttgggctgacccag

SEQ ID NO: 4648450 - DNA, 17 bp, Homo sapiens
gcttgggctgacccagc

SEQ ID NO: 4648451 - DNA, 13 bp, Homo sapiens
gcttgtaaatatg

SEQ ID NO: 4648452 - DNA, 24 bp, Homo sapiens
gcttgtaaatatggggatagtctg

SEQ ID NO: 4648453 - DNA, 14 bp, Homo sapiens
gctttataaacttt

SEQ ID NO: 4648454 - DNA, 16 bp, Homo sapiens
gctttatgcaaataca

SEQ ID NO: 4648455 - DNA, 16 bp, Homo sapiens
gctttcaattccgtag

SEQ ID NO: 4648456 - DNA, 17 bp, Homo sapiens
gctttccaaggaagcag

SEQ ID NO: 4648457 - DNA, 21 bp, Homo sapiens
gctttcccgcccagcctcact

SEQ ID NO: 4648458 - DNA, 14 bp, Homo sapiens
gctttcctgtttct

SEQ ID NO: 4648459 - DNA, 17 bp, Homo sapiens
gctttccttttttaaaa

SEQ ID NO: 4648460 - DNA, 17 bp, Homo sapiens
gctttctacgccaatgt

SEQ ID NO: 4648461 - DNA, 13 bp, Homo sapiens
gctttctttagaa

SEQ ID NO: 4648462 - DNA, 23 bp, Homo sapiens
gctttctttagaatttttaccca

SEQ ID NO: 4648463 - DNA, 15 bp, Homo sapiens
gctttgaaagaagca

SEQ ID NO: 4648464 - DNA, 20 bp, Homo sapiens
gctttgaaagaagcaagaca

SEQ ID NO: 4648465 - DNA, 14 bp, Homo sapiens
gctttgtgcctttg

SEQ ID NO: 4648466 - DNA, 16 bp, Homo sapiens
gcttttatttggtgtg

SEQ ID NO: 4648467 - DNA, 12 bp, Homo sapiens
gcttttcctctg

SEQ ID NO: 4648468 - DNA, 12 bp, Homo sapiens
gcttttcttgat

SEQ ID NO: 4648469 - DNA, 23 bp, Homo sapiens
gcttttggtatttgtttgtagct

SEQ ID NO: 4648470 - DNA, 13 bp, Homo sapiens
gctttttcatcct

SEQ ID NO: 4648471 - DNA, 15 bp, Homo sapiens
gctttttcatccttc

SEQ ID NO: 4648472 - DNA, 20 bp, Homo sapiens
gctttttctccccttcacgt

SEQ ID NO: 4648473 - DNA, 23 bp, Homo sapiens
ggaaaaaaaaaaaaagaaattcg

SEQ ID NO: 4648474 - DNA, 15 bp, Homo sapiens
ggaaaaatgagtaat

SEQ ID NO: 4648475 - DNA, 22 bp, Homo sapiens
ggaaaaccagactacttgggag

SEQ ID NO: 4648476 - DNA, 14 bp, Homo sapiens
ggaaaactgtgttg

SEQ ID NO: 4648477 - DNA, 18 bp, Homo sapiens
ggaaaattctaacccagg

SEQ ID NO: 4648478 - DNA, 15 bp, Homo sapiens
ggaaagaagggggcc

SEQ ID NO: 4648479 - DNA, 11 bp, Homo sapiens
ggaaaggagga

SEQ ID NO: 4648480 - DNA, 15 bp, Homo sapiens
ggaaaggaggaccag

SEQ ID NO: 4648481 - DNA, 15 bp, Homo sapiens
ggaaataacagagag

SEQ ID NO: 4648482 - DNA, 17 bp, Homo sapiens
ggaaataacagagagaa

SEQ ID NO: 4648483 - DNA, 17 bp, Homo sapiens
ggaaatatttagcaaat

SEQ ID NO: 4648484 - DNA, 20 bp, Homo sapiens
ggaaatatttagcaaataat

SEQ ID NO: 4648485 - DNA, 18 bp, Homo sapiens
ggaaatctgtaaagccag

SEQ ID NO: 4648486 - DNA, 15 bp, Homo sapiens
ggaaatgctgggctg

SEQ ID NO: 4648487 - DNA, 15 bp, Homo sapiens
ggaaatgtacacttt

SEQ ID NO: 4648488 - DNA, 20 bp, Homo sapiens
ggaaattgtaaatcctgtgt

SEQ ID NO: 4648489 - DNA, 12 bp, Homo sapiens
ggaacagaagtg

SEQ ID NO: 4648490 - DNA, 13 bp, Homo sapiens
ggaaccactccca

SEQ ID NO: 4648491 - DNA, 22 bp, Homo sapiens
ggaaccactcccaccacaggca

SEQ ID NO: 4648492 - DNA, 17 bp, Homo sapiens
ggaactgaacattccag

SEQ ID NO: 4648493 - DNA, 22 bp, Homo sapiens
ggaactggccaagctgaggtgc

SEQ ID NO: 4648494 - DNA, 20 bp, Homo sapiens
ggaactttctgttccctatg

SEQ ID NO: 4648495 - DNA, 22 bp, Homo sapiens
ggaactttctgttccctatgga

SEQ ID NO: 4648496 - DNA, 15 bp, Homo sapiens
ggaagacgcagagca

SEQ ID NO: 4648497 - DNA, 13 bp, Homo sapiens
ggaagagccacct

SEQ ID NO: 4648498 - DNA, 14 bp, Homo sapiens
ggaagagccacctg

SEQ ID NO: 4648499 - DNA, 19 bp, Homo sapiens
ggaagagccacctgcaaga

SEQ ID NO: 4648500 - DNA, 17 bp, Homo sapiens
ggaagagccgagcacct

SEQ ID NO: 4648501 - DNA, 18 bp, Homo sapiens
ggaagagccgagcacctg

SEQ ID NO: 4648502 - DNA, 21 bp, Homo sapiens
ggaagcccccaccgtgggcag

SEQ ID NO: 4648503 - DNA, 13 bp, Homo sapiens
ggaagcccctggg

SEQ ID NO: 4648504 - DNA, 18 bp, Homo sapiens
ggaagcccctgggcccag

SEQ ID NO: 4648505 - DNA, 19 bp, Homo sapiens
ggaagcccctgggcccagt

SEQ ID NO: 4648506 - DNA, 16 bp, Homo sapiens
ggaagctgctgaggcc

SEQ ID NO: 4648507 - DNA, 13 bp, Homo sapiens
ggaaggagacagg

SEQ ID NO: 4648508 - DNA, 21 bp, Homo sapiens
ggaaggagacaggatgaggtc

SEQ ID NO: 4648509 - DNA, 13 bp, Homo sapiens
ggaaggagggcac

SEQ ID NO: 4648510 - DNA, 13 bp, Homo sapiens
ggaaggcagacag

SEQ ID NO: 4648511 - DNA, 18 bp, Homo sapiens
ggaaggcagacagcaggc

SEQ ID NO: 4648512 - DNA, 17 bp, Homo sapiens
ggaaggcaggcagggct

SEQ ID NO: 4648513 - DNA, 18 bp, Homo sapiens
ggaaggcaggcagggctc

SEQ ID NO: 4648514 - DNA, 21 bp, Homo sapiens
ggaaggcaggcagggctctcc

SEQ ID NO: 4648515 - DNA, 17 bp, Homo sapiens
ggaaggcctgagcccct

SEQ ID NO: 4648516 - DNA, 22 bp, Homo sapiens
ggaaggctacttcggggctggg

SEQ ID NO: 4648517 - DNA, 20 bp, Homo sapiens
ggaaggggctatcctgggac

SEQ ID NO: 4648518 - DNA, 14 bp, Homo sapiens
ggaaggtgatgggt

SEQ ID NO: 4648519 - DNA, 19 bp, Homo sapiens
ggaaggtgggcgggcaggg

SEQ ID NO: 4648520 - DNA, 16 bp, Homo sapiens
ggaagtaacagacaca

SEQ ID NO: 4648521 - DNA, 14 bp, Homo sapiens
ggaagtgaggaagc

SEQ ID NO: 4648522 - DNA, 16 bp, Homo sapiens
ggaagtgaggaagcca

SEQ ID NO: 4648523 - DNA, 17 bp, Homo sapiens
ggaataaagttgcagat

SEQ ID NO: 4648524 - DNA, 21 bp, Homo sapiens
ggaataaagttgcagatgatt

SEQ ID NO: 4648525 - DNA, 18 bp, Homo sapiens
ggaatacattttattctg

SEQ ID NO: 4648526 - DNA, 14 bp, Homo sapiens
ggaatataagaaaa

SEQ ID NO: 4648527 - DNA, 14 bp, Homo sapiens
ggaatatttgaata

SEQ ID NO: 4648528 - DNA, 22 bp, Homo sapiens
ggaatcattaatttcaaaattt

SEQ ID NO: 4648529 - DNA, 23 bp, Homo sapiens
ggaatcattaatttcaaaattta

SEQ ID NO: 4648530 - DNA, 12 bp, Homo sapiens
ggaatcattttt

SEQ ID NO: 4648531 - DNA, 14 bp, Homo sapiens
ggaatcatttttgt

SEQ ID NO: 4648532 - DNA, 20 bp, Homo sapiens
ggaatgaaattaacacaaag

SEQ ID NO: 4648533 - DNA, 13 bp, Homo sapiens
ggaatgagcccag

SEQ ID NO: 4648534 - DNA, 17 bp, Homo sapiens
ggaatgagcccagagaa

SEQ ID NO: 4648535 - DNA, 20 bp, Homo sapiens
ggaatgagcccagagaacag

SEQ ID NO: 4648536 - DNA, 15 bp, Homo sapiens
ggaatgagtgtgcat

SEQ ID NO: 4648537 - DNA, 19 bp, Homo sapiens
ggaatggaggagccaggcc

SEQ ID NO: 4648538 - DNA, 22 bp, Homo sapiens
ggaattaagttatctttaaaat

SEQ ID NO: 4648539 - DNA, 14 bp, Homo sapiens
ggaattcagtgcct

SEQ ID NO: 4648540 - DNA, 14 bp, Homo sapiens
ggacaaaacttctt

SEQ ID NO: 4648541 - DNA, 17 bp, Homo sapiens
ggacaaaggagcctgtg

SEQ ID NO: 4648542 - DNA, 16 bp, Homo sapiens
ggacaaataagttttt

SEQ ID NO: 4648543 - DNA, 15 bp, Homo sapiens
ggacaaccagaaggc

SEQ ID NO: 4648544 - DNA, 22 bp, Homo sapiens
ggacaaccagaaggcccttaac

SEQ ID NO: 4648545 - DNA, 13 bp, Homo sapiens
ggacaagcaggcc

SEQ ID NO: 4648546 - DNA, 20 bp, Homo sapiens
ggacaagtggactcagggca

SEQ ID NO: 4648547 - DNA, 16 bp, Homo sapiens
ggacacaggcctgtgt

SEQ ID NO: 4648548 - DNA, 20 bp, Homo sapiens
ggacactcgtcaccccagcc

SEQ ID NO: 4648549 - DNA, 23 bp, Homo sapiens
ggacactcgtcaccccagccctc

SEQ ID NO: 4648550 - DNA, 15 bp, Homo sapiens
ggacactttgttaga

SEQ ID NO: 4648551 - DNA, 19 bp, Homo sapiens
ggacactttgttagaaagt

SEQ ID NO: 4648552 - DNA, 14 bp, Homo sapiens
ggacagaaaatgca

SEQ ID NO: 4648553 - DNA, 20 bp, Homo sapiens
ggacagacgagacaacagca

SEQ ID NO: 4648554 - DNA, 21 bp, Homo sapiens
ggacagagcaagaccctgcct

SEQ ID NO: 4648555 - DNA, 11 bp, Homo sapiens
ggacagctgtc

SEQ ID NO: 4648556 - DNA, 13 bp, Homo sapiens
ggacagctgtcct

SEQ ID NO: 4648557 - DNA, 15 bp, Homo sapiens
ggacagctgtgcctc

SEQ ID NO: 4648558 - DNA, 17 bp, Homo sapiens
ggacaggaccctcagga

SEQ ID NO: 4648559 - DNA, 17 bp, Homo sapiens
ggacaggagaagagagg

SEQ ID NO: 4648560 - DNA, 15 bp, Homo sapiens
ggacaggctgaagag

SEQ ID NO: 4648561 - DNA, 23 bp, Homo sapiens
ggacaggctgaagagagggacag

SEQ ID NO: 4648562 - DNA, 13 bp, Homo sapiens
ggacagtggcagg

SEQ ID NO: 4648563 - DNA, 16 bp, Homo sapiens
ggacagtggcaggaca

SEQ ID NO: 4648564 - DNA, 17 bp, Homo sapiens
ggacagtggcaggacag

SEQ ID NO: 4648565 - DNA, 17 bp, Homo sapiens
ggacataaaatttaaaa

SEQ ID NO: 4648566 - DNA, 15 bp, Homo sapiens
ggacatagagaggga

SEQ ID NO: 4648567 - DNA, 20 bp, Homo sapiens
ggacatagagagggagaaga

SEQ ID NO: 4648568 - DNA, 22 bp, Homo sapiens
ggacatagagagggagaagaag

SEQ ID NO: 4648569 - DNA, 20 bp, Homo sapiens
ggacatgagatcagggcctg

SEQ ID NO: 4648570 - DNA, 13 bp, Homo sapiens
ggacattctaatg

SEQ ID NO: 4648571 - DNA, 16 bp, Homo sapiens
ggacattctaatgcat

SEQ ID NO: 4648572 - DNA, 23 bp, Homo sapiens
ggaccacctcctctgccagcagg

SEQ ID NO: 4648573 - DNA, 13 bp, Homo sapiens
ggacccacctgct

SEQ ID NO: 4648574 - DNA, 11 bp, Homo sapiens
ggaccccagct

SEQ ID NO: 4648575 - DNA, 13 bp, Homo sapiens
ggaccccagctgc

SEQ ID NO: 4648576 - DNA, 13 bp, Homo sapiens
ggaccctgtccaa

SEQ ID NO: 4648577 - DNA, 21 bp, Homo sapiens
ggaccgctacaccactctggc

SEQ ID NO: 4648578 - DNA, 15 bp, Homo sapiens
ggaccggtgctgcag

SEQ ID NO: 4648579 - DNA, 15 bp, Homo sapiens
ggacctccccagccc

SEQ ID NO: 4648580 - DNA, 12 bp, Homo sapiens
ggacctgagcct

SEQ ID NO: 4648581 - DNA, 14 bp, Homo sapiens
ggacctgagcctgc

SEQ ID NO: 4648582 - DNA, 15 bp, Homo sapiens
ggacctgagcctgcc

SEQ ID NO: 4648583 - DNA, 14 bp, Homo sapiens
ggacctggctgcca

SEQ ID NO: 4648584 - DNA, 19 bp, Homo sapiens
ggacctgggacaagcaggc

SEQ ID NO: 4648585 - DNA, 19 bp, Homo sapiens
ggaccttaaaatgtgtaca

SEQ ID NO: 4648586 - DNA, 20 bp, Homo sapiens
ggactaacactcagaagcct

SEQ ID NO: 4648587 - DNA, 23 bp, Homo sapiens
ggactaacactcagaagcctggg

SEQ ID NO: 4648588 - DNA, 13 bp, Homo sapiens
ggactagccagaa

SEQ ID NO: 4648589 - DNA, 17 bp, Homo sapiens
ggactagccagaattct

SEQ ID NO: 4648590 - DNA, 22 bp, Homo sapiens
ggactagccagaattctaccct

SEQ ID NO: 4648591 - DNA, 13 bp, Homo sapiens
ggactcagggcag

SEQ ID NO: 4648592 - DNA, 15 bp, Homo sapiens
ggactcagggcagcg

SEQ ID NO: 4648593 - DNA, 15 bp, Homo sapiens
ggactcatccttgcc

SEQ ID NO: 4648594 - DNA, 21 bp, Homo sapiens
ggactcccaaccctggcttgg

SEQ ID NO: 4648595 - DNA, 20 bp, Homo sapiens
ggactctgaggactcctgag

SEQ ID NO: 4648596 - DNA, 14 bp, Homo sapiens
ggactgagggcagt

SEQ ID NO: 4648597 - DNA, 16 bp, Homo sapiens
ggactgccaggctgtt

SEQ ID NO: 4648598 - DNA, 15 bp, Homo sapiens
ggactggttccttcc

SEQ ID NO: 4648599 - DNA, 20 bp, Homo sapiens
ggactggttccttccttagt

SEQ ID NO: 4648600 - DNA, 14 bp, Homo sapiens
ggactgtcctagcc

SEQ ID NO: 4648601 - DNA, 14 bp, Homo sapiens
ggacttactgcctg

SEQ ID NO: 4648602 - DNA, 15 bp, Homo sapiens
ggacttactgcctga

SEQ ID NO: 4648603 - DNA, 17 bp, Homo sapiens
ggactttatttatttct

SEQ ID NO: 4648604 - DNA, 16 bp, Homo sapiens
ggactttcccacccag

SEQ ID NO: 4648605 - DNA, 23 bp, Homo sapiens
ggactttcccacccaggaaagga

SEQ ID NO: 4648606 - DNA, 13 bp, Homo sapiens
ggagaaagagctg

SEQ ID NO: 4648607 - DNA, 14 bp, Homo sapiens
ggagaaattgacag

SEQ ID NO: 4648608 - DNA, 21 bp, Homo sapiens
ggagaacagtggttgcctggg

SEQ ID NO: 4648609 - DNA, 20 bp, Homo sapiens
ggagaagaaagaggtgaccc

SEQ ID NO: 4648610 - DNA, 18 bp, Homo sapiens
ggagaagcacagctcctg

SEQ ID NO: 4648611 - DNA, 17 bp, Homo sapiens
ggagaatatttactaac

SEQ ID NO: 4648612 - DNA, 13 bp, Homo sapiens
ggagaccctgcaa

SEQ ID NO: 4648613 - DNA, 16 bp, Homo sapiens
ggagaccctgcaaaca

SEQ ID NO: 4648614 - DNA, 23 bp, Homo sapiens
ggagaccctgcaaacagaacagg

SEQ ID NO: 4648615 - DNA, 17 bp, Homo sapiens
ggagacctcagaagtaa

SEQ ID NO: 4648616 - DNA, 19 bp, Homo sapiens
ggagactttacaaaccttt

SEQ ID NO: 4648617 - DNA, 15 bp, Homo sapiens
ggagagagtcccaga

SEQ ID NO: 4648618 - DNA, 22 bp, Homo sapiens
ggagagatccctgcagaaccca

SEQ ID NO: 4648619 - DNA, 11 bp, Homo sapiens
ggagagccctg

SEQ ID NO: 4648620 - DNA, 14 bp, Homo sapiens
ggagagccctggga

SEQ ID NO: 4648621 - DNA, 12 bp, Homo sapiens
ggagagctagga

SEQ ID NO: 4648622 - DNA, 15 bp, Homo sapiens
ggagagctaggagca

SEQ ID NO: 4648623 - DNA, 22 bp, Homo sapiens
ggagagctaggagcaaagcctg

SEQ ID NO: 4648624 - DNA, 14 bp, Homo sapiens
ggagaggcagcatg

SEQ ID NO: 4648625 - DNA, 15 bp, Homo sapiens
ggagaggcagcatgc

SEQ ID NO: 4648626 - DNA, 21 bp, Homo sapiens
ggagaggcagcatgcttgggc

SEQ ID NO: 4648627 - DNA, 23 bp, Homo sapiens
ggagaggcagcatgcttgggctg

SEQ ID NO: 4648628 - DNA, 16 bp, Homo sapiens
ggagaggcttccctac

SEQ ID NO: 4648629 - DNA, 22 bp, Homo sapiens
ggagaggggtcacacccacccc

SEQ ID NO: 4648630 - DNA, 16 bp, Homo sapiens
ggagaggtcagccttg

SEQ ID NO: 4648631 - DNA, 17 bp, Homo sapiens
ggagaggtcagccttga

SEQ ID NO: 4648632 - DNA, 21 bp, Homo sapiens
ggagaggttacccgagaagca

SEQ ID NO: 4648633 - DNA, 18 bp, Homo sapiens
ggagatactggtggaagt

SEQ ID NO: 4648634 - DNA, 20 bp, Homo sapiens
ggagatcacagccccaccct

SEQ ID NO: 4648635 - DNA, 12 bp, Homo sapiens
ggagatggaggg

SEQ ID NO: 4648636 - DNA, 13 bp, Homo sapiens
ggagatggagttc

SEQ ID NO: 4648637 - DNA, 18 bp, Homo sapiens
ggagatgtgatcaggccc

SEQ ID NO: 4648638 - DNA, 16 bp, Homo sapiens
ggagcaaactctgctg

SEQ ID NO: 4648639 - DNA, 18 bp, Homo sapiens
ggagcaacggccccagcg

SEQ ID NO: 4648640 - DNA, 13 bp, Homo sapiens
ggagcaagaggag

SEQ ID NO: 4648641 - DNA, 14 bp, Homo sapiens
ggagcaagctcttc

SEQ ID NO: 4648642 - DNA, 17 bp, Homo sapiens
ggagcaagctcttccct

SEQ ID NO: 4648643 - DNA, 20 bp, Homo sapiens
ggagcaagctcttcccttgc

SEQ ID NO: 4648644 - DNA, 15 bp, Homo sapiens
ggagcagccctggcc

SEQ ID NO: 4648645 - DNA, 12 bp, Homo sapiens
ggagcaggagcc

SEQ ID NO: 4648646 - DNA, 23 bp, Homo sapiens
ggagcaggttccccaagggccct

SEQ ID NO: 4648647 - DNA, 15 bp, Homo sapiens
ggagccactctgttc

SEQ ID NO: 4648648 - DNA, 12 bp, Homo sapiens
ggagccaggccc

SEQ ID NO: 4648649 - DNA, 14 bp, Homo sapiens
ggagccaggcccca

SEQ ID NO: 4648650 - DNA, 18 bp, Homo sapiens
ggagccaggccccacccc

SEQ ID NO: 4648651 - DNA, 23 bp, Homo sapiens
ggagcccagcggcccaagagccc

SEQ ID NO: 4648652 - DNA, 16 bp, Homo sapiens
ggagccccaggcaggg

SEQ ID NO: 4648653 - DNA, 18 bp, Homo sapiens
ggagccccttctgctcag

SEQ ID NO: 4648654 - DNA, 21 bp, Homo sapiens
ggagcccgaagtctgctgctg

SEQ ID NO: 4648655 - DNA, 14 bp, Homo sapiens
ggagccgctggcag

SEQ ID NO: 4648656 - DNA, 19 bp, Homo sapiens
ggagccggtaactgtcctg

SEQ ID NO: 4648657 - DNA, 18 bp, Homo sapiens
ggagcctaggccaggtgc

SEQ ID NO: 4648658 - DNA, 14 bp, Homo sapiens
ggagcctccctgcc

SEQ ID NO: 4648659 - DNA, 18 bp, Homo sapiens
ggagcctgtgaacccagg

SEQ ID NO: 4648660 - DNA, 21 bp, Homo sapiens
ggagcctgtgaacccaggaca

SEQ ID NO: 4648661 - DNA, 21 bp, Homo sapiens
ggagccttcccaagttgtgct

SEQ ID NO: 4648662 - DNA, 22 bp, Homo sapiens
ggagccttcccaagttgtgctt

SEQ ID NO: 4648663 - DNA, 19 bp, Homo sapiens
ggagcgtgggctcagcagg

SEQ ID NO: 4648664 - DNA, 17 bp, Homo sapiens
ggagctcaacggtctgg

SEQ ID NO: 4648665 - DNA, 21 bp, Homo sapiens
ggagctcaacggtctggcagg

SEQ ID NO: 4648666 - DNA, 18 bp, Homo sapiens
ggagctctcaattttatg

SEQ ID NO: 4648667 - DNA, 22 bp, Homo sapiens
ggagctgagctggaaggggcca

SEQ ID NO: 4648668 - DNA, 15 bp, Homo sapiens
ggagctgccacagag

SEQ ID NO: 4648669 - DNA, 18 bp, Homo sapiens
ggagctgccacagagaag

SEQ ID NO: 4648670 - DNA, 21 bp, Homo sapiens
ggagctggcggggaaccctgg

SEQ ID NO: 4648671 - DNA, 23 bp, Homo sapiens
ggaggaaatttgaatgggtccat

SEQ ID NO: 4648672 - DNA, 22 bp, Homo sapiens
ggaggaaggagcctatggcatc

SEQ ID NO: 4648673 - DNA, 13 bp, Homo sapiens
ggaggacctgagc

SEQ ID NO: 4648674 - DNA, 16 bp, Homo sapiens
ggaggacctgagcctg

SEQ ID NO: 4648675 - DNA, 21 bp, Homo sapiens
ggaggagccaggccccacccc

SEQ ID NO: 4648676 - DNA, 22 bp, Homo sapiens
ggaggagcctgtgcgtcccagc

SEQ ID NO: 4648677 - DNA, 23 bp, Homo sapiens
ggaggagtcagatgaggccctgc

SEQ ID NO: 4648678 - DNA, 21 bp, Homo sapiens
ggaggatgtccctgggccagg

SEQ ID NO: 4648679 - DNA, 15 bp, Homo sapiens
ggaggccaaccagcc

SEQ ID NO: 4648680 - DNA, 18 bp, Homo sapiens
ggaggccaaccagcccga

SEQ ID NO: 4648681 - DNA, 15 bp, Homo sapiens
ggaggcccctggagc

SEQ ID NO: 4648682 - DNA, 12 bp, Homo sapiens
ggaggccgaagc

SEQ ID NO: 4648683 - DNA, 22 bp, Homo sapiens
ggaggctgctcggggtgcacag

SEQ ID NO: 4648684 - DNA, 19 bp, Homo sapiens
ggaggctttctgggctctg

SEQ ID NO: 4648685 - DNA, 20 bp, Homo sapiens
ggagggacaaaggagcctgt

SEQ ID NO: 4648686 - DNA, 22 bp, Homo sapiens
ggagggcacattaactccctcc

SEQ ID NO: 4648687 - DNA, 17 bp, Homo sapiens
ggagggcttggcccagc

SEQ ID NO: 4648688 - DNA, 15 bp, Homo sapiens
ggagggggcctcatt

SEQ ID NO: 4648689 - DNA, 22 bp, Homo sapiens
ggagggggtcgtggagagctag

SEQ ID NO: 4648690 - DNA, 19 bp, Homo sapiens
ggaggtcctttggacagct

SEQ ID NO: 4648691 - DNA, 20 bp, Homo sapiens
ggaggtcctttggacagctg

SEQ ID NO: 4648692 - DNA, 14 bp, Homo sapiens
ggaggtctccaggg

SEQ ID NO: 4648693 - DNA, 16 bp, Homo sapiens
ggaggtgcagtggagg

SEQ ID NO: 4648694 - DNA, 16 bp, Homo sapiens
ggaggtgctgtcccca

SEQ ID NO: 4648695 - DNA, 21 bp, Homo sapiens
ggaggtgctgtccccactgcc

SEQ ID NO: 4648696 - DNA, 13 bp, Homo sapiens
ggaggtgtgaatg

SEQ ID NO: 4648697 - DNA, 19 bp, Homo sapiens
ggaggtgtgaatgcacgtt

SEQ ID NO: 4648698 - DNA, 23 bp, Homo sapiens
ggagtacctgtccaagacagggc

SEQ ID NO: 4648699 - DNA, 17 bp, Homo sapiens
ggagtagcctggactgt

SEQ ID NO: 4648700 - DNA, 13 bp, Homo sapiens
ggagtagctagtt

SEQ ID NO: 4648701 - DNA, 14 bp, Homo sapiens
ggagtagctgagct

SEQ ID NO: 4648702 - DNA, 21 bp, Homo sapiens
ggagtcccttttcattctcct

SEQ ID NO: 4648703 - DNA, 16 bp, Homo sapiens
ggagtctcactcttgt

SEQ ID NO: 4648704 - DNA, 13 bp, Homo sapiens
ggagtctgaggtc

SEQ ID NO: 4648705 - DNA, 14 bp, Homo sapiens
ggagtgcagtggtg

SEQ ID NO: 4648706 - DNA, 21 bp, Homo sapiens
ggagtgccataccttctccca

SEQ ID NO: 4648707 - DNA, 16 bp, Homo sapiens
ggagtgctggctcaca

SEQ ID NO: 4648708 - DNA, 18 bp, Homo sapiens
ggagtgctggctcacagt

SEQ ID NO: 4648709 - DNA, 19 bp, Homo sapiens
ggagtgtgagccacctaag

SEQ ID NO: 4648710 - DNA, 22 bp, Homo sapiens
ggagttggtgaatcggttgttc

SEQ ID NO: 4648711 - DNA, 19 bp, Homo sapiens
ggataaaataatgctgcaa

SEQ ID NO: 4648712 - DNA, 17 bp, Homo sapiens
ggataagtggctgtttc

SEQ ID NO: 4648713 - DNA, 16 bp, Homo sapiens
ggatagtctgggtcag

SEQ ID NO: 4648714 - DNA, 20 bp, Homo sapiens
ggatatccttatcagagcta

SEQ ID NO: 4648715 - DNA, 14 bp, Homo sapiens
ggatattatagaaa

SEQ ID NO: 4648716 - DNA, 18 bp, Homo sapiens
ggatatttagaactttgt

SEQ ID NO: 4648717 - DNA, 18 bp, Homo sapiens
ggatcacagcctcacccc

SEQ ID NO: 4648718 - DNA, 23 bp, Homo sapiens
ggatcacagcctcacccctgccc

SEQ ID NO: 4648719 - DNA, 19 bp, Homo sapiens
ggatcagagcgcacaggga

SEQ ID NO: 4648720 - DNA, 18 bp, Homo sapiens
ggatcagcgtggccttgt

SEQ ID NO: 4648721 - DNA, 19 bp, Homo sapiens
ggatcagcgtggccttgtt

SEQ ID NO: 4648722 - DNA, 21 bp, Homo sapiens
ggatccagccacttccccctc

SEQ ID NO: 4648723 - DNA, 12 bp, Homo sapiens
ggatcctgctgg

SEQ ID NO: 4648724 - DNA, 13 bp, Homo sapiens
ggatcctgctggg

SEQ ID NO: 4648725 - DNA, 22 bp, Homo sapiens
ggatctctgagaccacagaggc

SEQ ID NO: 4648726 - DNA, 15 bp, Homo sapiens
ggatcttgaatgtgg

SEQ ID NO: 4648727 - DNA, 17 bp, Homo sapiens
ggatgacaccctggcct

SEQ ID NO: 4648728 - DNA, 18 bp, Homo sapiens
ggatgagaaacagctcag

SEQ ID NO: 4648729 - DNA, 22 bp, Homo sapiens
ggatgagaaacagctcagccag

SEQ ID NO: 4648730 - DNA, 13 bp, Homo sapiens
ggatgagacccag

SEQ ID NO: 4648731 - DNA, 18 bp, Homo sapiens
ggatgcaacaaatgtggc

SEQ ID NO: 4648732 - DNA, 19 bp, Homo sapiens
ggatgcccagatgaactga

SEQ ID NO: 4648733 - DNA, 20 bp, Homo sapiens
ggatgcggatcctgctgggg

SEQ ID NO: 4648734 - DNA, 16 bp, Homo sapiens
ggatgcgtgggcagag

SEQ ID NO: 4648735 - DNA, 16 bp, Homo sapiens
ggatgctgggctgggc

SEQ ID NO: 4648736 - DNA, 23 bp, Homo sapiens
ggatgctgtgctacgtgtgaaat

SEQ ID NO: 4648737 - DNA, 11 bp, Homo sapiens
ggatggtttgt

SEQ ID NO: 4648738 - DNA, 17 bp, Homo sapiens
ggatgtataatacatcc

SEQ ID NO: 4648739 - DNA, 19 bp, Homo sapiens
ggattcaggaaaaggcctg

SEQ ID NO: 4648740 - DNA, 23 bp, Homo sapiens
ggattctaccgtaattgctttgt

SEQ ID NO: 4648741 - DNA, 17 bp, Homo sapiens
ggattttaatttcagga

SEQ ID NO: 4648742 - DNA, 14 bp, Homo sapiens
ggatttttgtcttg

SEQ ID NO: 4648743 - DNA, 16 bp, Homo sapiens
ggcaacagggagcacc

SEQ ID NO: 4648744 - DNA, 15 bp, Homo sapiens
ggcaagaggatgaag

SEQ ID NO: 4648745 - DNA, 17 bp, Homo sapiens
ggcaagagggtgacagc

SEQ ID NO: 4648746 - DNA, 16 bp, Homo sapiens
ggcaagctaggcccca

SEQ ID NO: 4648747 - DNA, 21 bp, Homo sapiens
ggcaagctaggccccagaggc

SEQ ID NO: 4648748 - DNA, 13 bp, Homo sapiens
ggcaaggaggagg

SEQ ID NO: 4648749 - DNA, 18 bp, Homo sapiens
ggcaatggccaggggcca

SEQ ID NO: 4648750 - DNA, 20 bp, Homo sapiens
ggcaatggccaggggccagg

SEQ ID NO: 4648751 - DNA, 21 bp, Homo sapiens
ggcaatgggagctgaggccac

SEQ ID NO: 4648752 - DNA, 11 bp, Homo sapiens
ggcaattagtg

SEQ ID NO: 4648753 - DNA, 16 bp, Homo sapiens
ggcacagctaaccact

SEQ ID NO: 4648754 - DNA, 17 bp, Homo sapiens
ggcacaggagctacctg

SEQ ID NO: 4648755 - DNA, 20 bp, Homo sapiens
ggcacaggagctacctgtgt

SEQ ID NO: 4648756 - DNA, 17 bp, Homo sapiens
ggcacaggccatggatg

SEQ ID NO: 4648757 - DNA, 13 bp, Homo sapiens
ggcacagtgggag

SEQ ID NO: 4648758 - DNA, 17 bp, Homo sapiens
ggcacagtgggagctga

SEQ ID NO: 4648759 - DNA, 21 bp, Homo sapiens
ggcacagtgggagctgagctg

SEQ ID NO: 4648760 - DNA, 17 bp, Homo sapiens
ggcacccccacaagctg

SEQ ID NO: 4648761 - DNA, 13 bp, Homo sapiens
ggcacccccagcc

SEQ ID NO: 4648762 - DNA, 19 bp, Homo sapiens
ggcacccccagcctgggcc

SEQ ID NO: 4648763 - DNA, 21 bp, Homo sapiens
ggcacccccagcctgggccta

SEQ ID NO: 4648764 - DNA, 14 bp, Homo sapiens
ggcaccccctgcag

SEQ ID NO: 4648765 - DNA, 18 bp, Homo sapiens
ggcaccccctgcagcttg

SEQ ID NO: 4648766 - DNA, 19 bp, Homo sapiens
ggcaccccctgcagcttgt

SEQ ID NO: 4648767 - DNA, 19 bp, Homo sapiens
ggcaccgccacgtcccagc

SEQ ID NO: 4648768 - DNA, 13 bp, Homo sapiens
ggcacctgggccc

SEQ ID NO: 4648769 - DNA, 22 bp, Homo sapiens
ggcacctgggccctggggcctg

SEQ ID NO: 4648770 - DNA, 16 bp, Homo sapiens
ggcactcccaaccctg

SEQ ID NO: 4648771 - DNA, 21 bp, Homo sapiens
ggcactggtaggttgggacac

SEQ ID NO: 4648772 - DNA, 19 bp, Homo sapiens
ggcacttaatttgtaaact

SEQ ID NO: 4648773 - DNA, 20 bp, Homo sapiens
ggcacttccacctccagcct

SEQ ID NO: 4648774 - DNA, 21 bp, Homo sapiens
ggcagaaatagttgtctgtgc

SEQ ID NO: 4648775 - DNA, 11 bp, Homo sapiens
ggcagactctt

SEQ ID NO: 4648776 - DNA, 18 bp, Homo sapiens
ggcagactctttaataaa

SEQ ID NO: 4648777 - DNA, 16 bp, Homo sapiens
ggcagagctctacagg

SEQ ID NO: 4648778 - DNA, 18 bp, Homo sapiens
ggcagagctctacaggcc

SEQ ID NO: 4648779 - DNA, 19 bp, Homo sapiens
ggcagagctctacaggcct

SEQ ID NO: 4648780 - DNA, 18 bp, Homo sapiens
ggcagaggaatgtgggct

SEQ ID NO: 4648781 - DNA, 21 bp, Homo sapiens
ggcagaggaatgtgggctatg

SEQ ID NO: 4648782 - DNA, 15 bp, Homo sapiens
ggcagagtcctgcct

SEQ ID NO: 4648783 - DNA, 13 bp, Homo sapiens
ggcagatgccctt

SEQ ID NO: 4648784 - DNA, 14 bp, Homo sapiens
ggcagatgcccttg

SEQ ID NO: 4648785 - DNA, 23 bp, Homo sapiens
ggcagatgcccttgctgggcctg

SEQ ID NO: 4648786 - DNA, 14 bp, Homo sapiens
ggcagatgtaggag

SEQ ID NO: 4648787 - DNA, 17 bp, Homo sapiens
ggcagatgtaggaggga

SEQ ID NO: 4648788 - DNA, 19 bp, Homo sapiens
ggcagcaaggcccgagcag

SEQ ID NO: 4648789 - DNA, 14 bp, Homo sapiens
ggcagcactcccca

SEQ ID NO: 4648790 - DNA, 20 bp, Homo sapiens
ggcagcactccccagagctg

SEQ ID NO: 4648791 - DNA, 22 bp, Homo sapiens
ggcagcactccccagagctgtg

SEQ ID NO: 4648792 - DNA, 14 bp, Homo sapiens
ggcagcagccagcc

SEQ ID NO: 4648793 - DNA, 19 bp, Homo sapiens
ggcagcagccagccctgcc

SEQ ID NO: 4648794 - DNA, 15 bp, Homo sapiens
ggcagcagttgaggt

SEQ ID NO: 4648795 - DNA, 18 bp, Homo sapiens
ggcagcgccaagtgcgtg

SEQ ID NO: 4648796 - DNA, 14 bp, Homo sapiens
ggcagcgccaggct

SEQ ID NO: 4648797 - DNA, 16 bp, Homo sapiens
ggcagcgcccttcctc

SEQ ID NO: 4648798 - DNA, 20 bp, Homo sapiens
ggcagcgcccttcctctcca

SEQ ID NO: 4648799 - DNA, 21 bp, Homo sapiens
ggcagcgcccttcctctccac

SEQ ID NO: 4648800 - DNA, 23 bp, Homo sapiens
ggcagcgggcggaggggatccag

SEQ ID NO: 4648801 - DNA, 21 bp, Homo sapiens
ggcaggagctactgagaacat

SEQ ID NO: 4648802 - DNA, 19 bp, Homo sapiens
ggcaggagtagctgagctc

SEQ ID NO: 4648803 - DNA, 14 bp, Homo sapiens
ggcaggcagggctc

SEQ ID NO: 4648804 - DNA, 20 bp, Homo sapiens
ggcaggcattcctgaaggga

SEQ ID NO: 4648805 - DNA, 22 bp, Homo sapiens
ggcaggcattcctgaagggaac

SEQ ID NO: 4648806 - DNA, 18 bp, Homo sapiens
ggcagggaaggacaggac

SEQ ID NO: 4648807 - DNA, 21 bp, Homo sapiens
ggcagggaaggacaggaccct

SEQ ID NO: 4648808 - DNA, 14 bp, Homo sapiens
ggcagggacaagtc

SEQ ID NO: 4648809 - DNA, 20 bp, Homo sapiens
ggcagggaccggcagagctc

SEQ ID NO: 4648810 - DNA, 12 bp, Homo sapiens
ggcagggctctc

SEQ ID NO: 4648811 - DNA, 15 bp, Homo sapiens
ggcagtccatctagg

SEQ ID NO: 4648812 - DNA, 21 bp, Homo sapiens
ggcagtgagggagggctgtca

SEQ ID NO: 4648813 - DNA, 19 bp, Homo sapiens
ggcagtgcccatgtgtaca

SEQ ID NO: 4648814 - DNA, 14 bp, Homo sapiens
ggcagtgccctttg

SEQ ID NO: 4648815 - DNA, 15 bp, Homo sapiens
ggcagttcgcagcca

SEQ ID NO: 4648816 - DNA, 16 bp, Homo sapiens
ggcagttcgcagccac

SEQ ID NO: 4648817 - DNA, 17 bp, Homo sapiens
ggcagttcgcagccacc

SEQ ID NO: 4648818 - DNA, 21 bp, Homo sapiens
ggcagttcgcagccaccctga

SEQ ID NO: 4648819 - DNA, 22 bp, Homo sapiens
ggcagttcgcagccaccctgag

SEQ ID NO: 4648820 - DNA, 21 bp, Homo sapiens
ggcatacctgtgcctgcttct

SEQ ID NO: 4648821 - DNA, 21 bp, Homo sapiens
ggcatccacgtagggggcagg

SEQ ID NO: 4648822 - DNA, 19 bp, Homo sapiens
ggcatccgtgaggcaggga

SEQ ID NO: 4648823 - DNA, 13 bp, Homo sapiens
ggcatcctgtgaa

SEQ ID NO: 4648824 - DNA, 12 bp, Homo sapiens
ggcatgactgtc

SEQ ID NO: 4648825 - DNA, 17 bp, Homo sapiens
ggcatgagtctgtttcc

SEQ ID NO: 4648826 - DNA, 19 bp, Homo sapiens
ggcatgagtctgtttccca

SEQ ID NO: 4648827 - DNA, 15 bp, Homo sapiens
ggcatgatgcgggcc

SEQ ID NO: 4648828 - DNA, 22 bp, Homo sapiens
ggcatgctggctcccagggcca

SEQ ID NO: 4648829 - DNA, 15 bp, Homo sapiens
ggcatttgagcagct

SEQ ID NO: 4648830 - DNA, 16 bp, Homo sapiens
ggccaaaatcaagagt

SEQ ID NO: 4648831 - DNA, 19 bp, Homo sapiens
ggccaaacatggccagact

SEQ ID NO: 4648832 - DNA, 16 bp, Homo sapiens
ggccaaagtcacttcc

SEQ ID NO: 4648833 - DNA, 20 bp, Homo sapiens
ggccaagctgaggtgcccag

SEQ ID NO: 4648834 - DNA, 21 bp, Homo sapiens
ggccacactcagcacaaggcc

SEQ ID NO: 4648835 - DNA, 16 bp, Homo sapiens
ggccacatagatgctg

SEQ ID NO: 4648836 - DNA, 19 bp, Homo sapiens
ggccacatcaaagaggctg

SEQ ID NO: 4648837 - DNA, 14 bp, Homo sapiens
ggccagaagatgaa

SEQ ID NO: 4648838 - DNA, 16 bp, Homo sapiens
ggccagagcagctcca

SEQ ID NO: 4648839 - DNA, 15 bp, Homo sapiens
ggccagcctggcctc

SEQ ID NO: 4648840 - DNA, 16 bp, Homo sapiens
ggccagcctggcctcc

SEQ ID NO: 4648841 - DNA, 19 bp, Homo sapiens
ggccagcctggcctcctgc

SEQ ID NO: 4648842 - DNA, 20 bp, Homo sapiens
ggccagcctggcctcctgcc

SEQ ID NO: 4648843 - DNA, 18 bp, Homo sapiens
ggccagggctgccctgag

SEQ ID NO: 4648844 - DNA, 19 bp, Homo sapiens
ggccagggtctgtgtgaat

SEQ ID NO: 4648845 - DNA, 15 bp, Homo sapiens
ggccagtgctccagc

SEQ ID NO: 4648846 - DNA, 14 bp, Homo sapiens
ggccagtggggcct

SEQ ID NO: 4648847 - DNA, 15 bp, Homo sapiens
ggccagtggggcctg

SEQ ID NO: 4648848 - DNA, 17 bp, Homo sapiens
ggccagtggggcctgtg

SEQ ID NO: 4648849 - DNA, 17 bp, Homo sapiens
ggccatctcaggagatg

SEQ ID NO: 4648850 - DNA, 23 bp, Homo sapiens
ggccatctgactgccaagccaga

SEQ ID NO: 4648851 - DNA, 22 bp, Homo sapiens
ggccatgttgtgcctccctggt

SEQ ID NO: 4648852 - DNA, 20 bp, Homo sapiens
ggccattctccacagcaacc

SEQ ID NO: 4648853 - DNA, 22 bp, Homo sapiens
ggcccacgtgtatagtatctgt

SEQ ID NO: 4648854 - DNA, 22 bp, Homo sapiens
ggcccagtacctagctggctct

SEQ ID NO: 4648855 - DNA, 18 bp, Homo sapiens
ggccccacaaggcctggt

SEQ ID NO: 4648856 - DNA, 12 bp, Homo sapiens
ggccccacccct

SEQ ID NO: 4648857 - DNA, 16 bp, Homo sapiens
ggccccaccccttccc

SEQ ID NO: 4648858 - DNA, 17 bp, Homo sapiens
ggccccagaggccctgg

SEQ ID NO: 4648859 - DNA, 21 bp, Homo sapiens
ggccccagaggccctggaggt

SEQ ID NO: 4648860 - DNA, 17 bp, Homo sapiens
ggccccatcctcatccc

SEQ ID NO: 4648861 - DNA, 22 bp, Homo sapiens
ggcccccagcttcacctctggg

SEQ ID NO: 4648862 - DNA, 19 bp, Homo sapiens
ggcccccatcagccctgct

SEQ ID NO: 4648863 - DNA, 14 bp, Homo sapiens
ggcccccatctcat

SEQ ID NO: 4648864 - DNA, 13 bp, Homo sapiens
ggccccgccaggg

SEQ ID NO: 4648865 - DNA, 16 bp, Homo sapiens
ggccccgccagggctg

SEQ ID NO: 4648866 - DNA, 14 bp, Homo sapiens
ggccccgggctgga

SEQ ID NO: 4648867 - DNA, 16 bp, Homo sapiens
ggccccgggctggaga

SEQ ID NO: 4648868 - DNA, 15 bp, Homo sapiens
ggcccctccaatcct

SEQ ID NO: 4648869 - DNA, 15 bp, Homo sapiens
ggcccgagcagctga

SEQ ID NO: 4648870 - DNA, 16 bp, Homo sapiens
ggcccgagcagctgag

SEQ ID NO: 4648871 - DNA, 18 bp, Homo sapiens
ggcccgagcagctgagca

SEQ ID NO: 4648872 - DNA, 15 bp, Homo sapiens
ggcccgcgcagctgc

SEQ ID NO: 4648873 - DNA, 13 bp, Homo sapiens
ggcccgtgacaga

SEQ ID NO: 4648874 - DNA, 22 bp, Homo sapiens
ggccctcatctatgaggaaagg

SEQ ID NO: 4648875 - DNA, 16 bp, Homo sapiens
ggccctctttccctgc

SEQ ID NO: 4648876 - DNA, 17 bp, Homo sapiens
ggccctgcaccttcccc

SEQ ID NO: 4648877 - DNA, 9 bp, Homo sapiens
ggccctgct

SEQ ID NO: 4648878 - DNA, 10 bp, Homo sapiens
ggccctgcta

SEQ ID NO: 4648879 - DNA, 14 bp, Homo sapiens
ggccctgctacctg

SEQ ID NO: 4648880 - DNA, 20 bp, Homo sapiens
ggccctggatcagcgtggcc

SEQ ID NO: 4648881 - DNA, 22 bp, Homo sapiens
ggccctggatcagcgtggcctt

SEQ ID NO: 4648882 - DNA, 23 bp, Homo sapiens
ggccctggatcagcgtggccttg

SEQ ID NO: 4648883 - DNA, 15 bp, Homo sapiens
ggccctggcaccccc

SEQ ID NO: 4648884 - DNA, 13 bp, Homo sapiens
ggccctggggcct

SEQ ID NO: 4648885 - DNA, 17 bp, Homo sapiens
ggccctggggcctgtac

SEQ ID NO: 4648886 - DNA, 18 bp, Homo sapiens
ggccctggggcctgtact

SEQ ID NO: 4648887 - DNA, 18 bp, Homo sapiens
ggccctgtctctggctac

SEQ ID NO: 4648888 - DNA, 22 bp, Homo sapiens
ggcccttcctggacagctgtgc

SEQ ID NO: 4648889 - DNA, 18 bp, Homo sapiens
ggccgaagctaacaggga

SEQ ID NO: 4648890 - DNA, 16 bp, Homo sapiens
ggccgagtccaagctg

SEQ ID NO: 4648891 - DNA, 22 bp, Homo sapiens
ggccgccacggcctggctggtg

SEQ ID NO: 4648892 - DNA, 15 bp, Homo sapiens
ggccggccagcccct

SEQ ID NO: 4648893 - DNA, 14 bp, Homo sapiens
ggccgggcagaggg

SEQ ID NO: 4648894 - DNA, 21 bp, Homo sapiens
ggccgggcctgctgtcacctc

SEQ ID NO: 4648895 - DNA, 18 bp, Homo sapiens
ggcctagactctgtctac

SEQ ID NO: 4648896 - DNA, 15 bp, Homo sapiens
ggcctagtacaatct

SEQ ID NO: 4648897 - DNA, 22 bp, Homo sapiens
ggcctatggagagccctgggac

SEQ ID NO: 4648898 - DNA, 13 bp, Homo sapiens
ggcctcagagctt

SEQ ID NO: 4648899 - DNA, 14 bp, Homo sapiens
ggcctcaggctctg

SEQ ID NO: 4648900 - DNA, 20 bp, Homo sapiens
ggcctccagccctctcactg

SEQ ID NO: 4648901 - DNA, 22 bp, Homo sapiens
ggcctccagccctctcactgtg

SEQ ID NO: 4648902 - DNA, 12 bp, Homo sapiens
ggcctccctgct

SEQ ID NO: 4648903 - DNA, 14 bp, Homo sapiens
ggcctcctgcctct

SEQ ID NO: 4648904 - DNA, 17 bp, Homo sapiens
ggcctcgtgaggggcaa

SEQ ID NO: 4648905 - DNA, 16 bp, Homo sapiens
ggcctgaactgaggag

SEQ ID NO: 4648906 - DNA, 21 bp, Homo sapiens
ggcctgagagaattggctcaa

SEQ ID NO: 4648907 - DNA, 21 bp, Homo sapiens
ggcctgagtgacctccttctg

SEQ ID NO: 4648908 - DNA, 15 bp, Homo sapiens
ggcctgcagccccta

SEQ ID NO: 4648909 - DNA, 13 bp, Homo sapiens
ggcctgccccctg

SEQ ID NO: 4648910 - DNA, 14 bp, Homo sapiens
ggcctgccccctgg

SEQ ID NO: 4648911 - DNA, 17 bp, Homo sapiens
ggcctgccccctgggga

SEQ ID NO: 4648912 - DNA, 21 bp, Homo sapiens
ggcctgccccctggggatcac

SEQ ID NO: 4648913 - DNA, 10 bp, Homo sapiens
ggcctgctgc

SEQ ID NO: 4648914 - DNA, 11 bp, Homo sapiens
ggcctgctgct

SEQ ID NO: 4648915 - DNA, 14 bp, Homo sapiens
ggcctgctgctgag

SEQ ID NO: 4648916 - DNA, 19 bp, Homo sapiens
ggcctgctgctgagaacct

SEQ ID NO: 4648917 - DNA, 20 bp, Homo sapiens
ggcctgctgctgagaacctg

SEQ ID NO: 4648918 - DNA, 23 bp, Homo sapiens
ggcctgctgctgagaacctggcc

SEQ ID NO: 4648919 - DNA, 23 bp, Homo sapiens
ggcctggagccccatcggccaag

SEQ ID NO: 4648920 - DNA, 18 bp, Homo sapiens
ggcctggcatagagtagg

SEQ ID NO: 4648921 - DNA, 16 bp, Homo sapiens
ggcctggcccccagct

SEQ ID NO: 4648922 - DNA, 11 bp, Homo sapiens
ggcctggccct

SEQ ID NO: 4648923 - DNA, 13 bp, Homo sapiens
ggcctggccctgc

SEQ ID NO: 4648924 - DNA, 16 bp, Homo sapiens
ggcctggctggtggga

SEQ ID NO: 4648925 - DNA, 20 bp, Homo sapiens
ggcctgggtgatctgctgct

SEQ ID NO: 4648926 - DNA, 22 bp, Homo sapiens
ggcctggttcaaagtaaagcag

SEQ ID NO: 4648927 - DNA, 15 bp, Homo sapiens
ggcctgtctcagtga

SEQ ID NO: 4648928 - DNA, 20 bp, Homo sapiens
ggcctgtgggtctctgaagg

SEQ ID NO: 4648929 - DNA, 21 bp, Homo sapiens
ggcctgtgtagctgtgacctg

SEQ ID NO: 4648930 - DNA, 22 bp, Homo sapiens
ggcctgtgtagctgtgacctgc

SEQ ID NO: 4648931 - DNA, 23 bp, Homo sapiens
ggcctgtgtagctgtgacctgct

SEQ ID NO: 4648932 - DNA, 24 bp, Homo sapiens
ggcctgttgctatagagcctacct

SEQ ID NO: 4648933 - DNA, 15 bp, Homo sapiens
ggccttaaagaggga

SEQ ID NO: 4648934 - DNA, 16 bp, Homo sapiens
ggccttaaagagggac

SEQ ID NO: 4648935 - DNA, 15 bp, Homo sapiens
ggccttagggcactg

SEQ ID NO: 4648936 - DNA, 15 bp, Homo sapiens
ggccttgatcccctt

SEQ ID NO: 4648937 - DNA, 16 bp, Homo sapiens
ggcgcactgcctctca

SEQ ID NO: 4648938 - DNA, 16 bp, Homo sapiens
ggcgccccaacccgtg

SEQ ID NO: 4648939 - DNA, 18 bp, Homo sapiens
ggcgcctttttggcctgt

SEQ ID NO: 4648940 - DNA, 22 bp, Homo sapiens
ggcggcctatgacttgggcacc

SEQ ID NO: 4648941 - DNA, 17 bp, Homo sapiens
ggcgggcggagggaggg

SEQ ID NO: 4648942 - DNA, 17 bp, Homo sapiens
ggctactccctggacca

SEQ ID NO: 4648943 - DNA, 18 bp, Homo sapiens
ggctactctgtgccagag

SEQ ID NO: 4648944 - DNA, 22 bp, Homo sapiens
ggctactctgtgccagagcctg

SEQ ID NO: 4648945 - DNA, 22 bp, Homo sapiens
ggctagacagaaacatgtcttg

SEQ ID NO: 4648946 - DNA, 14 bp, Homo sapiens
ggctagggggagcc

SEQ ID NO: 4648947 - DNA, 23 bp, Homo sapiens
ggctcactgcaacctctgcctcc

SEQ ID NO: 4648948 - DNA, 19 bp, Homo sapiens
ggctccagatgcagggcag

SEQ ID NO: 4648949 - DNA, 21 bp, Homo sapiens
ggctccccctccagccagaga

SEQ ID NO: 4648950 - DNA, 17 bp, Homo sapiens
ggctccctctctcctgg

SEQ ID NO: 4648951 - DNA, 18 bp, Homo sapiens
ggctccctctctcctgga

SEQ ID NO: 4648952 - DNA, 20 bp, Homo sapiens
ggctccctctctcctggact

SEQ ID NO: 4648953 - DNA, 21 bp, Homo sapiens
ggctccctctctcctggactg

SEQ ID NO: 4648954 - DNA, 17 bp, Homo sapiens
ggctctaacgcctgagc

SEQ ID NO: 4648955 - DNA, 18 bp, Homo sapiens
ggctctaacgcctgagcc

SEQ ID NO: 4648956 - DNA, 22 bp, Homo sapiens
ggctctaacgcctgagcccagg

SEQ ID NO: 4648957 - DNA, 15 bp, Homo sapiens
ggctctagccccagc

SEQ ID NO: 4648958 - DNA, 22 bp, Homo sapiens
ggctctcatggtacttcctctg

SEQ ID NO: 4648959 - DNA, 12 bp, Homo sapiens
ggctctgagcca

SEQ ID NO: 4648960 - DNA, 16 bp, Homo sapiens
ggctctgcacccctct

SEQ ID NO: 4648961 - DNA, 21 bp, Homo sapiens
ggctctgcctgtctggtgcct

SEQ ID NO: 4648962 - DNA, 19 bp, Homo sapiens
ggctgaagagagggacagg

SEQ ID NO: 4648963 - DNA, 18 bp, Homo sapiens
ggctgaatcttctggaga

SEQ ID NO: 4648964 - DNA, 22 bp, Homo sapiens
ggctgacatgaagctgttgtgt

SEQ ID NO: 4648965 - DNA, 18 bp, Homo sapiens
ggctgaccacagcacagc

SEQ ID NO: 4648966 - DNA, 19 bp, Homo sapiens
ggctgaccacagcacagcc

SEQ ID NO: 4648967 - DNA, 15 bp, Homo sapiens
ggctgacccagcatc

SEQ ID NO: 4648968 - DNA, 18 bp, Homo sapiens
ggctgacccagcatctcc

SEQ ID NO: 4648969 - DNA, 21 bp, Homo sapiens
ggctgacccagcatctcccag

SEQ ID NO: 4648970 - DNA, 21 bp, Homo sapiens
ggctgagccgaagctgcgggg

SEQ ID NO: 4648971 - DNA, 14 bp, Homo sapiens
ggctgaggctggca

SEQ ID NO: 4648972 - DNA, 22 bp, Homo sapiens
ggctgagggcagttcgcagcca

SEQ ID NO: 4648973 - DNA, 15 bp, Homo sapiens
ggctgattcagcatt

SEQ ID NO: 4648974 - DNA, 17 bp, Homo sapiens
ggctgattcctctcatt

SEQ ID NO: 4648975 - DNA, 13 bp, Homo sapiens
ggctgcaaaatta

SEQ ID NO: 4648976 - DNA, 15 bp, Homo sapiens
ggctgcagtgagcca

SEQ ID NO: 4648977 - DNA, 22 bp, Homo sapiens
ggctgccatctcacctcctgct

SEQ ID NO: 4648978 - DNA, 23 bp, Homo sapiens
ggctgccatctcacctcctgctg

SEQ ID NO: 4648979 - DNA, 14 bp, Homo sapiens
ggctgctctttcca

SEQ ID NO: 4648980 - DNA, 22 bp, Homo sapiens
ggctgctctttccacttgccct

SEQ ID NO: 4648981 - DNA, 23 bp, Homo sapiens
ggctgctctttccacttgccctg

SEQ ID NO: 4648982 - DNA, 22 bp, Homo sapiens
ggctgctgcacaccaaggccct

SEQ ID NO: 4648983 - DNA, 22 bp, Homo sapiens
ggctggagaaggacatgagatc

SEQ ID NO: 4648984 - DNA, 20 bp, Homo sapiens
ggctggagtgcagtggcgcc

SEQ ID NO: 4648985 - DNA, 13 bp, Homo sapiens
ggctggcacagga

SEQ ID NO: 4648986 - DNA, 22 bp, Homo sapiens
ggctggctccagatgcagggca

SEQ ID NO: 4648987 - DNA, 14 bp, Homo sapiens
ggctggctgagggc

SEQ ID NO: 4648988 - DNA, 15 bp, Homo sapiens
ggctggctgagggca

SEQ ID NO: 4648989 - DNA, 13 bp, Homo sapiens
ggctggtcacctc

SEQ ID NO: 4648990 - DNA, 16 bp, Homo sapiens
ggctggtgggaaggcc

SEQ ID NO: 4648991 - DNA, 18 bp, Homo sapiens
ggctggtgggaaggccgg

SEQ ID NO: 4648992 - DNA, 21 bp, Homo sapiens
ggctggtttcaaactcctgac

SEQ ID NO: 4648993 - DNA, 23 bp, Homo sapiens
ggctggtttcaaactcctgacct

SEQ ID NO: 4648994 - DNA, 20 bp, Homo sapiens
ggctgtaactgagagaaaga

SEQ ID NO: 4648995 - DNA, 12 bp, Homo sapiens
ggcttaaaccag

SEQ ID NO: 4648996 - DNA, 15 bp, Homo sapiens
ggcttatgaaagagg

SEQ ID NO: 4648997 - DNA, 13 bp, Homo sapiens
ggcttatttctat

SEQ ID NO: 4648998 - DNA, 20 bp, Homo sapiens
ggcttccctacacagggcct

SEQ ID NO: 4648999 - DNA, 22 bp, Homo sapiens
ggcttccctacacagggcctgc

SEQ ID NO: 4649000 - DNA, 17 bp, Homo sapiens
ggcttcctcttcttgtt

SEQ ID NO: 4649001 - DNA, 16 bp, Homo sapiens
ggcttctctctcacca

SEQ ID NO: 4649002 - DNA, 15 bp, Homo sapiens
ggcttgaaggccagc

SEQ ID NO: 4649003 - DNA, 23 bp, Homo sapiens
ggcttgctgtatgacccctggcc

SEQ ID NO: 4649004 - DNA, 13 bp, Homo sapiens
ggcttggcccagc

SEQ ID NO: 4649005 - DNA, 16 bp, Homo sapiens
ggctttcccttatcaa

SEQ ID NO: 4649006 - DNA, 16 bp, Homo sapiens
ggctttctgggctctg

SEQ ID NO: 4649007 - DNA, 17 bp, Homo sapiens
ggctttctgggctctgg

SEQ ID NO: 4649008 - DNA, 18 bp, Homo sapiens
ggctttctgggctctgga

SEQ ID NO: 4649009 - DNA, 19 bp, Homo sapiens
ggctttctgggctctggac

SEQ ID NO: 4649010 - DNA, 21 bp, Homo sapiens
gggaaagacatccataaagaa

SEQ ID NO: 4649011 - DNA, 22 bp, Homo sapiens
gggaaattgtaaatcctgtgtt

SEQ ID NO: 4649012 - DNA, 20 bp, Homo sapiens
gggaactggccaagctgagg

SEQ ID NO: 4649013 - DNA, 18 bp, Homo sapiens
gggaagagacagcccagg

SEQ ID NO: 4649014 - DNA, 20 bp, Homo sapiens
gggaagagatcccaggaggt

SEQ ID NO: 4649015 - DNA, 20 bp, Homo sapiens
gggaagagggaaatgtacac

SEQ ID NO: 4649016 - DNA, 14 bp, Homo sapiens
gggaaggacaggac

SEQ ID NO: 4649017 - DNA, 22 bp, Homo sapiens
gggaaggacaggaccctcagga

SEQ ID NO: 4649018 - DNA, 14 bp, Homo sapiens
gggaaggcaggcag

SEQ ID NO: 4649019 - DNA, 22 bp, Homo sapiens
gggaaggctacttcggggctgg

SEQ ID NO: 4649020 - DNA, 18 bp, Homo sapiens
gggaagggagtctctctt

SEQ ID NO: 4649021 - DNA, 15 bp, Homo sapiens
gggaaggggctaggg

SEQ ID NO: 4649022 - DNA, 22 bp, Homo sapiens
gggaatgagcccagagaacagc

SEQ ID NO: 4649023 - DNA, 17 bp, Homo sapiens
gggacaaaggagcctgt

SEQ ID NO: 4649024 - DNA, 18 bp, Homo sapiens
gggacaaaggagcctgtg

SEQ ID NO: 4649025 - DNA, 19 bp, Homo sapiens
gggacaaccagaaggccct

SEQ ID NO: 4649026 - DNA, 18 bp, Homo sapiens
gggacaagtggactcagg

SEQ ID NO: 4649027 - DNA, 17 bp, Homo sapiens
gggacaccagggaagaa

SEQ ID NO: 4649028 - DNA, 13 bp, Homo sapiens
gggacactttgtt

SEQ ID NO: 4649029 - DNA, 19 bp, Homo sapiens
gggacagcccagagcctgg

SEQ ID NO: 4649030 - DNA, 21 bp, Homo sapiens
gggacagcccagagcctggct

SEQ ID NO: 4649031 - DNA, 17 bp, Homo sapiens
gggacaggagaagagag

SEQ ID NO: 4649032 - DNA, 12 bp, Homo sapiens
gggacaggctga

SEQ ID NO: 4649033 - DNA, 15 bp, Homo sapiens
gggacatctctttga

SEQ ID NO: 4649034 - DNA, 16 bp, Homo sapiens
gggaccaacctgacct

SEQ ID NO: 4649035 - DNA, 12 bp, Homo sapiens
gggacccacctg

SEQ ID NO: 4649036 - DNA, 12 bp, Homo sapiens
gggaccccagct

SEQ ID NO: 4649037 - DNA, 13 bp, Homo sapiens
gggaccccagctg

SEQ ID NO: 4649038 - DNA, 15 bp, Homo sapiens
gggaccccagctgct

SEQ ID NO: 4649039 - DNA, 13 bp, Homo sapiens
gggaccccccccc

SEQ ID NO: 4649040 - DNA, 22 bp, Homo sapiens
gggaccgctacaccactctggc

SEQ ID NO: 4649041 - DNA, 13 bp, Homo sapiens
gggaccggcagag

SEQ ID NO: 4649042 - DNA, 14 bp, Homo sapiens
gggaccggcagagc

SEQ ID NO: 4649043 - DNA, 16 bp, Homo sapiens
gggaccggcagagctc

SEQ ID NO: 4649044 - DNA, 17 bp, Homo sapiens
gggaccggcagagctct

SEQ ID NO: 4649045 - DNA, 13 bp, Homo sapiens
gggaccggtgctg

SEQ ID NO: 4649046 - DNA, 20 bp, Homo sapiens
gggaccggtgctgcaggagt

SEQ ID NO: 4649047 - DNA, 20 bp, Homo sapiens
gggacctccccagcccagga

SEQ ID NO: 4649048 - DNA, 19 bp, Homo sapiens
gggacgtggctcagccagc

SEQ ID NO: 4649049 - DNA, 22 bp, Homo sapiens
gggacgtggctcagccagcact

SEQ ID NO: 4649050 - DNA, 20 bp, Homo sapiens
gggactgagttcaggttacc

SEQ ID NO: 4649051 - DNA, 16 bp, Homo sapiens
gggactttcccaccca

SEQ ID NO: 4649052 - DNA, 19 bp, Homo sapiens
gggactttcccacccagga

SEQ ID NO: 4649053 - DNA, 16 bp, Homo sapiens
gggagaaattgacaga

SEQ ID NO: 4649054 - DNA, 17 bp, Homo sapiens
gggagaggtcagccttg

SEQ ID NO: 4649055 - DNA, 16 bp, Homo sapiens
gggagccgctggcaga

SEQ ID NO: 4649056 - DNA, 21 bp, Homo sapiens
gggagcctccctgcctcaggc

SEQ ID NO: 4649057 - DNA, 15 bp, Homo sapiens
gggagctgagctgga

SEQ ID NO: 4649058 - DNA, 22 bp, Homo sapiens
gggagctgagctggaaggggcc

SEQ ID NO: 4649059 - DNA, 12 bp, Homo sapiens
gggagctgaggc

SEQ ID NO: 4649060 - DNA, 12 bp, Homo sapiens
gggagctgccaa

SEQ ID NO: 4649061 - DNA, 17 bp, Homo sapiens
gggagcttccgctttga

SEQ ID NO: 4649062 - DNA, 23 bp, Homo sapiens
gggaggacaaaacttcttgtcag

SEQ ID NO: 4649063 - DNA, 13 bp, Homo sapiens
gggagggaaaagg

SEQ ID NO: 4649064 - DNA, 18 bp, Homo sapiens
gggagggctctgaggcgc

SEQ ID NO: 4649065 - DNA, 19 bp, Homo sapiens
gggagggctctgaggcgcc

SEQ ID NO: 4649066 - DNA, 11 bp, Homo sapiens
gggaggggagg

SEQ ID NO: 4649067 - DNA, 21 bp, Homo sapiens
gggagtacctgtccaagacag

SEQ ID NO: 4649068 - DNA, 23 bp, Homo sapiens
gggagtgctggctcacagtacag

SEQ ID NO: 4649069 - DNA, 22 bp, Homo sapiens
gggatagtctgggtcagaccca

SEQ ID NO: 4649070 - DNA, 13 bp, Homo sapiens
gggatccagccac

SEQ ID NO: 4649071 - DNA, 14 bp, Homo sapiens
gggatcctgcctgc

SEQ ID NO: 4649072 - DNA, 15 bp, Homo sapiens
gggatgcccttcccc

SEQ ID NO: 4649073 - DNA, 15 bp, Homo sapiens
gggatgctgggctgg

SEQ ID NO: 4649074 - DNA, 16 bp, Homo sapiens
gggatggagaaagaag

SEQ ID NO: 4649075 - DNA, 20 bp, Homo sapiens
gggattacaggcgtgagcca

SEQ ID NO: 4649076 - DNA, 22 bp, Homo sapiens
gggattcaggaaaaggcctggg

SEQ ID NO: 4649077 - DNA, 12 bp, Homo sapiens
gggcaagaggat

SEQ ID NO: 4649078 - DNA, 20 bp, Homo sapiens
gggcaagctaggccccagag

SEQ ID NO: 4649079 - DNA, 18 bp, Homo sapiens
gggcaatggccaggggcc

SEQ ID NO: 4649080 - DNA, 19 bp, Homo sapiens
gggcaatggccaggggcca

SEQ ID NO: 4649081 - DNA, 18 bp, Homo sapiens
gggcacaggagctacctg

SEQ ID NO: 4649082 - DNA, 16 bp, Homo sapiens
gggcacaggccatgga

SEQ ID NO: 4649083 - DNA, 19 bp, Homo sapiens
gggcacattaactccctcc

SEQ ID NO: 4649084 - DNA, 17 bp, Homo sapiens
gggcacccccagcctgg

SEQ ID NO: 4649085 - DNA, 21 bp, Homo sapiens
gggcactccgcgccgatgcca

SEQ ID NO: 4649086 - DNA, 20 bp, Homo sapiens
gggcacttaatttgtaaact

SEQ ID NO: 4649087 - DNA, 22 bp, Homo sapiens
gggcacttaatttgtaaacttc

SEQ ID NO: 4649088 - DNA, 22 bp, Homo sapiens
gggcagactgtgaacttgactg

SEQ ID NO: 4649089 - DNA, 11 bp, Homo sapiens
gggcagaggaa

SEQ ID NO: 4649090 - DNA, 14 bp, Homo sapiens
gggcagcactcccc

SEQ ID NO: 4649091 - DNA, 15 bp, Homo sapiens
gggcagcagccagcc

SEQ ID NO: 4649092 - DNA, 19 bp, Homo sapiens
gggcagcagccagccctgc

SEQ ID NO: 4649093 - DNA, 23 bp, Homo sapiens
gggcagcaggaggctttctgggc

SEQ ID NO: 4649094 - DNA, 17 bp, Homo sapiens
gggcagccccctcccta

SEQ ID NO: 4649095 - DNA, 16 bp, Homo sapiens
gggcagcgccaggctg

SEQ ID NO: 4649096 - DNA, 18 bp, Homo sapiens
gggcagcgcccttcctct

SEQ ID NO: 4649097 - DNA, 19 bp, Homo sapiens
gggcaggagtagctgagct

SEQ ID NO: 4649098 - DNA, 15 bp, Homo sapiens
gggcaggccagagct

SEQ ID NO: 4649099 - DNA, 17 bp, Homo sapiens
gggcaggccgggcctgc

SEQ ID NO: 4649100 - DNA, 12 bp, Homo sapiens
gggcagggagcg

SEQ ID NO: 4649101 - DNA, 16 bp, Homo sapiens
gggcagggcccacgtg

SEQ ID NO: 4649102 - DNA, 14 bp, Homo sapiens
gggcagtgcccttt

SEQ ID NO: 4649103 - DNA, 17 bp, Homo sapiens
gggcagttcgcagccac

SEQ ID NO: 4649104 - DNA, 17 bp, Homo sapiens
gggcagtttgggaaggt

SEQ ID NO: 4649105 - DNA, 23 bp, Homo sapiens
gggcatatcggctcacaaagaga

SEQ ID NO: 4649106 - DNA, 22 bp, Homo sapiens
gggcatgagtctgtttcccaag

SEQ ID NO: 4649107 - DNA, 17 bp, Homo sapiens
gggccactccttcctgc

SEQ ID NO: 4649108 - DNA, 21 bp, Homo sapiens
gggccactccttcctgcccca

SEQ ID NO: 4649109 - DNA, 11 bp, Homo sapiens
gggccagagca

SEQ ID NO: 4649110 - DNA, 12 bp, Homo sapiens
gggccagagcag

SEQ ID NO: 4649111 - DNA, 19 bp, Homo sapiens
gggccaggagtggggagag

SEQ ID NO: 4649112 - DNA, 18 bp, Homo sapiens
gggccagggtctgtgtga

SEQ ID NO: 4649113 - DNA, 14 bp, Homo sapiens
gggccagtgctcca

SEQ ID NO: 4649114 - DNA, 18 bp, Homo sapiens
gggccatgaactttgtcc

SEQ ID NO: 4649115 - DNA, 22 bp, Homo sapiens
gggccccatcctcatccctgac

SEQ ID NO: 4649116 - DNA, 15 bp, Homo sapiens
gggccccgccagggc

SEQ ID NO: 4649117 - DNA, 16 bp, Homo sapiens
gggccccgccagggct

SEQ ID NO: 4649118 - DNA, 17 bp, Homo sapiens
gggccccgccagggctg

SEQ ID NO: 4649119 - DNA, 15 bp, Homo sapiens
gggccccgggctgga

SEQ ID NO: 4649120 - DNA, 18 bp, Homo sapiens
gggccctctttccctgcg

SEQ ID NO: 4649121 - DNA, 11 bp, Homo sapiens
gggccctgcta

SEQ ID NO: 4649122 - DNA, 11 bp, Homo sapiens
gggccctggca

SEQ ID NO: 4649123 - DNA, 15 bp, Homo sapiens
gggccctggggcctg

SEQ ID NO: 4649124 - DNA, 18 bp, Homo sapiens
gggccctggggcctgtac

SEQ ID NO: 4649125 - DNA, 16 bp, Homo sapiens
gggccggggaactggc

SEQ ID NO: 4649126 - DNA, 20 bp, Homo sapiens
gggcctatggagagccctgg

SEQ ID NO: 4649127 - DNA, 15 bp, Homo sapiens
gggcctcaggctctg

SEQ ID NO: 4649128 - DNA, 18 bp, Homo sapiens
gggcctcaggctctgcac

SEQ ID NO: 4649129 - DNA, 20 bp, Homo sapiens
gggcctcaggctctgcacag

SEQ ID NO: 4649130 - DNA, 17 bp, Homo sapiens
gggcctgccccctgggg

SEQ ID NO: 4649131 - DNA, 16 bp, Homo sapiens
gggcctgcgagggcag

SEQ ID NO: 4649132 - DNA, 15 bp, Homo sapiens
gggcctgctgctgag

SEQ ID NO: 4649133 - DNA, 19 bp, Homo sapiens
gggcctgctgctgagaacc

SEQ ID NO: 4649134 - DNA, 20 bp, Homo sapiens
gggcctgctgctgagaacct

SEQ ID NO: 4649135 - DNA, 12 bp, Homo sapiens
gggcctggccct

SEQ ID NO: 4649136 - DNA, 16 bp, Homo sapiens
gggcctggctggctga

SEQ ID NO: 4649137 - DNA, 14 bp, Homo sapiens
gggcctggggcctg

SEQ ID NO: 4649138 - DNA, 19 bp, Homo sapiens
gggcctggggcctgagaga

SEQ ID NO: 4649139 - DNA, 15 bp, Homo sapiens
gggcctgtactgcct

SEQ ID NO: 4649140 - DNA, 18 bp, Homo sapiens
gggcctgtactgcctgct

SEQ ID NO: 4649141 - DNA, 16 bp, Homo sapiens
gggcctgtggaatgag

SEQ ID NO: 4649142 - DNA, 20 bp, Homo sapiens
gggccttagtgggccagggc

SEQ ID NO: 4649143 - DNA, 22 bp, Homo sapiens
gggccttagtgggccagggctg

SEQ ID NO: 4649144 - DNA, 12 bp, Homo sapiens
gggcggagggag

SEQ ID NO: 4649145 - DNA, 14 bp, Homo sapiens
gggcggagggaggg

SEQ ID NO: 4649146 - DNA, 16 bp, Homo sapiens
gggctatcctgggacc

SEQ ID NO: 4649147 - DNA, 16 bp, Homo sapiens
gggctcagggcctcag

SEQ ID NO: 4649148 - DNA, 17 bp, Homo sapiens
gggctctaacgcctgag

SEQ ID NO: 4649149 - DNA, 21 bp, Homo sapiens
gggctctaacgcctgagccca

SEQ ID NO: 4649150 - DNA, 13 bp, Homo sapiens
gggctctcctggc

SEQ ID NO: 4649151 - DNA, 22 bp, Homo sapiens
gggctctcctggcttcccatcc

SEQ ID NO: 4649152 - DNA, 15 bp, Homo sapiens
gggctctgaggcgcc

SEQ ID NO: 4649153 - DNA, 20 bp, Homo sapiens
gggctctgccccaggcccta

SEQ ID NO: 4649154 - DNA, 18 bp, Homo sapiens
gggctctgggtgctgccc

SEQ ID NO: 4649155 - DNA, 13 bp, Homo sapiens
gggctgccctgag

SEQ ID NO: 4649156 - DNA, 16 bp, Homo sapiens
gggctgccctgagaag

SEQ ID NO: 4649157 - DNA, 17 bp, Homo sapiens
gggctgctctttccact

SEQ ID NO: 4649158 - DNA, 16 bp, Homo sapiens
gggctggagaaagagc

SEQ ID NO: 4649159 - DNA, 19 bp, Homo sapiens
gggctggggacagagggtg

SEQ ID NO: 4649160 - DNA, 15 bp, Homo sapiens
gggctggggaggagg

SEQ ID NO: 4649161 - DNA, 17 bp, Homo sapiens
gggctggtcacctccca

SEQ ID NO: 4649162 - DNA, 16 bp, Homo sapiens
gggctgtcatctgtgc

SEQ ID NO: 4649163 - DNA, 12 bp, Homo sapiens
gggctgtgccaa

SEQ ID NO: 4649164 - DNA, 14 bp, Homo sapiens
gggctgtgccaacc

SEQ ID NO: 4649165 - DNA, 16 bp, Homo sapiens
gggctgtgccaacctg

SEQ ID NO: 4649166 - DNA, 18 bp, Homo sapiens
gggcttacggccctggcc

SEQ ID NO: 4649167 - DNA, 14 bp, Homo sapiens
gggcttctcctcct

SEQ ID NO: 4649168 - DNA, 21 bp, Homo sapiens
ggggaactggccaagctgagg

SEQ ID NO: 4649169 - DNA, 13 bp, Homo sapiens
ggggaaggaagga

SEQ ID NO: 4649170 - DNA, 14 bp, Homo sapiens
ggggactttattta

SEQ ID NO: 4649171 - DNA, 12 bp, Homo sapiens
ggggagaggtca

SEQ ID NO: 4649172 - DNA, 13 bp, Homo sapiens
ggggagaggtcag

SEQ ID NO: 4649173 - DNA, 22 bp, Homo sapiens
ggggagccccttctgctcagct

SEQ ID NO: 4649174 - DNA, 15 bp, Homo sapiens
ggggatccagccact

SEQ ID NO: 4649175 - DNA, 21 bp, Homo sapiens
ggggatccagccacttccccc

SEQ ID NO: 4649176 - DNA, 20 bp, Homo sapiens
ggggatgagagggtgctatc

SEQ ID NO: 4649177 - DNA, 13 bp, Homo sapiens
ggggcagcactcc

SEQ ID NO: 4649178 - DNA, 19 bp, Homo sapiens
ggggcaggagtagctgagc

SEQ ID NO: 4649179 - DNA, 21 bp, Homo sapiens
ggggcaggagtagctgagctc

SEQ ID NO: 4649180 - DNA, 17 bp, Homo sapiens
ggggcaggccgggcctg

SEQ ID NO: 4649181 - DNA, 20 bp, Homo sapiens
ggggccaggagtggggagag

SEQ ID NO: 4649182 - DNA, 12 bp, Homo sapiens
ggggccaggccc

SEQ ID NO: 4649183 - DNA, 13 bp, Homo sapiens
ggggccaggcccc

SEQ ID NO: 4649184 - DNA, 15 bp, Homo sapiens
ggggccccgccaggg

SEQ ID NO: 4649185 - DNA, 17 bp, Homo sapiens
ggggccccgccagggct

SEQ ID NO: 4649186 - DNA, 19 bp, Homo sapiens
ggggccccgccagggctgg

SEQ ID NO: 4649187 - DNA, 15 bp, Homo sapiens
ggggcctgagagaat

SEQ ID NO: 4649188 - DNA, 15 bp, Homo sapiens
ggggcctgcagaagg

SEQ ID NO: 4649189 - DNA, 19 bp, Homo sapiens
ggggcctggctggctgagg

SEQ ID NO: 4649190 - DNA, 14 bp, Homo sapiens
ggggcctgtactgc

SEQ ID NO: 4649191 - DNA, 12 bp, Homo sapiens
ggggcctgtctc

SEQ ID NO: 4649192 - DNA, 18 bp, Homo sapiens
ggggctagggaggaccaa

SEQ ID NO: 4649193 - DNA, 22 bp, Homo sapiens
ggggctatcctgggacctcccc

SEQ ID NO: 4649194 - DNA, 17 bp, Homo sapiens
ggggctctaacgcctga

SEQ ID NO: 4649195 - DNA, 23 bp, Homo sapiens
ggggctctaacgcctgagcccag

SEQ ID NO: 4649196 - DNA, 12 bp, Homo sapiens
gggggaatgagc

SEQ ID NO: 4649197 - DNA, 15 bp, Homo sapiens
gggggcaggggcagg

SEQ ID NO: 4649198 - DNA, 21 bp, Homo sapiens
gggggcgggattctctctcta

SEQ ID NO: 4649199 - DNA, 19 bp, Homo sapiens
gggggctcccgtggcctgt

SEQ ID NO: 4649200 - DNA, 20 bp, Homo sapiens
ggggtatttcaattaccttc

SEQ ID NO: 4649201 - DNA, 17 bp, Homo sapiens
ggggtcaagctgagctg

SEQ ID NO: 4649202 - DNA, 22 bp, Homo sapiens
ggggtccctggagggcaagccc

SEQ ID NO: 4649203 - DNA, 23 bp, Homo sapiens
ggggtgatgagggcagcagccag

SEQ ID NO: 4649204 - DNA, 16 bp, Homo sapiens
ggggtgcccacaggcc

SEQ ID NO: 4649205 - DNA, 19 bp, Homo sapiens
ggggtttaagctctgcccc

SEQ ID NO: 4649206 - DNA, 16 bp, Homo sapiens
ggggttttccaagccc

SEQ ID NO: 4649207 - DNA, 18 bp, Homo sapiens
gggtatactgaggggtct

SEQ ID NO: 4649208 - DNA, 16 bp, Homo sapiens
gggtatgcgtttcatg

SEQ ID NO: 4649209 - DNA, 15 bp, Homo sapiens
gggtcaagctgagct

SEQ ID NO: 4649210 - DNA, 15 bp, Homo sapiens
gggtcagacccatct

SEQ ID NO: 4649211 - DNA, 18 bp, Homo sapiens
gggtcgtggagagctagg

SEQ ID NO: 4649212 - DNA, 18 bp, Homo sapiens
gggtctctccctcaggtg

SEQ ID NO: 4649213 - DNA, 22 bp, Homo sapiens
gggtctggcagcctcccatcca

SEQ ID NO: 4649214 - DNA, 17 bp, Homo sapiens
gggtctgtgtgaatgtg

SEQ ID NO: 4649215 - DNA, 21 bp, Homo sapiens
gggtcttttcatctgggaaag

SEQ ID NO: 4649216 - DNA, 18 bp, Homo sapiens
gggtgacagtcatcatca

SEQ ID NO: 4649217 - DNA, 20 bp, Homo sapiens
gggtgacagtcatcatcagg

SEQ ID NO: 4649218 - DNA, 22 bp, Homo sapiens
gggtgacagtcatcatcagggc

SEQ ID NO: 4649219 - DNA, 14 bp, Homo sapiens
gggtgatgagggca

SEQ ID NO: 4649220 - DNA, 19 bp, Homo sapiens
gggtgcacaggagggggtc

SEQ ID NO: 4649221 - DNA, 23 bp, Homo sapiens
gggtgcagtatcatgccctgtgc

SEQ ID NO: 4649222 - DNA, 19 bp, Homo sapiens
gggtggctactctgtgcca

SEQ ID NO: 4649223 - DNA, 20 bp, Homo sapiens
gggtgggcctggccctgctt

SEQ ID NO: 4649224 - DNA, 13 bp, Homo sapiens
gggtgtagccagg

SEQ ID NO: 4649225 - DNA, 22 bp, Homo sapiens
gggttcacgtaatcctcctgag

SEQ ID NO: 4649226 - DNA, 23 bp, Homo sapiens
gggttcacgtaatcctcctgagt

SEQ ID NO: 4649227 - DNA, 21 bp, Homo sapiens
gggttggagcagtagctggag

SEQ ID NO: 4649228 - DNA, 15 bp, Homo sapiens
ggtaaatcccacatc

SEQ ID NO: 4649229 - DNA, 16 bp, Homo sapiens
ggtaactgtcctgtcc

SEQ ID NO: 4649230 - DNA, 14 bp, Homo sapiens
ggtaagttgctatt

SEQ ID NO: 4649231 - DNA, 13 bp, Homo sapiens
ggtacaggagagg

SEQ ID NO: 4649232 - DNA, 17 bp, Homo sapiens
ggtacaggagaggcagc

SEQ ID NO: 4649233 - DNA, 18 bp, Homo sapiens
ggtacatggtgtttgtgg

SEQ ID NO: 4649234 - DNA, 19 bp, Homo sapiens
ggtacccctttctggctct

SEQ ID NO: 4649235 - DNA, 13 bp, Homo sapiens
ggtacctgccctc

SEQ ID NO: 4649236 - DNA, 17 bp, Homo sapiens
ggtacctgccctctatt

SEQ ID NO: 4649237 - DNA, 19 bp, Homo sapiens
ggtactgcattctctccca

SEQ ID NO: 4649238 - DNA, 22 bp, Homo sapiens
ggtactgcattctctcccatcc

SEQ ID NO: 4649239 - DNA, 21 bp, Homo sapiens
ggtactgtggggtggacctgg

SEQ ID NO: 4649240 - DNA, 12 bp, Homo sapiens
ggtacttcctct

SEQ ID NO: 4649241 - DNA, 11 bp, Homo sapiens
ggtagcctatt

SEQ ID NO: 4649242 - DNA, 22 bp, Homo sapiens
ggtagctatagttgcagcccaa

SEQ ID NO: 4649243 - DNA, 19 bp, Homo sapiens
ggtaggccccacaaggcct

SEQ ID NO: 4649244 - DNA, 15 bp, Homo sapiens
ggtaggttgggacac

SEQ ID NO: 4649245 - DNA, 20 bp, Homo sapiens
ggtagtcatgctgtgcattt

SEQ ID NO: 4649246 - DNA, 15 bp, Homo sapiens
ggtatactgaggggt

SEQ ID NO: 4649247 - DNA, 20 bp, Homo sapiens
ggtatcctgggggaagagga

SEQ ID NO: 4649248 - DNA, 18 bp, Homo sapiens
ggtatttcttggcatgca

SEQ ID NO: 4649249 - DNA, 21 bp, Homo sapiens
ggtatttgtttgtagctttcc

SEQ ID NO: 4649250 - DNA, 21 bp, Homo sapiens
ggtattttattttggcttcat

SEQ ID NO: 4649251 - DNA, 21 bp, Homo sapiens
ggtatttttttgtaattgctt

SEQ ID NO: 4649252 - DNA, 18 bp, Homo sapiens
ggtcaagaaacagccagc

SEQ ID NO: 4649253 - DNA, 21 bp, Homo sapiens
ggtcaagaaacagccagcaag

SEQ ID NO: 4649254 - DNA, 20 bp, Homo sapiens
ggtcaagcctcttatggggg

SEQ ID NO: 4649255 - DNA, 13 bp, Homo sapiens
ggtcaagctgagc

SEQ ID NO: 4649256 - DNA, 21 bp, Homo sapiens
ggtcacacccaccccctgcct

SEQ ID NO: 4649257 - DNA, 22 bp, Homo sapiens
ggtcacacccaccccctgcctg

SEQ ID NO: 4649258 - DNA, 15 bp, Homo sapiens
ggtcaccaagcagtg

SEQ ID NO: 4649259 - DNA, 13 bp, Homo sapiens
ggtcaccagctgc

SEQ ID NO: 4649260 - DNA, 21 bp, Homo sapiens
ggtcaccaggggaggagcctg

SEQ ID NO: 4649261 - DNA, 12 bp, Homo sapiens
ggtcacctccca

SEQ ID NO: 4649262 - DNA, 19 bp, Homo sapiens
ggtcagaacaggttttttt

SEQ ID NO: 4649263 - DNA, 20 bp, Homo sapiens
ggtcagcccatggaggcaga

SEQ ID NO: 4649264 - DNA, 14 bp, Homo sapiens
ggtcagccttgacc

SEQ ID NO: 4649265 - DNA, 13 bp, Homo sapiens
ggtcataaaatag

SEQ ID NO: 4649266 - DNA, 20 bp, Homo sapiens
ggtcccacatccctgggcct

SEQ ID NO: 4649267 - DNA, 22 bp, Homo sapiens
ggtcccacatccctgggcctgc

SEQ ID NO: 4649268 - DNA, 12 bp, Homo sapiens
ggtcccagccct

SEQ ID NO: 4649269 - DNA, 13 bp, Homo sapiens
ggtcccagccctg

SEQ ID NO: 4649270 - DNA, 22 bp, Homo sapiens
ggtccctggagggcaagccctg

SEQ ID NO: 4649271 - DNA, 13 bp, Homo sapiens
ggtccctgggagg

SEQ ID NO: 4649272 - DNA, 22 bp, Homo sapiens
ggtcccttaaggcacagtggga

SEQ ID NO: 4649273 - DNA, 14 bp, Homo sapiens
ggtccgtgcgggaa

SEQ ID NO: 4649274 - DNA, 18 bp, Homo sapiens
ggtcctagggtgggaagg

SEQ ID NO: 4649275 - DNA, 21 bp, Homo sapiens
ggtcctctgtcagtcacagcc

SEQ ID NO: 4649276 - DNA, 18 bp, Homo sapiens
ggtcctggtggggcagct

SEQ ID NO: 4649277 - DNA, 14 bp, Homo sapiens
ggtcggatctcaca

SEQ ID NO: 4649278 - DNA, 15 bp, Homo sapiens
ggtcggatctcacag

SEQ ID NO: 4649279 - DNA, 13 bp, Homo sapiens
ggtctaacttttg

SEQ ID NO: 4649280 - DNA, 14 bp, Homo sapiens
ggtctaggacacag

SEQ ID NO: 4649281 - DNA, 20 bp, Homo sapiens
ggtctcccttctctacactc

SEQ ID NO: 4649282 - DNA, 23 bp, Homo sapiens
ggtctcctgggaaagggagatgt

SEQ ID NO: 4649283 - DNA, 13 bp, Homo sapiens
ggtctccttcctt

SEQ ID NO: 4649284 - DNA, 20 bp, Homo sapiens
ggtctcggatgacaccctgg

SEQ ID NO: 4649285 - DNA, 16 bp, Homo sapiens
ggtctctccctcaggt

SEQ ID NO: 4649286 - DNA, 12 bp, Homo sapiens
ggtctctgaagg

SEQ ID NO: 4649287 - DNA, 20 bp, Homo sapiens
ggtctgagtctatgttcaaa

SEQ ID NO: 4649288 - DNA, 11 bp, Homo sapiens
ggtctggcagg

SEQ ID NO: 4649289 - DNA, 22 bp, Homo sapiens
ggtctggctagagggcccaaag

SEQ ID NO: 4649290 - DNA, 23 bp, Homo sapiens
ggtctggcttgggtgaatttcag

SEQ ID NO: 4649291 - DNA, 17 bp, Homo sapiens
ggtctgtgtgaatgtgg

SEQ ID NO: 4649292 - DNA, 13 bp, Homo sapiens
ggtctgttcttga

SEQ ID NO: 4649293 - DNA, 18 bp, Homo sapiens
ggtctgttcttgaagcag

SEQ ID NO: 4649294 - DNA, 15 bp, Homo sapiens
ggtcttagctttaca

SEQ ID NO: 4649295 - DNA, 16 bp, Homo sapiens
ggtcttagctttacat

SEQ ID NO: 4649296 - DNA, 19 bp, Homo sapiens
ggtcttcctgtggctccct

SEQ ID NO: 4649297 - DNA, 22 bp, Homo sapiens
ggtctttccatctatcactgca

SEQ ID NO: 4649298 - DNA, 17 bp, Homo sapiens
ggtctttttatgcattt

SEQ ID NO: 4649299 - DNA, 19 bp, Homo sapiens
ggtgaacaaagcagccacg

SEQ ID NO: 4649300 - DNA, 14 bp, Homo sapiens
ggtgaattttcaag

SEQ ID NO: 4649301 - DNA, 19 bp, Homo sapiens
ggtgaattttcaaggcctt

SEQ ID NO: 4649302 - DNA, 18 bp, Homo sapiens
ggtgacaagatagagagc

SEQ ID NO: 4649303 - DNA, 20 bp, Homo sapiens
ggtgacactccagttgcaga

SEQ ID NO: 4649304 - DNA, 12 bp, Homo sapiens
ggtgacagtcat

SEQ ID NO: 4649305 - DNA, 19 bp, Homo sapiens
ggtgacagtcatcatcagg

SEQ ID NO: 4649306 - DNA, 21 bp, Homo sapiens
ggtgacagtcatcatcagggc

SEQ ID NO: 4649307 - DNA, 22 bp, Homo sapiens
ggtgacagtcatcatcagggcc

SEQ ID NO: 4649308 - DNA, 14 bp, Homo sapiens
ggtgaccccagggc

SEQ ID NO: 4649309 - DNA, 17 bp, Homo sapiens
ggtgaccccagggcaca

SEQ ID NO: 4649310 - DNA, 21 bp, Homo sapiens
ggtgacccggcaccccctgca

SEQ ID NO: 4649311 - DNA, 23 bp, Homo sapiens
ggtgacccggcaccccctgcagc

SEQ ID NO: 4649312 - DNA, 19 bp, Homo sapiens
ggtgacggccctcatctat

SEQ ID NO: 4649313 - DNA, 15 bp, Homo sapiens
ggtgacttgtctgcc

SEQ ID NO: 4649314 - DNA, 12 bp, Homo sapiens
ggtgagaattca

SEQ ID NO: 4649315 - DNA, 16 bp, Homo sapiens
ggtgagatgcagctgg

SEQ ID NO: 4649316 - DNA, 23 bp, Homo sapiens
ggtgatccgcccacctcagcctc

SEQ ID NO: 4649317 - DNA, 16 bp, Homo sapiens
ggtgatgagggcagca

SEQ ID NO: 4649318 - DNA, 22 bp, Homo sapiens
ggtgatgagggcagcagccagc

SEQ ID NO: 4649319 - DNA, 14 bp, Homo sapiens
ggtgcacaggaggg

SEQ ID NO: 4649320 - DNA, 15 bp, Homo sapiens
ggtgcagacagaagt

SEQ ID NO: 4649321 - DNA, 16 bp, Homo sapiens
ggtgcagggcctggca

SEQ ID NO: 4649322 - DNA, 17 bp, Homo sapiens
ggtgcagggcctggcat

SEQ ID NO: 4649323 - DNA, 13 bp, Homo sapiens
ggtgcagtggagg

SEQ ID NO: 4649324 - DNA, 17 bp, Homo sapiens
ggtgcatgatcttgagc

SEQ ID NO: 4649325 - DNA, 14 bp, Homo sapiens
ggtgccaccaccct

SEQ ID NO: 4649326 - DNA, 17 bp, Homo sapiens
ggtgccaccaccctgcc

SEQ ID NO: 4649327 - DNA, 19 bp, Homo sapiens
ggtgccaccaccctgcccc

SEQ ID NO: 4649328 - DNA, 13 bp, Homo sapiens
ggtgcccacaggc

SEQ ID NO: 4649329 - DNA, 16 bp, Homo sapiens
ggtgcccactccgcca

SEQ ID NO: 4649330 - DNA, 19 bp, Homo sapiens
ggtgcccactccgccagcc

SEQ ID NO: 4649331 - DNA, 20 bp, Homo sapiens
ggtgcccactccgccagcca

SEQ ID NO: 4649332 - DNA, 22 bp, Homo sapiens
ggtgcccactccgccagccaca

SEQ ID NO: 4649333 - DNA, 23 bp, Homo sapiens
ggtgcccactccgccagccacag

SEQ ID NO: 4649334 - DNA, 24 bp, Homo sapiens
ggtgcccactccgccagccacagg

SEQ ID NO: 4649335 - DNA, 14 bp, Homo sapiens
ggtgctatttgaag

SEQ ID NO: 4649336 - DNA, 15 bp, Homo sapiens
ggtgctgcaggagtg

SEQ ID NO: 4649337 - DNA, 21 bp, Homo sapiens
ggtgctgcaggagtgtcctgc

SEQ ID NO: 4649338 - DNA, 14 bp, Homo sapiens
ggtggacctgggac

SEQ ID NO: 4649339 - DNA, 15 bp, Homo sapiens
ggtggacctgggaca

SEQ ID NO: 4649340 - DNA, 23 bp, Homo sapiens
ggtggcacttccacctccagcct

SEQ ID NO: 4649341 - DNA, 12 bp, Homo sapiens
ggtggggcagct

SEQ ID NO: 4649342 - DNA, 13 bp, Homo sapiens
ggtgggtgctcag

SEQ ID NO: 4649343 - DNA, 13 bp, Homo sapiens
ggtggtcttgtgg

SEQ ID NO: 4649344 - DNA, 14 bp, Homo sapiens
ggtgtcatttcatt

SEQ ID NO: 4649345 - DNA, 13 bp, Homo sapiens
ggtgtgaatgcac

SEQ ID NO: 4649346 - DNA, 13 bp, Homo sapiens
ggtgtgatggtct

SEQ ID NO: 4649347 - DNA, 15 bp, Homo sapiens
ggtgtgccctgtgtg

SEQ ID NO: 4649348 - DNA, 14 bp, Homo sapiens
ggtgtttcaacaga

SEQ ID NO: 4649349 - DNA, 19 bp, Homo sapiens
ggttatttattttttaaga

SEQ ID NO: 4649350 - DNA, 22 bp, Homo sapiens
ggttcacgtaatcctcctgagt

SEQ ID NO: 4649351 - DNA, 14 bp, Homo sapiens
ggttccccaagggc

SEQ ID NO: 4649352 - DNA, 19 bp, Homo sapiens
ggttccccaagggccctgg

SEQ ID NO: 4649353 - DNA, 19 bp, Homo sapiens
ggttcctcgttctccctgg

SEQ ID NO: 4649354 - DNA, 20 bp, Homo sapiens
ggttctatttattcctgtta

SEQ ID NO: 4649355 - DNA, 14 bp, Homo sapiens
ggttggggtgacag

SEQ ID NO: 4649356 - DNA, 11 bp, Homo sapiens
ggttgtgtgtg

SEQ ID NO: 4649357 - DNA, 21 bp, Homo sapiens
ggtttattctatctgttttta

SEQ ID NO: 4649358 - DNA, 16 bp, Homo sapiens
ggtttcaaactcctga

SEQ ID NO: 4649359 - DNA, 22 bp, Homo sapiens
ggtttcaaactcctgacctcag

SEQ ID NO: 4649360 - DNA, 15 bp, Homo sapiens
ggtttcaacaaattt

SEQ ID NO: 4649361 - DNA, 19 bp, Homo sapiens
ggtttcaacaaatttcatt

SEQ ID NO: 4649362 - DNA, 12 bp, Homo sapiens
ggtttccaaagg

SEQ ID NO: 4649363 - DNA, 20 bp, Homo sapiens
ggtttccctttatttctctt

SEQ ID NO: 4649364 - DNA, 16 bp, Homo sapiens
ggtttctctccctcct

SEQ ID NO: 4649365 - DNA, 21 bp, Homo sapiens
ggtttgccaaaattcatttct

SEQ ID NO: 4649366 - DNA, 18 bp, Homo sapiens
ggtttttagagaatgtgt

SEQ ID NO: 4649367 - DNA, 19 bp, Homo sapiens
gtaaaaaaaaaaacaatta

SEQ ID NO: 4649368 - DNA, 23 bp, Homo sapiens
gtaaaaaatgtctcatgtcaatg

SEQ ID NO: 4649369 - DNA, 14 bp, Homo sapiens
gtaaaacaaaattt

SEQ ID NO: 4649370 - DNA, 20 bp, Homo sapiens
gtaaaacagggccacataga

SEQ ID NO: 4649371 - DNA, 16 bp, Homo sapiens
gtaaaaccttgttcta

SEQ ID NO: 4649372 - DNA, 19 bp, Homo sapiens
gtaaaagcagggcagcagg

SEQ ID NO: 4649373 - DNA, 20 bp, Homo sapiens
gtaaaaggccaaacctctgt

SEQ ID NO: 4649374 - DNA, 14 bp, Homo sapiens
gtaaaccattgtaa

SEQ ID NO: 4649375 - DNA, 16 bp, Homo sapiens
gtaaagaaatgtctta

SEQ ID NO: 4649376 - DNA, 16 bp, Homo sapiens
gtaaagtccccagaga

SEQ ID NO: 4649377 - DNA, 18 bp, Homo sapiens
gtaaagtccccagagaaa

SEQ ID NO: 4649378 - DNA, 19 bp, Homo sapiens
gtaaatatggggatagtct

SEQ ID NO: 4649379 - DNA, 18 bp, Homo sapiens
gtaaatcagaaagtaaca

SEQ ID NO: 4649380 - DNA, 17 bp, Homo sapiens
gtaaattaaacattttt

SEQ ID NO: 4649381 - DNA, 14 bp, Homo sapiens
gtaaattgctctgt

SEQ ID NO: 4649382 - DNA, 22 bp, Homo sapiens
gtaacaggtattttgtttcttt

SEQ ID NO: 4649383 - DNA, 19 bp, Homo sapiens
gtaacatgcatactttatt

SEQ ID NO: 4649384 - DNA, 16 bp, Homo sapiens
gtaactattaaccttt

SEQ ID NO: 4649385 - DNA, 22 bp, Homo sapiens
gtaactattaaccttttttgtc

SEQ ID NO: 4649386 - DNA, 23 bp, Homo sapiens
gtaactattaaccttttttgtct

SEQ ID NO: 4649387 - DNA, 14 bp, Homo sapiens
gtaactgagagaaa

SEQ ID NO: 4649388 - DNA, 16 bp, Homo sapiens
gtaactgtcctgtcct

SEQ ID NO: 4649389 - DNA, 14 bp, Homo sapiens
gtaactttctctta

SEQ ID NO: 4649390 - DNA, 23 bp, Homo sapiens
gtaagaacaactacctgagctaa

SEQ ID NO: 4649391 - DNA, 16 bp, Homo sapiens
gtaagcgatttgaaac

SEQ ID NO: 4649392 - DNA, 12 bp, Homo sapiens
gtaagggcagtg

SEQ ID NO: 4649393 - DNA, 20 bp, Homo sapiens
gtaagtaatatcaaagcatt

SEQ ID NO: 4649394 - DNA, 23 bp, Homo sapiens
gtaatatgacagataacctaata

SEQ ID NO: 4649395 - DNA, 20 bp, Homo sapiens
gtaatatggaaatcttttac

SEQ ID NO: 4649396 - DNA, 15 bp, Homo sapiens
gtaatcatttgttta

SEQ ID NO: 4649397 - DNA, 18 bp, Homo sapiens
gtaatcatttgtttacat

SEQ ID NO: 4649398 - DNA, 12 bp, Homo sapiens
gtaatcatttta

SEQ ID NO: 4649399 - DNA, 16 bp, Homo sapiens
gtaatcccagtacttt

SEQ ID NO: 4649400 - DNA, 16 bp, Homo sapiens
gtaatcctagctactt

SEQ ID NO: 4649401 - DNA, 23 bp, Homo sapiens
gtaatcctagctacttggcaggc

SEQ ID NO: 4649402 - DNA, 16 bp, Homo sapiens
gtaatctgtgtacaaa

SEQ ID NO: 4649403 - DNA, 14 bp, Homo sapiens
gtaatgaaatgttt

SEQ ID NO: 4649404 - DNA, 18 bp, Homo sapiens
gtaatgacttagaaactg

SEQ ID NO: 4649405 - DNA, 19 bp, Homo sapiens
gtaatgattttggaactgt

SEQ ID NO: 4649406 - DNA, 20 bp, Homo sapiens
gtaatggaggtcccagccct

SEQ ID NO: 4649407 - DNA, 21 bp, Homo sapiens
gtaatggaggtcccagccctg

SEQ ID NO: 4649408 - DNA, 14 bp, Homo sapiens
gtaatggcagagca

SEQ ID NO: 4649409 - DNA, 16 bp, Homo sapiens
gtaatggcagagcagt

SEQ ID NO: 4649410 - DNA, 17 bp, Homo sapiens
gtaattaactgtaaact

SEQ ID NO: 4649411 - DNA, 22 bp, Homo sapiens
gtaattgctttgtgcctttggg

SEQ ID NO: 4649412 - DNA, 12 bp, Homo sapiens
gtaattgctttt

SEQ ID NO: 4649413 - DNA, 23 bp, Homo sapiens
gtacaataagcgttaagggcaga

SEQ ID NO: 4649414 - DNA, 19 bp, Homo sapiens
gtacaataattcatattct

SEQ ID NO: 4649415 - DNA, 18 bp, Homo sapiens
gtacaatgaagaagtttc

SEQ ID NO: 4649416 - DNA, 17 bp, Homo sapiens
gtacacgtgtcctgtag

SEQ ID NO: 4649417 - DNA, 19 bp, Homo sapiens
gtacactacattttttcta

SEQ ID NO: 4649418 - DNA, 13 bp, Homo sapiens
gtacactttttac

SEQ ID NO: 4649419 - DNA, 20 bp, Homo sapiens
gtacagaggtcagcacacat

SEQ ID NO: 4649420 - DNA, 13 bp, Homo sapiens
gtacagtttttat

SEQ ID NO: 4649421 - DNA, 21 bp, Homo sapiens
gtacatacggttctgttatac

SEQ ID NO: 4649422 - DNA, 15 bp, Homo sapiens
gtacatgtgtgcaga

SEQ ID NO: 4649423 - DNA, 19 bp, Homo sapiens
gtacatgtgtgcagagcag

SEQ ID NO: 4649424 - DNA, 13 bp, Homo sapiens
gtacatttattca

SEQ ID NO: 4649425 - DNA, 19 bp, Homo sapiens
gtacattttgtaaaatatt

SEQ ID NO: 4649426 - DNA, 23 bp, Homo sapiens
gtacattttgtaaaatattatgt

SEQ ID NO: 4649427 - DNA, 16 bp, Homo sapiens
gtaccagcccagatgt

SEQ ID NO: 4649428 - DNA, 21 bp, Homo sapiens
gtaccatgtgctacaggggcc

SEQ ID NO: 4649429 - DNA, 18 bp, Homo sapiens
gtaccgcgtctaccctgg

SEQ ID NO: 4649430 - DNA, 20 bp, Homo sapiens
gtaccgcgtctaccctggga

SEQ ID NO: 4649431 - DNA, 17 bp, Homo sapiens
gtacctagctggctctg

SEQ ID NO: 4649432 - DNA, 19 bp, Homo sapiens
gtacctcaagccccatttc

SEQ ID NO: 4649433 - DNA, 14 bp, Homo sapiens
gtacctgccctcta

SEQ ID NO: 4649434 - DNA, 12 bp, Homo sapiens
gtacctggtgga

SEQ ID NO: 4649435 - DNA, 14 bp, Homo sapiens
gtacgattatactt

SEQ ID NO: 4649436 - DNA, 21 bp, Homo sapiens
gtactataatgaaaacatcct

SEQ ID NO: 4649437 - DNA, 19 bp, Homo sapiens
gtactgaccccatcaccta

SEQ ID NO: 4649438 - DNA, 18 bp, Homo sapiens
gtactgcattctctccca

SEQ ID NO: 4649439 - DNA, 22 bp, Homo sapiens
gtactgcattctctcccatcct

SEQ ID NO: 4649440 - DNA, 17 bp, Homo sapiens
gtactgttcatacagtt

SEQ ID NO: 4649441 - DNA, 22 bp, Homo sapiens
gtacttaagctcccctgcctta

SEQ ID NO: 4649442 - DNA, 15 bp, Homo sapiens
gtacttacattccag

SEQ ID NO: 4649443 - DNA, 14 bp, Homo sapiens
gtacttcctctgtg

SEQ ID NO: 4649444 - DNA, 15 bp, Homo sapiens
gtacttctctgtgtg

SEQ ID NO: 4649445 - DNA, 18 bp, Homo sapiens
gtagaactcactctgggc

SEQ ID NO: 4649446 - DNA, 21 bp, Homo sapiens
gtagaactcactctgggctgt

SEQ ID NO: 4649447 - DNA, 20 bp, Homo sapiens
gtagaactttattaagtaaa

SEQ ID NO: 4649448 - DNA, 12 bp, Homo sapiens
gtagaagatggc

SEQ ID NO: 4649449 - DNA, 14 bp, Homo sapiens
gtagacacaggtca

SEQ ID NO: 4649450 - DNA, 20 bp, Homo sapiens
gtagacactctgacaagctg

SEQ ID NO: 4649451 - DNA, 16 bp, Homo sapiens
gtagatacttcctgcc

SEQ ID NO: 4649452 - DNA, 23 bp, Homo sapiens
gtagcagtgtgaagtacaataat

SEQ ID NO: 4649453 - DNA, 21 bp, Homo sapiens
gtagccagcacacagggcagt

SEQ ID NO: 4649454 - DNA, 16 bp, Homo sapiens
gtagcctaaagggcag

SEQ ID NO: 4649455 - DNA, 21 bp, Homo sapiens
gtagctgggattacaggtgtg

SEQ ID NO: 4649456 - DNA, 17 bp, Homo sapiens
gtagctgtaagggcagt

SEQ ID NO: 4649457 - DNA, 16 bp, Homo sapiens
gtagctgtgacctgct

SEQ ID NO: 4649458 - DNA, 17 bp, Homo sapiens
gtagctgtgacctgctg

SEQ ID NO: 4649459 - DNA, 16 bp, Homo sapiens
gtagcttcttctgaaa

SEQ ID NO: 4649460 - DNA, 14 bp, Homo sapiens
gtagctttcctgga

SEQ ID NO: 4649461 - DNA, 15 bp, Homo sapiens
gtagctttcctggaa

SEQ ID NO: 4649462 - DNA, 16 bp, Homo sapiens
gtagctttcctggaag

SEQ ID NO: 4649463 - DNA, 21 bp, Homo sapiens
gtagctttttattattttaag

SEQ ID NO: 4649464 - DNA, 14 bp, Homo sapiens
gtaggaccaggcca

SEQ ID NO: 4649465 - DNA, 21 bp, Homo sapiens
gtaggagggactgtcgctgct

SEQ ID NO: 4649466 - DNA, 18 bp, Homo sapiens
gtaggatttttttcctcc

SEQ ID NO: 4649467 - DNA, 15 bp, Homo sapiens
gtaggccccacaagg

SEQ ID NO: 4649468 - DNA, 13 bp, Homo sapiens
gtaggctggttta

SEQ ID NO: 4649469 - DNA, 22 bp, Homo sapiens
gtagggatgcggatcctgctgg

SEQ ID NO: 4649470 - DNA, 22 bp, Homo sapiens
gtagtaacactgtgatttatct

SEQ ID NO: 4649471 - DNA, 15 bp, Homo sapiens
gtagtcataataaat

SEQ ID NO: 4649472 - DNA, 19 bp, Homo sapiens
gtagtcatgctgtgcattt

SEQ ID NO: 4649473 - DNA, 21 bp, Homo sapiens
gtagtccttggcatagacatg

SEQ ID NO: 4649474 - DNA, 19 bp, Homo sapiens
gtagtctcactgcttgaac

SEQ ID NO: 4649475 - DNA, 14 bp, Homo sapiens
gtagtgagatagca

SEQ ID NO: 4649476 - DNA, 19 bp, Homo sapiens
gtagttccctctgcctggg

SEQ ID NO: 4649477 - DNA, 20 bp, Homo sapiens
gtagtttttatatgttgtaa

SEQ ID NO: 4649478 - DNA, 14 bp, Homo sapiens
gtataagaaatgca

SEQ ID NO: 4649479 - DNA, 17 bp, Homo sapiens
gtataagaaatgcatat

SEQ ID NO: 4649480 - DNA, 17 bp, Homo sapiens
gtataatctttctatag

SEQ ID NO: 4649481 - DNA, 21 bp, Homo sapiens
gtataatctttctatagccaa

SEQ ID NO: 4649482 - DNA, 14 bp, Homo sapiens
gtatagaaatgctg

SEQ ID NO: 4649483 - DNA, 22 bp, Homo sapiens
gtatagaaatgctggtttttca

SEQ ID NO: 4649484 - DNA, 19 bp, Homo sapiens
gtatatgtgccacattttc

SEQ ID NO: 4649485 - DNA, 18 bp, Homo sapiens
gtatattatatggcagga

SEQ ID NO: 4649486 - DNA, 21 bp, Homo sapiens
gtatattatatggcaggagct

SEQ ID NO: 4649487 - DNA, 24 bp, Homo sapiens
gtatattccttttaaagaagcttt

SEQ ID NO: 4649488 - DNA, 21 bp, Homo sapiens
gtatattgtttaatcagttct

SEQ ID NO: 4649489 - DNA, 15 bp, Homo sapiens
gtatccccagtgccc

SEQ ID NO: 4649490 - DNA, 19 bp, Homo sapiens
gtatctacattaaaatgac

SEQ ID NO: 4649491 - DNA, 21 bp, Homo sapiens
gtatctgtatataagttgctg

SEQ ID NO: 4649492 - DNA, 15 bp, Homo sapiens
gtatcttaaaggaca

SEQ ID NO: 4649493 - DNA, 13 bp, Homo sapiens
gtatcttaaatct

SEQ ID NO: 4649494 - DNA, 17 bp, Homo sapiens
gtatgaataatgaaaat

SEQ ID NO: 4649495 - DNA, 19 bp, Homo sapiens
gtatgacccctggccacag

SEQ ID NO: 4649496 - DNA, 22 bp, Homo sapiens
gtatgacccctggccacagcct

SEQ ID NO: 4649497 - DNA, 18 bp, Homo sapiens
gtatgagagagagagtgt

SEQ ID NO: 4649498 - DNA, 17 bp, Homo sapiens
gtatgccacacctggcc

SEQ ID NO: 4649499 - DNA, 20 bp, Homo sapiens
gtatgccactgcactccagc

SEQ ID NO: 4649500 - DNA, 14 bp, Homo sapiens
gtatggtgtgttca

SEQ ID NO: 4649501 - DNA, 22 bp, Homo sapiens
gtatgtaatgtgtggtggcctc

SEQ ID NO: 4649502 - DNA, 23 bp, Homo sapiens
gtatgtaatgtgtggtggcctca

SEQ ID NO: 4649503 - DNA, 16 bp, Homo sapiens
gtattctttctgcctt

SEQ ID NO: 4649504 - DNA, 13 bp, Homo sapiens
gtatttataaaaa

SEQ ID NO: 4649505 - DNA, 20 bp, Homo sapiens
gtatttataaaaatataaat

SEQ ID NO: 4649506 - DNA, 18 bp, Homo sapiens
gtatttattaccgtcaca

SEQ ID NO: 4649507 - DNA, 13 bp, Homo sapiens
gtatttattccca

SEQ ID NO: 4649508 - DNA, 15 bp, Homo sapiens
gtatttcagaaggag

SEQ ID NO: 4649509 - DNA, 15 bp, Homo sapiens
gtatttctgttcctt

SEQ ID NO: 4649510 - DNA, 23 bp, Homo sapiens
gtatttgtttgtagctttcctgg

SEQ ID NO: 4649511 - DNA, 17 bp, Homo sapiens
gtcaaacattcgtgagc

SEQ ID NO: 4649512 - DNA, 23 bp, Homo sapiens
gtcaaacattcgtgagctgggga

SEQ ID NO: 4649513 - DNA, 16 bp, Homo sapiens
gtcaaataaatgtttc

SEQ ID NO: 4649514 - DNA, 21 bp, Homo sapiens
gtcaagctgagctggcttcgg

SEQ ID NO: 4649515 - DNA, 21 bp, Homo sapiens
gtcaagtaatggaggtcccag

SEQ ID NO: 4649516 - DNA, 23 bp, Homo sapiens
gtcacacccaccccctgcctggt

SEQ ID NO: 4649517 - DNA, 22 bp, Homo sapiens
gtcacatatcagaataggaaga

SEQ ID NO: 4649518 - DNA, 17 bp, Homo sapiens
gtcaccaagcagtggcc

SEQ ID NO: 4649519 - DNA, 13 bp, Homo sapiens
gtcaccagctgct

SEQ ID NO: 4649520 - DNA, 19 bp, Homo sapiens
gtcaccaggctggagtgca

SEQ ID NO: 4649521 - DNA, 13 bp, Homo sapiens
gtcaccaggggag

SEQ ID NO: 4649522 - DNA, 17 bp, Homo sapiens
gtcaccgagcgggtgca

SEQ ID NO: 4649523 - DNA, 15 bp, Homo sapiens
gtcacctcacaaacc

SEQ ID NO: 4649524 - DNA, 15 bp, Homo sapiens
gtcacctcagcactg

SEQ ID NO: 4649525 - DNA, 23 bp, Homo sapiens
gtcacctgccccgtagagaatgt

SEQ ID NO: 4649526 - DNA, 12 bp, Homo sapiens
gtcactagaatg

SEQ ID NO: 4649527 - DNA, 22 bp, Homo sapiens
gtcacttccccaagatctgcca

SEQ ID NO: 4649528 - DNA, 23 bp, Homo sapiens
gtcacttccccaagatctgccag

SEQ ID NO: 4649529 - DNA, 14 bp, Homo sapiens
gtcagacataaagc

SEQ ID NO: 4649530 - DNA, 15 bp, Homo sapiens
gtcagacataaagcc

SEQ ID NO: 4649531 - DNA, 17 bp, Homo sapiens
gtcagacataaagccat

SEQ ID NO: 4649532 - DNA, 14 bp, Homo sapiens
gtcagacccatctc

SEQ ID NO: 4649533 - DNA, 18 bp, Homo sapiens
gtcagacccatctctccc

SEQ ID NO: 4649534 - DNA, 23 bp, Homo sapiens
gtcagaggaacaaaccaggggac

SEQ ID NO: 4649535 - DNA, 14 bp, Homo sapiens
gtcagccagggcct

SEQ ID NO: 4649536 - DNA, 16 bp, Homo sapiens
gtcagcccatggaggc

SEQ ID NO: 4649537 - DNA, 12 bp, Homo sapiens
gtcagccttgac

SEQ ID NO: 4649538 - DNA, 16 bp, Homo sapiens
gtcaggatgaggcccc

SEQ ID NO: 4649539 - DNA, 17 bp, Homo sapiens
gtcaggatgaggccccg

SEQ ID NO: 4649540 - DNA, 20 bp, Homo sapiens
gtcagggagaggtcaccagc

SEQ ID NO: 4649541 - DNA, 18 bp, Homo sapiens
gtcagggtctccttcctt

SEQ ID NO: 4649542 - DNA, 22 bp, Homo sapiens
gtcagggtttgtcagaggaaca

SEQ ID NO: 4649543 - DNA, 20 bp, Homo sapiens
gtcagtgtagacacaggtca

SEQ ID NO: 4649544 - DNA, 19 bp, Homo sapiens
gtcagtgttaaagattttg

SEQ ID NO: 4649545 - DNA, 16 bp, Homo sapiens
gtcagttcaactttca

SEQ ID NO: 4649546 - DNA, 15 bp, Homo sapiens
gtcatcatcagggcc

SEQ ID NO: 4649547 - DNA, 16 bp, Homo sapiens
gtcatcatcagggcct

SEQ ID NO: 4649548 - DNA, 18 bp, Homo sapiens
gtcatcatcagggcctgg

SEQ ID NO: 4649549 - DNA, 16 bp, Homo sapiens
gtcatgctgtgcattt

SEQ ID NO: 4649550 - DNA, 18 bp, Homo sapiens
gtcatgttggccaggctg

SEQ ID NO: 4649551 - DNA, 22 bp, Homo sapiens
gtcattcttttgccacatccct

SEQ ID NO: 4649552 - DNA, 21 bp, Homo sapiens
gtcatttcattccattgccta

SEQ ID NO: 4649553 - DNA, 21 bp, Homo sapiens
gtccaagacagggctcatttt

SEQ ID NO: 4649554 - DNA, 14 bp, Homo sapiens
gtccacaaaggtca

SEQ ID NO: 4649555 - DNA, 14 bp, Homo sapiens
gtccacctgtgggt

SEQ ID NO: 4649556 - DNA, 17 bp, Homo sapiens
gtccaggttgatcttga

SEQ ID NO: 4649557 - DNA, 20 bp, Homo sapiens
gtccatagagatgagcccac

SEQ ID NO: 4649558 - DNA, 22 bp, Homo sapiens
gtccatctagggaatgggactg

SEQ ID NO: 4649559 - DNA, 13 bp, Homo sapiens
gtccatcttgttt

SEQ ID NO: 4649560 - DNA, 18 bp, Homo sapiens
gtccatcttgtttcattt

SEQ ID NO: 4649561 - DNA, 18 bp, Homo sapiens
gtccatgctaacaaagac

SEQ ID NO: 4649562 - DNA, 14 bp, Homo sapiens
gtcccacatccctg

SEQ ID NO: 4649563 - DNA, 19 bp, Homo sapiens
gtcccacatccctgggcct

SEQ ID NO: 4649564 - DNA, 23 bp, Homo sapiens
gtcccacatccctgggcctgctg

SEQ ID NO: 4649565 - DNA, 14 bp, Homo sapiens
gtcccagcatccct

SEQ ID NO: 4649566 - DNA, 17 bp, Homo sapiens
gtcccagcatccctgga

SEQ ID NO: 4649567 - DNA, 20 bp, Homo sapiens
gtcccagcatccctggagca

SEQ ID NO: 4649568 - DNA, 14 bp, Homo sapiens
gtcccagccctggg

SEQ ID NO: 4649569 - DNA, 12 bp, Homo sapiens
gtcccagctgaa

SEQ ID NO: 4649570 - DNA, 23 bp, Homo sapiens
gtccccagagaaagcgcagatgc

SEQ ID NO: 4649571 - DNA, 19 bp, Homo sapiens
gtccccatctaggtcctgg

SEQ ID NO: 4649572 - DNA, 22 bp, Homo sapiens
gtccctatatcagggcctgagt

SEQ ID NO: 4649573 - DNA, 20 bp, Homo sapiens
gtccctcttctggtttccct

SEQ ID NO: 4649574 - DNA, 14 bp, Homo sapiens
gtccctggagggca

SEQ ID NO: 4649575 - DNA, 23 bp, Homo sapiens
gtccctggagggcaagccctgcc

SEQ ID NO: 4649576 - DNA, 17 bp, Homo sapiens
gtccctgggccagggtc

SEQ ID NO: 4649577 - DNA, 19 bp, Homo sapiens
gtcccttttcattctcctc

SEQ ID NO: 4649578 - DNA, 14 bp, Homo sapiens
gtccgtcctggcac

SEQ ID NO: 4649579 - DNA, 19 bp, Homo sapiens
gtccgttcacatgtgtggt

SEQ ID NO: 4649580 - DNA, 21 bp, Homo sapiens
gtcctaaagaagacattttct

SEQ ID NO: 4649581 - DNA, 22 bp, Homo sapiens
gtcctagccaggtctcctggga

SEQ ID NO: 4649582 - DNA, 17 bp, Homo sapiens
gtcctatagtcgtgggt

SEQ ID NO: 4649583 - DNA, 21 bp, Homo sapiens
gtcctccaacaccaagcacag

SEQ ID NO: 4649584 - DNA, 22 bp, Homo sapiens
gtcctccaacaccaagcacagc

SEQ ID NO: 4649585 - DNA, 13 bp, Homo sapiens
gtcctccctagct

SEQ ID NO: 4649586 - DNA, 16 bp, Homo sapiens
gtcctccctagctctt

SEQ ID NO: 4649587 - DNA, 23 bp, Homo sapiens
gtcctctgtcagtcacagccacc

SEQ ID NO: 4649588 - DNA, 14 bp, Homo sapiens
gtcctgaccaggat

SEQ ID NO: 4649589 - DNA, 24 bp, Homo sapiens
gtcctgaccaggatggagcaagct

SEQ ID NO: 4649590 - DNA, 13 bp, Homo sapiens
gtcctgagcactg

SEQ ID NO: 4649591 - DNA, 17 bp, Homo sapiens
gtcctgagcactgccag

SEQ ID NO: 4649592 - DNA, 13 bp, Homo sapiens
gtcctgccttctt

SEQ ID NO: 4649593 - DNA, 21 bp, Homo sapiens
gtcctgccttcttccttgagg

SEQ ID NO: 4649594 - DNA, 13 bp, Homo sapiens
gtcctggaggggc

SEQ ID NO: 4649595 - DNA, 23 bp, Homo sapiens
gtcctggctggccgcatgaccac

SEQ ID NO: 4649596 - DNA, 23 bp, Homo sapiens
gtcctgtagttgcgtggactctg

SEQ ID NO: 4649597 - DNA, 14 bp, Homo sapiens
gtcctgtcctgctc

SEQ ID NO: 4649598 - DNA, 17 bp, Homo sapiens
gtcctgtttctgtcaag

SEQ ID NO: 4649599 - DNA, 15 bp, Homo sapiens
gtccttactcctgtg

SEQ ID NO: 4649600 - DNA, 17 bp, Homo sapiens
gtccttactcctgtggg

SEQ ID NO: 4649601 - DNA, 18 bp, Homo sapiens
gtccttaggcctctgaga

SEQ ID NO: 4649602 - DNA, 15 bp, Homo sapiens
gtccttcacctcact

SEQ ID NO: 4649603 - DNA, 21 bp, Homo sapiens
gtccttcacctcactgaaaac

SEQ ID NO: 4649604 - DNA, 20 bp, Homo sapiens
gtccttggactgttttgaaa

SEQ ID NO: 4649605 - DNA, 21 bp, Homo sapiens
gtcctttcccaccattcctgc

SEQ ID NO: 4649606 - DNA, 15 bp, Homo sapiens
gtcgacaagaatgtc

SEQ ID NO: 4649607 - DNA, 20 bp, Homo sapiens
gtcgcccaggctggagtgca

SEQ ID NO: 4649608 - DNA, 12 bp, Homo sapiens
gtcgcccctcag

SEQ ID NO: 4649609 - DNA, 18 bp, Homo sapiens
gtcgcccctcagagcatg

SEQ ID NO: 4649610 - DNA, 14 bp, Homo sapiens
gtcggatctcacag

SEQ ID NO: 4649611 - DNA, 16 bp, Homo sapiens
gtcgggcttgcggtgg

SEQ ID NO: 4649612 - DNA, 15 bp, Homo sapiens
gtcgtgcactttctc

SEQ ID NO: 4649613 - DNA, 16 bp, Homo sapiens
gtcgtgcactttctcg

SEQ ID NO: 4649614 - DNA, 24 bp, Homo sapiens
gtcgtggagagctaggagcaaagc

SEQ ID NO: 4649615 - DNA, 13 bp, Homo sapiens
gtctaaaacaata

SEQ ID NO: 4649616 - DNA, 18 bp, Homo sapiens
gtctaacttttgtgtgaa

SEQ ID NO: 4649617 - DNA, 18 bp, Homo sapiens
gtctagaggcagactcct

SEQ ID NO: 4649618 - DNA, 23 bp, Homo sapiens
gtctaggcaggacctgtggccaa

SEQ ID NO: 4649619 - DNA, 16 bp, Homo sapiens
gtctaggcaggcaaga

SEQ ID NO: 4649620 - DNA, 16 bp, Homo sapiens
gtctagtcattgtcat

SEQ ID NO: 4649621 - DNA, 20 bp, Homo sapiens
gtctataatcccagcacttt

SEQ ID NO: 4649622 - DNA, 20 bp, Homo sapiens
gtctcaaacctccaaaagcc

SEQ ID NO: 4649623 - DNA, 14 bp, Homo sapiens
gtctcactcttgtc

SEQ ID NO: 4649624 - DNA, 15 bp, Homo sapiens
gtctcactgcttgaa

SEQ ID NO: 4649625 - DNA, 17 bp, Homo sapiens
gtctcagtgattcgctt

SEQ ID NO: 4649626 - DNA, 19 bp, Homo sapiens
gtctcattgtcacctctgt

SEQ ID NO: 4649627 - DNA, 10 bp, Homo sapiens
gtctccctcg

SEQ ID NO: 4649628 - DNA, 14 bp, Homo sapiens
gtctcccttttata

SEQ ID NO: 4649629 - DNA, 17 bp, Homo sapiens
gtctcctaggggcttgg

SEQ ID NO: 4649630 - DNA, 23 bp, Homo sapiens
gtctcctcaatttttgtctcaga

SEQ ID NO: 4649631 - DNA, 16 bp, Homo sapiens
gtctcctctccatttt

SEQ ID NO: 4649632 - DNA, 12 bp, Homo sapiens
gtctcctgggaa

SEQ ID NO: 4649633 - DNA, 15 bp, Homo sapiens
gtctcctgggaaagg

SEQ ID NO: 4649634 - DNA, 16 bp, Homo sapiens
gtctccttccttccca

SEQ ID NO: 4649635 - DNA, 16 bp, Homo sapiens
gtctcgaccctgtccc

SEQ ID NO: 4649636 - DNA, 17 bp, Homo sapiens
gtctcgaccctgtcccc

SEQ ID NO: 4649637 - DNA, 14 bp, Homo sapiens
gtctcgagcgccct

SEQ ID NO: 4649638 - DNA, 17 bp, Homo sapiens
gtctcgagcgccctgca

SEQ ID NO: 4649639 - DNA, 23 bp, Homo sapiens
gtctcgagcgccctgcagaccct

SEQ ID NO: 4649640 - DNA, 13 bp, Homo sapiens
gtctcgtggtagg

SEQ ID NO: 4649641 - DNA, 11 bp, Homo sapiens
gtctctctctt

SEQ ID NO: 4649642 - DNA, 17 bp, Homo sapiens
gtctctgaagtactaac

SEQ ID NO: 4649643 - DNA, 14 bp, Homo sapiens
gtctctggctactc

SEQ ID NO: 4649644 - DNA, 16 bp, Homo sapiens
gtctgaatcatgtctg

SEQ ID NO: 4649645 - DNA, 14 bp, Homo sapiens
gtctgagtctatgt

SEQ ID NO: 4649646 - DNA, 15 bp, Homo sapiens
gtctgagtggcttca

SEQ ID NO: 4649647 - DNA, 23 bp, Homo sapiens
gtctgagtggcttcactcctgct

SEQ ID NO: 4649648 - DNA, 16 bp, Homo sapiens
gtctgcacagggtcct

SEQ ID NO: 4649649 - DNA, 13 bp, Homo sapiens
gtctgcctcctgc

SEQ ID NO: 4649650 - DNA, 17 bp, Homo sapiens
gtctgcctcctgctttg

SEQ ID NO: 4649651 - DNA, 13 bp, Homo sapiens
gtctgctctgcat

SEQ ID NO: 4649652 - DNA, 15 bp, Homo sapiens
gtctgctctgcatat

SEQ ID NO: 4649653 - DNA, 12 bp, Homo sapiens
gtctgctgctgt

SEQ ID NO: 4649654 - DNA, 17 bp, Homo sapiens
gtctggaaaacagaaac

SEQ ID NO: 4649655 - DNA, 22 bp, Homo sapiens
gtctggcagcctcccatccagg

SEQ ID NO: 4649656 - DNA, 16 bp, Homo sapiens
gtctggcagggcagca

SEQ ID NO: 4649657 - DNA, 18 bp, Homo sapiens
gtctggctagagggccca

SEQ ID NO: 4649658 - DNA, 23 bp, Homo sapiens
gtctggctccctgccccttaacc

SEQ ID NO: 4649659 - DNA, 16 bp, Homo sapiens
gtctgggagaaattga

SEQ ID NO: 4649660 - DNA, 17 bp, Homo sapiens
gtctgggtccatcctgg

SEQ ID NO: 4649661 - DNA, 20 bp, Homo sapiens
gtctgtacacgtgtcctgta

SEQ ID NO: 4649662 - DNA, 22 bp, Homo sapiens
gtctgtatccccagtgcccggt

SEQ ID NO: 4649663 - DNA, 20 bp, Homo sapiens
gtctgtctttcctgaaccat

SEQ ID NO: 4649664 - DNA, 13 bp, Homo sapiens
gtctgttcttgaa

SEQ ID NO: 4649665 - DNA, 19 bp, Homo sapiens
gtctgttgaaataaaacat

SEQ ID NO: 4649666 - DNA, 15 bp, Homo sapiens
gtctgtttcccaagc

SEQ ID NO: 4649667 - DNA, 24 bp, Homo sapiens
gtcttaatggtatcctactgagca

SEQ ID NO: 4649668 - DNA, 22 bp, Homo sapiens
gtcttaatttttgaaaaaagta

SEQ ID NO: 4649669 - DNA, 14 bp, Homo sapiens
gtcttactacttta

SEQ ID NO: 4649670 - DNA, 16 bp, Homo sapiens
gtcttactactttaaa

SEQ ID NO: 4649671 - DNA, 12 bp, Homo sapiens
gtcttagcttta

SEQ ID NO: 4649672 - DNA, 18 bp, Homo sapiens
gtcttatgtgaaaaatta

SEQ ID NO: 4649673 - DNA, 22 bp, Homo sapiens
gtcttatgtgaaaaattaactt

SEQ ID NO: 4649674 - DNA, 14 bp, Homo sapiens
gtcttcctgtggct

SEQ ID NO: 4649675 - DNA, 21 bp, Homo sapiens
gtcttcctgtggctccctctc

SEQ ID NO: 4649676 - DNA, 17 bp, Homo sapiens
gtcttcttacttggaac

SEQ ID NO: 4649677 - DNA, 20 bp, Homo sapiens
gtcttcttacttggaactga

SEQ ID NO: 4649678 - DNA, 22 bp, Homo sapiens
gtcttgactgttagttgtccac

SEQ ID NO: 4649679 - DNA, 18 bp, Homo sapiens
gtcttgcaaagcctttaa

SEQ ID NO: 4649680 - DNA, 14 bp, Homo sapiens
gtcttggacactgt

SEQ ID NO: 4649681 - DNA, 18 bp, Homo sapiens
gtcttggacactgtacaa

SEQ ID NO: 4649682 - DNA, 20 bp, Homo sapiens
gtcttggggccactttcaga

SEQ ID NO: 4649683 - DNA, 20 bp, Homo sapiens
gtcttgtgtatttctctgtg

SEQ ID NO: 4649684 - DNA, 13 bp, Homo sapiens
gtcttgttcattt

SEQ ID NO: 4649685 - DNA, 14 bp, Homo sapiens
gtcttgttcatttt

SEQ ID NO: 4649686 - DNA, 17 bp, Homo sapiens
gtctttaaatgctgctt

SEQ ID NO: 4649687 - DNA, 15 bp, Homo sapiens
gtctttcagtacttt

SEQ ID NO: 4649688 - DNA, 14 bp, Homo sapiens
gtcttttcatctgg

SEQ ID NO: 4649689 - DNA, 16 bp, Homo sapiens
gtcttttgttctctga

SEQ ID NO: 4649690 - DNA, 12 bp, Homo sapiens
gtgaaaatcttg

SEQ ID NO: 4649691 - DNA, 20 bp, Homo sapiens
gtgaaagaaagggacccacc

SEQ ID NO: 4649692 - DNA, 15 bp, Homo sapiens
gtgaaatctgtcttt

SEQ ID NO: 4649693 - DNA, 11 bp, Homo sapiens
gtgaaattaag

SEQ ID NO: 4649694 - DNA, 18 bp, Homo sapiens
gtgaacaaagcagccacg

SEQ ID NO: 4649695 - DNA, 16 bp, Homo sapiens
gtgaacatcccttatt

SEQ ID NO: 4649696 - DNA, 17 bp, Homo sapiens
gtgaacccaggacaagc

SEQ ID NO: 4649697 - DNA, 17 bp, Homo sapiens
gtgaacttgactgggtg

SEQ ID NO: 4649698 - DNA, 16 bp, Homo sapiens
gtgaagagtttcacaa

SEQ ID NO: 4649699 - DNA, 12 bp, Homo sapiens
gtgaaggcctcg

SEQ ID NO: 4649700 - DNA, 20 bp, Homo sapiens
gtgaaggtcctgctattact

SEQ ID NO: 4649701 - DNA, 23 bp, Homo sapiens
gtgaaggtctttgttatgacagt

SEQ ID NO: 4649702 - DNA, 17 bp, Homo sapiens
gtgaagtattgctgaaa

SEQ ID NO: 4649703 - DNA, 16 bp, Homo sapiens
gtgaagtccttcacct

SEQ ID NO: 4649704 - DNA, 18 bp, Homo sapiens
gtgaagtctagaatcata

SEQ ID NO: 4649705 - DNA, 22 bp, Homo sapiens
gtgaatacattaacggtgctaa

SEQ ID NO: 4649706 - DNA, 18 bp, Homo sapiens
gtgaatcacgtaaagcta

SEQ ID NO: 4649707 - DNA, 21 bp, Homo sapiens
gtgaatccatgggtctggcta

SEQ ID NO: 4649708 - DNA, 22 bp, Homo sapiens
gtgaatccatgggtctggctag

SEQ ID NO: 4649709 - DNA, 19 bp, Homo sapiens
gtgaatctgcttttcctct

SEQ ID NO: 4649710 - DNA, 14 bp, Homo sapiens
gtgaatgtgggcac

SEQ ID NO: 4649711 - DNA, 23 bp, Homo sapiens
gtgaatgtgggcactggcccagg

SEQ ID NO: 4649712 - DNA, 17 bp, Homo sapiens
gtgaattttcaaggcct

SEQ ID NO: 4649713 - DNA, 15 bp, Homo sapiens
gtgacagactcctga

SEQ ID NO: 4649714 - DNA, 20 bp, Homo sapiens
gtgacagactcctgaggaca

SEQ ID NO: 4649715 - DNA, 23 bp, Homo sapiens
gtgacagggccagtggggcctgt

SEQ ID NO: 4649716 - DNA, 16 bp, Homo sapiens
gtgacagtcatcatca

SEQ ID NO: 4649717 - DNA, 18 bp, Homo sapiens
gtgacagtcatcatcagg

SEQ ID NO: 4649718 - DNA, 20 bp, Homo sapiens
gtgacagtcatcatcagggc

SEQ ID NO: 4649719 - DNA, 15 bp, Homo sapiens
gtgacagtttccaaa

SEQ ID NO: 4649720 - DNA, 16 bp, Homo sapiens
gtgacagtttccaaat

SEQ ID NO: 4649721 - DNA, 21 bp, Homo sapiens
gtgacccggcaccccctgcag

SEQ ID NO: 4649722 - DNA, 15 bp, Homo sapiens
gtgacctgctgagct

SEQ ID NO: 4649723 - DNA, 16 bp, Homo sapiens
gtgacctgctgagctc

SEQ ID NO: 4649724 - DNA, 19 bp, Homo sapiens
gtgacctgctgagctctga

SEQ ID NO: 4649725 - DNA, 21 bp, Homo sapiens
gtgacctgctgagctctgaga

SEQ ID NO: 4649726 - DNA, 20 bp, Homo sapiens
gtgactcctgctggtacctg

SEQ ID NO: 4649727 - DNA, 16 bp, Homo sapiens
gtgactgtcacttgct

SEQ ID NO: 4649728 - DNA, 22 bp, Homo sapiens
gtgactgtgtaactttctctta

SEQ ID NO: 4649729 - DNA, 15 bp, Homo sapiens
gtgacttctgctgct

SEQ ID NO: 4649730 - DNA, 15 bp, Homo sapiens
gtgacttgtctgcct

SEQ ID NO: 4649731 - DNA, 17 bp, Homo sapiens
gtgacttgtctgcctcc

SEQ ID NO: 4649732 - DNA, 20 bp, Homo sapiens
gtgacttgtctgcctcctgc

SEQ ID NO: 4649733 - DNA, 11 bp, Homo sapiens
gtgagaattca

SEQ ID NO: 4649734 - DNA, 16 bp, Homo sapiens
gtgagacagtgggaaa

SEQ ID NO: 4649735 - DNA, 13 bp, Homo sapiens
gtgagagaaagag

SEQ ID NO: 4649736 - DNA, 21 bp, Homo sapiens
gtgagagaaagagagaagcca

SEQ ID NO: 4649737 - DNA, 23 bp, Homo sapiens
gtgagagaaagagagaagccagc

SEQ ID NO: 4649738 - DNA, 21 bp, Homo sapiens
gtgagatttaagttcctgctg

SEQ ID NO: 4649739 - DNA, 20 bp, Homo sapiens
gtgagcagggtcaagcctct

SEQ ID NO: 4649740 - DNA, 18 bp, Homo sapiens
gtgagccaaagcttatgt

SEQ ID NO: 4649741 - DNA, 13 bp, Homo sapiens
gtgaggcagggac

SEQ ID NO: 4649742 - DNA, 21 bp, Homo sapiens
gtgaggcagggacaagtcttt

SEQ ID NO: 4649743 - DNA, 17 bp, Homo sapiens
gtgagggagggctgtca

SEQ ID NO: 4649744 - DNA, 23 bp, Homo sapiens
gtgagtgggagagtacctgtgtg

SEQ ID NO: 4649745 - DNA, 13 bp, Homo sapiens
gtgatcaggcccc

SEQ ID NO: 4649746 - DNA, 16 bp, Homo sapiens
gtgatcaggccccacc

SEQ ID NO: 4649747 - DNA, 22 bp, Homo sapiens
gtgatccgcccacctcagcctc

SEQ ID NO: 4649748 - DNA, 18 bp, Homo sapiens
gtgatgagggcagcagcc

SEQ ID NO: 4649749 - DNA, 23 bp, Homo sapiens
gtgatgagggcagcagccagccc

SEQ ID NO: 4649750 - DNA, 11 bp, Homo sapiens
gtgatggaggg

SEQ ID NO: 4649751 - DNA, 15 bp, Homo sapiens
gtgatgtggaggaag

SEQ ID NO: 4649752 - DNA, 22 bp, Homo sapiens
gtgatgtggaggaagagccacc

SEQ ID NO: 4649753 - DNA, 14 bp, Homo sapiens
gtgattaatgtttt

SEQ ID NO: 4649754 - DNA, 21 bp, Homo sapiens
gtgattaatgttttcattatg

SEQ ID NO: 4649755 - DNA, 17 bp, Homo sapiens
gtgattacataatctgt

SEQ ID NO: 4649756 - DNA, 14 bp, Homo sapiens
gtgattttaactct

SEQ ID NO: 4649757 - DNA, 15 bp, Homo sapiens
gtgcaaaatgtcttg

SEQ ID NO: 4649758 - DNA, 21 bp, Homo sapiens
gtgcaaaatgtcttgtgtatt

SEQ ID NO: 4649759 - DNA, 16 bp, Homo sapiens
gtgcaaattcattttt

SEQ ID NO: 4649760 - DNA, 21 bp, Homo sapiens
gtgcaacctctgcttcccagg

SEQ ID NO: 4649761 - DNA, 13 bp, Homo sapiens
gtgcaagcactcg

SEQ ID NO: 4649762 - DNA, 20 bp, Homo sapiens
gtgcaattccaagaaaatat

SEQ ID NO: 4649763 - DNA, 18 bp, Homo sapiens
gtgcacaaaacccagacc

SEQ ID NO: 4649764 - DNA, 23 bp, Homo sapiens
gtgcacaaagtggcataaaaaac

SEQ ID NO: 4649765 - DNA, 12 bp, Homo sapiens
gtgcacaggagg

SEQ ID NO: 4649766 - DNA, 13 bp, Homo sapiens
gtgcagagcagac

SEQ ID NO: 4649767 - DNA, 16 bp, Homo sapiens
gtgcagagcagacagg

SEQ ID NO: 4649768 - DNA, 20 bp, Homo sapiens
gtgcaggggatggggtgggg

SEQ ID NO: 4649769 - DNA, 21 bp, Homo sapiens
gtgcaggtagacctgtctcct

SEQ ID NO: 4649770 - DNA, 14 bp, Homo sapiens
gtgcagtctgggtg

SEQ ID NO: 4649771 - DNA, 19 bp, Homo sapiens
gtgcagtggagggggcaag

SEQ ID NO: 4649772 - DNA, 19 bp, Homo sapiens
gtgcagtttcttttcacat

SEQ ID NO: 4649773 - DNA, 22 bp, Homo sapiens
gtgcatacgcctcttgttcatg

SEQ ID NO: 4649774 - DNA, 12 bp, Homo sapiens
gtgcatcattac

SEQ ID NO: 4649775 - DNA, 17 bp, Homo sapiens
gtgcatcattactgttc

SEQ ID NO: 4649776 - DNA, 19 bp, Homo sapiens
gtgcatcattactgttcca

SEQ ID NO: 4649777 - DNA, 18 bp, Homo sapiens
gtgcatgatcttgagcaa

SEQ ID NO: 4649778 - DNA, 12 bp, Homo sapiens
gtgcatgctctg

SEQ ID NO: 4649779 - DNA, 16 bp, Homo sapiens
gtgcatggaggccctc

SEQ ID NO: 4649780 - DNA, 23 bp, Homo sapiens
gtgcatgtatgtcttggacactg

SEQ ID NO: 4649781 - DNA, 16 bp, Homo sapiens
gtgcattatgtacaca

SEQ ID NO: 4649782 - DNA, 23 bp, Homo sapiens
gtgcatttgtgctagaaattttc

SEQ ID NO: 4649783 - DNA, 11 bp, Homo sapiens
gtgccaaggac

SEQ ID NO: 4649784 - DNA, 18 bp, Homo sapiens
gtgccaagtccaggtcct

SEQ ID NO: 4649785 - DNA, 15 bp, Homo sapiens
gtgccaccaccctgc

SEQ ID NO: 4649786 - DNA, 16 bp, Homo sapiens
gtgccaccatgcctca

SEQ ID NO: 4649787 - DNA, 13 bp, Homo sapiens
gtgccacccccag

SEQ ID NO: 4649788 - DNA, 15 bp, Homo sapiens
gtgccacccccagcc

SEQ ID NO: 4649789 - DNA, 16 bp, Homo sapiens
gtgccagaaagtcccc

SEQ ID NO: 4649790 - DNA, 14 bp, Homo sapiens
gtgccagagcctgg

SEQ ID NO: 4649791 - DNA, 18 bp, Homo sapiens
gtgccataccttctccca

SEQ ID NO: 4649792 - DNA, 23 bp, Homo sapiens
gtgccataccttctcccaggcct

SEQ ID NO: 4649793 - DNA, 14 bp, Homo sapiens
gtgccatgctgggc

SEQ ID NO: 4649794 - DNA, 11 bp, Homo sapiens
gtgccccacca

SEQ ID NO: 4649795 - DNA, 18 bp, Homo sapiens
gtgcccggtgcagggcct

SEQ ID NO: 4649796 - DNA, 23 bp, Homo sapiens
gtgcccggtgcagggcctggcat

SEQ ID NO: 4649797 - DNA, 15 bp, Homo sapiens
gtgccgtgtgagtgt

SEQ ID NO: 4649798 - DNA, 20 bp, Homo sapiens
gtgccgtgtgagtgtgacag

SEQ ID NO: 4649799 - DNA, 23 bp, Homo sapiens
gtgccgtgtgagtgtgacagggc

SEQ ID NO: 4649800 - DNA, 13 bp, Homo sapiens
gtgcctccctggt

SEQ ID NO: 4649801 - DNA, 15 bp, Homo sapiens
gtgcctcgctcccca

SEQ ID NO: 4649802 - DNA, 16 bp, Homo sapiens
gtgcctgaaagctggg

SEQ ID NO: 4649803 - DNA, 17 bp, Homo sapiens
gtgcctgaaagctggga

SEQ ID NO: 4649804 - DNA, 22 bp, Homo sapiens
gtgcctgcacatcatgagcctt

SEQ ID NO: 4649805 - DNA, 19 bp, Homo sapiens
gtgcctggcctggcacaca

SEQ ID NO: 4649806 - DNA, 19 bp, Homo sapiens
gtgcctggctgattcagca

SEQ ID NO: 4649807 - DNA, 14 bp, Homo sapiens
gtgcctttgggcac

SEQ ID NO: 4649808 - DNA, 22 bp, Homo sapiens
gtgcgtgccgtgtgagtgtgac

SEQ ID NO: 4649809 - DNA, 16 bp, Homo sapiens
gtgctactgattgttt

SEQ ID NO: 4649810 - DNA, 17 bp, Homo sapiens
gtgctatgcggaggaaa

SEQ ID NO: 4649811 - DNA, 22 bp, Homo sapiens
gtgctatgcggaggaaagcaag

SEQ ID NO: 4649812 - DNA, 19 bp, Homo sapiens
gtgctatggatggcttcta

SEQ ID NO: 4649813 - DNA, 15 bp, Homo sapiens
gtgctatttgaagaa

SEQ ID NO: 4649814 - DNA, 19 bp, Homo sapiens
gtgctatttgaagaaaaaa

SEQ ID NO: 4649815 - DNA, 14 bp, Homo sapiens
gtgctcctccttgg

SEQ ID NO: 4649816 - DNA, 14 bp, Homo sapiens
gtgctcgccccagc

SEQ ID NO: 4649817 - DNA, 16 bp, Homo sapiens
gtgctcgccccagcag

SEQ ID NO: 4649818 - DNA, 23 bp, Homo sapiens
gtgctgcaggagtgtcctgccca

SEQ ID NO: 4649819 - DNA, 20 bp, Homo sapiens
gtgctgggattacaggcgtg

SEQ ID NO: 4649820 - DNA, 24 bp, Homo sapiens
gtgctgttttattactgtttctaa

SEQ ID NO: 4649821 - DNA, 20 bp, Homo sapiens
gtgctttccttttttaaaaa

SEQ ID NO: 4649822 - DNA, 20 bp, Homo sapiens
gtggaaattaagactttatg

SEQ ID NO: 4649823 - DNA, 19 bp, Homo sapiens
gtggaaggcctccctctgt

SEQ ID NO: 4649824 - DNA, 14 bp, Homo sapiens
gtggactcagggca

SEQ ID NO: 4649825 - DNA, 14 bp, Homo sapiens
gtggactctgcaca

SEQ ID NO: 4649826 - DNA, 11 bp, Homo sapiens
gtggactggtg

SEQ ID NO: 4649827 - DNA, 11 bp, Homo sapiens
gtggagacagt

SEQ ID NO: 4649828 - DNA, 14 bp, Homo sapiens
gtggaggaggtgaa

SEQ ID NO: 4649829 - DNA, 23 bp, Homo sapiens
gtggagggacaagtggactcagg

SEQ ID NO: 4649830 - DNA, 19 bp, Homo sapiens
gtggagtgcagtggtgcga

SEQ ID NO: 4649831 - DNA, 20 bp, Homo sapiens
gtggataagtggctgtttca

SEQ ID NO: 4649832 - DNA, 15 bp, Homo sapiens
gtggatgctgtgcta

SEQ ID NO: 4649833 - DNA, 13 bp, Homo sapiens
gtggcaattagtg

SEQ ID NO: 4649834 - DNA, 19 bp, Homo sapiens
gtggcagctgttagggctg

SEQ ID NO: 4649835 - DNA, 21 bp, Homo sapiens
gtggcagggaccggcagagct

SEQ ID NO: 4649836 - DNA, 15 bp, Homo sapiens
gtggcaggggagcag

SEQ ID NO: 4649837 - DNA, 16 bp, Homo sapiens
gtggcaggggagcagg

SEQ ID NO: 4649838 - DNA, 14 bp, Homo sapiens
gtggccaagttctt

SEQ ID NO: 4649839 - DNA, 12 bp, Homo sapiens
gtggccccaccc

SEQ ID NO: 4649840 - DNA, 16 bp, Homo sapiens
gtggcctaatttacaa

SEQ ID NO: 4649841 - DNA, 11 bp, Homo sapiens
gtggcctcagc

SEQ ID NO: 4649842 - DNA, 13 bp, Homo sapiens
gtggcctccctgc

SEQ ID NO: 4649843 - DNA, 14 bp, Homo sapiens
gtggcctccctgct

SEQ ID NO: 4649844 - DNA, 14 bp, Homo sapiens
gtggcgtctccctc

SEQ ID NO: 4649845 - DNA, 17 bp, Homo sapiens
gtggctactctgtgcca

SEQ ID NO: 4649846 - DNA, 22 bp, Homo sapiens
gtggctactctgtgccagagcc

SEQ ID NO: 4649847 - DNA, 23 bp, Homo sapiens
gtggctactctgtgccagagcct

SEQ ID NO: 4649848 - DNA, 15 bp, Homo sapiens
gtggctcagccagca

SEQ ID NO: 4649849 - DNA, 20 bp, Homo sapiens
gtggctccctctctcctgga

SEQ ID NO: 4649850 - DNA, 23 bp, Homo sapiens
gtgggactcatccttgcccaggt

SEQ ID NO: 4649851 - DNA, 14 bp, Homo sapiens
gtgggagcctcgca

SEQ ID NO: 4649852 - DNA, 14 bp, Homo sapiens
gtgggagctgagct

SEQ ID NO: 4649853 - DNA, 13 bp, Homo sapiens
gtgggccagggct

SEQ ID NO: 4649854 - DNA, 21 bp, Homo sapiens
gtgggccagggctgccctgag

SEQ ID NO: 4649855 - DNA, 20 bp, Homo sapiens
gtgggccccgggctggagaa

SEQ ID NO: 4649856 - DNA, 21 bp, Homo sapiens
gtgggccccgggctggagaaa

SEQ ID NO: 4649857 - DNA, 17 bp, Homo sapiens
gtgggctcagcagggct

SEQ ID NO: 4649858 - DNA, 15 bp, Homo sapiens
gtggggtggacctgg

SEQ ID NO: 4649859 - DNA, 19 bp, Homo sapiens
gtggggtggacctgggaca

SEQ ID NO: 4649860 - DNA, 22 bp, Homo sapiens
gtggtacttaagctcccctgcc

SEQ ID NO: 4649861 - DNA, 23 bp, Homo sapiens
gtggtacttaagctcccctgcct

SEQ ID NO: 4649862 - DNA, 14 bp, Homo sapiens
gtggtatagaaatg

SEQ ID NO: 4649863 - DNA, 23 bp, Homo sapiens
gtggtattttattttggcttcat

SEQ ID NO: 4649864 - DNA, 14 bp, Homo sapiens
gtggtcataaaata

SEQ ID NO: 4649865 - DNA, 21 bp, Homo sapiens
gtggtcatgaattcatactct

SEQ ID NO: 4649866 - DNA, 13 bp, Homo sapiens
gtggtctcaggat

SEQ ID NO: 4649867 - DNA, 16 bp, Homo sapiens
gtggtcttgtggttgt

SEQ ID NO: 4649868 - DNA, 13 bp, Homo sapiens
gtggttacacagt

SEQ ID NO: 4649869 - DNA, 14 bp, Homo sapiens
gtggttacacagtg

SEQ ID NO: 4649870 - DNA, 23 bp, Homo sapiens
gtggttgcagtctttcccccagg

SEQ ID NO: 4649871 - DNA, 16 bp, Homo sapiens
gtggtttttgagccat

SEQ ID NO: 4649872 - DNA, 14 bp, Homo sapiens
gtgtaaaaaatgtc

SEQ ID NO: 4649873 - DNA, 20 bp, Homo sapiens
gtgtacatgtgtgcagagca

SEQ ID NO: 4649874 - DNA, 20 bp, Homo sapiens
gtgtaccgcgtctaccctgg

SEQ ID NO: 4649875 - DNA, 13 bp, Homo sapiens
gtgtactcccagg

SEQ ID NO: 4649876 - DNA, 21 bp, Homo sapiens
gtgtagccaggtatggctctg

SEQ ID NO: 4649877 - DNA, 12 bp, Homo sapiens
gtgtagctgtaa

SEQ ID NO: 4649878 - DNA, 23 bp, Homo sapiens
gtgtagctgtaagggcagtgccc

SEQ ID NO: 4649879 - DNA, 12 bp, Homo sapiens
gtgtagctgtga

SEQ ID NO: 4649880 - DNA, 14 bp, Homo sapiens
gtgtagttccctct

SEQ ID NO: 4649881 - DNA, 21 bp, Homo sapiens
gtgtatatattataaaaatta

SEQ ID NO: 4649882 - DNA, 20 bp, Homo sapiens
gtgtatgccacacctggcct

SEQ ID NO: 4649883 - DNA, 16 bp, Homo sapiens
gtgtatttctctgtga

SEQ ID NO: 4649884 - DNA, 19 bp, Homo sapiens
gtgtatttctctgtgaatc

SEQ ID NO: 4649885 - DNA, 13 bp, Homo sapiens
gtgtcacaaagaa

SEQ ID NO: 4649886 - DNA, 20 bp, Homo sapiens
gtgtcacctccttccccagc

SEQ ID NO: 4649887 - DNA, 20 bp, Homo sapiens
gtgtcagttcaactttcaga

SEQ ID NO: 4649888 - DNA, 16 bp, Homo sapiens
gtgtcatttcattcca

SEQ ID NO: 4649889 - DNA, 17 bp, Homo sapiens
gtgtccacctgtgggtg

SEQ ID NO: 4649890 - DNA, 15 bp, Homo sapiens
gtgtctatgatgttg

SEQ ID NO: 4649891 - DNA, 22 bp, Homo sapiens
gtgtctatgatgttgctgttca

SEQ ID NO: 4649892 - DNA, 20 bp, Homo sapiens
gtgtctgaatcatgtctgta

SEQ ID NO: 4649893 - DNA, 15 bp, Homo sapiens
gtgtcttgtgttttt

SEQ ID NO: 4649894 - DNA, 18 bp, Homo sapiens
gtgtctttaaatgctgct

SEQ ID NO: 4649895 - DNA, 16 bp, Homo sapiens
gtgtgaaatctgtctt

SEQ ID NO: 4649896 - DNA, 18 bp, Homo sapiens
gtgtgaaggtcctgctat

SEQ ID NO: 4649897 - DNA, 11 bp, Homo sapiens
gtgtgaatgca

SEQ ID NO: 4649898 - DNA, 14 bp, Homo sapiens
gtgtgaatgcacgt

SEQ ID NO: 4649899 - DNA, 19 bp, Homo sapiens
gtgtgaatgtgggcactgg

SEQ ID NO: 4649900 - DNA, 17 bp, Homo sapiens
gtgtgacagtttccaaa

SEQ ID NO: 4649901 - DNA, 19 bp, Homo sapiens
gtgtgactattcatggcta

SEQ ID NO: 4649902 - DNA, 14 bp, Homo sapiens
gtgtgagtgtgaca

SEQ ID NO: 4649903 - DNA, 19 bp, Homo sapiens
gtgtgagtgtgacagggcc

SEQ ID NO: 4649904 - DNA, 13 bp, Homo sapiens
gtgtgcctgtctg

SEQ ID NO: 4649905 - DNA, 21 bp, Homo sapiens
gtgtgggccaccgtgcctggc

SEQ ID NO: 4649906 - DNA, 22 bp, Homo sapiens
gtgtgggccaccgtgcctggct

SEQ ID NO: 4649907 - DNA, 16 bp, Homo sapiens
gtgtggtggcctcagc

SEQ ID NO: 4649908 - DNA, 15 bp, Homo sapiens
gtgtgtactctgtcc

SEQ ID NO: 4649909 - DNA, 20 bp, Homo sapiens
gtgtgtgtacaaatacatgt

SEQ ID NO: 4649910 - DNA, 21 bp, Homo sapiens
gtgtgttcgttgcacagctgt

SEQ ID NO: 4649911 - DNA, 21 bp, Homo sapiens
gtgttatcggacattctaatg

SEQ ID NO: 4649912 - DNA, 18 bp, Homo sapiens
gtgttcagctctttccaa

SEQ ID NO: 4649913 - DNA, 23 bp, Homo sapiens
gtgttcagctctttccaaattaa

SEQ ID NO: 4649914 - DNA, 14 bp, Homo sapiens
gtgttcatttcatt

SEQ ID NO: 4649915 - DNA, 14 bp, Homo sapiens
gtgttctgttgttt

SEQ ID NO: 4649916 - DNA, 14 bp, Homo sapiens
gtgttgaggttttt

SEQ ID NO: 4649917 - DNA, 20 bp, Homo sapiens
gtgttggcaaacgagacttt

SEQ ID NO: 4649918 - DNA, 14 bp, Homo sapiens
gtgtttctgaatgt

SEQ ID NO: 4649919 - DNA, 13 bp, Homo sapiens
gtgtttctttagt

SEQ ID NO: 4649920 - DNA, 17 bp, Homo sapiens
gtgtttgcttgaatgct

SEQ ID NO: 4649921 - DNA, 11 bp, Homo sapiens
gtgtttgtgtg

SEQ ID NO: 4649922 - DNA, 12 bp, Homo sapiens
gtgttttgctgt

SEQ ID NO: 4649923 - DNA, 18 bp, Homo sapiens
gttaaaaaacaaatgttc

SEQ ID NO: 4649924 - DNA, 23 bp, Homo sapiens
gttaaaacaaccagttaaagcca

SEQ ID NO: 4649925 - DNA, 11 bp, Homo sapiens
gttaaagccac

SEQ ID NO: 4649926 - DNA, 14 bp, Homo sapiens
gttaagggcagagt

SEQ ID NO: 4649927 - DNA, 12 bp, Homo sapiens
gttaataaaagt

SEQ ID NO: 4649928 - DNA, 13 bp, Homo sapiens
gttaatattttgt

SEQ ID NO: 4649929 - DNA, 20 bp, Homo sapiens
gttaatgctctatgtttgta

SEQ ID NO: 4649930 - DNA, 12 bp, Homo sapiens
gttaatgtggac

SEQ ID NO: 4649931 - DNA, 21 bp, Homo sapiens
gttaatgtggactggaacatg

SEQ ID NO: 4649932 - DNA, 16 bp, Homo sapiens
gttaattttaccttgt

SEQ ID NO: 4649933 - DNA, 19 bp, Homo sapiens
gttacctcctccatcttac

SEQ ID NO: 4649934 - DNA, 14 bp, Homo sapiens
gttactgctttgca

SEQ ID NO: 4649935 - DNA, 21 bp, Homo sapiens
gttactgtatactgaaggtct

SEQ ID NO: 4649936 - DNA, 22 bp, Homo sapiens
gttagaaaatgacttatttctg

SEQ ID NO: 4649937 - DNA, 13 bp, Homo sapiens
gttagcagacagg

SEQ ID NO: 4649938 - DNA, 18 bp, Homo sapiens
gttagcagacaggccccg

SEQ ID NO: 4649939 - DNA, 21 bp, Homo sapiens
gttagctttccaaggaagcag

SEQ ID NO: 4649940 - DNA, 17 bp, Homo sapiens
gttaggcatttcctgct

SEQ ID NO: 4649941 - DNA, 22 bp, Homo sapiens
gttaggggccttagggcactgg

SEQ ID NO: 4649942 - DNA, 17 bp, Homo sapiens
gttagtaatggcagagc

SEQ ID NO: 4649943 - DNA, 18 bp, Homo sapiens
gttagtataagcttttca

SEQ ID NO: 4649944 - DNA, 22 bp, Homo sapiens
gttagtatctttattaattttt

SEQ ID NO: 4649945 - DNA, 15 bp, Homo sapiens
gttatcggacattct

SEQ ID NO: 4649946 - DNA, 19 bp, Homo sapiens
gttatcggacattctaatg

SEQ ID NO: 4649947 - DNA, 23 bp, Homo sapiens
gttatcggacattctaatgcata

SEQ ID NO: 4649948 - DNA, 13 bp, Homo sapiens
gttattaaatgat

SEQ ID NO: 4649949 - DNA, 13 bp, Homo sapiens
gttattatgggat

SEQ ID NO: 4649950 - DNA, 16 bp, Homo sapiens
gttattgttgttgcca

SEQ ID NO: 4649951 - DNA, 23 bp, Homo sapiens
gttatttattttttaagaaaaaa

SEQ ID NO: 4649952 - DNA, 18 bp, Homo sapiens
gttattttaataccttta

SEQ ID NO: 4649953 - DNA, 22 bp, Homo sapiens
gttcaaaccctgtatccaattt

SEQ ID NO: 4649954 - DNA, 13 bp, Homo sapiens
gttcaaagactgt

SEQ ID NO: 4649955 - DNA, 16 bp, Homo sapiens
gttcaaagactgtgaa

SEQ ID NO: 4649956 - DNA, 20 bp, Homo sapiens
gttcactcttctcagccact

SEQ ID NO: 4649957 - DNA, 17 bp, Homo sapiens
gttcacttcaaagctaa

SEQ ID NO: 4649958 - DNA, 22 bp, Homo sapiens
gttcagacaagacagaggggag

SEQ ID NO: 4649959 - DNA, 23 bp, Homo sapiens
gttcagacaagacagaggggagc

SEQ ID NO: 4649960 - DNA, 18 bp, Homo sapiens
gttcagagatcaggatca

SEQ ID NO: 4649961 - DNA, 17 bp, Homo sapiens
gttcagctctttccaaa

SEQ ID NO: 4649962 - DNA, 13 bp, Homo sapiens
gttcaggagactt

SEQ ID NO: 4649963 - DNA, 16 bp, Homo sapiens
gttcagtgtaaatagt

SEQ ID NO: 4649964 - DNA, 22 bp, Homo sapiens
gttcatacactaaccaaatctc

SEQ ID NO: 4649965 - DNA, 18 bp, Homo sapiens
gttcatcaccatttcctc

SEQ ID NO: 4649966 - DNA, 16 bp, Homo sapiens
gttcatcgattttcta

SEQ ID NO: 4649967 - DNA, 13 bp, Homo sapiens
gttcattttgagt

SEQ ID NO: 4649968 - DNA, 17 bp, Homo sapiens
gttccaagtccaataag

SEQ ID NO: 4649969 - DNA, 23 bp, Homo sapiens
gttccattgaagccgactctggc

SEQ ID NO: 4649970 - DNA, 15 bp, Homo sapiens
gttcccacaagcctg

SEQ ID NO: 4649971 - DNA, 15 bp, Homo sapiens
gttcccagtagttat

SEQ ID NO: 4649972 - DNA, 19 bp, Homo sapiens
gttccccaagggccctggc

SEQ ID NO: 4649973 - DNA, 22 bp, Homo sapiens
gttccctatggagaggcttccc

SEQ ID NO: 4649974 - DNA, 23 bp, Homo sapiens
gttccctatggagaggcttccct

SEQ ID NO: 4649975 - DNA, 19 bp, Homo sapiens
gttcccttcctcttcctgc

SEQ ID NO: 4649976 - DNA, 23 bp, Homo sapiens
gttcccttcctcttcctgccctt

SEQ ID NO: 4649977 - DNA, 19 bp, Homo sapiens
gttcctccttttcttcacc

SEQ ID NO: 4649978 - DNA, 14 bp, Homo sapiens
gttcctcgttctcc

SEQ ID NO: 4649979 - DNA, 17 bp, Homo sapiens
gttcctcgttctccctg

SEQ ID NO: 4649980 - DNA, 20 bp, Homo sapiens
gttcctcgttctccctggga

SEQ ID NO: 4649981 - DNA, 12 bp, Homo sapiens
gttcctgcagca

SEQ ID NO: 4649982 - DNA, 22 bp, Homo sapiens
gttcctgcgcatatagactgta

SEQ ID NO: 4649983 - DNA, 16 bp, Homo sapiens
gttcctggctcagcct

SEQ ID NO: 4649984 - DNA, 14 bp, Homo sapiens
gttcctttttgtaa

SEQ ID NO: 4649985 - DNA, 16 bp, Homo sapiens
gttcgcagccaccctg

SEQ ID NO: 4649986 - DNA, 13 bp, Homo sapiens
gttctaacttatt

SEQ ID NO: 4649987 - DNA, 15 bp, Homo sapiens
gttctaggctgctgc

SEQ ID NO: 4649988 - DNA, 18 bp, Homo sapiens
gttctataagtgaggaag

SEQ ID NO: 4649989 - DNA, 19 bp, Homo sapiens
gttctcaacatactgtaat

SEQ ID NO: 4649990 - DNA, 16 bp, Homo sapiens
gttctccctgggaggc

SEQ ID NO: 4649991 - DNA, 19 bp, Homo sapiens
gttctctactccctcttgt

SEQ ID NO: 4649992 - DNA, 12 bp, Homo sapiens
gttctctgcttg

SEQ ID NO: 4649993 - DNA, 23 bp, Homo sapiens
gttctgaagccatgtagccaccc

SEQ ID NO: 4649994 - DNA, 15 bp, Homo sapiens
gttctgcaaaataca

SEQ ID NO: 4649995 - DNA, 12 bp, Homo sapiens
gttctgcctgga

SEQ ID NO: 4649996 - DNA, 12 bp, Homo sapiens
gttctgcttgct

SEQ ID NO: 4649997 - DNA, 18 bp, Homo sapiens
gttctgcttgctcccaag

SEQ ID NO: 4649998 - DNA, 17 bp, Homo sapiens
gttctgtccccatctag

SEQ ID NO: 4649999 - DNA, 15 bp, Homo sapiens
gttcttaaaaaggaa

SEQ ID NO: 4650000 - DNA, 14 bp, Homo sapiens
gttcttatgcaaaa

SEQ ID NO: 4650001 - DNA, 18 bp, Homo sapiens
gttcttatgcaaaatgga

SEQ ID NO: 4650002 - DNA, 14 bp, Homo sapiens
gttcttatttgcca

SEQ ID NO: 4650003 - DNA, 12 bp, Homo sapiens
gttctttcccca

SEQ ID NO: 4650004 - DNA, 18 bp, Homo sapiens
gttctttccccaggggca

SEQ ID NO: 4650005 - DNA, 19 bp, Homo sapiens
gttctttcctccccctgca

SEQ ID NO: 4650006 - DNA, 15 bp, Homo sapiens
gttctttgttttttt

SEQ ID NO: 4650007 - DNA, 17 bp, Homo sapiens
gttgaaacttacactgt

SEQ ID NO: 4650008 - DNA, 21 bp, Homo sapiens
gttgaaacttacactgtttca

SEQ ID NO: 4650009 - DNA, 19 bp, Homo sapiens
gttgacacatatgaacaca

SEQ ID NO: 4650010 - DNA, 15 bp, Homo sapiens
gttgacacggccatg

SEQ ID NO: 4650011 - DNA, 20 bp, Homo sapiens
gttgacacggccatgaccac

SEQ ID NO: 4650012 - DNA, 23 bp, Homo sapiens
gttgatttcagcacctacagtgt

SEQ ID NO: 4650013 - DNA, 12 bp, Homo sapiens
gttgcagcccaa

SEQ ID NO: 4650014 - DNA, 19 bp, Homo sapiens
gttgcagcccaaggacagt

SEQ ID NO: 4650015 - DNA, 17 bp, Homo sapiens
gttgcagtctttccccc

SEQ ID NO: 4650016 - DNA, 18 bp, Homo sapiens
gttgcagtctttccccca

SEQ ID NO: 4650017 - DNA, 20 bp, Homo sapiens
gttgccaactattctcaggc

SEQ ID NO: 4650018 - DNA, 19 bp, Homo sapiens
gttgccacagtagaactgt

SEQ ID NO: 4650019 - DNA, 13 bp, Homo sapiens
gttgccctggcat

SEQ ID NO: 4650020 - DNA, 14 bp, Homo sapiens
gttgcctcctctct

SEQ ID NO: 4650021 - DNA, 22 bp, Homo sapiens
gttgcctcctctctccctgcct

SEQ ID NO: 4650022 - DNA, 24 bp, Homo sapiens
gttgctcaccgactcacctgcgca

SEQ ID NO: 4650023 - DNA, 18 bp, Homo sapiens
gttggaactttctgttcc

SEQ ID NO: 4650024 - DNA, 22 bp, Homo sapiens
gttggaactttctgttccctat

SEQ ID NO: 4650025 - DNA, 18 bp, Homo sapiens
gttggagccactctgttc

SEQ ID NO: 4650026 - DNA, 11 bp, Homo sapiens
gttggcacaga

SEQ ID NO: 4650027 - DNA, 15 bp, Homo sapiens
gttggcacagaacag

SEQ ID NO: 4650028 - DNA, 15 bp, Homo sapiens
gttggccaggctggt

SEQ ID NO: 4650029 - DNA, 19 bp, Homo sapiens
gttgggcagccagaccagc

SEQ ID NO: 4650030 - DNA, 15 bp, Homo sapiens
gttggggtgacagtc

SEQ ID NO: 4650031 - DNA, 19 bp, Homo sapiens
gttggtgacttgtctgcct

SEQ ID NO: 4650032 - DNA, 20 bp, Homo sapiens
gttggtgacttgtctgcctc

SEQ ID NO: 4650033 - DNA, 17 bp, Homo sapiens
gttggttcacttcaaag

SEQ ID NO: 4650034 - DNA, 17 bp, Homo sapiens
gttgtaaaatagaaaaa

SEQ ID NO: 4650035 - DNA, 17 bp, Homo sapiens
gttgtaatatttcttca

SEQ ID NO: 4650036 - DNA, 21 bp, Homo sapiens
gttgtatctacagtaatgaaa

SEQ ID NO: 4650037 - DNA, 14 bp, Homo sapiens
gttgtcaccttcac

SEQ ID NO: 4650038 - DNA, 20 bp, Homo sapiens
gttgtctgtgcttccttggt

SEQ ID NO: 4650039 - DNA, 14 bp, Homo sapiens
gttgtcttagcatg

SEQ ID NO: 4650040 - DNA, 21 bp, Homo sapiens
gttgtgatggaggggagaggg

SEQ ID NO: 4650041 - DNA, 13 bp, Homo sapiens
gttgtgcttgagc

SEQ ID NO: 4650042 - DNA, 14 bp, Homo sapiens
gttgtgtgtgttct

SEQ ID NO: 4650043 - DNA, 14 bp, Homo sapiens
gttgttgttttgtt

SEQ ID NO: 4650044 - DNA, 22 bp, Homo sapiens
gtttaaaataaaatgaaaattg

SEQ ID NO: 4650045 - DNA, 16 bp, Homo sapiens
gtttaaactgattcat

SEQ ID NO: 4650046 - DNA, 12 bp, Homo sapiens
gtttaaatacca

SEQ ID NO: 4650047 - DNA, 20 bp, Homo sapiens
gtttaaataccagtacttga

SEQ ID NO: 4650048 - DNA, 12 bp, Homo sapiens
gtttaacaagta

SEQ ID NO: 4650049 - DNA, 22 bp, Homo sapiens
gtttaacggcactgtggccttg

SEQ ID NO: 4650050 - DNA, 23 bp, Homo sapiens
gtttacatgagttcaaatacttt

SEQ ID NO: 4650051 - DNA, 20 bp, Homo sapiens
gtttaggggcaaacatcaca

SEQ ID NO: 4650052 - DNA, 16 bp, Homo sapiens
gtttagttttacacta

SEQ ID NO: 4650053 - DNA, 18 bp, Homo sapiens
gtttagttttacatttta

SEQ ID NO: 4650054 - DNA, 19 bp, Homo sapiens
gtttagttttacattttaa

SEQ ID NO: 4650055 - DNA, 22 bp, Homo sapiens
gtttatgaagaaagatactaat

SEQ ID NO: 4650056 - DNA, 21 bp, Homo sapiens
gtttatgaattataaatgtgt

SEQ ID NO: 4650057 - DNA, 18 bp, Homo sapiens
gtttattataaactgtat

SEQ ID NO: 4650058 - DNA, 22 bp, Homo sapiens
gtttatttaacttttagtaaag

SEQ ID NO: 4650059 - DNA, 14 bp, Homo sapiens
gtttatttcatgtg

SEQ ID NO: 4650060 - DNA, 16 bp, Homo sapiens
gtttatttcatgtggt

SEQ ID NO: 4650061 - DNA, 12 bp, Homo sapiens
gtttcaacaaat

SEQ ID NO: 4650062 - DNA, 18 bp, Homo sapiens
gtttcaaggtcagaacag

SEQ ID NO: 4650063 - DNA, 14 bp, Homo sapiens
gtttcagctggaaa

SEQ ID NO: 4650064 - DNA, 18 bp, Homo sapiens
gtttcatgtaatcctcaa

SEQ ID NO: 4650065 - DNA, 20 bp, Homo sapiens
gtttcattgcgaatcttttt

SEQ ID NO: 4650066 - DNA, 21 bp, Homo sapiens
gtttcccatcccactgctccc

SEQ ID NO: 4650067 - DNA, 21 bp, Homo sapiens
gtttccccttttaaggtttca

SEQ ID NO: 4650068 - DNA, 21 bp, Homo sapiens
gtttcctggcctcagagcttc

SEQ ID NO: 4650069 - DNA, 23 bp, Homo sapiens
gtttccttttctgtctctctctt

SEQ ID NO: 4650070 - DNA, 13 bp, Homo sapiens
gtttctaaaaaca

SEQ ID NO: 4650071 - DNA, 18 bp, Homo sapiens
gtttctaagaaaatgtag

SEQ ID NO: 4650072 - DNA, 14 bp, Homo sapiens
gtttctattctgtc

SEQ ID NO: 4650073 - DNA, 15 bp, Homo sapiens
gtttctgaatgtttg

SEQ ID NO: 4650074 - DNA, 20 bp, Homo sapiens
gtttctgaatgtttgtgtct

SEQ ID NO: 4650075 - DNA, 20 bp, Homo sapiens
gtttctgcattcatttttat

SEQ ID NO: 4650076 - DNA, 21 bp, Homo sapiens
gtttctgtcaagctggtgcta

SEQ ID NO: 4650077 - DNA, 16 bp, Homo sapiens
gtttgaaacaaagaag

SEQ ID NO: 4650078 - DNA, 14 bp, Homo sapiens
gtttgatttttgtt

SEQ ID NO: 4650079 - DNA, 18 bp, Homo sapiens
gtttgccggtggtgcagg

SEQ ID NO: 4650080 - DNA, 19 bp, Homo sapiens
gtttgccggtggtgcaggt

SEQ ID NO: 4650081 - DNA, 21 bp, Homo sapiens
gtttgcgggggtctgagtcta

SEQ ID NO: 4650082 - DNA, 17 bp, Homo sapiens
gtttgggaaggtgatgg

SEQ ID NO: 4650083 - DNA, 13 bp, Homo sapiens
gtttgggcagagc

SEQ ID NO: 4650084 - DNA, 13 bp, Homo sapiens
gtttgtagccagg

SEQ ID NO: 4650085 - DNA, 14 bp, Homo sapiens
gtttgtagccaggt

SEQ ID NO: 4650086 - DNA, 15 bp, Homo sapiens
gtttgtagccaggta

SEQ ID NO: 4650087 - DNA, 22 bp, Homo sapiens
gtttgtatttggaatatttgaa

SEQ ID NO: 4650088 - DNA, 16 bp, Homo sapiens
gtttgtgggtatttct

SEQ ID NO: 4650089 - DNA, 14 bp, Homo sapiens
gtttgttatatcct

SEQ ID NO: 4650090 - DNA, 22 bp, Homo sapiens
gttttaaaatgtgaggcaataa

SEQ ID NO: 4650091 - DNA, 23 bp, Homo sapiens
gttttagggagtggttcctgtgg

SEQ ID NO: 4650092 - DNA, 18 bp, Homo sapiens
gttttatgcgtgtgacag

SEQ ID NO: 4650093 - DNA, 13 bp, Homo sapiens
gttttattacaaa

SEQ ID NO: 4650094 - DNA, 14 bp, Homo sapiens
gttttcaaaatact

SEQ ID NO: 4650095 - DNA, 22 bp, Homo sapiens
gttttcaaccggaaggaggcca

SEQ ID NO: 4650096 - DNA, 24 bp, Homo sapiens
gttttcaggagtgggttgatttca

SEQ ID NO: 4650097 - DNA, 22 bp, Homo sapiens
gttttcattatgttcatgtaag

SEQ ID NO: 4650098 - DNA, 13 bp, Homo sapiens
gttttccaagccc

SEQ ID NO: 4650099 - DNA, 20 bp, Homo sapiens
gttttccaagccctcagctg

SEQ ID NO: 4650100 - DNA, 12 bp, Homo sapiens
gttttctgctgt

SEQ ID NO: 4650101 - DNA, 20 bp, Homo sapiens
gttttgagtaaaaagacatt

SEQ ID NO: 4650102 - DNA, 13 bp, Homo sapiens
gttttgcactttt

SEQ ID NO: 4650103 - DNA, 14 bp, Homo sapiens
gttttggcagctga

SEQ ID NO: 4650104 - DNA, 12 bp, Homo sapiens
gttttgttgcta

SEQ ID NO: 4650105 - DNA, 18 bp, Homo sapiens
gttttgttttgttttttt

SEQ ID NO: 4650106 - DNA, 23 bp, Homo sapiens
gtttttaatgaccaattgagtaa

SEQ ID NO: 4650107 - DNA, 24 bp, Homo sapiens
gtttttaatgaccaattgagtaag

SEQ ID NO: 4650108 - DNA, 14 bp, Homo sapiens
gtttttcagttttc

SEQ ID NO: 4650109 - DNA, 23 bp, Homo sapiens
gtttttcccacgtctaactggaa

SEQ ID NO: 4650110 - DNA, 11 bp, Homo sapiens
gtttttctgaa

SEQ ID NO: 4650111 - DNA, 12 bp, Homo sapiens
gtttttgcaact

SEQ ID NO: 4650112 - DNA, 17 bp, Homo sapiens
gtttttgctaaatgtga

SEQ ID NO: 4650113 - DNA, 22 bp, Homo sapiens
gtttttgctaaatgtgagtatt

SEQ ID NO: 4650114 - DNA, 10 bp, Homo sapiens
gtttttggaa

SEQ ID NO: 4650115 - DNA, 9 bp, Homo sapiens
gttttttgt

SEQ ID NO: 4650116 - DNA, 14 bp, Homo sapiens
gttttttgtaacta

SEQ ID NO: 4650117 - DNA, 13 bp, Homo sapiens
gtttttttgagat

SEQ ID NO: 4650118 - DNA, 16 bp, Homo sapiens
taaaaaaaaaaaagta

SEQ ID NO: 4650119 - DNA, 13 bp, Homo sapiens
taaaaaagcatta

SEQ ID NO: 4650120 - DNA, 14 bp, Homo sapiens
taaaaaatattttc

SEQ ID NO: 4650121 - DNA, 13 bp, Homo sapiens
taaaaaatgaaat

SEQ ID NO: 4650122 - DNA, 11 bp, Homo sapiens
taaaaaatgtc

SEQ ID NO: 4650123 - DNA, 13 bp, Homo sapiens
taaaaaatgtctc

SEQ ID NO: 4650124 - DNA, 15 bp, Homo sapiens
taaaaacaaccaaca

SEQ ID NO: 4650125 - DNA, 18 bp, Homo sapiens
taaaaacagcattgcttt

SEQ ID NO: 4650126 - DNA, 20 bp, Homo sapiens
taaaaacagcattgctttct

SEQ ID NO: 4650127 - DNA, 13 bp, Homo sapiens
taaaaactttatt

SEQ ID NO: 4650128 - DNA, 15 bp, Homo sapiens
taaaaagaaaatatt

SEQ ID NO: 4650129 - DNA, 22 bp, Homo sapiens
taaaaagatgatcgctgtattt

SEQ ID NO: 4650130 - DNA, 19 bp, Homo sapiens
taaaaatatagcaaatgca

SEQ ID NO: 4650131 - DNA, 17 bp, Homo sapiens
taaaaattacatatata

SEQ ID NO: 4650132 - DNA, 14 bp, Homo sapiens
taaaaattagcatg

SEQ ID NO: 4650133 - DNA, 15 bp, Homo sapiens
taaaacaaaatttga

SEQ ID NO: 4650134 - DNA, 17 bp, Homo sapiens
taaaacaaaatttgttt

SEQ ID NO: 4650135 - DNA, 15 bp, Homo sapiens
taaaacaaatataca

SEQ ID NO: 4650136 - DNA, 19 bp, Homo sapiens
taaaacaaatatacatttt

SEQ ID NO: 4650137 - DNA, 13 bp, Homo sapiens
taaaacaaccagt

SEQ ID NO: 4650138 - DNA, 13 bp, Homo sapiens
taaaacattatat

SEQ ID NO: 4650139 - DNA, 20 bp, Homo sapiens
taaaaccttgttctattttt

SEQ ID NO: 4650140 - DNA, 22 bp, Homo sapiens
taaaaccttgttctatttttca

SEQ ID NO: 4650141 - DNA, 16 bp, Homo sapiens
taaaactcactgtgat

SEQ ID NO: 4650142 - DNA, 17 bp, Homo sapiens
taaaactttattaaaag

SEQ ID NO: 4650143 - DNA, 22 bp, Homo sapiens
taaaactttattaaaagaatga

SEQ ID NO: 4650144 - DNA, 15 bp, Homo sapiens
taaaagaatgactat

SEQ ID NO: 4650145 - DNA, 14 bp, Homo sapiens
taaaaggaagccaa

SEQ ID NO: 4650146 - DNA, 19 bp, Homo sapiens
taaaagtaagttttaagga

SEQ ID NO: 4650147 - DNA, 11 bp, Homo sapiens
taaaagttttg

SEQ ID NO: 4650148 - DNA, 22 bp, Homo sapiens
taaaagttttttattatgcatt

SEQ ID NO: 4650149 - DNA, 14 bp, Homo sapiens
taaaataaaatgaa

SEQ ID NO: 4650150 - DNA, 22 bp, Homo sapiens
taaaataaaatgaaaattgtat

SEQ ID NO: 4650151 - DNA, 23 bp, Homo sapiens
taaaatagacctaactgaataca

SEQ ID NO: 4650152 - DNA, 20 bp, Homo sapiens
taaaatagcaataactgaaa

SEQ ID NO: 4650153 - DNA, 20 bp, Homo sapiens
taaaataggcaccattgctt

SEQ ID NO: 4650154 - DNA, 16 bp, Homo sapiens
taaaatatatctggaa

SEQ ID NO: 4650155 - DNA, 12 bp, Homo sapiens
taaaatattttg

SEQ ID NO: 4650156 - DNA, 14 bp, Homo sapiens
taaaatccatttta

SEQ ID NO: 4650157 - DNA, 15 bp, Homo sapiens
taaaatccattttag

SEQ ID NO: 4650158 - DNA, 22 bp, Homo sapiens
taaaatccccttcgctgaaatt

SEQ ID NO: 4650159 - DNA, 16 bp, Homo sapiens
taaaatgaaaattgta

SEQ ID NO: 4650160 - DNA, 21 bp, Homo sapiens
taaaatgaacatctcttgaaa

SEQ ID NO: 4650161 - DNA, 23 bp, Homo sapiens
taaaatgaacatctcttgaaacc

SEQ ID NO: 4650162 - DNA, 12 bp, Homo sapiens
taaaatgacaaa

SEQ ID NO: 4650163 - DNA, 13 bp, Homo sapiens
taaaatggaattg

SEQ ID NO: 4650164 - DNA, 23 bp, Homo sapiens
taaaatggaattgaaaaactctt

SEQ ID NO: 4650165 - DNA, 18 bp, Homo sapiens
taaaatggctgtaatcat

SEQ ID NO: 4650166 - DNA, 23 bp, Homo sapiens
taaaatgtgtacagtgaacaaat

SEQ ID NO: 4650167 - DNA, 12 bp, Homo sapiens
taaaatgtttca

SEQ ID NO: 4650168 - DNA, 23 bp, Homo sapiens
taaaatgtttcattatgcacttt

SEQ ID NO: 4650169 - DNA, 21 bp, Homo sapiens
taaaatgtttggatggtttgt

SEQ ID NO: 4650170 - DNA, 14 bp, Homo sapiens
taaaattaacaaat

SEQ ID NO: 4650171 - DNA, 17 bp, Homo sapiens
taaaatttaagtatctt

SEQ ID NO: 4650172 - DNA, 24 bp, Homo sapiens
taaacaacattgagattatgatga

SEQ ID NO: 4650173 - DNA, 20 bp, Homo sapiens
taaacaagtcaattctgtgt

SEQ ID NO: 4650174 - DNA, 21 bp, Homo sapiens
taaacagcagcactttttagt

SEQ ID NO: 4650175 - DNA, 16 bp, Homo sapiens
taaacataagctaaat

SEQ ID NO: 4650176 - DNA, 20 bp, Homo sapiens
taaacatttttcacatctct

SEQ ID NO: 4650177 - DNA, 22 bp, Homo sapiens
taaaccagggatgtctgttgaa

SEQ ID NO: 4650178 - DNA, 13 bp, Homo sapiens
taaaccattgtaa

SEQ ID NO: 4650179 - DNA, 21 bp, Homo sapiens
taaactactgattacttgtaa

SEQ ID NO: 4650180 - DNA, 23 bp, Homo sapiens
taaactatgttcctaacaaaatg

SEQ ID NO: 4650181 - DNA, 23 bp, Homo sapiens
taaactgaatataaagcttaata

SEQ ID NO: 4650182 - DNA, 14 bp, Homo sapiens
taaactgactatca

SEQ ID NO: 4650183 - DNA, 13 bp, Homo sapiens
taaactgaggccc

SEQ ID NO: 4650184 - DNA, 15 bp, Homo sapiens
taaacttgtcttttc

SEQ ID NO: 4650185 - DNA, 11 bp, Homo sapiens
taaactttatt

SEQ ID NO: 4650186 - DNA, 21 bp, Homo sapiens
taaactttatttgtaaaccat

SEQ ID NO: 4650187 - DNA, 13 bp, Homo sapiens
taaactttctcca

SEQ ID NO: 4650188 - DNA, 13 bp, Homo sapiens
taaagaagcaata

SEQ ID NO: 4650189 - DNA, 15 bp, Homo sapiens
taaagaagctttatc

SEQ ID NO: 4650190 - DNA, 18 bp, Homo sapiens
taaagcaaactatgattt

SEQ ID NO: 4650191 - DNA, 15 bp, Homo sapiens
taaagccacttctgg

SEQ ID NO: 4650192 - DNA, 17 bp, Homo sapiens
taaagggaatcattttt

SEQ ID NO: 4650193 - DNA, 18 bp, Homo sapiens
taaaggggactagacagt

SEQ ID NO: 4650194 - DNA, 13 bp, Homo sapiens
taaagtacaaatg

SEQ ID NO: 4650195 - DNA, 15 bp, Homo sapiens
taaagtacaaatgaa

SEQ ID NO: 4650196 - DNA, 21 bp, Homo sapiens
taaagtacaaatgaagaaagt

SEQ ID NO: 4650197 - DNA, 22 bp, Homo sapiens
taaagtacaaatgaagaaagtc

SEQ ID NO: 4650198 - DNA, 21 bp, Homo sapiens
taaagtatttataaaaatata

SEQ ID NO: 4650199 - DNA, 17 bp, Homo sapiens
taaagtgtacttataaa

SEQ ID NO: 4650200 - DNA, 19 bp, Homo sapiens
taaagttctgcaaaataca

SEQ ID NO: 4650201 - DNA, 15 bp, Homo sapiens
taaagttgttgcatt

SEQ ID NO: 4650202 - DNA, 12 bp, Homo sapiens
taaagtttaaat

SEQ ID NO: 4650203 - DNA, 13 bp, Homo sapiens
taaagtttaaata

SEQ ID NO: 4650204 - DNA, 23 bp, Homo sapiens
taaagtttaaataccagtacttg

SEQ ID NO: 4650205 - DNA, 17 bp, Homo sapiens
taaataaaaaaagacaa

SEQ ID NO: 4650206 - DNA, 21 bp, Homo sapiens
taaataaaaatatgtaatttc

SEQ ID NO: 4650207 - DNA, 17 bp, Homo sapiens
taaataccagacacgta

SEQ ID NO: 4650208 - DNA, 15 bp, Homo sapiens
taaataccagtactt

SEQ ID NO: 4650209 - DNA, 16 bp, Homo sapiens
taaatagaaattttca

SEQ ID NO: 4650210 - DNA, 16 bp, Homo sapiens
taaatagcataaaatg

SEQ ID NO: 4650211 - DNA, 23 bp, Homo sapiens
taaatagtgtcatataaactcat

SEQ ID NO: 4650212 - DNA, 13 bp, Homo sapiens
taaatatcattct

SEQ ID NO: 4650213 - DNA, 16 bp, Homo sapiens
taaatatcattctttg

SEQ ID NO: 4650214 - DNA, 16 bp, Homo sapiens
taaatatgtgacattc

SEQ ID NO: 4650215 - DNA, 18 bp, Homo sapiens
taaatatgtgacattcct

SEQ ID NO: 4650216 - DNA, 17 bp, Homo sapiens
taaatattgtaatatga

SEQ ID NO: 4650217 - DNA, 20 bp, Homo sapiens
taaatattgtaatatgacag

SEQ ID NO: 4650218 - DNA, 13 bp, Homo sapiens
taaatatttactc

SEQ ID NO: 4650219 - DNA, 16 bp, Homo sapiens
taaatatttactcttt

SEQ ID NO: 4650220 - DNA, 20 bp, Homo sapiens
taaatatttgttacttttag

SEQ ID NO: 4650221 - DNA, 13 bp, Homo sapiens
taaatattttcta

SEQ ID NO: 4650222 - DNA, 14 bp, Homo sapiens
taaatattttctat

SEQ ID NO: 4650223 - DNA, 22 bp, Homo sapiens
taaatcagaaagtaacaatcta

SEQ ID NO: 4650224 - DNA, 14 bp, Homo sapiens
taaatcctaccaaa

SEQ ID NO: 4650225 - DNA, 16 bp, Homo sapiens
taaatcctaccaaagt

SEQ ID NO: 4650226 - DNA, 22 bp, Homo sapiens
taaatcctgtgtttcattactt

SEQ ID NO: 4650227 - DNA, 20 bp, Homo sapiens
taaatctaaatgattatctt

SEQ ID NO: 4650228 - DNA, 18 bp, Homo sapiens
taaatgatatcaaagaag

SEQ ID NO: 4650229 - DNA, 18 bp, Homo sapiens
taaatgtttcccccactc

SEQ ID NO: 4650230 - DNA, 17 bp, Homo sapiens
taaattgctctgttccc

SEQ ID NO: 4650231 - DNA, 15 bp, Homo sapiens
taaattgttcctctt

SEQ ID NO: 4650232 - DNA, 16 bp, Homo sapiens
taaattgttcctcttt

SEQ ID NO: 4650233 - DNA, 16 bp, Homo sapiens
taaatttaagaaaaca

SEQ ID NO: 4650234 - DNA, 15 bp, Homo sapiens
taaatttcttctggt

SEQ ID NO: 4650235 - DNA, 20 bp, Homo sapiens
taaatttgatttacatatat

SEQ ID NO: 4650236 - DNA, 14 bp, Homo sapiens
taaatttggcttct

SEQ ID NO: 4650237 - DNA, 11 bp, Homo sapiens
taacaagtgtt

SEQ ID NO: 4650238 - DNA, 14 bp, Homo sapiens
taacacaaaggaag

SEQ ID NO: 4650239 - DNA, 21 bp, Homo sapiens
taacactcagaagcctggggg

SEQ ID NO: 4650240 - DNA, 16 bp, Homo sapiens
taacactgtgatttat

SEQ ID NO: 4650241 - DNA, 20 bp, Homo sapiens
taacactgtgatttatcttt

SEQ ID NO: 4650242 - DNA, 17 bp, Homo sapiens
taacagagagaatgaga

SEQ ID NO: 4650243 - DNA, 14 bp, Homo sapiens
taacagggaaggca

SEQ ID NO: 4650244 - DNA, 20 bp, Homo sapiens
taacatacaagaaaatgtat

SEQ ID NO: 4650245 - DNA, 21 bp, Homo sapiens
taacatgatttcaaaatcagt

SEQ ID NO: 4650246 - DNA, 14 bp, Homo sapiens
taacatgtcagttt

SEQ ID NO: 4650247 - DNA, 13 bp, Homo sapiens
taacattgctgat

SEQ ID NO: 4650248 - DNA, 14 bp, Homo sapiens
taacatttaaattc

SEQ ID NO: 4650249 - DNA, 12 bp, Homo sapiens
taacatttccta

SEQ ID NO: 4650250 - DNA, 15 bp, Homo sapiens
taaccaaggaaatat

SEQ ID NO: 4650251 - DNA, 20 bp, Homo sapiens
taaccaaggccctgtctctg

SEQ ID NO: 4650252 - DNA, 15 bp, Homo sapiens
taaccaatttgtaat

SEQ ID NO: 4650253 - DNA, 14 bp, Homo sapiens
taacccagttactt

SEQ ID NO: 4650254 - DNA, 11 bp, Homo sapiens
taaccccaccc

SEQ ID NO: 4650255 - DNA, 22 bp, Homo sapiens
taaccgagatcagtatttaact

SEQ ID NO: 4650256 - DNA, 23 bp, Homo sapiens
taaccgagatcagtatttaacta

SEQ ID NO: 4650257 - DNA, 14 bp, Homo sapiens
taacctaataattg

SEQ ID NO: 4650258 - DNA, 22 bp, Homo sapiens
taacctaataattgtatctaca

SEQ ID NO: 4650259 - DNA, 22 bp, Homo sapiens
taacctcaagtgatcctcccac

SEQ ID NO: 4650260 - DNA, 14 bp, Homo sapiens
taacctgcacaggc

SEQ ID NO: 4650261 - DNA, 15 bp, Homo sapiens
taacctgcacaggct

SEQ ID NO: 4650262 - DNA, 16 bp, Homo sapiens
taacctgcacaggctt

SEQ ID NO: 4650263 - DNA, 22 bp, Homo sapiens
taacctgggaccaacctgacct

SEQ ID NO: 4650264 - DNA, 13 bp, Homo sapiens
taacgcctgagcc

SEQ ID NO: 4650265 - DNA, 14 bp, Homo sapiens
taacggtgctaaaa

SEQ ID NO: 4650266 - DNA, 13 bp, Homo sapiens
taactatgcttta

SEQ ID NO: 4650267 - DNA, 18 bp, Homo sapiens
taactcacacccctgccc

SEQ ID NO: 4650268 - DNA, 16 bp, Homo sapiens
taactccctccaccag

SEQ ID NO: 4650269 - DNA, 20 bp, Homo sapiens
taactccctccaccagcctg

SEQ ID NO: 4650270 - DNA, 17 bp, Homo sapiens
taactctgcccaccctc

SEQ ID NO: 4650271 - DNA, 19 bp, Homo sapiens
taactctgcccaccctcct

SEQ ID NO: 4650272 - DNA, 16 bp, Homo sapiens
taactgaaaatgaaag

SEQ ID NO: 4650273 - DNA, 14 bp, Homo sapiens
taactgacttcact

SEQ ID NO: 4650274 - DNA, 16 bp, Homo sapiens
taactgatgagtaaac

SEQ ID NO: 4650275 - DNA, 14 bp, Homo sapiens
taactggaaacaaa

SEQ ID NO: 4650276 - DNA, 19 bp, Homo sapiens
taactggaacaaattattt

SEQ ID NO: 4650277 - DNA, 13 bp, Homo sapiens
taactgtacattt

SEQ ID NO: 4650278 - DNA, 14 bp, Homo sapiens
taacttatttataa

SEQ ID NO: 4650279 - DNA, 20 bp, Homo sapiens
taacttatttataaaaagat

SEQ ID NO: 4650280 - DNA, 19 bp, Homo sapiens
taacttgcctccatctttt

SEQ ID NO: 4650281 - DNA, 22 bp, Homo sapiens
taactttgctttcatgaccatc

SEQ ID NO: 4650282 - DNA, 13 bp, Homo sapiens
taacttttatatt

SEQ ID NO: 4650283 - DNA, 16 bp, Homo sapiens
taacttttgtgtgaaa

SEQ ID NO: 4650284 - DNA, 23 bp, Homo sapiens
taacttttttgtggcaattagtg

SEQ ID NO: 4650285 - DNA, 23 bp, Homo sapiens
taagaaaagtaatgaagaatcac

SEQ ID NO: 4650286 - DNA, 13 bp, Homo sapiens
taagaaaggaagc

SEQ ID NO: 4650287 - DNA, 18 bp, Homo sapiens
taagaactgcttcatgtg

SEQ ID NO: 4650288 - DNA, 17 bp, Homo sapiens
taagaatgaagttctgc

SEQ ID NO: 4650289 - DNA, 14 bp, Homo sapiens
taagaattttgctt

SEQ ID NO: 4650290 - DNA, 12 bp, Homo sapiens
taagaccacctt

SEQ ID NO: 4650291 - DNA, 16 bp, Homo sapiens
taagaccaccttccct

SEQ ID NO: 4650292 - DNA, 18 bp, Homo sapiens
taagatattctttacaaa

SEQ ID NO: 4650293 - DNA, 23 bp, Homo sapiens
taagatattctttacaaactgaa

SEQ ID NO: 4650294 - DNA, 17 bp, Homo sapiens
taagatttctttatgtg

SEQ ID NO: 4650295 - DNA, 22 bp, Homo sapiens
taagcaagtatatttatttcta

SEQ ID NO: 4650296 - DNA, 15 bp, Homo sapiens
taagcaatcatttta

SEQ ID NO: 4650297 - DNA, 13 bp, Homo sapiens
taagcagaaacag

SEQ ID NO: 4650298 - DNA, 18 bp, Homo sapiens
taagcagattgctttaat

SEQ ID NO: 4650299 - DNA, 18 bp, Homo sapiens
taagcatactttgtaaat

SEQ ID NO: 4650300 - DNA, 16 bp, Homo sapiens
taagcattccacactg

SEQ ID NO: 4650301 - DNA, 20 bp, Homo sapiens
taagcattttgaaacaaagt

SEQ ID NO: 4650302 - DNA, 15 bp, Homo sapiens
taagccaaagaaaca

SEQ ID NO: 4650303 - DNA, 16 bp, Homo sapiens
taagcgatttgaaaca

SEQ ID NO: 4650304 - DNA, 19 bp, Homo sapiens
taagcgttaagggcagagt

SEQ ID NO: 4650305 - DNA, 22 bp, Homo sapiens
taagctatcacctagcagcctc

SEQ ID NO: 4650306 - DNA, 15 bp, Homo sapiens
taagctcccctgcct

SEQ ID NO: 4650307 - DNA, 14 bp, Homo sapiens
taagctctgcccct

SEQ ID NO: 4650308 - DNA, 15 bp, Homo sapiens
taagctctgcccctt

SEQ ID NO: 4650309 - DNA, 17 bp, Homo sapiens
taagctctgccccttcc

SEQ ID NO: 4650310 - DNA, 12 bp, Homo sapiens
taagcttttatt

SEQ ID NO: 4650311 - DNA, 17 bp, Homo sapiens
taaggacccttttaagc

SEQ ID NO: 4650312 - DNA, 16 bp, Homo sapiens
taaggaggtttgtata

SEQ ID NO: 4650313 - DNA, 17 bp, Homo sapiens
taaggcacagtgggagc

SEQ ID NO: 4650314 - DNA, 17 bp, Homo sapiens
taaggcaggtgggcaga

SEQ ID NO: 4650315 - DNA, 18 bp, Homo sapiens
taagggtgggtgctcaga

SEQ ID NO: 4650316 - DNA, 10 bp, Homo sapiens
taaggtttca

SEQ ID NO: 4650317 - DNA, 19 bp, Homo sapiens
taagtaatatcaaagcatt

SEQ ID NO: 4650318 - DNA, 12 bp, Homo sapiens
taagtcacatat

SEQ ID NO: 4650319 - DNA, 18 bp, Homo sapiens
taagtcaggacagcttgt

SEQ ID NO: 4650320 - DNA, 19 bp, Homo sapiens
taagtggactggtgtcata

SEQ ID NO: 4650321 - DNA, 18 bp, Homo sapiens
taagtgtaaaaaatgtct

SEQ ID NO: 4650322 - DNA, 15 bp, Homo sapiens
taataaacataatga

SEQ ID NO: 4650323 - DNA, 16 bp, Homo sapiens
taataaagctttataa

SEQ ID NO: 4650324 - DNA, 14 bp, Homo sapiens
taataaattgctta

SEQ ID NO: 4650325 - DNA, 18 bp, Homo sapiens
taataacgtgaaacttat

SEQ ID NO: 4650326 - DNA, 22 bp, Homo sapiens
taataatgttaaccaaggaaat

SEQ ID NO: 4650327 - DNA, 17 bp, Homo sapiens
taataattgtatctaca

SEQ ID NO: 4650328 - DNA, 16 bp, Homo sapiens
taataattttatagaa

SEQ ID NO: 4650329 - DNA, 13 bp, Homo sapiens
taatacaggaaat

SEQ ID NO: 4650330 - DNA, 16 bp, Homo sapiens
taatacatccattcta

SEQ ID NO: 4650331 - DNA, 21 bp, Homo sapiens
taatacctttaaatatcattc

SEQ ID NO: 4650332 - DNA, 22 bp, Homo sapiens
taatagagtacttaatatactc

SEQ ID NO: 4650333 - DNA, 19 bp, Homo sapiens
taatagcatttttgtaact

SEQ ID NO: 4650334 - DNA, 13 bp, Homo sapiens
taatagcttttta

SEQ ID NO: 4650335 - DNA, 15 bp, Homo sapiens
taatagggaatatat

SEQ ID NO: 4650336 - DNA, 16 bp, Homo sapiens
taatatagctgagact

SEQ ID NO: 4650337 - DNA, 16 bp, Homo sapiens
taatatcaaataaaat

SEQ ID NO: 4650338 - DNA, 14 bp, Homo sapiens
taatatcattttat

SEQ ID NO: 4650339 - DNA, 15 bp, Homo sapiens
taatatctttcagtt

SEQ ID NO: 4650340 - DNA, 19 bp, Homo sapiens
taatatctttcagttatta

SEQ ID NO: 4650341 - DNA, 14 bp, Homo sapiens
taatatgtttagtt

SEQ ID NO: 4650342 - DNA, 23 bp, Homo sapiens
taatatgtttagttttacatttt

SEQ ID NO: 4650343 - DNA, 16 bp, Homo sapiens
taatatttagctgtaa

SEQ ID NO: 4650344 - DNA, 14 bp, Homo sapiens
taatattttgttct

SEQ ID NO: 4650345 - DNA, 19 bp, Homo sapiens
taatatttttgtatttctc

SEQ ID NO: 4650346 - DNA, 14 bp, Homo sapiens
taatcagtcatttc

SEQ ID NO: 4650347 - DNA, 18 bp, Homo sapiens
taatcatacaaactctca

SEQ ID NO: 4650348 - DNA, 20 bp, Homo sapiens
taatcattatttgagactgt

SEQ ID NO: 4650349 - DNA, 12 bp, Homo sapiens
taatcattttaa

SEQ ID NO: 4650350 - DNA, 22 bp, Homo sapiens
taatccctgggcattgctttcc

SEQ ID NO: 4650351 - DNA, 21 bp, Homo sapiens
taatcctcctgagtagctggg

SEQ ID NO: 4650352 - DNA, 13 bp, Homo sapiens
taatctgtgtaca

SEQ ID NO: 4650353 - DNA, 14 bp, Homo sapiens
taatcttatacaac

SEQ ID NO: 4650354 - DNA, 16 bp, Homo sapiens
taatcttctctcttga

SEQ ID NO: 4650355 - DNA, 18 bp, Homo sapiens
taatcttctctcttgatt

SEQ ID NO: 4650356 - DNA, 12 bp, Homo sapiens
taatctttattt

SEQ ID NO: 4650357 - DNA, 21 bp, Homo sapiens
taatctttattttattattca

SEQ ID NO: 4650358 - DNA, 22 bp, Homo sapiens
taatctttattttattattcag

SEQ ID NO: 4650359 - DNA, 18 bp, Homo sapiens
taatgaaaataaaacaca

SEQ ID NO: 4650360 - DNA, 15 bp, Homo sapiens
taatgaaatgtttac

SEQ ID NO: 4650361 - DNA, 15 bp, Homo sapiens
taatgacacttgtcc

SEQ ID NO: 4650362 - DNA, 17 bp, Homo sapiens
taatgacagatggtgaa

SEQ ID NO: 4650363 - DNA, 18 bp, Homo sapiens
taatgaccaattgagtaa

SEQ ID NO: 4650364 - DNA, 22 bp, Homo sapiens
taatgaccaattgagtaagaac

SEQ ID NO: 4650365 - DNA, 17 bp, Homo sapiens
taatgacttagaaactg

SEQ ID NO: 4650366 - DNA, 23 bp, Homo sapiens
taatgaggtagctatagttgcag

SEQ ID NO: 4650367 - DNA, 15 bp, Homo sapiens
taatgataaaatagc

SEQ ID NO: 4650368 - DNA, 13 bp, Homo sapiens
taatgatggcaga

SEQ ID NO: 4650369 - DNA, 20 bp, Homo sapiens
taatgcaaatacccaccagg

SEQ ID NO: 4650370 - DNA, 18 bp, Homo sapiens
taatgcaaattaaaacat

SEQ ID NO: 4650371 - DNA, 15 bp, Homo sapiens
taatgcacagtgcat

SEQ ID NO: 4650372 - DNA, 21 bp, Homo sapiens
taatgcatatttataagagaa

SEQ ID NO: 4650373 - DNA, 12 bp, Homo sapiens
taatgcctgccc

SEQ ID NO: 4650374 - DNA, 17 bp, Homo sapiens
taatgctatttgaacaa

SEQ ID NO: 4650375 - DNA, 14 bp, Homo sapiens
taatgctgtttcta

SEQ ID NO: 4650376 - DNA, 19 bp, Homo sapiens
taatgctgtttctaagaaa

SEQ ID NO: 4650377 - DNA, 20 bp, Homo sapiens
taatgctgtttctaagaaaa

SEQ ID NO: 4650378 - DNA, 16 bp, Homo sapiens
taatgcttttactaag

SEQ ID NO: 4650379 - DNA, 18 bp, Homo sapiens
taatggaggtcccagccc

SEQ ID NO: 4650380 - DNA, 19 bp, Homo sapiens
taatggaggtcccagccct

SEQ ID NO: 4650381 - DNA, 22 bp, Homo sapiens
taatggattaaatttaattctt

SEQ ID NO: 4650382 - DNA, 19 bp, Homo sapiens
taatggcagagcagtctaa

SEQ ID NO: 4650383 - DNA, 18 bp, Homo sapiens
taatggtatcctactgag

SEQ ID NO: 4650384 - DNA, 14 bp, Homo sapiens
taatgtatcttaaa

SEQ ID NO: 4650385 - DNA, 15 bp, Homo sapiens
taatgtatcttaaag

SEQ ID NO: 4650386 - DNA, 13 bp, Homo sapiens
taatgtggactgg

SEQ ID NO: 4650387 - DNA, 13 bp, Homo sapiens
taatgttgataat

SEQ ID NO: 4650388 - DNA, 16 bp, Homo sapiens
taatgtttttctggaa

SEQ ID NO: 4650389 - DNA, 19 bp, Homo sapiens
taattaaccttactaatta

SEQ ID NO: 4650390 - DNA, 16 bp, Homo sapiens
taattaactgtaaact

SEQ ID NO: 4650391 - DNA, 19 bp, Homo sapiens
taattaagcagaaacagca

SEQ ID NO: 4650392 - DNA, 15 bp, Homo sapiens
taattatgaaaagaa

SEQ ID NO: 4650393 - DNA, 16 bp, Homo sapiens
taattcagtgggaatt

SEQ ID NO: 4650394 - DNA, 20 bp, Homo sapiens
taattcttcaccttaggaat

SEQ ID NO: 4650395 - DNA, 16 bp, Homo sapiens
taattgctttgtgcct

SEQ ID NO: 4650396 - DNA, 16 bp, Homo sapiens
taattggtgctatttg

SEQ ID NO: 4650397 - DNA, 20 bp, Homo sapiens
taattgtatctacattaaaa

SEQ ID NO: 4650398 - DNA, 12 bp, Homo sapiens
taatttaacacc

SEQ ID NO: 4650399 - DNA, 11 bp, Homo sapiens
taatttacaag

SEQ ID NO: 4650400 - DNA, 21 bp, Homo sapiens
taatttatagcaagatattga

SEQ ID NO: 4650401 - DNA, 16 bp, Homo sapiens
taatttcaaaatacat

SEQ ID NO: 4650402 - DNA, 19 bp, Homo sapiens
taatttcaaaatacatttg

SEQ ID NO: 4650403 - DNA, 12 bp, Homo sapiens
taatttcaggaa

SEQ ID NO: 4650404 - DNA, 14 bp, Homo sapiens
taatttcaggaaaa

SEQ ID NO: 4650405 - DNA, 17 bp, Homo sapiens
taatttgatgaggtatt

SEQ ID NO: 4650406 - DNA, 20 bp, Homo sapiens
taatttgatgaggtattttt

SEQ ID NO: 4650407 - DNA, 14 bp, Homo sapiens
taatttgtaaactt

SEQ ID NO: 4650408 - DNA, 17 bp, Homo sapiens
taatttgtaaacttctg

SEQ ID NO: 4650409 - DNA, 15 bp, Homo sapiens
taattttaatgctgt

SEQ ID NO: 4650410 - DNA, 17 bp, Homo sapiens
taattttgaaaagatgt

SEQ ID NO: 4650411 - DNA, 14 bp, Homo sapiens
taattttgcatact

SEQ ID NO: 4650412 - DNA, 17 bp, Homo sapiens
taattttgcatactgaa

SEQ ID NO: 4650413 - DNA, 12 bp, Homo sapiens
taattttgtcac

SEQ ID NO: 4650414 - DNA, 21 bp, Homo sapiens
taattttgtgaatctattgtt

SEQ ID NO: 4650415 - DNA, 19 bp, Homo sapiens
taatttttaatgatgacaa

SEQ ID NO: 4650416 - DNA, 13 bp, Homo sapiens
tacaaaatgattt

SEQ ID NO: 4650417 - DNA, 23 bp, Homo sapiens
tacaaacaagtggatgtttttaa

SEQ ID NO: 4650418 - DNA, 19 bp, Homo sapiens
tacaaagagccttcctatt

SEQ ID NO: 4650419 - DNA, 15 bp, Homo sapiens
tacaaagtggaaact

SEQ ID NO: 4650420 - DNA, 16 bp, Homo sapiens
tacaaatgaagaaagt

SEQ ID NO: 4650421 - DNA, 13 bp, Homo sapiens
tacaaatgcctta

SEQ ID NO: 4650422 - DNA, 15 bp, Homo sapiens
tacaaattgtcgttt

SEQ ID NO: 4650423 - DNA, 19 bp, Homo sapiens
tacaacatcaccagtgcca

SEQ ID NO: 4650424 - DNA, 23 bp, Homo sapiens
tacaactggagtttttttataca

SEQ ID NO: 4650425 - DNA, 15 bp, Homo sapiens
tacaagaaaatgtat

SEQ ID NO: 4650426 - DNA, 18 bp, Homo sapiens
tacaataacccagttact

SEQ ID NO: 4650427 - DNA, 19 bp, Homo sapiens
tacaataacccagttactt

SEQ ID NO: 4650428 - DNA, 18 bp, Homo sapiens
tacaatcttagtgaatgg

SEQ ID NO: 4650429 - DNA, 12 bp, Homo sapiens
tacaatcttggg

SEQ ID NO: 4650430 - DNA, 21 bp, Homo sapiens
tacaatgaacccccatgatgt

SEQ ID NO: 4650431 - DNA, 18 bp, Homo sapiens
tacaattttatctgtttc

SEQ ID NO: 4650432 - DNA, 12 bp, Homo sapiens
tacacagagaag

SEQ ID NO: 4650433 - DNA, 14 bp, Homo sapiens
tacacagagaaggc

SEQ ID NO: 4650434 - DNA, 21 bp, Homo sapiens
tacacagagaaggctatgtaa

SEQ ID NO: 4650435 - DNA, 14 bp, Homo sapiens
tacacagggcctgc

SEQ ID NO: 4650436 - DNA, 15 bp, Homo sapiens
tacacatttttcaga

SEQ ID NO: 4650437 - DNA, 17 bp, Homo sapiens
tacacatttttcagata

SEQ ID NO: 4650438 - DNA, 19 bp, Homo sapiens
tacaccactctggcagcca

SEQ ID NO: 4650439 - DNA, 19 bp, Homo sapiens
tacaccattatcttggaaa

SEQ ID NO: 4650440 - DNA, 13 bp, Homo sapiens
tacacgtgtcctg

SEQ ID NO: 4650441 - DNA, 14 bp, Homo sapiens
tacacgtttatctt

SEQ ID NO: 4650442 - DNA, 21 bp, Homo sapiens
tacactggaggagagaagaat

SEQ ID NO: 4650443 - DNA, 17 bp, Homo sapiens
tacactgtttcatctca

SEQ ID NO: 4650444 - DNA, 16 bp, Homo sapiens
tacagacctaatatca

SEQ ID NO: 4650445 - DNA, 23 bp, Homo sapiens
tacagagtgggccccgggctgga

SEQ ID NO: 4650446 - DNA, 23 bp, Homo sapiens
tacagcactactgggtgtcattt

SEQ ID NO: 4650447 - DNA, 13 bp, Homo sapiens
tacagcagcaata

SEQ ID NO: 4650448 - DNA, 13 bp, Homo sapiens
tacaggagaggca

SEQ ID NO: 4650449 - DNA, 15 bp, Homo sapiens
tacaggagaggcagc

SEQ ID NO: 4650450 - DNA, 16 bp, Homo sapiens
tacaggagaggcagca

SEQ ID NO: 4650451 - DNA, 15 bp, Homo sapiens
tacaggcgcctgcca

SEQ ID NO: 4650452 - DNA, 15 bp, Homo sapiens
tacaggggccagaag

SEQ ID NO: 4650453 - DNA, 15 bp, Homo sapiens
tacaggtgcatatta

SEQ ID NO: 4650454 - DNA, 14 bp, Homo sapiens
tacagtaatgaaat

SEQ ID NO: 4650455 - DNA, 16 bp, Homo sapiens
tacagtgtacagtctt

SEQ ID NO: 4650456 - DNA, 17 bp, Homo sapiens
tacagttgaaataactg

SEQ ID NO: 4650457 - DNA, 15 bp, Homo sapiens
tacagttgaatttta

SEQ ID NO: 4650458 - DNA, 12 bp, Homo sapiens
tacagttttata

SEQ ID NO: 4650459 - DNA, 12 bp, Homo sapiens
tacataatctgt

SEQ ID NO: 4650460 - DNA, 20 bp, Homo sapiens
tacataatctgtacaatgaa

SEQ ID NO: 4650461 - DNA, 13 bp, Homo sapiens
tacataggtctgt

SEQ ID NO: 4650462 - DNA, 16 bp, Homo sapiens
tacataggtctgtatg

SEQ ID NO: 4650463 - DNA, 12 bp, Homo sapiens
tacatagtcttt

SEQ ID NO: 4650464 - DNA, 18 bp, Homo sapiens
tacatagttgagattgta

SEQ ID NO: 4650465 - DNA, 22 bp, Homo sapiens
tacatatatttttaaaaaatga

SEQ ID NO: 4650466 - DNA, 13 bp, Homo sapiens
tacatattgtctg

SEQ ID NO: 4650467 - DNA, 17 bp, Homo sapiens
tacatatttattttctt

SEQ ID NO: 4650468 - DNA, 13 bp, Homo sapiens
tacatgagttcaa

SEQ ID NO: 4650469 - DNA, 16 bp, Homo sapiens
tacatgagttcaaata

SEQ ID NO: 4650470 - DNA, 15 bp, Homo sapiens
tacatgatacatttt

SEQ ID NO: 4650471 - DNA, 15 bp, Homo sapiens
tacatggtgtttgtg

SEQ ID NO: 4650472 - DNA, 15 bp, Homo sapiens
tacatggtttaaagt

SEQ ID NO: 4650473 - DNA, 13 bp, Homo sapiens
tacatgtaatttg

SEQ ID NO: 4650474 - DNA, 18 bp, Homo sapiens
tacatgtgtatattcctt

SEQ ID NO: 4650475 - DNA, 15 bp, Homo sapiens
tacatgtttataaat

SEQ ID NO: 4650476 - DNA, 15 bp, Homo sapiens
tacattaaaatgaca

SEQ ID NO: 4650477 - DNA, 15 bp, Homo sapiens
tacattaacggtgct

SEQ ID NO: 4650478 - DNA, 15 bp, Homo sapiens
tacattgtattctgt

SEQ ID NO: 4650479 - DNA, 11 bp, Homo sapiens
tacattttaaa

SEQ ID NO: 4650480 - DNA, 17 bp, Homo sapiens
tacattttcagtaccaa

SEQ ID NO: 4650481 - DNA, 15 bp, Homo sapiens
tacattttctaaata

SEQ ID NO: 4650482 - DNA, 23 bp, Homo sapiens
tacattttctaaataaaaatatg

SEQ ID NO: 4650483 - DNA, 18 bp, Homo sapiens
tacattttgtaaaatatt

SEQ ID NO: 4650484 - DNA, 16 bp, Homo sapiens
tacattttgttgcagg

SEQ ID NO: 4650485 - DNA, 21 bp, Homo sapiens
tacattttttaggacatctta

SEQ ID NO: 4650486 - DNA, 20 bp, Homo sapiens
tacattttttctaataaagc

SEQ ID NO: 4650487 - DNA, 22 bp, Homo sapiens
taccaaaggaatttgcatccag

SEQ ID NO: 4650488 - DNA, 20 bp, Homo sapiens
taccaagttgtgcttttctg

SEQ ID NO: 4650489 - DNA, 19 bp, Homo sapiens
taccactcttttgctgtgc

SEQ ID NO: 4650490 - DNA, 19 bp, Homo sapiens
taccaggtattattatctt

SEQ ID NO: 4650491 - DNA, 12 bp, Homo sapiens
taccatcttaat

SEQ ID NO: 4650492 - DNA, 22 bp, Homo sapiens
taccatcttaatctttatttta

SEQ ID NO: 4650493 - DNA, 17 bp, Homo sapiens
taccatgtgctacaggg

SEQ ID NO: 4650494 - DNA, 19 bp, Homo sapiens
tacccaccagggagatgtc

SEQ ID NO: 4650495 - DNA, 14 bp, Homo sapiens
tacccatcttgctt

SEQ ID NO: 4650496 - DNA, 13 bp, Homo sapiens
taccccatatatt

SEQ ID NO: 4650497 - DNA, 14 bp, Homo sapiens
taccccttcatgtc

SEQ ID NO: 4650498 - DNA, 14 bp, Homo sapiens
tacccgcagagttc

SEQ ID NO: 4650499 - DNA, 13 bp, Homo sapiens
tacccgttccaaa

SEQ ID NO: 4650500 - DNA, 18 bp, Homo sapiens
taccctttgctggaagaa

SEQ ID NO: 4650501 - DNA, 13 bp, Homo sapiens
tacccttttcctt

SEQ ID NO: 4650502 - DNA, 15 bp, Homo sapiens
taccctttttcattt

SEQ ID NO: 4650503 - DNA, 18 bp, Homo sapiens
taccgctggccctgccgt

SEQ ID NO: 4650504 - DNA, 21 bp, Homo sapiens
taccgtaattgctttgtgcct

SEQ ID NO: 4650505 - DNA, 13 bp, Homo sapiens
tacctcgcagtgt

SEQ ID NO: 4650506 - DNA, 14 bp, Homo sapiens
tacctctgtgtgct

SEQ ID NO: 4650507 - DNA, 12 bp, Homo sapiens
tacctgccctct

SEQ ID NO: 4650508 - DNA, 15 bp, Homo sapiens
tacctggcagacttg

SEQ ID NO: 4650509 - DNA, 14 bp, Homo sapiens
tacctgtctctctc

SEQ ID NO: 4650510 - DNA, 13 bp, Homo sapiens
tacctgtgtgttt

SEQ ID NO: 4650511 - DNA, 18 bp, Homo sapiens
taccttatcactgcatta

SEQ ID NO: 4650512 - DNA, 22 bp, Homo sapiens
taccttctcccaggcctctgcc

SEQ ID NO: 4650513 - DNA, 12 bp, Homo sapiens
tacctttaaata

SEQ ID NO: 4650514 - DNA, 19 bp, Homo sapiens
tacctttaaatatcattct

SEQ ID NO: 4650515 - DNA, 22 bp, Homo sapiens
tacctttaaatatcattctttg

SEQ ID NO: 4650516 - DNA, 15 bp, Homo sapiens
tacgagaaaatctgc

SEQ ID NO: 4650517 - DNA, 18 bp, Homo sapiens
tacgcactggacagcatc

SEQ ID NO: 4650518 - DNA, 21 bp, Homo sapiens
tacgcaggtatttagaagcag

SEQ ID NO: 4650519 - DNA, 20 bp, Homo sapiens
tacgtgtgaaatctgtcttt

SEQ ID NO: 4650520 - DNA, 22 bp, Homo sapiens
tactaagtggactggtgtcata

SEQ ID NO: 4650521 - DNA, 16 bp, Homo sapiens
tactaattttctagat

SEQ ID NO: 4650522 - DNA, 19 bp, Homo sapiens
tactactttgttaggattt

SEQ ID NO: 4650523 - DNA, 15 bp, Homo sapiens
tactaggatactgct

SEQ ID NO: 4650524 - DNA, 14 bp, Homo sapiens
tactagttacacat

SEQ ID NO: 4650525 - DNA, 15 bp, Homo sapiens
tactattaaaatatt

SEQ ID NO: 4650526 - DNA, 22 bp, Homo sapiens
tactattgttgctgaaacttgc

SEQ ID NO: 4650527 - DNA, 23 bp, Homo sapiens
tactattgttgctgaaacttgct

SEQ ID NO: 4650528 - DNA, 13 bp, Homo sapiens
tactatttagata

SEQ ID NO: 4650529 - DNA, 13 bp, Homo sapiens
tactcacacaggc

SEQ ID NO: 4650530 - DNA, 14 bp, Homo sapiens
tactcacacaggca

SEQ ID NO: 4650531 - DNA, 23 bp, Homo sapiens
tactcccagggcttacggccctg

SEQ ID NO: 4650532 - DNA, 16 bp, Homo sapiens
tactcctggtttgatt

SEQ ID NO: 4650533 - DNA, 11 bp, Homo sapiens
tactcctgtgg

SEQ ID NO: 4650534 - DNA, 12 bp, Homo sapiens
tactcctgtggg

SEQ ID NO: 4650535 - DNA, 18 bp, Homo sapiens
tactcctgtgggagcctc

SEQ ID NO: 4650536 - DNA, 15 bp, Homo sapiens
tactctgtgccagag

SEQ ID NO: 4650537 - DNA, 18 bp, Homo sapiens
tactctgtgccagagcct

SEQ ID NO: 4650538 - DNA, 16 bp, Homo sapiens
tactctgttgcctcct

SEQ ID NO: 4650539 - DNA, 22 bp, Homo sapiens
tactctgttgcctcctctctcc

SEQ ID NO: 4650540 - DNA, 22 bp, Homo sapiens
tactgagcatttgcacctctgt

SEQ ID NO: 4650541 - DNA, 13 bp, Homo sapiens
tactgattacttg

SEQ ID NO: 4650542 - DNA, 12 bp, Homo sapiens
tactgcctgctt

SEQ ID NO: 4650543 - DNA, 19 bp, Homo sapiens
tactgctctttattgcaga

SEQ ID NO: 4650544 - DNA, 22 bp, Homo sapiens
tactgctctttattgcagaatg

SEQ ID NO: 4650545 - DNA, 16 bp, Homo sapiens
tactgctttgcaaaga

SEQ ID NO: 4650546 - DNA, 17 bp, Homo sapiens
tactgggaaggctactt

SEQ ID NO: 4650547 - DNA, 15 bp, Homo sapiens
tactgggtgtcattt

SEQ ID NO: 4650548 - DNA, 16 bp, Homo sapiens
tactgtatgccttctg

SEQ ID NO: 4650549 - DNA, 20 bp, Homo sapiens
tactgtgaggagtctgggtc

SEQ ID NO: 4650550 - DNA, 18 bp, Homo sapiens
tactgttcatacagtttt

SEQ ID NO: 4650551 - DNA, 17 bp, Homo sapiens
tactgttctcaacatac

SEQ ID NO: 4650552 - DNA, 21 bp, Homo sapiens
tactgttctcaacatactgta

SEQ ID NO: 4650553 - DNA, 23 bp, Homo sapiens
tactgttctcaacatactgtaat

SEQ ID NO: 4650554 - DNA, 13 bp, Homo sapiens
tacttaatatact

SEQ ID NO: 4650555 - DNA, 13 bp, Homo sapiens
tacttacattcca

SEQ ID NO: 4650556 - DNA, 20 bp, Homo sapiens
tacttcggggctgggaagtc

SEQ ID NO: 4650557 - DNA, 13 bp, Homo sapiens
tacttctctgagt

SEQ ID NO: 4650558 - DNA, 14 bp, Homo sapiens
tacttctttttcat

SEQ ID NO: 4650559 - DNA, 15 bp, Homo sapiens
tacttctttttcatt

SEQ ID NO: 4650560 - DNA, 20 bp, Homo sapiens
tacttgctttcaattgacaa

SEQ ID NO: 4650561 - DNA, 21 bp, Homo sapiens
tacttgctttcaattgacaaa

SEQ ID NO: 4650562 - DNA, 15 bp, Homo sapiens
tacttggcaggctga

SEQ ID NO: 4650563 - DNA, 14 bp, Homo sapiens
tacttgtcctttga

SEQ ID NO: 4650564 - DNA, 13 bp, Homo sapiens
tactttgtaaata

SEQ ID NO: 4650565 - DNA, 16 bp, Homo sapiens
tactttgtagactgtt

SEQ ID NO: 4650566 - DNA, 21 bp, Homo sapiens
tactttgtagactgtttcaca

SEQ ID NO: 4650567 - DNA, 11 bp, Homo sapiens
tactttgtcag

SEQ ID NO: 4650568 - DNA, 15 bp, Homo sapiens
tactttgtgcattct

SEQ ID NO: 4650569 - DNA, 19 bp, Homo sapiens
tacttttattattttaatt

SEQ ID NO: 4650570 - DNA, 20 bp, Homo sapiens
tacttttttaaatattttct

SEQ ID NO: 4650571 - DNA, 15 bp, Homo sapiens
tagaaaaataaaatg

SEQ ID NO: 4650572 - DNA, 17 bp, Homo sapiens
tagaaaaggcgtgcagt

SEQ ID NO: 4650573 - DNA, 14 bp, Homo sapiens
tagaaacattgtaa

SEQ ID NO: 4650574 - DNA, 21 bp, Homo sapiens
tagaaagttgatattcaacct

SEQ ID NO: 4650575 - DNA, 14 bp, Homo sapiens
tagaaatgcatatt

SEQ ID NO: 4650576 - DNA, 16 bp, Homo sapiens
tagaaatggaaatttt

SEQ ID NO: 4650577 - DNA, 21 bp, Homo sapiens
tagaaatggaaattttgctat

SEQ ID NO: 4650578 - DNA, 18 bp, Homo sapiens
tagaacacaaaacttgaa

SEQ ID NO: 4650579 - DNA, 19 bp, Homo sapiens
tagaacacaaaacttgaaa

SEQ ID NO: 4650580 - DNA, 23 bp, Homo sapiens
tagaactacttgcatttgatttt

SEQ ID NO: 4650581 - DNA, 17 bp, Homo sapiens
tagaactcactctgggc

SEQ ID NO: 4650582 - DNA, 20 bp, Homo sapiens
tagaactttattaagtaaaa

SEQ ID NO: 4650583 - DNA, 16 bp, Homo sapiens
tagaactttgtatttt

SEQ ID NO: 4650584 - DNA, 14 bp, Homo sapiens
tagaagatagaaat

SEQ ID NO: 4650585 - DNA, 19 bp, Homo sapiens
tagaagattgttggtgaat

SEQ ID NO: 4650586 - DNA, 21 bp, Homo sapiens
tagaagattgttggtgaattt

SEQ ID NO: 4650587 - DNA, 14 bp, Homo sapiens
tagaagcagaggga

SEQ ID NO: 4650588 - DNA, 11 bp, Homo sapiens
tagaataattc

SEQ ID NO: 4650589 - DNA, 13 bp, Homo sapiens
tagaataattctt

SEQ ID NO: 4650590 - DNA, 14 bp, Homo sapiens
tagaataattcttt

SEQ ID NO: 4650591 - DNA, 17 bp, Homo sapiens
tagaatgagatctgaat

SEQ ID NO: 4650592 - DNA, 21 bp, Homo sapiens
tagaattaaaaaagcatactt

SEQ ID NO: 4650593 - DNA, 17 bp, Homo sapiens
tagaattccttcgaaag

SEQ ID NO: 4650594 - DNA, 13 bp, Homo sapiens
tagacacagataa

SEQ ID NO: 4650595 - DNA, 20 bp, Homo sapiens
tagacatgcccaaaacttat

SEQ ID NO: 4650596 - DNA, 21 bp, Homo sapiens
tagaccagggctgctctttcc

SEQ ID NO: 4650597 - DNA, 16 bp, Homo sapiens
tagacctgccagccac

SEQ ID NO: 4650598 - DNA, 14 bp, Homo sapiens
tagacctgtctcct

SEQ ID NO: 4650599 - DNA, 17 bp, Homo sapiens
tagactcgcctatctta

SEQ ID NO: 4650600 - DNA, 21 bp, Homo sapiens
tagactgtttcacattgcact

SEQ ID NO: 4650601 - DNA, 11 bp, Homo sapiens
tagagaatgtg

SEQ ID NO: 4650602 - DNA, 21 bp, Homo sapiens
tagagacttttttctagtaca

SEQ ID NO: 4650603 - DNA, 16 bp, Homo sapiens
tagagagggagaagaa

SEQ ID NO: 4650604 - DNA, 19 bp, Homo sapiens
tagagagggagaagaagtc

SEQ ID NO: 4650605 - DNA, 14 bp, Homo sapiens
tagagatgagccca

SEQ ID NO: 4650606 - DNA, 15 bp, Homo sapiens
tagagattttcattt

SEQ ID NO: 4650607 - DNA, 21 bp, Homo sapiens
tagagcccattaatcttgatc

SEQ ID NO: 4650608 - DNA, 19 bp, Homo sapiens
tagagccttgacaatgttg

SEQ ID NO: 4650609 - DNA, 20 bp, Homo sapiens
tagaggaaattcaaatccct

SEQ ID NO: 4650610 - DNA, 15 bp, Homo sapiens
tagaggtaaaagtac

SEQ ID NO: 4650611 - DNA, 14 bp, Homo sapiens
tagagtgtagctgt

SEQ ID NO: 4650612 - DNA, 18 bp, Homo sapiens
tagagtgtagctgtaagg

SEQ ID NO: 4650613 - DNA, 20 bp, Homo sapiens
tagagtgtagctgtaagggc

SEQ ID NO: 4650614 - DNA, 21 bp, Homo sapiens
tagagtgtagctgtaagggca

SEQ ID NO: 4650615 - DNA, 22 bp, Homo sapiens
tagagtgtagctgtaagggcag

SEQ ID NO: 4650616 - DNA, 17 bp, Homo sapiens
tagataaccttgtttat

SEQ ID NO: 4650617 - DNA, 14 bp, Homo sapiens
tagataatttgaaa

SEQ ID NO: 4650618 - DNA, 17 bp, Homo sapiens
tagataatttgaaaaag

SEQ ID NO: 4650619 - DNA, 14 bp, Homo sapiens
tagatgattatata

SEQ ID NO: 4650620 - DNA, 18 bp, Homo sapiens
tagatggcctcttactaa

SEQ ID NO: 4650621 - DNA, 14 bp, Homo sapiens
tagattaaataaaa

SEQ ID NO: 4650622 - DNA, 14 bp, Homo sapiens
tagatttagtgtaa

SEQ ID NO: 4650623 - DNA, 18 bp, Homo sapiens
tagcaaacagatgtttgt

SEQ ID NO: 4650624 - DNA, 19 bp, Homo sapiens
tagcagacaggccccgtga

SEQ ID NO: 4650625 - DNA, 19 bp, Homo sapiens
tagcagcaccgttctgtgc

SEQ ID NO: 4650626 - DNA, 19 bp, Homo sapiens
tagcatgaggccactgctg

SEQ ID NO: 4650627 - DNA, 17 bp, Homo sapiens
tagcatggcggcacaca

SEQ ID NO: 4650628 - DNA, 16 bp, Homo sapiens
tagcatttttgtaact

SEQ ID NO: 4650629 - DNA, 21 bp, Homo sapiens
tagccaaaagaatggctgact

SEQ ID NO: 4650630 - DNA, 17 bp, Homo sapiens
tagccaggtctcctggg

SEQ ID NO: 4650631 - DNA, 20 bp, Homo sapiens
tagcccagtgttttctttga

SEQ ID NO: 4650632 - DNA, 20 bp, Homo sapiens
tagcctaaagggcagggccc

SEQ ID NO: 4650633 - DNA, 21 bp, Homo sapiens
tagcctaaagggcagggccca

SEQ ID NO: 4650634 - DNA, 14 bp, Homo sapiens
tagcctcatagtta

SEQ ID NO: 4650635 - DNA, 18 bp, Homo sapiens
tagcctggactgtttcat

SEQ ID NO: 4650636 - DNA, 12 bp, Homo sapiens
tagcctgtggcc

SEQ ID NO: 4650637 - DNA, 18 bp, Homo sapiens
tagctaaattcagggaga

SEQ ID NO: 4650638 - DNA, 15 bp, Homo sapiens
tagctaactgtaaat

SEQ ID NO: 4650639 - DNA, 17 bp, Homo sapiens
tagctaactgtaaatca

SEQ ID NO: 4650640 - DNA, 22 bp, Homo sapiens
tagctactaaatatatattatg

SEQ ID NO: 4650641 - DNA, 17 bp, Homo sapiens
tagctagtttgcttttt

SEQ ID NO: 4650642 - DNA, 19 bp, Homo sapiens
tagctatagttgcagccca

SEQ ID NO: 4650643 - DNA, 23 bp, Homo sapiens
tagctctgaaatcaactctcttc

SEQ ID NO: 4650644 - DNA, 17 bp, Homo sapiens
tagctcttccccatctc

SEQ ID NO: 4650645 - DNA, 22 bp, Homo sapiens
tagctcttttttgtttgtttct

SEQ ID NO: 4650646 - DNA, 12 bp, Homo sapiens
tagctgagctca

SEQ ID NO: 4650647 - DNA, 21 bp, Homo sapiens
tagctgtaagggcagtgccca

SEQ ID NO: 4650648 - DNA, 15 bp, Homo sapiens
tagcttcttctgaaa

SEQ ID NO: 4650649 - DNA, 17 bp, Homo sapiens
tagctttccaaggaagc

SEQ ID NO: 4650650 - DNA, 14 bp, Homo sapiens
tagctttcctggaa

SEQ ID NO: 4650651 - DNA, 13 bp, Homo sapiens
taggaacagccca

SEQ ID NO: 4650652 - DNA, 14 bp, Homo sapiens
taggaagaatcagt

SEQ ID NO: 4650653 - DNA, 12 bp, Homo sapiens
taggaaggaaac

SEQ ID NO: 4650654 - DNA, 22 bp, Homo sapiens
taggaatatacatagtctttgt

SEQ ID NO: 4650655 - DNA, 18 bp, Homo sapiens
taggaattaagttatctt

SEQ ID NO: 4650656 - DNA, 13 bp, Homo sapiens
taggactgtagaa

SEQ ID NO: 4650657 - DNA, 18 bp, Homo sapiens
taggaggctgtgggtttt

SEQ ID NO: 4650658 - DNA, 23 bp, Homo sapiens
taggagggactgtcgctgcttcg

SEQ ID NO: 4650659 - DNA, 19 bp, Homo sapiens
taggatgtcatgtctgctt

SEQ ID NO: 4650660 - DNA, 13 bp, Homo sapiens
taggattttcaca

SEQ ID NO: 4650661 - DNA, 22 bp, Homo sapiens
taggattttcacattcttggct

SEQ ID NO: 4650662 - DNA, 15 bp, Homo sapiens
taggcaggacctgtg

SEQ ID NO: 4650663 - DNA, 14 bp, Homo sapiens
taggcatgtaaaca

SEQ ID NO: 4650664 - DNA, 16 bp, Homo sapiens
taggcattgtgatgtt

SEQ ID NO: 4650665 - DNA, 23 bp, Homo sapiens
taggccatgggtggaaagtgctc

SEQ ID NO: 4650666 - DNA, 17 bp, Homo sapiens
taggccccagaggccct

SEQ ID NO: 4650667 - DNA, 13 bp, Homo sapiens
taggctaaatgtt

SEQ ID NO: 4650668 - DNA, 22 bp, Homo sapiens
taggctagacttagattcatta

SEQ ID NO: 4650669 - DNA, 21 bp, Homo sapiens
taggctgcaaaattaaatcta

SEQ ID NO: 4650670 - DNA, 22 bp, Homo sapiens
taggctttcatgttgcaaagaa

SEQ ID NO: 4650671 - DNA, 21 bp, Homo sapiens
tagggactgtcctagccaggt

SEQ ID NO: 4650672 - DNA, 18 bp, Homo sapiens
tagggagtggttcctgtg

SEQ ID NO: 4650673 - DNA, 19 bp, Homo sapiens
tagggagtggttcctgtgg

SEQ ID NO: 4650674 - DNA, 14 bp, Homo sapiens
tagggcaagaggat

SEQ ID NO: 4650675 - DNA, 20 bp, Homo sapiens
tagggcacatgaaaaatttt

SEQ ID NO: 4650676 - DNA, 13 bp, Homo sapiens
tagggcactgggc

SEQ ID NO: 4650677 - DNA, 13 bp, Homo sapiens
tagggtgggaagg

SEQ ID NO: 4650678 - DNA, 16 bp, Homo sapiens
taggtcataaagcatt

SEQ ID NO: 4650679 - DNA, 17 bp, Homo sapiens
taggtcgcgctcttgca

SEQ ID NO: 4650680 - DNA, 12 bp, Homo sapiens
taggttatacaa

SEQ ID NO: 4650681 - DNA, 15 bp, Homo sapiens
taggtttctctccct

SEQ ID NO: 4650682 - DNA, 23 bp, Homo sapiens
tagtaaaaccttgttctattttt

SEQ ID NO: 4650683 - DNA, 17 bp, Homo sapiens
tagtaaagtcaaggaga

SEQ ID NO: 4650684 - DNA, 18 bp, Homo sapiens
tagtaatggcagagcagt

SEQ ID NO: 4650685 - DNA, 14 bp, Homo sapiens
tagtaatttctttt

SEQ ID NO: 4650686 - DNA, 14 bp, Homo sapiens
tagtacaatcttgg

SEQ ID NO: 4650687 - DNA, 16 bp, Homo sapiens
tagtacaatcttggga

SEQ ID NO: 4650688 - DNA, 18 bp, Homo sapiens
tagtagattttaaagaca

SEQ ID NO: 4650689 - DNA, 20 bp, Homo sapiens
tagtagttaaataactgtgt

SEQ ID NO: 4650690 - DNA, 18 bp, Homo sapiens
tagtattaatggacaaat

SEQ ID NO: 4650691 - DNA, 21 bp, Homo sapiens
tagtcacatggcctatgcaca

SEQ ID NO: 4650692 - DNA, 11 bp, Homo sapiens
tagtcataata

SEQ ID NO: 4650693 - DNA, 13 bp, Homo sapiens
tagtccttggcat

SEQ ID NO: 4650694 - DNA, 17 bp, Homo sapiens
tagtcgcccctcagagc

SEQ ID NO: 4650695 - DNA, 15 bp, Homo sapiens
tagtcgggcatgagt

SEQ ID NO: 4650696 - DNA, 13 bp, Homo sapiens
tagtgaatgggaa

SEQ ID NO: 4650697 - DNA, 20 bp, Homo sapiens
tagtgagcgagtggatgctg

SEQ ID NO: 4650698 - DNA, 22 bp, Homo sapiens
tagtgagcgagtggatgctgtg

SEQ ID NO: 4650699 - DNA, 23 bp, Homo sapiens
tagtgcaattccaagaaaatatc

SEQ ID NO: 4650700 - DNA, 17 bp, Homo sapiens
tagtggaaacatttata

SEQ ID NO: 4650701 - DNA, 15 bp, Homo sapiens
tagtgggccagggct

SEQ ID NO: 4650702 - DNA, 12 bp, Homo sapiens
tagtgggttgac

SEQ ID NO: 4650703 - DNA, 15 bp, Homo sapiens
tagtgtatctttaaa

SEQ ID NO: 4650704 - DNA, 20 bp, Homo sapiens
tagtgtgacagtttccaaat

SEQ ID NO: 4650705 - DNA, 19 bp, Homo sapiens
tagttaaattgaagaaagt

SEQ ID NO: 4650706 - DNA, 13 bp, Homo sapiens
tagttaatggatt

SEQ ID NO: 4650707 - DNA, 19 bp, Homo sapiens
tagttaatggattaaattt

SEQ ID NO: 4650708 - DNA, 22 bp, Homo sapiens
tagttataaaaggctttagtag

SEQ ID NO: 4650709 - DNA, 18 bp, Homo sapiens
tagttattttaatacctt

SEQ ID NO: 4650710 - DNA, 15 bp, Homo sapiens
tagttccctctgcct

SEQ ID NO: 4650711 - DNA, 16 bp, Homo sapiens
tagttccctctgcctg

SEQ ID NO: 4650712 - DNA, 18 bp, Homo sapiens
tagttccctctgcctggg

SEQ ID NO: 4650713 - DNA, 22 bp, Homo sapiens
tagttccctctgcctgggatgc

SEQ ID NO: 4650714 - DNA, 16 bp, Homo sapiens
tagttctagcagtccc

SEQ ID NO: 4650715 - DNA, 20 bp, Homo sapiens
tagttcttagctttgaaact

SEQ ID NO: 4650716 - DNA, 20 bp, Homo sapiens
tagttctttcctccccctgc

SEQ ID NO: 4650717 - DNA, 22 bp, Homo sapiens
tagttgcgtggactctgcacat

SEQ ID NO: 4650718 - DNA, 18 bp, Homo sapiens
tagttggttcctaagaat

SEQ ID NO: 4650719 - DNA, 18 bp, Homo sapiens
tagttgtcagtattattc

SEQ ID NO: 4650720 - DNA, 17 bp, Homo sapiens
tagtttcaaagtgtctc

SEQ ID NO: 4650721 - DNA, 21 bp, Homo sapiens
tagtttctcaaaacccttaaa

SEQ ID NO: 4650722 - DNA, 13 bp, Homo sapiens
tagttttacacta

SEQ ID NO: 4650723 - DNA, 14 bp, Homo sapiens
tataaagatcattt

SEQ ID NO: 4650724 - DNA, 19 bp, Homo sapiens
tataaagggggagggaaat

SEQ ID NO: 4650725 - DNA, 19 bp, Homo sapiens
tataaattgtacattttgt

SEQ ID NO: 4650726 - DNA, 16 bp, Homo sapiens
tataaatttaagaaaa

SEQ ID NO: 4650727 - DNA, 18 bp, Homo sapiens
tataaatttaagaaaaca

SEQ ID NO: 4650728 - DNA, 19 bp, Homo sapiens
tataaatttaagaaaacaa

SEQ ID NO: 4650729 - DNA, 20 bp, Homo sapiens
tataacggtttaattctgtc

SEQ ID NO: 4650730 - DNA, 21 bp, Homo sapiens
tataagaaaagtaatgaagaa

SEQ ID NO: 4650731 - DNA, 12 bp, Homo sapiens
tataagaatttt

SEQ ID NO: 4650732 - DNA, 16 bp, Homo sapiens
tataagcttttcacaa

SEQ ID NO: 4650733 - DNA, 12 bp, Homo sapiens
tataataaacat

SEQ ID NO: 4650734 - DNA, 12 bp, Homo sapiens
tataatactgtt

SEQ ID NO: 4650735 - DNA, 14 bp, Homo sapiens
tataatactgtttt

SEQ ID NO: 4650736 - DNA, 14 bp, Homo sapiens
tataatgaaaacat

SEQ ID NO: 4650737 - DNA, 14 bp, Homo sapiens
tataattaatgctt

SEQ ID NO: 4650738 - DNA, 19 bp, Homo sapiens
tataattaatgtttgtggg

SEQ ID NO: 4650739 - DNA, 19 bp, Homo sapiens
tataattggtgctatttga

SEQ ID NO: 4650740 - DNA, 21 bp, Homo sapiens
tataattggtgctatttgaag

SEQ ID NO: 4650741 - DNA, 20 bp, Homo sapiens
tatacaataacccagttact

SEQ ID NO: 4650742 - DNA, 21 bp, Homo sapiens
tatacaataacccagttactt

SEQ ID NO: 4650743 - DNA, 22 bp, Homo sapiens
tatacaataacccagttacttt

SEQ ID NO: 4650744 - DNA, 12 bp, Homo sapiens
tatacagaccta

SEQ ID NO: 4650745 - DNA, 19 bp, Homo sapiens
tatacagacctaatatcat

SEQ ID NO: 4650746 - DNA, 20 bp, Homo sapiens
tatacagacctaatatcatt

SEQ ID NO: 4650747 - DNA, 22 bp, Homo sapiens
tatacagacctaatatcatttt

SEQ ID NO: 4650748 - DNA, 23 bp, Homo sapiens
tatacccatgaacttaaaatgaa

SEQ ID NO: 4650749 - DNA, 22 bp, Homo sapiens
tatacgtgaaaattatttgaaa

SEQ ID NO: 4650750 - DNA, 22 bp, Homo sapiens
tatactcagggattccttctaa

SEQ ID NO: 4650751 - DNA, 13 bp, Homo sapiens
tatactgaggggt

SEQ ID NO: 4650752 - DNA, 18 bp, Homo sapiens
tatacttacactgtattg

SEQ ID NO: 4650753 - DNA, 22 bp, Homo sapiens
tatagaaaaataaaaatctctt

SEQ ID NO: 4650754 - DNA, 23 bp, Homo sapiens
tatagaaaaataaaaatctcttt

SEQ ID NO: 4650755 - DNA, 13 bp, Homo sapiens
tatagaaaaggaa

SEQ ID NO: 4650756 - DNA, 11 bp, Homo sapiens
tatagaaatgc

SEQ ID NO: 4650757 - DNA, 22 bp, Homo sapiens
tatagactgtacattatgaaga

SEQ ID NO: 4650758 - DNA, 17 bp, Homo sapiens
tatagcaaatgcagaac

SEQ ID NO: 4650759 - DNA, 21 bp, Homo sapiens
tatagcaagatattgatcaaa

SEQ ID NO: 4650760 - DNA, 15 bp, Homo sapiens
tatagtatctgtata

SEQ ID NO: 4650761 - DNA, 19 bp, Homo sapiens
tatagtgcaaattcatttt

SEQ ID NO: 4650762 - DNA, 16 bp, Homo sapiens
tatagttaatattttg

SEQ ID NO: 4650763 - DNA, 15 bp, Homo sapiens
tatagttgcagccca

SEQ ID NO: 4650764 - DNA, 14 bp, Homo sapiens
tatagttgtcagta

SEQ ID NO: 4650765 - DNA, 22 bp, Homo sapiens
tatataaaactaaggcttttat

SEQ ID NO: 4650766 - DNA, 16 bp, Homo sapiens
tatataaactgtgcca

SEQ ID NO: 4650767 - DNA, 20 bp, Homo sapiens
tatataagagcatgaaattt

SEQ ID NO: 4650768 - DNA, 23 bp, Homo sapiens
tatataagagcatgaaattttta

SEQ ID NO: 4650769 - DNA, 17 bp, Homo sapiens
tatataatttactttgt

SEQ ID NO: 4650770 - DNA, 14 bp, Homo sapiens
tatatagaatgctg

SEQ ID NO: 4650771 - DNA, 14 bp, Homo sapiens
tatatatcactcta

SEQ ID NO: 4650772 - DNA, 14 bp, Homo sapiens
tatatattaagtgt

SEQ ID NO: 4650773 - DNA, 13 bp, Homo sapiens
tatatattatata

SEQ ID NO: 4650774 - DNA, 15 bp, Homo sapiens
tatatatttttctga

SEQ ID NO: 4650775 - DNA, 19 bp, Homo sapiens
tatatcatgtaaagaaatg

SEQ ID NO: 4650776 - DNA, 18 bp, Homo sapiens
tatatgccaagctaattt

SEQ ID NO: 4650777 - DNA, 14 bp, Homo sapiens
tatatggcaggagc

SEQ ID NO: 4650778 - DNA, 19 bp, Homo sapiens
tatatggcaggagctactg

SEQ ID NO: 4650779 - DNA, 22 bp, Homo sapiens
tatatggcaggagctactgaga

SEQ ID NO: 4650780 - DNA, 13 bp, Homo sapiens
tatatgtacttgt

SEQ ID NO: 4650781 - DNA, 14 bp, Homo sapiens
tatatgtgtataca

SEQ ID NO: 4650782 - DNA, 15 bp, Homo sapiens
tatatgtgtatacat

SEQ ID NO: 4650783 - DNA, 14 bp, Homo sapiens
tatattaaagtaaa

SEQ ID NO: 4650784 - DNA, 20 bp, Homo sapiens
tatattacggaggaacagat

SEQ ID NO: 4650785 - DNA, 14 bp, Homo sapiens
tatattatgtttaa

SEQ ID NO: 4650786 - DNA, 16 bp, Homo sapiens
tatattcacagttttt

SEQ ID NO: 4650787 - DNA, 12 bp, Homo sapiens
tatattcctttt

SEQ ID NO: 4650788 - DNA, 13 bp, Homo sapiens
tatatttctatta

SEQ ID NO: 4650789 - DNA, 21 bp, Homo sapiens
tatatttttaaaaaatgaaat

SEQ ID NO: 4650790 - DNA, 19 bp, Homo sapiens
tatcaaagaagagtcaaca

SEQ ID NO: 4650791 - DNA, 21 bp, Homo sapiens
tatcaaagaagagtcaacatt

SEQ ID NO: 4650792 - DNA, 15 bp, Homo sapiens
tatcactctagaaaa

SEQ ID NO: 4650793 - DNA, 23 bp, Homo sapiens
tatcactgcattatcttgctcat

SEQ ID NO: 4650794 - DNA, 13 bp, Homo sapiens
tatcaggcaggac

SEQ ID NO: 4650795 - DNA, 16 bp, Homo sapiens
tatcataaaatcaaaa

SEQ ID NO: 4650796 - DNA, 13 bp, Homo sapiens
tatcataaagcat

SEQ ID NO: 4650797 - DNA, 15 bp, Homo sapiens
tatcatgcaaaatat

SEQ ID NO: 4650798 - DNA, 14 bp, Homo sapiens
tatcatgccctgtg

SEQ ID NO: 4650799 - DNA, 21 bp, Homo sapiens
tatcatgtaaagaaatgtctt

SEQ ID NO: 4650800 - DNA, 16 bp, Homo sapiens
tatcattaaaaattac

SEQ ID NO: 4650801 - DNA, 22 bp, Homo sapiens
tatcattgctcccctgatagaa

SEQ ID NO: 4650802 - DNA, 19 bp, Homo sapiens
tatcattttaaaaacttta

SEQ ID NO: 4650803 - DNA, 16 bp, Homo sapiens
tatcattttattcaca

SEQ ID NO: 4650804 - DNA, 21 bp, Homo sapiens
tatccaaggaaacattttatc

SEQ ID NO: 4650805 - DNA, 18 bp, Homo sapiens
tatccaggcaccaggact

SEQ ID NO: 4650806 - DNA, 23 bp, Homo sapiens
tatccataggtttctctccctcc

SEQ ID NO: 4650807 - DNA, 15 bp, Homo sapiens
tatccccagtgcccg

SEQ ID NO: 4650808 - DNA, 23 bp, Homo sapiens
tatcctgggacctccccagccca

SEQ ID NO: 4650809 - DNA, 12 bp, Homo sapiens
tatcctggggga

SEQ ID NO: 4650810 - DNA, 18 bp, Homo sapiens
tatccttacaatgtgaat

SEQ ID NO: 4650811 - DNA, 21 bp, Homo sapiens
tatccttacaatgtgaataat

SEQ ID NO: 4650812 - DNA, 19 bp, Homo sapiens
tatccttgggccataatta

SEQ ID NO: 4650813 - DNA, 18 bp, Homo sapiens
tatcggacattctaatgc

SEQ ID NO: 4650814 - DNA, 23 bp, Homo sapiens
tatcggacattctaatgcatatt

SEQ ID NO: 4650815 - DNA, 16 bp, Homo sapiens
tatctaatacctctgt

SEQ ID NO: 4650816 - DNA, 16 bp, Homo sapiens
tatctacagtaatgaa

SEQ ID NO: 4650817 - DNA, 16 bp, Homo sapiens
tatctacattaaaatg

SEQ ID NO: 4650818 - DNA, 19 bp, Homo sapiens
tatctacattaaaatgaca

SEQ ID NO: 4650819 - DNA, 13 bp, Homo sapiens
tatctattagcag

SEQ ID NO: 4650820 - DNA, 16 bp, Homo sapiens
tatctcactgttttat

SEQ ID NO: 4650821 - DNA, 19 bp, Homo sapiens
tatctcgaatttgaagaga

SEQ ID NO: 4650822 - DNA, 19 bp, Homo sapiens
tatctgggtgcatgatctt

SEQ ID NO: 4650823 - DNA, 20 bp, Homo sapiens
tatctgggttaagtgtttat

SEQ ID NO: 4650824 - DNA, 22 bp, Homo sapiens
tatctggtcaacctcctggaca

SEQ ID NO: 4650825 - DNA, 23 bp, Homo sapiens
tatctgtagtgagatagcattgt

SEQ ID NO: 4650826 - DNA, 17 bp, Homo sapiens
tatctgtgtttttgaaa

SEQ ID NO: 4650827 - DNA, 13 bp, Homo sapiens
tatcttaaaggac

SEQ ID NO: 4650828 - DNA, 22 bp, Homo sapiens
tatcttaggtagtcatgctgtg

SEQ ID NO: 4650829 - DNA, 12 bp, Homo sapiens
tatctttcagtt

SEQ ID NO: 4650830 - DNA, 17 bp, Homo sapiens
tatgaaataaattctga

SEQ ID NO: 4650831 - DNA, 18 bp, Homo sapiens
tatgaaattcaagtgctt

SEQ ID NO: 4650832 - DNA, 23 bp, Homo sapiens
tatgaacacagacaaagtgctat

SEQ ID NO: 4650833 - DNA, 16 bp, Homo sapiens
tatgaatatcattgat

SEQ ID NO: 4650834 - DNA, 18 bp, Homo sapiens
tatgaattagccaaaaga

SEQ ID NO: 4650835 - DNA, 23 bp, Homo sapiens
tatgacagataacctaataattg

SEQ ID NO: 4650836 - DNA, 17 bp, Homo sapiens
tatgacatttcttaaaa

SEQ ID NO: 4650837 - DNA, 20 bp, Homo sapiens
tatgacatttcttaaaactt

SEQ ID NO: 4650838 - DNA, 15 bp, Homo sapiens
tatgacccctggcca

SEQ ID NO: 4650839 - DNA, 15 bp, Homo sapiens
tatgagacacaggat

SEQ ID NO: 4650840 - DNA, 21 bp, Homo sapiens
tatgagatctaatgtgaaaat

SEQ ID NO: 4650841 - DNA, 18 bp, Homo sapiens
tatgagcttgctcattaa

SEQ ID NO: 4650842 - DNA, 16 bp, Homo sapiens
tatgagtacaaatgcc

SEQ ID NO: 4650843 - DNA, 17 bp, Homo sapiens
tatgatcagtgttactg

SEQ ID NO: 4650844 - DNA, 19 bp, Homo sapiens
tatgatccttttttgtcat

SEQ ID NO: 4650845 - DNA, 14 bp, Homo sapiens
tatgatctctctag

SEQ ID NO: 4650846 - DNA, 13 bp, Homo sapiens
tatgatggatggc

SEQ ID NO: 4650847 - DNA, 21 bp, Homo sapiens
tatgatggatggcagactctt

SEQ ID NO: 4650848 - DNA, 21 bp, Homo sapiens
tatgattcagattgttatcta

SEQ ID NO: 4650849 - DNA, 21 bp, Homo sapiens
tatgattgtttctcaaatctt

SEQ ID NO: 4650850 - DNA, 15 bp, Homo sapiens
tatgcaatgcttcat

SEQ ID NO: 4650851 - DNA, 19 bp, Homo sapiens
tatgcaccttgtgtctgta

SEQ ID NO: 4650852 - DNA, 22 bp, Homo sapiens
tatgcaccttgtgtctgtacac

SEQ ID NO: 4650853 - DNA, 15 bp, Homo sapiens
tatgcatgtgaagaa

SEQ ID NO: 4650854 - DNA, 16 bp, Homo sapiens
tatgcattatatcaaa

SEQ ID NO: 4650855 - DNA, 17 bp, Homo sapiens
tatgccacacctggcct

SEQ ID NO: 4650856 - DNA, 15 bp, Homo sapiens
tatgctgatctttta

SEQ ID NO: 4650857 - DNA, 16 bp, Homo sapiens
tatgctggaggcagag

SEQ ID NO: 4650858 - DNA, 13 bp, Homo sapiens
tatggcaggagct

SEQ ID NO: 4650859 - DNA, 19 bp, Homo sapiens
tatggcaggagctactgag

SEQ ID NO: 4650860 - DNA, 22 bp, Homo sapiens
tatggcaggagctactgagaac

SEQ ID NO: 4650861 - DNA, 18 bp, Homo sapiens
tatggctgtatttgctgt

SEQ ID NO: 4650862 - DNA, 14 bp, Homo sapiens
tatggcttatttct

SEQ ID NO: 4650863 - DNA, 23 bp, Homo sapiens
tatggcttatttctatgacaaat

SEQ ID NO: 4650864 - DNA, 18 bp, Homo sapiens
tatggggatagtctgggt

SEQ ID NO: 4650865 - DNA, 19 bp, Homo sapiens
tatggggatagtctgggtc

SEQ ID NO: 4650866 - DNA, 21 bp, Homo sapiens
tatggggatagtctgggtcag

SEQ ID NO: 4650867 - DNA, 21 bp, Homo sapiens
tatgtaaaaggccaaacctct

SEQ ID NO: 4650868 - DNA, 21 bp, Homo sapiens
tatgtaacaaacctgcactta

SEQ ID NO: 4650869 - DNA, 18 bp, Homo sapiens
tatgtaaggaggtttgta

SEQ ID NO: 4650870 - DNA, 18 bp, Homo sapiens
tatgtacaggatgctttg

SEQ ID NO: 4650871 - DNA, 22 bp, Homo sapiens
tatgtaccatatgatctgtttt

SEQ ID NO: 4650872 - DNA, 15 bp, Homo sapiens
tatgtacttgtcaaa

SEQ ID NO: 4650873 - DNA, 16 bp, Homo sapiens
tatgtacttgtcaaag

SEQ ID NO: 4650874 - DNA, 15 bp, Homo sapiens
tatgtagtcataata

SEQ ID NO: 4650875 - DNA, 18 bp, Homo sapiens
tatgtagtcataataaat

SEQ ID NO: 4650876 - DNA, 19 bp, Homo sapiens
tatgtattctttctgcctt

SEQ ID NO: 4650877 - DNA, 21 bp, Homo sapiens
tatgtctcgtggtaggactgt

SEQ ID NO: 4650878 - DNA, 22 bp, Homo sapiens
tatgtcttgcaaagcctttaaa

SEQ ID NO: 4650879 - DNA, 14 bp, Homo sapiens
tatgtgaaaaatta

SEQ ID NO: 4650880 - DNA, 15 bp, Homo sapiens
tatgtgaaaaattaa

SEQ ID NO: 4650881 - DNA, 18 bp, Homo sapiens
tatgtgattttaactctg

SEQ ID NO: 4650882 - DNA, 20 bp, Homo sapiens
tatgtgccacattttcttaa

SEQ ID NO: 4650883 - DNA, 16 bp, Homo sapiens
tatgtgtttactttaa

SEQ ID NO: 4650884 - DNA, 15 bp, Homo sapiens
tatgttaaaaagaaa

SEQ ID NO: 4650885 - DNA, 18 bp, Homo sapiens
tatgttctgtcttcccaa

SEQ ID NO: 4650886 - DNA, 22 bp, Homo sapiens
tatgttgtaatatttcttcaaa

SEQ ID NO: 4650887 - DNA, 16 bp, Homo sapiens
tattaaaaatgttctc

SEQ ID NO: 4650888 - DNA, 19 bp, Homo sapiens
tattaaaatacattttaag

SEQ ID NO: 4650889 - DNA, 12 bp, Homo sapiens
tattaaactgaa

SEQ ID NO: 4650890 - DNA, 19 bp, Homo sapiens
tattaaccttttttgtctt

SEQ ID NO: 4650891 - DNA, 15 bp, Homo sapiens
tattaagttgttaat

SEQ ID NO: 4650892 - DNA, 12 bp, Homo sapiens
tattaatattta

SEQ ID NO: 4650893 - DNA, 16 bp, Homo sapiens
tattacaaatgcaaat

SEQ ID NO: 4650894 - DNA, 19 bp, Homo sapiens
tattacaaatgcaaatttc

SEQ ID NO: 4650895 - DNA, 21 bp, Homo sapiens
tattacaaatgcaaatttcta

SEQ ID NO: 4650896 - DNA, 20 bp, Homo sapiens
tattaccatcttaatcttta

SEQ ID NO: 4650897 - DNA, 22 bp, Homo sapiens
tattacccaagaagtaaagatg

SEQ ID NO: 4650898 - DNA, 14 bp, Homo sapiens
tattactcagttta

SEQ ID NO: 4650899 - DNA, 19 bp, Homo sapiens
tattactgaataatatcaa

SEQ ID NO: 4650900 - DNA, 19 bp, Homo sapiens
tattagatacacttcttaa

SEQ ID NO: 4650901 - DNA, 23 bp, Homo sapiens
tattagatacacttcttaaatac

SEQ ID NO: 4650902 - DNA, 12 bp, Homo sapiens
tattagccaact

SEQ ID NO: 4650903 - DNA, 13 bp, Homo sapiens
tattagccaactg

SEQ ID NO: 4650904 - DNA, 14 bp, Homo sapiens
tattataaactgta

SEQ ID NO: 4650905 - DNA, 16 bp, Homo sapiens
tattatgtgcaacatt

SEQ ID NO: 4650906 - DNA, 12 bp, Homo sapiens
tattatgtttaa

SEQ ID NO: 4650907 - DNA, 16 bp, Homo sapiens
tattatgtttatttca

SEQ ID NO: 4650908 - DNA, 17 bp, Homo sapiens
tattattagataatatt

SEQ ID NO: 4650909 - DNA, 12 bp, Homo sapiens
tattattattat

SEQ ID NO: 4650910 - DNA, 17 bp, Homo sapiens
tattattattatacttc

SEQ ID NO: 4650911 - DNA, 14 bp, Homo sapiens
tattattattttcc

SEQ ID NO: 4650912 - DNA, 20 bp, Homo sapiens
tattcaacacattggaattg

SEQ ID NO: 4650913 - DNA, 18 bp, Homo sapiens
tattcagaattatacaga

SEQ ID NO: 4650914 - DNA, 13 bp, Homo sapiens
tattcatggctac

SEQ ID NO: 4650915 - DNA, 15 bp, Homo sapiens
tattcatggctacct

SEQ ID NO: 4650916 - DNA, 23 bp, Homo sapiens
tattccccagcagggtcttttca

SEQ ID NO: 4650917 - DNA, 23 bp, Homo sapiens
tattccttttaaagaagctttat

SEQ ID NO: 4650918 - DNA, 13 bp, Homo sapiens
tattctactatac

SEQ ID NO: 4650919 - DNA, 23 bp, Homo sapiens
tattctgagcatactcaacaaaa

SEQ ID NO: 4650920 - DNA, 18 bp, Homo sapiens
tattctgtcagtgttaaa

SEQ ID NO: 4650921 - DNA, 22 bp, Homo sapiens
tattcttaacttattacctcag

SEQ ID NO: 4650922 - DNA, 15 bp, Homo sapiens
tattcttattggaaa

SEQ ID NO: 4650923 - DNA, 20 bp, Homo sapiens
tattcttattggaaatgtac

SEQ ID NO: 4650924 - DNA, 22 bp, Homo sapiens
tattcttattggaaatgtactt

SEQ ID NO: 4650925 - DNA, 16 bp, Homo sapiens
tattgaaaaaaaaaat

SEQ ID NO: 4650926 - DNA, 20 bp, Homo sapiens
tattgaaaaaaaaaatgttg

SEQ ID NO: 4650927 - DNA, 14 bp, Homo sapiens
tattgcagaatgtg

SEQ ID NO: 4650928 - DNA, 22 bp, Homo sapiens
tattgcagaatgtgggtattga

SEQ ID NO: 4650929 - DNA, 21 bp, Homo sapiens
tattgccttttaatttttaat

SEQ ID NO: 4650930 - DNA, 19 bp, Homo sapiens
tattggaaatgtacttttg

SEQ ID NO: 4650931 - DNA, 21 bp, Homo sapiens
tattggaagctgctgaggccc

SEQ ID NO: 4650932 - DNA, 15 bp, Homo sapiens
tattgtaatatgaca

SEQ ID NO: 4650933 - DNA, 17 bp, Homo sapiens
tattgtaatatgacaga

SEQ ID NO: 4650934 - DNA, 15 bp, Homo sapiens
tattgtacagttttt

SEQ ID NO: 4650935 - DNA, 20 bp, Homo sapiens
tattgttggcacagaacagg

SEQ ID NO: 4650936 - DNA, 14 bp, Homo sapiens
tatttaaattacaa

SEQ ID NO: 4650937 - DNA, 18 bp, Homo sapiens
tatttaacaaaaaatgta

SEQ ID NO: 4650938 - DNA, 13 bp, Homo sapiens
tatttaactaatt

SEQ ID NO: 4650939 - DNA, 13 bp, Homo sapiens
tatttactaacta

SEQ ID NO: 4650940 - DNA, 21 bp, Homo sapiens
tatttactaactaaataccat

SEQ ID NO: 4650941 - DNA, 23 bp, Homo sapiens
tatttactgctctttattgcaga

SEQ ID NO: 4650942 - DNA, 22 bp, Homo sapiens
tatttagcatggggattgcaga

SEQ ID NO: 4650943 - DNA, 14 bp, Homo sapiens
tatttagctgtaaa

SEQ ID NO: 4650944 - DNA, 22 bp, Homo sapiens
tatttaggaaaatgcttattga

SEQ ID NO: 4650945 - DNA, 13 bp, Homo sapiens
tatttatataaat

SEQ ID NO: 4650946 - DNA, 21 bp, Homo sapiens
tatttatctgtagtaaactat

SEQ ID NO: 4650947 - DNA, 17 bp, Homo sapiens
tatttattagccaactg

SEQ ID NO: 4650948 - DNA, 18 bp, Homo sapiens
tatttattagccaactgt

SEQ ID NO: 4650949 - DNA, 12 bp, Homo sapiens
tatttattccca

SEQ ID NO: 4650950 - DNA, 16 bp, Homo sapiens
tatttattgttagaaa

SEQ ID NO: 4650951 - DNA, 11 bp, Homo sapiens
tatttatttct

SEQ ID NO: 4650952 - DNA, 23 bp, Homo sapiens
tatttatttctagcaaacagatg

SEQ ID NO: 4650953 - DNA, 22 bp, Homo sapiens
tatttcatgtggtgaatatgca

SEQ ID NO: 4650954 - DNA, 17 bp, Homo sapiens
tatttccactaaaaata

SEQ ID NO: 4650955 - DNA, 19 bp, Homo sapiens
tatttccactaaaaatatt

SEQ ID NO: 4650956 - DNA, 21 bp, Homo sapiens
tatttccactattttcaaaga

SEQ ID NO: 4650957 - DNA, 18 bp, Homo sapiens
tatttccttccagccttt

SEQ ID NO: 4650958 - DNA, 23 bp, Homo sapiens
tatttccttccagcctttttagg

SEQ ID NO: 4650959 - DNA, 13 bp, Homo sapiens
tatttctattatt

SEQ ID NO: 4650960 - DNA, 22 bp, Homo sapiens
tatttctcagactttggaaaat

SEQ ID NO: 4650961 - DNA, 13 bp, Homo sapiens
tatttctctgtga

SEQ ID NO: 4650962 - DNA, 23 bp, Homo sapiens
tatttctcttctacccttttcct

SEQ ID NO: 4650963 - DNA, 15 bp, Homo sapiens
tatttctgttatttt

SEQ ID NO: 4650964 - DNA, 23 bp, Homo sapiens
tatttcttggcatgcatctttaa

SEQ ID NO: 4650965 - DNA, 19 bp, Homo sapiens
tatttgaaaacatataaag

SEQ ID NO: 4650966 - DNA, 12 bp, Homo sapiens
tatttgaagaaa

SEQ ID NO: 4650967 - DNA, 21 bp, Homo sapiens
tatttgaagaaaaaaatgtac

SEQ ID NO: 4650968 - DNA, 23 bp, Homo sapiens
tatttgaataatgacagatggtg

SEQ ID NO: 4650969 - DNA, 19 bp, Homo sapiens
tatttggaatatttgaata

SEQ ID NO: 4650970 - DNA, 15 bp, Homo sapiens
tatttggtgtgttcg

SEQ ID NO: 4650971 - DNA, 22 bp, Homo sapiens
tatttgttacttttagttctat

SEQ ID NO: 4650972 - DNA, 18 bp, Homo sapiens
tattttaatacctttaaa

SEQ ID NO: 4650973 - DNA, 19 bp, Homo sapiens
tattttaatacctttaaat

SEQ ID NO: 4650974 - DNA, 23 bp, Homo sapiens
tattttaatacctttaaatatca

SEQ ID NO: 4650975 - DNA, 13 bp, Homo sapiens
tattttaccatac

SEQ ID NO: 4650976 - DNA, 14 bp, Homo sapiens
tattttaggcactg

SEQ ID NO: 4650977 - DNA, 22 bp, Homo sapiens
tattttaggcactgttcaatac

SEQ ID NO: 4650978 - DNA, 13 bp, Homo sapiens
tattttattattc

SEQ ID NO: 4650979 - DNA, 20 bp, Homo sapiens
tattttcccctatcatttat

SEQ ID NO: 4650980 - DNA, 21 bp, Homo sapiens
tattttcccctatcatttatt

SEQ ID NO: 4650981 - DNA, 13 bp, Homo sapiens
tattttccttcca

SEQ ID NO: 4650982 - DNA, 18 bp, Homo sapiens
tattttccttccatgctc

SEQ ID NO: 4650983 - DNA, 20 bp, Homo sapiens
tattttctctgtacttttca

SEQ ID NO: 4650984 - DNA, 19 bp, Homo sapiens
tattttcttttgaattgtt

SEQ ID NO: 4650985 - DNA, 20 bp, Homo sapiens
tattttggcttcatttcaat

SEQ ID NO: 4650986 - DNA, 12 bp, Homo sapiens
tattttgtaata

SEQ ID NO: 4650987 - DNA, 18 bp, Homo sapiens
tattttgttaacttttgt

SEQ ID NO: 4650988 - DNA, 12 bp, Homo sapiens
tatttttcaatc

SEQ ID NO: 4650989 - DNA, 18 bp, Homo sapiens
tatttttgaagtaaatta

SEQ ID NO: 4650990 - DNA, 19 bp, Homo sapiens
tatttttgttgtgttctgt

SEQ ID NO: 4650991 - DNA, 20 bp, Homo sapiens
tcaaaaaaggaaacttcctt

SEQ ID NO: 4650992 - DNA, 12 bp, Homo sapiens
tcaaaaaattat

SEQ ID NO: 4650993 - DNA, 21 bp, Homo sapiens
tcaaaaagtattatcattgct

SEQ ID NO: 4650994 - DNA, 16 bp, Homo sapiens
tcaaaacgggtcagta

SEQ ID NO: 4650995 - DNA, 18 bp, Homo sapiens
tcaaaactcacaagtgct

SEQ ID NO: 4650996 - DNA, 13 bp, Homo sapiens
tcaaaataaaaag

SEQ ID NO: 4650997 - DNA, 19 bp, Homo sapiens
tcaaaatacttctttttca

SEQ ID NO: 4650998 - DNA, 15 bp, Homo sapiens
tcaaaatattactca

SEQ ID NO: 4650999 - DNA, 21 bp, Homo sapiens
tcaaaatcagtttttcatact

SEQ ID NO: 4651000 - DNA, 22 bp, Homo sapiens
tcaaaattgtttaaaaattctt

SEQ ID NO: 4651001 - DNA, 19 bp, Homo sapiens
tcaaagaagagtcaacatt

SEQ ID NO: 4651002 - DNA, 23 bp, Homo sapiens
tcaaagagcacttgagctgtctg

SEQ ID NO: 4651003 - DNA, 15 bp, Homo sapiens
tcaaagccagggtct

SEQ ID NO: 4651004 - DNA, 15 bp, Homo sapiens
tcaaagctaaaaaat

SEQ ID NO: 4651005 - DNA, 20 bp, Homo sapiens
tcaaagctttcctgtttcca

SEQ ID NO: 4651006 - DNA, 15 bp, Homo sapiens
tcaaaggaatataag

SEQ ID NO: 4651007 - DNA, 16 bp, Homo sapiens
tcaaagtataatcttt

SEQ ID NO: 4651008 - DNA, 19 bp, Homo sapiens
tcaaagtataatctttcta

SEQ ID NO: 4651009 - DNA, 20 bp, Homo sapiens
tcaaagtataatctttctat

SEQ ID NO: 4651010 - DNA, 15 bp, Homo sapiens
tcaaagtatgcaatg

SEQ ID NO: 4651011 - DNA, 15 bp, Homo sapiens
tcaaataaaatatca

SEQ ID NO: 4651012 - DNA, 18 bp, Homo sapiens
tcaaataaaatatcataa

SEQ ID NO: 4651013 - DNA, 23 bp, Homo sapiens
tcaaataaaatatcataaagcat

SEQ ID NO: 4651014 - DNA, 13 bp, Homo sapiens
tcaaataaatgtt

SEQ ID NO: 4651015 - DNA, 14 bp, Homo sapiens
tcaaataaatgttt

SEQ ID NO: 4651016 - DNA, 16 bp, Homo sapiens
tcaaataaatgtttcc

SEQ ID NO: 4651017 - DNA, 22 bp, Homo sapiens
tcaaataaatgtttcccccact

SEQ ID NO: 4651018 - DNA, 13 bp, Homo sapiens
tcaaatatagaaa

SEQ ID NO: 4651019 - DNA, 15 bp, Homo sapiens
tcaaatatagaaagt

SEQ ID NO: 4651020 - DNA, 23 bp, Homo sapiens
tcaaatcaggctactagaattct

SEQ ID NO: 4651021 - DNA, 16 bp, Homo sapiens
tcaaatccacccatat

SEQ ID NO: 4651022 - DNA, 13 bp, Homo sapiens
tcaaatccctttt

SEQ ID NO: 4651023 - DNA, 15 bp, Homo sapiens
tcaaatggactgtta

SEQ ID NO: 4651024 - DNA, 20 bp, Homo sapiens
tcaaatgttagagtttaatt

SEQ ID NO: 4651025 - DNA, 21 bp, Homo sapiens
tcaacaaatttcattgcactt

SEQ ID NO: 4651026 - DNA, 17 bp, Homo sapiens
tcaacaacgtgagagaa

SEQ ID NO: 4651027 - DNA, 22 bp, Homo sapiens
tcaacacattggaattgatgtc

SEQ ID NO: 4651028 - DNA, 17 bp, Homo sapiens
tcaacagagggagttta

SEQ ID NO: 4651029 - DNA, 21 bp, Homo sapiens
tcaacaggtcacttgatcatg

SEQ ID NO: 4651030 - DNA, 13 bp, Homo sapiens
tcaacatactgta

SEQ ID NO: 4651031 - DNA, 18 bp, Homo sapiens
tcaacatactgtaatcaa

SEQ ID NO: 4651032 - DNA, 15 bp, Homo sapiens
tcaacggtctggcag

SEQ ID NO: 4651033 - DNA, 18 bp, Homo sapiens
tcaacggtctggcagggc

SEQ ID NO: 4651034 - DNA, 20 bp, Homo sapiens
tcaactaaaaaaaaaaaagt

SEQ ID NO: 4651035 - DNA, 19 bp, Homo sapiens
tcaactacggttgggagaa

SEQ ID NO: 4651036 - DNA, 22 bp, Homo sapiens
tcaactacggttgggagaatga

SEQ ID NO: 4651037 - DNA, 12 bp, Homo sapiens
tcaagaaacagc

SEQ ID NO: 4651038 - DNA, 13 bp, Homo sapiens
tcaagaaacagcc

SEQ ID NO: 4651039 - DNA, 17 bp, Homo sapiens
tcaagaaacagccagca

SEQ ID NO: 4651040 - DNA, 15 bp, Homo sapiens
tcaagaatgaaaaat

SEQ ID NO: 4651041 - DNA, 17 bp, Homo sapiens
tcaagacgaggggcagg

SEQ ID NO: 4651042 - DNA, 11 bp, Homo sapiens
tcaagagaaac

SEQ ID NO: 4651043 - DNA, 15 bp, Homo sapiens
tcaagatgagcctgg

SEQ ID NO: 4651044 - DNA, 17 bp, Homo sapiens
tcaagatgagcctgggc

SEQ ID NO: 4651045 - DNA, 18 bp, Homo sapiens
tcaagatgagcctgggct

SEQ ID NO: 4651046 - DNA, 19 bp, Homo sapiens
tcaagatgagcctgggctc

SEQ ID NO: 4651047 - DNA, 20 bp, Homo sapiens
tcaagatgcctcctgtcaga

SEQ ID NO: 4651048 - DNA, 21 bp, Homo sapiens
tcaaggccttcagtttatttc

SEQ ID NO: 4651049 - DNA, 20 bp, Homo sapiens
tcaagggcactgtgatacag

SEQ ID NO: 4651050 - DNA, 14 bp, Homo sapiens
tcaaggtaagctca

SEQ ID NO: 4651051 - DNA, 19 bp, Homo sapiens
tcaagtaatggaggtccca

SEQ ID NO: 4651052 - DNA, 16 bp, Homo sapiens
tcaagtgcttaaaaat

SEQ ID NO: 4651053 - DNA, 19 bp, Homo sapiens
tcaagtgcttaaaaatact

SEQ ID NO: 4651054 - DNA, 14 bp, Homo sapiens
tcaagttgtacatt

SEQ ID NO: 4651055 - DNA, 16 bp, Homo sapiens
tcaataaacaacagct

SEQ ID NO: 4651056 - DNA, 12 bp, Homo sapiens
tcaataaagttg

SEQ ID NO: 4651057 - DNA, 13 bp, Homo sapiens
tcaataaagttgt

SEQ ID NO: 4651058 - DNA, 14 bp, Homo sapiens
tcaataaagttgtt

SEQ ID NO: 4651059 - DNA, 15 bp, Homo sapiens
tcaataaagttgttg

SEQ ID NO: 4651060 - DNA, 22 bp, Homo sapiens
tcaatactgcacactgcacatt

SEQ ID NO: 4651061 - DNA, 21 bp, Homo sapiens
tcaatactgtatgccttctgt

SEQ ID NO: 4651062 - DNA, 17 bp, Homo sapiens
tcaatagctaagcatct

SEQ ID NO: 4651063 - DNA, 17 bp, Homo sapiens
tcaatcaagccatgtat

SEQ ID NO: 4651064 - DNA, 14 bp, Homo sapiens
tcaatcatgaatga

SEQ ID NO: 4651065 - DNA, 16 bp, Homo sapiens
tcaatcattgaagtat

SEQ ID NO: 4651066 - DNA, 23 bp, Homo sapiens
tcaatgtactaggatactgctgc

SEQ ID NO: 4651067 - DNA, 22 bp, Homo sapiens
tcaatgtggaaaaaatatttta

SEQ ID NO: 4651068 - DNA, 19 bp, Homo sapiens
tcaattatattatgtttaa

SEQ ID NO: 4651069 - DNA, 17 bp, Homo sapiens
tcaattccaccagggcc

SEQ ID NO: 4651070 - DNA, 23 bp, Homo sapiens
tcaattccaccagggccagagca

SEQ ID NO: 4651071 - DNA, 13 bp, Homo sapiens
tcaattctgtgtg

SEQ ID NO: 4651072 - DNA, 18 bp, Homo sapiens
tcaattctgtgtggtata

SEQ ID NO: 4651073 - DNA, 13 bp, Homo sapiens
tcaattgtaatat

SEQ ID NO: 4651074 - DNA, 11 bp, Homo sapiens
tcacaactcct

SEQ ID NO: 4651075 - DNA, 19 bp, Homo sapiens
tcacaagggctctcaaagt

SEQ ID NO: 4651076 - DNA, 14 bp, Homo sapiens
tcacacacagactg

SEQ ID NO: 4651077 - DNA, 22 bp, Homo sapiens
tcacacacagactgttgtccct

SEQ ID NO: 4651078 - DNA, 15 bp, Homo sapiens
tcacacaccctgagg

SEQ ID NO: 4651079 - DNA, 16 bp, Homo sapiens
tcacacaccctgaggt

SEQ ID NO: 4651080 - DNA, 12 bp, Homo sapiens
tcacacaggcat

SEQ ID NO: 4651081 - DNA, 19 bp, Homo sapiens
tcacacaggcatttcctgg

SEQ ID NO: 4651082 - DNA, 19 bp, Homo sapiens
tcacacccaccccctgcct

SEQ ID NO: 4651083 - DNA, 20 bp, Homo sapiens
tcacacccaccccctgcctg

SEQ ID NO: 4651084 - DNA, 21 bp, Homo sapiens
tcacacccaccccctgcctgg

SEQ ID NO: 4651085 - DNA, 22 bp, Homo sapiens
tcacacccaccccctgcctggt

SEQ ID NO: 4651086 - DNA, 23 bp, Homo sapiens
tcacactcttcagtgactcctgc

SEQ ID NO: 4651087 - DNA, 16 bp, Homo sapiens
tcacagcctcacccct

SEQ ID NO: 4651088 - DNA, 22 bp, Homo sapiens
tcacagcctcacccctgcccct

SEQ ID NO: 4651089 - DNA, 16 bp, Homo sapiens
tcacagcttttcttga

SEQ ID NO: 4651090 - DNA, 17 bp, Homo sapiens
tcacagcttttcttgat

SEQ ID NO: 4651091 - DNA, 16 bp, Homo sapiens
tcacaggtagcctatt

SEQ ID NO: 4651092 - DNA, 13 bp, Homo sapiens
tcacatatgtctt

SEQ ID NO: 4651093 - DNA, 17 bp, Homo sapiens
tcacatatgtcttacta

SEQ ID NO: 4651094 - DNA, 14 bp, Homo sapiens
tcacatctcccttc

SEQ ID NO: 4651095 - DNA, 13 bp, Homo sapiens
tcacatctgcaca

SEQ ID NO: 4651096 - DNA, 17 bp, Homo sapiens
tcacatctgcacactct

SEQ ID NO: 4651097 - DNA, 20 bp, Homo sapiens
tcacatctgcacactctctt

SEQ ID NO: 4651098 - DNA, 23 bp, Homo sapiens
tcacatctgcacactctcttctc

SEQ ID NO: 4651099 - DNA, 18 bp, Homo sapiens
tcacatgaccacatagca

SEQ ID NO: 4651100 - DNA, 16 bp, Homo sapiens
tcacatggcctatgca

SEQ ID NO: 4651101 - DNA, 19 bp, Homo sapiens
tcacatgtcctattactga

SEQ ID NO: 4651102 - DNA, 15 bp, Homo sapiens
tcacattaacatttt

SEQ ID NO: 4651103 - DNA, 21 bp, Homo sapiens
tcacattatttattaaaaatg

SEQ ID NO: 4651104 - DNA, 23 bp, Homo sapiens
tcaccaatgtacccaccgggcca

SEQ ID NO: 4651105 - DNA, 22 bp, Homo sapiens
tcaccactcaaaggccagacct

SEQ ID NO: 4651106 - DNA, 13 bp, Homo sapiens
tcaccagctgctg

SEQ ID NO: 4651107 - DNA, 15 bp, Homo sapiens
tcaccagctgctgtg

SEQ ID NO: 4651108 - DNA, 21 bp, Homo sapiens
tcaccatgatggccaggctga

SEQ ID NO: 4651109 - DNA, 18 bp, Homo sapiens
tcacccactcccttgaag

SEQ ID NO: 4651110 - DNA, 16 bp, Homo sapiens
tcacccaggctggagt

SEQ ID NO: 4651111 - DNA, 12 bp, Homo sapiens
tcacccagggac

SEQ ID NO: 4651112 - DNA, 23 bp, Homo sapiens
tcacccagggacactccaactct

SEQ ID NO: 4651113 - DNA, 16 bp, Homo sapiens
tcacccctcccctggg

SEQ ID NO: 4651114 - DNA, 16 bp, Homo sapiens
tcaccctgcaggactt

SEQ ID NO: 4651115 - DNA, 17 bp, Homo sapiens
tcaccgactcacctgcg

SEQ ID NO: 4651116 - DNA, 22 bp, Homo sapiens
tcaccgagcgggtgcaagcact

SEQ ID NO: 4651117 - DNA, 22 bp, Homo sapiens
tcacctacatatgctgatcttt

SEQ ID NO: 4651118 - DNA, 19 bp, Homo sapiens
tcacctactcacacaggca

SEQ ID NO: 4651119 - DNA, 19 bp, Homo sapiens
tcacctccaagcatttcat

SEQ ID NO: 4651120 - DNA, 14 bp, Homo sapiens
tcacctccttcccc

SEQ ID NO: 4651121 - DNA, 22 bp, Homo sapiens
tcacctccttccccagctcccc

SEQ ID NO: 4651122 - DNA, 13 bp, Homo sapiens
tcacctcgctggg

SEQ ID NO: 4651123 - DNA, 20 bp, Homo sapiens
tcacctctgggaccccagct

SEQ ID NO: 4651124 - DNA, 21 bp, Homo sapiens
tcacctctgtgacccctcctt

SEQ ID NO: 4651125 - DNA, 17 bp, Homo sapiens
tcacctcttccactcct

SEQ ID NO: 4651126 - DNA, 21 bp, Homo sapiens
tcacctgattcaactaaaaaa

SEQ ID NO: 4651127 - DNA, 20 bp, Homo sapiens
tcacctgccccgtagagaat

SEQ ID NO: 4651128 - DNA, 22 bp, Homo sapiens
tcacctgccccgtagagaatgt

SEQ ID NO: 4651129 - DNA, 16 bp, Homo sapiens
tcacctgcgcaagtgc

SEQ ID NO: 4651130 - DNA, 16 bp, Homo sapiens
tcacgaagtgttgcat

SEQ ID NO: 4651131 - DNA, 17 bp, Homo sapiens
tcacgtcatttgtttca

SEQ ID NO: 4651132 - DNA, 17 bp, Homo sapiens
tcactaaactttatttg

SEQ ID NO: 4651133 - DNA, 19 bp, Homo sapiens
tcactaaactttatttgta

SEQ ID NO: 4651134 - DNA, 15 bp, Homo sapiens
tcactaatttttgta

SEQ ID NO: 4651135 - DNA, 19 bp, Homo sapiens
tcactagaatggataaaat

SEQ ID NO: 4651136 - DNA, 16 bp, Homo sapiens
tcactaggcattgtga

SEQ ID NO: 4651137 - DNA, 19 bp, Homo sapiens
tcactaggcattgtgatgt

SEQ ID NO: 4651138 - DNA, 14 bp, Homo sapiens
tcactcctgctgta

SEQ ID NO: 4651139 - DNA, 15 bp, Homo sapiens
tcactcctgctgtaa

SEQ ID NO: 4651140 - DNA, 14 bp, Homo sapiens
tcactctccagggt

SEQ ID NO: 4651141 - DNA, 15 bp, Homo sapiens
tcactctccagggta

SEQ ID NO: 4651142 - DNA, 14 bp, Homo sapiens
tcactcttctcagc

SEQ ID NO: 4651143 - DNA, 17 bp, Homo sapiens
tcactgaaaacatctgg

SEQ ID NO: 4651144 - DNA, 16 bp, Homo sapiens
tcactgatgggaaaac

SEQ ID NO: 4651145 - DNA, 17 bp, Homo sapiens
tcactgcaacctctgcc

SEQ ID NO: 4651146 - DNA, 22 bp, Homo sapiens
tcactgcaacctctgcctcctg

SEQ ID NO: 4651147 - DNA, 19 bp, Homo sapiens
tcactgcattatcttgctc

SEQ ID NO: 4651148 - DNA, 19 bp, Homo sapiens
tcactgcttgaactaggct

SEQ ID NO: 4651149 - DNA, 18 bp, Homo sapiens
tcacttactattgttgct

SEQ ID NO: 4651150 - DNA, 13 bp, Homo sapiens
tcacttccccaag

SEQ ID NO: 4651151 - DNA, 14 bp, Homo sapiens
tcacttccccaaga

SEQ ID NO: 4651152 - DNA, 12 bp, Homo sapiens
tcacttgctgct

SEQ ID NO: 4651153 - DNA, 21 bp, Homo sapiens
tcagaaaagtaattttgtcac

SEQ ID NO: 4651154 - DNA, 22 bp, Homo sapiens
tcagaaaagtaattttgtcaca

SEQ ID NO: 4651155 - DNA, 16 bp, Homo sapiens
tcagaaaattggcagt

SEQ ID NO: 4651156 - DNA, 19 bp, Homo sapiens
tcagaaagggagggctctg

SEQ ID NO: 4651157 - DNA, 20 bp, Homo sapiens
tcagaaataataacctgtta

SEQ ID NO: 4651158 - DNA, 16 bp, Homo sapiens
tcagaaatcctctgtt

SEQ ID NO: 4651159 - DNA, 21 bp, Homo sapiens
tcagaaatcctctgttaatgt

SEQ ID NO: 4651160 - DNA, 22 bp, Homo sapiens
tcagaaatcctctgttaatgtg

SEQ ID NO: 4651161 - DNA, 17 bp, Homo sapiens
tcagaacattcagctct

SEQ ID NO: 4651162 - DNA, 19 bp, Homo sapiens
tcagaacattcagctctgg

SEQ ID NO: 4651163 - DNA, 22 bp, Homo sapiens
tcagaacattcagctctggaga

SEQ ID NO: 4651164 - DNA, 13 bp, Homo sapiens
tcagaagcctggg

SEQ ID NO: 4651165 - DNA, 22 bp, Homo sapiens
tcagaagcctgggggcctggct

SEQ ID NO: 4651166 - DNA, 16 bp, Homo sapiens
tcagaagtccctgttt

SEQ ID NO: 4651167 - DNA, 15 bp, Homo sapiens
tcagaataaggcagg

SEQ ID NO: 4651168 - DNA, 22 bp, Homo sapiens
tcagaattatacagacctaata

SEQ ID NO: 4651169 - DNA, 20 bp, Homo sapiens
tcagacacatgctatgttct

SEQ ID NO: 4651170 - DNA, 12 bp, Homo sapiens
tcagacataaag

SEQ ID NO: 4651171 - DNA, 13 bp, Homo sapiens
tcagacataaagc

SEQ ID NO: 4651172 - DNA, 14 bp, Homo sapiens
tcagaccacggctc

SEQ ID NO: 4651173 - DNA, 17 bp, Homo sapiens
tcagacccatctctccc

SEQ ID NO: 4651174 - DNA, 15 bp, Homo sapiens
tcagactttggaaaa

SEQ ID NO: 4651175 - DNA, 18 bp, Homo sapiens
tcagagatcaggatcagc

SEQ ID NO: 4651176 - DNA, 16 bp, Homo sapiens
tcagagcccccagccc

SEQ ID NO: 4651177 - DNA, 15 bp, Homo sapiens
tcagagcttcctggg

SEQ ID NO: 4651178 - DNA, 16 bp, Homo sapiens
tcagagcttcctgggg

SEQ ID NO: 4651179 - DNA, 22 bp, Homo sapiens
tcagaggcatttgagcagctga

SEQ ID NO: 4651180 - DNA, 23 bp, Homo sapiens
tcagaggcatttgagcagctgaa

SEQ ID NO: 4651181 - DNA, 23 bp, Homo sapiens
tcagagtaaaataggcaccattg

SEQ ID NO: 4651182 - DNA, 18 bp, Homo sapiens
tcagagttctgaagaaaa

SEQ ID NO: 4651183 - DNA, 14 bp, Homo sapiens
tcagatataaaaga

SEQ ID NO: 4651184 - DNA, 13 bp, Homo sapiens
tcagatgaggccc

SEQ ID NO: 4651185 - DNA, 14 bp, Homo sapiens
tcagatgaggccct

SEQ ID NO: 4651186 - DNA, 15 bp, Homo sapiens
tcagatgaggccctg

SEQ ID NO: 4651187 - DNA, 20 bp, Homo sapiens
tcagatgaggccctgcacct

SEQ ID NO: 4651188 - DNA, 21 bp, Homo sapiens
tcagattgcatgtgactctga

SEQ ID NO: 4651189 - DNA, 17 bp, Homo sapiens
tcagcagctagaaaaca

SEQ ID NO: 4651190 - DNA, 23 bp, Homo sapiens
tcagccagcacttgtccagctga

SEQ ID NO: 4651191 - DNA, 13 bp, Homo sapiens
tcagcccatggag

SEQ ID NO: 4651192 - DNA, 22 bp, Homo sapiens
tcagcccccaccaggggaagga

SEQ ID NO: 4651193 - DNA, 21 bp, Homo sapiens
tcagcgatgtatgcagctatc

SEQ ID NO: 4651194 - DNA, 15 bp, Homo sapiens
tcagcgtaaaatggt

SEQ ID NO: 4651195 - DNA, 20 bp, Homo sapiens
tcagctatcagtaggctaat

SEQ ID NO: 4651196 - DNA, 16 bp, Homo sapiens
tcagctctggagaaca

SEQ ID NO: 4651197 - DNA, 19 bp, Homo sapiens
tcagctctgggccattctc

SEQ ID NO: 4651198 - DNA, 21 bp, Homo sapiens
tcagctcttgtcaaaaggtct

SEQ ID NO: 4651199 - DNA, 17 bp, Homo sapiens
tcagctctttccaaatt

SEQ ID NO: 4651200 - DNA, 23 bp, Homo sapiens
tcagctgaatgcctcctgtgggg

SEQ ID NO: 4651201 - DNA, 19 bp, Homo sapiens
tcagctgccccaatgtgac

SEQ ID NO: 4651202 - DNA, 21 bp, Homo sapiens
tcagctgccccaatgtgacct

SEQ ID NO: 4651203 - DNA, 16 bp, Homo sapiens
tcagctggaaacttct

SEQ ID NO: 4651204 - DNA, 15 bp, Homo sapiens
tcagctggtcctgac

SEQ ID NO: 4651205 - DNA, 20 bp, Homo sapiens
tcagctggtcctgaccagga

SEQ ID NO: 4651206 - DNA, 15 bp, Homo sapiens
tcagctgtcctgcag

SEQ ID NO: 4651207 - DNA, 18 bp, Homo sapiens
tcagctgtcctgcagcaa

SEQ ID NO: 4651208 - DNA, 19 bp, Homo sapiens
tcagctgtcctgcagcaaa

SEQ ID NO: 4651209 - DNA, 14 bp, Homo sapiens
tcaggaaaaggcct

SEQ ID NO: 4651210 - DNA, 15 bp, Homo sapiens
tcaggaaaaggcctg

SEQ ID NO: 4651211 - DNA, 16 bp, Homo sapiens
tcaggaaaaggcctgg

SEQ ID NO: 4651212 - DNA, 19 bp, Homo sapiens
tcaggacacaggcctgtgt

SEQ ID NO: 4651213 - DNA, 23 bp, Homo sapiens
tcaggacacaggcctgtgtagct

SEQ ID NO: 4651214 - DNA, 20 bp, Homo sapiens
tcaggagaaggtggtggcat

SEQ ID NO: 4651215 - DNA, 22 bp, Homo sapiens
tcaggatatccttatcagagct

SEQ ID NO: 4651216 - DNA, 22 bp, Homo sapiens
tcaggatatggcttaggaatga

SEQ ID NO: 4651217 - DNA, 15 bp, Homo sapiens
tcaggatcagctttg

SEQ ID NO: 4651218 - DNA, 14 bp, Homo sapiens
tcaggatgaggccc

SEQ ID NO: 4651219 - DNA, 19 bp, Homo sapiens
tcaggatgaggccccgcct

SEQ ID NO: 4651220 - DNA, 12 bp, Homo sapiens
tcaggcaaggag

SEQ ID NO: 4651221 - DNA, 17 bp, Homo sapiens
tcaggccccacccctgt

SEQ ID NO: 4651222 - DNA, 20 bp, Homo sapiens
tcaggcctcacccctcccct

SEQ ID NO: 4651223 - DNA, 23 bp, Homo sapiens
tcaggcctcacccctcccctggg

SEQ ID NO: 4651224 - DNA, 11 bp, Homo sapiens
tcaggctctgc

SEQ ID NO: 4651225 - DNA, 20 bp, Homo sapiens
tcagggaccggtgctgcagg

SEQ ID NO: 4651226 - DNA, 14 bp, Homo sapiens
tcagggagaggtca

SEQ ID NO: 4651227 - DNA, 17 bp, Homo sapiens
tcagggagtgctggctc

SEQ ID NO: 4651228 - DNA, 15 bp, Homo sapiens
tcagggcagcgccag

SEQ ID NO: 4651229 - DNA, 19 bp, Homo sapiens
tcagggcagcgccaggctg

SEQ ID NO: 4651230 - DNA, 13 bp, Homo sapiens
tcagggcctgagt

SEQ ID NO: 4651231 - DNA, 13 bp, Homo sapiens
tcagggcctgccc

SEQ ID NO: 4651232 - DNA, 18 bp, Homo sapiens
tcagggcctgccccctgg

SEQ ID NO: 4651233 - DNA, 20 bp, Homo sapiens
tcagggcctggggcctgaga

SEQ ID NO: 4651234 - DNA, 20 bp, Homo sapiens
tcaggggtacattctagctg

SEQ ID NO: 4651235 - DNA, 17 bp, Homo sapiens
tcagggtctccttcctt

SEQ ID NO: 4651236 - DNA, 18 bp, Homo sapiens
tcaggtgaggcatcttta

SEQ ID NO: 4651237 - DNA, 22 bp, Homo sapiens
tcaggtgttttttatgaagtgc

SEQ ID NO: 4651238 - DNA, 20 bp, Homo sapiens
tcagtaaatagtgtcatata

SEQ ID NO: 4651239 - DNA, 13 bp, Homo sapiens
tcagtaccaaaga

SEQ ID NO: 4651240 - DNA, 21 bp, Homo sapiens
tcagtaccaaagaaacaccac

SEQ ID NO: 4651241 - DNA, 13 bp, Homo sapiens
tcagtaggaccag

SEQ ID NO: 4651242 - DNA, 17 bp, Homo sapiens
tcagtaggaccaggcca

SEQ ID NO: 4651243 - DNA, 13 bp, Homo sapiens
tcagtaggctaat

SEQ ID NO: 4651244 - DNA, 15 bp, Homo sapiens
tcagtcacagccacc

SEQ ID NO: 4651245 - DNA, 20 bp, Homo sapiens
tcagtcagggtttgtcagag

SEQ ID NO: 4651246 - DNA, 16 bp, Homo sapiens
tcagtgaagtctagaa

SEQ ID NO: 4651247 - DNA, 19 bp, Homo sapiens
tcagtgaagtctagaatca

SEQ ID NO: 4651248 - DNA, 17 bp, Homo sapiens
tcagtgactcctgctgg

SEQ ID NO: 4651249 - DNA, 22 bp, Homo sapiens
tcagtgactcctgctggtacct

SEQ ID NO: 4651250 - DNA, 21 bp, Homo sapiens
tcagtgcaaaatgtcttgtgt

SEQ ID NO: 4651251 - DNA, 13 bp, Homo sapiens
tcagtgcagtttc

SEQ ID NO: 4651252 - DNA, 12 bp, Homo sapiens
tcagtgcatcat

SEQ ID NO: 4651253 - DNA, 21 bp, Homo sapiens
tcagtgggaattgcagcatat

SEQ ID NO: 4651254 - DNA, 17 bp, Homo sapiens
tcagtggggctctctga

SEQ ID NO: 4651255 - DNA, 15 bp, Homo sapiens
tcagtgtagacacag

SEQ ID NO: 4651256 - DNA, 18 bp, Homo sapiens
tcagtgtagacacaggtc

SEQ ID NO: 4651257 - DNA, 15 bp, Homo sapiens
tcagttctctactcc

SEQ ID NO: 4651258 - DNA, 20 bp, Homo sapiens
tcagttctctactccctctt

SEQ ID NO: 4651259 - DNA, 22 bp, Homo sapiens
tcagttctgcttgctcccaagc

SEQ ID NO: 4651260 - DNA, 21 bp, Homo sapiens
tcagttgtccttaaatttgta

SEQ ID NO: 4651261 - DNA, 16 bp, Homo sapiens
tcagtttatttccact

SEQ ID NO: 4651262 - DNA, 14 bp, Homo sapiens
tcagtttctgcctg

SEQ ID NO: 4651263 - DNA, 16 bp, Homo sapiens
tcagtttctgcctggg

SEQ ID NO: 4651264 - DNA, 17 bp, Homo sapiens
tcagtttctgcctgggc

SEQ ID NO: 4651265 - DNA, 19 bp, Homo sapiens
tcagtttctgcctgggcaa

SEQ ID NO: 4651266 - DNA, 16 bp, Homo sapiens
tcagttttcaggagtg

SEQ ID NO: 4651267 - DNA, 23 bp, Homo sapiens
tcataaaatcaaaacaagtgaaa

SEQ ID NO: 4651268 - DNA, 11 bp, Homo sapiens
tcataaacttt

SEQ ID NO: 4651269 - DNA, 23 bp, Homo sapiens
tcataaagcattggagtttcaaa

SEQ ID NO: 4651270 - DNA, 19 bp, Homo sapiens
tcataaatttgaataagca

SEQ ID NO: 4651271 - DNA, 20 bp, Homo sapiens
tcataagtaaacctagtaaa

SEQ ID NO: 4651272 - DNA, 19 bp, Homo sapiens
tcataataaatatctgtac

SEQ ID NO: 4651273 - DNA, 16 bp, Homo sapiens
tcatacaaactctcac

SEQ ID NO: 4651274 - DNA, 18 bp, Homo sapiens
tcatacaaactctcacca

SEQ ID NO: 4651275 - DNA, 13 bp, Homo sapiens
tcatacagtttta

SEQ ID NO: 4651276 - DNA, 14 bp, Homo sapiens
tcatacagttttat

SEQ ID NO: 4651277 - DNA, 18 bp, Homo sapiens
tcatactctgttgcctcc

SEQ ID NO: 4651278 - DNA, 21 bp, Homo sapiens
tcatactctgttgcctcctct

SEQ ID NO: 4651279 - DNA, 15 bp, Homo sapiens
tcatagccactttta

SEQ ID NO: 4651280 - DNA, 22 bp, Homo sapiens
tcatagtatcttcactgtgtta

SEQ ID NO: 4651281 - DNA, 14 bp, Homo sapiens
tcatagttttctaa

SEQ ID NO: 4651282 - DNA, 14 bp, Homo sapiens
tcatatacgtgaaa

SEQ ID NO: 4651283 - DNA, 23 bp, Homo sapiens
tcatatatttggagtttttctga

SEQ ID NO: 4651284 - DNA, 22 bp, Homo sapiens
tcatatccttcttacacgacta

SEQ ID NO: 4651285 - DNA, 18 bp, Homo sapiens
tcatatgaattagccaaa

SEQ ID NO: 4651286 - DNA, 15 bp, Homo sapiens
tcatcacagggattt

SEQ ID NO: 4651287 - DNA, 14 bp, Homo sapiens
tcatcaccatttcc

SEQ ID NO: 4651288 - DNA, 19 bp, Homo sapiens
tcatcaccatttcctcctt

SEQ ID NO: 4651289 - DNA, 13 bp, Homo sapiens
tcatcatcagggc

SEQ ID NO: 4651290 - DNA, 14 bp, Homo sapiens
tcatcatcagggcc

SEQ ID NO: 4651291 - DNA, 17 bp, Homo sapiens
tcatcctcttttaatgg

SEQ ID NO: 4651292 - DNA, 21 bp, Homo sapiens
tcatccttctttccttgttca

SEQ ID NO: 4651293 - DNA, 16 bp, Homo sapiens
tcatccttgcccaggt

SEQ ID NO: 4651294 - DNA, 13 bp, Homo sapiens
tcatctaaatgaa

SEQ ID NO: 4651295 - DNA, 14 bp, Homo sapiens
tcatctaaatgaaa

SEQ ID NO: 4651296 - DNA, 22 bp, Homo sapiens
tcatctaactgatgagtaaact

SEQ ID NO: 4651297 - DNA, 12 bp, Homo sapiens
tcatctcccacc

SEQ ID NO: 4651298 - DNA, 14 bp, Homo sapiens
tcatctgggaaaga

SEQ ID NO: 4651299 - DNA, 12 bp, Homo sapiens
tcatctgtgcac

SEQ ID NO: 4651300 - DNA, 14 bp, Homo sapiens
tcatctgtggagct

SEQ ID NO: 4651301 - DNA, 14 bp, Homo sapiens
tcatctttgtgaag

SEQ ID NO: 4651302 - DNA, 14 bp, Homo sapiens
tcatgacattatgt

SEQ ID NO: 4651303 - DNA, 11 bp, Homo sapiens
tcatgcaaaat

SEQ ID NO: 4651304 - DNA, 16 bp, Homo sapiens
tcatgcccctggctgg

SEQ ID NO: 4651305 - DNA, 15 bp, Homo sapiens
tcatgccctgtgcaa

SEQ ID NO: 4651306 - DNA, 23 bp, Homo sapiens
tcatggagtagcctggactgttt

SEQ ID NO: 4651307 - DNA, 18 bp, Homo sapiens
tcatggcagatgtaggag

SEQ ID NO: 4651308 - DNA, 16 bp, Homo sapiens
tcatggccttgaaaca

SEQ ID NO: 4651309 - DNA, 16 bp, Homo sapiens
tcatgtaaagaaatgt

SEQ ID NO: 4651310 - DNA, 15 bp, Homo sapiens
tcatgtactttttag

SEQ ID NO: 4651311 - DNA, 21 bp, Homo sapiens
tcatgtagccagcagaactga

SEQ ID NO: 4651312 - DNA, 15 bp, Homo sapiens
tcatgtcaatgacca

SEQ ID NO: 4651313 - DNA, 14 bp, Homo sapiens
tcatgtcattatga

SEQ ID NO: 4651314 - DNA, 18 bp, Homo sapiens
tcatgtcattatgacatt

SEQ ID NO: 4651315 - DNA, 17 bp, Homo sapiens
tcatgtcctaaagaaga

SEQ ID NO: 4651316 - DNA, 23 bp, Homo sapiens
tcatgtctgcttgtcaaaagaaa

SEQ ID NO: 4651317 - DNA, 23 bp, Homo sapiens
tcatgtctgtatccccagtgccc

SEQ ID NO: 4651318 - DNA, 21 bp, Homo sapiens
tcatgttgatcatgtactttt

SEQ ID NO: 4651319 - DNA, 16 bp, Homo sapiens
tcatgttggccaggct

SEQ ID NO: 4651320 - DNA, 15 bp, Homo sapiens
tcatgttttaacaaa

SEQ ID NO: 4651321 - DNA, 16 bp, Homo sapiens
tcatgttttaacaaaa

SEQ ID NO: 4651322 - DNA, 18 bp, Homo sapiens
tcatgttttaacaaaaac

SEQ ID NO: 4651323 - DNA, 13 bp, Homo sapiens
tcattaaaaatta

SEQ ID NO: 4651324 - DNA, 16 bp, Homo sapiens
tcattaactcaaattc

SEQ ID NO: 4651325 - DNA, 15 bp, Homo sapiens
tcattactgggcctt

SEQ ID NO: 4651326 - DNA, 21 bp, Homo sapiens
tcattactgttccagattcct

SEQ ID NO: 4651327 - DNA, 21 bp, Homo sapiens
tcattatgacatttcttaaaa

SEQ ID NO: 4651328 - DNA, 23 bp, Homo sapiens
tcattatgacatttcttaaaact

SEQ ID NO: 4651329 - DNA, 14 bp, Homo sapiens
tcattatgttcatg

SEQ ID NO: 4651330 - DNA, 21 bp, Homo sapiens
tcattatgttcatgtaagaag

SEQ ID NO: 4651331 - DNA, 13 bp, Homo sapiens
tcattattcaaga

SEQ ID NO: 4651332 - DNA, 22 bp, Homo sapiens
tcattattcaagaatgaaaaat

SEQ ID NO: 4651333 - DNA, 21 bp, Homo sapiens
tcattcagcagcaaattttca

SEQ ID NO: 4651334 - DNA, 14 bp, Homo sapiens
tcattccattgcct

SEQ ID NO: 4651335 - DNA, 15 bp, Homo sapiens
tcattccttccacta

SEQ ID NO: 4651336 - DNA, 15 bp, Homo sapiens
tcattcgttctgtgg

SEQ ID NO: 4651337 - DNA, 14 bp, Homo sapiens
tcattctcctcctc

SEQ ID NO: 4651338 - DNA, 18 bp, Homo sapiens
tcattgaagtatattctt

SEQ ID NO: 4651339 - DNA, 13 bp, Homo sapiens
tcattgcactttc

SEQ ID NO: 4651340 - DNA, 19 bp, Homo sapiens
tcattgcactttcctttca

SEQ ID NO: 4651341 - DNA, 21 bp, Homo sapiens
tcattgcactttcctttcaat

SEQ ID NO: 4651342 - DNA, 15 bp, Homo sapiens
tcattgtcagccttg

SEQ ID NO: 4651343 - DNA, 18 bp, Homo sapiens
tcatttagataatttgaa

SEQ ID NO: 4651344 - DNA, 20 bp, Homo sapiens
tcatttataatactgtttta

SEQ ID NO: 4651345 - DNA, 15 bp, Homo sapiens
tcatttcaatcattg

SEQ ID NO: 4651346 - DNA, 17 bp, Homo sapiens
tcatttcaatcattgaa

SEQ ID NO: 4651347 - DNA, 19 bp, Homo sapiens
tcatttcagggtcttggct

SEQ ID NO: 4651348 - DNA, 13 bp, Homo sapiens
tcatttcattcca

SEQ ID NO: 4651349 - DNA, 15 bp, Homo sapiens
tcatttccagcttct

SEQ ID NO: 4651350 - DNA, 18 bp, Homo sapiens
tcatttccagcttctcag

SEQ ID NO: 4651351 - DNA, 19 bp, Homo sapiens
tcatttctctttttatctc

SEQ ID NO: 4651352 - DNA, 21 bp, Homo sapiens
tcatttggaggaatcacccca

SEQ ID NO: 4651353 - DNA, 21 bp, Homo sapiens
tcatttggcagcccctgtttt

SEQ ID NO: 4651354 - DNA, 12 bp, Homo sapiens
tcatttgtttac

SEQ ID NO: 4651355 - DNA, 18 bp, Homo sapiens
tcattttaaaaactttat

SEQ ID NO: 4651356 - DNA, 19 bp, Homo sapiens
tcattttaaaaactttatt

SEQ ID NO: 4651357 - DNA, 20 bp, Homo sapiens
tcattttaacatgatttcaa

SEQ ID NO: 4651358 - DNA, 17 bp, Homo sapiens
tcattttagtgtatctt

SEQ ID NO: 4651359 - DNA, 12 bp, Homo sapiens
tcattttattca

SEQ ID NO: 4651360 - DNA, 13 bp, Homo sapiens
tcattttattcac

SEQ ID NO: 4651361 - DNA, 13 bp, Homo sapiens
tcattttccaata

SEQ ID NO: 4651362 - DNA, 13 bp, Homo sapiens
tcatttttaagaa

SEQ ID NO: 4651363 - DNA, 21 bp, Homo sapiens
tcatttttgtaggaagcattt

SEQ ID NO: 4651364 - DNA, 17 bp, Homo sapiens
tccaaaaatgtgtaaga

SEQ ID NO: 4651365 - DNA, 21 bp, Homo sapiens
tccaaaaatgtgtaagaacaa

SEQ ID NO: 4651366 - DNA, 23 bp, Homo sapiens
tccaaaagtggcctctttgtcta

SEQ ID NO: 4651367 - DNA, 14 bp, Homo sapiens
tccaaaccttcaca

SEQ ID NO: 4651368 - DNA, 20 bp, Homo sapiens
tccaaactgttctgagaagg

SEQ ID NO: 4651369 - DNA, 15 bp, Homo sapiens
tccaaagcagacagc

SEQ ID NO: 4651370 - DNA, 21 bp, Homo sapiens
tccaaaggcattttattgctt

SEQ ID NO: 4651371 - DNA, 18 bp, Homo sapiens
tccaaattaaaacaaata

SEQ ID NO: 4651372 - DNA, 23 bp, Homo sapiens
tccaacaccaagcacagcagcct

SEQ ID NO: 4651373 - DNA, 15 bp, Homo sapiens
tccaagcatttcatg

SEQ ID NO: 4651374 - DNA, 20 bp, Homo sapiens
tccaagcatttcatgaaaaa

SEQ ID NO: 4651375 - DNA, 15 bp, Homo sapiens
tccaaggaaacatgc

SEQ ID NO: 4651376 - DNA, 14 bp, Homo sapiens
tccaaggggcaaat

SEQ ID NO: 4651377 - DNA, 23 bp, Homo sapiens
tccaataagacactcaaatatga

SEQ ID NO: 4651378 - DNA, 19 bp, Homo sapiens
tccaatagttagatctacc

SEQ ID NO: 4651379 - DNA, 16 bp, Homo sapiens
tccaatcctccccgct

SEQ ID NO: 4651380 - DNA, 20 bp, Homo sapiens
tccaatgttagagacttttt

SEQ ID NO: 4651381 - DNA, 15 bp, Homo sapiens
tccacactgcaggga

SEQ ID NO: 4651382 - DNA, 17 bp, Homo sapiens
tccacagcaaccccagg

SEQ ID NO: 4651383 - DNA, 11 bp, Homo sapiens
tccaccactgt

SEQ ID NO: 4651384 - DNA, 15 bp, Homo sapiens
tccaccagcctgctg

SEQ ID NO: 4651385 - DNA, 12 bp, Homo sapiens
tccaccagggcc

SEQ ID NO: 4651386 - DNA, 14 bp, Homo sapiens
tccaccagggccag

SEQ ID NO: 4651387 - DNA, 15 bp, Homo sapiens
tccaccagggccaga

SEQ ID NO: 4651388 - DNA, 16 bp, Homo sapiens
tccaccagggccagag

SEQ ID NO: 4651389 - DNA, 18 bp, Homo sapiens
tccaccagggccagagca

SEQ ID NO: 4651390 - DNA, 18 bp, Homo sapiens
tccacctcacaactcctt

SEQ ID NO: 4651391 - DNA, 15 bp, Homo sapiens
tccacctccagcctc

SEQ ID NO: 4651392 - DNA, 16 bp, Homo sapiens
tccacctccagcctct

SEQ ID NO: 4651393 - DNA, 12 bp, Homo sapiens
tccacctgtggg

SEQ ID NO: 4651394 - DNA, 21 bp, Homo sapiens
tccaccttccgttccccgcta

SEQ ID NO: 4651395 - DNA, 18 bp, Homo sapiens
tccaccttgcacccgcaa

SEQ ID NO: 4651396 - DNA, 19 bp, Homo sapiens
tccacggatgcgtgggcag

SEQ ID NO: 4651397 - DNA, 20 bp, Homo sapiens
tccacggatgcgtgggcaga

SEQ ID NO: 4651398 - DNA, 18 bp, Homo sapiens
tccacggtctgttcttga

SEQ ID NO: 4651399 - DNA, 15 bp, Homo sapiens
tccactattttcaaa

SEQ ID NO: 4651400 - DNA, 18 bp, Homo sapiens
tccactattttcaaagaa

SEQ ID NO: 4651401 - DNA, 21 bp, Homo sapiens
tccactcagctgtcctgcagc

SEQ ID NO: 4651402 - DNA, 23 bp, Homo sapiens
tccacttcatttttaagaaagga

SEQ ID NO: 4651403 - DNA, 13 bp, Homo sapiens
tccacttgccctg

SEQ ID NO: 4651404 - DNA, 18 bp, Homo sapiens
tccagaagttcaaaatca

SEQ ID NO: 4651405 - DNA, 14 bp, Homo sapiens
tccagagacaacag

SEQ ID NO: 4651406 - DNA, 16 bp, Homo sapiens
tccagatgcagggcag

SEQ ID NO: 4651407 - DNA, 17 bp, Homo sapiens
tccagatgcagggcagt

SEQ ID NO: 4651408 - DNA, 12 bp, Homo sapiens
tccagcagcagc

SEQ ID NO: 4651409 - DNA, 13 bp, Homo sapiens
tccagcagcagca

SEQ ID NO: 4651410 - DNA, 20 bp, Homo sapiens
tccagcccctgtcccacccc

SEQ ID NO: 4651411 - DNA, 14 bp, Homo sapiens
tccagcctctggtc

SEQ ID NO: 4651412 - DNA, 12 bp, Homo sapiens
tccagccttttt

SEQ ID NO: 4651413 - DNA, 14 bp, Homo sapiens
tccagcttctcagt

SEQ ID NO: 4651414 - DNA, 22 bp, Homo sapiens
tccagcttctcagtttctgcct

SEQ ID NO: 4651415 - DNA, 23 bp, Homo sapiens
tccagcttctcagtttctgcctg

SEQ ID NO: 4651416 - DNA, 16 bp, Homo sapiens
tccaggagagagccag

SEQ ID NO: 4651417 - DNA, 21 bp, Homo sapiens
tccaggattttaatttcagga

SEQ ID NO: 4651418 - DNA, 13 bp, Homo sapiens
tccaggcaccagg

SEQ ID NO: 4651419 - DNA, 18 bp, Homo sapiens
tccagggtacatgcttta

SEQ ID NO: 4651420 - DNA, 14 bp, Homo sapiens
tccagggtctgagt

SEQ ID NO: 4651421 - DNA, 17 bp, Homo sapiens
tccagggtgtgtgctcg

SEQ ID NO: 4651422 - DNA, 15 bp, Homo sapiens
tccaggtcctggtgg

SEQ ID NO: 4651423 - DNA, 15 bp, Homo sapiens
tccaggttgatcttg

SEQ ID NO: 4651424 - DNA, 14 bp, Homo sapiens
tccagttaaccaag

SEQ ID NO: 4651425 - DNA, 18 bp, Homo sapiens
tccagttagagcccatta

SEQ ID NO: 4651426 - DNA, 17 bp, Homo sapiens
tccagttcctttagaaa

SEQ ID NO: 4651427 - DNA, 18 bp, Homo sapiens
tccagtttgcacctgtcc

SEQ ID NO: 4651428 - DNA, 19 bp, Homo sapiens
tccagtttgcacctgtccc

SEQ ID NO: 4651429 - DNA, 13 bp, Homo sapiens
tccataaagtaca

SEQ ID NO: 4651430 - DNA, 19 bp, Homo sapiens
tccataatttggtcatttg

SEQ ID NO: 4651431 - DNA, 21 bp, Homo sapiens
tccatagagatgagcccaccc

SEQ ID NO: 4651432 - DNA, 21 bp, Homo sapiens
tccatagcctaatccctgggc

SEQ ID NO: 4651433 - DNA, 22 bp, Homo sapiens
tccataggagggaaggagcagt

SEQ ID NO: 4651434 - DNA, 19 bp, Homo sapiens
tccataggtttctctccct

SEQ ID NO: 4651435 - DNA, 11 bp, Homo sapiens
tccatccaatc

SEQ ID NO: 4651436 - DNA, 19 bp, Homo sapiens
tccatcccaaccagtgcca

SEQ ID NO: 4651437 - DNA, 17 bp, Homo sapiens
tccatcctttgtcttgg

SEQ ID NO: 4651438 - DNA, 17 bp, Homo sapiens
tccatctctctcttgcc

SEQ ID NO: 4651439 - DNA, 16 bp, Homo sapiens
tccatcttgtttcatt

SEQ ID NO: 4651440 - DNA, 18 bp, Homo sapiens
tccatcttgtttcatttg

SEQ ID NO: 4651441 - DNA, 15 bp, Homo sapiens
tccatctttttcttg

SEQ ID NO: 4651442 - DNA, 16 bp, Homo sapiens
tccatctttttcttgg

SEQ ID NO: 4651443 - DNA, 21 bp, Homo sapiens
tccatgcaccctcatacacag

SEQ ID NO: 4651444 - DNA, 17 bp, Homo sapiens
tccatgctgcaaaggag

SEQ ID NO: 4651445 - DNA, 18 bp, Homo sapiens
tccatgtgattaatgttt

SEQ ID NO: 4651446 - DNA, 15 bp, Homo sapiens
tccatgttctcccaa

SEQ ID NO: 4651447 - DNA, 15 bp, Homo sapiens
tccattaggccagca

SEQ ID NO: 4651448 - DNA, 17 bp, Homo sapiens
tccattaggccagcaac

SEQ ID NO: 4651449 - DNA, 16 bp, Homo sapiens
tccattcccacccctc

SEQ ID NO: 4651450 - DNA, 13 bp, Homo sapiens
tccattccctagc

SEQ ID NO: 4651451 - DNA, 21 bp, Homo sapiens
tccattgaagccgactctggc

SEQ ID NO: 4651452 - DNA, 14 bp, Homo sapiens
tccattgtttgaaa

SEQ ID NO: 4651453 - DNA, 20 bp, Homo sapiens
tccattgtttgaaacaaaga

SEQ ID NO: 4651454 - DNA, 14 bp, Homo sapiens
tccatttaagacac

SEQ ID NO: 4651455 - DNA, 19 bp, Homo sapiens
tccattttaggtgataaaa

SEQ ID NO: 4651456 - DNA, 14 bp, Homo sapiens
tccattttccccca

SEQ ID NO: 4651457 - DNA, 17 bp, Homo sapiens
tcccaaaatgctgggat

SEQ ID NO: 4651458 - DNA, 21 bp, Homo sapiens
tcccaaaatggtgggattaca

SEQ ID NO: 4651459 - DNA, 14 bp, Homo sapiens
tcccaaccagtgcc

SEQ ID NO: 4651460 - DNA, 22 bp, Homo sapiens
tcccaaccccttaagccctggc

SEQ ID NO: 4651461 - DNA, 13 bp, Homo sapiens
tcccaactccctt

SEQ ID NO: 4651462 - DNA, 17 bp, Homo sapiens
tcccaactcccttctgc

SEQ ID NO: 4651463 - DNA, 19 bp, Homo sapiens
tcccaactcccttctgctt

SEQ ID NO: 4651464 - DNA, 16 bp, Homo sapiens
tcccaagctcccttcc

SEQ ID NO: 4651465 - DNA, 21 bp, Homo sapiens
tcccaaggagggggcctcatt

SEQ ID NO: 4651466 - DNA, 20 bp, Homo sapiens
tcccaagtagctgggattac

SEQ ID NO: 4651467 - DNA, 16 bp, Homo sapiens
tcccaagttgtgcttg

SEQ ID NO: 4651468 - DNA, 18 bp, Homo sapiens
tcccacaagcctgcctcg

SEQ ID NO: 4651469 - DNA, 13 bp, Homo sapiens
tcccacatccctg

SEQ ID NO: 4651470 - DNA, 14 bp, Homo sapiens
tcccacatccctgg

SEQ ID NO: 4651471 - DNA, 15 bp, Homo sapiens
tcccacatccctggg

SEQ ID NO: 4651472 - DNA, 18 bp, Homo sapiens
tcccacatccctgggcct

SEQ ID NO: 4651473 - DNA, 14 bp, Homo sapiens
tcccacatgaggcc

SEQ ID NO: 4651474 - DNA, 23 bp, Homo sapiens
tcccacatgaggccatctcagga

SEQ ID NO: 4651475 - DNA, 19 bp, Homo sapiens
tcccaccattcctgccttt

SEQ ID NO: 4651476 - DNA, 18 bp, Homo sapiens
tcccacccacatgtgaca

SEQ ID NO: 4651477 - DNA, 22 bp, Homo sapiens
tcccacccacatgtgacacata

SEQ ID NO: 4651478 - DNA, 15 bp, Homo sapiens
tcccacccaggaaag

SEQ ID NO: 4651479 - DNA, 20 bp, Homo sapiens
tcccacccaggaaaggagga

SEQ ID NO: 4651480 - DNA, 22 bp, Homo sapiens
tcccaccccattttctgtgggc

SEQ ID NO: 4651481 - DNA, 18 bp, Homo sapiens
tcccacccctcataccta

SEQ ID NO: 4651482 - DNA, 18 bp, Homo sapiens
tcccacgtctaactggaa

SEQ ID NO: 4651483 - DNA, 18 bp, Homo sapiens
tcccagcatccctggagc

SEQ ID NO: 4651484 - DNA, 14 bp, Homo sapiens
tcccagcccattgc

SEQ ID NO: 4651485 - DNA, 16 bp, Homo sapiens
tcccagcccattgctg

SEQ ID NO: 4651486 - DNA, 15 bp, Homo sapiens
tcccagcgctgctgg

SEQ ID NO: 4651487 - DNA, 15 bp, Homo sapiens
tcccagctgaaggca

SEQ ID NO: 4651488 - DNA, 10 bp, Homo sapiens
tcccaggagg

SEQ ID NO: 4651489 - DNA, 14 bp, Homo sapiens
tcccaggaggtgca

SEQ ID NO: 4651490 - DNA, 17 bp, Homo sapiens
tcccaggaggtgcagtg

SEQ ID NO: 4651491 - DNA, 11 bp, Homo sapiens
tcccaggatct

SEQ ID NO: 4651492 - DNA, 11 bp, Homo sapiens
tcccaggcccc

SEQ ID NO: 4651493 - DNA, 21 bp, Homo sapiens
tcccaggccccatgacctcca

SEQ ID NO: 4651494 - DNA, 22 bp, Homo sapiens
tcccaggccccatgacctccag

SEQ ID NO: 4651495 - DNA, 11 bp, Homo sapiens
tcccaggcctc

SEQ ID NO: 4651496 - DNA, 21 bp, Homo sapiens
tcccaggctgggctctgcctg

SEQ ID NO: 4651497 - DNA, 13 bp, Homo sapiens
tcccagggccctc

SEQ ID NO: 4651498 - DNA, 18 bp, Homo sapiens
tcccagggccctcccagc

SEQ ID NO: 4651499 - DNA, 14 bp, Homo sapiens
tcccatcctggggc

SEQ ID NO: 4651500 - DNA, 20 bp, Homo sapiens
tcccatgagactgccctgcc

SEQ ID NO: 4651501 - DNA, 23 bp, Homo sapiens
tccccaaaggaaccgcccagtgc

SEQ ID NO: 4651502 - DNA, 17 bp, Homo sapiens
tccccaagatctgccag

SEQ ID NO: 4651503 - DNA, 17 bp, Homo sapiens
tccccaaggacccagcc

SEQ ID NO: 4651504 - DNA, 17 bp, Homo sapiens
tccccaagggccctggc

SEQ ID NO: 4651505 - DNA, 20 bp, Homo sapiens
tccccaagggccctggcacc

SEQ ID NO: 4651506 - DNA, 18 bp, Homo sapiens
tccccactctgctctgat

SEQ ID NO: 4651507 - DNA, 11 bp, Homo sapiens
tccccactgcc

SEQ ID NO: 4651508 - DNA, 14 bp, Homo sapiens
tccccactgcccca

SEQ ID NO: 4651509 - DNA, 17 bp, Homo sapiens
tccccactgccccacgt

SEQ ID NO: 4651510 - DNA, 17 bp, Homo sapiens
tccccagaatggaggca

SEQ ID NO: 4651511 - DNA, 23 bp, Homo sapiens
tccccagagaaagcgcagatgct

SEQ ID NO: 4651512 - DNA, 15 bp, Homo sapiens
tccccagagctgtgc

SEQ ID NO: 4651513 - DNA, 17 bp, Homo sapiens
tccccagagctgtgcca

SEQ ID NO: 4651514 - DNA, 20 bp, Homo sapiens
tccccagagctgtgccagca

SEQ ID NO: 4651515 - DNA, 21 bp, Homo sapiens
tccccagcagggtcttttcat

SEQ ID NO: 4651516 - DNA, 14 bp, Homo sapiens
tccccagcccagga

SEQ ID NO: 4651517 - DNA, 15 bp, Homo sapiens
tccccagctccccca

SEQ ID NO: 4651518 - DNA, 20 bp, Homo sapiens
tccccagctcccccaggcag

SEQ ID NO: 4651519 - DNA, 20 bp, Homo sapiens
tccccaggggcatgactgtc

SEQ ID NO: 4651520 - DNA, 15 bp, Homo sapiens
tccccagtgcccggt

SEQ ID NO: 4651521 - DNA, 18 bp, Homo sapiens
tccccagtgcccggtgca

SEQ ID NO: 4651522 - DNA, 14 bp, Homo sapiens
tccccatctgtgtt

SEQ ID NO: 4651523 - DNA, 18 bp, Homo sapiens
tccccatgaaccctgccc

SEQ ID NO: 4651524 - DNA, 19 bp, Homo sapiens
tccccatgaaccctgccct

SEQ ID NO: 4651525 - DNA, 24 bp, Homo sapiens
tccccattagctttcaattccgta

SEQ ID NO: 4651526 - DNA, 16 bp, Homo sapiens
tcccccagcaaggcag

SEQ ID NO: 4651527 - DNA, 17 bp, Homo sapiens
tcccccagcaaggcaga

SEQ ID NO: 4651528 - DNA, 14 bp, Homo sapiens
tcccccaggcagaa

SEQ ID NO: 4651529 - DNA, 20 bp, Homo sapiens
tcccccctgctgcccagtgc

SEQ ID NO: 4651530 - DNA, 17 bp, Homo sapiens
tccccctcttcttctga

SEQ ID NO: 4651531 - DNA, 12 bp, Homo sapiens
tccccctgctcc

SEQ ID NO: 4651532 - DNA, 16 bp, Homo sapiens
tccccctttctctgcc

SEQ ID NO: 4651533 - DNA, 18 bp, Homo sapiens
tccccctttctctgcctg

SEQ ID NO: 4651534 - DNA, 19 bp, Homo sapiens
tccccctttctctgcctgg

SEQ ID NO: 4651535 - DNA, 14 bp, Homo sapiens
tccccgctctgccg

SEQ ID NO: 4651536 - DNA, 17 bp, Homo sapiens
tccccgtgggccatggc

SEQ ID NO: 4651537 - DNA, 18 bp, Homo sapiens
tcccctccccatctgtgt

SEQ ID NO: 4651538 - DNA, 21 bp, Homo sapiens
tcccctccccatctgtgttct

SEQ ID NO: 4651539 - DNA, 13 bp, Homo sapiens
tcccctccttggc

SEQ ID NO: 4651540 - DNA, 17 bp, Homo sapiens
tcccctgcccctcacaa

SEQ ID NO: 4651541 - DNA, 16 bp, Homo sapiens
tcccctgccttaacct

SEQ ID NO: 4651542 - DNA, 20 bp, Homo sapiens
tcccctgccttaacctggga

SEQ ID NO: 4651543 - DNA, 20 bp, Homo sapiens
tcccctgggaactctcctgg

SEQ ID NO: 4651544 - DNA, 21 bp, Homo sapiens
tcccctgggaactctcctggc

SEQ ID NO: 4651545 - DNA, 22 bp, Homo sapiens
tcccctgggactttcccaccca

SEQ ID NO: 4651546 - DNA, 15 bp, Homo sapiens
tcccgcccagcctca

SEQ ID NO: 4651547 - DNA, 16 bp, Homo sapiens
tcccgcccagcctcac

SEQ ID NO: 4651548 - DNA, 19 bp, Homo sapiens
tcccgcccagcctcacttc

SEQ ID NO: 4651549 - DNA, 16 bp, Homo sapiens
tcccgtggaacgtttt

SEQ ID NO: 4651550 - DNA, 22 bp, Homo sapiens
tccctaatagctttttaaaaaa

SEQ ID NO: 4651551 - DNA, 14 bp, Homo sapiens
tccctacacagggc

SEQ ID NO: 4651552 - DNA, 14 bp, Homo sapiens
tccctaggcccaag

SEQ ID NO: 4651553 - DNA, 17 bp, Homo sapiens
tccctatatcagggcct

SEQ ID NO: 4651554 - DNA, 20 bp, Homo sapiens
tccctatatcagggcctgag

SEQ ID NO: 4651555 - DNA, 22 bp, Homo sapiens
tccctatatcagggcctgagtg

SEQ ID NO: 4651556 - DNA, 13 bp, Homo sapiens
tccctccaccagc

SEQ ID NO: 4651557 - DNA, 18 bp, Homo sapiens
tccctccaccagcctgct

SEQ ID NO: 4651558 - DNA, 15 bp, Homo sapiens
tccctcctttagtga

SEQ ID NO: 4651559 - DNA, 11 bp, Homo sapiens
tccctcctttc

SEQ ID NO: 4651560 - DNA, 13 bp, Homo sapiens
tccctctagtgcc

SEQ ID NO: 4651561 - DNA, 20 bp, Homo sapiens
tccctctccataaccccacc

SEQ ID NO: 4651562 - DNA, 13 bp, Homo sapiens
tccctctctcctg

SEQ ID NO: 4651563 - DNA, 20 bp, Homo sapiens
tccctctgcattgacctgga

SEQ ID NO: 4651564 - DNA, 23 bp, Homo sapiens
tccctctgcctgggatgcccttc

SEQ ID NO: 4651565 - DNA, 19 bp, Homo sapiens
tccctcttctggtttccct

SEQ ID NO: 4651566 - DNA, 22 bp, Homo sapiens
tccctcttgtcagtgtagacac

SEQ ID NO: 4651567 - DNA, 14 bp, Homo sapiens
tccctgactggcca

SEQ ID NO: 4651568 - DNA, 15 bp, Homo sapiens
tccctgcagggccat

SEQ ID NO: 4651569 - DNA, 14 bp, Homo sapiens
tccctgccccttaa

SEQ ID NO: 4651570 - DNA, 17 bp, Homo sapiens
tccctgcctcacatctc

SEQ ID NO: 4651571 - DNA, 11 bp, Homo sapiens
tccctgctgaa

SEQ ID NO: 4651572 - DNA, 15 bp, Homo sapiens
tccctgctgaatgcc

SEQ ID NO: 4651573 - DNA, 21 bp, Homo sapiens
tccctgctgtgccatgctggg

SEQ ID NO: 4651574 - DNA, 22 bp, Homo sapiens
tccctgctgtgccatgctgggc

SEQ ID NO: 4651575 - DNA, 18 bp, Homo sapiens
tccctggaaggacatcca

SEQ ID NO: 4651576 - DNA, 16 bp, Homo sapiens
tccctggagcaggagc

SEQ ID NO: 4651577 - DNA, 17 bp, Homo sapiens
tccctggagcaggagcc

SEQ ID NO: 4651578 - DNA, 23 bp, Homo sapiens
tccctggagcaggagccccgcca

SEQ ID NO: 4651579 - DNA, 19 bp, Homo sapiens
tccctggagggcaagccct

SEQ ID NO: 4651580 - DNA, 21 bp, Homo sapiens
tccctggagggcaagccctgc

SEQ ID NO: 4651581 - DNA, 22 bp, Homo sapiens
tccctggagggcaagccctgcc

SEQ ID NO: 4651582 - DNA, 18 bp, Homo sapiens
tccctgggcattgctttc

SEQ ID NO: 4651583 - DNA, 12 bp, Homo sapiens
tccctgggcctg

SEQ ID NO: 4651584 - DNA, 15 bp, Homo sapiens
tccctgggcctgctg

SEQ ID NO: 4651585 - DNA, 16 bp, Homo sapiens
tccctgggcctgctgc

SEQ ID NO: 4651586 - DNA, 17 bp, Homo sapiens
tccctgggcctgctgct

SEQ ID NO: 4651587 - DNA, 18 bp, Homo sapiens
tccctgggcctgctgctg

SEQ ID NO: 4651588 - DNA, 20 bp, Homo sapiens
tccctggggctagggggagc

SEQ ID NO: 4651589 - DNA, 21 bp, Homo sapiens
tccctggtgagagggccgggc

SEQ ID NO: 4651590 - DNA, 13 bp, Homo sapiens
tccctgtaatatt

SEQ ID NO: 4651591 - DNA, 14 bp, Homo sapiens
tcccttaagaagtt

SEQ ID NO: 4651592 - DNA, 14 bp, Homo sapiens
tcccttacccatct

SEQ ID NO: 4651593 - DNA, 19 bp, Homo sapiens
tcccttacccatcttgctt

SEQ ID NO: 4651594 - DNA, 21 bp, Homo sapiens
tcccttattagttacaaagtt

SEQ ID NO: 4651595 - DNA, 20 bp, Homo sapiens
tcccttgctttttgctgtgt

SEQ ID NO: 4651596 - DNA, 18 bp, Homo sapiens
tcccttttaatcctggct

SEQ ID NO: 4651597 - DNA, 22 bp, Homo sapiens
tcccttttataattaatgtttg

SEQ ID NO: 4651598 - DNA, 23 bp, Homo sapiens
tcccttttataattaatgtttgt

SEQ ID NO: 4651599 - DNA, 19 bp, Homo sapiens
tccgaacctcctctgtgaa

SEQ ID NO: 4651600 - DNA, 12 bp, Homo sapiens
tccgattaattt

SEQ ID NO: 4651601 - DNA, 17 bp, Homo sapiens
tccgcaccctccctagc

SEQ ID NO: 4651602 - DNA, 19 bp, Homo sapiens
tccgcaccctccctagctc

SEQ ID NO: 4651603 - DNA, 17 bp, Homo sapiens
tccgcatgatgtttccc

SEQ ID NO: 4651604 - DNA, 14 bp, Homo sapiens
tccgccagccacag

SEQ ID NO: 4651605 - DNA, 15 bp, Homo sapiens
tccgccagccacagg

SEQ ID NO: 4651606 - DNA, 16 bp, Homo sapiens
tccgcgccgatgccac

SEQ ID NO: 4651607 - DNA, 19 bp, Homo sapiens
tccgctgaggggtctcgga

SEQ ID NO: 4651608 - DNA, 18 bp, Homo sapiens
tccgctttgaaagaagca

SEQ ID NO: 4651609 - DNA, 20 bp, Homo sapiens
tccgctttgaaagaagcaag

SEQ ID NO: 4651610 - DNA, 21 bp, Homo sapiens
tccgctttgaaagaagcaaga

SEQ ID NO: 4651611 - DNA, 17 bp, Homo sapiens
tccgtgaggcagggaca

SEQ ID NO: 4651612 - DNA, 21 bp, Homo sapiens
tccgtttattataaactgtat

SEQ ID NO: 4651613 - DNA, 17 bp, Homo sapiens
tcctaaagaagacattt

SEQ ID NO: 4651614 - DNA, 18 bp, Homo sapiens
tcctaacatgcaccttgc

SEQ ID NO: 4651615 - DNA, 12 bp, Homo sapiens
tcctaccaaagt

SEQ ID NO: 4651616 - DNA, 22 bp, Homo sapiens
tcctagccaggtctcctgggaa

SEQ ID NO: 4651617 - DNA, 19 bp, Homo sapiens
tcctagtaagtcaggacag

SEQ ID NO: 4651618 - DNA, 23 bp, Homo sapiens
tcctataagatctgtttttggac

SEQ ID NO: 4651619 - DNA, 17 bp, Homo sapiens
tcctatagtcgtgggtg

SEQ ID NO: 4651620 - DNA, 14 bp, Homo sapiens
tcctatatatttct

SEQ ID NO: 4651621 - DNA, 17 bp, Homo sapiens
tcctatatatttctatt

SEQ ID NO: 4651622 - DNA, 19 bp, Homo sapiens
tcctatgatggatggcaga

SEQ ID NO: 4651623 - DNA, 21 bp, Homo sapiens
tcctatgatggatggcagact

SEQ ID NO: 4651624 - DNA, 23 bp, Homo sapiens
tcctatgatggatggcagactct

SEQ ID NO: 4651625 - DNA, 21 bp, Homo sapiens
tcctatgtgattttaactctg

SEQ ID NO: 4651626 - DNA, 23 bp, Homo sapiens
tcctatgtgattttaactctgtc

SEQ ID NO: 4651627 - DNA, 19 bp, Homo sapiens
tcctattttgcataataaa

SEQ ID NO: 4651628 - DNA, 23 bp, Homo sapiens
tcctcaagaaataaaaggaagcc

SEQ ID NO: 4651629 - DNA, 19 bp, Homo sapiens
tcctcacacaccctgaggt

SEQ ID NO: 4651630 - DNA, 23 bp, Homo sapiens
tcctcactccctaggcccaagtc

SEQ ID NO: 4651631 - DNA, 15 bp, Homo sapiens
tcctcagcaggccaa

SEQ ID NO: 4651632 - DNA, 21 bp, Homo sapiens
tcctcagtgcaaaatgtcttg

SEQ ID NO: 4651633 - DNA, 18 bp, Homo sapiens
tcctcagttcctgcagca

SEQ ID NO: 4651634 - DNA, 13 bp, Homo sapiens
tcctcatccctga

SEQ ID NO: 4651635 - DNA, 15 bp, Homo sapiens
tcctccatcttctgg

SEQ ID NO: 4651636 - DNA, 14 bp, Homo sapiens
tcctccccctgcaa

SEQ ID NO: 4651637 - DNA, 22 bp, Homo sapiens
tcctcccgccaggagcttcttc

SEQ ID NO: 4651638 - DNA, 13 bp, Homo sapiens
tcctccctagctc

SEQ ID NO: 4651639 - DNA, 17 bp, Homo sapiens
tcctcctgagtagctgg

SEQ ID NO: 4651640 - DNA, 20 bp, Homo sapiens
tcctcctgagtagctgggat

SEQ ID NO: 4651641 - DNA, 13 bp, Homo sapiens
tcctcctgccttt

SEQ ID NO: 4651642 - DNA, 17 bp, Homo sapiens
tcctccttggtgcctgg

SEQ ID NO: 4651643 - DNA, 19 bp, Homo sapiens
tcctcgttctccctgggag

SEQ ID NO: 4651644 - DNA, 14 bp, Homo sapiens
tcctctcatttcca

SEQ ID NO: 4651645 - DNA, 21 bp, Homo sapiens
tcctctcatttccagcttctc

SEQ ID NO: 4651646 - DNA, 13 bp, Homo sapiens
tcctctccaccct

SEQ ID NO: 4651647 - DNA, 23 bp, Homo sapiens
tcctctccattttagcccagtgt

SEQ ID NO: 4651648 - DNA, 20 bp, Homo sapiens
tcctctctccctgcctcaca

SEQ ID NO: 4651649 - DNA, 22 bp, Homo sapiens
tcctctctccctgcctcacatc

SEQ ID NO: 4651650 - DNA, 20 bp, Homo sapiens
tcctctgatagctgtttcaa

SEQ ID NO: 4651651 - DNA, 21 bp, Homo sapiens
tcctctgatagctgtttcaaa

SEQ ID NO: 4651652 - DNA, 21 bp, Homo sapiens
tcctctgtcagtcacagccac

SEQ ID NO: 4651653 - DNA, 15 bp, Homo sapiens
tcctctgtctcgagc

SEQ ID NO: 4651654 - DNA, 12 bp, Homo sapiens
tcctctgtgaag

SEQ ID NO: 4651655 - DNA, 14 bp, Homo sapiens
tcctcttcctgccc

SEQ ID NO: 4651656 - DNA, 15 bp, Homo sapiens
tcctcttcctgccct

SEQ ID NO: 4651657 - DNA, 22 bp, Homo sapiens
tcctcttctaaaatagcaataa

SEQ ID NO: 4651658 - DNA, 23 bp, Homo sapiens
tcctcttctaaaatagcaataac

SEQ ID NO: 4651659 - DNA, 17 bp, Homo sapiens
tcctcttctgcatcttg

SEQ ID NO: 4651660 - DNA, 22 bp, Homo sapiens
tcctctttgagaccccagtgcc

SEQ ID NO: 4651661 - DNA, 15 bp, Homo sapiens
tcctgacattgtctc

SEQ ID NO: 4651662 - DNA, 22 bp, Homo sapiens
tcctgaccaggatggagcaagc

SEQ ID NO: 4651663 - DNA, 18 bp, Homo sapiens
tcctgacggcgccttttt

SEQ ID NO: 4651664 - DNA, 13 bp, Homo sapiens
tcctgagcactgc

SEQ ID NO: 4651665 - DNA, 15 bp, Homo sapiens
tcctgagcactgcca

SEQ ID NO: 4651666 - DNA, 18 bp, Homo sapiens
tcctgagcactgccagga

SEQ ID NO: 4651667 - DNA, 14 bp, Homo sapiens
tcctgagtagctgg

SEQ ID NO: 4651668 - DNA, 15 bp, Homo sapiens
tcctgatcagaggca

SEQ ID NO: 4651669 - DNA, 20 bp, Homo sapiens
tcctgatcagaggcatttga

SEQ ID NO: 4651670 - DNA, 20 bp, Homo sapiens
tcctgcagcaaacactccac

SEQ ID NO: 4651671 - DNA, 16 bp, Homo sapiens
tcctgcagcagagcct

SEQ ID NO: 4651672 - DNA, 14 bp, Homo sapiens
tcctgccagcccag

SEQ ID NO: 4651673 - DNA, 15 bp, Homo sapiens
tcctgccagcccagc

SEQ ID NO: 4651674 - DNA, 16 bp, Homo sapiens
tcctgcccgagggcag

SEQ ID NO: 4651675 - DNA, 18 bp, Homo sapiens
tcctgcccgagggcagcc

SEQ ID NO: 4651676 - DNA, 20 bp, Homo sapiens
tcctgcccgagggcagcccc

SEQ ID NO: 4651677 - DNA, 20 bp, Homo sapiens
tcctgcccgcagacctctgg

SEQ ID NO: 4651678 - DNA, 23 bp, Homo sapiens
tcctgcccttgaaccccctccct

SEQ ID NO: 4651679 - DNA, 14 bp, Homo sapiens
tcctgcctcagcct

SEQ ID NO: 4651680 - DNA, 21 bp, Homo sapiens
tcctgcctcagcctcccgagt

SEQ ID NO: 4651681 - DNA, 16 bp, Homo sapiens
tcctgcctctactggg

SEQ ID NO: 4651682 - DNA, 14 bp, Homo sapiens
tcctgcctttaagc

SEQ ID NO: 4651683 - DNA, 16 bp, Homo sapiens
tcctgcctttaagcca

SEQ ID NO: 4651684 - DNA, 17 bp, Homo sapiens
tcctgcctttaagccaa

SEQ ID NO: 4651685 - DNA, 18 bp, Homo sapiens
tcctgcctttaagccaaa

SEQ ID NO: 4651686 - DNA, 23 bp, Homo sapiens
tcctgcctttaagccaaagaaac

SEQ ID NO: 4651687 - DNA, 10 bp, Homo sapiens
tcctgctggg

SEQ ID NO: 4651688 - DNA, 13 bp, Homo sapiens
tcctgctgggcag

SEQ ID NO: 4651689 - DNA, 13 bp, Homo sapiens
tcctgctggtacc

SEQ ID NO: 4651690 - DNA, 14 bp, Homo sapiens
tcctgctggtacct

SEQ ID NO: 4651691 - DNA, 18 bp, Homo sapiens
tcctgcttctcctgatcc

SEQ ID NO: 4651692 - DNA, 13 bp, Homo sapiens
tcctgctttggga

SEQ ID NO: 4651693 - DNA, 14 bp, Homo sapiens
tcctggacagctgt

SEQ ID NO: 4651694 - DNA, 18 bp, Homo sapiens
tcctggacagctgtgcct

SEQ ID NO: 4651695 - DNA, 14 bp, Homo sapiens
tcctggactggtta

SEQ ID NO: 4651696 - DNA, 22 bp, Homo sapiens
tcctggactggttatcttgtta

SEQ ID NO: 4651697 - DNA, 19 bp, Homo sapiens
tcctggcacagaagaggag

SEQ ID NO: 4651698 - DNA, 16 bp, Homo sapiens
tcctggcctcagagct

SEQ ID NO: 4651699 - DNA, 17 bp, Homo sapiens
tcctggcctcagagctt

SEQ ID NO: 4651700 - DNA, 13 bp, Homo sapiens
tcctggctcagcc

SEQ ID NO: 4651701 - DNA, 20 bp, Homo sapiens
tcctggcttcccatccccag

SEQ ID NO: 4651702 - DNA, 22 bp, Homo sapiens
tcctggcttcccatccccagcg

SEQ ID NO: 4651703 - DNA, 20 bp, Homo sapiens
tcctggggcagcactcccca

SEQ ID NO: 4651704 - DNA, 23 bp, Homo sapiens
tcctgggggaagaggagatgtga

SEQ ID NO: 4651705 - DNA, 22 bp, Homo sapiens
tcctgggtggctactctgtgcc

SEQ ID NO: 4651706 - DNA, 22 bp, Homo sapiens
tcctgtagttgcgtggactctg

SEQ ID NO: 4651707 - DNA, 18 bp, Homo sapiens
tcctgtgacagtgaaata

SEQ ID NO: 4651708 - DNA, 12 bp, Homo sapiens
tcctgtgctggg

SEQ ID NO: 4651709 - DNA, 14 bp, Homo sapiens
tcctgtgctggggg

SEQ ID NO: 4651710 - DNA, 13 bp, Homo sapiens
tcctgtggctccc

SEQ ID NO: 4651711 - DNA, 15 bp, Homo sapiens
tcctgtggctccctc

SEQ ID NO: 4651712 - DNA, 13 bp, Homo sapiens
tcctgtgggagcc

SEQ ID NO: 4651713 - DNA, 14 bp, Homo sapiens
tcctgtgggagcct

SEQ ID NO: 4651714 - DNA, 16 bp, Homo sapiens
tcctgtgggagcctcg

SEQ ID NO: 4651715 - DNA, 15 bp, Homo sapiens
tcctgtggggaaagg

SEQ ID NO: 4651716 - DNA, 13 bp, Homo sapiens
tcctgtgtttcat

SEQ ID NO: 4651717 - DNA, 17 bp, Homo sapiens
tcctgtgtttcattact

SEQ ID NO: 4651718 - DNA, 17 bp, Homo sapiens
tccttaaagagtgtggc

SEQ ID NO: 4651719 - DNA, 21 bp, Homo sapiens
tccttaagtatatcatgtaaa

SEQ ID NO: 4651720 - DNA, 14 bp, Homo sapiens
tccttacaatgtga

SEQ ID NO: 4651721 - DNA, 14 bp, Homo sapiens
tccttactcctgtg

SEQ ID NO: 4651722 - DNA, 16 bp, Homo sapiens
tccttactcctgtggg

SEQ ID NO: 4651723 - DNA, 17 bp, Homo sapiens
tccttaggcctctgaga

SEQ ID NO: 4651724 - DNA, 16 bp, Homo sapiens
tccttatcctagcctt

SEQ ID NO: 4651725 - DNA, 22 bp, Homo sapiens
tccttatcctagcctttgggca

SEQ ID NO: 4651726 - DNA, 14 bp, Homo sapiens
tccttccatgctcc

SEQ ID NO: 4651727 - DNA, 18 bp, Homo sapiens
tccttccatgctcccaac

SEQ ID NO: 4651728 - DNA, 12 bp, Homo sapiens
tccttccccagc

SEQ ID NO: 4651729 - DNA, 14 bp, Homo sapiens
tccttccccagctc

SEQ ID NO: 4651730 - DNA, 15 bp, Homo sapiens
tccttccccagctcc

SEQ ID NO: 4651731 - DNA, 19 bp, Homo sapiens
tccttcgaaaggccttcag

SEQ ID NO: 4651732 - DNA, 21 bp, Homo sapiens
tccttcgaaaggccttcagac

SEQ ID NO: 4651733 - DNA, 20 bp, Homo sapiens
tccttgactgaagcgaacat

SEQ ID NO: 4651734 - DNA, 21 bp, Homo sapiens
tccttgaggggcagtttggga

SEQ ID NO: 4651735 - DNA, 12 bp, Homo sapiens
tccttgcccagg

SEQ ID NO: 4651736 - DNA, 13 bp, Homo sapiens
tccttgcccaggt

SEQ ID NO: 4651737 - DNA, 22 bp, Homo sapiens
tccttggactgttttgaaaagt

SEQ ID NO: 4651738 - DNA, 17 bp, Homo sapiens
tccttggctttatgcaa

SEQ ID NO: 4651739 - DNA, 21 bp, Homo sapiens
tccttggctttatgcaaatac

SEQ ID NO: 4651740 - DNA, 14 bp, Homo sapiens
tccttggtgcctgg

SEQ ID NO: 4651741 - DNA, 18 bp, Homo sapiens
tccttggtgcctggcctg

SEQ ID NO: 4651742 - DNA, 13 bp, Homo sapiens
tccttggttcatg

SEQ ID NO: 4651743 - DNA, 16 bp, Homo sapiens
tccttggttcatgctt

SEQ ID NO: 4651744 - DNA, 20 bp, Homo sapiens
tccttgtcagggtctccttc

SEQ ID NO: 4651745 - DNA, 22 bp, Homo sapiens
tcctttcaataaagttgttgca

SEQ ID NO: 4651746 - DNA, 21 bp, Homo sapiens
tcctttcaattccaccagggc

SEQ ID NO: 4651747 - DNA, 18 bp, Homo sapiens
tcctttgaacctgtgcaa

SEQ ID NO: 4651748 - DNA, 15 bp, Homo sapiens
tcctttgcccttcct

SEQ ID NO: 4651749 - DNA, 15 bp, Homo sapiens
tcctttgtagctact

SEQ ID NO: 4651750 - DNA, 21 bp, Homo sapiens
tccttttaaagaagctttatc

SEQ ID NO: 4651751 - DNA, 12 bp, Homo sapiens
tcctttttaagg

SEQ ID NO: 4651752 - DNA, 14 bp, Homo sapiens
tcgaatttgaagag

SEQ ID NO: 4651753 - DNA, 14 bp, Homo sapiens
tcgacaagaatgtc

SEQ ID NO: 4651754 - DNA, 17 bp, Homo sapiens
tcgaccctgtcccctag

SEQ ID NO: 4651755 - DNA, 19 bp, Homo sapiens
tcgaccctgtcccctaggg

SEQ ID NO: 4651756 - DNA, 18 bp, Homo sapiens
tcgagaaacagcctgtgt

SEQ ID NO: 4651757 - DNA, 14 bp, Homo sapiens
tcgagcgccctgca

SEQ ID NO: 4651758 - DNA, 15 bp, Homo sapiens
tcgagcgccctgcag

SEQ ID NO: 4651759 - DNA, 17 bp, Homo sapiens
tcgagcgccctgcagac

SEQ ID NO: 4651760 - DNA, 17 bp, Homo sapiens
tcgattcccaagctccc

SEQ ID NO: 4651761 - DNA, 14 bp, Homo sapiens
tcgcacacacccat

SEQ ID NO: 4651762 - DNA, 10 bp, Homo sapiens
tcgcagccac

SEQ ID NO: 4651763 - DNA, 13 bp, Homo sapiens
tcgcagccaccct

SEQ ID NO: 4651764 - DNA, 14 bp, Homo sapiens
tcgcagccaccctg

SEQ ID NO: 4651765 - DNA, 13 bp, Homo sapiens
tcgcccctcagag

SEQ ID NO: 4651766 - DNA, 15 bp, Homo sapiens
tcgcccctcagagca

SEQ ID NO: 4651767 - DNA, 16 bp, Homo sapiens
tcgcccctcagagcat

SEQ ID NO: 4651768 - DNA, 17 bp, Homo sapiens
tcgcccctcagagcatg

SEQ ID NO: 4651769 - DNA, 18 bp, Homo sapiens
tcgcccctcagagcatga

SEQ ID NO: 4651770 - DNA, 22 bp, Homo sapiens
tcgcctgagggaagagtagctg

SEQ ID NO: 4651771 - DNA, 14 bp, Homo sapiens
tcgccttgtgttac

SEQ ID NO: 4651772 - DNA, 14 bp, Homo sapiens
tcgctccccactct

SEQ ID NO: 4651773 - DNA, 15 bp, Homo sapiens
tcgctccccactctg

SEQ ID NO: 4651774 - DNA, 18 bp, Homo sapiens
tcgctccccactctgctc

SEQ ID NO: 4651775 - DNA, 17 bp, Homo sapiens
tcgctcttgaggagctc

SEQ ID NO: 4651776 - DNA, 14 bp, Homo sapiens
tcgctgaaattgct

SEQ ID NO: 4651777 - DNA, 15 bp, Homo sapiens
tcgcttttggtattt

SEQ ID NO: 4651778 - DNA, 16 bp, Homo sapiens
tcgctttttcatcctt

SEQ ID NO: 4651779 - DNA, 21 bp, Homo sapiens
tcggacatgcttttctgccac

SEQ ID NO: 4651780 - DNA, 13 bp, Homo sapiens
tcggaggaagccc

SEQ ID NO: 4651781 - DNA, 20 bp, Homo sapiens
tcggagggatggagaaagaa

SEQ ID NO: 4651782 - DNA, 21 bp, Homo sapiens
tcggagggatggagaaagaag

SEQ ID NO: 4651783 - DNA, 22 bp, Homo sapiens
tcggccaagaatacttgaagaa

SEQ ID NO: 4651784 - DNA, 23 bp, Homo sapiens
tcggccaagatgtacttctctgt

SEQ ID NO: 4651785 - DNA, 15 bp, Homo sapiens
tcggcctcccaaaat

SEQ ID NO: 4651786 - DNA, 15 bp, Homo sapiens
tcgggcatgagtctg

SEQ ID NO: 4651787 - DNA, 22 bp, Homo sapiens
tcgggccccatcctcatccctg

SEQ ID NO: 4651788 - DNA, 23 bp, Homo sapiens
tcgggccccatcctcatccctga

SEQ ID NO: 4651789 - DNA, 13 bp, Homo sapiens
tcggggtccctgg

SEQ ID NO: 4651790 - DNA, 14 bp, Homo sapiens
tcgtcaccccagcc

SEQ ID NO: 4651791 - DNA, 21 bp, Homo sapiens
tcgtcatgttggccaggctgg

SEQ ID NO: 4651792 - DNA, 15 bp, Homo sapiens
tcgtccttactcctg

SEQ ID NO: 4651793 - DNA, 14 bp, Homo sapiens
tcgtgagctgggga

SEQ ID NO: 4651794 - DNA, 13 bp, Homo sapiens
tcgtgaggggcaa

SEQ ID NO: 4651795 - DNA, 11 bp, Homo sapiens
tcgtgatgtgg

SEQ ID NO: 4651796 - DNA, 24 bp, Homo sapiens
tcgtggagagctaggagcaaagcc

SEQ ID NO: 4651797 - DNA, 12 bp, Homo sapiens
tctaaaatagca

SEQ ID NO: 4651798 - DNA, 15 bp, Homo sapiens
tctaaaatagcaata

SEQ ID NO: 4651799 - DNA, 16 bp, Homo sapiens
tctaaactaggattga

SEQ ID NO: 4651800 - DNA, 17 bp, Homo sapiens
tctaaagcagcaggtct

SEQ ID NO: 4651801 - DNA, 21 bp, Homo sapiens
tctaaataaaaatatgtaatt

SEQ ID NO: 4651802 - DNA, 12 bp, Homo sapiens
tctaaatgaaag

SEQ ID NO: 4651803 - DNA, 17 bp, Homo sapiens
tctaaccacggttattt

SEQ ID NO: 4651804 - DNA, 20 bp, Homo sapiens
tctaaccacggttatttaag

SEQ ID NO: 4651805 - DNA, 15 bp, Homo sapiens
tctaacccaagacat

SEQ ID NO: 4651806 - DNA, 21 bp, Homo sapiens
tctaactgatgagtaaactga

SEQ ID NO: 4651807 - DNA, 16 bp, Homo sapiens
tctaaggtactgtggg

SEQ ID NO: 4651808 - DNA, 17 bp, Homo sapiens
tctaaggtactgtgggg

SEQ ID NO: 4651809 - DNA, 14 bp, Homo sapiens
tctaagtgtacttc

SEQ ID NO: 4651810 - DNA, 13 bp, Homo sapiens
tctaataaagcca

SEQ ID NO: 4651811 - DNA, 15 bp, Homo sapiens
tctaataaagccatt

SEQ ID NO: 4651812 - DNA, 16 bp, Homo sapiens
tctaatacctctgtgt

SEQ ID NO: 4651813 - DNA, 20 bp, Homo sapiens
tctaatacctctgtgtgctc

SEQ ID NO: 4651814 - DNA, 20 bp, Homo sapiens
tctaatgcatatttataaga

SEQ ID NO: 4651815 - DNA, 16 bp, Homo sapiens
tctaatgtgactgttg

SEQ ID NO: 4651816 - DNA, 12 bp, Homo sapiens
tctaattgtaag

SEQ ID NO: 4651817 - DNA, 19 bp, Homo sapiens
tctacactcttgtaataaa

SEQ ID NO: 4651818 - DNA, 15 bp, Homo sapiens
tctacagtaatgaaa

SEQ ID NO: 4651819 - DNA, 17 bp, Homo sapiens
tctacattaaaatgaca

SEQ ID NO: 4651820 - DNA, 19 bp, Homo sapiens
tctacattaaaatgacaaa

SEQ ID NO: 4651821 - DNA, 22 bp, Homo sapiens
tctacattaaaatgacaaacat

SEQ ID NO: 4651822 - DNA, 15 bp, Homo sapiens
tctacccgttccaaa

SEQ ID NO: 4651823 - DNA, 15 bp, Homo sapiens
tctacctggtctggt

SEQ ID NO: 4651824 - DNA, 15 bp, Homo sapiens
tctactccctcttgt

SEQ ID NO: 4651825 - DNA, 12 bp, Homo sapiens
tctactcctccc

SEQ ID NO: 4651826 - DNA, 17 bp, Homo sapiens
tctactctagatggcaa

SEQ ID NO: 4651827 - DNA, 15 bp, Homo sapiens
tctactctttttgtt

SEQ ID NO: 4651828 - DNA, 12 bp, Homo sapiens
tctactgtgaca

SEQ ID NO: 4651829 - DNA, 22 bp, Homo sapiens
tctacttgtcatatcactaaat

SEQ ID NO: 4651830 - DNA, 22 bp, Homo sapiens
tctagagagggaattctcttgg

SEQ ID NO: 4651831 - DNA, 23 bp, Homo sapiens
tctagagagggaattctcttggc

SEQ ID NO: 4651832 - DNA, 13 bp, Homo sapiens
tctagagctttta

SEQ ID NO: 4651833 - DNA, 14 bp, Homo sapiens
tctagataaccttg

SEQ ID NO: 4651834 - DNA, 23 bp, Homo sapiens
tctagatacaggactggttcctt

SEQ ID NO: 4651835 - DNA, 15 bp, Homo sapiens
tctaggaatggagga

SEQ ID NO: 4651836 - DNA, 12 bp, Homo sapiens
tctaggccaccc

SEQ ID NO: 4651837 - DNA, 14 bp, Homo sapiens
tctaggttatacaa

SEQ ID NO: 4651838 - DNA, 15 bp, Homo sapiens
tctaggttatacaat

SEQ ID NO: 4651839 - DNA, 18 bp, Homo sapiens
tctaggttatacaataac

SEQ ID NO: 4651840 - DNA, 23 bp, Homo sapiens
tctaggttatacaataacccagt

SEQ ID NO: 4651841 - DNA, 16 bp, Homo sapiens
tctagtcattgtcata

SEQ ID NO: 4651842 - DNA, 18 bp, Homo sapiens
tctagtccgtcctggcac

SEQ ID NO: 4651843 - DNA, 21 bp, Homo sapiens
tctagtgggttgacctttaaa

SEQ ID NO: 4651844 - DNA, 14 bp, Homo sapiens
tctagtttctcaaa

SEQ ID NO: 4651845 - DNA, 19 bp, Homo sapiens
tctataaatttaagaaaac

SEQ ID NO: 4651846 - DNA, 21 bp, Homo sapiens
tctataaatttaagaaaacaa

SEQ ID NO: 4651847 - DNA, 16 bp, Homo sapiens
tctataagtagtaaat

SEQ ID NO: 4651848 - DNA, 22 bp, Homo sapiens
tctataagtagtaaatcagaaa

SEQ ID NO: 4651849 - DNA, 15 bp, Homo sapiens
tctatactaatgctt

SEQ ID NO: 4651850 - DNA, 16 bp, Homo sapiens
tctatactaatgctta

SEQ ID NO: 4651851 - DNA, 18 bp, Homo sapiens
tctatactaatgcttaca

SEQ ID NO: 4651852 - DNA, 21 bp, Homo sapiens
tctatagaaaaagtaaaagat

SEQ ID NO: 4651853 - DNA, 16 bp, Homo sapiens
tctatagttgtcagta

SEQ ID NO: 4651854 - DNA, 18 bp, Homo sapiens
tctatatgtacttgtcaa

SEQ ID NO: 4651855 - DNA, 19 bp, Homo sapiens
tctatcagactcagttttt

SEQ ID NO: 4651856 - DNA, 23 bp, Homo sapiens
tctatctttcattaaaaagaata

SEQ ID NO: 4651857 - DNA, 14 bp, Homo sapiens
tctatgacaaattc

SEQ ID NO: 4651858 - DNA, 19 bp, Homo sapiens
tctatgatccttttttgtc

SEQ ID NO: 4651859 - DNA, 14 bp, Homo sapiens
tctatgatgttgct

SEQ ID NO: 4651860 - DNA, 21 bp, Homo sapiens
tctatggacagggctgtctct

SEQ ID NO: 4651861 - DNA, 17 bp, Homo sapiens
tctatggcttatttcta

SEQ ID NO: 4651862 - DNA, 21 bp, Homo sapiens
tctatggcttatttctatgac

SEQ ID NO: 4651863 - DNA, 14 bp, Homo sapiens
tctatgttcaaaga

SEQ ID NO: 4651864 - DNA, 19 bp, Homo sapiens
tctatgtttgtatttggaa

SEQ ID NO: 4651865 - DNA, 20 bp, Homo sapiens
tctattatggaaaactgtgt

SEQ ID NO: 4651866 - DNA, 13 bp, Homo sapiens
tctattctgtcag

SEQ ID NO: 4651867 - DNA, 14 bp, Homo sapiens
tctatttatgcctt

SEQ ID NO: 4651868 - DNA, 13 bp, Homo sapiens
tctatttcactta

SEQ ID NO: 4651869 - DNA, 17 bp, Homo sapiens
tctatttttcaatcatc

SEQ ID NO: 4651870 - DNA, 22 bp, Homo sapiens
tctcaaaatggtgtgctataaa

SEQ ID NO: 4651871 - DNA, 18 bp, Homo sapiens
tctcaaacctccaaaagc

SEQ ID NO: 4651872 - DNA, 18 bp, Homo sapiens
tctcaacatactgtaatc

SEQ ID NO: 4651873 - DNA, 20 bp, Homo sapiens
tctgaggtcctgagcactgc

SEQ ID NO: 4651874 - DNA, 16 bp, Homo sapiens
tctgagtcctggccca

SEQ ID NO: 4651875 - DNA, 12 bp, Homo sapiens
tctgagtctatg

SEQ ID NO: 4651876 - DNA, 22 bp, Homo sapiens
tctgagtctatgttcaaagact

SEQ ID NO: 4651877 - DNA, 14 bp, Homo sapiens
tctgataatttaaa

SEQ ID NO: 4651878 - DNA, 21 bp, Homo sapiens
tctgcaaagtggcagggaccg

SEQ ID NO: 4651879 - DNA, 22 bp, Homo sapiens
tctgcacagacaagcagccctt

SEQ ID NO: 4651880 - DNA, 14 bp, Homo sapiens
tctgcacagggtcc

SEQ ID NO: 4651881 - DNA, 15 bp, Homo sapiens
tctgcacatgtcttg

SEQ ID NO: 4651882 - DNA, 17 bp, Homo sapiens
tctgcacatgtcttgta

SEQ ID NO: 4651883 - DNA, 19 bp, Homo sapiens
tctgcacatgtcttgtaca

SEQ ID NO: 4651884 - DNA, 13 bp, Homo sapiens
tctgcacccctct

SEQ ID NO: 4651885 - DNA, 15 bp, Homo sapiens
tctgcagcattgaag

SEQ ID NO: 4651886 - DNA, 23 bp, Homo sapiens
tctgcatatatgtctctttggag

SEQ ID NO: 4651887 - DNA, 22 bp, Homo sapiens
tctgcatcttggggacatctct

SEQ ID NO: 4651888 - DNA, 13 bp, Homo sapiens
tctgcatgtttga

SEQ ID NO: 4651889 - DNA, 16 bp, Homo sapiens
tctgcattgacctgga

SEQ ID NO: 4651890 - DNA, 17 bp, Homo sapiens
tctgcattgacctggag

SEQ ID NO: 4651891 - DNA, 13 bp, Homo sapiens
tctgccagcagga

SEQ ID NO: 4651892 - DNA, 23 bp, Homo sapiens
tctgccagcaggaataaagactt

SEQ ID NO: 4651893 - DNA, 13 bp, Homo sapiens
tctgcccaccctc

SEQ ID NO: 4651894 - DNA, 11 bp, Homo sapiens
tctgcccaggc

SEQ ID NO: 4651895 - DNA, 22 bp, Homo sapiens
tctgcctccccttaaaggggag

SEQ ID NO: 4651896 - DNA, 16 bp, Homo sapiens
tctgcctcctgctttg

SEQ ID NO: 4651897 - DNA, 18 bp, Homo sapiens
tctgcctcctgctttggg

SEQ ID NO: 4651898 - DNA, 14 bp, Homo sapiens
tctgcctgggatgc

SEQ ID NO: 4651899 - DNA, 19 bp, Homo sapiens
tctgcctgggatgcccttc

SEQ ID NO: 4651900 - DNA, 23 bp, Homo sapiens
tctgcctgggatgcccttccccc

SEQ ID NO: 4651901 - DNA, 18 bp, Homo sapiens
tctgcctgggcaatggcc

SEQ ID NO: 4651902 - DNA, 18 bp, Homo sapiens
tctgcctgtctggtgcct

SEQ ID NO: 4651903 - DNA, 16 bp, Homo sapiens
tctgcgcgttcctccg

SEQ ID NO: 4651904 - DNA, 17 bp, Homo sapiens
tctgcgcttcagtaaca

SEQ ID NO: 4651905 - DNA, 14 bp, Homo sapiens
tctgctctgatgca

SEQ ID NO: 4651906 - DNA, 13 bp, Homo sapiens
tctgctctggaat

SEQ ID NO: 4651907 - DNA, 15 bp, Homo sapiens
tctgctgctggcccc

SEQ ID NO: 4651908 - DNA, 17 bp, Homo sapiens
tctgctgggctctgcct

SEQ ID NO: 4651909 - DNA, 12 bp, Homo sapiens
tctgcttcccag

SEQ ID NO: 4651910 - DNA, 14 bp, Homo sapiens
tctgcttcccaggt

SEQ ID NO: 4651911 - DNA, 19 bp, Homo sapiens
tctgcttgctcccaagccc

SEQ ID NO: 4651912 - DNA, 17 bp, Homo sapiens
tctggactccacggatg

SEQ ID NO: 4651913 - DNA, 20 bp, Homo sapiens
tctggagtgagaggccccca

SEQ ID NO: 4651914 - DNA, 13 bp, Homo sapiens
tctggcagccaca

SEQ ID NO: 4651915 - DNA, 18 bp, Homo sapiens
tctggcagccacacttct

SEQ ID NO: 4651916 - DNA, 22 bp, Homo sapiens
tctggcccgggcatccacgtag

SEQ ID NO: 4651917 - DNA, 18 bp, Homo sapiens
tctggctactccctggac

SEQ ID NO: 4651918 - DNA, 16 bp, Homo sapiens
tctggctccctgcccc

SEQ ID NO: 4651919 - DNA, 17 bp, Homo sapiens
tctggctccctgcccct

SEQ ID NO: 4651920 - DNA, 21 bp, Homo sapiens
tctggcttcagcccccaccag

SEQ ID NO: 4651921 - DNA, 14 bp, Homo sapiens
tctgggaccccagc

SEQ ID NO: 4651922 - DNA, 12 bp, Homo sapiens
tctgggctctgg

SEQ ID NO: 4651923 - DNA, 21 bp, Homo sapiens
tctgggctgtaacgtggcact

SEQ ID NO: 4651924 - DNA, 14 bp, Homo sapiens
tctgggctgtgggc

SEQ ID NO: 4651925 - DNA, 13 bp, Homo sapiens
tctggggctgtgt

SEQ ID NO: 4651926 - DNA, 15 bp, Homo sapiens
tctgggtccatcctg

SEQ ID NO: 4651927 - DNA, 14 bp, Homo sapiens
tctgggtgctgccc

SEQ ID NO: 4651928 - DNA, 15 bp, Homo sapiens
tctgggtgctgccct

SEQ ID NO: 4651929 - DNA, 21 bp, Homo sapiens
tctggtcctaccaatggattc

SEQ ID NO: 4651930 - DNA, 13 bp, Homo sapiens
tctggtgtctgct

SEQ ID NO: 4651931 - DNA, 16 bp, Homo sapiens
tctggttgtctagtca

SEQ ID NO: 4651932 - DNA, 12 bp, Homo sapiens
tctgtaaagcca

SEQ ID NO: 4651933 - DNA, 13 bp, Homo sapiens
tctgtaaagccag

SEQ ID NO: 4651934 - DNA, 23 bp, Homo sapiens
tctgtaacaggtattttgtttct

SEQ ID NO: 4651935 - DNA, 15 bp, Homo sapiens
tctgtaatcctagct

SEQ ID NO: 4651936 - DNA, 17 bp, Homo sapiens
tctgtacacgtgtcctg

SEQ ID NO: 4651937 - DNA, 20 bp, Homo sapiens
tctgtacttttcattctctt

SEQ ID NO: 4651938 - DNA, 17 bp, Homo sapiens
tctgtagtgagatagca

SEQ ID NO: 4651939 - DNA, 21 bp, Homo sapiens
tctgtatataagttgctgtgt

SEQ ID NO: 4651940 - DNA, 13 bp, Homo sapiens
tctgtatccccag

SEQ ID NO: 4651941 - DNA, 20 bp, Homo sapiens
tctgtcaggtgtgataaaat

SEQ ID NO: 4651942 - DNA, 21 bp, Homo sapiens
tctgtctcgagcgccctgcag

SEQ ID NO: 4651943 - DNA, 12 bp, Homo sapiens
tctgtctctctc

SEQ ID NO: 4651944 - DNA, 15 bp, Homo sapiens
tctgtcttcacctga

SEQ ID NO: 4651945 - DNA, 13 bp, Homo sapiens
tctgtcttgttca

SEQ ID NO: 4651946 - DNA, 14 bp, Homo sapiens
tctgtctttcctga

SEQ ID NO: 4651947 - DNA, 19 bp, Homo sapiens
tctgtcttttggagaacca

SEQ ID NO: 4651948 - DNA, 17 bp, Homo sapiens
tctgtgacccctccttg

SEQ ID NO: 4651949 - DNA, 18 bp, Homo sapiens
tctgtgccagagcctggg

SEQ ID NO: 4651950 - DNA, 19 bp, Homo sapiens
tctgtgccagagcctgggg

SEQ ID NO: 4651951 - DNA, 20 bp, Homo sapiens
tctgtgccagagcctggggc

SEQ ID NO: 4651952 - DNA, 23 bp, Homo sapiens
tctgtgccagagcctggggctct

SEQ ID NO: 4651953 - DNA, 13 bp, Homo sapiens
tctgtgtgaatgt

SEQ ID NO: 4651954 - DNA, 14 bp, Homo sapiens
tctgtgtgaatgtg

SEQ ID NO: 4651955 - DNA, 22 bp, Homo sapiens
tctgtgtgaatgtgggcactgg

SEQ ID NO: 4651956 - DNA, 18 bp, Homo sapiens
tctgtgttctaacttatt

SEQ ID NO: 4651957 - DNA, 22 bp, Homo sapiens
tctgtgttctaacttatttata

SEQ ID NO: 4651958 - DNA, 15 bp, Homo sapiens
tctgtgtttttgaaa

SEQ ID NO: 4651959 - DNA, 13 bp, Homo sapiens
tctgttacccagg

SEQ ID NO: 4651960 - DNA, 14 bp, Homo sapiens
tctgttatacccca

SEQ ID NO: 4651961 - DNA, 20 bp, Homo sapiens
tctgttataccccatatatt

SEQ ID NO: 4651962 - DNA, 19 bp, Homo sapiens
tctgttatttttaagcttt

SEQ ID NO: 4651963 - DNA, 12 bp, Homo sapiens
tctgttcagtgt

SEQ ID NO: 4651964 - DNA, 16 bp, Homo sapiens
tctgttcagtgtaaat

SEQ ID NO: 4651965 - DNA, 13 bp, Homo sapiens
tctgttcctggct

SEQ ID NO: 4651966 - DNA, 22 bp, Homo sapiens
tctgttcctggctcagcctcaa

SEQ ID NO: 4651967 - DNA, 13 bp, Homo sapiens
tctgttcttgaag

SEQ ID NO: 4651968 - DNA, 14 bp, Homo sapiens
tctgttgcctcctc

SEQ ID NO: 4651969 - DNA, 21 bp, Homo sapiens
tctgttgcctcctctctccct

SEQ ID NO: 4651970 - DNA, 17 bp, Homo sapiens
tctgttgtcaccttcac

SEQ ID NO: 4651971 - DNA, 18 bp, Homo sapiens
tctgttgtcaccttcacc

SEQ ID NO: 4651972 - DNA, 19 bp, Homo sapiens
tctgtttaaagcatataga

SEQ ID NO: 4651973 - DNA, 14 bp, Homo sapiens
tctgtttcccaagc

SEQ ID NO: 4651974 - DNA, 20 bp, Homo sapiens
tctgtttcctgacattgtct

SEQ ID NO: 4651975 - DNA, 23 bp, Homo sapiens
tctgtttcctggcctcagagctt

SEQ ID NO: 4651976 - DNA, 15 bp, Homo sapiens
tctgttttgtaaagt

SEQ ID NO: 4651977 - DNA, 20 bp, Homo sapiens
tcttaaagggaatcattttt

SEQ ID NO: 4651978 - DNA, 20 bp, Homo sapiens
tcttaactggcctaaatttc

SEQ ID NO: 4651979 - DNA, 16 bp, Homo sapiens
tcttaagattaatttt

SEQ ID NO: 4651980 - DNA, 10 bp, Homo sapiens
tcttaatttt

SEQ ID NO: 4651981 - DNA, 20 bp, Homo sapiens
tcttactaatgtaaaatgat

SEQ ID NO: 4651982 - DNA, 22 bp, Homo sapiens
tcttacttgtcctttgaggccc

SEQ ID NO: 4651983 - DNA, 17 bp, Homo sapiens
tgaatgcccccagctgg

SEQ ID NO: 4651984 - DNA, 20 bp, Homo sapiens
tgaatgctaagaatgcatta

SEQ ID NO: 4651985 - DNA, 15 bp, Homo sapiens
tgaatgtggtctcag

SEQ ID NO: 4651986 - DNA, 12 bp, Homo sapiens
tgaattagccaa

SEQ ID NO: 4651987 - DNA, 14 bp, Homo sapiens
tgaattagccaaaa

SEQ ID NO: 4651988 - DNA, 23 bp, Homo sapiens
tgacaaacatgatactgctgctt

SEQ ID NO: 4651989 - DNA, 19 bp, Homo sapiens
tgacaagctggccaaagtc

SEQ ID NO: 4651990 - DNA, 14 bp, Homo sapiens
tgacaattgggagc

SEQ ID NO: 4651991 - DNA, 21 bp, Homo sapiens
tgacacatatgcaccttgtgt

SEQ ID NO: 4651992 - DNA, 18 bp, Homo sapiens
tgacactccagttgcaga

SEQ ID NO: 4651993 - DNA, 15 bp, Homo sapiens
tgacacttgtcccca

SEQ ID NO: 4651994 - DNA, 19 bp, Homo sapiens
tgacagactcctgaggaca

SEQ ID NO: 4651995 - DNA, 20 bp, Homo sapiens
tgacagactgtagcttctct

SEQ ID NO: 4651996 - DNA, 15 bp, Homo sapiens
tgacagatcaagctg

SEQ ID NO: 4651997 - DNA, 16 bp, Homo sapiens
tgacagatcaagctgt

SEQ ID NO: 4651998 - DNA, 19 bp, Homo sapiens
tgacagatggtgaagtaac

SEQ ID NO: 4651999 - DNA, 17 bp, Homo sapiens
tgacagccttttttcct

SEQ ID NO: 4652000 - DNA, 18 bp, Homo sapiens
tgacaggcagcctggaca

SEQ ID NO: 4652001 - DNA, 12 bp, Homo sapiens
tgacagggccag

SEQ ID NO: 4652002 - DNA, 13 bp, Homo sapiens
tgacagggccagt

SEQ ID NO: 4652003 - DNA, 17 bp, Homo sapiens
tgacagtcatcatcagg

SEQ ID NO: 4652004 - DNA, 18 bp, Homo sapiens
tgacagtcatcatcaggg

SEQ ID NO: 4652005 - DNA, 20 bp, Homo sapiens
tgacagtcatcatcagggcc

SEQ ID NO: 4652006 - DNA, 23 bp, Homo sapiens
tgacagtcatcatcagggcctgg

SEQ ID NO: 4652007 - DNA, 21 bp, Homo sapiens
tgacataaccaatttgtaatg

SEQ ID NO: 4652008 - DNA, 18 bp, Homo sapiens
tgacatccagagatgact

SEQ ID NO: 4652009 - DNA, 13 bp, Homo sapiens
tgacatgtagctt

SEQ ID NO: 4652010 - DNA, 16 bp, Homo sapiens
tgacatgtagcttctt

SEQ ID NO: 4652011 - DNA, 16 bp, Homo sapiens
tgacattccatgacga

SEQ ID NO: 4652012 - DNA, 11 bp, Homo sapiens
tgacattgtct

SEQ ID NO: 4652013 - DNA, 14 bp, Homo sapiens
tgacattgtctcct

SEQ ID NO: 4652014 - DNA, 15 bp, Homo sapiens
tgacatttcttaaaa

SEQ ID NO: 4652015 - DNA, 18 bp, Homo sapiens
tgacatttcttaaaactt

SEQ ID NO: 4652016 - DNA, 19 bp, Homo sapiens
tgaccaatattgtacagtt

SEQ ID NO: 4652017 - DNA, 21 bp, Homo sapiens
tgaccaatattgtacagtttt

SEQ ID NO: 4652018 - DNA, 19 bp, Homo sapiens
tgaccaattgagtaagaac

SEQ ID NO: 4652019 - DNA, 14 bp, Homo sapiens
tgaccacagcacag

SEQ ID NO: 4652020 - DNA, 15 bp, Homo sapiens
tgaccacagcacagc

SEQ ID NO: 4652021 - DNA, 17 bp, Homo sapiens
tgaccacagcacagcca

SEQ ID NO: 4652022 - DNA, 21 bp, Homo sapiens
tgaccacccctctcgcctcat

SEQ ID NO: 4652023 - DNA, 14 bp, Homo sapiens
tgaccagcacactg

SEQ ID NO: 4652024 - DNA, 21 bp, Homo sapiens
tgaccaggatggagcaagctc

SEQ ID NO: 4652025 - DNA, 18 bp, Homo sapiens
tgaccagggatgctgggc

SEQ ID NO: 4652026 - DNA, 21 bp, Homo sapiens
tgaccagggatgctgggctgg

SEQ ID NO: 4652027 - DNA, 22 bp, Homo sapiens
tgaccagggatgctgggctggg

SEQ ID NO: 4652028 - DNA, 18 bp, Homo sapiens
tgaccatcatttcccagg

SEQ ID NO: 4652029 - DNA, 19 bp, Homo sapiens
tgaccatcatttcccaggc

SEQ ID NO: 4652030 - DNA, 17 bp, Homo sapiens
tgaccccagggcacagg

SEQ ID NO: 4652031 - DNA, 20 bp, Homo sapiens
tgaccccagggcacaggagc

SEQ ID NO: 4652032 - DNA, 21 bp, Homo sapiens
tgaccccagggcacaggagct

SEQ ID NO: 4652033 - DNA, 22 bp, Homo sapiens
tgaccccagggcacaggagcta

SEQ ID NO: 4652034 - DNA, 16 bp, Homo sapiens
tgacccctggccacag

SEQ ID NO: 4652035 - DNA, 19 bp, Homo sapiens
tgacccctggccacagcct

SEQ ID NO: 4652036 - DNA, 23 bp, Homo sapiens
tgacccgctcggacttactgcct

SEQ ID NO: 4652037 - DNA, 21 bp, Homo sapiens
tgacccggcaccccctgcagc

SEQ ID NO: 4652038 - DNA, 22 bp, Homo sapiens
tgacccttacagcctctgactt

SEQ ID NO: 4652039 - DNA, 16 bp, Homo sapiens
tgacccttttgtgtct

SEQ ID NO: 4652040 - DNA, 15 bp, Homo sapiens
tgacctaacctagga

SEQ ID NO: 4652041 - DNA, 14 bp, Homo sapiens
tgacctccttctgc

SEQ ID NO: 4652042 - DNA, 19 bp, Homo sapiens
tgacctcgtgatctaccca

SEQ ID NO: 4652043 - DNA, 19 bp, Homo sapiens
tgacctgctgagctctgag

SEQ ID NO: 4652044 - DNA, 21 bp, Homo sapiens
tgacctgctgagctctgagag

SEQ ID NO: 4652045 - DNA, 19 bp, Homo sapiens
tgacgaacttccatggccc

SEQ ID NO: 4652046 - DNA, 21 bp, Homo sapiens
tgacgacatacatgctacttt

SEQ ID NO: 4652047 - DNA, 19 bp, Homo sapiens
tgacgcccgagagcctcgc

SEQ ID NO: 4652048 - DNA, 12 bp, Homo sapiens
tgacgctgctga

SEQ ID NO: 4652049 - DNA, 18 bp, Homo sapiens
tgactaattttacatgtt

SEQ ID NO: 4652050 - DNA, 21 bp, Homo sapiens
tgactaattttacatgtttat

SEQ ID NO: 4652051 - DNA, 22 bp, Homo sapiens
tgactaattttacatgtttata

SEQ ID NO: 4652052 - DNA, 16 bp, Homo sapiens
tgactagtagatttct

SEQ ID NO: 4652053 - DNA, 13 bp, Homo sapiens
tgactcctgctgg

SEQ ID NO: 4652054 - DNA, 15 bp, Homo sapiens
tgactctcacctgta

SEQ ID NO: 4652055 - DNA, 19 bp, Homo sapiens
tgactctcacctgtactat

SEQ ID NO: 4652056 - DNA, 22 bp, Homo sapiens
tgactcttatttatagaattta

SEQ ID NO: 4652057 - DNA, 21 bp, Homo sapiens
tgactcttgaagtacttaaca

SEQ ID NO: 4652058 - DNA, 22 bp, Homo sapiens
tgactgaagcgaacatcttcat

SEQ ID NO: 4652059 - DNA, 14 bp, Homo sapiens
tgactgaaggaaaa

SEQ ID NO: 4652060 - DNA, 20 bp, Homo sapiens
tgactgtcacttgctgcttt

SEQ ID NO: 4652061 - DNA, 22 bp, Homo sapiens
tgactgtcacttgctgcttttt

SEQ ID NO: 4652062 - DNA, 23 bp, Homo sapiens
tgactgtcgccacacgcctctgt

SEQ ID NO: 4652063 - DNA, 14 bp, Homo sapiens
tgacttagaaactg

SEQ ID NO: 4652064 - DNA, 14 bp, Homo sapiens
tgacttatttctgc

SEQ ID NO: 4652065 - DNA, 19 bp, Homo sapiens
tgacttctaatttatatta

SEQ ID NO: 4652066 - DNA, 13 bp, Homo sapiens
tgacttctgctgc

SEQ ID NO: 4652067 - DNA, 14 bp, Homo sapiens
tgacttctgctgct

SEQ ID NO: 4652068 - DNA, 16 bp, Homo sapiens
tgacttcttgcttcag

SEQ ID NO: 4652069 - DNA, 21 bp, Homo sapiens
tgacttcttgcttcagtcatc

SEQ ID NO: 4652070 - DNA, 22 bp, Homo sapiens
tgacttgggcacccccagcctg

SEQ ID NO: 4652071 - DNA, 14 bp, Homo sapiens
tgacttgtctgcct

SEQ ID NO: 4652072 - DNA, 19 bp, Homo sapiens
tgacttgtctgcctcctgc

SEQ ID NO: 4652073 - DNA, 19 bp, Homo sapiens
tgagaaacagctcagccag

SEQ ID NO: 4652074 - DNA, 20 bp, Homo sapiens
tgagaaatagctgaaaaggg

SEQ ID NO: 4652075 - DNA, 16 bp, Homo sapiens
tgagaacctggccttc

SEQ ID NO: 4652076 - DNA, 23 bp, Homo sapiens
tgagaactcgttcacctccaagc

SEQ ID NO: 4652077 - DNA, 16 bp, Homo sapiens
tgagaagatcattgga

SEQ ID NO: 4652078 - DNA, 20 bp, Homo sapiens
tgagaagctgctccaggcct

SEQ ID NO: 4652079 - DNA, 19 bp, Homo sapiens
tgagaatctaggccacccc

SEQ ID NO: 4652080 - DNA, 16 bp, Homo sapiens
tgagaattcaggcaaa

SEQ ID NO: 4652081 - DNA, 14 bp, Homo sapiens
tgagacagagcctc

SEQ ID NO: 4652082 - DNA, 17 bp, Homo sapiens
tgagacagataagagaa

SEQ ID NO: 4652083 - DNA, 13 bp, Homo sapiens
tgagacagtggga

SEQ ID NO: 4652084 - DNA, 18 bp, Homo sapiens
tgagacagtgggaaatat

SEQ ID NO: 4652085 - DNA, 19 bp, Homo sapiens
tgagactacaagtgtgtgc

SEQ ID NO: 4652086 - DNA, 14 bp, Homo sapiens
tgagactgccctgc

SEQ ID NO: 4652087 - DNA, 17 bp, Homo sapiens
tgagactgccctgccca

SEQ ID NO: 4652088 - DNA, 19 bp, Homo sapiens
tgagactgccctgcccagg

SEQ ID NO: 4652089 - DNA, 20 bp, Homo sapiens
tgagactgccctgcccaggt

SEQ ID NO: 4652090 - DNA, 21 bp, Homo sapiens
tgagactttccgactgctttt

SEQ ID NO: 4652091 - DNA, 17 bp, Homo sapiens
tgagagaaagagagaag

SEQ ID NO: 4652092 - DNA, 23 bp, Homo sapiens
tgataggcctagtacaatcttgg

SEQ ID NO: 4652093 - DNA, 13 bp, Homo sapiens
tgatcaagatata

SEQ ID NO: 4652094 - DNA, 21 bp, Homo sapiens
tgatcaatatttttatatcat

SEQ ID NO: 4652095 - DNA, 16 bp, Homo sapiens
tgatcagaatcccaaa

SEQ ID NO: 4652096 - DNA, 17 bp, Homo sapiens
tgatcaggccccacccc

SEQ ID NO: 4652097 - DNA, 14 bp, Homo sapiens
tgatcatgtacttt

SEQ ID NO: 4652098 - DNA, 23 bp, Homo sapiens
tgatccagtcattttattttgta

SEQ ID NO: 4652099 - DNA, 12 bp, Homo sapiens
tgatctcccctc

SEQ ID NO: 4652100 - DNA, 14 bp, Homo sapiens
tgatgagattttta

SEQ ID NO: 4652101 - DNA, 15 bp, Homo sapiens
tgatgagggcagcag

SEQ ID NO: 4652102 - DNA, 21 bp, Homo sapiens
tgatgagggcagcagccagcc

SEQ ID NO: 4652103 - DNA, 22 bp, Homo sapiens
tgatgaggtattttttcctttt

SEQ ID NO: 4652104 - DNA, 22 bp, Homo sapiens
tgatgcatcagaaagggagggc

SEQ ID NO: 4652105 - DNA, 16 bp, Homo sapiens
tgatgcatgtctttta

SEQ ID NO: 4652106 - DNA, 11 bp, Homo sapiens
tgatggagggg

SEQ ID NO: 4652107 - DNA, 15 bp, Homo sapiens
tgatggagtgtgagc

SEQ ID NO: 4652108 - DNA, 14 bp, Homo sapiens
tgatggatggcaga

SEQ ID NO: 4652109 - DNA, 16 bp, Homo sapiens
tgatgggaaaatagta

SEQ ID NO: 4652110 - DNA, 18 bp, Homo sapiens
tgatgggaggtgtgccag

SEQ ID NO: 4652111 - DNA, 20 bp, Homo sapiens
tgatgggtattagtggggga

SEQ ID NO: 4652112 - DNA, 14 bp, Homo sapiens
tgatggtactgatg

SEQ ID NO: 4652113 - DNA, 14 bp, Homo sapiens
tgatgtgaagccaa

SEQ ID NO: 4652114 - DNA, 16 bp, Homo sapiens
tgatgtgacattccat

SEQ ID NO: 4652115 - DNA, 15 bp, Homo sapiens
tgatgtggaggaaga

SEQ ID NO: 4652116 - DNA, 16 bp, Homo sapiens
tgatgtggaggaagag

SEQ ID NO: 4652117 - DNA, 18 bp, Homo sapiens
tgatgtggaggaagagcc

SEQ ID NO: 4652118 - DNA, 21 bp, Homo sapiens
tgatgttgctgttcacagctt

SEQ ID NO: 4652119 - DNA, 13 bp, Homo sapiens
tgattaaaaatgt

SEQ ID NO: 4652120 - DNA, 19 bp, Homo sapiens
tgattaatgttttcattat

SEQ ID NO: 4652121 - DNA, 20 bp, Homo sapiens
tgattatagcaactaatgtt

SEQ ID NO: 4652122 - DNA, 16 bp, Homo sapiens
tgattattcaacacat

SEQ ID NO: 4652123 - DNA, 12 bp, Homo sapiens
tgattattttag

SEQ ID NO: 4652124 - DNA, 16 bp, Homo sapiens
tgattattttagctaa

SEQ ID NO: 4652125 - DNA, 23 bp, Homo sapiens
tgattcaactaaaaaaaaaaaag

SEQ ID NO: 4652126 - DNA, 15 bp, Homo sapiens
tgattcagcattttt

SEQ ID NO: 4652127 - DNA, 20 bp, Homo sapiens
tgattcagcattttttatca

SEQ ID NO: 4652128 - DNA, 14 bp, Homo sapiens
tgattgctcccagg

SEQ ID NO: 4652129 - DNA, 15 bp, Homo sapiens
tgatttaaaaacaac

SEQ ID NO: 4652130 - DNA, 15 bp, Homo sapiens
tgatttaatatggat

SEQ ID NO: 4652131 - DNA, 17 bp, Homo sapiens
tgatttcacatttctac

SEQ ID NO: 4652132 - DNA, 20 bp, Homo sapiens
tgatttcagcacctacagtg

SEQ ID NO: 4652133 - DNA, 21 bp, Homo sapiens
tgatttcagcacctacagtgt

SEQ ID NO: 4652134 - DNA, 22 bp, Homo sapiens
tgatttctaattgtaagtgaaa

SEQ ID NO: 4652135 - DNA, 14 bp, Homo sapiens
tgatttggccaggc

SEQ ID NO: 4652136 - DNA, 20 bp, Homo sapiens
tgatttgggtttttttgttg

SEQ ID NO: 4652137 - DNA, 18 bp, Homo sapiens
tgatttgtagtggaaaca

SEQ ID NO: 4652138 - DNA, 14 bp, Homo sapiens
tgattttataattg

SEQ ID NO: 4652139 - DNA, 14 bp, Homo sapiens
tgattttgctgtag

SEQ ID NO: 4652140 - DNA, 17 bp, Homo sapiens
tgattttgctgtagaag

SEQ ID NO: 4652141 - DNA, 19 bp, Homo sapiens
tgattttgctgtagaagat

SEQ ID NO: 4652142 - DNA, 20 bp, Homo sapiens
tgatttttaaagtttaaata

SEQ ID NO: 4652143 - DNA, 21 bp, Homo sapiens
tgatttttaaagtttaaatac

SEQ ID NO: 4652144 - DNA, 21 bp, Homo sapiens
tgcaaaattaaatctagacat

SEQ ID NO: 4652145 - DNA, 15 bp, Homo sapiens
tgcaaacagaacagg

SEQ ID NO: 4652146 - DNA, 19 bp, Homo sapiens
tgcaaacagaacagggtca

SEQ ID NO: 4652147 - DNA, 19 bp, Homo sapiens
tgcaaaccacttctccatg

SEQ ID NO: 4652148 - DNA, 15 bp, Homo sapiens
tgcaaagcctttaaa

SEQ ID NO: 4652149 - DNA, 15 bp, Homo sapiens
tgcaaatcctatgtg

SEQ ID NO: 4652150 - DNA, 19 bp, Homo sapiens
tgcaaatcctatgtgattt

SEQ ID NO: 4652151 - DNA, 21 bp, Homo sapiens
tgcaaccagggagctgcaggg

SEQ ID NO: 4652152 - DNA, 16 bp, Homo sapiens
tgcaacctctgcctcc

SEQ ID NO: 4652153 - DNA, 18 bp, Homo sapiens
tgcaacctctgcctcctg

SEQ ID NO: 4652154 - DNA, 19 bp, Homo sapiens
tgcaacctctgcctcctgg

SEQ ID NO: 4652155 - DNA, 20 bp, Homo sapiens
tgcaacctctgcctcctggg

SEQ ID NO: 4652156 - DNA, 21 bp, Homo sapiens
tgcaacctctgcctcctgggt

SEQ ID NO: 4652157 - DNA, 21 bp, Homo sapiens
tgcaacttccgctgaggggtc

SEQ ID NO: 4652158 - DNA, 11 bp, Homo sapiens
tgcaacttttt

SEQ ID NO: 4652159 - DNA, 23 bp, Homo sapiens
tgcaagatggacacgagccacaa

SEQ ID NO: 4652160 - DNA, 17 bp, Homo sapiens
tgcaaggcggtacacta

SEQ ID NO: 4652161 - DNA, 17 bp, Homo sapiens
tgcaagtcaggaatcat

SEQ ID NO: 4652162 - DNA, 17 bp, Homo sapiens
tgcaattccaagaaaat

SEQ ID NO: 4652163 - DNA, 19 bp, Homo sapiens
tgcaattccaagaaaatat

SEQ ID NO: 4652164 - DNA, 18 bp, Homo sapiens
tgcacaaaacccagacct

SEQ ID NO: 4652165 - DNA, 14 bp, Homo sapiens
tgcacaccaaggcc

SEQ ID NO: 4652166 - DNA, 20 bp, Homo sapiens
tgcacacccatgcacactca

SEQ ID NO: 4652167 - DNA, 20 bp, Homo sapiens
tgcacaccctccagagacaa

SEQ ID NO: 4652168 - DNA, 16 bp, Homo sapiens
tgcacactgcacattt

SEQ ID NO: 4652169 - DNA, 17 bp, Homo sapiens
tgcacagaagctgtttt

SEQ ID NO: 4652170 - DNA, 13 bp, Homo sapiens
tgcacagacaagc

SEQ ID NO: 4652171 - DNA, 18 bp, Homo sapiens
tgcacagagcaagtcctc

SEQ ID NO: 4652172 - DNA, 17 bp, Homo sapiens
tgcacagctgtttgaaa

SEQ ID NO: 4652173 - DNA, 13 bp, Homo sapiens
tgcacaggcttgc

SEQ ID NO: 4652174 - DNA, 12 bp, Homo sapiens
tgcacagggtcc

SEQ ID NO: 4652175 - DNA, 19 bp, Homo sapiens
tgcacagtgttggtttcct

SEQ ID NO: 4652176 - DNA, 15 bp, Homo sapiens
tgcacatatggactc

SEQ ID NO: 4652177 - DNA, 15 bp, Homo sapiens
tgcacatgtcttgta

SEQ ID NO: 4652178 - DNA, 23 bp, Homo sapiens
tgcacatgtcttgtacatgtgta

SEQ ID NO: 4652179 - DNA, 18 bp, Homo sapiens
tgcacctctgttcatttc

SEQ ID NO: 4652180 - DNA, 22 bp, Homo sapiens
tgcaccttcactctccagggta

SEQ ID NO: 4652181 - DNA, 19 bp, Homo sapiens
tgcaccttccccaaaggaa

SEQ ID NO: 4652182 - DNA, 14 bp, Homo sapiens
tgcactccagcctg

SEQ ID NO: 4652183 - DNA, 16 bp, Homo sapiens
tgcactccagcctggg

SEQ ID NO: 4652184 - DNA, 17 bp, Homo sapiens
tgcactctttaagggag

SEQ ID NO: 4652185 - DNA, 14 bp, Homo sapiens
tgcactgatgttgt

SEQ ID NO: 4652186 - DNA, 15 bp, Homo sapiens
tgcactgatgttgtg

SEQ ID NO: 4652187 - DNA, 14 bp, Homo sapiens
tgcacttagccatg

SEQ ID NO: 4652188 - DNA, 24 bp, Homo sapiens
tgcacttagccatgatggcaacag

SEQ ID NO: 4652189 - DNA, 19 bp, Homo sapiens
tgcactttccaatgccaca

SEQ ID NO: 4652190 - DNA, 23 bp, Homo sapiens
tgcactttccaatgccacagaca

SEQ ID NO: 4652191 - DNA, 12 bp, Homo sapiens
tgcactttcctt

SEQ ID NO: 4652192 - DNA, 19 bp, Homo sapiens
tgcacttttagaaatgcat

SEQ ID NO: 4652193 - DNA, 15 bp, Homo sapiens
tgcagaatgaagcca

SEQ ID NO: 4652194 - DNA, 17 bp, Homo sapiens
tgcagacctgtcaccct

SEQ ID NO: 4652195 - DNA, 23 bp, Homo sapiens
tgcagacctgtcaccctgcagga

SEQ ID NO: 4652196 - DNA, 11 bp, Homo sapiens
tgcagagcaga

SEQ ID NO: 4652197 - DNA, 16 bp, Homo sapiens
tgcagagcagacaggc

SEQ ID NO: 4652198 - DNA, 19 bp, Homo sapiens
tgcagagcagacaggctac

SEQ ID NO: 4652199 - DNA, 23 bp, Homo sapiens
tgcagagtgaccagcacactgga

SEQ ID NO: 4652200 - DNA, 18 bp, Homo sapiens
tgcagcaaacactccacc

SEQ ID NO: 4652201 - DNA, 15 bp, Homo sapiens
tgcagcacctccagg

SEQ ID NO: 4652202 - DNA, 20 bp, Homo sapiens
tgctcccaatggtgcttgga

SEQ ID NO: 4652203 - DNA, 15 bp, Homo sapiens
tgctcccaggatctc

SEQ ID NO: 4652204 - DNA, 19 bp, Homo sapiens
tgctcctccttggtgcctg

SEQ ID NO: 4652205 - DNA, 14 bp, Homo sapiens
tgctcgccccagca

SEQ ID NO: 4652206 - DNA, 16 bp, Homo sapiens
tgctcgccccagcagg

SEQ ID NO: 4652207 - DNA, 14 bp, Homo sapiens
tgctcgccctgcgg

SEQ ID NO: 4652208 - DNA, 15 bp, Homo sapiens
tgctcggggtgcaca

SEQ ID NO: 4652209 - DNA, 20 bp, Homo sapiens
tgctcggggtgcacaggagg

SEQ ID NO: 4652210 - DNA, 14 bp, Homo sapiens
tgctctaagcccag

SEQ ID NO: 4652211 - DNA, 15 bp, Homo sapiens
tgctctaagcccagg

SEQ ID NO: 4652212 - DNA, 16 bp, Homo sapiens
tgctctagtgggacag

SEQ ID NO: 4652213 - DNA, 22 bp, Homo sapiens
tgctctatgtttgtatttggaa

SEQ ID NO: 4652214 - DNA, 22 bp, Homo sapiens
tgctctcactgtttgtttttat

SEQ ID NO: 4652215 - DNA, 17 bp, Homo sapiens
tgctctctcaaattgtc

SEQ ID NO: 4652216 - DNA, 20 bp, Homo sapiens
tgctctctcaaattgtcagc

SEQ ID NO: 4652217 - DNA, 16 bp, Homo sapiens
tgctctgatgcatcag

SEQ ID NO: 4652218 - DNA, 20 bp, Homo sapiens
tgctctgcccaggcaaggaa

SEQ ID NO: 4652219 - DNA, 13 bp, Homo sapiens
tgctctgttccca

SEQ ID NO: 4652220 - DNA, 12 bp, Homo sapiens
tgctcttgggga

SEQ ID NO: 4652221 - DNA, 17 bp, Homo sapiens
tgctctttattgcagaa

SEQ ID NO: 4652222 - DNA, 14 bp, Homo sapiens
tgctctttcacctg

SEQ ID NO: 4652223 - DNA, 18 bp, Homo sapiens
tgctctttcacctgggtg

SEQ ID NO: 4652224 - DNA, 22 bp, Homo sapiens
tgctctttccacttgccctgtg

SEQ ID NO: 4652225 - DNA, 22 bp, Homo sapiens
tgctgacagacactaactttgt

SEQ ID NO: 4652226 - DNA, 18 bp, Homo sapiens
tgctgacattcacctgcc

SEQ ID NO: 4652227 - DNA, 15 bp, Homo sapiens
tgctgagctctgaga

SEQ ID NO: 4652228 - DNA, 19 bp, Homo sapiens
tgctgatcttttaaaatca

SEQ ID NO: 4652229 - DNA, 20 bp, Homo sapiens
tgctgatcttttaaaatcat

SEQ ID NO: 4652230 - DNA, 14 bp, Homo sapiens
tgctgcaatacatt

SEQ ID NO: 4652231 - DNA, 19 bp, Homo sapiens
tgctgcaatacattaaaat

SEQ ID NO: 4652232 - DNA, 16 bp, Homo sapiens
tgctgcacaccaaggc

SEQ ID NO: 4652233 - DNA, 21 bp, Homo sapiens
tgctgcacaccaaggccctgc

SEQ ID NO: 4652234 - DNA, 22 bp, Homo sapiens
tgctgcacaccaaggccctgca

SEQ ID NO: 4652235 - DNA, 14 bp, Homo sapiens
tgctgcctgggtag

SEQ ID NO: 4652236 - DNA, 11 bp, Homo sapiens
tgctgctgaga

SEQ ID NO: 4652237 - DNA, 17 bp, Homo sapiens
tgctgctgagaacctgg

SEQ ID NO: 4652238 - DNA, 22 bp, Homo sapiens
tgctgctgagaacctggccttc

SEQ ID NO: 4652239 - DNA, 14 bp, Homo sapiens
tgctggaagaaact

SEQ ID NO: 4652240 - DNA, 22 bp, Homo sapiens
tgctggagatcagcatgcctgt

SEQ ID NO: 4652241 - DNA, 23 bp, Homo sapiens
tgctggccgcccccagccccctc

SEQ ID NO: 4652242 - DNA, 18 bp, Homo sapiens
tgctggctcccagggcca

SEQ ID NO: 4652243 - DNA, 16 bp, Homo sapiens
tgctgggattacagac

SEQ ID NO: 4652244 - DNA, 12 bp, Homo sapiens
tgctgggcctgg

SEQ ID NO: 4652245 - DNA, 12 bp, Homo sapiens
tgctgggctggg

SEQ ID NO: 4652246 - DNA, 22 bp, Homo sapiens
tgctggggccaggccccatgga

SEQ ID NO: 4652247 - DNA, 23 bp, Homo sapiens
tgctggggccgccacggcctggc

SEQ ID NO: 4652248 - DNA, 14 bp, Homo sapiens
tgctgggggaatga

SEQ ID NO: 4652249 - DNA, 21 bp, Homo sapiens
tgctgggggaatgagcccaga

SEQ ID NO: 4652250 - DNA, 22 bp, Homo sapiens
tgctgggggaatgagcccagag

SEQ ID NO: 4652251 - DNA, 16 bp, Homo sapiens
tgctggtttttcagtt

SEQ ID NO: 4652252 - DNA, 21 bp, Homo sapiens
tgctgtatgacccctggccac

SEQ ID NO: 4652253 - DNA, 23 bp, Homo sapiens
tgctgtatgacccctggccacag

SEQ ID NO: 4652254 - DNA, 20 bp, Homo sapiens
tgctgtcacctcgctgggct

SEQ ID NO: 4652255 - DNA, 21 bp, Homo sapiens
tgctgtcacctcgctgggctc

SEQ ID NO: 4652256 - DNA, 22 bp, Homo sapiens
tgctgtcacctcgctgggctct

SEQ ID NO: 4652257 - DNA, 16 bp, Homo sapiens
tgctgtcacttcttca

SEQ ID NO: 4652258 - DNA, 15 bp, Homo sapiens
tgctgtccccactgc

SEQ ID NO: 4652259 - DNA, 18 bp, Homo sapiens
tgctgtctaacctgtgac

SEQ ID NO: 4652260 - DNA, 13 bp, Homo sapiens
tgctgtgcatttt

SEQ ID NO: 4652261 - DNA, 16 bp, Homo sapiens
tgctgtgctacgtgtg

SEQ ID NO: 4652262 - DNA, 17 bp, Homo sapiens
tgctgtgctacgtgtga

SEQ ID NO: 4652263 - DNA, 22 bp, Homo sapiens
tgctgtgctacgtgtgaaatct

SEQ ID NO: 4652264 - DNA, 16 bp, Homo sapiens
tgctgtgtagttccct

SEQ ID NO: 4652265 - DNA, 17 bp, Homo sapiens
tgctgtgtagttccctc

SEQ ID NO: 4652266 - DNA, 20 bp, Homo sapiens
tgctgtgtagttccctctgc

SEQ ID NO: 4652267 - DNA, 15 bp, Homo sapiens
tgctgttcacagctt

SEQ ID NO: 4652268 - DNA, 21 bp, Homo sapiens
tgcttaaaagaaagttaactg

SEQ ID NO: 4652269 - DNA, 17 bp, Homo sapiens
tgcttagagactatcaa

SEQ ID NO: 4652270 - DNA, 19 bp, Homo sapiens
tgcttagaggttctgcctc

SEQ ID NO: 4652271 - DNA, 21 bp, Homo sapiens
tgcttagaggttctgcctcta

SEQ ID NO: 4652272 - DNA, 13 bp, Homo sapiens
tgcttagataact

SEQ ID NO: 4652273 - DNA, 19 bp, Homo sapiens
tgcttccaagaccatttgt

SEQ ID NO: 4652274 - DNA, 14 bp, Homo sapiens
tgcttccacctcac

SEQ ID NO: 4652275 - DNA, 16 bp, Homo sapiens
tgcttccacctcaccc

SEQ ID NO: 4652276 - DNA, 20 bp, Homo sapiens
tgcttccacctcaccccact

SEQ ID NO: 4652277 - DNA, 18 bp, Homo sapiens
tgcttccgagacaccaca

SEQ ID NO: 4652278 - DNA, 12 bp, Homo sapiens
tgcttcctagta

SEQ ID NO: 4652279 - DNA, 16 bp, Homo sapiens
tgcttctactgtgaca

SEQ ID NO: 4652280 - DNA, 21 bp, Homo sapiens
tgcttctatcagactcagttt

SEQ ID NO: 4652281 - DNA, 22 bp, Homo sapiens
tgcttctctagctctctaggcc

SEQ ID NO: 4652282 - DNA, 12 bp, Homo sapiens
tgcttgaatgct

SEQ ID NO: 4652283 - DNA, 18 bp, Homo sapiens
tgcttgagcccagaactt

SEQ ID NO: 4652284 - DNA, 13 bp, Homo sapiens
tgcttggaagcca

SEQ ID NO: 4652285 - DNA, 15 bp, Homo sapiens
tgcttggaagccagg

SEQ ID NO: 4652286 - DNA, 12 bp, Homo sapiens
tgctttcaattg

SEQ ID NO: 4652287 - DNA, 12 bp, Homo sapiens
tgctttccaagc

SEQ ID NO: 4652288 - DNA, 15 bp, Homo sapiens
tgctttcctgggcct

SEQ ID NO: 4652289 - DNA, 21 bp, Homo sapiens
tgctttcggagctcctgtcca

SEQ ID NO: 4652290 - DNA, 12 bp, Homo sapiens
tgctttctgaaa

SEQ ID NO: 4652291 - DNA, 16 bp, Homo sapiens
tggaaaaatgtatcca

SEQ ID NO: 4652292 - DNA, 14 bp, Homo sapiens
tggaaaacagaaac

SEQ ID NO: 4652293 - DNA, 15 bp, Homo sapiens
tggaaaactgtgttg

SEQ ID NO: 4652294 - DNA, 19 bp, Homo sapiens
tggaaaagggtcttgggaa

SEQ ID NO: 4652295 - DNA, 16 bp, Homo sapiens
tggaaacaaaacagaa

SEQ ID NO: 4652296 - DNA, 21 bp, Homo sapiens
tggaaacttctgtaaggggca

SEQ ID NO: 4652297 - DNA, 21 bp, Homo sapiens
tggaaaggagcctaggccagg

SEQ ID NO: 4652298 - DNA, 15 bp, Homo sapiens
tggaaatacacagtg

SEQ ID NO: 4652299 - DNA, 15 bp, Homo sapiens
tggaaatcttttaca

SEQ ID NO: 4652300 - DNA, 16 bp, Homo sapiens
tggaaatgtacttttg

SEQ ID NO: 4652301 - DNA, 19 bp, Homo sapiens
tggaaattagccacatgta

SEQ ID NO: 4652302 - DNA, 21 bp, Homo sapiens
tggaacgtttttcctgttctt

SEQ ID NO: 4652303 - DNA, 13 bp, Homo sapiens
tggaactgaaggg

SEQ ID NO: 4652304 - DNA, 16 bp, Homo sapiens
tggaactgaagggggc

SEQ ID NO: 4652305 - DNA, 17 bp, Homo sapiens
tggaactttctgttccc

SEQ ID NO: 4652306 - DNA, 20 bp, Homo sapiens
tggaagccaggtacaggaga

SEQ ID NO: 4652307 - DNA, 20 bp, Homo sapiens
tggaagcccctgggcccagt

SEQ ID NO: 4652308 - DNA, 21 bp, Homo sapiens
tggaagcttactctctgcttc

SEQ ID NO: 4652309 - DNA, 14 bp, Homo sapiens
tggaaggcagacag

SEQ ID NO: 4652310 - DNA, 23 bp, Homo sapiens
tggaagtcaaataaatgtttccc

SEQ ID NO: 4652311 - DNA, 19 bp, Homo sapiens
tggaagtgtgacttcttac

SEQ ID NO: 4652312 - DNA, 14 bp, Homo sapiens
tggcatctgctttt

SEQ ID NO: 4652313 - DNA, 20 bp, Homo sapiens
tggcatggtggctcccgcct

SEQ ID NO: 4652314 - DNA, 18 bp, Homo sapiens
tggcattgcactgcttat

SEQ ID NO: 4652315 - DNA, 16 bp, Homo sapiens
tggcatttctctttaa

SEQ ID NO: 4652316 - DNA, 18 bp, Homo sapiens
tggcatttttgcttccta

SEQ ID NO: 4652317 - DNA, 21 bp, Homo sapiens
tggccaagctgaggtgcccag

SEQ ID NO: 4652318 - DNA, 14 bp, Homo sapiens
tggccaatttttgt

SEQ ID NO: 4652319 - DNA, 13 bp, Homo sapiens
tggccacagcctt

SEQ ID NO: 4652320 - DNA, 14 bp, Homo sapiens
tggccacagccttc

SEQ ID NO: 4652321 - DNA, 18 bp, Homo sapiens
tggccagactcccttgct

SEQ ID NO: 4652322 - DNA, 20 bp, Homo sapiens
tggccaggctggtcttgaac

SEQ ID NO: 4652323 - DNA, 16 bp, Homo sapiens
tggccaggctggtttc

SEQ ID NO: 4652324 - DNA, 18 bp, Homo sapiens
tggccaggggccaggagt

SEQ ID NO: 4652325 - DNA, 15 bp, Homo sapiens
tggccccaggacctg

SEQ ID NO: 4652326 - DNA, 12 bp, Homo sapiens
tggcccccagct

SEQ ID NO: 4652327 - DNA, 15 bp, Homo sapiens
tggcccccatacttg

SEQ ID NO: 4652328 - DNA, 19 bp, Homo sapiens
tggcccccatcagccctgc

SEQ ID NO: 4652329 - DNA, 20 bp, Homo sapiens
tggcccccatcagccctgct

SEQ ID NO: 4652330 - DNA, 15 bp, Homo sapiens
tggcccgtgacagac

SEQ ID NO: 4652331 - DNA, 13 bp, Homo sapiens
tggccctggccct

SEQ ID NO: 4652332 - DNA, 13 bp, Homo sapiens
tggcccttcctgg

SEQ ID NO: 4652333 - DNA, 20 bp, Homo sapiens
tggcccttcctggacagctg

SEQ ID NO: 4652334 - DNA, 16 bp, Homo sapiens
tggcctaaatttcttc

SEQ ID NO: 4652335 - DNA, 16 bp, Homo sapiens
tggcctaatttacaag

SEQ ID NO: 4652336 - DNA, 13 bp, Homo sapiens
tggcctatgcaca

SEQ ID NO: 4652337 - DNA, 20 bp, Homo sapiens
tggcctatgcacatatggac

SEQ ID NO: 4652338 - DNA, 14 bp, Homo sapiens
tggcctcagagctt

SEQ ID NO: 4652339 - DNA, 22 bp, Homo sapiens
tggcctcagagcttcctgggga

SEQ ID NO: 4652340 - DNA, 23 bp, Homo sapiens
tggcctcagagcttcctggggac

SEQ ID NO: 4652341 - DNA, 18 bp, Homo sapiens
tggcctcagctgaatgcc

SEQ ID NO: 4652342 - DNA, 15 bp, Homo sapiens
tggcctccctgctgt

SEQ ID NO: 4652343 - DNA, 19 bp, Homo sapiens
tggcctccctgctgtgcca

SEQ ID NO: 4652344 - DNA, 20 bp, Homo sapiens
tggcctccctttgtgtgcat

SEQ ID NO: 4652345 - DNA, 14 bp, Homo sapiens
tggcctcctgcctc

SEQ ID NO: 4652346 - DNA, 15 bp, Homo sapiens
tggcctcctgcctct

SEQ ID NO: 4652347 - DNA, 16 bp, Homo sapiens
tggcctcctgcctcta

SEQ ID NO: 4652348 - DNA, 21 bp, Homo sapiens
tggcctcctgcctctactggg

SEQ ID NO: 4652349 - DNA, 17 bp, Homo sapiens
tggcctcgtgaggggca

SEQ ID NO: 4652350 - DNA, 18 bp, Homo sapiens
tggcctcgtgaggggcaa

SEQ ID NO: 4652351 - DNA, 21 bp, Homo sapiens
tggcctcgtgaggggcaagct

SEQ ID NO: 4652352 - DNA, 14 bp, Homo sapiens
tggcctctttgtct

SEQ ID NO: 4652353 - DNA, 22 bp, Homo sapiens
tggcctctttgtctaaaacaat

SEQ ID NO: 4652354 - DNA, 22 bp, Homo sapiens
tggcctgatcagaccacggctc

SEQ ID NO: 4652355 - DNA, 21 bp, Homo sapiens
tggcctgtagaatagcctgtg

SEQ ID NO: 4652356 - DNA, 23 bp, Homo sapiens
tggcctgtagaatagcctgtggc

SEQ ID NO: 4652357 - DNA, 13 bp, Homo sapiens
tggcctgtgatgt

SEQ ID NO: 4652358 - DNA, 15 bp, Homo sapiens
tggccttgaaacagt

SEQ ID NO: 4652359 - DNA, 23 bp, Homo sapiens
tggccttgaaacagttccattta

SEQ ID NO: 4652360 - DNA, 19 bp, Homo sapiens
tggcgagtcattaaactta

SEQ ID NO: 4652361 - DNA, 17 bp, Homo sapiens
tggcgccatctcggctc

SEQ ID NO: 4652362 - DNA, 12 bp, Homo sapiens
tggcggcacaca

SEQ ID NO: 4652363 - DNA, 15 bp, Homo sapiens
tggcggcacacatct

SEQ ID NO: 4652364 - DNA, 20 bp, Homo sapiens
tggcggctctagccccagcg

SEQ ID NO: 4652365 - DNA, 16 bp, Homo sapiens
tggctaatttaacacc

SEQ ID NO: 4652366 - DNA, 14 bp, Homo sapiens
tggctactccctgg

SEQ ID NO: 4652367 - DNA, 18 bp, Homo sapiens
tggctactccctggacca

SEQ ID NO: 4652368 - DNA, 15 bp, Homo sapiens
tggctactctgtgcc

SEQ ID NO: 4652369 - DNA, 17 bp, Homo sapiens
tggctactctgtgccag

SEQ ID NO: 4652370 - DNA, 18 bp, Homo sapiens
tggctactctgtgccaga

SEQ ID NO: 4652371 - DNA, 24 bp, Homo sapiens
tggctactctgtgccagagcctgg

SEQ ID NO: 4652372 - DNA, 23 bp, Homo sapiens
tggctagagggcccaaagcttgt

SEQ ID NO: 4652373 - DNA, 15 bp, Homo sapiens
tggctagtccttgtt

SEQ ID NO: 4652374 - DNA, 24 bp, Homo sapiens
tggctcacagtacagcatgtgcct

SEQ ID NO: 4652375 - DNA, 12 bp, Homo sapiens
tggctcagccag

SEQ ID NO: 4652376 - DNA, 16 bp, Homo sapiens
tggctcagccagcact

SEQ ID NO: 4652377 - DNA, 18 bp, Homo sapiens
tggctccctctctcctgg

SEQ ID NO: 4652378 - DNA, 19 bp, Homo sapiens
tggctccctctctcctgga

SEQ ID NO: 4652379 - DNA, 20 bp, Homo sapiens
tggctccctctctcctggac

SEQ ID NO: 4652380 - DNA, 14 bp, Homo sapiens
tggctccctgcccc

SEQ ID NO: 4652381 - DNA, 15 bp, Homo sapiens
tggctccctgcccct

SEQ ID NO: 4652382 - DNA, 17 bp, Homo sapiens
tggctctcccatttcct

SEQ ID NO: 4652383 - DNA, 18 bp, Homo sapiens
tggctgacatgaagctgt

SEQ ID NO: 4652384 - DNA, 13 bp, Homo sapiens
tggctgagggcag

SEQ ID NO: 4652385 - DNA, 15 bp, Homo sapiens
tggctgagggcagtt

SEQ ID NO: 4652386 - DNA, 18 bp, Homo sapiens
tggctggctgagggcagt

SEQ ID NO: 4652387 - DNA, 19 bp, Homo sapiens
tggctgggacgtggctcag

SEQ ID NO: 4652388 - DNA, 16 bp, Homo sapiens
tggctggtgggaaggc

SEQ ID NO: 4652389 - DNA, 21 bp, Homo sapiens
tggctggtgggaaggccggca

SEQ ID NO: 4652390 - DNA, 22 bp, Homo sapiens
tggctgtaatcatttgtttaca

SEQ ID NO: 4652391 - DNA, 15 bp, Homo sapiens
tggcttaatcatttt

SEQ ID NO: 4652392 - DNA, 16 bp, Homo sapiens
tggcttatgaaagagg

SEQ ID NO: 4652393 - DNA, 13 bp, Homo sapiens
tggcttatttcta

SEQ ID NO: 4652394 - DNA, 20 bp, Homo sapiens
tggcttcagcccccaccagg

SEQ ID NO: 4652395 - DNA, 14 bp, Homo sapiens
tggctttaatgaat

SEQ ID NO: 4652396 - DNA, 17 bp, Homo sapiens
tggctttcctgtttcta

SEQ ID NO: 4652397 - DNA, 23 bp, Homo sapiens
tgggaaaaagcaggactgtgcct

SEQ ID NO: 4652398 - DNA, 17 bp, Homo sapiens
tgggaactctcctggcc

SEQ ID NO: 4652399 - DNA, 19 bp, Homo sapiens
tgggaatgaaattaacaca

SEQ ID NO: 4652400 - DNA, 23 bp, Homo sapiens
tgggaattggaatcaaaagagtt

SEQ ID NO: 4652401 - DNA, 15 bp, Homo sapiens
tgggacaagcaggcc

SEQ ID NO: 4652402 - DNA, 16 bp, Homo sapiens
tgggaccaacctgacc

SEQ ID NO: 4652403 - DNA, 16 bp, Homo sapiens
tgggaccccagctgct

SEQ ID NO: 4652404 - DNA, 18 bp, Homo sapiens
tgggaccccagctgctct

SEQ ID NO: 4652405 - DNA, 17 bp, Homo sapiens
tgggacctaaaaaggtc

SEQ ID NO: 4652406 - DNA, 23 bp, Homo sapiens
tgggacctataactgcccagcgg

SEQ ID NO: 4652407 - DNA, 13 bp, Homo sapiens
tgggacggaggtc

SEQ ID NO: 4652408 - DNA, 16 bp, Homo sapiens
tgggacgtggctcagc

SEQ ID NO: 4652409 - DNA, 18 bp, Homo sapiens
tgggacttttctttctta

SEQ ID NO: 4652410 - DNA, 19 bp, Homo sapiens
tgggagacacccaaagggt

SEQ ID NO: 4652411 - DNA, 23 bp, Homo sapiens
tgggagattcaagggacccatga

SEQ ID NO: 4652412 - DNA, 14 bp, Homo sapiens
tgggagctgagctg

SEQ ID NO: 4652413 - DNA, 18 bp, Homo sapiens
tgggagctgagctggaag

SEQ ID NO: 4652414 - DNA, 21 bp, Homo sapiens
tgggagctgagctggaagggg

SEQ ID NO: 4652415 - DNA, 16 bp, Homo sapiens
tgggagctgaggccac

SEQ ID NO: 4652416 - DNA, 20 bp, Homo sapiens
tgggagctgaggccacactc

SEQ ID NO: 4652417 - DNA, 18 bp, Homo sapiens
tgggagcttccgctttga

SEQ ID NO: 4652418 - DNA, 21 bp, Homo sapiens
tgggaggaggaaaagaaacct

SEQ ID NO: 4652419 - DNA, 19 bp, Homo sapiens
tgggatggtcggatctcac

SEQ ID NO: 4652420 - DNA, 20 bp, Homo sapiens
tgggatggtcggatctcaca

SEQ ID NO: 4652421 - DNA, 20 bp, Homo sapiens
tgggattcaggaaaaggcct

SEQ ID NO: 4652422 - DNA, 19 bp, Homo sapiens
tgtagtaaactatttatct

SEQ ID NO: 4652423 - DNA, 22 bp, Homo sapiens
tgtagtgaatcacgtaaagcta

SEQ ID NO: 4652424 - DNA, 15 bp, Homo sapiens
tgtagttgcgtggac

SEQ ID NO: 4652425 - DNA, 20 bp, Homo sapiens
tgtagtttttatatgttgta

SEQ ID NO: 4652426 - DNA, 19 bp, Homo sapiens
tgtataggagccccaggca

SEQ ID NO: 4652427 - DNA, 14 bp, Homo sapiens
tgtatagtatctgt

SEQ ID NO: 4652428 - DNA, 16 bp, Homo sapiens
tgtatattatgtttat

SEQ ID NO: 4652429 - DNA, 18 bp, Homo sapiens
tgtatccaaggaaacatt

SEQ ID NO: 4652430 - DNA, 22 bp, Homo sapiens
tgtatccaattttaatgataaa

SEQ ID NO: 4652431 - DNA, 19 bp, Homo sapiens
tgtatctacagtaatgaaa

SEQ ID NO: 4652432 - DNA, 20 bp, Homo sapiens
tgtatctacattaaaatgac

SEQ ID NO: 4652433 - DNA, 12 bp, Homo sapiens
tgtatcttaaag

SEQ ID NO: 4652434 - DNA, 15 bp, Homo sapiens
tgtatcttaaaggac

SEQ ID NO: 4652435 - DNA, 18 bp, Homo sapiens
tgtatcttaaatctgtga

SEQ ID NO: 4652436 - DNA, 18 bp, Homo sapiens
tgtatgaataatgaaaat

SEQ ID NO: 4652437 - DNA, 18 bp, Homo sapiens
tgtatgacccctggccac

SEQ ID NO: 4652438 - DNA, 17 bp, Homo sapiens
tgtatgcagctatctgg

SEQ ID NO: 4652439 - DNA, 19 bp, Homo sapiens
tgtatgccacacctggcct

SEQ ID NO: 4652440 - DNA, 22 bp, Homo sapiens
tgtatgtcaataaacaacagct

SEQ ID NO: 4652441 - DNA, 18 bp, Homo sapiens
tgtatgtctcgtggtagg

SEQ ID NO: 4652442 - DNA, 20 bp, Homo sapiens
tgtattctttataattgaat

SEQ ID NO: 4652443 - DNA, 12 bp, Homo sapiens
tgtattgattca

SEQ ID NO: 4652444 - DNA, 19 bp, Homo sapiens
tgtattggatatataagag

SEQ ID NO: 4652445 - DNA, 20 bp, Homo sapiens
tgtatttggaatatttgaat

SEQ ID NO: 4652446 - DNA, 14 bp, Homo sapiens
tgtattttgagttt

SEQ ID NO: 4652447 - DNA, 23 bp, Homo sapiens
tgtcaaaagaaataatccctgta

SEQ ID NO: 4652448 - DNA, 12 bp, Homo sapiens
tgtcaaaataaa

SEQ ID NO: 4652449 - DNA, 17 bp, Homo sapiens
tgtcaagctggtgctac

SEQ ID NO: 4652450 - DNA, 15 bp, Homo sapiens
tgtcaagttgtacat

SEQ ID NO: 4652451 - DNA, 12 bp, Homo sapiens
tgtcacaaagaa

SEQ ID NO: 4652452 - DNA, 15 bp, Homo sapiens
tgtcacattcctgac

SEQ ID NO: 4652453 - DNA, 23 bp, Homo sapiens
tgtcacccaggctggagtgcagt

SEQ ID NO: 4652454 - DNA, 13 bp, Homo sapiens
tgtcacctccttc

SEQ ID NO: 4652455 - DNA, 18 bp, Homo sapiens
tgtcacctccttccccag

SEQ ID NO: 4652456 - DNA, 19 bp, Homo sapiens
tgtcacctccttccccagc

SEQ ID NO: 4652457 - DNA, 19 bp, Homo sapiens
tgtcacctcgctgggctct

SEQ ID NO: 4652458 - DNA, 22 bp, Homo sapiens
tgtcacctctgtgacccctcct

SEQ ID NO: 4652459 - DNA, 16 bp, Homo sapiens
tgtcacttgctgcttt

SEQ ID NO: 4652460 - DNA, 19 bp, Homo sapiens
tgtcacttgctgctttttc

SEQ ID NO: 4652461 - DNA, 21 bp, Homo sapiens
tgtcagctttggattgctggg

SEQ ID NO: 4652462 - DNA, 18 bp, Homo sapiens
tgtcaggctacaaggtag

SEQ ID NO: 4652463 - DNA, 21 bp, Homo sapiens
tgtcagggtctccttccttcc

SEQ ID NO: 4652464 - DNA, 16 bp, Homo sapiens
tgtcagtattattcta

SEQ ID NO: 4652465 - DNA, 19 bp, Homo sapiens
tgtcagtggggctctctga

SEQ ID NO: 4652466 - DNA, 22 bp, Homo sapiens
tgtcagtgttaaagattttgtt

SEQ ID NO: 4652467 - DNA, 20 bp, Homo sapiens
tgtcagttctctgggaagtg

SEQ ID NO: 4652468 - DNA, 15 bp, Homo sapiens
tgtcataaactttct

SEQ ID NO: 4652469 - DNA, 16 bp, Homo sapiens
tgtcataaggttttta

SEQ ID NO: 4652470 - DNA, 16 bp, Homo sapiens
tgtcataagtaaacct

SEQ ID NO: 4652471 - DNA, 13 bp, Homo sapiens
tgtcattatgaca

SEQ ID NO: 4652472 - DNA, 22 bp, Homo sapiens
tgtcattatgacatttcttaaa

SEQ ID NO: 4652473 - DNA, 22 bp, Homo sapiens
tgtccaagacagggctcatttt

SEQ ID NO: 4652474 - DNA, 14 bp, Homo sapiens
tgtccatactaaca

SEQ ID NO: 4652475 - DNA, 20 bp, Homo sapiens
tgtcccagaggctgccccac

SEQ ID NO: 4652476 - DNA, 14 bp, Homo sapiens
tgtcccagggccct

SEQ ID NO: 4652477 - DNA, 19 bp, Homo sapiens
tgtcccagggccctcccag

SEQ ID NO: 4652478 - DNA, 21 bp, Homo sapiens
tgtccccaaatccgaacctcc

SEQ ID NO: 4652479 - DNA, 19 bp, Homo sapiens
tgtccccaccctccactca

SEQ ID NO: 4652480 - DNA, 13 bp, Homo sapiens
tgtcccttccagg

SEQ ID NO: 4652481 - DNA, 20 bp, Homo sapiens
tgtcctaaagaagacatttt

SEQ ID NO: 4652482 - DNA, 21 bp, Homo sapiens
tgtcctaaagaagacattttc

SEQ ID NO: 4652483 - DNA, 21 bp, Homo sapiens
tgtcctagccaggtctcctgg

SEQ ID NO: 4652484 - DNA, 14 bp, Homo sapiens
tgtcctcctgttca

SEQ ID NO: 4652485 - DNA, 18 bp, Homo sapiens
tgtcctcctgttcatctg

SEQ ID NO: 4652486 - DNA, 12 bp, Homo sapiens
tgtcctgatttc

SEQ ID NO: 4652487 - DNA, 17 bp, Homo sapiens
tgtcctttgaggcccca

SEQ ID NO: 4652488 - DNA, 17 bp, Homo sapiens
tgtctagaggcagactc

SEQ ID NO: 4652489 - DNA, 17 bp, Homo sapiens
tgtctaggcaggacctg

SEQ ID NO: 4652490 - DNA, 14 bp, Homo sapiens
tgtctagtttctca

SEQ ID NO: 4652491 - DNA, 22 bp, Homo sapiens
tgtctataatcccagcactttg

SEQ ID NO: 4652492 - DNA, 18 bp, Homo sapiens
tgtctatagttgtcagta

SEQ ID NO: 4652493 - DNA, 20 bp, Homo sapiens
tgtctatgatgttgctgttc

SEQ ID NO: 4652494 - DNA, 11 bp, Homo sapiens
tgtctcagtga

SEQ ID NO: 4652495 - DNA, 12 bp, Homo sapiens
tgtctcattctc

SEQ ID NO: 4652496 - DNA, 15 bp, Homo sapiens
tgtctcattctcaga

SEQ ID NO: 4652497 - DNA, 18 bp, Homo sapiens
tgtctcccgtgcatgctc

SEQ ID NO: 4652498 - DNA, 19 bp, Homo sapiens
tgtctcccgtgcatgctct

SEQ ID NO: 4652499 - DNA, 11 bp, Homo sapiens
tgtctcctggc

SEQ ID NO: 4652500 - DNA, 19 bp, Homo sapiens
tgtctcgtggtaggactgt

SEQ ID NO: 4652501 - DNA, 24 bp, Homo sapiens
tgtctgaagcccaaagcctgagga

SEQ ID NO: 4652502 - DNA, 19 bp, Homo sapiens
tgtctgaatcatgtctgta

SEQ ID NO: 4652503 - DNA, 13 bp, Homo sapiens
tgtctgcctcctg

SEQ ID NO: 4652504 - DNA, 13 bp, Homo sapiens
tgtctgcttgtca

SEQ ID NO: 4652505 - DNA, 21 bp, Homo sapiens
tgtctgtacacgtgtcctgta

SEQ ID NO: 4652506 - DNA, 17 bp, Homo sapiens
tgtctgtcctgatttct

SEQ ID NO: 4652507 - DNA, 19 bp, Homo sapiens
tgtctgtgaacagagagac

SEQ ID NO: 4652508 - DNA, 23 bp, Homo sapiens
tgtctgtggttgcagtctttccc

SEQ ID NO: 4652509 - DNA, 17 bp, Homo sapiens
tgtctgttacactggag

SEQ ID NO: 4652510 - DNA, 14 bp, Homo sapiens
tgtcttatgtgaaa

SEQ ID NO: 4652511 - DNA, 17 bp, Homo sapiens
tgtcttgccttcatttc

SEQ ID NO: 4652512 - DNA, 20 bp, Homo sapiens
tgtcttgtacatgtgtagcc

SEQ ID NO: 4652513 - DNA, 14 bp, Homo sapiens
tgtcttgtgtattt

SEQ ID NO: 4652514 - DNA, 22 bp, Homo sapiens
tgtcttgtgtatttctctgtga

SEQ ID NO: 4652515 - DNA, 15 bp, Homo sapiens
tgtcttgttcatttt

SEQ ID NO: 4652516 - DNA, 13 bp, Homo sapiens
tgtctttcctgaa

SEQ ID NO: 4652517 - DNA, 20 bp, Homo sapiens
tgtctttgcggggcctgtct

SEQ ID NO: 4652518 - DNA, 22 bp, Homo sapiens
tgtctttgcggggcctgtctca

SEQ ID NO: 4652519 - DNA, 15 bp, Homo sapiens
tgtcttttaaaatgc

SEQ ID NO: 4652520 - DNA, 20 bp, Homo sapiens
tgtcttttaaaatgcaatgt

SEQ ID NO: 4652521 - DNA, 23 bp, Homo sapiens
tgtctttttttttttttttaatg

SEQ ID NO: 4652522 - DNA, 12 bp, Homo sapiens
tgtgaaaaatta

SEQ ID NO: 4652523 - DNA, 21 bp, Homo sapiens
tgtgaaacagttgctgtgaac

SEQ ID NO: 4652524 - DNA, 13 bp, Homo sapiens
tgtgaacagcttg

SEQ ID NO: 4652525 - DNA, 16 bp, Homo sapiens
tgtgaacagcttgctg

SEQ ID NO: 4652526 - DNA, 13 bp, Homo sapiens
tgtgaacccagga

SEQ ID NO: 4652527 - DNA, 15 bp, Homo sapiens
tgtgaacccaggaca

SEQ ID NO: 4652528 - DNA, 16 bp, Homo sapiens
tgtgaactctcccctc

SEQ ID NO: 4652529 - DNA, 21 bp, Homo sapiens
tgtgaagccaattcagacagg

SEQ ID NO: 4652530 - DNA, 23 bp, Homo sapiens
tgtgaagtccttcacctcactga

SEQ ID NO: 4652531 - DNA, 22 bp, Homo sapiens
tgtgaatccatgggtctggcta

SEQ ID NO: 4652532 - DNA, 21 bp, Homo sapiens
tgtgaatctgcttttcctctg

SEQ ID NO: 4652533 - DNA, 15 bp, Homo sapiens
tgtgaatgtgggcac

SEQ ID NO: 4652534 - DNA, 18 bp, Homo sapiens
tgtgaatgtgggcactgg

SEQ ID NO: 4652535 - DNA, 19 bp, Homo sapiens
tgtgacaattctgttttta

SEQ ID NO: 4652536 - DNA, 14 bp, Homo sapiens
tgtgacagggccag

SEQ ID NO: 4652537 - DNA, 18 bp, Homo sapiens
tgtgacattccatgacga

SEQ ID NO: 4652538 - DNA, 17 bp, Homo sapiens
tgtgacccccagctccg

SEQ ID NO: 4652539 - DNA, 22 bp, Homo sapiens
tgtgacctgctgagctctgaga

SEQ ID NO: 4652540 - DNA, 13 bp, Homo sapiens
tgtgacctggggc

SEQ ID NO: 4652541 - DNA, 18 bp, Homo sapiens
tgtgactattcatggcta

SEQ ID NO: 4652542 - DNA, 19 bp, Homo sapiens
tgtgagaagatcattgcca

SEQ ID NO: 4652543 - DNA, 13 bp, Homo sapiens
tgtgagaagccag

SEQ ID NO: 4652544 - DNA, 21 bp, Homo sapiens
tgtgagaagccagccagaggc

SEQ ID NO: 4652545 - DNA, 14 bp, Homo sapiens
tgtgagcccagctg

SEQ ID NO: 4652546 - DNA, 19 bp, Homo sapiens
tgtgaggccatacttgtga

SEQ ID NO: 4652547 - DNA, 13 bp, Homo sapiens
tgtgagtatttct

SEQ ID NO: 4652548 - DNA, 15 bp, Homo sapiens
tgtgagtatttctgt

SEQ ID NO: 4652549 - DNA, 17 bp, Homo sapiens
tgtgagtatttctgttc

SEQ ID NO: 4652550 - DNA, 19 bp, Homo sapiens
tgtgagtatttctgttcct

SEQ ID NO: 4652551 - DNA, 17 bp, Homo sapiens
tgtgagtgtgacagggc

SEQ ID NO: 4652552 - DNA, 14 bp, Homo sapiens
tgtgatacagtttt

SEQ ID NO: 4652553 - DNA, 20 bp, Homo sapiens
tgtgatacagttttgagtaa

SEQ ID NO: 4652554 - DNA, 18 bp, Homo sapiens
tgtgatcaggccccaccc

SEQ ID NO: 4652555 - DNA, 19 bp, Homo sapiens
tgtgatcaggccccacccc

SEQ ID NO: 4652556 - DNA, 21 bp, Homo sapiens
tgtgatcaggccccacccctg

SEQ ID NO: 4652557 - DNA, 14 bp, Homo sapiens
tgtgatttctttaa

SEQ ID NO: 4652558 - DNA, 14 bp, Homo sapiens
tgtgcacaaagtgg

SEQ ID NO: 4652559 - DNA, 21 bp, Homo sapiens
tgtgcaccaccacacccggct

SEQ ID NO: 4652560 - DNA, 17 bp, Homo sapiens
tgtgcacttatttatga

SEQ ID NO: 4652561 - DNA, 19 bp, Homo sapiens
tgtgcagtactttgtgcat

SEQ ID NO: 4652562 - DNA, 14 bp, Homo sapiens
tgtgccaacctgtt

SEQ ID NO: 4652563 - DNA, 22 bp, Homo sapiens
tgtgccaatacagacaaagcat

SEQ ID NO: 4652564 - DNA, 23 bp, Homo sapiens
tgtgccacacttcgctcttgagg

SEQ ID NO: 4652565 - DNA, 14 bp, Homo sapiens
tgtgccagaaagtc

SEQ ID NO: 4652566 - DNA, 14 bp, Homo sapiens
tgtgccagagcctg

SEQ ID NO: 4652567 - DNA, 16 bp, Homo sapiens
tgtgccagagcctggg

SEQ ID NO: 4652568 - DNA, 18 bp, Homo sapiens
tgtgccagagcctggggc

SEQ ID NO: 4652569 - DNA, 16 bp, Homo sapiens
tgtgccatagtcacat

SEQ ID NO: 4652570 - DNA, 13 bp, Homo sapiens
tgtgccctgtgtg

SEQ ID NO: 4652571 - DNA, 14 bp, Homo sapiens
tgtgcctccctggt

SEQ ID NO: 4652572 - DNA, 16 bp, Homo sapiens
tgtgcctccctggtga

SEQ ID NO: 4652573 - DNA, 21 bp, Homo sapiens
tgtgcctcgctccccactctg

SEQ ID NO: 4652574 - DNA, 17 bp, Homo sapiens
tgtgctacaggggccag

SEQ ID NO: 4652575 - DNA, 14 bp, Homo sapiens
tgtgctacgtgtga

SEQ ID NO: 4652576 - DNA, 16 bp, Homo sapiens
tgtgctacgtgtgaaa

SEQ ID NO: 4652577 - DNA, 20 bp, Homo sapiens
tgtgctacgtgtgaaatctg

SEQ ID NO: 4652578 - DNA, 21 bp, Homo sapiens
tgtgctcaaaaatgagagtga

SEQ ID NO: 4652579 - DNA, 16 bp, Homo sapiens
tgtgctcctccttggt

SEQ ID NO: 4652580 - DNA, 19 bp, Homo sapiens
tgtgcttgagccaggaggc

SEQ ID NO: 4652581 - DNA, 23 bp, Homo sapiens
tgtggaaatgggacggaggtcct

SEQ ID NO: 4652582 - DNA, 16 bp, Homo sapiens
tgtggaaggcctccct

SEQ ID NO: 4652583 - DNA, 16 bp, Homo sapiens
tgtggaatgagtgtgc

SEQ ID NO: 4652584 - DNA, 18 bp, Homo sapiens
tgtggaatgagtgtgcat

SEQ ID NO: 4652585 - DNA, 15 bp, Homo sapiens
tgtggagctgccaca

SEQ ID NO: 4652586 - DNA, 18 bp, Homo sapiens
tgtggaggaagagccacc

SEQ ID NO: 4652587 - DNA, 21 bp, Homo sapiens
tgtggaggaagagccacctgc

SEQ ID NO: 4652588 - DNA, 14 bp, Homo sapiens
tgtggaggaggtga

SEQ ID NO: 4652589 - DNA, 15 bp, Homo sapiens
tgtggatccaatgtt

SEQ ID NO: 4652590 - DNA, 16 bp, Homo sapiens
tgtggattaaaccttt

SEQ ID NO: 4652591 - DNA, 15 bp, Homo sapiens
tgtggcaaactgaag

SEQ ID NO: 4652592 - DNA, 22 bp, Homo sapiens
tgtggcctggttcaaagtaaag

SEQ ID NO: 4652593 - DNA, 14 bp, Homo sapiens
tgtggctccctctc

SEQ ID NO: 4652594 - DNA, 17 bp, Homo sapiens
tgtgggcactggcccag

SEQ ID NO: 4652595 - DNA, 17 bp, Homo sapiens
tgtgggccaccgtgcct

SEQ ID NO: 4652596 - DNA, 21 bp, Homo sapiens
tgtgggccaccgtgcctggct

SEQ ID NO: 4652597 - DNA, 22 bp, Homo sapiens
tgtgggctatgtagtcataata

SEQ ID NO: 4652598 - DNA, 18 bp, Homo sapiens
tgtggggtggacctggga

SEQ ID NO: 4652599 - DNA, 22 bp, Homo sapiens
tgtgggtatttcttggcatgca

SEQ ID NO: 4652600 - DNA, 19 bp, Homo sapiens
tgtggtgacttctgctgct

SEQ ID NO: 4652601 - DNA, 12 bp, Homo sapiens
tgtggtgcattc

SEQ ID NO: 4652602 - DNA, 16 bp, Homo sapiens
tgtggtgcattcctga

SEQ ID NO: 4652603 - DNA, 14 bp, Homo sapiens
tgtggttgcagtct

SEQ ID NO: 4652604 - DNA, 15 bp, Homo sapiens
tgtggttgtgtgtgt

SEQ ID NO: 4652605 - DNA, 18 bp, Homo sapiens
tgtggttgtgtgtgttct

SEQ ID NO: 4652606 - DNA, 22 bp, Homo sapiens
tgtggtttagttataaaaggct

SEQ ID NO: 4652607 - DNA, 17 bp, Homo sapiens
tgtgtacaaatacatgt

SEQ ID NO: 4652608 - DNA, 14 bp, Homo sapiens
tgtgtactctgtcc

SEQ ID NO: 4652609 - DNA, 16 bp, Homo sapiens
tgtgtagcctgtgcat

SEQ ID NO: 4652610 - DNA, 22 bp, Homo sapiens
tgtgtagttccctctgcctggg

SEQ ID NO: 4652611 - DNA, 12 bp, Homo sapiens
tgtgtatacata

SEQ ID NO: 4652612 - DNA, 21 bp, Homo sapiens
tgtgtatattccttttaaaga

SEQ ID NO: 4652613 - DNA, 13 bp, Homo sapiens
tgtgtatttctct

SEQ ID NO: 4652614 - DNA, 15 bp, Homo sapiens
tgtgtatttctctgt

SEQ ID NO: 4652615 - DNA, 16 bp, Homo sapiens
tgtgtatttctctgtg

SEQ ID NO: 4652616 - DNA, 20 bp, Homo sapiens
tgtgtatttctctgtgaatc

SEQ ID NO: 4652617 - DNA, 14 bp, Homo sapiens
tgtgtcaaaataaa

SEQ ID NO: 4652618 - DNA, 16 bp, Homo sapiens
tgtgtcacaaagaatt

SEQ ID NO: 4652619 - DNA, 19 bp, Homo sapiens
tgtgtcagtggggctctct

SEQ ID NO: 4652620 - DNA, 22 bp, Homo sapiens
tgtgtcagtggggctctctgag

SEQ ID NO: 4652621 - DNA, 15 bp, Homo sapiens
tgtgtccctctctct

SEQ ID NO: 4652622 - DNA, 16 bp, Homo sapiens
tgtgtccctctctctg

SEQ ID NO: 4652623 - DNA, 17 bp, Homo sapiens
tgtgtccctctctctgg

SEQ ID NO: 4652624 - DNA, 19 bp, Homo sapiens
tgtgtctaggcaggacctg

SEQ ID NO: 4652625 - DNA, 19 bp, Homo sapiens
tgtgtctgaatcatgtctg

SEQ ID NO: 4652626 - DNA, 13 bp, Homo sapiens
tgtgtctgtacac

SEQ ID NO: 4652627 - DNA, 16 bp, Homo sapiens
tgtgtcttgtgttttt

SEQ ID NO: 4652628 - DNA, 19 bp, Homo sapiens
tgtgtctttaaatgctgct

SEQ ID NO: 4652629 - DNA, 12 bp, Homo sapiens
tgtgtgaatgtg

SEQ ID NO: 4652630 - DNA, 15 bp, Homo sapiens
tgtgtgacaattctg

SEQ ID NO: 4652631 - DNA, 21 bp, Homo sapiens
tgtgtgcagagcagacaggct

SEQ ID NO: 4652632 - DNA, 16 bp, Homo sapiens
tgtgtggaaatgggac

SEQ ID NO: 4652633 - DNA, 12 bp, Homo sapiens
tgtgtggcaggg

SEQ ID NO: 4652634 - DNA, 18 bp, Homo sapiens
tgtgtggcccagttctga

SEQ ID NO: 4652635 - DNA, 16 bp, Homo sapiens
tgtgtgtgacaattct

SEQ ID NO: 4652636 - DNA, 13 bp, Homo sapiens
tgtgtgtggcagg

SEQ ID NO: 4652637 - DNA, 14 bp, Homo sapiens
tgtgtgtggcaggg

SEQ ID NO: 4652638 - DNA, 14 bp, Homo sapiens
tgtgttactgcttt

SEQ ID NO: 4652639 - DNA, 19 bp, Homo sapiens
tgtgttcagctctttccaa

SEQ ID NO: 4652640 - DNA, 14 bp, Homo sapiens
tgtgttcatttcat

SEQ ID NO: 4652641 - DNA, 22 bp, Homo sapiens
ttaatgtatcttaaaggacata

SEQ ID NO: 4652642 - DNA, 18 bp, Homo sapiens
ttaatgtgaactctcccc

SEQ ID NO: 4652643 - DNA, 20 bp, Homo sapiens
ttaatgtgaactctcccctc

SEQ ID NO: 4652644 - DNA, 15 bp, Homo sapiens
ttaattaaacattgt

SEQ ID NO: 4652645 - DNA, 17 bp, Homo sapiens
ttaattctctttcaaag

SEQ ID NO: 4652646 - DNA, 18 bp, Homo sapiens
ttaattgttttgcacttt

SEQ ID NO: 4652647 - DNA, 16 bp, Homo sapiens
ttaatttatactggca

SEQ ID NO: 4652648 - DNA, 12 bp, Homo sapiens
ttaatttgtaaa

SEQ ID NO: 4652649 - DNA, 17 bp, Homo sapiens
ttaattttgtgaatcta

SEQ ID NO: 4652650 - DNA, 17 bp, Homo sapiens
ttaatttttaatgatga

SEQ ID NO: 4652651 - DNA, 17 bp, Homo sapiens
ttacaaaatttattctc

SEQ ID NO: 4652652 - DNA, 18 bp, Homo sapiens
ttacaattttatctgttt

SEQ ID NO: 4652653 - DNA, 20 bp, Homo sapiens
ttacacaattcttaccctgt

SEQ ID NO: 4652654 - DNA, 17 bp, Homo sapiens
ttacacagtgtgaataa

SEQ ID NO: 4652655 - DNA, 17 bp, Homo sapiens
ttacacatcttcaacag

SEQ ID NO: 4652656 - DNA, 17 bp, Homo sapiens
ttacacatttttcagat

SEQ ID NO: 4652657 - DNA, 23 bp, Homo sapiens
ttacacatttttcagatataaaa

SEQ ID NO: 4652658 - DNA, 19 bp, Homo sapiens
ttacactcccccagcccca

SEQ ID NO: 4652659 - DNA, 16 bp, Homo sapiens
ttacactgtttcatct

SEQ ID NO: 4652660 - DNA, 19 bp, Homo sapiens
ttacagactgaaaggtgtg

SEQ ID NO: 4652661 - DNA, 14 bp, Homo sapiens
ttacagcagcaata

SEQ ID NO: 4652662 - DNA, 18 bp, Homo sapiens
ttacagcccttggcttgt

SEQ ID NO: 4652663 - DNA, 17 bp, Homo sapiens
ttacatcctctgatagc

SEQ ID NO: 4652664 - DNA, 21 bp, Homo sapiens
ttacatgagttcaaatacttt

SEQ ID NO: 4652665 - DNA, 13 bp, Homo sapiens
ttaccatcttaat

SEQ ID NO: 4652666 - DNA, 17 bp, Homo sapiens
ttaccatcttaatcttt

SEQ ID NO: 4652667 - DNA, 14 bp, Homo sapiens
ttaccattaacatt

SEQ ID NO: 4652668 - DNA, 14 bp, Homo sapiens
ttacccatcttgct

SEQ ID NO: 4652669 - DNA, 14 bp, Homo sapiens
ttacctgtctctct

SEQ ID NO: 4652670 - DNA, 14 bp, Homo sapiens
ttactactttaaat

SEQ ID NO: 4652671 - DNA, 20 bp, Homo sapiens
ttactgaataatatcaaata

SEQ ID NO: 4652672 - DNA, 22 bp, Homo sapiens
ttactgaataatatcaaataaa

SEQ ID NO: 4652673 - DNA, 15 bp, Homo sapiens
ttactgactcctcag

SEQ ID NO: 4652674 - DNA, 15 bp, Homo sapiens
ttactgatgtgtgca

SEQ ID NO: 4652675 - DNA, 11 bp, Homo sapiens
ttactgcctga

SEQ ID NO: 4652676 - DNA, 17 bp, Homo sapiens
ttactgcctgaccttgg

SEQ ID NO: 4652677 - DNA, 13 bp, Homo sapiens
ttactgcgtagaa

SEQ ID NO: 4652678 - DNA, 18 bp, Homo sapiens
ttacttccagcaagcaaa

SEQ ID NO: 4652679 - DNA, 16 bp, Homo sapiens
ttacttgctttcaatt

SEQ ID NO: 4652680 - DNA, 22 bp, Homo sapiens
ttacttgctttcaattgacaaa

SEQ ID NO: 4652681 - DNA, 23 bp, Homo sapiens
ttacttgctttcaattgacaaat

SEQ ID NO: 4652682 - DNA, 11 bp, Homo sapiens
ttactttgaac

SEQ ID NO: 4652683 - DNA, 19 bp, Homo sapiens
ttagaaaattcagctcctt

SEQ ID NO: 4652684 - DNA, 21 bp, Homo sapiens
ttagaaagtagccacgtatgg

SEQ ID NO: 4652685 - DNA, 15 bp, Homo sapiens
ttagaagaaatgcta

SEQ ID NO: 4652686 - DNA, 22 bp, Homo sapiens
ttagaagcaaggagaaaatata

SEQ ID NO: 4652687 - DNA, 17 bp, Homo sapiens
ttagaagcagagggaca

SEQ ID NO: 4652688 - DNA, 18 bp, Homo sapiens
ttagaaggcttaagaact

SEQ ID NO: 4652689 - DNA, 20 bp, Homo sapiens
ttagaaggcttaagaactgc

SEQ ID NO: 4652690 - DNA, 14 bp, Homo sapiens
ttagacctgccagc

SEQ ID NO: 4652691 - DNA, 19 bp, Homo sapiens
ttagacctgccagccactg

SEQ ID NO: 4652692 - DNA, 15 bp, Homo sapiens
ttagagattttcatt

SEQ ID NO: 4652693 - DNA, 17 bp, Homo sapiens
ttagagattttcatttt

SEQ ID NO: 4652694 - DNA, 22 bp, Homo sapiens
ttagagcccattaatcttgatc

SEQ ID NO: 4652695 - DNA, 15 bp, Homo sapiens
ttagaggttctgcct

SEQ ID NO: 4652696 - DNA, 15 bp, Homo sapiens
ttagagtgtagctgt

SEQ ID NO: 4652697 - DNA, 15 bp, Homo sapiens
ttagcagacctaaag

SEQ ID NO: 4652698 - DNA, 23 bp, Homo sapiens
ttagcatcctgcccgagggcagc

SEQ ID NO: 4652699 - DNA, 20 bp, Homo sapiens
ttagccaactgtttccctgc

SEQ ID NO: 4652700 - DNA, 18 bp, Homo sapiens
ttagctccataaagtaca

SEQ ID NO: 4652701 - DNA, 23 bp, Homo sapiens
ttaggaattaagttatctttaaa

SEQ ID NO: 4652702 - DNA, 13 bp, Homo sapiens
ttaggacatctta

SEQ ID NO: 4652703 - DNA, 17 bp, Homo sapiens
ttaggccagcaacgctt

SEQ ID NO: 4652704 - DNA, 14 bp, Homo sapiens
ttaggcctctgaga

SEQ ID NO: 4652705 - DNA, 15 bp, Homo sapiens
ttaggctgttggttc

SEQ ID NO: 4652706 - DNA, 19 bp, Homo sapiens
ttagggagtggttcctgtg

SEQ ID NO: 4652707 - DNA, 15 bp, Homo sapiens
ttaggggaactgggt

SEQ ID NO: 4652708 - DNA, 14 bp, Homo sapiens
ttaggggcaaacat

SEQ ID NO: 4652709 - DNA, 18 bp, Homo sapiens
ttaggggcaaacatcaca

SEQ ID NO: 4652710 - DNA, 21 bp, Homo sapiens
ttaggtcttcctgtggctccc

SEQ ID NO: 4652711 - DNA, 16 bp, Homo sapiens
ttagtaatggcagagc

SEQ ID NO: 4652712 - DNA, 17 bp, Homo sapiens
ttagtaatttctttttt

SEQ ID NO: 4652713 - DNA, 20 bp, Homo sapiens
ttagtataagcttttcacaa

SEQ ID NO: 4652714 - DNA, 15 bp, Homo sapiens
ttagtgtaataagac

SEQ ID NO: 4652715 - DNA, 17 bp, Homo sapiens
ttagtgtgacagtttcc

SEQ ID NO: 4652716 - DNA, 19 bp, Homo sapiens
ttagtgtgacagtttccaa

SEQ ID NO: 4652717 - DNA, 16 bp, Homo sapiens
ttagtgttaaaaatct

SEQ ID NO: 4652718 - DNA, 14 bp, Homo sapiens
ttagttaatggatt

SEQ ID NO: 4652719 - DNA, 12 bp, Homo sapiens
ttagttcaatac

SEQ ID NO: 4652720 - DNA, 13 bp, Homo sapiens
ttagttcaataca

SEQ ID NO: 4652721 - DNA, 13 bp, Homo sapiens
ttagttgctgtat

SEQ ID NO: 4652722 - DNA, 19 bp, Homo sapiens
ttagttggtctttccatct

SEQ ID NO: 4652723 - DNA, 18 bp, Homo sapiens
ttataaaaataaagggaa

SEQ ID NO: 4652724 - DNA, 19 bp, Homo sapiens
ttataaaaatataaattgt

SEQ ID NO: 4652725 - DNA, 23 bp, Homo sapiens
ttataaactatttttttcttaaa

SEQ ID NO: 4652726 - DNA, 18 bp, Homo sapiens
ttataaagggacactttt

SEQ ID NO: 4652727 - DNA, 18 bp, Homo sapiens
ttataaatcttatgctct

SEQ ID NO: 4652728 - DNA, 23 bp, Homo sapiens
ttataaatgtgtttatagctcat

SEQ ID NO: 4652729 - DNA, 14 bp, Homo sapiens
ttataattaatgtt

SEQ ID NO: 4652730 - DNA, 21 bp, Homo sapiens
ttataattggtgctatttgaa

SEQ ID NO: 4652731 - DNA, 23 bp, Homo sapiens
ttataattggtgctatttgaaga

SEQ ID NO: 4652732 - DNA, 14 bp, Homo sapiens
ttataccccatata

SEQ ID NO: 4652733 - DNA, 18 bp, Homo sapiens
ttataccctttttcattt

SEQ ID NO: 4652734 - DNA, 23 bp, Homo sapiens
ttatactactttgttaggatttt

SEQ ID NO: 4652735 - DNA, 12 bp, Homo sapiens
ttatagaaaatt

SEQ ID NO: 4652736 - DNA, 16 bp, Homo sapiens
ttatagaatatggact

SEQ ID NO: 4652737 - DNA, 14 bp, Homo sapiens
ttatagagaatgat

SEQ ID NO: 4652738 - DNA, 21 bp, Homo sapiens
ttatagcaagatattgatcaa

SEQ ID NO: 4652739 - DNA, 16 bp, Homo sapiens
ttatatcatgcaaaat

SEQ ID NO: 4652740 - DNA, 21 bp, Homo sapiens
ttatatctgggttaagtgttt

SEQ ID NO: 4652741 - DNA, 12 bp, Homo sapiens
ttatatgtcttg

SEQ ID NO: 4652742 - DNA, 17 bp, Homo sapiens
ttatcaaaaagtattat

SEQ ID NO: 4652743 - DNA, 14 bp, Homo sapiens
ttatcaattatatt

SEQ ID NO: 4652744 - DNA, 17 bp, Homo sapiens
ttatcaattatattatg

SEQ ID NO: 4652745 - DNA, 20 bp, Homo sapiens
ttatcaattatattatgttt

SEQ ID NO: 4652746 - DNA, 12 bp, Homo sapiens
ttatcaggagaa

SEQ ID NO: 4652747 - DNA, 16 bp, Homo sapiens
ttatcattaaaaatta

SEQ ID NO: 4652748 - DNA, 12 bp, Homo sapiens
ttatcattgctc

SEQ ID NO: 4652749 - DNA, 13 bp, Homo sapiens
ttatccctctcca

SEQ ID NO: 4652750 - DNA, 15 bp, Homo sapiens
ttatccttttatctc

SEQ ID NO: 4652751 - DNA, 18 bp, Homo sapiens
ttcaggggctccctgcct

SEQ ID NO: 4652752 - DNA, 16 bp, Homo sapiens
ttcagtaacaagtgtt

SEQ ID NO: 4652753 - DNA, 14 bp, Homo sapiens
ttcagtaccaaaga

SEQ ID NO: 4652754 - DNA, 15 bp, Homo sapiens
ttcagtaccaaagaa

SEQ ID NO: 4652755 - DNA, 17 bp, Homo sapiens
ttcagtaccaaagaaac

SEQ ID NO: 4652756 - DNA, 16 bp, Homo sapiens
ttcagtgactcctgct

SEQ ID NO: 4652757 - DNA, 23 bp, Homo sapiens
ttcagtgcatcattactgttcca

SEQ ID NO: 4652758 - DNA, 13 bp, Homo sapiens
ttcagtgtaaata

SEQ ID NO: 4652759 - DNA, 18 bp, Homo sapiens
ttcagttattaaatgata

SEQ ID NO: 4652760 - DNA, 17 bp, Homo sapiens
ttcataagatattcttt

SEQ ID NO: 4652761 - DNA, 21 bp, Homo sapiens
ttcataagatattctttacaa

SEQ ID NO: 4652762 - DNA, 14 bp, Homo sapiens
ttcataatcagtaa

SEQ ID NO: 4652763 - DNA, 21 bp, Homo sapiens
ttcataatcagtaaatagtgt

SEQ ID NO: 4652764 - DNA, 20 bp, Homo sapiens
ttcatacactaaccaaatct

SEQ ID NO: 4652765 - DNA, 12 bp, Homo sapiens
ttcatacagttt

SEQ ID NO: 4652766 - DNA, 13 bp, Homo sapiens
ttcatacatttga

SEQ ID NO: 4652767 - DNA, 18 bp, Homo sapiens
ttcatacatttgacttct

SEQ ID NO: 4652768 - DNA, 21 bp, Homo sapiens
ttcatactctgttgcctcctc

SEQ ID NO: 4652769 - DNA, 15 bp, Homo sapiens
ttcatagttttctaa

SEQ ID NO: 4652770 - DNA, 22 bp, Homo sapiens
ttcatattcttcatatccttct

SEQ ID NO: 4652771 - DNA, 15 bp, Homo sapiens
ttcatctcagctttt

SEQ ID NO: 4652772 - DNA, 16 bp, Homo sapiens
ttcatgattatagcaa

SEQ ID NO: 4652773 - DNA, 23 bp, Homo sapiens
ttcatgattatagcaactaatgt

SEQ ID NO: 4652774 - DNA, 16 bp, Homo sapiens
ttcatgcttctactgt

SEQ ID NO: 4652775 - DNA, 20 bp, Homo sapiens
ttcatggagtagcctggact

SEQ ID NO: 4652776 - DNA, 23 bp, Homo sapiens
ttcatggcagatgtaggagggac

SEQ ID NO: 4652777 - DNA, 19 bp, Homo sapiens
ttcatggctacctcagaaa

SEQ ID NO: 4652778 - DNA, 23 bp, Homo sapiens
ttcatgtcctaaagaagacattt

SEQ ID NO: 4652779 - DNA, 20 bp, Homo sapiens
ttcatgtggtgaatatgcaa

SEQ ID NO: 4652780 - DNA, 12 bp, Homo sapiens
ttcattacttga

SEQ ID NO: 4652781 - DNA, 16 bp, Homo sapiens
ttcattatgttcatgt

SEQ ID NO: 4652782 - DNA, 14 bp, Homo sapiens
ttcattattcaaga

SEQ ID NO: 4652783 - DNA, 19 bp, Homo sapiens
ttcattattcaagaatgaa

SEQ ID NO: 4652784 - DNA, 18 bp, Homo sapiens
ttcattctcataattcct

SEQ ID NO: 4652785 - DNA, 21 bp, Homo sapiens
ttcattgtttttaactttgct

SEQ ID NO: 4652786 - DNA, 17 bp, Homo sapiens
ttcatttaactttataa

SEQ ID NO: 4652787 - DNA, 20 bp, Homo sapiens
ttcatttagataatttgaaa

SEQ ID NO: 4652788 - DNA, 13 bp, Homo sapiens
ttcatttcaatca

SEQ ID NO: 4652789 - DNA, 19 bp, Homo sapiens
ttcattttaacatgatttc

SEQ ID NO: 4652790 - DNA, 21 bp, Homo sapiens
ttcattttagtgtatctttaa

SEQ ID NO: 4652791 - DNA, 23 bp, Homo sapiens
ttcattttagtgtatctttaaaa

SEQ ID NO: 4652792 - DNA, 11 bp, Homo sapiens
ttcattttcca

SEQ ID NO: 4652793 - DNA, 14 bp, Homo sapiens
ttcatttttaagaa

SEQ ID NO: 4652794 - DNA, 15 bp, Homo sapiens
ttccaaaagccaatg

SEQ ID NO: 4652795 - DNA, 21 bp, Homo sapiens
ttccaaaagtggcctctttgt

SEQ ID NO: 4652796 - DNA, 21 bp, Homo sapiens
ttccaaacagacaaaacagat

SEQ ID NO: 4652797 - DNA, 23 bp, Homo sapiens
ttccaaattgccctatgctgtgc

SEQ ID NO: 4652798 - DNA, 19 bp, Homo sapiens
ttccaagctccaaatccaa

SEQ ID NO: 4652799 - DNA, 14 bp, Homo sapiens
ttccaaggaagcag

SEQ ID NO: 4652800 - DNA, 22 bp, Homo sapiens
ttccaagtcctttatctgcacc

SEQ ID NO: 4652801 - DNA, 17 bp, Homo sapiens
ttccaatagaaagaaac

SEQ ID NO: 4652802 - DNA, 19 bp, Homo sapiens
ttccacactgcagggagga

SEQ ID NO: 4652803 - DNA, 19 bp, Homo sapiens
ttccactattttcaaagaa

SEQ ID NO: 4652804 - DNA, 16 bp, Homo sapiens
ttccactccattgtcg

SEQ ID NO: 4652805 - DNA, 19 bp, Homo sapiens
ttccacttgccctgtgttc

SEQ ID NO: 4652806 - DNA, 14 bp, Homo sapiens
ttccacttttgttc

SEQ ID NO: 4652807 - DNA, 15 bp, Homo sapiens
ttccagcttgcctgt

SEQ ID NO: 4652808 - DNA, 12 bp, Homo sapiens
ttccaggagaag

SEQ ID NO: 4652809 - DNA, 15 bp, Homo sapiens
ttccatgctcccaac

SEQ ID NO: 4652810 - DNA, 17 bp, Homo sapiens
ttccatgctcccaactc

SEQ ID NO: 4652811 - DNA, 18 bp, Homo sapiens
ttccatgctcccaactcc

SEQ ID NO: 4652812 - DNA, 15 bp, Homo sapiens
ttccattgtttgaaa

SEQ ID NO: 4652813 - DNA, 16 bp, Homo sapiens
ttccattttcccccac

SEQ ID NO: 4652814 - DNA, 21 bp, Homo sapiens
ttcccaaacccagtctcctct

SEQ ID NO: 4652815 - DNA, 21 bp, Homo sapiens
ttcccaaccccttaagccctg

SEQ ID NO: 4652816 - DNA, 20 bp, Homo sapiens
ttcccaagagcatcatgcct

SEQ ID NO: 4652817 - DNA, 21 bp, Homo sapiens
ttcccaagagcatcatgcctc

SEQ ID NO: 4652818 - DNA, 21 bp, Homo sapiens
ttcccaagctagactgtgtct

SEQ ID NO: 4652819 - DNA, 11 bp, Homo sapiens
ttcccaagctc

SEQ ID NO: 4652820 - DNA, 19 bp, Homo sapiens
ttcccaccattcctgcctt

SEQ ID NO: 4652821 - DNA, 21 bp, Homo sapiens
ttcccacccaggaaaggagga

SEQ ID NO: 4652822 - DNA, 14 bp, Homo sapiens
ttcccatccccagc

SEQ ID NO: 4652823 - DNA, 18 bp, Homo sapiens
ttccccaacgaaaagcac

SEQ ID NO: 4652824 - DNA, 22 bp, Homo sapiens
ttccccaagatctgccagacct

SEQ ID NO: 4652825 - DNA, 16 bp, Homo sapiens
ttccccaaggacccag

SEQ ID NO: 4652826 - DNA, 17 bp, Homo sapiens
ttccccaagggccctgg

SEQ ID NO: 4652827 - DNA, 22 bp, Homo sapiens
ttccccagcagggtcttttcat

SEQ ID NO: 4652828 - DNA, 14 bp, Homo sapiens
ttccccagctcccc

SEQ ID NO: 4652829 - DNA, 19 bp, Homo sapiens
ttccccatgaaccctgccc

SEQ ID NO: 4652830 - DNA, 17 bp, Homo sapiens
ttcccccactactgcag

SEQ ID NO: 4652831 - DNA, 18 bp, Homo sapiens
ttccccctttctctgcct

SEQ ID NO: 4652832 - DNA, 23 bp, Homo sapiens
ttcccctgggaactctcctggcc

SEQ ID NO: 4652833 - DNA, 17 bp, Homo sapiens
ttccctacacagggcct

SEQ ID NO: 4652834 - DNA, 20 bp, Homo sapiens
ttccctataggaacagccca

SEQ ID NO: 4652835 - DNA, 15 bp, Homo sapiens
ttccctctcccaggc

SEQ ID NO: 4652836 - DNA, 17 bp, Homo sapiens
ttccctctcccaggccc

SEQ ID NO: 4652837 - DNA, 15 bp, Homo sapiens
ttccctctccttcca

SEQ ID NO: 4652838 - DNA, 13 bp, Homo sapiens
ttccctctgcatt

SEQ ID NO: 4652839 - DNA, 19 bp, Homo sapiens
ttccctctgcctgggatgc

SEQ ID NO: 4652840 - DNA, 22 bp, Homo sapiens
ttccctctgcctgggatgccct

SEQ ID NO: 4652841 - DNA, 21 bp, Homo sapiens
ttcccttagtgactcttgaag

SEQ ID NO: 4652842 - DNA, 15 bp, Homo sapiens
ttcccttcctcttcc

SEQ ID NO: 4652843 - DNA, 15 bp, Homo sapiens
ttcccttgctcatga

SEQ ID NO: 4652844 - DNA, 18 bp, Homo sapiens
ttccgcaccctccctagc

SEQ ID NO: 4652845 - DNA, 19 bp, Homo sapiens
ttccgctttgaaagaagca

SEQ ID NO: 4652846 - DNA, 13 bp, Homo sapiens
ttccgttccccgc

SEQ ID NO: 4652847 - DNA, 15 bp, Homo sapiens
ttccgttccccgcta

SEQ ID NO: 4652848 - DNA, 17 bp, Homo sapiens
ttcctaggatgtcatgt

SEQ ID NO: 4652849 - DNA, 14 bp, Homo sapiens
ttcctatgacacag

SEQ ID NO: 4652850 - DNA, 13 bp, Homo sapiens
ttcctcctgcctt

SEQ ID NO: 4652851 - DNA, 18 bp, Homo sapiens
ttcctcctttacctttca

SEQ ID NO: 4652852 - DNA, 19 bp, Homo sapiens
ttcctctcatttccagctt

SEQ ID NO: 4652853 - DNA, 21 bp, Homo sapiens
ttcctctcatttccagcttct

SEQ ID NO: 4652854 - DNA, 12 bp, Homo sapiens
ttcctctccacc

SEQ ID NO: 4652855 - DNA, 16 bp, Homo sapiens
ttcctgactctcacct

SEQ ID NO: 4652856 - DNA, 18 bp, Homo sapiens
ttcctgactctcacctgt

SEQ ID NO: 4652857 - DNA, 17 bp, Homo sapiens
ttcctgagacaaatttt

SEQ ID NO: 4652858 - DNA, 23 bp, Homo sapiens
ttcctgccccaactccttccagc

SEQ ID NO: 4652859 - DNA, 12 bp, Homo sapiens
ttcctgcccttg

SEQ ID NO: 4652860 - DNA, 13 bp, Homo sapiens
ttcctgcccttga

SEQ ID NO: 4652861 - DNA, 13 bp, Homo sapiens
ttctgtcttccca

SEQ ID NO: 4652862 - DNA, 22 bp, Homo sapiens
ttctgtcttgttcattttgagt

SEQ ID NO: 4652863 - DNA, 18 bp, Homo sapiens
ttctgtgtggtatattgt

SEQ ID NO: 4652864 - DNA, 21 bp, Homo sapiens
ttctgttatttttaagctttt

SEQ ID NO: 4652865 - DNA, 19 bp, Homo sapiens
ttctgttccctatggagag

SEQ ID NO: 4652866 - DNA, 22 bp, Homo sapiens
ttctgttgaaacttacactgtt

SEQ ID NO: 4652867 - DNA, 19 bp, Homo sapiens
ttctgtttagttttacact

SEQ ID NO: 4652868 - DNA, 22 bp, Homo sapiens
ttctgtttcctggcctcagagc

SEQ ID NO: 4652869 - DNA, 15 bp, Homo sapiens
ttcttaaagcaaact

SEQ ID NO: 4652870 - DNA, 22 bp, Homo sapiens
ttcttacacgactaagttgaat

SEQ ID NO: 4652871 - DNA, 19 bp, Homo sapiens
ttcttagagtgtagctgta

SEQ ID NO: 4652872 - DNA, 15 bp, Homo sapiens
ttcttagctttgaaa

SEQ ID NO: 4652873 - DNA, 16 bp, Homo sapiens
ttcttagctttgaaac

SEQ ID NO: 4652874 - DNA, 14 bp, Homo sapiens
ttcttagttgctgt

SEQ ID NO: 4652875 - DNA, 15 bp, Homo sapiens
ttcttattgctttta

SEQ ID NO: 4652876 - DNA, 18 bp, Homo sapiens
ttcttcagcgtaaaatgg

SEQ ID NO: 4652877 - DNA, 20 bp, Homo sapiens
ttcttctattaatcaagaga

SEQ ID NO: 4652878 - DNA, 19 bp, Homo sapiens
ttcttgaaagaattttcct

SEQ ID NO: 4652879 - DNA, 17 bp, Homo sapiens
ttcttgcttggaagcca

SEQ ID NO: 4652880 - DNA, 22 bp, Homo sapiens
ttcttgggcctcaggctctgca

SEQ ID NO: 4652881 - DNA, 16 bp, Homo sapiens
ttcttgtcagacataa

SEQ ID NO: 4652882 - DNA, 21 bp, Homo sapiens
ttcttgtcagacataaagcca

SEQ ID NO: 4652883 - DNA, 23 bp, Homo sapiens
ttcttgtctatagttgtcagtat

SEQ ID NO: 4652884 - DNA, 13 bp, Homo sapiens
ttctttaaaagaa

SEQ ID NO: 4652885 - DNA, 18 bp, Homo sapiens
ttctttaaaagaatgact

SEQ ID NO: 4652886 - DNA, 17 bp, Homo sapiens
ttctttactattaaaat

SEQ ID NO: 4652887 - DNA, 14 bp, Homo sapiens
ttctttataattga

SEQ ID NO: 4652888 - DNA, 20 bp, Homo sapiens
ttctttatatttatccacta

SEQ ID NO: 4652889 - DNA, 19 bp, Homo sapiens
ttctttcctccccctgcaa

SEQ ID NO: 4652890 - DNA, 13 bp, Homo sapiens
ttctttgaattta

SEQ ID NO: 4652891 - DNA, 14 bp, Homo sapiens
ttctttgtatctta

SEQ ID NO: 4652892 - DNA, 15 bp, Homo sapiens
ttctttgtatcttaa

SEQ ID NO: 4652893 - DNA, 10 bp, Homo sapiens
ttctttgtgt

SEQ ID NO: 4652894 - DNA, 13 bp, Homo sapiens
ttcttttgcattt

SEQ ID NO: 4652895 - DNA, 22 bp, Homo sapiens
ttcttttttttttttttgagac

SEQ ID NO: 4652896 - DNA, 18 bp, Homo sapiens
ttgaaaaaaaaaatgttg

SEQ ID NO: 4652897 - DNA, 18 bp, Homo sapiens
ttgaaaacctaaaagaca

SEQ ID NO: 4652898 - DNA, 23 bp, Homo sapiens
ttgaaaatatatattatatacat

SEQ ID NO: 4652899 - DNA, 14 bp, Homo sapiens
ttgaaacagttcca

SEQ ID NO: 4652900 - DNA, 18 bp, Homo sapiens
ttgaaatattcagaaatt

SEQ ID NO: 4652901 - DNA, 15 bp, Homo sapiens
ttgaaatctgtatct

SEQ ID NO: 4652902 - DNA, 15 bp, Homo sapiens
ttgaaccaacatctt

SEQ ID NO: 4652903 - DNA, 17 bp, Homo sapiens
ttgaagaaacagagtgg

SEQ ID NO: 4652904 - DNA, 18 bp, Homo sapiens
ttgaagaaggaaagaacc

SEQ ID NO: 4652905 - DNA, 18 bp, Homo sapiens
ttgaagccgactctggcc

SEQ ID NO: 4652906 - DNA, 12 bp, Homo sapiens
ttgaaggccagc

SEQ ID NO: 4652907 - DNA, 21 bp, Homo sapiens
ttgaagtaaattaaacatttt

SEQ ID NO: 4652908 - DNA, 14 bp, Homo sapiens
ttgaagtatattct

SEQ ID NO: 4652909 - DNA, 20 bp, Homo sapiens
ttgaagtatattcttattgg

SEQ ID NO: 4652910 - DNA, 18 bp, Homo sapiens
ttgaagtatggtgtgttc

SEQ ID NO: 4652911 - DNA, 23 bp, Homo sapiens
ttgaataagcagaacatactgtt

SEQ ID NO: 4652912 - DNA, 14 bp, Homo sapiens
ttgaatatatttta

SEQ ID NO: 4652913 - DNA, 18 bp, Homo sapiens
ttgacataggtcataaag

SEQ ID NO: 4652914 - DNA, 22 bp, Homo sapiens
ttgacataggtcataaagcatt

SEQ ID NO: 4652915 - DNA, 13 bp, Homo sapiens
ttgacatgtagct

SEQ ID NO: 4652916 - DNA, 13 bp, Homo sapiens
ttgacattctaca

SEQ ID NO: 4652917 - DNA, 20 bp, Homo sapiens
ttgacctggaggggagaggt

SEQ ID NO: 4652918 - DNA, 17 bp, Homo sapiens
ttgactcctttccaata

SEQ ID NO: 4652919 - DNA, 21 bp, Homo sapiens
ttgactcctttccaatagaaa

SEQ ID NO: 4652920 - DNA, 19 bp, Homo sapiens
ttgactgaagcgaacatct

SEQ ID NO: 4652921 - DNA, 21 bp, Homo sapiens
ttgacttcttgcttcagtcat

SEQ ID NO: 4652922 - DNA, 17 bp, Homo sapiens
ttgagaccccagtgcct

SEQ ID NO: 4652923 - DNA, 19 bp, Homo sapiens
ttgagaggccctggggttc

SEQ ID NO: 4652924 - DNA, 11 bp, Homo sapiens
ttgagatggag

SEQ ID NO: 4652925 - DNA, 15 bp, Homo sapiens
ttgagattgtactgt

SEQ ID NO: 4652926 - DNA, 16 bp, Homo sapiens
ttgagattgtactgtt

SEQ ID NO: 4652927 - DNA, 15 bp, Homo sapiens
ttgaggccccaactc

SEQ ID NO: 4652928 - DNA, 14 bp, Homo sapiens
ttgaggtttagcaa

SEQ ID NO: 4652929 - DNA, 15 bp, Homo sapiens
ttgagtaagaacatc

SEQ ID NO: 4652930 - DNA, 19 bp, Homo sapiens
ttgagtataagaaatgcat

SEQ ID NO: 4652931 - DNA, 13 bp, Homo sapiens
ttgagtccctgct

SEQ ID NO: 4652932 - DNA, 15 bp, Homo sapiens
ttgagttatcaggga

SEQ ID NO: 4652933 - DNA, 16 bp, Homo sapiens
ttgagtttcagctgga

SEQ ID NO: 4652934 - DNA, 15 bp, Homo sapiens
ttgatactctttcta

SEQ ID NO: 4652935 - DNA, 20 bp, Homo sapiens
ttgatactctttctaatgct

SEQ ID NO: 4652936 - DNA, 12 bp, Homo sapiens
ttgatagatgtt

SEQ ID NO: 4652937 - DNA, 22 bp, Homo sapiens
ttgataggaaggaaactggaat

SEQ ID NO: 4652938 - DNA, 14 bp, Homo sapiens
ttgatcagtataat

SEQ ID NO: 4652939 - DNA, 16 bp, Homo sapiens
ttgatcatgtactttt

SEQ ID NO: 4652940 - DNA, 16 bp, Homo sapiens
ttgatggagtgtgagc

SEQ ID NO: 4652941 - DNA, 18 bp, Homo sapiens
ttgatttagaagatagaa

SEQ ID NO: 4652942 - DNA, 16 bp, Homo sapiens
ttgatttcacatttct

SEQ ID NO: 4652943 - DNA, 20 bp, Homo sapiens
ttgatttttgtttttgtaat

SEQ ID NO: 4652944 - DNA, 13 bp, Homo sapiens
ttgcacctgtccc

SEQ ID NO: 4652945 - DNA, 18 bp, Homo sapiens
ttgcacctgtccccaccc

SEQ ID NO: 4652946 - DNA, 14 bp, Homo sapiens
ttgcactttccttt

SEQ ID NO: 4652947 - DNA, 23 bp, Homo sapiens
ttgcactttcctttcaataaagt

SEQ ID NO: 4652948 - DNA, 20 bp, Homo sapiens
ttgcagcccaaaggctgcag

SEQ ID NO: 4652949 - DNA, 17 bp, Homo sapiens
ttgcagcccaaggacag

SEQ ID NO: 4652950 - DNA, 18 bp, Homo sapiens
ttgcagcccaaggacagt

SEQ ID NO: 4652951 - DNA, 15 bp, Homo sapiens
ttgcagcctgctcta

SEQ ID NO: 4652952 - DNA, 14 bp, Homo sapiens
ttgcagcttcaact

SEQ ID NO: 4652953 - DNA, 12 bp, Homo sapiens
ttgcagtctttc

SEQ ID NO: 4652954 - DNA, 13 bp, Homo sapiens
ttgcagtctttcc

SEQ ID NO: 4652955 - DNA, 12 bp, Homo sapiens
ttgcataataaa

SEQ ID NO: 4652956 - DNA, 18 bp, Homo sapiens
ttgcatgggctaatgaag

SEQ ID NO: 4652957 - DNA, 17 bp, Homo sapiens
ttgcatgtgactctgaa

SEQ ID NO: 4652958 - DNA, 17 bp, Homo sapiens
ttgcatttaaacatgtt

SEQ ID NO: 4652959 - DNA, 15 bp, Homo sapiens
ttgccacccccagtt

SEQ ID NO: 4652960 - DNA, 23 bp, Homo sapiens
ttgccagactctaggttatacaa

SEQ ID NO: 4652961 - DNA, 17 bp, Homo sapiens
ttgccatcaccatttgg

SEQ ID NO: 4652962 - DNA, 14 bp, Homo sapiens
ttgccatctgtgat

SEQ ID NO: 4652963 - DNA, 22 bp, Homo sapiens
ttgcccaggtgagggaaggaga

SEQ ID NO: 4652964 - DNA, 16 bp, Homo sapiens
ttgccctatgctgtgc

SEQ ID NO: 4652965 - DNA, 19 bp, Homo sapiens
ttgccctcccctgcccctc

SEQ ID NO: 4652966 - DNA, 12 bp, Homo sapiens
ttgcccttcctc

SEQ ID NO: 4652967 - DNA, 15 bp, Homo sapiens
ttgcctcctctctcc

SEQ ID NO: 4652968 - DNA, 16 bp, Homo sapiens
ttgcctcctctctccc

SEQ ID NO: 4652969 - DNA, 17 bp, Homo sapiens
ttgcctcctctctccct

SEQ ID NO: 4652970 - DNA, 20 bp, Homo sapiens
ttgcctcctctctccctgcc

SEQ ID NO: 4652971 - DNA, 14 bp, Homo sapiens
tttctttttttcct

SEQ ID NO: 4652972 - DNA, 18 bp, Homo sapiens
tttgaaagaagcaagaca

SEQ ID NO: 4652973 - DNA, 23 bp, Homo sapiens
tttgaaatgtttaataaagcttt

SEQ ID NO: 4652974 - DNA, 22 bp, Homo sapiens
tttgaagagattgctgacgccc

SEQ ID NO: 4652975 - DNA, 12 bp, Homo sapiens
tttgaataagca

SEQ ID NO: 4652976 - DNA, 22 bp, Homo sapiens
tttgaataagcagaacatactg

SEQ ID NO: 4652977 - DNA, 16 bp, Homo sapiens
tttgaattttctgtgt

SEQ ID NO: 4652978 - DNA, 19 bp, Homo sapiens
tttgacgggaaacaaaact

SEQ ID NO: 4652979 - DNA, 14 bp, Homo sapiens
tttgactaatttta

SEQ ID NO: 4652980 - DNA, 16 bp, Homo sapiens
tttgactaattttaca

SEQ ID NO: 4652981 - DNA, 17 bp, Homo sapiens
tttgactaattttacat

SEQ ID NO: 4652982 - DNA, 18 bp, Homo sapiens
tttgagctatttccttcc

SEQ ID NO: 4652983 - DNA, 21 bp, Homo sapiens
tttgagtttcagctggaaact

SEQ ID NO: 4652984 - DNA, 22 bp, Homo sapiens
tttgatgcatgtcttttaaaat

SEQ ID NO: 4652985 - DNA, 12 bp, Homo sapiens
tttgatttctaa

SEQ ID NO: 4652986 - DNA, 14 bp, Homo sapiens
tttgatttgtctca

SEQ ID NO: 4652987 - DNA, 15 bp, Homo sapiens
tttgcacctgtcccc

SEQ ID NO: 4652988 - DNA, 16 bp, Homo sapiens
tttgcatactgaaaat

SEQ ID NO: 4652989 - DNA, 22 bp, Homo sapiens
tttgcattttgccgctgagata

SEQ ID NO: 4652990 - DNA, 21 bp, Homo sapiens
tttgccagagccaaattttat

SEQ ID NO: 4652991 - DNA, 19 bp, Homo sapiens
tttgcccttacctgtctct

SEQ ID NO: 4652992 - DNA, 16 bp, Homo sapiens
tttgccgctgagatat

SEQ ID NO: 4652993 - DNA, 16 bp, Homo sapiens
tttgcggggcctgtct

SEQ ID NO: 4652994 - DNA, 16 bp, Homo sapiens
tttgctaaatgtgagt

SEQ ID NO: 4652995 - DNA, 16 bp, Homo sapiens
tttgctccttcagttc

SEQ ID NO: 4652996 - DNA, 14 bp, Homo sapiens
tttgctggaagaaa

SEQ ID NO: 4652997 - DNA, 18 bp, Homo sapiens
tttgcttgtactgggaca

SEQ ID NO: 4652998 - DNA, 21 bp, Homo sapiens
tttgctttcggtactgtaata

SEQ ID NO: 4652999 - DNA, 19 bp, Homo sapiens
tttggaaaagacagaaaac

SEQ ID NO: 4653000 - DNA, 18 bp, Homo sapiens
tttggaactgtgtttcaa

SEQ ID NO: 4653001 - DNA, 15 bp, Homo sapiens
tttggaatatttgaa

SEQ ID NO: 4653002 - DNA, 19 bp, Homo sapiens
tttggaatatttgaataat

SEQ ID NO: 4653003 - DNA, 19 bp, Homo sapiens
tttggaattattgtagaca

SEQ ID NO: 4653004 - DNA, 16 bp, Homo sapiens
tttggcagcccctgtt

SEQ ID NO: 4653005 - DNA, 12 bp, Homo sapiens
tttggcctgtga

SEQ ID NO: 4653006 - DNA, 16 bp, Homo sapiens
tttggctagtccttgt

SEQ ID NO: 4653007 - DNA, 14 bp, Homo sapiens
tttggcttcatttc

SEQ ID NO: 4653008 - DNA, 16 bp, Homo sapiens
tttggcttcatttcaa

SEQ ID NO: 4653009 - DNA, 16 bp, Homo sapiens
tttgggagggaaaagg

SEQ ID NO: 4653010 - DNA, 22 bp, Homo sapiens
tttgggataggaaaaatgagta

SEQ ID NO: 4653011 - DNA, 16 bp, Homo sapiens
tttggggagtacctgt

SEQ ID NO: 4653012 - DNA, 20 bp, Homo sapiens
tttggggcaggagtagctga

SEQ ID NO: 4653013 - DNA, 14 bp, Homo sapiens
tttggtcatttggc

SEQ ID NO: 4653014 - DNA, 21 bp, Homo sapiens
tttggtccttcaaaggcttgt

SEQ ID NO: 4653015 - DNA, 18 bp, Homo sapiens
tttggtcttagctttaca

SEQ ID NO: 4653016 - DNA, 19 bp, Homo sapiens
tttggtggcctaatttaca

SEQ ID NO: 4653017 - DNA, 16 bp, Homo sapiens
tttggtgtgttcctgt

SEQ ID NO: 4653018 - DNA, 18 bp, Homo sapiens
tttgtaaaatattatgtt

SEQ ID NO: 4653019 - DNA, 17 bp, Homo sapiens
tttgtaaagtccccaga

SEQ ID NO: 4653020 - DNA, 14 bp, Homo sapiens
tttgtaaataggat

SEQ ID NO: 4653021 - DNA, 20 bp, Homo sapiens
tttgtaaataggatttttag

SEQ ID NO: 4653022 - DNA, 22 bp, Homo sapiens
tttgtaatatggaaatctttta

SEQ ID NO: 4653023 - DNA, 19 bp, Homo sapiens
tttgtacttttagtagaga

SEQ ID NO: 4653024 - DNA, 14 bp, Homo sapiens
tttgtagactgttt

SEQ ID NO: 4653025 - DNA, 20 bp, Homo sapiens
tttgtagctttcctggaagt

SEQ ID NO: 4653026 - DNA, 14 bp, Homo sapiens
tttgtatcttaaat

SEQ ID NO: 4653027 - DNA, 15 bp, Homo sapiens
tttgtatcttaaatc

SEQ ID NO: 4653028 - DNA, 17 bp, Homo sapiens
tttgtatttctctattt

SEQ ID NO: 4653029 - DNA, 20 bp, Homo sapiens
tttgtcacattatttattaa

SEQ ID NO: 4653030 - DNA, 20 bp, Homo sapiens
tttgtcatagttatgtgatt

SEQ ID NO: 4653031 - DNA, 21 bp, Homo sapiens
tttgtccatcttgtttcattt

SEQ ID NO: 4653032 - DNA, 21 bp, Homo sapiens
tttgtcttgtgtttctttagt

SEQ ID NO: 4653033 - DNA, 24 bp, Homo sapiens
tttgtgaaggcctcgcaggaagac

SEQ ID NO: 4653034 - DNA, 20 bp, Homo sapiens
tttgtgctagaaattttcaa

SEQ ID NO: 4653035 - DNA, 18 bp, Homo sapiens
tttgtggattaaaccttt

SEQ ID NO: 4653036 - DNA, 15 bp, Homo sapiens
tttgtgtgtttcaag

SEQ ID NO: 4653037 - DNA, 19 bp, Homo sapiens
tttgttagactagtttctt

SEQ ID NO: 4653038 - DNA, 17 bp, Homo sapiens
tttgttaggattttcac

SEQ ID NO: 4653039 - DNA, 15 bp, Homo sapiens
tttgttcccaagagc

SEQ ID NO: 4653040 - DNA, 15 bp, Homo sapiens
tttgttcttcaagaa

SEQ ID NO: 4653041 - DNA, 13 bp, Homo sapiens
tttgttctttgtt

SEQ ID NO: 4653042 - DNA, 15 bp, Homo sapiens
tttgttgtaaaacaa

SEQ ID NO: 4653043 - DNA, 10 bp, Homo sapiens
tttgtttctt

SEQ ID NO: 4653044 - DNA, 14 bp, Homo sapiens
tttgttttcaagat

SEQ ID NO: 4653045 - DNA, 17 bp, Homo sapiens
tttgtttttttgagatg

SEQ ID NO: 4653046 - DNA, 15 bp, Homo sapiens
ttttaaaaaacactg

SEQ ID NO: 4653047 - DNA, 18 bp, Homo sapiens
ttttaaaactctacagat

SEQ ID NO: 4653048 - DNA, 13 bp, Homo sapiens
ttttaaaagcaca

SEQ ID NO: 4653049 - DNA, 13 bp, Homo sapiens
ttttaaaagcctt

SEQ ID NO: 4653050 - DNA, 11 bp, Homo sapiens
ttttaaagaat

SEQ ID NO: 4653051 - DNA, 23 bp, Homo sapiens
ttttaaagaatatgactttttat

SEQ ID NO: 4653052 - DNA, 22 bp, Homo sapiens
ttttaaagtttaaataccagta

SEQ ID NO: 4653053 - DNA, 21 bp, Homo sapiens
ttttaacctgttttgttaatg

SEQ ID NO: 4653054 - DNA, 19 bp, Homo sapiens
ttttaagaaggcattggca

SEQ ID NO: 4653055 - DNA, 13 bp, Homo sapiens
ttttaagcctttt

SEQ ID NO: 4653056 - DNA, 13 bp, Homo sapiens
ttttaaggtcttt

SEQ ID NO: 4653057 - DNA, 23 bp, Homo sapiens
ttttaaggtttcaacaaatttca

SEQ ID NO: 4653058 - DNA, 22 bp, Homo sapiens
ttttaagttacacatttttcag

SEQ ID NO: 4653059 - DNA, 18 bp, Homo sapiens
ttttaatagaataaaata

SEQ ID NO: 4653060 - DNA, 18 bp, Homo sapiens
ttttaatgctgtttctaa

SEQ ID NO: 4653061 - DNA, 13 bp, Homo sapiens
ttttaatggcatt

SEQ ID NO: 4653062 - DNA, 15 bp, Homo sapiens
ttttaatttcaggaa

SEQ ID NO: 4653063 - DNA, 12 bp, Homo sapiens
ttttaattttta

SEQ ID NO: 4653064 - DNA, 15 bp, Homo sapiens
ttttacagcagcaat

SEQ ID NO: 4653065 - DNA, 17 bp, Homo sapiens
ttttacagcagcaatat

SEQ ID NO: 4653066 - DNA, 13 bp, Homo sapiens
ttttactttgaac

SEQ ID NO: 4653067 - DNA, 16 bp, Homo sapiens
ttttagaaatgcatat

SEQ ID NO: 4653068 - DNA, 22 bp, Homo sapiens
ttttagaaatgcatatttgcca

SEQ ID NO: 4653069 - DNA, 23 bp, Homo sapiens
ttttagagaatgtgtttcaaaac

SEQ ID NO: 4653070 - DNA, 19 bp, Homo sapiens
ttttaggcactgttcaata

SEQ ID NO: 4653071 - DNA, 16 bp, Homo sapiens
ttttaggcataagatg

SEQ ID NO: 4653072 - DNA, 14 bp, Homo sapiens
ttttagtaatttct

SEQ ID NO: 4653073 - DNA, 15 bp, Homo sapiens
ttttataaggaaact

SEQ ID NO: 4653074 - DNA, 18 bp, Homo sapiens
ttttataatgttattcat

SEQ ID NO: 4653075 - DNA, 13 bp, Homo sapiens
ttttatagaaaag

SEQ ID NO: 4653076 - DNA, 15 bp, Homo sapiens
ttttatcaggcagga

SEQ ID NO: 4653077 - DNA, 14 bp, Homo sapiens
ttttatctgtttaa

SEQ ID NO: 4653078 - DNA, 15 bp, Homo sapiens
ttttatctgtttcct

SEQ ID NO: 4653079 - DNA, 20 bp, Homo sapiens
ttttatgttggttgatataa

SEQ ID NO: 4653080 - DNA, 13 bp, Homo sapiens
ttttattataaag

SEQ ID NO: 4653081 - DNA, 22 bp, Homo sapiens
gattcaggaaaaggcctggggt

SEQ ID NO: 4653082 - DNA, 23 bp, Homo sapiens
gattcatggagtagcctggactg

SEQ ID NO: 4653083 - DNA, 17 bp, Homo sapiens
gattcattaactcaaat

SEQ ID NO: 4653084 - DNA, 17 bp, Homo sapiens
gattccctctcccaggc

SEQ ID NO: 4653085 - DNA, 23 bp, Homo sapiens
gattcctatgatggatggcagac

SEQ ID NO: 4653086 - DNA, 15 bp, Homo sapiens
gattctggggctgtg

SEQ ID NO: 4653087 - DNA, 13 bp, Homo sapiens
gattgacattcta

SEQ ID NO: 4653088 - DNA, 18 bp, Homo sapiens
gattgacattctacagtt

SEQ ID NO: 4653089 - DNA, 23 bp, Homo sapiens
gattgatttttaaagtttaaata

SEQ ID NO: 4653090 - DNA, 14 bp, Homo sapiens
gattgctcccagga

SEQ ID NO: 4653091 - DNA, 15 bp, Homo sapiens
gattgctcccaggat

SEQ ID NO: 4653092 - DNA, 15 bp, Homo sapiens
gattgctgcaaagat

SEQ ID NO: 4653093 - DNA, 20 bp, Homo sapiens
gattgctggggccaggcccc

SEQ ID NO: 4653094 - DNA, 17 bp, Homo sapiens
gattgcttgagcccaga

SEQ ID NO: 4653095 - DNA, 14 bp, Homo sapiens
gattgtactgttca

SEQ ID NO: 4653096 - DNA, 22 bp, Homo sapiens
gattgtactgttcatacagttt

SEQ ID NO: 4653097 - DNA, 20 bp, Homo sapiens
gattgtgtgactattcatgg

SEQ ID NO: 4653098 - DNA, 17 bp, Homo sapiens
gatttaagtgaatacat

SEQ ID NO: 4653099 - DNA, 19 bp, Homo sapiens
gatttaagtgaatacatta

SEQ ID NO: 4653100 - DNA, 22 bp, Homo sapiens
gatttaagtgaatacattaacg

SEQ ID NO: 4653101 - DNA, 17 bp, Homo sapiens
gatttaagttcctgctg

SEQ ID NO: 4653102 - DNA, 20 bp, Homo sapiens
gatttaagttcctgctgcct

SEQ ID NO: 4653103 - DNA, 21 bp, Homo sapiens
gatttaagttcctgctgcctg

SEQ ID NO: 4653104 - DNA, 14 bp, Homo sapiens
gatttaatatggat

SEQ ID NO: 4653105 - DNA, 14 bp, Homo sapiens
gatttcaaaatcag

SEQ ID NO: 4653106 - DNA, 15 bp, Homo sapiens
gatttcaagatcctc

SEQ ID NO: 4653107 - DNA, 12 bp, Homo sapiens
gatttcacattt

SEQ ID NO: 4653108 - DNA, 22 bp, Homo sapiens
gatttctaattgtaagtgaaat

SEQ ID NO: 4653109 - DNA, 17 bp, Homo sapiens
gatttctgcaggttctt

SEQ ID NO: 4653110 - DNA, 16 bp, Homo sapiens
gattttaactctgtct

SEQ ID NO: 4653111 - DNA, 19 bp, Homo sapiens
gattttaatttcaggaaaa

SEQ ID NO: 4653112 - DNA, 13 bp, Homo sapiens
gattttcatttta

SEQ ID NO: 4653113 - DNA, 23 bp, Homo sapiens
gattttctattatggaaaactgt

SEQ ID NO: 4653114 - DNA, 21 bp, Homo sapiens
gatttttaaaaaatattttct

SEQ ID NO: 4653115 - DNA, 15 bp, Homo sapiens
gcaaaaattatatat

SEQ ID NO: 4653116 - DNA, 16 bp, Homo sapiens
gcaaaaggcctcttgt

SEQ ID NO: 4653117 - DNA, 17 bp, Homo sapiens
gcaaaaggcctcttgta

SEQ ID NO: 4653118 - DNA, 15 bp, Homo sapiens
gcaaaattaaatcta

SEQ ID NO: 4653119 - DNA, 15 bp, Homo sapiens
gcaaacagaacaggg

SEQ ID NO: 4653120 - DNA, 15 bp, Homo sapiens
gcaaacgagactttc

SEQ ID NO: 4653121 - DNA, 14 bp, Homo sapiens
gcaaactctgctgt

SEQ ID NO: 4653122 - DNA, 19 bp, Homo sapiens
gcaaagcctgttcatggca

SEQ ID NO: 4653123 - DNA, 21 bp, Homo sapiens
gcaaagcctgttcatggcaga

SEQ ID NO: 4653124 - DNA, 19 bp, Homo sapiens
gcaaaggaaaggggcaaaa

SEQ ID NO: 4653125 - DNA, 14 bp, Homo sapiens
gcaaaggagaagca

SEQ ID NO: 4653126 - DNA, 16 bp, Homo sapiens
gcaaatacaatcagcc

SEQ ID NO: 4653127 - DNA, 17 bp, Homo sapiens
gcaaatttctataaatt

SEQ ID NO: 4653128 - DNA, 21 bp, Homo sapiens
gcaaatttctataaatttaag

SEQ ID NO: 4653129 - DNA, 19 bp, Homo sapiens
gcaacaaatgtggccaagc

SEQ ID NO: 4653130 - DNA, 16 bp, Homo sapiens
gcaacacagaggaatt

SEQ ID NO: 4653131 - DNA, 22 bp, Homo sapiens
gcaacagaaaccaagagacaca

SEQ ID NO: 4653132 - DNA, 15 bp, Homo sapiens
gcaacattggacaga

SEQ ID NO: 4653133 - DNA, 17 bp, Homo sapiens
gcaacattggacagaaa

SEQ ID NO: 4653134 - DNA, 19 bp, Homo sapiens
gcaaccccaggctgaagca

SEQ ID NO: 4653135 - DNA, 18 bp, Homo sapiens
gcaaccgtggcccttcct

SEQ ID NO: 4653136 - DNA, 18 bp, Homo sapiens
gcaacctacccagcgtgg

SEQ ID NO: 4653137 - DNA, 14 bp, Homo sapiens
gcaacctctgcctc

SEQ ID NO: 4653138 - DNA, 17 bp, Homo sapiens
gcaacctctgcctcctg

SEQ ID NO: 4653139 - DNA, 18 bp, Homo sapiens
gcaacctctgcctcctgg

SEQ ID NO: 4653140 - DNA, 20 bp, Homo sapiens
gcaacctctgcttcccaggt

SEQ ID NO: 4653141 - DNA, 20 bp, Homo sapiens
gcaactaatgtttgaacaaa

SEQ ID NO: 4653142 - DNA, 15 bp, Homo sapiens
gcaacttccgctgag

SEQ ID NO: 4653143 - DNA, 11 bp, Homo sapiens
gcaagaaacag

SEQ ID NO: 4653144 - DNA, 15 bp, Homo sapiens
gcaagaccctgcctc

SEQ ID NO: 4653145 - DNA, 23 bp, Homo sapiens
gcaagacctcatctgtggagctg

SEQ ID NO: 4653146 - DNA, 24 bp, Homo sapiens
gcaagacctcatctgtggagctgc

SEQ ID NO: 4653147 - DNA, 20 bp, Homo sapiens
gcaagactgggccccacatg

SEQ ID NO: 4653148 - DNA, 19 bp, Homo sapiens
gcaagaggatgaaggaagg

SEQ ID NO: 4653149 - DNA, 15 bp, Homo sapiens
gcaagatatttttga

SEQ ID NO: 4653150 - DNA, 19 bp, Homo sapiens
gcaagcaacacagaggaat

SEQ ID NO: 4653151 - DNA, 12 bp, Homo sapiens
gcaagccctgcc

SEQ ID NO: 4653152 - DNA, 16 bp, Homo sapiens
gcaagccctgcccaca

SEQ ID NO: 4653153 - DNA, 16 bp, Homo sapiens
gcaagctaggccccag

SEQ ID NO: 4653154 - DNA, 18 bp, Homo sapiens
gcaagctaggccccagag

SEQ ID NO: 4653155 - DNA, 20 bp, Homo sapiens
gcaagctcttcccttgctca

SEQ ID NO: 4653156 - DNA, 12 bp, Homo sapiens
gcaaggaacaga

SEQ ID NO: 4653157 - DNA, 18 bp, Homo sapiens
gcaaggaacagaagtgag

SEQ ID NO: 4653158 - DNA, 20 bp, Homo sapiens
gcaaggaacagaagtgagga

SEQ ID NO: 4653159 - DNA, 14 bp, Homo sapiens
gcaaggcccgagca

SEQ ID NO: 4653160 - DNA, 21 bp, Homo sapiens
gcaaggcccgagcagctgagc

SEQ ID NO: 4653161 - DNA, 22 bp, Homo sapiens
gcaaggcccgagcagctgagca

SEQ ID NO: 4653162 - DNA, 15 bp, Homo sapiens
gcaagggaggggtgg

SEQ ID NO: 4653163 - DNA, 17 bp, Homo sapiens
gcaaggtgtgatggtct

SEQ ID NO: 4653164 - DNA, 14 bp, Homo sapiens
gcaagtatatttat

SEQ ID NO: 4653165 - DNA, 14 bp, Homo sapiens
gcaagtgcctggga

SEQ ID NO: 4653166 - DNA, 15 bp, Homo sapiens
gcaagtgcctgggat

SEQ ID NO: 4653167 - DNA, 19 bp, Homo sapiens
gcaagtgcctgggattcta

SEQ ID NO: 4653168 - DNA, 21 bp, Homo sapiens
gcaagttcatgtgtggaaatg

SEQ ID NO: 4653169 - DNA, 13 bp, Homo sapiens
gcaataactgaaa

SEQ ID NO: 4653170 - DNA, 14 bp, Homo sapiens
gcaataactgaaaa

SEQ ID NO: 4653171 - DNA, 16 bp, Homo sapiens
gcaataactgaaaatg

SEQ ID NO: 4653172 - DNA, 22 bp, Homo sapiens
gcaatattccttagtcaaatca

SEQ ID NO: 4653173 - DNA, 23 bp, Homo sapiens
gcaatattttgtatattatgttt

SEQ ID NO: 4653174 - DNA, 16 bp, Homo sapiens
gcaatctctgcctccc

SEQ ID NO: 4653175 - DNA, 14 bp, Homo sapiens
gcaatgctgtactt

SEQ ID NO: 4653176 - DNA, 15 bp, Homo sapiens
gcaatgctgtacttt

SEQ ID NO: 4653177 - DNA, 18 bp, Homo sapiens
gcaatggccaggggccag

SEQ ID NO: 4653178 - DNA, 14 bp, Homo sapiens
gcaatgtgctactg

SEQ ID NO: 4653179 - DNA, 23 bp, Homo sapiens
gcacaaaacccagacctgttagc

SEQ ID NO: 4653180 - DNA, 13 bp, Homo sapiens
gcacaaagtggca

SEQ ID NO: 4653181 - DNA, 18 bp, Homo sapiens
gcacaatcactaaacttt

SEQ ID NO: 4653182 - DNA, 21 bp, Homo sapiens
gcacaatcactaaactttatt

SEQ ID NO: 4653183 - DNA, 22 bp, Homo sapiens
gcacaatcactaaactttattt

SEQ ID NO: 4653184 - DNA, 18 bp, Homo sapiens
gcacaattcctgtgctca

SEQ ID NO: 4653185 - DNA, 11 bp, Homo sapiens
gcacacaccca

SEQ ID NO: 4653186 - DNA, 12 bp, Homo sapiens
gcacacacccat

SEQ ID NO: 4653187 - DNA, 16 bp, Homo sapiens
gcacacagctgagcac

SEQ ID NO: 4653188 - DNA, 11 bp, Homo sapiens
gcacacaggca

SEQ ID NO: 4653189 - DNA, 16 bp, Homo sapiens
gcacacaggcagccag

SEQ ID NO: 4653190 - DNA, 22 bp, Homo sapiens
gcacacaggcagccagccgtgg

SEQ ID NO: 4653191 - DNA, 15 bp, Homo sapiens
gcagcacctccaggc

SEQ ID NO: 4653192 - DNA, 18 bp, Homo sapiens
gcagcacctccaggcctg

SEQ ID NO: 4653193 - DNA, 19 bp, Homo sapiens
gcagcacctccaggcctgt

SEQ ID NO: 4653194 - DNA, 12 bp, Homo sapiens
gcagcactcccc

SEQ ID NO: 4653195 - DNA, 20 bp, Homo sapiens
gcagcactccccagagctgt

SEQ ID NO: 4653196 - DNA, 22 bp, Homo sapiens
gcagcactccccagagctgtgc

SEQ ID NO: 4653197 - DNA, 21 bp, Homo sapiens
gcagcacttagacctgccagc

SEQ ID NO: 4653198 - DNA, 21 bp, Homo sapiens
gcagcagcacttagacctgcc

SEQ ID NO: 4653199 - DNA, 12 bp, Homo sapiens
gcagcagccagc

SEQ ID NO: 4653200 - DNA, 14 bp, Homo sapiens
gcagcagccagccc

SEQ ID NO: 4653201 - DNA, 13 bp, Homo sapiens
gcagcagttgagg

SEQ ID NO: 4653202 - DNA, 18 bp, Homo sapiens
gcagcattgaagtatggt

SEQ ID NO: 4653203 - DNA, 19 bp, Homo sapiens
gcagccacacttctcagga

SEQ ID NO: 4653204 - DNA, 12 bp, Homo sapiens
gcagccaccctg

SEQ ID NO: 4653205 - DNA, 14 bp, Homo sapiens
gcagccaccctgag

SEQ ID NO: 4653206 - DNA, 15 bp, Homo sapiens
gcagccaccctgagg

SEQ ID NO: 4653207 - DNA, 17 bp, Homo sapiens
gcagccaccctgaggag

SEQ ID NO: 4653208 - DNA, 20 bp, Homo sapiens
gcagccaccctgaggagtct

SEQ ID NO: 4653209 - DNA, 20 bp, Homo sapiens
gcagccagccctgcctggag

SEQ ID NO: 4653210 - DNA, 16 bp, Homo sapiens
gcagcccctgttttct

SEQ ID NO: 4653211 - DNA, 14 bp, Homo sapiens
gcagccctggcccc

SEQ ID NO: 4653212 - DNA, 16 bp, Homo sapiens
gcagccctggccccca

SEQ ID NO: 4653213 - DNA, 22 bp, Homo sapiens
gcagccctggcccccatcagcc

SEQ ID NO: 4653214 - DNA, 18 bp, Homo sapiens
gcagcctcccatccaggg

SEQ ID NO: 4653215 - DNA, 20 bp, Homo sapiens
gcagcctcccatccagggcc

SEQ ID NO: 4653216 - DNA, 14 bp, Homo sapiens
gcagcctgaacact

SEQ ID NO: 4653217 - DNA, 16 bp, Homo sapiens
gcagcctgctctagtg

SEQ ID NO: 4653218 - DNA, 17 bp, Homo sapiens
gcagcctggggctggcc

SEQ ID NO: 4653219 - DNA, 19 bp, Homo sapiens
gcagcgcccttcctctcca

SEQ ID NO: 4653220 - DNA, 21 bp, Homo sapiens
gcagcgcccttcctctccacc

SEQ ID NO: 4653221 - DNA, 15 bp, Homo sapiens
gcagcgggcggaggg

SEQ ID NO: 4653222 - DNA, 18 bp, Homo sapiens
gcagctccaccactgtgc

SEQ ID NO: 4653223 - DNA, 20 bp, Homo sapiens
gcagctccaccactgtgcac

SEQ ID NO: 4653224 - DNA, 13 bp, Homo sapiens
gcagctcctctgt

SEQ ID NO: 4653225 - DNA, 21 bp, Homo sapiens
gcagctgaataacctgcacag

SEQ ID NO: 4653226 - DNA, 23 bp, Homo sapiens
gcagctgacttggttctgaagcc

SEQ ID NO: 4653227 - DNA, 14 bp, Homo sapiens
gcagctgagcaggg

SEQ ID NO: 4653228 - DNA, 15 bp, Homo sapiens
gcagctgagcagggc

SEQ ID NO: 4653229 - DNA, 14 bp, Homo sapiens
gcagcttgtagcca

SEQ ID NO: 4653230 - DNA, 16 bp, Homo sapiens
gcagcttgtagccagc

SEQ ID NO: 4653231 - DNA, 20 bp, Homo sapiens
gcagcttgtagccagccggg

SEQ ID NO: 4653232 - DNA, 16 bp, Homo sapiens
gcaggaataaagactt

SEQ ID NO: 4653233 - DNA, 17 bp, Homo sapiens
gcaggactgtgcctcca

SEQ ID NO: 4653234 - DNA, 17 bp, Homo sapiens
gcaggaggctttctggg

SEQ ID NO: 4653235 - DNA, 20 bp, Homo sapiens
gcaggaggctttctgggctc

SEQ ID NO: 4653236 - DNA, 21 bp, Homo sapiens
gcaggaggctttctgggctct

SEQ ID NO: 4653237 - DNA, 19 bp, Homo sapiens
gcaggagtagctgagctca

SEQ ID NO: 4653238 - DNA, 15 bp, Homo sapiens
gcaggagtggtgcag

SEQ ID NO: 4653239 - DNA, 18 bp, Homo sapiens
gcaggagtggtgcagaca

SEQ ID NO: 4653240 - DNA, 15 bp, Homo sapiens
gcaggagtgtcctgc

SEQ ID NO: 4653241 - DNA, 17 bp, Homo sapiens
gcaggagtgtcctgccc

SEQ ID NO: 4653242 - DNA, 22 bp, Homo sapiens
gcaggagtgtcctgcccatgcc

SEQ ID NO: 4653243 - DNA, 23 bp, Homo sapiens
gcaggcaagagaattgaaatgag

SEQ ID NO: 4653244 - DNA, 12 bp, Homo sapiens
gcaggcagggct

SEQ ID NO: 4653245 - DNA, 15 bp, Homo sapiens
gcaggcagggctctc

SEQ ID NO: 4653246 - DNA, 16 bp, Homo sapiens
gcaggcagggctctcc

SEQ ID NO: 4653247 - DNA, 20 bp, Homo sapiens
gcaggcagggctctcctggc

SEQ ID NO: 4653248 - DNA, 22 bp, Homo sapiens
gcaggcagggctctcctggctt

SEQ ID NO: 4653249 - DNA, 16 bp, Homo sapiens
gcaggcattgaggaag

SEQ ID NO: 4653250 - DNA, 23 bp, Homo sapiens
gcaggcctcgaaaaccatcacat

SEQ ID NO: 4653251 - DNA, 19 bp, Homo sapiens
gcagggaaggacaggaccc

SEQ ID NO: 4653252 - DNA, 20 bp, Homo sapiens
gcagggacaagtctttctcc

SEQ ID NO: 4653253 - DNA, 19 bp, Homo sapiens
gcagggaccggcagagctc

SEQ ID NO: 4653254 - DNA, 13 bp, Homo sapiens
gcagggaggagtg

SEQ ID NO: 4653255 - DNA, 14 bp, Homo sapiens
gcagggaggagtgg

SEQ ID NO: 4653256 - DNA, 24 bp, Homo sapiens
gcagggccatctgactgccaagcc

SEQ ID NO: 4653257 - DNA, 22 bp, Homo sapiens
gcagggccggggaactggccaa

SEQ ID NO: 4653258 - DNA, 14 bp, Homo sapiens
gcagggcctggcat

SEQ ID NO: 4653259 - DNA, 14 bp, Homo sapiens
gcagggctctcctg

SEQ ID NO: 4653260 - DNA, 20 bp, Homo sapiens
gcaggggagggtcagccagg

SEQ ID NO: 4653261 - DNA, 22 bp, Homo sapiens
gcaggggcgggcggagggaggg

SEQ ID NO: 4653262 - DNA, 16 bp, Homo sapiens
gcaggggggctgtgcc

SEQ ID NO: 4653263 - DNA, 22 bp, Homo sapiens
gcaggggggctgtgccaacctg

SEQ ID NO: 4653264 - DNA, 16 bp, Homo sapiens
gcagggtcaagcctct

SEQ ID NO: 4653265 - DNA, 21 bp, Homo sapiens
gcagggtcttttcatctggga

SEQ ID NO: 4653266 - DNA, 22 bp, Homo sapiens
gcagggtgcagtatcatgccct

SEQ ID NO: 4653267 - DNA, 21 bp, Homo sapiens
gcaggtatttagaagcagagg

SEQ ID NO: 4653268 - DNA, 23 bp, Homo sapiens
gcaggtatttagaagcagaggga

SEQ ID NO: 4653269 - DNA, 14 bp, Homo sapiens
gcaggtcagcccat

SEQ ID NO: 4653270 - DNA, 23 bp, Homo sapiens
gcaggtcagcccatggaggcaga

SEQ ID NO: 4653271 - DNA, 13 bp, Homo sapiens
gcaggttcccaag

SEQ ID NO: 4653272 - DNA, 16 bp, Homo sapiens
gcaggttcccaagctc

SEQ ID NO: 4653273 - DNA, 19 bp, Homo sapiens
gcaggttccccaagggccc

SEQ ID NO: 4653274 - DNA, 20 bp, Homo sapiens
gcaggttccccaagggccct

SEQ ID NO: 4653275 - DNA, 21 bp, Homo sapiens
gcagtatcatgccctgtgcaa

SEQ ID NO: 4653276 - DNA, 17 bp, Homo sapiens
gcagtctttcccccagg

SEQ ID NO: 4653277 - DNA, 16 bp, Homo sapiens
gcagtggagggggcaa

SEQ ID NO: 4653278 - DNA, 19 bp, Homo sapiens
gcagtggagggggcaagct

SEQ ID NO: 4653279 - DNA, 16 bp, Homo sapiens
gcagtggtgcgatctc

SEQ ID NO: 4653280 - DNA, 20 bp, Homo sapiens
gcagttcgcagccaccctga

SEQ ID NO: 4653281 - DNA, 22 bp, Homo sapiens
gcagttcgcagccaccctgagg

SEQ ID NO: 4653282 - DNA, 23 bp, Homo sapiens
gcagttcgcagccaccctgagga

SEQ ID NO: 4653283 - DNA, 15 bp, Homo sapiens
gcagtttaacaaaat

SEQ ID NO: 4653284 - DNA, 11 bp, Homo sapiens
gcataataaat

SEQ ID NO: 4653285 - DNA, 20 bp, Homo sapiens
gcataataaatgcttcagtg

SEQ ID NO: 4653286 - DNA, 17 bp, Homo sapiens
gcataatctgaaaacat

SEQ ID NO: 4653287 - DNA, 16 bp, Homo sapiens
gcatactgaaaatcca

SEQ ID NO: 4653288 - DNA, 14 bp, Homo sapiens
gcatactttgtaaa

SEQ ID NO: 4653289 - DNA, 17 bp, Homo sapiens
gcatatttataagagaa

SEQ ID NO: 4653290 - DNA, 21 bp, Homo sapiens
gcatcacatctgcacactctc

SEQ ID NO: 4653291 - DNA, 18 bp, Homo sapiens
gcatcagaaagggagggc

SEQ ID NO: 4653292 - DNA, 14 bp, Homo sapiens
gcatcatgcctctg

SEQ ID NO: 4653293 - DNA, 21 bp, Homo sapiens
gcatcatgcctctgaggccag

SEQ ID NO: 4653294 - DNA, 12 bp, Homo sapiens
gcatccagcagc

SEQ ID NO: 4653295 - DNA, 17 bp, Homo sapiens
gcatccagcagcagcac

SEQ ID NO: 4653296 - DNA, 13 bp, Homo sapiens
gcatccctggagc

SEQ ID NO: 4653297 - DNA, 21 bp, Homo sapiens
gcatccctggagcaggagccc

SEQ ID NO: 4653298 - DNA, 16 bp, Homo sapiens
gcatccgtgaggcagg

SEQ ID NO: 4653299 - DNA, 17 bp, Homo sapiens
gcatccgtgaggcaggg

SEQ ID NO: 4653300 - DNA, 22 bp, Homo sapiens
gcccagtacctagctggctctg

SEQ ID NO: 4653301 - DNA, 22 bp, Homo sapiens
gcccagtgttttctttgaggac

SEQ ID NO: 4653302 - DNA, 19 bp, Homo sapiens
gcccatccattaggccagc

SEQ ID NO: 4653303 - DNA, 16 bp, Homo sapiens
gcccatctctccctgc

SEQ ID NO: 4653304 - DNA, 18 bp, Homo sapiens
gcccatgtgtacattctg

SEQ ID NO: 4653305 - DNA, 17 bp, Homo sapiens
gcccattaatcttgatc

SEQ ID NO: 4653306 - DNA, 14 bp, Homo sapiens
gcccattgctgcca

SEQ ID NO: 4653307 - DNA, 16 bp, Homo sapiens
gccccaaagttgctca

SEQ ID NO: 4653308 - DNA, 22 bp, Homo sapiens
gccccaacccgtggaggctgct

SEQ ID NO: 4653309 - DNA, 23 bp, Homo sapiens
gccccaacccgtggaggctgctc

SEQ ID NO: 4653310 - DNA, 19 bp, Homo sapiens
gccccacaaggcctggtct

SEQ ID NO: 4653311 - DNA, 22 bp, Homo sapiens
gccccacaaggcctggtctggg

SEQ ID NO: 4653312 - DNA, 15 bp, Homo sapiens
gccccacccctgtaa

SEQ ID NO: 4653313 - DNA, 16 bp, Homo sapiens
gccccaccccttccct

SEQ ID NO: 4653314 - DNA, 19 bp, Homo sapiens
gccccacccttgtccctca

SEQ ID NO: 4653315 - DNA, 12 bp, Homo sapiens
gccccagaggcc

SEQ ID NO: 4653316 - DNA, 13 bp, Homo sapiens
gccccagaggccc

SEQ ID NO: 4653317 - DNA, 15 bp, Homo sapiens
gccccagaggccctg

SEQ ID NO: 4653318 - DNA, 17 bp, Homo sapiens
gccccagaggccctgga

SEQ ID NO: 4653319 - DNA, 20 bp, Homo sapiens
gccccaggacctggctgcca

SEQ ID NO: 4653320 - DNA, 22 bp, Homo sapiens
gccccaggacctggctgccata

SEQ ID NO: 4653321 - DNA, 20 bp, Homo sapiens
gccccaggccctactaccca

SEQ ID NO: 4653322 - DNA, 14 bp, Homo sapiens
gccccatgacctcc

SEQ ID NO: 4653323 - DNA, 16 bp, Homo sapiens
gccccatgacctccag

SEQ ID NO: 4653324 - DNA, 17 bp, Homo sapiens
gccccatgacctccagc

SEQ ID NO: 4653325 - DNA, 18 bp, Homo sapiens
gccccatgacctccagct

SEQ ID NO: 4653326 - DNA, 14 bp, Homo sapiens
gccccattgctcca

SEQ ID NO: 4653327 - DNA, 15 bp, Homo sapiens
gcccccagccctggg

SEQ ID NO: 4653328 - DNA, 16 bp, Homo sapiens
gcccccagccctggga

SEQ ID NO: 4653329 - DNA, 21 bp, Homo sapiens
gcccccagccctgggaaccac

SEQ ID NO: 4653330 - DNA, 12 bp, Homo sapiens
gcccccagctgg

SEQ ID NO: 4653331 - DNA, 17 bp, Homo sapiens
gcccccatcagccctgc

SEQ ID NO: 4653332 - DNA, 13 bp, Homo sapiens
gcccccatctcat

SEQ ID NO: 4653333 - DNA, 15 bp, Homo sapiens
gccccctccaggaga

SEQ ID NO: 4653334 - DNA, 16 bp, Homo sapiens
gccccgccagggctgg

SEQ ID NO: 4653335 - DNA, 16 bp, Homo sapiens
gccccgggctggagaa

SEQ ID NO: 4653336 - DNA, 19 bp, Homo sapiens
gccccgggctggagaaaga

SEQ ID NO: 4653337 - DNA, 15 bp, Homo sapiens
gccccgtagagaatg

SEQ ID NO: 4653338 - DNA, 13 bp, Homo sapiens
gccccgtgaggca

SEQ ID NO: 4653339 - DNA, 14 bp, Homo sapiens
gcccctcacttcca

SEQ ID NO: 4653340 - DNA, 20 bp, Homo sapiens
gcccctcctccagcccctgt

SEQ ID NO: 4653341 - DNA, 15 bp, Homo sapiens
gcccctctctgggcc

SEQ ID NO: 4653342 - DNA, 23 bp, Homo sapiens
gcccctggctgggacgtggctca

SEQ ID NO: 4653343 - DNA, 22 bp, Homo sapiens
gcccctgtgggactcatccttg

SEQ ID NO: 4653344 - DNA, 23 bp, Homo sapiens
gcccctgtgggactcatccttgc

SEQ ID NO: 4653345 - DNA, 19 bp, Homo sapiens
gccccttaaccccaaggac

SEQ ID NO: 4653346 - DNA, 14 bp, Homo sapiens
gccccttcccctgg

SEQ ID NO: 4653347 - DNA, 15 bp, Homo sapiens
gccccttcccctggg

SEQ ID NO: 4653348 - DNA, 19 bp, Homo sapiens
gccccttcccctgggaact

SEQ ID NO: 4653349 - DNA, 15 bp, Homo sapiens
gcccgacagtgccat

SEQ ID NO: 4653350 - DNA, 20 bp, Homo sapiens
gcccgagagcctcgcttttt

SEQ ID NO: 4653351 - DNA, 12 bp, Homo sapiens
gcccgagcagct

SEQ ID NO: 4653352 - DNA, 13 bp, Homo sapiens
gcccgagcagctg

SEQ ID NO: 4653353 - DNA, 17 bp, Homo sapiens
gcccgagcagctgagca

SEQ ID NO: 4653354 - DNA, 18 bp, Homo sapiens
gcccgagggcagccccct

SEQ ID NO: 4653355 - DNA, 23 bp, Homo sapiens
gcccgagggcagccccctcccta

SEQ ID NO: 4653356 - DNA, 20 bp, Homo sapiens
gcccgcccagaggagcccag

SEQ ID NO: 4653357 - DNA, 16 bp, Homo sapiens
gcccgcgcagctgcct

SEQ ID NO: 4653358 - DNA, 17 bp, Homo sapiens
gcccgcgcagctgccta

SEQ ID NO: 4653359 - DNA, 23 bp, Homo sapiens
gcccggagctgcccctctctggg

SEQ ID NO: 4653360 - DNA, 16 bp, Homo sapiens
gcccggtgcagggcct

SEQ ID NO: 4653361 - DNA, 19 bp, Homo sapiens
gcccggtgcagggcctggc

SEQ ID NO: 4653362 - DNA, 21 bp, Homo sapiens
gcccggtgcagggcctggcat

SEQ ID NO: 4653363 - DNA, 22 bp, Homo sapiens
gcccggtgcagggcctggcata

SEQ ID NO: 4653364 - DNA, 22 bp, Homo sapiens
gcccgtgccacccccagccctg

SEQ ID NO: 4653365 - DNA, 14 bp, Homo sapiens
gccctatgctgtgc

SEQ ID NO: 4653366 - DNA, 20 bp, Homo sapiens
gccctcagctggtcctgacc

SEQ ID NO: 4653367 - DNA, 21 bp, Homo sapiens
gccctcagctggtcctgacca

SEQ ID NO: 4653368 - DNA, 21 bp, Homo sapiens
gccctcatctatgaggaaagg

SEQ ID NO: 4653369 - DNA, 14 bp, Homo sapiens
gccctcccagccca

SEQ ID NO: 4653370 - DNA, 21 bp, Homo sapiens
gccctcccctgcccctcacaa

SEQ ID NO: 4653371 - DNA, 18 bp, Homo sapiens
gccctcctgtgctggggg

SEQ ID NO: 4653372 - DNA, 17 bp, Homo sapiens
gccctcgcctctgcgag

SEQ ID NO: 4653373 - DNA, 15 bp, Homo sapiens
gccctctatttatta

SEQ ID NO: 4653374 - DNA, 21 bp, Homo sapiens
gccctctatttattagccaac

SEQ ID NO: 4653375 - DNA, 13 bp, Homo sapiens
gccctctttccct

SEQ ID NO: 4653376 - DNA, 13 bp, Homo sapiens
gccctgcaccttc

SEQ ID NO: 4653377 - DNA, 14 bp, Homo sapiens
gccctgcagaccct

SEQ ID NO: 4653378 - DNA, 15 bp, Homo sapiens
gccctgcatctgtct

SEQ ID NO: 4653379 - DNA, 16 bp, Homo sapiens
gccctgcatctgtctg

SEQ ID NO: 4653380 - DNA, 17 bp, Homo sapiens
gccctgcatctgtctgc

SEQ ID NO: 4653381 - DNA, 18 bp, Homo sapiens
gccctgcatctgtctgct

SEQ ID NO: 4653382 - DNA, 20 bp, Homo sapiens
gccctgcatctgtctgctct

SEQ ID NO: 4653383 - DNA, 22 bp, Homo sapiens
gccctgccattctgcatgagct

SEQ ID NO: 4653384 - DNA, 13 bp, Homo sapiens
gccctgcccacag

SEQ ID NO: 4653385 - DNA, 14 bp, Homo sapiens
gccctgcccaggta

SEQ ID NO: 4653386 - DNA, 14 bp, Homo sapiens
gccctgcctggagg

SEQ ID NO: 4653387 - DNA, 15 bp, Homo sapiens
gccctgcctggagga

SEQ ID NO: 4653388 - DNA, 16 bp, Homo sapiens
gccctgcctggaggac

SEQ ID NO: 4653389 - DNA, 19 bp, Homo sapiens
gccctgcctggaggacctg

SEQ ID NO: 4653390 - DNA, 21 bp, Homo sapiens
gccctgcctggaggacctgag

SEQ ID NO: 4653391 - DNA, 23 bp, Homo sapiens
gccctgcctggaggacctgagcc

SEQ ID NO: 4653392 - DNA, 9 bp, Homo sapiens
gccctgcta

SEQ ID NO: 4653393 - DNA, 21 bp, Homo sapiens
gccctgctagacgcaccgcct

SEQ ID NO: 4653394 - DNA, 16 bp, Homo sapiens
gccctgctctgcccag

SEQ ID NO: 4653395 - DNA, 17 bp, Homo sapiens
gccctgctctgcccagg

SEQ ID NO: 4653396 - DNA, 22 bp, Homo sapiens
gccctgctctgcccaggcaagg

SEQ ID NO: 4653397 - DNA, 21 bp, Homo sapiens
gccctggatcagcgtggcctt

SEQ ID NO: 4653398 - DNA, 21 bp, Homo sapiens
gccctggcccccatcagccct

SEQ ID NO: 4653399 - DNA, 15 bp, Homo sapiens
gccctggggcctgta

SEQ ID NO: 4653400 - DNA, 22 bp, Homo sapiens
gccctggggcctgtactgcctg

SEQ ID NO: 4653401 - DNA, 23 bp, Homo sapiens
gccctggggcctgtactgcctgc

SEQ ID NO: 4653402 - DNA, 16 bp, Homo sapiens
gccctgtctctggcta

SEQ ID NO: 4653403 - DNA, 18 bp, Homo sapiens
gccctgtgttctttcccc

SEQ ID NO: 4653404 - DNA, 20 bp, Homo sapiens
gccctgtgttctttccccag

SEQ ID NO: 4653405 - DNA, 20 bp, Homo sapiens
gcccttaactatcaccagtg

SEQ ID NO: 4653406 - DNA, 19 bp, Homo sapiens
gcccttacctgtctctctc

SEQ ID NO: 4653407 - DNA, 21 bp, Homo sapiens
gcccttcagcatcctcagttc

SEQ ID NO: 4653408 - DNA, 16 bp, Homo sapiens
gcccttccccctttct

SEQ ID NO: 4653409 - DNA, 19 bp, Homo sapiens
gcctggcctcctgcctcta

SEQ ID NO: 4653410 - DNA, 17 bp, Homo sapiens
gcctggctggctgaggg

SEQ ID NO: 4653411 - DNA, 14 bp, Homo sapiens
gcctggctggtggg

SEQ ID NO: 4653412 - DNA, 17 bp, Homo sapiens
gcctgggctcatagtga

SEQ ID NO: 4653413 - DNA, 14 bp, Homo sapiens
gcctggggcctgag

SEQ ID NO: 4653414 - DNA, 15 bp, Homo sapiens
gcctggggcctgaga

SEQ ID NO: 4653415 - DNA, 17 bp, Homo sapiens
gcctggggctggcctcc

SEQ ID NO: 4653416 - DNA, 18 bp, Homo sapiens
gcctgggggcctggctgg

SEQ ID NO: 4653417 - DNA, 22 bp, Homo sapiens
gcctgggggcttttgccactcc

SEQ ID NO: 4653418 - DNA, 21 bp, Homo sapiens
gcctgggggttttccaagccc

SEQ ID NO: 4653419 - DNA, 19 bp, Homo sapiens
gcctggggtgacccggcac

SEQ ID NO: 4653420 - DNA, 16 bp, Homo sapiens
gcctgggtaggcccca

SEQ ID NO: 4653421 - DNA, 17 bp, Homo sapiens
gcctgggtaggccccac

SEQ ID NO: 4653422 - DNA, 20 bp, Homo sapiens
gcctgggtgatctgctgctg

SEQ ID NO: 4653423 - DNA, 16 bp, Homo sapiens
atggaaattttgctat

SEQ ID NO: 4653424 - DNA, 15 bp, Homo sapiens
atggaattaaatgtg

SEQ ID NO: 4653425 - DNA, 14 bp, Homo sapiens
atggacatggtggc

SEQ ID NO: 4653426 - DNA, 22 bp, Homo sapiens
atggacgtgtctgcacagggtc

SEQ ID NO: 4653427 - DNA, 15 bp, Homo sapiens
atggactctgcacat

SEQ ID NO: 4653428 - DNA, 13 bp, Homo sapiens
atggagaaagaag

SEQ ID NO: 4653429 - DNA, 14 bp, Homo sapiens
atggagaaagaagt

SEQ ID NO: 4653430 - DNA, 11 bp, Homo sapiens
atggagaggct

SEQ ID NO: 4653431 - DNA, 19 bp, Homo sapiens
atggagggtatactgaggg

SEQ ID NO: 4653432 - DNA, 19 bp, Homo sapiens
atggaggtcccagccctgg

SEQ ID NO: 4653433 - DNA, 13 bp, Homo sapiens
atggagtagaggt

SEQ ID NO: 4653434 - DNA, 20 bp, Homo sapiens
atggcaacagaaaccaagag

SEQ ID NO: 4653435 - DNA, 15 bp, Homo sapiens
atggcagaggagctt

SEQ ID NO: 4653436 - DNA, 17 bp, Homo sapiens
atggcatcctgtgaagt

SEQ ID NO: 4653437 - DNA, 17 bp, Homo sapiens
atggcatcttcaatatg

SEQ ID NO: 4653438 - DNA, 13 bp, Homo sapiens
atggcatttctct

SEQ ID NO: 4653439 - DNA, 16 bp, Homo sapiens
atggcatttctcttta

SEQ ID NO: 4653440 - DNA, 16 bp, Homo sapiens
atggccagactccctt

SEQ ID NO: 4653441 - DNA, 18 bp, Homo sapiens
atggccaggggccaggag

SEQ ID NO: 4653442 - DNA, 22 bp, Homo sapiens
atggcctcttactaatgtaaaa

SEQ ID NO: 4653443 - DNA, 13 bp, Homo sapiens
atggccttgaaac

SEQ ID NO: 4653444 - DNA, 20 bp, Homo sapiens
atggcggcacacatctgtaa

SEQ ID NO: 4653445 - DNA, 18 bp, Homo sapiens
atggctacctcagaaaga

SEQ ID NO: 4653446 - DNA, 14 bp, Homo sapiens
atggctctgcaccc

SEQ ID NO: 4653447 - DNA, 17 bp, Homo sapiens
atggctctgcacccctc

SEQ ID NO: 4653448 - DNA, 22 bp, Homo sapiens
atggctctgcacccctctgccc

SEQ ID NO: 4653449 - DNA, 20 bp, Homo sapiens
atggctgtgtttgcagcctg

SEQ ID NO: 4653450 - DNA, 21 bp, Homo sapiens
atggctgtgtttgcagcctgc

SEQ ID NO: 4653451 - DNA, 21 bp, Homo sapiens
atgggaaggtgggcgggcagg

SEQ ID NO: 4653452 - DNA, 17 bp, Homo sapiens
atgggaattggaatcaa

SEQ ID NO: 4653453 - DNA, 15 bp, Homo sapiens
atgggacctataact

SEQ ID NO: 4653454 - DNA, 22 bp, Homo sapiens
atgggacctataactgcccagc

SEQ ID NO: 4653455 - DNA, 23 bp, Homo sapiens
atgggagctgaggccacactcag

SEQ ID NO: 4653456 - DNA, 22 bp, Homo sapiens
atgggatggtcggatctcacag

SEQ ID NO: 4653457 - DNA, 15 bp, Homo sapiens
atgggcaaagcttgt

SEQ ID NO: 4653458 - DNA, 17 bp, Homo sapiens
atgggctaatgaagatc

SEQ ID NO: 4653459 - DNA, 17 bp, Homo sapiens
atggggatgggaggggg

SEQ ID NO: 4653460 - DNA, 10 bp, Homo sapiens
atggggtggg

SEQ ID NO: 4653461 - DNA, 13 bp, Homo sapiens
atggtactattta

SEQ ID NO: 4653462 - DNA, 18 bp, Homo sapiens
atggtacttcctctgtga

SEQ ID NO: 4653463 - DNA, 24 bp, Homo sapiens
atggtacttcctctgtgaactgtg

SEQ ID NO: 4653464 - DNA, 15 bp, Homo sapiens
atggtatcctactga

SEQ ID NO: 4653465 - DNA, 12 bp, Homo sapiens
atggtcaagcct

SEQ ID NO: 4653466 - DNA, 19 bp, Homo sapiens
atggtcccacatccctggg

SEQ ID NO: 4653467 - DNA, 23 bp, Homo sapiens
atggtcccacatccctgggcctg

SEQ ID NO: 4653468 - DNA, 16 bp, Homo sapiens
atggtcggatctcaca

SEQ ID NO: 4653469 - DNA, 19 bp, Homo sapiens
atggtgagatgcagctgga

SEQ ID NO: 4653470 - DNA, 18 bp, Homo sapiens
atgtaaaaggccaaacct

SEQ ID NO: 4653471 - DNA, 21 bp, Homo sapiens
atgtaaacaaaccacagcagg

SEQ ID NO: 4653472 - DNA, 19 bp, Homo sapiens
atgtaagcatactttgtaa

SEQ ID NO: 4653473 - DNA, 20 bp, Homo sapiens
atgtaatgtgtggtggcctc

SEQ ID NO: 4653474 - DNA, 21 bp, Homo sapiens
atgtaatgtgtggtggcctca

SEQ ID NO: 4653475 - DNA, 13 bp, Homo sapiens
atgtaatttcaaa

SEQ ID NO: 4653476 - DNA, 16 bp, Homo sapiens
atgtaatttcaaaata

SEQ ID NO: 4653477 - DNA, 15 bp, Homo sapiens
atgtacacaggtcaa

SEQ ID NO: 4653478 - DNA, 16 bp, Homo sapiens
atgtacatttattcat

SEQ ID NO: 4653479 - DNA, 19 bp, Homo sapiens
atgtacttctctgtgtgca

SEQ ID NO: 4653480 - DNA, 16 bp, Homo sapiens
atgtacttgtcaaaga

SEQ ID NO: 4653481 - DNA, 17 bp, Homo sapiens
atgtacttgtcaaagaa

SEQ ID NO: 4653482 - DNA, 15 bp, Homo sapiens
atgtactttttagta

SEQ ID NO: 4653483 - DNA, 17 bp, Homo sapiens
atgtagccagcagaact

SEQ ID NO: 4653484 - DNA, 18 bp, Homo sapiens
atgtagcttcttctgaaa

SEQ ID NO: 4653485 - DNA, 20 bp, Homo sapiens
atgtagcttcttctgaaaga

SEQ ID NO: 4653486 - DNA, 17 bp, Homo sapiens
atgtagtcataataaat

SEQ ID NO: 4653487 - DNA, 16 bp, Homo sapiens
atgtataaatgtgata

SEQ ID NO: 4653488 - DNA, 20 bp, Homo sapiens
atgtatccaaggaaacattt

SEQ ID NO: 4653489 - DNA, 14 bp, Homo sapiens
atgtatgcagctat

SEQ ID NO: 4653490 - DNA, 16 bp, Homo sapiens
atgtatgtatgtatta

SEQ ID NO: 4653491 - DNA, 14 bp, Homo sapiens
atgtcactagaatg

SEQ ID NO: 4653492 - DNA, 13 bp, Homo sapiens
atgtcatgtctgc

SEQ ID NO: 4653493 - DNA, 17 bp, Homo sapiens
atgtcatgtctgcttgt

SEQ ID NO: 4653494 - DNA, 18 bp, Homo sapiens
atgtcatgtctgcttgtc

SEQ ID NO: 4653495 - DNA, 17 bp, Homo sapiens
atgtccctgggccaggg

SEQ ID NO: 4653496 - DNA, 19 bp, Homo sapiens
atgtcctaaagaagacatt

SEQ ID NO: 4653497 - DNA, 16 bp, Homo sapiens
atgtcctattactgat

SEQ ID NO: 4653498 - DNA, 23 bp, Homo sapiens
atgtcctattactgatgtgtgca

SEQ ID NO: 4653499 - DNA, 21 bp, Homo sapiens
atgtcggtcatagtttcctga

SEQ ID NO: 4653500 - DNA, 22 bp, Homo sapiens
atgtctataatcccagcacttt

SEQ ID NO: 4653501 - DNA, 15 bp, Homo sapiens
atgtctcgtggtagg

SEQ ID NO: 4653502 - DNA, 19 bp, Homo sapiens
atgtctcgtggtaggactg

SEQ ID NO: 4653503 - DNA, 19 bp, Homo sapiens
atgtctctttggagttgga

SEQ ID NO: 4653504 - DNA, 21 bp, Homo sapiens
atgtctgcttgtcaaaagaaa

SEQ ID NO: 4653505 - DNA, 19 bp, Homo sapiens
atgtctgtatcactctgtg

SEQ ID NO: 4653506 - DNA, 19 bp, Homo sapiens
atgtctgtatccccagtgc

SEQ ID NO: 4653507 - DNA, 13 bp, Homo sapiens
atgtctgttcttc

SEQ ID NO: 4653508 - DNA, 17 bp, Homo sapiens
atgtcttactactttaa

SEQ ID NO: 4653509 - DNA, 20 bp, Homo sapiens
atgtcttactactttaaatc

SEQ ID NO: 4653510 - DNA, 21 bp, Homo sapiens
atgtcttactactttaaatcc

SEQ ID NO: 4653511 - DNA, 17 bp, Homo sapiens
atgtcttgactgttagt

SEQ ID NO: 4653512 - DNA, 20 bp, Homo sapiens
atgtcttgcaaagcctttaa

SEQ ID NO: 4653513 - DNA, 20 bp, Homo sapiens
atgtcttggacactgtacaa

SEQ ID NO: 4653514 - DNA, 17 bp, Homo sapiens
atgtcttgtacatgtgt

SEQ ID NO: 4653515 - DNA, 14 bp, Homo sapiens
atgtcttgtgtatt

SEQ ID NO: 4653516 - DNA, 15 bp, Homo sapiens
atgtcttgtgtattt

SEQ ID NO: 4653517 - DNA, 13 bp, Homo sapiens
atgtcttttaaaa

SEQ ID NO: 4653518 - DNA, 14 bp, Homo sapiens
atgtcttttaaaat

SEQ ID NO: 4653519 - DNA, 17 bp, Homo sapiens
atgtgaaaaattaactt

SEQ ID NO: 4653520 - DNA, 13 bp, Homo sapiens
atgtgaaaatcat

SEQ ID NO: 4653521 - DNA, 19 bp, Homo sapiens
atgtgaactctcccctccc

SEQ ID NO: 4653522 - DNA, 21 bp, Homo sapiens
atgtgaactctcccctcccca

SEQ ID NO: 4653523 - DNA, 23 bp, Homo sapiens
atgtgaactctcccctccccatc

SEQ ID NO: 4653524 - DNA, 19 bp, Homo sapiens
atgtgaataatggcactga

SEQ ID NO: 4653525 - DNA, 21 bp, Homo sapiens
atgtgacattccatgacgaca

SEQ ID NO: 4653526 - DNA, 22 bp, Homo sapiens
atgtgacattccatgacgacat

SEQ ID NO: 4653527 - DNA, 14 bp, Homo sapiens
atgtgagaagccag

SEQ ID NO: 4653528 - DNA, 15 bp, Homo sapiens
atgtgagaagccagc

SEQ ID NO: 4653529 - DNA, 18 bp, Homo sapiens
atgtgagtatttctgttc

SEQ ID NO: 4653530 - DNA, 15 bp, Homo sapiens
atgtgatcaggcccc

SEQ ID NO: 4653531 - DNA, 16 bp, Homo sapiens
atgtgatcaggcccca

SEQ ID NO: 4653532 - DNA, 20 bp, Homo sapiens
atgtgatcaggccccacccc

SEQ ID NO: 4653533 - DNA, 20 bp, Homo sapiens
attatattggtccagaagtt

SEQ ID NO: 4653534 - DNA, 12 bp, Homo sapiens
attatcattgct

SEQ ID NO: 4653535 - DNA, 12 bp, Homo sapiens
attatcttgaaa

SEQ ID NO: 4653536 - DNA, 18 bp, Homo sapiens
attatcttggaaagaaac

SEQ ID NO: 4653537 - DNA, 17 bp, Homo sapiens
attatgacatttcttaa

SEQ ID NO: 4653538 - DNA, 20 bp, Homo sapiens
attatgacatttcttaaaac

SEQ ID NO: 4653539 - DNA, 23 bp, Homo sapiens
attatgagacacaggatgaagca

SEQ ID NO: 4653540 - DNA, 21 bp, Homo sapiens
attatgcacttttagaaatgc

SEQ ID NO: 4653541 - DNA, 23 bp, Homo sapiens
attatgcacttttagaaatgcat

SEQ ID NO: 4653542 - DNA, 22 bp, Homo sapiens
attatgccacttccttttaact

SEQ ID NO: 4653543 - DNA, 15 bp, Homo sapiens
attatgtgcaacatt

SEQ ID NO: 4653544 - DNA, 15 bp, Homo sapiens
attatgtttatttca

SEQ ID NO: 4653545 - DNA, 18 bp, Homo sapiens
attatgtttgatttctct

SEQ ID NO: 4653546 - DNA, 17 bp, Homo sapiens
attattattattgctga

SEQ ID NO: 4653547 - DNA, 16 bp, Homo sapiens
attattcaagaatgaa

SEQ ID NO: 4653548 - DNA, 18 bp, Homo sapiens
attattcaagaatgaaaa

SEQ ID NO: 4653549 - DNA, 19 bp, Homo sapiens
attattcaagaatgaaaaa

SEQ ID NO: 4653550 - DNA, 23 bp, Homo sapiens
attattcaagaatgaaaaatata

SEQ ID NO: 4653551 - DNA, 19 bp, Homo sapiens
attattcagaattatacag

SEQ ID NO: 4653552 - DNA, 21 bp, Homo sapiens
attatttattaaaaatgttct

SEQ ID NO: 4653553 - DNA, 23 bp, Homo sapiens
attatttgaaaacatataaagca

SEQ ID NO: 4653554 - DNA, 19 bp, Homo sapiens
attatttgccttctgaaat

SEQ ID NO: 4653555 - DNA, 20 bp, Homo sapiens
attatttgggagggaaaagg

SEQ ID NO: 4653556 - DNA, 21 bp, Homo sapiens
attatttgggagggaaaaggg

SEQ ID NO: 4653557 - DNA, 11 bp, Homo sapiens
attatttgtat

SEQ ID NO: 4653558 - DNA, 14 bp, Homo sapiens
attattttagctaa

SEQ ID NO: 4653559 - DNA, 14 bp, Homo sapiens
attattttccaaaa

SEQ ID NO: 4653560 - DNA, 22 bp, Homo sapiens
attcaagtgcttaaaaatactt

SEQ ID NO: 4653561 - DNA, 12 bp, Homo sapiens
attcacagtttt

SEQ ID NO: 4653562 - DNA, 19 bp, Homo sapiens
attcacctgccccaactct

SEQ ID NO: 4653563 - DNA, 23 bp, Homo sapiens
attcagaattatacagacctaat

SEQ ID NO: 4653564 - DNA, 19 bp, Homo sapiens
attcagagtatgtttttaa

SEQ ID NO: 4653565 - DNA, 20 bp, Homo sapiens
attcagcagcaaattttcag

SEQ ID NO: 4653566 - DNA, 17 bp, Homo sapiens
attcagctctggagaac

SEQ ID NO: 4653567 - DNA, 21 bp, Homo sapiens
attcagctctggagaacagtg

SEQ ID NO: 4653568 - DNA, 18 bp, Homo sapiens
attcaggaaaaggcctgg

SEQ ID NO: 4653569 - DNA, 21 bp, Homo sapiens
attcaggaaaaggcctggggt

SEQ ID NO: 4653570 - DNA, 13 bp, Homo sapiens
attcatactctgt

SEQ ID NO: 4653571 - DNA, 19 bp, Homo sapiens
attcatactctgttgcctc

SEQ ID NO: 4653572 - DNA, 22 bp, Homo sapiens
attcatactctgttgcctcctc

SEQ ID NO: 4653573 - DNA, 15 bp, Homo sapiens
attcatgacattatg

SEQ ID NO: 4653574 - DNA, 22 bp, Homo sapiens
attcattctcataattcctaca

SEQ ID NO: 4653575 - DNA, 11 bp, Homo sapiens
attcatttcta

SEQ ID NO: 4653576 - DNA, 13 bp, Homo sapiens
attcatttggtga

SEQ ID NO: 4653577 - DNA, 13 bp, Homo sapiens
attccaccagggc

SEQ ID NO: 4653578 - DNA, 14 bp, Homo sapiens
attccaccagggcc

SEQ ID NO: 4653579 - DNA, 22 bp, Homo sapiens
attccaccagggccagagcagc

SEQ ID NO: 4653580 - DNA, 17 bp, Homo sapiens
attccatctagtttttg

SEQ ID NO: 4653581 - DNA, 20 bp, Homo sapiens
attccattgcctagctcttt

SEQ ID NO: 4653582 - DNA, 23 bp, Homo sapiens
attccatttgttgagccccagtc

SEQ ID NO: 4653583 - DNA, 16 bp, Homo sapiens
attccctagcaggaac

SEQ ID NO: 4653584 - DNA, 15 bp, Homo sapiens
attccctctcccagg

SEQ ID NO: 4653585 - DNA, 16 bp, Homo sapiens
attccgtagccagctg

SEQ ID NO: 4653586 - DNA, 18 bp, Homo sapiens
attcctaaagaaaaatat

SEQ ID NO: 4653587 - DNA, 15 bp, Homo sapiens
attcctacagcacta

SEQ ID NO: 4653588 - DNA, 15 bp, Homo sapiens
attcctctcatttcc

SEQ ID NO: 4653589 - DNA, 21 bp, Homo sapiens
attcctctcatttccagcttc

SEQ ID NO: 4653590 - DNA, 23 bp, Homo sapiens
attcctctcatttccagcttctc

SEQ ID NO: 4653591 - DNA, 14 bp, Homo sapiens
attcctcttattgg

SEQ ID NO: 4653592 - DNA, 16 bp, Homo sapiens
attcctgaagggaact

SEQ ID NO: 4653593 - DNA, 22 bp, Homo sapiens
attccttccactaactcatagt

SEQ ID NO: 4653594 - DNA, 17 bp, Homo sapiens
attccttcgaaaggcct

SEQ ID NO: 4653595 - DNA, 19 bp, Homo sapiens
attccttcgaaaggccttc

SEQ ID NO: 4653596 - DNA, 19 bp, Homo sapiens
attccttctaagtgtactt

SEQ ID NO: 4653597 - DNA, 18 bp, Homo sapiens
attccttttaaagaagct

SEQ ID NO: 4653598 - DNA, 22 bp, Homo sapiens
attcgaatggggtagaaacatt

SEQ ID NO: 4653599 - DNA, 13 bp, Homo sapiens
attcgttctgtgg

SEQ ID NO: 4653600 - DNA, 11 bp, Homo sapiens
attctaatgca

SEQ ID NO: 4653601 - DNA, 12 bp, Homo sapiens
attctaatgcat

SEQ ID NO: 4653602 - DNA, 16 bp, Homo sapiens
attctaatgcatattt

SEQ ID NO: 4653603 - DNA, 21 bp, Homo sapiens
attctaccgtaattgctttgt

SEQ ID NO: 4653604 - DNA, 22 bp, Homo sapiens
attctaccgtaattgctttgtg

SEQ ID NO: 4653605 - DNA, 16 bp, Homo sapiens
attctaggtgtttcaa

SEQ ID NO: 4653606 - DNA, 16 bp, Homo sapiens
attctcataattccta

SEQ ID NO: 4653607 - DNA, 22 bp, Homo sapiens
attctcataattcctacagcac

SEQ ID NO: 4653608 - DNA, 14 bp, Homo sapiens
attctccacagcaa

SEQ ID NO: 4653609 - DNA, 19 bp, Homo sapiens
attctcgtttaaacaacaa

SEQ ID NO: 4653610 - DNA, 12 bp, Homo sapiens
attctctcttta

SEQ ID NO: 4653611 - DNA, 17 bp, Homo sapiens
attctcttggctggctt

SEQ ID NO: 4653612 - DNA, 20 bp, Homo sapiens
attctcttggctggcttcct

SEQ ID NO: 4653613 - DNA, 16 bp, Homo sapiens
attctcttttatctgt

SEQ ID NO: 4653614 - DNA, 17 bp, Homo sapiens
attctgcatgagctgat

SEQ ID NO: 4653615 - DNA, 21 bp, Homo sapiens
attctgcctagagtgtagcct

SEQ ID NO: 4653616 - DNA, 15 bp, Homo sapiens
attctggagatactg

SEQ ID NO: 4653617 - DNA, 22 bp, Homo sapiens
attctgtccatgaagcatacac

SEQ ID NO: 4653618 - DNA, 23 bp, Homo sapiens
attctgtcttgttcattttgagt

SEQ ID NO: 4653619 - DNA, 15 bp, Homo sapiens
attctgtgtggtata

SEQ ID NO: 4653620 - DNA, 21 bp, Homo sapiens
attcttaacttattacctcag

SEQ ID NO: 4653621 - DNA, 20 bp, Homo sapiens
attcttcagcgtaaaatggt

SEQ ID NO: 4653622 - DNA, 20 bp, Homo sapiens
attcttgaaagaattttcct

SEQ ID NO: 4653623 - DNA, 12 bp, Homo sapiens
attctttacaaa

SEQ ID NO: 4653624 - DNA, 18 bp, Homo sapiens
attctttgtatcttaaat

SEQ ID NO: 4653625 - DNA, 18 bp, Homo sapiens
attgaaaaaaaaaatgtt

SEQ ID NO: 4653626 - DNA, 12 bp, Homo sapiens
attgaaggaatt

SEQ ID NO: 4653627 - DNA, 20 bp, Homo sapiens
attgaaggaatttgggagga

SEQ ID NO: 4653628 - DNA, 17 bp, Homo sapiens
attgacctggaggggag

SEQ ID NO: 4653629 - DNA, 21 bp, Homo sapiens
attgactcctttccaatagaa

SEQ ID NO: 4653630 - DNA, 23 bp, Homo sapiens
attgactcctttccaatagaaag

SEQ ID NO: 4653631 - DNA, 19 bp, Homo sapiens
attgagattatgatgaaaa

SEQ ID NO: 4653632 - DNA, 15 bp, Homo sapiens
attgaggaagagtct

SEQ ID NO: 4653633 - DNA, 16 bp, Homo sapiens
attgagggtcattctt

SEQ ID NO: 4653634 - DNA, 20 bp, Homo sapiens
attgagggtcattctttatt

SEQ ID NO: 4653635 - DNA, 18 bp, Homo sapiens
attgatccagtcatttta

SEQ ID NO: 4653636 - DNA, 15 bp, Homo sapiens
attgatttgggtttt

SEQ ID NO: 4653637 - DNA, 15 bp, Homo sapiens
attgcacatctaaca

SEQ ID NO: 4653638 - DNA, 20 bp, Homo sapiens
attgcactttcctttcaata

SEQ ID NO: 4653639 - DNA, 21 bp, Homo sapiens
attgcactttcctttcaataa

SEQ ID NO: 4653640 - DNA, 17 bp, Homo sapiens
attgcagaatgaagcca

SEQ ID NO: 4653641 - DNA, 14 bp, Homo sapiens
attgcagacctgtc

SEQ ID NO: 4653642 - DNA, 21 bp, Homo sapiens
atttctttaaaagaatgacta

SEQ ID NO: 4653643 - DNA, 22 bp, Homo sapiens
atttgaaaaagttccatagaaa

SEQ ID NO: 4653644 - DNA, 14 bp, Homo sapiens
atttgactaatttt

SEQ ID NO: 4653645 - DNA, 23 bp, Homo sapiens
atttgagaatagacccttactag

SEQ ID NO: 4653646 - DNA, 23 bp, Homo sapiens
atttgatgggccacaactgtctt

SEQ ID NO: 4653647 - DNA, 18 bp, Homo sapiens
atttgattagcatattaa

SEQ ID NO: 4653648 - DNA, 15 bp, Homo sapiens
atttgatttctaatt

SEQ ID NO: 4653649 - DNA, 17 bp, Homo sapiens
atttggaatatttgaat

SEQ ID NO: 4653650 - DNA, 20 bp, Homo sapiens
atttggaatatttgaataat

SEQ ID NO: 4653651 - DNA, 18 bp, Homo sapiens
atttggatgattgtcata

SEQ ID NO: 4653652 - DNA, 17 bp, Homo sapiens
atttggcttctgttgtc

SEQ ID NO: 4653653 - DNA, 17 bp, Homo sapiens
atttgggagggaaaagg

SEQ ID NO: 4653654 - DNA, 19 bp, Homo sapiens
atttggtcttagctttaca

SEQ ID NO: 4653655 - DNA, 12 bp, Homo sapiens
atttgtaaacca

SEQ ID NO: 4653656 - DNA, 18 bp, Homo sapiens
atttgtaaaccattgtaa

SEQ ID NO: 4653657 - DNA, 15 bp, Homo sapiens
atttgtaagtgtaaa

SEQ ID NO: 4653658 - DNA, 21 bp, Homo sapiens
atttgtaagtgtaaaaaatgt

SEQ ID NO: 4653659 - DNA, 24 bp, Homo sapiens
atttgtagactcttgctcctgctt

SEQ ID NO: 4653660 - DNA, 14 bp, Homo sapiens
atttgtctttttgt

SEQ ID NO: 4653661 - DNA, 23 bp, Homo sapiens
atttgtctttttgttgtaaaaca

SEQ ID NO: 4653662 - DNA, 21 bp, Homo sapiens
atttgtgtcacaaagaattta

SEQ ID NO: 4653663 - DNA, 14 bp, Homo sapiens
atttgtttgtagct

SEQ ID NO: 4653664 - DNA, 21 bp, Homo sapiens
atttgtttgtagctttcctgg

SEQ ID NO: 4653665 - DNA, 22 bp, Homo sapiens
atttgtttgtagctttcctgga

SEQ ID NO: 4653666 - DNA, 17 bp, Homo sapiens
attttaaaaactttatt

SEQ ID NO: 4653667 - DNA, 15 bp, Homo sapiens
attttaactctgtct

SEQ ID NO: 4653668 - DNA, 14 bp, Homo sapiens
attttaataccttt

SEQ ID NO: 4653669 - DNA, 18 bp, Homo sapiens
attttaatacctttaaat

SEQ ID NO: 4653670 - DNA, 23 bp, Homo sapiens
attttaatacctttaaatatcat

SEQ ID NO: 4653671 - DNA, 14 bp, Homo sapiens
attttaatgataaa

SEQ ID NO: 4653672 - DNA, 21 bp, Homo sapiens
attttaatgataaaatagcca

SEQ ID NO: 4653673 - DNA, 20 bp, Homo sapiens
attttaatgctgtttctaag

SEQ ID NO: 4653674 - DNA, 23 bp, Homo sapiens
attttaatgctgtttctaagaaa

SEQ ID NO: 4653675 - DNA, 14 bp, Homo sapiens
attttaccttgttt

SEQ ID NO: 4653676 - DNA, 18 bp, Homo sapiens
attttagcccagtgtttt

SEQ ID NO: 4653677 - DNA, 13 bp, Homo sapiens
attttagctaaat

SEQ ID NO: 4653678 - DNA, 14 bp, Homo sapiens
attttagtgtatct

SEQ ID NO: 4653679 - DNA, 17 bp, Homo sapiens
attttatcattaaaaat

SEQ ID NO: 4653680 - DNA, 14 bp, Homo sapiens
attttattattcag

SEQ ID NO: 4653681 - DNA, 15 bp, Homo sapiens
attttattattcaga

SEQ ID NO: 4653682 - DNA, 21 bp, Homo sapiens
attttattcacatatgtctta

SEQ ID NO: 4653683 - DNA, 12 bp, Homo sapiens
attttattttgt

SEQ ID NO: 4653684 - DNA, 15 bp, Homo sapiens
attttcaaagaaaat

SEQ ID NO: 4653685 - DNA, 21 bp, Homo sapiens
attttcaaccataaaagaagt

SEQ ID NO: 4653686 - DNA, 15 bp, Homo sapiens
attttcaaggccttc

SEQ ID NO: 4653687 - DNA, 16 bp, Homo sapiens
attttcaaggccttca

SEQ ID NO: 4653688 - DNA, 20 bp, Homo sapiens
attttcaaggccttcagttt

SEQ ID NO: 4653689 - DNA, 15 bp, Homo sapiens
attttcacattcttg

SEQ ID NO: 4653690 - DNA, 19 bp, Homo sapiens
attttcacattcttggctt

SEQ ID NO: 4653691 - DNA, 16 bp, Homo sapiens
attttcagtgcatcat

SEQ ID NO: 4653692 - DNA, 18 bp, Homo sapiens
attttcagtgcatcatta

SEQ ID NO: 4653693 - DNA, 17 bp, Homo sapiens
attttcataatcagtaa

SEQ ID NO: 4653694 - DNA, 18 bp, Homo sapiens
attttcatgcaaaagttc

SEQ ID NO: 4653695 - DNA, 22 bp, Homo sapiens
attttccaaaagtggcctcttt

SEQ ID NO: 4653696 - DNA, 20 bp, Homo sapiens
attttcccccactactgcag

SEQ ID NO: 4653697 - DNA, 15 bp, Homo sapiens
attttcctaatgtga

SEQ ID NO: 4653698 - DNA, 18 bp, Homo sapiens
attttcctaatgtgatca

SEQ ID NO: 4653699 - DNA, 22 bp, Homo sapiens
attttcctaatgtgatcatatg

SEQ ID NO: 4653700 - DNA, 15 bp, Homo sapiens
attttccttccatgc

SEQ ID NO: 4653701 - DNA, 17 bp, Homo sapiens
attttcctttgtagcta

SEQ ID NO: 4653702 - DNA, 12 bp, Homo sapiens
attttctaaata

SEQ ID NO: 4653703 - DNA, 19 bp, Homo sapiens
attttctacaaataatttt

SEQ ID NO: 4653704 - DNA, 17 bp, Homo sapiens
attttctctgtactttt

SEQ ID NO: 4653705 - DNA, 13 bp, Homo sapiens
attttctcttaga

SEQ ID NO: 4653706 - DNA, 15 bp, Homo sapiens
attttgaaacaaagt

SEQ ID NO: 4653707 - DNA, 22 bp, Homo sapiens
attttgaaacaaagtactcttt

SEQ ID NO: 4653708 - DNA, 17 bp, Homo sapiens
attttgagctatttcct

SEQ ID NO: 4653709 - DNA, 19 bp, Homo sapiens
attttgagctatttccttc

SEQ ID NO: 4653710 - DNA, 18 bp, Homo sapiens
attttgagtatttttaaa

SEQ ID NO: 4653711 - DNA, 13 bp, Homo sapiens
attttgagtttca

SEQ ID NO: 4653712 - DNA, 19 bp, Homo sapiens
attttgagtttcagctgga

SEQ ID NO: 4653713 - DNA, 22 bp, Homo sapiens
attttgcccttccatagcctaa

SEQ ID NO: 4653714 - DNA, 20 bp, Homo sapiens
attttggcttcatttcaatc

SEQ ID NO: 4653715 - DNA, 21 bp, Homo sapiens
attttggcttcatttcaatca

SEQ ID NO: 4653716 - DNA, 20 bp, Homo sapiens
attttggtgcacaaatacaa

SEQ ID NO: 4653717 - DNA, 13 bp, Homo sapiens
attttgtaaaata

SEQ ID NO: 4653718 - DNA, 17 bp, Homo sapiens
attttgtgaatctattg

SEQ ID NO: 4653719 - DNA, 15 bp, Homo sapiens
atttttaaaaaatat

SEQ ID NO: 4653720 - DNA, 20 bp, Homo sapiens
atttttaaaaaatattttct

SEQ ID NO: 4653721 - DNA, 14 bp, Homo sapiens
atttttaaagttta

SEQ ID NO: 4653722 - DNA, 18 bp, Homo sapiens
atttttaaagtttaaata

SEQ ID NO: 4653723 - DNA, 21 bp, Homo sapiens
atttttaaagtttaaatacca

SEQ ID NO: 4653724 - DNA, 22 bp, Homo sapiens
atttttaaagtttaaataccag

SEQ ID NO: 4653725 - DNA, 12 bp, Homo sapiens
atttttaaattg

SEQ ID NO: 4653726 - DNA, 13 bp, Homo sapiens
atttttaaattgt

SEQ ID NO: 4653727 - DNA, 14 bp, Homo sapiens
atttttaaattgtt

SEQ ID NO: 4653728 - DNA, 12 bp, Homo sapiens
atttttaagaaa

SEQ ID NO: 4653729 - DNA, 20 bp, Homo sapiens
atttttaagaaaggaagcaa

SEQ ID NO: 4653730 - DNA, 21 bp, Homo sapiens
atttttatagcaacaacaatt

SEQ ID NO: 4653731 - DNA, 17 bp, Homo sapiens
atttttatatcatgcaa

SEQ ID NO: 4653732 - DNA, 19 bp, Homo sapiens
atttttcttagtgttgtgg

SEQ ID NO: 4653733 - DNA, 21 bp, Homo sapiens
atttttgaagtaaattaaaca

SEQ ID NO: 4653734 - DNA, 14 bp, Homo sapiens
atttttgcttccta

SEQ ID NO: 4653735 - DNA, 16 bp, Homo sapiens
atttttgtctcagaag

SEQ ID NO: 4653736 - DNA, 14 bp, Homo sapiens
atttttgtcttgtg

SEQ ID NO: 4653737 - DNA, 23 bp, Homo sapiens
atttttgttggggggtgggagag

SEQ ID NO: 4653738 - DNA, 20 bp, Homo sapiens
attttttaaaagccttccag

SEQ ID NO: 4653739 - DNA, 13 bp, Homo sapiens
attttttaagaaa

SEQ ID NO: 4653740 - DNA, 17 bp, Homo sapiens
attttttggtgtgccct

SEQ ID NO: 4653741 - DNA, 16 bp, Homo sapiens
atttttttatgctctt

SEQ ID NO: 4653742 - DNA, 17 bp, Homo sapiens
attttttttatatttat

SEQ ID NO: 4653743 - DNA, 14 bp, Homo sapiens
attttttttcatgt

SEQ ID NO: 4653744 - DNA, 15 bp, Homo sapiens
attttttttgtttca

SEQ ID NO: 4653745 - DNA, 14 bp, Homo sapiens
caaaaaaaaaggct

SEQ ID NO: 4653746 - DNA, 15 bp, Homo sapiens
caaaaaatgttttaa

SEQ ID NO: 4653747 - DNA, 11 bp, Homo sapiens
caaaaaattat

SEQ ID NO: 4653748 - DNA, 16 bp, Homo sapiens
caaaaactacacatat

SEQ ID NO: 4653749 - DNA, 22 bp, Homo sapiens
caaaaccatgcctggtattttc

SEQ ID NO: 4653750 - DNA, 11 bp, Homo sapiens
caaaactgttc

SEQ ID NO: 4653751 - DNA, 13 bp, Homo sapiens
caaaactgttctt

SEQ ID NO: 4653752 - DNA, 13 bp, Homo sapiens
caacaacatcaga

SEQ ID NO: 4653753 - DNA, 20 bp, Homo sapiens
caacaacatcagaaagaatt

SEQ ID NO: 4653754 - DNA, 16 bp, Homo sapiens
caacaacgtgagagaa

SEQ ID NO: 4653755 - DNA, 14 bp, Homo sapiens
caacaattggtaaa

SEQ ID NO: 4653756 - DNA, 18 bp, Homo sapiens
caacaattggtaaaactc

SEQ ID NO: 4653757 - DNA, 13 bp, Homo sapiens
caacaccaagcac

SEQ ID NO: 4653758 - DNA, 22 bp, Homo sapiens
caacaccaagcacagcagcctg

SEQ ID NO: 4653759 - DNA, 17 bp, Homo sapiens
caacagaaaccaagaga

SEQ ID NO: 4653760 - DNA, 16 bp, Homo sapiens
caacagcaaaccctga

SEQ ID NO: 4653761 - DNA, 14 bp, Homo sapiens
caacagcacacagg

SEQ ID NO: 4653762 - DNA, 16 bp, Homo sapiens
caacagcacacaggca

SEQ ID NO: 4653763 - DNA, 14 bp, Homo sapiens
caacagctgaagca

SEQ ID NO: 4653764 - DNA, 20 bp, Homo sapiens
caacagggagcacctgtctg

SEQ ID NO: 4653765 - DNA, 22 bp, Homo sapiens
caacagggagcacctgtctgga

SEQ ID NO: 4653766 - DNA, 17 bp, Homo sapiens
caacaggtaaaacaggg

SEQ ID NO: 4653767 - DNA, 16 bp, Homo sapiens
caacaggtcacttgat

SEQ ID NO: 4653768 - DNA, 12 bp, Homo sapiens
caacatactgta

SEQ ID NO: 4653769 - DNA, 15 bp, Homo sapiens
caacatgcactgatg

SEQ ID NO: 4653770 - DNA, 17 bp, Homo sapiens
caacatgtagggcaaga

SEQ ID NO: 4653771 - DNA, 20 bp, Homo sapiens
caaccagataacataccttt

SEQ ID NO: 4653772 - DNA, 11 bp, Homo sapiens
caaccagcccg

SEQ ID NO: 4653773 - DNA, 17 bp, Homo sapiens
caaccagggagctgcag

SEQ ID NO: 4653774 - DNA, 19 bp, Homo sapiens
caaccagggagctgcaggg

SEQ ID NO: 4653775 - DNA, 12 bp, Homo sapiens
caaccagtgcca

SEQ ID NO: 4653776 - DNA, 20 bp, Homo sapiens
caaccccttaagccctggcc

SEQ ID NO: 4653777 - DNA, 23 bp, Homo sapiens
caacccgtgccaagtccaggtcc

SEQ ID NO: 4653778 - DNA, 16 bp, Homo sapiens
caacccgtggaggctg

SEQ ID NO: 4653779 - DNA, 17 bp, Homo sapiens
caaccctgggctgggga

SEQ ID NO: 4653780 - DNA, 19 bp, Homo sapiens
caacctctgcctcctgggt

SEQ ID NO: 4653781 - DNA, 16 bp, Homo sapiens
caacctctgcttccca

SEQ ID NO: 4653782 - DNA, 19 bp, Homo sapiens
caacctctgttccccaccc

SEQ ID NO: 4653783 - DNA, 15 bp, Homo sapiens
caacctgttcttaga

SEQ ID NO: 4653784 - DNA, 14 bp, Homo sapiens
caacggtctggcag

SEQ ID NO: 4653785 - DNA, 15 bp, Homo sapiens
caacggtctggcagg

SEQ ID NO: 4653786 - DNA, 17 bp, Homo sapiens
caacgtgagagaaagag

SEQ ID NO: 4653787 - DNA, 11 bp, Homo sapiens
caactacctga

SEQ ID NO: 4653788 - DNA, 21 bp, Homo sapiens
caactacctgagctaaataaa

SEQ ID NO: 4653789 - DNA, 13 bp, Homo sapiens
caactactattca

SEQ ID NO: 4653790 - DNA, 17 bp, Homo sapiens
caactcaagtgtcacct

SEQ ID NO: 4653791 - DNA, 23 bp, Homo sapiens
caactcaagtgtcacctccttcc

SEQ ID NO: 4653792 - DNA, 21 bp, Homo sapiens
caactcacattgttcaactcc

SEQ ID NO: 4653793 - DNA, 15 bp, Homo sapiens
caactcccttctgct

SEQ ID NO: 4653794 - DNA, 18 bp, Homo sapiens
caactctacacagctcag

SEQ ID NO: 4653795 - DNA, 16 bp, Homo sapiens
caactgtcccaaggag

SEQ ID NO: 4653796 - DNA, 16 bp, Homo sapiens
caactgtttccctgct

SEQ ID NO: 4653797 - DNA, 19 bp, Homo sapiens
caactgtttccctgctgaa

SEQ ID NO: 4653798 - DNA, 22 bp, Homo sapiens
caacttctgcctcccatgctta

SEQ ID NO: 4653799 - DNA, 12 bp, Homo sapiens
caagaaacagcc

SEQ ID NO: 4653800 - DNA, 13 bp, Homo sapiens
caagaaacagcca

SEQ ID NO: 4653801 - DNA, 15 bp, Homo sapiens
caagaaacagccagc

SEQ ID NO: 4653802 - DNA, 13 bp, Homo sapiens
caagaaataaaag

SEQ ID NO: 4653803 - DNA, 13 bp, Homo sapiens
caagaatacttga

SEQ ID NO: 4653804 - DNA, 16 bp, Homo sapiens
caagacacgtggcctc

SEQ ID NO: 4653805 - DNA, 17 bp, Homo sapiens
caagacacgtggcctcg

SEQ ID NO: 4653806 - DNA, 20 bp, Homo sapiens
caagacctcatctgtggagc

SEQ ID NO: 4653807 - DNA, 22 bp, Homo sapiens
caagacctcatctgtggagctg

SEQ ID NO: 4653808 - DNA, 16 bp, Homo sapiens
caagacgaggggcagg

SEQ ID NO: 4653809 - DNA, 17 bp, Homo sapiens
caagacgaggggcaggg

SEQ ID NO: 4653810 - DNA, 12 bp, Homo sapiens
caagagaaactt

SEQ ID NO: 4653811 - DNA, 22 bp, Homo sapiens
caagagacacaattacgcaggt

SEQ ID NO: 4653812 - DNA, 13 bp, Homo sapiens
caagagcaggagg

SEQ ID NO: 4653813 - DNA, 14 bp, Homo sapiens
caagagcaggaggt

SEQ ID NO: 4653814 - DNA, 17 bp, Homo sapiens
caagagcaggaggtgcc

SEQ ID NO: 4653815 - DNA, 22 bp, Homo sapiens
caagagcatcatgcctctgagg

SEQ ID NO: 4653816 - DNA, 16 bp, Homo sapiens
caagagggaacaaaac

SEQ ID NO: 4653817 - DNA, 21 bp, Homo sapiens
caagagggtgacagcttcctt

SEQ ID NO: 4653818 - DNA, 19 bp, Homo sapiens
caagatattgatcaaatat

SEQ ID NO: 4653819 - DNA, 20 bp, Homo sapiens
caagatctgccagacctgca

SEQ ID NO: 4653820 - DNA, 16 bp, Homo sapiens
caagatgagcctgggc

SEQ ID NO: 4653821 - DNA, 17 bp, Homo sapiens
caagatgagcctgggct

SEQ ID NO: 4653822 - DNA, 18 bp, Homo sapiens
caagatggacacgagcca

SEQ ID NO: 4653823 - DNA, 19 bp, Homo sapiens
caagattttcctcttgtga

SEQ ID NO: 4653824 - DNA, 12 bp, Homo sapiens
caagcacagcag

SEQ ID NO: 4653825 - DNA, 17 bp, Homo sapiens
caagcacagcagcctgg

SEQ ID NO: 4653826 - DNA, 20 bp, Homo sapiens
caagcactcggggtccctgg

SEQ ID NO: 4653827 - DNA, 23 bp, Homo sapiens
caagcactcggggtccctggagg

SEQ ID NO: 4653828 - DNA, 16 bp, Homo sapiens
caagcatttcatgaaa

SEQ ID NO: 4653829 - DNA, 20 bp, Homo sapiens
caagcatttcatgaaaaagc

SEQ ID NO: 4653830 - DNA, 18 bp, Homo sapiens
caagccagattctcttga

SEQ ID NO: 4653831 - DNA, 14 bp, Homo sapiens
caagccccatttcc

SEQ ID NO: 4653832 - DNA, 12 bp, Homo sapiens
caagccctgccc

SEQ ID NO: 4653833 - DNA, 14 bp, Homo sapiens
caagccctgcccac

SEQ ID NO: 4653834 - DNA, 23 bp, Homo sapiens
caagcctcttattccaggagaag

SEQ ID NO: 4653835 - DNA, 19 bp, Homo sapiens
caagcctgcctcgccttgt

SEQ ID NO: 4653836 - DNA, 16 bp, Homo sapiens
caagcgattctcctgc

SEQ ID NO: 4653837 - DNA, 17 bp, Homo sapiens
caagctagactgtgtct

SEQ ID NO: 4653838 - DNA, 18 bp, Homo sapiens
caagctagactgtgtctg

SEQ ID NO: 4653839 - DNA, 16 bp, Homo sapiens
caagctaggccccaga

SEQ ID NO: 4653840 - DNA, 22 bp, Homo sapiens
caagctaggccccagaggccct

SEQ ID NO: 4653841 - DNA, 20 bp, Homo sapiens
caagctccgcctcccgggtt

SEQ ID NO: 4653842 - DNA, 18 bp, Homo sapiens
caagctgagctggcttcg

SEQ ID NO: 4653843 - DNA, 15 bp, Homo sapiens
caagctgaggtgccc

SEQ ID NO: 4653844 - DNA, 19 bp, Homo sapiens
caagctgaggtgcccagga

SEQ ID NO: 4653845 - DNA, 21 bp, Homo sapiens
caagctgaggtgcccaggaga

SEQ ID NO: 4653846 - DNA, 13 bp, Homo sapiens
caagctgcactgt

SEQ ID NO: 4653847 - DNA, 15 bp, Homo sapiens
caagctggccaaagt

SEQ ID NO: 4653848 - DNA, 13 bp, Homo sapiens
caagctgtccctg

SEQ ID NO: 4653849 - DNA, 15 bp, Homo sapiens
caagctgtccctgca

SEQ ID NO: 4653850 - DNA, 20 bp, Homo sapiens
caagctgtccctgcagggcc

SEQ ID NO: 4653851 - DNA, 21 bp, Homo sapiens
caagctgtccctgcagggcca

SEQ ID NO: 4653852 - DNA, 14 bp, Homo sapiens
caagctgtgagaca

SEQ ID NO: 4653853 - DNA, 22 bp, Homo sapiens
caagctgtgagacagtgggaaa

SEQ ID NO: 4653854 - DNA, 19 bp, Homo sapiens
caagctgtgcaggcatggt

SEQ ID NO: 4653855 - DNA, 12 bp, Homo sapiens
caagctttgctc

SEQ ID NO: 4653856 - DNA, 13 bp, Homo sapiens
caagctttgctcc

SEQ ID NO: 4653857 - DNA, 22 bp, Homo sapiens
caagctttgctccttcagttct

SEQ ID NO: 4653858 - DNA, 11 bp, Homo sapiens
caaggaagcag

SEQ ID NO: 4653859 - DNA, 19 bp, Homo sapiens
caaggacagttcagagatc

SEQ ID NO: 4653860 - DNA, 15 bp, Homo sapiens
caaggacccagccct

SEQ ID NO: 4653861 - DNA, 20 bp, Homo sapiens
caaggacctcctcttccccc

SEQ ID NO: 4653862 - DNA, 12 bp, Homo sapiens
tgcttgccccgc

SEQ ID NO: 4653863 - DNA, 17 bp, Homo sapiens
tgcttgctcccaagccc

SEQ ID NO: 4653864 - DNA, 14 bp, Homo sapiens
tgcttggaggggga

SEQ ID NO: 4653865 - DNA, 23 bp, Homo sapiens
tgcttgggaatgaaattaacaca

SEQ ID NO: 4653866 - DNA, 13 bp, Homo sapiens
tgcttgggctgac

SEQ ID NO: 4653867 - DNA, 18 bp, Homo sapiens
tgctttagagaatgccac

SEQ ID NO: 4653868 - DNA, 14 bp, Homo sapiens
tgctttcaattgac

SEQ ID NO: 4653869 - DNA, 15 bp, Homo sapiens
tgctttgggaagccg

SEQ ID NO: 4653870 - DNA, 19 bp, Homo sapiens
tgctttgtaggtgtctcat

SEQ ID NO: 4653871 - DNA, 22 bp, Homo sapiens
tgctttgtgcctttgggcacgg

SEQ ID NO: 4653872 - DNA, 20 bp, Homo sapiens
tgctttttgcgtacacagag

SEQ ID NO: 4653873 - DNA, 13 bp, Homo sapiens
tggaaaaaatatt

SEQ ID NO: 4653874 - DNA, 16 bp, Homo sapiens
tggaaaaaatatttta

SEQ ID NO: 4653875 - DNA, 23 bp, Homo sapiens
tggaaaacaaagccaaacaaaac

SEQ ID NO: 4653876 - DNA, 20 bp, Homo sapiens
tggaaaactgtgttgccaca

SEQ ID NO: 4653877 - DNA, 17 bp, Homo sapiens
tggaaacaaaacagaag

SEQ ID NO: 4653878 - DNA, 20 bp, Homo sapiens
tggaaacatttatattttta

SEQ ID NO: 4653879 - DNA, 17 bp, Homo sapiens
tggaaaccctgagagtc

SEQ ID NO: 4653880 - DNA, 19 bp, Homo sapiens
tggaaacctctacatattt

SEQ ID NO: 4653881 - DNA, 14 bp, Homo sapiens
tggaaacttctgta

SEQ ID NO: 4653882 - DNA, 20 bp, Homo sapiens
tggaaataatatcatttata

SEQ ID NO: 4653883 - DNA, 21 bp, Homo sapiens
tggaaatcaatactgcacact

SEQ ID NO: 4653884 - DNA, 16 bp, Homo sapiens
tggaaatgctgggctg

SEQ ID NO: 4653885 - DNA, 14 bp, Homo sapiens
tggaaatgtacttt

SEQ ID NO: 4653886 - DNA, 14 bp, Homo sapiens
tggaacatccttgg

SEQ ID NO: 4653887 - DNA, 15 bp, Homo sapiens
tggaaccaccagtct

SEQ ID NO: 4653888 - DNA, 15 bp, Homo sapiens
tggaactgaaggggg

SEQ ID NO: 4653889 - DNA, 16 bp, Homo sapiens
tggaactgtgtttcaa

SEQ ID NO: 4653890 - DNA, 23 bp, Homo sapiens
tggaactgtgtttcaaatggact

SEQ ID NO: 4653891 - DNA, 21 bp, Homo sapiens
tggaactttctgttccctatg

SEQ ID NO: 4653892 - DNA, 21 bp, Homo sapiens
tggaactttttagattattcc

SEQ ID NO: 4653893 - DNA, 18 bp, Homo sapiens
tggaagccaggtacagga

SEQ ID NO: 4653894 - DNA, 16 bp, Homo sapiens
tggaagcccctgggcc

SEQ ID NO: 4653895 - DNA, 15 bp, Homo sapiens
tggaagcttactctc

SEQ ID NO: 4653896 - DNA, 19 bp, Homo sapiens
tggaagtcaaataaatgtt

SEQ ID NO: 4653897 - DNA, 21 bp, Homo sapiens
tggaagtcaaataaatgtttc

SEQ ID NO: 4653898 - DNA, 16 bp, Homo sapiens
tggaagttgagactta

SEQ ID NO: 4653899 - DNA, 16 bp, Homo sapiens
tggaataaagttgcag

SEQ ID NO: 4653900 - DNA, 17 bp, Homo sapiens
tggaatgagtgtgcatg

SEQ ID NO: 4653901 - DNA, 19 bp, Homo sapiens
tggaatgagtgtgcatgga

SEQ ID NO: 4653902 - DNA, 21 bp, Homo sapiens
tggaatgagtgtgcatggagg

SEQ ID NO: 4653903 - DNA, 15 bp, Homo sapiens
tggaatgcagaggtc

SEQ ID NO: 4653904 - DNA, 14 bp, Homo sapiens
tggacacgagccac

SEQ ID NO: 4653905 - DNA, 15 bp, Homo sapiens
tggacacgagccaca

SEQ ID NO: 4653906 - DNA, 16 bp, Homo sapiens
tggacacgagccacaa

SEQ ID NO: 4653907 - DNA, 22 bp, Homo sapiens
tggcccccatacttggctgctt

SEQ ID NO: 4653908 - DNA, 15 bp, Homo sapiens
tggcccccatcagcc

SEQ ID NO: 4653909 - DNA, 18 bp, Homo sapiens
tggcccccatcagccctg

SEQ ID NO: 4653910 - DNA, 18 bp, Homo sapiens
tggccccgcccctgcccc

SEQ ID NO: 4653911 - DNA, 11 bp, Homo sapiens
tggcccctcca

SEQ ID NO: 4653912 - DNA, 18 bp, Homo sapiens
tggcccgtgacagactcc

SEQ ID NO: 4653913 - DNA, 20 bp, Homo sapiens
tggcccgtgacagactcctg

SEQ ID NO: 4653914 - DNA, 23 bp, Homo sapiens
tggcccgtgacagactcctgagg

SEQ ID NO: 4653915 - DNA, 13 bp, Homo sapiens
tggccctgccgtt

SEQ ID NO: 4653916 - DNA, 19 bp, Homo sapiens
tggccgagtccaagctggg

SEQ ID NO: 4653917 - DNA, 22 bp, Homo sapiens
tggccggagcaaactctgctgt

SEQ ID NO: 4653918 - DNA, 19 bp, Homo sapiens
tggcctatgtggtctaagg

SEQ ID NO: 4653919 - DNA, 15 bp, Homo sapiens
tggcctcagagcttc

SEQ ID NO: 4653920 - DNA, 19 bp, Homo sapiens
tggcctcagagcttcctgg

SEQ ID NO: 4653921 - DNA, 12 bp, Homo sapiens
tggcctccctgc

SEQ ID NO: 4653922 - DNA, 14 bp, Homo sapiens
tggcctccctgctg

SEQ ID NO: 4653923 - DNA, 16 bp, Homo sapiens
tggcctggcacacatc

SEQ ID NO: 4653924 - DNA, 18 bp, Homo sapiens
tggcctggcacacatcag

SEQ ID NO: 4653925 - DNA, 17 bp, Homo sapiens
tggcctgtgatgtttta

SEQ ID NO: 4653926 - DNA, 21 bp, Homo sapiens
tggcctgtgatgttttatcct

SEQ ID NO: 4653927 - DNA, 13 bp, Homo sapiens
tggccttgaaaca

SEQ ID NO: 4653928 - DNA, 23 bp, Homo sapiens
tggccttgtaagacccttattgc

SEQ ID NO: 4653929 - DNA, 14 bp, Homo sapiens
tggccttgttctgt

SEQ ID NO: 4653930 - DNA, 13 bp, Homo sapiens
tggcgtctccctc

SEQ ID NO: 4653931 - DNA, 21 bp, Homo sapiens
tggctaactatatttgctttt

SEQ ID NO: 4653932 - DNA, 17 bp, Homo sapiens
tggctactccctggacc

SEQ ID NO: 4653933 - DNA, 19 bp, Homo sapiens
tggctactccctggaccac

SEQ ID NO: 4653934 - DNA, 21 bp, Homo sapiens
tggctactctgtgccagagcc

SEQ ID NO: 4653935 - DNA, 23 bp, Homo sapiens
tggctactctgtgccagagcctg

SEQ ID NO: 4653936 - DNA, 22 bp, Homo sapiens
tggctcacagtacagcatgtgc

SEQ ID NO: 4653937 - DNA, 17 bp, Homo sapiens
tggctcccagggccatg

SEQ ID NO: 4653938 - DNA, 14 bp, Homo sapiens
tggctccctctctc

SEQ ID NO: 4653939 - DNA, 15 bp, Homo sapiens
tggctccctctctcc

SEQ ID NO: 4653940 - DNA, 16 bp, Homo sapiens
tggctccctctctcct

SEQ ID NO: 4653941 - DNA, 19 bp, Homo sapiens
tggctgcagtccgtgtgga

SEQ ID NO: 4653942 - DNA, 22 bp, Homo sapiens
tggctgcccatcatgtggcccc

SEQ ID NO: 4653943 - DNA, 16 bp, Homo sapiens
tggctgcttcctgtga

SEQ ID NO: 4653944 - DNA, 13 bp, Homo sapiens
tggctggctgagg

SEQ ID NO: 4653945 - DNA, 16 bp, Homo sapiens
tggctgtaatcatttg

SEQ ID NO: 4653946 - DNA, 21 bp, Homo sapiens
tggctgtgtttgcagcctgct

SEQ ID NO: 4653947 - DNA, 15 bp, Homo sapiens
tggctgtttcatcag

SEQ ID NO: 4653948 - DNA, 20 bp, Homo sapiens
tggcttacctatctgtggaa

SEQ ID NO: 4653949 - DNA, 16 bp, Homo sapiens
tggcttcactcctgct

SEQ ID NO: 4653950 - DNA, 23 bp, Homo sapiens
tggcttcactcctgctgtaaatt

SEQ ID NO: 4653951 - DNA, 12 bp, Homo sapiens
tggcttcatttc

SEQ ID NO: 4653952 - DNA, 19 bp, Homo sapiens
tggctttatgcaaatacaa

SEQ ID NO: 4653953 - DNA, 19 bp, Homo sapiens
tgggaaatatttagcaaat

SEQ ID NO: 4653954 - DNA, 13 bp, Homo sapiens
tgggaaccactcc

SEQ ID NO: 4653955 - DNA, 18 bp, Homo sapiens
tgggaaccactcccacca

SEQ ID NO: 4653956 - DNA, 15 bp, Homo sapiens
tgggaagattctcta

SEQ ID NO: 4653957 - DNA, 17 bp, Homo sapiens
tgggaaggccggcagcg

SEQ ID NO: 4653958 - DNA, 23 bp, Homo sapiens
tgggaagtcgtccttactcctgt

SEQ ID NO: 4653959 - DNA, 21 bp, Homo sapiens
tgggacaagcaggccgccctc

SEQ ID NO: 4653960 - DNA, 18 bp, Homo sapiens
tgggacaccagggaagaa

SEQ ID NO: 4653961 - DNA, 14 bp, Homo sapiens
tgggacagcccaga

SEQ ID NO: 4653962 - DNA, 20 bp, Homo sapiens
tgggacagcccagagcctgg

SEQ ID NO: 4653963 - DNA, 22 bp, Homo sapiens
tgggaccaacctgacctaacct

SEQ ID NO: 4653964 - DNA, 15 bp, Homo sapiens
tgggaccccagctgc

SEQ ID NO: 4653965 - DNA, 22 bp, Homo sapiens
tgggaccgctacaccactctgg

SEQ ID NO: 4653966 - DNA, 17 bp, Homo sapiens
tgggacctccccagccc

SEQ ID NO: 4653967 - DNA, 19 bp, Homo sapiens
tgggacctccccagcccag

SEQ ID NO: 4653968 - DNA, 20 bp, Homo sapiens
tgggacctccccagcccagg

SEQ ID NO: 4653969 - DNA, 15 bp, Homo sapiens
tgggacgtggctcag

SEQ ID NO: 4653970 - DNA, 18 bp, Homo sapiens
tgggagagtacctgtgtg

SEQ ID NO: 4653971 - DNA, 16 bp, Homo sapiens
tgggagctgccaagag

SEQ ID NO: 4653972 - DNA, 18 bp, Homo sapiens
tgggaggaggaaaagaaa

SEQ ID NO: 4653973 - DNA, 12 bp, Homo sapiens
tgggaggcgggc

SEQ ID NO: 4653974 - DNA, 18 bp, Homo sapiens
tgggagggaaaagggaag

SEQ ID NO: 4653975 - DNA, 17 bp, Homo sapiens
tgggagggaggctcagg

SEQ ID NO: 4653976 - DNA, 15 bp, Homo sapiens
aagggagtctctctt

SEQ ID NO: 4653977 - DNA, 19 bp, Homo sapiens
aagggagtgtactcccagg

SEQ ID NO: 4653978 - DNA, 15 bp, Homo sapiens
aagggatggtattga

SEQ ID NO: 4653979 - DNA, 19 bp, Homo sapiens
aagggcacttaatttgtaa

SEQ ID NO: 4653980 - DNA, 16 bp, Homo sapiens
aagggcagggcccacg

SEQ ID NO: 4653981 - DNA, 15 bp, Homo sapiens
aaggggacattccag

SEQ ID NO: 4653982 - DNA, 19 bp, Homo sapiens
aaggggttggggtgacagt

SEQ ID NO: 4653983 - DNA, 17 bp, Homo sapiens
aagggtgggtgctcaga

SEQ ID NO: 4653984 - DNA, 18 bp, Homo sapiens
aaggtaagctcaggatat

SEQ ID NO: 4653985 - DNA, 19 bp, Homo sapiens
aaggtaggaaggtcaaggt

SEQ ID NO: 4653986 - DNA, 15 bp, Homo sapiens
aaggtctgacagtag

SEQ ID NO: 4653987 - DNA, 13 bp, Homo sapiens
aaggtgctaacat

SEQ ID NO: 4653988 - DNA, 13 bp, Homo sapiens
aaggtggtggcat

SEQ ID NO: 4653989 - DNA, 16 bp, Homo sapiens
aaggtgtagaaaaggt

SEQ ID NO: 4653990 - DNA, 18 bp, Homo sapiens
aaggttaccaagaagcct

SEQ ID NO: 4653991 - DNA, 19 bp, Homo sapiens
aagtaacaatctatggctt

SEQ ID NO: 4653992 - DNA, 21 bp, Homo sapiens
aagtaacatgcatactttatt

SEQ ID NO: 4653993 - DNA, 15 bp, Homo sapiens
aagtaatatcaaagc

SEQ ID NO: 4653994 - DNA, 21 bp, Homo sapiens
aagtaattttgtcacattatt

SEQ ID NO: 4653995 - DNA, 13 bp, Homo sapiens
aagtacaaatgaa

SEQ ID NO: 4653996 - DNA, 13 bp, Homo sapiens
aagtacatattta

SEQ ID NO: 4653997 - DNA, 14 bp, Homo sapiens
aagtacttaacata

SEQ ID NO: 4653998 - DNA, 17 bp, Homo sapiens
aagtacttacattccag

SEQ ID NO: 4653999 - DNA, 13 bp, Homo sapiens
aagtagctttgaa

SEQ ID NO: 4654000 - DNA, 13 bp, Homo sapiens
aagtagtaaatca

SEQ ID NO: 4654001 - DNA, 19 bp, Homo sapiens
aagtatattatatggcagg

SEQ ID NO: 4654002 - DNA, 18 bp, Homo sapiens
aagtatatttatttctag

SEQ ID NO: 4654003 - DNA, 18 bp, Homo sapiens
aagtatcttttttcaaaa

SEQ ID NO: 4654004 - DNA, 16 bp, Homo sapiens
aagtatggtgtgttca

SEQ ID NO: 4654005 - DNA, 19 bp, Homo sapiens
aagtattacaaccatatat

SEQ ID NO: 4654006 - DNA, 23 bp, Homo sapiens
aagtattatcattgctcccctga

SEQ ID NO: 4654007 - DNA, 14 bp, Homo sapiens
aagtattgctgaaa

SEQ ID NO: 4654008 - DNA, 14 bp, Homo sapiens
aagtatttataaaa

SEQ ID NO: 4654009 - DNA, 19 bp, Homo sapiens
aagtatttataaaaatata

SEQ ID NO: 4654010 - DNA, 21 bp, Homo sapiens
aagtatttataaaaatataaa

SEQ ID NO: 4654011 - DNA, 11 bp, Homo sapiens
aagtatttctg

SEQ ID NO: 4654012 - DNA, 16 bp, Homo sapiens
aagtcaaataaatgtt

SEQ ID NO: 4654013 - DNA, 13 bp, Homo sapiens
aagtcaaggagaa

SEQ ID NO: 4654014 - DNA, 17 bp, Homo sapiens
aagtcaattctgtgtgg

SEQ ID NO: 4654015 - DNA, 20 bp, Homo sapiens
aagtcaattctgtgtggtat

SEQ ID NO: 4654016 - DNA, 18 bp, Homo sapiens
aagtcacgtcatttgttt

SEQ ID NO: 4654017 - DNA, 16 bp, Homo sapiens
aagtcaggacagcttg

SEQ ID NO: 4654018 - DNA, 16 bp, Homo sapiens
aagtcaggtccaattt

SEQ ID NO: 4654019 - DNA, 19 bp, Homo sapiens
aagtccaggtcctggtggg

SEQ ID NO: 4654020 - DNA, 19 bp, Homo sapiens
aagtccttggactgttttg

SEQ ID NO: 4654021 - DNA, 22 bp, Homo sapiens
aagtccttggactgttttgaaa

SEQ ID NO: 4654022 - DNA, 17 bp, Homo sapiens
aagtcctttcaattcca

SEQ ID NO: 4654023 - DNA, 24 bp, Homo sapiens
aagtcgtccttactcctgtgggag

SEQ ID NO: 4654024 - DNA, 15 bp, Homo sapiens
aagtctgctgctgtg

SEQ ID NO: 4654025 - DNA, 13 bp, Homo sapiens
aagtgaaattaag

SEQ ID NO: 4654026 - DNA, 16 bp, Homo sapiens
aagtgcaaacacagca

SEQ ID NO: 4654027 - DNA, 15 bp, Homo sapiens
aagtgccaaatgctc

SEQ ID NO: 4654028 - DNA, 16 bp, Homo sapiens
aagtgcgtgccgtgtg

SEQ ID NO: 4654029 - DNA, 21 bp, Homo sapiens
aagtgctgcggagcaagagga

SEQ ID NO: 4654030 - DNA, 12 bp, Homo sapiens
aagtgctgtttt

SEQ ID NO: 4654031 - DNA, 21 bp, Homo sapiens
aagtgcttagaggttctgcct

SEQ ID NO: 4654032 - DNA, 22 bp, Homo sapiens
aagtgcttagaggttctgcctc

SEQ ID NO: 4654033 - DNA, 23 bp, Homo sapiens
aagtgcttagaggttctgcctct

SEQ ID NO: 4654034 - DNA, 15 bp, Homo sapiens
tggggatagtctggg

SEQ ID NO: 4654035 - DNA, 17 bp, Homo sapiens
tggggatagtctgggtc

SEQ ID NO: 4654036 - DNA, 22 bp, Homo sapiens
tggggcaggagtagctgagctc

SEQ ID NO: 4654037 - DNA, 15 bp, Homo sapiens
tggggccaggcccca

SEQ ID NO: 4654038 - DNA, 22 bp, Homo sapiens
tggggccaggccccatggaggg

SEQ ID NO: 4654039 - DNA, 13 bp, Homo sapiens
tggggcctgagag

SEQ ID NO: 4654040 - DNA, 14 bp, Homo sapiens
tggggcctgagaga

SEQ ID NO: 4654041 - DNA, 16 bp, Homo sapiens
tggggcctgagagaat

SEQ ID NO: 4654042 - DNA, 20 bp, Homo sapiens
tggggcctgtactgcctgct

SEQ ID NO: 4654043 - DNA, 12 bp, Homo sapiens
tggggcctgtgg

SEQ ID NO: 4654044 - DNA, 22 bp, Homo sapiens
tggggcctgtggaatgagtgtg

SEQ ID NO: 4654045 - DNA, 18 bp, Homo sapiens
tggggctctaacgcctga

SEQ ID NO: 4654046 - DNA, 20 bp, Homo sapiens
tggggctctaacgcctgagc

SEQ ID NO: 4654047 - DNA, 23 bp, Homo sapiens
tggggctctaacgcctgagccca

SEQ ID NO: 4654048 - DNA, 24 bp, Homo sapiens
tggggctctaacgcctgagcccag

SEQ ID NO: 4654049 - DNA, 20 bp, Homo sapiens
tggggctgtgttatgaaaat

SEQ ID NO: 4654050 - DNA, 12 bp, Homo sapiens
tgggggacagag

SEQ ID NO: 4654051 - DNA, 13 bp, Homo sapiens
tgggggcctggct

SEQ ID NO: 4654052 - DNA, 21 bp, Homo sapiens
tgggggcggggtgggaaagat

SEQ ID NO: 4654053 - DNA, 24 bp, Homo sapiens
tggggggtgatgagggcagcagcc

SEQ ID NO: 4654054 - DNA, 16 bp, Homo sapiens
tggggtagaaacattg

SEQ ID NO: 4654055 - DNA, 19 bp, Homo sapiens
tggggtcaagctgagctgg

SEQ ID NO: 4654056 - DNA, 18 bp, Homo sapiens
tggggtctggcagcctcc

SEQ ID NO: 4654057 - DNA, 19 bp, Homo sapiens
tggggtgaatacttatttt

SEQ ID NO: 4654058 - DNA, 14 bp, Homo sapiens
tggggtgacagtca

SEQ ID NO: 4654059 - DNA, 17 bp, Homo sapiens
tggggtgacagtcatca

SEQ ID NO: 4654060 - DNA, 23 bp, Homo sapiens
tggggtgacagtcatcatcaggg

SEQ ID NO: 4654061 - DNA, 22 bp, Homo sapiens
tggggtgacccggcaccccctg

SEQ ID NO: 4654062 - DNA, 14 bp, Homo sapiens
tggggtggacctgg

SEQ ID NO: 4654063 - DNA, 20 bp, Homo sapiens
tgggtcagacccatctctcc

SEQ ID NO: 4654064 - DNA, 14 bp, Homo sapiens
tgggtctctgaagg

SEQ ID NO: 4654065 - DNA, 23 bp, Homo sapiens
tgggtctctgaagggaccccccc

SEQ ID NO: 4654066 - DNA, 14 bp, Homo sapiens
tgggtgctcagaat

SEQ ID NO: 4654067 - DNA, 22 bp, Homo sapiens
tgggtgctcagaataaggcagg

SEQ ID NO: 4654068 - DNA, 14 bp, Homo sapiens
tgggtggctactct

SEQ ID NO: 4654069 - DNA, 23 bp, Homo sapiens
tgggtggctactctgtgccagag

SEQ ID NO: 4654070 - DNA, 16 bp, Homo sapiens
tgggtgggcctggccc

SEQ ID NO: 4654071 - DNA, 22 bp, Homo sapiens
tgggttcacgtaatcctcctga

SEQ ID NO: 4654072 - DNA, 22 bp, Homo sapiens
tggtaatcagaaataataacct

SEQ ID NO: 4654073 - DNA, 18 bp, Homo sapiens
tggtacatggtgtttgtg

SEQ ID NO: 4654074 - DNA, 14 bp, Homo sapiens
tggtacctgccctc

SEQ ID NO: 4654075 - DNA, 15 bp, Homo sapiens
tggtacttcctctgt

SEQ ID NO: 4654076 - DNA, 17 bp, Homo sapiens
tggtacttcctctgtga

SEQ ID NO: 4654077 - DNA, 22 bp, Homo sapiens
tggtacttcctctgtgaactgt

SEQ ID NO: 4654078 - DNA, 16 bp, Homo sapiens
tggtagatgcttgatt

SEQ ID NO: 4654079 - DNA, 17 bp, Homo sapiens
tggtaggactgtagaaa

SEQ ID NO: 4654080 - DNA, 22 bp, Homo sapiens
tggtatagaaatgctggttttt

SEQ ID NO: 4654081 - DNA, 18 bp, Homo sapiens
tggtcaacctcctggaca

SEQ ID NO: 4654082 - DNA, 15 bp, Homo sapiens
tggtcatgaatagaa

SEQ ID NO: 4654083 - DNA, 13 bp, Homo sapiens
tggtcccacatcc

SEQ ID NO: 4654084 - DNA, 16 bp, Homo sapiens
tggtcccacatccctg

SEQ ID NO: 4654085 - DNA, 22 bp, Homo sapiens
tggtcccacatccctgggcctg

SEQ ID NO: 4654086 - DNA, 23 bp, Homo sapiens
tggtcccacatccctgggcctgc

SEQ ID NO: 4654087 - DNA, 19 bp, Homo sapiens
tggtccctgggaggaaatt

SEQ ID NO: 4654088 - DNA, 22 bp, Homo sapiens
tggtccgtgcgggaaattcagt

SEQ ID NO: 4654089 - DNA, 17 bp, Homo sapiens
tggtcctgaccaggatg

SEQ ID NO: 4654090 - DNA, 18 bp, Homo sapiens
tggtctaaggttcagcct

SEQ ID NO: 4654091 - DNA, 11 bp, Homo sapiens
tggtctagacc

SEQ ID NO: 4654092 - DNA, 17 bp, Homo sapiens
tggtctagaccagggct

SEQ ID NO: 4654093 - DNA, 20 bp, Homo sapiens
tggtctagaccagggctgct

SEQ ID NO: 4654094 - DNA, 23 bp, Homo sapiens
tggtctagaccagggctgctctt

SEQ ID NO: 4654095 - DNA, 23 bp, Homo sapiens
tggtctcaggatatccttatcag

SEQ ID NO: 4654096 - DNA, 19 bp, Homo sapiens
tggtcttagctttacattt

SEQ ID NO: 4654097 - DNA, 23 bp, Homo sapiens
tggtcttaggtcttcctgtggct

SEQ ID NO: 4654098 - DNA, 24 bp, Homo sapiens
tggtcttaggtcttcctgtggctc

SEQ ID NO: 4654099 - DNA, 20 bp, Homo sapiens
tggtgagatgcagctggaaa

SEQ ID NO: 4654100 - DNA, 22 bp, Homo sapiens
tggtgcagacagaagtctcctc

SEQ ID NO: 4654101 - DNA, 14 bp, Homo sapiens
tggtgcattcctga

SEQ ID NO: 4654102 - DNA, 10 bp, Homo sapiens
tggtgccacc

SEQ ID NO: 4654103 - DNA, 14 bp, Homo sapiens
tggtgcctggcctg

SEQ ID NO: 4654104 - DNA, 14 bp, Homo sapiens
tggtgctatttgaa

SEQ ID NO: 4654105 - DNA, 15 bp, Homo sapiens
tggtgctatttgaag

SEQ ID NO: 4654106 - DNA, 11 bp, Homo sapiens
aatcggactgc

SEQ ID NO: 4654107 - DNA, 12 bp, Homo sapiens
aatcggactgcc

SEQ ID NO: 4654108 - DNA, 20 bp, Homo sapiens
aatcggactgccaaattctc

SEQ ID NO: 4654109 - DNA, 22 bp, Homo sapiens
aatcgtccctatatcagggcct

SEQ ID NO: 4654110 - DNA, 14 bp, Homo sapiens
aatctaattttttc

SEQ ID NO: 4654111 - DNA, 20 bp, Homo sapiens
aatctagacattcttttaat

SEQ ID NO: 4654112 - DNA, 19 bp, Homo sapiens
aatctatggcttatttcta

SEQ ID NO: 4654113 - DNA, 19 bp, Homo sapiens
aatctccccagtagagaaa

SEQ ID NO: 4654114 - DNA, 22 bp, Homo sapiens
aatctgtctttgcggggcctgt

SEQ ID NO: 4654115 - DNA, 14 bp, Homo sapiens
aatctgttatccca

SEQ ID NO: 4654116 - DNA, 20 bp, Homo sapiens
aatcttcagtattttctcca

SEQ ID NO: 4654117 - DNA, 19 bp, Homo sapiens
aatcttctctcttgattga

SEQ ID NO: 4654118 - DNA, 16 bp, Homo sapiens
aatcttgatcattccg

SEQ ID NO: 4654119 - DNA, 22 bp, Homo sapiens
aatcttgctttctttagaattt

SEQ ID NO: 4654120 - DNA, 18 bp, Homo sapiens
aatcttggcgagtcatta

SEQ ID NO: 4654121 - DNA, 20 bp, Homo sapiens
aatcttgtgttaacttgcct

SEQ ID NO: 4654122 - DNA, 20 bp, Homo sapiens
aatctttattttattattca

SEQ ID NO: 4654123 - DNA, 21 bp, Homo sapiens
aatctttattttattattcag

SEQ ID NO: 4654124 - DNA, 16 bp, Homo sapiens
aatgaaaaatataatg

SEQ ID NO: 4654125 - DNA, 17 bp, Homo sapiens
aatgaaaataaaacaca

SEQ ID NO: 4654126 - DNA, 14 bp, Homo sapiens
aatgaaaattgtat

SEQ ID NO: 4654127 - DNA, 15 bp, Homo sapiens
aatgaaattaacaca

SEQ ID NO: 4654128 - DNA, 18 bp, Homo sapiens
aatgaacatctcttgaaa

SEQ ID NO: 4654129 - DNA, 19 bp, Homo sapiens
aatgaacatctcttgaaac

SEQ ID NO: 4654130 - DNA, 15 bp, Homo sapiens
aatgaagaatcacga

SEQ ID NO: 4654131 - DNA, 13 bp, Homo sapiens
aatgacagatggt

SEQ ID NO: 4654132 - DNA, 19 bp, Homo sapiens
aatgacccttttgtgtcta

SEQ ID NO: 4654133 - DNA, 21 bp, Homo sapiens
aatgactatataatttatttc

SEQ ID NO: 4654134 - DNA, 23 bp, Homo sapiens
aatgactatataatttatttcca

SEQ ID NO: 4654135 - DNA, 14 bp, Homo sapiens
aatgacttatttct

SEQ ID NO: 4654136 - DNA, 21 bp, Homo sapiens
aatgacttatttctgctctgg

SEQ ID NO: 4654137 - DNA, 23 bp, Homo sapiens
aatgacttatttctgctctggaa

SEQ ID NO: 4654138 - DNA, 14 bp, Homo sapiens
aatgagcccagaga

SEQ ID NO: 4654139 - DNA, 21 bp, Homo sapiens
aatgagcctacgctgaagatg

SEQ ID NO: 4654140 - DNA, 18 bp, Homo sapiens
aatgagggaaatctgtaa

SEQ ID NO: 4654141 - DNA, 20 bp, Homo sapiens
aatgatccccagctgtttat

SEQ ID NO: 4654142 - DNA, 22 bp, Homo sapiens
aatgatccccagctgtttatgc

SEQ ID NO: 4654143 - DNA, 15 bp, Homo sapiens
aatgatggcagagga

SEQ ID NO: 4654144 - DNA, 20 bp, Homo sapiens
aatgatttggccaggcctag

SEQ ID NO: 4654145 - DNA, 12 bp, Homo sapiens
aatgatttgtgt

SEQ ID NO: 4654146 - DNA, 18 bp, Homo sapiens
aatgcaaattaaaacata

SEQ ID NO: 4654147 - DNA, 16 bp, Homo sapiens
aatgcactgtttttaa

SEQ ID NO: 4654148 - DNA, 18 bp, Homo sapiens
aatgcatatttataagag

SEQ ID NO: 4654149 - DNA, 19 bp, Homo sapiens
aatgcatatttataagaga

SEQ ID NO: 4654150 - DNA, 20 bp, Homo sapiens
aatgcatatttataagagaa

SEQ ID NO: 4654151 - DNA, 22 bp, Homo sapiens
aatgcattgtatcgatgttatg

SEQ ID NO: 4654152 - DNA, 13 bp, Homo sapiens
aatgcctcctgtg

SEQ ID NO: 4654153 - DNA, 17 bp, Homo sapiens
aatgccttaaaatggaa

SEQ ID NO: 4654154 - DNA, 22 bp, Homo sapiens
aatgctagcacaatattcctat

SEQ ID NO: 4654155 - DNA, 16 bp, Homo sapiens
aatgctctatgtttgt

SEQ ID NO: 4654156 - DNA, 21 bp, Homo sapiens
aatgctctatgtttgtatttg

SEQ ID NO: 4654157 - DNA, 19 bp, Homo sapiens
aatgctctctcaaattgtc

SEQ ID NO: 4654158 - DNA, 15 bp, Homo sapiens
gcctggctggctgag

SEQ ID NO: 4654159 - DNA, 21 bp, Homo sapiens
gcctggcttacctatctgtgg

SEQ ID NO: 4654160 - DNA, 14 bp, Homo sapiens
gcctgggatgccct

SEQ ID NO: 4654161 - DNA, 16 bp, Homo sapiens
gcctgggatgcccttc

SEQ ID NO: 4654162 - DNA, 18 bp, Homo sapiens
gcctgggatgcccttccc

SEQ ID NO: 4654163 - DNA, 19 bp, Homo sapiens
gcctgggatgcccttcccc

SEQ ID NO: 4654164 - DNA, 14 bp, Homo sapiens
gcctgggcctatgg

SEQ ID NO: 4654165 - DNA, 19 bp, Homo sapiens
gcctgggcctatggagagc

SEQ ID NO: 4654166 - DNA, 20 bp, Homo sapiens
gcctgggcctatggagagcc

SEQ ID NO: 4654167 - DNA, 23 bp, Homo sapiens
gcctgggcctatggagagccctg

SEQ ID NO: 4654168 - DNA, 11 bp, Homo sapiens
aaaaaaaagaa

SEQ ID NO: 4654169 - DNA, 12 bp, Homo sapiens
aaaaaaagtatt

SEQ ID NO: 4654170 - DNA, 12 bp, Homo sapiens
aaaaaaatgttg

SEQ ID NO: 4654171 - DNA, 12 bp, Homo sapiens
aaaaaatgtaat

SEQ ID NO: 4654172 - DNA, 18 bp, Homo sapiens
aaaaactggccttttgat

SEQ ID NO: 4654173 - DNA, 17 bp, Homo sapiens
aaaaacttaaatattgt

SEQ ID NO: 4654174 - DNA, 20 bp, Homo sapiens
aaaaacttaaatattgtaat

SEQ ID NO: 4654175 - DNA, 15 bp, Homo sapiens
aaaaagaaaatatta

SEQ ID NO: 4654176 - DNA, 20 bp, Homo sapiens
aaaaagaaattcgcatgttt

SEQ ID NO: 4654177 - DNA, 23 bp, Homo sapiens
aaaaagtaatgacttagaaactg

SEQ ID NO: 4654178 - DNA, 14 bp, Homo sapiens
aaaaagtattattt

SEQ ID NO: 4654179 - DNA, 11 bp, Homo sapiens
aaaaatacttc

SEQ ID NO: 4654180 - DNA, 21 bp, Homo sapiens
aaaaatagagcaaaatcaaca

SEQ ID NO: 4654181 - DNA, 14 bp, Homo sapiens
aaaaatataatgtt

SEQ ID NO: 4654182 - DNA, 14 bp, Homo sapiens
aaaaatatgtaatt

SEQ ID NO: 4654183 - DNA, 13 bp, Homo sapiens
aaaaatattttct

SEQ ID NO: 4654184 - DNA, 15 bp, Homo sapiens
aaaaatcttgtgtta

SEQ ID NO: 4654185 - DNA, 18 bp, Homo sapiens
aaaaatgcaaatcctatg

SEQ ID NO: 4654186 - DNA, 13 bp, Homo sapiens
aaaaatgttctca

SEQ ID NO: 4654187 - DNA, 15 bp, Homo sapiens
aaaaattaacttttt

SEQ ID NO: 4654188 - DNA, 19 bp, Homo sapiens
aaaaattacctttaatttt

SEQ ID NO: 4654189 - DNA, 23 bp, Homo sapiens
aaaaattacctttaattttaatg

SEQ ID NO: 4654190 - DNA, 22 bp, Homo sapiens
aaaacaagtatataatttactt

SEQ ID NO: 4654191 - DNA, 15 bp, Homo sapiens
aaaacaagtgaaata

SEQ ID NO: 4654192 - DNA, 21 bp, Homo sapiens
aaaacactgaaaaatattcca

SEQ ID NO: 4654193 - DNA, 12 bp, Homo sapiens
aaaacagaaacc

SEQ ID NO: 4654194 - DNA, 13 bp, Homo sapiens
aaaacagaagcct

SEQ ID NO: 4654195 - DNA, 15 bp, Homo sapiens
aaaacagataaacaa

SEQ ID NO: 4654196 - DNA, 16 bp, Homo sapiens
aaaacagcattgcttt

SEQ ID NO: 4654197 - DNA, 20 bp, Homo sapiens
aaaacagcattgctttctga

SEQ ID NO: 4654198 - DNA, 18 bp, Homo sapiens
aaaacagggccacataga

SEQ ID NO: 4654199 - DNA, 15 bp, Homo sapiens
aaaacatatttcatt

SEQ ID NO: 4654200 - DNA, 13 bp, Homo sapiens
aaaactctacaga

SEQ ID NO: 4654201 - DNA, 13 bp, Homo sapiens
aaaacttaaatat

SEQ ID NO: 4654202 - DNA, 17 bp, Homo sapiens
aaaacttaaatattgta

SEQ ID NO: 4654203 - DNA, 20 bp, Homo sapiens
aaaacttcttgtcagacata

SEQ ID NO: 4654204 - DNA, 22 bp, Homo sapiens
aaaacttcttgtcagacataaa

SEQ ID NO: 4654205 - DNA, 23 bp, Homo sapiens
aaaacttcttgtcagacataaag

SEQ ID NO: 4654206 - DNA, 18 bp, Homo sapiens
aaaactttattaaaagaa

SEQ ID NO: 4654207 - DNA, 12 bp, Homo sapiens
aaaactttattg

SEQ ID NO: 4654208 - DNA, 21 bp, Homo sapiens
aaaactttattgggtttttat

SEQ ID NO: 4654209 - DNA, 13 bp, Homo sapiens
aaaagaaaatatt

SEQ ID NO: 4654210 - DNA, 16 bp, Homo sapiens
aaaagaaatatatttt

SEQ ID NO: 4654211 - DNA, 11 bp, Homo sapiens
aaaagaagttt

SEQ ID NO: 4654212 - DNA, 20 bp, Homo sapiens
aaaagaatgagtgaagtatt

SEQ ID NO: 4654213 - DNA, 17 bp, Homo sapiens
aaaagcacaatcactaa

SEQ ID NO: 4654214 - DNA, 15 bp, Homo sapiens
aaaagcagggcagca

SEQ ID NO: 4654215 - DNA, 14 bp, Homo sapiens
aaaagccttccagt

SEQ ID NO: 4654216 - DNA, 14 bp, Homo sapiens
aaaaggccaaacct

SEQ ID NO: 4654217 - DNA, 15 bp, Homo sapiens
aaaaggccaaacctc

SEQ ID NO: 4654218 - DNA, 19 bp, Homo sapiens
aaaaggccaaacctctgtt

SEQ ID NO: 4654219 - DNA, 22 bp, Homo sapiens
aaaaggccaaacctctgttcag

SEQ ID NO: 4654220 - DNA, 13 bp, Homo sapiens
aaaaggcctgggg

SEQ ID NO: 4654221 - DNA, 14 bp, Homo sapiens
aaaaggcctggggt

SEQ ID NO: 4654222 - DNA, 12 bp, Homo sapiens
aaaagggaagta

SEQ ID NO: 4654223 - DNA, 18 bp, Homo sapiens
aaaagggaagtagtcctt

SEQ ID NO: 4654224 - DNA, 21 bp, Homo sapiens
aaaagtaattttgtcacatta

SEQ ID NO: 4654225 - DNA, 21 bp, Homo sapiens
aaaagtacatatttattttct

SEQ ID NO: 4654226 - DNA, 22 bp, Homo sapiens
aaaagtacctctgcattgagca

SEQ ID NO: 4654227 - DNA, 14 bp, Homo sapiens
aaaagtattatttt

SEQ ID NO: 4654228 - DNA, 15 bp, Homo sapiens
aaaagtcacttacta

SEQ ID NO: 4654229 - DNA, 14 bp, Homo sapiens
aaaagtctgtcttt

SEQ ID NO: 4654230 - DNA, 16 bp, Homo sapiens
aaaagtgagagacctc

SEQ ID NO: 4654231 - DNA, 17 bp, Homo sapiens
aaaagtggcctctttgt

SEQ ID NO: 4654232 - DNA, 13 bp, Homo sapiens
aaaagtttcctag

SEQ ID NO: 4654233 - DNA, 19 bp, Homo sapiens
aaaagttttgaaggaaacc

SEQ ID NO: 4654234 - DNA, 20 bp, Homo sapiens
aaaagttttgaaggaaacct

SEQ ID NO: 4654235 - DNA, 20 bp, Homo sapiens
aaaagttttgatatttattt

SEQ ID NO: 4654236 - DNA, 13 bp, Homo sapiens
aaaataaaatgaa

SEQ ID NO: 4654237 - DNA, 18 bp, Homo sapiens
aaaataaaggataactct

SEQ ID NO: 4654238 - DNA, 14 bp, Homo sapiens
aaaataatgctgca

SEQ ID NO: 4654239 - DNA, 13 bp, Homo sapiens
aaaatacatttta

SEQ ID NO: 4654240 - DNA, 11 bp, Homo sapiens
aaaatacttct

SEQ ID NO: 4654241 - DNA, 16 bp, Homo sapiens
aaaatagaataattct

SEQ ID NO: 4654242 - DNA, 20 bp, Homo sapiens
aaaatagacctaactgaata

SEQ ID NO: 4654243 - DNA, 19 bp, Homo sapiens
aaaatataaattgtacatt

SEQ ID NO: 4654244 - DNA, 22 bp, Homo sapiens
aaaatataaggactttttgatg

SEQ ID NO: 4654245 - DNA, 13 bp, Homo sapiens
aaaatatagcaaa

SEQ ID NO: 4654246 - DNA, 16 bp, Homo sapiens
aaaatatgtaatttca

SEQ ID NO: 4654247 - DNA, 13 bp, Homo sapiens
aaaatattttctc

SEQ ID NO: 4654248 - DNA, 15 bp, Homo sapiens
aaaatcagtttttca

SEQ ID NO: 4654249 - DNA, 22 bp, Homo sapiens
aaaatccccttcgctgaaattg

SEQ ID NO: 4654250 - DNA, 20 bp, Homo sapiens
aaaatcttggagaccctgca

SEQ ID NO: 4654251 - DNA, 11 bp, Homo sapiens
aaaatcttgtg

SEQ ID NO: 4654252 - DNA, 14 bp, Homo sapiens
aaaatcttgtgtta

SEQ ID NO: 4654253 - DNA, 13 bp, Homo sapiens
aaaatgagagtga

SEQ ID NO: 4654254 - DNA, 14 bp, Homo sapiens
aaaatgtaatttaa

SEQ ID NO: 4654255 - DNA, 15 bp, Homo sapiens
aaaatgtacatttat

SEQ ID NO: 4654256 - DNA, 19 bp, Homo sapiens
actctcccctccccatctg

SEQ ID NO: 4654257 - DNA, 14 bp, Homo sapiens
actctcctggcctt

SEQ ID NO: 4654258 - DNA, 18 bp, Homo sapiens
actctcgcatcttcccaa

SEQ ID NO: 4654259 - DNA, 15 bp, Homo sapiens
actctcttctccatt

SEQ ID NO: 4654260 - DNA, 21 bp, Homo sapiens
actctgacaagctggccaaag

SEQ ID NO: 4654261 - DNA, 11 bp, Homo sapiens
actctgcacat

SEQ ID NO: 4654262 - DNA, 13 bp, Homo sapiens
actctgcacatgt

SEQ ID NO: 4654263 - DNA, 21 bp, Homo sapiens
actctgcacatgtcttgtaca

SEQ ID NO: 4654264 - DNA, 11 bp, Homo sapiens
actctgctctg

SEQ ID NO: 4654265 - DNA, 15 bp, Homo sapiens
actctgctctgatgc

SEQ ID NO: 4654266 - DNA, 14 bp, Homo sapiens
actctggcagccac

SEQ ID NO: 4654267 - DNA, 14 bp, Homo sapiens
actctggccctggc

SEQ ID NO: 4654268 - DNA, 15 bp, Homo sapiens
actctggccctggcc

SEQ ID NO: 4654269 - DNA, 17 bp, Homo sapiens
actctggccctggccct

SEQ ID NO: 4654270 - DNA, 23 bp, Homo sapiens
actctgggctgtaacgtggcact

SEQ ID NO: 4654271 - DNA, 16 bp, Homo sapiens
actctgtcttcacctg

SEQ ID NO: 4654272 - DNA, 17 bp, Homo sapiens
actctgtcttcacctga

SEQ ID NO: 4654273 - DNA, 22 bp, Homo sapiens
actctgtcttcacctgattcaa

SEQ ID NO: 4654274 - DNA, 17 bp, Homo sapiens
actctgtgccagagcct

SEQ ID NO: 4654275 - DNA, 19 bp, Homo sapiens
actctgtgccagagcctgg

SEQ ID NO: 4654276 - DNA, 21 bp, Homo sapiens
actctgtgccagagcctgggg

SEQ ID NO: 4654277 - DNA, 23 bp, Homo sapiens
actctgtgccagagcctggggct

SEQ ID NO: 4654278 - DNA, 17 bp, Homo sapiens
actctgttgcctcctct

SEQ ID NO: 4654279 - DNA, 21 bp, Homo sapiens
actcttcagtgactcctgctg

SEQ ID NO: 4654280 - DNA, 12 bp, Homo sapiens
actcttctcagc

SEQ ID NO: 4654281 - DNA, 17 bp, Homo sapiens
actcttctgactgcccc

SEQ ID NO: 4654282 - DNA, 17 bp, Homo sapiens
actcttgaagtacttaa

SEQ ID NO: 4654283 - DNA, 19 bp, Homo sapiens
actcttgctcctgcttctc

SEQ ID NO: 4654284 - DNA, 18 bp, Homo sapiens
actcttgtcacccaggct

SEQ ID NO: 4654285 - DNA, 16 bp, Homo sapiens
actctttctaatgctg

SEQ ID NO: 4654286 - DNA, 14 bp, Homo sapiens
actgaaaacatctg

SEQ ID NO: 4654287 - DNA, 16 bp, Homo sapiens
actgaaaacatctgga

SEQ ID NO: 4654288 - DNA, 17 bp, Homo sapiens
actgaaaacatctggaa

SEQ ID NO: 4654289 - DNA, 16 bp, Homo sapiens
actgaacattccagag

SEQ ID NO: 4654290 - DNA, 14 bp, Homo sapiens
acctgacctaacct

SEQ ID NO: 4654291 - DNA, 15 bp, Homo sapiens
acctgcaagatggac

SEQ ID NO: 4654292 - DNA, 13 bp, Homo sapiens
acctgcacaggct

SEQ ID NO: 4654293 - DNA, 14 bp, Homo sapiens
acctgcacaggctt

SEQ ID NO: 4654294 - DNA, 14 bp, Homo sapiens
acctgcatggtcaa

SEQ ID NO: 4654295 - DNA, 21 bp, Homo sapiens
acctgccagccactgtcaccg

SEQ ID NO: 4654296 - DNA, 17 bp, Homo sapiens
acctgccccaactctcc

SEQ ID NO: 4654297 - DNA, 21 bp, Homo sapiens
acctgccctctatttattagc

SEQ ID NO: 4654298 - DNA, 23 bp, Homo sapiens
acctgccctctatttattagcca

SEQ ID NO: 4654299 - DNA, 17 bp, Homo sapiens
acctgcgcaagtgcctg

SEQ ID NO: 4654300 - DNA, 18 bp, Homo sapiens
acctgcgcaagtgcctgg

SEQ ID NO: 4654301 - DNA, 23 bp, Homo sapiens
acctgctgagctctgagaggccc

SEQ ID NO: 4654302 - DNA, 19 bp, Homo sapiens
acctggaggggagaggtca

SEQ ID NO: 4654303 - DNA, 14 bp, Homo sapiens
acctggcagacttg

SEQ ID NO: 4654304 - DNA, 18 bp, Homo sapiens
acctgggacaagcaggcc

SEQ ID NO: 4654305 - DNA, 14 bp, Homo sapiens
acctgggccctggg

SEQ ID NO: 4654306 - DNA, 16 bp, Homo sapiens
acctgggccctggggc

SEQ ID NO: 4654307 - DNA, 20 bp, Homo sapiens
acctgggccctggggcctgt

SEQ ID NO: 4654308 - DNA, 21 bp, Homo sapiens
acctgggccctggggcctgta

SEQ ID NO: 4654309 - DNA, 14 bp, Homo sapiens
acctgtcattgtat

SEQ ID NO: 4654310 - DNA, 16 bp, Homo sapiens
acctgtctcagctgtt

SEQ ID NO: 4654311 - DNA, 15 bp, Homo sapiens
acctgtctctctctt

SEQ ID NO: 4654312 - DNA, 15 bp, Homo sapiens
acctgtgagcccagc

SEQ ID NO: 4654313 - DNA, 19 bp, Homo sapiens
acctgtggccaagttctta

SEQ ID NO: 4654314 - DNA, 22 bp, Homo sapiens
acctgttaaaacaaccagttaa

SEQ ID NO: 4654315 - DNA, 17 bp, Homo sapiens
acctgttagcagacagg

SEQ ID NO: 4654316 - DNA, 21 bp, Homo sapiens
acctgttcttagagtgtagct

SEQ ID NO: 4654317 - DNA, 21 bp, Homo sapiens
acctgttcttgggcctcaggc

SEQ ID NO: 4654318 - DNA, 22 bp, Homo sapiens
accttaggcccggagctgcccc

SEQ ID NO: 4654319 - DNA, 19 bp, Homo sapiens
accttatcactgcattatt

SEQ ID NO: 4654320 - DNA, 23 bp, Homo sapiens
accttatcactgcattattctct

SEQ ID NO: 4654321 - DNA, 23 bp, Homo sapiens
accttcacacacagactgttgtc

SEQ ID NO: 4654322 - DNA, 12 bp, Homo sapiens
accttcccttcc

SEQ ID NO: 4654323 - DNA, 18 bp, Homo sapiens
accttcccttcctcagca

SEQ ID NO: 4654324 - DNA, 22 bp, Homo sapiens
accttcccttcctcagcaggcc

SEQ ID NO: 4654325 - DNA, 12 bp, Homo sapiens
accttctcccag

SEQ ID NO: 4654326 - DNA, 16 bp, Homo sapiens
accttctcccaggcct

SEQ ID NO: 4654327 - DNA, 12 bp, Homo sapiens
accttgtgtctg

SEQ ID NO: 4654328 - DNA, 13 bp, Homo sapiens
accttgtgtctgt

SEQ ID NO: 4654329 - DNA, 18 bp, Homo sapiens
accttgtgtctgtacacg

SEQ ID NO: 4654330 - DNA, 15 bp, Homo sapiens
accttgttctatttt

SEQ ID NO: 4654331 - DNA, 15 bp, Homo sapiens
acctttaaatatcat

SEQ ID NO: 4654332 - DNA, 21 bp, Homo sapiens
acctttatatctgtcttttat

SEQ ID NO: 4654333 - DNA, 19 bp, Homo sapiens
acctttcagtgcagtttct

SEQ ID NO: 4654334 - DNA, 23 bp, Homo sapiens
acctttcagtgcagtttcttttc

SEQ ID NO: 4654335 - DNA, 13 bp, Homo sapiens
accttttttgtct

SEQ ID NO: 4654336 - DNA, 20 bp, Homo sapiens
acgagacaacagcacacagg

SEQ ID NO: 4654337 - DNA, 19 bp, Homo sapiens
acgagactttctcctggcc

SEQ ID NO: 4654338 - DNA, 18 bp, Homo sapiens
acgagggcaacagggagc

SEQ ID NO: 4654339 - DNA, 19 bp, Homo sapiens
acgaggggcagggaaggac

SEQ ID NO: 4654340 - DNA, 20 bp, Homo sapiens
acgaggggcagggaaggaca

SEQ ID NO: 4654341 - DNA, 16 bp, Homo sapiens
acgattatacttgaga

SEQ ID NO: 4654342 - DNA, 17 bp, Homo sapiens
acgcactggacagcatc

SEQ ID NO: 4654343 - DNA, 14 bp, Homo sapiens
acgcagaagagggg

SEQ ID NO: 4654344 - DNA, 13 bp, Homo sapiens
acgcaggtattta

SEQ ID NO: 4654345 - DNA, 21 bp, Homo sapiens
acgcaggtatttagaagcaga

SEQ ID NO: 4654346 - DNA, 11 bp, Homo sapiens
acgcctgagcc

SEQ ID NO: 4654347 - DNA, 12 bp, Homo sapiens
acgcctgagccc

SEQ ID NO: 4654348 - DNA, 13 bp, Homo sapiens
acgcctgagccca

SEQ ID NO: 4654349 - DNA, 21 bp, Homo sapiens
acgcctgagcccagggaggcc

SEQ ID NO: 4654350 - DNA, 18 bp, Homo sapiens
acgctctctactctgctt

SEQ ID NO: 4654351 - DNA, 20 bp, Homo sapiens
acgctggccaatttttgtac

SEQ ID NO: 4654352 - DNA, 22 bp, Homo sapiens
acgcttgtagaactcactctgg

SEQ ID NO: 4654353 - DNA, 19 bp, Homo sapiens
acgctttcagcgaatgaca

SEQ ID NO: 4654354 - DNA, 12 bp, Homo sapiens
acggagggctgg

SEQ ID NO: 4654355 - DNA, 23 bp, Homo sapiens
acggcacctgggccctggggcct

SEQ ID NO: 4654356 - DNA, 14 bp, Homo sapiens
acggcactgtggcc

SEQ ID NO: 4654357 - DNA, 18 bp, Homo sapiens
acggccacatcaaagagg

SEQ ID NO: 4654358 - DNA, 22 bp, Homo sapiens
acggccctcatctatgaggaaa

SEQ ID NO: 4654359 - DNA, 23 bp, Homo sapiens
acggcctggctggtgggaaggcc

SEQ ID NO: 4654360 - DNA, 16 bp, Homo sapiens
acggcgcctttttggc

SEQ ID NO: 4654361 - DNA, 19 bp, Homo sapiens
acggctcgatttctccagg

SEQ ID NO: 4654362 - DNA, 17 bp, Homo sapiens
acggtgcagtctgggtg

SEQ ID NO: 4654363 - DNA, 18 bp, Homo sapiens
acgtaaagctagaaatga

SEQ ID NO: 4654364 - DNA, 18 bp, Homo sapiens
acgtagttctagcagtcc

SEQ ID NO: 4654365 - DNA, 18 bp, Homo sapiens
acgtcccagcatccctgg

SEQ ID NO: 4654366 - DNA, 15 bp, Homo sapiens
acgtctaactggaaa

SEQ ID NO: 4654367 - DNA, 17 bp, Homo sapiens
acgtctgggagaaattg

SEQ ID NO: 4654368 - DNA, 23 bp, Homo sapiens
acgtctgggagaaattgacagat

SEQ ID NO: 4654369 - DNA, 18 bp, Homo sapiens
acgtgagagaaagagaga

SEQ ID NO: 4654370 - DNA, 13 bp, Homo sapiens
acgtggcactggt

SEQ ID NO: 4654371 - DNA, 21 bp, Homo sapiens
acgtggcctcgtgaggggcaa

SEQ ID NO: 4654372 - DNA, 14 bp, Homo sapiens
acgtggctcagcca

SEQ ID NO: 4654373 - DNA, 21 bp, Homo sapiens
acgtggtctagaccagggctg

SEQ ID NO: 4654374 - DNA, 18 bp, Homo sapiens
acgtgtatagtatctgta

SEQ ID NO: 4654375 - DNA, 21 bp, Homo sapiens
acgttaggcatttcctgctga

SEQ ID NO: 4654376 - DNA, 13 bp, Homo sapiens
actaaaaatattg

SEQ ID NO: 4654377 - DNA, 15 bp, Homo sapiens
actaaaaatattgtt

SEQ ID NO: 4654378 - DNA, 21 bp, Homo sapiens
actaaaaatattgtttctgca

SEQ ID NO: 4654379 - DNA, 11 bp, Homo sapiens
actaaacagaa

SEQ ID NO: 4654380 - DNA, 12 bp, Homo sapiens
actaaacagaaa

SEQ ID NO: 4654381 - DNA, 15 bp, Homo sapiens
actaacacaaggaca

SEQ ID NO: 4654382 - DNA, 18 bp, Homo sapiens
actaacactcagaagcct

SEQ ID NO: 4654383 - DNA, 19 bp, Homo sapiens
actaacactcagaagcctg

SEQ ID NO: 4654384 - DNA, 16 bp, Homo sapiens
actaacttctaaagaa

SEQ ID NO: 4654385 - DNA, 19 bp, Homo sapiens
actaaggcaggtgggcaga

SEQ ID NO: 4654386 - DNA, 17 bp, Homo sapiens
actaaggcttttatttc

SEQ ID NO: 4654387 - DNA, 17 bp, Homo sapiens
actaatagagtacttaa

SEQ ID NO: 4654388 - DNA, 21 bp, Homo sapiens
actaatagatttttttttcca

SEQ ID NO: 4654389 - DNA, 18 bp, Homo sapiens
actaatgcttacaacttt

SEQ ID NO: 4654390 - DNA, 12 bp, Homo sapiens
actaatgtaaaa

SEQ ID NO: 4654391 - DNA, 15 bp, Homo sapiens
actaatttatacttt

SEQ ID NO: 4654392 - DNA, 21 bp, Homo sapiens
actaattttacatgtttataa

SEQ ID NO: 4654393 - DNA, 20 bp, Homo sapiens
actacacatttttaaattgt

SEQ ID NO: 4654394 - DNA, 18 bp, Homo sapiens
actacattttttctaata

SEQ ID NO: 4654395 - DNA, 22 bp, Homo sapiens
actacccattgttcccttcctc

SEQ ID NO: 4654396 - DNA, 17 bp, Homo sapiens
actacctaagtaattct

SEQ ID NO: 4654397 - DNA, 16 bp, Homo sapiens
actactaggtaataat

SEQ ID NO: 4654398 - DNA, 14 bp, Homo sapiens
actactctctgttt

SEQ ID NO: 4654399 - DNA, 15 bp, Homo sapiens
actactgattacttg

SEQ ID NO: 4654400 - DNA, 21 bp, Homo sapiens
aaaatgtatccaaggaaacat

SEQ ID NO: 4654401 - DNA, 14 bp, Homo sapiens
aaaatgtcttgtgt

SEQ ID NO: 4654402 - DNA, 18 bp, Homo sapiens
aaaatgtgaggcaataag

SEQ ID NO: 4654403 - DNA, 12 bp, Homo sapiens
aaaatgttttaa

SEQ ID NO: 4654404 - DNA, 15 bp, Homo sapiens
aaaattaaatctaga

SEQ ID NO: 4654405 - DNA, 18 bp, Homo sapiens
aaaattaaatctagacat

SEQ ID NO: 4654406 - DNA, 19 bp, Homo sapiens
aaaattacctttaatttta

SEQ ID NO: 4654407 - DNA, 13 bp, Homo sapiens
aaaattcatttct

SEQ ID NO: 4654408 - DNA, 17 bp, Homo sapiens
aaaattcttgaaagaat

SEQ ID NO: 4654409 - DNA, 15 bp, Homo sapiens
aaaatttattctcag

SEQ ID NO: 4654410 - DNA, 12 bp, Homo sapiens
aaacaaaatttg

SEQ ID NO: 4654411 - DNA, 15 bp, Homo sapiens
aaacaagctgtgcag

SEQ ID NO: 4654412 - DNA, 15 bp, Homo sapiens
aaacaagtatataat

SEQ ID NO: 4654413 - DNA, 20 bp, Homo sapiens
aaacacactgttgtttagtt

SEQ ID NO: 4654414 - DNA, 24 bp, Homo sapiens
aaacaccacttaatcttctctctt

SEQ ID NO: 4654415 - DNA, 12 bp, Homo sapiens
aaacagaagcct

SEQ ID NO: 4654416 - DNA, 13 bp, Homo sapiens
aaacagacaaaac

SEQ ID NO: 4654417 - DNA, 14 bp, Homo sapiens
aaacagacaaaaca

SEQ ID NO: 4654418 - DNA, 20 bp, Homo sapiens
aaacagacaaaacagataaa

SEQ ID NO: 4654419 - DNA, 17 bp, Homo sapiens
aaacagcattgctttct

SEQ ID NO: 4654420 - DNA, 15 bp, Homo sapiens
aaacagcctgtgtct

SEQ ID NO: 4654421 - DNA, 17 bp, Homo sapiens
aaacagggccacataga

SEQ ID NO: 4654422 - DNA, 22 bp, Homo sapiens
aaacagggctgccttctggcct

SEQ ID NO: 4654423 - DNA, 16 bp, Homo sapiens
aaacagttgctgtgaa

SEQ ID NO: 4654424 - DNA, 18 bp, Homo sapiens
aaacataatgaaaatatt

SEQ ID NO: 4654425 - DNA, 14 bp, Homo sapiens
aaacatatggcttt

SEQ ID NO: 4654426 - DNA, 15 bp, Homo sapiens
aaacatatttcattt

SEQ ID NO: 4654427 - DNA, 19 bp, Homo sapiens
aaacatcccccaatgacct

SEQ ID NO: 4654428 - DNA, 16 bp, Homo sapiens
aaacatctagcccaaa

SEQ ID NO: 4654429 - DNA, 20 bp, Homo sapiens
aaacatgtggttacacagtg

SEQ ID NO: 4654430 - DNA, 18 bp, Homo sapiens
aaacattatatgtataca

SEQ ID NO: 4654431 - DNA, 11 bp, Homo sapiens
aaacatttata

SEQ ID NO: 4654432 - DNA, 22 bp, Homo sapiens
aaacattttatcattaaaaatt

SEQ ID NO: 4654433 - DNA, 14 bp, Homo sapiens
aaaccaaacttgtt

SEQ ID NO: 4654434 - DNA, 20 bp, Homo sapiens
aaaccacaaggctgttgcat

SEQ ID NO: 4654435 - DNA, 16 bp, Homo sapiens
aaaccaggaccctgtc

SEQ ID NO: 4654436 - DNA, 21 bp, Homo sapiens
aaaccctggtggtattttatt

SEQ ID NO: 4654437 - DNA, 17 bp, Homo sapiens
aaacctctacatattta

SEQ ID NO: 4654438 - DNA, 22 bp, Homo sapiens
aaacctgtattactgaataata

SEQ ID NO: 4654439 - DNA, 14 bp, Homo sapiens
aaacgagactttct

SEQ ID NO: 4654440 - DNA, 13 bp, Homo sapiens
aaacgtgaacaaa

SEQ ID NO: 4654441 - DNA, 23 bp, Homo sapiens
aaacgtgttgtatctacagtaat

SEQ ID NO: 4654442 - DNA, 17 bp, Homo sapiens
aaactaaaaaggaagaa

SEQ ID NO: 4654443 - DNA, 18 bp, Homo sapiens
aaactaaggccctcttga

SEQ ID NO: 4654444 - DNA, 19 bp, Homo sapiens
aaactaaggcttttatttc

SEQ ID NO: 4654445 - DNA, 14 bp, Homo sapiens
aaactatgttccta

SEQ ID NO: 4654446 - DNA, 15 bp, Homo sapiens
aaactatgttcctaa

SEQ ID NO: 4654447 - DNA, 13 bp, Homo sapiens
aaactatttatct

SEQ ID NO: 4654448 - DNA, 11 bp, Homo sapiens
aaactctgctg

SEQ ID NO: 4654449 - DNA, 15 bp, Homo sapiens
aaactgaatataaag

SEQ ID NO: 4654450 - DNA, 19 bp, Homo sapiens
aaactgaatataaagctta

SEQ ID NO: 4654451 - DNA, 21 bp, Homo sapiens
aaactggttttaagtgctttc

SEQ ID NO: 4654452 - DNA, 14 bp, Homo sapiens
aaactgtgttgcca

SEQ ID NO: 4654453 - DNA, 16 bp, Homo sapiens
aaactgttcttttgca

SEQ ID NO: 4654454 - DNA, 18 bp, Homo sapiens
aaactgttcttttgcatt

SEQ ID NO: 4654455 - DNA, 15 bp, Homo sapiens
aaactgtttttacta

SEQ ID NO: 4654456 - DNA, 15 bp, Homo sapiens
aaacttaaatattgt

SEQ ID NO: 4654457 - DNA, 16 bp, Homo sapiens
aaacttcattcagagg

SEQ ID NO: 4654458 - DNA, 11 bp, Homo sapiens
aaacttctgaa

SEQ ID NO: 4654459 - DNA, 22 bp, Homo sapiens
aaacttgaaagaagttttatgc

SEQ ID NO: 4654460 - DNA, 23 bp, Homo sapiens
aaacttgcagcttggtattgcag

SEQ ID NO: 4654461 - DNA, 18 bp, Homo sapiens
aaacttgctttatgcctt

SEQ ID NO: 4654462 - DNA, 15 bp, Homo sapiens
aaactttattaaaag

SEQ ID NO: 4654463 - DNA, 11 bp, Homo sapiens
aaactttattg

SEQ ID NO: 4654464 - DNA, 21 bp, Homo sapiens
aaactttattgggtttttatt

SEQ ID NO: 4654465 - DNA, 13 bp, Homo sapiens
aaagaaaatgcct

SEQ ID NO: 4654466 - DNA, 16 bp, Homo sapiens
aaagaaacaccactta

SEQ ID NO: 4654467 - DNA, 20 bp, Homo sapiens
aaagaaacctggggtgaata

SEQ ID NO: 4654468 - DNA, 19 bp, Homo sapiens
aaagaaattcgcatgttta

SEQ ID NO: 4654469 - DNA, 21 bp, Homo sapiens
aaagaaattcgcatgtttaat

SEQ ID NO: 4654470 - DNA, 15 bp, Homo sapiens
aaagaacatacatga

SEQ ID NO: 4654471 - DNA, 13 bp, Homo sapiens
aaagaagcaagac

SEQ ID NO: 4654472 - DNA, 22 bp, Homo sapiens
aaagaaggtttgtgtttttctg

SEQ ID NO: 4654473 - DNA, 19 bp, Homo sapiens
aatttaacaccctttagaa

SEQ ID NO: 4654474 - DNA, 21 bp, Homo sapiens
aatttaagaaaacaagtatat

SEQ ID NO: 4654475 - DNA, 20 bp, Homo sapiens
aatttatttccactaaaaat

SEQ ID NO: 4654476 - DNA, 21 bp, Homo sapiens
aatttatttccactaaaaata

SEQ ID NO: 4654477 - DNA, 16 bp, Homo sapiens
aatttcaaaatttaaa

SEQ ID NO: 4654478 - DNA, 14 bp, Homo sapiens
aatttcattgcact

SEQ ID NO: 4654479 - DNA, 16 bp, Homo sapiens
aatttcattgcacttt

SEQ ID NO: 4654480 - DNA, 17 bp, Homo sapiens
aatttcattgcactttc

SEQ ID NO: 4654481 - DNA, 23 bp, Homo sapiens
aatttcattgcactttcctttca

SEQ ID NO: 4654482 - DNA, 18 bp, Homo sapiens
aatttcctggtgtgaagg

SEQ ID NO: 4654483 - DNA, 21 bp, Homo sapiens
aatttctataaatttaagaaa

SEQ ID NO: 4654484 - DNA, 21 bp, Homo sapiens
aatttcttctggtagtgtcag

SEQ ID NO: 4654485 - DNA, 12 bp, Homo sapiens
aatttctttgtt

SEQ ID NO: 4654486 - DNA, 22 bp, Homo sapiens
aatttctttttttcctttttaa

SEQ ID NO: 4654487 - DNA, 15 bp, Homo sapiens
aatttgaaaaagttc

SEQ ID NO: 4654488 - DNA, 17 bp, Homo sapiens
aatttgagatacaaaca

SEQ ID NO: 4654489 - DNA, 14 bp, Homo sapiens
aatttggtcatttg

SEQ ID NO: 4654490 - DNA, 16 bp, Homo sapiens
aatttggtcatttggc

SEQ ID NO: 4654491 - DNA, 22 bp, Homo sapiens
aatttggtcttagctttacatt

SEQ ID NO: 4654492 - DNA, 18 bp, Homo sapiens
aatttgtaaacttctgaa

SEQ ID NO: 4654493 - DNA, 22 bp, Homo sapiens
aatttgtaaacttctgaagact

SEQ ID NO: 4654494 - DNA, 16 bp, Homo sapiens
aatttgttttagccat

SEQ ID NO: 4654495 - DNA, 14 bp, Homo sapiens
aattttaatgctgt

SEQ ID NO: 4654496 - DNA, 18 bp, Homo sapiens
aattttaatgctgtttct

SEQ ID NO: 4654497 - DNA, 19 bp, Homo sapiens
aattttaatgctgtttcta

SEQ ID NO: 4654498 - DNA, 20 bp, Homo sapiens
aattttaatgctgtttctaa

SEQ ID NO: 4654499 - DNA, 11 bp, Homo sapiens
aattttatgta

SEQ ID NO: 4654500 - DNA, 11 bp, Homo sapiens
aattttattat

SEQ ID NO: 4654501 - DNA, 13 bp, Homo sapiens
aattttattatta

SEQ ID NO: 4654502 - DNA, 15 bp, Homo sapiens
aattttcaaggcctt

SEQ ID NO: 4654503 - DNA, 17 bp, Homo sapiens
aattttcaaggccttca

SEQ ID NO: 4654504 - DNA, 16 bp, Homo sapiens
aattttcagagacttt

SEQ ID NO: 4654505 - DNA, 13 bp, Homo sapiens
aattttgagaaaa

SEQ ID NO: 4654506 - DNA, 15 bp, Homo sapiens
aattttgagaaaaat

SEQ ID NO: 4654507 - DNA, 19 bp, Homo sapiens
aattttgagaaaaatagag

SEQ ID NO: 4654508 - DNA, 19 bp, Homo sapiens
aattttgcatactgaaaat

SEQ ID NO: 4654509 - DNA, 23 bp, Homo sapiens
aatttttgtacttttagtagaga

SEQ ID NO: 4654510 - DNA, 15 bp, Homo sapiens
aattttttttcatgt

SEQ ID NO: 4654511 - DNA, 23 bp, Homo sapiens
aattttttttcatgttttaacaa

SEQ ID NO: 4654512 - DNA, 19 bp, Homo sapiens
aatttttttttaaatttta

SEQ ID NO: 4654513 - DNA, 17 bp, Homo sapiens
acaaaacccatgcattt

SEQ ID NO: 4654514 - DNA, 11 bp, Homo sapiens
acaaaacttct

SEQ ID NO: 4654515 - DNA, 12 bp, Homo sapiens
acaaaacttgaa

SEQ ID NO: 4654516 - DNA, 20 bp, Homo sapiens
acaaaagttctgcgtaatga

SEQ ID NO: 4654517 - DNA, 13 bp, Homo sapiens
acaaaatttgact

SEQ ID NO: 4654518 - DNA, 20 bp, Homo sapiens
acaaaatttgactaatttta

SEQ ID NO: 4654519 - DNA, 21 bp, Homo sapiens
acaaacaagtggatgttttta

SEQ ID NO: 4654520 - DNA, 17 bp, Homo sapiens
acaaagccaaacaaaac

SEQ ID NO: 4654521 - DNA, 20 bp, Homo sapiens
acaaagccaaacaaaactga

SEQ ID NO: 4654522 - DNA, 16 bp, Homo sapiens
acaaagtactctttaa

SEQ ID NO: 4654523 - DNA, 18 bp, Homo sapiens
acaaagtactctttaaca

SEQ ID NO: 4654524 - DNA, 19 bp, Homo sapiens
acaaataagtaatatcttt

SEQ ID NO: 4654525 - DNA, 14 bp, Homo sapiens
acaaatacatgtgt

SEQ ID NO: 4654526 - DNA, 15 bp, Homo sapiens
acaaatgaagaaagt

SEQ ID NO: 4654527 - DNA, 20 bp, Homo sapiens
acaaatgccttaaaatggaa

SEQ ID NO: 4654528 - DNA, 22 bp, Homo sapiens
acaaattcaagagctagaaaaa

SEQ ID NO: 4654529 - DNA, 20 bp, Homo sapiens
acaaattgactcttatttat

SEQ ID NO: 4654530 - DNA, 17 bp, Homo sapiens
acaaattgtcgttttta

SEQ ID NO: 4654531 - DNA, 18 bp, Homo sapiens
acaacagcaaaccctgat

SEQ ID NO: 4654532 - DNA, 15 bp, Homo sapiens
acaacagcacacagg

SEQ ID NO: 4654533 - DNA, 16 bp, Homo sapiens
acaacaggtaaaacag

SEQ ID NO: 4654534 - DNA, 15 bp, Homo sapiens
acaacagtcacctca

SEQ ID NO: 4654535 - DNA, 18 bp, Homo sapiens
acaacatcaccagtgcca

SEQ ID NO: 4654536 - DNA, 22 bp, Homo sapiens
acaacatcaccagtgccacgtc

SEQ ID NO: 4654537 - DNA, 17 bp, Homo sapiens
acaactggagttttttt

SEQ ID NO: 4654538 - DNA, 13 bp, Homo sapiens
acaacttagtgta

SEQ ID NO: 4654539 - DNA, 15 bp, Homo sapiens
acaagaaggaacaat

SEQ ID NO: 4654540 - DNA, 16 bp, Homo sapiens
acaagacagaggggag

SEQ ID NO: 4654541 - DNA, 14 bp, Homo sapiens
acaagatttcctta

SEQ ID NO: 4654542 - DNA, 17 bp, Homo sapiens
acaagccaaaatgggag

SEQ ID NO: 4654543 - DNA, 14 bp, Homo sapiens
acaagctgcactgt

SEQ ID NO: 4654544 - DNA, 17 bp, Homo sapiens
acaagctgcactgtgaa

SEQ ID NO: 4654545 - DNA, 19 bp, Homo sapiens
acaagctgcactgtgaacc

SEQ ID NO: 4654546 - DNA, 13 bp, Homo sapiens
acaagctgtccct

SEQ ID NO: 4654547 - DNA, 16 bp, Homo sapiens
acaagctgtccctgca

SEQ ID NO: 4654548 - DNA, 13 bp, Homo sapiens
acaagctgtgcag

SEQ ID NO: 4654549 - DNA, 22 bp, Homo sapiens
acaaggcagcaaggcccgagca

SEQ ID NO: 4654550 - DNA, 18 bp, Homo sapiens
acaaggccatctgggctc

SEQ ID NO: 4654551 - DNA, 21 bp, Homo sapiens
acaagggctctcaaagtataa

SEQ ID NO: 4654552 - DNA, 22 bp, Homo sapiens
acaaggtaggctgcaaaattaa

SEQ ID NO: 4654553 - DNA, 23 bp, Homo sapiens
acaaggtcctctgtcagtcacag

SEQ ID NO: 4654554 - DNA, 13 bp, Homo sapiens
acaagtatataat

SEQ ID NO: 4654555 - DNA, 19 bp, Homo sapiens
acaagtcaattctgtgtgg

SEQ ID NO: 4654556 - DNA, 15 bp, Homo sapiens
acaagtggactcagg

SEQ ID NO: 4654557 - DNA, 14 bp, Homo sapiens
acaagttttaaata

SEQ ID NO: 4654558 - DNA, 13 bp, Homo sapiens
acaataacccagt

SEQ ID NO: 4654559 - DNA, 17 bp, Homo sapiens
acaataacccagttact

SEQ ID NO: 4654560 - DNA, 18 bp, Homo sapiens
acaataacccagttactt

SEQ ID NO: 4654561 - DNA, 14 bp, Homo sapiens
acaataacttttat

SEQ ID NO: 4654562 - DNA, 13 bp, Homo sapiens
acaatattcctat

SEQ ID NO: 4654563 - DNA, 17 bp, Homo sapiens
acaatcactaaacttta

SEQ ID NO: 4654564 - DNA, 19 bp, Homo sapiens
acaatcactaaactttatt

SEQ ID NO: 4654565 - DNA, 22 bp, Homo sapiens
acaatcctagtgctttcctttt

SEQ ID NO: 4654566 - DNA, 21 bp, Homo sapiens
acaatctatggcttatttcta

SEQ ID NO: 4654567 - DNA, 22 bp, Homo sapiens
acaatgatgtataattaatgct

SEQ ID NO: 4654568 - DNA, 20 bp, Homo sapiens
acaatgatttggccaggcct

SEQ ID NO: 4654569 - DNA, 20 bp, Homo sapiens
acaatgtgaataatggcact

SEQ ID NO: 4654570 - DNA, 22 bp, Homo sapiens
acaatgtgaataatggcactga

SEQ ID NO: 4654571 - DNA, 13 bp, Homo sapiens
acaattgggagct

SEQ ID NO: 4654572 - DNA, 23 bp, Homo sapiens
acaattggtaaaactcactgtga

SEQ ID NO: 4654573 - DNA, 15 bp, Homo sapiens
acacaaagcacattg

SEQ ID NO: 4654574 - DNA, 14 bp, Homo sapiens
acacaattgtttta

SEQ ID NO: 4654575 - DNA, 19 bp, Homo sapiens
acacacggttttggcagct

SEQ ID NO: 4654576 - DNA, 21 bp, Homo sapiens
acacacggttttggcagctga

SEQ ID NO: 4654577 - DNA, 21 bp, Homo sapiens
acacagccaaggggatattta

SEQ ID NO: 4654578 - DNA, 23 bp, Homo sapiens
acacagcctaaagctaaaaatat

SEQ ID NO: 4654579 - DNA, 15 bp, Homo sapiens
acacaggcagccagc

SEQ ID NO: 4654580 - DNA, 16 bp, Homo sapiens
acacaggcatttcctg

SEQ ID NO: 4654581 - DNA, 18 bp, Homo sapiens
acacaggcatttcctggg

SEQ ID NO: 4654582 - DNA, 16 bp, Homo sapiens
acacaggcctgtgtag

SEQ ID NO: 4654583 - DNA, 19 bp, Homo sapiens
acaggactaacactcagaa

SEQ ID NO: 4654584 - DNA, 24 bp, Homo sapiens
acaggactaacactcagaagcctg

SEQ ID NO: 4654585 - DNA, 14 bp, Homo sapiens
acaggagaggcagc

SEQ ID NO: 4654586 - DNA, 15 bp, Homo sapiens
acaggagaggcagca

SEQ ID NO: 4654587 - DNA, 17 bp, Homo sapiens
acaggagaggcagcatg

SEQ ID NO: 4654588 - DNA, 18 bp, Homo sapiens
acaggagaggcagcatgc

SEQ ID NO: 4654589 - DNA, 22 bp, Homo sapiens
acaggagaggcagcatgcttgg

SEQ ID NO: 4654590 - DNA, 20 bp, Homo sapiens
acaggagggggtcgtggaga

SEQ ID NO: 4654591 - DNA, 23 bp, Homo sapiens
acaggagggggtcgtggagagct

SEQ ID NO: 4654592 - DNA, 16 bp, Homo sapiens
acaggaggtgtgaatg

SEQ ID NO: 4654593 - DNA, 17 bp, Homo sapiens
acaggaggtgtgaatgc

SEQ ID NO: 4654594 - DNA, 21 bp, Homo sapiens
acaggcactccaaacctgtct

SEQ ID NO: 4654595 - DNA, 16 bp, Homo sapiens
acaggccgccctgcgg

SEQ ID NO: 4654596 - DNA, 23 bp, Homo sapiens
acaggcctgtgtagctgtgacct

SEQ ID NO: 4654597 - DNA, 13 bp, Homo sapiens
acaggcgcctgcc

SEQ ID NO: 4654598 - DNA, 19 bp, Homo sapiens
acaggctgaagagagggac

SEQ ID NO: 4654599 - DNA, 21 bp, Homo sapiens
acaggctgaagagagggacag

SEQ ID NO: 4654600 - DNA, 23 bp, Homo sapiens
acagggaagaaactttctggtgc

SEQ ID NO: 4654601 - DNA, 13 bp, Homo sapiens
acagggaaggcag

SEQ ID NO: 4654602 - DNA, 19 bp, Homo sapiens
acagggactacgtattttt

SEQ ID NO: 4654603 - DNA, 16 bp, Homo sapiens
acagggcacaggccat

SEQ ID NO: 4654604 - DNA, 15 bp, Homo sapiens
acagggccacataga

SEQ ID NO: 4654605 - DNA, 16 bp, Homo sapiens
acagggctgccttctg

SEQ ID NO: 4654606 - DNA, 14 bp, Homo sapiens
acaggggccagaag

SEQ ID NO: 4654607 - DNA, 14 bp, Homo sapiens
acaggtaaaacagg

SEQ ID NO: 4654608 - DNA, 15 bp, Homo sapiens
acaggtaaaacaggg

SEQ ID NO: 4654609 - DNA, 22 bp, Homo sapiens
acaggtaaaacagggccacata

SEQ ID NO: 4654610 - DNA, 12 bp, Homo sapiens
acaggtattttg

SEQ ID NO: 4654611 - DNA, 18 bp, Homo sapiens
acaggtattttgtttctt

SEQ ID NO: 4654612 - DNA, 21 bp, Homo sapiens
acaggtattttgtttctttta

SEQ ID NO: 4654613 - DNA, 18 bp, Homo sapiens
acaggtcaccattatgct

SEQ ID NO: 4654614 - DNA, 19 bp, Homo sapiens
acaggttcttaaaaaggaa

SEQ ID NO: 4654615 - DNA, 12 bp, Homo sapiens
acagtaatgaaa

SEQ ID NO: 4654616 - DNA, 15 bp, Homo sapiens
acagtacagcatgtg

SEQ ID NO: 4654617 - DNA, 13 bp, Homo sapiens
acagtagaactgt

SEQ ID NO: 4654618 - DNA, 15 bp, Homo sapiens
acagtcactaatata

SEQ ID NO: 4654619 - DNA, 17 bp, Homo sapiens
acagtcatcatcagggc

SEQ ID NO: 4654620 - DNA, 22 bp, Homo sapiens
acagtcctttcccaccattcct

SEQ ID NO: 4654621 - DNA, 14 bp, Homo sapiens
acagtctagtttcc

SEQ ID NO: 4654622 - DNA, 22 bp, Homo sapiens
acagtcttgtattaagttgtta

SEQ ID NO: 4654623 - DNA, 17 bp, Homo sapiens
acagtgaggcaggagaa

SEQ ID NO: 4654624 - DNA, 21 bp, Homo sapiens
acagtgccatccccaccttca

SEQ ID NO: 4654625 - DNA, 15 bp, Homo sapiens
acagtggttgcctgg

SEQ ID NO: 4654626 - DNA, 17 bp, Homo sapiens
acagtgtacagtcttgt

SEQ ID NO: 4654627 - DNA, 18 bp, Homo sapiens
acagtgtacagtcttgta

SEQ ID NO: 4654628 - DNA, 13 bp, Homo sapiens
acagttcagagat

SEQ ID NO: 4654629 - DNA, 13 bp, Homo sapiens
acagttgctgtga

SEQ ID NO: 4654630 - DNA, 21 bp, Homo sapiens
acagtttttatttagcatggg

SEQ ID NO: 4654631 - DNA, 21 bp, Homo sapiens
acataaagccttttgctttat

SEQ ID NO: 4654632 - DNA, 16 bp, Homo sapiens
acataaatcacagaaa

SEQ ID NO: 4654633 - DNA, 20 bp, Homo sapiens
acataactcacacccctgcc

SEQ ID NO: 4654634 - DNA, 21 bp, Homo sapiens
acataactcacacccctgccc

SEQ ID NO: 4654635 - DNA, 15 bp, Homo sapiens
acataagtcctttca

SEQ ID NO: 4654636 - DNA, 18 bp, Homo sapiens
acatacaagaaaatgtat

SEQ ID NO: 4654637 - DNA, 17 bp, Homo sapiens
acatacatgctactttt

SEQ ID NO: 4654638 - DNA, 15 bp, Homo sapiens
acatacggttctgtt

SEQ ID NO: 4654639 - DNA, 14 bp, Homo sapiens
acatactgtaatca

SEQ ID NO: 4654640 - DNA, 21 bp, Homo sapiens
acatataaatagatgatttca

SEQ ID NO: 4654641 - DNA, 16 bp, Homo sapiens
acatatattatttatt

SEQ ID NO: 4654642 - DNA, 22 bp, Homo sapiens
acatatatttttaaaaaatgaa

SEQ ID NO: 4654643 - DNA, 13 bp, Homo sapiens
acatatgaacaca

SEQ ID NO: 4654644 - DNA, 17 bp, Homo sapiens
acatatgcaccttgtgt

SEQ ID NO: 4654645 - DNA, 18 bp, Homo sapiens
acatatgcaccttgtgtc

SEQ ID NO: 4654646 - DNA, 23 bp, Homo sapiens
acatatgctgatcttttaaaatc

SEQ ID NO: 4654647 - DNA, 16 bp, Homo sapiens
acatatgtaaacataa

SEQ ID NO: 4654648 - DNA, 19 bp, Homo sapiens
acatatgtcttactacttt

SEQ ID NO: 4654649 - DNA, 20 bp, Homo sapiens
acatatgtcttactacttta

SEQ ID NO: 4654650 - DNA, 13 bp, Homo sapiens
acatatttcattt

SEQ ID NO: 4654651 - DNA, 12 bp, Homo sapiens
acatcaaagagg

SEQ ID NO: 4654652 - DNA, 18 bp, Homo sapiens
acatcaacccgagtcatt

SEQ ID NO: 4654653 - DNA, 23 bp, Homo sapiens
acatcagtatagtgttttattat

SEQ ID NO: 4654654 - DNA, 16 bp, Homo sapiens
acatcattgtcagcct

SEQ ID NO: 4654655 - DNA, 18 bp, Homo sapiens
acatcattgtcagccttg

SEQ ID NO: 4654656 - DNA, 18 bp, Homo sapiens
acatccaaagcagacagc

SEQ ID NO: 4654657 - DNA, 19 bp, Homo sapiens
acatccaggcaatggccta

SEQ ID NO: 4654658 - DNA, 17 bp, Homo sapiens
acatccataaagaagca

SEQ ID NO: 4654659 - DNA, 18 bp, Homo sapiens
acatcccccaatgacctt

SEQ ID NO: 4654660 - DNA, 13 bp, Homo sapiens
acatccctgggcc

SEQ ID NO: 4654661 - DNA, 17 bp, Homo sapiens
acatccctgggcctgct

SEQ ID NO: 4654662 - DNA, 21 bp, Homo sapiens
acatccctgggcctgctgctg

SEQ ID NO: 4654663 - DNA, 20 bp, Homo sapiens
acatcccttattagttacaa

SEQ ID NO: 4654664 - DNA, 19 bp, Homo sapiens
acatctagcccaaaggtaa

SEQ ID NO: 4654665 - DNA, 13 bp, Homo sapiens
acatctctggaaa

SEQ ID NO: 4654666 - DNA, 11 bp, Homo sapiens
acatcttaaat

SEQ ID NO: 4654667 - DNA, 11 bp, Homo sapiens
acatcttcata

SEQ ID NO: 4654668 - DNA, 11 bp, Homo sapiens
acatgaaagcg

SEQ ID NO: 4654669 - DNA, 19 bp, Homo sapiens
acatgaagctgttgtgtga

SEQ ID NO: 4654670 - DNA, 15 bp, Homo sapiens
acatgacatccagag

SEQ ID NO: 4654671 - DNA, 22 bp, Homo sapiens
acatgacgccagataaaatgtt

SEQ ID NO: 4654672 - DNA, 22 bp, Homo sapiens
acatgagatcagggcctgcccc

SEQ ID NO: 4654673 - DNA, 19 bp, Homo sapiens
acatgaggccatctcagga

SEQ ID NO: 4654674 - DNA, 21 bp, Homo sapiens
acatgaggccatctcaggaga

SEQ ID NO: 4654675 - DNA, 15 bp, Homo sapiens
acatgagttcaaata

SEQ ID NO: 4654676 - DNA, 18 bp, Homo sapiens
acatgagttcaaatactt

SEQ ID NO: 4654677 - DNA, 16 bp, Homo sapiens
acatgcaacagaagtg

SEQ ID NO: 4654678 - DNA, 16 bp, Homo sapiens
acatgcatactttatt

SEQ ID NO: 4654679 - DNA, 17 bp, Homo sapiens
acatgcggtagccagca

SEQ ID NO: 4654680 - DNA, 20 bp, Homo sapiens
acatgcggtagccagcacac

SEQ ID NO: 4654681 - DNA, 23 bp, Homo sapiens
acatgcggtagccagcacacagg

SEQ ID NO: 4654682 - DNA, 23 bp, Homo sapiens
acatgctatgttctgtcttccca

SEQ ID NO: 4654683 - DNA, 15 bp, Homo sapiens
acatgtagcttcttc

SEQ ID NO: 4654684 - DNA, 14 bp, Homo sapiens
acatgtcttgtaca

SEQ ID NO: 4654685 - DNA, 12 bp, Homo sapiens
acatgtgacaca

SEQ ID NO: 4654686 - DNA, 15 bp, Homo sapiens
acatgtgtgcagagc

SEQ ID NO: 4654687 - DNA, 17 bp, Homo sapiens
acatgtgtgcagagcag

SEQ ID NO: 4654688 - DNA, 18 bp, Homo sapiens
acatgtgtgcagagcaga

SEQ ID NO: 4654689 - DNA, 21 bp, Homo sapiens
acatgtgtgcagagcagacag

SEQ ID NO: 4654690 - DNA, 12 bp, Homo sapiens
acattaaaatga

SEQ ID NO: 4654691 - DNA, 14 bp, Homo sapiens
acattaaaatgaca

SEQ ID NO: 4654692 - DNA, 16 bp, Homo sapiens
acattaaaatgacaaa

SEQ ID NO: 4654693 - DNA, 20 bp, Homo sapiens
accccagctgctctaagccc

SEQ ID NO: 4654694 - DNA, 23 bp, Homo sapiens
accccagctgctctaagcccagg

SEQ ID NO: 4654695 - DNA, 20 bp, Homo sapiens
accccaggctgaagcaggtt

SEQ ID NO: 4654696 - DNA, 12 bp, Homo sapiens
accccagggcac

SEQ ID NO: 4654697 - DNA, 15 bp, Homo sapiens
accccagtgcctgca

SEQ ID NO: 4654698 - DNA, 20 bp, Homo sapiens
accccagtgcctgcacatca

SEQ ID NO: 4654699 - DNA, 12 bp, Homo sapiens
accccatatatt

SEQ ID NO: 4654700 - DNA, 16 bp, Homo sapiens
accccattttctgtgg

SEQ ID NO: 4654701 - DNA, 13 bp, Homo sapiens
acccccaccaagg

SEQ ID NO: 4654702 - DNA, 22 bp, Homo sapiens
acccccagccctggcccctcca

SEQ ID NO: 4654703 - DNA, 21 bp, Homo sapiens
acccccagtcctccctagctc

SEQ ID NO: 4654704 - DNA, 17 bp, Homo sapiens
accccctccctgtccca

SEQ ID NO: 4654705 - DNA, 14 bp, Homo sapiens
accccctctagaaa

SEQ ID NO: 4654706 - DNA, 12 bp, Homo sapiens
accccctgcagc

SEQ ID NO: 4654707 - DNA, 13 bp, Homo sapiens
accccctgcagct

SEQ ID NO: 4654708 - DNA, 17 bp, Homo sapiens
accccctgcctggttct

SEQ ID NO: 4654709 - DNA, 20 bp, Homo sapiens
accccggggtgcccacaggc

SEQ ID NO: 4654710 - DNA, 15 bp, Homo sapiens
acccctcccctggga

SEQ ID NO: 4654711 - DNA, 16 bp, Homo sapiens
acccctcccctgggac

SEQ ID NO: 4654712 - DNA, 12 bp, Homo sapiens
acccctggccac

SEQ ID NO: 4654713 - DNA, 18 bp, Homo sapiens
accccttaagccctggcc

SEQ ID NO: 4654714 - DNA, 17 bp, Homo sapiens
accccttaatcttgctt

SEQ ID NO: 4654715 - DNA, 22 bp, Homo sapiens
accccttccctataggaacagc

SEQ ID NO: 4654716 - DNA, 21 bp, Homo sapiens
acccgagtcattcgttctgtg

SEQ ID NO: 4654717 - DNA, 19 bp, Homo sapiens
acccggcaccccctgcagc

SEQ ID NO: 4654718 - DNA, 22 bp, Homo sapiens
acccggcaccccctgcagcttg

SEQ ID NO: 4654719 - DNA, 21 bp, Homo sapiens
acccgtgccaagtccaggtcc

SEQ ID NO: 4654720 - DNA, 13 bp, Homo sapiens
acccgtggaggct

SEQ ID NO: 4654721 - DNA, 16 bp, Homo sapiens
accctatgggtctagg

SEQ ID NO: 4654722 - DNA, 23 bp, Homo sapiens
accctatgggtctaggacacagt

SEQ ID NO: 4654723 - DNA, 15 bp, Homo sapiens
accctccaccttcca

SEQ ID NO: 4654724 - DNA, 15 bp, Homo sapiens
accctcccagacctg

SEQ ID NO: 4654725 - DNA, 19 bp, Homo sapiens
accctcgggccccatcctc

SEQ ID NO: 4654726 - DNA, 22 bp, Homo sapiens
accctctcttgattaagggcta

SEQ ID NO: 4654727 - DNA, 14 bp, Homo sapiens
accctgaggtcagg

SEQ ID NO: 4654728 - DNA, 23 bp, Homo sapiens
accctgatgcaggtcagcccatg

SEQ ID NO: 4654729 - DNA, 21 bp, Homo sapiens
accctgcccttgtttggggca

SEQ ID NO: 4654730 - DNA, 10 bp, Homo sapiens
accctgcctc

SEQ ID NO: 4654731 - DNA, 18 bp, Homo sapiens
accctggccgagtccaag

SEQ ID NO: 4654732 - DNA, 11 bp, Homo sapiens
accctggcctg

SEQ ID NO: 4654733 - DNA, 20 bp, Homo sapiens
accctggcctgaactgagga

SEQ ID NO: 4654734 - DNA, 17 bp, Homo sapiens
acccttgcccaccccac

SEQ ID NO: 4654735 - DNA, 19 bp, Homo sapiens
acccttgctttcctgggcc

SEQ ID NO: 4654736 - DNA, 20 bp, Homo sapiens
acccttgctttcctgggcct

SEQ ID NO: 4654737 - DNA, 22 bp, Homo sapiens
acccttgggcagagtcctgcct

SEQ ID NO: 4654738 - DNA, 14 bp, Homo sapiens
acccttttaagcat

SEQ ID NO: 4654739 - DNA, 20 bp, Homo sapiens
accctttttggactagccag

SEQ ID NO: 4654740 - DNA, 15 bp, Homo sapiens
accgactcacctgcg

SEQ ID NO: 4654741 - DNA, 16 bp, Homo sapiens
accgccacgtcccagc

SEQ ID NO: 4654742 - DNA, 17 bp, Homo sapiens
accgccacgtcccagca

SEQ ID NO: 4654743 - DNA, 23 bp, Homo sapiens
accgcccagcggcttgcctgcct

SEQ ID NO: 4654744 - DNA, 17 bp, Homo sapiens
accgcgtctaccctggg

SEQ ID NO: 4654745 - DNA, 14 bp, Homo sapiens
accgctacaccact

SEQ ID NO: 4654746 - DNA, 19 bp, Homo sapiens
accgctggccctgccgttt

SEQ ID NO: 4654747 - DNA, 22 bp, Homo sapiens
accggaaggaggccaaccagcc

SEQ ID NO: 4654748 - DNA, 13 bp, Homo sapiens
accggcagagctc

SEQ ID NO: 4654749 - DNA, 19 bp, Homo sapiens
accgggccactccttcctg

SEQ ID NO: 4654750 - DNA, 15 bp, Homo sapiens
accggtgctgcagga

SEQ ID NO: 4654751 - DNA, 14 bp, Homo sapiens
accggtggggctgg

SEQ ID NO: 4654752 - DNA, 15 bp, Homo sapiens
accgtcgacaagaat

SEQ ID NO: 4654753 - DNA, 17 bp, Homo sapiens
accgtcgacaagaatgt

SEQ ID NO: 4654754 - DNA, 18 bp, Homo sapiens
accgtggcccttcctgga

SEQ ID NO: 4654755 - DNA, 18 bp, Homo sapiens
accgtgggcagggagcgg

SEQ ID NO: 4654756 - DNA, 14 bp, Homo sapiens
accgttctgtgcac

SEQ ID NO: 4654757 - DNA, 17 bp, Homo sapiens
acctaaagcaagcctga

SEQ ID NO: 4654758 - DNA, 15 bp, Homo sapiens
acctacagtgtacag

SEQ ID NO: 4654759 - DNA, 18 bp, Homo sapiens
acctacagtgtacagtct

SEQ ID NO: 4654760 - DNA, 16 bp, Homo sapiens
acctactcacacaggc

SEQ ID NO: 4654761 - DNA, 14 bp, Homo sapiens
acctagcagcctca

SEQ ID NO: 4654762 - DNA, 14 bp, Homo sapiens
acctcaagccccat

SEQ ID NO: 4654763 - DNA, 14 bp, Homo sapiens
acctcacaactcct

SEQ ID NO: 4654764 - DNA, 20 bp, Homo sapiens
agggtttttagagaatgtgt

SEQ ID NO: 4654765 - DNA, 14 bp, Homo sapiens
aggtacaggagagg

SEQ ID NO: 4654766 - DNA, 16 bp, Homo sapiens
aggacacagttcctgg

SEQ ID NO: 4654767 - DNA, 13 bp, Homo sapiens
aggacagctgtcc

SEQ ID NO: 4654768 - DNA, 20 bp, Homo sapiens
aggacagttcagagatcagg

SEQ ID NO: 4654769 - DNA, 14 bp, Homo sapiens
aggacatgagatca

SEQ ID NO: 4654770 - DNA, 19 bp, Homo sapiens
aggacatgagatcagggcc

SEQ ID NO: 4654771 - DNA, 16 bp, Homo sapiens
aggaccacctcctctg

SEQ ID NO: 4654772 - DNA, 22 bp, Homo sapiens
aggaccacctcctctgccagca

SEQ ID NO: 4654773 - DNA, 13 bp, Homo sapiens
agcctcacttcct

SEQ ID NO: 4654774 - DNA, 16 bp, Homo sapiens
agcctcacttcctttg

SEQ ID NO: 4654775 - DNA, 21 bp, Homo sapiens
agcctcacttcctttgccctt

SEQ ID NO: 4654776 - DNA, 22 bp, Homo sapiens
agcctcacttcctttgcccttc

SEQ ID NO: 4654777 - DNA, 14 bp, Homo sapiens
agcctccctgcctc

SEQ ID NO: 4654778 - DNA, 23 bp, Homo sapiens
agcctccctgcctcaggcctctg

SEQ ID NO: 4654779 - DNA, 19 bp, Homo sapiens
agcctcgcaacccgtgcca

SEQ ID NO: 4654780 - DNA, 13 bp, Homo sapiens
agcctcgctctgt

SEQ ID NO: 4654781 - DNA, 20 bp, Homo sapiens
agcctcgctttttcatcctt

SEQ ID NO: 4654782 - DNA, 22 bp, Homo sapiens
agcctcgctttttcatccttct

SEQ ID NO: 4654783 - DNA, 21 bp, Homo sapiens
agcctctgacttaagctgcct

SEQ ID NO: 4654784 - DNA, 17 bp, Homo sapiens
agcctcttatgggggtg

SEQ ID NO: 4654785 - DNA, 14 bp, Homo sapiens
agcctcttattcca

SEQ ID NO: 4654786 - DNA, 18 bp, Homo sapiens
agacctaatatcatttta

SEQ ID NO: 4654787 - DNA, 19 bp, Homo sapiens
agacctaatatcattttat

SEQ ID NO: 4654788 - DNA, 22 bp, Homo sapiens
agacctaatatcattttattca

SEQ ID NO: 4654789 - DNA, 19 bp, Homo sapiens
agacctctggttaatttat

SEQ ID NO: 4654790 - DNA, 17 bp, Homo sapiens
agacctgcatggtcaag

SEQ ID NO: 4654791 - DNA, 20 bp, Homo sapiens
agacctgcatggtcaagcct

SEQ ID NO: 4654792 - DNA, 12 bp, Homo sapiens
agacctgccagc

SEQ ID NO: 4654793 - DNA, 15 bp, Homo sapiens
agacctgtcaccctg

SEQ ID NO: 4654794 - DNA, 14 bp, Homo sapiens
agacctgtctcctg

SEQ ID NO: 4654795 - DNA, 16 bp, Homo sapiens
agacctgtctcctggc

SEQ ID NO: 4654796 - DNA, 16 bp, Homo sapiens
agacgagacaacagca

SEQ ID NO: 4654797 - DNA, 21 bp, Homo sapiens
agacgagacaacagcacacag

SEQ ID NO: 4654798 - DNA, 17 bp, Homo sapiens
agacgtggtctagacca

SEQ ID NO: 4654799 - DNA, 19 bp, Homo sapiens
agacgtggtctagaccagg

SEQ ID NO: 4654800 - DNA, 13 bp, Homo sapiens
agactcagttttt

SEQ ID NO: 4654801 - DNA, 16 bp, Homo sapiens
agactcagttttttgt

SEQ ID NO: 4654802 - DNA, 16 bp, Homo sapiens
agactcgcctatctta

SEQ ID NO: 4654803 - DNA, 17 bp, Homo sapiens
agactctaggttataca

SEQ ID NO: 4654804 - DNA, 20 bp, Homo sapiens
agactctttaataaattgct

SEQ ID NO: 4654805 - DNA, 20 bp, Homo sapiens
agactgaccttgatgagctg

SEQ ID NO: 4654806 - DNA, 18 bp, Homo sapiens
agactgccctgcccaggt

SEQ ID NO: 4654807 - DNA, 20 bp, Homo sapiens
agactgtcaggcaagcccgg

SEQ ID NO: 4654808 - DNA, 20 bp, Homo sapiens
agactgtgaacagcttgctg

SEQ ID NO: 4654809 - DNA, 21 bp, Homo sapiens
agactgtgaacttgactgggt

SEQ ID NO: 4654810 - DNA, 19 bp, Homo sapiens
agactgttgtccctgcact

SEQ ID NO: 4654811 - DNA, 14 bp, Homo sapiens
agactgtttcacat

SEQ ID NO: 4654812 - DNA, 22 bp, Homo sapiens
agacttaaaaaatacttgcatg

SEQ ID NO: 4654813 - DNA, 17 bp, Homo sapiens
agactttacaaaccttt

SEQ ID NO: 4654814 - DNA, 22 bp, Homo sapiens
agactttggaaaatgcattgta

SEQ ID NO: 4654815 - DNA, 23 bp, Homo sapiens
agactttggaaaatgcattgtat

SEQ ID NO: 4654816 - DNA, 19 bp, Homo sapiens
agagaaactacccaggtat

SEQ ID NO: 4654817 - DNA, 20 bp, Homo sapiens
agagaaagagagaagccagc

SEQ ID NO: 4654818 - DNA, 23 bp, Homo sapiens
agagaagtttgtagccaggtact

SEQ ID NO: 4654819 - DNA, 19 bp, Homo sapiens
agagaatgagagcgacaca

SEQ ID NO: 4654820 - DNA, 20 bp, Homo sapiens
agagaatgagagcgacacag

SEQ ID NO: 4654821 - DNA, 14 bp, Homo sapiens
agagaattggctca

SEQ ID NO: 4654822 - DNA, 17 bp, Homo sapiens
agagacacatacagagt

SEQ ID NO: 4654823 - DNA, 23 bp, Homo sapiens
agagacacatacagagtgggccc

SEQ ID NO: 4654824 - DNA, 19 bp, Homo sapiens
agagacactcccccctcca

SEQ ID NO: 4654825 - DNA, 18 bp, Homo sapiens
agagacagcccaggatac

SEQ ID NO: 4654826 - DNA, 20 bp, Homo sapiens
agagaccacacattttatga

SEQ ID NO: 4654827 - DNA, 14 bp, Homo sapiens
agagaccccagtca

SEQ ID NO: 4654828 - DNA, 17 bp, Homo sapiens
agagacttttttctagt

SEQ ID NO: 4654829 - DNA, 22 bp, Homo sapiens
agagagaaagaagatagtgaga

SEQ ID NO: 4654830 - DNA, 14 bp, Homo sapiens
agagagaagccagc

SEQ ID NO: 4654831 - DNA, 17 bp, Homo sapiens
agagagaagccagccac

SEQ ID NO: 4654832 - DNA, 23 bp, Homo sapiens
agagagaatgagagcgacacaga

SEQ ID NO: 4654833 - DNA, 14 bp, Homo sapiens
agagagaccccagt

SEQ ID NO: 4654834 - DNA, 21 bp, Homo sapiens
agagagaccccgcacccggct

SEQ ID NO: 4654835 - DNA, 15 bp, Homo sapiens
agagagagtgtgtgt

SEQ ID NO: 4654836 - DNA, 16 bp, Homo sapiens
agagagccaggatgcc

SEQ ID NO: 4654837 - DNA, 17 bp, Homo sapiens
agagaggcttgaaggcc

SEQ ID NO: 4654838 - DNA, 15 bp, Homo sapiens
agagagggagaagaa

SEQ ID NO: 4654839 - DNA, 19 bp, Homo sapiens
agagagggagaagaagtca

SEQ ID NO: 4654840 - DNA, 16 bp, Homo sapiens
agagatattgatattg

SEQ ID NO: 4654841 - DNA, 20 bp, Homo sapiens
agagatcgacagacagccag

SEQ ID NO: 4654842 - DNA, 12 bp, Homo sapiens
agagatgagccc

SEQ ID NO: 4654843 - DNA, 13 bp, Homo sapiens
agagatgagccca

SEQ ID NO: 4654844 - DNA, 22 bp, Homo sapiens
agagattttcattttagtgtat

SEQ ID NO: 4654845 - DNA, 20 bp, Homo sapiens
agagcagctccaccactgtg

SEQ ID NO: 4654846 - DNA, 19 bp, Homo sapiens
agagcagtctaaacagagt

SEQ ID NO: 4654847 - DNA, 16 bp, Homo sapiens
agagcatcatgcctct

SEQ ID NO: 4654848 - DNA, 20 bp, Homo sapiens
agagcatcatgcctctgagg

SEQ ID NO: 4654849 - DNA, 22 bp, Homo sapiens
agagcatcatgcctctgaggcc

SEQ ID NO: 4654850 - DNA, 12 bp, Homo sapiens
agagcatgaaat

SEQ ID NO: 4654851 - DNA, 14 bp, Homo sapiens
agagccacctgcaa

SEQ ID NO: 4654852 - DNA, 18 bp, Homo sapiens
agagccacctgcaagatg

SEQ ID NO: 4654853 - DNA, 19 bp, Homo sapiens
agagccacctgcaagatgg

SEQ ID NO: 4654854 - DNA, 15 bp, Homo sapiens
agagccaggatgccc

SEQ ID NO: 4654855 - DNA, 21 bp, Homo sapiens
agagccaggatgcccagatga

SEQ ID NO: 4654856 - DNA, 22 bp, Homo sapiens
agagccaggatgcccagatgaa

SEQ ID NO: 4654857 - DNA, 22 bp, Homo sapiens
agagcccccagccctgggaacc

SEQ ID NO: 4654858 - DNA, 14 bp, Homo sapiens
agagccctgaggcc

SEQ ID NO: 4654859 - DNA, 21 bp, Homo sapiens
agagcctcgctttttcatcct

SEQ ID NO: 4654860 - DNA, 23 bp, Homo sapiens
agagcctggggctctaacgcctg

SEQ ID NO: 4654861 - DNA, 14 bp, Homo sapiens
agagcgcacaggga

SEQ ID NO: 4654862 - DNA, 22 bp, Homo sapiens
agagctaagggtgggtgctcag

SEQ ID NO: 4654863 - DNA, 21 bp, Homo sapiens
agagctaggagcaaagcctgt

SEQ ID NO: 4654864 - DNA, 15 bp, Homo sapiens
agagctctacaggcc

SEQ ID NO: 4654865 - DNA, 22 bp, Homo sapiens
agagctctacaggcctgcagcc

SEQ ID NO: 4654866 - DNA, 11 bp, Homo sapiens
agagctgcctg

SEQ ID NO: 4654867 - DNA, 13 bp, Homo sapiens
agagctgcctgga

SEQ ID NO: 4654868 - DNA, 14 bp, Homo sapiens
agagctgcctggat

SEQ ID NO: 4654869 - DNA, 16 bp, Homo sapiens
agagctgcctggatga

SEQ ID NO: 4654870 - DNA, 19 bp, Homo sapiens
agagctgcctggatgagaa

SEQ ID NO: 4654871 - DNA, 22 bp, Homo sapiens
agagcttcctggggaccaagat

SEQ ID NO: 4654872 - DNA, 23 bp, Homo sapiens
agagcttttatttggtgtgttcg

SEQ ID NO: 4654873 - DNA, 24 bp, Homo sapiens
agaggcttccctacacagggcctg

SEQ ID NO: 4654874 - DNA, 18 bp, Homo sapiens
agaggcttgaaggccagc

SEQ ID NO: 4654875 - DNA, 21 bp, Homo sapiens
agagggaacaaaactgttctt

SEQ ID NO: 4654876 - DNA, 15 bp, Homo sapiens
agagggacaggcact

SEQ ID NO: 4654877 - DNA, 17 bp, Homo sapiens
agagggacaggcactcc

SEQ ID NO: 4654878 - DNA, 16 bp, Homo sapiens
agagggagaagaaaga

SEQ ID NO: 4654879 - DNA, 14 bp, Homo sapiens
agagggagaagaag

SEQ ID NO: 4654880 - DNA, 15 bp, Homo sapiens
agagggagaagaagt

SEQ ID NO: 4654881 - DNA, 18 bp, Homo sapiens
agagggccgggcagaggg

SEQ ID NO: 4654882 - DNA, 17 bp, Homo sapiens
agagggggaggggaagc

SEQ ID NO: 4654883 - DNA, 18 bp, Homo sapiens
agagggggaggggaagct

SEQ ID NO: 4654884 - DNA, 14 bp, Homo sapiens
agaggtcagccttg

SEQ ID NO: 4654885 - DNA, 23 bp, Homo sapiens
agaggtctccaaactgattaaat

SEQ ID NO: 4654886 - DNA, 16 bp, Homo sapiens
agaggtgaccccaggg

SEQ ID NO: 4654887 - DNA, 17 bp, Homo sapiens
agaggtgaccccagggc

SEQ ID NO: 4654888 - DNA, 14 bp, Homo sapiens
agagtacttaatat

SEQ ID NO: 4654889 - DNA, 17 bp, Homo sapiens
agagtaggtactccata

SEQ ID NO: 4654890 - DNA, 17 bp, Homo sapiens
agagtctctcttcactt

SEQ ID NO: 4654891 - DNA, 21 bp, Homo sapiens
agagtcttccacttcaatgca

SEQ ID NO: 4654892 - DNA, 14 bp, Homo sapiens
agagtgaagggaag

SEQ ID NO: 4654893 - DNA, 22 bp, Homo sapiens
agagtgaagggaagagacagcc

SEQ ID NO: 4654894 - DNA, 18 bp, Homo sapiens
agagtgaccagcacactg

SEQ ID NO: 4654895 - DNA, 20 bp, Homo sapiens
agagtgagctttagctctct

SEQ ID NO: 4654896 - DNA, 20 bp, Homo sapiens
agagtggagagaagctcttc

SEQ ID NO: 4654897 - DNA, 15 bp, Homo sapiens
agagtggcctccctg

SEQ ID NO: 4654898 - DNA, 16 bp, Homo sapiens
agagtggcctccctgc

SEQ ID NO: 4654899 - DNA, 18 bp, Homo sapiens
agagtggcctccctgctg

SEQ ID NO: 4654900 - DNA, 21 bp, Homo sapiens
agagtggcctccctgctgtgc

SEQ ID NO: 4654901 - DNA, 22 bp, Homo sapiens
agagtggcctccctgctgtgcc

SEQ ID NO: 4654902 - DNA, 17 bp, Homo sapiens
agagtgggccccgggct

SEQ ID NO: 4654903 - DNA, 13 bp, Homo sapiens
agagtgtagccta

SEQ ID NO: 4654904 - DNA, 21 bp, Homo sapiens
agagtgtagctgtaagggcag

SEQ ID NO: 4654905 - DNA, 23 bp, Homo sapiens
agagtgtagctgtaagggcagtg

SEQ ID NO: 4654906 - DNA, 15 bp, Homo sapiens
agagttctagacctc

SEQ ID NO: 4654907 - DNA, 19 bp, Homo sapiens
agagttgtgatggagggga

SEQ ID NO: 4654908 - DNA, 20 bp, Homo sapiens
agagttgtgatggaggggag

SEQ ID NO: 4654909 - DNA, 23 bp, Homo sapiens
agataacctaataattgtatcta

SEQ ID NO: 4654910 - DNA, 14 bp, Homo sapiens
agataaccttgttt

SEQ ID NO: 4654911 - DNA, 23 bp, Homo sapiens
agataatgaaatagttattttaa

SEQ ID NO: 4654912 - DNA, 13 bp, Homo sapiens
agataatttgaaa

SEQ ID NO: 4654913 - DNA, 21 bp, Homo sapiens
agatagaacacaaaacttgaa

SEQ ID NO: 4654914 - DNA, 16 bp, Homo sapiens
agatagcattgtgaac

SEQ ID NO: 4654915 - DNA, 19 bp, Homo sapiens
agatagcattgtgaactga

SEQ ID NO: 4654916 - DNA, 14 bp, Homo sapiens
agatatatgtgtat

SEQ ID NO: 4654917 - DNA, 18 bp, Homo sapiens
agatatatgtgtatacat

SEQ ID NO: 4654918 - DNA, 20 bp, Homo sapiens
agatatgccactaacttcta

SEQ ID NO: 4654919 - DNA, 21 bp, Homo sapiens
agatatggcattgcactgctt

SEQ ID NO: 4654920 - DNA, 17 bp, Homo sapiens
agatcacagccccaccc

SEQ ID NO: 4654921 - DNA, 22 bp, Homo sapiens
agatcagaaagtgacatttgct

SEQ ID NO: 4654922 - DNA, 14 bp, Homo sapiens
agatcagaacattc

SEQ ID NO: 4654923 - DNA, 20 bp, Homo sapiens
agatcagaacattcagctct

SEQ ID NO: 4654924 - DNA, 22 bp, Homo sapiens
agatcagaacattcagctctgg

SEQ ID NO: 4654925 - DNA, 16 bp, Homo sapiens
agatcaggatcagctt

SEQ ID NO: 4654926 - DNA, 16 bp, Homo sapiens
agatcagggcctgccc

SEQ ID NO: 4654927 - DNA, 19 bp, Homo sapiens
agatcagggcctgccccct

SEQ ID NO: 4654928 - DNA, 20 bp, Homo sapiens
agatcatttataatactgtt

SEQ ID NO: 4654929 - DNA, 20 bp, Homo sapiens
agatccctattagatacact

SEQ ID NO: 4654930 - DNA, 17 bp, Homo sapiens
agatccctgcagaaccc

SEQ ID NO: 4654931 - DNA, 14 bp, Homo sapiens
agatcgacagacag

SEQ ID NO: 4654932 - DNA, 22 bp, Homo sapiens
agatctcggtttgccaaaattc

SEQ ID NO: 4654933 - DNA, 16 bp, Homo sapiens
agatctgccagacctg

SEQ ID NO: 4654934 - DNA, 17 bp, Homo sapiens
agatctggggaggcagg

SEQ ID NO: 4654935 - DNA, 18 bp, Homo sapiens
agatgaacagactgacct

SEQ ID NO: 4654936 - DNA, 20 bp, Homo sapiens
agatgaactgactgaaggaa

SEQ ID NO: 4654937 - DNA, 12 bp, Homo sapiens
agatgagcctgg

SEQ ID NO: 4654938 - DNA, 22 bp, Homo sapiens
agatgaggccctgcaccttccc

SEQ ID NO: 4654939 - DNA, 15 bp, Homo sapiens
agatgattatatatt

SEQ ID NO: 4654940 - DNA, 14 bp, Homo sapiens
agatgccccctcca

SEQ ID NO: 4654941 - DNA, 19 bp, Homo sapiens
agatgccccctccaggaga

SEQ ID NO: 4654942 - DNA, 16 bp, Homo sapiens
agatgcccttgctggg

SEQ ID NO: 4654943 - DNA, 17 bp, Homo sapiens
agatgcctcctgtcaga

SEQ ID NO: 4654944 - DNA, 12 bp, Homo sapiens
agatgcttctgg

SEQ ID NO: 4654945 - DNA, 16 bp, Homo sapiens
agatgcttctgggaga

SEQ ID NO: 4654946 - DNA, 10 bp, Homo sapiens
agatggaaag

SEQ ID NO: 4654947 - DNA, 21 bp, Homo sapiens
agatggaagcttactctctgc

SEQ ID NO: 4654948 - DNA, 19 bp, Homo sapiens
agatggacacgagccacaa

SEQ ID NO: 4654949 - DNA, 18 bp, Homo sapiens
agatggagggcttggccc

SEQ ID NO: 4654950 - DNA, 20 bp, Homo sapiens
agatggagtctcactcttgt

SEQ ID NO: 4654951 - DNA, 17 bp, Homo sapiens
agatggagttcttgtgc

SEQ ID NO: 4654952 - DNA, 14 bp, Homo sapiens
agatggcaacattg

SEQ ID NO: 4654953 - DNA, 15 bp, Homo sapiens
agatggcaacattgg

SEQ ID NO: 4654954 - DNA, 22 bp, Homo sapiens
agatggcaagagggtgacagct

SEQ ID NO: 4654955 - DNA, 17 bp, Homo sapiens
agatggcatcctgtgaa

SEQ ID NO: 4654956 - DNA, 22 bp, Homo sapiens
agatgggcatatgtgtcagtgg

SEQ ID NO: 4654957 - DNA, 13 bp, Homo sapiens
agatgtaggaggg

SEQ ID NO: 4654958 - DNA, 17 bp, Homo sapiens
agatgtattctttataa

SEQ ID NO: 4654959 - DNA, 21 bp, Homo sapiens
agatgtgatcaggccccaccc

SEQ ID NO: 4654960 - DNA, 15 bp, Homo sapiens
agatgtttggatatt

SEQ ID NO: 4654961 - DNA, 14 bp, Homo sapiens
agatgtttgttttc

SEQ ID NO: 4654962 - DNA, 18 bp, Homo sapiens
agatgtttgttttcaaaa

SEQ ID NO: 4654963 - DNA, 18 bp, Homo sapiens
agattaacctgaaagaac

SEQ ID NO: 4654964 - DNA, 15 bp, Homo sapiens
agattatcacattaa

SEQ ID NO: 4654965 - DNA, 18 bp, Homo sapiens
agattatcacattaattt

SEQ ID NO: 4654966 - DNA, 16 bp, Homo sapiens
agattctcttgaataa

SEQ ID NO: 4654967 - DNA, 13 bp, Homo sapiens
agattgcatgtga

SEQ ID NO: 4654968 - DNA, 22 bp, Homo sapiens
agattgcatgtgactctgaagc

SEQ ID NO: 4654969 - DNA, 14 bp, Homo sapiens
agattgtactgttc

SEQ ID NO: 4654970 - DNA, 21 bp, Homo sapiens
agattgtactgttcatacagt

SEQ ID NO: 4654971 - DNA, 21 bp, Homo sapiens
agattgttggtgaattttcaa

SEQ ID NO: 4654972 - DNA, 22 bp, Homo sapiens
agatttaccaattcacccactc

SEQ ID NO: 4654973 - DNA, 17 bp, Homo sapiens
agatttacttaattgct

SEQ ID NO: 4654974 - DNA, 22 bp, Homo sapiens
agattttggttggtttttacat

SEQ ID NO: 4654975 - DNA, 21 bp, Homo sapiens
agatttttaaaaaatattttc

SEQ ID NO: 4654976 - DNA, 22 bp, Homo sapiens
agatttttttttccacttttgt

SEQ ID NO: 4654977 - DNA, 17 bp, Homo sapiens
agcaaaaatctgagaaa

SEQ ID NO: 4654978 - DNA, 19 bp, Homo sapiens
agcaaaccattatacctta

SEQ ID NO: 4654979 - DNA, 14 bp, Homo sapiens
agcaaactctgctg

SEQ ID NO: 4654980 - DNA, 21 bp, Homo sapiens
agcaaagcctgttcatggcag

SEQ ID NO: 4654981 - DNA, 13 bp, Homo sapiens
agcaacagataga

SEQ ID NO: 4654982 - DNA, 20 bp, Homo sapiens
actgtgtttatatgtcttgc

SEQ ID NO: 4654983 - DNA, 21 bp, Homo sapiens
actgtgtttgatttgtctcat

SEQ ID NO: 4654984 - DNA, 14 bp, Homo sapiens
actgttacagactg

SEQ ID NO: 4654985 - DNA, 17 bp, Homo sapiens
actgttacagactgaaa

SEQ ID NO: 4654986 - DNA, 18 bp, Homo sapiens
actgttcttcattttatt

SEQ ID NO: 4654987 - DNA, 12 bp, Homo sapiens
actgtttcatct

SEQ ID NO: 4654988 - DNA, 16 bp, Homo sapiens
actgtttccctgctga

SEQ ID NO: 4654989 - DNA, 12 bp, Homo sapiens
actgtttttaat

SEQ ID NO: 4654990 - DNA, 16 bp, Homo sapiens
acttaaatattgtaat

SEQ ID NO: 4654991 - DNA, 20 bp, Homo sapiens
acttaaatattgtaatatga

SEQ ID NO: 4654992 - DNA, 14 bp, Homo sapiens
acttaacagatgca

SEQ ID NO: 4654993 - DNA, 19 bp, Homo sapiens
acttaacatttcattgtac

SEQ ID NO: 4654994 - DNA, 18 bp, Homo sapiens
acttaagctcccctgcct

SEQ ID NO: 4654995 - DNA, 19 bp, Homo sapiens
acttaagctcccctgcctt

SEQ ID NO: 4654996 - DNA, 16 bp, Homo sapiens
acttaaggaagtttga

SEQ ID NO: 4654997 - DNA, 20 bp, Homo sapiens
acttaatcttctctcttgat

SEQ ID NO: 4654998 - DNA, 19 bp, Homo sapiens
acttaattgctacatctaa

SEQ ID NO: 4654999 - DNA, 20 bp, Homo sapiens
acttacactgtttcatctca

SEQ ID NO: 4655000 - DNA, 13 bp, Homo sapiens
acttacctggcag

SEQ ID NO: 4655001 - DNA, 15 bp, Homo sapiens
acttactgcctgacc

SEQ ID NO: 4655002 - DNA, 19 bp, Homo sapiens
acttagacctgccagccac

SEQ ID NO: 4655003 - DNA, 14 bp, Homo sapiens
acttagcaggcacc

SEQ ID NO: 4655004 - DNA, 21 bp, Homo sapiens
acttatgcaagatatttttga

SEQ ID NO: 4655005 - DNA, 15 bp, Homo sapiens
acttatgtacagaaa

SEQ ID NO: 4655006 - DNA, 17 bp, Homo sapiens
acttatttatgaacctg

SEQ ID NO: 4655007 - DNA, 12 bp, Homo sapiens
acttatttctgc

SEQ ID NO: 4655008 - DNA, 13 bp, Homo sapiens
acttatttctgct

SEQ ID NO: 4655009 - DNA, 20 bp, Homo sapiens
acttcaagatgagcctgggc

SEQ ID NO: 4655010 - DNA, 19 bp, Homo sapiens
acttcacgctttcagcgaa

SEQ ID NO: 4655011 - DNA, 16 bp, Homo sapiens
acttcatttttaagaa

SEQ ID NO: 4655012 - DNA, 13 bp, Homo sapiens
agaaagtgacatt

SEQ ID NO: 4655013 - DNA, 14 bp, Homo sapiens
agaaagttcatgct

SEQ ID NO: 4655014 - DNA, 19 bp, Homo sapiens
agaaataaaaggaagccaa

SEQ ID NO: 4655015 - DNA, 20 bp, Homo sapiens
agaaataaaaggaagccaaa

SEQ ID NO: 4655016 - DNA, 19 bp, Homo sapiens
agaaataatccctgtaata

SEQ ID NO: 4655017 - DNA, 23 bp, Homo sapiens
agaaatagctgaaaagggcactc

SEQ ID NO: 4655018 - DNA, 16 bp, Homo sapiens
agaaatagttgtctgt

SEQ ID NO: 4655019 - DNA, 23 bp, Homo sapiens
agaaatccagtttgtgtttttct

SEQ ID NO: 4655020 - DNA, 23 bp, Homo sapiens
agaaatgcatatgtcactagaat

SEQ ID NO: 4655021 - DNA, 16 bp, Homo sapiens
agaaatggaaattttg

SEQ ID NO: 4655022 - DNA, 16 bp, Homo sapiens
agaaatgtcttaattt

SEQ ID NO: 4655023 - DNA, 19 bp, Homo sapiens
agaaattcgcatgtttaat

SEQ ID NO: 4655024 - DNA, 21 bp, Homo sapiens
agaaattcgcatgtttaatgt

SEQ ID NO: 4655025 - DNA, 17 bp, Homo sapiens
agaacaggaggtgtgaa

SEQ ID NO: 4655026 - DNA, 11 bp, Homo sapiens
agaacagggtc

SEQ ID NO: 4655027 - DNA, 23 bp, Homo sapiens
agaacaggttcttaaaaaggaac

SEQ ID NO: 4655028 - DNA, 18 bp, Homo sapiens
agaacagtggttgcctgg

SEQ ID NO: 4655029 - DNA, 22 bp, Homo sapiens
agaacagtggttgcctgggggc

SEQ ID NO: 4655030 - DNA, 17 bp, Homo sapiens
agaacatacatgataca

SEQ ID NO: 4655031 - DNA, 18 bp, Homo sapiens
agaacattcagctctgga

SEQ ID NO: 4655032 - DNA, 19 bp, Homo sapiens
agaacattcagctctggag

SEQ ID NO: 4655033 - DNA, 20 bp, Homo sapiens
agaacattcagctctggaga

SEQ ID NO: 4655034 - DNA, 21 bp, Homo sapiens
agaacattcagctctggagaa

SEQ ID NO: 4655035 - DNA, 21 bp, Homo sapiens
agaacccagtgtttccacact

SEQ ID NO: 4655036 - DNA, 14 bp, Homo sapiens
agaacctccctcct

SEQ ID NO: 4655037 - DNA, 13 bp, Homo sapiens
agaacctggcctt

SEQ ID NO: 4655038 - DNA, 14 bp, Homo sapiens
agaacctggccttc

SEQ ID NO: 4655039 - DNA, 15 bp, Homo sapiens
agaactctcctcttt

SEQ ID NO: 4655040 - DNA, 21 bp, Homo sapiens
agaactctctggaagcccctg

SEQ ID NO: 4655041 - DNA, 11 bp, Homo sapiens
agaagaaagaa

SEQ ID NO: 4655042 - DNA, 16 bp, Homo sapiens
agaagaaagaggtgac

SEQ ID NO: 4655043 - DNA, 22 bp, Homo sapiens
agaagacgggaggggaggcatt

SEQ ID NO: 4655044 - DNA, 23 bp, Homo sapiens
agaagacgggaggggaggcattg

SEQ ID NO: 4655045 - DNA, 20 bp, Homo sapiens
agaagatcattggagtttag

SEQ ID NO: 4655046 - DNA, 17 bp, Homo sapiens
agaagattttataagaa

SEQ ID NO: 4655047 - DNA, 23 bp, Homo sapiens
agaagattttataagaattttgc

SEQ ID NO: 4655048 - DNA, 20 bp, Homo sapiens
agaagcaataaagaagagtg

SEQ ID NO: 4655049 - DNA, 21 bp, Homo sapiens
agaagcaataaagaagagtgc

SEQ ID NO: 4655050 - DNA, 13 bp, Homo sapiens
agaagcagaggga

SEQ ID NO: 4655051 - DNA, 16 bp, Homo sapiens
agaagcagagggacaa

SEQ ID NO: 4655052 - DNA, 10 bp, Homo sapiens
agaagccagc

SEQ ID NO: 4655053 - DNA, 19 bp, Homo sapiens
agaagccagccacagaccc

SEQ ID NO: 4655054 - DNA, 17 bp, Homo sapiens
agaagcctgatgctgac

SEQ ID NO: 4655055 - DNA, 21 bp, Homo sapiens
agaagcctgatgctgacattc

SEQ ID NO: 4655056 - DNA, 18 bp, Homo sapiens
agaagcctgggggcctgg

SEQ ID NO: 4655057 - DNA, 14 bp, Homo sapiens
agaagcctgtttca

SEQ ID NO: 4655058 - DNA, 18 bp, Homo sapiens
agaagctgctccaggcct

SEQ ID NO: 4655059 - DNA, 14 bp, Homo sapiens
agaagcttggagga

SEQ ID NO: 4655060 - DNA, 18 bp, Homo sapiens
agaagcttggaggagggt

SEQ ID NO: 4655061 - DNA, 13 bp, Homo sapiens
agaagggggccct

SEQ ID NO: 4655062 - DNA, 19 bp, Homo sapiens
agaagggggctctgcccca

SEQ ID NO: 4655063 - DNA, 20 bp, Homo sapiens
agaagggggctctgccccag

SEQ ID NO: 4655064 - DNA, 17 bp, Homo sapiens
agaaggtttgtgttttt

SEQ ID NO: 4655065 - DNA, 21 bp, Homo sapiens
agaagttcaaaccctgtatcc

SEQ ID NO: 4655066 - DNA, 19 bp, Homo sapiens
agaagtttcagttgtcctt

SEQ ID NO: 4655067 - DNA, 17 bp, Homo sapiens
agaatcagtaggaccag

SEQ ID NO: 4655068 - DNA, 18 bp, Homo sapiens
agaatcagtaggaccagg

SEQ ID NO: 4655069 - DNA, 19 bp, Homo sapiens
agaatcatacttaacattt

SEQ ID NO: 4655070 - DNA, 15 bp, Homo sapiens
agaatgacagccttt

SEQ ID NO: 4655071 - DNA, 21 bp, Homo sapiens
agaatgactatataatttatt

SEQ ID NO: 4655072 - DNA, 17 bp, Homo sapiens
agaatgagagcgacaca

SEQ ID NO: 4655073 - DNA, 20 bp, Homo sapiens
agaatgatgataacagaact

SEQ ID NO: 4655074 - DNA, 22 bp, Homo sapiens
agaatggctgactgttgccttt

SEQ ID NO: 4655075 - DNA, 20 bp, Homo sapiens
agaatgttactgactcctca

SEQ ID NO: 4655076 - DNA, 21 bp, Homo sapiens
agaattatttgccttctgaaa

SEQ ID NO: 4655077 - DNA, 12 bp, Homo sapiens
agaattccttcg

SEQ ID NO: 4655078 - DNA, 13 bp, Homo sapiens
agaattccttcga

SEQ ID NO: 4655079 - DNA, 21 bp, Homo sapiens
agaattccttcgaaaggcctt

SEQ ID NO: 4655080 - DNA, 13 bp, Homo sapiens
agaatttaatata

SEQ ID NO: 4655081 - DNA, 19 bp, Homo sapiens
agacaacagcacacaggca

SEQ ID NO: 4655082 - DNA, 12 bp, Homo sapiens
agacaagacaga

SEQ ID NO: 4655083 - DNA, 18 bp, Homo sapiens
agacaagacagaggggag

SEQ ID NO: 4655084 - DNA, 16 bp, Homo sapiens
agacaagcagcccttg

SEQ ID NO: 4655085 - DNA, 18 bp, Homo sapiens
agacaagcagcccttgct

SEQ ID NO: 4655086 - DNA, 19 bp, Homo sapiens
agacaccgttcattcaggc

SEQ ID NO: 4655087 - DNA, 17 bp, Homo sapiens
agacacgtggcctcgtg

SEQ ID NO: 4655088 - DNA, 14 bp, Homo sapiens
agacactaactttg

SEQ ID NO: 4655089 - DNA, 13 bp, Homo sapiens
agacactctgaca

SEQ ID NO: 4655090 - DNA, 16 bp, Homo sapiens
agacagagcctcgctc

SEQ ID NO: 4655091 - DNA, 23 bp, Homo sapiens
agacagcccaggatactggcaca

SEQ ID NO: 4655092 - DNA, 16 bp, Homo sapiens
agacaggaaagccagg

SEQ ID NO: 4655093 - DNA, 21 bp, Homo sapiens
agacaggctacaaagcagaga

SEQ ID NO: 4655094 - DNA, 23 bp, Homo sapiens
agacaggctacaaagcagagatc

SEQ ID NO: 4655095 - DNA, 15 bp, Homo sapiens
agacataaagccttt

SEQ ID NO: 4655096 - DNA, 17 bp, Homo sapiens
agacatcattgtcagcc

SEQ ID NO: 4655097 - DNA, 16 bp, Homo sapiens
ttattattttccttcc

SEQ ID NO: 4655098 - DNA, 13 bp, Homo sapiens
ttattcaacacat

SEQ ID NO: 4655099 - DNA, 14 bp, Homo sapiens
ttattccaggagaa

SEQ ID NO: 4655100 - DNA, 16 bp, Homo sapiens
ttattcctcttattgg

SEQ ID NO: 4655101 - DNA, 14 bp, Homo sapiens
ttattctactatac

SEQ ID NO: 4655102 - DNA, 22 bp, Homo sapiens
ttattgagggtcattctttatt

SEQ ID NO: 4655103 - DNA, 20 bp, Homo sapiens
ttattggaaatgtacttttg

SEQ ID NO: 4655104 - DNA, 14 bp, Homo sapiens
ttattgggttttta

SEQ ID NO: 4655105 - DNA, 23 bp, Homo sapiens
ttattgtgggccatgaaccaaat

SEQ ID NO: 4655106 - DNA, 16 bp, Homo sapiens
ttatttaacaaaaaat

SEQ ID NO: 4655107 - DNA, 18 bp, Homo sapiens
ttatttaacaaaaaatgt

SEQ ID NO: 4655108 - DNA, 13 bp, Homo sapiens
ttatttaagattt

SEQ ID NO: 4655109 - DNA, 11 bp, Homo sapiens
ttatttagcat

SEQ ID NO: 4655110 - DNA, 16 bp, Homo sapiens
ttatttataaaaagat

SEQ ID NO: 4655111 - DNA, 12 bp, Homo sapiens
ttatttatttct

SEQ ID NO: 4655112 - DNA, 23 bp, Homo sapiens
ttatttcacacgctgttctaatg

SEQ ID NO: 4655113 - DNA, 24 bp, Homo sapiens
ttatttcatgtggtgaatatgcaa

SEQ ID NO: 4655114 - DNA, 19 bp, Homo sapiens
ttatttccactattttcaa

SEQ ID NO: 4655115 - DNA, 16 bp, Homo sapiens
ttatttctgctctgga

SEQ ID NO: 4655116 - DNA, 16 bp, Homo sapiens
ttatttggtgtgttcg

SEQ ID NO: 4655117 - DNA, 20 bp, Homo sapiens
ttatttgtaaaccattgtaa

SEQ ID NO: 4655118 - DNA, 18 bp, Homo sapiens
ttattttcttttgaattg

SEQ ID NO: 4655119 - DNA, 23 bp, Homo sapiens
ttattttggcttcatttcaatca

SEQ ID NO: 4655120 - DNA, 17 bp, Homo sapiens
ttattttgtaatattga

SEQ ID NO: 4655121 - DNA, 16 bp, Homo sapiens
ttatttttctgtgggt

SEQ ID NO: 4655122 - DNA, 13 bp, Homo sapiens
ttattttttaaga

SEQ ID NO: 4655123 - DNA, 14 bp, Homo sapiens
ttattttttaagaa

SEQ ID NO: 4655124 - DNA, 23 bp, Homo sapiens
ttcaaaagaaatttaagttctat

SEQ ID NO: 4655125 - DNA, 13 bp, Homo sapiens
ttcaaaagcaatc

SEQ ID NO: 4655126 - DNA, 16 bp, Homo sapiens
ttcaaaataaaaagta

SEQ ID NO: 4655127 - DNA, 16 bp, Homo sapiens
ttcaaaatacttcttt

SEQ ID NO: 4655128 - DNA, 19 bp, Homo sapiens
ttcaaactcctgacctcag

SEQ ID NO: 4655129 - DNA, 15 bp, Homo sapiens
ttcaaagactgtgaa

SEQ ID NO: 4655130 - DNA, 22 bp, Homo sapiens
ttcaaagtgtctcattctcaga

SEQ ID NO: 4655131 - DNA, 14 bp, Homo sapiens
ttcaacaaatttca

SEQ ID NO: 4655132 - DNA, 15 bp, Homo sapiens
ttcaacaaatttcat

SEQ ID NO: 4655133 - DNA, 19 bp, Homo sapiens
ttcaacaaatttcattgca

SEQ ID NO: 4655134 - DNA, 22 bp, Homo sapiens
ttcaacaaatttcattgcactt

SEQ ID NO: 4655135 - DNA, 13 bp, Homo sapiens
ttcaacagggaag

SEQ ID NO: 4655136 - DNA, 16 bp, Homo sapiens
ttcaaccataaaagaa

SEQ ID NO: 4655137 - DNA, 23 bp, Homo sapiens
ttcaactaatacatggtttaaag

SEQ ID NO: 4655138 - DNA, 20 bp, Homo sapiens
ttcaagaatgaaaaatataa

SEQ ID NO: 4655139 - DNA, 17 bp, Homo sapiens
ttcaagatgagcctggg

SEQ ID NO: 4655140 - DNA, 19 bp, Homo sapiens
ttcaagatgagcctgggct

SEQ ID NO: 4655141 - DNA, 21 bp, Homo sapiens
ttcaagatgagcctgggctca

SEQ ID NO: 4655142 - DNA, 11 bp, Homo sapiens
ttcaaggcctt

SEQ ID NO: 4655143 - DNA, 20 bp, Homo sapiens
ttcaagtgcttaaaaatact

SEQ ID NO: 4655144 - DNA, 13 bp, Homo sapiens
ttcaataaagttg

SEQ ID NO: 4655145 - DNA, 18 bp, Homo sapiens
ttcaataaagttgttgca

SEQ ID NO: 4655146 - DNA, 21 bp, Homo sapiens
ttcaatacagtgaaggtcttt

SEQ ID NO: 4655147 - DNA, 13 bp, Homo sapiens
ttcaatactgtat

SEQ ID NO: 4655148 - DNA, 12 bp, Homo sapiens
ttcaatagcttt

SEQ ID NO: 4655149 - DNA, 16 bp, Homo sapiens
ttcaatatgaatctat

SEQ ID NO: 4655150 - DNA, 17 bp, Homo sapiens
ttcaatgacttctaatt

SEQ ID NO: 4655151 - DNA, 16 bp, Homo sapiens
ttcaatgtgactgaaa

SEQ ID NO: 4655152 - DNA, 21 bp, Homo sapiens
ttcaattaatattaattttct

SEQ ID NO: 4655153 - DNA, 17 bp, Homo sapiens
ttcaattccaccagggc

SEQ ID NO: 4655154 - DNA, 20 bp, Homo sapiens
ttcacacacagactgttgtc

SEQ ID NO: 4655155 - DNA, 15 bp, Homo sapiens
ttcacagcttttctt

SEQ ID NO: 4655156 - DNA, 16 bp, Homo sapiens
ttcacattaggctgtt

SEQ ID NO: 4655157 - DNA, 16 bp, Homo sapiens
ttcacattcttggctt

SEQ ID NO: 4655158 - DNA, 22 bp, Homo sapiens
ttcacctcactgaaaacatctg

SEQ ID NO: 4655159 - DNA, 21 bp, Homo sapiens
ttcacctccaagcatttcatg

SEQ ID NO: 4655160 - DNA, 19 bp, Homo sapiens
ttcacctctgggaccccag

SEQ ID NO: 4655161 - DNA, 16 bp, Homo sapiens
ttcacctgattcaact

SEQ ID NO: 4655162 - DNA, 20 bp, Homo sapiens
ttcacgaagtgttgcatgga

SEQ ID NO: 4655163 - DNA, 13 bp, Homo sapiens
ttcacttcaaagc

SEQ ID NO: 4655164 - DNA, 13 bp, Homo sapiens
ttcacttcacgct

SEQ ID NO: 4655165 - DNA, 21 bp, Homo sapiens
ttcagacaagacagaggggag

SEQ ID NO: 4655166 - DNA, 19 bp, Homo sapiens
ttcagcaagttagaactag

SEQ ID NO: 4655167 - DNA, 19 bp, Homo sapiens
ttcagcaggctagacagaa

SEQ ID NO: 4655168 - DNA, 17 bp, Homo sapiens
ttcagcattaagctgtt

SEQ ID NO: 4655169 - DNA, 14 bp, Homo sapiens
ttcagcccccacca

SEQ ID NO: 4655170 - DNA, 10 bp, Homo sapiens
ttcagctcct

SEQ ID NO: 4655171 - DNA, 12 bp, Homo sapiens
ttcagctctgga

SEQ ID NO: 4655172 - DNA, 14 bp, Homo sapiens
ttcagctctggaga

SEQ ID NO: 4655173 - DNA, 14 bp, Homo sapiens
ttcagctctttcca

SEQ ID NO: 4655174 - DNA, 17 bp, Homo sapiens
ttcagctctttccaaat

SEQ ID NO: 4655175 - DNA, 19 bp, Homo sapiens
ttcagctctttccaaatta

SEQ ID NO: 4655176 - DNA, 13 bp, Homo sapiens
ttcagctgcccca

SEQ ID NO: 4655177 - DNA, 17 bp, Homo sapiens
ttcaggaaaaggcctgg

SEQ ID NO: 4655178 - DNA, 16 bp, Homo sapiens
ttcaggaacaccccca

SEQ ID NO: 4655179 - DNA, 13 bp, Homo sapiens
ttcaggagacttt

SEQ ID NO: 4655180 - DNA, 21 bp, Homo sapiens
ttcagtacttttttaaatatt

SEQ ID NO: 4655181 - DNA, 21 bp, Homo sapiens
ttcagtgcagtttcttttcac

SEQ ID NO: 4655182 - DNA, 15 bp, Homo sapiens
ttcagtgccttcaac

SEQ ID NO: 4655183 - DNA, 17 bp, Homo sapiens
ttcagttattaaatgat

SEQ ID NO: 4655184 - DNA, 13 bp, Homo sapiens
ttcatacagtttt

SEQ ID NO: 4655185 - DNA, 15 bp, Homo sapiens
ttcatactacccttt

SEQ ID NO: 4655186 - DNA, 19 bp, Homo sapiens
ttcatactctgttgcctcc

SEQ ID NO: 4655187 - DNA, 23 bp, Homo sapiens
ttcatactctgttgcctcctctc

SEQ ID NO: 4655188 - DNA, 14 bp, Homo sapiens
ttcatagttttcta

SEQ ID NO: 4655189 - DNA, 14 bp, Homo sapiens
ttcatccttctttc

SEQ ID NO: 4655190 - DNA, 22 bp, Homo sapiens
ttcatccttctttccttgttca

SEQ ID NO: 4655191 - DNA, 14 bp, Homo sapiens
ttcatctaaatgaa

SEQ ID NO: 4655192 - DNA, 15 bp, Homo sapiens
ttcatctaaatgaaa

SEQ ID NO: 4655193 - DNA, 14 bp, Homo sapiens
tttcataatcagta

SEQ ID NO: 4655194 - DNA, 16 bp, Homo sapiens
tttcatctaaatgaaa

SEQ ID NO: 4655195 - DNA, 22 bp, Homo sapiens
tttcatgtagccagcagaactg

SEQ ID NO: 4655196 - DNA, 14 bp, Homo sapiens
tttcattaaaggct

SEQ ID NO: 4655197 - DNA, 14 bp, Homo sapiens
tttcattacttgaa

SEQ ID NO: 4655198 - DNA, 16 bp, Homo sapiens
tttcattacttgaatg

SEQ ID NO: 4655199 - DNA, 12 bp, Homo sapiens
tttcattatgca

SEQ ID NO: 4655200 - DNA, 15 bp, Homo sapiens
tttcattatgttcat

SEQ ID NO: 4655201 - DNA, 17 bp, Homo sapiens
tttcattctcctcctcc

SEQ ID NO: 4655202 - DNA, 11 bp, Homo sapiens
tttcattgcac

SEQ ID NO: 4655203 - DNA, 12 bp, Homo sapiens
tttcattgcact

SEQ ID NO: 4655204 - DNA, 15 bp, Homo sapiens
tttcattgcactttc

SEQ ID NO: 4655205 - DNA, 13 bp, Homo sapiens
tttcattggtgta

SEQ ID NO: 4655206 - DNA, 13 bp, Homo sapiens
tttcattgtacaa

SEQ ID NO: 4655207 - DNA, 17 bp, Homo sapiens
tttccaaattaaaacaa

SEQ ID NO: 4655208 - DNA, 20 bp, Homo sapiens
tttccaaattaaaacaaata

SEQ ID NO: 4655209 - DNA, 15 bp, Homo sapiens
tttccaatagaaaga

SEQ ID NO: 4655210 - DNA, 19 bp, Homo sapiens
tttccacttgccctgtgtt

SEQ ID NO: 4655211 - DNA, 20 bp, Homo sapiens
tttccacttgccctgtgttc

SEQ ID NO: 4655212 - DNA, 16 bp, Homo sapiens
tttccacttgttctca

SEQ ID NO: 4655213 - DNA, 23 bp, Homo sapiens
tttcccaagctagactgtgtctg

SEQ ID NO: 4655214 - DNA, 21 bp, Homo sapiens
tttcccacgtctaactggaaa

SEQ ID NO: 4655215 - DNA, 21 bp, Homo sapiens
tttccccaaggacccagccct

SEQ ID NO: 4655216 - DNA, 14 bp, Homo sapiens
tttcccccaggaaa

SEQ ID NO: 4655217 - DNA, 20 bp, Homo sapiens
tttccccgaagagtcagccc

SEQ ID NO: 4655218 - DNA, 16 bp, Homo sapiens
tttccctgctgaatgc

SEQ ID NO: 4655219 - DNA, 21 bp, Homo sapiens
tttccctttatttctcttcta

SEQ ID NO: 4655220 - DNA, 22 bp, Homo sapiens
tttcctaggatgtcatgtctgc

SEQ ID NO: 4655221 - DNA, 11 bp, Homo sapiens
tttcctcagtg

SEQ ID NO: 4655222 - DNA, 16 bp, Homo sapiens
tttcctccccctgcaa

SEQ ID NO: 4655223 - DNA, 13 bp, Homo sapiens
tttcctctgcctt

SEQ ID NO: 4655224 - DNA, 13 bp, Homo sapiens
tttcctcttgtga

SEQ ID NO: 4655225 - DNA, 15 bp, Homo sapiens
tttcctgaagcattt

SEQ ID NO: 4655226 - DNA, 20 bp, Homo sapiens
tttcctgagaccacagagag

SEQ ID NO: 4655227 - DNA, 12 bp, Homo sapiens
tttcctggaagt

SEQ ID NO: 4655228 - DNA, 19 bp, Homo sapiens
tttcctggacttaaagaaa

SEQ ID NO: 4655229 - DNA, 20 bp, Homo sapiens
tttcctggacttaaagaaaa

SEQ ID NO: 4655230 - DNA, 16 bp, Homo sapiens
tttcctggcctcagag

SEQ ID NO: 4655231 - DNA, 23 bp, Homo sapiens
tttcctggcctcagagcttcctg

SEQ ID NO: 4655232 - DNA, 23 bp, Homo sapiens
tttcctgtatttgttcccaagag

SEQ ID NO: 4655233 - DNA, 14 bp, Homo sapiens
tttccttccagcct

SEQ ID NO: 4655234 - DNA, 23 bp, Homo sapiens
tttccttccatgctcccaactcc

SEQ ID NO: 4655235 - DNA, 21 bp, Homo sapiens
tttcctttcaataaagttgtt

SEQ ID NO: 4655236 - DNA, 14 bp, Homo sapiens
tttcctttgtagct

SEQ ID NO: 4655237 - DNA, 15 bp, Homo sapiens
tttctaaactaggat

SEQ ID NO: 4655238 - DNA, 14 bp, Homo sapiens
tttctaaataaaaa

SEQ ID NO: 4655239 - DNA, 16 bp, Homo sapiens
tttctagttctttcct

SEQ ID NO: 4655240 - DNA, 12 bp, Homo sapiens
tttctataaatt

SEQ ID NO: 4655241 - DNA, 13 bp, Homo sapiens
tttctatgacaaa

SEQ ID NO: 4655242 - DNA, 22 bp, Homo sapiens
tttctattctgtcagtgttaaa

SEQ ID NO: 4655243 - DNA, 17 bp, Homo sapiens
tttctatttatgccttg

SEQ ID NO: 4655244 - DNA, 15 bp, Homo sapiens
tttctattttaagac

SEQ ID NO: 4655245 - DNA, 16 bp, Homo sapiens
tttctcaactgtccca

SEQ ID NO: 4655246 - DNA, 19 bp, Homo sapiens
tttctcagactttggaaaa

SEQ ID NO: 4655247 - DNA, 19 bp, Homo sapiens
tttctccacttcattttta

SEQ ID NO: 4655248 - DNA, 16 bp, Homo sapiens
tttctcctctttgaga

SEQ ID NO: 4655249 - DNA, 17 bp, Homo sapiens
tttctcctctttgagac

SEQ ID NO: 4655250 - DNA, 15 bp, Homo sapiens
tttctcgacagatga

SEQ ID NO: 4655251 - DNA, 16 bp, Homo sapiens
tttctcgacagatgat

SEQ ID NO: 4655252 - DNA, 14 bp, Homo sapiens
tttctctgcctggc

SEQ ID NO: 4655253 - DNA, 22 bp, Homo sapiens
tttctctgcctggcaacatctt

SEQ ID NO: 4655254 - DNA, 15 bp, Homo sapiens
tttctctgtactttt

SEQ ID NO: 4655255 - DNA, 12 bp, Homo sapiens
tttctctgtgaa

SEQ ID NO: 4655256 - DNA, 12 bp, Homo sapiens
tttctcttagag

SEQ ID NO: 4655257 - DNA, 13 bp, Homo sapiens
tttctcttctacc

SEQ ID NO: 4655258 - DNA, 11 bp, Homo sapiens
tttctgcctgg

SEQ ID NO: 4655259 - DNA, 15 bp, Homo sapiens
tttctgctctggaat

SEQ ID NO: 4655260 - DNA, 11 bp, Homo sapiens
tttctgctgtt

SEQ ID NO: 4655261 - DNA, 18 bp, Homo sapiens
tttctgggctctggactc

SEQ ID NO: 4655262 - DNA, 13 bp, Homo sapiens
tttcttaaaactt

SEQ ID NO: 4655263 - DNA, 21 bp, Homo sapiens
tttcttaaaactttattaaaa

SEQ ID NO: 4655264 - DNA, 18 bp, Homo sapiens
tttctttatatttatcca

SEQ ID NO: 4655265 - DNA, 20 bp, Homo sapiens
tttctttatatttatccact

SEQ ID NO: 4655266 - DNA, 12 bp, Homo sapiens
tttctttgagga

SEQ ID NO: 4655267 - DNA, 16 bp, Homo sapiens
tttcttttgaattgtt

SEQ ID NO: 4655268 - DNA, 15 bp, Homo sapiens
tttgaaaacatataa

SEQ ID NO: 4655269 - DNA, 15 bp, Homo sapiens
tttgaaacaaagaag

SEQ ID NO: 4655270 - DNA, 15 bp, Homo sapiens
tttgaaacaaagtac

SEQ ID NO: 4655271 - DNA, 21 bp, Homo sapiens
tttgaaatgtttaataaagct

SEQ ID NO: 4655272 - DNA, 17 bp, Homo sapiens
tttgaaccaacatcttt

SEQ ID NO: 4655273 - DNA, 18 bp, Homo sapiens
tttgaagtaaattaaaca

SEQ ID NO: 4655274 - DNA, 22 bp, Homo sapiens
tttgaatgctaagaatgcatta

SEQ ID NO: 4655275 - DNA, 14 bp, Homo sapiens
tttgagaaaaatag

SEQ ID NO: 4655276 - DNA, 19 bp, Homo sapiens
tttgagcagatcttggaat

SEQ ID NO: 4655277 - DNA, 20 bp, Homo sapiens
tttgagtaaaaagacatttt

SEQ ID NO: 4655278 - DNA, 21 bp, Homo sapiens
tttgatgaggtattttttcct

SEQ ID NO: 4655279 - DNA, 19 bp, Homo sapiens
tttgatggtactgatgagt

SEQ ID NO: 4655280 - DNA, 14 bp, Homo sapiens
tttgatttctaatt

SEQ ID NO: 4655281 - DNA, 11 bp, Homo sapiens
tttgatttttg

SEQ ID NO: 4655282 - DNA, 13 bp, Homo sapiens
tttgcaacattta

SEQ ID NO: 4655283 - DNA, 13 bp, Homo sapiens
tttgcacctgtcc

SEQ ID NO: 4655284 - DNA, 21 bp, Homo sapiens
tttgcagttgatgtgtctttt

SEQ ID NO: 4655285 - DNA, 19 bp, Homo sapiens
tttgccagactctaggtta

SEQ ID NO: 4655286 - DNA, 23 bp, Homo sapiens
tttgccagagccaaattttatct

SEQ ID NO: 4655287 - DNA, 22 bp, Homo sapiens
tttgcccttcctcctgcctttc

SEQ ID NO: 4655288 - DNA, 20 bp, Homo sapiens
tttgcggggcctgtctcagt

SEQ ID NO: 4655289 - DNA, 19 bp, Homo sapiens
tttgcgtacacagagaagg

SEQ ID NO: 4655290 - DNA, 15 bp, Homo sapiens
tttgctaaatgtgag

SEQ ID NO: 4655291 - DNA, 16 bp, Homo sapiens
tttgctggaagaaact

SEQ ID NO: 4655292 - DNA, 21 bp, Homo sapiens
tttgctgtagaagatggcact

SEQ ID NO: 4655293 - DNA, 21 bp, Homo sapiens
tttgctgttgattcagacttt

SEQ ID NO: 4655294 - DNA, 18 bp, Homo sapiens
tttggaaaagacagaaaa

SEQ ID NO: 4655295 - DNA, 17 bp, Homo sapiens
tttggatcttgaatgtg

SEQ ID NO: 4655296 - DNA, 13 bp, Homo sapiens
tttggcctgtgat

SEQ ID NO: 4655297 - DNA, 15 bp, Homo sapiens
tttgggtttttttgt

SEQ ID NO: 4655298 - DNA, 15 bp, Homo sapiens
tttggtaaaacagtt

SEQ ID NO: 4655299 - DNA, 12 bp, Homo sapiens
tttggtgtgccc

SEQ ID NO: 4655300 - DNA, 12 bp, Homo sapiens
ttttgtaaaata

SEQ ID NO: 4655301 - DNA, 13 bp, Homo sapiens
ttttgtatcttaa

SEQ ID NO: 4655302 - DNA, 23 bp, Homo sapiens
ttttgtcacattatttattaaaa

SEQ ID NO: 4655303 - DNA, 16 bp, Homo sapiens
ttttgtttgtttcttt

SEQ ID NO: 4655304 - DNA, 12 bp, Homo sapiens
tttttaaaaaat

SEQ ID NO: 4655305 - DNA, 20 bp, Homo sapiens
tttttaaaaatgcaaatcct

SEQ ID NO: 4655306 - DNA, 18 bp, Homo sapiens
tttttaaagttactttgt

SEQ ID NO: 4655307 - DNA, 20 bp, Homo sapiens
tttttaaagtttaaatacca

SEQ ID NO: 4655308 - DNA, 13 bp, Homo sapiens
tttttaatgctat

SEQ ID NO: 4655309 - DNA, 22 bp, Homo sapiens
ttggagaccctgcaaacagaac

SEQ ID NO: 4655310 - DNA, 15 bp, Homo sapiens
ttggagcaaaccatt

SEQ ID NO: 4655311 - DNA, 17 bp, Homo sapiens
ttggaggcctttcatcc

SEQ ID NO: 4655312 - DNA, 16 bp, Homo sapiens
ttggaggctgcagtga

SEQ ID NO: 4655313 - DNA, 15 bp, Homo sapiens
ttggagtttaggaat

SEQ ID NO: 4655314 - DNA, 16 bp, Homo sapiens
ttggataaacaacatt

SEQ ID NO: 4655315 - DNA, 22 bp, Homo sapiens
ttggataagtagggctaagcca

SEQ ID NO: 4655316 - DNA, 16 bp, Homo sapiens
ttggatcttgaatgtg

SEQ ID NO: 4655317 - DNA, 21 bp, Homo sapiens
ttggcaaacgagactttctcc

SEQ ID NO: 4655318 - DNA, 20 bp, Homo sapiens
ttggcactttgttttcaaga

SEQ ID NO: 4655319 - DNA, 23 bp, Homo sapiens
ttggcagcccctgttttctgctg

SEQ ID NO: 4655320 - DNA, 12 bp, Homo sapiens
ttggcagctgac

SEQ ID NO: 4655321 - DNA, 15 bp, Homo sapiens
ttggcaggctgaggt

SEQ ID NO: 4655322 - DNA, 19 bp, Homo sapiens
ttggcaggctgaggtgaga

SEQ ID NO: 4655323 - DNA, 14 bp, Homo sapiens
ttggcatctgcttt

SEQ ID NO: 4655324 - DNA, 12 bp, Homo sapiens
ttggccaggcct

SEQ ID NO: 4655325 - DNA, 14 bp, Homo sapiens
ttggccaggcctag

SEQ ID NO: 4655326 - DNA, 15 bp, Homo sapiens
ttggcctcctgcttc

SEQ ID NO: 4655327 - DNA, 19 bp, Homo sapiens
ttggcctgatcagaccacg

SEQ ID NO: 4655328 - DNA, 17 bp, Homo sapiens
ttggctgccgtctggcc

SEQ ID NO: 4655329 - DNA, 16 bp, Homo sapiens
ttggctgcttcctgtg

SEQ ID NO: 4655330 - DNA, 16 bp, Homo sapiens
ttgggaagattctcta

SEQ ID NO: 4655331 - DNA, 21 bp, Homo sapiens
ttgggcacccccagcctgggc

SEQ ID NO: 4655332 - DNA, 22 bp, Homo sapiens
ttgggcacccccagcctgggcc

SEQ ID NO: 4655333 - DNA, 23 bp, Homo sapiens
ttgggcacccccagcctgggcct

SEQ ID NO: 4655334 - DNA, 20 bp, Homo sapiens
ttgggcctcaggctctgcac

SEQ ID NO: 4655335 - DNA, 17 bp, Homo sapiens
ttgggctgacccagcat

SEQ ID NO: 4655336 - DNA, 22 bp, Homo sapiens
ttggggcaggagtagctgagct

SEQ ID NO: 4655337 - DNA, 21 bp, Homo sapiens
ttgggggggctcccgtggcct

SEQ ID NO: 4655338 - DNA, 13 bp, Homo sapiens
ttggtcatttggc

SEQ ID NO: 4655339 - DNA, 16 bp, Homo sapiens
ttggtcttaggtcttc

SEQ ID NO: 4655340 - DNA, 17 bp, Homo sapiens
ttggtgacttgtctgcc

SEQ ID NO: 4655341 - DNA, 20 bp, Homo sapiens
ttggtgcatgtctgttcttc

SEQ ID NO: 4655342 - DNA, 13 bp, Homo sapiens
ttggtgcctggcc

SEQ ID NO: 4655343 - DNA, 19 bp, Homo sapiens
ttggtgctatttgaagaaa

SEQ ID NO: 4655344 - DNA, 19 bp, Homo sapiens
ttggtggcctaatttacaa

SEQ ID NO: 4655345 - DNA, 12 bp, Homo sapiens
ttggtgtactgt

SEQ ID NO: 4655346 - DNA, 13 bp, Homo sapiens
ttggtgtgccctg

SEQ ID NO: 4655347 - DNA, 19 bp, Homo sapiens
ttggttatggttatgttca

SEQ ID NO: 4655348 - DNA, 13 bp, Homo sapiens
ttggttcatgctt

SEQ ID NO: 4655349 - DNA, 16 bp, Homo sapiens
ttggttttaaaagcac

SEQ ID NO: 4655350 - DNA, 22 bp, Homo sapiens
ttggtttttacatagttgagat

SEQ ID NO: 4655351 - DNA, 19 bp, Homo sapiens
ttgtaaaaacagcattgct

SEQ ID NO: 4655352 - DNA, 17 bp, Homo sapiens
ttgtaaaatagaaaaag

SEQ ID NO: 4655353 - DNA, 13 bp, Homo sapiens
ttgtaaaccattg

SEQ ID NO: 4655354 - DNA, 20 bp, Homo sapiens
ttgtaaaccattgtaactat

SEQ ID NO: 4655355 - DNA, 22 bp, Homo sapiens
ttgtaaatatggggatagtctg

SEQ ID NO: 4655356 - DNA, 16 bp, Homo sapiens
ttgtaactattaacct

SEQ ID NO: 4655357 - DNA, 16 bp, Homo sapiens
ttgtaaggggaagagg

SEQ ID NO: 4655358 - DNA, 13 bp, Homo sapiens
ttgtaatatgaca

SEQ ID NO: 4655359 - DNA, 22 bp, Homo sapiens
ttgtaatatgacagataaccta

SEQ ID NO: 4655360 - DNA, 22 bp, Homo sapiens
ttgtaatgcactgtttttaatc

SEQ ID NO: 4655361 - DNA, 12 bp, Homo sapiens
ttgtacagtttt

SEQ ID NO: 4655362 - DNA, 21 bp, Homo sapiens
ttgtacattttgtaaaatatt

SEQ ID NO: 4655363 - DNA, 12 bp, Homo sapiens
ttgtactgggac

SEQ ID NO: 4655364 - DNA, 15 bp, Homo sapiens
ttgtagccagccggg

SEQ ID NO: 4655365 - DNA, 16 bp, Homo sapiens
ttgtagctttcctgga

SEQ ID NO: 4655366 - DNA, 17 bp, Homo sapiens
ttgtagctttcctggaa

SEQ ID NO: 4655367 - DNA, 22 bp, Homo sapiens
ttgtaggatttttttcctcccc

SEQ ID NO: 4655368 - DNA, 14 bp, Homo sapiens
ttgtagttgtttta

SEQ ID NO: 4655369 - DNA, 20 bp, Homo sapiens
ttgtatattatgtttatttc

SEQ ID NO: 4655370 - DNA, 18 bp, Homo sapiens
ttgtatcgatgttatgta

SEQ ID NO: 4655371 - DNA, 17 bp, Homo sapiens
ttgtatctacattaaaa

SEQ ID NO: 4655372 - DNA, 22 bp, Homo sapiens
ttgtatctacattaaaatgaca

SEQ ID NO: 4655373 - DNA, 15 bp, Homo sapiens
ttgtatcttaaatct

SEQ ID NO: 4655374 - DNA, 14 bp, Homo sapiens
ttgtatcttaaatt

SEQ ID NO: 4655375 - DNA, 17 bp, Homo sapiens
ttgtattatttttgtag

SEQ ID NO: 4655376 - DNA, 20 bp, Homo sapiens
ttgtatttggaatatttgaa

SEQ ID NO: 4655377 - DNA, 16 bp, Homo sapiens
ttgtcacccaggctgg

SEQ ID NO: 4655378 - DNA, 17 bp, Homo sapiens
ttgtcacccaggctgga

SEQ ID NO: 4655379 - DNA, 19 bp, Homo sapiens
ttgtcacccaggctggagt

SEQ ID NO: 4655380 - DNA, 15 bp, Homo sapiens
ttgtcagacataaag

SEQ ID NO: 4655381 - DNA, 23 bp, Homo sapiens
ttgtcagtgtagacacaggtcac

SEQ ID NO: 4655382 - DNA, 21 bp, Homo sapiens
ttgtcatatcactaaataaac

SEQ ID NO: 4655383 - DNA, 21 bp, Homo sapiens
ttgtcatatcagcacatattt

SEQ ID NO: 4655384 - DNA, 19 bp, Homo sapiens
ttgtcccatgtggcttgtt

SEQ ID NO: 4655385 - DNA, 21 bp, Homo sapiens
ttgtccggtggaaggccttct

SEQ ID NO: 4655386 - DNA, 13 bp, Homo sapiens
ttgtcgtttttat

SEQ ID NO: 4655387 - DNA, 17 bp, Homo sapiens
ttgtctaaaacaataaa

SEQ ID NO: 4655388 - DNA, 20 bp, Homo sapiens
ttgtctatagttgtcagtat

SEQ ID NO: 4655389 - DNA, 12 bp, Homo sapiens
ttgtctcagaag

SEQ ID NO: 4655390 - DNA, 20 bp, Homo sapiens
ttgtgatggaggggagaggg

SEQ ID NO: 4655391 - DNA, 13 bp, Homo sapiens
ttgtgatgtttag

SEQ ID NO: 4655392 - DNA, 23 bp, Homo sapiens
ttgtgatttctttaaaagaatga

SEQ ID NO: 4655393 - DNA, 16 bp, Homo sapiens
ttgtgcagtcatcaga

SEQ ID NO: 4655394 - DNA, 17 bp, Homo sapiens
ttgtgcctccctggtga

SEQ ID NO: 4655395 - DNA, 21 bp, Homo sapiens
ttgtgcttttctgttttcaag

SEQ ID NO: 4655396 - DNA, 14 bp, Homo sapiens
ttgtggagagaatg

SEQ ID NO: 4655397 - DNA, 17 bp, Homo sapiens
ttgtggcgtctccctcg

SEQ ID NO: 4655398 - DNA, 14 bp, Homo sapiens
ttgtggtttagtta

SEQ ID NO: 4655399 - DNA, 21 bp, Homo sapiens
ttgtgtatatattataaaaat

SEQ ID NO: 4655400 - DNA, 15 bp, Homo sapiens
ttgtgtatttctctg

SEQ ID NO: 4655401 - DNA, 19 bp, Homo sapiens
ttgtgtatttctctgtgaa

SEQ ID NO: 4655402 - DNA, 21 bp, Homo sapiens
ttgtgtatttctctgtgaatc

SEQ ID NO: 4655403 - DNA, 15 bp, Homo sapiens
ttgtgtctgtacacg

SEQ ID NO: 4655404 - DNA, 15 bp, Homo sapiens
ttgtgtggtattcaa

SEQ ID NO: 4655405 - DNA, 21 bp, Homo sapiens
ttgtgttcagctctttccaaa

SEQ ID NO: 4655406 - DNA, 20 bp, Homo sapiens
ttgttaatgctctatgtttg

SEQ ID NO: 4655407 - DNA, 21 bp, Homo sapiens
ttgttaatgctctatgtttgt

SEQ ID NO: 4655408 - DNA, 11 bp, Homo sapiens
ttgttcaactc

SEQ ID NO: 4655409 - DNA, 14 bp, Homo sapiens
ttgttcaactccct

SEQ ID NO: 4655410 - DNA, 17 bp, Homo sapiens
ttgttctactccttccc

SEQ ID NO: 4655411 - DNA, 20 bp, Homo sapiens
ttgttctctgaattttcaga

SEQ ID NO: 4655412 - DNA, 14 bp, Homo sapiens
ttgttctttaaagt

SEQ ID NO: 4655413 - DNA, 15 bp, Homo sapiens
ttgttgaagtgctgt

SEQ ID NO: 4655414 - DNA, 20 bp, Homo sapiens
ttgttgaagtgctgttttat

SEQ ID NO: 4655415 - DNA, 23 bp, Homo sapiens
ttgttggctttcccttatcaaac

SEQ ID NO: 4655416 - DNA, 18 bp, Homo sapiens
ttgttggtgaattttcaa

SEQ ID NO: 4655417 - DNA, 21 bp, Homo sapiens
ttgttgtaaaacaaaatttga

SEQ ID NO: 4655418 - DNA, 15 bp, Homo sapiens
ttgtttacatgagtt

SEQ ID NO: 4655419 - DNA, 20 bp, Homo sapiens
ttgtttacatgagttcaaat

SEQ ID NO: 4655420 - DNA, 14 bp, Homo sapiens
ttcttgtctatagt

SEQ ID NO: 4655421 - DNA, 15 bp, Homo sapiens
ttcttgtctatagtt

SEQ ID NO: 4655422 - DNA, 19 bp, Homo sapiens
ttctttaaaagaatgacta

SEQ ID NO: 4655423 - DNA, 15 bp, Homo sapiens
ttctttacaaactga

SEQ ID NO: 4655424 - DNA, 23 bp, Homo sapiens
ttctttacaaactgaagataatg

SEQ ID NO: 4655425 - DNA, 21 bp, Homo sapiens
tgtttctgaatgtttgtgtct

SEQ ID NO: 4655426 - DNA, 22 bp, Homo sapiens
tgtttctgtcaagctggtgcta

SEQ ID NO: 4655427 - DNA, 16 bp, Homo sapiens
tgtttctttatatttt

SEQ ID NO: 4655428 - DNA, 12 bp, Homo sapiens
tgtttctttgtg

SEQ ID NO: 4655429 - DNA, 19 bp, Homo sapiens
tgtttgaaatgtttaataa

SEQ ID NO: 4655430 - DNA, 23 bp, Homo sapiens
tgtttgatgcgcttttaactttg

SEQ ID NO: 4655431 - DNA, 18 bp, Homo sapiens
tgtttgatttgtctcata

SEQ ID NO: 4655432 - DNA, 15 bp, Homo sapiens
tgtttgtagctttcc

SEQ ID NO: 4655433 - DNA, 18 bp, Homo sapiens
tgtttgtagctttcctgg

SEQ ID NO: 4655434 - DNA, 19 bp, Homo sapiens
tgtttgtagctttcctgga

SEQ ID NO: 4655435 - DNA, 15 bp, Homo sapiens
tgtttgtatttggaa

SEQ ID NO: 4655436 - DNA, 12 bp, Homo sapiens
tgtttgtgggac

SEQ ID NO: 4655437 - DNA, 12 bp, Homo sapiens
tgtttgtgtctg

SEQ ID NO: 4655438 - DNA, 13 bp, Homo sapiens
tgtttgtgtctgt

SEQ ID NO: 4655439 - DNA, 15 bp, Homo sapiens
tgtttgtttctttgt

SEQ ID NO: 4655440 - DNA, 19 bp, Homo sapiens
tgttttaaagaatatgact

SEQ ID NO: 4655441 - DNA, 13 bp, Homo sapiens
tgttttaacaaaa

SEQ ID NO: 4655442 - DNA, 16 bp, Homo sapiens
tgttttataattagtc

SEQ ID NO: 4655443 - DNA, 16 bp, Homo sapiens
tgttttatccttacaa

SEQ ID NO: 4655444 - DNA, 18 bp, Homo sapiens
tgttttattactgtttct

SEQ ID NO: 4655445 - DNA, 19 bp, Homo sapiens
tgttttattactgtttcta

SEQ ID NO: 4655446 - DNA, 14 bp, Homo sapiens
ttacattccagtag

SEQ ID NO: 4655447 - DNA, 11 bp, Homo sapiens
ttacattttaa

SEQ ID NO: 4655448 - DNA, 21 bp, Homo sapiens
ttacattttcagtaccaaaga

SEQ ID NO: 4655449 - DNA, 14 bp, Homo sapiens
ttaccaagaagcct

SEQ ID NO: 4655450 - DNA, 18 bp, Homo sapiens
ttactaactaaataccat

SEQ ID NO: 4655451 - DNA, 18 bp, Homo sapiens
ttactaagttttcaaatt

SEQ ID NO: 4655452 - DNA, 16 bp, Homo sapiens
ttactaatgtaaaatg

SEQ ID NO: 4655453 - DNA, 17 bp, Homo sapiens
ttactaattatactact

SEQ ID NO: 4655454 - DNA, 13 bp, Homo sapiens
ttactattaaaat

SEQ ID NO: 4655455 - DNA, 15 bp, Homo sapiens
ttactcagtttatgt

SEQ ID NO: 4655456 - DNA, 14 bp, Homo sapiens
ttactctttgcaaa

SEQ ID NO: 4655457 - DNA, 22 bp, Homo sapiens
ttactgcctataatcttataca

SEQ ID NO: 4655458 - DNA, 23 bp, Homo sapiens
ttactgggccttagtgggccagg

SEQ ID NO: 4655459 - DNA, 13 bp, Homo sapiens
ttactgtttctaa

SEQ ID NO: 4655460 - DNA, 19 bp, Homo sapiens
ttacttccagcaagcaaag

SEQ ID NO: 4655461 - DNA, 14 bp, Homo sapiens
ttacttctctgagt

SEQ ID NO: 4655462 - DNA, 14 bp, Homo sapiens
ttacttgcttctct

SEQ ID NO: 4655463 - DNA, 16 bp, Homo sapiens
ttactttaaacttgtc

SEQ ID NO: 4655464 - DNA, 18 bp, Homo sapiens
ttactttttcttgtattc

SEQ ID NO: 4655465 - DNA, 14 bp, Homo sapiens
ttagaaaatgactt

SEQ ID NO: 4655466 - DNA, 19 bp, Homo sapiens
ttagaaaatgacttatttc

SEQ ID NO: 4655467 - DNA, 20 bp, Homo sapiens
ttagaaaatgacttatttct

SEQ ID NO: 4655468 - DNA, 13 bp, Homo sapiens
ttagaagcagagg

SEQ ID NO: 4655469 - DNA, 13 bp, Homo sapiens
ttagaattaaaaa

SEQ ID NO: 4655470 - DNA, 15 bp, Homo sapiens
ttagacttactatta

SEQ ID NO: 4655471 - DNA, 18 bp, Homo sapiens
ttagagcccattaatctt

SEQ ID NO: 4655472 - DNA, 19 bp, Homo sapiens
ttagagcccattaatcttg

SEQ ID NO: 4655473 - DNA, 20 bp, Homo sapiens
ttagagcccattaatcttga

SEQ ID NO: 4655474 - DNA, 21 bp, Homo sapiens
ttagagcccattaatcttgat

SEQ ID NO: 4655475 - DNA, 17 bp, Homo sapiens
ttagaggttctgcctct

SEQ ID NO: 4655476 - DNA, 14 bp, Homo sapiens
ttagatataacact

SEQ ID NO: 4655477 - DNA, 14 bp, Homo sapiens
ttagatctaccctg

SEQ ID NO: 4655478 - DNA, 20 bp, Homo sapiens
ttagcaatagctagctatat

SEQ ID NO: 4655479 - DNA, 20 bp, Homo sapiens
ttagcatgttcctccttttc

SEQ ID NO: 4655480 - DNA, 17 bp, Homo sapiens
ttagccacatgtacact

SEQ ID NO: 4655481 - DNA, 24 bp, Homo sapiens
ttagctccataaagtacaaatgaa

SEQ ID NO: 4655482 - DNA, 12 bp, Homo sapiens
ttagcttcctta

SEQ ID NO: 4655483 - DNA, 19 bp, Homo sapiens
ttagctttccaaggaagca

SEQ ID NO: 4655484 - DNA, 13 bp, Homo sapiens
ttagctttgaaac

SEQ ID NO: 4655485 - DNA, 19 bp, Homo sapiens
ttaggaattaagttatctt

SEQ ID NO: 4655486 - DNA, 16 bp, Homo sapiens
ttaggcatttcctgct

SEQ ID NO: 4655487 - DNA, 17 bp, Homo sapiens
ttaggcatttcctgctg

SEQ ID NO: 4655488 - DNA, 18 bp, Homo sapiens
ttaggcatttcctgctga

SEQ ID NO: 4655489 - DNA, 10 bp, Homo sapiens
ttaggccagc

SEQ ID NO: 4655490 - DNA, 19 bp, Homo sapiens
ttagggattccttccaata

SEQ ID NO: 4655491 - DNA, 14 bp, Homo sapiens
ttagggatttattt

SEQ ID NO: 4655492 - DNA, 14 bp, Homo sapiens
ttagggcagatttt

SEQ ID NO: 4655493 - DNA, 16 bp, Homo sapiens
ttaggtctctgttgac

SEQ ID NO: 4655494 - DNA, 23 bp, Homo sapiens
ttaggtcttcctgtggctccctc

SEQ ID NO: 4655495 - DNA, 14 bp, Homo sapiens
ttagtaaataaaat

SEQ ID NO: 4655496 - DNA, 13 bp, Homo sapiens
ttagtagagacag

SEQ ID NO: 4655497 - DNA, 16 bp, Homo sapiens
ttagtagagacagtgt

SEQ ID NO: 4655498 - DNA, 18 bp, Homo sapiens
ttagtagagacagtgttt

SEQ ID NO: 4655499 - DNA, 22 bp, Homo sapiens
ttagtcgggcatgagtctgttt

SEQ ID NO: 4655500 - DNA, 14 bp, Homo sapiens
ttagtgaatgggaa

SEQ ID NO: 4655501 - DNA, 20 bp, Homo sapiens
ttagtgtgacagtttccaaa

SEQ ID NO: 4655502 - DNA, 20 bp, Homo sapiens
ttagttaaattgaagaaagt

SEQ ID NO: 4655503 - DNA, 15 bp, Homo sapiens
ttagttgctgtatgt

SEQ ID NO: 4655504 - DNA, 17 bp, Homo sapiens
ttagtttcaaagtgtct

SEQ ID NO: 4655505 - DNA, 20 bp, Homo sapiens
ttataaaatggctgtaatca

SEQ ID NO: 4655506 - DNA, 15 bp, Homo sapiens
ttataaacagataat

SEQ ID NO: 4655507 - DNA, 16 bp, Homo sapiens
ttataagagaagttta

SEQ ID NO: 4655508 - DNA, 22 bp, Homo sapiens
ttataatactgttttaaaatgt

SEQ ID NO: 4655509 - DNA, 20 bp, Homo sapiens
ttataattggtgctatttga

SEQ ID NO: 4655510 - DNA, 19 bp, Homo sapiens
ttatacagacctaatatca

SEQ ID NO: 4655511 - DNA, 20 bp, Homo sapiens
ttatacagacctaatatcat

SEQ ID NO: 4655512 - DNA, 16 bp, Homo sapiens
ttataccccatatatt

SEQ ID NO: 4655513 - DNA, 17 bp, Homo sapiens
ttataccctttttcatt

SEQ ID NO: 4655514 - DNA, 17 bp, Homo sapiens
ttatagcaactaatgtt

SEQ ID NO: 4655515 - DNA, 18 bp, Homo sapiens
ttatagcaactaatgttt

SEQ ID NO: 4655516 - DNA, 19 bp, Homo sapiens
ttatagcaactaatgtttg

SEQ ID NO: 4655517 - DNA, 15 bp, Homo sapiens
ttatagctcatttgt

SEQ ID NO: 4655518 - DNA, 23 bp, Homo sapiens
ttatatacagaggaaatctgtaa

SEQ ID NO: 4655519 - DNA, 20 bp, Homo sapiens
ttatatcatgcaaaatatgt

SEQ ID NO: 4655520 - DNA, 18 bp, Homo sapiens
ttatatgccaagctaatt

SEQ ID NO: 4655521 - DNA, 16 bp, Homo sapiens
ttatattaaagtaaat

SEQ ID NO: 4655522 - DNA, 22 bp, Homo sapiens
ttatcaaaaagtattatcattg

SEQ ID NO: 4655523 - DNA, 18 bp, Homo sapiens
ttatcaattatattatgt

SEQ ID NO: 4655524 - DNA, 15 bp, Homo sapiens
ttatcattaaaaatt

SEQ ID NO: 4655525 - DNA, 17 bp, Homo sapiens
ttatcattaaaaattac

SEQ ID NO: 4655526 - DNA, 18 bp, Homo sapiens
ttatcattaaaaattacc

SEQ ID NO: 4655527 - DNA, 19 bp, Homo sapiens
ttatcattgctcccctgat

SEQ ID NO: 4655528 - DNA, 13 bp, Homo sapiens
ttatcctagcctt

SEQ ID NO: 4655529 - DNA, 22 bp, Homo sapiens
ttatccttacaatgtgaataat

SEQ ID NO: 4655530 - DNA, 22 bp, Homo sapiens
ttatccttacactcccccagcc

SEQ ID NO: 4655531 - DNA, 18 bp, Homo sapiens
ttatcggacattctaatg

SEQ ID NO: 4655532 - DNA, 23 bp, Homo sapiens
ttatcggacattctaatgcatat

SEQ ID NO: 4655533 - DNA, 13 bp, Homo sapiens
ttatctcacaaat

SEQ ID NO: 4655534 - DNA, 16 bp, Homo sapiens
ttatgaatatcattga

SEQ ID NO: 4655535 - DNA, 16 bp, Homo sapiens
ttatgacatttcttaa

SEQ ID NO: 4655536 - DNA, 16 bp, Homo sapiens
ttatgagatctaatgt

SEQ ID NO: 4655537 - DNA, 14 bp, Homo sapiens
ttatgcaaatacaa

SEQ ID NO: 4655538 - DNA, 12 bp, Homo sapiens
tgtgtgtgttct

SEQ ID NO: 4655539 - DNA, 17 bp, Homo sapiens
tgtgttactgctttgca

SEQ ID NO: 4655540 - DNA, 18 bp, Homo sapiens
tgtgttactgctttgcaa

SEQ ID NO: 4655541 - DNA, 20 bp, Homo sapiens
tgtgttcagctctttccaaa

SEQ ID NO: 4655542 - DNA, 21 bp, Homo sapiens
tgtgttcagctctttccaaat

SEQ ID NO: 4655543 - DNA, 22 bp, Homo sapiens
tgtgttcgttgcacagctgttt

SEQ ID NO: 4655544 - DNA, 20 bp, Homo sapiens
tgtgtttcattacttgaatg

SEQ ID NO: 4655545 - DNA, 22 bp, Homo sapiens
tgtgtttcattacttgaatgta

SEQ ID NO: 4655546 - DNA, 14 bp, Homo sapiens
tgtgtttctttata

SEQ ID NO: 4655547 - DNA, 16 bp, Homo sapiens
tgtgtttgcagcctgc

SEQ ID NO: 4655548 - DNA, 15 bp, Homo sapiens
tgtgtttttaacatg

SEQ ID NO: 4655549 - DNA, 13 bp, Homo sapiens
tgtgtttttgaaa

SEQ ID NO: 4655550 - DNA, 20 bp, Homo sapiens
tgttaagaatgaagttctgc

SEQ ID NO: 4655551 - DNA, 23 bp, Homo sapiens
tgttaaggacccttttaagcatg

SEQ ID NO: 4655552 - DNA, 18 bp, Homo sapiens
tgttaataaaagtacatg

SEQ ID NO: 4655553 - DNA, 21 bp, Homo sapiens
tgttaatgctctatgtttgta

SEQ ID NO: 4655554 - DNA, 23 bp, Homo sapiens
tgttacagccaagtgccaaatgc

SEQ ID NO: 4655555 - DNA, 13 bp, Homo sapiens
tgttaccttttat

SEQ ID NO: 4655556 - DNA, 21 bp, Homo sapiens
tgttacgatatttcgtttggt

SEQ ID NO: 4655557 - DNA, 13 bp, Homo sapiens
tgttactgctttg

SEQ ID NO: 4655558 - DNA, 13 bp, Homo sapiens
tgttacttctctg

SEQ ID NO: 4655559 - DNA, 16 bp, Homo sapiens
tgttacttctctgagt

SEQ ID NO: 4655560 - DNA, 13 bp, Homo sapiens
tgttagagacttt

SEQ ID NO: 4655561 - DNA, 15 bp, Homo sapiens
tgttagcttccttaa

SEQ ID NO: 4655562 - DNA, 14 bp, Homo sapiens
tgttagctttccaa

SEQ ID NO: 4655563 - DNA, 20 bp, Homo sapiens
tgttagggattccttccaat

SEQ ID NO: 4655564 - DNA, 18 bp, Homo sapiens
tgttagtaatggcagagc

SEQ ID NO: 4655565 - DNA, 15 bp, Homo sapiens
tgttagttgtccaca

SEQ ID NO: 4655566 - DNA, 15 bp, Homo sapiens
tgttatctcttgtta

SEQ ID NO: 4655567 - DNA, 23 bp, Homo sapiens
tgttattaaacgtatgcatgtga

SEQ ID NO: 4655568 - DNA, 13 bp, Homo sapiens
tgttatttctcag

SEQ ID NO: 4655569 - DNA, 18 bp, Homo sapiens
tgttatttttaagctttt

SEQ ID NO: 4655570 - DNA, 20 bp, Homo sapiens
tgttatttttaagcttttat

SEQ ID NO: 4655571 - DNA, 20 bp, Homo sapiens
tgttcaaagactgtgaacag

SEQ ID NO: 4655572 - DNA, 16 bp, Homo sapiens
tgttcaatactgtatg

SEQ ID NO: 4655573 - DNA, 17 bp, Homo sapiens
tgttcacagcttttctt

SEQ ID NO: 4655574 - DNA, 18 bp, Homo sapiens
tgttcacagcttttcttg

SEQ ID NO: 4655575 - DNA, 21 bp, Homo sapiens
tgttcacagcttttcttgata

SEQ ID NO: 4655576 - DNA, 20 bp, Homo sapiens
tgttcagctctttccaaatt

SEQ ID NO: 4655577 - DNA, 12 bp, Homo sapiens
tgttcaggcagg

SEQ ID NO: 4655578 - DNA, 10 bp, Homo sapiens
tgttcattta

SEQ ID NO: 4655579 - DNA, 20 bp, Homo sapiens
tgttcatttagataatttga

SEQ ID NO: 4655580 - DNA, 13 bp, Homo sapiens
tgttcatttcatt

SEQ ID NO: 4655581 - DNA, 21 bp, Homo sapiens
tgttcccagtagttataaagt

SEQ ID NO: 4655582 - DNA, 12 bp, Homo sapiens
tgttccccaccc

SEQ ID NO: 4655583 - DNA, 15 bp, Homo sapiens
tgttccccacccagt

SEQ ID NO: 4655584 - DNA, 23 bp, Homo sapiens
tgttcccttcctcttcctgccct

SEQ ID NO: 4655585 - DNA, 16 bp, Homo sapiens
tgttcctaacaaaatg

SEQ ID NO: 4655586 - DNA, 17 bp, Homo sapiens
tgttcctaacaaaatga

SEQ ID NO: 4655587 - DNA, 20 bp, Homo sapiens
tgttcgttgcacagctgttt

SEQ ID NO: 4655588 - DNA, 22 bp, Homo sapiens
tgttcgttgcacagctgtttga

SEQ ID NO: 4655589 - DNA, 23 bp, Homo sapiens
tgttctcaacatactgtaatcaa

SEQ ID NO: 4655590 - DNA, 14 bp, Homo sapiens
tgttcttagagtgt

SEQ ID NO: 4655591 - DNA, 15 bp, Homo sapiens
tgttcttagagtgta

SEQ ID NO: 4655592 - DNA, 13 bp, Homo sapiens
tgttcttgaagca

SEQ ID NO: 4655593 - DNA, 16 bp, Homo sapiens
tgttctttccccaggg

SEQ ID NO: 4655594 - DNA, 19 bp, Homo sapiens
tgttctttccccaggggca

SEQ ID NO: 4655595 - DNA, 21 bp, Homo sapiens
tgttgaaacttacactgtttc

SEQ ID NO: 4655596 - DNA, 17 bp, Homo sapiens
tgttgaaataaaacatt

SEQ ID NO: 4655597 - DNA, 17 bp, Homo sapiens
tgttgacacatatgaac

SEQ ID NO: 4655598 - DNA, 17 bp, Homo sapiens
tgttgcatggatgtttt

SEQ ID NO: 4655599 - DNA, 14 bp, Homo sapiens
tgttgcatgggcta

SEQ ID NO: 4655600 - DNA, 20 bp, Homo sapiens
tgttgcatgggctaatgaag

SEQ ID NO: 4655601 - DNA, 12 bp, Homo sapiens
tgttgcctcctc

SEQ ID NO: 4655602 - DNA, 13 bp, Homo sapiens
tgttgcctcctct

SEQ ID NO: 4655603 - DNA, 14 bp, Homo sapiens
tgttgcctcctctc

SEQ ID NO: 4655604 - DNA, 17 bp, Homo sapiens
tgttgcctcctctctcc

SEQ ID NO: 4655605 - DNA, 19 bp, Homo sapiens
tgttgcctcctctctccct

SEQ ID NO: 4655606 - DNA, 22 bp, Homo sapiens
tgttgcctcctctctccctgcc

SEQ ID NO: 4655607 - DNA, 20 bp, Homo sapiens
tgttgcctttgctcttataa

SEQ ID NO: 4655608 - DNA, 14 bp, Homo sapiens
tgttgctgttcaca

SEQ ID NO: 4655609 - DNA, 23 bp, Homo sapiens
tgttgctgttcacagcttttctt

SEQ ID NO: 4655610 - DNA, 17 bp, Homo sapiens
tgttggagcaaaccatt

SEQ ID NO: 4655611 - DNA, 18 bp, Homo sapiens
tgttggagcaaaccatta

SEQ ID NO: 4655612 - DNA, 17 bp, Homo sapiens
tgttggatttttgtctt

SEQ ID NO: 4655613 - DNA, 13 bp, Homo sapiens
tgttggccaggct

SEQ ID NO: 4655614 - DNA, 19 bp, Homo sapiens
tgttggccaggctggtttc

SEQ ID NO: 4655615 - DNA, 23 bp, Homo sapiens
tgttggtgaattttcaaggcctt

SEQ ID NO: 4655616 - DNA, 14 bp, Homo sapiens
tgttgtacttgaaa

SEQ ID NO: 4655617 - DNA, 19 bp, Homo sapiens
tgttgtcaaggatggtttt

SEQ ID NO: 4655618 - DNA, 18 bp, Homo sapiens
tgttgtcctcctgttcat

SEQ ID NO: 4655619 - DNA, 14 bp, Homo sapiens
tgttgtctttttta

SEQ ID NO: 4655620 - DNA, 14 bp, Homo sapiens
tgttgttgccaaag

SEQ ID NO: 4655621 - DNA, 18 bp, Homo sapiens
tgtttaaaataaaatgaa

SEQ ID NO: 4655622 - DNA, 19 bp, Homo sapiens
tgtttaaaataaaatgaaa

SEQ ID NO: 4655623 - DNA, 16 bp, Homo sapiens
tgtttaataaagcttt

SEQ ID NO: 4655624 - DNA, 18 bp, Homo sapiens
tgtttaataaagctttat

SEQ ID NO: 4655625 - DNA, 17 bp, Homo sapiens
tgtttacaacatcacca

SEQ ID NO: 4655626 - DNA, 19 bp, Homo sapiens
tgtttagttttacatttta

SEQ ID NO: 4655627 - DNA, 19 bp, Homo sapiens
tgtttatcaaagagcactt

SEQ ID NO: 4655628 - DNA, 21 bp, Homo sapiens
tgtttatcaaagagcacttga

SEQ ID NO: 4655629 - DNA, 14 bp, Homo sapiens
tgtttatgaagaaa

SEQ ID NO: 4655630 - DNA, 20 bp, Homo sapiens
tgtttatgaagaaagatact

SEQ ID NO: 4655631 - DNA, 13 bp, Homo sapiens
tgtttattagcat

SEQ ID NO: 4655632 - DNA, 14 bp, Homo sapiens
tgtttcaaaaccat

SEQ ID NO: 4655633 - DNA, 19 bp, Homo sapiens
tgtttcaaaaccatgcctg

SEQ ID NO: 4655634 - DNA, 21 bp, Homo sapiens
tgtttcaaatgtgcattttgt

SEQ ID NO: 4655635 - DNA, 15 bp, Homo sapiens
tgtttcaacagaggg

SEQ ID NO: 4655636 - DNA, 15 bp, Homo sapiens
tgtttcaactttctt

SEQ ID NO: 4655637 - DNA, 20 bp, Homo sapiens
tgtttcaactttcttatctg

SEQ ID NO: 4655638 - DNA, 17 bp, Homo sapiens
tgtttcatagttttcta

SEQ ID NO: 4655639 - DNA, 20 bp, Homo sapiens
tgtttcatattgatgtgtgt

SEQ ID NO: 4655640 - DNA, 17 bp, Homo sapiens
tgtttcatctcagcttt

SEQ ID NO: 4655641 - DNA, 12 bp, Homo sapiens
tgtttcattatg

SEQ ID NO: 4655642 - DNA, 13 bp, Homo sapiens
tgtttccagggtc

SEQ ID NO: 4655643 - DNA, 14 bp, Homo sapiens
tgtttcccccactc

SEQ ID NO: 4655644 - DNA, 14 bp, Homo sapiens
tgtttccctgctga

SEQ ID NO: 4655645 - DNA, 15 bp, Homo sapiens
tgtttccctgctgaa

SEQ ID NO: 4655646 - DNA, 18 bp, Homo sapiens
tgtttcctggcctcagag

SEQ ID NO: 4655647 - DNA, 23 bp, Homo sapiens
tgtttcgtcatgttggccaggct

SEQ ID NO: 4655648 - DNA, 15 bp, Homo sapiens
tgtttctgaatgttt

SEQ ID NO: 4655649 - DNA, 16 bp, Homo sapiens
tgtgaacccaggacaa

SEQ ID NO: 4655650 - DNA, 13 bp, Homo sapiens
tgtgaactgtgtg

SEQ ID NO: 4655651 - DNA, 14 bp, Homo sapiens
tgtgaactgtgtgt

SEQ ID NO: 4655652 - DNA, 11 bp, Homo sapiens
tgtgaatgcac

SEQ ID NO: 4655653 - DNA, 13 bp, Homo sapiens
tgtgacaagccaa

SEQ ID NO: 4655654 - DNA, 21 bp, Homo sapiens
tgtgacaattctgtttttaat

SEQ ID NO: 4655655 - DNA, 17 bp, Homo sapiens
tgtgacacatatgcacc

SEQ ID NO: 4655656 - DNA, 22 bp, Homo sapiens
tgtgacacatatgcaccttgtg

SEQ ID NO: 4655657 - DNA, 23 bp, Homo sapiens
tgtgacagggccagtggggcctg

SEQ ID NO: 4655658 - DNA, 22 bp, Homo sapiens
tgtgacagtgaaatacatcctt

SEQ ID NO: 4655659 - DNA, 15 bp, Homo sapiens
tgtgacagtttccaa

SEQ ID NO: 4655660 - DNA, 16 bp, Homo sapiens
tgtgacagtttccaaa

SEQ ID NO: 4655661 - DNA, 20 bp, Homo sapiens
tgtgacattccatgacgaca

SEQ ID NO: 4655662 - DNA, 14 bp, Homo sapiens
tgtgacattcctga

SEQ ID NO: 4655663 - DNA, 15 bp, Homo sapiens
tgtgacattcctgat

SEQ ID NO: 4655664 - DNA, 16 bp, Homo sapiens
tgtgacattcctgatt
